United States Patent 11,254,933 (CRISPR/CAS TRANSCRIPTIONAL MODULATION) - sequence listing, part 18

SEQ ID NO: 784269 - DNA, 20 bp, mouse
gccttctgatacttatttga

SEQ ID NO: 784270 - DNA, 20 bp, mouse
ggttccaaatcaagatagac

SEQ ID NO: 784271 - DNA, 20 bp, mouse
gcaaatcaagatagacagga

SEQ ID NO: 784272 - DNA, 20 bp, mouse
gccacagtataattagagat

SEQ ID NO: 784273 - DNA, 20 bp, mouse
gtataattagagattggatg

SEQ ID NO: 784274 - DNA, 20 bp, mouse
gtgaactcacaaagaaaggc

SEQ ID NO: 784275 - DNA, 20 bp, mouse
gatttggaacgttttttgcc

SEQ ID NO: 784276 - DNA, 20 bp, mouse
ggggctttgaggtgggtagt

SEQ ID NO: 784277 - DNA, 20 bp, mouse
ggctccgcagggctttgagg

SEQ ID NO: 784278 - DNA, 20 bp, mouse
ggcagtccccggcgcttccc

SEQ ID NO: 784279 - DNA, 20 bp, mouse
gaagaacgatcaggagcgtg

SEQ ID NO: 784280 - DNA, 20 bp, mouse
ggctcctgatcgttcttgat

SEQ ID NO: 784281 - DNA, 20 bp, mouse
gtgcacaaaagaagcgtcgc

SEQ ID NO: 784282 - DNA, 20 bp, mouse
ggtagtgggcgggcagtccc

SEQ ID NO: 784283 - DNA, 20 bp, mouse
gaaagccctgcggagcactg

SEQ ID NO: 784284 - DNA, 20 bp, mouse
gtcgccggggccgggctagc

SEQ ID NO: 784285 - DNA, 20 bp, mouse
gtgcacatgcgccacgacct

SEQ ID NO: 784286 - DNA, 20 bp, mouse
gttgctaagtgtcagtaggt

SEQ ID NO: 784287 - DNA, 20 bp, mouse
gcggccccacctctggttaa

SEQ ID NO: 784288 - DNA, 20 bp, mouse
gcctcctttaaccagaggtg

SEQ ID NO: 784289 - DNA, 20 bp, mouse
ggaggctctctcatcaggaa

SEQ ID NO: 784290 - DNA, 20 bp, mouse
gaccagaggtggggccgtga

SEQ ID NO: 784291 - DNA, 20 bp, mouse
gcaaccctacggggcaggac

SEQ ID NO: 784292 - DNA, 20 bp, mouse
gaaggcttagatctcagtgg

SEQ ID NO: 784293 - DNA, 20 bp, mouse
ggggtcggaaagtcccgccc

SEQ ID NO: 784294 - DNA, 20 bp, mouse
gctcatcaggaagggcacaa

SEQ ID NO: 784295 - DNA, 20 bp, mouse
gggggatggtgtaacctaac

SEQ ID NO: 784296 - DNA, 20 bp, mouse
gccaaaagaagtccgtagac

SEQ ID NO: 784297 - DNA, 20 bp, mouse
gccgtccagagtgacgtgat

SEQ ID NO: 784298 - DNA, 20 bp, mouse
ggtgtgaacttcccagtcta

SEQ ID NO: 784299 - DNA, 20 bp, mouse
gctagggagttaagcaagct

SEQ ID NO: 784300 - DNA, 20 bp, mouse
gttgacccatcacgtcactc

SEQ ID NO: 784301 - DNA, 20 bp, mouse
gcgtgatgggtcaacaagac

SEQ ID NO: 784302 - DNA, 20 bp, mouse
gcgtcactctggacggggac

SEQ ID NO: 784303 - DNA, 20 bp, mouse
ggattataattttacatttc

SEQ ID NO: 784304 - DNA, 20 bp, mouse
gaaagggggggctgtagacc

SEQ ID NO: 784305 - DNA, 20 bp, mouse
gctacggacttcttttggca

SEQ ID NO: 784306 - DNA, 20 bp, mouse
ggggaggtgactctaaccac

SEQ ID NO: 784307 - DNA, 20 bp, mouse
gaaggctgggtgctaggtga

SEQ ID NO: 784308 - DNA, 20 bp, mouse
gcctccccccaacaggatgc

SEQ ID NO: 784309 - DNA, 20 bp, mouse
gtctccagcatcctgttggg

SEQ ID NO: 784310 - DNA, 20 bp, mouse
gctaggtgagggcaagtggg

SEQ ID NO: 784311 - DNA, 20 bp, mouse
gcatggtgcatgtgtggcac

SEQ ID NO: 784312 - DNA, 20 bp, mouse
gacacatccctccccccaac

SEQ ID NO: 784313 - DNA, 20 bp, mouse
gcattctagcaagcagagag

SEQ ID NO: 784314 - DNA, 20 bp, mouse
ggtgggaggaagtcactcaa

SEQ ID NO: 784315 - DNA, 20 bp, mouse
ggaaaagttcccagaaggct

SEQ ID NO: 784316 - DNA, 20 bp, mouse
gcaacgaacagatgtctcct

SEQ ID NO: 784317 - DNA, 20 bp, mouse
gggtctgcagaatatggctc

SEQ ID NO: 784318 - DNA, 20 bp, mouse
ggcagaatatggctctggag

SEQ ID NO: 784319 - DNA, 20 bp, mouse
gctcctgggtctgcagaata

SEQ ID NO: 784320 - DNA, 20 bp, mouse
gaataggatcctcacatcta

SEQ ID NO: 784321 - DNA, 20 bp, mouse
gctctctaggtcccttctga

SEQ ID NO: 784322 - DNA, 20 bp, mouse
gcaggtgctggccctcagaa

SEQ ID NO: 784323 - DNA, 20 bp, mouse
gcaggcttctcaggtccaac

SEQ ID NO: 784324 - DNA, 20 bp, mouse
gaacaactgacatctccagt

SEQ ID NO: 784325 - DNA, 20 bp, mouse
gcctgctagatacagacaat

SEQ ID NO: 784326 - DNA, 20 bp, mouse
gaaggcccggcacctggcta

SEQ ID NO: 784327 - DNA, 20 bp, mouse
gacctggctaaggctcctct

SEQ ID NO: 784328 - DNA, 20 bp, mouse
gggagtctgtactaggatgt

SEQ ID NO: 784329 - DNA, 20 bp, mouse
gtgggcaccagctgtgtaca

SEQ ID NO: 784330 - DNA, 20 bp, mouse
ggtagctaggagtctgtact

SEQ ID NO: 784331 - DNA, 20 bp, mouse
ggacagggttacacacagtc

SEQ ID NO: 784332 - DNA, 20 bp, mouse
gccaggtgccgggccttaga

SEQ ID NO: 784333 - DNA, 20 bp, mouse
gctgtgtacagggcacccag

SEQ ID NO: 784334 - DNA, 20 bp, mouse
gggtgaggtaagcaggatgt

SEQ ID NO: 784335 - DNA, 20 bp, mouse
gcagtcaggtggcatgtcat

SEQ ID NO: 784336 - DNA, 20 bp, mouse
gagtgggtgtgcttcccgga

SEQ ID NO: 784337 - DNA, 20 bp, mouse
gggaggaccctgggtatgta

SEQ ID NO: 784338 - DNA, 20 bp, mouse
gggcctaggagactagagta

SEQ ID NO: 784339 - DNA, 20 bp, mouse
gttccagactcgccattagt

SEQ ID NO: 784340 - DNA, 20 bp, mouse
gcgggaagcacacccactaa

SEQ ID NO: 784341 - DNA, 20 bp, mouse
gtggggagtgctttgttgtt

SEQ ID NO: 784342 - DNA, 20 bp, mouse
gtcccggagggccaggcaat

SEQ ID NO: 784343 - DNA, 20 bp, mouse
ggcagtcagactagcatctc

SEQ ID NO: 784344 - DNA, 20 bp, mouse
gaagcagagcacattggcgc

SEQ ID NO: 784345 - DNA, 20 bp, mouse
gcacccactaatggcgagtc

SEQ ID NO: 784346 - DNA, 20 bp, mouse
gcgggtcacggggtcgagag

SEQ ID NO: 784347 - DNA, 20 bp, mouse
gggaagagggacgggtcacg

SEQ ID NO: 784348 - DNA, 20 bp, mouse
gggtagagatgtgtcagtcg

SEQ ID NO: 784349 - DNA, 20 bp, mouse
gcgcccacttcgccaaagtc

SEQ ID NO: 784350 - DNA, 20 bp, mouse
gcgccaaagtccggctgcct

SEQ ID NO: 784351 - DNA, 20 bp, mouse
gttatatagaccattggctc

SEQ ID NO: 784352 - DNA, 20 bp, mouse
ggccctgggccatcgtttcc

SEQ ID NO: 784353 - DNA, 20 bp, mouse
gccctggaaacgatggccca

SEQ ID NO: 784354 - DNA, 20 bp, mouse
gttcagcacgttactgtgat

SEQ ID NO: 784355 - DNA, 20 bp, mouse
gatggcccagggcctgccca

SEQ ID NO: 784356 - DNA, 20 bp, mouse
gagtgcggggcgggtgataa

SEQ ID NO: 784357 - DNA, 20 bp, mouse
gcgcacgtgcgagtgcgggg

SEQ ID NO: 784358 - DNA, 20 bp, mouse
gccctgaggcgaagagggtg

SEQ ID NO: 784359 - DNA, 20 bp, mouse
gaggcatgaggcgcgagccc

SEQ ID NO: 784360 - DNA, 20 bp, mouse
gcggcccgtccgagtgcccg

SEQ ID NO: 784361 - DNA, 20 bp, mouse
gcaagcgagaccaagccctg

SEQ ID NO: 784362 - DNA, 20 bp, mouse
ggcaacgggtgtacagaact

SEQ ID NO: 784363 - DNA, 20 bp, mouse
gggaggcgcacgtgcgagtg

SEQ ID NO: 784364 - DNA, 20 bp, mouse
gaacgctgcagcggaggtgc

SEQ ID NO: 784365 - DNA, 20 bp, mouse
gcgggctgcttgagacgacg

SEQ ID NO: 784366 - DNA, 20 bp, mouse
gccgccccgaccaatcgcgg

SEQ ID NO: 784367 - DNA, 20 bp, mouse
gaaccgcagccgcagttccg

SEQ ID NO: 784368 - DNA, 20 bp, mouse
gcgggccgaaggttagctcc

SEQ ID NO: 784369 - DNA, 20 bp, mouse
ggggcggggcttggcgcata

SEQ ID NO: 784370 - DNA, 20 bp, mouse
ggctcgcgcccgcggaactg

SEQ ID NO: 784371 - DNA, 20 bp, mouse
ggcccgcggaactgcggctg

SEQ ID NO: 784372 - DNA, 20 bp, mouse
ggcggggcttggtggtgcag

SEQ ID NO: 784373 - DNA, 20 bp, mouse
gggtgaggctaaggcggcta

SEQ ID NO: 784374 - DNA, 20 bp, mouse
gccgaccaatcgcggcgggt

SEQ ID NO: 784375 - DNA, 20 bp, mouse
ggggcttggcgcatagggcg

SEQ ID NO: 784376 - DNA, 20 bp, mouse
gtggactcaagagtgtggtg

SEQ ID NO: 784377 - DNA, 20 bp, mouse
gagtcaggcgagctggggaa

SEQ ID NO: 784378 - DNA, 20 bp, mouse
gggcactggactcaagagtg

SEQ ID NO: 784379 - DNA, 20 bp, mouse
gccccagctcgcctgacttt

SEQ ID NO: 784380 - DNA, 20 bp, mouse
gtccgagagtagcgacggga

SEQ ID NO: 784381 - DNA, 20 bp, mouse
ggctgcagaaaactatctga

SEQ ID NO: 784382 - DNA, 20 bp, mouse
ggaaaactatctgaaggtgg

SEQ ID NO: 784383 - DNA, 20 bp, mouse
gccactctgggacgttgagg

SEQ ID NO: 784384 - DNA, 20 bp, mouse
ggagctggaaggctgagtcg

SEQ ID NO: 784385 - DNA, 20 bp, mouse
gggacagctgggcgatcctc

SEQ ID NO: 784386 - DNA, 20 bp, mouse
gtgctcgcgggaaacggaga

SEQ ID NO: 784387 - DNA, 20 bp, mouse
ggcgaggcctacagctgcaa

SEQ ID NO: 784388 - DNA, 20 bp, mouse
gaaaagctgcggggcgcgaa

SEQ ID NO: 784389 - DNA, 20 bp, mouse
gcctacagctgcaacggacg

SEQ ID NO: 784390 - DNA, 20 bp, mouse
gcgcggaggcgggcagccat

SEQ ID NO: 784391 - DNA, 20 bp, mouse
gaatggcgcgggacgcaagg

SEQ ID NO: 784392 - DNA, 20 bp, mouse
gggcgcaagcagggaccaat

SEQ ID NO: 784393 - DNA, 20 bp, mouse
gtggcccagggtgactgacc

SEQ ID NO: 784394 - DNA, 20 bp, mouse
ggcagagcgccaaccggcaa

SEQ ID NO: 784395 - DNA, 20 bp, mouse
ggcgccccgcagcttttccg

SEQ ID NO: 784396 - DNA, 20 bp, mouse
gggagcgtacagctggtcgg

SEQ ID NO: 784397 - DNA, 20 bp, mouse
gcccgggccaggccattcct

SEQ ID NO: 784398 - DNA, 20 bp, mouse
gcaggcccagcgttaggggg

SEQ ID NO: 784399 - DNA, 20 bp, mouse
gaggaggcgtggcctaggaa

SEQ ID NO: 784400 - DNA, 20 bp, mouse
gtgggggcggggttggctag

SEQ ID NO: 784401 - DNA, 20 bp, mouse
gaacccggggggccgcgcag

SEQ ID NO: 784402 - DNA, 20 bp, mouse
gggcctgcgcggacacgccc

SEQ ID NO: 784403 - DNA, 20 bp, mouse
gcaagcgcaccactacaccc

SEQ ID NO: 784404 - DNA, 20 bp, mouse
gtggggctcggcggaacccg

SEQ ID NO: 784405 - DNA, 20 bp, mouse
gcctcctccaggtcctgtaa

SEQ ID NO: 784406 - DNA, 20 bp, mouse
ggggacagttggttgctata

SEQ ID NO: 784407 - DNA, 20 bp, mouse
gctagtaaccccacagtctt

SEQ ID NO: 784408 - DNA, 20 bp, mouse
gccctcgggagcagaactgg

SEQ ID NO: 784409 - DNA, 20 bp, mouse
gccaactgtcccaagactgt

SEQ ID NO: 784410 - DNA, 20 bp, mouse
gagcgccgccagaactaata

SEQ ID NO: 784411 - DNA, 20 bp, mouse
gaggatggaaaagaccacgt

SEQ ID NO: 784412 - DNA, 20 bp, mouse
gaatatggactcagcttagt

SEQ ID NO: 784413 - DNA, 20 bp, mouse
ggctcaagctaggaccgcgc

SEQ ID NO: 784414 - DNA, 20 bp, mouse
ggcggcctttggacactcga

SEQ ID NO: 784415 - DNA, 20 bp, mouse
gataggtgcaaaaaacagag

SEQ ID NO: 784416 - DNA, 20 bp, mouse
ggaagtgggtgtagagtcgc

SEQ ID NO: 784417 - DNA, 20 bp, mouse
ggcgctgtcccggtcgcggt

SEQ ID NO: 784418 - DNA, 20 bp, mouse
gccgtgggatctccacctcc

SEQ ID NO: 784419 - DNA, 20 bp, mouse
gtcccggtcgcggtggggtg

SEQ ID NO: 784420 - DNA, 20 bp, mouse
gtccacctcctggttgggag

SEQ ID NO: 784421 - DNA, 20 bp, mouse
ggggatctccacctcctggt

SEQ ID NO: 784422 - DNA, 20 bp, mouse
gagggggtgccggtgatata

SEQ ID NO: 784423 - DNA, 20 bp, mouse
gtgcgtctgggtggagggta

SEQ ID NO: 784424 - DNA, 20 bp, mouse
ggtagagtcgcaggacccgt

SEQ ID NO: 784425 - DNA, 20 bp, mouse
gagtcgcgctgtcccggtcg

SEQ ID NO: 784426 - DNA, 20 bp, mouse
gtccgcaacacacagggtgg

SEQ ID NO: 784427 - DNA, 20 bp, mouse
gtctaggtccgcaacacaca

SEQ ID NO: 784428 - DNA, 20 bp, mouse
gaggtccgcaacacacaggg

SEQ ID NO: 784429 - DNA, 20 bp, mouse
gcccccgcgtcagtgggact

SEQ ID NO: 784430 - DNA, 20 bp, mouse
ggccccgccccctattgctt

SEQ ID NO: 784431 - DNA, 20 bp, mouse
gagctctgatttatctgcaa

SEQ ID NO: 784432 - DNA, 20 bp, mouse
gcacagggtgggggaaatga

SEQ ID NO: 784433 - DNA, 20 bp, mouse
gggacctagacagcatctcg

SEQ ID NO: 784434 - DNA, 20 bp, mouse
gctacccagtcccactgacg

SEQ ID NO: 784435 - DNA, 20 bp, mouse
gggcggggccccgcgaggac

SEQ ID NO: 784436 - DNA, 20 bp, mouse
gacccccgaggctacatagg

SEQ ID NO: 784437 - DNA, 20 bp, mouse
gtgagggtgcccggaaaccg

SEQ ID NO: 784438 - DNA, 20 bp, mouse
gcgagctgcactatgatctg

SEQ ID NO: 784439 - DNA, 20 bp, mouse
gaggtggccgcgaagggcgg

SEQ ID NO: 784440 - DNA, 20 bp, mouse
ggggctggctcgggcaagct

SEQ ID NO: 784441 - DNA, 20 bp, mouse
ggtggccctggttgacggag

SEQ ID NO: 784442 - DNA, 20 bp, mouse
gggagcgggccctaaagtca

SEQ ID NO: 784443 - DNA, 20 bp, mouse
gccaggggagagagtataag

SEQ ID NO: 784444 - DNA, 20 bp, mouse
ggctcggtggccctggttga

SEQ ID NO: 784445 - DNA, 20 bp, mouse
gaagacccccgaggctacat

SEQ ID NO: 784446 - DNA, 20 bp, mouse
ggggaagtgtggggcgaggt

SEQ ID NO: 784447 - DNA, 20 bp, mouse
gccccagcccctcacgtgat

SEQ ID NO: 784448 - DNA, 20 bp, mouse
gcgttggggctgtgagagca

SEQ ID NO: 784449 - DNA, 20 bp, mouse
gaagtgtggggcgaggtggg

SEQ ID NO: 784450 - DNA, 20 bp, mouse
gccccaggctgaaagcgttg

SEQ ID NO: 784451 - DNA, 20 bp, mouse
gccggctgcttattggctgt

SEQ ID NO: 784452 - DNA, 20 bp, mouse
gggctggggcgtggcagcgc

SEQ ID NO: 784453 - DNA, 20 bp, mouse
gagggccgcgggcttgggga

SEQ ID NO: 784454 - DNA, 20 bp, mouse
gtcgcagctcgggctctggc

SEQ ID NO: 784455 - DNA, 20 bp, mouse
gtatgggcggagcgccgtca

SEQ ID NO: 784456 - DNA, 20 bp, mouse
ggcgacgcggtgccccagaa

SEQ ID NO: 784457 - DNA, 20 bp, mouse
gcagacagggagctcaaggg

SEQ ID NO: 784458 - DNA, 20 bp, mouse
gccccagaaaggatacagag

SEQ ID NO: 784459 - DNA, 20 bp, mouse
gcagggagctcaagggcggg

SEQ ID NO: 784460 - DNA, 20 bp, mouse
gagctcaagggcgggaggca

SEQ ID NO: 784461 - DNA, 20 bp, mouse
ggcggcagtgacagctgcat

SEQ ID NO: 784462 - DNA, 20 bp, mouse
ggcaccgcgtcgcgccagac

SEQ ID NO: 784463 - DNA, 20 bp, mouse
gcggaagcggcgggtctcca

SEQ ID NO: 784464 - DNA, 20 bp, mouse
gaagcggcgggtctccatgg

SEQ ID NO: 784465 - DNA, 20 bp, mouse
gtagcagctggaagtctgac

SEQ ID NO: 784466 - DNA, 20 bp, mouse
gtcaagagcactgggtggag

SEQ ID NO: 784467 - DNA, 20 bp, mouse
gggacgctgtcagtgagcgg

SEQ ID NO: 784468 - DNA, 20 bp, mouse
gaccatgcacagacaaaaag

SEQ ID NO: 784469 - DNA, 20 bp, mouse
gacaggacgctgtcagtgag

SEQ ID NO: 784470 - DNA, 20 bp, mouse
gccaaagccgggatctaagt

SEQ ID NO: 784471 - DNA, 20 bp, mouse
gcctgaaggctgctcctggt

SEQ ID NO: 784472 - DNA, 20 bp, mouse
gagcggccccacttagatcc

SEQ ID NO: 784473 - DNA, 20 bp, mouse
gggctgctcctggtaggata

SEQ ID NO: 784474 - DNA, 20 bp, mouse
gcttcctggggagcagtaag

SEQ ID NO: 784475 - DNA, 20 bp, mouse
gtccacgccctcctctgcga

SEQ ID NO: 784476 - DNA, 20 bp, mouse
gcccccgaggtgagggtgtg

SEQ ID NO: 784477 - DNA, 20 bp, mouse
gtgggtgcccgcaccccctg

SEQ ID NO: 784478 - DNA, 20 bp, mouse
gagccctcctgcgccacagg

SEQ ID NO: 784479 - DNA, 20 bp, mouse
gcaagggcgacagggagcgg

SEQ ID NO: 784480 - DNA, 20 bp, mouse
gcagctgcacgctgggggtg

SEQ ID NO: 784481 - DNA, 20 bp, mouse
gaccccacaccctcacctcg

SEQ ID NO: 784482 - DNA, 20 bp, mouse
gtggtccagctgcacgctgg

SEQ ID NO: 784483 - DNA, 20 bp, mouse
gcccgcaccccctgtggcgc

SEQ ID NO: 784484 - DNA, 20 bp, mouse
ggagcggagcccccgaggtg

SEQ ID NO: 784485 - DNA, 20 bp, mouse
ggaggggggcaagggcgaca

SEQ ID NO: 784486 - DNA, 20 bp, mouse
ggccggggagacatatggac

SEQ ID NO: 784487 - DNA, 20 bp, mouse
ggggaggggtctcaaatacc

SEQ ID NO: 784488 - DNA, 20 bp, mouse
ggagccccaggtatggtggt

SEQ ID NO: 784489 - DNA, 20 bp, mouse
gccccaggtatggtggtggg

SEQ ID NO: 784490 - DNA, 20 bp, mouse
ggacatatggactggatcgt

SEQ ID NO: 784491 - DNA, 20 bp, mouse
gcggggtgggaggaaagact

SEQ ID NO: 784492 - DNA, 20 bp, mouse
gggctaaggaatggatagag

SEQ ID NO: 784493 - DNA, 20 bp, mouse
gcctccaccaacaggaaagg

SEQ ID NO: 784494 - DNA, 20 bp, mouse
gagtgagaatgagtggtgat

SEQ ID NO: 784495 - DNA, 20 bp, mouse
gcgccctccaccaacaggaa

SEQ ID NO: 784496 - DNA, 20 bp, mouse
gtggcggcgcatgcccagat

SEQ ID NO: 784497 - DNA, 20 bp, mouse
gtgcccagatcggcagagta

SEQ ID NO: 784498 - DNA, 20 bp, mouse
ggacttgggaggacacgttc

SEQ ID NO: 784499 - DNA, 20 bp, mouse
ggcgagcgggacaaaatggc

SEQ ID NO: 784500 - DNA, 20 bp, mouse
gtgagcaaggggaaggtctc

SEQ ID NO: 784501 - DNA, 20 bp, mouse
gtcaggcgcctcgcagcgga

SEQ ID NO: 784502 - DNA, 20 bp, mouse
gacccctactctgccgatct

SEQ ID NO: 784503 - DNA, 20 bp, mouse
gtgtggcgagcgggacaaaa

SEQ ID NO: 784504 - DNA, 20 bp, mouse
gcccctggggccgaaggctc

SEQ ID NO: 784505 - DNA, 20 bp, mouse
gggggtcaggcgcctcgcag

SEQ ID NO: 784506 - DNA, 20 bp, mouse
gcagcccagcggtttcccca

SEQ ID NO: 784507 - DNA, 20 bp, mouse
gaaggcctgtgcagagcatc

SEQ ID NO: 784508 - DNA, 20 bp, mouse
gggtgagaggcgggaggtca

SEQ ID NO: 784509 - DNA, 20 bp, mouse
ggggagagcggagcttggcg

SEQ ID NO: 784510 - DNA, 20 bp, mouse
gcttccttggggaaaccgct

SEQ ID NO: 784511 - DNA, 20 bp, mouse
gcccgtgcgggcgagcgcta

SEQ ID NO: 784512 - DNA, 20 bp, mouse
gaggagggaaggccttaggg

SEQ ID NO: 784513 - DNA, 20 bp, mouse
gcaagctccgctctccccgt

SEQ ID NO: 784514 - DNA, 20 bp, mouse
gccagcgctgagttttgtga

SEQ ID NO: 784515 - DNA, 20 bp, mouse
ggcggcaacaaaggtagccc

SEQ ID NO: 784516 - DNA, 20 bp, mouse
gtctgactggtgagaacgga

SEQ ID NO: 784517 - DNA, 20 bp, mouse
ggggctctgtggctttaatg

SEQ ID NO: 784518 - DNA, 20 bp, mouse
ggaagggtcggatcttgaag

SEQ ID NO: 784519 - DNA, 20 bp, mouse
gcgttgctgcatgatctttt

SEQ ID NO: 784520 - DNA, 20 bp, mouse
ggccgagcgacgtgcattct

SEQ ID NO: 784521 - DNA, 20 bp, mouse
gtcggatcttgaagaggcgg

SEQ ID NO: 784522 - DNA, 20 bp, mouse
gcgtttctgactggtgagaa

SEQ ID NO: 784523 - DNA, 20 bp, mouse
gttgaagaggcgggggtcgg

SEQ ID NO: 784524 - DNA, 20 bp, mouse
ggtgttttgcagtcttccgc

SEQ ID NO: 784525 - DNA, 20 bp, mouse
gactggatcggaaaggagtt

SEQ ID NO: 784526 - DNA, 20 bp, mouse
gcccgtacggaagcctctcc

SEQ ID NO: 784527 - DNA, 20 bp, mouse
gcggaagtcccgcctcttgg

SEQ ID NO: 784528 - DNA, 20 bp, mouse
gaagtcccgcctcttggtgg

SEQ ID NO: 784529 - DNA, 20 bp, mouse
ggcggcaccagcggtcagga

SEQ ID NO: 784530 - DNA, 20 bp, mouse
ggaaaatggcgatgcccgta

SEQ ID NO: 784531 - DNA, 20 bp, mouse
ggcccaaggacgagtggtga

SEQ ID NO: 784532 - DNA, 20 bp, mouse
gggccctgaactccgcgcac

SEQ ID NO: 784533 - DNA, 20 bp, mouse
gaggtctgtaagctggagcg

SEQ ID NO: 784534 - DNA, 20 bp, mouse
ggggccgcccgggcggaggg

SEQ ID NO: 784535 - DNA, 20 bp, mouse
gtgaactccgcgcacaggaa

SEQ ID NO: 784536 - DNA, 20 bp, mouse
gggcgggccggaggaggggt

SEQ ID NO: 784537 - DNA, 20 bp, mouse
gctgcggggaggtgcttccg

SEQ ID NO: 784538 - DNA, 20 bp, mouse
ggggcgccgacaggaagcga

SEQ ID NO: 784539 - DNA, 20 bp, mouse
gcgcgtccctcgcttcctgt

SEQ ID NO: 784540 - DNA, 20 bp, mouse
ggggcagccgacccctcctc

SEQ ID NO: 784541 - DNA, 20 bp, mouse
gaagcgagggacgcgcgcga

SEQ ID NO: 784542 - DNA, 20 bp, mouse
gcccccgcccctccaggaag

SEQ ID NO: 784543 - DNA, 20 bp, mouse
gcatggcaacgggcgccgac

SEQ ID NO: 784544 - DNA, 20 bp, mouse
gcctgccccgccgcgagggt

SEQ ID NO: 784545 - DNA, 20 bp, mouse
gaaagcgctggcctctagag

SEQ ID NO: 784546 - DNA, 20 bp, mouse
ggctcactgtggggtctcgg

SEQ ID NO: 784547 - DNA, 20 bp, mouse
gccgccccgcgtcctccgga

SEQ ID NO: 784548 - DNA, 20 bp, mouse
gacgccttcgagccttccgg

SEQ ID NO: 784549 - DNA, 20 bp, mouse
gaggcgagtcttaatgattg

SEQ ID NO: 784550 - DNA, 20 bp, mouse
gacaggccacgggtccccgg

SEQ ID NO: 784551 - DNA, 20 bp, mouse
gcgaaggcgtccggctcggg

SEQ ID NO: 784552 - DNA, 20 bp, mouse
gccaccggggcgggggtcac

SEQ ID NO: 784553 - DNA, 20 bp, mouse
gccacagtgagccaccgggg

SEQ ID NO: 784554 - DNA, 20 bp, mouse
gcggacgccttcgagccttc

SEQ ID NO: 784555 - DNA, 20 bp, mouse
gcgtcctccggaaggctcga

SEQ ID NO: 784556 - DNA, 20 bp, mouse
gaaatagagggtgtctggga

SEQ ID NO: 784557 - DNA, 20 bp, mouse
gtgtctgggaaggaccactt

SEQ ID NO: 784558 - DNA, 20 bp, mouse
gcagacaccctctatttcta

SEQ ID NO: 784559 - DNA, 20 bp, mouse
gagccgaggggcgggatctg

SEQ ID NO: 784560 - DNA, 20 bp, mouse
gcacctcaactctctctgtg

SEQ ID NO: 784561 - DNA, 20 bp, mouse
gctcaactctctctgtgagg

SEQ ID NO: 784562 - DNA, 20 bp, mouse
gtgcaagagccaagagccga

SEQ ID NO: 784563 - DNA, 20 bp, mouse
gtatattcgtcgcagacccc

SEQ ID NO: 784564 - DNA, 20 bp, mouse
gtggcctgtgtttccctaag

SEQ ID NO: 784565 - DNA, 20 bp, mouse
ggagggagcctggcagtcgc

SEQ ID NO: 784566 - DNA, 20 bp, mouse
gccaaaccatcagcctctgt

SEQ ID NO: 784567 - DNA, 20 bp, mouse
gacgaagagtactctttgtg

SEQ ID NO: 784568 - DNA, 20 bp, mouse
gcaattaagacaacctacag

SEQ ID NO: 784569 - DNA, 20 bp, mouse
gagggcagtgtctgcttcgg

SEQ ID NO: 784570 - DNA, 20 bp, mouse
gagaggctgatggtttggac

SEQ ID NO: 784571 - DNA, 20 bp, mouse
gaaatgctccaggatatccc

SEQ ID NO: 784572 - DNA, 20 bp, mouse
ggctagagaacaaaatacat

SEQ ID NO: 784573 - DNA, 20 bp, mouse
gtcctggagcattttatttt

SEQ ID NO: 784574 - DNA, 20 bp, mouse
gttgctactttgcactgcaa

SEQ ID NO: 784575 - DNA, 20 bp, mouse
gaagagttcctgggatatcc

SEQ ID NO: 784576 - DNA, 20 bp, mouse
gacaggcagcgtgaatgggg

SEQ ID NO: 784577 - DNA, 20 bp, mouse
ggggcgacaggcagcgtgaa

SEQ ID NO: 784578 - DNA, 20 bp, mouse
ggcagcgtgaatggggaggg

SEQ ID NO: 784579 - DNA, 20 bp, mouse
ggggttacgcgtgcgcagaa

SEQ ID NO: 784580 - DNA, 20 bp, mouse
ggcggggcagctaacggatg

SEQ ID NO: 784581 - DNA, 20 bp, mouse
ggggagggcggtgccgcgtg

SEQ ID NO: 784582 - DNA, 20 bp, mouse
gcgcagaagggcggggcgac

SEQ ID NO: 784583 - DNA, 20 bp, mouse
ggccgcgagagcactggtgt

SEQ ID NO: 784584 - DNA, 20 bp, mouse
gcctccggccgcgagagcac

SEQ ID NO: 784585 - DNA, 20 bp, mouse
gagggcggtgccgcgtgcgg

SEQ ID NO: 784586 - DNA, 20 bp, mouse
gacagataatgccttatatg

SEQ ID NO: 784587 - DNA, 20 bp, mouse
gaatggccacctgatgaaac

SEQ ID NO: 784588 - DNA, 20 bp, mouse
ggaaattcttgggccgggtg

SEQ ID NO: 784589 - DNA, 20 bp, mouse
gtatacatgcaaagaaccta

SEQ ID NO: 784590 - DNA, 20 bp, mouse
gttaataaatgccacatata

SEQ ID NO: 784591 - DNA, 20 bp, mouse
gaaacttaatcgaatacaaa

SEQ ID NO: 784592 - DNA, 20 bp, mouse
ggatttgaaattcttgggcc

SEQ ID NO: 784593 - DNA, 20 bp, mouse
gagtattctcctgtttcatc

SEQ ID NO: 784594 - DNA, 20 bp, mouse
gtgcatgtatagaaatttag

SEQ ID NO: 784595 - DNA, 20 bp, mouse
gattctcctgtttcatcagg

SEQ ID NO: 784596 - DNA, 20 bp, mouse
gtctctagggcgtctagcct

SEQ ID NO: 784597 - DNA, 20 bp, mouse
gtttctaaatgatgggcgct

SEQ ID NO: 784598 - DNA, 20 bp, mouse
gcaggccacgctgagaagtg

SEQ ID NO: 784599 - DNA, 20 bp, mouse
ggcaaaagatattttatctc

SEQ ID NO: 784600 - DNA, 20 bp, mouse
gtaaaatatcttttgcaggg

SEQ ID NO: 784601 - DNA, 20 bp, mouse
gtatgttttttctaaatgat

SEQ ID NO: 784602 - DNA, 20 bp, mouse
gacgccctagagaccctgaa

SEQ ID NO: 784603 - DNA, 20 bp, mouse
gagacccttcagggtctcta

SEQ ID NO: 784604 - DNA, 20 bp, mouse
gcttggctcaaccaaggacc

SEQ ID NO: 784605 - DNA, 20 bp, mouse
gctgacttattttggacctt

SEQ ID NO: 784606 - DNA, 20 bp, mouse
gtctctaggtcttctagcct

SEQ ID NO: 784607 - DNA, 20 bp, mouse
gtttctaaattataggcgct

SEQ ID NO: 784608 - DNA, 20 bp, mouse
gcaggccaccctgagaagtg

SEQ ID NO: 784609 - DNA, 20 bp, mouse
gcagggaggaatacctggga

SEQ ID NO: 784610 - DNA, 20 bp, mouse
ggcaaaagatgtttcatctc

SEQ ID NO: 784611 - DNA, 20 bp, mouse
gtttgcagggaggaatacct

SEQ ID NO: 784612 - DNA, 20 bp, mouse
gtatttccctatgtgactga

SEQ ID NO: 784613 - DNA, 20 bp, mouse
gtgaaacatcttttgcaggg

SEQ ID NO: 784614 - DNA, 20 bp, mouse
gtttgttttttctaaattat

SEQ ID NO: 784615 - DNA, 20 bp, mouse
gaagacctagagaccctgaa

SEQ ID NO: 784616 - DNA, 20 bp, mouse
gggagaccagaataagctat

SEQ ID NO: 784617 - DNA, 20 bp, mouse
ggggcgccatcccacttccc

SEQ ID NO: 784618 - DNA, 20 bp, mouse
gttgctctagtggagaattc

SEQ ID NO: 784619 - DNA, 20 bp, mouse
ggtgaggagctgaagagata

SEQ ID NO: 784620 - DNA, 20 bp, mouse
gatgtgtcctcacaagtgcc

SEQ ID NO: 784621 - DNA, 20 bp, mouse
gagagcaccagttgctctag

SEQ ID NO: 784622 - DNA, 20 bp, mouse
gggacacatacaattttttg

SEQ ID NO: 784623 - DNA, 20 bp, mouse
ggtatttgcaaactcagaga

SEQ ID NO: 784624 - DNA, 20 bp, mouse
gaataagctataggatcttt

SEQ ID NO: 784625 - DNA, 20 bp, mouse
gtagctgaccagattgctag

SEQ ID NO: 784626 - DNA, 20 bp, mouse
gagggcctaaaataacttag

SEQ ID NO: 784627 - DNA, 20 bp, mouse
ggtgaaagcaaagacctaat

SEQ ID NO: 784628 - DNA, 20 bp, mouse
gaggagctagaagtagaatc

SEQ ID NO: 784629 - DNA, 20 bp, mouse
gaaagcaaagacctaattgg

SEQ ID NO: 784630 - DNA, 20 bp, mouse
ggccaatgtgatgaaaacca

SEQ ID NO: 784631 - DNA, 20 bp, mouse
gcatttcgggaaacgaaact

SEQ ID NO: 784632 - DNA, 20 bp, mouse
gtctagagagccagggaaat

SEQ ID NO: 784633 - DNA, 20 bp, mouse
gtcctcccctaagttatttt

SEQ ID NO: 784634 - DNA, 20 bp, mouse
gtgcagcagcagcatggggc

SEQ ID NO: 784635 - DNA, 20 bp, mouse
ggcctaaaataacttagggg

SEQ ID NO: 784636 - DNA, 20 bp, mouse
gggaaagcgcgtaggggtca

SEQ ID NO: 784637 - DNA, 20 bp, mouse
ggcagtacgccggcgcacgg

SEQ ID NO: 784638 - DNA, 20 bp, mouse
ggcggtgatggggtaccccc

SEQ ID NO: 784639 - DNA, 20 bp, mouse
gcccgcgcagccgcggtgat

SEQ ID NO: 784640 - DNA, 20 bp, mouse
gaggccgccggctgtcactg

SEQ ID NO: 784641 - DNA, 20 bp, mouse
gccggcgtactgcgattgga

SEQ ID NO: 784642 - DNA, 20 bp, mouse
gggaacctgaggcctcgctt

SEQ ID NO: 784643 - DNA, 20 bp, mouse
gcgtgaggcggctgtgtgag

SEQ ID NO: 784644 - DNA, 20 bp, mouse
gccggcgcacggcggagagg

SEQ ID NO: 784645 - DNA, 20 bp, mouse
ggcgcctgggaaagcgcgta

SEQ ID NO: 784646 - DNA, 20 bp, mouse
gcggcagcgcacgaatgcgg

SEQ ID NO: 784647 - DNA, 20 bp, mouse
gacgccggggcgcaacgcta

SEQ ID NO: 784648 - DNA, 20 bp, mouse
gggagcgtcgcgaggttcgt

SEQ ID NO: 784649 - DNA, 20 bp, mouse
ggctcggcgcgctgccttct

SEQ ID NO: 784650 - DNA, 20 bp, mouse
gctgcggcagcgcacgaatg

SEQ ID NO: 784651 - DNA, 20 bp, mouse
gccgccctcgcggacgtcag

SEQ ID NO: 784652 - DNA, 20 bp, mouse
gctcccccgctctgaagctc

SEQ ID NO: 784653 - DNA, 20 bp, mouse
gagtccctagcgttgcgccc

SEQ ID NO: 784654 - DNA, 20 bp, mouse
gtgactggacttcgtcatgt

SEQ ID NO: 784655 - DNA, 20 bp, mouse
gcagcgcacgaatgcggagg

SEQ ID NO: 784656 - DNA, 20 bp, mouse
gagaactagtcattgctggt

SEQ ID NO: 784657 - DNA, 20 bp, mouse
gcctgggcagccgaagctga

SEQ ID NO: 784658 - DNA, 20 bp, mouse
gactatggaaatcagagtac

SEQ ID NO: 784659 - DNA, 20 bp, mouse
gcacaagctggagtaatcaa

SEQ ID NO: 784660 - DNA, 20 bp, mouse
ggcccagggcggcgtttccg

SEQ ID NO: 784661 - DNA, 20 bp, mouse
gcctaagaactagtcattgc

SEQ ID NO: 784662 - DNA, 20 bp, mouse
gcccggatacagctccgaca

SEQ ID NO: 784663 - DNA, 20 bp, mouse
gcagggcggcgtttccgcgg

SEQ ID NO: 784664 - DNA, 20 bp, mouse
ggcgcatgcgccctcagctt

SEQ ID NO: 784665 - DNA, 20 bp, mouse
ggaggaagtgaaagccgccg

SEQ ID NO: 784666 - DNA, 20 bp, mouse
gcgcactgccagcggaccgc

SEQ ID NO: 784667 - DNA, 20 bp, mouse
gacggcatgcgtatagacca

SEQ ID NO: 784668 - DNA, 20 bp, mouse
gatagaccagggtcatccgg

SEQ ID NO: 784669 - DNA, 20 bp, mouse
gggtgagacaggcacttttc

SEQ ID NO: 784670 - DNA, 20 bp, mouse
gcagcaggaaagcccggatg

SEQ ID NO: 784671 - DNA, 20 bp, mouse
gtccacgcgcggccctggcc

SEQ ID NO: 784672 - DNA, 20 bp, mouse
ggcggaccgccggatgaccc

SEQ ID NO: 784673 - DNA, 20 bp, mouse
gtggccgggaggcgccgcta

SEQ ID NO: 784674 - DNA, 20 bp, mouse
gcggatgcggctgtcctcta

SEQ ID NO: 784675 - DNA, 20 bp, mouse
gccgctggcagtgcgctcgg

SEQ ID NO: 784676 - DNA, 20 bp, mouse
gtgggtctggggcgcgaagg

SEQ ID NO: 784677 - DNA, 20 bp, mouse
gtggctccggcgacagtccc

SEQ ID NO: 784678 - DNA, 20 bp, mouse
ggacactcgcggaggaaacg

SEQ ID NO: 784679 - DNA, 20 bp, mouse
gggggggggaacacgacagg

SEQ ID NO: 784680 - DNA, 20 bp, mouse
ggggggccgcaacgctacct

SEQ ID NO: 784681 - DNA, 20 bp, mouse
gagcccgtgcaagtcccatc

SEQ ID NO: 784682 - DNA, 20 bp, mouse
gtcgccggagccaaacaact

SEQ ID NO: 784683 - DNA, 20 bp, mouse
gcctggggacagggcgggtt

SEQ ID NO: 784684 - DNA, 20 bp, mouse
gaccgtgtagggcacccccc

SEQ ID NO: 784685 - DNA, 20 bp, mouse
gggcgggcgggtgaccgtgt

SEQ ID NO: 784686 - DNA, 20 bp, mouse
gcgtgggagcgcacagtgtc

SEQ ID NO: 784687 - DNA, 20 bp, mouse
ggcagcgcgcgcagcaggag

SEQ ID NO: 784688 - DNA, 20 bp, mouse
ggggcgggagcagagcgcta

SEQ ID NO: 784689 - DNA, 20 bp, mouse
gagggcggggtgagattagg

SEQ ID NO: 784690 - DNA, 20 bp, mouse
gcggctgcgctcgccctacc

SEQ ID NO: 784691 - DNA, 20 bp, mouse
gctcctggccgggccttccg

SEQ ID NO: 784692 - DNA, 20 bp, mouse
ggggccttccgaggagccga

SEQ ID NO: 784693 - DNA, 20 bp, mouse
gctgaagggccaggcggcca

SEQ ID NO: 784694 - DNA, 20 bp, mouse
ggccccctcggctcctcgga

SEQ ID NO: 784695 - DNA, 20 bp, mouse
gaagccggtggcgctcgtga

SEQ ID NO: 784696 - DNA, 20 bp, mouse
gagcccctctggctgcagtc

SEQ ID NO: 784697 - DNA, 20 bp, mouse
gaatccccagccaaaggaga

SEQ ID NO: 784698 - DNA, 20 bp, mouse
ggggagcaagcccctaccag

SEQ ID NO: 784699 - DNA, 20 bp, mouse
ggtgtctcctaggaggaaga

SEQ ID NO: 784700 - DNA, 20 bp, mouse
ggggcggggagccgctggta

SEQ ID NO: 784701 - DNA, 20 bp, mouse
ggctccagaggtgggtgagg

SEQ ID NO: 784702 - DNA, 20 bp, mouse
ggctgccccagttccaactc

SEQ ID NO: 784703 - DNA, 20 bp, mouse
ggggacgcagactcatttct

SEQ ID NO: 784704 - DNA, 20 bp, mouse
ggccgcacgccctaccggga

SEQ ID NO: 784705 - DNA, 20 bp, mouse
ggtcgcccggagttggaact

SEQ ID NO: 784706 - DNA, 20 bp, mouse
ggggccccgcagcgtctccc

SEQ ID NO: 784707 - DNA, 20 bp, mouse
gcccgcgcagcgagtccagc

SEQ ID NO: 784708 - DNA, 20 bp, mouse
ggggaggggccggtgagctc

SEQ ID NO: 784709 - DNA, 20 bp, mouse
ggcggccccgggagacgctg

SEQ ID NO: 784710 - DNA, 20 bp, mouse
gtaattagcaggggccgcac

SEQ ID NO: 784711 - DNA, 20 bp, mouse
gcggggacgtcaataattcg

SEQ ID NO: 784712 - DNA, 20 bp, mouse
ggaccaacccgggtcgtgaa

SEQ ID NO: 784713 - DNA, 20 bp, mouse
gtgtagtagctgtgtgcgtg

SEQ ID NO: 784714 - DNA, 20 bp, mouse
gcccgcttatgtaattagca

SEQ ID NO: 784715 - DNA, 20 bp, mouse
gcgccagccgcgggctccaa

SEQ ID NO: 784716 - DNA, 20 bp, mouse
ggagccgcggccccaccgaa

SEQ ID NO: 784717 - DNA, 20 bp, mouse
ggggtggccccgggactccc

SEQ ID NO: 784718 - DNA, 20 bp, mouse
ggctccgcggctcgtctccc

SEQ ID NO: 784719 - DNA, 20 bp, mouse
gacccggggcgctgacgtag

SEQ ID NO: 784720 - DNA, 20 bp, mouse
gggagccagcagccgggctc

SEQ ID NO: 784721 - DNA, 20 bp, mouse
ggcgggccgcggtagaaggt

SEQ ID NO: 784722 - DNA, 20 bp, mouse
ggggctcgggggcaccccgc

SEQ ID NO: 784723 - DNA, 20 bp, mouse
gctcccagggagacgagccg

SEQ ID NO: 784724 - DNA, 20 bp, mouse
gggcaccccgcgggagaggg

SEQ ID NO: 784725 - DNA, 20 bp, mouse
gtcgtctccctgggagtccc

SEQ ID NO: 784726 - DNA, 20 bp, mouse
gccggggcggggctgtaggg

SEQ ID NO: 784727 - DNA, 20 bp, mouse
gagtccgcactcacccgtga

SEQ ID NO: 784728 - DNA, 20 bp, mouse
gggcccggggcggggctgta

SEQ ID NO: 784729 - DNA, 20 bp, mouse
gtcgtcctggcgaccgggag

SEQ ID NO: 784730 - DNA, 20 bp, mouse
gcggcgttcccgcttcaggg

SEQ ID NO: 784731 - DNA, 20 bp, mouse
gcactcacccgtgacggctg

SEQ ID NO: 784732 - DNA, 20 bp, mouse
gagctcttgcgtgtgaagag

SEQ ID NO: 784733 - DNA, 20 bp, mouse
gaggctgcgtcactcggcgg

SEQ ID NO: 784734 - DNA, 20 bp, mouse
gcccgcccctcccggtcgcc

SEQ ID NO: 784735 - DNA, 20 bp, mouse
ggttcccgcttcagggaggt

SEQ ID NO: 784736 - DNA, 20 bp, mouse
gctggcgcggcgcagccgat

SEQ ID NO: 784737 - DNA, 20 bp, mouse
ggcgcggcgcagccgattgg

SEQ ID NO: 784738 - DNA, 20 bp, mouse
ggattggaggactattctgg

SEQ ID NO: 784739 - DNA, 20 bp, mouse
ggcccgcgacgcgccggaag

SEQ ID NO: 784740 - DNA, 20 bp, mouse
gtgagtcacgtggtacgcga

SEQ ID NO: 784741 - DNA, 20 bp, mouse
ggacgcgccggaagcgggct

SEQ ID NO: 784742 - DNA, 20 bp, mouse
gacgtgggatagaacagaca

SEQ ID NO: 784743 - DNA, 20 bp, mouse
gtcctcttgaccccaccaag

SEQ ID NO: 784744 - DNA, 20 bp, mouse
gtccccttggtggggtcaag

SEQ ID NO: 784745 - DNA, 20 bp, mouse
ggccgattggaggactattc

SEQ ID NO: 784746 - DNA, 20 bp, mouse
ggggcggcccgggaccgtcg

SEQ ID NO: 784747 - DNA, 20 bp, mouse
gtcccgagagccgggcgaga

SEQ ID NO: 784748 - DNA, 20 bp, mouse
gcctgggcggagggatcccc

SEQ ID NO: 784749 - DNA, 20 bp, mouse
ggactggagctggggaagcg

SEQ ID NO: 784750 - DNA, 20 bp, mouse
ggggcggagctggaccgcga

SEQ ID NO: 784751 - DNA, 20 bp, mouse
gcccgccgctcccgagagcc

SEQ ID NO: 784752 - DNA, 20 bp, mouse
ggcgccggggacccccacgg

SEQ ID NO: 784753 - DNA, 20 bp, mouse
gtccctctcgcccggctctc

SEQ ID NO: 784754 - DNA, 20 bp, mouse
gccggggccgggtggtgaat

SEQ ID NO: 784755 - DNA, 20 bp, mouse
gggcgcctcccgcgagcgac

SEQ ID NO: 784756 - DNA, 20 bp, mouse
gagggccgccccagggtgag

SEQ ID NO: 784757 - DNA, 20 bp, mouse
gtcccggggcggccggccgg

SEQ ID NO: 784758 - DNA, 20 bp, mouse
gccagggtgaggggtgcagg

SEQ ID NO: 784759 - DNA, 20 bp, mouse
gggcggccggccggcggcga

SEQ ID NO: 784760 - DNA, 20 bp, mouse
ggcccctcagagaggggccg

SEQ ID NO: 784761 - DNA, 20 bp, mouse
gacggcgggagggccgcccc

SEQ ID NO: 784762 - DNA, 20 bp, mouse
gtgaggggcctgcgagtccc

SEQ ID NO: 784763 - DNA, 20 bp, mouse
gctcgcaggcccctcagaga

SEQ ID NO: 784764 - DNA, 20 bp, mouse
ggccccagggtgaggggtgc

SEQ ID NO: 784765 - DNA, 20 bp, mouse
ggccgccggccggccgcccc

SEQ ID NO: 784766 - DNA, 20 bp, mouse
gtgagcggagcgcaaagtcg

SEQ ID NO: 784767 - DNA, 20 bp, mouse
ggctcaggaaacaaaagtgg

SEQ ID NO: 784768 - DNA, 20 bp, mouse
gcgcaccgaggagatcgctc

SEQ ID NO: 784769 - DNA, 20 bp, mouse
gggcgcccgagcgatctcct

SEQ ID NO: 784770 - DNA, 20 bp, mouse
gaagtcgcggctctgagatc

SEQ ID NO: 784771 - DNA, 20 bp, mouse
ggtgcgcagccgagagcacg

SEQ ID NO: 784772 - DNA, 20 bp, mouse
gaacaaaagtggcggctgag

SEQ ID NO: 784773 - DNA, 20 bp, mouse
gaggcgctgcgggagaggac

SEQ ID NO: 784774 - DNA, 20 bp, mouse
gcggcccagcgaccaggctc

SEQ ID NO: 784775 - DNA, 20 bp, mouse
gcgcgcgtgcgcattgcgtt

SEQ ID NO: 784776 - DNA, 20 bp, mouse
ggcacgccgcaatatcactc

SEQ ID NO: 784777 - DNA, 20 bp, mouse
gcggtgcccgagtgatattg

SEQ ID NO: 784778 - DNA, 20 bp, mouse
gtagagctgcccagggaaca

SEQ ID NO: 784779 - DNA, 20 bp, mouse
gtccctgggcagctctagga

SEQ ID NO: 784780 - DNA, 20 bp, mouse
gtaacagtgagggtcggtgc

SEQ ID NO: 784781 - DNA, 20 bp, mouse
gggcaccggccgcctctcgc

SEQ ID NO: 784782 - DNA, 20 bp, mouse
gcaactcgggcgaccggaaa

SEQ ID NO: 784783 - DNA, 20 bp, mouse
ggggaacagggtgcatggac

SEQ ID NO: 784784 - DNA, 20 bp, mouse
gccttcctggaacatgtccc

SEQ ID NO: 784785 - DNA, 20 bp, mouse
gcgcccgagttgtgcaaacg

SEQ ID NO: 784786 - DNA, 20 bp, mouse
gctatcgcgcagtgcaccaa

SEQ ID NO: 784787 - DNA, 20 bp, mouse
gtgtgcaggggcagcggaaa

SEQ ID NO: 784788 - DNA, 20 bp, mouse
gcgccaatccgtggcttcct

SEQ ID NO: 784789 - DNA, 20 bp, mouse
gtggcggggagatacgcaac

SEQ ID NO: 784790 - DNA, 20 bp, mouse
gtgcgggaggcagtggtgga

SEQ ID NO: 784791 - DNA, 20 bp, mouse
gttcccaggaagccacggat

SEQ ID NO: 784792 - DNA, 20 bp, mouse
gaagtggggcggtaccctga

SEQ ID NO: 784793 - DNA, 20 bp, mouse
gcgcgatagtgccggcgggg

SEQ ID NO: 784794 - DNA, 20 bp, mouse
ggtgcactgcgcgatagtgc

SEQ ID NO: 784795 - DNA, 20 bp, mouse
ggggggagggggcccggtcc

SEQ ID NO: 784796 - DNA, 20 bp, mouse
gactgcagctcggacgggga

SEQ ID NO: 784797 - DNA, 20 bp, mouse
gccgagcggggaacacacgc

SEQ ID NO: 784798 - DNA, 20 bp, mouse
gagtagctggaaaacagaca

SEQ ID NO: 784799 - DNA, 20 bp, mouse
gcccccggaacggtaaacag

SEQ ID NO: 784800 - DNA, 20 bp, mouse
gcctggcagagcctcgcggg

SEQ ID NO: 784801 - DNA, 20 bp, mouse
gactgggtgtcagatgaaaa

SEQ ID NO: 784802 - DNA, 20 bp, mouse
ggccgcaagccgatggctgc

SEQ ID NO: 784803 - DNA, 20 bp, mouse
gaccctgcagcccactagct

SEQ ID NO: 784804 - DNA, 20 bp, mouse
gccgctcggccgcagaggcc

SEQ ID NO: 784805 - DNA, 20 bp, mouse
gggttgctacgcggagtagc

SEQ ID NO: 784806 - DNA, 20 bp, mouse
gggaggaggccccaccctcg

SEQ ID NO: 784807 - DNA, 20 bp, mouse
gtaagcgagcccagagacgt

SEQ ID NO: 784808 - DNA, 20 bp, mouse
gcagagacgtgggtttacgg

SEQ ID NO: 784809 - DNA, 20 bp, mouse
gagagacgagtcaaccgcga

SEQ ID NO: 784810 - DNA, 20 bp, mouse
gcacctgcaaggacctagcg

SEQ ID NO: 784811 - DNA, 20 bp, mouse
gcccgcccgccggcaagctt

SEQ ID NO: 784812 - DNA, 20 bp, mouse
gtaagcacgccgtaggttaa

SEQ ID NO: 784813 - DNA, 20 bp, mouse
ggcagatagcacagtgggcg

SEQ ID NO: 784814 - DNA, 20 bp, mouse
gcccaagggcaaaggtgaca

SEQ ID NO: 784815 - DNA, 20 bp, mouse
ggcgaggcgggctcgattcg

SEQ ID NO: 784816 - DNA, 20 bp, mouse
gcgcgtgcgccgtccttcgg

SEQ ID NO: 784817 - DNA, 20 bp, mouse
gcggcagagcggagaataga

SEQ ID NO: 784818 - DNA, 20 bp, mouse
gctgccgcccggctgaggct

SEQ ID NO: 784819 - DNA, 20 bp, mouse
gggcaccccgaacctttcga

SEQ ID NO: 784820 - DNA, 20 bp, mouse
gcgcagaccggcccctcgaa

SEQ ID NO: 784821 - DNA, 20 bp, mouse
gacggcgcacgcgcgcagac

SEQ ID NO: 784822 - DNA, 20 bp, mouse
gccgcccggctgaggcttgg

SEQ ID NO: 784823 - DNA, 20 bp, mouse
gaggagaaggcgttgggttg

SEQ ID NO: 784824 - DNA, 20 bp, mouse
gggttgaagccgccgaagga

SEQ ID NO: 784825 - DNA, 20 bp, mouse
gtccgcgcgcgagcaggagg

SEQ ID NO: 784826 - DNA, 20 bp, mouse
gcgcgcgcgcgtcgaggcga

SEQ ID NO: 784827 - DNA, 20 bp, mouse
gcgagggcgcgcacgtgcgg

SEQ ID NO: 784828 - DNA, 20 bp, mouse
gcggggctgagaagccctaa

SEQ ID NO: 784829 - DNA, 20 bp, mouse
gtccgcgggaagatgaataa

SEQ ID NO: 784830 - DNA, 20 bp, mouse
ggcgcggcccgttgtctgtg

SEQ ID NO: 784831 - DNA, 20 bp, mouse
gcacgacgagcctaacccgg

SEQ ID NO: 784832 - DNA, 20 bp, mouse
gggagcgcccaccgccctta

SEQ ID NO: 784833 - DNA, 20 bp, mouse
gtccgccggccgaacggcgg

SEQ ID NO: 784834 - DNA, 20 bp, mouse
ggaagaccagcccccgggtt

SEQ ID NO: 784835 - DNA, 20 bp, mouse
ggggcggcgcgggtttagca

SEQ ID NO: 784836 - DNA, 20 bp, mouse
ggccgcgtcacgcagtgccc

SEQ ID NO: 784837 - DNA, 20 bp, mouse
ggggcggggcgacaccttga

SEQ ID NO: 784838 - DNA, 20 bp, mouse
ggctctgagggccagacggt

SEQ ID NO: 784839 - DNA, 20 bp, mouse
gagacgaggcgcaacatcct

SEQ ID NO: 784840 - DNA, 20 bp, mouse
ggacaggagcctatccccca

SEQ ID NO: 784841 - DNA, 20 bp, mouse
ggcggcgcgcgctgaatgct

SEQ ID NO: 784842 - DNA, 20 bp, mouse
gcagtgcccgggctctgacg

SEQ ID NO: 784843 - DNA, 20 bp, mouse
gagcccgccgccatcttacg

SEQ ID NO: 784844 - DNA, 20 bp, mouse
gaggcagttgaggcggagag

SEQ ID NO: 784845 - DNA, 20 bp, mouse
gggctcttgcgtgacgtcat

SEQ ID NO: 784846 - DNA, 20 bp, mouse
ggctcacccggggcaggtaa

SEQ ID NO: 784847 - DNA, 20 bp, mouse
gtgggaggctctgcccgggg

SEQ ID NO: 784848 - DNA, 20 bp, mouse
ggtgaagcccttacctgccc

SEQ ID NO: 784849 - DNA, 20 bp, mouse
gcaggtaagggcttcactgc

SEQ ID NO: 784850 - DNA, 20 bp, mouse
gctggaagtgtagtctgtgt

SEQ ID NO: 784851 - DNA, 20 bp, mouse
ggactgttggcgcgaggagg

SEQ ID NO: 784852 - DNA, 20 bp, mouse
gtgcgtgttaaagctcaccc

SEQ ID NO: 784853 - DNA, 20 bp, mouse
gtgtgtgggaggctctgccc

SEQ ID NO: 784854 - DNA, 20 bp, mouse
gccaacagtctccttttgat

SEQ ID NO: 784855 - DNA, 20 bp, mouse
gacgcacgatttatgccagc

SEQ ID NO: 784856 - DNA, 20 bp, mouse
ggcaaagagcactagaaagc

SEQ ID NO: 784857 - DNA, 20 bp, mouse
gagggttcaaggaatgaaga

SEQ ID NO: 784858 - DNA, 20 bp, mouse
ggctggactagtctccacct

SEQ ID NO: 784859 - DNA, 20 bp, mouse
gtgggagagtccagggctga

SEQ ID NO: 784860 - DNA, 20 bp, mouse
gacgtgctggggggagatgg

SEQ ID NO: 784861 - DNA, 20 bp, mouse
gtccctctcccacgtgctgg

SEQ ID NO: 784862 - DNA, 20 bp, mouse
gcagacaagctcactggatt

SEQ ID NO: 784863 - DNA, 20 bp, mouse
gctagtgctctttgcccagg

SEQ ID NO: 784864 - DNA, 20 bp, mouse
gcaggtgagttctccacaca

SEQ ID NO: 784865 - DNA, 20 bp, mouse
gcccacgtgctggggggaga

SEQ ID NO: 784866 - DNA, 20 bp, mouse
gcgggcgcgggcctaggccg

SEQ ID NO: 784867 - DNA, 20 bp, mouse
gaaaaggagtgcctcggcct

SEQ ID NO: 784868 - DNA, 20 bp, mouse
gttccagcgcgaggagatgt

SEQ ID NO: 784869 - DNA, 20 bp, mouse
gggcgggggcggcgagtgcg

SEQ ID NO: 784870 - DNA, 20 bp, mouse
ggccaggcagcccgccgctt

SEQ ID NO: 784871 - DNA, 20 bp, mouse
gtctctaaagaggccgcggg

SEQ ID NO: 784872 - DNA, 20 bp, mouse
gcgcgggaaaaggagtgcct

SEQ ID NO: 784873 - DNA, 20 bp, mouse
ggggaaatgccgggaggact

SEQ ID NO: 784874 - DNA, 20 bp, mouse
gcggagggatctgacgcaca

SEQ ID NO: 784875 - DNA, 20 bp, mouse
gggagatgtcggagccgaag

SEQ ID NO: 784876 - DNA, 20 bp, mouse
ggcctcgggcgacacattct

SEQ ID NO: 784877 - DNA, 20 bp, mouse
ggaaaataactcccccgggg

SEQ ID NO: 784878 - DNA, 20 bp, mouse
gtcgggcgacacattctggg

SEQ ID NO: 784879 - DNA, 20 bp, mouse
gcggggagagcacagcgcct

SEQ ID NO: 784880 - DNA, 20 bp, mouse
gccaagggaggcggcacccg

SEQ ID NO: 784881 - DNA, 20 bp, mouse
ggcgacacattctgggcgga

SEQ ID NO: 784882 - DNA, 20 bp, mouse
gacacattctgggcggaggg

SEQ ID NO: 784883 - DNA, 20 bp, mouse
gcagctgcgcgctacgccca

SEQ ID NO: 784884 - DNA, 20 bp, mouse
ggcacgctcgccaagggagg

SEQ ID NO: 784885 - DNA, 20 bp, mouse
ggcccccgcacgctcgccaa

SEQ ID NO: 784886 - DNA, 20 bp, mouse
gggtcgcggcccccggggta

SEQ ID NO: 784887 - DNA, 20 bp, mouse
gggagagggtctacagagga

SEQ ID NO: 784888 - DNA, 20 bp, mouse
gggtggcctccgtaccccgg

SEQ ID NO: 784889 - DNA, 20 bp, mouse
ggttggaagcaggttgaggt

SEQ ID NO: 784890 - DNA, 20 bp, mouse
gcggaaggaacgcgttgggg

SEQ ID NO: 784891 - DNA, 20 bp, mouse
gagagtccgccccacgaggg

SEQ ID NO: 784892 - DNA, 20 bp, mouse
gcaaccgcggctgaggctaa

SEQ ID NO: 784893 - DNA, 20 bp, mouse
gcggtcagcagctgccccga

SEQ ID NO: 784894 - DNA, 20 bp, mouse
gccgcccggaaggaacgcgt

SEQ ID NO: 784895 - DNA, 20 bp, mouse
gaaagggagagggtctacag

SEQ ID NO: 784896 - DNA, 20 bp, mouse
gcagcgtgagagtgcagcga

SEQ ID NO: 784897 - DNA, 20 bp, mouse
gcgggccgaaggcgccatgg

SEQ ID NO: 784898 - DNA, 20 bp, mouse
gactcggggtgcggcctcac

SEQ ID NO: 784899 - DNA, 20 bp, mouse
gccaagacgccgaggagcta

SEQ ID NO: 784900 - DNA, 20 bp, mouse
gccccctcgcgcgacactgt

SEQ ID NO: 784901 - DNA, 20 bp, mouse
gcgagaaaagactcggggtg

SEQ ID NO: 784902 - DNA, 20 bp, mouse
gcgtcggagaaacagcccca

SEQ ID NO: 784903 - DNA, 20 bp, mouse
gcagcgaggggctgcccgtg

SEQ ID NO: 784904 - DNA, 20 bp, mouse
gccgaccgagaaaagactcg

SEQ ID NO: 784905 - DNA, 20 bp, mouse
gtcctcggcgtcttggtcgt

SEQ ID NO: 784906 - DNA, 20 bp, mouse
gctggggcagaactacatca

SEQ ID NO: 784907 - DNA, 20 bp, mouse
gtccagcagggctaggcctg

SEQ ID NO: 784908 - DNA, 20 bp, mouse
gtggggaaagcacatgtggc

SEQ ID NO: 784909 - DNA, 20 bp, mouse
gcatcaggggtgacacctgg

SEQ ID NO: 784910 - DNA, 20 bp, mouse
ggcctagccctgctggacct

SEQ ID NO: 784911 - DNA, 20 bp, mouse
gctacatcaggggtgacacc

SEQ ID NO: 784912 - DNA, 20 bp, mouse
gtgacacctggcggagcctg

SEQ ID NO: 784913 - DNA, 20 bp, mouse
ggccaaggtccagcagggct

SEQ ID NO: 784914 - DNA, 20 bp, mouse
gaatgtgttggagaacactt

SEQ ID NO: 784915 - DNA, 20 bp, mouse
ggccccaggcctagccctgc

SEQ ID NO: 784916 - DNA, 20 bp, mouse
gtggaaaatggcagtccaat

SEQ ID NO: 784917 - DNA, 20 bp, mouse
gggcgctagaagtccccaaa

SEQ ID NO: 784918 - DNA, 20 bp, mouse
gacccgtgcgagcggggagg

SEQ ID NO: 784919 - DNA, 20 bp, mouse
ggggccattggctgcaatga

SEQ ID NO: 784920 - DNA, 20 bp, mouse
gcagctgagggtctttgcgc

SEQ ID NO: 784921 - DNA, 20 bp, mouse
gccaacggccttgtccgccc

SEQ ID NO: 784922 - DNA, 20 bp, mouse
gataggaagacgggattcca

SEQ ID NO: 784923 - DNA, 20 bp, mouse
gaaaccctccgattggaaaa

SEQ ID NO: 784924 - DNA, 20 bp, mouse
ggtcgctgtgggagccttac

SEQ ID NO: 784925 - DNA, 20 bp, mouse
gggcagtccaataggaagac

SEQ ID NO: 784926 - DNA, 20 bp, mouse
gtccgctgggtgtcactcgg

SEQ ID NO: 784927 - DNA, 20 bp, mouse
gcgtacgcctcattaacttg

SEQ ID NO: 784928 - DNA, 20 bp, mouse
gcgtgtccgcggcgggctct

SEQ ID NO: 784929 - DNA, 20 bp, mouse
gtgacacccagcggaaaagg

SEQ ID NO: 784930 - DNA, 20 bp, mouse
gcggagccgactccagacaa

SEQ ID NO: 784931 - DNA, 20 bp, mouse
ggcgactgccgacgcccaga

SEQ ID NO: 784932 - DNA, 20 bp, mouse
ggcccgcgccgcctggaagc

SEQ ID NO: 784933 - DNA, 20 bp, mouse
ggcggagagcccacctgcta

SEQ ID NO: 784934 - DNA, 20 bp, mouse
gaggctccacgcggtcgctg

SEQ ID NO: 784935 - DNA, 20 bp, mouse
gccggctgccgagcgcctct

SEQ ID NO: 784936 - DNA, 20 bp, mouse
gtgggaggagacggtggcca

SEQ ID NO: 784937 - DNA, 20 bp, mouse
gccggcccgtgagtcacgag

SEQ ID NO: 784938 - DNA, 20 bp, mouse
gtatcggaggacggagggtg

SEQ ID NO: 784939 - DNA, 20 bp, mouse
gctcggggctcccgtcagag

SEQ ID NO: 784940 - DNA, 20 bp, mouse
gcacctggcagctgggacgt

SEQ ID NO: 784941 - DNA, 20 bp, mouse
ggcttgaagctaccgcttat

SEQ ID NO: 784942 - DNA, 20 bp, mouse
gcctgcccctcgtgactcac

SEQ ID NO: 784943 - DNA, 20 bp, mouse
gccgcagcccagacacgccc

SEQ ID NO: 784944 - DNA, 20 bp, mouse
ggcttcaagcaatgggtaag

SEQ ID NO: 784945 - DNA, 20 bp, mouse
ggcctggggcggttggtggg

SEQ ID NO: 784946 - DNA, 20 bp, mouse
gaggccggggtgaacggttg

SEQ ID NO: 784947 - DNA, 20 bp, mouse
gagcagcgcgggcccgggag

SEQ ID NO: 784948 - DNA, 20 bp, mouse
gggtgcgcggcgcagagggg

SEQ ID NO: 784949 - DNA, 20 bp, mouse
gccccggggccctgtccggg

SEQ ID NO: 784950 - DNA, 20 bp, mouse
gccgggcccgcgctgctgat

SEQ ID NO: 784951 - DNA, 20 bp, mouse
gccgcgcacccgcccggaca

SEQ ID NO: 784952 - DNA, 20 bp, mouse
gggtgtgaggccggggtgaa

SEQ ID NO: 784953 - DNA, 20 bp, mouse
gcgccccccggggccctgtc

SEQ ID NO: 784954 - DNA, 20 bp, mouse
gcggcgcaggaggcgagcgg

SEQ ID NO: 784955 - DNA, 20 bp, mouse
gcgagcggtggaacatgtaa

SEQ ID NO: 784956 - DNA, 20 bp, mouse
gaggactcatggggagtcag

SEQ ID NO: 784957 - DNA, 20 bp, mouse
gtggtctaggagggtcggaa

SEQ ID NO: 784958 - DNA, 20 bp, mouse
gaaagcgggcgctgtgcaag

SEQ ID NO: 784959 - DNA, 20 bp, mouse
gagtggagggtggtctagga

SEQ ID NO: 784960 - DNA, 20 bp, mouse
gcaggcggacaggacgggat

SEQ ID NO: 784961 - DNA, 20 bp, mouse
gttgggctccagcaccacaa

SEQ ID NO: 784962 - DNA, 20 bp, mouse
ggggagtcaggggacgattc

SEQ ID NO: 784963 - DNA, 20 bp, mouse
gggcggggactcagggaagc

SEQ ID NO: 784964 - DNA, 20 bp, mouse
gggcgctgtgcaagcggggg

SEQ ID NO: 784965 - DNA, 20 bp, mouse
ggggacgattcaggcatctt

SEQ ID NO: 784966 - DNA, 20 bp, mouse
gggaggatgccaccaggcgg

SEQ ID NO: 784967 - DNA, 20 bp, mouse
ggatgaagaacccgcgctcg

SEQ ID NO: 784968 - DNA, 20 bp, mouse
ggagctggatggagagggcg

SEQ ID NO: 784969 - DNA, 20 bp, mouse
gactgtgacaaggtcaccct

SEQ ID NO: 784970 - DNA, 20 bp, mouse
gtgggagggaggatgccacc

SEQ ID NO: 784971 - DNA, 20 bp, mouse
gggccggccaccacaggcgg

SEQ ID NO: 784972 - DNA, 20 bp, mouse
ggctggagggatagtagggc

SEQ ID NO: 784973 - DNA, 20 bp, mouse
gaaaaagtgggactcatcat

SEQ ID NO: 784974 - DNA, 20 bp, mouse
gtcttcatcccgccgcctgg

SEQ ID NO: 784975 - DNA, 20 bp, mouse
gcgcccctcccgggcattgg

SEQ ID NO: 784976 - DNA, 20 bp, mouse
gagacgggcggctaccaagt

SEQ ID NO: 784977 - DNA, 20 bp, mouse
gacctccgcagagagacggg

SEQ ID NO: 784978 - DNA, 20 bp, mouse
gctcacctggggcgataagg

SEQ ID NO: 784979 - DNA, 20 bp, mouse
ggtagccgcccgtctctctg

SEQ ID NO: 784980 - DNA, 20 bp, mouse
ggagccaccagggtgcgcaa

SEQ ID NO: 784981 - DNA, 20 bp, mouse
gcgggcgcccctcccggtgg

SEQ ID NO: 784982 - DNA, 20 bp, mouse
gatcgccccaggtgagtagt

SEQ ID NO: 784983 - DNA, 20 bp, mouse
gttgcctttgcgcaccctgg

SEQ ID NO: 784984 - DNA, 20 bp, mouse
ggctaccaagtcggctgagg

SEQ ID NO: 784985 - DNA, 20 bp, mouse
gaccaagtcggctgaggggg

SEQ ID NO: 784986 - DNA, 20 bp, mouse
gcccgctcgcgactggggag

SEQ ID NO: 784987 - DNA, 20 bp, mouse
ggacacacacacctagaggt

SEQ ID NO: 784988 - DNA, 20 bp, mouse
gagccgggctagtcccgaga

SEQ ID NO: 784989 - DNA, 20 bp, mouse
gtaggtgtgtgtgtcacctt

SEQ ID NO: 784990 - DNA, 20 bp, mouse
gcccagagggcggaacctaa

SEQ ID NO: 784991 - DNA, 20 bp, mouse
ggggctgcagaaggggctca

SEQ ID NO: 784992 - DNA, 20 bp, mouse
gcccgggaggaggtcctcgt

SEQ ID NO: 784993 - DNA, 20 bp, mouse
gtgggcgtggtcagtttcag

SEQ ID NO: 784994 - DNA, 20 bp, mouse
gcagtcgcgagcgggtcccc

SEQ ID NO: 784995 - DNA, 20 bp, mouse
gcgcgggcgtagatttcctg

SEQ ID NO: 784996 - DNA, 20 bp, mouse
gagcccgcgacccgcgggga

SEQ ID NO: 784997 - DNA, 20 bp, mouse
gtgtcctcgccatagaggag

SEQ ID NO: 784998 - DNA, 20 bp, mouse
gaacgtgacgcgtgcgtacg

SEQ ID NO: 784999 - DNA, 20 bp, mouse
ggggccttgtagttcgctgt

SEQ ID NO: 785000 - DNA, 20 bp, mouse
gacgacatttctgcggagag

SEQ ID NO: 785001 - DNA, 20 bp, mouse
gtagcatgacgacatttctg

SEQ ID NO: 785002 - DNA, 20 bp, mouse
gaggctgtccagcagcgggc

SEQ ID NO: 785003 - DNA, 20 bp, mouse
gggctcgcgttgcacagtgg

SEQ ID NO: 785004 - DNA, 20 bp, mouse
gtctgcggagagcgggaggc

SEQ ID NO: 785005 - DNA, 20 bp, mouse
ggacgcgtgcgtacgggggt

SEQ ID NO: 785006 - DNA, 20 bp, mouse
ggggtcggggagggaccgaa

SEQ ID NO: 785007 - DNA, 20 bp, mouse
ggaggccggagtagaattgt

SEQ ID NO: 785008 - DNA, 20 bp, mouse
gtcagggtggagcgcagcag

SEQ ID NO: 785009 - DNA, 20 bp, mouse
gaggtccagcgggtcgggga

SEQ ID NO: 785010 - DNA, 20 bp, mouse
gccctggtcctaggagctca

SEQ ID NO: 785011 - DNA, 20 bp, mouse
ggccggagtagaattgtggg

SEQ ID NO: 785012 - DNA, 20 bp, mouse
gccagaggaagtgacaggta

SEQ ID NO: 785013 - DNA, 20 bp, mouse
ggggcggagcgtcttggtta

SEQ ID NO: 785014 - DNA, 20 bp, mouse
gtacgcaggtccagcgggtc

SEQ ID NO: 785015 - DNA, 20 bp, mouse
gccagcgccgcccatggtgg

SEQ ID NO: 785016 - DNA, 20 bp, mouse
gcgtcccgtccgaggagcgt

SEQ ID NO: 785017 - DNA, 20 bp, mouse
ggcgtggcgcgtcccgtccg

SEQ ID NO: 785018 - DNA, 20 bp, mouse
ggccccgcacccacgctcct

SEQ ID NO: 785019 - DNA, 20 bp, mouse
ggcaccctctgcgtgcgcgt

SEQ ID NO: 785020 - DNA, 20 bp, mouse
ggggaagccgggcggtggaa

SEQ ID NO: 785021 - DNA, 20 bp, mouse
gcgagctcggagcacatgga

SEQ ID NO: 785022 - DNA, 20 bp, mouse
ggcgccggcgcacatcaaag

SEQ ID NO: 785023 - DNA, 20 bp, mouse
ggtgcccacgcgcacgcaga

SEQ ID NO: 785024 - DNA, 20 bp, mouse
gactgggcgggcgggacggg

SEQ ID NO: 785025 - DNA, 20 bp, mouse
ggggcgggacgggtggagcg

SEQ ID NO: 785026 - DNA, 20 bp, mouse
gcaggaaggagccctgtccg

SEQ ID NO: 785027 - DNA, 20 bp, mouse
ggaaccgaggcccgaagccc

SEQ ID NO: 785028 - DNA, 20 bp, mouse
gcgtgcgcagtgcagagcag

SEQ ID NO: 785029 - DNA, 20 bp, mouse
gggcaggcgaaggaaagcca

SEQ ID NO: 785030 - DNA, 20 bp, mouse
gtggagactgacgtcacttc

SEQ ID NO: 785031 - DNA, 20 bp, mouse
gtggttgctaaacaaccaaa

SEQ ID NO: 785032 - DNA, 20 bp, mouse
ggggccaaggcagctcacct

SEQ ID NO: 785033 - DNA, 20 bp, mouse
gccaacctgcctaacttcca

SEQ ID NO: 785034 - DNA, 20 bp, mouse
gtcgggcctcggttcagccg

SEQ ID NO: 785035 - DNA, 20 bp, mouse
gacacccgggcttcgggcct

SEQ ID NO: 785036 - DNA, 20 bp, mouse
gggtgcaggcggagcatcgt

SEQ ID NO: 785037 - DNA, 20 bp, mouse
gccaaagggcctccctctta

SEQ ID NO: 785038 - DNA, 20 bp, mouse
gagggctcccgaggtgcagg

SEQ ID NO: 785039 - DNA, 20 bp, mouse
gaacgcgcaggaccccgcgg

SEQ ID NO: 785040 - DNA, 20 bp, mouse
ggataagggactctcggatt

SEQ ID NO: 785041 - DNA, 20 bp, mouse
gaggtcgggaccctcctgct

SEQ ID NO: 785042 - DNA, 20 bp, mouse
gggtgggaggcccaggaacg

SEQ ID NO: 785043 - DNA, 20 bp, mouse
ggagggaggccctttggggt

SEQ ID NO: 785044 - DNA, 20 bp, mouse
gttcctgggcctcccacctg

SEQ ID NO: 785045 - DNA, 20 bp, mouse
ggacccgaggtggctagggg

SEQ ID NO: 785046 - DNA, 20 bp, mouse
gggttagaagggaggatcag

SEQ ID NO: 785047 - DNA, 20 bp, mouse
gccagtgccagcccaataga

SEQ ID NO: 785048 - DNA, 20 bp, mouse
ggggcaggagctggttagaa

SEQ ID NO: 785049 - DNA, 20 bp, mouse
gtcaggggctcggtgcgtaa

SEQ ID NO: 785050 - DNA, 20 bp, mouse
ggatgcaggaatcaatgata

SEQ ID NO: 785051 - DNA, 20 bp, mouse
ggcaggaatcaatgataggg

SEQ ID NO: 785052 - DNA, 20 bp, mouse
gcacttggacaatagcaaag

SEQ ID NO: 785053 - DNA, 20 bp, mouse
gggctcggtgcgtaatggtg

SEQ ID NO: 785054 - DNA, 20 bp, mouse
gctgtgagatgccttgtctg

SEQ ID NO: 785055 - DNA, 20 bp, mouse
ggaatcaatgatagggaggt

SEQ ID NO: 785056 - DNA, 20 bp, mouse
gcccaaagctgcaaagaact

SEQ ID NO: 785057 - DNA, 20 bp, mouse
gggcccgcctccctacgcat

SEQ ID NO: 785058 - DNA, 20 bp, mouse
ggaggcccgagggtgtgaag

SEQ ID NO: 785059 - DNA, 20 bp, mouse
ggccacggccaatcccgtga

SEQ ID NO: 785060 - DNA, 20 bp, mouse
gcagttgtacctccaatctg

SEQ ID NO: 785061 - DNA, 20 bp, mouse
ggctcatgagtcccagttaa

SEQ ID NO: 785062 - DNA, 20 bp, mouse
gccgacccaggcctatgcgt

SEQ ID NO: 785063 - DNA, 20 bp, mouse
gtaggacccaggagtggaac

SEQ ID NO: 785064 - DNA, 20 bp, mouse
gcaaagaactgggttgcaat

SEQ ID NO: 785065 - DNA, 20 bp, mouse
gcctgggtcgggtttggtaa

SEQ ID NO: 785066 - DNA, 20 bp, mouse
ggggagggcgggacggttgt

SEQ ID NO: 785067 - DNA, 20 bp, mouse
gcaaaacggggaggaactcg

SEQ ID NO: 785068 - DNA, 20 bp, mouse
gccatcacaagtactgtcag

SEQ ID NO: 785069 - DNA, 20 bp, mouse
gagggcgggacggttgtggg

SEQ ID NO: 785070 - DNA, 20 bp, mouse
gggctagtcggtgttctgag

SEQ ID NO: 785071 - DNA, 20 bp, mouse
gctcaccagtgcactaaacc

SEQ ID NO: 785072 - DNA, 20 bp, mouse
gccgccgcgatgaatgggag

SEQ ID NO: 785073 - DNA, 20 bp, mouse
gaggaggaggcgctcacggg

SEQ ID NO: 785074 - DNA, 20 bp, mouse
gatcgcggcggatggggagt

SEQ ID NO: 785075 - DNA, 20 bp, mouse
gaccaggaggaggcgctcac

SEQ ID NO: 785076 - DNA, 20 bp, mouse
gggaccgacgggtactggga

SEQ ID NO: 785077 - DNA, 20 bp, mouse
gccagcctcccggggaccga

SEQ ID NO: 785078 - DNA, 20 bp, mouse
ggtacccgtcggtccccggg

SEQ ID NO: 785079 - DNA, 20 bp, mouse
gacatcgggaccagcctccc

SEQ ID NO: 785080 - DNA, 20 bp, mouse
ggccacctcggcacccgcaa

SEQ ID NO: 785081 - DNA, 20 bp, mouse
gccggcccggggccgtctgc

SEQ ID NO: 785082 - DNA, 20 bp, mouse
gaggacgcgcgccgttgctc

SEQ ID NO: 785083 - DNA, 20 bp, mouse
gacggcgcgcgtcctccgtg

SEQ ID NO: 785084 - DNA, 20 bp, mouse
gcgccgctctggctgcccgg

SEQ ID NO: 785085 - DNA, 20 bp, mouse
gtcgagggttacacgcgagg

SEQ ID NO: 785086 - DNA, 20 bp, mouse
gagcccgcaggttacgggac

SEQ ID NO: 785087 - DNA, 20 bp, mouse
ggggaccgggcgagaggggt

SEQ ID NO: 785088 - DNA, 20 bp, mouse
gcgcccggtcccgtaacctg

SEQ ID NO: 785089 - DNA, 20 bp, mouse
gggagggtcccggcgagcga

SEQ ID NO: 785090 - DNA, 20 bp, mouse
gggtcccggcgagcgagggc

SEQ ID NO: 785091 - DNA, 20 bp, mouse
gcgagggcgggcccgacggc

SEQ ID NO: 785092 - DNA, 20 bp, mouse
ggagaggggtgggagggtcc

SEQ ID NO: 785093 - DNA, 20 bp, mouse
ggcccgacggcgggcgtgat

SEQ ID NO: 785094 - DNA, 20 bp, mouse
ggttacgggaccgggcgaga

SEQ ID NO: 785095 - DNA, 20 bp, mouse
ggcccgccccttagtcctat

SEQ ID NO: 785096 - DNA, 20 bp, mouse
gggactgtcaggaaattcag

SEQ ID NO: 785097 - DNA, 20 bp, mouse
gctgtcaggaaattcagagg

SEQ ID NO: 785098 - DNA, 20 bp, mouse
ggaggaagggaatgggctta

SEQ ID NO: 785099 - DNA, 20 bp, mouse
ggctgcaaaatccttagcct

SEQ ID NO: 785100 - DNA, 20 bp, mouse
gtaggacagttcatggttta

SEQ ID NO: 785101 - DNA, 20 bp, mouse
gtactgatttgggacatctc

SEQ ID NO: 785102 - DNA, 20 bp, mouse
gtatacaccaagttaatgat

SEQ ID NO: 785103 - DNA, 20 bp, mouse
gtcaatctgagtggctgtgt

SEQ ID NO: 785104 - DNA, 20 bp, mouse
ggaaatgtgcatggactgtc

SEQ ID NO: 785105 - DNA, 20 bp, mouse
gggggattttaaacagaaat

SEQ ID NO: 785106 - DNA, 20 bp, mouse
gtatgtgtggtgatatgagt

SEQ ID NO: 785107 - DNA, 20 bp, mouse
gtggtgatatgagtaggtat

SEQ ID NO: 785108 - DNA, 20 bp, mouse
gccctgggagcctggaatgg

SEQ ID NO: 785109 - DNA, 20 bp, mouse
gcctcatagattcatgtact

SEQ ID NO: 785110 - DNA, 20 bp, mouse
ggctgccttccttttgtcag

SEQ ID NO: 785111 - DNA, 20 bp, mouse
ggatgactcccctgggagcc

SEQ ID NO: 785112 - DNA, 20 bp, mouse
gtcttaagtaaggcagtccc

SEQ ID NO: 785113 - DNA, 20 bp, mouse
gttcaagatagattcctcaa

SEQ ID NO: 785114 - DNA, 20 bp, mouse
gctgattggatgactcccct

SEQ ID NO: 785115 - DNA, 20 bp, mouse
gggatatgcagtttggggct

SEQ ID NO: 785116 - DNA, 20 bp, mouse
ggagcagcccgaggccgtta

SEQ ID NO: 785117 - DNA, 20 bp, mouse
gagaacaaagacacagcggc

SEQ ID NO: 785118 - DNA, 20 bp, mouse
ggggtggctcagatccctaa

SEQ ID NO: 785119 - DNA, 20 bp, mouse
gggccccgcctcctagtaga

SEQ ID NO: 785120 - DNA, 20 bp, mouse
gagggtggagttctgtccaa

SEQ ID NO: 785121 - DNA, 20 bp, mouse
gcccgcctcctagtagaggg

SEQ ID NO: 785122 - DNA, 20 bp, mouse
gcaccccagtcgcaaaattt

SEQ ID NO: 785123 - DNA, 20 bp, mouse
gaactccaccctctactagg

SEQ ID NO: 785124 - DNA, 20 bp, mouse
gctcccccaggctgggggtt

SEQ ID NO: 785125 - DNA, 20 bp, mouse
gctcagatccctaacggcct

SEQ ID NO: 785126 - DNA, 20 bp, mouse
gggactgggccctgggtgga

SEQ ID NO: 785127 - DNA, 20 bp, mouse
gtctaacagatgtccctcta

SEQ ID NO: 785128 - DNA, 20 bp, mouse
gagtctgtgccttccaccca

SEQ ID NO: 785129 - DNA, 20 bp, mouse
ggtactagtgtgtctagtgt

SEQ ID NO: 785130 - DNA, 20 bp, mouse
gctaatcctggattaactgg

SEQ ID NO: 785131 - DNA, 20 bp, mouse
ggtgaaggccaaagggtcct

SEQ ID NO: 785132 - DNA, 20 bp, mouse
gaggggagggactgggccct

SEQ ID NO: 785133 - DNA, 20 bp, mouse
gacctccaaggtcagaaatg

SEQ ID NO: 785134 - DNA, 20 bp, mouse
gaaggcagatgagcgtcctg

SEQ ID NO: 785135 - DNA, 20 bp, mouse
gagccaggggcctcgggatg

SEQ ID NO: 785136 - DNA, 20 bp, mouse
ggacatctgtatagctccca

SEQ ID NO: 785137 - DNA, 20 bp, mouse
gcgaatctggctccaccaat

SEQ ID NO: 785138 - DNA, 20 bp, mouse
gcctgctcgcccaggcttgt

SEQ ID NO: 785139 - DNA, 20 bp, mouse
gggctcaggaggctgggtaa

SEQ ID NO: 785140 - DNA, 20 bp, mouse
gtgggggctgaattccaagt

SEQ ID NO: 785141 - DNA, 20 bp, mouse
gggagctatacagatgtcct

SEQ ID NO: 785142 - DNA, 20 bp, mouse
gggtggagccagattcggtc

SEQ ID NO: 785143 - DNA, 20 bp, mouse
gaggggtggagcttaaccca

SEQ ID NO: 785144 - DNA, 20 bp, mouse
ggtgttgaacggacttcagg

SEQ ID NO: 785145 - DNA, 20 bp, mouse
gtaaggtgctcagagagggg

SEQ ID NO: 785146 - DNA, 20 bp, mouse
gtacgcgcgcgcggcaggta

SEQ ID NO: 785147 - DNA, 20 bp, mouse
gcacacgcgcacggaggaca

SEQ ID NO: 785148 - DNA, 20 bp, mouse
gggtgcgcgccccaggacaa

SEQ ID NO: 785149 - DNA, 20 bp, mouse
gtctgcgagaggtaggaaag

SEQ ID NO: 785150 - DNA, 20 bp, mouse
gcacggaggacaggggtccg

SEQ ID NO: 785151 - DNA, 20 bp, mouse
gcaagggcgggcggcaggca

SEQ ID NO: 785152 - DNA, 20 bp, mouse
gtccgtgcgcgtgtgcgcaa

SEQ ID NO: 785153 - DNA, 20 bp, mouse
gggcggggtctgcgagaggt

SEQ ID NO: 785154 - DNA, 20 bp, mouse
ggggccgcgcacgctcacgg

SEQ ID NO: 785155 - DNA, 20 bp, mouse
gcgtgggcgcgccactggct

SEQ ID NO: 785156 - DNA, 20 bp, mouse
gaagtccgaccatggatcag

SEQ ID NO: 785157 - DNA, 20 bp, mouse
gtggggacacattcctggga

SEQ ID NO: 785158 - DNA, 20 bp, mouse
ggaagggcgaagtccgacca

SEQ ID NO: 785159 - DNA, 20 bp, mouse
gggtctggggacacattcct

SEQ ID NO: 785160 - DNA, 20 bp, mouse
ggatactctccgctgatcca

SEQ ID NO: 785161 - DNA, 20 bp, mouse
gcacccagagctgacgtcgc

SEQ ID NO: 785162 - DNA, 20 bp, mouse
gaatgtgtccccagaccgcc

SEQ ID NO: 785163 - DNA, 20 bp, mouse
gcctcgggcgtaggagagaa

SEQ ID NO: 785164 - DNA, 20 bp, mouse
gggagcgggactctaaactg

SEQ ID NO: 785165 - DNA, 20 bp, mouse
gttgcagttcacgtcatcac

SEQ ID NO: 785166 - DNA, 20 bp, mouse
ggggtggcaacctttttatg

SEQ ID NO: 785167 - DNA, 20 bp, mouse
gtcctcactgccacataaaa

SEQ ID NO: 785168 - DNA, 20 bp, mouse
gtcactgaaaaggtagaaaa

SEQ ID NO: 785169 - DNA, 20 bp, mouse
gagcccctccccttggattt

SEQ ID NO: 785170 - DNA, 20 bp, mouse
ggggaggaattaaaagactg

SEQ ID NO: 785171 - DNA, 20 bp, mouse
gaccaacaacagagattggg

SEQ ID NO: 785172 - DNA, 20 bp, mouse
gaacaaccaacaacagagat

SEQ ID NO: 785173 - DNA, 20 bp, mouse
gtcagccaaaatccaagggg

SEQ ID NO: 785174 - DNA, 20 bp, mouse
ggccacccaatctctgttgt

SEQ ID NO: 785175 - DNA, 20 bp, mouse
ggtctctcagccaaaatcca

SEQ ID NO: 785176 - DNA, 20 bp, mouse
gaggggagtggattctgctc

SEQ ID NO: 785177 - DNA, 20 bp, mouse
gtccccctcaggagggatgg

SEQ ID NO: 785178 - DNA, 20 bp, mouse
gcggctcacacaatgtctcc

SEQ ID NO: 785179 - DNA, 20 bp, mouse
gcaggagggctgggtgcctt

SEQ ID NO: 785180 - DNA, 20 bp, mouse
gacaatgtctccaggagggc

SEQ ID NO: 785181 - DNA, 20 bp, mouse
gaggatctgtccccctcagg

SEQ ID NO: 785182 - DNA, 20 bp, mouse
gctgtaggggcaggtctgta

SEQ ID NO: 785183 - DNA, 20 bp, mouse
gagccctttactgagagaaa

SEQ ID NO: 785184 - DNA, 20 bp, mouse
gctcacacaatgtctccagg

SEQ ID NO: 785185 - DNA, 20 bp, mouse
gagacctgcccctacaggat

SEQ ID NO: 785186 - DNA, 20 bp, mouse
gggaagctggggcgggctaa

SEQ ID NO: 785187 - DNA, 20 bp, mouse
gcgtaggcgcaggttctgat

SEQ ID NO: 785188 - DNA, 20 bp, mouse
ggcccctcgcgcttgtgtag

SEQ ID NO: 785189 - DNA, 20 bp, mouse
gaaggaggccgcgattgcgt

SEQ ID NO: 785190 - DNA, 20 bp, mouse
ggaaacgacaacaatgacat

SEQ ID NO: 785191 - DNA, 20 bp, mouse
gaaacaggacaggctagggg

SEQ ID NO: 785192 - DNA, 20 bp, mouse
gggccactacacaagcgcga

SEQ ID NO: 785193 - DNA, 20 bp, mouse
ggctaggggcggagctacgg

SEQ ID NO: 785194 - DNA, 20 bp, mouse
ggccgcgattgcgtaggcgc

SEQ ID NO: 785195 - DNA, 20 bp, mouse
ggcccgccccagcttccaat

SEQ ID NO: 785196 - DNA, 20 bp, mouse
ggggcggggtagggcattga

SEQ ID NO: 785197 - DNA, 20 bp, mouse
gggtggggcaagcgagggtg

SEQ ID NO: 785198 - DNA, 20 bp, mouse
gtctgctggatccactgcaa

SEQ ID NO: 785199 - DNA, 20 bp, mouse
gggcgtaaggaaggcgtccc

SEQ ID NO: 785200 - DNA, 20 bp, mouse
gcaatggctggcaacgctct

SEQ ID NO: 785201 - DNA, 20 bp, mouse
gggaagggatgcacctcccg

SEQ ID NO: 785202 - DNA, 20 bp, mouse
gcgcagaaggacagggggtg

SEQ ID NO: 785203 - DNA, 20 bp, mouse
gaggaccagcgtcatttccg

SEQ ID NO: 785204 - DNA, 20 bp, mouse
ggcgggctggtggactggtg

SEQ ID NO: 785205 - DNA, 20 bp, mouse
gcctcccgcggaaatgacgc

SEQ ID NO: 785206 - DNA, 20 bp, mouse
gccctcccccgcactgggtg

SEQ ID NO: 785207 - DNA, 20 bp, mouse
gccggcgggcggattcactg

SEQ ID NO: 785208 - DNA, 20 bp, mouse
gtccagagccaacccggcgg

SEQ ID NO: 785209 - DNA, 20 bp, mouse
ggcctccagagccaacccgg

SEQ ID NO: 785210 - DNA, 20 bp, mouse
gagccaacccggcggcggag

SEQ ID NO: 785211 - DNA, 20 bp, mouse
gcaggccccacccagtgcgg

SEQ ID NO: 785212 - DNA, 20 bp, mouse
gtgccgctccgccgccgggt

SEQ ID NO: 785213 - DNA, 20 bp, mouse
ggaccaggccccacccagtg

SEQ ID NO: 785214 - DNA, 20 bp, mouse
gcggcggcggagcggcagag

SEQ ID NO: 785215 - DNA, 20 bp, mouse
gcctgcgcagtaaggaccgg

SEQ ID NO: 785216 - DNA, 20 bp, mouse
gagggaggaggggcttacgg

SEQ ID NO: 785217 - DNA, 20 bp, mouse
gaggcccgccctcaaacaca

SEQ ID NO: 785218 - DNA, 20 bp, mouse
gaagaaaggctcgggcccag

SEQ ID NO: 785219 - DNA, 20 bp, mouse
ggcccaggggactcttacat

SEQ ID NO: 785220 - DNA, 20 bp, mouse
ggtagcgtgggtaagatcag

SEQ ID NO: 785221 - DNA, 20 bp, mouse
gcactcgactcagattacga

SEQ ID NO: 785222 - DNA, 20 bp, mouse
gaagcaatctcccggaagaa

SEQ ID NO: 785223 - DNA, 20 bp, mouse
gaaggcgggccctgtgtttg

SEQ ID NO: 785224 - DNA, 20 bp, mouse
ggaagagcttttggaagcta

SEQ ID NO: 785225 - DNA, 20 bp, mouse
gtgcccgcggcgccgcctga

SEQ ID NO: 785226 - DNA, 20 bp, mouse
gaagctgcgcttaggtagag

SEQ ID NO: 785227 - DNA, 20 bp, mouse
gtcgcagcgtagcaaacgaa

SEQ ID NO: 785228 - DNA, 20 bp, mouse
gtgagaggaccaaagagggg

SEQ ID NO: 785229 - DNA, 20 bp, mouse
gctacagacgtgagaaggag

SEQ ID NO: 785230 - DNA, 20 bp, mouse
gcgggctcggctgggttcgg

SEQ ID NO: 785231 - DNA, 20 bp, mouse
ggtggcctacagacgtgaga

SEQ ID NO: 785232 - DNA, 20 bp, mouse
gggagacgctcgcttcggct

SEQ ID NO: 785233 - DNA, 20 bp, mouse
gggtctgtgaagctgcgctt

SEQ ID NO: 785234 - DNA, 20 bp, mouse
gagttggggactcaaatgta

SEQ ID NO: 785235 - DNA, 20 bp, mouse
gtaccatcactacccaaagg

SEQ ID NO: 785236 - DNA, 20 bp, mouse
ggcagcgagctcctggagtg

SEQ ID NO: 785237 - DNA, 20 bp, mouse
gccgtggcttcagtcaactg

SEQ ID NO: 785238 - DNA, 20 bp, mouse
ggggctcagagggcagccga

SEQ ID NO: 785239 - DNA, 20 bp, mouse
gcagccgaaggatgagactg

SEQ ID NO: 785240 - DNA, 20 bp, mouse
ggaagaggccacatctgggg

SEQ ID NO: 785241 - DNA, 20 bp, mouse
ggccgagccagtagcgccca

SEQ ID NO: 785242 - DNA, 20 bp, mouse
gcagtcaactggggctcaga

SEQ ID NO: 785243 - DNA, 20 bp, mouse
gggcggagcgggaaggctga

SEQ ID NO: 785244 - DNA, 20 bp, mouse
gccagtagcgcccagggaag

SEQ ID NO: 785245 - DNA, 20 bp, mouse
gactggctcggccagtgtgg

SEQ ID NO: 785246 - DNA, 20 bp, mouse
gcccgcgcaggtcacgtgag

SEQ ID NO: 785247 - DNA, 20 bp, mouse
ggcagagcgggcagctcccg

SEQ ID NO: 785248 - DNA, 20 bp, mouse
gagcaggaccgcgctcggta

SEQ ID NO: 785249 - DNA, 20 bp, mouse
ggggacttggaggaccgcct

SEQ ID NO: 785250 - DNA, 20 bp, mouse
ggctgcccgctctgccggtg

SEQ ID NO: 785251 - DNA, 20 bp, mouse
ggaccgcgctcggtagggac

SEQ ID NO: 785252 - DNA, 20 bp, mouse
gcgacccacgcgcttccggt

SEQ ID NO: 785253 - DNA, 20 bp, mouse
gcacgtgaggggcccggtgg

SEQ ID NO: 785254 - DNA, 20 bp, mouse
ggcggccgcggcgtctagag

SEQ ID NO: 785255 - DNA, 20 bp, mouse
gccaccaaccggaagcgcgt

SEQ ID NO: 785256 - DNA, 20 bp, mouse
gccgccaggacctcggagag

SEQ ID NO: 785257 - DNA, 20 bp, mouse
gccctcccgcaagggatcaa

SEQ ID NO: 785258 - DNA, 20 bp, mouse
gccgggaaggggaggtgtag

SEQ ID NO: 785259 - DNA, 20 bp, mouse
gggtaagcccgccaggacct

SEQ ID NO: 785260 - DNA, 20 bp, mouse
ggctggggccgccccctcca

SEQ ID NO: 785261 - DNA, 20 bp, mouse
gacgagaaggcggacccgaa

SEQ ID NO: 785262 - DNA, 20 bp, mouse
ggcacggctggagttcagtc

SEQ ID NO: 785263 - DNA, 20 bp, mouse
ggcggagcccaggagccggg

SEQ ID NO: 785264 - DNA, 20 bp, mouse
gtgaggagagaagagattct

SEQ ID NO: 785265 - DNA, 20 bp, mouse
gaaggcggacccgaagggat

SEQ ID NO: 785266 - DNA, 20 bp, mouse
gcctacaggaaccccgcccg

SEQ ID NO: 785267 - DNA, 20 bp, mouse
gtcccgcctctcagacgcgg

SEQ ID NO: 785268 - DNA, 20 bp, mouse
gaggatctgaccaatcacaa

SEQ ID NO: 785269 - DNA, 20 bp, mouse
gcgcccccgcgtctgagagg

SEQ ID NO: 785270 - DNA, 20 bp, mouse
gtaccacgcccactctgggg

SEQ ID NO: 785271 - DNA, 20 bp, mouse
gccttgaaaaataaccgtgg

SEQ ID NO: 785272 - DNA, 20 bp, mouse
gcgctaccacgcccactctg

SEQ ID NO: 785273 - DNA, 20 bp, mouse
ggggccctcacgtgacgcga

SEQ ID NO: 785274 - DNA, 20 bp, mouse
gagggccctcgactaaaggg

SEQ ID NO: 785275 - DNA, 20 bp, mouse
gggctccgccctttagtcga

SEQ ID NO: 785276 - DNA, 20 bp, mouse
ggggccgcgtggtgacgagg

SEQ ID NO: 785277 - DNA, 20 bp, mouse
ggcctcgcggcgtgggatcc

SEQ ID NO: 785278 - DNA, 20 bp, mouse
gaggctgctcgcctggtccc

SEQ ID NO: 785279 - DNA, 20 bp, mouse
gactacctgcgggatgacat

SEQ ID NO: 785280 - DNA, 20 bp, mouse
ggtagtgcggccacgggcag

SEQ ID NO: 785281 - DNA, 20 bp, mouse
ggcagccgatgtcatcccgc

SEQ ID NO: 785282 - DNA, 20 bp, mouse
ggatggcaggatgcgagcga

SEQ ID NO: 785283 - DNA, 20 bp, mouse
ggaccggggaggcgggtctt

SEQ ID NO: 785284 - DNA, 20 bp, mouse
gaggcgcgttcgttccccga

SEQ ID NO: 785285 - DNA, 20 bp, mouse
gccaatcaccgcgaccgtcg

SEQ ID NO: 785286 - DNA, 20 bp, mouse
ggcgcccgcgcgctacgtgg

SEQ ID NO: 785287 - DNA, 20 bp, mouse
ggcagggccccgcgtgtcgt

SEQ ID NO: 785288 - DNA, 20 bp, mouse
gccctccctcgctccggcga

SEQ ID NO: 785289 - DNA, 20 bp, mouse
gacgcccgccctcgtgtcag

SEQ ID NO: 785290 - DNA, 20 bp, mouse
ggacacgcggggccctgcct

SEQ ID NO: 785291 - DNA, 20 bp, mouse
gtcttccctcgccggagcga

SEQ ID NO: 785292 - DNA, 20 bp, mouse
gcggcgagggaagagcgggg

SEQ ID NO: 785293 - DNA, 20 bp, mouse
ggcggcgcccgcgcgctacg

SEQ ID NO: 785294 - DNA, 20 bp, mouse
ggggcgggaggaagcgagca

SEQ ID NO: 785295 - DNA, 20 bp, mouse
gctccggcgagggaagagcg

SEQ ID NO: 785296 - DNA, 20 bp, mouse
gtcccggagcggagacagaa

SEQ ID NO: 785297 - DNA, 20 bp, mouse
ggattggggcaaagactcga

SEQ ID NO: 785298 - DNA, 20 bp, mouse
gcggccaagggcggggtccg

SEQ ID NO: 785299 - DNA, 20 bp, mouse
gagggcaacgggagcatcct

SEQ ID NO: 785300 - DNA, 20 bp, mouse
gggtccccagagtgccgcta

SEQ ID NO: 785301 - DNA, 20 bp, mouse
gtggccgttccgccatcttg

SEQ ID NO: 785302 - DNA, 20 bp, mouse
gctccgggactctctgaacc

SEQ ID NO: 785303 - DNA, 20 bp, mouse
gagctctgtcctccccaaga

SEQ ID NO: 785304 - DNA, 20 bp, mouse
gctcttcccagcttccttag

SEQ ID NO: 785305 - DNA, 20 bp, mouse
gaacccttctgtctccgctc

SEQ ID NO: 785306 - DNA, 20 bp, mouse
gcccgggcgggcttctgcca

SEQ ID NO: 785307 - DNA, 20 bp, mouse
gggtctgagcatgcccgggc

SEQ ID NO: 785308 - DNA, 20 bp, mouse
gtcagcttctagcctctcca

SEQ ID NO: 785309 - DNA, 20 bp, mouse
gtgcaggatgccagggtctg

SEQ ID NO: 785310 - DNA, 20 bp, mouse
gcagaccgcgcaggtccggg

SEQ ID NO: 785311 - DNA, 20 bp, mouse
gtggtactggatctggtaga

SEQ ID NO: 785312 - DNA, 20 bp, mouse
ggtacagaccccacagcccc

SEQ ID NO: 785313 - DNA, 20 bp, mouse
gcaagcccctaagttggtac

SEQ ID NO: 785314 - DNA, 20 bp, mouse
ggccgccgcccggacctgcg

SEQ ID NO: 785315 - DNA, 20 bp, mouse
gaccgcgcaggtccgggcgg

SEQ ID NO: 785316 - DNA, 20 bp, mouse
gactgcgctgggctgaagga

SEQ ID NO: 785317 - DNA, 20 bp, mouse
gagactgcgctgggcagcga

SEQ ID NO: 785318 - DNA, 20 bp, mouse
ggggccggacggcgacgcgg

SEQ ID NO: 785319 - DNA, 20 bp, mouse
gagcgccggccctactagcc

SEQ ID NO: 785320 - DNA, 20 bp, mouse
gggcaccagccaggctagta

SEQ ID NO: 785321 - DNA, 20 bp, mouse
gaaggcccgcaggcgggagc

SEQ ID NO: 785322 - DNA, 20 bp, mouse
gaactcacggcggctcgtgg

SEQ ID NO: 785323 - DNA, 20 bp, mouse
gccagccaggctagtagggc

SEQ ID NO: 785324 - DNA, 20 bp, mouse
gtgggctgaaggagggtttg

SEQ ID NO: 785325 - DNA, 20 bp, mouse
gcgtggggcgcttctccctg

SEQ ID NO: 785326 - DNA, 20 bp, mouse
gcacgcgtgcctggcgaagt

SEQ ID NO: 785327 - DNA, 20 bp, mouse
gaggcgccctgcaccgacgt

SEQ ID NO: 785328 - DNA, 20 bp, mouse
gtgtcccagggccaatagga

SEQ ID NO: 785329 - DNA, 20 bp, mouse
gggagctgtctgaaccagga

SEQ ID NO: 785330 - DNA, 20 bp, mouse
gacgcgccccacgtcggtgc

SEQ ID NO: 785331 - DNA, 20 bp, mouse
gcaagccctgaggactactg

SEQ ID NO: 785332 - DNA, 20 bp, mouse
gacgcaagaaacaaaactat

SEQ ID NO: 785333 - DNA, 20 bp, mouse
gtcgccaggcacgcgtgggc

SEQ ID NO: 785334 - DNA, 20 bp, mouse
gaccgggacgcgccccacgt

SEQ ID NO: 785335 - DNA, 20 bp, mouse
gccctcctcagtagtcctca

SEQ ID NO: 785336 - DNA, 20 bp, mouse
gcaatcagggacaggggcgg

SEQ ID NO: 785337 - DNA, 20 bp, mouse
ggcagacagcgtaaattgaa

SEQ ID NO: 785338 - DNA, 20 bp, mouse
gaggggcgggggcgtgtcta

SEQ ID NO: 785339 - DNA, 20 bp, mouse
gtccacgagtgggcgtggtg

SEQ ID NO: 785340 - DNA, 20 bp, mouse
gtaaagaccaggccggtgat

SEQ ID NO: 785341 - DNA, 20 bp, mouse
gtggaaagacgaagaaacgc

SEQ ID NO: 785342 - DNA, 20 bp, mouse
gcgggggcgtgtctacgggc

SEQ ID NO: 785343 - DNA, 20 bp, mouse
ggctttttgtgtttggtctt

SEQ ID NO: 785344 - DNA, 20 bp, mouse
gtctagccaatcagggacag

SEQ ID NO: 785345 - DNA, 20 bp, mouse
ggccaagcacagtcatgtgg

SEQ ID NO: 785346 - DNA, 20 bp, mouse
gcagctaggcaccaggtgga

SEQ ID NO: 785347 - DNA, 20 bp, mouse
gagtgtgtggaaaacttctt

SEQ ID NO: 785348 - DNA, 20 bp, mouse
gttgaggctcttaactctag

SEQ ID NO: 785349 - DNA, 20 bp, mouse
gccaggtggaagggctacat

SEQ ID NO: 785350 - DNA, 20 bp, mouse
gaccctaggtctggactccg

SEQ ID NO: 785351 - DNA, 20 bp, mouse
ggtccccggagtccagacct

SEQ ID NO: 785352 - DNA, 20 bp, mouse
gcctgcgcagcaggttgctc

SEQ ID NO: 785353 - DNA, 20 bp, mouse
gaatacactgctgtaaaggt

SEQ ID NO: 785354 - DNA, 20 bp, mouse
gtgctgtaaaggtaggtcta

SEQ ID NO: 785355 - DNA, 20 bp, mouse
ggcgcgctcagagctctccg

SEQ ID NO: 785356 - DNA, 20 bp, mouse
ggggcccaagtctctagcgc

SEQ ID NO: 785357 - DNA, 20 bp, mouse
gaggagcgggaatgcgggga

SEQ ID NO: 785358 - DNA, 20 bp, mouse
ggggaccttccgcagctctt

SEQ ID NO: 785359 - DNA, 20 bp, mouse
gcggggagggcggggataag

SEQ ID NO: 785360 - DNA, 20 bp, mouse
gcaatcccgcgctagagact

SEQ ID NO: 785361 - DNA, 20 bp, mouse
gaaccagggcacttacgccc

SEQ ID NO: 785362 - DNA, 20 bp, mouse
ggtcccgggcgtaagtgccc

SEQ ID NO: 785363 - DNA, 20 bp, mouse
gtagagacttgggcccgact

SEQ ID NO: 785364 - DNA, 20 bp, mouse
gacagtggcggccatgggac

SEQ ID NO: 785365 - DNA, 20 bp, mouse
gggtctctctaaccggaagg

SEQ ID NO: 785366 - DNA, 20 bp, mouse
ggcgctgtgcgaggtgtgtc

SEQ ID NO: 785367 - DNA, 20 bp, mouse
gctcggaggtaacagagcag

SEQ ID NO: 785368 - DNA, 20 bp, mouse
gtcgcggggcccaatcttag

SEQ ID NO: 785369 - DNA, 20 bp, mouse
gccggaagcggatgagtctc

SEQ ID NO: 785370 - DNA, 20 bp, mouse
gttacctccgagcgcctcct

SEQ ID NO: 785371 - DNA, 20 bp, mouse
gagcggatgagtctccgggt

SEQ ID NO: 785372 - DNA, 20 bp, mouse
gctgtgcgaggtgtgtcagg

SEQ ID NO: 785373 - DNA, 20 bp, mouse
ggtagtgccggagcagcgaa

SEQ ID NO: 785374 - DNA, 20 bp, mouse
gcaggaagtgctgccggaag

SEQ ID NO: 785375 - DNA, 20 bp, mouse
gcgcacagcgcccgccgagg

SEQ ID NO: 785376 - DNA, 20 bp, mouse
gagaaggcaggaagagtcgc

SEQ ID NO: 785377 - DNA, 20 bp, mouse
gtggaaggggactactgtgg

SEQ ID NO: 785378 - DNA, 20 bp, mouse
ggagggcagcagtgacctcg

SEQ ID NO: 785379 - DNA, 20 bp, mouse
ggagaggagcaatcagtaga

SEQ ID NO: 785380 - DNA, 20 bp, mouse
ggcggtgtggagtctcgggg

SEQ ID NO: 785381 - DNA, 20 bp, mouse
gccactaggagcagattgcc

SEQ ID NO: 785382 - DNA, 20 bp, mouse
gcgggacgccggcttggaag

SEQ ID NO: 785383 - DNA, 20 bp, mouse
gcgcggggctggtggaagac

SEQ ID NO: 785384 - DNA, 20 bp, mouse
ggggaagcaaatccctcagt

SEQ ID NO: 785385 - DNA, 20 bp, mouse
ggcttggaaggggactactg

SEQ ID NO: 785386 - DNA, 20 bp, mouse
ggggctgagagtccggaagc

SEQ ID NO: 785387 - DNA, 20 bp, mouse
gcggagacgacttcctcttc

SEQ ID NO: 785388 - DNA, 20 bp, mouse
gctggggcgttgttgtgttt

SEQ ID NO: 785389 - DNA, 20 bp, mouse
gactctcagccctcccgctc

SEQ ID NO: 785390 - DNA, 20 bp, mouse
gcccgtacctagaaagtcgc

SEQ ID NO: 785391 - DNA, 20 bp, mouse
ggggcagggtaggaagacac

SEQ ID NO: 785392 - DNA, 20 bp, mouse
gataaacgcgagctgatggg

SEQ ID NO: 785393 - DNA, 20 bp, mouse
gccgcccgccgaagggaagg

SEQ ID NO: 785394 - DNA, 20 bp, mouse
ggggataaacgcgagctgat

SEQ ID NO: 785395 - DNA, 20 bp, mouse
gggacacccccatgtaagga

SEQ ID NO: 785396 - DNA, 20 bp, mouse
gcaggtgcggggactctcgg

SEQ ID NO: 785397 - DNA, 20 bp, mouse
gcggaagcgaggctcccgaa

SEQ ID NO: 785398 - DNA, 20 bp, mouse
gcaaaggtccacggaatccc

SEQ ID NO: 785399 - DNA, 20 bp, mouse
ggggcaggtgcggggactct

SEQ ID NO: 785400 - DNA, 20 bp, mouse
ggccccggggtgattctccc

SEQ ID NO: 785401 - DNA, 20 bp, mouse
gaatccccggctgatccatt

SEQ ID NO: 785402 - DNA, 20 bp, mouse
gcggggactctcggtggcac

SEQ ID NO: 785403 - DNA, 20 bp, mouse
gactcccgggagaatcaccc

SEQ ID NO: 785404 - DNA, 20 bp, mouse
gtccgcggggaacgtcgtca

SEQ ID NO: 785405 - DNA, 20 bp, mouse
gtgagatggcggggcaggtg

SEQ ID NO: 785406 - DNA, 20 bp, mouse
ggaaccgcggcaccagtttt

SEQ ID NO: 785407 - DNA, 20 bp, mouse
gcggaggctcgaagtctcgt

SEQ ID NO: 785408 - DNA, 20 bp, mouse
gttctggggagtttgggcta

SEQ ID NO: 785409 - DNA, 20 bp, mouse
gctgcccaaaactggtgccg

SEQ ID NO: 785410 - DNA, 20 bp, mouse
ggtagtcgctcactgagagc

SEQ ID NO: 785411 - DNA, 20 bp, mouse
gcagccgcttccgggatggt

SEQ ID NO: 785412 - DNA, 20 bp, mouse
gaactggtgccgcggttctg

SEQ ID NO: 785413 - DNA, 20 bp, mouse
gacggctgcgcggacaggca

SEQ ID NO: 785414 - DNA, 20 bp, mouse
ggagacttcgagcctccggg

SEQ ID NO: 785415 - DNA, 20 bp, mouse
gttccctgcgaagggatttt

SEQ ID NO: 785416 - DNA, 20 bp, mouse
ggtggccggggcaacctaat

SEQ ID NO: 785417 - DNA, 20 bp, mouse
gtggaggaaggtgtatgcgg

SEQ ID NO: 785418 - DNA, 20 bp, mouse
gcactccagaacctgaatgg

SEQ ID NO: 785419 - DNA, 20 bp, mouse
ggccgctgccgtgcacgggg

SEQ ID NO: 785420 - DNA, 20 bp, mouse
gggccactccagaacctgaa

SEQ ID NO: 785421 - DNA, 20 bp, mouse
gtgcacgggggggtgtggtt

SEQ ID NO: 785422 - DNA, 20 bp, mouse
ggaatggaggaaggtgtatg

SEQ ID NO: 785423 - DNA, 20 bp, mouse
gacccccccgtgcacggcag

SEQ ID NO: 785424 - DNA, 20 bp, mouse
ggctgccgctgccgtgcacg

SEQ ID NO: 785425 - DNA, 20 bp, mouse
gcaactcaaggccactacca

SEQ ID NO: 785426 - DNA, 20 bp, mouse
gcgaggagacggggcagtat

SEQ ID NO: 785427 - DNA, 20 bp, mouse
gtgccccgtctcctcggtgg

SEQ ID NO: 785428 - DNA, 20 bp, mouse
gggagacggggcagtatggg

SEQ ID NO: 785429 - DNA, 20 bp, mouse
gtacccggcatggaattggt

SEQ ID NO: 785430 - DNA, 20 bp, mouse
ggtgggtcagagtgcggcgg

SEQ ID NO: 785431 - DNA, 20 bp, mouse
gccctgcgggaaaacggaac

SEQ ID NO: 785432 - DNA, 20 bp, mouse
gggctggagaccaagattcg

SEQ ID NO: 785433 - DNA, 20 bp, mouse
ggaactcagcggaacgaatg

SEQ ID NO: 785434 - DNA, 20 bp, mouse
ggattccgccaccgaggaga

SEQ ID NO: 785435 - DNA, 20 bp, mouse
gaggcgcagtgccacttacc

SEQ ID NO: 785436 - DNA, 20 bp, mouse
gctgtccggaaatcccggag

SEQ ID NO: 785437 - DNA, 20 bp, mouse
gccttcgccggaggaagctg

SEQ ID NO: 785438 - DNA, 20 bp, mouse
gcggaacgattgccttcctc

SEQ ID NO: 785439 - DNA, 20 bp, mouse
ggggctctcagctgtctccg

SEQ ID NO: 785440 - DNA, 20 bp, mouse
gacagctgagagcccgcgcg

SEQ ID NO: 785441 - DNA, 20 bp, mouse
ggaggccggaagtaccgtgg

SEQ ID NO: 785442 - DNA, 20 bp, mouse
gtcccagctcagatctacgg

SEQ ID NO: 785443 - DNA, 20 bp, mouse
ggaaatcccgccttcgccgg

SEQ ID NO: 785444 - DNA, 20 bp, mouse
gcgttcccagctcagatcta

SEQ ID NO: 785445 - DNA, 20 bp, mouse
gcgctagacagccaatcccg

SEQ ID NO: 785446 - DNA, 20 bp, mouse
gtcggctactggtgcagcag

SEQ ID NO: 785447 - DNA, 20 bp, mouse
gctaggctctaggtgaggag

SEQ ID NO: 785448 - DNA, 20 bp, mouse
gccactccaaggccagaggt

SEQ ID NO: 785449 - DNA, 20 bp, mouse
gtccaaggccagaggtgggt

SEQ ID NO: 785450 - DNA, 20 bp, mouse
gcttggagtggcaagatcga

SEQ ID NO: 785451 - DNA, 20 bp, mouse
ggacggggcggggcgaagat

SEQ ID NO: 785452 - DNA, 20 bp, mouse
ggtgcagcagcggctgagac

SEQ ID NO: 785453 - DNA, 20 bp, mouse
ggggctgcctaggtggtcgg

SEQ ID NO: 785454 - DNA, 20 bp, mouse
ggggaggtgctgctgcatac

SEQ ID NO: 785455 - DNA, 20 bp, mouse
gcccacaagctctcgaggat

SEQ ID NO: 785456 - DNA, 20 bp, mouse
gagggcaaggtctaagagag

SEQ ID NO: 785457 - DNA, 20 bp, mouse
gaagttcgacaagaaacgtg

SEQ ID NO: 785458 - DNA, 20 bp, mouse
gtggggctgaaaactttgat

SEQ ID NO: 785459 - DNA, 20 bp, mouse
gagccctgccgctgcacttc

SEQ ID NO: 785460 - DNA, 20 bp, mouse
gcaggcggcgacaaatctcc

SEQ ID NO: 785461 - DNA, 20 bp, mouse
gaaaatgctcggtggtccct

SEQ ID NO: 785462 - DNA, 20 bp, mouse
gcaaaaatggacagtgagtc

SEQ ID NO: 785463 - DNA, 20 bp, mouse
gcctgacagagcgccctacc

SEQ ID NO: 785464 - DNA, 20 bp, mouse
gcggcgacaaatctcctggt

SEQ ID NO: 785465 - DNA, 20 bp, mouse
gcatgaaagaagaaaagccc

SEQ ID NO: 785466 - DNA, 20 bp, mouse
gcaccgcgaccgcagcgagg

SEQ ID NO: 785467 - DNA, 20 bp, mouse
gcgtcggcagcccgcgtctg

SEQ ID NO: 785468 - DNA, 20 bp, mouse
gtcgccccctcagctcggtg

SEQ ID NO: 785469 - DNA, 20 bp, mouse
gcgcctgcgccaagcggcgg

SEQ ID NO: 785470 - DNA, 20 bp, mouse
gcccctcagctcggtggggt

SEQ ID NO: 785471 - DNA, 20 bp, mouse
gagcccgcgagcctcagacg

SEQ ID NO: 785472 - DNA, 20 bp, mouse
gagccccctcgctgcggtcg

SEQ ID NO: 785473 - DNA, 20 bp, mouse
gcgggtctggttgacgtgga

SEQ ID NO: 785474 - DNA, 20 bp, mouse
gccgcagagcgaacgctccg

SEQ ID NO: 785475 - DNA, 20 bp, mouse
gagcgttcgctctgcgggtc

SEQ ID NO: 785476 - DNA, 20 bp, mouse
gcggctaccatggtcctcaa

SEQ ID NO: 785477 - DNA, 20 bp, mouse
gccaggcggtaagaacaaag

SEQ ID NO: 785478 - DNA, 20 bp, mouse
ggtaaatatcctgaaaggtc

SEQ ID NO: 785479 - DNA, 20 bp, mouse
gccggtggatccagcctttg

SEQ ID NO: 785480 - DNA, 20 bp, mouse
ggacagcccgggcatgtttg

SEQ ID NO: 785481 - DNA, 20 bp, mouse
gtcgctgtaaatatcctgaa

SEQ ID NO: 785482 - DNA, 20 bp, mouse
gaactctcgggctcaggcga

SEQ ID NO: 785483 - DNA, 20 bp, mouse
ggatggaagggcctgggttt

SEQ ID NO: 785484 - DNA, 20 bp, mouse
gaagaacaaagcggctacca

SEQ ID NO: 785485 - DNA, 20 bp, mouse
gcagactatgcggcccacac

SEQ ID NO: 785486 - DNA, 20 bp, mouse
gggtgtcttcccaagtacag

SEQ ID NO: 785487 - DNA, 20 bp, mouse
gggccgttgtcccatagtca

SEQ ID NO: 785488 - DNA, 20 bp, mouse
gtggctggctaccttgacta

SEQ ID NO: 785489 - DNA, 20 bp, mouse
ggggagcccagatagagtcc

SEQ ID NO: 785490 - DNA, 20 bp, mouse
gagaaaacacggagctccgg

SEQ ID NO: 785491 - DNA, 20 bp, mouse
gcctgaaactacaacaatgg

SEQ ID NO: 785492 - DNA, 20 bp, mouse
gcccgcacctggctcttaaa

SEQ ID NO: 785493 - DNA, 20 bp, mouse
gatggaggatctacgcatga

SEQ ID NO: 785494 - DNA, 20 bp, mouse
gtatcctgaaactacaacaa

SEQ ID NO: 785495 - DNA, 20 bp, mouse
ggtcaccagtagtgccttcc

SEQ ID NO: 785496 - DNA, 20 bp, mouse
gcgagcgcgtaccctctcac

SEQ ID NO: 785497 - DNA, 20 bp, mouse
gggagagggcccagagtccg

SEQ ID NO: 785498 - DNA, 20 bp, mouse
gcgcaggcggagcccgtgag

SEQ ID NO: 785499 - DNA, 20 bp, mouse
gctgacgcacgccagtgcgc

SEQ ID NO: 785500 - DNA, 20 bp, mouse
gtaatcccctgcattggaga

SEQ ID NO: 785501 - DNA, 20 bp, mouse
gtgcactcaatgaaaagcca

SEQ ID NO: 785502 - DNA, 20 bp, mouse
gacgcacgccagtgcgcagg

SEQ ID NO: 785503 - DNA, 20 bp, mouse
gacgggctccgcctgcgcac

SEQ ID NO: 785504 - DNA, 20 bp, mouse
gccaccacgttcagcggaag

SEQ ID NO: 785505 - DNA, 20 bp, mouse
gcagcagtgttgctcgtgat

SEQ ID NO: 785506 - DNA, 20 bp, mouse
gaaggggtgtgggcgtgtgg

SEQ ID NO: 785507 - DNA, 20 bp, mouse
gcgtcccggaaaccactccg

SEQ ID NO: 785508 - DNA, 20 bp, mouse
gctgaaggggtgtgggcgtg

SEQ ID NO: 785509 - DNA, 20 bp, mouse
gttgccgacctggcctgaag

SEQ ID NO: 785510 - DNA, 20 bp, mouse
gcggtcatccaataggaagc

SEQ ID NO: 785511 - DNA, 20 bp, mouse
ggcagcacttggtaccggga

SEQ ID NO: 785512 - DNA, 20 bp, mouse
gtgagggcccgcgcacctat

SEQ ID NO: 785513 - DNA, 20 bp, mouse
gcatcgcccgcgcccaccaa

SEQ ID NO: 785514 - DNA, 20 bp, mouse
gaaagcacctataggtgcgc

SEQ ID NO: 785515 - DNA, 20 bp, mouse
gacggacctccgtgtccctc

SEQ ID NO: 785516 - DNA, 20 bp, mouse
gaagccctgcggcgagtcga

SEQ ID NO: 785517 - DNA, 20 bp, mouse
gcggcgagtcgacggaaagt

SEQ ID NO: 785518 - DNA, 20 bp, mouse
ggtgtggcgaggaaacactt

SEQ ID NO: 785519 - DNA, 20 bp, mouse
gctcaaggcactatattgtg

SEQ ID NO: 785520 - DNA, 20 bp, mouse
gccacactgtagtacctccg

SEQ ID NO: 785521 - DNA, 20 bp, mouse
gactcgccgcagggctttct

SEQ ID NO: 785522 - DNA, 20 bp, mouse
ggtgtggcgcgcaagtcttg

SEQ ID NO: 785523 - DNA, 20 bp, mouse
gtcggaggaggaagcatccc

SEQ ID NO: 785524 - DNA, 20 bp, mouse
gtgtgtcaaactttttgcaa

SEQ ID NO: 785525 - DNA, 20 bp, mouse
gacttctcttgcttgatcag

SEQ ID NO: 785526 - DNA, 20 bp, mouse
ggcggtgagtcgcaccttcc

SEQ ID NO: 785527 - DNA, 20 bp, mouse
gttgaccccagctagggcgg

SEQ ID NO: 785528 - DNA, 20 bp, mouse
gtcctcaggtgtcaccacgc

SEQ ID NO: 785529 - DNA, 20 bp, mouse
ggctgctcacggcaggggac

SEQ ID NO: 785530 - DNA, 20 bp, mouse
ggagggaagctgtcaaacgc

SEQ ID NO: 785531 - DNA, 20 bp, mouse
ggccatgttgaccccagcta

SEQ ID NO: 785532 - DNA, 20 bp, mouse
gggcgctgcgctcccgggtc

SEQ ID NO: 785533 - DNA, 20 bp, mouse
gaaactgctggcgagtcaag

SEQ ID NO: 785534 - DNA, 20 bp, mouse
gggcacggacgggacccgga

SEQ ID NO: 785535 - DNA, 20 bp, mouse
gtgaagttggagctccgcgg

SEQ ID NO: 785536 - DNA, 20 bp, mouse
gccgcccttccaatcggcct

SEQ ID NO: 785537 - DNA, 20 bp, mouse
gtggcggagcactgcaaccg

SEQ ID NO: 785538 - DNA, 20 bp, mouse
gcagcccaggccgattggaa

SEQ ID NO: 785539 - DNA, 20 bp, mouse
gagtcccagcccaggccgat

SEQ ID NO: 785540 - DNA, 20 bp, mouse
gagagaaagccgggagctcc

SEQ ID NO: 785541 - DNA, 20 bp, mouse
gggagccggcggcctgggac

SEQ ID NO: 785542 - DNA, 20 bp, mouse
ggccgattggaagggcgggt

SEQ ID NO: 785543 - DNA, 20 bp, mouse
gcccgccggctcctccccag

SEQ ID NO: 785544 - DNA, 20 bp, mouse
gcagcgggaagagcccgtgg

SEQ ID NO: 785545 - DNA, 20 bp, mouse
ggacgcacgtggcccgtccc

SEQ ID NO: 785546 - DNA, 20 bp, mouse
gcggttgtgggcaggaagcg

SEQ ID NO: 785547 - DNA, 20 bp, mouse
gcctaggtgggcccttggac

SEQ ID NO: 785548 - DNA, 20 bp, mouse
gcccgcacgcatccggttgt

SEQ ID NO: 785549 - DNA, 20 bp, mouse
gcgcggggagtgcggtccta

SEQ ID NO: 785550 - DNA, 20 bp, mouse
gccccggccgggatgacgag

SEQ ID NO: 785551 - DNA, 20 bp, mouse
ggcactgcacagaggagctt

SEQ ID NO: 785552 - DNA, 20 bp, mouse
ggatcctcggggcgcctagg

SEQ ID NO: 785553 - DNA, 20 bp, mouse
gggcccacctaggcgccccg

SEQ ID NO: 785554 - DNA, 20 bp, mouse
gagcctacaggaataaccat

SEQ ID NO: 785555 - DNA, 20 bp, mouse
gggcagctcgcccggtccaa

SEQ ID NO: 785556 - DNA, 20 bp, mouse
gcccccgtggtcttgattga

SEQ ID NO: 785557 - DNA, 20 bp, mouse
gctaaggatcccatcgtctc

SEQ ID NO: 785558 - DNA, 20 bp, mouse
ggacgcccagccagagacga

SEQ ID NO: 785559 - DNA, 20 bp, mouse
ggggctgtcccgccttcgtg

SEQ ID NO: 785560 - DNA, 20 bp, mouse
gccggtccgcgcgtgctcat

SEQ ID NO: 785561 - DNA, 20 bp, mouse
gtgagagcaccggatagcta

SEQ ID NO: 785562 - DNA, 20 bp, mouse
ggagcctgggagcgaaggca

SEQ ID NO: 785563 - DNA, 20 bp, mouse
gtggtcttgattgacgggtg

SEQ ID NO: 785564 - DNA, 20 bp, mouse
gtcaccttgccttcgctccc

SEQ ID NO: 785565 - DNA, 20 bp, mouse
gaggaacccagatcccgcga

SEQ ID NO: 785566 - DNA, 20 bp, mouse
gtagctacgcggagagaaga

SEQ ID NO: 785567 - DNA, 20 bp, mouse
gccgcagtctgcagtggtcg

SEQ ID NO: 785568 - DNA, 20 bp, mouse
gtgcccggtgcgggtccctc

SEQ ID NO: 785569 - DNA, 20 bp, mouse
gagtctgcagtggtcgcggt

SEQ ID NO: 785570 - DNA, 20 bp, mouse
gccactgcagactgcgggac

SEQ ID NO: 785571 - DNA, 20 bp, mouse
gacgcggagagaagaaggat

SEQ ID NO: 785572 - DNA, 20 bp, mouse
gctccagagggacccgcacc

SEQ ID NO: 785573 - DNA, 20 bp, mouse
gcgatggcgttccctctcca

SEQ ID NO: 785574 - DNA, 20 bp, mouse
gcgactctggacttcaacca

SEQ ID NO: 785575 - DNA, 20 bp, mouse
gatcccttggcctaattccc

SEQ ID NO: 785576 - DNA, 20 bp, mouse
ggggtcctggggaaacacta

SEQ ID NO: 785577 - DNA, 20 bp, mouse
ggggctgggcggctggcggt

SEQ ID NO: 785578 - DNA, 20 bp, mouse
ggtgaccacccgttcctgaa

SEQ ID NO: 785579 - DNA, 20 bp, mouse
gtcctggggaaacactacgg

SEQ ID NO: 785580 - DNA, 20 bp, mouse
ggaggaccgcgagaggtatg

SEQ ID NO: 785581 - DNA, 20 bp, mouse
ggcttccgagaaggccgcag

SEQ ID NO: 785582 - DNA, 20 bp, mouse
ggggctcccgtcatccactg

SEQ ID NO: 785583 - DNA, 20 bp, mouse
gaaacactacggcggcgttc

SEQ ID NO: 785584 - DNA, 20 bp, mouse
gggagcccgcgcgccccaag

SEQ ID NO: 785585 - DNA, 20 bp, mouse
gtcctcgcggttttcgttta

SEQ ID NO: 785586 - DNA, 20 bp, mouse
gaggctgcggcgcacggtat

SEQ ID NO: 785587 - DNA, 20 bp, mouse
gctgacgggtgcaggaagga

SEQ ID NO: 785588 - DNA, 20 bp, mouse
ggaagctgacgggtgcagga

SEQ ID NO: 785589 - DNA, 20 bp, mouse
gaccggcgagcccgctctgt

SEQ ID NO: 785590 - DNA, 20 bp, mouse
ggctctgtgggagtctccgg

SEQ ID NO: 785591 - DNA, 20 bp, mouse
gagcccgctgacagacatgg

SEQ ID NO: 785592 - DNA, 20 bp, mouse
gctgcacccgtcagcttcca

SEQ ID NO: 785593 - DNA, 20 bp, mouse
gagacaagcgggacggcctg

SEQ ID NO: 785594 - DNA, 20 bp, mouse
ggccgtcccgcttgtctctc

SEQ ID NO: 785595 - DNA, 20 bp, mouse
gggtcgccgtggaagctgac

SEQ ID NO: 785596 - DNA, 20 bp, mouse
gtcgtcccgttcagggtcta

SEQ ID NO: 785597 - DNA, 20 bp, mouse
gaccctgaacgggacgagct

SEQ ID NO: 785598 - DNA, 20 bp, mouse
gggatcccacagcctaaccc

SEQ ID NO: 785599 - DNA, 20 bp, mouse
ggcagccatagaccctgaac

SEQ ID NO: 785600 - DNA, 20 bp, mouse
ggaacgggacgagctgggat

SEQ ID NO: 785601 - DNA, 20 bp, mouse
ggactctgctagccaatcac

SEQ ID NO: 785602 - DNA, 20 bp, mouse
gaagtagatcgacctgggtt

SEQ ID NO: 785603 - DNA, 20 bp, mouse
ggtcttcaaagtaaaggcag

SEQ ID NO: 785604 - DNA, 20 bp, mouse
gagagtcaagcaggaactag

SEQ ID NO: 785605 - DNA, 20 bp, mouse
gatcgacctgggttaggctg

SEQ ID NO: 785606 - DNA, 20 bp, mouse
gcacgcgcggcggttgggga

SEQ ID NO: 785607 - DNA, 20 bp, mouse
gaggtgctggaactggggga

SEQ ID NO: 785608 - DNA, 20 bp, mouse
gggagggaagacagactgta

SEQ ID NO: 785609 - DNA, 20 bp, mouse
gcacgagcaggggtcggcgc

SEQ ID NO: 785610 - DNA, 20 bp, mouse
gacacacgtggcacgagcag

SEQ ID NO: 785611 - DNA, 20 bp, mouse
gacgtggcacgagcaggggt

SEQ ID NO: 785612 - DNA, 20 bp, mouse
gctcttgggggacatcgagg

SEQ ID NO: 785613 - DNA, 20 bp, mouse
gacgaccagccgccagctcc

SEQ ID NO: 785614 - DNA, 20 bp, mouse
ggggcagcggggactcgcac

SEQ ID NO: 785615 - DNA, 20 bp, mouse
gcagtctgaggtgctggaac

SEQ ID NO: 785616 - DNA, 20 bp, mouse
ggcaaggcgctcaagtacgg

SEQ ID NO: 785617 - DNA, 20 bp, mouse
gccggccaggaggagtcccg

SEQ ID NO: 785618 - DNA, 20 bp, mouse
gtcaggtaggccatccgcgt

SEQ ID NO: 785619 - DNA, 20 bp, mouse
gtgtggttgccccggggaat

SEQ ID NO: 785620 - DNA, 20 bp, mouse
gaccgcgcgcctctgatctc

SEQ ID NO: 785621 - DNA, 20 bp, mouse
gtccccgagaggcccccggc

SEQ ID NO: 785622 - DNA, 20 bp, mouse
ggcagcagcggggaggttgc

SEQ ID NO: 785623 - DNA, 20 bp, mouse
ggcggatggcctacctgaga

SEQ ID NO: 785624 - DNA, 20 bp, mouse
gggcgcgcggtgctgggaca

SEQ ID NO: 785625 - DNA, 20 bp, mouse
gggaatgggtgtcttaggcg

SEQ ID NO: 785626 - DNA, 20 bp, mouse
gcccgcctccgcaccgtgtg

SEQ ID NO: 785627 - DNA, 20 bp, mouse
gcgtcctgagcagaccccgg

SEQ ID NO: 785628 - DNA, 20 bp, mouse
gcaggacgccgcacacggtg

SEQ ID NO: 785629 - DNA, 20 bp, mouse
gtggcccccggggtctgctc

SEQ ID NO: 785630 - DNA, 20 bp, mouse
gcaatctgccagcgggaagt

SEQ ID NO: 785631 - DNA, 20 bp, mouse
gggcggggcggcgggaacac

SEQ ID NO: 785632 - DNA, 20 bp, mouse
gcacggcgcgcgaggctcac

SEQ ID NO: 785633 - DNA, 20 bp, mouse
ggacgccgcacacggtgcgg

SEQ ID NO: 785634 - DNA, 20 bp, mouse
gtcgcgggagccagagggcg

SEQ ID NO: 785635 - DNA, 20 bp, mouse
gcagcaatcccacttcccgc

SEQ ID NO: 785636 - DNA, 20 bp, mouse
gggggtgggatcagtacata

SEQ ID NO: 785637 - DNA, 20 bp, mouse
gtcagtacatagggatgtga

SEQ ID NO: 785638 - DNA, 20 bp, mouse
gatggcccccgataatctga

SEQ ID NO: 785639 - DNA, 20 bp, mouse
gctgaaggaagatgctgtaa

SEQ ID NO: 785640 - DNA, 20 bp, mouse
gttatcgggggccatgttga

SEQ ID NO: 785641 - DNA, 20 bp, mouse
gtcgtagttaagttacaata

SEQ ID NO: 785642 - DNA, 20 bp, mouse
gtcttccttcagattatcgg

SEQ ID NO: 785643 - DNA, 20 bp, mouse
gtcgggggccatgttgaggg

SEQ ID NO: 785644 - DNA, 20 bp, mouse
ggacatctcagacaaaaatg

SEQ ID NO: 785645 - DNA, 20 bp, mouse
ggagaatgttccagcttaag

SEQ ID NO: 785646 - DNA, 20 bp, mouse
gcgacggaacagcccctggg

SEQ ID NO: 785647 - DNA, 20 bp, mouse
gctaacgaaagcaaacgcga

SEQ ID NO: 785648 - DNA, 20 bp, mouse
gccaggaagcatggcttatg

SEQ ID NO: 785649 - DNA, 20 bp, mouse
gtgcccttaagcaagatggc

SEQ ID NO: 785650 - DNA, 20 bp, mouse
gtttccgtctcaatcaaagt

SEQ ID NO: 785651 - DNA, 20 bp, mouse
ggcgtacagcagcccgccca

SEQ ID NO: 785652 - DNA, 20 bp, mouse
gtgcggggattgctcggcta

SEQ ID NO: 785653 - DNA, 20 bp, mouse
gacgcgacggaacagcccct

SEQ ID NO: 785654 - DNA, 20 bp, mouse
gctcggctatggcagatggg

SEQ ID NO: 785655 - DNA, 20 bp, mouse
gaaccagccatcttgcttaa

SEQ ID NO: 785656 - DNA, 20 bp, mouse
gcagaggagggtgagagctg

SEQ ID NO: 785657 - DNA, 20 bp, mouse
ggcaaagaccggaagtgagg

SEQ ID NO: 785658 - DNA, 20 bp, mouse
ggctgcaaagaccggaagtg

SEQ ID NO: 785659 - DNA, 20 bp, mouse
ggaaacagggctgcaaagac

SEQ ID NO: 785660 - DNA, 20 bp, mouse
gccccaggaggggggagccg

SEQ ID NO: 785661 - DNA, 20 bp, mouse
gccgggcaatgggcaagttc

SEQ ID NO: 785662 - DNA, 20 bp, mouse
gccactcggggcggaagagc

SEQ ID NO: 785663 - DNA, 20 bp, mouse
ggggcggaagagcaggacgc

SEQ ID NO: 785664 - DNA, 20 bp, mouse
gttgcaacgccccggaaaca

SEQ ID NO: 785665 - DNA, 20 bp, mouse
gcacccccggctccgctcgc

SEQ ID NO: 785666 - DNA, 20 bp, mouse
gcggcagcgcagtaggaacg

SEQ ID NO: 785667 - DNA, 20 bp, mouse
gtggtgctgcctcccctcga

SEQ ID NO: 785668 - DNA, 20 bp, mouse
gggcttgcgcggtgagtggg

SEQ ID NO: 785669 - DNA, 20 bp, mouse
ggcctggaggcgggcgtcgg

SEQ ID NO: 785670 - DNA, 20 bp, mouse
gcaccaccgcagctgacgtt

SEQ ID NO: 785671 - DNA, 20 bp, mouse
gagtgggcggggctgcctgg

SEQ ID NO: 785672 - DNA, 20 bp, mouse
gagccccgcccctcgagggg

SEQ ID NO: 785673 - DNA, 20 bp, mouse
gggcggggctgcctggaggc

SEQ ID NO: 785674 - DNA, 20 bp, mouse
gcggggcttgcgcggtgagt

SEQ ID NO: 785675 - DNA, 20 bp, mouse
ggggattggccctagagggt

SEQ ID NO: 785676 - DNA, 20 bp, mouse
gggcccgctgggcttggggc

SEQ ID NO: 785677 - DNA, 20 bp, mouse
gagcccagcgggccctgcga

SEQ ID NO: 785678 - DNA, 20 bp, mouse
ggaacagagctggggttcga

SEQ ID NO: 785679 - DNA, 20 bp, mouse
gtaccctcgcagggcccgct

SEQ ID NO: 785680 - DNA, 20 bp, mouse
gcggggctggagaggcgtag

SEQ ID NO: 785681 - DNA, 20 bp, mouse
gctgctggtgctaccctcgc

SEQ ID NO: 785682 - DNA, 20 bp, mouse
gggtgagtggctactgtctt

SEQ ID NO: 785683 - DNA, 20 bp, mouse
gtgtgcggactgtcagtagg

SEQ ID NO: 785684 - DNA, 20 bp, mouse
ggccccgccccaagcccagc

SEQ ID NO: 785685 - DNA, 20 bp, mouse
ggcagggcccgctgggcttg

SEQ ID NO: 785686 - DNA, 20 bp, mouse
gaggaagagacgaggtgccc

SEQ ID NO: 785687 - DNA, 20 bp, mouse
ggagacgaggtgccccgggt

SEQ ID NO: 785688 - DNA, 20 bp, mouse
gaagagtgagagaaatagta

SEQ ID NO: 785689 - DNA, 20 bp, mouse
ggggaggtctcaccaatgta

SEQ ID NO: 785690 - DNA, 20 bp, mouse
gggctgcgtagccacagtat

SEQ ID NO: 785691 - DNA, 20 bp, mouse
gtgtgtgtgtgttgtaactg

SEQ ID NO: 785692 - DNA, 20 bp, mouse
gtatgccttgggtatatttt

SEQ ID NO: 785693 - DNA, 20 bp, mouse
gaggaagtgttgcagttacc

SEQ ID NO: 785694 - DNA, 20 bp, mouse
gggcttattcgaattctcaa

SEQ ID NO: 785695 - DNA, 20 bp, mouse
ggctctgtgtgtgcttcagc

SEQ ID NO: 785696 - DNA, 20 bp, mouse
gaactcagccaagccgagag

SEQ ID NO: 785697 - DNA, 20 bp, mouse
gaaaacctctctgccactct

SEQ ID NO: 785698 - DNA, 20 bp, mouse
gcaagccgagagtggcagag

SEQ ID NO: 785699 - DNA, 20 bp, mouse
gactaaccctgagccaagag

SEQ ID NO: 785700 - DNA, 20 bp, mouse
gcctgggcatgcagttgtgc

SEQ ID NO: 785701 - DNA, 20 bp, mouse
gaggaggcttaggacccagg

SEQ ID NO: 785702 - DNA, 20 bp, mouse
gtgatctggtaaggtctagg

SEQ ID NO: 785703 - DNA, 20 bp, mouse
gtggctcagggttagtgatc

SEQ ID NO: 785704 - DNA, 20 bp, mouse
gacagagtcactgtgtcaga

SEQ ID NO: 785705 - DNA, 20 bp, mouse
ggtcagaaggcatcgtggag

SEQ ID NO: 785706 - DNA, 20 bp, mouse
gcctctgccagtctccggga

SEQ ID NO: 785707 - DNA, 20 bp, mouse
ggatgccccgggcgactgga

SEQ ID NO: 785708 - DNA, 20 bp, mouse
ggagggcagcgaggggtgcg

SEQ ID NO: 785709 - DNA, 20 bp, mouse
ggaggcggagggcgcggctc

SEQ ID NO: 785710 - DNA, 20 bp, mouse
ggggagggctaccaaggtct

SEQ ID NO: 785711 - DNA, 20 bp, mouse
gcgcctgcggggcgtcgccc

SEQ ID NO: 785712 - DNA, 20 bp, mouse
gctccgcctctgccagtctc

SEQ ID NO: 785713 - DNA, 20 bp, mouse
gcgggggcgagggcagcgag

SEQ ID NO: 785714 - DNA, 20 bp, mouse
gtagagcgctccgtagcgga

SEQ ID NO: 785715 - DNA, 20 bp, mouse
gccggggcatccccgagccg

SEQ ID NO: 785716 - DNA, 20 bp, mouse
gcacactcggcagcttccgg

SEQ ID NO: 785717 - DNA, 20 bp, mouse
gaggcggagcccgaagaccg

SEQ ID NO: 785718 - DNA, 20 bp, mouse
gctgccgagtgtgctcccgc

SEQ ID NO: 785719 - DNA, 20 bp, mouse
ggagtgtgctcccgcgggaa

SEQ ID NO: 785720 - DNA, 20 bp, mouse
ggtgctcccgcgggaatggg

SEQ ID NO: 785721 - DNA, 20 bp, mouse
gcccgaagaccgaggcacgc

SEQ ID NO: 785722 - DNA, 20 bp, mouse
gcccagcctcccattcccgc

SEQ ID NO: 785723 - DNA, 20 bp, mouse
gaaaacactagaaagcggaa

SEQ ID NO: 785724 - DNA, 20 bp, mouse
gagccgagcacggccgtcgg

SEQ ID NO: 785725 - DNA, 20 bp, mouse
ggcctccgagtcaactccca

SEQ ID NO: 785726 - DNA, 20 bp, mouse
gccaaccaaccgggcaggac

SEQ ID NO: 785727 - DNA, 20 bp, mouse
gtgcgcccggctccgactcc

SEQ ID NO: 785728 - DNA, 20 bp, mouse
gaggcgccaaccaaccgggc

SEQ ID NO: 785729 - DNA, 20 bp, mouse
gaccaaccgggcaggacagg

SEQ ID NO: 785730 - DNA, 20 bp, mouse
gggagagttaaaagtcgaag

SEQ ID NO: 785731 - DNA, 20 bp, mouse
gcagttaaggtgcaaaggag

SEQ ID NO: 785732 - DNA, 20 bp, mouse
gaagtcgaagcggagggtgg

SEQ ID NO: 785733 - DNA, 20 bp, mouse
gtcgagtctcgcaggctgac

SEQ ID NO: 785734 - DNA, 20 bp, mouse
gttaaagtgtcgagtctcgc

SEQ ID NO: 785735 - DNA, 20 bp, mouse
gtaaaagtcgaagcggaggg

SEQ ID NO: 785736 - DNA, 20 bp, mouse
gtggcctcgctgcctcaagc

SEQ ID NO: 785737 - DNA, 20 bp, mouse
gtgagatcggaagtgacgga

SEQ ID NO: 785738 - DNA, 20 bp, mouse
gctaggttttctaagtacgt

SEQ ID NO: 785739 - DNA, 20 bp, mouse
ggaaaagcacctcctgcttg

SEQ ID NO: 785740 - DNA, 20 bp, mouse
ggcttgaggaagcgttcagt

SEQ ID NO: 785741 - DNA, 20 bp, mouse
gtcaacccggaggctttccc

SEQ ID NO: 785742 - DNA, 20 bp, mouse
gtcactaactctgtgaccaa

SEQ ID NO: 785743 - DNA, 20 bp, mouse
gaagttgaaatccaacttag

SEQ ID NO: 785744 - DNA, 20 bp, mouse
ggccggttgctaggaaacaa

SEQ ID NO: 785745 - DNA, 20 bp, mouse
gcctagctcccccactaagt

SEQ ID NO: 785746 - DNA, 20 bp, mouse
ggctaggaccccatccgctt

SEQ ID NO: 785747 - DNA, 20 bp, mouse
gaggggtgcaggccttttaa

SEQ ID NO: 785748 - DNA, 20 bp, mouse
gtacacaagccgaagcggat

SEQ ID NO: 785749 - DNA, 20 bp, mouse
gtgggggcggggtatgacca

SEQ ID NO: 785750 - DNA, 20 bp, mouse
gcggatggggtcctagcgca

SEQ ID NO: 785751 - DNA, 20 bp, mouse
gactctagggctggatgtac

SEQ ID NO: 785752 - DNA, 20 bp, mouse
gacatccagccctagagttt

SEQ ID NO: 785753 - DNA, 20 bp, mouse
gcgagaaggaagcagctcat

SEQ ID NO: 785754 - DNA, 20 bp, mouse
ggacacaatcgagccaccag

SEQ ID NO: 785755 - DNA, 20 bp, mouse
gggaacctcaccttactttt

SEQ ID NO: 785756 - DNA, 20 bp, mouse
ggtaggatgggacataagtg

SEQ ID NO: 785757 - DNA, 20 bp, mouse
ggggatgaacatttccacaa

SEQ ID NO: 785758 - DNA, 20 bp, mouse
gctaatgcaagtgacctgtc

SEQ ID NO: 785759 - DNA, 20 bp, mouse
gggtccctcatgcccaccgt

SEQ ID NO: 785760 - DNA, 20 bp, mouse
gggcccacaaagcccctccc

SEQ ID NO: 785761 - DNA, 20 bp, mouse
gtggacatatccatcccttg

SEQ ID NO: 785762 - DNA, 20 bp, mouse
gccagaataaggaaccccca

SEQ ID NO: 785763 - DNA, 20 bp, mouse
ggggacataagtggggtacc

SEQ ID NO: 785764 - DNA, 20 bp, mouse
gtgcaagtgacctgtctgga

SEQ ID NO: 785765 - DNA, 20 bp, mouse
gggacaggactagctgtgtg

SEQ ID NO: 785766 - DNA, 20 bp, mouse
gggtctagaacgatactctc

SEQ ID NO: 785767 - DNA, 20 bp, mouse
gtctgatcggaaggtctaga

SEQ ID NO: 785768 - DNA, 20 bp, mouse
gctgaaggaagcggggagga

SEQ ID NO: 785769 - DNA, 20 bp, mouse
ggcagcgttaagtcctctgg

SEQ ID NO: 785770 - DNA, 20 bp, mouse
gctccccgcttccttcagga

SEQ ID NO: 785771 - DNA, 20 bp, mouse
gcggagccggcccttggagc

SEQ ID NO: 785772 - DNA, 20 bp, mouse
gaccttccgatcagatgttc

SEQ ID NO: 785773 - DNA, 20 bp, mouse
ggatcggaaggtctagaggg

SEQ ID NO: 785774 - DNA, 20 bp, mouse
gagaacgatactctctgggt

SEQ ID NO: 785775 - DNA, 20 bp, mouse
ggctgcctcagccatcctga

SEQ ID NO: 785776 - DNA, 20 bp, mouse
gctccctgaaagacaagaaa

SEQ ID NO: 785777 - DNA, 20 bp, mouse
gagaaagggcaagttgtgat

SEQ ID NO: 785778 - DNA, 20 bp, mouse
gagttgtgatgggaacagag

SEQ ID NO: 785779 - DNA, 20 bp, mouse
gcagtgcccaggcagaatca

SEQ ID NO: 785780 - DNA, 20 bp, mouse
gcaaagccttgattctgcct

SEQ ID NO: 785781 - DNA, 20 bp, mouse
gttctgcctgggcactgtga

SEQ ID NO: 785782 - DNA, 20 bp, mouse
ggggagccttcacagtgccc

SEQ ID NO: 785783 - DNA, 20 bp, mouse
gattatgtctctcatcatgc

SEQ ID NO: 785784 - DNA, 20 bp, mouse
gttgccctttcttgtctttc

SEQ ID NO: 785785 - DNA, 20 bp, mouse
gtgtgatgggaacagagagg

SEQ ID NO: 785786 - DNA, 20 bp, mouse
ggggagccttcccagtgcac

SEQ ID NO: 785787 - DNA, 20 bp, mouse
gcagtgcacaggcagaatca

SEQ ID NO: 785788 - DNA, 20 bp, mouse
ggaaagagcaagttgcgatg

SEQ ID NO: 785789 - DNA, 20 bp, mouse
gactgggaaggctccctgaa

SEQ ID NO: 785790 - DNA, 20 bp, mouse
gttctgcctgtgcactggga

SEQ ID NO: 785791 - DNA, 20 bp, mouse
gtgctctttcttgcctttca

SEQ ID NO: 785792 - DNA, 20 bp, mouse
ggagacaaggccttgtcctc

SEQ ID NO: 785793 - DNA, 20 bp, mouse
gacaaggccttgtcctcagg

SEQ ID NO: 785794 - DNA, 20 bp, mouse
gaaggaagagcagggtaggg

SEQ ID NO: 785795 - DNA, 20 bp, mouse
gttgcgatgtggacagagag

SEQ ID NO: 785796 - DNA, 20 bp, mouse
gcttgattctgcctgggcac

SEQ ID NO: 785797 - DNA, 20 bp, mouse
gagaaagagcaagttgcgat

SEQ ID NO: 785798 - DNA, 20 bp, mouse
gttctgcctgggcactggga

SEQ ID NO: 785799 - DNA, 20 bp, mouse
gactgggaaggctccctgaa

SEQ ID NO: 785800 - DNA, 20 bp, mouse
ggggagccttcccagtgccc

SEQ ID NO: 785801 - DNA, 20 bp, mouse
gcaaagccttgattctgcct

SEQ ID NO: 785802 - DNA, 20 bp, mouse
gtgctctttcttgcctttca

SEQ ID NO: 785803 - DNA, 20 bp, mouse
gatgagaaagagattaagta

SEQ ID NO: 785804 - DNA, 20 bp, mouse
gcaaggaggtggagatggaa

SEQ ID NO: 785805 - DNA, 20 bp, mouse
gcaatgaggaaggtgtaatc

SEQ ID NO: 785806 - DNA, 20 bp, mouse
ggagaggggtgtagccgcga

SEQ ID NO: 785807 - DNA, 20 bp, mouse
ggggctggctcggcggcgga

SEQ ID NO: 785808 - DNA, 20 bp, mouse
gcggggaggcggcgggacca

SEQ ID NO: 785809 - DNA, 20 bp, mouse
ggccccgccgccaggagtaa

SEQ ID NO: 785810 - DNA, 20 bp, mouse
gagccgggctggctcggcgg

SEQ ID NO: 785811 - DNA, 20 bp, mouse
ggtggggagccgggctggct

SEQ ID NO: 785812 - DNA, 20 bp, mouse
gccgaggtggggagccgggc

SEQ ID NO: 785813 - DNA, 20 bp, mouse
gccacctcggcctcccggag

SEQ ID NO: 785814 - DNA, 20 bp, mouse
gtggctgaagccgcgcccga

SEQ ID NO: 785815 - DNA, 20 bp, mouse
gggggcggggcctctccggg

SEQ ID NO: 785816 - DNA, 20 bp, mouse
gaggttcttccgcggaggaa

SEQ ID NO: 785817 - DNA, 20 bp, mouse
gcatacaggcccttcctccg

SEQ ID NO: 785818 - DNA, 20 bp, mouse
gcctgtatgcaaatgtagga

SEQ ID NO: 785819 - DNA, 20 bp, mouse
gggggcacttgaaacgttga

SEQ ID NO: 785820 - DNA, 20 bp, mouse
gtgccccggctcagtagcgt

SEQ ID NO: 785821 - DNA, 20 bp, mouse
ggcacttgaaacgttgaggg

SEQ ID NO: 785822 - DNA, 20 bp, mouse
gcgcgcagggcgactctccc

SEQ ID NO: 785823 - DNA, 20 bp, mouse
gtcccgggaggcgcgtgccc

SEQ ID NO: 785824 - DNA, 20 bp, mouse
gaggactggctcggattggc

SEQ ID NO: 785825 - DNA, 20 bp, mouse
ggcagggcgactctcccggg

SEQ ID NO: 785826 - DNA, 20 bp, mouse
gcacctccgcgactctacta

SEQ ID NO: 785827 - DNA, 20 bp, mouse
ggctccctgtcgtttcacca

SEQ ID NO: 785828 - DNA, 20 bp, mouse
gcgcgctgccggagacataa

SEQ ID NO: 785829 - DNA, 20 bp, mouse
gagcccttggtgaaacgaca

SEQ ID NO: 785830 - DNA, 20 bp, mouse
gggcggcccccttatgtctc

SEQ ID NO: 785831 - DNA, 20 bp, mouse
gctactacggcaagctagtc

SEQ ID NO: 785832 - DNA, 20 bp, mouse
gcggacttccgcttctcaga

SEQ ID NO: 785833 - DNA, 20 bp, mouse
gacggcaagctagtccggac

SEQ ID NO: 785834 - DNA, 20 bp, mouse
gtgccgtagtagagtcgcgg

SEQ ID NO: 785835 - DNA, 20 bp, mouse
gacaccgcaaagcgagcctc

SEQ ID NO: 785836 - DNA, 20 bp, mouse
gtgtaggggcggtccgaccg

SEQ ID NO: 785837 - DNA, 20 bp, mouse
gaaggtgggaggctgtgtgt

SEQ ID NO: 785838 - DNA, 20 bp, mouse
gagccaatcggcagtggtgt

SEQ ID NO: 785839 - DNA, 20 bp, mouse
gcagacgagccaatcggcag

SEQ ID NO: 785840 - DNA, 20 bp, mouse
gaggggcggtccgaccgcgg

SEQ ID NO: 785841 - DNA, 20 bp, mouse
gtcccaacaccactgccgat

SEQ ID NO: 785842 - DNA, 20 bp, mouse
gagggagccactttcccggt

SEQ ID NO: 785843 - DNA, 20 bp, mouse
gggtgctccaaccgggaaag

SEQ ID NO: 785844 - DNA, 20 bp, mouse
ggagcagcgccgctggtgat

SEQ ID NO: 785845 - DNA, 20 bp, mouse
ggctccctctaagcgtcaaa

SEQ ID NO: 785846 - DNA, 20 bp, mouse
gctagtaagtaaacgaaagc

SEQ ID NO: 785847 - DNA, 20 bp, mouse
ggtcaacctgggacaaatca

SEQ ID NO: 785848 - DNA, 20 bp, mouse
gtacttactagcaccatctg

SEQ ID NO: 785849 - DNA, 20 bp, mouse
gggacgagcactccatccaa

SEQ ID NO: 785850 - DNA, 20 bp, mouse
gtcctgcagactaaggagct

SEQ ID NO: 785851 - DNA, 20 bp, mouse
gtgcaaatccaaattctacc

SEQ ID NO: 785852 - DNA, 20 bp, mouse
ggtctgcaggaggttgcctt

SEQ ID NO: 785853 - DNA, 20 bp, mouse
gggcaacctcctgcagacta

SEQ ID NO: 785854 - DNA, 20 bp, mouse
gatcacagcccggtagaatt

SEQ ID NO: 785855 - DNA, 20 bp, mouse
gacctagctccttagtctgc

SEQ ID NO: 785856 - DNA, 20 bp, mouse
gaagccgaagccttacgggg

SEQ ID NO: 785857 - DNA, 20 bp, mouse
gtacggggaggcgggaacaa

SEQ ID NO: 785858 - DNA, 20 bp, mouse
gtgcgcatgcacaaaaaagt

SEQ ID NO: 785859 - DNA, 20 bp, mouse
ggagaagccgaagccttacg

SEQ ID NO: 785860 - DNA, 20 bp, mouse
gcatgcacaaaaaagtgggc

SEQ ID NO: 785861 - DNA, 20 bp, mouse
gtggaacagacccagtcctt

SEQ ID NO: 785862 - DNA, 20 bp, mouse
gccgcctccccgtaaggctt

SEQ ID NO: 785863 - DNA, 20 bp, mouse
gcaaagaacaagtgcaaatg

SEQ ID NO: 785864 - DNA, 20 bp, mouse
ggctgcgctttctcgtctct

SEQ ID NO: 785865 - DNA, 20 bp, mouse
gtgcggaggacatacctgtg

SEQ ID NO: 785866 - DNA, 20 bp, mouse
ggggttgtgaacaacttcac

SEQ ID NO: 785867 - DNA, 20 bp, mouse
gtgcaaaccagctgcaccaa

SEQ ID NO: 785868 - DNA, 20 bp, mouse
gactagctaacaggtgtaaa

SEQ ID NO: 785869 - DNA, 20 bp, mouse
gtgaacaacttcactggtcc

SEQ ID NO: 785870 - DNA, 20 bp, mouse
gactttgaacccaggtcgag

SEQ ID NO: 785871 - DNA, 20 bp, mouse
ggcgcccccgcgtgctgcgc

SEQ ID NO: 785872 - DNA, 20 bp, mouse
gtcaacgtctcatcttaacc

SEQ ID NO: 785873 - DNA, 20 bp, mouse
gaggtgtaaagggcctggat

SEQ ID NO: 785874 - DNA, 20 bp, mouse
gctgcgcaggagaactgccg

SEQ ID NO: 785875 - DNA, 20 bp, mouse
gacactgccctggctatcga

SEQ ID NO: 785876 - DNA, 20 bp, mouse
gtgggcccaggtgcagaaaa

SEQ ID NO: 785877 - DNA, 20 bp, mouse
gaggctgtggaagactccca

SEQ ID NO: 785878 - DNA, 20 bp, mouse
ggggtcatctgattccctga

SEQ ID NO: 785879 - DNA, 20 bp, mouse
gggtccaggtggaagaaatt

SEQ ID NO: 785880 - DNA, 20 bp, mouse
gcttccccagcttcttataa

SEQ ID NO: 785881 - DNA, 20 bp, mouse
ggtggaagaaatttgggccc

SEQ ID NO: 785882 - DNA, 20 bp, mouse
gctcaccccagggtgaaggt

SEQ ID NO: 785883 - DNA, 20 bp, mouse
gccaaggaggcgcccagcgt

SEQ ID NO: 785884 - DNA, 20 bp, mouse
gcttgtggatgctggttccg

SEQ ID NO: 785885 - DNA, 20 bp, mouse
gctgggcgcctccttgggaa

SEQ ID NO: 785886 - DNA, 20 bp, mouse
gagaaccccggacaactcta

SEQ ID NO: 785887 - DNA, 20 bp, mouse
gaggggcggacccgccttgg

SEQ ID NO: 785888 - DNA, 20 bp, mouse
ggaggcacagattctttcta

SEQ ID NO: 785889 - DNA, 20 bp, mouse
ggacccgccttgggggactg

SEQ ID NO: 785890 - DNA, 20 bp, mouse
gcggaggggcggacccgcct

SEQ ID NO: 785891 - DNA, 20 bp, mouse
gcggccgaagaggaaggtat

SEQ ID NO: 785892 - DNA, 20 bp, mouse
ggcaaccttagagttgtccg

SEQ ID NO: 785893 - DNA, 20 bp, mouse
gtctctcagcatcccacaat

SEQ ID NO: 785894 - DNA, 20 bp, mouse
gccaactgcatgaagcggag

SEQ ID NO: 785895 - DNA, 20 bp, mouse
gaagaggaaggtattggcac

SEQ ID NO: 785896 - DNA, 20 bp, mouse
ggtaaggaaagatcatgatg

SEQ ID NO: 785897 - DNA, 20 bp, mouse
gagtggcttctgggtaacaa

SEQ ID NO: 785898 - DNA, 20 bp, mouse
gtgtcaaaggccttctataa

SEQ ID NO: 785899 - DNA, 20 bp, mouse
gttctataaaggttctttct

SEQ ID NO: 785900 - DNA, 20 bp, mouse
gcaaataataatttaaagta

SEQ ID NO: 785901 - DNA, 20 bp, mouse
gtcatgatctttccttactg

SEQ ID NO: 785902 - DNA, 20 bp, mouse
gcctattttcttagtgtcaa

SEQ ID NO: 785903 - DNA, 20 bp, mouse
gactgtaatacctgataaca

SEQ ID NO: 785904 - DNA, 20 bp, mouse
gataatttaaagtaaggagc

SEQ ID NO: 785905 - DNA, 20 bp, mouse
gagtagactttctgattgat

SEQ ID NO: 785906 - DNA, 20 bp, mouse
gggcggggcgggtgcggatg

SEQ ID NO: 785907 - DNA, 20 bp, mouse
gagagtgctcgtcttagcac

SEQ ID NO: 785908 - DNA, 20 bp, mouse
gggccgcgatccgtctgggg

SEQ ID NO: 785909 - DNA, 20 bp, mouse
ggggcagcggcgccgacggg

SEQ ID NO: 785910 - DNA, 20 bp, mouse
ggggaggctgctgcggagtg

SEQ ID NO: 785911 - DNA, 20 bp, mouse
gagcctccccagacggatcg

SEQ ID NO: 785912 - DNA, 20 bp, mouse
ggctaagacgagcactctcc

SEQ ID NO: 785913 - DNA, 20 bp, mouse
gtggcggccgcgatccgtct

SEQ ID NO: 785914 - DNA, 20 bp, mouse
gagccaagggagctccgagg

SEQ ID NO: 785915 - DNA, 20 bp, mouse
gagggagcccccagatgcat

SEQ ID NO: 785916 - DNA, 20 bp, mouse
ggggagagccgggatccagt

SEQ ID NO: 785917 - DNA, 20 bp, mouse
gggtaccattccgacgggga

SEQ ID NO: 785918 - DNA, 20 bp, mouse
gagagccgggatccagtggg

SEQ ID NO: 785919 - DNA, 20 bp, mouse
gggcggggtgaggatcaggc

SEQ ID NO: 785920 - DNA, 20 bp, mouse
ggggcggtaccattccgacg

SEQ ID NO: 785921 - DNA, 20 bp, mouse
gccggctctcccctccccgt

SEQ ID NO: 785922 - DNA, 20 bp, mouse
gcctcctctcccggcctgaa

SEQ ID NO: 785923 - DNA, 20 bp, mouse
ggggtggggaggtaacggga

SEQ ID NO: 785924 - DNA, 20 bp, mouse
gggggtggggatcggttcgg

SEQ ID NO: 785925 - DNA, 20 bp, mouse
gggcaccgcccactggatcc

SEQ ID NO: 785926 - DNA, 20 bp, mouse
ggtgaccgcccggcagccga

SEQ ID NO: 785927 - DNA, 20 bp, mouse
gactcacaaggatgcggggt

SEQ ID NO: 785928 - DNA, 20 bp, mouse
gtataccgagaatgaggcag

SEQ ID NO: 785929 - DNA, 20 bp, mouse
ggggttggcgctgtgcaggg

SEQ ID NO: 785930 - DNA, 20 bp, mouse
ggccgggcggtcacctggct

SEQ ID NO: 785931 - DNA, 20 bp, mouse
gctggactaagcaaggagac

SEQ ID NO: 785932 - DNA, 20 bp, mouse
ggcggcgcttctgtcgcttc

SEQ ID NO: 785933 - DNA, 20 bp, mouse
gctcaggcgcgcgagcgggg

SEQ ID NO: 785934 - DNA, 20 bp, mouse
gttgcagactccatgaagtt

SEQ ID NO: 785935 - DNA, 20 bp, mouse
gggggtggagccatccccgc

SEQ ID NO: 785936 - DNA, 20 bp, mouse
ggtagaccgtgagtctacgg

SEQ ID NO: 785937 - DNA, 20 bp, mouse
gtagactcacggtctacggt

SEQ ID NO: 785938 - DNA, 20 bp, mouse
gtggctcagtaggccaatat

SEQ ID NO: 785939 - DNA, 20 bp, mouse
gactcacggtctacggtcgg

SEQ ID NO: 785940 - DNA, 20 bp, mouse
gaaaagagaagccaatcaga

SEQ ID NO: 785941 - DNA, 20 bp, mouse
gcggtggattccttggggtg

SEQ ID NO: 785942 - DNA, 20 bp, mouse
gcagatgatgccacacccca

SEQ ID NO: 785943 - DNA, 20 bp, mouse
gacggtcggtggattccttg

SEQ ID NO: 785944 - DNA, 20 bp, mouse
gtaggttcgtatctttgatc

SEQ ID NO: 785945 - DNA, 20 bp, mouse
ggacagtcctggaaagaatt

SEQ ID NO: 785946 - DNA, 20 bp, mouse
gagagcgttaggtccgactg

SEQ ID NO: 785947 - DNA, 20 bp, mouse
gtggcgcggcgaggcgagat

SEQ ID NO: 785948 - DNA, 20 bp, mouse
gctgctgctgcaaaccggtc

SEQ ID NO: 785949 - DNA, 20 bp, mouse
ggtgccgctgccagtgtccc

SEQ ID NO: 785950 - DNA, 20 bp, mouse
gactccggcgcgccgtgcgg

SEQ ID NO: 785951 - DNA, 20 bp, mouse
gctgtcccgcacgccctgca

SEQ ID NO: 785952 - DNA, 20 bp, mouse
gctgccgaccagaggagcgg

SEQ ID NO: 785953 - DNA, 20 bp, mouse
ggcggggcaccgccactcct

SEQ ID NO: 785954 - DNA, 20 bp, mouse
gcgcggcgaggcgagatcgg

SEQ ID NO: 785955 - DNA, 20 bp, mouse
gaacgcggggacacgcacac

SEQ ID NO: 785956 - DNA, 20 bp, mouse
gtctgcaggggaccgagatg

SEQ ID NO: 785957 - DNA, 20 bp, mouse
gcggtcccctgcagacgctc

SEQ ID NO: 785958 - DNA, 20 bp, mouse
ggccctccggcgtccggtgc

SEQ ID NO: 785959 - DNA, 20 bp, mouse
ggcctccaagcgtccataga

SEQ ID NO: 785960 - DNA, 20 bp, mouse
gacagccaatcggatatcaa

SEQ ID NO: 785961 - DNA, 20 bp, mouse
ggaagaaacgtgttcacgtg

SEQ ID NO: 785962 - DNA, 20 bp, mouse
gtccacccctgctacctaat

SEQ ID NO: 785963 - DNA, 20 bp, mouse
gttcacgtgcggtatggggg

SEQ ID NO: 785964 - DNA, 20 bp, mouse
gtatggacgcttggaggcgc

SEQ ID NO: 785965 - DNA, 20 bp, mouse
gttagggcggcacacactca

SEQ ID NO: 785966 - DNA, 20 bp, mouse
gccttgtcacggttgcacga

SEQ ID NO: 785967 - DNA, 20 bp, mouse
gggaccgagcctcctggcga

SEQ ID NO: 785968 - DNA, 20 bp, mouse
ggcatccgtggaggtggaac

SEQ ID NO: 785969 - DNA, 20 bp, mouse
gcctcggaggggggacccaa

SEQ ID NO: 785970 - DNA, 20 bp, mouse
gcctcggaggggggacccgc

SEQ ID NO: 785971 - DNA, 20 bp, mouse
ggtcccccctccgaggatgt

SEQ ID NO: 785972 - DNA, 20 bp, mouse
ggcagaggatcctacatcct

SEQ ID NO: 785973 - DNA, 20 bp, mouse
gtggtggaaaggccttgtca

SEQ ID NO: 785974 - DNA, 20 bp, mouse
ggagtatgctgcatccgtgg

SEQ ID NO: 785975 - DNA, 20 bp, mouse
gacctcgcccagccagaacc

SEQ ID NO: 785976 - DNA, 20 bp, mouse
ggcaaactggagggatgcaa

SEQ ID NO: 785977 - DNA, 20 bp, mouse
gtccccctgcagagcagagc

SEQ ID NO: 785978 - DNA, 20 bp, mouse
gcccggggcccagcttggtc

SEQ ID NO: 785979 - DNA, 20 bp, mouse
gctggagggatgcaagggtg

SEQ ID NO: 785980 - DNA, 20 bp, mouse
gctgggtggactgatttgtg

SEQ ID NO: 785981 - DNA, 20 bp, mouse
gagccctgtgccaggctttt

SEQ ID NO: 785982 - DNA, 20 bp, mouse
ggggaggagggccataccct

SEQ ID NO: 785983 - DNA, 20 bp, mouse
gtggcaggatgcccagggta

SEQ ID NO: 785984 - DNA, 20 bp, mouse
gacctcgccacccaccaggg

SEQ ID NO: 785985 - DNA, 20 bp, mouse
ggggggaggcagcattcccg

SEQ ID NO: 785986 - DNA, 20 bp, mouse
gcaaacccagggtaaataaa

SEQ ID NO: 785987 - DNA, 20 bp, mouse
ggcgcgcccccaagaggccg

SEQ ID NO: 785988 - DNA, 20 bp, mouse
gcccgcctcccaggaatgta

SEQ ID NO: 785989 - DNA, 20 bp, mouse
gactccgccccatggctctc

SEQ ID NO: 785990 - DNA, 20 bp, mouse
gtgactcagcgctttgttgc

SEQ ID NO: 785991 - DNA, 20 bp, mouse
gcgggcagcgcgcccccaag

SEQ ID NO: 785992 - DNA, 20 bp, mouse
gtgtcccatacattcctggg

SEQ ID NO: 785993 - DNA, 20 bp, mouse
gtctcaggggccttggaccg

SEQ ID NO: 785994 - DNA, 20 bp, mouse
gcggggtgcgcatcactctt

SEQ ID NO: 785995 - DNA, 20 bp, mouse
gtgacaagatgacttgagtg

SEQ ID NO: 785996 - DNA, 20 bp, mouse
gtggcgcaggcactcgaatg

SEQ ID NO: 785997 - DNA, 20 bp, mouse
gtccacagcctgctgaacct

SEQ ID NO: 785998 - DNA, 20 bp, mouse
ggctgtggaggttctgggat

SEQ ID NO: 785999 - DNA, 20 bp, mouse
gtatttggctggtagtgcct

SEQ ID NO: 786000 - DNA, 20 bp, mouse
gagcctgctgaacctaggtc

SEQ ID NO: 786001 - DNA, 20 bp, mouse
ggcagagaggatcctgacct

SEQ ID NO: 786002 - DNA, 20 bp, mouse
gcagcaggctgtggaggttc

SEQ ID NO: 786003 - DNA, 20 bp, mouse
gccactgagcaggctccggc

SEQ ID NO: 786004 - DNA, 20 bp, mouse
gcaccaggatgtggcctaat

SEQ ID NO: 786005 - DNA, 20 bp, mouse
gttcagtagaagtgtgtatt

SEQ ID NO: 786006 - DNA, 20 bp, mouse
gcaggaggctatgacagggt

SEQ ID NO: 786007 - DNA, 20 bp, mouse
ggtggggagcggtcagtctt

SEQ ID NO: 786008 - DNA, 20 bp, mouse
gacaaggcctctgtcttgta

SEQ ID NO: 786009 - DNA, 20 bp, mouse
gctgggtgttgagtggggag

SEQ ID NO: 786010 - DNA, 20 bp, mouse
gagggcccagcactctccag

SEQ ID NO: 786011 - DNA, 20 bp, mouse
gctctgctgggtgttgagtg

SEQ ID NO: 786012 - DNA, 20 bp, mouse
gtcagagcaggcaggggctc

SEQ ID NO: 786013 - DNA, 20 bp, mouse
ggggtccctgaactcccagg

SEQ ID NO: 786014 - DNA, 20 bp, mouse
gccaagcaacagaagcccgg

SEQ ID NO: 786015 - DNA, 20 bp, mouse
gacacccagcagagccacaa

SEQ ID NO: 786016 - DNA, 20 bp, mouse
gttcaagcgtggaaactgta

SEQ ID NO: 786017 - DNA, 20 bp, mouse
ggggccgggagggattgacg

SEQ ID NO: 786018 - DNA, 20 bp, mouse
gcgtggaaactgtagggctg

SEQ ID NO: 786019 - DNA, 20 bp, mouse
gcggagaaaggtggccgcta

SEQ ID NO: 786020 - DNA, 20 bp, mouse
gcatgcgcgcgcggcccaga

SEQ ID NO: 786021 - DNA, 20 bp, mouse
ggcacgctttggctcgggag

SEQ ID NO: 786022 - DNA, 20 bp, mouse
ggaggttaacagggcgtcag

SEQ ID NO: 786023 - DNA, 20 bp, mouse
gaaaagaggcgggagaaagt

SEQ ID NO: 786024 - DNA, 20 bp, mouse
ggccaccgaggcgtcgtaaa

SEQ ID NO: 786025 - DNA, 20 bp, mouse
ggggaagaaagcgcacgctt

SEQ ID NO: 786026 - DNA, 20 bp, mouse
gtctgggcccaggtctggtt

SEQ ID NO: 786027 - DNA, 20 bp, mouse
gtggaggggtggacccggga

SEQ ID NO: 786028 - DNA, 20 bp, mouse
ggccacggcccatttaaggg

SEQ ID NO: 786029 - DNA, 20 bp, mouse
gggcccatttaagggtggag

SEQ ID NO: 786030 - DNA, 20 bp, mouse
gcgtgtcagcatctgggccc

SEQ ID NO: 786031 - DNA, 20 bp, mouse
gcgggggcggggcgtctctg

SEQ ID NO: 786032 - DNA, 20 bp, mouse
gggagccacggcccatttaa

SEQ ID NO: 786033 - DNA, 20 bp, mouse
gcacccctccacccttaaat

SEQ ID NO: 786034 - DNA, 20 bp, mouse
ggtctggtttggtagtcaag

SEQ ID NO: 786035 - DNA, 20 bp, mouse
gccagatgctgacacggacc

SEQ ID NO: 786036 - DNA, 20 bp, mouse
gcgtgagcggggcgtggact

SEQ ID NO: 786037 - DNA, 20 bp, mouse
gagtacgcaggcgcgctcca

SEQ ID NO: 786038 - DNA, 20 bp, mouse
gagcagtggggcagcaagcg

SEQ ID NO: 786039 - DNA, 20 bp, mouse
gaggggccacgcagccgcag

SEQ ID NO: 786040 - DNA, 20 bp, mouse
ggcctcgtgctccgtgagcg

SEQ ID NO: 786041 - DNA, 20 bp, mouse
gcccaggcgcgctgacgcaa

SEQ ID NO: 786042 - DNA, 20 bp, mouse
ggggcggagtcagctccccc

SEQ ID NO: 786043 - DNA, 20 bp, mouse
gctaaacctgaggtcgtcct

SEQ ID NO: 786044 - DNA, 20 bp, mouse
ggccccgctcacggagcacg

SEQ ID NO: 786045 - DNA, 20 bp, mouse
ggcaatggccggcggcggaa

SEQ ID NO: 786046 - DNA, 20 bp, mouse
gcatccggccaatggggaaa

SEQ ID NO: 786047 - DNA, 20 bp, mouse
gtagccccatccggccaatg

SEQ ID NO: 786048 - DNA, 20 bp, mouse
gcggggagggtagccccatc

SEQ ID NO: 786049 - DNA, 20 bp, mouse
gctgacatcagcagcggccg

SEQ ID NO: 786050 - DNA, 20 bp, mouse
gcgtctgctgccagacgcca

SEQ ID NO: 786051 - DNA, 20 bp, mouse
ggaaatggcaaagaatgtgg

SEQ ID NO: 786052 - DNA, 20 bp, mouse
gaatcgcaaagaagctatcc

SEQ ID NO: 786053 - DNA, 20 bp, mouse
gcgttagctgttctaggttc

SEQ ID NO: 786054 - DNA, 20 bp, mouse
gctagtgccccttgactttg

SEQ ID NO: 786055 - DNA, 20 bp, mouse
gccccagccccaaagtcaag

SEQ ID NO: 786056 - DNA, 20 bp, mouse
gtgccccgaccctgccgggg

SEQ ID NO: 786057 - DNA, 20 bp, mouse
ggggctgccccgaccctgcc

SEQ ID NO: 786058 - DNA, 20 bp, mouse
gtccaagacagacggggaag

SEQ ID NO: 786059 - DNA, 20 bp, mouse
gtggtcctccccaccccggc

SEQ ID NO: 786060 - DNA, 20 bp, mouse
gcggcggggagggacagcag

SEQ ID NO: 786061 - DNA, 20 bp, mouse
ggcccgcggcgcagcaaggc

SEQ ID NO: 786062 - DNA, 20 bp, mouse
ggccctgactgggcctgggt

SEQ ID NO: 786063 - DNA, 20 bp, mouse
gcggggcagctgcagtgacg

SEQ ID NO: 786064 - DNA, 20 bp, mouse
gccccaccccggcagggtcg

SEQ ID NO: 786065 - DNA, 20 bp, mouse
gcaggagggctgccctgact

SEQ ID NO: 786066 - DNA, 20 bp, mouse
ggggcgaccgcgctcgggga

SEQ ID NO: 786067 - DNA, 20 bp, mouse
ggcgctcggggagggaccgg

SEQ ID NO: 786068 - DNA, 20 bp, mouse
gggagcgctgggaagactag

SEQ ID NO: 786069 - DNA, 20 bp, mouse
gaagccgctgccagctcccc

SEQ ID NO: 786070 - DNA, 20 bp, mouse
ggcgaggggcgaccgcgctc

SEQ ID NO: 786071 - DNA, 20 bp, mouse
gtgcggggccagagtcggag

SEQ ID NO: 786072 - DNA, 20 bp, mouse
gcccgctggccatcagcaga

SEQ ID NO: 786073 - DNA, 20 bp, mouse
gcactgccgagcccgcgcgc

SEQ ID NO: 786074 - DNA, 20 bp, mouse
gtaagagtgttgcccgtctc

SEQ ID NO: 786075 - DNA, 20 bp, mouse
ggcgcgggctcggcagtgcg

SEQ ID NO: 786076 - DNA, 20 bp, mouse
ggcggaggagccatatgcca

SEQ ID NO: 786077 - DNA, 20 bp, mouse
gcgctggcagagcttgaggc

SEQ ID NO: 786078 - DNA, 20 bp, mouse
ggacgccttcccctggcata

SEQ ID NO: 786079 - DNA, 20 bp, mouse
gtgcgcaccgaggcagggtg

SEQ ID NO: 786080 - DNA, 20 bp, mouse
gtggggcatggctggacggt

SEQ ID NO: 786081 - DNA, 20 bp, mouse
gggccgaggcctgtttgggg

SEQ ID NO: 786082 - DNA, 20 bp, mouse
gtggcagagcttgaggcggg

SEQ ID NO: 786083 - DNA, 20 bp, mouse
gcaatcccacagttctgctg

SEQ ID NO: 786084 - DNA, 20 bp, mouse
gtcggcctgcgcaccgaggc

SEQ ID NO: 786085 - DNA, 20 bp, mouse
gggtgggaaagtatgactca

SEQ ID NO: 786086 - DNA, 20 bp, mouse
gtctcagtggccgcaatcag

SEQ ID NO: 786087 - DNA, 20 bp, mouse
ggggagggactgacgacgga

SEQ ID NO: 786088 - DNA, 20 bp, mouse
ggccggggagggactgacga

SEQ ID NO: 786089 - DNA, 20 bp, mouse
gggccaccgcagcgcgcggg

SEQ ID NO: 786090 - DNA, 20 bp, mouse
gcccctccgcgccgccgggg

SEQ ID NO: 786091 - DNA, 20 bp, mouse
gggcccgcgggggcggtgtc

SEQ ID NO: 786092 - DNA, 20 bp, mouse
gagacgctgcgggccaggca

SEQ ID NO: 786093 - DNA, 20 bp, mouse
gtcgccgctcggctccttta

SEQ ID NO: 786094 - DNA, 20 bp, mouse
ggcgcagtgaccctgagaca

SEQ ID NO: 786095 - DNA, 20 bp, mouse
gccagaaagaggcgctccta

SEQ ID NO: 786096 - DNA, 20 bp, mouse
gtctctaataggctggaggg

SEQ ID NO: 786097 - DNA, 20 bp, mouse
ggatgggcggtccaggaaaa

SEQ ID NO: 786098 - DNA, 20 bp, mouse
gacctcgctcctccccacgg

SEQ ID NO: 786099 - DNA, 20 bp, mouse
ggagagcgagtgataagtga

SEQ ID NO: 786100 - DNA, 20 bp, mouse
ggcgagtgataagtgatggg

SEQ ID NO: 786101 - DNA, 20 bp, mouse
gcacgacgcggggcggggaa

SEQ ID NO: 786102 - DNA, 20 bp, mouse
gtggagacgacgtctctaat

SEQ ID NO: 786103 - DNA, 20 bp, mouse
gagggaggatcctccgccgt

SEQ ID NO: 786104 - DNA, 20 bp, mouse
ggaaagccgactgtggtagc

SEQ ID NO: 786105 - DNA, 20 bp, mouse
gtctcattggacaggtggaa

SEQ ID NO: 786106 - DNA, 20 bp, mouse
gaaggtggctgcgacgggga

SEQ ID NO: 786107 - DNA, 20 bp, mouse
gggcgcgggcgaggccagga

SEQ ID NO: 786108 - DNA, 20 bp, mouse
gccagcgccagggcagtcag

SEQ ID NO: 786109 - DNA, 20 bp, mouse
gtccctgcgccaggggtggt

SEQ ID NO: 786110 - DNA, 20 bp, mouse
gcgggaaggtggctgcgacg

SEQ ID NO: 786111 - DNA, 20 bp, mouse
gggagaaattcgtgtgtcac

SEQ ID NO: 786112 - DNA, 20 bp, mouse
gtgggtggggtgggcctcgg

SEQ ID NO: 786113 - DNA, 20 bp, mouse
gggggtgggcctcggtggga

SEQ ID NO: 786114 - DNA, 20 bp, mouse
gtgcgccaggggtggtgggt

SEQ ID NO: 786115 - DNA, 20 bp, mouse
gtccagcagtccctgcgcca

SEQ ID NO: 786116 - DNA, 20 bp, mouse
gcggctcggggcctcgtgat

SEQ ID NO: 786117 - DNA, 20 bp, mouse
gcctccgagcacaccctccg

SEQ ID NO: 786118 - DNA, 20 bp, mouse
ggagagaccggcaagatctg

SEQ ID NO: 786119 - DNA, 20 bp, mouse
gtggctccacaccaatcacg

SEQ ID NO: 786120 - DNA, 20 bp, mouse
gcagaaccatccctctgccg

SEQ ID NO: 786121 - DNA, 20 bp, mouse
gtgggcctcgcactgctgat

SEQ ID NO: 786122 - DNA, 20 bp, mouse
gccgagccgcggcagaggga

SEQ ID NO: 786123 - DNA, 20 bp, mouse
gggccccgagccgcggcaga

SEQ ID NO: 786124 - DNA, 20 bp, mouse
gccgacccgaagaagggtct

SEQ ID NO: 786125 - DNA, 20 bp, mouse
gacccgaagaagggtctggg

SEQ ID NO: 786126 - DNA, 20 bp, mouse
ggggcggcgcatctggaaag

SEQ ID NO: 786127 - DNA, 20 bp, mouse
gcagtccgggccacgtgggg

SEQ ID NO: 786128 - DNA, 20 bp, mouse
gggcgcgcggcatgctgcgg

SEQ ID NO: 786129 - DNA, 20 bp, mouse
ggggcctaaaggttcacagc

SEQ ID NO: 786130 - DNA, 20 bp, mouse
ggggccgcccccctgctctg

SEQ ID NO: 786131 - DNA, 20 bp, mouse
gtggggcgcgcggcatgctg

SEQ ID NO: 786132 - DNA, 20 bp, mouse
gggcgcatctggaaaggggc

SEQ ID NO: 786133 - DNA, 20 bp, mouse
gggcaggacccctcccacta

SEQ ID NO: 786134 - DNA, 20 bp, mouse
gtgggaggggtcctgccacc

SEQ ID NO: 786135 - DNA, 20 bp, mouse
ggccataggggcggagttct

SEQ ID NO: 786136 - DNA, 20 bp, mouse
ggaagggccaccattgagtg

SEQ ID NO: 786137 - DNA, 20 bp, mouse
gtctctgcaagacgctggaa

SEQ ID NO: 786138 - DNA, 20 bp, mouse
ggaagaatggggcttgggtg

SEQ ID NO: 786139 - DNA, 20 bp, mouse
gtgggtggcggttttgtgtg

SEQ ID NO: 786140 - DNA, 20 bp, mouse
gtccacccctgagacgtatg

SEQ ID NO: 786141 - DNA, 20 bp, mouse
gaatcctcctcactcaatgg

SEQ ID NO: 786142 - DNA, 20 bp, mouse
ggcgaatcctcctcactcaa

SEQ ID NO: 786143 - DNA, 20 bp, mouse
gttaacccagaggtctgtgg

SEQ ID NO: 786144 - DNA, 20 bp, mouse
gacccacgtggcagccaatc

SEQ ID NO: 786145 - DNA, 20 bp, mouse
gagtgaggaggattcgcacc

SEQ ID NO: 786146 - DNA, 20 bp, mouse
gggcgagactcagatgtgga

SEQ ID NO: 786147 - DNA, 20 bp, mouse
gacgcagtctagctatgtgg

SEQ ID NO: 786148 - DNA, 20 bp, mouse
ggcacgaggctcattccaag

SEQ ID NO: 786149 - DNA, 20 bp, mouse
gagggcccgcccaccctttt

SEQ ID NO: 786150 - DNA, 20 bp, mouse
gagagggcgagactcagatg

SEQ ID NO: 786151 - DNA, 20 bp, mouse
gacctggcctagggtcgtca

SEQ ID NO: 786152 - DNA, 20 bp, mouse
ggatccggaaatcaggacct

SEQ ID NO: 786153 - DNA, 20 bp, mouse
gggacggctaggagggtgaa

SEQ ID NO: 786154 - DNA, 20 bp, mouse
gtcaggaccctgacgaccct

SEQ ID NO: 786155 - DNA, 20 bp, mouse
gcagatgtggacggctagga

SEQ ID NO: 786156 - DNA, 20 bp, mouse
gtagcaaatgagggacacag

SEQ ID NO: 786157 - DNA, 20 bp, mouse
gcgcaggcgcatgatgggcg

SEQ ID NO: 786158 - DNA, 20 bp, mouse
gcatgcgcctgcgcattctg

SEQ ID NO: 786159 - DNA, 20 bp, mouse
gaaggggtgaggtgaaacgg

SEQ ID NO: 786160 - DNA, 20 bp, mouse
gcatgatgggcgcggcaagg

SEQ ID NO: 786161 - DNA, 20 bp, mouse
gcagaggaaggcaaaaaaaa

SEQ ID NO: 786162 - DNA, 20 bp, mouse
ggtggacccccagaatgcgc

SEQ ID NO: 786163 - DNA, 20 bp, mouse
ggaagtgtgagggaagcttg

SEQ ID NO: 786164 - DNA, 20 bp, mouse
gggcaaaaaaaaaggtatag

SEQ ID NO: 786165 - DNA, 20 bp, mouse
gttagggtgtatcctgagaa

SEQ ID NO: 786166 - DNA, 20 bp, mouse
ggccacccccgccacatcaa

SEQ ID NO: 786167 - DNA, 20 bp, mouse
gcgcgtccgcccccttgatg

SEQ ID NO: 786168 - DNA, 20 bp, mouse
gcgcccccttgatgtggcgg

SEQ ID NO: 786169 - DNA, 20 bp, mouse
ggaaacgctgtgatttttca

SEQ ID NO: 786170 - DNA, 20 bp, mouse
gagcccaccccaattcacag

SEQ ID NO: 786171 - DNA, 20 bp, mouse
gtgctgccctctgtgaattg

SEQ ID NO: 786172 - DNA, 20 bp, mouse
gaagtctgaagcagatcttc

SEQ ID NO: 786173 - DNA, 20 bp, mouse
gcccccgctaaagagcacta

SEQ ID NO: 786174 - DNA, 20 bp, mouse
gtgccctagtgctctttagc

SEQ ID NO: 786175 - DNA, 20 bp, mouse
gacatgctatggtttgtctg

SEQ ID NO: 786176 - DNA, 20 bp, mouse
ggggtctcccgaagggaagg

SEQ ID NO: 786177 - DNA, 20 bp, mouse
gtgcgctgcgaaggaggcgg

SEQ ID NO: 786178 - DNA, 20 bp, mouse
ggccccttgcgctgcgaagg

SEQ ID NO: 786179 - DNA, 20 bp, mouse
ggttggacgtggcagaaaaa

SEQ ID NO: 786180 - DNA, 20 bp, mouse
gccttgcgctgcgaaggagg

SEQ ID NO: 786181 - DNA, 20 bp, mouse
gagagggccgtgaagtctat

SEQ ID NO: 786182 - DNA, 20 bp, mouse
ggcgcagccaatagacttca

SEQ ID NO: 786183 - DNA, 20 bp, mouse
gcaatcgcagtcctagaagt

SEQ ID NO: 786184 - DNA, 20 bp, mouse
gcgggcgcagggccagagag

SEQ ID NO: 786185 - DNA, 20 bp, mouse
ggaaaaagggaaaataactg

SEQ ID NO: 786186 - DNA, 20 bp, mouse
gtcactgggcggagcctctg

SEQ ID NO: 786187 - DNA, 20 bp, mouse
ggaaggaagggcgccctcag

SEQ ID NO: 786188 - DNA, 20 bp, mouse
gttggtgggcggggtctcac

SEQ ID NO: 786189 - DNA, 20 bp, mouse
gtgggcggggtctcacggga

SEQ ID NO: 786190 - DNA, 20 bp, mouse
gcgcccctgcgcttccaagt

SEQ ID NO: 786191 - DNA, 20 bp, mouse
gcaccaaggctcacgctcac

SEQ ID NO: 786192 - DNA, 20 bp, mouse
gaaggctcacgctcactggg

SEQ ID NO: 786193 - DNA, 20 bp, mouse
ggcagatcctgcagtaggcg

SEQ ID NO: 786194 - DNA, 20 bp, mouse
gcgaaacgccgcagcagagg

SEQ ID NO: 786195 - DNA, 20 bp, mouse
gggatctgcaatgaagaggg

SEQ ID NO: 786196 - DNA, 20 bp, mouse
ggggaacaggggtaaggcta

SEQ ID NO: 786197 - DNA, 20 bp, mouse
gcctgcagtacaagagtcac

SEQ ID NO: 786198 - DNA, 20 bp, mouse
ggggttgctttcagggaaca

SEQ ID NO: 786199 - DNA, 20 bp, mouse
gggtgctcacagtgggctct

SEQ ID NO: 786200 - DNA, 20 bp, mouse
ggggagtccaggaatagaga

SEQ ID NO: 786201 - DNA, 20 bp, mouse
gaaggctatggtgctcacag

SEQ ID NO: 786202 - DNA, 20 bp, mouse
gccaggagggatgaaagggt

SEQ ID NO: 786203 - DNA, 20 bp, mouse
gcactggcttcttgtgagac

SEQ ID NO: 786204 - DNA, 20 bp, mouse
gttgccaacctcagcatcca

SEQ ID NO: 786205 - DNA, 20 bp, mouse
gaggccagctgcatagaaac

SEQ ID NO: 786206 - DNA, 20 bp, mouse
gttgtcaggttgatacaagt

SEQ ID NO: 786207 - DNA, 20 bp, mouse
gtgttggtctggattttgtc

SEQ ID NO: 786208 - DNA, 20 bp, mouse
ggataactgtacatttaggt

SEQ ID NO: 786209 - DNA, 20 bp, mouse
gcagttatctaggtgtgtgt

SEQ ID NO: 786210 - DNA, 20 bp, mouse
gctacagcaaagtctgataa

SEQ ID NO: 786211 - DNA, 20 bp, mouse
gatgaaagtcaatgtgggga

SEQ ID NO: 786212 - DNA, 20 bp, mouse
ggaacccgacacataaacct

SEQ ID NO: 786213 - DNA, 20 bp, mouse
gctgctgtaagtgagcattg

SEQ ID NO: 786214 - DNA, 20 bp, mouse
gtttgctgtaggcatccctg

SEQ ID NO: 786215 - DNA, 20 bp, mouse
gaccgtgatgaaagtcaatg

SEQ ID NO: 786216 - DNA, 20 bp, mouse
ggcaacatataaaggagtgg

SEQ ID NO: 786217 - DNA, 20 bp, mouse
gtggaaaggaagatggatgg

SEQ ID NO: 786218 - DNA, 20 bp, mouse
gtgggaatggcaacatataa

SEQ ID NO: 786219 - DNA, 20 bp, mouse
gcgcatagaaggttagttat

SEQ ID NO: 786220 - DNA, 20 bp, mouse
gggtgaatgtgtctgtgttt

SEQ ID NO: 786221 - DNA, 20 bp, mouse
gacactgggcgttcaggtaa

SEQ ID NO: 786222 - DNA, 20 bp, mouse
gcacacaataggactgcata

SEQ ID NO: 786223 - DNA, 20 bp, mouse
gcatgaattgcttttcagac

SEQ ID NO: 786224 - DNA, 20 bp, mouse
gcctgcctgtcccacgagac

SEQ ID NO: 786225 - DNA, 20 bp, mouse
ggggaagacggttatcacct

SEQ ID NO: 786226 - DNA, 20 bp, mouse
gtcgccaagtctagtaacac

SEQ ID NO: 786227 - DNA, 20 bp, mouse
gaaacggggctttacagtcg

SEQ ID NO: 786228 - DNA, 20 bp, mouse
gccaaagctacctgcaagca

SEQ ID NO: 786229 - DNA, 20 bp, mouse
gaggtatgtgtccagaaaaa

SEQ ID NO: 786230 - DNA, 20 bp, mouse
ggacacatacctcattgcta

SEQ ID NO: 786231 - DNA, 20 bp, mouse
gctgggcgtgtagacacaga

SEQ ID NO: 786232 - DNA, 20 bp, mouse
gtgcaaatgaatagcaaacg

SEQ ID NO: 786233 - DNA, 20 bp, mouse
ggtccgtattgttcttttgt

SEQ ID NO: 786234 - DNA, 20 bp, mouse
gaaaccagtgttactagact

SEQ ID NO: 786235 - DNA, 20 bp, mouse
gcaacctgccaaggagataa

SEQ ID NO: 786236 - DNA, 20 bp, mouse
gaccaagcaagctaccccgt

SEQ ID NO: 786237 - DNA, 20 bp, mouse
gagggatccaagtagagcca

SEQ ID NO: 786238 - DNA, 20 bp, mouse
gtcggtgcccacattcctac

SEQ ID NO: 786239 - DNA, 20 bp, mouse
gtgggcaccgatggggaccc

SEQ ID NO: 786240 - DNA, 20 bp, mouse
gagctaccccgtaggaatgt

SEQ ID NO: 786241 - DNA, 20 bp, mouse
ggtagagccagggtccccat

SEQ ID NO: 786242 - DNA, 20 bp, mouse
ggggagcagcaggccgactc

SEQ ID NO: 786243 - DNA, 20 bp, mouse
gcagccagctcgtcgggaaa

SEQ ID NO: 786244 - DNA, 20 bp, mouse
gtgcaaaggtgcaaggagga

SEQ ID NO: 786245 - DNA, 20 bp, mouse
gagcccctttcccgacgagc

SEQ ID NO: 786246 - DNA, 20 bp, mouse
gagacagactagaaggatgg

SEQ ID NO: 786247 - DNA, 20 bp, mouse
gaaaaggaatggaactataa

SEQ ID NO: 786248 - DNA, 20 bp, mouse
gcaactgttgagttggtcaa

SEQ ID NO: 786249 - DNA, 20 bp, mouse
gcaaagggcagggacaacgg

SEQ ID NO: 786250 - DNA, 20 bp, mouse
gccacccagacaggaggccg

SEQ ID NO: 786251 - DNA, 20 bp, mouse
ggtcccctggtgactggaga

SEQ ID NO: 786252 - DNA, 20 bp, mouse
gagggcagggacaacggggg

SEQ ID NO: 786253 - DNA, 20 bp, mouse
gactactgatagagctgtca

SEQ ID NO: 786254 - DNA, 20 bp, mouse
ggctagggccagatagaacc

SEQ ID NO: 786255 - DNA, 20 bp, mouse
gaccaggggacagctgaagg

SEQ ID NO: 786256 - DNA, 20 bp, mouse
gggcggtgccctatctgcgc

SEQ ID NO: 786257 - DNA, 20 bp, mouse
gaggcgcggggccggggcta

SEQ ID NO: 786258 - DNA, 20 bp, mouse
gggtgaagcgcgagccttgg

SEQ ID NO: 786259 - DNA, 20 bp, mouse
gctctgaggcactactgcgc

SEQ ID NO: 786260 - DNA, 20 bp, mouse
gggagggctgacacgttttt

SEQ ID NO: 786261 - DNA, 20 bp, mouse
gtgtgtgcgcctgcgcagat

SEQ ID NO: 786262 - DNA, 20 bp, mouse
gcctgcagtattaacatgag

SEQ ID NO: 786263 - DNA, 20 bp, mouse
gtagtgcctcagagtgctaa

SEQ ID NO: 786264 - DNA, 20 bp, mouse
gttgctccgttagcactctg

SEQ ID NO: 786265 - DNA, 20 bp, mouse
gggaggtgaagcgcgagcct

SEQ ID NO: 786266 - DNA, 20 bp, mouse
ggccagccgggcctgggaag

SEQ ID NO: 786267 - DNA, 20 bp, mouse
gaggtcccgctgtcagtcag

SEQ ID NO: 786268 - DNA, 20 bp, mouse
gcgcgcggccccccgagctc

SEQ ID NO: 786269 - DNA, 20 bp, mouse
gctgggaagcggcgcggagg

SEQ ID NO: 786270 - DNA, 20 bp, mouse
ggccccccgagctcgggttg

SEQ ID NO: 786271 - DNA, 20 bp, mouse
ggcccggccgagccagtcct

SEQ ID NO: 786272 - DNA, 20 bp, mouse
gccgaggccaggctggataa

SEQ ID NO: 786273 - DNA, 20 bp, mouse
gccgccccctctggccgccc

SEQ ID NO: 786274 - DNA, 20 bp, mouse
gacagcgggacctcctcccg

SEQ ID NO: 786275 - DNA, 20 bp, mouse
ggggacccggaggccgaaag

SEQ ID NO: 786276 - DNA, 20 bp, mouse
gagggacagtggggttccca

SEQ ID NO: 786277 - DNA, 20 bp, mouse
gtcggggacagtacactctc

SEQ ID NO: 786278 - DNA, 20 bp, mouse
gtaagggacagtatgttccc

SEQ ID NO: 786279 - DNA, 20 bp, mouse
gtgggctctcagggtcatca

SEQ ID NO: 786280 - DNA, 20 bp, mouse
gaggcggttcacccgaggtg

SEQ ID NO: 786281 - DNA, 20 bp, mouse
gaggggcggtgggtcccaaa

SEQ ID NO: 786282 - DNA, 20 bp, mouse
ggcgagcgagcgtaccggga

SEQ ID NO: 786283 - DNA, 20 bp, mouse
gagtatgttcccaggggcgg

SEQ ID NO: 786284 - DNA, 20 bp, mouse
gctgagagcccactgttcct

SEQ ID NO: 786285 - DNA, 20 bp, mouse
gccagggctagtgagtttaa

SEQ ID NO: 786286 - DNA, 20 bp, mouse
gacttagagacccaaagaaa

SEQ ID NO: 786287 - DNA, 20 bp, mouse
gtgggcactcagtaactgaa

SEQ ID NO: 786288 - DNA, 20 bp, mouse
gcaggtagctcacttcctgt

SEQ ID NO: 786289 - DNA, 20 bp, mouse
gatcctgcaccctatgctat

SEQ ID NO: 786290 - DNA, 20 bp, mouse
gactgaaagcccatagcata

SEQ ID NO: 786291 - DNA, 20 bp, mouse
ggcactcagtaactgaaagg

SEQ ID NO: 786292 - DNA, 20 bp, mouse
gctgagacacatgcagtaag

SEQ ID NO: 786293 - DNA, 20 bp, mouse
gggcacagcctggggttcaa

SEQ ID NO: 786294 - DNA, 20 bp, mouse
gtgtaagcagccctttcttt

SEQ ID NO: 786295 - DNA, 20 bp, mouse
gggagcatgtaagttcctgc

SEQ ID NO: 786296 - DNA, 20 bp, mouse
gcccgcccccagctcgtccg

SEQ ID NO: 786297 - DNA, 20 bp, mouse
gacacaccgcggacgagctg

SEQ ID NO: 786298 - DNA, 20 bp, mouse
gaggttcgccctggcttctg

SEQ ID NO: 786299 - DNA, 20 bp, mouse
gtgaaatcccagacacaccg

SEQ ID NO: 786300 - DNA, 20 bp, mouse
gctagcaaggaaagcatcag

SEQ ID NO: 786301 - DNA, 20 bp, mouse
gtgaatggggttcatgtatt

SEQ ID NO: 786302 - DNA, 20 bp, mouse
ggggactcaccccagaagcc

SEQ ID NO: 786303 - DNA, 20 bp, mouse
gctggcagccaggttcgccc

SEQ ID NO: 786304 - DNA, 20 bp, mouse
ggctcgtccgcggtgtgtct

SEQ ID NO: 786305 - DNA, 20 bp, mouse
gagttctagaatttaaaaga

SEQ ID NO: 786306 - DNA, 20 bp, mouse
gacgctgctccccggagtgg

SEQ ID NO: 786307 - DNA, 20 bp, mouse
gcccgaaagacgctgctccc

SEQ ID NO: 786308 - DNA, 20 bp, mouse
gaaaatcagcctccactccg

SEQ ID NO: 786309 - DNA, 20 bp, mouse
gaatgctgcgggtgtaaaat

SEQ ID NO: 786310 - DNA, 20 bp, mouse
gcagcgatagtgacagggga

SEQ ID NO: 786311 - DNA, 20 bp, mouse
gcactcggtgcgaaccgcgg

SEQ ID NO: 786312 - DNA, 20 bp, mouse
gcaaacagcgatagtgacag

SEQ ID NO: 786313 - DNA, 20 bp, mouse
ggacaatcatccctcagatt

SEQ ID NO: 786314 - DNA, 20 bp, mouse
gtttacacccgcagcattgc

SEQ ID NO: 786315 - DNA, 20 bp, mouse
gagcggcgagtctccccccg

SEQ ID NO: 786316 - DNA, 20 bp, mouse
gcggaggtgtgtaatttcaa

SEQ ID NO: 786317 - DNA, 20 bp, mouse
gcctgctccaggtgtcctaa

SEQ ID NO: 786318 - DNA, 20 bp, mouse
gctggtggcagcaatgtgtg

SEQ ID NO: 786319 - DNA, 20 bp, mouse
ggtggcaggttctgcttaac

SEQ ID NO: 786320 - DNA, 20 bp, mouse
ggtggcagcaatgtgtgggg

SEQ ID NO: 786321 - DNA, 20 bp, mouse
gctgttgcgtttgtcccctg

SEQ ID NO: 786322 - DNA, 20 bp, mouse
gaggttctgcttaactgggc

SEQ ID NO: 786323 - DNA, 20 bp, mouse
gcaacagtagttcctgctcc

SEQ ID NO: 786324 - DNA, 20 bp, mouse
gtcgcgggggcgggaccgag

SEQ ID NO: 786325 - DNA, 20 bp, mouse
gcttaactgggcaggtcctg

SEQ ID NO: 786326 - DNA, 20 bp, mouse
gtcgcctagcagtccctctg

SEQ ID NO: 786327 - DNA, 20 bp, mouse
gtcaagtgagccaggttcac

SEQ ID NO: 786328 - DNA, 20 bp, mouse
gccctctggggcagtcataa

SEQ ID NO: 786329 - DNA, 20 bp, mouse
gccaggttcacaggatgcta

SEQ ID NO: 786330 - DNA, 20 bp, mouse
gcacttgagagctactgagc

SEQ ID NO: 786331 - DNA, 20 bp, mouse
gagtagctctcaagtgagcc

SEQ ID NO: 786332 - DNA, 20 bp, mouse
ggagagttacagaatctgtc

SEQ ID NO: 786333 - DNA, 20 bp, mouse
gacaggatgctaggggtacc

SEQ ID NO: 786334 - DNA, 20 bp, mouse
gactgagctgggagtgttct

SEQ ID NO: 786335 - DNA, 20 bp, mouse
gaggctgatgtggcaccaag

SEQ ID NO: 786336 - DNA, 20 bp, mouse
gccctcacctagagcctcga

SEQ ID NO: 786337 - DNA, 20 bp, mouse
gggacgcgactgggagcaat

SEQ ID NO: 786338 - DNA, 20 bp, mouse
ggactgggagcaatgggcgg

SEQ ID NO: 786339 - DNA, 20 bp, mouse
gaggaaggaaagcggtcctg

SEQ ID NO: 786340 - DNA, 20 bp, mouse
gtggtggcataaacatccga

SEQ ID NO: 786341 - DNA, 20 bp, mouse
gtcccgcgtcgcttgctcta

SEQ ID NO: 786342 - DNA, 20 bp, mouse
ggccgggaagggacgcgact

SEQ ID NO: 786343 - DNA, 20 bp, mouse
gcgcgactgggagcaatggg

SEQ ID NO: 786344 - DNA, 20 bp, mouse
ggggtcttagctctccagag

SEQ ID NO: 786345 - DNA, 20 bp, mouse
gcgcctaggcaacggctcgg

SEQ ID NO: 786346 - DNA, 20 bp, mouse
gaggtggaaactgagcaagt

SEQ ID NO: 786347 - DNA, 20 bp, mouse
gctgcggcctcagtgacaaa

SEQ ID NO: 786348 - DNA, 20 bp, mouse
gagggctgtaactgcatccc

SEQ ID NO: 786349 - DNA, 20 bp, mouse
gcgtcctcccagggactaag

SEQ ID NO: 786350 - DNA, 20 bp, mouse
gtctcttgtggacagagagg

SEQ ID NO: 786351 - DNA, 20 bp, mouse
gggccactgacccactacat

SEQ ID NO: 786352 - DNA, 20 bp, mouse
gaggcagccgccgtcctccc

SEQ ID NO: 786353 - DNA, 20 bp, mouse
gttcctatgtagtgggtcag

SEQ ID NO: 786354 - DNA, 20 bp, mouse
gactaagaggcagatttatg

SEQ ID NO: 786355 - DNA, 20 bp, mouse
gaaaaggcttcctatgtagt

SEQ ID NO: 786356 - DNA, 20 bp, mouse
gagggactctgtgtggggat

SEQ ID NO: 786357 - DNA, 20 bp, mouse
gaaccgacagccctccagaa

SEQ ID NO: 786358 - DNA, 20 bp, mouse
gacacagagtcccttctgga

SEQ ID NO: 786359 - DNA, 20 bp, mouse
gccccacacagagtcccttc

SEQ ID NO: 786360 - DNA, 20 bp, mouse
ggaaaagaggcacacccagt

SEQ ID NO: 786361 - DNA, 20 bp, mouse
gaggaaaaacggatgaccta

SEQ ID NO: 786362 - DNA, 20 bp, mouse
ggtcccttctggagggctgt

SEQ ID NO: 786363 - DNA, 20 bp, mouse
gaaacggatgacctagggga

SEQ ID NO: 786364 - DNA, 20 bp, mouse
gtgaacagagaggagaatta

SEQ ID NO: 786365 - DNA, 20 bp, mouse
ggcttccaaagtgtgggact

SEQ ID NO: 786366 - DNA, 20 bp, mouse
gggcgccccgcctctcaacg

SEQ ID NO: 786367 - DNA, 20 bp, mouse
gaaggtagtcctcctcaaaa

SEQ ID NO: 786368 - DNA, 20 bp, mouse
gcgggcgccccgttgagagg

SEQ ID NO: 786369 - DNA, 20 bp, mouse
gcgccccagtacaccctctg

SEQ ID NO: 786370 - DNA, 20 bp, mouse
ggtggcgcccgggaacctag

SEQ ID NO: 786371 - DNA, 20 bp, mouse
gcaagcaggttgcccttttg

SEQ ID NO: 786372 - DNA, 20 bp, mouse
ggccggccgcagcccggatt

SEQ ID NO: 786373 - DNA, 20 bp, mouse
gcggggctgcggagggattg

SEQ ID NO: 786374 - DNA, 20 bp, mouse
gtgaggaggactaccttccg

SEQ ID NO: 786375 - DNA, 20 bp, mouse
gcacctcctgagagaagctc

SEQ ID NO: 786376 - DNA, 20 bp, mouse
ggcgctccggcaaacttcgg

SEQ ID NO: 786377 - DNA, 20 bp, mouse
gagacccgctgcaccaggcg

SEQ ID NO: 786378 - DNA, 20 bp, mouse
gttcggaggcggggagacct

SEQ ID NO: 786379 - DNA, 20 bp, mouse
gcgaggcggggccaatgccc

SEQ ID NO: 786380 - DNA, 20 bp, mouse
gtgtggggaccatagtgtga

SEQ ID NO: 786381 - DNA, 20 bp, mouse
gccggcaaacttcggaggcg

SEQ ID NO: 786382 - DNA, 20 bp, mouse
gtcttcgaggcctattgcgg

SEQ ID NO: 786383 - DNA, 20 bp, mouse
gggtgcgcacgcaagacgcg

SEQ ID NO: 786384 - DNA, 20 bp, mouse
gggtctagcgcccggggcat

SEQ ID NO: 786385 - DNA, 20 bp, mouse
ggacaaataccgacagagag

SEQ ID NO: 786386 - DNA, 20 bp, mouse
gggcttgcagcggggaaata

SEQ ID NO: 786387 - DNA, 20 bp, mouse
gtccccgctgcaagccccgg

SEQ ID NO: 786388 - DNA, 20 bp, mouse
gggcccccggggcttgcagc

SEQ ID NO: 786389 - DNA, 20 bp, mouse
gtagcgtaggggactctgag

SEQ ID NO: 786390 - DNA, 20 bp, mouse
ggggccgtgtgtgtcgaggg

SEQ ID NO: 786391 - DNA, 20 bp, mouse
gggggaaatagggtccctgt

SEQ ID NO: 786392 - DNA, 20 bp, mouse
ggctgggccgtgtgtgtcga

SEQ ID NO: 786393 - DNA, 20 bp, mouse
gcaagcgctccttgtagcgt

SEQ ID NO: 786394 - DNA, 20 bp, mouse
gtgcctcccgggaaacggga

SEQ ID NO: 786395 - DNA, 20 bp, mouse
ggcgggggacaaggcctctg

SEQ ID NO: 786396 - DNA, 20 bp, mouse
gcagtccagaggccctggca

SEQ ID NO: 786397 - DNA, 20 bp, mouse
gcgcagaggatgctgggaac

SEQ ID NO: 786398 - DNA, 20 bp, mouse
gagctctagggcaagttttt

SEQ ID NO: 786399 - DNA, 20 bp, mouse
gtagcaggcaggatattgtg

SEQ ID NO: 786400 - DNA, 20 bp, mouse
gagggtgtgtgccatggaag

SEQ ID NO: 786401 - DNA, 20 bp, mouse
gagcaggcatggccatttag

SEQ ID NO: 786402 - DNA, 20 bp, mouse
ggccatttaggggttgatgt

SEQ ID NO: 786403 - DNA, 20 bp, mouse
gattgaggactgtttctccc

SEQ ID NO: 786404 - DNA, 20 bp, mouse
gagaggaagtggcagtccag

SEQ ID NO: 786405 - DNA, 20 bp, mouse
gggcctggcgcagaggatgc

SEQ ID NO: 786406 - DNA, 20 bp, mouse
gtgggcgggcccggatgaca

SEQ ID NO: 786407 - DNA, 20 bp, mouse
gaagccaaggagggttggcg

SEQ ID NO: 786408 - DNA, 20 bp, mouse
gaccccagggccaggcgcgc

SEQ ID NO: 786409 - DNA, 20 bp, mouse
gacagggaggcgaaaggccc

SEQ ID NO: 786410 - DNA, 20 bp, mouse
gggtccccgccaaccctcct

SEQ ID NO: 786411 - DNA, 20 bp, mouse
gcccctgctgggcgggctct

SEQ ID NO: 786412 - DNA, 20 bp, mouse
gcgcggggcggggcggactc

SEQ ID NO: 786413 - DNA, 20 bp, mouse
gggccccgccccctgctggg

SEQ ID NO: 786414 - DNA, 20 bp, mouse
ggagcagaccacacccaccg

SEQ ID NO: 786415 - DNA, 20 bp, mouse
gcgcggctccccagcaggga

SEQ ID NO: 786416 - DNA, 20 bp, mouse
ggggcgcgcgagtctccgga

SEQ ID NO: 786417 - DNA, 20 bp, mouse
gtgctcccgcgtggccggga

SEQ ID NO: 786418 - DNA, 20 bp, mouse
gaggtgactcaggaccccgg

SEQ ID NO: 786419 - DNA, 20 bp, mouse
gttgcccgcagcatgcgctg

SEQ ID NO: 786420 - DNA, 20 bp, mouse
gaggccccagcgcatgctgc

SEQ ID NO: 786421 - DNA, 20 bp, mouse
gaggatgtccacaggggctg

SEQ ID NO: 786422 - DNA, 20 bp, mouse
gagcctccgccctgcagcag

SEQ ID NO: 786423 - DNA, 20 bp, mouse
ggcgtgacgctgctcccgcg

SEQ ID NO: 786424 - DNA, 20 bp, mouse
gaggggtccacaatgtggag

SEQ ID NO: 786425 - DNA, 20 bp, mouse
gtgcggggcgcgcgagtctc

SEQ ID NO: 786426 - DNA, 20 bp, mouse
gcccccgcccagcgcgacgg

SEQ ID NO: 786427 - DNA, 20 bp, mouse
ggggaggcccagaatcgcga

SEQ ID NO: 786428 - DNA, 20 bp, mouse
gggggagggcccaagcgggg

SEQ ID NO: 786429 - DNA, 20 bp, mouse
gcccgcggtgaatattgatg

SEQ ID NO: 786430 - DNA, 20 bp, mouse
gcgacacagcctcgctcaat

SEQ ID NO: 786431 - DNA, 20 bp, mouse
gcgcccgccgtcgcgctggg

SEQ ID NO: 786432 - DNA, 20 bp, mouse
ggcagcctgccccgccccag

SEQ ID NO: 786433 - DNA, 20 bp, mouse
gcaggctgctactggcgccc

SEQ ID NO: 786434 - DNA, 20 bp, mouse
gaggcgccgctcagaacgaa

SEQ ID NO: 786435 - DNA, 20 bp, mouse
ggggcggggcaggctgctac

SEQ ID NO: 786436 - DNA, 20 bp, mouse
gaagcggccgggtccaggag

SEQ ID NO: 786437 - DNA, 20 bp, mouse
gcggctcagacatcaggctc

SEQ ID NO: 786438 - DNA, 20 bp, mouse
ggagccgagcctccagtaga

SEQ ID NO: 786439 - DNA, 20 bp, mouse
ggctaaggaggacaccgggt

SEQ ID NO: 786440 - DNA, 20 bp, mouse
gaggccagccgggcaggaat

SEQ ID NO: 786441 - DNA, 20 bp, mouse
gcagcaggcgcccagacctg

SEQ ID NO: 786442 - DNA, 20 bp, mouse
gggccgggtccaggagtggg

SEQ ID NO: 786443 - DNA, 20 bp, mouse
gctagagtgtctccctctac

SEQ ID NO: 786444 - DNA, 20 bp, mouse
ggggtgcgcctgcatttctg

SEQ ID NO: 786445 - DNA, 20 bp, mouse
gcctctgtcaggcaaccccc

SEQ ID NO: 786446 - DNA, 20 bp, mouse
gcctctccaggtgacgtcca

SEQ ID NO: 786447 - DNA, 20 bp, mouse
gggagaggaaggacgagcct

SEQ ID NO: 786448 - DNA, 20 bp, mouse
ggacccaggggcgtctcccc

SEQ ID NO: 786449 - DNA, 20 bp, mouse
gctgggcggcggggagtgcc

SEQ ID NO: 786450 - DNA, 20 bp, mouse
ggtctcccctggacgtcacc

SEQ ID NO: 786451 - DNA, 20 bp, mouse
ggcagctcgcgtctgagcgg

SEQ ID NO: 786452 - DNA, 20 bp, mouse
gcccggtgtgcaatgctccc

SEQ ID NO: 786453 - DNA, 20 bp, mouse
gggacctctgtcgaggaaaa

SEQ ID NO: 786454 - DNA, 20 bp, mouse
ggggcactgtggctgccagg

SEQ ID NO: 786455 - DNA, 20 bp, mouse
ggtccaggggagacgcccct

SEQ ID NO: 786456 - DNA, 20 bp, mouse
gaggacgtgctcgccccggg

SEQ ID NO: 786457 - DNA, 20 bp, mouse
gcgcgagccgagaatacgtg

SEQ ID NO: 786458 - DNA, 20 bp, mouse
gggggcgagcacgtcctctg

SEQ ID NO: 786459 - DNA, 20 bp, mouse
gccagctgcacctgtcctaa

SEQ ID NO: 786460 - DNA, 20 bp, mouse
gaagcaggcgcactccgccc

SEQ ID NO: 786461 - DNA, 20 bp, mouse
gcgcaaagccgcagaggcgt

SEQ ID NO: 786462 - DNA, 20 bp, mouse
gccgtaggacccaggccctt

SEQ ID NO: 786463 - DNA, 20 bp, mouse
gcccctgtcccctaagggcc

SEQ ID NO: 786464 - DNA, 20 bp, mouse
gcctgcccgcaaagccgcag

SEQ ID NO: 786465 - DNA, 20 bp, mouse
gtgaggcccccacgtattct

SEQ ID NO: 786466 - DNA, 20 bp, mouse
gcccagggccacaggaacgt

SEQ ID NO: 786467 - DNA, 20 bp, mouse
ggccctgggacaggaggaaa

SEQ ID NO: 786468 - DNA, 20 bp, mouse
gcctgcttaaggtggaattt

SEQ ID NO: 786469 - DNA, 20 bp, mouse
gcgctggcacccatggggtt

SEQ ID NO: 786470 - DNA, 20 bp, mouse
gtgggacattccttctcata

SEQ ID NO: 786471 - DNA, 20 bp, mouse
gctagagctcccaacccccc

SEQ ID NO: 786472 - DNA, 20 bp, mouse
ggcacccatggggtttggtc

SEQ ID NO: 786473 - DNA, 20 bp, mouse
ggggaaggccaggcgacttg

SEQ ID NO: 786474 - DNA, 20 bp, mouse
gcctcctgtcccagggccac

SEQ ID NO: 786475 - DNA, 20 bp, mouse
ggttcctgtggccctgggac

SEQ ID NO: 786476 - DNA, 20 bp, mouse
gaacgagccaatgggagctg

SEQ ID NO: 786477 - DNA, 20 bp, mouse
gtagagggccaggagaaggt

SEQ ID NO: 786478 - DNA, 20 bp, mouse
ggatgctgttaagagctaga

SEQ ID NO: 786479 - DNA, 20 bp, mouse
ggctccgcgcccgccccatt

SEQ ID NO: 786480 - DNA, 20 bp, mouse
gttaggggattcccgggaga

SEQ ID NO: 786481 - DNA, 20 bp, mouse
ggggagagggctctgaaatc

SEQ ID NO: 786482 - DNA, 20 bp, mouse
gtccttccgcccaatggggc

SEQ ID NO: 786483 - DNA, 20 bp, mouse
gctgaaaccgcagctcccat

SEQ ID NO: 786484 - DNA, 20 bp, mouse
gttaacagcatcggtctcca

SEQ ID NO: 786485 - DNA, 20 bp, mouse
gcacgctgccgtccccagac

SEQ ID NO: 786486 - DNA, 20 bp, mouse
gctgggccatgtgacatccc

SEQ ID NO: 786487 - DNA, 20 bp, mouse
ggaatcattaactggctctg

SEQ ID NO: 786488 - DNA, 20 bp, mouse
gggacttaggaatcattaac

SEQ ID NO: 786489 - DNA, 20 bp, mouse
gtaacacccacttgggactt

SEQ ID NO: 786490 - DNA, 20 bp, mouse
ggtacccatacgtgtgtcat

SEQ ID NO: 786491 - DNA, 20 bp, mouse
ggcagcctttcatctcccag

SEQ ID NO: 786492 - DNA, 20 bp, mouse
ggtcacttcctgatcttctt

SEQ ID NO: 786493 - DNA, 20 bp, mouse
gcaccgggtgaggttcccta

SEQ ID NO: 786494 - DNA, 20 bp, mouse
ggggagatgaaaggctgcct

SEQ ID NO: 786495 - DNA, 20 bp, mouse
gtccagctgctcagtatccc

SEQ ID NO: 786496 - DNA, 20 bp, mouse
ggggcggagtcaagcaggag

SEQ ID NO: 786497 - DNA, 20 bp, mouse
gaggggcgcttacgacacaa

SEQ ID NO: 786498 - DNA, 20 bp, mouse
gccaaaaggggatcaggttc

SEQ ID NO: 786499 - DNA, 20 bp, mouse
gggagcgagcaggatcgtgt

SEQ ID NO: 786500 - DNA, 20 bp, mouse
gaggcagacctcggagaggt

SEQ ID NO: 786501 - DNA, 20 bp, mouse
gttggcctcagcattccatt

SEQ ID NO: 786502 - DNA, 20 bp, mouse
gtcaagcaggagtggtcacc

SEQ ID NO: 786503 - DNA, 20 bp, mouse
gccgtggggcggagtcaagc

SEQ ID NO: 786504 - DNA, 20 bp, mouse
gactccgccccacggaaaga

SEQ ID NO: 786505 - DNA, 20 bp, mouse
gatcccgtgcagtctgcctc

SEQ ID NO: 786506 - DNA, 20 bp, mouse
ggaggcaggaccgtaagcta

SEQ ID NO: 786507 - DNA, 20 bp, mouse
gtcattgcccacgtggtctc

SEQ ID NO: 786508 - DNA, 20 bp, mouse
ggtaagctacgggagcgttc

SEQ ID NO: 786509 - DNA, 20 bp, mouse
gagcgttccggagaccacgt

SEQ ID NO: 786510 - DNA, 20 bp, mouse
gggactgcggagcccaaggg

SEQ ID NO: 786511 - DNA, 20 bp, mouse
gtgcgcatgcgcccgagcgt

SEQ ID NO: 786512 - DNA, 20 bp, mouse
gcaatgaggctcccacgctc

SEQ ID NO: 786513 - DNA, 20 bp, mouse
gcccgggcgggcccaccgtt

SEQ ID NO: 786514 - DNA, 20 bp, mouse
ggggagcctcattgcccacg

SEQ ID NO: 786515 - DNA, 20 bp, mouse
gcccaggccttgtccagtaa

SEQ ID NO: 786516 - DNA, 20 bp, mouse
gtggaccccgaagcgctggg

SEQ ID NO: 786517 - DNA, 20 bp, mouse
gactgctcactctgtgaggc

SEQ ID NO: 786518 - DNA, 20 bp, mouse
gccaagaggggacttcccag

SEQ ID NO: 786519 - DNA, 20 bp, mouse
gggtgaagatgaccccagta

SEQ ID NO: 786520 - DNA, 20 bp, mouse
ggtctcgcacacaccctcat

SEQ ID NO: 786521 - DNA, 20 bp, mouse
ggtcctggggaggcccatga

SEQ ID NO: 786522 - DNA, 20 bp, mouse
gtgtatgaggatggcccaag

SEQ ID NO: 786523 - DNA, 20 bp, mouse
gctgaggtgctcaagtgtgc

SEQ ID NO: 786524 - DNA, 20 bp, mouse
gaggacaaaggtgaaaccgt

SEQ ID NO: 786525 - DNA, 20 bp, mouse
gccagtggaccccgaagcgc

SEQ ID NO: 786526 - DNA, 20 bp, mouse
gcgacagctgggatgataag

SEQ ID NO: 786527 - DNA, 20 bp, mouse
gtaggagcagggcgacagct

SEQ ID NO: 786528 - DNA, 20 bp, mouse
ggcgcgcagcaaagtcccgg

SEQ ID NO: 786529 - DNA, 20 bp, mouse
gataagcggctcccatcggt

SEQ ID NO: 786530 - DNA, 20 bp, mouse
gggcgggtggtgagctccgg

SEQ ID NO: 786531 - DNA, 20 bp, mouse
ggcagcaaagtcccggaggt

SEQ ID NO: 786532 - DNA, 20 bp, mouse
gtcccggaggtgggcatggg

SEQ ID NO: 786533 - DNA, 20 bp, mouse
gtcggcgcgcagcaaagtcc

SEQ ID NO: 786534 - DNA, 20 bp, mouse
gcatcgatcgaccaaccgat

SEQ ID NO: 786535 - DNA, 20 bp, mouse
gccggtgggagggacgctcg

SEQ ID NO: 786536 - DNA, 20 bp, mouse
gagtgtgtataggctgtcaa

SEQ ID NO: 786537 - DNA, 20 bp, mouse
gcagagaggcgggaacgcag

SEQ ID NO: 786538 - DNA, 20 bp, mouse
gtataggctgtcaagggctg

SEQ ID NO: 786539 - DNA, 20 bp, mouse
gaggcgggaacgcagcggga

SEQ ID NO: 786540 - DNA, 20 bp, mouse
gttccatgaggagtgtgtat

SEQ ID NO: 786541 - DNA, 20 bp, mouse
gccgcccctcctcctgtaac

SEQ ID NO: 786542 - DNA, 20 bp, mouse
ggctctcattagccagttac

SEQ ID NO: 786543 - DNA, 20 bp, mouse
gagcctatacacactcctca

SEQ ID NO: 786544 - DNA, 20 bp, mouse
ggctaatgagagcgtcgcca

SEQ ID NO: 786545 - DNA, 20 bp, mouse
gcataacatgttcttccatg

SEQ ID NO: 786546 - DNA, 20 bp, mouse
ggggttagggggagtagtaa

SEQ ID NO: 786547 - DNA, 20 bp, mouse
ggggccccatgtataaaaga

SEQ ID NO: 786548 - DNA, 20 bp, mouse
gacttgtcataatggggtta

SEQ ID NO: 786549 - DNA, 20 bp, mouse
gatctggaaaccatcccctt

SEQ ID NO: 786550 - DNA, 20 bp, mouse
ggccccacgctcccaagata

SEQ ID NO: 786551 - DNA, 20 bp, mouse
gagtgccaggcgcaaatctg

SEQ ID NO: 786552 - DNA, 20 bp, mouse
gcacttcctccccaagggga

SEQ ID NO: 786553 - DNA, 20 bp, mouse
gtataaaagagggaagtcac

SEQ ID NO: 786554 - DNA, 20 bp, mouse
ggggctggccttggtctatc

SEQ ID NO: 786555 - DNA, 20 bp, mouse
gctggcacttcctccccaag

SEQ ID NO: 786556 - DNA, 20 bp, mouse
gtgggtccccagaaactgag

SEQ ID NO: 786557 - DNA, 20 bp, mouse
gggtcgcagccaggcaccgg

SEQ ID NO: 786558 - DNA, 20 bp, mouse
ggcagctaagggaatctcct

SEQ ID NO: 786559 - DNA, 20 bp, mouse
ggaggtgagaggcccgctgt

SEQ ID NO: 786560 - DNA, 20 bp, mouse
ggagtcggggtcatgtgcag

SEQ ID NO: 786561 - DNA, 20 bp, mouse
ggtaaacagccctgtctccc

SEQ ID NO: 786562 - DNA, 20 bp, mouse
gccaggttggctctgtccct

SEQ ID NO: 786563 - DNA, 20 bp, mouse
gcatttgagtggccctcccc

SEQ ID NO: 786564 - DNA, 20 bp, mouse
gtggcaaccgccaaggggtg

SEQ ID NO: 786565 - DNA, 20 bp, mouse
ggggcacttggagctgtggg

SEQ ID NO: 786566 - DNA, 20 bp, mouse
gaagcaggaggcgcgtgggt

SEQ ID NO: 786567 - DNA, 20 bp, mouse
ggggttgggtaggattcgca

SEQ ID NO: 786568 - DNA, 20 bp, mouse
ggcagggggactaacataag

SEQ ID NO: 786569 - DNA, 20 bp, mouse
gtcaagcagcttcaaggtct

SEQ ID NO: 786570 - DNA, 20 bp, mouse
gctgcgatggagctatgttg

SEQ ID NO: 786571 - DNA, 20 bp, mouse
gaagaatcatgtatctagaa

SEQ ID NO: 786572 - DNA, 20 bp, mouse
ggaggaagcaggaggcgcgt

SEQ ID NO: 786573 - DNA, 20 bp, mouse
ggcagaaaacctgaaaaaca

SEQ ID NO: 786574 - DNA, 20 bp, mouse
gcctggcttgttggaggctt

SEQ ID NO: 786575 - DNA, 20 bp, mouse
ggaggatcatgtgtgaagac

SEQ ID NO: 786576 - DNA, 20 bp, mouse
gtccccggggggctcttccg

SEQ ID NO: 786577 - DNA, 20 bp, mouse
ggggccagccagttccccgg

SEQ ID NO: 786578 - DNA, 20 bp, mouse
gccgagggtgtgtgaaaaca

SEQ ID NO: 786579 - DNA, 20 bp, mouse
ggaagagccccccggggaac

SEQ ID NO: 786580 - DNA, 20 bp, mouse
gtgtgggggtccagagaagg

SEQ ID NO: 786581 - DNA, 20 bp, mouse
gagccccccggggaactggc

SEQ ID NO: 786582 - DNA, 20 bp, mouse
ggcactgggcctcatccaat

SEQ ID NO: 786583 - DNA, 20 bp, mouse
gaccctcggaagagcccccc

SEQ ID NO: 786584 - DNA, 20 bp, mouse
gactccagggttaatgacgg

SEQ ID NO: 786585 - DNA, 20 bp, mouse
gccacccccgtcattaaccc

SEQ ID NO: 786586 - DNA, 20 bp, mouse
gaatcctgacctgggcagga

SEQ ID NO: 786587 - DNA, 20 bp, mouse
ggcaaactgtctcagaatcc

SEQ ID NO: 786588 - DNA, 20 bp, mouse
gagggagcgcaagaggagcc

SEQ ID NO: 786589 - DNA, 20 bp, mouse
gagtccctagcttctggcct

SEQ ID NO: 786590 - DNA, 20 bp, mouse
ggcatcgaagtttagtccct

SEQ ID NO: 786591 - DNA, 20 bp, mouse
gcttgcgctccctactccca

SEQ ID NO: 786592 - DNA, 20 bp, mouse
ggcttctggcctgggtcacg

SEQ ID NO: 786593 - DNA, 20 bp, mouse
gcagctgttcctatgactca

SEQ ID NO: 786594 - DNA, 20 bp, mouse
gcaacatgatacagccctat

SEQ ID NO: 786595 - DNA, 20 bp, mouse
gcagctgactcccaacagca

SEQ ID NO: 786596 - DNA, 20 bp, mouse
gtcagcctacccaccccctt

SEQ ID NO: 786597 - DNA, 20 bp, mouse
gaagggctgtatcagtggga

SEQ ID NO: 786598 - DNA, 20 bp, mouse
ggggtgggtaggctgatgtg

SEQ ID NO: 786599 - DNA, 20 bp, mouse
gtaccagccgggtgtgggaa

SEQ ID NO: 786600 - DNA, 20 bp, mouse
gccccctgcacctgaagcaa

SEQ ID NO: 786601 - DNA, 20 bp, mouse
ggtgggaagggctgtatcag

SEQ ID NO: 786602 - DNA, 20 bp, mouse
gccccttgggcttgggagtg

SEQ ID NO: 786603 - DNA, 20 bp, mouse
gacagtgagcacgtgggatt

SEQ ID NO: 786604 - DNA, 20 bp, mouse
ggcccttgcttcaggtgcag

SEQ ID NO: 786605 - DNA, 20 bp, mouse
gatacagcccttcccacacc

SEQ ID NO: 786606 - DNA, 20 bp, mouse
ggctccgcggacacgatgag

SEQ ID NO: 786607 - DNA, 20 bp, mouse
gcctccactcatcgtgtccg

SEQ ID NO: 786608 - DNA, 20 bp, mouse
gaggaggaaggctggtgtat

SEQ ID NO: 786609 - DNA, 20 bp, mouse
gacacgatgagtggaggcgt

SEQ ID NO: 786610 - DNA, 20 bp, mouse
gaggtgactggacagctccg

SEQ ID NO: 786611 - DNA, 20 bp, mouse
gtggaggagggaggtcaagg

SEQ ID NO: 786612 - DNA, 20 bp, mouse
gggccaatgaatggagccta

SEQ ID NO: 786613 - DNA, 20 bp, mouse
gggctcccacagatgcttcc

SEQ ID NO: 786614 - DNA, 20 bp, mouse
ggctgtccagtcacctgccc

SEQ ID NO: 786615 - DNA, 20 bp, mouse
gctccctaggctccattcat

SEQ ID NO: 786616 - DNA, 20 bp, mouse
ggtaggaggggctaagaagt

SEQ ID NO: 786617 - DNA, 20 bp, mouse
gcacgcacatgcataccccc

SEQ ID NO: 786618 - DNA, 20 bp, mouse
ggtgacctaactggtcctgg

SEQ ID NO: 786619 - DNA, 20 bp, mouse
gacttctagaaagtcttctc

SEQ ID NO: 786620 - DNA, 20 bp, mouse
ggtgatctaactggtcctag

SEQ ID NO: 786621 - DNA, 20 bp, mouse
gtgaagactaacattctaaa

SEQ ID NO: 786622 - DNA, 20 bp, mouse
ggaattcaagcgagctcctc

SEQ ID NO: 786623 - DNA, 20 bp, mouse
ggtctctgtggatgttaagg

SEQ ID NO: 786624 - DNA, 20 bp, mouse
gcttctccggctggtaggag

SEQ ID NO: 786625 - DNA, 20 bp, mouse
gtaaaaatatgtgatctaac

SEQ ID NO: 786626 - DNA, 20 bp, mouse
gctccccggctgtacggggt

SEQ ID NO: 786627 - DNA, 20 bp, mouse
ggtggcgcctgtctcctccc

SEQ ID NO: 786628 - DNA, 20 bp, mouse
ggtcccaccccgtacagccg

SEQ ID NO: 786629 - DNA, 20 bp, mouse
gccaaggggcccacctcaag

SEQ ID NO: 786630 - DNA, 20 bp, mouse
gtctcctccccggctgtacg

SEQ ID NO: 786631 - DNA, 20 bp, mouse
gataggacaaatctggacat

SEQ ID NO: 786632 - DNA, 20 bp, mouse
gccactaccctgcatgggtg

SEQ ID NO: 786633 - DNA, 20 bp, mouse
ggggctttcaaaactgggat

SEQ ID NO: 786634 - DNA, 20 bp, mouse
gaaccgaagccacttgaggt

SEQ ID NO: 786635 - DNA, 20 bp, mouse
gcggggctgcgatcctggag

SEQ ID NO: 786636 - DNA, 20 bp, mouse
gaaccccctcctctcagtta

SEQ ID NO: 786637 - DNA, 20 bp, mouse
gacctcctggagttggccac

SEQ ID NO: 786638 - DNA, 20 bp, mouse
gtctgtgggagggatccaag

SEQ ID NO: 786639 - DNA, 20 bp, mouse
gagccctaactgagaggagg

SEQ ID NO: 786640 - DNA, 20 bp, mouse
gttaaggtgtctcacttcct

SEQ ID NO: 786641 - DNA, 20 bp, mouse
ggggctaaggatcacgttgt

SEQ ID NO: 786642 - DNA, 20 bp, mouse
gactgcagagaatggacttc

SEQ ID NO: 786643 - DNA, 20 bp, mouse
gagcagtgggcgtggggctt

SEQ ID NO: 786644 - DNA, 20 bp, mouse
gacctggagctgggcggcta

SEQ ID NO: 786645 - DNA, 20 bp, mouse
gtgactccagcattagctta

SEQ ID NO: 786646 - DNA, 20 bp, mouse
ggcccagcctatggagggga

SEQ ID NO: 786647 - DNA, 20 bp, mouse
gttaaaggaagcccagccta

SEQ ID NO: 786648 - DNA, 20 bp, mouse
gttgcaagctggcaccagtt

SEQ ID NO: 786649 - DNA, 20 bp, mouse
gtgtgccaaagggaactaac

SEQ ID NO: 786650 - DNA, 20 bp, mouse
gaggaagcccagcctatgga

SEQ ID NO: 786651 - DNA, 20 bp, mouse
gcccctcccctccataggct

SEQ ID NO: 786652 - DNA, 20 bp, mouse
gtaattgtagttgtgccaaa

SEQ ID NO: 786653 - DNA, 20 bp, mouse
ggactttttcaagacactgt

SEQ ID NO: 786654 - DNA, 20 bp, mouse
ggtttctttgtcatgtctaa

SEQ ID NO: 786655 - DNA, 20 bp, mouse
gctatgaaacctcaatgtaa

SEQ ID NO: 786656 - DNA, 20 bp, mouse
ggcaaaacaccaggcctcgt

SEQ ID NO: 786657 - DNA, 20 bp, mouse
gtggcagaggcagttccccg

SEQ ID NO: 786658 - DNA, 20 bp, mouse
gaaacccctggcaaaacacc

SEQ ID NO: 786659 - DNA, 20 bp, mouse
gaaacaccaggcctcgtggg

SEQ ID NO: 786660 - DNA, 20 bp, mouse
ggaaagatgctccacccacg

SEQ ID NO: 786661 - DNA, 20 bp, mouse
gaggcctggtgttttgccag

SEQ ID NO: 786662 - DNA, 20 bp, mouse
gctgtgtgacagtgacctgg

SEQ ID NO: 786663 - DNA, 20 bp, mouse
ggaggcagagggcaacaaag

SEQ ID NO: 786664 - DNA, 20 bp, mouse
gtttcaggaaagaagcacca

SEQ ID NO: 786665 - DNA, 20 bp, mouse
gaggtgaggggctgtgatca

SEQ ID NO: 786666 - DNA, 20 bp, mouse
gggggctggcgatatgcctg

SEQ ID NO: 786667 - DNA, 20 bp, mouse
gtgaggctagcaggatctaa

SEQ ID NO: 786668 - DNA, 20 bp, mouse
gaattgagcaatggctttac

SEQ ID NO: 786669 - DNA, 20 bp, mouse
gaaaacaaatacccacctct

SEQ ID NO: 786670 - DNA, 20 bp, mouse
gactacgtagtgcggggcgg

SEQ ID NO: 786671 - DNA, 20 bp, mouse
gtagctcaaaacagagatgc

SEQ ID NO: 786672 - DNA, 20 bp, mouse
gaaaacagagatgcgggatg

SEQ ID NO: 786673 - DNA, 20 bp, mouse
gctaggctctcagctgatgg

SEQ ID NO: 786674 - DNA, 20 bp, mouse
gtctagcactacgtagtgcg

SEQ ID NO: 786675 - DNA, 20 bp, mouse
gcagagctgcgattcaggct

SEQ ID NO: 786676 - DNA, 20 bp, mouse
gcccatacatggcaagggat

SEQ ID NO: 786677 - DNA, 20 bp, mouse
gcccaagagtctcttggaaa

SEQ ID NO: 786678 - DNA, 20 bp, mouse
ggcaacttgcctattgccta

SEQ ID NO: 786679 - DNA, 20 bp, mouse
gaagtagcacaggagtggga

SEQ ID NO: 786680 - DNA, 20 bp, mouse
gtcaggaggtactataatca

SEQ ID NO: 786681 - DNA, 20 bp, mouse
gctgacaagtagcacaggag

SEQ ID NO: 786682 - DNA, 20 bp, mouse
gcccttgccatgtatgggta

SEQ ID NO: 786683 - DNA, 20 bp, mouse
gcaggaccccaagagtctct

SEQ ID NO: 786684 - DNA, 20 bp, mouse
gcaggtctgacaagtagcac

SEQ ID NO: 786685 - DNA, 20 bp, mouse
gtaggctgaggcaccggggc

SEQ ID NO: 786686 - DNA, 20 bp, mouse
gagggctaagggattatcga

SEQ ID NO: 786687 - DNA, 20 bp, mouse
ggccccacgggggttagtca

SEQ ID NO: 786688 - DNA, 20 bp, mouse
gccagctgaagccactgggg

SEQ ID NO: 786689 - DNA, 20 bp, mouse
ggccctgactaacccccgtg

SEQ ID NO: 786690 - DNA, 20 bp, mouse
gcacccagcgcattccagtg

SEQ ID NO: 786691 - DNA, 20 bp, mouse
gcagcgcattccagtgggga

SEQ ID NO: 786692 - DNA, 20 bp, mouse
gaaggctgctgggggctgag

SEQ ID NO: 786693 - DNA, 20 bp, mouse
gcccccagcagccttcatgg

SEQ ID NO: 786694 - DNA, 20 bp, mouse
ggaggccaagtgtctcggga

SEQ ID NO: 786695 - DNA, 20 bp, mouse
gagcacgaacacagagcccg

SEQ ID NO: 786696 - DNA, 20 bp, mouse
gcgccccctggcaacagaag

SEQ ID NO: 786697 - DNA, 20 bp, mouse
gtcagtttgcggaagtagga

SEQ ID NO: 786698 - DNA, 20 bp, mouse
gcctgcctgcggcatgggct

SEQ ID NO: 786699 - DNA, 20 bp, mouse
gcacagcctgcctgcggcat

SEQ ID NO: 786700 - DNA, 20 bp, mouse
gcggcatgggctcggtggat

SEQ ID NO: 786701 - DNA, 20 bp, mouse
ggggcagttatagaagatgg

SEQ ID NO: 786702 - DNA, 20 bp, mouse
gaggtccacgcttggggtcg

SEQ ID NO: 786703 - DNA, 20 bp, mouse
gagccgtagtgtcgtcacgt

SEQ ID NO: 786704 - DNA, 20 bp, mouse
gagtaagccgaggtgagtga

SEQ ID NO: 786705 - DNA, 20 bp, mouse
ggcgtgcgaggtccacgctt

SEQ ID NO: 786706 - DNA, 20 bp, mouse
gcacgcatgggcgctcgaag

SEQ ID NO: 786707 - DNA, 20 bp, mouse
ggagaatcgggtgtcagact

SEQ ID NO: 786708 - DNA, 20 bp, mouse
gccgccccccaggcacagtc

SEQ ID NO: 786709 - DNA, 20 bp, mouse
ggatcctgactgtgcctggg

SEQ ID NO: 786710 - DNA, 20 bp, mouse
ggcgctcgaagaggtccaag

SEQ ID NO: 786711 - DNA, 20 bp, mouse
gtcgcgagcctgatgagaat

SEQ ID NO: 786712 - DNA, 20 bp, mouse
gacagtcaggatccacgcat

SEQ ID NO: 786713 - DNA, 20 bp, mouse
gctcgaagaggtccaagtgg

SEQ ID NO: 786714 - DNA, 20 bp, mouse
gctccaagctgctgcgactc

SEQ ID NO: 786715 - DNA, 20 bp, mouse
gttgcacagcaaccggagga

SEQ ID NO: 786716 - DNA, 20 bp, mouse
ggagcagggaaggggagcca

SEQ ID NO: 786717 - DNA, 20 bp, mouse
gttggggttaggagaaagta

SEQ ID NO: 786718 - DNA, 20 bp, mouse
gctgcccactggatttgcaa

SEQ ID NO: 786719 - DNA, 20 bp, mouse
gagtgctcaaacttctctct

SEQ ID NO: 786720 - DNA, 20 bp, mouse
ggctcacccacactggggac

SEQ ID NO: 786721 - DNA, 20 bp, mouse
gtagggctaaagcagcaccg

SEQ ID NO: 786722 - DNA, 20 bp, mouse
ggagcgagctaatcctctcc

SEQ ID NO: 786723 - DNA, 20 bp, mouse
gtggtcacccgtccccagtg

SEQ ID NO: 786724 - DNA, 20 bp, mouse
gtaaacactctggccttttg

SEQ ID NO: 786725 - DNA, 20 bp, mouse
gagagaagtttgagcactca

SEQ ID NO: 786726 - DNA, 20 bp, mouse
gtgacgcagagtgtgtgcgt

SEQ ID NO: 786727 - DNA, 20 bp, mouse
gcttctgcgccctggatcgc

SEQ ID NO: 786728 - DNA, 20 bp, mouse
gccagggcgcagaaggatag

SEQ ID NO: 786729 - DNA, 20 bp, mouse
gctggatcgccggccgaaga

SEQ ID NO: 786730 - DNA, 20 bp, mouse
gccgaccggacccagacctc

SEQ ID NO: 786731 - DNA, 20 bp, mouse
gaattccggcgtgtgtgtta

SEQ ID NO: 786732 - DNA, 20 bp, mouse
gagatcaggaaattctgcgt

SEQ ID NO: 786733 - DNA, 20 bp, mouse
gccccgcggtccttccgcac

SEQ ID NO: 786734 - DNA, 20 bp, mouse
gcgcggcggatgatgaattc

SEQ ID NO: 786735 - DNA, 20 bp, mouse
gagcgtcccgagtgactcgc

SEQ ID NO: 786736 - DNA, 20 bp, mouse
gtcaagactcttggctaaga

SEQ ID NO: 786737 - DNA, 20 bp, mouse
gaagctgcaaagcgaacctg

SEQ ID NO: 786738 - DNA, 20 bp, mouse
gtgccaactggtagagacca

SEQ ID NO: 786739 - DNA, 20 bp, mouse
gcctgccttgctcaattagg

SEQ ID NO: 786740 - DNA, 20 bp, mouse
gagctggtgagcaatcccac

SEQ ID NO: 786741 - DNA, 20 bp, mouse
gcagcttgagagttgggaaa

SEQ ID NO: 786742 - DNA, 20 bp, mouse
gtggtgagcaatcccactgg

SEQ ID NO: 786743 - DNA, 20 bp, mouse
ggagagggcgagcatactcc

SEQ ID NO: 786744 - DNA, 20 bp, mouse
ggagcctgccttgctcaatt

SEQ ID NO: 786745 - DNA, 20 bp, mouse
ggggcgagcatactcctgga

SEQ ID NO: 786746 - DNA, 20 bp, mouse
gctacactctaacctataga

SEQ ID NO: 786747 - DNA, 20 bp, mouse
gggagctaaaagaaaatcac

SEQ ID NO: 786748 - DNA, 20 bp, mouse
gcggagaaaggcaagcaaca

SEQ ID NO: 786749 - DNA, 20 bp, mouse
gtcactcaataaaattgtgc

SEQ ID NO: 786750 - DNA, 20 bp, mouse
ggctaaaagaaaatcacagg

SEQ ID NO: 786751 - DNA, 20 bp, mouse
ggggtgctattagaagacat

SEQ ID NO: 786752 - DNA, 20 bp, mouse
gctcagaagatggagactat

SEQ ID NO: 786753 - DNA, 20 bp, mouse
gcaggaggatgttaacctat

SEQ ID NO: 786754 - DNA, 20 bp, mouse
gtgtcactctcacttatagg

SEQ ID NO: 786755 - DNA, 20 bp, mouse
ggaatgtcactctcacttat

SEQ ID NO: 786756 - DNA, 20 bp, mouse
gtcaaagaagcatacataag

SEQ ID NO: 786757 - DNA, 20 bp, mouse
gggaaagagggctagagcta

SEQ ID NO: 786758 - DNA, 20 bp, mouse
gaatttgtgcggcatagtgg

SEQ ID NO: 786759 - DNA, 20 bp, mouse
gtatgcttctttgagatttg

SEQ ID NO: 786760 - DNA, 20 bp, mouse
gcagggacgagccaggaaag

SEQ ID NO: 786761 - DNA, 20 bp, mouse
gtgctaactacttaaaactc

SEQ ID NO: 786762 - DNA, 20 bp, mouse
gacttcaacaagaaaaatga

SEQ ID NO: 786763 - DNA, 20 bp, mouse
gttgttgaagtaggctgtag

SEQ ID NO: 786764 - DNA, 20 bp, mouse
gtctaatttgtgcggcatag

SEQ ID NO: 786765 - DNA, 20 bp, mouse
gatttgtggagtaaataatc

SEQ ID NO: 786766 - DNA, 20 bp, mouse
gctaacctctaaggtctcgg

SEQ ID NO: 786767 - DNA, 20 bp, mouse
gcaggcaggtagctaatcag

SEQ ID NO: 786768 - DNA, 20 bp, mouse
gagcccttggaattgtaagg

SEQ ID NO: 786769 - DNA, 20 bp, mouse
gtaaggaggaaaaccctatt

SEQ ID NO: 786770 - DNA, 20 bp, mouse
ggaggtatcaaccccgtgga

SEQ ID NO: 786771 - DNA, 20 bp, mouse
ggaaaataaggtgtgagact

SEQ ID NO: 786772 - DNA, 20 bp, mouse
gttccaagggctaacctcta

SEQ ID NO: 786773 - DNA, 20 bp, mouse
gactcaaggacagtctgagc

SEQ ID NO: 786774 - DNA, 20 bp, mouse
gccccgtggagggtggggta

SEQ ID NO: 786775 - DNA, 20 bp, mouse
gagactcggagagctttgtc

SEQ ID NO: 786776 - DNA, 20 bp, mouse
ggaggcctctctcctctcgg

SEQ ID NO: 786777 - DNA, 20 bp, mouse
gcattggcctgggacaaggt

SEQ ID NO: 786778 - DNA, 20 bp, mouse
gggaaaggaattcactgaac

SEQ ID NO: 786779 - DNA, 20 bp, mouse
ggtgaaagaaaccaaagggg

SEQ ID NO: 786780 - DNA, 20 bp, mouse
ggcaagagcgggaagagagt

SEQ ID NO: 786781 - DNA, 20 bp, mouse
ggctagggacaggacgtggt

SEQ ID NO: 786782 - DNA, 20 bp, mouse
ggcctctctcctctcggagg

SEQ ID NO: 786783 - DNA, 20 bp, mouse
ggtccctgatgtccagagga

SEQ ID NO: 786784 - DNA, 20 bp, mouse
gagcccctgccacgagtcat

SEQ ID NO: 786785 - DNA, 20 bp, mouse
gggaaacaaaccattggcct

SEQ ID NO: 786786 - DNA, 20 bp, mouse
gacagcacatgcccaactga

SEQ ID NO: 786787 - DNA, 20 bp, mouse
gagcttagtggcacttaaca

SEQ ID NO: 786788 - DNA, 20 bp, mouse
gtaggcaaggcactatcaac

SEQ ID NO: 786789 - DNA, 20 bp, mouse
gttctagtctgaagggagac

SEQ ID NO: 786790 - DNA, 20 bp, mouse
gcctgcttttgggtaaatta

SEQ ID NO: 786791 - DNA, 20 bp, mouse
gggaaaggtctcacagcctg

SEQ ID NO: 786792 - DNA, 20 bp, mouse
ggggaattgtgtcatcttac

SEQ ID NO: 786793 - DNA, 20 bp, mouse
gggcactatcaacaggatag

SEQ ID NO: 786794 - DNA, 20 bp, mouse
gtccttgataagcaatcccc

SEQ ID NO: 786795 - DNA, 20 bp, mouse
gaataggacagaccctcagt

SEQ ID NO: 786796 - DNA, 20 bp, mouse
gacagacaggtgaatatcct

SEQ ID NO: 786797 - DNA, 20 bp, mouse
gatatcctgggtctgggcag

SEQ ID NO: 786798 - DNA, 20 bp, mouse
ggatccgctgctcactgtgt

SEQ ID NO: 786799 - DNA, 20 bp, mouse
gtcactgtgtggggaaagcc

SEQ ID NO: 786800 - DNA, 20 bp, mouse
gcgtcctcaattgcacagac

SEQ ID NO: 786801 - DNA, 20 bp, mouse
gcaagccgctgcccagaccc

SEQ ID NO: 786802 - DNA, 20 bp, mouse
gcaggtgaatatcctgggtc

SEQ ID NO: 786803 - DNA, 20 bp, mouse
gtcacctgtctgtgcaattg

SEQ ID NO: 786804 - DNA, 20 bp, mouse
gttccccacacagtgagcag

SEQ ID NO: 786805 - DNA, 20 bp, mouse
gtgtaaattctgcccgtggt

SEQ ID NO: 786806 - DNA, 20 bp, mouse
gacagacaggtgaatatcct

SEQ ID NO: 786807 - DNA, 20 bp, mouse
gatatcctgggtctgggcag

SEQ ID NO: 786808 - DNA, 20 bp, mouse
ggatccgctgctcactgtgt

SEQ ID NO: 786809 - DNA, 20 bp, mouse
gtcactgtgtggggaaagcc

SEQ ID NO: 786810 - DNA, 20 bp, mouse
gcgtcctcaattgcacagac

SEQ ID NO: 786811 - DNA, 20 bp, mouse
gcaagccgctgcccagaccc

SEQ ID NO: 786812 - DNA, 20 bp, mouse
gcaggtgaatatcctgggtc

SEQ ID NO: 786813 - DNA, 20 bp, mouse
gtcacctgtctgtgcaattg

SEQ ID NO: 786814 - DNA, 20 bp, mouse
gttccccacacagtgagcag

SEQ ID NO: 786815 - DNA, 20 bp, mouse
gtgtaaattctgcccgtggt

SEQ ID NO: 786816 - DNA, 20 bp, mouse
ggcggtgggcgcgacgtcgg

SEQ ID NO: 786817 - DNA, 20 bp, mouse
gagggctcaagcaggaggag

SEQ ID NO: 786818 - DNA, 20 bp, mouse
gcctcctcacgctccgccca

SEQ ID NO: 786819 - DNA, 20 bp, mouse
gtggtaagagcgatgctgaa

SEQ ID NO: 786820 - DNA, 20 bp, mouse
gagggcctggccagtccgag

SEQ ID NO: 786821 - DNA, 20 bp, mouse
ggggcgggcacctcggcggg

SEQ ID NO: 786822 - DNA, 20 bp, mouse
gaactctgtgaggttggggc

SEQ ID NO: 786823 - DNA, 20 bp, mouse
ggcggcggtgggcgcgacgt

SEQ ID NO: 786824 - DNA, 20 bp, mouse
ggctgcccatcaggccgaag

SEQ ID NO: 786825 - DNA, 20 bp, mouse
gagcgatgctgaagggcggg

SEQ ID NO: 786826 - DNA, 20 bp, mouse
gcagcccagcggtgactcat

SEQ ID NO: 786827 - DNA, 20 bp, mouse
ggacccccggagccccaacg

SEQ ID NO: 786828 - DNA, 20 bp, mouse
gaacacgccagccaagggga

SEQ ID NO: 786829 - DNA, 20 bp, mouse
gacacgtgacactggagggg

SEQ ID NO: 786830 - DNA, 20 bp, mouse
gaggccccgttggggctccg

SEQ ID NO: 786831 - DNA, 20 bp, mouse
ggtgaggaggaggccccgtt

SEQ ID NO: 786832 - DNA, 20 bp, mouse
gcagccgatgagtcaccgct

SEQ ID NO: 786833 - DNA, 20 bp, mouse
gtcctcacacgtgacactgg

SEQ ID NO: 786834 - DNA, 20 bp, mouse
gtggggctccgggggtcggt

SEQ ID NO: 786835 - DNA, 20 bp, mouse
gagggtggatcatctctgtg

SEQ ID NO: 786836 - DNA, 20 bp, mouse
ggcggcggcgcccatgtcga

SEQ ID NO: 786837 - DNA, 20 bp, mouse
gtccgggccgtggcactctg

SEQ ID NO: 786838 - DNA, 20 bp, mouse
gggcggcgcgcggggagcac

SEQ ID NO: 786839 - DNA, 20 bp, mouse
gagggaagaagaggcgcgag

SEQ ID NO: 786840 - DNA, 20 bp, mouse
ggacatgggcgccgccgcgt

SEQ ID NO: 786841 - DNA, 20 bp, mouse
gaggcgcccggagacttctc

SEQ ID NO: 786842 - DNA, 20 bp, mouse
gccgctccgcgggcggtcag

SEQ ID NO: 786843 - DNA, 20 bp, mouse
gggcctctctagcccgcggg

SEQ ID NO: 786844 - DNA, 20 bp, mouse
ggggcgctcgggtcgtggag

SEQ ID NO: 786845 - DNA, 20 bp, mouse
gtggggctctgccgtcgaca

SEQ ID NO: 786846 - DNA, 20 bp, mouse
gggagcagccggtgtctcta

SEQ ID NO: 786847 - DNA, 20 bp, mouse
gggggaggaagtgcgcgcgg

SEQ ID NO: 786848 - DNA, 20 bp, mouse
ggcagccggtgtctctaagg

SEQ ID NO: 786849 - DNA, 20 bp, mouse
ggagaccggggttttaaaac

SEQ ID NO: 786850 - DNA, 20 bp, mouse
ggtacggtgaataatcaaac

SEQ ID NO: 786851 - DNA, 20 bp, mouse
gaggcctaaaaggaactgta

SEQ ID NO: 786852 - DNA, 20 bp, mouse
gggtgtctctaaggaggggg

SEQ ID NO: 786853 - DNA, 20 bp, mouse
ggccccgcccagttggggat

SEQ ID NO: 786854 - DNA, 20 bp, mouse
ggggtttctcctctgctggt

SEQ ID NO: 786855 - DNA, 20 bp, mouse
gactggcggcaagccaagac

SEQ ID NO: 786856 - DNA, 20 bp, mouse
gagcaagcgcggtccagttg

SEQ ID NO: 786857 - DNA, 20 bp, mouse
gaagcgcggtccagttgcgg

SEQ ID NO: 786858 - DNA, 20 bp, mouse
gtgcggtgggatgcaggaaa

SEQ ID NO: 786859 - DNA, 20 bp, mouse
gcccgcccaggtttgctgga

SEQ ID NO: 786860 - DNA, 20 bp, mouse
gtctggcgggccctaataaa

SEQ ID NO: 786861 - DNA, 20 bp, mouse
gtccagttgcggtgggatgc

SEQ ID NO: 786862 - DNA, 20 bp, mouse
gccgtgacttcgtcaaagtt

SEQ ID NO: 786863 - DNA, 20 bp, mouse
gccccagtgtagcgtggtga

SEQ ID NO: 786864 - DNA, 20 bp, mouse
gggatcgagcgatgatccgg

SEQ ID NO: 786865 - DNA, 20 bp, mouse
ggccctccagcaaacctggg

SEQ ID NO: 786866 - DNA, 20 bp, mouse
gttgaactatggaagaggaa

SEQ ID NO: 786867 - DNA, 20 bp, mouse
gtcccccgagtctggatcat

SEQ ID NO: 786868 - DNA, 20 bp, mouse
gaaagagtgagtcagctcca

SEQ ID NO: 786869 - DNA, 20 bp, mouse
gtgcccatgatccagactcg

SEQ ID NO: 786870 - DNA, 20 bp, mouse
ggattctaacccttgctatt

SEQ ID NO: 786871 - DNA, 20 bp, mouse
ggtaccgcctcggccaagga

SEQ ID NO: 786872 - DNA, 20 bp, mouse
ggaagacaaccaaatagcaa

SEQ ID NO: 786873 - DNA, 20 bp, mouse
ggcatcttactatgtatgga

SEQ ID NO: 786874 - DNA, 20 bp, mouse
gactatggaagaggaagggc

SEQ ID NO: 786875 - DNA, 20 bp, mouse
gaaacagtgggaggagccct

SEQ ID NO: 786876 - DNA, 20 bp, mouse
gaacccttgacatcatggga

SEQ ID NO: 786877 - DNA, 20 bp, mouse
ggggaacagaggtagcagag

SEQ ID NO: 786878 - DNA, 20 bp, mouse
gtaggcagacgcttgacaac

SEQ ID NO: 786879 - DNA, 20 bp, mouse
gaccatgtagtcttgatctt

SEQ ID NO: 786880 - DNA, 20 bp, mouse
gtcaagggttcattcagagt

SEQ ID NO: 786881 - DNA, 20 bp, mouse
ggggatgtgcccaagattcc

SEQ ID NO: 786882 - DNA, 20 bp, mouse
gaatgaacccttgacatcat

SEQ ID NO: 786883 - DNA, 20 bp, mouse
gtcccagaggggcataaaag

SEQ ID NO: 786884 - DNA, 20 bp, mouse
gccactatgtaacacaaccc

SEQ ID NO: 786885 - DNA, 20 bp, mouse
gaacacaaccctggaatctt

SEQ ID NO: 786886 - DNA, 20 bp, mouse
ggggtcgcatgcctccccgt

SEQ ID NO: 786887 - DNA, 20 bp, mouse
ggggctaaggaatcagttaa

SEQ ID NO: 786888 - DNA, 20 bp, mouse
ggtccctgtagcagaggata

SEQ ID NO: 786889 - DNA, 20 bp, mouse
gagagaaagcagcacagccc

SEQ ID NO: 786890 - DNA, 20 bp, mouse
gaagacacaaagctaaggtc

SEQ ID NO: 786891 - DNA, 20 bp, mouse
ggctggagggtcagaccaga

SEQ ID NO: 786892 - DNA, 20 bp, mouse
ggggcggagctgattcacgc

SEQ ID NO: 786893 - DNA, 20 bp, mouse
gtggtcgcctcctggagggt

SEQ ID NO: 786894 - DNA, 20 bp, mouse
ggggcgaaggttggttccca

SEQ ID NO: 786895 - DNA, 20 bp, mouse
gctaaggaatcagttaaagg

SEQ ID NO: 786896 - DNA, 20 bp, mouse
gcagaaagaaattccttggg

SEQ ID NO: 786897 - DNA, 20 bp, mouse
ggggggcggggcttgtgctt

SEQ ID NO: 786898 - DNA, 20 bp, mouse
gaaaggactcgcgctctctg

SEQ ID NO: 786899 - DNA, 20 bp, mouse
gaaccagaaagaaattcctt

SEQ ID NO: 786900 - DNA, 20 bp, mouse
gagcgcgagtcctttaaggc

SEQ ID NO: 786901 - DNA, 20 bp, mouse
gtgtgcttgggcttccggga

SEQ ID NO: 786902 - DNA, 20 bp, mouse
gtgggcttccgggatgggcg

SEQ ID NO: 786903 - DNA, 20 bp, mouse
gaggcaggccccgcctctcc

SEQ ID NO: 786904 - DNA, 20 bp, mouse
gagaataagtaaaaaaggtg

SEQ ID NO: 786905 - DNA, 20 bp, mouse
ggaaaaagaagttgcggggc

SEQ ID NO: 786906 - DNA, 20 bp, mouse
gacgggaagcggggacgcag

SEQ ID NO: 786907 - DNA, 20 bp, mouse
gcaggggcgggaggagcgga

SEQ ID NO: 786908 - DNA, 20 bp, mouse
gcaaacgccagccttggcta

SEQ ID NO: 786909 - DNA, 20 bp, mouse
gctcagagggtgtgcggcgc

SEQ ID NO: 786910 - DNA, 20 bp, mouse
ggcgcaggcgtcggctgcag

SEQ ID NO: 786911 - DNA, 20 bp, mouse
gggcatgctcagagggtgtg

SEQ ID NO: 786912 - DNA, 20 bp, mouse
ggtggggcccgggagccggg

SEQ ID NO: 786913 - DNA, 20 bp, mouse
gcaaagttgggcagggagct

SEQ ID NO: 786914 - DNA, 20 bp, mouse
gtgcgcgctgggtcagcaac

SEQ ID NO: 786915 - DNA, 20 bp, mouse
ggcggcacctcccggctccc

SEQ ID NO: 786916 - DNA, 20 bp, mouse
gcacccgcccagtactggtc

SEQ ID NO: 786917 - DNA, 20 bp, mouse
gggggaggaactcccaggag

SEQ ID NO: 786918 - DNA, 20 bp, mouse
gaggaggaggctgatttaca

SEQ ID NO: 786919 - DNA, 20 bp, mouse
gccccggcttcaggaggagg

SEQ ID NO: 786920 - DNA, 20 bp, mouse
ggggtgggggaggaactccc

SEQ ID NO: 786921 - DNA, 20 bp, mouse
gtactgcagcccccggcttc

SEQ ID NO: 786922 - DNA, 20 bp, mouse
gctgggctgctgtgaactga

SEQ ID NO: 786923 - DNA, 20 bp, mouse
ggagggcgggatctggaagt

SEQ ID NO: 786924 - DNA, 20 bp, mouse
gtgcagcccccggcttcagg

SEQ ID NO: 786925 - DNA, 20 bp, mouse
gggaagtgggagtcagggat

SEQ ID NO: 786926 - DNA, 20 bp, mouse
gcagccaaagggatgatgga

SEQ ID NO: 786927 - DNA, 20 bp, mouse
gcggcgccccctcgcggttg

SEQ ID NO: 786928 - DNA, 20 bp, mouse
ggtcgccgccccaaccgcga

SEQ ID NO: 786929 - DNA, 20 bp, mouse
ggggtcgggcggcaccatag

SEQ ID NO: 786930 - DNA, 20 bp, mouse
gggcggcgactgcagccaaa

SEQ ID NO: 786931 - DNA, 20 bp, mouse
gccgccccctcccaccgcta

SEQ ID NO: 786932 - DNA, 20 bp, mouse
gggtgccgcccgacccacgg

SEQ ID NO: 786933 - DNA, 20 bp, mouse
gggcgccgccgtgggtcggg

SEQ ID NO: 786934 - DNA, 20 bp, mouse
gcgggcggcaccatagcggt

SEQ ID NO: 786935 - DNA, 20 bp, mouse
gccagccagtctgtcccgga

SEQ ID NO: 786936 - DNA, 20 bp, mouse
gttcaggcacatcaggaggc

SEQ ID NO: 786937 - DNA, 20 bp, mouse
gctagatttggtaacaatga

SEQ ID NO: 786938 - DNA, 20 bp, mouse
gtgtacgcaagaactctgaa

SEQ ID NO: 786939 - DNA, 20 bp, mouse
ggaaccgaacagattcacaa

SEQ ID NO: 786940 - DNA, 20 bp, mouse
gtttactgctacatgctacc

SEQ ID NO: 786941 - DNA, 20 bp, mouse
gactaagttaagtgtttggt

SEQ ID NO: 786942 - DNA, 20 bp, mouse
ggcacccacggatttcagaa

SEQ ID NO: 786943 - DNA, 20 bp, mouse
gaaggagccattgaacagca

SEQ ID NO: 786944 - DNA, 20 bp, mouse
ggtatcacttcaggcacatc

SEQ ID NO: 786945 - DNA, 20 bp, mouse
gagatagccttgctgttcaa

SEQ ID NO: 786946 - DNA, 20 bp, mouse
ggccgagtccagttcatcag

SEQ ID NO: 786947 - DNA, 20 bp, mouse
gcaagtctgaggaggctatg

SEQ ID NO: 786948 - DNA, 20 bp, mouse
gaaactaaggcaggatttag

SEQ ID NO: 786949 - DNA, 20 bp, mouse
gcacagaaactcctgggtga

SEQ ID NO: 786950 - DNA, 20 bp, mouse
gaagaaggagagttttgact

SEQ ID NO: 786951 - DNA, 20 bp, mouse
gcctaaacacagaaactcct

SEQ ID NO: 786952 - DNA, 20 bp, mouse
gtgcctttgggtcacatgtt

SEQ ID NO: 786953 - DNA, 20 bp, mouse
gtccactgatgaactggact

SEQ ID NO: 786954 - DNA, 20 bp, mouse
gctgaggatgggccaccaaa

SEQ ID NO: 786955 - DNA, 20 bp, mouse
gggactcggcatctgcagac

SEQ ID NO: 786956 - DNA, 20 bp, mouse
gtgggcgcctggcctcgccg

SEQ ID NO: 786957 - DNA, 20 bp, mouse
ggggccagctgggtgcgcca

SEQ ID NO: 786958 - DNA, 20 bp, mouse
gtggccctggcgcacccagc

SEQ ID NO: 786959 - DNA, 20 bp, mouse
ggcagctcgccgtaatgaca

SEQ ID NO: 786960 - DNA, 20 bp, mouse
gggaaaggacgcggtgctgg

SEQ ID NO: 786961 - DNA, 20 bp, mouse
gaggggacctggaaaggacg

SEQ ID NO: 786962 - DNA, 20 bp, mouse
gcccgagccccggccagggt

SEQ ID NO: 786963 - DNA, 20 bp, mouse
gcgcccacaggcagggcgtg

SEQ ID NO: 786964 - DNA, 20 bp, mouse
gacaggaatcactgctaaag

SEQ ID NO: 786965 - DNA, 20 bp, mouse
gggccaggcgcccacaggca

SEQ ID NO: 786966 - DNA, 20 bp, mouse
gggccagagtccctgttgaa

SEQ ID NO: 786967 - DNA, 20 bp, mouse
gtccaggcctggggtcccgc

SEQ ID NO: 786968 - DNA, 20 bp, mouse
ggagcgaggccgaacttagg

SEQ ID NO: 786969 - DNA, 20 bp, mouse
gggcgaacgcgtagacacca

SEQ ID NO: 786970 - DNA, 20 bp, mouse
gtccctaagggacccggcta

SEQ ID NO: 786971 - DNA, 20 bp, mouse
ggaaagaccgactcactagt

SEQ ID NO: 786972 - DNA, 20 bp, mouse
gcaccttagccgggtccctt

SEQ ID NO: 786973 - DNA, 20 bp, mouse
ggcctcgcaccgcctaagtt

SEQ ID NO: 786974 - DNA, 20 bp, mouse
gggcgcgcagctccaggcct

SEQ ID NO: 786975 - DNA, 20 bp, mouse
gggctaaggtggatggacta

SEQ ID NO: 786976 - DNA, 20 bp, mouse
gtcaacaggaggaattgtgg

SEQ ID NO: 786977 - DNA, 20 bp, mouse
gtgatagcgacgcatctcta

SEQ ID NO: 786978 - DNA, 20 bp, mouse
gtgggattggggtcagtaag

SEQ ID NO: 786979 - DNA, 20 bp, mouse
gtcagtaaggggtccaggtg

SEQ ID NO: 786980 - DNA, 20 bp, mouse
gggggaggcatcaagataca

SEQ ID NO: 786981 - DNA, 20 bp, mouse
ggggcctttaagagttggat

SEQ ID NO: 786982 - DNA, 20 bp, mouse
ggggttgcagaaaaggatta

SEQ ID NO: 786983 - DNA, 20 bp, mouse
gcagggcactggtcaacagg

SEQ ID NO: 786984 - DNA, 20 bp, mouse
ggccctgggcctttaagagt

SEQ ID NO: 786985 - DNA, 20 bp, mouse
gtggggtcagtaaggggtcc

SEQ ID NO: 786986 - DNA, 20 bp, mouse
ggatcacattctgcgacttg

SEQ ID NO: 786987 - DNA, 20 bp, mouse
gttgacagttcctttcattc

SEQ ID NO: 786988 - DNA, 20 bp, mouse
gacctgctgttttgaaatac

SEQ ID NO: 786989 - DNA, 20 bp, mouse
gggcttattgttaatgtgca

SEQ ID NO: 786990 - DNA, 20 bp, mouse
ggctaatttttagaaggatt

SEQ ID NO: 786991 - DNA, 20 bp, mouse
gaccagtatttcaaaacagc

SEQ ID NO: 786992 - DNA, 20 bp, mouse
gaaactataggtcaattctg

SEQ ID NO: 786993 - DNA, 20 bp, mouse
gcattacctcttttcttaca

SEQ ID NO: 786994 - DNA, 20 bp, mouse
ggggttttatttaatccact

SEQ ID NO: 786995 - DNA, 20 bp, mouse
gttttgtactccgtttttgc

SEQ ID NO: 786996 - DNA, 20 bp, mouse
gcaagtgcccgggagcacag

SEQ ID NO: 786997 - DNA, 20 bp, mouse
gaactcgcccgcggggtgag

SEQ ID NO: 786998 - DNA, 20 bp, mouse
ggctggggcgagggacgcgc

SEQ ID NO: 786999 - DNA, 20 bp, mouse
gaggagccgggcaagtgccc

SEQ ID NO: 787000 - DNA, 20 bp, mouse
gcgggctgcgcccggagcgc

SEQ ID NO: 787001 - DNA, 20 bp, mouse
ggcgcgcactgctggggcga

SEQ ID NO: 787002 - DNA, 20 bp, mouse
gcgggcagcgcgcactgctg

SEQ ID NO: 787003 - DNA, 20 bp, mouse
gcaccccgcgggcgagttct

SEQ ID NO: 787004 - DNA, 20 bp, mouse
gctgtgctgctgacactcgg

SEQ ID NO: 787005 - DNA, 20 bp, mouse
ggtgctcccgggcacttgcc

SEQ ID NO: 787006 - DNA, 20 bp, mouse
ggaggggcgcactcgtggat

SEQ ID NO: 787007 - DNA, 20 bp, mouse
gaccacgcgagaggcctcga

SEQ ID NO: 787008 - DNA, 20 bp, mouse
gggccctgcccacacctgcg

SEQ ID NO: 787009 - DNA, 20 bp, mouse
ggggcagcggaccacgcgag

SEQ ID NO: 787010 - DNA, 20 bp, mouse
gagcagacagacgggttcta

SEQ ID NO: 787011 - DNA, 20 bp, mouse
gcctccgcgcaccctctccg

SEQ ID NO: 787012 - DNA, 20 bp, mouse
gcccgcgtccgagagtctga

SEQ ID NO: 787013 - DNA, 20 bp, mouse
ggggccacgcaggtgtgggc

SEQ ID NO: 787014 - DNA, 20 bp, mouse
gagtgcgcccctccccggag

SEQ ID NO: 787015 - DNA, 20 bp, mouse
gagccccctcgctccctggg

SEQ ID NO: 787016 - DNA, 20 bp, mouse
gagacagggcggcgcgttaa

SEQ ID NO: 787017 - DNA, 20 bp, mouse
gaacgcgccgccctgtctca

SEQ ID NO: 787018 - DNA, 20 bp, mouse
gcccgaccagggggaaactg

SEQ ID NO: 787019 - DNA, 20 bp, mouse
gaggctgcggcatttaagat

SEQ ID NO: 787020 - DNA, 20 bp, mouse
ggacccgccttgagacaggg

SEQ ID NO: 787021 - DNA, 20 bp, mouse
gcatgccttgcccgaccagg

SEQ ID NO: 787022 - DNA, 20 bp, mouse
ggccgcgccacgtgactcct

SEQ ID NO: 787023 - DNA, 20 bp, mouse
gcagctctgtcaaccccgag

SEQ ID NO: 787024 - DNA, 20 bp, mouse
gcgggacccgccttgagaca

SEQ ID NO: 787025 - DNA, 20 bp, mouse
ggcgccgccctgtctcaagg

SEQ ID NO: 787026 - DNA, 20 bp, mouse
gcacacacagagacacgtag

SEQ ID NO: 787027 - DNA, 20 bp, mouse
gaaaccctcctcacctacgg

SEQ ID NO: 787028 - DNA, 20 bp, mouse
gtgacctccgtaggtgagga

SEQ ID NO: 787029 - DNA, 20 bp, mouse
ggggagatactgattaccat

SEQ ID NO: 787030 - DNA, 20 bp, mouse
gtagcctatggtgcggaaga

SEQ ID NO: 787031 - DNA, 20 bp, mouse
gtcagcctgcgtcactccta

SEQ ID NO: 787032 - DNA, 20 bp, mouse
gattaccataggagtgacgc

SEQ ID NO: 787033 - DNA, 20 bp, mouse
gatctcccagtgacctccgt

SEQ ID NO: 787034 - DNA, 20 bp, mouse
gctcacctacggaggtcact

SEQ ID NO: 787035 - DNA, 20 bp, mouse
gaagaaaccctcctcaccta

SEQ ID NO: 787036 - DNA, 20 bp, mouse
gcaaggagggagtttcatgt

SEQ ID NO: 787037 - DNA, 20 bp, mouse
gactgagccagcacttttga

SEQ ID NO: 787038 - DNA, 20 bp, mouse
gctagtccctcctaccacag

SEQ ID NO: 787039 - DNA, 20 bp, mouse
gcacttttgaggggccagaa

SEQ ID NO: 787040 - DNA, 20 bp, mouse
gcaggcggggctcccgtggg

SEQ ID NO: 787041 - DNA, 20 bp, mouse
gtctggatagcagccaaagt

SEQ ID NO: 787042 - DNA, 20 bp, mouse
gcccccaaggcctccaaaat

SEQ ID NO: 787043 - DNA, 20 bp, mouse
gatagccaagagttaagggc

SEQ ID NO: 787044 - DNA, 20 bp, mouse
gcccgcctgcccttaactct

SEQ ID NO: 787045 - DNA, 20 bp, mouse
gctagctttgaaagaaaggt

SEQ ID NO: 787046 - DNA, 20 bp, mouse
ggctggccccgctgtcctct

SEQ ID NO: 787047 - DNA, 20 bp, mouse
gagcgcaacgcgcagagact

SEQ ID NO: 787048 - DNA, 20 bp, mouse
ggggcgcgacgtggaaccgc

SEQ ID NO: 787049 - DNA, 20 bp, mouse
gtccggccacgcagaggcga

SEQ ID NO: 787050 - DNA, 20 bp, mouse
gcccgccccctcctggtccg

SEQ ID NO: 787051 - DNA, 20 bp, mouse
gtgcccgccccgcgctggga

SEQ ID NO: 787052 - DNA, 20 bp, mouse
gggttgcggcggacgcgggg

SEQ ID NO: 787053 - DNA, 20 bp, mouse
gccggagcctcggaccagga

SEQ ID NO: 787054 - DNA, 20 bp, mouse
gctacgcgcagcgcagccga

SEQ ID NO: 787055 - DNA, 20 bp, mouse
gcgtagagcggggcgcgacg

SEQ ID NO: 787056 - DNA, 20 bp, mouse
gggagcctgccaatccccac

SEQ ID NO: 787057 - DNA, 20 bp, mouse
gtgtgcccgagcgcgaagaa

SEQ ID NO: 787058 - DNA, 20 bp, mouse
ggctcgggcacacccctccg

SEQ ID NO: 787059 - DNA, 20 bp, mouse
gggcacacccctccgcggtg

SEQ ID NO: 787060 - DNA, 20 bp, mouse
gcgaccaatcctcaccgcgg

SEQ ID NO: 787061 - DNA, 20 bp, mouse
gaggagccgaggctcaccga

SEQ ID NO: 787062 - DNA, 20 bp, mouse
gcccagctggccccggtact

SEQ ID NO: 787063 - DNA, 20 bp, mouse
gtggtcggcccgaaccccct

SEQ ID NO: 787064 - DNA, 20 bp, mouse
ggcggccccaggaagtgcgg

SEQ ID NO: 787065 - DNA, 20 bp, mouse
gacagcccgtggggattggc

SEQ ID NO: 787066 - DNA, 20 bp, mouse
gtacctctggggtcctgccg

SEQ ID NO: 787067 - DNA, 20 bp, mouse
ggacacgtgcgcccactccg

SEQ ID NO: 787068 - DNA, 20 bp, mouse
gggcgcgcgcgcgttatttt

SEQ ID NO: 787069 - DNA, 20 bp, mouse
gcccgccgccgcgagctcgt

SEQ ID NO: 787070 - DNA, 20 bp, mouse
gtcgcggcggcggggcgcga

SEQ ID NO: 787071 - DNA, 20 bp, mouse
gcgtgcagcgagctcgcctc

SEQ ID NO: 787072 - DNA, 20 bp, mouse
ggcccccgctgccggcacct

SEQ ID NO: 787073 - DNA, 20 bp, mouse
gcgctgccggcacctgggga

SEQ ID NO: 787074 - DNA, 20 bp, mouse
gctcaccgacgagctcgcgg

SEQ ID NO: 787075 - DNA, 20 bp, mouse
gagccctgaaggtgtggggg

SEQ ID NO: 787076 - DNA, 20 bp, mouse
ggactagagccgagcagggt

SEQ ID NO: 787077 - DNA, 20 bp, mouse
gctggtgcttggtaagagag

SEQ ID NO: 787078 - DNA, 20 bp, mouse
gagcacacagtaggcaccga

SEQ ID NO: 787079 - DNA, 20 bp, mouse
gctagtccctgcattagggg

SEQ ID NO: 787080 - DNA, 20 bp, mouse
gcgagcagggtaggaagagt

SEQ ID NO: 787081 - DNA, 20 bp, mouse
gggtggggaccaactctgac

SEQ ID NO: 787082 - DNA, 20 bp, mouse
gcagggactagagccgagca

SEQ ID NO: 787083 - DNA, 20 bp, mouse
gcaggggacagagtcttttg

SEQ ID NO: 787084 - DNA, 20 bp, mouse
gctagcatctgagatacaga

SEQ ID NO: 787085 - DNA, 20 bp, mouse
gagaagggagggggccaccg

SEQ ID NO: 787086 - DNA, 20 bp, mouse
gaccccgctggagtggagag

SEQ ID NO: 787087 - DNA, 20 bp, mouse
gtgggagcgcgatgtagggg

SEQ ID NO: 787088 - DNA, 20 bp, mouse
gaggagctaagaagcagggg

SEQ ID NO: 787089 - DNA, 20 bp, mouse
gtaagaagcaggggaggcgt

SEQ ID NO: 787090 - DNA, 20 bp, mouse
gaggcgtgggagcgcgatgt

SEQ ID NO: 787091 - DNA, 20 bp, mouse
ggcggcctgctgctccggaa

SEQ ID NO: 787092 - DNA, 20 bp, mouse
gaggggaggagctaagaagc

SEQ ID NO: 787093 - DNA, 20 bp, mouse
gtgtccactcgctaccccgc

SEQ ID NO: 787094 - DNA, 20 bp, mouse
ggggagatgtgcaccgtggc

SEQ ID NO: 787095 - DNA, 20 bp, mouse
gggtagcgagtggacaggtc

SEQ ID NO: 787096 - DNA, 20 bp, mouse
gcacctaggaggggtgagac

SEQ ID NO: 787097 - DNA, 20 bp, mouse
ggagtctggcaaggcaagga

SEQ ID NO: 787098 - DNA, 20 bp, mouse
gaaggcagagccacctagga

SEQ ID NO: 787099 - DNA, 20 bp, mouse
gctaggaggggtgagacggg

SEQ ID NO: 787100 - DNA, 20 bp, mouse
gacgtcaggaacaaaagccc

SEQ ID NO: 787101 - DNA, 20 bp, mouse
gagagcagagcacggacgtc

SEQ ID NO: 787102 - DNA, 20 bp, mouse
gaagccccggcagtggagtc

SEQ ID NO: 787103 - DNA, 20 bp, mouse
gctgcgccacacccacagga

SEQ ID NO: 787104 - DNA, 20 bp, mouse
gggaacaaaagccccggcag

SEQ ID NO: 787105 - DNA, 20 bp, mouse
gcgctctgcgccacacccac

SEQ ID NO: 787106 - DNA, 20 bp, mouse
gtgaaatgaagggtgctcac

SEQ ID NO: 787107 - DNA, 20 bp, mouse
gtatgctggtctatgaagaa

SEQ ID NO: 787108 - DNA, 20 bp, mouse
ggggtgagaaaacggtccat

SEQ ID NO: 787109 - DNA, 20 bp, mouse
ggcctgcgcactcaccctga

SEQ ID NO: 787110 - DNA, 20 bp, mouse
gagcctggactaagagcctg

SEQ ID NO: 787111 - DNA, 20 bp, mouse
gagcagacagagatcgtcaa

SEQ ID NO: 787112 - DNA, 20 bp, mouse
gaatgagtaacaccttgaat

SEQ ID NO: 787113 - DNA, 20 bp, mouse
ggggataccttgcccattca

SEQ ID NO: 787114 - DNA, 20 bp, mouse
gcgctgagtgacatggccag

SEQ ID NO: 787115 - DNA, 20 bp, mouse
gaagctttagagcagtatgc

SEQ ID NO: 787116 - DNA, 20 bp, mouse
ggccacacagactagagcta

SEQ ID NO: 787117 - DNA, 20 bp, mouse
gccttttagtgcaatgtcta

SEQ ID NO: 787118 - DNA, 20 bp, mouse
ggtacagtctcccctccgtt

SEQ ID NO: 787119 - DNA, 20 bp, mouse
gtataggctaaagtgctctg

SEQ ID NO: 787120 - DNA, 20 bp, mouse
gatttcatggccccaacgga

SEQ ID NO: 787121 - DNA, 20 bp, mouse
ggctgattcacgttaaacaa

SEQ ID NO: 787122 - DNA, 20 bp, mouse
gagagtgtctacttagcata

SEQ ID NO: 787123 - DNA, 20 bp, mouse
gttacagtgctgtatgtttc

SEQ ID NO: 787124 - DNA, 20 bp, mouse
gaccggcttgaattgccttt

SEQ ID NO: 787125 - DNA, 20 bp, mouse
gagtcatttcatggccccaa

SEQ ID NO: 787126 - DNA, 20 bp, mouse
gtgcgccccgcggataactg

SEQ ID NO: 787127 - DNA, 20 bp, mouse
gtcgccgcccggaactcggc

SEQ ID NO: 787128 - DNA, 20 bp, mouse
gccagtcttggacaaggatt

SEQ ID NO: 787129 - DNA, 20 bp, mouse
gactcagccacagttatccg

SEQ ID NO: 787130 - DNA, 20 bp, mouse
gtcaccagttggctcgctgt

SEQ ID NO: 787131 - DNA, 20 bp, mouse
gtgcgggccagtcttggaca

SEQ ID NO: 787132 - DNA, 20 bp, mouse
gggattgggctcagagacca

SEQ ID NO: 787133 - DNA, 20 bp, mouse
gagaccggccgagttccggg

SEQ ID NO: 787134 - DNA, 20 bp, mouse
gaggcatggaggaaggccgg

SEQ ID NO: 787135 - DNA, 20 bp, mouse
ggaagaaagtgttagaaccg

SEQ ID NO: 787136 - DNA, 20 bp, mouse
gcccgggcgtctctaacgca

SEQ ID NO: 787137 - DNA, 20 bp, mouse
gaatccgggcagaacggcct

SEQ ID NO: 787138 - DNA, 20 bp, mouse
ggggcccgggccgcccactc

SEQ ID NO: 787139 - DNA, 20 bp, mouse
gcccgggccgcccactccgg

SEQ ID NO: 787140 - DNA, 20 bp, mouse
gagtgggcggcctccggagt

SEQ ID NO: 787141 - DNA, 20 bp, mouse
gcaacccaggccgttctgcc

SEQ ID NO: 787142 - DNA, 20 bp, mouse
gacgtggatcgcacactggg

SEQ ID NO: 787143 - DNA, 20 bp, mouse
gggaggccgcccactcccca

SEQ ID NO: 787144 - DNA, 20 bp, mouse
gtagccagcaggtgccccga

SEQ ID NO: 787145 - DNA, 20 bp, mouse
gcagggcgggcagaggacgg

SEQ ID NO: 787146 - DNA, 20 bp, mouse
gacagcccacgcaatgggat

SEQ ID NO: 787147 - DNA, 20 bp, mouse
gtcccctcgaaccgggaaag

SEQ ID NO: 787148 - DNA, 20 bp, mouse
gggtcctgagcaacctggtt

SEQ ID NO: 787149 - DNA, 20 bp, mouse
gctgcagtgggcgtgatccg

SEQ ID NO: 787150 - DNA, 20 bp, mouse
gcggctgactcccctcgaac

SEQ ID NO: 787151 - DNA, 20 bp, mouse
gagaagacagcccacgcaat

SEQ ID NO: 787152 - DNA, 20 bp, mouse
gggggagaaatgaggaaact

SEQ ID NO: 787153 - DNA, 20 bp, mouse
gaacctggtttggggtagag

SEQ ID NO: 787154 - DNA, 20 bp, mouse
gttctcggtcccttttggga

SEQ ID NO: 787155 - DNA, 20 bp, mouse
gtgacttctcggtccctttt

SEQ ID NO: 787156 - DNA, 20 bp, mouse
gcaaccagcaagagagtgtg

SEQ ID NO: 787157 - DNA, 20 bp, mouse
gggctagagcggctggtgga

SEQ ID NO: 787158 - DNA, 20 bp, mouse
gggcgggcggcccaggccga

SEQ ID NO: 787159 - DNA, 20 bp, mouse
gacagttggcgcgacccgga

SEQ ID NO: 787160 - DNA, 20 bp, mouse
ggggcgggcgggcgcctcgt

SEQ ID NO: 787161 - DNA, 20 bp, mouse
ggaagtcctgcccttgatac

SEQ ID NO: 787162 - DNA, 20 bp, mouse
ggctctgtgttgtcatgtga

SEQ ID NO: 787163 - DNA, 20 bp, mouse
ggactgggacggaggaggtt

SEQ ID NO: 787164 - DNA, 20 bp, mouse
gtgctggttggaggctagga

SEQ ID NO: 787165 - DNA, 20 bp, mouse
gaagggcaggacttccgggg

SEQ ID NO: 787166 - DNA, 20 bp, mouse
gaagacagatcgggtctcta

SEQ ID NO: 787167 - DNA, 20 bp, mouse
gtggggtgctcagaacaaag

SEQ ID NO: 787168 - DNA, 20 bp, mouse
ggagaagttaagtcagtttg

SEQ ID NO: 787169 - DNA, 20 bp, mouse
gccctctctaggagcaagca

SEQ ID NO: 787170 - DNA, 20 bp, mouse
gaccctgcttgctcctagag

SEQ ID NO: 787171 - DNA, 20 bp, mouse
gacccgatctgtcttgacgt

SEQ ID NO: 787172 - DNA, 20 bp, mouse
gtgactgagggaccctctct

SEQ ID NO: 787173 - DNA, 20 bp, mouse
gccccacgtcaagacagatc

SEQ ID NO: 787174 - DNA, 20 bp, mouse
gagctgagaactttcacctc

SEQ ID NO: 787175 - DNA, 20 bp, mouse
gactgacttaacttctccag

SEQ ID NO: 787176 - DNA, 20 bp, mouse
gcggaggcgagctcatagtc

SEQ ID NO: 787177 - DNA, 20 bp, mouse
gcgagaacccgcgcaggcga

SEQ ID NO: 787178 - DNA, 20 bp, mouse
gcggccgagcgggagcccgc

SEQ ID NO: 787179 - DNA, 20 bp, mouse
gcccgcgcaggcgagggcta

SEQ ID NO: 787180 - DNA, 20 bp, mouse
gggagagaggcgcgcgcaga

SEQ ID NO: 787181 - DNA, 20 bp, mouse
gattgcgggcaagactcggg

SEQ ID NO: 787182 - DNA, 20 bp, mouse
gtgccggcgagaacccgcgc

SEQ ID NO: 787183 - DNA, 20 bp, mouse
gctagggctagggcagggcg

SEQ ID NO: 787184 - DNA, 20 bp, mouse
gcacttcaccagccgctcgg

SEQ ID NO: 787185 - DNA, 20 bp, mouse
gcgcgattgcgggcaagact

SEQ ID NO: 787186 - DNA, 20 bp, mouse
gaatgagcgcgcttccccaa

SEQ ID NO: 787187 - DNA, 20 bp, mouse
ggggcgggctggcacgtgtt

SEQ ID NO: 787188 - DNA, 20 bp, mouse
gggggaagcgcgctcattgg

SEQ ID NO: 787189 - DNA, 20 bp, mouse
ggaaaagaaatggggatagt

SEQ ID NO: 787190 - DNA, 20 bp, mouse
gctctagagcagtcaggtaa

SEQ ID NO: 787191 - DNA, 20 bp, mouse
gcagccaggagctaaactag

SEQ ID NO: 787192 - DNA, 20 bp, mouse
gcaaccgctagtttagctcc

SEQ ID NO: 787193 - DNA, 20 bp, mouse
gcaagctagcaaagagccct

SEQ ID NO: 787194 - DNA, 20 bp, mouse
gggtgtgccacgcccccttg

SEQ ID NO: 787195 - DNA, 20 bp, mouse
gggcgtggcacacccggagt

SEQ ID NO: 787196 - DNA, 20 bp, mouse
gcgggtttcctgtttctggt

SEQ ID NO: 787197 - DNA, 20 bp, mouse
gccagaggggagtgtccctg

SEQ ID NO: 787198 - DNA, 20 bp, mouse
ggctggccccaggatcacaa

SEQ ID NO: 787199 - DNA, 20 bp, mouse
gagtgtccctgcgggaaagg

SEQ ID NO: 787200 - DNA, 20 bp, mouse
gaacctgggtatagcgatgg

SEQ ID NO: 787201 - DNA, 20 bp, mouse
gccctcagcccaccagaaac

SEQ ID NO: 787202 - DNA, 20 bp, mouse
gaacccgggtttcctgtttc

SEQ ID NO: 787203 - DNA, 20 bp, mouse
gtagaacctgggtatagcga

SEQ ID NO: 787204 - DNA, 20 bp, mouse
gtacccaggttctactgctg

SEQ ID NO: 787205 - DNA, 20 bp, mouse
gtatccccatggccacccag

SEQ ID NO: 787206 - DNA, 20 bp, mouse
gccgactcgggaaccagagg

SEQ ID NO: 787207 - DNA, 20 bp, mouse
gaggaagggcctcactccgg

SEQ ID NO: 787208 - DNA, 20 bp, mouse
gaagtggcccggggcgaagg

SEQ ID NO: 787209 - DNA, 20 bp, mouse
ggcctggcgcgccccttcgc

SEQ ID NO: 787210 - DNA, 20 bp, mouse
gcccgcccgtggggcatcct

SEQ ID NO: 787211 - DNA, 20 bp, mouse
gtacggggcaggtcgcctgc

SEQ ID NO: 787212 - DNA, 20 bp, mouse
gaggcagcgcgtccagctac

SEQ ID NO: 787213 - DNA, 20 bp, mouse
gggaaccagaggcggctgac

SEQ ID NO: 787214 - DNA, 20 bp, mouse
gtctggttcccgagtcggca

SEQ ID NO: 787215 - DNA, 20 bp, mouse
gaggcgacctgccccgtagc

SEQ ID NO: 787216 - DNA, 20 bp, mouse
ggggactcctaggatttgtg

SEQ ID NO: 787217 - DNA, 20 bp, mouse
gggtcaggacttttacatat

SEQ ID NO: 787218 - DNA, 20 bp, mouse
gtccatcattaggaaagcat

SEQ ID NO: 787219 - DNA, 20 bp, mouse
gctgggccacatgccagtgt

SEQ ID NO: 787220 - DNA, 20 bp, mouse
ggcatgtggcccagccagtc

SEQ ID NO: 787221 - DNA, 20 bp, mouse
gcaacaaagacagggtgggt

SEQ ID NO: 787222 - DNA, 20 bp, mouse
ggggacaacaaagacagggt

SEQ ID NO: 787223 - DNA, 20 bp, mouse
gtggcgagcactcacctgac

SEQ ID NO: 787224 - DNA, 20 bp, mouse
gacatccttttcccctctct

SEQ ID NO: 787225 - DNA, 20 bp, mouse
gtcaagaacaattcctaagc

SEQ ID NO: 787226 - DNA, 20 bp, mouse
ggccctgcgggcaggaagtc

SEQ ID NO: 787227 - DNA, 20 bp, mouse
gaccgcgggccgtgcggggt

SEQ ID NO: 787228 - DNA, 20 bp, mouse
ggcacctggcgtgggaaggt

SEQ ID NO: 787229 - DNA, 20 bp, mouse
gcggggtagggttggcacac

SEQ ID NO: 787230 - DNA, 20 bp, mouse
gtgggcgcgggcggcgtcgg

SEQ ID NO: 787231 - DNA, 20 bp, mouse
gcacactgggcacctggcgt

SEQ ID NO: 787232 - DNA, 20 bp, mouse
gcggagcagaagtcccgacc

SEQ ID NO: 787233 - DNA, 20 bp, mouse
gaactatagacagaggtcca

SEQ ID NO: 787234 - DNA, 20 bp, mouse
gagcctcccgccctgcgggc

SEQ ID NO: 787235 - DNA, 20 bp, mouse
ggcaggaagtctggcccggt

SEQ ID NO: 787236 - DNA, 20 bp, mouse
ggcgtggcgggcaaaggaat

SEQ ID NO: 787237 - DNA, 20 bp, mouse
gaggctccgcgcacgcccgg

SEQ ID NO: 787238 - DNA, 20 bp, mouse
gcggccgcgagccaccaccc

SEQ ID NO: 787239 - DNA, 20 bp, mouse
ggggcgtcttcctagttcca

SEQ ID NO: 787240 - DNA, 20 bp, mouse
gcaagccccaggatgcagcg

SEQ ID NO: 787241 - DNA, 20 bp, mouse
gcatgccgcgctgcatcctg

SEQ ID NO: 787242 - DNA, 20 bp, mouse
ggaacactacaagtcccgac

SEQ ID NO: 787243 - DNA, 20 bp, mouse
gcgtcttcctagttccaggg

SEQ ID NO: 787244 - DNA, 20 bp, mouse
gccggcggcgtggcgggcaa

SEQ ID NO: 787245 - DNA, 20 bp, mouse
gtgcgcgggcgggccgtcgt

SEQ ID NO: 787246 - DNA, 20 bp, mouse
gcgaccggaggtggcccaat

SEQ ID NO: 787247 - DNA, 20 bp, mouse
gctaggggaggtggcccatt

SEQ ID NO: 787248 - DNA, 20 bp, mouse
ggcgcagagcgcggtgagtc

SEQ ID NO: 787249 - DNA, 20 bp, mouse
gcagagaggcgcaagggtcc

SEQ ID NO: 787250 - DNA, 20 bp, mouse
gaggcgcaagggtccgggcg

SEQ ID NO: 787251 - DNA, 20 bp, mouse
gtgcgcagcaagggtcgcat

SEQ ID NO: 787252 - DNA, 20 bp, mouse
gccccgaggcgcagagctct

SEQ ID NO: 787253 - DNA, 20 bp, mouse
ggcaagggtccgggcgcgga

SEQ ID NO: 787254 - DNA, 20 bp, mouse
ggtcgccaccgccaggggtc

SEQ ID NO: 787255 - DNA, 20 bp, mouse
gaggggtgcggagacctcga

SEQ ID NO: 787256 - DNA, 20 bp, mouse
gccctcgtggggcggctccg

SEQ ID NO: 787257 - DNA, 20 bp, mouse
gctgcgccgcgcgccctcgt

SEQ ID NO: 787258 - DNA, 20 bp, mouse
gtgcaggatgccccgggagt

SEQ ID NO: 787259 - DNA, 20 bp, mouse
gtccgcggtcccccgctccc

SEQ ID NO: 787260 - DNA, 20 bp, mouse
gcgcagcagaccaactcccg

SEQ ID NO: 787261 - DNA, 20 bp, mouse
ggactggagatgtccggatg

SEQ ID NO: 787262 - DNA, 20 bp, mouse
ggccgcgcgccctcgtgggg

SEQ ID NO: 787263 - DNA, 20 bp, mouse
gtccccggctgccccgcatc

SEQ ID NO: 787264 - DNA, 20 bp, mouse
ggctgcggactggagatgtc

SEQ ID NO: 787265 - DNA, 20 bp, mouse
gcggggcatcctgcacaagg

SEQ ID NO: 787266 - DNA, 20 bp, mouse
gactcctctatgtttggaga

SEQ ID NO: 787267 - DNA, 20 bp, mouse
gcaggggtcaagttgtagtg

SEQ ID NO: 787268 - DNA, 20 bp, mouse
gagtcccagccacagcttag

SEQ ID NO: 787269 - DNA, 20 bp, mouse
gtgcaaccccagggcagaat

SEQ ID NO: 787270 - DNA, 20 bp, mouse
ggagaggggctgcaacccca

SEQ ID NO: 787271 - DNA, 20 bp, mouse
gattgggctcccctaagctg

SEQ ID NO: 787272 - DNA, 20 bp, mouse
gggcggggatagccaggatt

SEQ ID NO: 787273 - DNA, 20 bp, mouse
ggctcccctaagctgtggct

SEQ ID NO: 787274 - DNA, 20 bp, mouse
gcacctctctcgaaggtacc

SEQ ID NO: 787275 - DNA, 20 bp, mouse
ggggatagccaggattggga

SEQ ID NO: 787276 - DNA, 20 bp, mouse
ggggctgcacgtcaccccgg

SEQ ID NO: 787277 - DNA, 20 bp, mouse
gaaagccgcgtggacgatgt

SEQ ID NO: 787278 - DNA, 20 bp, mouse
gcggggacgcaatgtttcac

SEQ ID NO: 787279 - DNA, 20 bp, mouse
gcgaccccgcatccctttgc

SEQ ID NO: 787280 - DNA, 20 bp, mouse
gtgcgccaacatcgtccacg

SEQ ID NO: 787281 - DNA, 20 bp, mouse
ggcagcccgccggtgagtgg

SEQ ID NO: 787282 - DNA, 20 bp, mouse
gccggccggcaaagggatgc

SEQ ID NO: 787283 - DNA, 20 bp, mouse
gaaagggatgcggggtcgcg

SEQ ID NO: 787284 - DNA, 20 bp, mouse
gtcagggtataaaagccgcg

SEQ ID NO: 787285 - DNA, 20 bp, mouse
gaggctgtcccggccggcaa

SEQ ID NO: 787286 - DNA, 20 bp, mouse
gccgccgccccggctgagtc

SEQ ID NO: 787287 - DNA, 20 bp, mouse
gggccgcggaggatgccgag

SEQ ID NO: 787288 - DNA, 20 bp, mouse
gcgcccctcggcatcctccg

SEQ ID NO: 787289 - DNA, 20 bp, mouse
gaggccggactcagccgggg

SEQ ID NO: 787290 - DNA, 20 bp, mouse
gggcgcccgcccggagggct

SEQ ID NO: 787291 - DNA, 20 bp, mouse
ggccgccctaccccctcggg

SEQ ID NO: 787292 - DNA, 20 bp, mouse
gcgccggcgggacccgaccc

SEQ ID NO: 787293 - DNA, 20 bp, mouse
ggcgccgcgcgaaggttccg

SEQ ID NO: 787294 - DNA, 20 bp, mouse
ggaggggcggcgacgcaggc

SEQ ID NO: 787295 - DNA, 20 bp, mouse
ggacgcaggccggactcagc

SEQ ID NO: 787296 - DNA, 20 bp, mouse
gagggccgggagtcccaccc

SEQ ID NO: 787297 - DNA, 20 bp, mouse
ggggacctgctgggtattaa

SEQ ID NO: 787298 - DNA, 20 bp, mouse
gggagcacgcctacaacctg

SEQ ID NO: 787299 - DNA, 20 bp, mouse
gcggccctcactctcctccg

SEQ ID NO: 787300 - DNA, 20 bp, mouse
gaagagttgtcacttgctca

SEQ ID NO: 787301 - DNA, 20 bp, mouse
gaacctgaggcgcttaactc

SEQ ID NO: 787302 - DNA, 20 bp, mouse
gaatgctgctgcctccccgg

SEQ ID NO: 787303 - DNA, 20 bp, mouse
ggcctccccggaggagagtg

SEQ ID NO: 787304 - DNA, 20 bp, mouse
gccaggcctcctcacctaat

SEQ ID NO: 787305 - DNA, 20 bp, mouse
gttgctcagggttagtcaaa

SEQ ID NO: 787306 - DNA, 20 bp, mouse
gtggaacaaggagttgggta

SEQ ID NO: 787307 - DNA, 20 bp, mouse
gagctggagtaactaggagt

SEQ ID NO: 787308 - DNA, 20 bp, mouse
gacaagatctgaggagggat

SEQ ID NO: 787309 - DNA, 20 bp, mouse
gcaccacaggggaacccagt

SEQ ID NO: 787310 - DNA, 20 bp, mouse
ggtaactaggagttggaaca

SEQ ID NO: 787311 - DNA, 20 bp, mouse
ggagttgggtagggataggg

SEQ ID NO: 787312 - DNA, 20 bp, mouse
ggatagggagaagggtgcat

SEQ ID NO: 787313 - DNA, 20 bp, mouse
gagtgggagggacgagaaac

SEQ ID NO: 787314 - DNA, 20 bp, mouse
gagttgttggacagagtgag

SEQ ID NO: 787315 - DNA, 20 bp, mouse
gaggggcggggcgaggagat

SEQ ID NO: 787316 - DNA, 20 bp, mouse
ggcgcggaggggctgaccgg

SEQ ID NO: 787317 - DNA, 20 bp, mouse
gcgggtggcaggtcacccat

SEQ ID NO: 787318 - DNA, 20 bp, mouse
gctgccacccgcgtgcgcat

SEQ ID NO: 787319 - DNA, 20 bp, mouse
gcctggagcctagaccccca

SEQ ID NO: 787320 - DNA, 20 bp, mouse
gggctgagacccggaatcct

SEQ ID NO: 787321 - DNA, 20 bp, mouse
gccgcgcagtggccaaaccc

SEQ ID NO: 787322 - DNA, 20 bp, mouse
ggctccgatgcgcacgcggg

SEQ ID NO: 787323 - DNA, 20 bp, mouse
gactgcgcggaggggctgac

SEQ ID NO: 787324 - DNA, 20 bp, mouse
gcagtggccaaaccctggcg

SEQ ID NO: 787325 - DNA, 20 bp, mouse
gtgactggaagcttggtctc

SEQ ID NO: 787326 - DNA, 20 bp, mouse
ggcagccacccaataggaca

SEQ ID NO: 787327 - DNA, 20 bp, mouse
gacccaataggacagggagt

SEQ ID NO: 787328 - DNA, 20 bp, mouse
ggccagaggagcatggaaca

SEQ ID NO: 787329 - DNA, 20 bp, mouse
gtgctcctctggcctgaatg

SEQ ID NO: 787330 - DNA, 20 bp, mouse
gcagcaggcagccacccaat

SEQ ID NO: 787331 - DNA, 20 bp, mouse
ggcaggtaaaggccagaatg

SEQ ID NO: 787332 - DNA, 20 bp, mouse
ggctgcctgctgaccctact

SEQ ID NO: 787333 - DNA, 20 bp, mouse
gcacccactccctgtcctat

SEQ ID NO: 787334 - DNA, 20 bp, mouse
ggacaagggcagcaagcgaa

SEQ ID NO: 787335 - DNA, 20 bp, mouse
gcagggccttgccaaggttc

SEQ ID NO: 787336 - DNA, 20 bp, mouse
gctgcccagcagatcatttg

SEQ ID NO: 787337 - DNA, 20 bp, mouse
gccctccctgggagtgagtt

SEQ ID NO: 787338 - DNA, 20 bp, mouse
gaggacagccctggaaatat

SEQ ID NO: 787339 - DNA, 20 bp, mouse
gtaggcagatctaaaaagag

SEQ ID NO: 787340 - DNA, 20 bp, mouse
ggtagtctgcagttctacac

SEQ ID NO: 787341 - DNA, 20 bp, mouse
gcagacccaactcactccca

SEQ ID NO: 787342 - DNA, 20 bp, mouse
gcagcacaggattgttattc

SEQ ID NO: 787343 - DNA, 20 bp, mouse
gacccaactcactcccaggg

SEQ ID NO: 787344 - DNA, 20 bp, mouse
gtaaagtggtgcacaagggg

SEQ ID NO: 787345 - DNA, 20 bp, mouse
gaaagccaggatggcagtcc

SEQ ID NO: 787346 - DNA, 20 bp, mouse
gtgggctgttatctgctcaa

SEQ ID NO: 787347 - DNA, 20 bp, mouse
gccaagggcaaactgaacct

SEQ ID NO: 787348 - DNA, 20 bp, mouse
gaaaagcgtgacagcgggaa

SEQ ID NO: 787349 - DNA, 20 bp, mouse
gaaggcgttgctctcaacct

SEQ ID NO: 787350 - DNA, 20 bp, mouse
gcaggtgccacccgggtgca

SEQ ID NO: 787351 - DNA, 20 bp, mouse
gcgcaaggcaggtgccaccc

SEQ ID NO: 787352 - DNA, 20 bp, mouse
gtagagaaaagcgtgacagc

SEQ ID NO: 787353 - DNA, 20 bp, mouse
ggtactggggaggcttagtc

SEQ ID NO: 787354 - DNA, 20 bp, mouse
gcgcgcatgcgcatggctcg

SEQ ID NO: 787355 - DNA, 20 bp, mouse
ggggtgcagggccgaagcca

SEQ ID NO: 787356 - DNA, 20 bp, mouse
gagcgagcgccaatcagggt

SEQ ID NO: 787357 - DNA, 20 bp, mouse
gcggcagcgagcgccaatca

SEQ ID NO: 787358 - DNA, 20 bp, mouse
ggaggctgcaggcacgggag

SEQ ID NO: 787359 - DNA, 20 bp, mouse
gggtgtagtggccaaatccc

SEQ ID NO: 787360 - DNA, 20 bp, mouse
gtgccactcccagccaatcc

SEQ ID NO: 787361 - DNA, 20 bp, mouse
gagtaggcgccaaccctgat

SEQ ID NO: 787362 - DNA, 20 bp, mouse
ggcaggtgagcggctcaggc

SEQ ID NO: 787363 - DNA, 20 bp, mouse
ggagtctgcagggtcctggt

SEQ ID NO: 787364 - DNA, 20 bp, mouse
ggtgcctgcagcctcaattc

SEQ ID NO: 787365 - DNA, 20 bp, mouse
ggggagggcagctccgccgc

SEQ ID NO: 787366 - DNA, 20 bp, mouse
gaaaccgctggaccgtaaac

SEQ ID NO: 787367 - DNA, 20 bp, mouse
ggggacgatgggctgattcc

SEQ ID NO: 787368 - DNA, 20 bp, mouse
gagccctggcacgcaggcgg

SEQ ID NO: 787369 - DNA, 20 bp, mouse
gggtcagcagcggttgtgcg

SEQ ID NO: 787370 - DNA, 20 bp, mouse
gcctgcgccgcccacgcctc

SEQ ID NO: 787371 - DNA, 20 bp, mouse
gtgcgtgccagggcttcgat

SEQ ID NO: 787372 - DNA, 20 bp, mouse
gcgcccccgcctgcgtgcca

SEQ ID NO: 787373 - DNA, 20 bp, mouse
gggttgtgcgtggggacgat

SEQ ID NO: 787374 - DNA, 20 bp, mouse
gaccgtaaacgggtcagcag

SEQ ID NO: 787375 - DNA, 20 bp, mouse
gtggtccagagtccctcgaa

SEQ ID NO: 787376 - DNA, 20 bp, mouse
ggccccccgtgcggtcgcgt

SEQ ID NO: 787377 - DNA, 20 bp, mouse
gcggtcgcgtggggatggag

SEQ ID NO: 787378 - DNA, 20 bp, mouse
ggaagagcccgccccccgtg

SEQ ID NO: 787379 - DNA, 20 bp, mouse
gcggggggcgggctcttcag

SEQ ID NO: 787380 - DNA, 20 bp, mouse
gaaggcgatgggcggggcga

SEQ ID NO: 787381 - DNA, 20 bp, mouse
gggaacgcgcgcctctgcag

SEQ ID NO: 787382 - DNA, 20 bp, mouse
gaggggcggggcaaggcgat

SEQ ID NO: 787383 - DNA, 20 bp, mouse
gggggcgggctcttcagcgg

SEQ ID NO: 787384 - DNA, 20 bp, mouse
ggcggggcaaggcgatgggc

SEQ ID NO: 787385 - DNA, 20 bp, mouse
gcatccccacgcgaccgcac

SEQ ID NO: 787386 - DNA, 20 bp, mouse
ggggccctgcgggaggaaag

SEQ ID NO: 787387 - DNA, 20 bp, mouse
gctcccgcagggccccgtgg

SEQ ID NO: 787388 - DNA, 20 bp, mouse
ggacacgccgggagcagagt

SEQ ID NO: 787389 - DNA, 20 bp, mouse
gggaccgcaacccgctgcag

SEQ ID NO: 787390 - DNA, 20 bp, mouse
gccgcctccacggggccctg

SEQ ID NO: 787391 - DNA, 20 bp, mouse
gctccgccgagactattcca

SEQ ID NO: 787392 - DNA, 20 bp, mouse
gcggtccccgcccgcctcca

SEQ ID NO: 787393 - DNA, 20 bp, mouse
gggcgcgtggccgaggtccc

SEQ ID NO: 787394 - DNA, 20 bp, mouse
gaggggcggctcccgagcgc

SEQ ID NO: 787395 - DNA, 20 bp, mouse
ggctcctcggtccgctgcag

SEQ ID NO: 787396 - DNA, 20 bp, mouse
gccccccagcaggcgggaac

SEQ ID NO: 787397 - DNA, 20 bp, mouse
gccggcacgccctcccgtaa

SEQ ID NO: 787398 - DNA, 20 bp, mouse
gcatctggggcggggagagt

SEQ ID NO: 787399 - DNA, 20 bp, mouse
ggcaacgccgcatctggggc

SEQ ID NO: 787400 - DNA, 20 bp, mouse
gagagtcgggtcccagatgt

SEQ ID NO: 787401 - DNA, 20 bp, mouse
ggggaacaggatgtgagccg

SEQ ID NO: 787402 - DNA, 20 bp, mouse
gtgcaattattcagagtagg

SEQ ID NO: 787403 - DNA, 20 bp, mouse
gtaggctcttggaatgtggg

SEQ ID NO: 787404 - DNA, 20 bp, mouse
gcccaggaggcgtgagaatc

SEQ ID NO: 787405 - DNA, 20 bp, mouse
gtgcaagcaagcggttccaa

SEQ ID NO: 787406 - DNA, 20 bp, mouse
ggctgcgatccagcaattgg

SEQ ID NO: 787407 - DNA, 20 bp, mouse
gctcgctcgcaccgccgcga

SEQ ID NO: 787408 - DNA, 20 bp, mouse
gccgccgcgaaggttccccc

SEQ ID NO: 787409 - DNA, 20 bp, mouse
ggaccaggaatgtttccagt

SEQ ID NO: 787410 - DNA, 20 bp, mouse
ggcggccagcgggacccaca

SEQ ID NO: 787411 - DNA, 20 bp, mouse
gagccagggaggggcggacc

SEQ ID NO: 787412 - DNA, 20 bp, mouse
gtggctcccgctgtagacag

SEQ ID NO: 787413 - DNA, 20 bp, mouse
gtgggtggagactgcgctcg

SEQ ID NO: 787414 - DNA, 20 bp, mouse
gatcccaaggcgcacgtggt

SEQ ID NO: 787415 - DNA, 20 bp, mouse
gccccagagccgccaattgc

SEQ ID NO: 787416 - DNA, 20 bp, mouse
gggcacgcgtgctgagacag

SEQ ID NO: 787417 - DNA, 20 bp, mouse
gagagggcctgggtcagtta

SEQ ID NO: 787418 - DNA, 20 bp, mouse
ggaacacagcaggcggttgg

SEQ ID NO: 787419 - DNA, 20 bp, mouse
gagaagatggacttcccggg

SEQ ID NO: 787420 - DNA, 20 bp, mouse
gtgggggcctggctagtggg

SEQ ID NO: 787421 - DNA, 20 bp, mouse
gtggcctgggacaagaacca

SEQ ID NO: 787422 - DNA, 20 bp, mouse
ggaggaacataacccttccc

SEQ ID NO: 787423 - DNA, 20 bp, mouse
gcagggatgaagcaaataag

SEQ ID NO: 787424 - DNA, 20 bp, mouse
gaccgcctgctgtgttcaga

SEQ ID NO: 787425 - DNA, 20 bp, mouse
ggggaagagttcaggacggg

SEQ ID NO: 787426 - DNA, 20 bp, mouse
gtggacgcggcgctctctag

SEQ ID NO: 787427 - DNA, 20 bp, mouse
gggcgcggatgctctaggca

SEQ ID NO: 787428 - DNA, 20 bp, mouse
gagggctcgccaagtctccg

SEQ ID NO: 787429 - DNA, 20 bp, mouse
gcgccgctctgcaaggccga

SEQ ID NO: 787430 - DNA, 20 bp, mouse
gtgcaaggccgagggtgcgg

SEQ ID NO: 787431 - DNA, 20 bp, mouse
gctctgcaaggccgagggtg

SEQ ID NO: 787432 - DNA, 20 bp, mouse
gcggcagaatgagaagtcaa

SEQ ID NO: 787433 - DNA, 20 bp, mouse
gggctggaggaccgaatcac

SEQ ID NO: 787434 - DNA, 20 bp, mouse
gagagtaggaacccagcggc

SEQ ID NO: 787435 - DNA, 20 bp, mouse
gtaggaacccagcggccggc

SEQ ID NO: 787436 - DNA, 20 bp, mouse
gcgcgcgtggccatccccgg

SEQ ID NO: 787437 - DNA, 20 bp, mouse
ggggcgctgcacagaacgga

SEQ ID NO: 787438 - DNA, 20 bp, mouse
ggctgcgccccggttccagg

SEQ ID NO: 787439 - DNA, 20 bp, mouse
ggcaggagaccgcctggaac

SEQ ID NO: 787440 - DNA, 20 bp, mouse
ggggagacggggcgtgtccc

SEQ ID NO: 787441 - DNA, 20 bp, mouse
ggctgccacccgcggatcca

SEQ ID NO: 787442 - DNA, 20 bp, mouse
gcggcgcgcgtggccatccc

SEQ ID NO: 787443 - DNA, 20 bp, mouse
gccggccggaagtgcctcca

SEQ ID NO: 787444 - DNA, 20 bp, mouse
gacggcgcctccgcgggaga

SEQ ID NO: 787445 - DNA, 20 bp, mouse
gcctcccgcacccagacacg

SEQ ID NO: 787446 - DNA, 20 bp, mouse
gcacccggacagagagggta

SEQ ID NO: 787447 - DNA, 20 bp, mouse
gctggtcacccggacagaga

SEQ ID NO: 787448 - DNA, 20 bp, mouse
gaccaggagtgctcacttct

SEQ ID NO: 787449 - DNA, 20 bp, mouse
gctggtctggggttggtgta

SEQ ID NO: 787450 - DNA, 20 bp, mouse
gccaggcgccagggtaatga

SEQ ID NO: 787451 - DNA, 20 bp, mouse
gagttcaggtgcaaaagaaa

SEQ ID NO: 787452 - DNA, 20 bp, mouse
gtgtcacctggtcggggcca

SEQ ID NO: 787453 - DNA, 20 bp, mouse
gggttggtgtacggagagtc

SEQ ID NO: 787454 - DNA, 20 bp, mouse
ggcaggggtctggccgggaa

SEQ ID NO: 787455 - DNA, 20 bp, mouse
gggaagggaggacacgctgg

SEQ ID NO: 787456 - DNA, 20 bp, mouse
gacagcgtgggatccccggc

SEQ ID NO: 787457 - DNA, 20 bp, mouse
gtgcgacccccagacagcgt

SEQ ID NO: 787458 - DNA, 20 bp, mouse
gtggaccctccctccgcgga

SEQ ID NO: 787459 - DNA, 20 bp, mouse
gtcgctgggacctccttccg

SEQ ID NO: 787460 - DNA, 20 bp, mouse
gggggatcccacgctgtctg

SEQ ID NO: 787461 - DNA, 20 bp, mouse
gctgggacctccttccgcgg

SEQ ID NO: 787462 - DNA, 20 bp, mouse
gtctggtgagcatcccgccg

SEQ ID NO: 787463 - DNA, 20 bp, mouse
gacctccttccgcggaggga

SEQ ID NO: 787464 - DNA, 20 bp, mouse
ggacagccagggagccagaa

SEQ ID NO: 787465 - DNA, 20 bp, mouse
ggcagctcgcggccaggcac

SEQ ID NO: 787466 - DNA, 20 bp, mouse
gtactccgaggggcaccggg

SEQ ID NO: 787467 - DNA, 20 bp, mouse
ggggaatacctcttgggtca

SEQ ID NO: 787468 - DNA, 20 bp, mouse
ggccgaccacctggcgtcac

SEQ ID NO: 787469 - DNA, 20 bp, mouse
gggcggccggagtagctaat

SEQ ID NO: 787470 - DNA, 20 bp, mouse
gcacctggcgtcactggagg

SEQ ID NO: 787471 - DNA, 20 bp, mouse
gtaaagagccctgacccaag

SEQ ID NO: 787472 - DNA, 20 bp, mouse
gggacagcgccgcctcctgc

SEQ ID NO: 787473 - DNA, 20 bp, mouse
gaggcagtgggaatacctct

SEQ ID NO: 787474 - DNA, 20 bp, mouse
ggaccacctggcgtcactgg

SEQ ID NO: 787475 - DNA, 20 bp, mouse
ggggcagtctggagactcac

SEQ ID NO: 787476 - DNA, 20 bp, mouse
ggggttgcatcatgtgtctc

SEQ ID NO: 787477 - DNA, 20 bp, mouse
gcccaagcttgaaaccgcgg

SEQ ID NO: 787478 - DNA, 20 bp, mouse
gggcgccaggaacaatgatt

SEQ ID NO: 787479 - DNA, 20 bp, mouse
gtggctgagtgacagtaggg

SEQ ID NO: 787480 - DNA, 20 bp, mouse
ggcggtttcaagcttgggat

SEQ ID NO: 787481 - DNA, 20 bp, mouse
ggtcggacacggggtgtctg

SEQ ID NO: 787482 - DNA, 20 bp, mouse
gctctggctgagtgacagta

SEQ ID NO: 787483 - DNA, 20 bp, mouse
gtctgcccaatcattgttcc

SEQ ID NO: 787484 - DNA, 20 bp, mouse
gggtgtctgtggcgtcacgt

SEQ ID NO: 787485 - DNA, 20 bp, mouse
gcctaccctgtgaagaaggg

SEQ ID NO: 787486 - DNA, 20 bp, mouse
gcggttgaacagagtcagac

SEQ ID NO: 787487 - DNA, 20 bp, mouse
ggggagagaaaggagcgtcg

SEQ ID NO: 787488 - DNA, 20 bp, mouse
gtgaacagagtcagacggga

SEQ ID NO: 787489 - DNA, 20 bp, mouse
gagggcggagcgaaactgtg

SEQ ID NO: 787490 - DNA, 20 bp, mouse
gcgtcggggaggcttgaagg

SEQ ID NO: 787491 - DNA, 20 bp, mouse
gcgggcgcgcgccgatcctg

SEQ ID NO: 787492 - DNA, 20 bp, mouse
ggccggcgccgctagactta

SEQ ID NO: 787493 - DNA, 20 bp, mouse
gggcgccgctagacttaggg

SEQ ID NO: 787494 - DNA, 20 bp, mouse
gggaaagcgttagggttcac

SEQ ID NO: 787495 - DNA, 20 bp, mouse
gtgacaagaggaaagcgtta

SEQ ID NO: 787496 - DNA, 20 bp, mouse
gactgggcctagaggagccg

SEQ ID NO: 787497 - DNA, 20 bp, mouse
gcctgccgctctcgctactc

SEQ ID NO: 787498 - DNA, 20 bp, mouse
gagagccagagtagcgagag

SEQ ID NO: 787499 - DNA, 20 bp, mouse
ggcgtctgacgccatcacgt

SEQ ID NO: 787500 - DNA, 20 bp, mouse
ggccctgcaatccggggcaa

SEQ ID NO: 787501 - DNA, 20 bp, mouse
ggtcagctcttcccttgccc

SEQ ID NO: 787502 - DNA, 20 bp, mouse
gctgggtagcgcagagaggc

SEQ ID NO: 787503 - DNA, 20 bp, mouse
gttgcagggcttcttggctc

SEQ ID NO: 787504 - DNA, 20 bp, mouse
gagaagtcccgaagctccaa

SEQ ID NO: 787505 - DNA, 20 bp, mouse
ggcctagaggagccgagggg

SEQ ID NO: 787506 - DNA, 20 bp, mouse
gacccggggcgatggagacc

SEQ ID NO: 787507 - DNA, 20 bp, mouse
gcctccgagacccggggcga

SEQ ID NO: 787508 - DNA, 20 bp, mouse
gcgggctgtgtgagtcccct

SEQ ID NO: 787509 - DNA, 20 bp, mouse
gtggtcgccgccgtccctcc

SEQ ID NO: 787510 - DNA, 20 bp, mouse
gtctccatcgccccgggtct

SEQ ID NO: 787511 - DNA, 20 bp, mouse
gagagagggagcaatatcta

SEQ ID NO: 787512 - DNA, 20 bp, mouse
ggcgccagcaccggccggga

SEQ ID NO: 787513 - DNA, 20 bp, mouse
gtccggatctctgagctccc

SEQ ID NO: 787514 - DNA, 20 bp, mouse
gttacagggaagggaagtgt

SEQ ID NO: 787515 - DNA, 20 bp, mouse
gtcctgggtctatgcgatcc

SEQ ID NO: 787516 - DNA, 20 bp, mouse
ggaggctctgcggaaggcgt

SEQ ID NO: 787517 - DNA, 20 bp, mouse
ggcaaccaggtgcctcactg

SEQ ID NO: 787518 - DNA, 20 bp, mouse
gaggaccagagctccccaca

SEQ ID NO: 787519 - DNA, 20 bp, mouse
gagtagaaccgctcccctgt

SEQ ID NO: 787520 - DNA, 20 bp, mouse
gttgtagtgtccagtggcag

SEQ ID NO: 787521 - DNA, 20 bp, mouse
gagagctccccacaggggag

SEQ ID NO: 787522 - DNA, 20 bp, mouse
gacaagtcttgcaacctgtg

SEQ ID NO: 787523 - DNA, 20 bp, mouse
gtcctgccagggtcggcctg

SEQ ID NO: 787524 - DNA, 20 bp, mouse
gcgggtcactgaggaagtga

SEQ ID NO: 787525 - DNA, 20 bp, mouse
gaaggggaacttggtacaca

SEQ ID NO: 787526 - DNA, 20 bp, mouse
ggggaccaagcctgggataa

SEQ ID NO: 787527 - DNA, 20 bp, mouse
gaggagggaccggtcctcac

SEQ ID NO: 787528 - DNA, 20 bp, mouse
gctcggtcttgggaagaacg

SEQ ID NO: 787529 - DNA, 20 bp, mouse
gaggagcaggcggtcgggcg

SEQ ID NO: 787530 - DNA, 20 bp, mouse
gctgccgcggggaagctttt

SEQ ID NO: 787531 - DNA, 20 bp, mouse
gagttccagccggtgaggac

SEQ ID NO: 787532 - DNA, 20 bp, mouse
ggtcttgggaagaacgtgga

SEQ ID NO: 787533 - DNA, 20 bp, mouse
gcgcctgctcctcccgtagg

SEQ ID NO: 787534 - DNA, 20 bp, mouse
ggaggaccggtccctcctac

SEQ ID NO: 787535 - DNA, 20 bp, mouse
ggggaccggtcctcaccggc

SEQ ID NO: 787536 - DNA, 20 bp, mouse
ggcacaaatggctactagaa

SEQ ID NO: 787537 - DNA, 20 bp, mouse
gccaagagtgctcttctaat

SEQ ID NO: 787538 - DNA, 20 bp, mouse
gaggagagcccatgctacag

SEQ ID NO: 787539 - DNA, 20 bp, mouse
gagggccatccactaagcta

SEQ ID NO: 787540 - DNA, 20 bp, mouse
gactccactgaggacttctc

SEQ ID NO: 787541 - DNA, 20 bp, mouse
gcccacatagagcgggtggg

SEQ ID NO: 787542 - DNA, 20 bp, mouse
gtaaacaccctctgtagcat

SEQ ID NO: 787543 - DNA, 20 bp, mouse
gcaggcacactgacttaatg

SEQ ID NO: 787544 - DNA, 20 bp, mouse
gggatccttcacaggaagtc

SEQ ID NO: 787545 - DNA, 20 bp, mouse
gtatcctgcatgttgagatt

SEQ ID NO: 787546 - DNA, 20 bp, mouse
gtctatgcagggtgctgaga

SEQ ID NO: 787547 - DNA, 20 bp, mouse
gcctggggaggctcctctct

SEQ ID NO: 787548 - DNA, 20 bp, mouse
ggaggagcctccccaggtag

SEQ ID NO: 787549 - DNA, 20 bp, mouse
gggcccaaggcaatgagcct

SEQ ID NO: 787550 - DNA, 20 bp, mouse
gggaaggtttccctcaaaag

SEQ ID NO: 787551 - DNA, 20 bp, mouse
gctcctctctgggcccggat

SEQ ID NO: 787552 - DNA, 20 bp, mouse
gtcagcaccctgcatagacc

SEQ ID NO: 787553 - DNA, 20 bp, mouse
gagtctgaatacaagtgtgc

SEQ ID NO: 787554 - DNA, 20 bp, mouse
gaccccaaggctcattgcct

SEQ ID NO: 787555 - DNA, 20 bp, mouse
gatgagccttggggtagaat

SEQ ID NO: 787556 - DNA, 20 bp, mouse
gccaccgccgctgacgtcgc

SEQ ID NO: 787557 - DNA, 20 bp, mouse
gggagtctgcgggtccgagg

SEQ ID NO: 787558 - DNA, 20 bp, mouse
ggggcccgaggcgtggcgag

SEQ ID NO: 787559 - DNA, 20 bp, mouse
ggggtcggaaacaaaggcgg

SEQ ID NO: 787560 - DNA, 20 bp, mouse
gctccgccagccggagtctg

SEQ ID NO: 787561 - DNA, 20 bp, mouse
gcggacccgcagactccggc

SEQ ID NO: 787562 - DNA, 20 bp, mouse
ggaggcgcgagcggataacc

SEQ ID NO: 787563 - DNA, 20 bp, mouse
gcccggcagtaggtcgagag

SEQ ID NO: 787564 - DNA, 20 bp, mouse
gctcacgtccgcccggcagt

SEQ ID NO: 787565 - DNA, 20 bp, mouse
ggcggtggccggggccggtg

SEQ ID NO: 787566 - DNA, 20 bp, mouse
gcgcagctgggtgaggagca

SEQ ID NO: 787567 - DNA, 20 bp, mouse
gcattcccggagctgaagac

SEQ ID NO: 787568 - DNA, 20 bp, mouse
gcggggccagggcggatcct

SEQ ID NO: 787569 - DNA, 20 bp, mouse
gaggcggaggcgagggatgc

SEQ ID NO: 787570 - DNA, 20 bp, mouse
gggaatggacggaagaacct

SEQ ID NO: 787571 - DNA, 20 bp, mouse
ggggcccaagaaacttcggg

SEQ ID NO: 787572 - DNA, 20 bp, mouse
ggctgggtgaggagcatggc

SEQ ID NO: 787573 - DNA, 20 bp, mouse
gtgggagggggtagaggcta

SEQ ID NO: 787574 - DNA, 20 bp, mouse
gccccgcccgcagctgggtg

SEQ ID NO: 787575 - DNA, 20 bp, mouse
gaggagcatggccgggtggg

SEQ ID NO: 787576 - DNA, 20 bp, mouse
ggggcctaaggggaagtcct

SEQ ID NO: 787577 - DNA, 20 bp, mouse
gaagatgtgttggtgagata

SEQ ID NO: 787578 - DNA, 20 bp, mouse
gaagcccaggacttcccctt

SEQ ID NO: 787579 - DNA, 20 bp, mouse
gaatggaaactggggcctaa

SEQ ID NO: 787580 - DNA, 20 bp, mouse
gtcaccaacacatcttcctt

SEQ ID NO: 787581 - DNA, 20 bp, mouse
gacaagaagaatgaaagccc

SEQ ID NO: 787582 - DNA, 20 bp, mouse
gtagtcactgcagaaggtca

SEQ ID NO: 787583 - DNA, 20 bp, mouse
gccaatacaaatggaaactg

SEQ ID NO: 787584 - DNA, 20 bp, mouse
gacctgatgttccaggtaac

SEQ ID NO: 787585 - DNA, 20 bp, mouse
gattcctggaagctactcga

SEQ ID NO: 787586 - DNA, 20 bp, mouse
gtgtaggggtccaatgggga

SEQ ID NO: 787587 - DNA, 20 bp, mouse
gacagggtgtaggggtccaa

SEQ ID NO: 787588 - DNA, 20 bp, mouse
ggaggtgtaacagggtgtag

SEQ ID NO: 787589 - DNA, 20 bp, mouse
ggaggacggagaggtgtaac

SEQ ID NO: 787590 - DNA, 20 bp, mouse
gcagagcctgtggtagatgc

SEQ ID NO: 787591 - DNA, 20 bp, mouse
gcacttccagcatctaccac

SEQ ID NO: 787592 - DNA, 20 bp, mouse
ggcagaatctggcatatggg

SEQ ID NO: 787593 - DNA, 20 bp, mouse
gaacatggtggcttgggagg

SEQ ID NO: 787594 - DNA, 20 bp, mouse
gggcaacatggtggcttggg

SEQ ID NO: 787595 - DNA, 20 bp, mouse
gtggcagtggccttccccat

SEQ ID NO: 787596 - DNA, 20 bp, mouse
gtgcaccggaagaacacccc

SEQ ID NO: 787597 - DNA, 20 bp, mouse
ggcgcctggagccgggaggt

SEQ ID NO: 787598 - DNA, 20 bp, mouse
gcgggtgcccgcggaggcct

SEQ ID NO: 787599 - DNA, 20 bp, mouse
gagaacaccccaggcctccg

SEQ ID NO: 787600 - DNA, 20 bp, mouse
ggtaaggtgcgtgattttga

SEQ ID NO: 787601 - DNA, 20 bp, mouse
gcggtgcaggcgcctggagc

SEQ ID NO: 787602 - DNA, 20 bp, mouse
gcgggcacccgagcgcttaa

SEQ ID NO: 787603 - DNA, 20 bp, mouse
gagccaaaggccacgctgat

SEQ ID NO: 787604 - DNA, 20 bp, mouse
ggattggttggctatgacag

SEQ ID NO: 787605 - DNA, 20 bp, mouse
gaaggcccaaggaagcagcg

SEQ ID NO: 787606 - DNA, 20 bp, mouse
ggggctcaccctaacttcta

SEQ ID NO: 787607 - DNA, 20 bp, mouse
ggggctgtctgagactgagg

SEQ ID NO: 787608 - DNA, 20 bp, mouse
ggtgagcccaggggacaccc

SEQ ID NO: 787609 - DNA, 20 bp, mouse
gctcaccctaacttctatgg

SEQ ID NO: 787610 - DNA, 20 bp, mouse
ggaaagggaccagagattat

SEQ ID NO: 787611 - DNA, 20 bp, mouse
gggtcagacagctaaggcaa

SEQ ID NO: 787612 - DNA, 20 bp, mouse
gaggtggttctcagagctga

SEQ ID NO: 787613 - DNA, 20 bp, mouse
gaacacttgcagccactcca

SEQ ID NO: 787614 - DNA, 20 bp, mouse
gtctagctgggaggtctgag

SEQ ID NO: 787615 - DNA, 20 bp, mouse
gtggagggcgaatgttacat

SEQ ID NO: 787616 - DNA, 20 bp, mouse
gactctggggccactcattg

SEQ ID NO: 787617 - DNA, 20 bp, mouse
ggggctggactgggactctg

SEQ ID NO: 787618 - DNA, 20 bp, mouse
gacagcagaaggcctcgccc

SEQ ID NO: 787619 - DNA, 20 bp, mouse
ggggccgctgaaccctgtgc

SEQ ID NO: 787620 - DNA, 20 bp, mouse
gtgggctcaggaaaccaagg

SEQ ID NO: 787621 - DNA, 20 bp, mouse
ggggctatcacgtggctcgg

SEQ ID NO: 787622 - DNA, 20 bp, mouse
gcaacctggtgccacaatat

SEQ ID NO: 787623 - DNA, 20 bp, mouse
gggccactcattggggatga

SEQ ID NO: 787624 - DNA, 20 bp, mouse
ggtactgatctgggatctca

SEQ ID NO: 787625 - DNA, 20 bp, mouse
ggctgtctgacttaggtcag

SEQ ID NO: 787626 - DNA, 20 bp, mouse
gagtcctgatcctagatgga

SEQ ID NO: 787627 - DNA, 20 bp, mouse
gctcccctccatctaggatc

SEQ ID NO: 787628 - DNA, 20 bp, mouse
ggggctgggtcgccttagaa

SEQ ID NO: 787629 - DNA, 20 bp, mouse
ggagaggggagtgccattct

SEQ ID NO: 787630 - DNA, 20 bp, mouse
gaggtctctggaaacatggg

SEQ ID NO: 787631 - DNA, 20 bp, mouse
gggccaatcagaggtcccta

SEQ ID NO: 787632 - DNA, 20 bp, mouse
gcggccttgtgcatcccccg

SEQ ID NO: 787633 - DNA, 20 bp, mouse
gggatctggaagcctctcta

SEQ ID NO: 787634 - DNA, 20 bp, mouse
gcaactaatgcaagcaacct

SEQ ID NO: 787635 - DNA, 20 bp, mouse
gttggagtcctgatcctaga

SEQ ID NO: 787636 - DNA, 20 bp, mouse
gtggcccacagtggagagca

SEQ ID NO: 787637 - DNA, 20 bp, mouse
ggagagcaggggaaaggtgc

SEQ ID NO: 787638 - DNA, 20 bp, mouse
gcaacaggcaccataaacag

SEQ ID NO: 787639 - DNA, 20 bp, mouse
ggtcccttgggatgcatgac

SEQ ID NO: 787640 - DNA, 20 bp, mouse
gcagagagtgggaggtccct

SEQ ID NO: 787641 - DNA, 20 bp, mouse
gaccctccccagaccctata

SEQ ID NO: 787642 - DNA, 20 bp, mouse
gccacaccgcctgtgcgggc

SEQ ID NO: 787643 - DNA, 20 bp, mouse
gaggtggtgcctggtaagaa

SEQ ID NO: 787644 - DNA, 20 bp, mouse
gtgaaggcccagtgactaac

SEQ ID NO: 787645 - DNA, 20 bp, mouse
ggtcacatgcctgcccgcac

SEQ ID NO: 787646 - DNA, 20 bp, mouse
ggggcgcaggcgagggtaga

SEQ ID NO: 787647 - DNA, 20 bp, mouse
gcaggtgagggcgcaggcga

SEQ ID NO: 787648 - DNA, 20 bp, mouse
gcgcaggcgagggtagaggg

SEQ ID NO: 787649 - DNA, 20 bp, mouse
gggcagggtggaagtggcgg

SEQ ID NO: 787650 - DNA, 20 bp, mouse
gaatcctggtccagtcacca

SEQ ID NO: 787651 - DNA, 20 bp, mouse
gacggagggctgactcaggt

SEQ ID NO: 787652 - DNA, 20 bp, mouse
ggagctctgcacccaggtga

SEQ ID NO: 787653 - DNA, 20 bp, mouse
gccggggggcggatacacgc

SEQ ID NO: 787654 - DNA, 20 bp, mouse
gacccccggcggcgcctcat

SEQ ID NO: 787655 - DNA, 20 bp, mouse
gccccgcccaactgggtcct

SEQ ID NO: 787656 - DNA, 20 bp, mouse
ggcaccatgggagtgctcta

SEQ ID NO: 787657 - DNA, 20 bp, mouse
ggcgccgtagagcactccca

SEQ ID NO: 787658 - DNA, 20 bp, mouse
gtgccggcgaaatttttaat

SEQ ID NO: 787659 - DNA, 20 bp, mouse
gcaagatcggagtttaaagg

SEQ ID NO: 787660 - DNA, 20 bp, mouse
gagaaggccgggtccggtgg

SEQ ID NO: 787661 - DNA, 20 bp, mouse
gggcgctgggaacgttacaa

SEQ ID NO: 787662 - DNA, 20 bp, mouse
gtggaggactgcgtttgctc

SEQ ID NO: 787663 - DNA, 20 bp, mouse
gtgagagtgcaccgcctccg

SEQ ID NO: 787664 - DNA, 20 bp, mouse
ggcactctcaagctaccggt

SEQ ID NO: 787665 - DNA, 20 bp, mouse
ggggcctgcgcgttgctgat

SEQ ID NO: 787666 - DNA, 20 bp, mouse
gtggctcggcaggaacatag

SEQ ID NO: 787667 - DNA, 20 bp, mouse
gctagcgcgcggaacctgtg

SEQ ID NO: 787668 - DNA, 20 bp, mouse
gggtcacggggacccagcca

SEQ ID NO: 787669 - DNA, 20 bp, mouse
gaggtccccgttcttcccag

SEQ ID NO: 787670 - DNA, 20 bp, mouse
gggaacctgtgtggctcggc

SEQ ID NO: 787671 - DNA, 20 bp, mouse
gctcggcaggaacatagtgg

SEQ ID NO: 787672 - DNA, 20 bp, mouse
gagggcttcctagggccaag

SEQ ID NO: 787673 - DNA, 20 bp, mouse
ggctgggtccccgtgaccac

SEQ ID NO: 787674 - DNA, 20 bp, mouse
gaacatagtgggggtgaact

SEQ ID NO: 787675 - DNA, 20 bp, mouse
gtgttcctgccgagccacac

SEQ ID NO: 787676 - DNA, 20 bp, mouse
gtgtaggacggattctgtag

SEQ ID NO: 787677 - DNA, 20 bp, mouse
gccgcggtgtgggtccggga

SEQ ID NO: 787678 - DNA, 20 bp, mouse
ggcgcctagcggcctgaaga

SEQ ID NO: 787679 - DNA, 20 bp, mouse
gacagagagactggcaaggg

SEQ ID NO: 787680 - DNA, 20 bp, mouse
gggagcagccctggtggtac

SEQ ID NO: 787681 - DNA, 20 bp, mouse
gtcttctccctgtaccacca

SEQ ID NO: 787682 - DNA, 20 bp, mouse
gttagccgcggtgtgggtcc

SEQ ID NO: 787683 - DNA, 20 bp, mouse
gctgaagagggcggggcgaa

SEQ ID NO: 787684 - DNA, 20 bp, mouse
gcctagcggcctgaagaggg

SEQ ID NO: 787685 - DNA, 20 bp, mouse
ggcggggttagccgcggtgt

SEQ ID NO: 787686 - DNA, 20 bp, mouse
ggtggccgcctggatgtcgt

SEQ ID NO: 787687 - DNA, 20 bp, mouse
gggccccggagtccgcgctg

SEQ ID NO: 787688 - DNA, 20 bp, mouse
gtcagggcacgcgacgaact

SEQ ID NO: 787689 - DNA, 20 bp, mouse
ggtggcaagtaggcagtgtc

SEQ ID NO: 787690 - DNA, 20 bp, mouse
ggagagagactggtgctcga

SEQ ID NO: 787691 - DNA, 20 bp, mouse
gtcgtcgcgtgccctgactt

SEQ ID NO: 787692 - DNA, 20 bp, mouse
gtccgcgctgtggataggtg

SEQ ID NO: 787693 - DNA, 20 bp, mouse
gtcgctggatgacagggtgt

SEQ ID NO: 787694 - DNA, 20 bp, mouse
gcgacctggcctgaaggcgg

SEQ ID NO: 787695 - DNA, 20 bp, mouse
gcggggctcgctggatgaca

SEQ ID NO: 787696 - DNA, 20 bp, mouse
ggctcctttaaggccagagc

SEQ ID NO: 787697 - DNA, 20 bp, mouse
gcaggcgactagctcaaccg

SEQ ID NO: 787698 - DNA, 20 bp, mouse
gtgcgatcgcgccagggcaa

SEQ ID NO: 787699 - DNA, 20 bp, mouse
gcgcctgccgagctggttct

SEQ ID NO: 787700 - DNA, 20 bp, mouse
ggacttcagcacacattcta

SEQ ID NO: 787701 - DNA, 20 bp, mouse
gtgtgctgaagtcggagtgg

SEQ ID NO: 787702 - DNA, 20 bp, mouse
gtttaagaacgcccaggcaa

SEQ ID NO: 787703 - DNA, 20 bp, mouse
gcaagcctggcagccaggaa

SEQ ID NO: 787704 - DNA, 20 bp, mouse
ggatgacgaaacaccgggga

SEQ ID NO: 787705 - DNA, 20 bp, mouse
ggtgacgtaaggcggagcaa

SEQ ID NO: 787706 - DNA, 20 bp, mouse
gtagcgcggacgctaataat

SEQ ID NO: 787707 - DNA, 20 bp, mouse
gcgggttcggggctgttcta

SEQ ID NO: 787708 - DNA, 20 bp, mouse
gtggtgggctggcgggttcg

SEQ ID NO: 787709 - DNA, 20 bp, mouse
gtgtacgactgaccgtagcg

SEQ ID NO: 787710 - DNA, 20 bp, mouse
gtggacacagcgacgcactg

SEQ ID NO: 787711 - DNA, 20 bp, mouse
gctgaaggataatagggctt

SEQ ID NO: 787712 - DNA, 20 bp, mouse
gccctgctgcgcatgcgtgt

SEQ ID NO: 787713 - DNA, 20 bp, mouse
gcacttccggcctagagcga

SEQ ID NO: 787714 - DNA, 20 bp, mouse
gggtctccgcctctaagaag

SEQ ID NO: 787715 - DNA, 20 bp, mouse
gcacactctccacttcttag

SEQ ID NO: 787716 - DNA, 20 bp, mouse
gaggtgcaggtctgggagcg

SEQ ID NO: 787717 - DNA, 20 bp, mouse
gtcacccatccgggaaactg

SEQ ID NO: 787718 - DNA, 20 bp, mouse
gagcgcggctgaactaagcc

SEQ ID NO: 787719 - DNA, 20 bp, mouse
gaacaagtcccaagaggtgc

SEQ ID NO: 787720 - DNA, 20 bp, mouse
gtcccaagaggtgcaggtct

SEQ ID NO: 787721 - DNA, 20 bp, mouse
gcaggtatctggctcccggt

SEQ ID NO: 787722 - DNA, 20 bp, mouse
gaaaccagcagagagttctc

SEQ ID NO: 787723 - DNA, 20 bp, mouse
gggtgcaggcgggaccccac

SEQ ID NO: 787724 - DNA, 20 bp, mouse
gcggggcccggacgccggtg

SEQ ID NO: 787725 - DNA, 20 bp, mouse
gagcacctgccactcggctt

SEQ ID NO: 787726 - DNA, 20 bp, mouse
gccaagtcgggagtgtttgt

SEQ ID NO: 787727 - DNA, 20 bp, mouse
gagcgctgtgggcaggtgtc

SEQ ID NO: 787728 - DNA, 20 bp, mouse
gtgccgcgaggggtgtgctt

SEQ ID NO: 787729 - DNA, 20 bp, mouse
gtgtgtgtggatgccaagtc

SEQ ID NO: 787730 - DNA, 20 bp, mouse
gcccccaagcacacccctcg

SEQ ID NO: 787731 - DNA, 20 bp, mouse
gcgtgtggaagtgccgcgag

SEQ ID NO: 787732 - DNA, 20 bp, mouse
gttgggtgtctaaatgttgt

SEQ ID NO: 787733 - DNA, 20 bp, mouse
gtgtccagatgtgttttgta

SEQ ID NO: 787734 - DNA, 20 bp, mouse
gtgtgcttgggggtgtgtct

SEQ ID NO: 787735 - DNA, 20 bp, mouse
gtgtgtgtctgggtatttag

SEQ ID NO: 787736 - DNA, 20 bp, mouse
gcgaacccagggttaagggg

SEQ ID NO: 787737 - DNA, 20 bp, mouse
gcacctgtgagttctgtcta

SEQ ID NO: 787738 - DNA, 20 bp, mouse
gtgcctggctgtctgtagat

SEQ ID NO: 787739 - DNA, 20 bp, mouse
gaaccctgggttcgcctgtt

SEQ ID NO: 787740 - DNA, 20 bp, mouse
gaaggggcggggcctcaaga

SEQ ID NO: 787741 - DNA, 20 bp, mouse
gctgtctgtagatcggtcta

SEQ ID NO: 787742 - DNA, 20 bp, mouse
gcaggcgaacccagggttaa

SEQ ID NO: 787743 - DNA, 20 bp, mouse
gaggccccgccccttaaccc

SEQ ID NO: 787744 - DNA, 20 bp, mouse
ggctgtgactgaatctaaca

SEQ ID NO: 787745 - DNA, 20 bp, mouse
ggaggccccgccccttcttg

SEQ ID NO: 787746 - DNA, 20 bp, mouse
ggaggagaaaaaggattcta

SEQ ID NO: 787747 - DNA, 20 bp, mouse
gaggtcttatgacatcacgt

SEQ ID NO: 787748 - DNA, 20 bp, mouse
gcagctgctcccataaacct

SEQ ID NO: 787749 - DNA, 20 bp, mouse
ggagaaaaaggattctaggg

SEQ ID NO: 787750 - DNA, 20 bp, mouse
ggacaagcaaggctctgcga

SEQ ID NO: 787751 - DNA, 20 bp, mouse
gtcaacagaggcagggttaa

SEQ ID NO: 787752 - DNA, 20 bp, mouse
gttatgggagcagctgcagt

SEQ ID NO: 787753 - DNA, 20 bp, mouse
gaggaattctaacatgtgat

SEQ ID NO: 787754 - DNA, 20 bp, mouse
gagagctaacatagttgtga

SEQ ID NO: 787755 - DNA, 20 bp, mouse
gtgaaggaatgcaggtagct

SEQ ID NO: 787756 - DNA, 20 bp, mouse
gagggagagcatggacggtc

SEQ ID NO: 787757 - DNA, 20 bp, mouse
gcccacttggagagaagcgg

SEQ ID NO: 787758 - DNA, 20 bp, mouse
gagcatggacggtccggcat

SEQ ID NO: 787759 - DNA, 20 bp, mouse
gcacgcctccgcccgcctcg

SEQ ID NO: 787760 - DNA, 20 bp, mouse
gctctccaagtgggcgagga

SEQ ID NO: 787761 - DNA, 20 bp, mouse
gcaacgacctgccccaagtc

SEQ ID NO: 787762 - DNA, 20 bp, mouse
gtccggcatcgggacccagg

SEQ ID NO: 787763 - DNA, 20 bp, mouse
gcgacctgccccaagtctgg

SEQ ID NO: 787764 - DNA, 20 bp, mouse
ggggaagggttttcctgctt

SEQ ID NO: 787765 - DNA, 20 bp, mouse
gctccgcccgcctcggggaa

SEQ ID NO: 787766 - DNA, 20 bp, mouse
gtaggcgtaggcgactcgga

SEQ ID NO: 787767 - DNA, 20 bp, mouse
gcggactgggaggactgcgt

SEQ ID NO: 787768 - DNA, 20 bp, mouse
gaggcggtgcacgtaggcgt

SEQ ID NO: 787769 - DNA, 20 bp, mouse
gtaggcgactcggagggtgg

SEQ ID NO: 787770 - DNA, 20 bp, mouse
gcacgtaggcgtaggcgact

SEQ ID NO: 787771 - DNA, 20 bp, mouse
ggctccagggagcttgcttg

SEQ ID NO: 787772 - DNA, 20 bp, mouse
gctggagcggagggcggact

SEQ ID NO: 787773 - DNA, 20 bp, mouse
ggctctcctggcaccagcag

SEQ ID NO: 787774 - DNA, 20 bp, mouse
gggtaccgaagagcacggag

SEQ ID NO: 787775 - DNA, 20 bp, mouse
gcaatcctctccgtgctctt

SEQ ID NO: 787776 - DNA, 20 bp, mouse
gcagacggcgagacaaggca

SEQ ID NO: 787777 - DNA, 20 bp, mouse
gatcgcgcggacatcctcgt

SEQ ID NO: 787778 - DNA, 20 bp, mouse
gacaggataggcaggttcgg

SEQ ID NO: 787779 - DNA, 20 bp, mouse
gcaaccgaatccccccggga

SEQ ID NO: 787780 - DNA, 20 bp, mouse
gtgtgagtcaggcagtgccc

SEQ ID NO: 787781 - DNA, 20 bp, mouse
gcccgcgggcgcgggctgga

SEQ ID NO: 787782 - DNA, 20 bp, mouse
gcgcctggaccctcctcaaa

SEQ ID NO: 787783 - DNA, 20 bp, mouse
gagcgcggggacacgcaccg

SEQ ID NO: 787784 - DNA, 20 bp, mouse
ggagccgagggtccggtcct

SEQ ID NO: 787785 - DNA, 20 bp, mouse
gggactccgccctggaaaaa

SEQ ID NO: 787786 - DNA, 20 bp, mouse
ggcaacgagcagtgagagtt

SEQ ID NO: 787787 - DNA, 20 bp, mouse
ggggatactcccttctttaa

SEQ ID NO: 787788 - DNA, 20 bp, mouse
gaaagaagggagtatcccaa

SEQ ID NO: 787789 - DNA, 20 bp, mouse
ggacccaaggatcatttggg

SEQ ID NO: 787790 - DNA, 20 bp, mouse
ggaagggagtatcccaaagg

SEQ ID NO: 787791 - DNA, 20 bp, mouse
gagatggagcccttaaagaa

SEQ ID NO: 787792 - DNA, 20 bp, mouse
gggagtatcccaaaggaggt

SEQ ID NO: 787793 - DNA, 20 bp, mouse
gggaaaggttccatggtcaa

SEQ ID NO: 787794 - DNA, 20 bp, mouse
gttctagagaagctttaggg

SEQ ID NO: 787795 - DNA, 20 bp, mouse
gaatcctcccaaatgatcct

SEQ ID NO: 787796 - DNA, 20 bp, mouse
ggcacacagccttatctaca

SEQ ID NO: 787797 - DNA, 20 bp, mouse
gtaccgagggaatctggctt

SEQ ID NO: 787798 - DNA, 20 bp, mouse
gttcggccgcagggcaaagg

SEQ ID NO: 787799 - DNA, 20 bp, mouse
gctgcggccgaagacgatac

SEQ ID NO: 787800 - DNA, 20 bp, mouse
gcaaagcaggcggggccgga

SEQ ID NO: 787801 - DNA, 20 bp, mouse
ggcgggacccgtatcgtctt

SEQ ID NO: 787802 - DNA, 20 bp, mouse
ggtcttcggccgcagggcaa

SEQ ID NO: 787803 - DNA, 20 bp, mouse
gctagcaaagcaggcggggc

SEQ ID NO: 787804 - DNA, 20 bp, mouse
gggaagccccctttgccctg

SEQ ID NO: 787805 - DNA, 20 bp, mouse
ggctgaaaaaggggtagctg

SEQ ID NO: 787806 - DNA, 20 bp, mouse
gccgccgcgcaggggtcgag

SEQ ID NO: 787807 - DNA, 20 bp, mouse
ggtcgaggggcggagtctag

SEQ ID NO: 787808 - DNA, 20 bp, mouse
ggaggggcggagtctagcgg

SEQ ID NO: 787809 - DNA, 20 bp, mouse
gagtcccgctctcctccaag

SEQ ID NO: 787810 - DNA, 20 bp, mouse
gccgccccagtcccgcccag

SEQ ID NO: 787811 - DNA, 20 bp, mouse
gacttcggcagccgctgggc

SEQ ID NO: 787812 - DNA, 20 bp, mouse
ggggcggagtctagcggtgg

SEQ ID NO: 787813 - DNA, 20 bp, mouse
gactggggcggggtttgggc

SEQ ID NO: 787814 - DNA, 20 bp, mouse
gtggcgcgctcccttagctc

SEQ ID NO: 787815 - DNA, 20 bp, mouse
ggtaccgcccctaaacgtta

SEQ ID NO: 787816 - DNA, 20 bp, mouse
gctcccgggaggagtgaaac

SEQ ID NO: 787817 - DNA, 20 bp, mouse
gaaaggccaacctggaacat

SEQ ID NO: 787818 - DNA, 20 bp, mouse
gggctgttgtagattagaaa

SEQ ID NO: 787819 - DNA, 20 bp, mouse
gctggaacatgggtgtggct

SEQ ID NO: 787820 - DNA, 20 bp, mouse
gcaatgagacctcatctccc

SEQ ID NO: 787821 - DNA, 20 bp, mouse
gccacacccatgttccaggt

SEQ ID NO: 787822 - DNA, 20 bp, mouse
gtgagacctcatctcccggg

SEQ ID NO: 787823 - DNA, 20 bp, mouse
gagtcccgtttcactcctcc

SEQ ID NO: 787824 - DNA, 20 bp, mouse
gctaggtagaaaggccaacc

SEQ ID NO: 787825 - DNA, 20 bp, mouse
gaagcactgtgaagcctcaa

SEQ ID NO: 787826 - DNA, 20 bp, mouse
gtttgcagtcaggtgaaagg

SEQ ID NO: 787827 - DNA, 20 bp, mouse
gttgcaggagctaactaaag

SEQ ID NO: 787828 - DNA, 20 bp, mouse
gaggttgggggatggaagat

SEQ ID NO: 787829 - DNA, 20 bp, mouse
ggagtgaagcgtgggcagca

SEQ ID NO: 787830 - DNA, 20 bp, mouse
gaagtggacccgcgctgcag

SEQ ID NO: 787831 - DNA, 20 bp, mouse
gccaccagatctttgcagtc

SEQ ID NO: 787832 - DNA, 20 bp, mouse
gatctggtggcctctcccct

SEQ ID NO: 787833 - DNA, 20 bp, mouse
gactaaagaggtttgtgttg

SEQ ID NO: 787834 - DNA, 20 bp, mouse
ggttgctgcacccaggggag

SEQ ID NO: 787835 - DNA, 20 bp, mouse
ggcaactaaaacctggcgag

SEQ ID NO: 787836 - DNA, 20 bp, mouse
gcagggatgggcaatgagga

SEQ ID NO: 787837 - DNA, 20 bp, mouse
gtgtcacatcaactgggtgg

SEQ ID NO: 787838 - DNA, 20 bp, mouse
gaggtagggaatggaaaaac

SEQ ID NO: 787839 - DNA, 20 bp, mouse
gggagcctgtcacatcaact

SEQ ID NO: 787840 - DNA, 20 bp, mouse
ggagagacccggcagcagca

SEQ ID NO: 787841 - DNA, 20 bp, mouse
gtaagttcttccaccaggta

SEQ ID NO: 787842 - DNA, 20 bp, mouse
gcagctgcagagattcctag

SEQ ID NO: 787843 - DNA, 20 bp, mouse
ggcctgtcacatcaactggg

SEQ ID NO: 787844 - DNA, 20 bp, mouse
gggctgtagctggaaatgga

SEQ ID NO: 787845 - DNA, 20 bp, mouse
gccatctgagccaatggctg

SEQ ID NO: 787846 - DNA, 20 bp, mouse
gagtacccaaataggttggg

SEQ ID NO: 787847 - DNA, 20 bp, mouse
gtcccgcacagtacccaaat

SEQ ID NO: 787848 - DNA, 20 bp, mouse
ggggcgcagctagaggattc

SEQ ID NO: 787849 - DNA, 20 bp, mouse
gaaaggctattcatcacctg

SEQ ID NO: 787850 - DNA, 20 bp, mouse
gagggctgatggaacagatg

SEQ ID NO: 787851 - DNA, 20 bp, mouse
gaagcaggaaagtaagtttg

SEQ ID NO: 787852 - DNA, 20 bp, mouse
gtcaaccacccaacctattt

SEQ ID NO: 787853 - DNA, 20 bp, mouse
gtaaagaaagttccgagaag

SEQ ID NO: 787854 - DNA, 20 bp, mouse
gaaacttgaaagtgcaaaca

SEQ ID NO: 787855 - DNA, 20 bp, mouse
gcgagaagaggccactcccc

SEQ ID NO: 787856 - DNA, 20 bp, mouse
ggtactcagtagaagaagtt

SEQ ID NO: 787857 - DNA, 20 bp, mouse
gcagacccataacagtcata

SEQ ID NO: 787858 - DNA, 20 bp, mouse
gaaaacacaagcagtcttgt

SEQ ID NO: 787859 - DNA, 20 bp, mouse
gtggtcctaccggctcctgc

SEQ ID NO: 787860 - DNA, 20 bp, mouse
gctgattcaaaaggagactc

SEQ ID NO: 787861 - DNA, 20 bp, mouse
gctgtggtggtggtgaatct

SEQ ID NO: 787862 - DNA, 20 bp, mouse
ggcagtggaggtcagagtaa

SEQ ID NO: 787863 - DNA, 20 bp, mouse
gcacagttctggaacgccaa

SEQ ID NO: 787864 - DNA, 20 bp, mouse
gtaaaacttacctgtggtgg

SEQ ID NO: 787865 - DNA, 20 bp, mouse
gactgagtaccagcaggagc

SEQ ID NO: 787866 - DNA, 20 bp, mouse
gccttccgctccgactgcag

SEQ ID NO: 787867 - DNA, 20 bp, mouse
gagcggaaggggcggaacca

SEQ ID NO: 787868 - DNA, 20 bp, mouse
gcaagcctctgcagtcggag

SEQ ID NO: 787869 - DNA, 20 bp, mouse
ggggcgactgcgcagaaagc

SEQ ID NO: 787870 - DNA, 20 bp, mouse
gtcgccccgcccggactggg

SEQ ID NO: 787871 - DNA, 20 bp, mouse
ggcacaaggtccaaggtccg

SEQ ID NO: 787872 - DNA, 20 bp, mouse
gacaaagcgcacaaggtcca

SEQ ID NO: 787873 - DNA, 20 bp, mouse
gagtgggtcaacgctgtgac

SEQ ID NO: 787874 - DNA, 20 bp, mouse
gaatcaccctccaacaggcc

SEQ ID NO: 787875 - DNA, 20 bp, mouse
gggccccccgacttattctg

SEQ ID NO: 787876 - DNA, 20 bp, mouse
gcccgccaccagcagaggag

SEQ ID NO: 787877 - DNA, 20 bp, mouse
gatcaaactggtctcctcca

SEQ ID NO: 787878 - DNA, 20 bp, mouse
gcaccagcagaggagcggtt

SEQ ID NO: 787879 - DNA, 20 bp, mouse
gggcgccagcgaagcccgcg

SEQ ID NO: 787880 - DNA, 20 bp, mouse
ggttcggagctcaaccccgc

SEQ ID NO: 787881 - DNA, 20 bp, mouse
gtcaaccccgcgggcttcgc

SEQ ID NO: 787882 - DNA, 20 bp, mouse
gctctgggaggagtttacat

SEQ ID NO: 787883 - DNA, 20 bp, mouse
gcggctctcattcccatccc

SEQ ID NO: 787884 - DNA, 20 bp, mouse
ggaatgagagccgagcagtg

SEQ ID NO: 787885 - DNA, 20 bp, mouse
gcgcagggtaaacaagttgt

SEQ ID NO: 787886 - DNA, 20 bp, mouse
gtggtctgttaagtactcag

SEQ ID NO: 787887 - DNA, 20 bp, mouse
gagtacttaacagaccacat

SEQ ID NO: 787888 - DNA, 20 bp, mouse
gagaaagtcccataacttcg

SEQ ID NO: 787889 - DNA, 20 bp, mouse
gtggcagtctcgcccgtgat

SEQ ID NO: 787890 - DNA, 20 bp, mouse
gctctcggccacgaagttat

SEQ ID NO: 787891 - DNA, 20 bp, mouse
gaaacactctagaaccagcg

SEQ ID NO: 787892 - DNA, 20 bp, mouse
gtgttgttatactaccactc

SEQ ID NO: 787893 - DNA, 20 bp, mouse
gtgtgtgaatcaacctatca

SEQ ID NO: 787894 - DNA, 20 bp, mouse
gtgaaagtaaaacgcctact

SEQ ID NO: 787895 - DNA, 20 bp, mouse
gcatgctctggaatccgatg

SEQ ID NO: 787896 - DNA, 20 bp, mouse
ggggacgctggcagttggga

SEQ ID NO: 787897 - DNA, 20 bp, mouse
gctgctgtctggacaagtgg

SEQ ID NO: 787898 - DNA, 20 bp, mouse
ggggcgggacgctggcagtt

SEQ ID NO: 787899 - DNA, 20 bp, mouse
gcggaggcccagacttataa

SEQ ID NO: 787900 - DNA, 20 bp, mouse
gtagctgctgtctggacaag

SEQ ID NO: 787901 - DNA, 20 bp, mouse
gcggcgaggaggggggtcgg

SEQ ID NO: 787902 - DNA, 20 bp, mouse
gccgagtgggagttcccata

SEQ ID NO: 787903 - DNA, 20 bp, mouse
gggaagaaccgcggcgagga

SEQ ID NO: 787904 - DNA, 20 bp, mouse
ggggaatgaccgtagggcat

SEQ ID NO: 787905 - DNA, 20 bp, mouse
gcgtcccctcccagccccca

SEQ ID NO: 787906 - DNA, 20 bp, mouse
gtggagggcggggcactcac

SEQ ID NO: 787907 - DNA, 20 bp, mouse
gggcagctgtgataggtgga

SEQ ID NO: 787908 - DNA, 20 bp, mouse
gactcactgggtgactgaac

SEQ ID NO: 787909 - DNA, 20 bp, mouse
gctgttagataacacgtccc

SEQ ID NO: 787910 - DNA, 20 bp, mouse
gtggagtgggagagtggcgg

SEQ ID NO: 787911 - DNA, 20 bp, mouse
gcatctaaagtggggtgtgt

SEQ ID NO: 787912 - DNA, 20 bp, mouse
gtgaactgcgccaggcaggg

SEQ ID NO: 787913 - DNA, 20 bp, mouse
gaacacgtcccgggagcaga

SEQ ID NO: 787914 - DNA, 20 bp, mouse
gagttcctcaacagcctggg

SEQ ID NO: 787915 - DNA, 20 bp, mouse
gcagtctgggcagctgtgat

SEQ ID NO: 787916 - DNA, 20 bp, mouse
ggaccgcgccgggacatctc

SEQ ID NO: 787917 - DNA, 20 bp, mouse
gcgcggtcccgggtcccgtg

SEQ ID NO: 787918 - DNA, 20 bp, mouse
ggctccgcgccgcaccccac

SEQ ID NO: 787919 - DNA, 20 bp, mouse
ggggagccaacggcccaagt

SEQ ID NO: 787920 - DNA, 20 bp, mouse
gagggcggggcgcaacgctg

SEQ ID NO: 787921 - DNA, 20 bp, mouse
gtggggcagcggggttctct

SEQ ID NO: 787922 - DNA, 20 bp, mouse
gaaacctaagtaaaaggccg

SEQ ID NO: 787923 - DNA, 20 bp, mouse
gcagaaagtcgcatgctctt

SEQ ID NO: 787924 - DNA, 20 bp, mouse
gtggggtcggtgctggagat

SEQ ID NO: 787925 - DNA, 20 bp, mouse
ggatgtcccggcgcggtccc

SEQ ID NO: 787926 - DNA, 20 bp, mouse
gccagcaccaacctgtccat

SEQ ID NO: 787927 - DNA, 20 bp, mouse
ggctggctgcgggttttggg

SEQ ID NO: 787928 - DNA, 20 bp, mouse
gccccactcgcaccagtcct

SEQ ID NO: 787929 - DNA, 20 bp, mouse
gactggtgcgagtggggcgg

SEQ ID NO: 787930 - DNA, 20 bp, mouse
ggaggaaggtgggagaagcc

SEQ ID NO: 787931 - DNA, 20 bp, mouse
gcaaaggtcatgaaccgggt

SEQ ID NO: 787932 - DNA, 20 bp, mouse
gcgggtgggcggatggcgtc

SEQ ID NO: 787933 - DNA, 20 bp, mouse
gcgctccagctctacacttt

SEQ ID NO: 787934 - DNA, 20 bp, mouse
gtggggccgcaatggtcctc

SEQ ID NO: 787935 - DNA, 20 bp, mouse
gcatctgtgggagacttttc

SEQ ID NO: 787936 - DNA, 20 bp, mouse
gggcggggcgggacccgcga

SEQ ID NO: 787937 - DNA, 20 bp, mouse
gccccaccgcttgccttcaa

SEQ ID NO: 787938 - DNA, 20 bp, mouse
gaaaactctggactggggtg

SEQ ID NO: 787939 - DNA, 20 bp, mouse
gggacccgcgatggcctgca

SEQ ID NO: 787940 - DNA, 20 bp, mouse
ggccctttgaaggcaagcgg

SEQ ID NO: 787941 - DNA, 20 bp, mouse
gcgcgcgcgctctcgccgcg

SEQ ID NO: 787942 - DNA, 20 bp, mouse
gcacctcagccttaaaactc

SEQ ID NO: 787943 - DNA, 20 bp, mouse
ggcaggaccgcgtaccggac

SEQ ID NO: 787944 - DNA, 20 bp, mouse
gcatgcgccggccgaagccg

SEQ ID NO: 787945 - DNA, 20 bp, mouse
gacctcgccgggtcgatcgc

SEQ ID NO: 787946 - DNA, 20 bp, mouse
ggcccagaaaggttgtacca

SEQ ID NO: 787947 - DNA, 20 bp, mouse
gcaagaacccggcagagcta

SEQ ID NO: 787948 - DNA, 20 bp, mouse
gcgggcggggcgcgtgggcg

SEQ ID NO: 787949 - DNA, 20 bp, mouse
gtctagggactcatgtcttg

SEQ ID NO: 787950 - DNA, 20 bp, mouse
ggacaggtgacgccacgcga

SEQ ID NO: 787951 - DNA, 20 bp, mouse
ggctggtccacccaagaacc

SEQ ID NO: 787952 - DNA, 20 bp, mouse
ggtgacgccacgcgagggga

SEQ ID NO: 787953 - DNA, 20 bp, mouse
gggcggggagggggttaacg

SEQ ID NO: 787954 - DNA, 20 bp, mouse
gaagccagctggctaggctt

SEQ ID NO: 787955 - DNA, 20 bp, mouse
gttcttgggtggaccagcta

SEQ ID NO: 787956 - DNA, 20 bp, mouse
gcggccgcgcacagattcca

SEQ ID NO: 787957 - DNA, 20 bp, mouse
gagcaaagggggctgttctc

SEQ ID NO: 787958 - DNA, 20 bp, mouse
gaagcagagcgcatggcggt

SEQ ID NO: 787959 - DNA, 20 bp, mouse
gaggctgcggggccaagcga

SEQ ID NO: 787960 - DNA, 20 bp, mouse
gctctctgggagccccctcc

SEQ ID NO: 787961 - DNA, 20 bp, mouse
gcaagaagcaagcctctcat

SEQ ID NO: 787962 - DNA, 20 bp, mouse
gaacagccccctttgctcaa

SEQ ID NO: 787963 - DNA, 20 bp, mouse
gcggccgcgccacaccccct

SEQ ID NO: 787964 - DNA, 20 bp, mouse
gagcgcatggcggttggggg

SEQ ID NO: 787965 - DNA, 20 bp, mouse
ggggaggccgctaggccctg

SEQ ID NO: 787966 - DNA, 20 bp, mouse
gccagctagcgagccagaga

SEQ ID NO: 787967 - DNA, 20 bp, mouse
gcgagccagagagggagcgg

SEQ ID NO: 787968 - DNA, 20 bp, mouse
gtctgccggccgctctacct

SEQ ID NO: 787969 - DNA, 20 bp, mouse
ggcgactgacatctagacca

SEQ ID NO: 787970 - DNA, 20 bp, mouse
gtagaccaaggtagagcggc

SEQ ID NO: 787971 - DNA, 20 bp, mouse
gccaccgccagggtgactcg

SEQ ID NO: 787972 - DNA, 20 bp, mouse
gagagcaggcgggccagtgg

SEQ ID NO: 787973 - DNA, 20 bp, mouse
gccagtggcggcagcgtgcg

SEQ ID NO: 787974 - DNA, 20 bp, mouse
gtgtctgcaaacgtccacac

SEQ ID NO: 787975 - DNA, 20 bp, mouse
gcttcctcgagtcaccctgg

SEQ ID NO: 787976 - DNA, 20 bp, mouse
gaagccgcgtcggccggccc

SEQ ID NO: 787977 - DNA, 20 bp, mouse
gggaagctgccgggagaacg

SEQ ID NO: 787978 - DNA, 20 bp, mouse
gccgccagacccacctccga

SEQ ID NO: 787979 - DNA, 20 bp, mouse
ggcggggtcccggatggctg

SEQ ID NO: 787980 - DNA, 20 bp, mouse
gctgcctccgctgggaacaa

SEQ ID NO: 787981 - DNA, 20 bp, mouse
gatcccgcgggaccggaatg

SEQ ID NO: 787982 - DNA, 20 bp, mouse
gagacccacctccgagggga

SEQ ID NO: 787983 - DNA, 20 bp, mouse
gggaccggaatgcggggtcc

SEQ ID NO: 787984 - DNA, 20 bp, mouse
gcggcccgacgggcgggggg

SEQ ID NO: 787985 - DNA, 20 bp, mouse
gaacccctctcattaaatgg

SEQ ID NO: 787986 - DNA, 20 bp, mouse
gggaaacgcggggtacgcta

SEQ ID NO: 787987 - DNA, 20 bp, mouse
gagggagggacgagactaag

SEQ ID NO: 787988 - DNA, 20 bp, mouse
gcccccgccaggggagaagg

SEQ ID NO: 787989 - DNA, 20 bp, mouse
ggacgagactaaggggtaga

SEQ ID NO: 787990 - DNA, 20 bp, mouse
ggcaaagcggtgtgcataag

SEQ ID NO: 787991 - DNA, 20 bp, mouse
gtctgagccgagggaaacgc

SEQ ID NO: 787992 - DNA, 20 bp, mouse
gccgcccccgccaggggaga

SEQ ID NO: 787993 - DNA, 20 bp, mouse
gagggagcgcggattgctac

SEQ ID NO: 787994 - DNA, 20 bp, mouse
ggcgtaccccgcgtttccct

SEQ ID NO: 787995 - DNA, 20 bp, mouse
gtcggcctggggcactcccg

SEQ ID NO: 787996 - DNA, 20 bp, mouse
ggacagaggggacattgttg

SEQ ID NO: 787997 - DNA, 20 bp, mouse
gggggcaagggcctggagat

SEQ ID NO: 787998 - DNA, 20 bp, mouse
gacaaagctgccagctgtgg

SEQ ID NO: 787999 - DNA, 20 bp, mouse
gacaccagatagcaggtccc

SEQ ID NO: 788000 - DNA, 20 bp, mouse
gtgtccagaggcccaggcca

SEQ ID NO: 788001 - DNA, 20 bp, mouse
gcccagggccaccatgaatg

SEQ ID NO: 788002 - DNA, 20 bp, mouse
gctggcagctttgtcaatag

SEQ ID NO: 788003 - DNA, 20 bp, mouse
ggggcattgtcctgagtggg

SEQ ID NO: 788004 - DNA, 20 bp, mouse
gggctagaacagccagagtg

SEQ ID NO: 788005 - DNA, 20 bp, mouse
ggctactgacactgaggctg

SEQ ID NO: 788006 - DNA, 20 bp, mouse
gtcaccgaatcaagaaggga

SEQ ID NO: 788007 - DNA, 20 bp, mouse
gcggggagggctggagaggt

SEQ ID NO: 788008 - DNA, 20 bp, mouse
ggatctcaccgaatcaagaa

SEQ ID NO: 788009 - DNA, 20 bp, mouse
gaagggaggggacgggcgga

SEQ ID NO: 788010 - DNA, 20 bp, mouse
gggaacccggggcgagcaag

SEQ ID NO: 788011 - DNA, 20 bp, mouse
gtgtgaaagtgggatgcaac

SEQ ID NO: 788012 - DNA, 20 bp, mouse
ggggttgcggcggaggccca

SEQ ID NO: 788013 - DNA, 20 bp, mouse
gctcgcggagccaggaccca

SEQ ID NO: 788014 - DNA, 20 bp, mouse
gcggggcgagcaaggggcga

SEQ ID NO: 788015 - DNA, 20 bp, mouse
gccaggacccagggtcgaac

SEQ ID NO: 788016 - DNA, 20 bp, mouse
gggcgtggcccggggcgaaa

SEQ ID NO: 788017 - DNA, 20 bp, mouse
ggggcggggagatgggctgt

SEQ ID NO: 788018 - DNA, 20 bp, mouse
ggcccggggcgaaagggcgt

SEQ ID NO: 788019 - DNA, 20 bp, mouse
ggggagatgggctgtgggcg

SEQ ID NO: 788020 - DNA, 20 bp, mouse
gccccggcccgactctggcg

SEQ ID NO: 788021 - DNA, 20 bp, mouse
ggtcactggtggccgatacc

SEQ ID NO: 788022 - DNA, 20 bp, mouse
ggctgtgggcgtggtctcca

SEQ ID NO: 788023 - DNA, 20 bp, mouse
gcggcgccccggcccgactc

SEQ ID NO: 788024 - DNA, 20 bp, mouse
gtgagcgcctcgccagagtc

SEQ ID NO: 788025 - DNA, 20 bp, mouse
gggccacgccccgcggtccg

SEQ ID NO: 788026 - DNA, 20 bp, mouse
gctagagggcagcaactcaa

SEQ ID NO: 788027 - DNA, 20 bp, mouse
gagtcctgacccttgtctag

SEQ ID NO: 788028 - DNA, 20 bp, mouse
ggttgctgccctctagacaa

SEQ ID NO: 788029 - DNA, 20 bp, mouse
gaaaacaggagcaaactcgt

SEQ ID NO: 788030 - DNA, 20 bp, mouse
gggcgggtcgctcgattgat

SEQ ID NO: 788031 - DNA, 20 bp, mouse
gtaaatgccagaacaagagc

SEQ ID NO: 788032 - DNA, 20 bp, mouse
gggtcgctcgattgattggt

SEQ ID NO: 788033 - DNA, 20 bp, mouse
gcaacagtgtgtctgttgat

SEQ ID NO: 788034 - DNA, 20 bp, mouse
gggagcaaactcgtcggggc

SEQ ID NO: 788035 - DNA, 20 bp, mouse
ggactagcctgctcttgttc

SEQ ID NO: 788036 - DNA, 20 bp, mouse
ggagcggtgcggactgccaa

SEQ ID NO: 788037 - DNA, 20 bp, mouse
gagtcctcggccgccctcgg

SEQ ID NO: 788038 - DNA, 20 bp, mouse
gggactgccaagggctgccg

SEQ ID NO: 788039 - DNA, 20 bp, mouse
ggggcggccgaggactgatt

SEQ ID NO: 788040 - DNA, 20 bp, mouse
ggaggcgcctagccttgcgg

SEQ ID NO: 788041 - DNA, 20 bp, mouse
gcggccgccctcggcggctt

SEQ ID NO: 788042 - DNA, 20 bp, mouse
gtggtcgccgaagccgccga

SEQ ID NO: 788043 - DNA, 20 bp, mouse
ggtgccgccgagcgttgcat

SEQ ID NO: 788044 - DNA, 20 bp, mouse
gtcgccgaagccgccgaggg

SEQ ID NO: 788045 - DNA, 20 bp, mouse
gttagggtggtgctgtacgg

SEQ ID NO: 788046 - DNA, 20 bp, mouse
gtcggcgccgcggcgatctg

SEQ ID NO: 788047 - DNA, 20 bp, mouse
gtcgccgcggcgccgaccta

SEQ ID NO: 788048 - DNA, 20 bp, mouse
ggaaccgagcgaagtggagc

SEQ ID NO: 788049 - DNA, 20 bp, mouse
ggccccggcaagttgcgctc

SEQ ID NO: 788050 - DNA, 20 bp, mouse
gcagtggcgcccgtcaggag

SEQ ID NO: 788051 - DNA, 20 bp, mouse
gccgcggcgccgacctacgg

SEQ ID NO: 788052 - DNA, 20 bp, mouse
gcccccgagcgcaacttgcc

SEQ ID NO: 788053 - DNA, 20 bp, mouse
gtacggcggagggcgcaagg

SEQ ID NO: 788054 - DNA, 20 bp, mouse
gtccccgccccttcgaacgg

SEQ ID NO: 788055 - DNA, 20 bp, mouse
gggcaagcctcagatcgccg

SEQ ID NO: 788056 - DNA, 20 bp, mouse
gtacacacgaaataaacaac

SEQ ID NO: 788057 - DNA, 20 bp, mouse
ggattaaggtctttgagaga

SEQ ID NO: 788058 - DNA, 20 bp, mouse
gtcaaagtgggatgttatta

SEQ ID NO: 788059 - DNA, 20 bp, mouse
gagaaggaaactgtaatagc

SEQ ID NO: 788060 - DNA, 20 bp, mouse
gctttctgtgagtagattat

SEQ ID NO: 788061 - DNA, 20 bp, mouse
gaggcgagcctggtatcctg

SEQ ID NO: 788062 - DNA, 20 bp, mouse
ggattataggctcttcaaag

SEQ ID NO: 788063 - DNA, 20 bp, mouse
gtgttattaaggaagaccac

SEQ ID NO: 788064 - DNA, 20 bp, mouse
gtcagacagaaagtatataa

SEQ ID NO: 788065 - DNA, 20 bp, mouse
ggcgaatgcttgcattgttt

SEQ ID NO: 788066 - DNA, 20 bp, mouse
gctggaaagagttcactgat

SEQ ID NO: 788067 - DNA, 20 bp, mouse
ggccagcaataaaacaacac

SEQ ID NO: 788068 - DNA, 20 bp, mouse
gtcactgtttcggggttcat

SEQ ID NO: 788069 - DNA, 20 bp, mouse
gctccagaggaggggaaacc

SEQ ID NO: 788070 - DNA, 20 bp, mouse
gacagctcaatgacagtttc

SEQ ID NO: 788071 - DNA, 20 bp, mouse
gtgacagtttctggtttcgc

SEQ ID NO: 788072 - DNA, 20 bp, mouse
gaccatccctttctatatag

SEQ ID NO: 788073 - DNA, 20 bp, mouse
gagtgagacagtattaagct

SEQ ID NO: 788074 - DNA, 20 bp, mouse
gctaccctcccagccccttc

SEQ ID NO: 788075 - DNA, 20 bp, mouse
gtcccctcctctggagggag

SEQ ID NO: 788076 - DNA, 20 bp, mouse
gcgggcctgcggagtctcga

SEQ ID NO: 788077 - DNA, 20 bp, mouse
gggagcccccgtgcctgcgg

SEQ ID NO: 788078 - DNA, 20 bp, mouse
gcgcggggcgggctcttaaa

SEQ ID NO: 788079 - DNA, 20 bp, mouse
gactccgcaggcccggtccg

SEQ ID NO: 788080 - DNA, 20 bp, mouse
gctcccgcggaccgggcctg

SEQ ID NO: 788081 - DNA, 20 bp, mouse
gggcccgtcgctcgcggggc

SEQ ID NO: 788082 - DNA, 20 bp, mouse
ggcccccgcgcggtgggaac

SEQ ID NO: 788083 - DNA, 20 bp, mouse
gtctacgcagcgccggcgac

SEQ ID NO: 788084 - DNA, 20 bp, mouse
ggcctagcgtccatgtagac

SEQ ID NO: 788085 - DNA, 20 bp, mouse
gcgccggcgaccggtctaca

SEQ ID NO: 788086 - DNA, 20 bp, mouse
ggggctggatagaggcacat

SEQ ID NO: 788087 - DNA, 20 bp, mouse
ggccactgccccgccccatc

SEQ ID NO: 788088 - DNA, 20 bp, mouse
gagacaggagggctggatag

SEQ ID NO: 788089 - DNA, 20 bp, mouse
gaattagttctcagctccgg

SEQ ID NO: 788090 - DNA, 20 bp, mouse
gagaactaattcctcgtcct

SEQ ID NO: 788091 - DNA, 20 bp, mouse
gggaatgcccgtcacggagc

SEQ ID NO: 788092 - DNA, 20 bp, mouse
gaatcccagaccctgacctt

SEQ ID NO: 788093 - DNA, 20 bp, mouse
gtccaatcggaggtcctgtt

SEQ ID NO: 788094 - DNA, 20 bp, mouse
gcacggagccggatggggcg

SEQ ID NO: 788095 - DNA, 20 bp, mouse
gcccaaaagccagagtttag

SEQ ID NO: 788096 - DNA, 20 bp, mouse
gttacctggtaaggctaggt

SEQ ID NO: 788097 - DNA, 20 bp, mouse
gataggggttccacgaactg

SEQ ID NO: 788098 - DNA, 20 bp, mouse
ggagccaagtcaggacaatg

SEQ ID NO: 788099 - DNA, 20 bp, mouse
gtgacggcaggcaggtaaca

SEQ ID NO: 788100 - DNA, 20 bp, mouse
gagaaaggttgctttcgctc

SEQ ID NO: 788101 - DNA, 20 bp, mouse
gcaacagctcaaaacaagaa

SEQ ID NO: 788102 - DNA, 20 bp, mouse
gctagccttaccaggtaaga

SEQ ID NO: 788103 - DNA, 20 bp, mouse
gatgcatagaggtgcatcat

SEQ ID NO: 788104 - DNA, 20 bp, mouse
gcacccaacctagccttacc

SEQ ID NO: 788105 - DNA, 20 bp, mouse
gtctggctacgcgtatcgtg

SEQ ID NO: 788106 - DNA, 20 bp, mouse
gaggaaggcctcagaagagt

SEQ ID NO: 788107 - DNA, 20 bp, mouse
gggtagggcccggggaagtt

SEQ ID NO: 788108 - DNA, 20 bp, mouse
gctgccgagtaccaagggat

SEQ ID NO: 788109 - DNA, 20 bp, mouse
gccacaatcaatccctgtga

SEQ ID NO: 788110 - DNA, 20 bp, mouse
gttcttctgccgagtaccaa

SEQ ID NO: 788111 - DNA, 20 bp, mouse
gttggctactctcaagaggt

SEQ ID NO: 788112 - DNA, 20 bp, mouse
gctcttgagagtagccaatc

SEQ ID NO: 788113 - DNA, 20 bp, mouse
gtcacagcaccacacttcct

SEQ ID NO: 788114 - DNA, 20 bp, mouse
gctaagagctgcgcagtcaa

SEQ ID NO: 788115 - DNA, 20 bp, mouse
gtactctcaagaggtgggcg

SEQ ID NO: 788116 - DNA, 20 bp, mouse
gcagggctgggcgggtctag

SEQ ID NO: 788117 - DNA, 20 bp, mouse
gcaagcccggcatgcgggca

SEQ ID NO: 788118 - DNA, 20 bp, mouse
gcctcccaagtgcaccctag

SEQ ID NO: 788119 - DNA, 20 bp, mouse
ggagaaagactagggagcta

SEQ ID NO: 788120 - DNA, 20 bp, mouse
gtgagccatgcccgcatgcc

SEQ ID NO: 788121 - DNA, 20 bp, mouse
gtctccactagggtgcactt

SEQ ID NO: 788122 - DNA, 20 bp, mouse
gggtgtgcatgctgcgtacg

SEQ ID NO: 788123 - DNA, 20 bp, mouse
ggtctgtgaaggcgggaaat

SEQ ID NO: 788124 - DNA, 20 bp, mouse
ggtaaacaagcccggcatgc

SEQ ID NO: 788125 - DNA, 20 bp, mouse
gaacacttggaaaggagtgg

SEQ ID NO: 788126 - DNA, 20 bp, mouse
ggcgggaaaaggggttgaac

SEQ ID NO: 788127 - DNA, 20 bp, mouse
gggcgccgaaagaagagtac

SEQ ID NO: 788128 - DNA, 20 bp, mouse
gtcagggcgctccctacggt

SEQ ID NO: 788129 - DNA, 20 bp, mouse
ggccccgccccctcgcggga

SEQ ID NO: 788130 - DNA, 20 bp, mouse
gtgaaccggaagacagtgtc

SEQ ID NO: 788131 - DNA, 20 bp, mouse
gtacaggcacctaggattga

SEQ ID NO: 788132 - DNA, 20 bp, mouse
gcgccggttcctatctccgt

SEQ ID NO: 788133 - DNA, 20 bp, mouse
gccagctgcgcagcacgggg

SEQ ID NO: 788134 - DNA, 20 bp, mouse
ggataggaaccggcgggaaa

SEQ ID NO: 788135 - DNA, 20 bp, mouse
ggattgaggggcgtggcagt

SEQ ID NO: 788136 - DNA, 20 bp, mouse
gccaccaccgcgagcctccc

SEQ ID NO: 788137 - DNA, 20 bp, mouse
gactggcaggcaggacgcct

SEQ ID NO: 788138 - DNA, 20 bp, mouse
gcatgcgcccttcaactttc

SEQ ID NO: 788139 - DNA, 20 bp, mouse
gtacctgccgcggggcagtc

SEQ ID NO: 788140 - DNA, 20 bp, mouse
ggggcgccgcctacctgccg

SEQ ID NO: 788141 - DNA, 20 bp, mouse
gccccggtcgggtctaggac

SEQ ID NO: 788142 - DNA, 20 bp, mouse
gccatgggaagattccctaa

SEQ ID NO: 788143 - DNA, 20 bp, mouse
gcaggtaggcggcgcccggg

SEQ ID NO: 788144 - DNA, 20 bp, mouse
gactctctgtctcttcgaca

SEQ ID NO: 788145 - DNA, 20 bp, mouse
gcaggcggcgggctcatggt

SEQ ID NO: 788146 - DNA, 20 bp, mouse
gcgttgctagaagcttagag

SEQ ID NO: 788147 - DNA, 20 bp, mouse
gtgccaatggagcccagact

SEQ ID NO: 788148 - DNA, 20 bp, mouse
ggtcccttcccttgcttcca

SEQ ID NO: 788149 - DNA, 20 bp, mouse
gcattcctgaagcaaccaat

SEQ ID NO: 788150 - DNA, 20 bp, mouse
gaacctgcaaagtttaattc

SEQ ID NO: 788151 - DNA, 20 bp, mouse
gtaacgaacaccataatcag

SEQ ID NO: 788152 - DNA, 20 bp, mouse
gaatctgagattccaggcac

SEQ ID NO: 788153 - DNA, 20 bp, mouse
gaaatgctgactaaccctaa

SEQ ID NO: 788154 - DNA, 20 bp, mouse
gtccctgaattaaactttgc

SEQ ID NO: 788155 - DNA, 20 bp, mouse
gagcaacgggatttatatcc

SEQ ID NO: 788156 - DNA, 20 bp, mouse
ggggcgaaggtgcaatgtat

SEQ ID NO: 788157 - DNA, 20 bp, mouse
gcccgagtaccacagatcta

SEQ ID NO: 788158 - DNA, 20 bp, mouse
gagggtcagcgtgtgcggga

SEQ ID NO: 788159 - DNA, 20 bp, mouse
gtgcagaagggtgtgtccca

SEQ ID NO: 788160 - DNA, 20 bp, mouse
gcagagatctggtttttccg

SEQ ID NO: 788161 - DNA, 20 bp, mouse
gagggcgtagttcccgttaa

SEQ ID NO: 788162 - DNA, 20 bp, mouse
gtcagcgtgtgcgggagggc

SEQ ID NO: 788163 - DNA, 20 bp, mouse
ggtcccagggtcagcgtgtg

SEQ ID NO: 788164 - DNA, 20 bp, mouse
ggcgccaagacctgaggtcc

SEQ ID NO: 788165 - DNA, 20 bp, mouse
gaacccagcactgcgcactt

SEQ ID NO: 788166 - DNA, 20 bp, mouse
gcgcgcctcccggggtgatc

SEQ ID NO: 788167 - DNA, 20 bp, mouse
ggggacttgggaggctaccg

SEQ ID NO: 788168 - DNA, 20 bp, mouse
ggctgggcggaggcttgctg

SEQ ID NO: 788169 - DNA, 20 bp, mouse
gtctcctccgcgcgcctccc

SEQ ID NO: 788170 - DNA, 20 bp, mouse
ggaaaggcgcccaggctggg

SEQ ID NO: 788171 - DNA, 20 bp, mouse
gacgtcccgatcaccccggg

SEQ ID NO: 788172 - DNA, 20 bp, mouse
gcactgggcggggataggga

SEQ ID NO: 788173 - DNA, 20 bp, mouse
gtggcctcggctcatcgttc

SEQ ID NO: 788174 - DNA, 20 bp, mouse
gacgtccctgacccagtcac

SEQ ID NO: 788175 - DNA, 20 bp, mouse
gcgcacgtcccgatcacccc

SEQ ID NO: 788176 - DNA, 20 bp, mouse
ggggcgcgccccctctatcg

SEQ ID NO: 788177 - DNA, 20 bp, mouse
ggccgcgcgccgctcaccgt

SEQ ID NO: 788178 - DNA, 20 bp, mouse
ggccccctctatcgcggacg

SEQ ID NO: 788179 - DNA, 20 bp, mouse
ggatgtcgggctacgcgcgg

SEQ ID NO: 788180 - DNA, 20 bp, mouse
ggctccgcgtccgcgataga

SEQ ID NO: 788181 - DNA, 20 bp, mouse
gcgcggggcggggtcggaag

SEQ ID NO: 788182 - DNA, 20 bp, mouse
gctcaccgtcgggaaccaca

SEQ ID NO: 788183 - DNA, 20 bp, mouse
gggcgctcacagtctagctg

SEQ ID NO: 788184 - DNA, 20 bp, mouse
gtggcccgcaaggcagtcgc

SEQ ID NO: 788185 - DNA, 20 bp, mouse
ggccccgcggcgttcggcgc

SEQ ID NO: 788186 - DNA, 20 bp, mouse
gaactggggagggagtcaaa

SEQ ID NO: 788187 - DNA, 20 bp, mouse
ggagggagtcaaagggtgaa

SEQ ID NO: 788188 - DNA, 20 bp, mouse
gtcaaagggtgaagggattg

SEQ ID NO: 788189 - DNA, 20 bp, mouse
gacacaagggacaaagtgaa

SEQ ID NO: 788190 - DNA, 20 bp, mouse
gatttggagcgaactgggga

SEQ ID NO: 788191 - DNA, 20 bp, mouse
gctccaggccccagaactag

SEQ ID NO: 788192 - DNA, 20 bp, mouse
gcagttcgctccaaataatc

SEQ ID NO: 788193 - DNA, 20 bp, mouse
gagagagatccagtgcggga

SEQ ID NO: 788194 - DNA, 20 bp, mouse
gagcccagacacagaatcaa

SEQ ID NO: 788195 - DNA, 20 bp, mouse
gctcggcaaaggtattccta

SEQ ID NO: 788196 - DNA, 20 bp, mouse
gctagccagaggacctactg

SEQ ID NO: 788197 - DNA, 20 bp, mouse
gtggcggccggtaagctcga

SEQ ID NO: 788198 - DNA, 20 bp, mouse
ggcgccccaccgcttccgga

SEQ ID NO: 788199 - DNA, 20 bp, mouse
gggtcacaggacaattcccg

SEQ ID NO: 788200 - DNA, 20 bp, mouse
gcgaaggcttcctagagctg

SEQ ID NO: 788201 - DNA, 20 bp, mouse
ggaccacctgcggacaccta

SEQ ID NO: 788202 - DNA, 20 bp, mouse
gcccgcccacagcaggaagt

SEQ ID NO: 788203 - DNA, 20 bp, mouse
gagctgcggcacggcccaga

SEQ ID NO: 788204 - DNA, 20 bp, mouse
ggcggcgcgccgaccacctg

SEQ ID NO: 788205 - DNA, 20 bp, mouse
gttcccgcggcagccacagt

SEQ ID NO: 788206 - DNA, 20 bp, mouse
gctagactggacgagggata

SEQ ID NO: 788207 - DNA, 20 bp, mouse
gggcgcgctagactggacga

SEQ ID NO: 788208 - DNA, 20 bp, mouse
ggccaactcaaaggtcaagt

SEQ ID NO: 788209 - DNA, 20 bp, mouse
gtgcacgtggcccgcgtcgg

SEQ ID NO: 788210 - DNA, 20 bp, mouse
gaaggtagcgggcgagggac

SEQ ID NO: 788211 - DNA, 20 bp, mouse
gcggcccctgcctggtgcgc

SEQ ID NO: 788212 - DNA, 20 bp, mouse
gcaaggaaggtagcgggcga

SEQ ID NO: 788213 - DNA, 20 bp, mouse
gcagaagggaccgggaccct

SEQ ID NO: 788214 - DNA, 20 bp, mouse
ggaagtccccgagctttcat

SEQ ID NO: 788215 - DNA, 20 bp, mouse
gcgtctcctggaacacccat

SEQ ID NO: 788216 - DNA, 20 bp, mouse
ggggccatgacgtcacatct

SEQ ID NO: 788217 - DNA, 20 bp, mouse
gttgtgtagaagggaacttg

SEQ ID NO: 788218 - DNA, 20 bp, mouse
gaaaccagcgcgcagagaat

SEQ ID NO: 788219 - DNA, 20 bp, mouse
gcatgacgtcacatctgggc

SEQ ID NO: 788220 - DNA, 20 bp, mouse
gctcaccttgtcagccgaga

SEQ ID NO: 788221 - DNA, 20 bp, mouse
gggtgagccgagagtgacgc

SEQ ID NO: 788222 - DNA, 20 bp, mouse
gcgtcatggccccgccttct

SEQ ID NO: 788223 - DNA, 20 bp, mouse
gagagaatgggcgtagaaac

SEQ ID NO: 788224 - DNA, 20 bp, mouse
gggaaaggtacttagatact

SEQ ID NO: 788225 - DNA, 20 bp, mouse
gtaagtgcgtgctgcgcagg

SEQ ID NO: 788226 - DNA, 20 bp, mouse
gtaactaaggagttggacag

SEQ ID NO: 788227 - DNA, 20 bp, mouse
ggccttgtaaggcaattccc

SEQ ID NO: 788228 - DNA, 20 bp, mouse
gagcgggggcgggtgggctg

SEQ ID NO: 788229 - DNA, 20 bp, mouse
gcacccccactctggactag

SEQ ID NO: 788230 - DNA, 20 bp, mouse
gctaggagacattgcggcgg

SEQ ID NO: 788231 - DNA, 20 bp, mouse
gacccgggaattgccttaca

SEQ ID NO: 788232 - DNA, 20 bp, mouse
gcacttggctaccagaccac

SEQ ID NO: 788233 - DNA, 20 bp, mouse
gtgggcagccgagcacgcgg

SEQ ID NO: 788234 - DNA, 20 bp, mouse
ggggtgggctggggcgtaca

SEQ ID NO: 788235 - DNA, 20 bp, mouse
gcggctgcccagggctcgcg

SEQ ID NO: 788236 - DNA, 20 bp, mouse
gggtctgaacgcgatgtagt

SEQ ID NO: 788237 - DNA, 20 bp, mouse
gcccctggtgcggagaggcg

SEQ ID NO: 788238 - DNA, 20 bp, mouse
gggctcctccccctactggt

SEQ ID NO: 788239 - DNA, 20 bp, mouse
gctgaacgcgatgtagtggg

SEQ ID NO: 788240 - DNA, 20 bp, mouse
gcccgccccggcccctggtg

SEQ ID NO: 788241 - DNA, 20 bp, mouse
gtcccagcacctgcgcgcta

SEQ ID NO: 788242 - DNA, 20 bp, mouse
ggcctccagacccaccagta

SEQ ID NO: 788243 - DNA, 20 bp, mouse
gcccggcccctggtgcggag

SEQ ID NO: 788244 - DNA, 20 bp, mouse
gcaccctagcgcgcaggtgc

SEQ ID NO: 788245 - DNA, 20 bp, mouse
gcctgcgcgctagggtgcga

SEQ ID NO: 788246 - DNA, 20 bp, mouse
gcgcagtgaggattgcatat

SEQ ID NO: 788247 - DNA, 20 bp, mouse
gggaaccgttgtggtagctt

SEQ ID NO: 788248 - DNA, 20 bp, mouse
gcgaacccgcccatgggcaa

SEQ ID NO: 788249 - DNA, 20 bp, mouse
gagagcgcctcaagcgagtc

SEQ ID NO: 788250 - DNA, 20 bp, mouse
gccaaagctcatctatgcta

SEQ ID NO: 788251 - DNA, 20 bp, mouse
gaggactgcgcatgcgccgt

SEQ ID NO: 788252 - DNA, 20 bp, mouse
ggggcaaggggcggaatttc

SEQ ID NO: 788253 - DNA, 20 bp, mouse
gcgtagggatcaagtgacta

SEQ ID NO: 788254 - DNA, 20 bp, mouse
gactgcgcatgcgccgtggg

SEQ ID NO: 788255 - DNA, 20 bp, mouse
gtctgagccagagcggatag

SEQ ID NO: 788256 - DNA, 20 bp, mouse
gtcccagcatgagaagatca

SEQ ID NO: 788257 - DNA, 20 bp, mouse
gctgcgcagcggaaacgcgt

SEQ ID NO: 788258 - DNA, 20 bp, mouse
ggctggtgggagtttcagtg

SEQ ID NO: 788259 - DNA, 20 bp, mouse
ggtcacaccaaggccagagc

SEQ ID NO: 788260 - DNA, 20 bp, mouse
gcggcgcgccctgggactag

SEQ ID NO: 788261 - DNA, 20 bp, mouse
ggaaacgcgtgggcagcacg

SEQ ID NO: 788262 - DNA, 20 bp, mouse
ggccctgggactagcggcta

SEQ ID NO: 788263 - DNA, 20 bp, mouse
gagaagcccaggttctctag

SEQ ID NO: 788264 - DNA, 20 bp, mouse
gcttctcatgctgggaaaag

SEQ ID NO: 788265 - DNA, 20 bp, mouse
gagctgtgctgaaagatcat

SEQ ID NO: 788266 - DNA, 20 bp, mouse
gaagcccagagaagtaccgg

SEQ ID NO: 788267 - DNA, 20 bp, mouse
gcagcctccggtacttctct

SEQ ID NO: 788268 - DNA, 20 bp, mouse
gagcgttccaaggtgtccgt

SEQ ID NO: 788269 - DNA, 20 bp, mouse
ggataagcccagagaagtac

SEQ ID NO: 788270 - DNA, 20 bp, mouse
gcagacgagcaaagattgat

SEQ ID NO: 788271 - DNA, 20 bp, mouse
ggatatggaatgttctccgc

SEQ ID NO: 788272 - DNA, 20 bp, mouse
gaaaattagaagtacgtcct

SEQ ID NO: 788273 - DNA, 20 bp, mouse
gactgtgttcgaggggactc

SEQ ID NO: 788274 - DNA, 20 bp, mouse
gtctgtgtgcccgtgggcac

SEQ ID NO: 788275 - DNA, 20 bp, mouse
gttgtgaaacctgtgcccac

SEQ ID NO: 788276 - DNA, 20 bp, mouse
gcagatcttcccacaagcct

SEQ ID NO: 788277 - DNA, 20 bp, mouse
gcagagaagcagagccctct

SEQ ID NO: 788278 - DNA, 20 bp, mouse
gcacatgagcttgggctggc

SEQ ID NO: 788279 - DNA, 20 bp, mouse
ggactgcagtccaaacgata

SEQ ID NO: 788280 - DNA, 20 bp, mouse
gagcatgctttcatcatccc

SEQ ID NO: 788281 - DNA, 20 bp, mouse
gttggtggtaaaatcagggt

SEQ ID NO: 788282 - DNA, 20 bp, mouse
gctgcttggtggtaaaatca

SEQ ID NO: 788283 - DNA, 20 bp, mouse
gataaggctggagcataaaa

SEQ ID NO: 788284 - DNA, 20 bp, mouse
gaagcagagccctcttggcg

SEQ ID NO: 788285 - DNA, 20 bp, mouse
ggcagacgagtgacttagtg

SEQ ID NO: 788286 - DNA, 20 bp, mouse
gcaaaaggggaggtgacttc

SEQ ID NO: 788287 - DNA, 20 bp, mouse
gatcgtggcagcaccaccct

SEQ ID NO: 788288 - DNA, 20 bp, mouse
ggcaccaccctgggaccttc

SEQ ID NO: 788289 - DNA, 20 bp, mouse
gtatccccagtgggcgggac

SEQ ID NO: 788290 - DNA, 20 bp, mouse
gcatccggtcccgcccactg

SEQ ID NO: 788291 - DNA, 20 bp, mouse
gtggggctatccccagtggg

SEQ ID NO: 788292 - DNA, 20 bp, mouse
ggggacagccccacctacac

SEQ ID NO: 788293 - DNA, 20 bp, mouse
gtacgggaggctgtgtaggt

SEQ ID NO: 788294 - DNA, 20 bp, mouse
gtgggcgggaccggatgctg

SEQ ID NO: 788295 - DNA, 20 bp, mouse
gtggggctgtcccgggtggg

SEQ ID NO: 788296 - DNA, 20 bp, mouse
gttgctatggtgccaagaag

SEQ ID NO: 788297 - DNA, 20 bp, mouse
gcgagatacgcgggctccag

SEQ ID NO: 788298 - DNA, 20 bp, mouse
gtgacactgggggagacaag

SEQ ID NO: 788299 - DNA, 20 bp, mouse
ggactcctcaaaccccttct

SEQ ID NO: 788300 - DNA, 20 bp, mouse
gaagaatcagggaaggcggg

SEQ ID NO: 788301 - DNA, 20 bp, mouse
gagtgggatcaggtggttcc

SEQ ID NO: 788302 - DNA, 20 bp, mouse
gctgcagtggagggcggaac

SEQ ID NO: 788303 - DNA, 20 bp, mouse
gcatgacgacgcgagatacg

SEQ ID NO: 788304 - DNA, 20 bp, mouse
gtgaggagtctattctatga

SEQ ID NO: 788305 - DNA, 20 bp, mouse
gtagcaaccgccagatcctc

SEQ ID NO: 788306 - DNA, 20 bp, mouse
ggaggaacgcaggatcagga

SEQ ID NO: 788307 - DNA, 20 bp, mouse
gcgggcggtcgctgcggcag

SEQ ID NO: 788308 - DNA, 20 bp, mouse
gtctgagcgggcggtcgctg

SEQ ID NO: 788309 - DNA, 20 bp, mouse
gagttcccggcaacgcgggg

SEQ ID NO: 788310 - DNA, 20 bp, mouse
gtcaggaggagggaccgcga

SEQ ID NO: 788311 - DNA, 20 bp, mouse
gcagatccaactttgctcgg

SEQ ID NO: 788312 - DNA, 20 bp, mouse
gccgccccgccccgcgttgc

SEQ ID NO: 788313 - DNA, 20 bp, mouse
gcggagaagggagggtacga

SEQ ID NO: 788314 - DNA, 20 bp, mouse
gggagggagaaagcggggtc

SEQ ID NO: 788315 - DNA, 20 bp, mouse
gaccgcgaggggtgggtcgc

SEQ ID NO: 788316 - DNA, 20 bp, mouse
ggcgtcgcctgggagacagc

SEQ ID NO: 788317 - DNA, 20 bp, mouse
gtgtctgttgcctaggcctt

SEQ ID NO: 788318 - DNA, 20 bp, mouse
ggtctcccaggcgacgcaga

SEQ ID NO: 788319 - DNA, 20 bp, mouse
ggcaggggtgtattggggat

SEQ ID NO: 788320 - DNA, 20 bp, mouse
gttgggcaacctggggcctc

SEQ ID NO: 788321 - DNA, 20 bp, mouse
ggagacccctgagcactctg

SEQ ID NO: 788322 - DNA, 20 bp, mouse
gcagcaggtgacgtcaccgg

SEQ ID NO: 788323 - DNA, 20 bp, mouse
gcggcgcattggacaacttg

SEQ ID NO: 788324 - DNA, 20 bp, mouse
gaggaccgcagagtgctcag

SEQ ID NO: 788325 - DNA, 20 bp, mouse
gtcacaaaccccagattcag

SEQ ID NO: 788326 - DNA, 20 bp, mouse
gcaacctccttgcaagtcca

SEQ ID NO: 788327 - DNA, 20 bp, mouse
gagcagggttcagtgaggtt

SEQ ID NO: 788328 - DNA, 20 bp, mouse
gtgaacaagactgaatgtct

SEQ ID NO: 788329 - DNA, 20 bp, mouse
gctgcaaccaaaggtcagca

SEQ ID NO: 788330 - DNA, 20 bp, mouse
gagactgaatgtctgggaaa

SEQ ID NO: 788331 - DNA, 20 bp, mouse
gtagaaaggcagtgatgtcc

SEQ ID NO: 788332 - DNA, 20 bp, mouse
gaggcaaagaccaatgccag

SEQ ID NO: 788333 - DNA, 20 bp, mouse
gggaaaatgccaatgtcagg

SEQ ID NO: 788334 - DNA, 20 bp, mouse
gtggggaaaatgccaatgtc

SEQ ID NO: 788335 - DNA, 20 bp, mouse
gtgccagtggaggaaagaac

SEQ ID NO: 788336 - DNA, 20 bp, mouse
gctccatggcaacagtccat

SEQ ID NO: 788337 - DNA, 20 bp, mouse
ggtggagaaacggctctgga

SEQ ID NO: 788338 - DNA, 20 bp, mouse
gtgactgcttaggtgttcat

SEQ ID NO: 788339 - DNA, 20 bp, mouse
ggccagctcggtatagatca

SEQ ID NO: 788340 - DNA, 20 bp, mouse
gctcagatccgcatccccgg

SEQ ID NO: 788341 - DNA, 20 bp, mouse
gcgtggtggagaaacggctc

SEQ ID NO: 788342 - DNA, 20 bp, mouse
gaaagagaaaaagtagtccg

SEQ ID NO: 788343 - DNA, 20 bp, mouse
gcatcctagcctgctgtgtg

SEQ ID NO: 788344 - DNA, 20 bp, mouse
ggtcctcagatccgcatccc

SEQ ID NO: 788345 - DNA, 20 bp, mouse
gatggagaccgccggggatg

SEQ ID NO: 788346 - DNA, 20 bp, mouse
gcgcagcagctgctcttaaa

SEQ ID NO: 788347 - DNA, 20 bp, mouse
ggcagcctgcagtgttacta

SEQ ID NO: 788348 - DNA, 20 bp, mouse
ggagacggggactagcagga

SEQ ID NO: 788349 - DNA, 20 bp, mouse
gctgcagctggggtctgccc

SEQ ID NO: 788350 - DNA, 20 bp, mouse
gaggtgggaaggagggttta

SEQ ID NO: 788351 - DNA, 20 bp, mouse
ggaggcctgtaatcgcagga

SEQ ID NO: 788352 - DNA, 20 bp, mouse
gagctgctgcgaccgtaccc

SEQ ID NO: 788353 - DNA, 20 bp, mouse
ggtgatcagtctcacttcaa

SEQ ID NO: 788354 - DNA, 20 bp, mouse
gtgctcttaaagggccaggt

SEQ ID NO: 788355 - DNA, 20 bp, mouse
gtatggagacggggactagc

SEQ ID NO: 788356 - DNA, 20 bp, mouse
gtagacctcgggaaagagaa

SEQ ID NO: 788357 - DNA, 20 bp, mouse
ggcagccctggagcgatcag

SEQ ID NO: 788358 - DNA, 20 bp, mouse
gcaagtggaaagcaagggtg

SEQ ID NO: 788359 - DNA, 20 bp, mouse
ggggacccagtggtagataa

SEQ ID NO: 788360 - DNA, 20 bp, mouse
ggcaggagcgatgttctaaa

SEQ ID NO: 788361 - DNA, 20 bp, mouse
gtggggtaccgctggaactg

SEQ ID NO: 788362 - DNA, 20 bp, mouse
gccagcccctgatcgctcca

SEQ ID NO: 788363 - DNA, 20 bp, mouse
gatgctgggcaaagagtctt

SEQ ID NO: 788364 - DNA, 20 bp, mouse
ggctcagacactaactgaga

SEQ ID NO: 788365 - DNA, 20 bp, mouse
gtccgggcggggggacccag

SEQ ID NO: 788366 - DNA, 20 bp, mouse
gggccccagccaatgatcgc

SEQ ID NO: 788367 - DNA, 20 bp, mouse
gcaaccacggcaggcggcga

SEQ ID NO: 788368 - DNA, 20 bp, mouse
gaccacccgaggaccggaag

SEQ ID NO: 788369 - DNA, 20 bp, mouse
ggtgatagatccaatctcgg

SEQ ID NO: 788370 - DNA, 20 bp, mouse
gggagcgcaaccacggcagg

SEQ ID NO: 788371 - DNA, 20 bp, mouse
ggagcggggagggattacgt

SEQ ID NO: 788372 - DNA, 20 bp, mouse
gtgatcgcgggcttcttctc

SEQ ID NO: 788373 - DNA, 20 bp, mouse
gtgacttgccggcttctcat

SEQ ID NO: 788374 - DNA, 20 bp, mouse
gctcgggcctggaccacccg

SEQ ID NO: 788375 - DNA, 20 bp, mouse
gaagcagcggagcgcaacca

SEQ ID NO: 788376 - DNA, 20 bp, mouse
gcatgccaggggcctaaggc

SEQ ID NO: 788377 - DNA, 20 bp, mouse
gcttcggctgcgagcgtatg

SEQ ID NO: 788378 - DNA, 20 bp, mouse
ggtaaagactgtgaatgctt

SEQ ID NO: 788379 - DNA, 20 bp, mouse
gggaccccgcctaggaaaag

SEQ ID NO: 788380 - DNA, 20 bp, mouse
gtgtggagaagcatctgttg

SEQ ID NO: 788381 - DNA, 20 bp, mouse
gaaggcttccgggtagaatg

SEQ ID NO: 788382 - DNA, 20 bp, mouse
gcaggggcctaaggctggat

SEQ ID NO: 788383 - DNA, 20 bp, mouse
gggtccatgccaggggccta

SEQ ID NO: 788384 - DNA, 20 bp, mouse
gctgcgagcgtatgagggca

SEQ ID NO: 788385 - DNA, 20 bp, mouse
gcacggagacattagcaaac

SEQ ID NO: 788386 - DNA, 20 bp, mouse
gtagaggctgcgttgatggg

SEQ ID NO: 788387 - DNA, 20 bp, mouse
gaggcaggcaggattgtagt

SEQ ID NO: 788388 - DNA, 20 bp, mouse
gtgaacgcggagcaggggag

SEQ ID NO: 788389 - DNA, 20 bp, mouse
gcgggagtccaggtgaaaac

SEQ ID NO: 788390 - DNA, 20 bp, mouse
gaggctagaggctgcgttga

SEQ ID NO: 788391 - DNA, 20 bp, mouse
gtgtgaggatggccagccta

SEQ ID NO: 788392 - DNA, 20 bp, mouse
ggaaggggagggctgtgcgt

SEQ ID NO: 788393 - DNA, 20 bp, mouse
ggggctgtttggttgatgaa

SEQ ID NO: 788394 - DNA, 20 bp, mouse
gtaggcatgtgtcatcatcg

SEQ ID NO: 788395 - DNA, 20 bp, mouse
gccaggtgaaaacaggctag

SEQ ID NO: 788396 - DNA, 20 bp, mouse
ggggctgaggatataaaggc

SEQ ID NO: 788397 - DNA, 20 bp, mouse
ggttgccttagactaggagt

SEQ ID NO: 788398 - DNA, 20 bp, mouse
gctagatggtaggcatagac

SEQ ID NO: 788399 - DNA, 20 bp, mouse
gcaaggccgctgccattggc

SEQ ID NO: 788400 - DNA, 20 bp, mouse
ggtgtttccccaaatcctgc

SEQ ID NO: 788401 - DNA, 20 bp, mouse
gcctggggctgaggatataa

SEQ ID NO: 788402 - DNA, 20 bp, mouse
ggtgtgcgggtttcatctgc

SEQ ID NO: 788403 - DNA, 20 bp, mouse
ggtctctttgaaaagaactc

SEQ ID NO: 788404 - DNA, 20 bp, mouse
gcatagacaggatggcaaga

SEQ ID NO: 788405 - DNA, 20 bp, mouse
gggatggcaagatggcaaga

SEQ ID NO: 788406 - DNA, 20 bp, mouse
gaaatcatgactgtgtgcgg

SEQ ID NO: 788407 - DNA, 20 bp, mouse
gcatgactgtgtgcgggggt

SEQ ID NO: 788408 - DNA, 20 bp, mouse
gctagtctaaggccaccagc

SEQ ID NO: 788409 - DNA, 20 bp, mouse
ggtggggggggatcacctgc

SEQ ID NO: 788410 - DNA, 20 bp, mouse
ggcctggggctaggatgtaa

SEQ ID NO: 788411 - DNA, 20 bp, mouse
ggggggggatcacctgctgg

SEQ ID NO: 788412 - DNA, 20 bp, mouse
gatagtaggcataaacagga

SEQ ID NO: 788413 - DNA, 20 bp, mouse
gggggctaggatgtaaaggc

SEQ ID NO: 788414 - DNA, 20 bp, mouse
gcaaggctgctgccattggt

SEQ ID NO: 788415 - DNA, 20 bp, mouse
gaggatgtaaaggccggcct

SEQ ID NO: 788416 - DNA, 20 bp, mouse
ggtgggctgcaggatggctt

SEQ ID NO: 788417 - DNA, 20 bp, mouse
gagggggcgtggcggatagg

SEQ ID NO: 788418 - DNA, 20 bp, mouse
ggcagcccacaatggaagtg

SEQ ID NO: 788419 - DNA, 20 bp, mouse
gttcccctcacttccattgt

SEQ ID NO: 788420 - DNA, 20 bp, mouse
gaagagcagcctgtcagtga

SEQ ID NO: 788421 - DNA, 20 bp, mouse
gccagagtctgaatggggtg

SEQ ID NO: 788422 - DNA, 20 bp, mouse
gccgtccagagcagggtgca

SEQ ID NO: 788423 - DNA, 20 bp, mouse
ggcgtggcggatagggggcg

SEQ ID NO: 788424 - DNA, 20 bp, mouse
gagcagcctgtcagtgaggg

SEQ ID NO: 788425 - DNA, 20 bp, mouse
gagacagcgtgtagcgatgg

SEQ ID NO: 788426 - DNA, 20 bp, mouse
gcccagcaggtgtcacgaag

SEQ ID NO: 788427 - DNA, 20 bp, mouse
gtgggcagcccctggactca

SEQ ID NO: 788428 - DNA, 20 bp, mouse
gcaggggctgcccaagctgt

SEQ ID NO: 788429 - DNA, 20 bp, mouse
gcaggtgtcacgaaggggcg

SEQ ID NO: 788430 - DNA, 20 bp, mouse
gggcggggcctggtcggcag

SEQ ID NO: 788431 - DNA, 20 bp, mouse
gttagtgcggggtgagggcg

SEQ ID NO: 788432 - DNA, 20 bp, mouse
gtgggtatccctggagaagg

SEQ ID NO: 788433 - DNA, 20 bp, mouse
gcaaagccatctgagagacc

SEQ ID NO: 788434 - DNA, 20 bp, mouse
gcctgggcgcgcgatccaac

SEQ ID NO: 788435 - DNA, 20 bp, mouse
gcggctctccctgagtccag

SEQ ID NO: 788436 - DNA, 20 bp, mouse
gtggccagatctaagtgggt

SEQ ID NO: 788437 - DNA, 20 bp, mouse
gtcttgagggtgcacctctt

SEQ ID NO: 788438 - DNA, 20 bp, mouse
gccagagagaggagaatcta

SEQ ID NO: 788439 - DNA, 20 bp, mouse
gcctagcatgggaagacgga

SEQ ID NO: 788440 - DNA, 20 bp, mouse
gagcggagggcccacttcct

SEQ ID NO: 788441 - DNA, 20 bp, mouse
ggatctggccaagtaggtga

SEQ ID NO: 788442 - DNA, 20 bp, mouse
gtgtaagctactgttcttga

SEQ ID NO: 788443 - DNA, 20 bp, mouse
gctgcccacccacttagatc

SEQ ID NO: 788444 - DNA, 20 bp, mouse
gaacagtagcttacagcgga

SEQ ID NO: 788445 - DNA, 20 bp, mouse
gatggcacgtggcctagcat

SEQ ID NO: 788446 - DNA, 20 bp, mouse
ggtgggctttcccaaatcct

SEQ ID NO: 788447 - DNA, 20 bp, mouse
gagccagtgggaggcccaat

SEQ ID NO: 788448 - DNA, 20 bp, mouse
gcccacgcgggagggacatg

SEQ ID NO: 788449 - DNA, 20 bp, mouse
gtgggaaagcccacgcggga

SEQ ID NO: 788450 - DNA, 20 bp, mouse
gcacccgaagacagcttagg

SEQ ID NO: 788451 - DNA, 20 bp, mouse
gcagccgcctaagctgtctt

SEQ ID NO: 788452 - DNA, 20 bp, mouse
gctaggcttggatgcttgct

SEQ ID NO: 788453 - DNA, 20 bp, mouse
gggaggcccaatgggcgtac

SEQ ID NO: 788454 - DNA, 20 bp, mouse
gcgcgggagggacatggggc

SEQ ID NO: 788455 - DNA, 20 bp, mouse
ggaaaaggagagagtgccac

SEQ ID NO: 788456 - DNA, 20 bp, mouse
ggaccagcaccgtaagtggg

SEQ ID NO: 788457 - DNA, 20 bp, mouse
ggaaagaggcacaatcagga

SEQ ID NO: 788458 - DNA, 20 bp, mouse
gctgtggccctagcaagtga

SEQ ID NO: 788459 - DNA, 20 bp, mouse
gtctgagcaggtgagatgat

SEQ ID NO: 788460 - DNA, 20 bp, mouse
gcctggtgtacacgtggaga

SEQ ID NO: 788461 - DNA, 20 bp, mouse
gtggggtgagtggaactcag

SEQ ID NO: 788462 - DNA, 20 bp, mouse
gaagatagcagcagtatgtg

SEQ ID NO: 788463 - DNA, 20 bp, mouse
gaagtcgcctggcatggacc

SEQ ID NO: 788464 - DNA, 20 bp, mouse
gggtgtacacgtggagaggg

SEQ ID NO: 788465 - DNA, 20 bp, mouse
ggtgtaattgggaatcgtgt

SEQ ID NO: 788466 - DNA, 20 bp, mouse
ggaatcggacacaggggaaa

SEQ ID NO: 788467 - DNA, 20 bp, mouse
ggggaaagggagggcatgta

SEQ ID NO: 788468 - DNA, 20 bp, mouse
gcggtggtctaatttgtaac

SEQ ID NO: 788469 - DNA, 20 bp, mouse
ggggcggctgttaaataaaa

SEQ ID NO: 788470 - DNA, 20 bp, mouse
gacaggccttgtgagggctt

SEQ ID NO: 788471 - DNA, 20 bp, mouse
ggagctgacgatttatgaaa

SEQ ID NO: 788472 - DNA, 20 bp, mouse
gccagccatgcctagtgtgg

SEQ ID NO: 788473 - DNA, 20 bp, mouse
gcgtctgacaggccttgtga

SEQ ID NO: 788474 - DNA, 20 bp, mouse
gtggtcctccggggagtccc

SEQ ID NO: 788475 - DNA, 20 bp, mouse
gtagtgtggcggcctcttaa

SEQ ID NO: 788476 - DNA, 20 bp, mouse
gaccgccgggagttgtagtc

SEQ ID NO: 788477 - DNA, 20 bp, mouse
gtccccaactcttaccattc

SEQ ID NO: 788478 - DNA, 20 bp, mouse
gcctgtaggcgctgctgggt

SEQ ID NO: 788479 - DNA, 20 bp, mouse
gccagccaaaggtatctagg

SEQ ID NO: 788480 - DNA, 20 bp, mouse
ggccccactgcaaaccggaa

SEQ ID NO: 788481 - DNA, 20 bp, mouse
gaaccggaatggtaagagtt

SEQ ID NO: 788482 - DNA, 20 bp, mouse
gagtccgaaacaatcgatgg

SEQ ID NO: 788483 - DNA, 20 bp, mouse
gtggaaatcgaggagcaaaa

SEQ ID NO: 788484 - DNA, 20 bp, mouse
gtggcttgtgagacgagcta

SEQ ID NO: 788485 - DNA, 20 bp, mouse
ggtgagacgagctaggggta

SEQ ID NO: 788486 - DNA, 20 bp, mouse
gacgtggggacggccgtctg

SEQ ID NO: 788487 - DNA, 20 bp, mouse
gggagaccagaagtgtaaag

SEQ ID NO: 788488 - DNA, 20 bp, mouse
ggggacggccgtctggggtt

SEQ ID NO: 788489 - DNA, 20 bp, mouse
gtaaagtggctgacagttca

SEQ ID NO: 788490 - DNA, 20 bp, mouse
gaagaaggaggcaagcgaca

SEQ ID NO: 788491 - DNA, 20 bp, mouse
gagcacagtcagggatcaag

SEQ ID NO: 788492 - DNA, 20 bp, mouse
gcacccgagcggagtgatgt

SEQ ID NO: 788493 - DNA, 20 bp, mouse
ggctgacagttcagggaggt

SEQ ID NO: 788494 - DNA, 20 bp, mouse
gagggatcaagcggccacgt

SEQ ID NO: 788495 - DNA, 20 bp, mouse
gcggagtgatgtaggcaagg

SEQ ID NO: 788496 - DNA, 20 bp, mouse
gggaagtgacgcaagctcta

SEQ ID NO: 788497 - DNA, 20 bp, mouse
gctcctaagcctacgtaata

SEQ ID NO: 788498 - DNA, 20 bp, mouse
gcagccacgccctattacgt

SEQ ID NO: 788499 - DNA, 20 bp, mouse
ggagaggcaccgcttcggaa

SEQ ID NO: 788500 - DNA, 20 bp, mouse
gggaggggcggggagtttgt

SEQ ID NO: 788501 - DNA, 20 bp, mouse
ggcacttgccccttccgaag

SEQ ID NO: 788502 - DNA, 20 bp, mouse
gacggttaggcggagatcaa

SEQ ID NO: 788503 - DNA, 20 bp, mouse
gcttgggagaggcaccgctt

SEQ ID NO: 788504 - DNA, 20 bp, mouse
ggggggcggggcgtagcggt

SEQ ID NO: 788505 - DNA, 20 bp, mouse
ggcgcccggaccccaaacac

SEQ ID NO: 788506 - DNA, 20 bp, mouse
gccaatgggcagcgcctcca

SEQ ID NO: 788507 - DNA, 20 bp, mouse
gagggcggggcgaagtctcg

SEQ ID NO: 788508 - DNA, 20 bp, mouse
gggagcgagaccaattagag

SEQ ID NO: 788509 - DNA, 20 bp, mouse
gaaggaacccagcagccaat

SEQ ID NO: 788510 - DNA, 20 bp, mouse
ggggacagcagccaaggcga

SEQ ID NO: 788511 - DNA, 20 bp, mouse
gcggggcgaagtctcggggc

SEQ ID NO: 788512 - DNA, 20 bp, mouse
ggctactgaagaagaacgta

SEQ ID NO: 788513 - DNA, 20 bp, mouse
ggtggtgggctgatactctg

SEQ ID NO: 788514 - DNA, 20 bp, mouse
ggtaagtggccggccagtgg

SEQ ID NO: 788515 - DNA, 20 bp, mouse
gactggccggccacttactg

SEQ ID NO: 788516 - DNA, 20 bp, mouse
gcggcgcgggaagtattaaa

SEQ ID NO: 788517 - DNA, 20 bp, mouse
gtgaaagaaacgcattctgg

SEQ ID NO: 788518 - DNA, 20 bp, mouse
gactccgcccacaggagtgc

SEQ ID NO: 788519 - DNA, 20 bp, mouse
ggactgaaagaaacgcattc

SEQ ID NO: 788520 - DNA, 20 bp, mouse
gcattctggtggtttgactc

SEQ ID NO: 788521 - DNA, 20 bp, mouse
gccgggaaagcaatccttgc

SEQ ID NO: 788522 - DNA, 20 bp, mouse
gcggcagtttgcaggctcca

SEQ ID NO: 788523 - DNA, 20 bp, mouse
gtgcgtccgactccgcccac

SEQ ID NO: 788524 - DNA, 20 bp, mouse
ggcgcgcgctagtgttatca

SEQ ID NO: 788525 - DNA, 20 bp, mouse
gttttcaccgataagggtgg

SEQ ID NO: 788526 - DNA, 20 bp, mouse
gggcgcggaggcgggaccga

SEQ ID NO: 788527 - DNA, 20 bp, mouse
ggggcctcgggtaacaacac

SEQ ID NO: 788528 - DNA, 20 bp, mouse
gcaacgtgcgctctttgtga

SEQ ID NO: 788529 - DNA, 20 bp, mouse
gcacccccaggctaccccaa

SEQ ID NO: 788530 - DNA, 20 bp, mouse
gtgggccgccgcagggaggt

SEQ ID NO: 788531 - DNA, 20 bp, mouse
gttgcgcaggcgcgcccaac

SEQ ID NO: 788532 - DNA, 20 bp, mouse
gccccaaaggatcgctgcca

SEQ ID NO: 788533 - DNA, 20 bp, mouse
gttgcctcggggcgcggagg

SEQ ID NO: 788534 - DNA, 20 bp, mouse
gcccgcccacctccctgcgg

SEQ ID NO: 788535 - DNA, 20 bp, mouse
gctctcggtaagagcccgtt

SEQ ID NO: 788536 - DNA, 20 bp, mouse
gtctccctgtagagggaagg

SEQ ID NO: 788537 - DNA, 20 bp, mouse
gtagagggaaggaggcttgg

SEQ ID NO: 788538 - DNA, 20 bp, mouse
gcctgcgggaggagcatgtc

SEQ ID NO: 788539 - DNA, 20 bp, mouse
ggccgctgcaagcgcggaag

SEQ ID NO: 788540 - DNA, 20 bp, mouse
gtgcaagcgcggaagaggac

SEQ ID NO: 788541 - DNA, 20 bp, mouse
gtgcggggtggctgttgtca

SEQ ID NO: 788542 - DNA, 20 bp, mouse
ggggctggcccagtgaccgc

SEQ ID NO: 788543 - DNA, 20 bp, mouse
gcggggaaagtccagcagcg

SEQ ID NO: 788544 - DNA, 20 bp, mouse
gttgctggggcacgcggggg

SEQ ID NO: 788545 - DNA, 20 bp, mouse
gcgggtgcgaccgactccct

SEQ ID NO: 788546 - DNA, 20 bp, mouse
ggaacgacccgacttccggt

SEQ ID NO: 788547 - DNA, 20 bp, mouse
gggaagtcgggtcgttcgat

SEQ ID NO: 788548 - DNA, 20 bp, mouse
gctcggcgggtcacctcatc

SEQ ID NO: 788549 - DNA, 20 bp, mouse
gtaccgagatgctccggggc

SEQ ID NO: 788550 - DNA, 20 bp, mouse
gtcccgcccaccgcaattaa

SEQ ID NO: 788551 - DNA, 20 bp, mouse
ggaggcttttggctgctcgg

SEQ ID NO: 788552 - DNA, 20 bp, mouse
gcgacccgacttccggtcgg

SEQ ID NO: 788553 - DNA, 20 bp, mouse
gacggagcgcgcagccatcg

SEQ ID NO: 788554 - DNA, 20 bp, mouse
gcgcccgccccggagcatct

SEQ ID NO: 788555 - DNA, 20 bp, mouse
gtagaacttcatttccccga

SEQ ID NO: 788556 - DNA, 20 bp, mouse
gcgcgcgcgcgcggcgtctc

SEQ ID NO: 788557 - DNA, 20 bp, mouse
gactccggagaggggagctt

SEQ ID NO: 788558 - DNA, 20 bp, mouse
ggctacctccgaagctcgcg

SEQ ID NO: 788559 - DNA, 20 bp, mouse
ggcgcccggaaccgtcagac

SEQ ID NO: 788560 - DNA, 20 bp, mouse
gttcggaggtagcggactac

SEQ ID NO: 788561 - DNA, 20 bp, mouse
ggagagagagatgtgatcgg

SEQ ID NO: 788562 - DNA, 20 bp, mouse
gcgcgctcccgccaggctct

SEQ ID NO: 788563 - DNA, 20 bp, mouse
ggtgatcggtggtggcgaag

SEQ ID NO: 788564 - DNA, 20 bp, mouse
gggactaccgggttgttgtc

SEQ ID NO: 788565 - DNA, 20 bp, mouse
gcggcgtctcggggctcgtc

SEQ ID NO: 788566 - DNA, 20 bp, mouse
gccgccccgtagtagtcctc

SEQ ID NO: 788567 - DNA, 20 bp, mouse
gcgagcatgcgctctgttct

SEQ ID NO: 788568 - DNA, 20 bp, mouse
gtgtcccgcggagatacctt

SEQ ID NO: 788569 - DNA, 20 bp, mouse
gggagcccaaggtatctccg

SEQ ID NO: 788570 - DNA, 20 bp, mouse
gtgtgcctgaggactactac

SEQ ID NO: 788571 - DNA, 20 bp, mouse
gcctgtaaatctcctacttc

SEQ ID NO: 788572 - DNA, 20 bp, mouse
gcgcgggacaagccggaagt

SEQ ID NO: 788573 - DNA, 20 bp, mouse
ggtatctccgcgggacaagc

SEQ ID NO: 788574 - DNA, 20 bp, mouse
ggggctccgcccacttacca

SEQ ID NO: 788575 - DNA, 20 bp, mouse
gtgttctgggaactctgggc

SEQ ID NO: 788576 - DNA, 20 bp, mouse
ggggaccctgcgcctgtgtc

SEQ ID NO: 788577 - DNA, 20 bp, mouse
gtggaggcacccggtgttgg

SEQ ID NO: 788578 - DNA, 20 bp, mouse
ggtcccgctgggcgccgaga

SEQ ID NO: 788579 - DNA, 20 bp, mouse
gcacaggcgcagggtcccgc

SEQ ID NO: 788580 - DNA, 20 bp, mouse
gcgctgggcgccgagaggga

SEQ ID NO: 788581 - DNA, 20 bp, mouse
gccgccaagcccggcgccgt

SEQ ID NO: 788582 - DNA, 20 bp, mouse
gagccctctcggttctcctc

SEQ ID NO: 788583 - DNA, 20 bp, mouse
gcccgcaggctggcaggcgg

SEQ ID NO: 788584 - DNA, 20 bp, mouse
gcctgcgcctgtgtcgggag

SEQ ID NO: 788585 - DNA, 20 bp, mouse
gggcggggggcccacttccc

SEQ ID NO: 788586 - DNA, 20 bp, mouse
ggagtacggtggaatttcga

SEQ ID NO: 788587 - DNA, 20 bp, mouse
gcaaacagcggatgtggaga

SEQ ID NO: 788588 - DNA, 20 bp, mouse
gaggcgggacagctcgttgt

SEQ ID NO: 788589 - DNA, 20 bp, mouse
gagggtgagggcctcaagct

SEQ ID NO: 788590 - DNA, 20 bp, mouse
gagcaacctcatcacctctg

SEQ ID NO: 788591 - DNA, 20 bp, mouse
gttgaggccctcaccctcag

SEQ ID NO: 788592 - DNA, 20 bp, mouse
gggccacaactggcaaacag

SEQ ID NO: 788593 - DNA, 20 bp, mouse
gaactggcaaacagcggatg

SEQ ID NO: 788594 - DNA, 20 bp, mouse
gcccaagagctggccacaac

SEQ ID NO: 788595 - DNA, 20 bp, mouse
gacgagctgtcccgcctcag

SEQ ID NO: 788596 - DNA, 20 bp, mouse
ggagctggggtgattggagc

SEQ ID NO: 788597 - DNA, 20 bp, mouse
gcctcggcctgccctcttca

SEQ ID NO: 788598 - DNA, 20 bp, mouse
gcatggctgtggctcggctc

SEQ ID NO: 788599 - DNA, 20 bp, mouse
gaggttatgaaagtggagct

SEQ ID NO: 788600 - DNA, 20 bp, mouse
gctggctgaggttatgaaag

SEQ ID NO: 788601 - DNA, 20 bp, mouse
ggctcggctcaggctggctg

SEQ ID NO: 788602 - DNA, 20 bp, mouse
gccctcttcagggaggggaa

SEQ ID NO: 788603 - DNA, 20 bp, mouse
ggtcagaccaaataccagat

SEQ ID NO: 788604 - DNA, 20 bp, mouse
gaatcaccctatctggtatt

SEQ ID NO: 788605 - DNA, 20 bp, mouse
gaatggggtgccagtggatg

SEQ ID NO: 788606 - DNA, 20 bp, mouse
gggctgcgaacaataagcag

SEQ ID NO: 788607 - DNA, 20 bp, mouse
gaggagctcgcccacagcgg

SEQ ID NO: 788608 - DNA, 20 bp, mouse
ggcaatgtgtaggacatccg

SEQ ID NO: 788609 - DNA, 20 bp, mouse
gactccgccctggagcgcgg

SEQ ID NO: 788610 - DNA, 20 bp, mouse
gggaaggcgctgaggtctgg

SEQ ID NO: 788611 - DNA, 20 bp, mouse
gaggccagcgcggacgggac

SEQ ID NO: 788612 - DNA, 20 bp, mouse
gccacagcggcggcggggtc

SEQ ID NO: 788613 - DNA, 20 bp, mouse
ggaaactccgccctggagcg

SEQ ID NO: 788614 - DNA, 20 bp, mouse
ggagcaggggctggcggtcc

SEQ ID NO: 788615 - DNA, 20 bp, mouse
gagaggaggaaactccgccc

SEQ ID NO: 788616 - DNA, 20 bp, mouse
ggatgcagcggagggatcgg

SEQ ID NO: 788617 - DNA, 20 bp, mouse
gagcacttcgccacccgggg

SEQ ID NO: 788618 - DNA, 20 bp, mouse
gcgcccaatcgatgcagcgg

SEQ ID NO: 788619 - DNA, 20 bp, mouse
gaggaccaggctttggtgaa

SEQ ID NO: 788620 - DNA, 20 bp, mouse
gtgctcgaggcccgaggtgc

SEQ ID NO: 788621 - DNA, 20 bp, mouse
ggggcggatgagcgcgtgag

SEQ ID NO: 788622 - DNA, 20 bp, mouse
ggcagcggagggatcggggg

SEQ ID NO: 788623 - DNA, 20 bp, mouse
gcagggaggtcccccccccc

SEQ ID NO: 788624 - DNA, 20 bp, mouse
gcgggccccagttacagcga

SEQ ID NO: 788625 - DNA, 20 bp, mouse
gcgggggcgggaccctattg

SEQ ID NO: 788626 - DNA, 20 bp, mouse
gaggggcggattcacctggc

SEQ ID NO: 788627 - DNA, 20 bp, mouse
gaggtgaatccgcccctcag

SEQ ID NO: 788628 - DNA, 20 bp, mouse
gggcactgacacgcccctga

SEQ ID NO: 788629 - DNA, 20 bp, mouse
gaaagtagacacagaagttc

SEQ ID NO: 788630 - DNA, 20 bp, mouse
ggggagattgctccaggaaa

SEQ ID NO: 788631 - DNA, 20 bp, mouse
gcaccctgggagattgctcc

SEQ ID NO: 788632 - DNA, 20 bp, mouse
gcctggcacgcaaacctgcc

SEQ ID NO: 788633 - DNA, 20 bp, mouse
gtaggctttaatttggtctg

SEQ ID NO: 788634 - DNA, 20 bp, mouse
gggttctggaatgagtactt

SEQ ID NO: 788635 - DNA, 20 bp, mouse
gtgactgaagccagataaac

SEQ ID NO: 788636 - DNA, 20 bp, mouse
ggggcgctcgggtcgtggag

SEQ ID NO: 788637 - DNA, 20 bp, mouse
gcgagcgggcgctcgggtcg

SEQ ID NO: 788638 - DNA, 20 bp, mouse
gcgggaccatagagagcccg

SEQ ID NO: 788639 - DNA, 20 bp, mouse
gcggtgccgcgggctctcta

SEQ ID NO: 788640 - DNA, 20 bp, mouse
gggcctctctagcccgcggg

SEQ ID NO: 788641 - DNA, 20 bp, mouse
gggcccggctagagcaaagg

SEQ ID NO: 788642 - DNA, 20 bp, mouse
gccattgtgcggtgcattgt

SEQ ID NO: 788643 - DNA, 20 bp, mouse
gcccgctcaggccccggtag

SEQ ID NO: 788644 - DNA, 20 bp, mouse
gacccgagcgcccgctcgcg

SEQ ID NO: 788645 - DNA, 20 bp, mouse
gcggcggtcgggccattgtg

SEQ ID NO: 788646 - DNA, 20 bp, mouse
gcgtctgagtaggagtatgt

SEQ ID NO: 788647 - DNA, 20 bp, mouse
gagtatgtgggcgtgaccag

SEQ ID NO: 788648 - DNA, 20 bp, mouse
gggggtgggtcctggggaat

SEQ ID NO: 788649 - DNA, 20 bp, mouse
ggaagggcgtgactgcgctg

SEQ ID NO: 788650 - DNA, 20 bp, mouse
gtcagctgagggcgctgcgg

SEQ ID NO: 788651 - DNA, 20 bp, mouse
gagaggcgcgtgcgcaccgt

SEQ ID NO: 788652 - DNA, 20 bp, mouse
gcgcgtgcgcaccgtgggtc

SEQ ID NO: 788653 - DNA, 20 bp, mouse
gtgtgggcgtgaccaggggt

SEQ ID NO: 788654 - DNA, 20 bp, mouse
gcgtgaccaggggtgggtcc

SEQ ID NO: 788655 - DNA, 20 bp, mouse
gcgcctctcttcgtctgagt

SEQ ID NO: 788656 - DNA, 20 bp, mouse
ggaggtgggcatttgctcgg

SEQ ID NO: 788657 - DNA, 20 bp, mouse
ggggagcgaggacacgtggt

SEQ ID NO: 788658 - DNA, 20 bp, mouse
gtgtgcgcggaggggtgacc

SEQ ID NO: 788659 - DNA, 20 bp, mouse
gtcgagccgcgttagcccgg

SEQ ID NO: 788660 - DNA, 20 bp, mouse
gagcccagggtgttaggggc

SEQ ID NO: 788661 - DNA, 20 bp, mouse
gtgcctgagcggaaaggctg

SEQ ID NO: 788662 - DNA, 20 bp, mouse
gtctggatgcctgagcggaa

SEQ ID NO: 788663 - DNA, 20 bp, mouse
ggggcggagcccagggtgtt

SEQ ID NO: 788664 - DNA, 20 bp, mouse
gagcccgcccctaacaccct

SEQ ID NO: 788665 - DNA, 20 bp, mouse
gtgacgtcagcaggtctcgg

SEQ ID NO: 788666 - DNA, 20 bp, mouse
gccgcccagcagaaggatgg

SEQ ID NO: 788667 - DNA, 20 bp, mouse
gcgggtggcacatttaataa

SEQ ID NO: 788668 - DNA, 20 bp, mouse
ggagcctggcatgggaaata

SEQ ID NO: 788669 - DNA, 20 bp, mouse
ggggaatccgcagtggtctg

SEQ ID NO: 788670 - DNA, 20 bp, mouse
ggagcccgcccctaggcctc

SEQ ID NO: 788671 - DNA, 20 bp, mouse
gaggcagcaggaagcccatt

SEQ ID NO: 788672 - DNA, 20 bp, mouse
gccaggctcccggaggccta

SEQ ID NO: 788673 - DNA, 20 bp, mouse
gcccagcagaaggatggcgg

SEQ ID NO: 788674 - DNA, 20 bp, mouse
gagcaggaagcccattcggg

SEQ ID NO: 788675 - DNA, 20 bp, mouse
gcggcagccatctttgtgta

SEQ ID NO: 788676 - DNA, 20 bp, mouse
gcggggcgagagggtcggtg

SEQ ID NO: 788677 - DNA, 20 bp, mouse
gagaaaagaagcccggacaa

SEQ ID NO: 788678 - DNA, 20 bp, mouse
gggagggcggaagtgacgag

SEQ ID NO: 788679 - DNA, 20 bp, mouse
gaaagagcacgagaagggga

SEQ ID NO: 788680 - DNA, 20 bp, mouse
ggtgggggggccaaggaatg

SEQ ID NO: 788681 - DNA, 20 bp, mouse
gctccgcggggcgagagggt

SEQ ID NO: 788682 - DNA, 20 bp, mouse
gacgagaggtatccctccgc

SEQ ID NO: 788683 - DNA, 20 bp, mouse
gagaagcccggacaagggtt

SEQ ID NO: 788684 - DNA, 20 bp, mouse
gtatccctccgcggggcgag

SEQ ID NO: 788685 - DNA, 20 bp, mouse
gtccctcgggttcgagtgat

SEQ ID NO: 788686 - DNA, 20 bp, mouse
gggaacctcggcgaggaccg

SEQ ID NO: 788687 - DNA, 20 bp, mouse
gccgcccccggccttcccgc

SEQ ID NO: 788688 - DNA, 20 bp, mouse
gcatgggaaaaggggttctc

SEQ ID NO: 788689 - DNA, 20 bp, mouse
gttcgctcaggggtcatcac

SEQ ID NO: 788690 - DNA, 20 bp, mouse
gaaaagcgggaacctcggcg

SEQ ID NO: 788691 - DNA, 20 bp, mouse
ggcgccaaatgcactcccgc

SEQ ID NO: 788692 - DNA, 20 bp, mouse
ggagcgaaaagcgggaacct

SEQ ID NO: 788693 - DNA, 20 bp, mouse
gcgtaggacgcatgggaaaa

SEQ ID NO: 788694 - DNA, 20 bp, mouse
gggcgaggaccggggagacc

SEQ ID NO: 788695 - DNA, 20 bp, mouse
gatgacccctgagcgaaaag

SEQ ID NO: 788696 - DNA, 20 bp, mouse
gctgaaacagccacagtacg

SEQ ID NO: 788697 - DNA, 20 bp, mouse
gtggccaagggtaaaaaaaa

SEQ ID NO: 788698 - DNA, 20 bp, mouse
ggtccagcacggccctggaa

SEQ ID NO: 788699 - DNA, 20 bp, mouse
gcgggagggcaggtcactga

SEQ ID NO: 788700 - DNA, 20 bp, mouse
ggagctaacgtgcccttcca

SEQ ID NO: 788701 - DNA, 20 bp, mouse
gtgcccttccagggccgtgc

SEQ ID NO: 788702 - DNA, 20 bp, mouse
gcttgcgcgaggttctgctc

SEQ ID NO: 788703 - DNA, 20 bp, mouse
gaacagcgcctcctggccaa

SEQ ID NO: 788704 - DNA, 20 bp, mouse
ggcagctgcagtgggaggac

SEQ ID NO: 788705 - DNA, 20 bp, mouse
gtgacaccctaagaatggaa

SEQ ID NO: 788706 - DNA, 20 bp, mouse
gagagcagatttgatctctc

SEQ ID NO: 788707 - DNA, 20 bp, mouse
gtgggcggaggggagctagg

SEQ ID NO: 788708 - DNA, 20 bp, mouse
gtgcagacggaggtggacgt

SEQ ID NO: 788709 - DNA, 20 bp, mouse
gtgcgggtgcggggaatctc

SEQ ID NO: 788710 - DNA, 20 bp, mouse
gcacgcgccaggctacgggg

SEQ ID NO: 788711 - DNA, 20 bp, mouse
gccacctccgtctgcatctc

SEQ ID NO: 788712 - DNA, 20 bp, mouse
gttagagcccgagatgcaga

SEQ ID NO: 788713 - DNA, 20 bp, mouse
gcacgcctcacaaacagtac

SEQ ID NO: 788714 - DNA, 20 bp, mouse
ggcggggaatctctgggcgg

SEQ ID NO: 788715 - DNA, 20 bp, mouse
gacggcctgtactgtttgtg

SEQ ID NO: 788716 - DNA, 20 bp, mouse
ggggcggggccacttgcgag

SEQ ID NO: 788717 - DNA, 20 bp, mouse
ggggccacttgcgagaggcg

SEQ ID NO: 788718 - DNA, 20 bp, mouse
gccctaagagccaggatgct

SEQ ID NO: 788719 - DNA, 20 bp, mouse
gccatgacgctaacggaaca

SEQ ID NO: 788720 - DNA, 20 bp, mouse
gggtcctccagagtgggacg

SEQ ID NO: 788721 - DNA, 20 bp, mouse
gctcctgcagtgggcgctcg

SEQ ID NO: 788722 - DNA, 20 bp, mouse
gttccgttagcgtcatgggg

SEQ ID NO: 788723 - DNA, 20 bp, mouse
gggccaaacccctaagagcc

SEQ ID NO: 788724 - DNA, 20 bp, mouse
gccccgccccatgacgctaa

SEQ ID NO: 788725 - DNA, 20 bp, mouse
ggagggttcaggggtcacgg

SEQ ID NO: 788726 - DNA, 20 bp, mouse
ggctgcgcgggtcaactctt

SEQ ID NO: 788727 - DNA, 20 bp, mouse
gtcctcatcctgcggataag

SEQ ID NO: 788728 - DNA, 20 bp, mouse
gcaggctgggcgcactgccg

SEQ ID NO: 788729 - DNA, 20 bp, mouse
gcggataagggggttggatg

SEQ ID NO: 788730 - DNA, 20 bp, mouse
gggactcggtcacccaggct

SEQ ID NO: 788731 - DNA, 20 bp, mouse
ggccgcctacatgaagtcgg

SEQ ID NO: 788732 - DNA, 20 bp, mouse
gataggggactcggtcaccc

SEQ ID NO: 788733 - DNA, 20 bp, mouse
gctgacctccgacttcatgt

SEQ ID NO: 788734 - DNA, 20 bp, mouse
gggatgaggaagcgcgaccc

SEQ ID NO: 788735 - DNA, 20 bp, mouse
gaagcaggctcacgtggagc

SEQ ID NO: 788736 - DNA, 20 bp, mouse
gaaacccagtgctaagtgat

SEQ ID NO: 788737 - DNA, 20 bp, mouse
gaggcggggcgcacggggat

SEQ ID NO: 788738 - DNA, 20 bp, mouse
gcaggcgcccagcctcacta

SEQ ID NO: 788739 - DNA, 20 bp, mouse
ggggttgtcccgggaaccgg

SEQ ID NO: 788740 - DNA, 20 bp, mouse
gacaacccatcacttagcac

SEQ ID NO: 788741 - DNA, 20 bp, mouse
ggcgccccgcctctggaccg

SEQ ID NO: 788742 - DNA, 20 bp, mouse
gggtagcgtgggccgtagtg

SEQ ID NO: 788743 - DNA, 20 bp, mouse
ggatgggttgtcccgggaac

SEQ ID NO: 788744 - DNA, 20 bp, mouse
gagtcacgcctccggttccc

SEQ ID NO: 788745 - DNA, 20 bp, mouse
gcctcatcgggtgaactcct

SEQ ID NO: 788746 - DNA, 20 bp, mouse
ggccagccagggctgatgta

SEQ ID NO: 788747 - DNA, 20 bp, mouse
gcaaccaaggcgccgcgcta

SEQ ID NO: 788748 - DNA, 20 bp, mouse
ggaagtgaggcgcgagcccg

SEQ ID NO: 788749 - DNA, 20 bp, mouse
gaagttggagcgagaccgac

SEQ ID NO: 788750 - DNA, 20 bp, mouse
gggcgcgagcccgtggttgt

SEQ ID NO: 788751 - DNA, 20 bp, mouse
gtgagggccaaactagtgag

SEQ ID NO: 788752 - DNA, 20 bp, mouse
ggcgagaccgaccggaagtg

SEQ ID NO: 788753 - DNA, 20 bp, mouse
gcccccagcggtgaaatata

SEQ ID NO: 788754 - DNA, 20 bp, mouse
gggtgcacaccgacaaccac

SEQ ID NO: 788755 - DNA, 20 bp, mouse
ggcgctacggcggcgggtga

SEQ ID NO: 788756 - DNA, 20 bp, mouse
ggcaatcggcagaagacggg

SEQ ID NO: 788757 - DNA, 20 bp, mouse
ggctgcgtttcgagtgagga

SEQ ID NO: 788758 - DNA, 20 bp, mouse
ggaggaggtggtgaagtctg

SEQ ID NO: 788759 - DNA, 20 bp, mouse
gaagtctggggcatcttgac

SEQ ID NO: 788760 - DNA, 20 bp, mouse
gtgctgctgcgtttcgagtg

SEQ ID NO: 788761 - DNA, 20 bp, mouse
gaatggcaatcggcagaaga

SEQ ID NO: 788762 - DNA, 20 bp, mouse
gaatgagaaacccgaggagg

SEQ ID NO: 788763 - DNA, 20 bp, mouse
gtggaccaatgagaaacccg

SEQ ID NO: 788764 - DNA, 20 bp, mouse
ggaagacaggcgtcattccc

SEQ ID NO: 788765 - DNA, 20 bp, mouse
gaggagaaaaaggttctcag

SEQ ID NO: 788766 - DNA, 20 bp, mouse
gcacaggcgccggatgtagc

SEQ ID NO: 788767 - DNA, 20 bp, mouse
gtgagcggaagtccgagttt

SEQ ID NO: 788768 - DNA, 20 bp, mouse
gccgccccccgcggccgcgt

SEQ ID NO: 788769 - DNA, 20 bp, mouse
gaagctgcgtgcccagctcg

SEQ ID NO: 788770 - DNA, 20 bp, mouse
gtacatccggcgcctgtgag

SEQ ID NO: 788771 - DNA, 20 bp, mouse
gtctgcctcacgctctgatc

SEQ ID NO: 788772 - DNA, 20 bp, mouse
gccctcgggcccgccccccg

SEQ ID NO: 788773 - DNA, 20 bp, mouse
gatcacctgatcagagcgtg

SEQ ID NO: 788774 - DNA, 20 bp, mouse
gaggcgccggatgtagctgg

SEQ ID NO: 788775 - DNA, 20 bp, mouse
ggctgggcacgcagcttccg

SEQ ID NO: 788776 - DNA, 20 bp, mouse
ggaggagtccggagccttat

SEQ ID NO: 788777 - DNA, 20 bp, mouse
gccgcggccggagtcaagag

SEQ ID NO: 788778 - DNA, 20 bp, mouse
ggaaaagctcgagacggaag

SEQ ID NO: 788779 - DNA, 20 bp, mouse
ggggggagagagagcccata

SEQ ID NO: 788780 - DNA, 20 bp, mouse
ggagagagcccataaggctc

SEQ ID NO: 788781 - DNA, 20 bp, mouse
gagcaccgcaaaggctcacg

SEQ ID NO: 788782 - DNA, 20 bp, mouse
gaacgtgtctacgttcctca

SEQ ID NO: 788783 - DNA, 20 bp, mouse
gctcattagcaaaaggagga

SEQ ID NO: 788784 - DNA, 20 bp, mouse
gagtatggtgagtgtccgat

SEQ ID NO: 788785 - DNA, 20 bp, mouse
gaagctcgagacggaagggg

SEQ ID NO: 788786 - DNA, 20 bp, mouse
gctcgctgagggcggaggaa

SEQ ID NO: 788787 - DNA, 20 bp, mouse
gcaccctctgcgctcgccgg

SEQ ID NO: 788788 - DNA, 20 bp, mouse
gagcgcagagggtgggtcgc

SEQ ID NO: 788789 - DNA, 20 bp, mouse
gggtgggtcgcagggaccgg

SEQ ID NO: 788790 - DNA, 20 bp, mouse
gtgaggccgcgccttctcat

SEQ ID NO: 788791 - DNA, 20 bp, mouse
gggacggccgggctcgctga

SEQ ID NO: 788792 - DNA, 20 bp, mouse
gcctcggctctccaatcctc

SEQ ID NO: 788793 - DNA, 20 bp, mouse
ggggaaaagagtgcactagc

SEQ ID NO: 788794 - DNA, 20 bp, mouse
ggcacccggcccgggacaca

SEQ ID NO: 788795 - DNA, 20 bp, mouse
gaaaaggaggggtgccgaca

SEQ ID NO: 788796 - DNA, 20 bp, mouse
gcctgcctagggagtgaagt

SEQ ID NO: 788797 - DNA, 20 bp, mouse
ggtcccgcccttatattctt

SEQ ID NO: 788798 - DNA, 20 bp, mouse
ggtagagtcagagtagaaga

SEQ ID NO: 788799 - DNA, 20 bp, mouse
gaatataagggcgggacaag

SEQ ID NO: 788800 - DNA, 20 bp, mouse
gaagagggtagctgagtgtc

SEQ ID NO: 788801 - DNA, 20 bp, mouse
gaactctcatagccctggaa

SEQ ID NO: 788802 - DNA, 20 bp, mouse
gaagggaagactctgggtgc

SEQ ID NO: 788803 - DNA, 20 bp, mouse
ggaatctcagaccctgccta

SEQ ID NO: 788804 - DNA, 20 bp, mouse
gcactcctacttcactccct

SEQ ID NO: 788805 - DNA, 20 bp, mouse
gtctacaactctcatagccc

SEQ ID NO: 788806 - DNA, 20 bp, mouse
gacactggggacttgtggcg

SEQ ID NO: 788807 - DNA, 20 bp, mouse
gggcacgctgggagaatcga

SEQ ID NO: 788808 - DNA, 20 bp, mouse
ggtccgggatgccgtggaag

SEQ ID NO: 788809 - DNA, 20 bp, mouse
gtgtagtagagaaacaagcc

SEQ ID NO: 788810 - DNA, 20 bp, mouse
gaagcctggagtggaacgtc

SEQ ID NO: 788811 - DNA, 20 bp, mouse
ggtcctaaaccattgcgaca

SEQ ID NO: 788812 - DNA, 20 bp, mouse
ggggctacactggggacttg

SEQ ID NO: 788813 - DNA, 20 bp, mouse
gtggaacgtccgggatgccg

SEQ ID NO: 788814 - DNA, 20 bp, mouse
gaagcggatggaaatttcaa

SEQ ID NO: 788815 - DNA, 20 bp, mouse
ggggcggggctctctataag

SEQ ID NO: 788816 - DNA, 20 bp, mouse
gaccgcgcgccacacgtttc

SEQ ID NO: 788817 - DNA, 20 bp, mouse
ggggccacgcccacacggag

SEQ ID NO: 788818 - DNA, 20 bp, mouse
gcccccgggtgcactcgtcg

SEQ ID NO: 788819 - DNA, 20 bp, mouse
gcaacaggaggggaacccgt

SEQ ID NO: 788820 - DNA, 20 bp, mouse
ggggtctgatgtactcttcc

SEQ ID NO: 788821 - DNA, 20 bp, mouse
gaccgccccctctgactccg

SEQ ID NO: 788822 - DNA, 20 bp, mouse
ggccacgcctagtgagggtg

SEQ ID NO: 788823 - DNA, 20 bp, mouse
gcccggccgcttccaggctg

SEQ ID NO: 788824 - DNA, 20 bp, mouse
ggcacgcgccaggataaaga

SEQ ID NO: 788825 - DNA, 20 bp, mouse
ggaaaggggcgtggcatcta

SEQ ID NO: 788826 - DNA, 20 bp, mouse
gtctgacgcgagcctgaagg

SEQ ID NO: 788827 - DNA, 20 bp, mouse
gcccgcccgcgggggtgcag

SEQ ID NO: 788828 - DNA, 20 bp, mouse
gagtccctctgcacccccgc

SEQ ID NO: 788829 - DNA, 20 bp, mouse
gtcgcgcagacgggaagttg

SEQ ID NO: 788830 - DNA, 20 bp, mouse
gcagtctgacgcgagcctga

SEQ ID NO: 788831 - DNA, 20 bp, mouse
gaaagcgtgtagccgccttc

SEQ ID NO: 788832 - DNA, 20 bp, mouse
ggggcgggcggctccattgg

SEQ ID NO: 788833 - DNA, 20 bp, mouse
gactggtctatcttttccgt

SEQ ID NO: 788834 - DNA, 20 bp, mouse
gtccgctacttccctcccca

SEQ ID NO: 788835 - DNA, 20 bp, mouse
gtggcggccgcgtggcctaa

SEQ ID NO: 788836 - DNA, 20 bp, mouse
ggggcgtatcccggcctccg

SEQ ID NO: 788837 - DNA, 20 bp, mouse
gacgctggcgtcagccgcgg

SEQ ID NO: 788838 - DNA, 20 bp, mouse
gaaacaagtgaatgtgaggc

SEQ ID NO: 788839 - DNA, 20 bp, mouse
gggccgggatacgcccaagg

SEQ ID NO: 788840 - DNA, 20 bp, mouse
gggcaggtggagttaccaaa

SEQ ID NO: 788841 - DNA, 20 bp, mouse
ggtagtaaacaatcagacgc

SEQ ID NO: 788842 - DNA, 20 bp, mouse
gcagacgctggcgtcagccg

SEQ ID NO: 788843 - DNA, 20 bp, mouse
gggtgaccaggtcttaaaaa

SEQ ID NO: 788844 - DNA, 20 bp, mouse
ggtgctgtagaccacgcccc

SEQ ID NO: 788845 - DNA, 20 bp, mouse
gcctcacatcagtaccgtcc

SEQ ID NO: 788846 - DNA, 20 bp, mouse
gagtcccagaagttggagct

SEQ ID NO: 788847 - DNA, 20 bp, mouse
gcgcgcggaagtggccgctt

SEQ ID NO: 788848 - DNA, 20 bp, mouse
ggcgcggccgtcacccgaag

SEQ ID NO: 788849 - DNA, 20 bp, mouse
gctggggaacggaagttccg

SEQ ID NO: 788850 - DNA, 20 bp, mouse
ggagcgtgagtcccagaagt

SEQ ID NO: 788851 - DNA, 20 bp, mouse
gctagagccgggaaccccac

SEQ ID NO: 788852 - DNA, 20 bp, mouse
gtcaacgtgtggtcccgcca

SEQ ID NO: 788853 - DNA, 20 bp, mouse
gaagtggccgcttcgggtga

SEQ ID NO: 788854 - DNA, 20 bp, mouse
ggggaccacacgttgatacc

SEQ ID NO: 788855 - DNA, 20 bp, mouse
gggaaccccaccggcgtccc

SEQ ID NO: 788856 - DNA, 20 bp, mouse
gcccgagcgtggcagaggcg

SEQ ID NO: 788857 - DNA, 20 bp, mouse
gaagcgaaacagcccgagcg

SEQ ID NO: 788858 - DNA, 20 bp, mouse
ggcggtgcggttggcccgaa

SEQ ID NO: 788859 - DNA, 20 bp, mouse
gtccccgcctctgccacgct

SEQ ID NO: 788860 - DNA, 20 bp, mouse
gaatgagaaagatctggttg

SEQ ID NO: 788861 - DNA, 20 bp, mouse
gtgcgcaggcgccaggctgg

SEQ ID NO: 788862 - DNA, 20 bp, mouse
gggggagaatgagaaagatc

SEQ ID NO: 788863 - DNA, 20 bp, mouse
gcaggctggaggctaggccg

SEQ ID NO: 788864 - DNA, 20 bp, mouse
gagagagaagaggaggcatc

SEQ ID NO: 788865 - DNA, 20 bp, mouse
ggttggcccgaagggaagat

SEQ ID NO: 788866 - DNA, 20 bp, mouse
gggccctcccgggtgacgac

SEQ ID NO: 788867 - DNA, 20 bp, mouse
gcccgggagggccggaggta

SEQ ID NO: 788868 - DNA, 20 bp, mouse
gtgacgacgggtagggaagg

SEQ ID NO: 788869 - DNA, 20 bp, mouse
gcgccccgggcccctcccgg

SEQ ID NO: 788870 - DNA, 20 bp, mouse
gtacccgtcgtcacccggga

SEQ ID NO: 788871 - DNA, 20 bp, mouse
gagccgccgggaggggcccg

SEQ ID NO: 788872 - DNA, 20 bp, mouse
gcgtcacccgggagggccgg

SEQ ID NO: 788873 - DNA, 20 bp, mouse
gactgaggttggcatctagg

SEQ ID NO: 788874 - DNA, 20 bp, mouse
gtcgcgacgctccctacctc

SEQ ID NO: 788875 - DNA, 20 bp, mouse
ggcgtcgcgagccgccggga

SEQ ID NO: 788876 - DNA, 20 bp, mouse
gttcctgggcggagggaaga

SEQ ID NO: 788877 - DNA, 20 bp, mouse
ggagaagacggcactgctgc

SEQ ID NO: 788878 - DNA, 20 bp, mouse
ggccctggggggaaggacga

SEQ ID NO: 788879 - DNA, 20 bp, mouse
gtggttggaggttttgcggt

SEQ ID NO: 788880 - DNA, 20 bp, mouse
gcgcatagagcccgccctgg

SEQ ID NO: 788881 - DNA, 20 bp, mouse
gagacggcactgctgcagga

SEQ ID NO: 788882 - DNA, 20 bp, mouse
gagcggggagagatgatata

SEQ ID NO: 788883 - DNA, 20 bp, mouse
gcggcgcgttcctgggcgga

SEQ ID NO: 788884 - DNA, 20 bp, mouse
gggcccggcgcgttcctggg

SEQ ID NO: 788885 - DNA, 20 bp, mouse
ggtcatccggaagtgatcat

SEQ ID NO: 788886 - DNA, 20 bp, mouse
gtacccaggggaagtggcgt

SEQ ID NO: 788887 - DNA, 20 bp, mouse
gaagccccgcctacgggccc

SEQ ID NO: 788888 - DNA, 20 bp, mouse
gacgggcccaggctactcta

SEQ ID NO: 788889 - DNA, 20 bp, mouse
gcctcgggggcgaggaagag

SEQ ID NO: 788890 - DNA, 20 bp, mouse
gaagccaaaagcatcctaga

SEQ ID NO: 788891 - DNA, 20 bp, mouse
gctgtcaccagcagaggcag

SEQ ID NO: 788892 - DNA, 20 bp, mouse
gctaaggtctgggaaaccac

SEQ ID NO: 788893 - DNA, 20 bp, mouse
gccaggctactctaaggtct

SEQ ID NO: 788894 - DNA, 20 bp, mouse
gaaagtgcccgcccagtacg

SEQ ID NO: 788895 - DNA, 20 bp, mouse
gccgagactccgcccccgag

SEQ ID NO: 788896 - DNA, 20 bp, mouse
gcagaggcggggctaagggg

SEQ ID NO: 788897 - DNA, 20 bp, mouse
gagcctagcgggaaggacgg

SEQ ID NO: 788898 - DNA, 20 bp, mouse
gtaccccggctcgttgaagg

SEQ ID NO: 788899 - DNA, 20 bp, mouse
gccgctaggctcaagaggat

SEQ ID NO: 788900 - DNA, 20 bp, mouse
ggggaaggacggcgggccag

SEQ ID NO: 788901 - DNA, 20 bp, mouse
gaacccccttcaacgagccg

SEQ ID NO: 788902 - DNA, 20 bp, mouse
gcgagccggggtaaagtgat

SEQ ID NO: 788903 - DNA, 20 bp, mouse
gaaagccaatcactttaccc

SEQ ID NO: 788904 - DNA, 20 bp, mouse
gaaggacggcgggccagagg

SEQ ID NO: 788905 - DNA, 20 bp, mouse
gcccgcccccgctcgggagt

SEQ ID NO: 788906 - DNA, 20 bp, mouse
gaacagcccgcgctgatatc

SEQ ID NO: 788907 - DNA, 20 bp, mouse
gagaaaaggggatagagtgc

SEQ ID NO: 788908 - DNA, 20 bp, mouse
gtggcggctggggatagaaa

SEQ ID NO: 788909 - DNA, 20 bp, mouse
gcggcctccgctggcggctg

SEQ ID NO: 788910 - DNA, 20 bp, mouse
gggaagccagatatcagcgc

SEQ ID NO: 788911 - DNA, 20 bp, mouse
gtctagccaggagaactctg

SEQ ID NO: 788912 - DNA, 20 bp, mouse
ggactaccatagagtggtga

SEQ ID NO: 788913 - DNA, 20 bp, mouse
gtccgtccctcaccactcta

SEQ ID NO: 788914 - DNA, 20 bp, mouse
gtaacccgactaccatagag

SEQ ID NO: 788915 - DNA, 20 bp, mouse
gaggagaactctgtggttcc

SEQ ID NO: 788916 - DNA, 20 bp, mouse
gcctccgcctccagggtcga

SEQ ID NO: 788917 - DNA, 20 bp, mouse
gtttgctttcggggtgggta

SEQ ID NO: 788918 - DNA, 20 bp, mouse
gaagagtccaaagatggcgg

SEQ ID NO: 788919 - DNA, 20 bp, mouse
gcccgctgcgaaaggacagg

SEQ ID NO: 788920 - DNA, 20 bp, mouse
ggaaccgcggcttggcaaat

SEQ ID NO: 788921 - DNA, 20 bp, mouse
ggcctccagggtcgaggggc

SEQ ID NO: 788922 - DNA, 20 bp, mouse
gggaacgtctcatctccaaa

SEQ ID NO: 788923 - DNA, 20 bp, mouse
ggtggtcacaaggtcctgtt

SEQ ID NO: 788924 - DNA, 20 bp, mouse
gccctctcaagggtaacacg

SEQ ID NO: 788925 - DNA, 20 bp, mouse
ggaccttgtgaccacccgtt

SEQ ID NO: 788926 - DNA, 20 bp, mouse
gtcccagaaggccacggggt

SEQ ID NO: 788927 - DNA, 20 bp, mouse
ggcaccctgatgcagacctc

SEQ ID NO: 788928 - DNA, 20 bp, mouse
gacggggtagggtggctgtg

SEQ ID NO: 788929 - DNA, 20 bp, mouse
gcgactggaaacttacacca

SEQ ID NO: 788930 - DNA, 20 bp, mouse
ggtcttgaaacaccggggtg

SEQ ID NO: 788931 - DNA, 20 bp, mouse
ggtggggcgggccgaacaag

SEQ ID NO: 788932 - DNA, 20 bp, mouse
gtactcgtggctggctggaa

SEQ ID NO: 788933 - DNA, 20 bp, mouse
ggtcgactctgagaaaagaa

SEQ ID NO: 788934 - DNA, 20 bp, mouse
ggaaaagaaaggaccagtgt

SEQ ID NO: 788935 - DNA, 20 bp, mouse
gaaccggtctaatcacgcca

SEQ ID NO: 788936 - DNA, 20 bp, mouse
ggtgctggcccggaatgggg

SEQ ID NO: 788937 - DNA, 20 bp, mouse
ggcgacccgggtccgaggga

SEQ ID NO: 788938 - DNA, 20 bp, mouse
gagcgtgcgacccgggtccg

SEQ ID NO: 788939 - DNA, 20 bp, mouse
gcgaccgcccgggcaaggtg

SEQ ID NO: 788940 - DNA, 20 bp, mouse
ggatccgccgggacgccgaa

SEQ ID NO: 788941 - DNA, 20 bp, mouse
ggggcctcggctctctgtgg

SEQ ID NO: 788942 - DNA, 20 bp, mouse
gtgggaagagcgtgcgaccc

SEQ ID NO: 788943 - DNA, 20 bp, mouse
ggacgccgaagggagaaacc

SEQ ID NO: 788944 - DNA, 20 bp, mouse
gaggggcgaccgcccgggca

SEQ ID NO: 788945 - DNA, 20 bp, mouse
gcagcgacgggaagcctcga

SEQ ID NO: 788946 - DNA, 20 bp, mouse
ggcgcggcagggccctctgt

SEQ ID NO: 788947 - DNA, 20 bp, mouse
gcgcgcctgggcgtggtcgg

SEQ ID NO: 788948 - DNA, 20 bp, mouse
gttcagtggcacttggggac

SEQ ID NO: 788949 - DNA, 20 bp, mouse
gaccacgcccaggcgcgggc

SEQ ID NO: 788950 - DNA, 20 bp, mouse
gaaccgtcctgcccgcgcct

SEQ ID NO: 788951 - DNA, 20 bp, mouse
gcaggaacccgactgcccca

SEQ ID NO: 788952 - DNA, 20 bp, mouse
gcccgcccccgaccacgccc

SEQ ID NO: 788953 - DNA, 20 bp, mouse
gtctgtgggcggggctaaac

SEQ ID NO: 788954 - DNA, 20 bp, mouse
ggcgggcaggacggttcacc

SEQ ID NO: 788955 - DNA, 20 bp, mouse
gtgctcttcagtggcacttg

SEQ ID NO: 788956 - DNA, 20 bp, mouse
ggggagggtgtgatcctcaa

SEQ ID NO: 788957 - DNA, 20 bp, mouse
gcggggacgcgatccagtga

SEQ ID NO: 788958 - DNA, 20 bp, mouse
gtggaggtccgagacgaaag

SEQ ID NO: 788959 - DNA, 20 bp, mouse
gacaccctcccccttgcagg

SEQ ID NO: 788960 - DNA, 20 bp, mouse
gactgcatcctcctgcaagg

SEQ ID NO: 788961 - DNA, 20 bp, mouse
gcgcgtccccgcccactctt

SEQ ID NO: 788962 - DNA, 20 bp, mouse
gaaaagtgaagctgctctcc

SEQ ID NO: 788963 - DNA, 20 bp, mouse
gtcccacagcttagagcctg

SEQ ID NO: 788964 - DNA, 20 bp, mouse
gatcacaccctcccccttgc

SEQ ID NO: 788965 - DNA, 20 bp, mouse
ggggcctagaatgtcacttc

SEQ ID NO: 788966 - DNA, 20 bp, mouse
gagtgcacgggaaacccgaa

SEQ ID NO: 788967 - DNA, 20 bp, mouse
gcggccccgtagcgcaaggg

SEQ ID NO: 788968 - DNA, 20 bp, mouse
gaaaccgaggacttacagaa

SEQ ID NO: 788969 - DNA, 20 bp, mouse
gggcggagttgttgacgcta

SEQ ID NO: 788970 - DNA, 20 bp, mouse
gagggctccggctccctggt

SEQ ID NO: 788971 - DNA, 20 bp, mouse
gtcagaaagaacacccaacc

SEQ ID NO: 788972 - DNA, 20 bp, mouse
gcgccgcgcgcgctccgtgt

SEQ ID NO: 788973 - DNA, 20 bp, mouse
gccgtagcgcaagggagggc

SEQ ID NO: 788974 - DNA, 20 bp, mouse
gaggaaggggcgggacacaa

SEQ ID NO: 788975 - DNA, 20 bp, mouse
gaacccgaaaggaggacgac

SEQ ID NO: 788976 - DNA, 20 bp, mouse
gagttcaggcagacgtgcaa

SEQ ID NO: 788977 - DNA, 20 bp, mouse
gcgccagcgtgcatcatcct

SEQ ID NO: 788978 - DNA, 20 bp, mouse
gcatgtggacagcgcgagga

SEQ ID NO: 788979 - DNA, 20 bp, mouse
gggctccttagccagaagtt

SEQ ID NO: 788980 - DNA, 20 bp, mouse
gccccagcgactagacgaga

SEQ ID NO: 788981 - DNA, 20 bp, mouse
gggctgccgctgaggacaga

SEQ ID NO: 788982 - DNA, 20 bp, mouse
gtgcgcgagtgatgactagc

SEQ ID NO: 788983 - DNA, 20 bp, mouse
gtgcgcagacgactggcaaa

SEQ ID NO: 788984 - DNA, 20 bp, mouse
gcagcacggtggcttctgga

SEQ ID NO: 788985 - DNA, 20 bp, mouse
gtgcccgcgcgcctggcttg

SEQ ID NO: 788986 - DNA, 20 bp, mouse
gggcgcttccggctagtcgc

SEQ ID NO: 788987 - DNA, 20 bp, mouse
ggccaccagcagtttgtcgg

SEQ ID NO: 788988 - DNA, 20 bp, mouse
gttggggatttcaagagtat

SEQ ID NO: 788989 - DNA, 20 bp, mouse
gaaactgctggtggccgcgc

SEQ ID NO: 788990 - DNA, 20 bp, mouse
ggggctggagatacggcatt

SEQ ID NO: 788991 - DNA, 20 bp, mouse
gccacctgctgaccggaggc

SEQ ID NO: 788992 - DNA, 20 bp, mouse
gcgcagcgccacctgctgac

SEQ ID NO: 788993 - DNA, 20 bp, mouse
gtgccccgccgacaaactgc

SEQ ID NO: 788994 - DNA, 20 bp, mouse
ggaccaatgcattttggcgc

SEQ ID NO: 788995 - DNA, 20 bp, mouse
gccggaggccggaactctcc

SEQ ID NO: 788996 - DNA, 20 bp, mouse
ggagaagggcaggtcggaca

SEQ ID NO: 788997 - DNA, 20 bp, mouse
gacactgcggggagctcgcg

SEQ ID NO: 788998 - DNA, 20 bp, mouse
ggaggcggggccaagtgaat

SEQ ID NO: 788999 - DNA, 20 bp, mouse
gggggccaaggaagcggaga

SEQ ID NO: 789000 - DNA, 20 bp, mouse
gaggctgcccgcgagggggg

SEQ ID NO: 789001 - DNA, 20 bp, mouse
gtcggacagggtctacactg

SEQ ID NO: 789002 - DNA, 20 bp, mouse
ggccaaggaagcggagaggg

SEQ ID NO: 789003 - DNA, 20 bp, mouse
gccccgaccgcccccctcgc

SEQ ID NO: 789004 - DNA, 20 bp, mouse
gtgcccgcgaggggggcggt

SEQ ID NO: 789005 - DNA, 20 bp, mouse
ggcgaggctgcccgcgaggg

SEQ ID NO: 789006 - DNA, 20 bp, mouse
gacaccgccccggtgaaggc

SEQ ID NO: 789007 - DNA, 20 bp, mouse
ggcagcctgtcgtggaaagt

SEQ ID NO: 789008 - DNA, 20 bp, mouse
gacagcccgggagacgccta

SEQ ID NO: 789009 - DNA, 20 bp, mouse
gccgacgcgcgacaccgccc

SEQ ID NO: 789010 - DNA, 20 bp, mouse
gcccgggagacgcctaaggg

SEQ ID NO: 789011 - DNA, 20 bp, mouse
gcgcgacaccgccccggtga

SEQ ID NO: 789012 - DNA, 20 bp, mouse
ggcagccccagccttcaccg

SEQ ID NO: 789013 - DNA, 20 bp, mouse
gacagcacgaacctgggcgg

SEQ ID NO: 789014 - DNA, 20 bp, mouse
gcccaggttcgtgctgtcta

SEQ ID NO: 789015 - DNA, 20 bp, mouse
gcccaacgcgcagcctgtcg

SEQ ID NO: 789016 - DNA, 20 bp, mouse
gtccccggaccgtcacgata

SEQ ID NO: 789017 - DNA, 20 bp, mouse
gacgcccaggtcatcgccta

SEQ ID NO: 789018 - DNA, 20 bp, mouse
gaagctggtgcccgacccct

SEQ ID NO: 789019 - DNA, 20 bp, mouse
ggtgcccgacccctcggctc

SEQ ID NO: 789020 - DNA, 20 bp, mouse
gctgtccggagccgaggggt

SEQ ID NO: 789021 - DNA, 20 bp, mouse
gagtccctatcgtgacggtc

SEQ ID NO: 789022 - DNA, 20 bp, mouse
gaccacagtccctatcgtga

SEQ ID NO: 789023 - DNA, 20 bp, mouse
gtccgcacggagaaactcca

SEQ ID NO: 789024 - DNA, 20 bp, mouse
gctcaccttaggcgatgacc

SEQ ID NO: 789025 - DNA, 20 bp, mouse
gtaaggtgagcgctcctccc

SEQ ID NO: 789026 - DNA, 20 bp, mouse
gaggaggggagtatgaacgg

SEQ ID NO: 789027 - DNA, 20 bp, mouse
ggattgagtcttaacgtcat

SEQ ID NO: 789028 - DNA, 20 bp, mouse
gaggggagtatgaacggtgg

SEQ ID NO: 789029 - DNA, 20 bp, mouse
gcggtggtgggcaggcctga

SEQ ID NO: 789030 - DNA, 20 bp, mouse
ggcgaccgcagagaagtggt

SEQ ID NO: 789031 - DNA, 20 bp, mouse
gaatttgctttaagtaggag

SEQ ID NO: 789032 - DNA, 20 bp, mouse
gttgccacggctgggtttaa

SEQ ID NO: 789033 - DNA, 20 bp, mouse
ggagtcttaacgtcatgggc

SEQ ID NO: 789034 - DNA, 20 bp, mouse
gggaagcgaccgcagagaag

SEQ ID NO: 789035 - DNA, 20 bp, mouse
gtaagactcaatcagcgctg

SEQ ID NO: 789036 - DNA, 20 bp, mouse
ggcgcagcgcggtaccccgt

SEQ ID NO: 789037 - DNA, 20 bp, mouse
gaactcggtgactccgtcca

SEQ ID NO: 789038 - DNA, 20 bp, mouse
gcagcgcggtaccccgtcgg

SEQ ID NO: 789039 - DNA, 20 bp, mouse
gccgggaagggccacctccg

SEQ ID NO: 789040 - DNA, 20 bp, mouse
gtgaagaagccccgagaagg

SEQ ID NO: 789041 - DNA, 20 bp, mouse
gcaaggcccgagcacctcgg

SEQ ID NO: 789042 - DNA, 20 bp, mouse
gccacaaggcccgagcacct

SEQ ID NO: 789043 - DNA, 20 bp, mouse
gggcccgagcacctcggagg

SEQ ID NO: 789044 - DNA, 20 bp, mouse
gaagtgaagaagccccgaga

SEQ ID NO: 789045 - DNA, 20 bp, mouse
gtcttcacttccgccgggaa

SEQ ID NO: 789046 - DNA, 20 bp, mouse
ggagtagcagagggtatcaa

SEQ ID NO: 789047 - DNA, 20 bp, mouse
ggggaagcaggttccgaaat

SEQ ID NO: 789048 - DNA, 20 bp, mouse
gaggccgaagccgggaagaa

SEQ ID NO: 789049 - DNA, 20 bp, mouse
gcgtgcacgggaagcaggag

SEQ ID NO: 789050 - DNA, 20 bp, mouse
ggaacagagtccaccgagta

SEQ ID NO: 789051 - DNA, 20 bp, mouse
gcgtgcacggaaggcctctc

SEQ ID NO: 789052 - DNA, 20 bp, mouse
gcctgcttcccaactccgag

SEQ ID NO: 789053 - DNA, 20 bp, mouse
gttaggtggagaacttgcat

SEQ ID NO: 789054 - DNA, 20 bp, mouse
gcctgcttcccgtgcacgga

SEQ ID NO: 789055 - DNA, 20 bp, mouse
gatgcgcgatgtcatccgca

SEQ ID NO: 789056 - DNA, 20 bp, mouse
gcctggcccccgccccctag

SEQ ID NO: 789057 - DNA, 20 bp, mouse
gggctcggatgacctaatgc

SEQ ID NO: 789058 - DNA, 20 bp, mouse
gcccccgccccctagcggct

SEQ ID NO: 789059 - DNA, 20 bp, mouse
gtccccggtaccgactgaat

SEQ ID NO: 789060 - DNA, 20 bp, mouse
ggtaccggggagccagctac

SEQ ID NO: 789061 - DNA, 20 bp, mouse
gcccccgggtgggccgacac

SEQ ID NO: 789062 - DNA, 20 bp, mouse
gtgggactaagagtctaagt

SEQ ID NO: 789063 - DNA, 20 bp, mouse
gggagcaagaagggatgtaa

SEQ ID NO: 789064 - DNA, 20 bp, mouse
ggctacaggtggctcaactc

SEQ ID NO: 789065 - DNA, 20 bp, mouse
gtgctgcaggacccccgggt

SEQ ID NO: 789066 - DNA, 20 bp, mouse
gtccacagctcggcattcga

SEQ ID NO: 789067 - DNA, 20 bp, mouse
gcccccgcactgcgagggag

SEQ ID NO: 789068 - DNA, 20 bp, mouse
gcagtccccccgcactgcga

SEQ ID NO: 789069 - DNA, 20 bp, mouse
gaacccaagacaggcaatgc

SEQ ID NO: 789070 - DNA, 20 bp, mouse
gaaggtttgtgcttgtgtaa

SEQ ID NO: 789071 - DNA, 20 bp, mouse
gccctctccctcgcagtgcg

SEQ ID NO: 789072 - DNA, 20 bp, mouse
gctggtgttcgcctaagcat

SEQ ID NO: 789073 - DNA, 20 bp, mouse
ggtgtcaaatcgtgaagtat

SEQ ID NO: 789074 - DNA, 20 bp, mouse
ggcgctgcctcgccaacttc

SEQ ID NO: 789075 - DNA, 20 bp, mouse
gaaatcgtgaagtattggta

SEQ ID NO: 789076 - DNA, 20 bp, mouse
ggcggcgcgcacaggtacgg

SEQ ID NO: 789077 - DNA, 20 bp, mouse
ggggaccgggatgctgccgc

SEQ ID NO: 789078 - DNA, 20 bp, mouse
gcagggctgcggcgggattc

SEQ ID NO: 789079 - DNA, 20 bp, mouse
gcccccccctcccgctgtgg

SEQ ID NO: 789080 - DNA, 20 bp, mouse
gcggggctctggatcttacg

SEQ ID NO: 789081 - DNA, 20 bp, mouse
ggccgcttcagggtaatcat

SEQ ID NO: 789082 - DNA, 20 bp, mouse
gaatcatgggagccggggca

SEQ ID NO: 789083 - DNA, 20 bp, mouse
ggatgctgccgcgggctcgg

SEQ ID NO: 789084 - DNA, 20 bp, mouse
gccgctgtggtggtagatcc

SEQ ID NO: 789085 - DNA, 20 bp, mouse
gactccaaggggtctcggtc

SEQ ID NO: 789086 - DNA, 20 bp, mouse
gcaggacgaggggacgcccg

SEQ ID NO: 789087 - DNA, 20 bp, mouse
gcgcccgaggaagcgtgcag

SEQ ID NO: 789088 - DNA, 20 bp, mouse
gccgccaaacccagacgcct

SEQ ID NO: 789089 - DNA, 20 bp, mouse
gccgccaaggcgtctgggtt

SEQ ID NO: 789090 - DNA, 20 bp, mouse
gccgaggaagcgtgcagggg

SEQ ID NO: 789091 - DNA, 20 bp, mouse
ggggtttggcgggctttctc

SEQ ID NO: 789092 - DNA, 20 bp, mouse
gcatcaccgccaaggcgtct

SEQ ID NO: 789093 - DNA, 20 bp, mouse
gacggacaggccaggacgag

SEQ ID NO: 789094 - DNA, 20 bp, mouse
gaataacggggttataatga

SEQ ID NO: 789095 - DNA, 20 bp, mouse
gcctgtgcactgggaaatat

SEQ ID NO: 789096 - DNA, 20 bp, mouse
gaggccgcgcagatcagtgg

SEQ ID NO: 789097 - DNA, 20 bp, mouse
gcctaggccgcgcagatcag

SEQ ID NO: 789098 - DNA, 20 bp, mouse
gcacgtgcggcgctctacgg

SEQ ID NO: 789099 - DNA, 20 bp, mouse
gcctaggtgcattttcgtga

SEQ ID NO: 789100 - DNA, 20 bp, mouse
gtcgtgaaggagccgctaga

SEQ ID NO: 789101 - DNA, 20 bp, mouse
ggaagaggaagcggcacgtg

SEQ ID NO: 789102 - DNA, 20 bp, mouse
gcaaaacagcagaagaggcc

SEQ ID NO: 789103 - DNA, 20 bp, mouse
gggaaaatggctttttcagg

SEQ ID NO: 789104 - DNA, 20 bp, mouse
gtagatggcgatctagaagg

SEQ ID NO: 789105 - DNA, 20 bp, mouse
gcgctctacggtggccgggg

SEQ ID NO: 789106 - DNA, 20 bp, mouse
gaacccggaagtgaccgagc

SEQ ID NO: 789107 - DNA, 20 bp, mouse
gctaatcctagcctcttgac

SEQ ID NO: 789108 - DNA, 20 bp, mouse
gacctcggaagtacaccagt

SEQ ID NO: 789109 - DNA, 20 bp, mouse
gtggaaatgagcctgtcaag

SEQ ID NO: 789110 - DNA, 20 bp, mouse
gacccactggtgtacttccg

SEQ ID NO: 789111 - DNA, 20 bp, mouse
ggaagtgaccgagccggatg

SEQ ID NO: 789112 - DNA, 20 bp, mouse
ggtacttccgaggtctcgcc

SEQ ID NO: 789113 - DNA, 20 bp, mouse
gccgggttcctccgcaggtt

SEQ ID NO: 789114 - DNA, 20 bp, mouse
gtccccagaatgattgaata

SEQ ID NO: 789115 - DNA, 20 bp, mouse
ggccgtattcaatcattctg

SEQ ID NO: 789116 - DNA, 20 bp, mouse
gctcccggcaccaaaggcag

SEQ ID NO: 789117 - DNA, 20 bp, mouse
ggcccgcctcccggcaccaa

SEQ ID NO: 789118 - DNA, 20 bp, mouse
gaggagagaaagagcgtccc

SEQ ID NO: 789119 - DNA, 20 bp, mouse
gcggactcacgtgacccttg

SEQ ID NO: 789120 - DNA, 20 bp, mouse
gcgcccagaggaggcggcga

SEQ ID NO: 789121 - DNA, 20 bp, mouse
ggtgccgggaggcgggcctc

SEQ ID NO: 789122 - DNA, 20 bp, mouse
gctggcgggcgggcctctcg

SEQ ID NO: 789123 - DNA, 20 bp, mouse
gccggagcgcgggacacacg

SEQ ID NO: 789124 - DNA, 20 bp, mouse
gccggcgccgcgtaggtcct

SEQ ID NO: 789125 - DNA, 20 bp, mouse
ggcggcgggccgcccagagg

SEQ ID NO: 789126 - DNA, 20 bp, mouse
ggtgccggggtgtgactcgt

SEQ ID NO: 789127 - DNA, 20 bp, mouse
gggcccctggcagggagtag

SEQ ID NO: 789128 - DNA, 20 bp, mouse
ggggcggaagtgacatcaag

SEQ ID NO: 789129 - DNA, 20 bp, mouse
gggcccgtggttgctctagt

SEQ ID NO: 789130 - DNA, 20 bp, mouse
gcccgactccgggaagaacc

SEQ ID NO: 789131 - DNA, 20 bp, mouse
gagagggcgaaaaaggatgt

SEQ ID NO: 789132 - DNA, 20 bp, mouse
gtccggagccccatcccgag

SEQ ID NO: 789133 - DNA, 20 bp, mouse
gaccacgccaaggtcaacgc

SEQ ID NO: 789134 - DNA, 20 bp, mouse
ggcccccacgagtcacaccc

SEQ ID NO: 789135 - DNA, 20 bp, mouse
gcgtgtctcggcccctggca

SEQ ID NO: 789136 - DNA, 20 bp, mouse
ggacccgcgggctgcagaga

SEQ ID NO: 789137 - DNA, 20 bp, mouse
gtcgccgctgcgctcgcaga

SEQ ID NO: 789138 - DNA, 20 bp, mouse
ggcggggcattgtgggtaag

SEQ ID NO: 789139 - DNA, 20 bp, mouse
gcgccggggcggggcattgt

SEQ ID NO: 789140 - DNA, 20 bp, mouse
gagagcgcacatcgacagca

SEQ ID NO: 789141 - DNA, 20 bp, mouse
gtgggtaagaggaagcgcga

SEQ ID NO: 789142 - DNA, 20 bp, mouse
gaaactccgccggacacgtg

SEQ ID NO: 789143 - DNA, 20 bp, mouse
gcccttcggcgagctgctcg

SEQ ID NO: 789144 - DNA, 20 bp, mouse
gagcctgccttggcagcggt

SEQ ID NO: 789145 - DNA, 20 bp, mouse
gtcgaatcccaccgctgcca

SEQ ID NO: 789146 - DNA, 20 bp, mouse
gcgggagccgagcagatgat

SEQ ID NO: 789147 - DNA, 20 bp, mouse
ggaaacgcaagctgcagcgg

SEQ ID NO: 789148 - DNA, 20 bp, mouse
gcaagaatatgccttctcgg

SEQ ID NO: 789149 - DNA, 20 bp, mouse
gtccctgccaatcatctgct

SEQ ID NO: 789150 - DNA, 20 bp, mouse
gaggccgagggcatgacgca

SEQ ID NO: 789151 - DNA, 20 bp, mouse
gcgcgctgggccttcttcat

SEQ ID NO: 789152 - DNA, 20 bp, mouse
gtgggccttcttcatcggat

SEQ ID NO: 789153 - DNA, 20 bp, mouse
gcatctgctcggctcccgat

SEQ ID NO: 789154 - DNA, 20 bp, mouse
ggaggctgaagggtgcgtac

SEQ ID NO: 789155 - DNA, 20 bp, mouse
ggcagccagagacaagggcg

SEQ ID NO: 789156 - DNA, 20 bp, mouse
gggggccgggagagatgcgt

SEQ ID NO: 789157 - DNA, 20 bp, mouse
ggtgaggccgagcctgttgg

SEQ ID NO: 789158 - DNA, 20 bp, mouse
ggaggggcggggatgcggaa

SEQ ID NO: 789159 - DNA, 20 bp, mouse
gaacgcaggctgctgaagcg

SEQ ID NO: 789160 - DNA, 20 bp, mouse
gccggaggaggtgcgatcga

SEQ ID NO: 789161 - DNA, 20 bp, mouse
gccccccgctgcccgtgtgg

SEQ ID NO: 789162 - DNA, 20 bp, mouse
gtcccgcgaggccacacccc

SEQ ID NO: 789163 - DNA, 20 bp, mouse
ggggtgcggccgggctaggt

SEQ ID NO: 789164 - DNA, 20 bp, mouse
gctctgcggctcggacggga

SEQ ID NO: 789165 - DNA, 20 bp, mouse
ggggtgcagcctgcgctctg

SEQ ID NO: 789166 - DNA, 20 bp, mouse
gaagtggcgcgctgagacct

SEQ ID NO: 789167 - DNA, 20 bp, mouse
gaggagggagcgagcttaac

SEQ ID NO: 789168 - DNA, 20 bp, mouse
gagcggaggcgggcgaggag

SEQ ID NO: 789169 - DNA, 20 bp, mouse
gtctggctccgccacgtgtc

SEQ ID NO: 789170 - DNA, 20 bp, mouse
gatgcccagaccgaactaga

SEQ ID NO: 789171 - DNA, 20 bp, mouse
gtagccatctagttcggtct

SEQ ID NO: 789172 - DNA, 20 bp, mouse
gacatcttagccatctagtt

SEQ ID NO: 789173 - DNA, 20 bp, mouse
gagttcggtctgggcataag

SEQ ID NO: 789174 - DNA, 20 bp, mouse
ggcgagcttaaccggaactg

SEQ ID NO: 789175 - DNA, 20 bp, mouse
gcgcctccgctctcgtcgat

SEQ ID NO: 789176 - DNA, 20 bp, mouse
ggggcaggtgcgactataga

SEQ ID NO: 789177 - DNA, 20 bp, mouse
gggtgcagatggctcgagat

SEQ ID NO: 789178 - DNA, 20 bp, mouse
gaggggtacagtggttagtc

SEQ ID NO: 789179 - DNA, 20 bp, mouse
gtctgccggcaggagaggag

SEQ ID NO: 789180 - DNA, 20 bp, mouse
gcccacgggcggtgttttcc

SEQ ID NO: 789181 - DNA, 20 bp, mouse
gaaaacaccgcccgtggggc

SEQ ID NO: 789182 - DNA, 20 bp, mouse
ggctcagtgggggctcacat

SEQ ID NO: 789183 - DNA, 20 bp, mouse
gaacactggattttacttgg

SEQ ID NO: 789184 - DNA, 20 bp, mouse
ggtcgcacctgccccacggg

SEQ ID NO: 789185 - DNA, 20 bp, mouse
gccagtgttctcagtaagat

SEQ ID NO: 789186 - DNA, 20 bp, mouse
gtctctcaggggcccggggt

SEQ ID NO: 789187 - DNA, 20 bp, mouse
ggcggggtagagtgccgaaa

SEQ ID NO: 789188 - DNA, 20 bp, mouse
gcccgcaagtgagagaagag

SEQ ID NO: 789189 - DNA, 20 bp, mouse
gttcgcgaggctcccgtgag

SEQ ID NO: 789190 - DNA, 20 bp, mouse
gccgggcccctgagagagtc

SEQ ID NO: 789191 - DNA, 20 bp, mouse
ggcgaggctcccgtgagggg

SEQ ID NO: 789192 - DNA, 20 bp, mouse
gggttggcttgcttcaggat

SEQ ID NO: 789193 - DNA, 20 bp, mouse
gcgggtcgcagagcttcgcg

SEQ ID NO: 789194 - DNA, 20 bp, mouse
ggaagctctgcgacccgcag

SEQ ID NO: 789195 - DNA, 20 bp, mouse
ggtagagtgccgaaagggcg

SEQ ID NO: 789196 - DNA, 20 bp, mouse
gcacacgcgcagaaacgaca

SEQ ID NO: 789197 - DNA, 20 bp, mouse
ggcagcctcgcacactccat

SEQ ID NO: 789198 - DNA, 20 bp, mouse
gcgtgcaggcagcatgctat

SEQ ID NO: 789199 - DNA, 20 bp, mouse
gcaggcagcatgctattggc

SEQ ID NO: 789200 - DNA, 20 bp, mouse
ggtacccaggtgagaggttc

SEQ ID NO: 789201 - DNA, 20 bp, mouse
ggcccgccgcagtgcctact

SEQ ID NO: 789202 - DNA, 20 bp, mouse
ggcgcagaaacgacagggct

SEQ ID NO: 789203 - DNA, 20 bp, mouse
gtcctcctgtaacacgtcca

SEQ ID NO: 789204 - DNA, 20 bp, mouse
gggaacgtcttgaggatccc

SEQ ID NO: 789205 - DNA, 20 bp, mouse
gagcatgctattggctggat

SEQ ID NO: 789206 - DNA, 20 bp, mouse
gacgctgcccgctgcctctt

SEQ ID NO: 789207 - DNA, 20 bp, mouse
ggtcctgtgagaggagtcga

SEQ ID NO: 789208 - DNA, 20 bp, mouse
gactgccggaagcgctctta

SEQ ID NO: 789209 - DNA, 20 bp, mouse
ggtggcagagcaggagtata

SEQ ID NO: 789210 - DNA, 20 bp, mouse
gaggagaaacaaatagggta

SEQ ID NO: 789211 - DNA, 20 bp, mouse
gcagaactacagctccctgc

SEQ ID NO: 789212 - DNA, 20 bp, mouse
gcagaccctaagagcgcttc

SEQ ID NO: 789213 - DNA, 20 bp, mouse
gaaacaaatagggtagggac

SEQ ID NO: 789214 - DNA, 20 bp, mouse
gaatcagggccgtagaaaga

SEQ ID NO: 789215 - DNA, 20 bp, mouse
gtgctctgccacccagtact

SEQ ID NO: 789216 - DNA, 20 bp, mouse
gtcgacgacagtgacgtcgg

SEQ ID NO: 789217 - DNA, 20 bp, mouse
gcggcgcgccgggtggaaag

SEQ ID NO: 789218 - DNA, 20 bp, mouse
ggcgtcgacgacagtgacgt

SEQ ID NO: 789219 - DNA, 20 bp, mouse
gacagcttaggtaggcggat

SEQ ID NO: 789220 - DNA, 20 bp, mouse
ggccttgcctctcagaacgc

SEQ ID NO: 789221 - DNA, 20 bp, mouse
gttgcctctcagaacgcggg

SEQ ID NO: 789222 - DNA, 20 bp, mouse
ggggaaaccgccgccgcgtg

SEQ ID NO: 789223 - DNA, 20 bp, mouse
gcctctcagaacgcgggagg

SEQ ID NO: 789224 - DNA, 20 bp, mouse
gcgcgcggcgcggtgtaccc

SEQ ID NO: 789225 - DNA, 20 bp, mouse
gcgtgctccgcacgcggcgg

SEQ ID NO: 789226 - DNA, 20 bp, mouse
gaacgtacgagggaacgagt

SEQ ID NO: 789227 - DNA, 20 bp, mouse
gcacactggcagagctcatg

SEQ ID NO: 789228 - DNA, 20 bp, mouse
gtctgagctggaagcgactc

SEQ ID NO: 789229 - DNA, 20 bp, mouse
gtgcggtctgagcaccacac

SEQ ID NO: 789230 - DNA, 20 bp, mouse
gagaccgcagatcccagagc

SEQ ID NO: 789231 - DNA, 20 bp, mouse
gtccaaggccgggtcctgcc

SEQ ID NO: 789232 - DNA, 20 bp, mouse
gcaaccacgtcagcccgctc

SEQ ID NO: 789233 - DNA, 20 bp, mouse
ggaaaagcgcgagggaactg

SEQ ID NO: 789234 - DNA, 20 bp, mouse
gcgctgctcgagtgacggtt

SEQ ID NO: 789235 - DNA, 20 bp, mouse
gcgtacgagtgaacgtacga

SEQ ID NO: 789236 - DNA, 20 bp, mouse
ggccaggaaggtcacgtcca

SEQ ID NO: 789237 - DNA, 20 bp, mouse
ggggcggcgggcctcgggag

SEQ ID NO: 789238 - DNA, 20 bp, mouse
gtgcagaagcgctgccagga

SEQ ID NO: 789239 - DNA, 20 bp, mouse
gacacctggcgctggtggtt

SEQ ID NO: 789240 - DNA, 20 bp, mouse
gagcgcttctgcagcgaagg

SEQ ID NO: 789241 - DNA, 20 bp, mouse
ggaggggggcttcccggtcc

SEQ ID NO: 789242 - DNA, 20 bp, mouse
ggccaggtgtgcgcttcagc

SEQ ID NO: 789243 - DNA, 20 bp, mouse
gacccgctgaagcgcacacc

SEQ ID NO: 789244 - DNA, 20 bp, mouse
gagcgcaaggcacatctgcc

SEQ ID NO: 789245 - DNA, 20 bp, mouse
gtatacttgcagggttgggt

SEQ ID NO: 789246 - DNA, 20 bp, mouse
gccgccgccgcggggtgaga

SEQ ID NO: 789247 - DNA, 20 bp, mouse
gcgcccgaggtccactcgtg

SEQ ID NO: 789248 - DNA, 20 bp, mouse
gccagacaggcagagtacgc

SEQ ID NO: 789249 - DNA, 20 bp, mouse
ggaccgtaaccctgccagac

SEQ ID NO: 789250 - DNA, 20 bp, mouse
gtgggcaagccaggatcaga

SEQ ID NO: 789251 - DNA, 20 bp, mouse
ggggcggcgggcggcgctta

SEQ ID NO: 789252 - DNA, 20 bp, mouse
gagctgcagccctctgatcc

SEQ ID NO: 789253 - DNA, 20 bp, mouse
gccgggcgtctgcagcgcga

SEQ ID NO: 789254 - DNA, 20 bp, mouse
gggtccgcacgagtggacct

SEQ ID NO: 789255 - DNA, 20 bp, mouse
gcgggcggcgcttagggcgg

SEQ ID NO: 789256 - DNA, 20 bp, mouse
gtcactgaacgcagccaata

SEQ ID NO: 789257 - DNA, 20 bp, mouse
gtgccaccacagtcccctat

SEQ ID NO: 789258 - DNA, 20 bp, mouse
gagccaataggggactgtgg

SEQ ID NO: 789259 - DNA, 20 bp, mouse
ggagaggcaaagagcgactc

SEQ ID NO: 789260 - DNA, 20 bp, mouse
gagacctaggaacgccttgt

SEQ ID NO: 789261 - DNA, 20 bp, mouse
gaaggaccagttaaaaatcc

SEQ ID NO: 789262 - DNA, 20 bp, mouse
gagaataaggggaaagatac

SEQ ID NO: 789263 - DNA, 20 bp, mouse
gtaacgcgcgctttgggaag

SEQ ID NO: 789264 - DNA, 20 bp, mouse
gccggcctaaaggaaggggc

SEQ ID NO: 789265 - DNA, 20 bp, mouse
ggcgagacgcctgaattctt

SEQ ID NO: 789266 - DNA, 20 bp, mouse
gtcggccaggatcacctctt

SEQ ID NO: 789267 - DNA, 20 bp, mouse
ggagcagcatgcacgagcct

SEQ ID NO: 789268 - DNA, 20 bp, mouse
gctggccgaggtccgagagg

SEQ ID NO: 789269 - DNA, 20 bp, mouse
gtgagccgaagaggtgatcc

SEQ ID NO: 789270 - DNA, 20 bp, mouse
gggacccgcctctcggacct

SEQ ID NO: 789271 - DNA, 20 bp, mouse
gtaagggaggagcgatccat

SEQ ID NO: 789272 - DNA, 20 bp, mouse
ggggtgtcagatgacagtgt

SEQ ID NO: 789273 - DNA, 20 bp, mouse
ggagtcttaaaagcatgtca

SEQ ID NO: 789274 - DNA, 20 bp, mouse
gagctcaaactccggaaccc

SEQ ID NO: 789275 - DNA, 20 bp, mouse
gacaagaagcctggtaaggg

SEQ ID NO: 789276 - DNA, 20 bp, mouse
gcaacagcaaggttgagcct

SEQ ID NO: 789277 - DNA, 20 bp, mouse
gtggacgcccgcgccagcgt

SEQ ID NO: 789278 - DNA, 20 bp, mouse
gggaaatgaggaccagggta

SEQ ID NO: 789279 - DNA, 20 bp, mouse
gcctctagccaaactggtga

SEQ ID NO: 789280 - DNA, 20 bp, mouse
gtacactctctgcaaagcgg

SEQ ID NO: 789281 - DNA, 20 bp, mouse
gggcgcgggcgtccactgta

SEQ ID NO: 789282 - DNA, 20 bp, mouse
gaggccaggctgcaacagca

SEQ ID NO: 789283 - DNA, 20 bp, mouse
gggcgcggtcatccataccc

SEQ ID NO: 789284 - DNA, 20 bp, mouse
gaccgcgcctacgctggcgc

SEQ ID NO: 789285 - DNA, 20 bp, mouse
gcaaccttgctgttgcagcc

SEQ ID NO: 789286 - DNA, 20 bp, mouse
gagggccaagggcgcagctc

SEQ ID NO: 789287 - DNA, 20 bp, mouse
ggctgtcccccggtgagcga

SEQ ID NO: 789288 - DNA, 20 bp, mouse
gtcgcgggacggtgttagat

SEQ ID NO: 789289 - DNA, 20 bp, mouse
gagggagtagcgttgggccg

SEQ ID NO: 789290 - DNA, 20 bp, mouse
gaggagcagggagtagcgtt

SEQ ID NO: 789291 - DNA, 20 bp, mouse
gacagcgagcgtgggagccc

SEQ ID NO: 789292 - DNA, 20 bp, mouse
gacaccgtcccgcgaggcca

SEQ ID NO: 789293 - DNA, 20 bp, mouse
gcgccggaagtgcgtccttc

SEQ ID NO: 789294 - DNA, 20 bp, mouse
ggcgcagctcgggtgtgcac

SEQ ID NO: 789295 - DNA, 20 bp, mouse
gcttggccctcgctcaccgg

SEQ ID NO: 789296 - DNA, 20 bp, mouse
gcagccggagcgcgaggtag

SEQ ID NO: 789297 - DNA, 20 bp, mouse
ggaaagggagccctaaggat

SEQ ID NO: 789298 - DNA, 20 bp, mouse
gctcaccggccatcaaagtt

SEQ ID NO: 789299 - DNA, 20 bp, mouse
gaggtagtggcgcgcatgcg

SEQ ID NO: 789300 - DNA, 20 bp, mouse
gtatgcccaactttgatggc

SEQ ID NO: 789301 - DNA, 20 bp, mouse
gaaggggaaagggagcccta

SEQ ID NO: 789302 - DNA, 20 bp, mouse
gactgactgtcctatcctta

SEQ ID NO: 789303 - DNA, 20 bp, mouse
gtcagtatgcccaactttga

SEQ ID NO: 789304 - DNA, 20 bp, mouse
gcgagcctgagaccttgggg

SEQ ID NO: 789305 - DNA, 20 bp, mouse
gtcaactagttgtgtctacg

SEQ ID NO: 789306 - DNA, 20 bp, mouse
ggcggggccagcccgaagga

SEQ ID NO: 789307 - DNA, 20 bp, mouse
ggaaacgcggagaagagctg

SEQ ID NO: 789308 - DNA, 20 bp, mouse
ggggccagcccgaaggaggg

SEQ ID NO: 789309 - DNA, 20 bp, mouse
ggggccgggaaggctaaact

SEQ ID NO: 789310 - DNA, 20 bp, mouse
gaaggtctgtgccccacgtc

SEQ ID NO: 789311 - DNA, 20 bp, mouse
gtgcacgccgggagtcgttg

SEQ ID NO: 789312 - DNA, 20 bp, mouse
gggtagacagacctcttcta

SEQ ID NO: 789313 - DNA, 20 bp, mouse
gagcggggtccagagagcga

SEQ ID NO: 789314 - DNA, 20 bp, mouse
ggagcgaaggttggactaga

SEQ ID NO: 789315 - DNA, 20 bp, mouse
gcccctgagagacatacgaa

SEQ ID NO: 789316 - DNA, 20 bp, mouse
gggatgggttgggtagatga

SEQ ID NO: 789317 - DNA, 20 bp, mouse
gagaaaaggcagacataaac

SEQ ID NO: 789318 - DNA, 20 bp, mouse
gccactgggctgcaggtctc

SEQ ID NO: 789319 - DNA, 20 bp, mouse
gtggaggactctggctaaat

SEQ ID NO: 789320 - DNA, 20 bp, mouse
gtataattgggggatgggtt

SEQ ID NO: 789321 - DNA, 20 bp, mouse
gaggggattaagcaagcagg

SEQ ID NO: 789322 - DNA, 20 bp, mouse
gaggcagacataaactggtc

SEQ ID NO: 789323 - DNA, 20 bp, mouse
ggggagctggaacttagaag

SEQ ID NO: 789324 - DNA, 20 bp, mouse
gttgggggcgggcctcagac

SEQ ID NO: 789325 - DNA, 20 bp, mouse
gggaggaaacagagagccct

SEQ ID NO: 789326 - DNA, 20 bp, mouse
ggcagctgcgcgaggatcgg

SEQ ID NO: 789327 - DNA, 20 bp, mouse
gcatccgcacatgcccgcgt

SEQ ID NO: 789328 - DNA, 20 bp, mouse
gcatgtgcggatgtgctccg

SEQ ID NO: 789329 - DNA, 20 bp, mouse
gggtgcagctgcgcgaggat

SEQ ID NO: 789330 - DNA, 20 bp, mouse
gggccaccctaaagttttca

SEQ ID NO: 789331 - DNA, 20 bp, mouse
gtgcgcgaggatcggaggct

SEQ ID NO: 789332 - DNA, 20 bp, mouse
gcagctccctgaaaacttta

SEQ ID NO: 789333 - DNA, 20 bp, mouse
gctccctgaaaactttaggg

SEQ ID NO: 789334 - DNA, 20 bp, mouse
ggagcaggtgcagctgcgcg

SEQ ID NO: 789335 - DNA, 20 bp, mouse
gcgaggatcggaggcttggc

SEQ ID NO: 789336 - DNA, 20 bp, mouse
gtgagccctccatgtggagg

SEQ ID NO: 789337 - DNA, 20 bp, mouse
gggcacaagggactgatcag

SEQ ID NO: 789338 - DNA, 20 bp, mouse
gtgaaactcaagtagacaag

SEQ ID NO: 789339 - DNA, 20 bp, mouse
ggctcaaagccacctccaca

SEQ ID NO: 789340 - DNA, 20 bp, mouse
gtggctttgagccttggcgc

SEQ ID NO: 789341 - DNA, 20 bp, mouse
ggcaggcaggcggggcacaa

SEQ ID NO: 789342 - DNA, 20 bp, mouse
ggctctggggcgcggactca

SEQ ID NO: 789343 - DNA, 20 bp, mouse
gcacaactgccaggaggtgc

SEQ ID NO: 789344 - DNA, 20 bp, mouse
ggatcagcacaactgccagg

SEQ ID NO: 789345 - DNA, 20 bp, mouse
ggaagactggtgccgctctg

SEQ ID NO: 789346 - DNA, 20 bp, mouse
ggggccgtgcgaattcgcac

SEQ ID NO: 789347 - DNA, 20 bp, mouse
gctggtcagtggacaagagt

SEQ ID NO: 789348 - DNA, 20 bp, mouse
gcccgctcgctcaccctctg

SEQ ID NO: 789349 - DNA, 20 bp, mouse
gcagatgggggcaagatctt

SEQ ID NO: 789350 - DNA, 20 bp, mouse
gggccccggcagctccagat

SEQ ID NO: 789351 - DNA, 20 bp, mouse
gcaaatccctcagagaatgg

SEQ ID NO: 789352 - DNA, 20 bp, mouse
gcgaattcgcacggcccgat

SEQ ID NO: 789353 - DNA, 20 bp, mouse
gggagctgccggggccccga

SEQ ID NO: 789354 - DNA, 20 bp, mouse
gggcaaaagagttttagttc

SEQ ID NO: 789355 - DNA, 20 bp, mouse
gaggtgcagtgttgcaagtt

SEQ ID NO: 789356 - DNA, 20 bp, mouse
gagagcaagctgccatagag

SEQ ID NO: 789357 - DNA, 20 bp, mouse
gctccctcgcgtcctctcta

SEQ ID NO: 789358 - DNA, 20 bp, mouse
gtaactggagtagtcgtgtt

SEQ ID NO: 789359 - DNA, 20 bp, mouse
gagagaggagcggattttgc

SEQ ID NO: 789360 - DNA, 20 bp, mouse
gcgagggagattggggacga

SEQ ID NO: 789361 - DNA, 20 bp, mouse
ggagaggacgcgagggagat

SEQ ID NO: 789362 - DNA, 20 bp, mouse
gagttggccggggatatcgg

SEQ ID NO: 789363 - DNA, 20 bp, mouse
gctgccatagagaggacgcg

SEQ ID NO: 789364 - DNA, 20 bp, mouse
gaggcgcccgatccgaaatc

SEQ ID NO: 789365 - DNA, 20 bp, mouse
gggagggcacaagttggccg

SEQ ID NO: 789366 - DNA, 20 bp, mouse
gtgagcgcacagaacttgtg

SEQ ID NO: 789367 - DNA, 20 bp, mouse
gtgaccttaaacgttcactt

SEQ ID NO: 789368 - DNA, 20 bp, mouse
gtcccccaagtgaacgttta

SEQ ID NO: 789369 - DNA, 20 bp, mouse
ggcaggggatcagaagttcg

SEQ ID NO: 789370 - DNA, 20 bp, mouse
ggcggagcgtggagattgac

SEQ ID NO: 789371 - DNA, 20 bp, mouse
gctctcggactttaagtgca

SEQ ID NO: 789372 - DNA, 20 bp, mouse
gtcgcctccggccggcgctg

SEQ ID NO: 789373 - DNA, 20 bp, mouse
gcgagagtgtcgcacgatct

SEQ ID NO: 789374 - DNA, 20 bp, mouse
ggaaaatccccagcgccggc

SEQ ID NO: 789375 - DNA, 20 bp, mouse
gtcagtctggggttagcttg

SEQ ID NO: 789376 - DNA, 20 bp, mouse
gtaaggctcgcgagacttga

SEQ ID NO: 789377 - DNA, 20 bp, mouse
gaggcggggctaattgacag

SEQ ID NO: 789378 - DNA, 20 bp, mouse
gggactagctagcagaggcg

SEQ ID NO: 789379 - DNA, 20 bp, mouse
gcgggactcgaggatcgagg

SEQ ID NO: 789380 - DNA, 20 bp, mouse
ggtcccgccctgcccgggga

SEQ ID NO: 789381 - DNA, 20 bp, mouse
gtgcgcacgcgcacgaggaa

SEQ ID NO: 789382 - DNA, 20 bp, mouse
gtgacagaggcgggcccaag

SEQ ID NO: 789383 - DNA, 20 bp, mouse
gcggggctaattgacagagg

SEQ ID NO: 789384 - DNA, 20 bp, mouse
gccagctccaatgctgaccc

SEQ ID NO: 789385 - DNA, 20 bp, mouse
ggttctagtgagcgcttcga

SEQ ID NO: 789386 - DNA, 20 bp, mouse
ggaggacaagataagaccca

SEQ ID NO: 789387 - DNA, 20 bp, mouse
gtaagacccagggtcaacag

SEQ ID NO: 789388 - DNA, 20 bp, mouse
ggcacttagcatacctccag

SEQ ID NO: 789389 - DNA, 20 bp, mouse
ggctggcagtgaaagaaaac

SEQ ID NO: 789390 - DNA, 20 bp, mouse
gccaaacatggtatccctct

SEQ ID NO: 789391 - DNA, 20 bp, mouse
gagcagggaattgaggtcca

SEQ ID NO: 789392 - DNA, 20 bp, mouse
gaagaaagggtgaccccaga

SEQ ID NO: 789393 - DNA, 20 bp, mouse
ggggataccatgtttggaat

SEQ ID NO: 789394 - DNA, 20 bp, mouse
gctgtgtcccgtccactcca

SEQ ID NO: 789395 - DNA, 20 bp, mouse
ggaaagcaagcagggaattg

SEQ ID NO: 789396 - DNA, 20 bp, mouse
gaactcgcgaggctctaagt

SEQ ID NO: 789397 - DNA, 20 bp, mouse
gactcatggtaaccagtctt

SEQ ID NO: 789398 - DNA, 20 bp, mouse
gcgaaggtggcacatggggt

SEQ ID NO: 789399 - DNA, 20 bp, mouse
gcagccagcgggtgccagca

SEQ ID NO: 789400 - DNA, 20 bp, mouse
gacaagaaaaatcaccagag

SEQ ID NO: 789401 - DNA, 20 bp, mouse
gcagggtctgggccgaagac

SEQ ID NO: 789402 - DNA, 20 bp, mouse
gctccaccaagggtagccca

SEQ ID NO: 789403 - DNA, 20 bp, mouse
gccagaccctgggctaccct

SEQ ID NO: 789404 - DNA, 20 bp, mouse
gccgtccccgccgctgggag

SEQ ID NO: 789405 - DNA, 20 bp, mouse
gtgtgtactgggcagaaaag

SEQ ID NO: 789406 - DNA, 20 bp, mouse
gttaggggcgggacccacga

SEQ ID NO: 789407 - DNA, 20 bp, mouse
ggcgaggcgtgccttttccg

SEQ ID NO: 789408 - DNA, 20 bp, mouse
gcaacagcagagatttagaa

SEQ ID NO: 789409 - DNA, 20 bp, mouse
gcgcacgcggcttttgtggg

SEQ ID NO: 789410 - DNA, 20 bp, mouse
gagcccagctctcagctcct

SEQ ID NO: 789411 - DNA, 20 bp, mouse
gctgttggtacggccctcgt

SEQ ID NO: 789412 - DNA, 20 bp, mouse
gaccacggcccgggaggctg

SEQ ID NO: 789413 - DNA, 20 bp, mouse
gtaaatctctgctgttggta

SEQ ID NO: 789414 - DNA, 20 bp, mouse
ggcgtgcgcgctcttgaggc

SEQ ID NO: 789415 - DNA, 20 bp, mouse
gttttccgaggagaggatga

SEQ ID NO: 789416 - DNA, 20 bp, mouse
gagggcttcggtcatttcag

SEQ ID NO: 789417 - DNA, 20 bp, mouse
gtctgcctagcatcctgctg

SEQ ID NO: 789418 - DNA, 20 bp, mouse
gaaccccagactccaggcag

SEQ ID NO: 789419 - DNA, 20 bp, mouse
ggtgtgaaggaggagctcaa

SEQ ID NO: 789420 - DNA, 20 bp, mouse
ggctgaggctagactgtcgc

SEQ ID NO: 789421 - DNA, 20 bp, mouse
gaaggaggagctcaagggtg

SEQ ID NO: 789422 - DNA, 20 bp, mouse
gcaggatgctaggcagagct

SEQ ID NO: 789423 - DNA, 20 bp, mouse
gcacctctctggttcataaa

SEQ ID NO: 789424 - DNA, 20 bp, mouse
gaagctgtgctgaacctggt

SEQ ID NO: 789425 - DNA, 20 bp, mouse
gaggttcagcacagcttagg

SEQ ID NO: 789426 - DNA, 20 bp, mouse
gaatgcaagagggactattg

SEQ ID NO: 789427 - DNA, 20 bp, mouse
gcccgagcatcgcgaggagg

SEQ ID NO: 789428 - DNA, 20 bp, mouse
gagtgagcccgagcatcgcg

SEQ ID NO: 789429 - DNA, 20 bp, mouse
ggagcccgagcatcgcgagg

SEQ ID NO: 789430 - DNA, 20 bp, mouse
ggagcacgtcggcgcacaga

SEQ ID NO: 789431 - DNA, 20 bp, mouse
ggagcaggattgaggggcgc

SEQ ID NO: 789432 - DNA, 20 bp, mouse
gcccgctcccgctttcggat

SEQ ID NO: 789433 - DNA, 20 bp, mouse
gcggcgcacagaaggttcac

SEQ ID NO: 789434 - DNA, 20 bp, mouse
gccgactactaacccttagg

SEQ ID NO: 789435 - DNA, 20 bp, mouse
gcctgagctggaatggcaag

SEQ ID NO: 789436 - DNA, 20 bp, mouse
gctgtccctggaaatctcct

SEQ ID NO: 789437 - DNA, 20 bp, mouse
gagctcagagacacagagtg

SEQ ID NO: 789438 - DNA, 20 bp, mouse
gtgggagggagcaaggctgt

SEQ ID NO: 789439 - DNA, 20 bp, mouse
gggctgctggtgcttctgta

SEQ ID NO: 789440 - DNA, 20 bp, mouse
gagaacccaggagatttcca

SEQ ID NO: 789441 - DNA, 20 bp, mouse
ggggagcaaggctgtgggag

SEQ ID NO: 789442 - DNA, 20 bp, mouse
ggatttccagggacagccca

SEQ ID NO: 789443 - DNA, 20 bp, mouse
gtaaggccatcgcaagcttc

SEQ ID NO: 789444 - DNA, 20 bp, mouse
gcacggagaagagaaatcac

SEQ ID NO: 789445 - DNA, 20 bp, mouse
gaacctatagaagtgaaaaa

SEQ ID NO: 789446 - DNA, 20 bp, mouse
gcgcgtgagccaaggagcgg

SEQ ID NO: 789447 - DNA, 20 bp, mouse
gcggaaatccgcgtgagcca

SEQ ID NO: 789448 - DNA, 20 bp, mouse
gagctgtgtctcagccacca

SEQ ID NO: 789449 - DNA, 20 bp, mouse
ggggcgagccggaccagttt

SEQ ID NO: 789450 - DNA, 20 bp, mouse
gtgcttgcccctccgctcct

SEQ ID NO: 789451 - DNA, 20 bp, mouse
gggctggggattgtctcctt

SEQ ID NO: 789452 - DNA, 20 bp, mouse
ggctagaattgcagtgtggc

SEQ ID NO: 789453 - DNA, 20 bp, mouse
gctcccgggtaaacaagaag

SEQ ID NO: 789454 - DNA, 20 bp, mouse
ggggcttccagtcgacagaa

SEQ ID NO: 789455 - DNA, 20 bp, mouse
ggagacaatccccagcctgc

SEQ ID NO: 789456 - DNA, 20 bp, mouse
gcccctaatggatttttctg

SEQ ID NO: 789457 - DNA, 20 bp, mouse
ggggagaacacactgttcaa

SEQ ID NO: 789458 - DNA, 20 bp, mouse
gtctgcagggaccaactggg

SEQ ID NO: 789459 - DNA, 20 bp, mouse
gcagttggtccctgcagagt

SEQ ID NO: 789460 - DNA, 20 bp, mouse
gccattaggggcgtggaaag

SEQ ID NO: 789461 - DNA, 20 bp, mouse
gtccccagaaaaatccatta

SEQ ID NO: 789462 - DNA, 20 bp, mouse
gtgcgtgtgtcccacggctc

SEQ ID NO: 789463 - DNA, 20 bp, mouse
gcgaaaggcaggcggggcct

SEQ ID NO: 789464 - DNA, 20 bp, mouse
gtggagtctcactcggaata

SEQ ID NO: 789465 - DNA, 20 bp, mouse
gagcacgagcaaaaagcggg

SEQ ID NO: 789466 - DNA, 20 bp, mouse
gaagccctgcctagccaatc

SEQ ID NO: 789467 - DNA, 20 bp, mouse
gtctctgaggctatgggtaa

SEQ ID NO: 789468 - DNA, 20 bp, mouse
gatgggtaaaggtgctgagt

SEQ ID NO: 789469 - DNA, 20 bp, mouse
ggcaataaaaatgtcagtgg

SEQ ID NO: 789470 - DNA, 20 bp, mouse
gggcgactgctggatcgcga

SEQ ID NO: 789471 - DNA, 20 bp, mouse
ggggcccagttaaatgataa

SEQ ID NO: 789472 - DNA, 20 bp, mouse
gcctgcaataaaaatgtcag

SEQ ID NO: 789473 - DNA, 20 bp, mouse
ggggacaggcaagatttctt

SEQ ID NO: 789474 - DNA, 20 bp, mouse
gaggcctgattggctaggca

SEQ ID NO: 789475 - DNA, 20 bp, mouse
gctggtgtccgttctcattt

SEQ ID NO: 789476 - DNA, 20 bp, mouse
ggacgtacaaagtgaggagc

SEQ ID NO: 789477 - DNA, 20 bp, mouse
gacaaagcaacactcctgtg

SEQ ID NO: 789478 - DNA, 20 bp, mouse
gggttatgacgtacaaagtg

SEQ ID NO: 789479 - DNA, 20 bp, mouse
gttgggcacagacagtattt

SEQ ID NO: 789480 - DNA, 20 bp, mouse
gatgaagtggcaatgaaaag

SEQ ID NO: 789481 - DNA, 20 bp, mouse
gtcaataaatgataactttg

SEQ ID NO: 789482 - DNA, 20 bp, mouse
gctgtgcccaaggagaagcc

SEQ ID NO: 789483 - DNA, 20 bp, mouse
ggtttctcagagtaatgaag

SEQ ID NO: 789484 - DNA, 20 bp, mouse
gtccctaccttatcctactt

SEQ ID NO: 789485 - DNA, 20 bp, mouse
gatccaaagtaggataaggt

SEQ ID NO: 789486 - DNA, 20 bp, mouse
gccttgggggtgcacacagt

SEQ ID NO: 789487 - DNA, 20 bp, mouse
gcacacagtgggttgacagg

SEQ ID NO: 789488 - DNA, 20 bp, mouse
gcagccagtgggggccttgg

SEQ ID NO: 789489 - DNA, 20 bp, mouse
gggcctcctgtgctgtatgg

SEQ ID NO: 789490 - DNA, 20 bp, mouse
gcctatgtggcataacaccg

SEQ ID NO: 789491 - DNA, 20 bp, mouse
gtgagcgatgaggggtccaa

SEQ ID NO: 789492 - DNA, 20 bp, mouse
gcagctctgcctgaggtagg

SEQ ID NO: 789493 - DNA, 20 bp, mouse
gcgagctgggaccaatggta

SEQ ID NO: 789494 - DNA, 20 bp, mouse
gtcaagcactctccagccag

SEQ ID NO: 789495 - DNA, 20 bp, mouse
gagtctgtatgaacgcaaaa

SEQ ID NO: 789496 - DNA, 20 bp, mouse
ggggtggagctcttccaagg

SEQ ID NO: 789497 - DNA, 20 bp, mouse
ggccccctggcgcgcgcctc

SEQ ID NO: 789498 - DNA, 20 bp, mouse
gggccggcgctgctctccgc

SEQ ID NO: 789499 - DNA, 20 bp, mouse
gtctcccgaggcgcgcgcca

SEQ ID NO: 789500 - DNA, 20 bp, mouse
gggagagcagcgccggcctc

SEQ ID NO: 789501 - DNA, 20 bp, mouse
gcaccgcgcgcgcagggggg

SEQ ID NO: 789502 - DNA, 20 bp, mouse
gtgctctccgccggccccct

SEQ ID NO: 789503 - DNA, 20 bp, mouse
gcacagcggcgcggacggga

SEQ ID NO: 789504 - DNA, 20 bp, mouse
gcgggagggtgcggagagga

SEQ ID NO: 789505 - DNA, 20 bp, mouse
ggcgcaccgcgcgcgcaggg

SEQ ID NO: 789506 - DNA, 20 bp, mouse
gcggtccgcccccttcggaa

SEQ ID NO: 789507 - DNA, 20 bp, mouse
gcatgagtgtatttgagtag

SEQ ID NO: 789508 - DNA, 20 bp, mouse
gtcgcctgggccgctggggt

SEQ ID NO: 789509 - DNA, 20 bp, mouse
gttgctggggccacactagg

SEQ ID NO: 789510 - DNA, 20 bp, mouse
gcgtgtggggctgtgagaga

SEQ ID NO: 789511 - DNA, 20 bp, mouse
gatctggaacagggcgtgtg

SEQ ID NO: 789512 - DNA, 20 bp, mouse
gcccccgcagcacggagggg

SEQ ID NO: 789513 - DNA, 20 bp, mouse
gtctgcccccgcagcacgga

SEQ ID NO: 789514 - DNA, 20 bp, mouse
gaggccgaccccagcggccc

SEQ ID NO: 789515 - DNA, 20 bp, mouse
ggggtggaaagcgaggacgc

SEQ ID NO: 789516 - DNA, 20 bp, mouse
gctgccaggcggggtctcga

SEQ ID NO: 789517 - DNA, 20 bp, mouse
gggcccccgcgcttggtccc

SEQ ID NO: 789518 - DNA, 20 bp, mouse
gggaactgggggccgggaga

SEQ ID NO: 789519 - DNA, 20 bp, mouse
ggggtgtcaaggtgctgccg

SEQ ID NO: 789520 - DNA, 20 bp, mouse
ggctgagggcgtgatgggga

SEQ ID NO: 789521 - DNA, 20 bp, mouse
ggacggacaggtgttcctca

SEQ ID NO: 789522 - DNA, 20 bp, mouse
ggagccgctgagggcgtgat

SEQ ID NO: 789523 - DNA, 20 bp, mouse
gaggcggggtctcgacggac

SEQ ID NO: 789524 - DNA, 20 bp, mouse
gggcccgggaccaagcgcgg

SEQ ID NO: 789525 - DNA, 20 bp, mouse
gccaggagtaggagccgctg

SEQ ID NO: 789526 - DNA, 20 bp, mouse
gcagctggattgagttgtca

SEQ ID NO: 789527 - DNA, 20 bp, mouse
gggaagcgggagtgctctgc

SEQ ID NO: 789528 - DNA, 20 bp, mouse
gcggggccctgcagcccatc

SEQ ID NO: 789529 - DNA, 20 bp, mouse
gctgcagcccatctggcaga

SEQ ID NO: 789530 - DNA, 20 bp, mouse
gtccctctggggagaaaacc

SEQ ID NO: 789531 - DNA, 20 bp, mouse
gtgcatggtgctgtggaatg

SEQ ID NO: 789532 - DNA, 20 bp, mouse
gaaggccacttttccctctg

SEQ ID NO: 789533 - DNA, 20 bp, mouse
gctagaagggacttgttgct

SEQ ID NO: 789534 - DNA, 20 bp, mouse
gggtggagagcaaagcgtcc

SEQ ID NO: 789535 - DNA, 20 bp, mouse
ggagctgaacttggactcaa

SEQ ID NO: 789536 - DNA, 20 bp, mouse
gtgtacgcgggcggtggtgg

SEQ ID NO: 789537 - DNA, 20 bp, mouse
gagacccaatagcgagctcc

SEQ ID NO: 789538 - DNA, 20 bp, mouse
gcaacccggagctcgctatt

SEQ ID NO: 789539 - DNA, 20 bp, mouse
gtggaacgtggggaccgacc

SEQ ID NO: 789540 - DNA, 20 bp, mouse
gaggcgggaggcggctccgc

SEQ ID NO: 789541 - DNA, 20 bp, mouse
ggggcccacgcagccgggac

SEQ ID NO: 789542 - DNA, 20 bp, mouse
gctcccggggtcccgcgcgc

SEQ ID NO: 789543 - DNA, 20 bp, mouse
gccacgcagccgggaccgga

SEQ ID NO: 789544 - DNA, 20 bp, mouse
gaccgcaccccctccggtcc

SEQ ID NO: 789545 - DNA, 20 bp, mouse
gcacgtggggagtggcgcgg

SEQ ID NO: 789546 - DNA, 20 bp, mouse
ggggcgcagagccaatggga

SEQ ID NO: 789547 - DNA, 20 bp, mouse
ggcgggctctgccaagagag

SEQ ID NO: 789548 - DNA, 20 bp, mouse
gggagagagcttgagagcgc

SEQ ID NO: 789549 - DNA, 20 bp, mouse
ggcgtcggagctgcccgcta

SEQ ID NO: 789550 - DNA, 20 bp, mouse
gagcttgagagcgcggggag

SEQ ID NO: 789551 - DNA, 20 bp, mouse
ggggcggggcccatccgagt

SEQ ID NO: 789552 - DNA, 20 bp, mouse
gccaccccgcgcgacctatt

SEQ ID NO: 789553 - DNA, 20 bp, mouse
gcccctccaccccctcccat

SEQ ID NO: 789554 - DNA, 20 bp, mouse
ggcgctctggtggactacag

SEQ ID NO: 789555 - DNA, 20 bp, mouse
gtggcagagcccgctcgcag

SEQ ID NO: 789556 - DNA, 20 bp, mouse
ggggcggggacccgtacttc

SEQ ID NO: 789557 - DNA, 20 bp, mouse
gcagagtccgcactcgtccg

SEQ ID NO: 789558 - DNA, 20 bp, mouse
gtcggggagcaagggctccg

SEQ ID NO: 789559 - DNA, 20 bp, mouse
gtccgcactcgtccgaggac

SEQ ID NO: 789560 - DNA, 20 bp, mouse
gccccctggccgggagcgat

SEQ ID NO: 789561 - DNA, 20 bp, mouse
gcagcgaggctcgcccactg

SEQ ID NO: 789562 - DNA, 20 bp, mouse
gcgaggctcgcccactgggg

SEQ ID NO: 789563 - DNA, 20 bp, mouse
gcgagagagcgcccgaagta

SEQ ID NO: 789564 - DNA, 20 bp, mouse
gccgaggacaggaggagccg

SEQ ID NO: 789565 - DNA, 20 bp, mouse
gtccgtggccagccccttca

SEQ ID NO: 789566 - DNA, 20 bp, mouse
gcgagctcgctttccaaatt

SEQ ID NO: 789567 - DNA, 20 bp, mouse
ggagactacaaggctgttag

SEQ ID NO: 789568 - DNA, 20 bp, mouse
gccccctcccggagactaca

SEQ ID NO: 789569 - DNA, 20 bp, mouse
gcagccaatggtggtgcggg

SEQ ID NO: 789570 - DNA, 20 bp, mouse
gacacagccaatggtggtgc

SEQ ID NO: 789571 - DNA, 20 bp, mouse
gtaacccgcgctagcggctt

SEQ ID NO: 789572 - DNA, 20 bp, mouse
gctcgctttccaaattaggc

SEQ ID NO: 789573 - DNA, 20 bp, mouse
ggtttcagtgagacccaagc

SEQ ID NO: 789574 - DNA, 20 bp, mouse
gggccaatcgcagtgcgact

SEQ ID NO: 789575 - DNA, 20 bp, mouse
ggtggcagagaataaataga

SEQ ID NO: 789576 - DNA, 20 bp, mouse
gagggcgcgcgccagacaga

SEQ ID NO: 789577 - DNA, 20 bp, mouse
gctggtggtcactataagag

SEQ ID NO: 789578 - DNA, 20 bp, mouse
gggtctgcaaagatcaaaaa

SEQ ID NO: 789579 - DNA, 20 bp, mouse
gctcgtcgagccgcgaccgg

SEQ ID NO: 789580 - DNA, 20 bp, mouse
gcgcatgcctggccagctac

SEQ ID NO: 789581 - DNA, 20 bp, mouse
gccgctcgctcgcccaagca

SEQ ID NO: 789582 - DNA, 20 bp, mouse
gtcgcccaagcacggcgccg

SEQ ID NO: 789583 - DNA, 20 bp, mouse
ggggccggccgcgagaagtg

SEQ ID NO: 789584 - DNA, 20 bp, mouse
ggtgaccaccagcaaggaca

SEQ ID NO: 789585 - DNA, 20 bp, mouse
ggtcgagccgcgaccggcgg

SEQ ID NO: 789586 - DNA, 20 bp, mouse
ggggtgcagggagaactgaa

SEQ ID NO: 789587 - DNA, 20 bp, mouse
ggggaaggctgcgggtcccg

SEQ ID NO: 789588 - DNA, 20 bp, mouse
gagcctgcggggagccaggg

SEQ ID NO: 789589 - DNA, 20 bp, mouse
ggggtcaggcgcgggaagag

SEQ ID NO: 789590 - DNA, 20 bp, mouse
gcagggagaactgaaaggac

SEQ ID NO: 789591 - DNA, 20 bp, mouse
ggcgcctgccggggcaggga

SEQ ID NO: 789592 - DNA, 20 bp, mouse
gcggagcctgcggggagcca

SEQ ID NO: 789593 - DNA, 20 bp, mouse
gaacagcagagcgcctgccg

SEQ ID NO: 789594 - DNA, 20 bp, mouse
gctgccaggacgcactgctc

SEQ ID NO: 789595 - DNA, 20 bp, mouse
ggtggcccgaagcaccgacc

SEQ ID NO: 789596 - DNA, 20 bp, mouse
gcagacgtgcacacgcgccc

SEQ ID NO: 789597 - DNA, 20 bp, mouse
gacgcgcccgggactcgcag

SEQ ID NO: 789598 - DNA, 20 bp, mouse
gcggggtataaatgctgtgg

SEQ ID NO: 789599 - DNA, 20 bp, mouse
gggaagaggccctgccaggc

SEQ ID NO: 789600 - DNA, 20 bp, mouse
gcgcgtgcccgggcccttcc

SEQ ID NO: 789601 - DNA, 20 bp, mouse
gcatccaggcagctcgagct

SEQ ID NO: 789602 - DNA, 20 bp, mouse
gcgccactctgagcctgatg

SEQ ID NO: 789603 - DNA, 20 bp, mouse
gtcgagctgcctggatgaaa

SEQ ID NO: 789604 - DNA, 20 bp, mouse
gaggggaggcagcaagcgag

SEQ ID NO: 789605 - DNA, 20 bp, mouse
gggactcgcaggggcggccc

SEQ ID NO: 789606 - DNA, 20 bp, mouse
gtcctggggtcccgtcctaa

SEQ ID NO: 789607 - DNA, 20 bp, mouse
gaggttggggacgtctggac

SEQ ID NO: 789608 - DNA, 20 bp, mouse
gtctggacaggacaaccctt

SEQ ID NO: 789609 - DNA, 20 bp, mouse
gacctccgtctggaagacac

SEQ ID NO: 789610 - DNA, 20 bp, mouse
gtgaaaatgaaggcctcctg

SEQ ID NO: 789611 - DNA, 20 bp, mouse
gacaggacaacccttaggac

SEQ ID NO: 789612 - DNA, 20 bp, mouse
ggacgtccccaacctccgtc

SEQ ID NO: 789613 - DNA, 20 bp, mouse
gctgagtgggctgtaaggac

SEQ ID NO: 789614 - DNA, 20 bp, mouse
gggtgggtaagcaagaactg

SEQ ID NO: 789615 - DNA, 20 bp, mouse
gaaggctagagggtgggatt

SEQ ID NO: 789616 - DNA, 20 bp, mouse
gtgaaaacaacggtcaggac

SEQ ID NO: 789617 - DNA, 20 bp, mouse
gaaagtgtgtttgaaagctg

SEQ ID NO: 789618 - DNA, 20 bp, mouse
gccagtcaaggataagatcc

SEQ ID NO: 789619 - DNA, 20 bp, mouse
gtcgagccccgccccccagt

SEQ ID NO: 789620 - DNA, 20 bp, mouse
gtgggaaagcttggcgtggg

SEQ ID NO: 789621 - DNA, 20 bp, mouse
gagagttgaaaacaacggtc

SEQ ID NO: 789622 - DNA, 20 bp, mouse
gaaagcttggcgtgggaggc

SEQ ID NO: 789623 - DNA, 20 bp, mouse
gagcactgcaagcaagacac

SEQ ID NO: 789624 - DNA, 20 bp, mouse
gagtgattgcgtcccagtca

SEQ ID NO: 789625 - DNA, 20 bp, mouse
ggagtgggaaagcttggcgt

SEQ ID NO: 789626 - DNA, 20 bp, mouse
gaagctgcgagctgcgcgtg

SEQ ID NO: 789627 - DNA, 20 bp, mouse
gcggcggtcaggaaaaggag

SEQ ID NO: 789628 - DNA, 20 bp, mouse
gccagtcctgctctccaagg

SEQ ID NO: 789629 - DNA, 20 bp, mouse
gcaggactggagtctcgata

SEQ ID NO: 789630 - DNA, 20 bp, mouse
gcccaggcctcgcggggact

SEQ ID NO: 789631 - DNA, 20 bp, mouse
gtgaggttggccgttgagaa

SEQ ID NO: 789632 - DNA, 20 bp, mouse
gggtcaactgcccttctcaa

SEQ ID NO: 789633 - DNA, 20 bp, mouse
ggtcgccttcccttcagccg

SEQ ID NO: 789634 - DNA, 20 bp, mouse
gactccagtcctgctctcca

SEQ ID NO: 789635 - DNA, 20 bp, mouse
gctgaagggaaggcgacacg

SEQ ID NO: 789636 - DNA, 20 bp, mouse
gggaagtcagggatgtggtg

SEQ ID NO: 789637 - DNA, 20 bp, mouse
gagggaaggagcctgaattt

SEQ ID NO: 789638 - DNA, 20 bp, mouse
gggaccctgcagtgggttcg

SEQ ID NO: 789639 - DNA, 20 bp, mouse
ggggccccgaacccactgca

SEQ ID NO: 789640 - DNA, 20 bp, mouse
gagagagcaagtgggtctta

SEQ ID NO: 789641 - DNA, 20 bp, mouse
gggaaggtcgcgtcgctgtg

SEQ ID NO: 789642 - DNA, 20 bp, mouse
gaggagagattcaaagtcac

SEQ ID NO: 789643 - DNA, 20 bp, mouse
gcacatgatgatttcaagga

SEQ ID NO: 789644 - DNA, 20 bp, mouse
gatcatgtgaagcaggacgg

SEQ ID NO: 789645 - DNA, 20 bp, mouse
gtgaaaaccaccacgtggca

SEQ ID NO: 789646 - DNA, 20 bp, mouse
gtgggccttctgattgatgg

SEQ ID NO: 789647 - DNA, 20 bp, mouse
gggaacctccatcaatcaga

SEQ ID NO: 789648 - DNA, 20 bp, mouse
gagatggtcaacactgtaac

SEQ ID NO: 789649 - DNA, 20 bp, mouse
ggtgttaaccaacttcccag

SEQ ID NO: 789650 - DNA, 20 bp, mouse
ggctaaaattccagattaga

SEQ ID NO: 789651 - DNA, 20 bp, mouse
gttcaagtcctggatcacaa

SEQ ID NO: 789652 - DNA, 20 bp, mouse
gaagtgggccttctgattga

SEQ ID NO: 789653 - DNA, 20 bp, mouse
gtctctagcccccagccccg

SEQ ID NO: 789654 - DNA, 20 bp, mouse
gtggatcacaaaggttgcta

SEQ ID NO: 789655 - DNA, 20 bp, mouse
gaaaagaaagaaatcccact

SEQ ID NO: 789656 - DNA, 20 bp, mouse
gggcgcctgccacgtggccc

SEQ ID NO: 789657 - DNA, 20 bp, mouse
ggccctctggaagcggactg

SEQ ID NO: 789658 - DNA, 20 bp, mouse
gaaccagcgttctgtcccag

SEQ ID NO: 789659 - DNA, 20 bp, mouse
gaacgctggttactctcctg

SEQ ID NO: 789660 - DNA, 20 bp, mouse
gtggcccaggttgcgaaccg

SEQ ID NO: 789661 - DNA, 20 bp, mouse
ggaagcggactgcgggttgg

SEQ ID NO: 789662 - DNA, 20 bp, mouse
gagactgcctggggaacagg

SEQ ID NO: 789663 - DNA, 20 bp, mouse
gcgcccccggttcgcaacct

SEQ ID NO: 789664 - DNA, 20 bp, mouse
gagagtgcgcctgcgcgggt

SEQ ID NO: 789665 - DNA, 20 bp, mouse
ggagctggcccgccggtcgc

SEQ ID NO: 789666 - DNA, 20 bp, mouse
ggacactgacagtgtgtgag

SEQ ID NO: 789667 - DNA, 20 bp, mouse
gggccccaggaatgcagaag

SEQ ID NO: 789668 - DNA, 20 bp, mouse
gtggagaggtaggtggcccc

SEQ ID NO: 789669 - DNA, 20 bp, mouse
gcaggaatgcagaagagggt

SEQ ID NO: 789670 - DNA, 20 bp, mouse
gttgctccacaagccctcag

SEQ ID NO: 789671 - DNA, 20 bp, mouse
gagcccgcactgcctccccg

SEQ ID NO: 789672 - DNA, 20 bp, mouse
gagaaccgcagggtcggtgc

SEQ ID NO: 789673 - DNA, 20 bp, mouse
gcttgtggagcaaagtggag

SEQ ID NO: 789674 - DNA, 20 bp, mouse
ggcgtggtggtgaattcctg

SEQ ID NO: 789675 - DNA, 20 bp, mouse
ggcagcgcgcgcatggcgga

SEQ ID NO: 789676 - DNA, 20 bp, mouse
gtggccggcacgcaggaagt

SEQ ID NO: 789677 - DNA, 20 bp, mouse
ggaccgttggatgacgtcac

SEQ ID NO: 789678 - DNA, 20 bp, mouse
ggacgtcatccaacggtcct

SEQ ID NO: 789679 - DNA, 20 bp, mouse
ggtccggagccaaggaccgt

SEQ ID NO: 789680 - DNA, 20 bp, mouse
gtgccgaaacgttcaggata

SEQ ID NO: 789681 - DNA, 20 bp, mouse
ggggcctcacaattatttga

SEQ ID NO: 789682 - DNA, 20 bp, mouse
gggccagtgacgtcatccaa

SEQ ID NO: 789683 - DNA, 20 bp, mouse
ggccgcgtggcaccggaagt

SEQ ID NO: 789684 - DNA, 20 bp, mouse
gtacgcttgccgaaacgttc

SEQ ID NO: 789685 - DNA, 20 bp, mouse
ggaaccctcaaataattgtg

SEQ ID NO: 789686 - DNA, 20 bp, mouse
gtggaagctggttaacgggg

SEQ ID NO: 789687 - DNA, 20 bp, mouse
gaatctggaagctggttaac

SEQ ID NO: 789688 - DNA, 20 bp, mouse
gtggcgggcagcaggagcta

SEQ ID NO: 789689 - DNA, 20 bp, mouse
gggggccaattgcagggatt

SEQ ID NO: 789690 - DNA, 20 bp, mouse
ggccccgccccgccgacttg

SEQ ID NO: 789691 - DNA, 20 bp, mouse
gggcgggctccgcaagtcgg

SEQ ID NO: 789692 - DNA, 20 bp, mouse
gcggggcggggccaattgca

SEQ ID NO: 789693 - DNA, 20 bp, mouse
gaagcatcgcctagcactaa

SEQ ID NO: 789694 - DNA, 20 bp, mouse
gtaaccagcttccagattcg

SEQ ID NO: 789695 - DNA, 20 bp, mouse
ggagctatggaatggtgtat

SEQ ID NO: 789696 - DNA, 20 bp, mouse
gtctccccacctctaatcaa

SEQ ID NO: 789697 - DNA, 20 bp, mouse
gcttaagctgcctaaaacgt

SEQ ID NO: 789698 - DNA, 20 bp, mouse
gaggtggggagaggatcggt

SEQ ID NO: 789699 - DNA, 20 bp, mouse
gatcacagcggcagcccggg

SEQ ID NO: 789700 - DNA, 20 bp, mouse
gtggggagaggatcggtggg

SEQ ID NO: 789701 - DNA, 20 bp, mouse
gtggagtttctgaacgctag

SEQ ID NO: 789702 - DNA, 20 bp, mouse
gctaaaacgtaggataatta

SEQ ID NO: 789703 - DNA, 20 bp, mouse
gcaaagcatcacaaaagggg

SEQ ID NO: 789704 - DNA, 20 bp, mouse
gcgcctttaaaaagcgaggg

SEQ ID NO: 789705 - DNA, 20 bp, mouse
gctacggtgtaaaagactcc

SEQ ID NO: 789706 - DNA, 20 bp, mouse
gctgggatccgagaatctca

SEQ ID NO: 789707 - DNA, 20 bp, mouse
gacccgggcgcgcaggggca

SEQ ID NO: 789708 - DNA, 20 bp, mouse
ggggtgtgggagcgtgtctc

SEQ ID NO: 789709 - DNA, 20 bp, mouse
ggtggcaaacacacccctca

SEQ ID NO: 789710 - DNA, 20 bp, mouse
gagaaagtgcggaggcggga

SEQ ID NO: 789711 - DNA, 20 bp, mouse
gggctgggatgggcgggtgt

SEQ ID NO: 789712 - DNA, 20 bp, mouse
gctgcgcgcccgggtcaagg

SEQ ID NO: 789713 - DNA, 20 bp, mouse
ggagagggcggaggccctga

SEQ ID NO: 789714 - DNA, 20 bp, mouse
ggaaccccgcccaagtgttg

SEQ ID NO: 789715 - DNA, 20 bp, mouse
gtggagatccctcccaaata

SEQ ID NO: 789716 - DNA, 20 bp, mouse
ggatcggcgttatcaggagt

SEQ ID NO: 789717 - DNA, 20 bp, mouse
gtccgggagcccagagcggg

SEQ ID NO: 789718 - DNA, 20 bp, mouse
gacctgaagaggctggtgtc

SEQ ID NO: 789719 - DNA, 20 bp, mouse
gtcctgataacgccgatcag

SEQ ID NO: 789720 - DNA, 20 bp, mouse
gtccctgacgcgcccctgat

SEQ ID NO: 789721 - DNA, 20 bp, mouse
ggcccctgatcggcgttatc

SEQ ID NO: 789722 - DNA, 20 bp, mouse
gtcaggagtgggacctgaag

SEQ ID NO: 789723 - DNA, 20 bp, mouse
ggtggagccagagaatgcca

SEQ ID NO: 789724 - DNA, 20 bp, mouse
gcgacagcagggcatccccc

SEQ ID NO: 789725 - DNA, 20 bp, mouse
ggggaagccgcgcagcgcgc

SEQ ID NO: 789726 - DNA, 20 bp, mouse
gggcgctcgcacttcctaag

SEQ ID NO: 789727 - DNA, 20 bp, mouse
gtcaccctggggaggaaacg

SEQ ID NO: 789728 - DNA, 20 bp, mouse
ggccacctagcgaactccgc

SEQ ID NO: 789729 - DNA, 20 bp, mouse
gcgagcgcccagggacgcct

SEQ ID NO: 789730 - DNA, 20 bp, mouse
gccaaaggtgatctgttagg

SEQ ID NO: 789731 - DNA, 20 bp, mouse
gcgcggggactgactaccag

SEQ ID NO: 789732 - DNA, 20 bp, mouse
gacgcccagctcggctccca

SEQ ID NO: 789733 - DNA, 20 bp, mouse
gggaaacggggaagattgac

SEQ ID NO: 789734 - DNA, 20 bp, mouse
gaagggaaaaaactgggctg

SEQ ID NO: 789735 - DNA, 20 bp, mouse
gtaggaagtgcgagcgccca

SEQ ID NO: 789736 - DNA, 20 bp, mouse
gcgggatggcagtgcggaag

SEQ ID NO: 789737 - DNA, 20 bp, mouse
ggtgacacctggcggagacg

SEQ ID NO: 789738 - DNA, 20 bp, mouse
gaaccgggagtaccagcttg

SEQ ID NO: 789739 - DNA, 20 bp, mouse
gggagtaccagcttgaggag

SEQ ID NO: 789740 - DNA, 20 bp, mouse
gtccgcactgccatcccgga

SEQ ID NO: 789741 - DNA, 20 bp, mouse
gacctggcggagacgtggga

SEQ ID NO: 789742 - DNA, 20 bp, mouse
gcaggtgaaggacgcagtga

SEQ ID NO: 789743 - DNA, 20 bp, mouse
ggtaccagcttgaggagagg

SEQ ID NO: 789744 - DNA, 20 bp, mouse
gcggaagaggctgacgggct

SEQ ID NO: 789745 - DNA, 20 bp, mouse
gaggagggcaatcaagggat

SEQ ID NO: 789746 - DNA, 20 bp, mouse
gctagggccagagaccagaa

SEQ ID NO: 789747 - DNA, 20 bp, mouse
ggcccagccaggggaacaag

SEQ ID NO: 789748 - DNA, 20 bp, mouse
ggaccagaacgggaagcaaa

SEQ ID NO: 789749 - DNA, 20 bp, mouse
gtctctggccctagcagaga

SEQ ID NO: 789750 - DNA, 20 bp, mouse
gttagagtccatctctgcta

SEQ ID NO: 789751 - DNA, 20 bp, mouse
gtgcttcccgttctggtctc

SEQ ID NO: 789752 - DNA, 20 bp, mouse
gactctatgttgggtctcta

SEQ ID NO: 789753 - DNA, 20 bp, mouse
ggatctgccctggtcaaagc

SEQ ID NO: 789754 - DNA, 20 bp, mouse
gcgccaatagagccacggac

SEQ ID NO: 789755 - DNA, 20 bp, mouse
ggcgctggccctgtaagggt

SEQ ID NO: 789756 - DNA, 20 bp, mouse
gggctggagggcacgcgcga

SEQ ID NO: 789757 - DNA, 20 bp, mouse
gaccccgcaggggacgtccg

SEQ ID NO: 789758 - DNA, 20 bp, mouse
gcgctccaggggactcgaag

SEQ ID NO: 789759 - DNA, 20 bp, mouse
gcccacgacaggggtgacgg

SEQ ID NO: 789760 - DNA, 20 bp, mouse
gtgtcccgggacagtgaggt

SEQ ID NO: 789761 - DNA, 20 bp, mouse
ggcgccaggaggggcgtaag

SEQ ID NO: 789762 - DNA, 20 bp, mouse
gcctcctggcgcctcctcct

SEQ ID NO: 789763 - DNA, 20 bp, mouse
gacgctacggtcccacgaca

SEQ ID NO: 789764 - DNA, 20 bp, mouse
ggccaagcgcgcccaggagg

SEQ ID NO: 789765 - DNA, 20 bp, mouse
ggacccacagccactggaga

SEQ ID NO: 789766 - DNA, 20 bp, mouse
gaagcgctggggagaagtta

SEQ ID NO: 789767 - DNA, 20 bp, mouse
ggcggagcgatggctgtcaa

SEQ ID NO: 789768 - DNA, 20 bp, mouse
ggcgatggctgtcaaaggag

SEQ ID NO: 789769 - DNA, 20 bp, mouse
gggggcgagtgcttagttgt

SEQ ID NO: 789770 - DNA, 20 bp, mouse
gcggcgattggctactgcta

SEQ ID NO: 789771 - DNA, 20 bp, mouse
ggggcgctgcagacgcgcca

SEQ ID NO: 789772 - DNA, 20 bp, mouse
ggccctctgcagtcagacgt

SEQ ID NO: 789773 - DNA, 20 bp, mouse
gggctactgctatggcggaa

SEQ ID NO: 789774 - DNA, 20 bp, mouse
gagcggcgcggtgacatcac

SEQ ID NO: 789775 - DNA, 20 bp, mouse
ggccagggcagctgtgcagt

SEQ ID NO: 789776 - DNA, 20 bp, mouse
gcgactctgacctgaggcgg

SEQ ID NO: 789777 - DNA, 20 bp, mouse
ggggcccgtcgcactcagag

SEQ ID NO: 789778 - DNA, 20 bp, mouse
gtggggcgctcgggtcgggt

SEQ ID NO: 789779 - DNA, 20 bp, mouse
gccggggcgactctgacctg

SEQ ID NO: 789780 - DNA, 20 bp, mouse
gccgacccgagcgccccagg

SEQ ID NO: 789781 - DNA, 20 bp, mouse
gcggcgggccgcgtggcccg

SEQ ID NO: 789782 - DNA, 20 bp, mouse
gcgggtgctgtgcgtcggtg

SEQ ID NO: 789783 - DNA, 20 bp, mouse
ggggaccgagtgtgacgaca

SEQ ID NO: 789784 - DNA, 20 bp, mouse
ggggtcgcgcgcagcctgag

SEQ ID NO: 789785 - DNA, 20 bp, mouse
ggcggcccgccggagggacg

SEQ ID NO: 789786 - DNA, 20 bp, mouse
gtctaagcgttacttcactg

SEQ ID NO: 789787 - DNA, 20 bp, mouse
gaagtaacgcttagagagag

SEQ ID NO: 789788 - DNA, 20 bp, mouse
ggatgcttgaagcctcccaa

SEQ ID NO: 789789 - DNA, 20 bp, mouse
gaactcctgacgtcactcca

SEQ ID NO: 789790 - DNA, 20 bp, mouse
gcgttacttcactgaggcag

SEQ ID NO: 789791 - DNA, 20 bp, mouse
ggctgccttggagtgacgtc

SEQ ID NO: 789792 - DNA, 20 bp, mouse
gagttggtggcattcaaagc

SEQ ID NO: 789793 - DNA, 20 bp, mouse
gttgtgcagcaagcttgcac

SEQ ID NO: 789794 - DNA, 20 bp, mouse
gaatgccaccaactctaaac

SEQ ID NO: 789795 - DNA, 20 bp, mouse
gagcaagcttgcacaggaga

SEQ ID NO: 789796 - DNA, 20 bp, mouse
gtaggagcaggaaaagccgg

SEQ ID NO: 789797 - DNA, 20 bp, mouse
ggagctcgggcccccggctg

SEQ ID NO: 789798 - DNA, 20 bp, mouse
gtgcccggcgggcgggtgga

SEQ ID NO: 789799 - DNA, 20 bp, mouse
ggagcctggggtcgcacccc

SEQ ID NO: 789800 - DNA, 20 bp, mouse
ggtctcgcagccccccgcag

SEQ ID NO: 789801 - DNA, 20 bp, mouse
gcagccaggtggcggtgccc

SEQ ID NO: 789802 - DNA, 20 bp, mouse
gagggaggaggctgcccggc

SEQ ID NO: 789803 - DNA, 20 bp, mouse
gcgctctaacagtaaggagg

SEQ ID NO: 789804 - DNA, 20 bp, mouse
gaagccgggggtgcgacccc

SEQ ID NO: 789805 - DNA, 20 bp, mouse
gggtgcccgcattgctgcgc

SEQ ID NO: 789806 - DNA, 20 bp, mouse
gcggggctacggagtcaaag

SEQ ID NO: 789807 - DNA, 20 bp, mouse
ggctctccgccaatcagcta

SEQ ID NO: 789808 - DNA, 20 bp, mouse
gcttgggcgcgggaaaataa

SEQ ID NO: 789809 - DNA, 20 bp, mouse
ggcggcgcgcttcatagaag

SEQ ID NO: 789810 - DNA, 20 bp, mouse
ggggacggcgtgagaccagg

SEQ ID NO: 789811 - DNA, 20 bp, mouse
gcccgcaggcagccaaaaag

SEQ ID NO: 789812 - DNA, 20 bp, mouse
gaacggctcaggttttctga

SEQ ID NO: 789813 - DNA, 20 bp, mouse
gtgagaccagggggcacgaa

SEQ ID NO: 789814 - DNA, 20 bp, mouse
gaaagtagcgatcctgacct

SEQ ID NO: 789815 - DNA, 20 bp, mouse
gggagcggaccaagtcctga

SEQ ID NO: 789816 - DNA, 20 bp, mouse
gaaggggaagtgagtgtatg

SEQ ID NO: 789817 - DNA, 20 bp, mouse
gtcttcggcagtataaaaag

SEQ ID NO: 789818 - DNA, 20 bp, mouse
gcaacccatatcaaccagac

SEQ ID NO: 789819 - DNA, 20 bp, mouse
gtaacctgtctggttgatat

SEQ ID NO: 789820 - DNA, 20 bp, mouse
gaggtctgacctctaagtcg

SEQ ID NO: 789821 - DNA, 20 bp, mouse
gaactggtagctaactctgc

SEQ ID NO: 789822 - DNA, 20 bp, mouse
gggatgaactgatgcagaac

SEQ ID NO: 789823 - DNA, 20 bp, mouse
gttatactgccgaagaggtg

SEQ ID NO: 789824 - DNA, 20 bp, mouse
ggctcctcctcaaagaccac

SEQ ID NO: 789825 - DNA, 20 bp, mouse
gactctctctgtcatttggt

SEQ ID NO: 789826 - DNA, 20 bp, mouse
gggggagccgcgacattgaa

SEQ ID NO: 789827 - DNA, 20 bp, mouse
gctaaagccacattaggcag

SEQ ID NO: 789828 - DNA, 20 bp, mouse
gctgggagttgtagtcattg

SEQ ID NO: 789829 - DNA, 20 bp, mouse
ggagtcgtggtctatttctg

SEQ ID NO: 789830 - DNA, 20 bp, mouse
gagtgatcgcatggccttct

SEQ ID NO: 789831 - DNA, 20 bp, mouse
ggcggctcccctgcctaatg

SEQ ID NO: 789832 - DNA, 20 bp, mouse
ggcaaggctaaagccacatt

SEQ ID NO: 789833 - DNA, 20 bp, mouse
gagtgagcctttcaatgtcg

SEQ ID NO: 789834 - DNA, 20 bp, mouse
gcatggccttctgggagtcg

SEQ ID NO: 789835 - DNA, 20 bp, mouse
ggtgcccattgctacttgag

SEQ ID NO: 789836 - DNA, 20 bp, mouse
gcctggggagaactatacgg

SEQ ID NO: 789837 - DNA, 20 bp, mouse
gtactggcggacataggaaa

SEQ ID NO: 789838 - DNA, 20 bp, mouse
gcccgtcgggaagcgtctag

SEQ ID NO: 789839 - DNA, 20 bp, mouse
ggagcctggggagaactata

SEQ ID NO: 789840 - DNA, 20 bp, mouse
gtgttctgggaaagcccgtc

SEQ ID NO: 789841 - DNA, 20 bp, mouse
ggactgcgacaattggggag

SEQ ID NO: 789842 - DNA, 20 bp, mouse
gggactgactgcgacaattg

SEQ ID NO: 789843 - DNA, 20 bp, mouse
gtcctctagacgcttcccga

SEQ ID NO: 789844 - DNA, 20 bp, mouse
ggggcgccggctctcctgtg

SEQ ID NO: 789845 - DNA, 20 bp, mouse
ggggagaactatacggtggc

SEQ ID NO: 789846 - DNA, 20 bp, mouse
gctcggggtggagtctaata

SEQ ID NO: 789847 - DNA, 20 bp, mouse
ggggtggagtctaataggga

SEQ ID NO: 789848 - DNA, 20 bp, mouse
ggggtgggcccgctgtgaag

SEQ ID NO: 789849 - DNA, 20 bp, mouse
ggctacttctggtctatcag

SEQ ID NO: 789850 - DNA, 20 bp, mouse
ggaggtgagggcagtgacga

SEQ ID NO: 789851 - DNA, 20 bp, mouse
ggagtctaatagggaagggc

SEQ ID NO: 789852 - DNA, 20 bp, mouse
gagagggtggcacagactga

SEQ ID NO: 789853 - DNA, 20 bp, mouse
gcctagcattgcagaaggta

SEQ ID NO: 789854 - DNA, 20 bp, mouse
ggggttctccgccgaggtga

SEQ ID NO: 789855 - DNA, 20 bp, mouse
gcggctgcgtggtgagacaa

SEQ ID NO: 789856 - DNA, 20 bp, mouse
gtaatggactgcaatctcag

SEQ ID NO: 789857 - DNA, 20 bp, mouse
gcagtctggtcctgcctgga

SEQ ID NO: 789858 - DNA, 20 bp, mouse
ggactatactccatccaggc

SEQ ID NO: 789859 - DNA, 20 bp, mouse
ggtcacatgactgcttccaa

SEQ ID NO: 789860 - DNA, 20 bp, mouse
gagccacatcagcatgaaat

SEQ ID NO: 789861 - DNA, 20 bp, mouse
gaaggaatgtgttcaagtaa

SEQ ID NO: 789862 - DNA, 20 bp, mouse
gcatcctttgggtcaaatga

SEQ ID NO: 789863 - DNA, 20 bp, mouse
gaagagaaactcagtaaata

SEQ ID NO: 789864 - DNA, 20 bp, mouse
gaccagactgctgcttgcaa

SEQ ID NO: 789865 - DNA, 20 bp, mouse
gggatggagcctctaaggcg

SEQ ID NO: 789866 - DNA, 20 bp, mouse
ggccctgcagctggtctctg

SEQ ID NO: 789867 - DNA, 20 bp, mouse
gtaaggagctcaggctcatc

SEQ ID NO: 789868 - DNA, 20 bp, mouse
ggctgcagggcgccagatgc

SEQ ID NO: 789869 - DNA, 20 bp, mouse
gctctcttgtttctgggtta

SEQ ID NO: 789870 - DNA, 20 bp, mouse
gtcctactggatgtaggaaa

SEQ ID NO: 789871 - DNA, 20 bp, mouse
ggtggaacagctccagcatc

SEQ ID NO: 789872 - DNA, 20 bp, mouse
gcttcctgcagcccacaggg

SEQ ID NO: 789873 - DNA, 20 bp, mouse
gactgggtatacactctgaa

SEQ ID NO: 789874 - DNA, 20 bp, mouse
gacagaaggagcctccctgt

SEQ ID NO: 789875 - DNA, 20 bp, mouse
ggcaccctttgtgactcttg

SEQ ID NO: 789876 - DNA, 20 bp, mouse
gtagtgggcgggcggtctat

SEQ ID NO: 789877 - DNA, 20 bp, mouse
ggggactccccagaggtctt

SEQ ID NO: 789878 - DNA, 20 bp, mouse
ggaccgcccgcccactaccg

SEQ ID NO: 789879 - DNA, 20 bp, mouse
gtgcgcatgcgctagatccg

SEQ ID NO: 789880 - DNA, 20 bp, mouse
gctagatccgcggtagtggg

SEQ ID NO: 789881 - DNA, 20 bp, mouse
gggttcgaactcagtcgtca

SEQ ID NO: 789882 - DNA, 20 bp, mouse
gccaaccccctgcggagaca

SEQ ID NO: 789883 - DNA, 20 bp, mouse
ggcgctagatccgcggtagt

SEQ ID NO: 789884 - DNA, 20 bp, mouse
ggtctatcgggagatccaat

SEQ ID NO: 789885 - DNA, 20 bp, mouse
gaaagcgaggactagccaat

SEQ ID NO: 789886 - DNA, 20 bp, mouse
ggggctccgggtggggtatt

SEQ ID NO: 789887 - DNA, 20 bp, mouse
gtgcagcaggagccccgggg

SEQ ID NO: 789888 - DNA, 20 bp, mouse
ggcgtgcagcaggagccccg

SEQ ID NO: 789889 - DNA, 20 bp, mouse
ggggcggagagatggtaatc

SEQ ID NO: 789890 - DNA, 20 bp, mouse
gcatcccgggccacccagag

SEQ ID NO: 789891 - DNA, 20 bp, mouse
gcacgcgaaagtggcggcgg

SEQ ID NO: 789892 - DNA, 20 bp, mouse
gctgctgcacgcgaaagtgg

SEQ ID NO: 789893 - DNA, 20 bp, mouse
ggggtggcccgggatgccaa

SEQ ID NO: 789894 - DNA, 20 bp, mouse
gagagatggtaatccgggac

SEQ ID NO: 789895 - DNA, 20 bp, mouse
gctgcacgcgaaagtggcgg

SEQ ID NO: 789896 - DNA, 20 bp, mouse
gacagacggctggatgaggt

SEQ ID NO: 789897 - DNA, 20 bp, mouse
ggatcagcgctgaaggggtg

SEQ ID NO: 789898 - DNA, 20 bp, mouse
gtggatgctgaatttagcga

SEQ ID NO: 789899 - DNA, 20 bp, mouse
gtgaggtgggcgtggcaatg

SEQ ID NO: 789900 - DNA, 20 bp, mouse
gtacaagaggagccaaggtg

SEQ ID NO: 789901 - DNA, 20 bp, mouse
gttacagatcagcgctgaag

SEQ ID NO: 789902 - DNA, 20 bp, mouse
gtagttggagcatacaggtg

SEQ ID NO: 789903 - DNA, 20 bp, mouse
gtgatctgtaagtgcaactt

SEQ ID NO: 789904 - DNA, 20 bp, mouse
gtagcgagggtcacgattaa

SEQ ID NO: 789905 - DNA, 20 bp, mouse
gagaatgcacaagtgagctt

SEQ ID NO: 789906 - DNA, 20 bp, mouse
gagggaggagaattttttgg

SEQ ID NO: 789907 - DNA, 20 bp, mouse
gaccgcccgggatctgtggg

SEQ ID NO: 789908 - DNA, 20 bp, mouse
gccgcagtcgccagatccag

SEQ ID NO: 789909 - DNA, 20 bp, mouse
gttaacagaagactgacgga

SEQ ID NO: 789910 - DNA, 20 bp, mouse
gcccccccacagatcccggg

SEQ ID NO: 789911 - DNA, 20 bp, mouse
gggaggctgtacggtgacaa

SEQ ID NO: 789912 - DNA, 20 bp, mouse
gggcgactgcggcctcgcgg

SEQ ID NO: 789913 - DNA, 20 bp, mouse
gacgaccgcccgggatctgt

SEQ ID NO: 789914 - DNA, 20 bp, mouse
gtggtgggcacccctggatc

SEQ ID NO: 789915 - DNA, 20 bp, mouse
gaaaggggccacgaccgccc

SEQ ID NO: 789916 - DNA, 20 bp, mouse
ggctgaggaaaacggtaata

SEQ ID NO: 789917 - DNA, 20 bp, mouse
gggaaagggaacaagtccgt

SEQ ID NO: 789918 - DNA, 20 bp, mouse
gagaacaagttgggcgggaa

SEQ ID NO: 789919 - DNA, 20 bp, mouse
gcaggctatagaaaaggctg

SEQ ID NO: 789920 - DNA, 20 bp, mouse
ggtcagcagagagaacaagt

SEQ ID NO: 789921 - DNA, 20 bp, mouse
gtgagcccttcgttgtgaag

SEQ ID NO: 789922 - DNA, 20 bp, mouse
gattgccactcacaagtcaa

SEQ ID NO: 789923 - DNA, 20 bp, mouse
gagtcaggccacagcttagg

SEQ ID NO: 789924 - DNA, 20 bp, mouse
gaagtccgttggcaatgtac

SEQ ID NO: 789925 - DNA, 20 bp, mouse
ggcaaccagtgcaaagatct

SEQ ID NO: 789926 - DNA, 20 bp, mouse
gcgcgcgcccggccaatcag

SEQ ID NO: 789927 - DNA, 20 bp, mouse
gcgggaaccagccccagggg

SEQ ID NO: 789928 - DNA, 20 bp, mouse
gaaccagccccaggggcgga

SEQ ID NO: 789929 - DNA, 20 bp, mouse
gcggtccgctgcggtccgta

SEQ ID NO: 789930 - DNA, 20 bp, mouse
ggcgcgcggtcactccgagg

SEQ ID NO: 789931 - DNA, 20 bp, mouse
gtccgtagggcgcggataaa

SEQ ID NO: 789932 - DNA, 20 bp, mouse
gcctggggctggttcccgcc

SEQ ID NO: 789933 - DNA, 20 bp, mouse
ggggagaccaggcgccgcct

SEQ ID NO: 789934 - DNA, 20 bp, mouse
gtggccgagcccagcggagc

SEQ ID NO: 789935 - DNA, 20 bp, mouse
ggggcggggcctcgcgcttg

SEQ ID NO: 789936 - DNA, 20 bp, mouse
ggtcccggagtgtggctctc

SEQ ID NO: 789937 - DNA, 20 bp, mouse
ggggtcctcgcgggccactg

SEQ ID NO: 789938 - DNA, 20 bp, mouse
ggccactgcggtgcgggaga

SEQ ID NO: 789939 - DNA, 20 bp, mouse
gccctgtggaactggaactg

SEQ ID NO: 789940 - DNA, 20 bp, mouse
gaggcaagtccctgtggaac

SEQ ID NO: 789941 - DNA, 20 bp, mouse
ggtggctcttgggtcctcgc

SEQ ID NO: 789942 - DNA, 20 bp, mouse
gggcagaggggcggttccta

SEQ ID NO: 789943 - DNA, 20 bp, mouse
gagaggctggtcccggagtg

SEQ ID NO: 789944 - DNA, 20 bp, mouse
ggggagaccacgcccctctc

SEQ ID NO: 789945 - DNA, 20 bp, mouse
gctgctgggaccttccccct

SEQ ID NO: 789946 - DNA, 20 bp, mouse
gctccggcccggggccgtcg

SEQ ID NO: 789947 - DNA, 20 bp, mouse
gcccgcggcggcttcacctc

SEQ ID NO: 789948 - DNA, 20 bp, mouse
ggcgcagaggcgaagcggag

SEQ ID NO: 789949 - DNA, 20 bp, mouse
gccgcggcgcgcaaaagcgc

SEQ ID NO: 789950 - DNA, 20 bp, mouse
gctgcaccgcgctgcgttcg

SEQ ID NO: 789951 - DNA, 20 bp, mouse
gcggggccgtcggggtttgg

SEQ ID NO: 789952 - DNA, 20 bp, mouse
gagaggatgcgagcccgcgg

SEQ ID NO: 789953 - DNA, 20 bp, mouse
gcgggccgcggccgtctcct

SEQ ID NO: 789954 - DNA, 20 bp, mouse
gcgcgccggaagtgccttta

SEQ ID NO: 789955 - DNA, 20 bp, mouse
gcgccgtgggagcttacctt

SEQ ID NO: 789956 - DNA, 20 bp, mouse
gtaccactggggaagaccag

SEQ ID NO: 789957 - DNA, 20 bp, mouse
gcgcgccgcaaccatctagt

SEQ ID NO: 789958 - DNA, 20 bp, mouse
ggggcccgaaccgggtataa

SEQ ID NO: 789959 - DNA, 20 bp, mouse
ggaccccgcccgaccttgaa

SEQ ID NO: 789960 - DNA, 20 bp, mouse
gcccgcgggctcctactaga

SEQ ID NO: 789961 - DNA, 20 bp, mouse
gaagagtccgagggcagtta

SEQ ID NO: 789962 - DNA, 20 bp, mouse
gggctcctactagatggttg

SEQ ID NO: 789963 - DNA, 20 bp, mouse
ggttgcggcgcggtcggtgg

SEQ ID NO: 789964 - DNA, 20 bp, mouse
ggggccccgacgcgttccta

SEQ ID NO: 789965 - DNA, 20 bp, mouse
ggtccgagggcagttaggga

SEQ ID NO: 789966 - DNA, 20 bp, mouse
gtcgctgcgcagggagaacg

SEQ ID NO: 789967 - DNA, 20 bp, mouse
gcaggcgtggggtggacccg

SEQ ID NO: 789968 - DNA, 20 bp, mouse
gtggccgcccaggcgtgggg

SEQ ID NO: 789969 - DNA, 20 bp, mouse
gcgcagcgacgccgagtggt

SEQ ID NO: 789970 - DNA, 20 bp, mouse
gcccggcagcgcctaccact

SEQ ID NO: 789971 - DNA, 20 bp, mouse
gtggggtcgcaaggcacgct

SEQ ID NO: 789972 - DNA, 20 bp, mouse
gacgttacagccctctgatt

SEQ ID NO: 789973 - DNA, 20 bp, mouse
gggtgcgcaaaggcagcgtt

SEQ ID NO: 789974 - DNA, 20 bp, mouse
gggcagcccggaccggaaaa

SEQ ID NO: 789975 - DNA, 20 bp, mouse
gccttgacatacccaatcag

SEQ ID NO: 789976 - DNA, 20 bp, mouse
gcgcctgcgcggtcccggta

SEQ ID NO: 789977 - DNA, 20 bp, mouse
gaactccccggaggtcggag

SEQ ID NO: 789978 - DNA, 20 bp, mouse
gagagagcagaatactgaca

SEQ ID NO: 789979 - DNA, 20 bp, mouse
gccgacctccggggagttct

SEQ ID NO: 789980 - DNA, 20 bp, mouse
ggcgcgctgcgggccctatt

SEQ ID NO: 789981 - DNA, 20 bp, mouse
gaaaccgtggccggaattgg

SEQ ID NO: 789982 - DNA, 20 bp, mouse
gaagcggagtaagcctaata

SEQ ID NO: 789983 - DNA, 20 bp, mouse
gggcacctctccgacctccg

SEQ ID NO: 789984 - DNA, 20 bp, mouse
gcacgcccagaactccccgg

SEQ ID NO: 789985 - DNA, 20 bp, mouse
gcagagggagcggcgttgtg

SEQ ID NO: 789986 - DNA, 20 bp, mouse
gaggggccaggcgcagaaac

SEQ ID NO: 789987 - DNA, 20 bp, mouse
gtcgtggcagagtcgaggct

SEQ ID NO: 789988 - DNA, 20 bp, mouse
gcacactaaaaagaaaccga

SEQ ID NO: 789989 - DNA, 20 bp, mouse
gcgcagaaaccggaaggtga

SEQ ID NO: 789990 - DNA, 20 bp, mouse
ggcccctaatgcttctcttt

SEQ ID NO: 789991 - DNA, 20 bp, mouse
gaccgccggaagctgtactc

SEQ ID NO: 789992 - DNA, 20 bp, mouse
gcggaaggtgaaggcgccac

SEQ ID NO: 789993 - DNA, 20 bp, mouse
gcatcgctgggtggagaatt

SEQ ID NO: 789994 - DNA, 20 bp, mouse
ggccaggcgcagaaaccgga

SEQ ID NO: 789995 - DNA, 20 bp, mouse
gcagcgatgcagcaaacacc

SEQ ID NO: 789996 - DNA, 20 bp, mouse
ggggagctacagccaagaag

SEQ ID NO: 789997 - DNA, 20 bp, mouse
gccgccccgacctaagggga

SEQ ID NO: 789998 - DNA, 20 bp, mouse
gcagctgtttttggccaatt

SEQ ID NO: 789999 - DNA, 20 bp, mouse
ggaccatagtgtgttggtaa

SEQ ID NO: 790000 - DNA, 20 bp, mouse
ggctggaaggaaacaaacct

SEQ ID NO: 790001 - DNA, 20 bp, mouse
ggggaggggcgacggcgagg

SEQ ID NO: 790002 - DNA, 20 bp, mouse
gtggctgtagctcccagagc

SEQ ID NO: 790003 - DNA, 20 bp, mouse
gcgcccctccccttaggtcg

SEQ ID NO: 790004 - DNA, 20 bp, mouse
gagacccgccccgacctaag

SEQ ID NO: 790005 - DNA, 20 bp, mouse
gcgccgtcgcccctcccctt

SEQ ID NO: 790006 - DNA, 20 bp, mouse
ggcaggggacgctagcgaac

SEQ ID NO: 790007 - DNA, 20 bp, mouse
gggcgcggcggaggcgtgga

SEQ ID NO: 790008 - DNA, 20 bp, mouse
gtagcgaacaggttccgagg

SEQ ID NO: 790009 - DNA, 20 bp, mouse
gaatctgaggtggctcagaa

SEQ ID NO: 790010 - DNA, 20 bp, mouse
gctgccagcggcaaccggca

SEQ ID NO: 790011 - DNA, 20 bp, mouse
gttgccgctggcagcgtaat

SEQ ID NO: 790012 - DNA, 20 bp, mouse
gcgccgccgcctttattggt

SEQ ID NO: 790013 - DNA, 20 bp, mouse
ggtcccctgccggttgccgc

SEQ ID NO: 790014 - DNA, 20 bp, mouse
gaggcaaggtcgtacgaccc

SEQ ID NO: 790015 - DNA, 20 bp, mouse
gcgctagcgaacaggttccg

SEQ ID NO: 790016 - DNA, 20 bp, mouse
gcgggaacgccgggagtcgc

SEQ ID NO: 790017 - DNA, 20 bp, mouse
gagcccaggccaggcgtgga

SEQ ID NO: 790018 - DNA, 20 bp, mouse
gaagtgatgcgcatcatttc

SEQ ID NO: 790019 - DNA, 20 bp, mouse
gtggagggaaggtgtcgcgc

SEQ ID NO: 790020 - DNA, 20 bp, mouse
gaaaccatcaagcgacccgt

SEQ ID NO: 790021 - DNA, 20 bp, mouse
gtcgcgccggaagtacgtca

SEQ ID NO: 790022 - DNA, 20 bp, mouse
ggggccccgtggtggcccgg

SEQ ID NO: 790023 - DNA, 20 bp, mouse
gttcccgacgggtcgcttga

SEQ ID NO: 790024 - DNA, 20 bp, mouse
gccggaagtacgtcagggat

SEQ ID NO: 790025 - DNA, 20 bp, mouse
gtctctaaatacctcgacag

SEQ ID NO: 790026 - DNA, 20 bp, mouse
ggcgccccgccccggaagtg

SEQ ID NO: 790027 - DNA, 20 bp, mouse
gagctgaggggaggaaacgc

SEQ ID NO: 790028 - DNA, 20 bp, mouse
gggcgcgcgctgaggttgtt

SEQ ID NO: 790029 - DNA, 20 bp, mouse
gtgagctggtcggagctgag

SEQ ID NO: 790030 - DNA, 20 bp, mouse
ggcgctgaggttgttgggaa

SEQ ID NO: 790031 - DNA, 20 bp, mouse
gagcgcgcgccacacttccg

SEQ ID NO: 790032 - DNA, 20 bp, mouse
gccggggcggggcgcaatcg

SEQ ID NO: 790033 - DNA, 20 bp, mouse
gagcgcagacgcagtggaaa

SEQ ID NO: 790034 - DNA, 20 bp, mouse
ggcatctttgtcaaagtctg

SEQ ID NO: 790035 - DNA, 20 bp, mouse
gtgtcacagctcatgagccg

SEQ ID NO: 790036 - DNA, 20 bp, mouse
gacgaaggatccttctttct

SEQ ID NO: 790037 - DNA, 20 bp, mouse
gcaggggcatcacccaagtc

SEQ ID NO: 790038 - DNA, 20 bp, mouse
ggcgtggcgcgaatcgcccc

SEQ ID NO: 790039 - DNA, 20 bp, mouse
gcacgctccggaacagtgat

SEQ ID NO: 790040 - DNA, 20 bp, mouse
gcctccaatcagagtgaaga

SEQ ID NO: 790041 - DNA, 20 bp, mouse
gggcgattcgcgccacgctc

SEQ ID NO: 790042 - DNA, 20 bp, mouse
ggctgggacaagaatgacga

SEQ ID NO: 790043 - DNA, 20 bp, mouse
gtctgccgctccagcgctgg

SEQ ID NO: 790044 - DNA, 20 bp, mouse
gaccggaagtgtgtgcccag

SEQ ID NO: 790045 - DNA, 20 bp, mouse
gtaacccgggacccgcccct

SEQ ID NO: 790046 - DNA, 20 bp, mouse
ggggaggcaacgcagtatgg

SEQ ID NO: 790047 - DNA, 20 bp, mouse
gcacccagcacctggacacc

SEQ ID NO: 790048 - DNA, 20 bp, mouse
gtgggggaggcaacgcagta

SEQ ID NO: 790049 - DNA, 20 bp, mouse
gtgggtgcaggcaccgtgct

SEQ ID NO: 790050 - DNA, 20 bp, mouse
ggaaaagtttttgagggctt

SEQ ID NO: 790051 - DNA, 20 bp, mouse
gtgatgggcctgaagggcgt

SEQ ID NO: 790052 - DNA, 20 bp, mouse
ggatccagtgcgtcgatctc

SEQ ID NO: 790053 - DNA, 20 bp, mouse
gagcaagcttcagcctagca

SEQ ID NO: 790054 - DNA, 20 bp, mouse
ggagacccagaccaaagatc

SEQ ID NO: 790055 - DNA, 20 bp, mouse
gtctgggaattgtggtttcc

SEQ ID NO: 790056 - DNA, 20 bp, mouse
gaccactgaagggctcgcgg

SEQ ID NO: 790057 - DNA, 20 bp, mouse
gctcgctggaggtgcacatc

SEQ ID NO: 790058 - DNA, 20 bp, mouse
gtagagctctcaggggccga

SEQ ID NO: 790059 - DNA, 20 bp, mouse
gtggtcctccgagtcctagt

SEQ ID NO: 790060 - DNA, 20 bp, mouse
gagagactgacgggagagta

SEQ ID NO: 790061 - DNA, 20 bp, mouse
ggctccgggcttcacttctg

SEQ ID NO: 790062 - DNA, 20 bp, mouse
gggaaagagttgggcagaag

SEQ ID NO: 790063 - DNA, 20 bp, mouse
ggtgtgaagttgggcggaat

SEQ ID NO: 790064 - DNA, 20 bp, mouse
gtctcctcatcacaccgact

SEQ ID NO: 790065 - DNA, 20 bp, mouse
gagtcctagtcggtgtgatg

SEQ ID NO: 790066 - DNA, 20 bp, mouse
ggcgccgtcgcccacctcgg

SEQ ID NO: 790067 - DNA, 20 bp, mouse
gcggcccggcagctgttatc

SEQ ID NO: 790068 - DNA, 20 bp, mouse
gggaaatcgcgcctccgagg

SEQ ID NO: 790069 - DNA, 20 bp, mouse
gacgtcgtgacgtaagacgt

SEQ ID NO: 790070 - DNA, 20 bp, mouse
gcaaggggaggatgtgccgc

SEQ ID NO: 790071 - DNA, 20 bp, mouse
gcgagccggccattaggccg

SEQ ID NO: 790072 - DNA, 20 bp, mouse
ggatgcctccgctattccta

SEQ ID NO: 790073 - DNA, 20 bp, mouse
gcaacctcttccaaaggcaa

SEQ ID NO: 790074 - DNA, 20 bp, mouse
gccagggcaacctcttccaa

SEQ ID NO: 790075 - DNA, 20 bp, mouse
gtcggaggcgcgatttcccg

SEQ ID NO: 790076 - DNA, 20 bp, mouse
ggaagccgagccgggaacaa

SEQ ID NO: 790077 - DNA, 20 bp, mouse
gcagtcctggaaggaatctc

SEQ ID NO: 790078 - DNA, 20 bp, mouse
ggggacctgagtgagttcgt

SEQ ID NO: 790079 - DNA, 20 bp, mouse
ggggaggaacctgtaggccg

SEQ ID NO: 790080 - DNA, 20 bp, mouse
gggtgcggagaacccaccga

SEQ ID NO: 790081 - DNA, 20 bp, mouse
ggaacctgtaggccgcggtg

SEQ ID NO: 790082 - DNA, 20 bp, mouse
gaaggtcggctgcaaatccc

SEQ ID NO: 790083 - DNA, 20 bp, mouse
gtccacccgagattccttcc

SEQ ID NO: 790084 - DNA, 20 bp, mouse
gtctccgcaccgcggcctac

SEQ ID NO: 790085 - DNA, 20 bp, mouse
gtcctggaaggaatctcggg

SEQ ID NO: 790086 - DNA, 20 bp, mouse
ggctcctagtggccgcacgg

SEQ ID NO: 790087 - DNA, 20 bp, mouse
ggactggcaggcaacgcagt

SEQ ID NO: 790088 - DNA, 20 bp, mouse
gtgccggtgcgcgccctctg

SEQ ID NO: 790089 - DNA, 20 bp, mouse
gcggggccgtgggtagtccc

SEQ ID NO: 790090 - DNA, 20 bp, mouse
ggcgcgcaccggcaacagtc

SEQ ID NO: 790091 - DNA, 20 bp, mouse
ggagggaggcgggtgagtgc

SEQ ID NO: 790092 - DNA, 20 bp, mouse
gaacgcagtaggaaatcaag

SEQ ID NO: 790093 - DNA, 20 bp, mouse
gtacccacggccccgagcgc

SEQ ID NO: 790094 - DNA, 20 bp, mouse
ggccaccctcctccattctg

SEQ ID NO: 790095 - DNA, 20 bp, mouse
gggaagggtgggctcggcga

SEQ ID NO: 790096 - DNA, 20 bp, mouse
gaccggaagcggaactgccg

SEQ ID NO: 790097 - DNA, 20 bp, mouse
gtatctggtgctaccggaag

SEQ ID NO: 790098 - DNA, 20 bp, mouse
gcagggaagaggcgtgtcgg

SEQ ID NO: 790099 - DNA, 20 bp, mouse
gtggcgcttgtggaacagga

SEQ ID NO: 790100 - DNA, 20 bp, mouse
gtccctgcccgccctccaca

SEQ ID NO: 790101 - DNA, 20 bp, mouse
ggaaggctcaggcgggtcgt

SEQ ID NO: 790102 - DNA, 20 bp, mouse
gggtccgccggaaactgttc

SEQ ID NO: 790103 - DNA, 20 bp, mouse
ggctcccacggaaactgcac

SEQ ID NO: 790104 - DNA, 20 bp, mouse
gcaccggccggaacagtttc

SEQ ID NO: 790105 - DNA, 20 bp, mouse
ggggcagggaagaggcgtgt

SEQ ID NO: 790106 - DNA, 20 bp, mouse
gcagtaacaggcaacagggg

SEQ ID NO: 790107 - DNA, 20 bp, mouse
gaacaggggcggtgtccggc

SEQ ID NO: 790108 - DNA, 20 bp, mouse
gaggcaacaggggcggtgtc

SEQ ID NO: 790109 - DNA, 20 bp, mouse
ggcagcctgtcgccagaacc

SEQ ID NO: 790110 - DNA, 20 bp, mouse
gtgcctgccgcaccccggga

SEQ ID NO: 790111 - DNA, 20 bp, mouse
ggcgcagcctctgcagtaac

SEQ ID NO: 790112 - DNA, 20 bp, mouse
gcgccagaacctggacgact

SEQ ID NO: 790113 - DNA, 20 bp, mouse
ggcaggtggcctagtcgtcc

SEQ ID NO: 790114 - DNA, 20 bp, mouse
gggagacccgaggtggaagt

SEQ ID NO: 790115 - DNA, 20 bp, mouse
gccaggctctatgtgcacga

SEQ ID NO: 790116 - DNA, 20 bp, mouse
gcagctgcggcgcggcccat

SEQ ID NO: 790117 - DNA, 20 bp, mouse
gggcccgcggcagcgacctg

SEQ ID NO: 790118 - DNA, 20 bp, mouse
ggggccgcgccgcagctgca

SEQ ID NO: 790119 - DNA, 20 bp, mouse
gtgtgggagggccggaactg

SEQ ID NO: 790120 - DNA, 20 bp, mouse
gctccctagggatcggcccg

SEQ ID NO: 790121 - DNA, 20 bp, mouse
gaggacgtccacgctcccta

SEQ ID NO: 790122 - DNA, 20 bp, mouse
ggacccggatgtgggagggc

SEQ ID NO: 790123 - DNA, 20 bp, mouse
gggaactgcggcttgggcgg

SEQ ID NO: 790124 - DNA, 20 bp, mouse
gtgccgcgggccgatcccta

SEQ ID NO: 790125 - DNA, 20 bp, mouse
gagggccggaactgcggctt

SEQ ID NO: 790126 - DNA, 20 bp, mouse
ggaggggcggggaaagacgg

SEQ ID NO: 790127 - DNA, 20 bp, mouse
gcgggagaacgtagattgac

SEQ ID NO: 790128 - DNA, 20 bp, mouse
gaagatactaggggccaggt

SEQ ID NO: 790129 - DNA, 20 bp, mouse
gtggggctgaataaagtaaa

SEQ ID NO: 790130 - DNA, 20 bp, mouse
gctcgggctccgccccccaa

SEQ ID NO: 790131 - DNA, 20 bp, mouse
ggctactagggtgggcaggt

SEQ ID NO: 790132 - DNA, 20 bp, mouse
gtgaccttgccaattaaggt

SEQ ID NO: 790133 - DNA, 20 bp, mouse
ggaagcacagaagatactag

SEQ ID NO: 790134 - DNA, 20 bp, mouse
gacacacgcggcgtcccaat

SEQ ID NO: 790135 - DNA, 20 bp, mouse
gccccccaagggcacccatt

SEQ ID NO: 790136 - DNA, 20 bp, mouse
gcggttgcagagagatgcgg

SEQ ID NO: 790137 - DNA, 20 bp, mouse
gagcgcgctcccccggtcgg

SEQ ID NO: 790138 - DNA, 20 bp, mouse
gtaacagcggaaaaccccca

SEQ ID NO: 790139 - DNA, 20 bp, mouse
ggcgggccgagcgagatcag

SEQ ID NO: 790140 - DNA, 20 bp, mouse
gtcgctgagacagaccaatc

SEQ ID NO: 790141 - DNA, 20 bp, mouse
gtcgctcggcccgccgaccg

SEQ ID NO: 790142 - DNA, 20 bp, mouse
gtcgaccggcccagctctcg

SEQ ID NO: 790143 - DNA, 20 bp, mouse
gagctgggccggtcgagtcg

SEQ ID NO: 790144 - DNA, 20 bp, mouse
gcgagccgagtgacgtcatc

SEQ ID NO: 790145 - DNA, 20 bp, mouse
gggggggggcgcgtgatgtc

SEQ ID NO: 790146 - DNA, 20 bp, mouse
gcaccccgctccggtctgga

SEQ ID NO: 790147 - DNA, 20 bp, mouse
ggtccctcccgtcgagtctg

SEQ ID NO: 790148 - DNA, 20 bp, mouse
gcgcgcacagggtccagcgg

SEQ ID NO: 790149 - DNA, 20 bp, mouse
ggagctctcggtagggattg

SEQ ID NO: 790150 - DNA, 20 bp, mouse
ggggcaccggcgatcagcac

SEQ ID NO: 790151 - DNA, 20 bp, mouse
gtggagggaaagttggtggc

SEQ ID NO: 790152 - DNA, 20 bp, mouse
ggcgccaccccgctccggtc

SEQ ID NO: 790153 - DNA, 20 bp, mouse
gtaccactccacagactcga

SEQ ID NO: 790154 - DNA, 20 bp, mouse
gcgcgcacgtccgagctcgg

SEQ ID NO: 790155 - DNA, 20 bp, mouse
gtgcctagagactgtcgcca

SEQ ID NO: 790156 - DNA, 20 bp, mouse
gtgcgcttgcgcagagcctg

SEQ ID NO: 790157 - DNA, 20 bp, mouse
gcctctgctctcttgtttca

SEQ ID NO: 790158 - DNA, 20 bp, mouse
gatgcggcttcatactgctc

SEQ ID NO: 790159 - DNA, 20 bp, mouse
gagcctgcggcgcctaggac

SEQ ID NO: 790160 - DNA, 20 bp, mouse
gcattgcttcacaacgtgtg

SEQ ID NO: 790161 - DNA, 20 bp, mouse
gaggcagtgtacacgttcat

SEQ ID NO: 790162 - DNA, 20 bp, mouse
gtagcaacgcactggctatt

SEQ ID NO: 790163 - DNA, 20 bp, mouse
gcctggggcctgtggttaag

SEQ ID NO: 790164 - DNA, 20 bp, mouse
gcgcaagcgcagtcgggcct

SEQ ID NO: 790165 - DNA, 20 bp, mouse
gttctaaagtctctgatggg

SEQ ID NO: 790166 - DNA, 20 bp, mouse
gagggcggggcgagttgcta

SEQ ID NO: 790167 - DNA, 20 bp, mouse
gccacgcccaccaacggctg

SEQ ID NO: 790168 - DNA, 20 bp, mouse
gtcaccgcgccagtagggcg

SEQ ID NO: 790169 - DNA, 20 bp, mouse
gtggttgccacgcccaccaa

SEQ ID NO: 790170 - DNA, 20 bp, mouse
ggcaactcgccccgccctcg

SEQ ID NO: 790171 - DNA, 20 bp, mouse
gtaggaggcggtaacgggac

SEQ ID NO: 790172 - DNA, 20 bp, mouse
gggcgggccgttgtccccga

SEQ ID NO: 790173 - DNA, 20 bp, mouse
ggcaaccagtctcgcgggag

SEQ ID NO: 790174 - DNA, 20 bp, mouse
ggcggctcaccgcgccagta

SEQ ID NO: 790175 - DNA, 20 bp, mouse
gccggctaggaggcggtaac

SEQ ID NO: 790176 - DNA, 20 bp, mouse
gtacctggcgaggaggatgg

SEQ ID NO: 790177 - DNA, 20 bp, mouse
gggtggctggacaggtgtta

SEQ ID NO: 790178 - DNA, 20 bp, mouse
ggggacgcaaggatccgttg

SEQ ID NO: 790179 - DNA, 20 bp, mouse
gcgcccccatcctcctcgcc

SEQ ID NO: 790180 - DNA, 20 bp, mouse
gtcctcgccaggtaccgacc

SEQ ID NO: 790181 - DNA, 20 bp, mouse
gcaggtgcaatggtggtggt

SEQ ID NO: 790182 - DNA, 20 bp, mouse
gggcgggcctggtcggtacc

SEQ ID NO: 790183 - DNA, 20 bp, mouse
gaagaggggtaggcgctggg

SEQ ID NO: 790184 - DNA, 20 bp, mouse
gagacgcaggcgggcctggt

SEQ ID NO: 790185 - DNA, 20 bp, mouse
gtgtgctcggccggcagggg

SEQ ID NO: 790186 - DNA, 20 bp, mouse
gagcgggtggagcagttccc

SEQ ID NO: 790187 - DNA, 20 bp, mouse
gggggcgggcccacggtcga

SEQ ID NO: 790188 - DNA, 20 bp, mouse
gtgtcccgcctgagtgtcaa

SEQ ID NO: 790189 - DNA, 20 bp, mouse
gccgcccacctggaacccta

SEQ ID NO: 790190 - DNA, 20 bp, mouse
gagcctggggaagtttgtta

SEQ ID NO: 790191 - DNA, 20 bp, mouse
gcgcccaccctcgtcataat

SEQ ID NO: 790192 - DNA, 20 bp, mouse
ggtgccccgccctcgaccgt

SEQ ID NO: 790193 - DNA, 20 bp, mouse
gcactcaggcgggacaaagc

SEQ ID NO: 790194 - DNA, 20 bp, mouse
gcgtgggcccgccccctgag

SEQ ID NO: 790195 - DNA, 20 bp, mouse
ggggaagtttgttaaggacc

SEQ ID NO: 790196 - DNA, 20 bp, mouse
gtgtaattggctcagattga

SEQ ID NO: 790197 - DNA, 20 bp, mouse
gggcctggcggcctcgaatc

SEQ ID NO: 790198 - DNA, 20 bp, mouse
gtggccaaatggagacccgg

SEQ ID NO: 790199 - DNA, 20 bp, mouse
gggcgccccgccctcctgat

SEQ ID NO: 790200 - DNA, 20 bp, mouse
ggtccctggtgcctgattcg

SEQ ID NO: 790201 - DNA, 20 bp, mouse
gcgtagagcgacgtcaaagt

SEQ ID NO: 790202 - DNA, 20 bp, mouse
ggccgccaggcccatcagga

SEQ ID NO: 790203 - DNA, 20 bp, mouse
ggccaggcccatcaggaggg

SEQ ID NO: 790204 - DNA, 20 bp, mouse
gtggcgaaaagcaaggtccc

SEQ ID NO: 790205 - DNA, 20 bp, mouse
gcgaggccgccaggcccatc

SEQ ID NO: 790206 - DNA, 20 bp, mouse
gtaacactgtcacccggctg

SEQ ID NO: 790207 - DNA, 20 bp, mouse
gggcccgaaggagctcgccg

SEQ ID NO: 790208 - DNA, 20 bp, mouse
gcgccccggcgagctccttc

SEQ ID NO: 790209 - DNA, 20 bp, mouse
gctgggaaacgcagcacgat

SEQ ID NO: 790210 - DNA, 20 bp, mouse
gtgggcagcaggcgggtcgg

SEQ ID NO: 790211 - DNA, 20 bp, mouse
gggaagcgccactcccgggg

SEQ ID NO: 790212 - DNA, 20 bp, mouse
gcgccggggcggacgcacgt

SEQ ID NO: 790213 - DNA, 20 bp, mouse
gtgcccacgtgcgtccgccc

SEQ ID NO: 790214 - DNA, 20 bp, mouse
gggtcgggggagagccgcgg

SEQ ID NO: 790215 - DNA, 20 bp, mouse
gacgtgggcagcaggcgggt

SEQ ID NO: 790216 - DNA, 20 bp, mouse
gaaactggccgcacacacag

SEQ ID NO: 790217 - DNA, 20 bp, mouse
gtgtgtgcggccagtttctt

SEQ ID NO: 790218 - DNA, 20 bp, mouse
gcgcacacacaggggccgat

SEQ ID NO: 790219 - DNA, 20 bp, mouse
gtaccactgaaaaggcacaa

SEQ ID NO: 790220 - DNA, 20 bp, mouse
gacacacaggggccgatggg

SEQ ID NO: 790221 - DNA, 20 bp, mouse
ggaaccgtggagagtcatcc

SEQ ID NO: 790222 - DNA, 20 bp, mouse
gtcagaggatcgagtcccac

SEQ ID NO: 790223 - DNA, 20 bp, mouse
gtccttggaggtgtaagagc

SEQ ID NO: 790224 - DNA, 20 bp, mouse
gactgggaggaagcgagcct

SEQ ID NO: 790225 - DNA, 20 bp, mouse
ggaagggcttccactctcag

SEQ ID NO: 790226 - DNA, 20 bp, mouse
gcccacactttctgggtcag

SEQ ID NO: 790227 - DNA, 20 bp, mouse
gtcaggccaggtcaagggat

SEQ ID NO: 790228 - DNA, 20 bp, mouse
gaatgcgtgtggagatcgga

SEQ ID NO: 790229 - DNA, 20 bp, mouse
gccttgacctggcctgaagt

SEQ ID NO: 790230 - DNA, 20 bp, mouse
ggcccctgacccagaaagtg

SEQ ID NO: 790231 - DNA, 20 bp, mouse
gaggacacacaaggtagaat

SEQ ID NO: 790232 - DNA, 20 bp, mouse
gaaaagagattagggaaggc

SEQ ID NO: 790233 - DNA, 20 bp, mouse
ggtcaggggctgattgagct

SEQ ID NO: 790234 - DNA, 20 bp, mouse
gacccactgagctctatctt

SEQ ID NO: 790235 - DNA, 20 bp, mouse
gacctaagatagagctcagt

SEQ ID NO: 790236 - DNA, 20 bp, mouse
gagaactcgacaaccctagc

SEQ ID NO: 790237 - DNA, 20 bp, mouse
gaactgggtaacggagtctg

SEQ ID NO: 790238 - DNA, 20 bp, mouse
gggtggaagcgctgcggcga

SEQ ID NO: 790239 - DNA, 20 bp, mouse
gaagaggtctcttcctgcta

SEQ ID NO: 790240 - DNA, 20 bp, mouse
gccttcgcacaaaggaaact

SEQ ID NO: 790241 - DNA, 20 bp, mouse
gggctgttgcgcacttccgg

SEQ ID NO: 790242 - DNA, 20 bp, mouse
gtgcgcagatgcaggtgccc

SEQ ID NO: 790243 - DNA, 20 bp, mouse
gagcgccgcctaccgcccac

SEQ ID NO: 790244 - DNA, 20 bp, mouse
gcgcaacagccttcgcacaa

SEQ ID NO: 790245 - DNA, 20 bp, mouse
gtactgagccagtgggcggt

SEQ ID NO: 790246 - DNA, 20 bp, mouse
ggggtgagcaggttcaagtc

SEQ ID NO: 790247 - DNA, 20 bp, mouse
ggccgccagaaaggaatcga

SEQ ID NO: 790248 - DNA, 20 bp, mouse
gctccccagcacaaaccctt

SEQ ID NO: 790249 - DNA, 20 bp, mouse
gaaagcggctgttgctcctc

SEQ ID NO: 790250 - DNA, 20 bp, mouse
gaacaggttaacccgctcca

SEQ ID NO: 790251 - DNA, 20 bp, mouse
gggaatcgacggagagtcgg

SEQ ID NO: 790252 - DNA, 20 bp, mouse
gtgtgctggggagatagcgt

SEQ ID NO: 790253 - DNA, 20 bp, mouse
ggtcacgcaggccgccagaa

SEQ ID NO: 790254 - DNA, 20 bp, mouse
gtggagtgcgggttctggat

SEQ ID NO: 790255 - DNA, 20 bp, mouse
gaggccagtccgtggggaga

SEQ ID NO: 790256 - DNA, 20 bp, mouse
ggcccgccgcccctcctctt

SEQ ID NO: 790257 - DNA, 20 bp, mouse
gcgctcgcccgaggccctct

SEQ ID NO: 790258 - DNA, 20 bp, mouse
gcggcagggcgattcctcca

SEQ ID NO: 790259 - DNA, 20 bp, mouse
gggtgagccggggttcggta

SEQ ID NO: 790260 - DNA, 20 bp, mouse
ggctagagagcggggaacta

SEQ ID NO: 790261 - DNA, 20 bp, mouse
ggggaactacggacgcggca

SEQ ID NO: 790262 - DNA, 20 bp, mouse
gctgcggagcttcccgtcca

SEQ ID NO: 790263 - DNA, 20 bp, mouse
ggcggtcgaccgaagaggag

SEQ ID NO: 790264 - DNA, 20 bp, mouse
ggcggggcggtcgaccgaag

SEQ ID NO: 790265 - DNA, 20 bp, mouse
ggagcggggaactacggacg

SEQ ID NO: 790266 - DNA, 20 bp, mouse
gttagcaaccgcggagggga

SEQ ID NO: 790267 - DNA, 20 bp, mouse
ggctaggcggcccgcaaggg

SEQ ID NO: 790268 - DNA, 20 bp, mouse
ggcggctaggcggcccgcaa

SEQ ID NO: 790269 - DNA, 20 bp, mouse
gaggggagggagtgacgctg

SEQ ID NO: 790270 - DNA, 20 bp, mouse
gctccccgccctcccctccg

SEQ ID NO: 790271 - DNA, 20 bp, mouse
gaggcggcccgcaagggcgg

SEQ ID NO: 790272 - DNA, 20 bp, mouse
gccgccctgcgcctgcgtag

SEQ ID NO: 790273 - DNA, 20 bp, mouse
gtggcggctggggtctgacg

SEQ ID NO: 790274 - DNA, 20 bp, mouse
gtgcgcgttagcaaccgcgg

SEQ ID NO: 790275 - DNA, 20 bp, mouse
ggcgtgcgcgcagttcggcg

SEQ ID NO: 790276 - DNA, 20 bp, mouse
gacccctcggagccaatctg

SEQ ID NO: 790277 - DNA, 20 bp, mouse
gggaaggatcccgcgcgcgg

SEQ ID NO: 790278 - DNA, 20 bp, mouse
gggaaatagaccccctgtgg

SEQ ID NO: 790279 - DNA, 20 bp, mouse
gagaccccctgtggcgggag

SEQ ID NO: 790280 - DNA, 20 bp, mouse
gcagcagagccggaaggagc

SEQ ID NO: 790281 - DNA, 20 bp, mouse
gggcggggtttgagcgcgta

SEQ ID NO: 790282 - DNA, 20 bp, mouse
ggcggggccggcgccgggaa

SEQ ID NO: 790283 - DNA, 20 bp, mouse
gcgggatccttccgccaaac

SEQ ID NO: 790284 - DNA, 20 bp, mouse
ggatccttccgccaaacggg

SEQ ID NO: 790285 - DNA, 20 bp, mouse
gcccttcccgcgcgctctat

SEQ ID NO: 790286 - DNA, 20 bp, mouse
gagacggaagaggggaaccg

SEQ ID NO: 790287 - DNA, 20 bp, mouse
gatagcaaggagacggaaga

SEQ ID NO: 790288 - DNA, 20 bp, mouse
gaagaggggaaccgagggaa

SEQ ID NO: 790289 - DNA, 20 bp, mouse
gcggctgctcacatgtctaa

SEQ ID NO: 790290 - DNA, 20 bp, mouse
gaggagggacgtccaatccg

SEQ ID NO: 790291 - DNA, 20 bp, mouse
ggcttcgggaaggtggagga

SEQ ID NO: 790292 - DNA, 20 bp, mouse
ggaagggggcttcgggaagg

SEQ ID NO: 790293 - DNA, 20 bp, mouse
gacccggggtcgccctcggt

SEQ ID NO: 790294 - DNA, 20 bp, mouse
ggtgcgagccgggtcgcccg

SEQ ID NO: 790295 - DNA, 20 bp, mouse
gggacgcggcgatcacgcgc

SEQ ID NO: 790296 - DNA, 20 bp, mouse
gcaatagtgcgcagacgctg

SEQ ID NO: 790297 - DNA, 20 bp, mouse
ggaagtgatgtcatagtggg

SEQ ID NO: 790298 - DNA, 20 bp, mouse
gtctgcgcactattgcatta

SEQ ID NO: 790299 - DNA, 20 bp, mouse
gaggcaaggcttaagttcat

SEQ ID NO: 790300 - DNA, 20 bp, mouse
gagtgcgcagacgctgaggt

SEQ ID NO: 790301 - DNA, 20 bp, mouse
gccaccgcctgggtcaaagc

SEQ ID NO: 790302 - DNA, 20 bp, mouse
ggcgacgcctgctttgaccc

SEQ ID NO: 790303 - DNA, 20 bp, mouse
gcattacggcggaactattc

SEQ ID NO: 790304 - DNA, 20 bp, mouse
gtcgaggccgttgtgctgaa

SEQ ID NO: 790305 - DNA, 20 bp, mouse
gacgcctgctttgacccagg

SEQ ID NO: 790306 - DNA, 20 bp, mouse
ggggccgcagggcgcctccc

SEQ ID NO: 790307 - DNA, 20 bp, mouse
gcggcccccgagctcttcct

SEQ ID NO: 790308 - DNA, 20 bp, mouse
gcggcccaggaagagctcgg

SEQ ID NO: 790309 - DNA, 20 bp, mouse
gcggccggggaggcgccctg

SEQ ID NO: 790310 - DNA, 20 bp, mouse
ggcgggagggcgtctgtggt

SEQ ID NO: 790311 - DNA, 20 bp, mouse
gtcggcctgggcctcggctt

SEQ ID NO: 790312 - DNA, 20 bp, mouse
gcgcgagatcgcggccgggg

SEQ ID NO: 790313 - DNA, 20 bp, mouse
gcgcatgcgcgctcccgcct

SEQ ID NO: 790314 - DNA, 20 bp, mouse
ggggcgctaccggagggaag

SEQ ID NO: 790315 - DNA, 20 bp, mouse
gcagtccgtcagccgcggcc

SEQ ID NO: 790316 - DNA, 20 bp, mouse
gaagctgcaccctcctccga

SEQ ID NO: 790317 - DNA, 20 bp, mouse
gtcagtacgggacttgtagt

SEQ ID NO: 790318 - DNA, 20 bp, mouse
ggggatgtgtagttcccgta

SEQ ID NO: 790319 - DNA, 20 bp, mouse
gagggcgcactggagcccta

SEQ ID NO: 790320 - DNA, 20 bp, mouse
ggtgctagattccccctcgg

SEQ ID NO: 790321 - DNA, 20 bp, mouse
ggggctccagtgcgccctca

SEQ ID NO: 790322 - DNA, 20 bp, mouse
gggtgcagcttgtccttgac

SEQ ID NO: 790323 - DNA, 20 bp, mouse
gcaactgtctcccagaccgg

SEQ ID NO: 790324 - DNA, 20 bp, mouse
gaaagaggatgccaccggtc

SEQ ID NO: 790325 - DNA, 20 bp, mouse
gcgcgtgcgtgctgaagcta

SEQ ID NO: 790326 - DNA, 20 bp, mouse
gcgccgacccaaagccctct

SEQ ID NO: 790327 - DNA, 20 bp, mouse
gtagctatcgctgggggcaa

SEQ ID NO: 790328 - DNA, 20 bp, mouse
gtacccagagggctttgggt

SEQ ID NO: 790329 - DNA, 20 bp, mouse
gctacgaggggcttcttttt

SEQ ID NO: 790330 - DNA, 20 bp, mouse
gacttgcgtagctatcgctg

SEQ ID NO: 790331 - DNA, 20 bp, mouse
gcgggactcggttacccaga

SEQ ID NO: 790332 - DNA, 20 bp, mouse
gaagcccctcgtagcgagct

SEQ ID NO: 790333 - DNA, 20 bp, mouse
gtatgcaaggctcctcaatg

SEQ ID NO: 790334 - DNA, 20 bp, mouse
ggggaaatgggttctacaag

SEQ ID NO: 790335 - DNA, 20 bp, mouse
ggtgacgtcaatataccgag

SEQ ID NO: 790336 - DNA, 20 bp, mouse
ggggggtaggcgggataaga

SEQ ID NO: 790337 - DNA, 20 bp, mouse
gtgcgcgtctgcgctctcgg

SEQ ID NO: 790338 - DNA, 20 bp, mouse
gacactgagcggtatgcaat

SEQ ID NO: 790339 - DNA, 20 bp, mouse
gtaggcgggataagagggcg

SEQ ID NO: 790340 - DNA, 20 bp, mouse
ggcgcgctctcacctggccg

SEQ ID NO: 790341 - DNA, 20 bp, mouse
gcccccaccggaccaatcat

SEQ ID NO: 790342 - DNA, 20 bp, mouse
gcgcctacgccacctatgat

SEQ ID NO: 790343 - DNA, 20 bp, mouse
gcctgcggggtgagccgagt

SEQ ID NO: 790344 - DNA, 20 bp, mouse
gcgtctgcgctctcggcggc

SEQ ID NO: 790345 - DNA, 20 bp, mouse
gtggtccggtgggggtaggc

SEQ ID NO: 790346 - DNA, 20 bp, mouse
gcaaatggaagtgtccctgg

SEQ ID NO: 790347 - DNA, 20 bp, mouse
gaatgggcgaggcgccgcca

SEQ ID NO: 790348 - DNA, 20 bp, mouse
gaggcgtgtccctcggagga

SEQ ID NO: 790349 - DNA, 20 bp, mouse
gtagaccctcacctcactat

SEQ ID NO: 790350 - DNA, 20 bp, mouse
ggggatttgtagtcccgaat

SEQ ID NO: 790351 - DNA, 20 bp, mouse
ggatcttctggacctagctc

SEQ ID NO: 790352 - DNA, 20 bp, mouse
gcggttgcctggagcacctt

SEQ ID NO: 790353 - DNA, 20 bp, mouse
gagatcatggacgtcctgga

SEQ ID NO: 790354 - DNA, 20 bp, mouse
gtgtacccatagtgaggtga

SEQ ID NO: 790355 - DNA, 20 bp, mouse
ggatcgcgtctgactccaaa

SEQ ID NO: 790356 - DNA, 20 bp, mouse
gtgcccaccacgtggatcca

SEQ ID NO: 790357 - DNA, 20 bp, mouse
gggcccacgcaggacctgcg

SEQ ID NO: 790358 - DNA, 20 bp, mouse
gggaagcatccaagtcctgt

SEQ ID NO: 790359 - DNA, 20 bp, mouse
ggcaagctagctcggatcta

SEQ ID NO: 790360 - DNA, 20 bp, mouse
gggcccctccggagctggaa

SEQ ID NO: 790361 - DNA, 20 bp, mouse
gagacgaagggcatccggga

SEQ ID NO: 790362 - DNA, 20 bp, mouse
gacgtgagcaaagttgtcgg

SEQ ID NO: 790363 - DNA, 20 bp, mouse
gtgagtggagcttgaactgg

SEQ ID NO: 790364 - DNA, 20 bp, mouse
gcggaacgctgcccaccacg

SEQ ID NO: 790365 - DNA, 20 bp, mouse
gttaagagtggaggttatcc

SEQ ID NO: 790366 - DNA, 20 bp, mouse
gtgaacccccgcaggacccc

SEQ ID NO: 790367 - DNA, 20 bp, mouse
gcaagcccggggtcctgcgg

SEQ ID NO: 790368 - DNA, 20 bp, mouse
ggtcctgcgggggttcagat

SEQ ID NO: 790369 - DNA, 20 bp, mouse
gggtcccaggacacgctcta

SEQ ID NO: 790370 - DNA, 20 bp, mouse
gcccggagatgcctgccctg

SEQ ID NO: 790371 - DNA, 20 bp, mouse
ggcagcgaagggtgttgcaa

SEQ ID NO: 790372 - DNA, 20 bp, mouse
ggccctggggcactctaaga

SEQ ID NO: 790373 - DNA, 20 bp, mouse
gcccggcgatcggggagggg

SEQ ID NO: 790374 - DNA, 20 bp, mouse
gggaccctagagcgtgtcct

SEQ ID NO: 790375 - DNA, 20 bp, mouse
gaatgtgcagccttcaagcc

SEQ ID NO: 790376 - DNA, 20 bp, mouse
ggcctcctgaaaggggatag

SEQ ID NO: 790377 - DNA, 20 bp, mouse
gaggccagaggttaagttat

SEQ ID NO: 790378 - DNA, 20 bp, mouse
gtctaggcatgagacggtgt

SEQ ID NO: 790379 - DNA, 20 bp, mouse
gtcctgaaaggggatagggg

SEQ ID NO: 790380 - DNA, 20 bp, mouse
gcgggacccttggtcatcaa

SEQ ID NO: 790381 - DNA, 20 bp, mouse
gtgtgggcgcagatgcggtg

SEQ ID NO: 790382 - DNA, 20 bp, mouse
gcctagtggcgtgaagatcc

SEQ ID NO: 790383 - DNA, 20 bp, mouse
gaatgaaacagggtcagaag

SEQ ID NO: 790384 - DNA, 20 bp, mouse
gaagaggactatggtcctag

SEQ ID NO: 790385 - DNA, 20 bp, mouse
gacagagaaagcggcagcgg

SEQ ID NO: 790386 - DNA, 20 bp, mouse
ggggtggggccgaaggagag

SEQ ID NO: 790387 - DNA, 20 bp, mouse
gccggctaggaagtcgtccg

SEQ ID NO: 790388 - DNA, 20 bp, mouse
gcccagcgacagggcctcga

SEQ ID NO: 790389 - DNA, 20 bp, mouse
gggaagagggcgggcgatga

SEQ ID NO: 790390 - DNA, 20 bp, mouse
gcgaggggctgtgtagtcca

SEQ ID NO: 790391 - DNA, 20 bp, mouse
gctgccccagagaccgcccc

SEQ ID NO: 790392 - DNA, 20 bp, mouse
gcccctcgaggccctgtcgc

SEQ ID NO: 790393 - DNA, 20 bp, mouse
ggggcacagattctccacct

SEQ ID NO: 790394 - DNA, 20 bp, mouse
ggctaggaagtcgtccgagg

SEQ ID NO: 790395 - DNA, 20 bp, mouse
ggagactggcgtggatcgtc

SEQ ID NO: 790396 - DNA, 20 bp, mouse
ggccactggctggcagagag

SEQ ID NO: 790397 - DNA, 20 bp, mouse
gaggctaggaagttcattcc

SEQ ID NO: 790398 - DNA, 20 bp, mouse
gcagctgcagaatggaggct

SEQ ID NO: 790399 - DNA, 20 bp, mouse
gatatggctctgaatgccac

SEQ ID NO: 790400 - DNA, 20 bp, mouse
gggctctgaatgccactggc

SEQ ID NO: 790401 - DNA, 20 bp, mouse
gcaaacaagcaaatgtcaag

SEQ ID NO: 790402 - DNA, 20 bp, mouse
ggctatcccggaagacaggt

SEQ ID NO: 790403 - DNA, 20 bp, mouse
gggaagagggccaaggctct

SEQ ID NO: 790404 - DNA, 20 bp, mouse
gcgggatagctctagacata

SEQ ID NO: 790405 - DNA, 20 bp, mouse
gtagagctatcccggaagac

SEQ ID NO: 790406 - DNA, 20 bp, mouse
ggggctgcacgtcaccccgg

SEQ ID NO: 790407 - DNA, 20 bp, mouse
gaaagccgcgtggacgatgt

SEQ ID NO: 790408 - DNA, 20 bp, mouse
gggaaattacgtgagatcga

SEQ ID NO: 790409 - DNA, 20 bp, mouse
gcaagtacgcgaaccttatc

SEQ ID NO: 790410 - DNA, 20 bp, mouse
gcggggacgcaatgtttcac

SEQ ID NO: 790411 - DNA, 20 bp, mouse
gtctcggaagtccctgggaa

SEQ ID NO: 790412 - DNA, 20 bp, mouse
gtgcgccaacatcgtccacg

SEQ ID NO: 790413 - DNA, 20 bp, mouse
gcggggtctcggaagtccct

SEQ ID NO: 790414 - DNA, 20 bp, mouse
gggagactccgcgctctgtg

SEQ ID NO: 790415 - DNA, 20 bp, mouse
ggaccccaggaggaataacc

SEQ ID NO: 790416 - DNA, 20 bp, mouse
gcaagcgtacatcctaggtc

SEQ ID NO: 790417 - DNA, 20 bp, mouse
gccccaccctctaggtcaaa

SEQ ID NO: 790418 - DNA, 20 bp, mouse
ggtagagcggggctcgcacg

SEQ ID NO: 790419 - DNA, 20 bp, mouse
gccccgctctaccccgagta

SEQ ID NO: 790420 - DNA, 20 bp, mouse
gccgacagggaccacagacg

SEQ ID NO: 790421 - DNA, 20 bp, mouse
gaatcagaggccacgcacga

SEQ ID NO: 790422 - DNA, 20 bp, mouse
gaagctgcagggcgagacgg

SEQ ID NO: 790423 - DNA, 20 bp, mouse
ggggcgagacggaggaccga

SEQ ID NO: 790424 - DNA, 20 bp, mouse
gcccacccttgcctcccgag

SEQ ID NO: 790425 - DNA, 20 bp, mouse
gtcaaagggaatggctgggg

SEQ ID NO: 790426 - DNA, 20 bp, mouse
ggggctgagtcgttttgcga

SEQ ID NO: 790427 - DNA, 20 bp, mouse
gcgcccctgtcaatctacag

SEQ ID NO: 790428 - DNA, 20 bp, mouse
ggtccggggtagggcgggaa

SEQ ID NO: 790429 - DNA, 20 bp, mouse
gtccctggaggacgctcctt

SEQ ID NO: 790430 - DNA, 20 bp, mouse
ggcctaaggagcgtcctcca

SEQ ID NO: 790431 - DNA, 20 bp, mouse
gagctgattggttgatactg

SEQ ID NO: 790432 - DNA, 20 bp, mouse
gacaggggcggggtcagctc

SEQ ID NO: 790433 - DNA, 20 bp, mouse
ggggagaagcagtcccgatg

SEQ ID NO: 790434 - DNA, 20 bp, mouse
ggtcagctccggtagctgat

SEQ ID NO: 790435 - DNA, 20 bp, mouse
gcggaagccgcggtgctggg

SEQ ID NO: 790436 - DNA, 20 bp, mouse
gagggcagccagcatggaag

SEQ ID NO: 790437 - DNA, 20 bp, mouse
gaagaggagcagaggttccc

SEQ ID NO: 790438 - DNA, 20 bp, mouse
gaccctgcctaggacaatgg

SEQ ID NO: 790439 - DNA, 20 bp, mouse
gacctggcggcctcagtcca

SEQ ID NO: 790440 - DNA, 20 bp, mouse
gggttcccaggggctgccag

SEQ ID NO: 790441 - DNA, 20 bp, mouse
gtatggcagcaaaggtcagg

SEQ ID NO: 790442 - DNA, 20 bp, mouse
gcctaggacaatggagggca

SEQ ID NO: 790443 - DNA, 20 bp, mouse
gcaagcccctggcagcccct

SEQ ID NO: 790444 - DNA, 20 bp, mouse
gaagctggaactttgttatc

SEQ ID NO: 790445 - DNA, 20 bp, mouse
ggtgcaccctgaccccaaga

SEQ ID NO: 790446 - DNA, 20 bp, mouse
gtgggcccgcgcatccccaa

SEQ ID NO: 790447 - DNA, 20 bp, mouse
gacccagtgaggcccagaaa

SEQ ID NO: 790448 - DNA, 20 bp, mouse
ggaaggaagtggtcatgcct

SEQ ID NO: 790449 - DNA, 20 bp, mouse
gtagaggtgggacacagtca

SEQ ID NO: 790450 - DNA, 20 bp, mouse
gaaaaggggtcttcatttgg

SEQ ID NO: 790451 - DNA, 20 bp, mouse
gcagaaaaggggtcttcatt

SEQ ID NO: 790452 - DNA, 20 bp, mouse
gttgacagatagacccagtg

SEQ ID NO: 790453 - DNA, 20 bp, mouse
gagctgaggctccgccttaa

SEQ ID NO: 790454 - DNA, 20 bp, mouse
ggactccacgtcacaggcca

SEQ ID NO: 790455 - DNA, 20 bp, mouse
gaggacggggctatatagat

SEQ ID NO: 790456 - DNA, 20 bp, mouse
ggataagaggagctggagta

SEQ ID NO: 790457 - DNA, 20 bp, mouse
gtctcaggcaccagggcaag

SEQ ID NO: 790458 - DNA, 20 bp, mouse
gaagaactcaacgtagactc

SEQ ID NO: 790459 - DNA, 20 bp, mouse
gcagctggtccctagataag

SEQ ID NO: 790460 - DNA, 20 bp, mouse
gctactgaaaattcagaggc

SEQ ID NO: 790461 - DNA, 20 bp, mouse
gctccagctcctcttatcta

SEQ ID NO: 790462 - DNA, 20 bp, mouse
gttgcctgggattacaaata

SEQ ID NO: 790463 - DNA, 20 bp, mouse
gtaggattctaaagtggagt

SEQ ID NO: 790464 - DNA, 20 bp, mouse
gtacaaacaacggcaacacc

SEQ ID NO: 790465 - DNA, 20 bp, mouse
gttcaggggtaaggttgcct

SEQ ID NO: 790466 - DNA, 20 bp, mouse
gcaaaaggggagacactcca

SEQ ID NO: 790467 - DNA, 20 bp, mouse
ggggaggccggcgagattgt

SEQ ID NO: 790468 - DNA, 20 bp, mouse
gtgaacgcggctggacgcca

SEQ ID NO: 790469 - DNA, 20 bp, mouse
gcggggctgcacacttgctc

SEQ ID NO: 790470 - DNA, 20 bp, mouse
gagattgtagggactgaacg

SEQ ID NO: 790471 - DNA, 20 bp, mouse
gtacacgcctcggggtccct

SEQ ID NO: 790472 - DNA, 20 bp, mouse
ggtgcagtggagtcaggcgt

SEQ ID NO: 790473 - DNA, 20 bp, mouse
gcagggttctgggaatgtac

SEQ ID NO: 790474 - DNA, 20 bp, mouse
gtctacggacaatggggcga

SEQ ID NO: 790475 - DNA, 20 bp, mouse
gaggcgaagggagatccgga

SEQ ID NO: 790476 - DNA, 20 bp, mouse
gcacgacggggttaaggctc

SEQ ID NO: 790477 - DNA, 20 bp, mouse
gctaggacagcgaccaaccg

SEQ ID NO: 790478 - DNA, 20 bp, mouse
gggatccttagcttgagggg

SEQ ID NO: 790479 - DNA, 20 bp, mouse
gacagcgaccaaccggggtc

SEQ ID NO: 790480 - DNA, 20 bp, mouse
gcaagctggtgcaggtttca

SEQ ID NO: 790481 - DNA, 20 bp, mouse
gcggggttaaggctcgggac

SEQ ID NO: 790482 - DNA, 20 bp, mouse
gcacagccacgacggggtta

SEQ ID NO: 790483 - DNA, 20 bp, mouse
ggtcgccgcccctcaagcta

SEQ ID NO: 790484 - DNA, 20 bp, mouse
gggctcgtcaccgtccctcc

SEQ ID NO: 790485 - DNA, 20 bp, mouse
gggtctggatccttagcttg

SEQ ID NO: 790486 - DNA, 20 bp, mouse
gctgggaggagggtgcggag

SEQ ID NO: 790487 - DNA, 20 bp, mouse
gagttctggggatactgcag

SEQ ID NO: 790488 - DNA, 20 bp, mouse
gtcgagaagcgtgttctccc

SEQ ID NO: 790489 - DNA, 20 bp, mouse
gaagtccagcggtgacgcta

SEQ ID NO: 790490 - DNA, 20 bp, mouse
gcgggccgctcccctagccc

SEQ ID NO: 790491 - DNA, 20 bp, mouse
gacgcctgggcgccagtccc

SEQ ID NO: 790492 - DNA, 20 bp, mouse
gagcggtgacgctaagggga

SEQ ID NO: 790493 - DNA, 20 bp, mouse
gggagtgggagccagggcta

SEQ ID NO: 790494 - DNA, 20 bp, mouse
ggtgcagccagtagcggcag

SEQ ID NO: 790495 - DNA, 20 bp, mouse
gaagcgtgttctcccgggct

SEQ ID NO: 790496 - DNA, 20 bp, mouse
gcagggcagcaggtccttca

SEQ ID NO: 790497 - DNA, 20 bp, mouse
ggcattcatcgatgaggtgg

SEQ ID NO: 790498 - DNA, 20 bp, mouse
gtctactgtacattactaac

SEQ ID NO: 790499 - DNA, 20 bp, mouse
ggttgagcgtgtaacagcaa

SEQ ID NO: 790500 - DNA, 20 bp, mouse
ggctctctctgagcattaca

SEQ ID NO: 790501 - DNA, 20 bp, mouse
gtgggtcctcgcactttcaa

SEQ ID NO: 790502 - DNA, 20 bp, mouse
ggcaggaagtttttagaggt

SEQ ID NO: 790503 - DNA, 20 bp, mouse
gtagctgatattattagttg

SEQ ID NO: 790504 - DNA, 20 bp, mouse
gcactttcaacggagaaatg

SEQ ID NO: 790505 - DNA, 20 bp, mouse
gcactgcactttcgagcagc

SEQ ID NO: 790506 - DNA, 20 bp, mouse
gagcccgcctaacacagagg

SEQ ID NO: 790507 - DNA, 20 bp, mouse
gcccgcccctcctctgtgtt

SEQ ID NO: 790508 - DNA, 20 bp, mouse
ggaaggttcacacacttgtt

SEQ ID NO: 790509 - DNA, 20 bp, mouse
gctcatagggcgatgggaga

SEQ ID NO: 790510 - DNA, 20 bp, mouse
ggcggaggggcggggcaaga

SEQ ID NO: 790511 - DNA, 20 bp, mouse
gctagatatcgcgagaggga

SEQ ID NO: 790512 - DNA, 20 bp, mouse
gcccctcctctgtgttaggc

SEQ ID NO: 790513 - DNA, 20 bp, mouse
gccgccctagatatcgcgag

SEQ ID NO: 790514 - DNA, 20 bp, mouse
gggagggccgggcttggctt

SEQ ID NO: 790515 - DNA, 20 bp, mouse
gtatcgcgagagggagggcc

SEQ ID NO: 790516 - DNA, 20 bp, mouse
gtcttccaacatggcgtcta

SEQ ID NO: 790517 - DNA, 20 bp, mouse
ggggccgcacatgcgcgaac

SEQ ID NO: 790518 - DNA, 20 bp, mouse
gggaatggatggaacaccga

SEQ ID NO: 790519 - DNA, 20 bp, mouse
gccgcctggaaacccggaag

SEQ ID NO: 790520 - DNA, 20 bp, mouse
ggggcgagccagaatcaagc

SEQ ID NO: 790521 - DNA, 20 bp, mouse
gcccgggaggagcaagtgtg

SEQ ID NO: 790522 - DNA, 20 bp, mouse
gcgagccagaatcaagcggg

SEQ ID NO: 790523 - DNA, 20 bp, mouse
ggacgccatgttggaagagg

SEQ ID NO: 790524 - DNA, 20 bp, mouse
ggcgcgaaccggagcaccag

SEQ ID NO: 790525 - DNA, 20 bp, mouse
gaaccggagcaccagagggc

SEQ ID NO: 790526 - DNA, 20 bp, mouse
gcgcaggctccgagtcccgc

SEQ ID NO: 790527 - DNA, 20 bp, mouse
gcgcgcgggaggagcgcatg

SEQ ID NO: 790528 - DNA, 20 bp, mouse
gaggcgtggccgtgaagaga

SEQ ID NO: 790529 - DNA, 20 bp, mouse
ggcatggggcagcttggaaa

SEQ ID NO: 790530 - DNA, 20 bp, mouse
ggacacgcacggcgcgcggg

SEQ ID NO: 790531 - DNA, 20 bp, mouse
gggccccgggtgggaggaca

SEQ ID NO: 790532 - DNA, 20 bp, mouse
gcgcgtcggcaagttggcca

SEQ ID NO: 790533 - DNA, 20 bp, mouse
gaaaaagaaggtatgtgcga

SEQ ID NO: 790534 - DNA, 20 bp, mouse
ggggcgctcgcagtgcaggt

SEQ ID NO: 790535 - DNA, 20 bp, mouse
ggccccgcggtgtccagagc

SEQ ID NO: 790536 - DNA, 20 bp, mouse
gagcacaggatcatgtttag

SEQ ID NO: 790537 - DNA, 20 bp, mouse
gctaggtccagctgcggaga

SEQ ID NO: 790538 - DNA, 20 bp, mouse
gaaaggggtcagatccttcc

SEQ ID NO: 790539 - DNA, 20 bp, mouse
ggagggagtagtagccagga

SEQ ID NO: 790540 - DNA, 20 bp, mouse
gcggagagggagtagtagcc

SEQ ID NO: 790541 - DNA, 20 bp, mouse
gatcctgtgctcagggagcg

SEQ ID NO: 790542 - DNA, 20 bp, mouse
gtgagctcaagggcatcaag

SEQ ID NO: 790543 - DNA, 20 bp, mouse
ggatcacctgtctacctact

SEQ ID NO: 790544 - DNA, 20 bp, mouse
gtttggccggacatagtgac

SEQ ID NO: 790545 - DNA, 20 bp, mouse
gcaccttctaggtccagctg

SEQ ID NO: 790546 - DNA, 20 bp, mouse
gtcaaaccatggcccactga

SEQ ID NO: 790547 - DNA, 20 bp, mouse
gtgtctaggaagggaagtcc

SEQ ID NO: 790548 - DNA, 20 bp, mouse
gtcagcccctcagtgggcca

SEQ ID NO: 790549 - DNA, 20 bp, mouse
gtggtcttgtccaggcagcg

SEQ ID NO: 790550 - DNA, 20 bp, mouse
gacctggaagagccgctagg

SEQ ID NO: 790551 - DNA, 20 bp, mouse
gggctctgtcccacgctgcc

SEQ ID NO: 790552 - DNA, 20 bp, mouse
gagtgggccatggtttgaga

SEQ ID NO: 790553 - DNA, 20 bp, mouse
gactcttcgtggtcttgtcc

SEQ ID NO: 790554 - DNA, 20 bp, mouse
gtaaatgggagagattgtcc

SEQ ID NO: 790555 - DNA, 20 bp, mouse
gagaaggacttcagaggctt

SEQ ID NO: 790556 - DNA, 20 bp, mouse
gggaatccgtagagtaccta

SEQ ID NO: 790557 - DNA, 20 bp, mouse
gaggcggggcgttagagcga

SEQ ID NO: 790558 - DNA, 20 bp, mouse
gcggtgccctaggtactcta

SEQ ID NO: 790559 - DNA, 20 bp, mouse
gcggaagtgcgtccggaagc

SEQ ID NO: 790560 - DNA, 20 bp, mouse
gcctccggggctaccactac

SEQ ID NO: 790561 - DNA, 20 bp, mouse
gcgaagttagcgtgtgaggg

SEQ ID NO: 790562 - DNA, 20 bp, mouse
ggccacacccccgttcccta

SEQ ID NO: 790563 - DNA, 20 bp, mouse
ggcccgccgcgccactccat

SEQ ID NO: 790564 - DNA, 20 bp, mouse
gaaggcgaagttagcgtgtg

SEQ ID NO: 790565 - DNA, 20 bp, mouse
gctctaacgccccgccttaa

SEQ ID NO: 790566 - DNA, 20 bp, mouse
gctggccgcgagcacagcag

SEQ ID NO: 790567 - DNA, 20 bp, mouse
gcacagcgtgagggtttcat

SEQ ID NO: 790568 - DNA, 20 bp, mouse
ggtgctcggggtcccccgtc

SEQ ID NO: 790569 - DNA, 20 bp, mouse
gtaagctgaaacacagtgag

SEQ ID NO: 790570 - DNA, 20 bp, mouse
ggcggggcgcgtgttactgc

SEQ ID NO: 790571 - DNA, 20 bp, mouse
gcaatcaaagcacagcgtga

SEQ ID NO: 790572 - DNA, 20 bp, mouse
gggaagcgtcaagtccgggc

SEQ ID NO: 790573 - DNA, 20 bp, mouse
gcggggctcccgccggacgg

SEQ ID NO: 790574 - DNA, 20 bp, mouse
gtgcaggaagcgtcaagtcc

SEQ ID NO: 790575 - DNA, 20 bp, mouse
gccctccggcgccagccgga

SEQ ID NO: 790576 - DNA, 20 bp, mouse
gtcgaggacgacaggaagac

SEQ ID NO: 790577 - DNA, 20 bp, mouse
gcggaaaaaagaaacgtgac

SEQ ID NO: 790578 - DNA, 20 bp, mouse
gtactcgcggagctcggcgg

SEQ ID NO: 790579 - DNA, 20 bp, mouse
gaaaccgtgtcgaggacgac

SEQ ID NO: 790580 - DNA, 20 bp, mouse
gtgtagcgaaagtgtggctg

SEQ ID NO: 790581 - DNA, 20 bp, mouse
gcctgcgagagggctgtcag

SEQ ID NO: 790582 - DNA, 20 bp, mouse
gtccgggagacagcgttcat

SEQ ID NO: 790583 - DNA, 20 bp, mouse
gtcggcttgtagcgaaagtg

SEQ ID NO: 790584 - DNA, 20 bp, mouse
gagcctgactgttgacagct

SEQ ID NO: 790585 - DNA, 20 bp, mouse
gtttggctctgcagattcgc

SEQ ID NO: 790586 - DNA, 20 bp, mouse
gtgcatgtgttgatgagctc

SEQ ID NO: 790587 - DNA, 20 bp, mouse
ggatagcatcaaagctactc

SEQ ID NO: 790588 - DNA, 20 bp, mouse
ggctgatatctgagatactg

SEQ ID NO: 790589 - DNA, 20 bp, mouse
gagtgaaatctggaacattg

SEQ ID NO: 790590 - DNA, 20 bp, mouse
gctatgctagcctgcctcca

SEQ ID NO: 790591 - DNA, 20 bp, mouse
gagaagtcagctctataaat

SEQ ID NO: 790592 - DNA, 20 bp, mouse
ggtacaaaggtgtcaactac

SEQ ID NO: 790593 - DNA, 20 bp, mouse
gctctataaataggtccaaa

SEQ ID NO: 790594 - DNA, 20 bp, mouse
gtttgatgctatcatataaa

SEQ ID NO: 790595 - DNA, 20 bp, mouse
ggctatcatataaaaggcct

SEQ ID NO: 790596 - DNA, 20 bp, mouse
ggggctgccccgttcccggg

SEQ ID NO: 790597 - DNA, 20 bp, mouse
gggaacggggcagcccgcgt

SEQ ID NO: 790598 - DNA, 20 bp, mouse
gctcgggtctcggaaggcaa

SEQ ID NO: 790599 - DNA, 20 bp, mouse
gcgagctccacccgggaacg

SEQ ID NO: 790600 - DNA, 20 bp, mouse
ggcagtgtgtggcgagtgac

SEQ ID NO: 790601 - DNA, 20 bp, mouse
gaacctaagtggggagtagt

SEQ ID NO: 790602 - DNA, 20 bp, mouse
ggcacacgctgtgtcgtctc

SEQ ID NO: 790603 - DNA, 20 bp, mouse
gcggcgggacagcccagatg

SEQ ID NO: 790604 - DNA, 20 bp, mouse
gctcgaggcgagctccaccc

SEQ ID NO: 790605 - DNA, 20 bp, mouse
gaaccggggtacccatgcca

SEQ ID NO: 790606 - DNA, 20 bp, mouse
gagcctggcggggtcttcta

SEQ ID NO: 790607 - DNA, 20 bp, mouse
gcccgctggcccagggctca

SEQ ID NO: 790608 - DNA, 20 bp, mouse
gggtccctccgaccaatcaa

SEQ ID NO: 790609 - DNA, 20 bp, mouse
ggatcacgttccaggggcag

SEQ ID NO: 790610 - DNA, 20 bp, mouse
gaacgtgatcaccgcggggc

SEQ ID NO: 790611 - DNA, 20 bp, mouse
gcaggctccgggaacacggc

SEQ ID NO: 790612 - DNA, 20 bp, mouse
ggtgaccagagcgtgctgga

SEQ ID NO: 790613 - DNA, 20 bp, mouse
ggctggatcccgctggccca

SEQ ID NO: 790614 - DNA, 20 bp, mouse
ggccgccttccagcacgctc

SEQ ID NO: 790615 - DNA, 20 bp, mouse
gaccagagcgtgctggaagg

SEQ ID NO: 790616 - DNA, 20 bp, mouse
ggcgctgcggcggaagggtg

SEQ ID NO: 790617 - DNA, 20 bp, mouse
gcggctgcgctgcggcggaa

SEQ ID NO: 790618 - DNA, 20 bp, mouse
gccgcgcagccccacgctgt

SEQ ID NO: 790619 - DNA, 20 bp, mouse
gcggctgccccgcgttcgcc

SEQ ID NO: 790620 - DNA, 20 bp, mouse
gtgggggctggggtggtcgc

SEQ ID NO: 790621 - DNA, 20 bp, mouse
gcacgtgacgaggttcccgg

SEQ ID NO: 790622 - DNA, 20 bp, mouse
gcgcgcggttccgacagcgt

SEQ ID NO: 790623 - DNA, 20 bp, mouse
gaacctcgtcacgtgtgttc

SEQ ID NO: 790624 - DNA, 20 bp, mouse
gtgcacccatccatcagcga

SEQ ID NO: 790625 - DNA, 20 bp, mouse
gccggcgggcggcgtcacga

SEQ ID NO: 790626 - DNA, 20 bp, mouse
gagggcggggactcccgaga

SEQ ID NO: 790627 - DNA, 20 bp, mouse
gcacccggggcggttcccca

SEQ ID NO: 790628 - DNA, 20 bp, mouse
ggataccagccacctgtcag

SEQ ID NO: 790629 - DNA, 20 bp, mouse
ggcggcgaagccgggctcca

SEQ ID NO: 790630 - DNA, 20 bp, mouse
gccgccctggggaaccgccc

SEQ ID NO: 790631 - DNA, 20 bp, mouse
gtaggcgtcccgtcgtgccc

SEQ ID NO: 790632 - DNA, 20 bp, mouse
gactgggtgtagtgactgaa

SEQ ID NO: 790633 - DNA, 20 bp, mouse
gcccggggccggggcacgac

SEQ ID NO: 790634 - DNA, 20 bp, mouse
ggggcctcagccttccctct

SEQ ID NO: 790635 - DNA, 20 bp, mouse
gaaggctgaggcccggggcc

SEQ ID NO: 790636 - DNA, 20 bp, mouse
gtggggctccagtggagcgt

SEQ ID NO: 790637 - DNA, 20 bp, mouse
gggtgagctagagacaggta

SEQ ID NO: 790638 - DNA, 20 bp, mouse
gtaggcggtgagctagagac

SEQ ID NO: 790639 - DNA, 20 bp, mouse
gcccccgccggtcccaccgc

SEQ ID NO: 790640 - DNA, 20 bp, mouse
gggctccagtggagcgtagg

SEQ ID NO: 790641 - DNA, 20 bp, mouse
gcgcgcgtgggcgggatgga

SEQ ID NO: 790642 - DNA, 20 bp, mouse
ggcggcggcaccgacggcac

SEQ ID NO: 790643 - DNA, 20 bp, mouse
gctcccgcgtggctgtccat

SEQ ID NO: 790644 - DNA, 20 bp, mouse
gagccaatggacagccacgc

SEQ ID NO: 790645 - DNA, 20 bp, mouse
gaggacgcccgcgcgtgggc

SEQ ID NO: 790646 - DNA, 20 bp, mouse
ggggtctgggatccttgcgg

SEQ ID NO: 790647 - DNA, 20 bp, mouse
gaaggatcccagaccctcta

SEQ ID NO: 790648 - DNA, 20 bp, mouse
gttgaccggcaacccccaga

SEQ ID NO: 790649 - DNA, 20 bp, mouse
ggggctggcacctccctcca

SEQ ID NO: 790650 - DNA, 20 bp, mouse
ggaccctctaaggctcagtc

SEQ ID NO: 790651 - DNA, 20 bp, mouse
gaggcctgactgagccttag

SEQ ID NO: 790652 - DNA, 20 bp, mouse
gggctcagtcaggccttctg

SEQ ID NO: 790653 - DNA, 20 bp, mouse
gctggcaattgggttttgac

SEQ ID NO: 790654 - DNA, 20 bp, mouse
ggcagttgcaggccaggcgc

SEQ ID NO: 790655 - DNA, 20 bp, mouse
gcgccttccttcagacttga

SEQ ID NO: 790656 - DNA, 20 bp, mouse
gatcccgggaacctgataat

SEQ ID NO: 790657 - DNA, 20 bp, mouse
gggcactattctcaatatcc

SEQ ID NO: 790658 - DNA, 20 bp, mouse
gcacccattatcaggttccc

SEQ ID NO: 790659 - DNA, 20 bp, mouse
gcattcataccacacaatga

SEQ ID NO: 790660 - DNA, 20 bp, mouse
ggtgctggtttgattgaaaa

SEQ ID NO: 790661 - DNA, 20 bp, mouse
gttatggaacagttttatca

SEQ ID NO: 790662 - DNA, 20 bp, mouse
gtgacattttcatacagtgc

SEQ ID NO: 790663 - DNA, 20 bp, mouse
gtggtcctcataggcccaca

SEQ ID NO: 790664 - DNA, 20 bp, mouse
ggtggtatgaatgtggtatg

SEQ ID NO: 790665 - DNA, 20 bp, mouse
gtgaaaaagaaatgatgtta

SEQ ID NO: 790666 - DNA, 20 bp, mouse
ggacgtcagggaagcccgca

SEQ ID NO: 790667 - DNA, 20 bp, mouse
gagttggtgttgtgcactgg

SEQ ID NO: 790668 - DNA, 20 bp, mouse
ggacagggacgccagagagt

SEQ ID NO: 790669 - DNA, 20 bp, mouse
ggtgcacaacaccaactctc

SEQ ID NO: 790670 - DNA, 20 bp, mouse
ggcagggcccgccttgagtc

SEQ ID NO: 790671 - DNA, 20 bp, mouse
gtgcccctgtatagacccaa

SEQ ID NO: 790672 - DNA, 20 bp, mouse
ggaaaaagaccagttagttt

SEQ ID NO: 790673 - DNA, 20 bp, mouse
gacccaaaggaatagcctgt

SEQ ID NO: 790674 - DNA, 20 bp, mouse
ggagtctggctctttgtgac

SEQ ID NO: 790675 - DNA, 20 bp, mouse
gtacctacaggctattcctt

SEQ ID NO: 790676 - DNA, 20 bp, mouse
gcgcgggcgcagtgtttcat

SEQ ID NO: 790677 - DNA, 20 bp, mouse
gtccggctccacctgggtta

SEQ ID NO: 790678 - DNA, 20 bp, mouse
gggcctaaggcgacagattc

SEQ ID NO: 790679 - DNA, 20 bp, mouse
gaagtgaggctcccgaagtc

SEQ ID NO: 790680 - DNA, 20 bp, mouse
ggggagacacttcaagcttg

SEQ ID NO: 790681 - DNA, 20 bp, mouse
gacaggctccggctccacct

SEQ ID NO: 790682 - DNA, 20 bp, mouse
ggtcactatgccaacttcgg

SEQ ID NO: 790683 - DNA, 20 bp, mouse
ggagctgacaatgcttgcgc

SEQ ID NO: 790684 - DNA, 20 bp, mouse
gacgaagaaagcagacatcc

SEQ ID NO: 790685 - DNA, 20 bp, mouse
gatcaaacccctaacccagg

SEQ ID NO: 790686 - DNA, 20 bp, mouse
ggcggagggcatcaggggct

SEQ ID NO: 790687 - DNA, 20 bp, mouse
gctcctgggagcgcctctgg

SEQ ID NO: 790688 - DNA, 20 bp, mouse
gcctctggcggagggcatca

SEQ ID NO: 790689 - DNA, 20 bp, mouse
gtctccttggtcacggggtc

SEQ ID NO: 790690 - DNA, 20 bp, mouse
gtgggagcgcctctggcgga

SEQ ID NO: 790691 - DNA, 20 bp, mouse
gcagacccgccaaatgggag

SEQ ID NO: 790692 - DNA, 20 bp, mouse
gaacgcaaggacgctctcct

SEQ ID NO: 790693 - DNA, 20 bp, mouse
gcgggtgtctccttggtcac

SEQ ID NO: 790694 - DNA, 20 bp, mouse
gaagtcgggcagtcgaacag

SEQ ID NO: 790695 - DNA, 20 bp, mouse
gtggcggcagccgtgaactc

SEQ ID NO: 790696 - DNA, 20 bp, mouse
gccccctcgcccacggtctt

SEQ ID NO: 790697 - DNA, 20 bp, mouse
ggccccacccccaagaccgt

SEQ ID NO: 790698 - DNA, 20 bp, mouse
gggtaacaggtgcctcacct

SEQ ID NO: 790699 - DNA, 20 bp, mouse
gcaggccgcggggatgagga

SEQ ID NO: 790700 - DNA, 20 bp, mouse
gaccgtgggcgagggggctc

SEQ ID NO: 790701 - DNA, 20 bp, mouse
gaacgaagggcgaaaggcac

SEQ ID NO: 790702 - DNA, 20 bp, mouse
ggggcctcagggcccggcgt

SEQ ID NO: 790703 - DNA, 20 bp, mouse
gagcctctggcggccaacga

SEQ ID NO: 790704 - DNA, 20 bp, mouse
ggctgatgggattaactcta

SEQ ID NO: 790705 - DNA, 20 bp, mouse
ggagggggctctggcactta

SEQ ID NO: 790706 - DNA, 20 bp, mouse
ggaaaagccgagtttgggat

SEQ ID NO: 790707 - DNA, 20 bp, mouse
gcgacagggtggaagggaag

SEQ ID NO: 790708 - DNA, 20 bp, mouse
gcgcccccagggttaaatga

SEQ ID NO: 790709 - DNA, 20 bp, mouse
gggtctctcctactcatagt

SEQ ID NO: 790710 - DNA, 20 bp, mouse
gggtaccagtcccccagcgg

SEQ ID NO: 790711 - DNA, 20 bp, mouse
gaaatgaggggacgcctaag

SEQ ID NO: 790712 - DNA, 20 bp, mouse
gaggtgaaggggaatctcag

SEQ ID NO: 790713 - DNA, 20 bp, mouse
gctctcctactcatagttgg

SEQ ID NO: 790714 - DNA, 20 bp, mouse
gacaaagtgaaggggttctg

SEQ ID NO: 790715 - DNA, 20 bp, mouse
gaaccccttcactttgtggg

SEQ ID NO: 790716 - DNA, 20 bp, mouse
gcggggagggcgacggagtg

SEQ ID NO: 790717 - DNA, 20 bp, mouse
gagttggctgccgaaggaag

SEQ ID NO: 790718 - DNA, 20 bp, mouse
gcgtggtcctcccgctggga

SEQ ID NO: 790719 - DNA, 20 bp, mouse
gagaccgcgcaggcgccctg

SEQ ID NO: 790720 - DNA, 20 bp, mouse
gcctcccgctgggagggcgg

SEQ ID NO: 790721 - DNA, 20 bp, mouse
gctggcgtcccaggctccgc

SEQ ID NO: 790722 - DNA, 20 bp, mouse
ggagggcgacggagtggggc

SEQ ID NO: 790723 - DNA, 20 bp, mouse
gagagcgaagccacttcctt

SEQ ID NO: 790724 - DNA, 20 bp, mouse
gggggcgtggtcctcccgct

SEQ ID NO: 790725 - DNA, 20 bp, mouse
gcgcttgcgccccggctcca

SEQ ID NO: 790726 - DNA, 20 bp, mouse
ggggcccggcgcacgaggag

SEQ ID NO: 790727 - DNA, 20 bp, mouse
gtctccgccgggccgcgcga

SEQ ID NO: 790728 - DNA, 20 bp, mouse
gcgagaaccggattccccaa

SEQ ID NO: 790729 - DNA, 20 bp, mouse
gagagtgggcaggaggaccg

SEQ ID NO: 790730 - DNA, 20 bp, mouse
ggaccgggggaaggatgcaa

SEQ ID NO: 790731 - DNA, 20 bp, mouse
ggattccccaagggcagagt

SEQ ID NO: 790732 - DNA, 20 bp, mouse
gcatgctctagggtagtgaa

SEQ ID NO: 790733 - DNA, 20 bp, mouse
gccgccgggaaaaggcgagt

SEQ ID NO: 790734 - DNA, 20 bp, mouse
gctgtgcggagagaggtcca

SEQ ID NO: 790735 - DNA, 20 bp, mouse
gagaggtccaaggcgagaac

SEQ ID NO: 790736 - DNA, 20 bp, mouse
gaagatggccccttggggag

SEQ ID NO: 790737 - DNA, 20 bp, mouse
gcgcccgagccgccctacag

SEQ ID NO: 790738 - DNA, 20 bp, mouse
gccaatggtgaatgagaagt

SEQ ID NO: 790739 - DNA, 20 bp, mouse
gacgtaggcgggcacaatct

SEQ ID NO: 790740 - DNA, 20 bp, mouse
gtggttgctagcagcgacgt

SEQ ID NO: 790741 - DNA, 20 bp, mouse
gcggcgggacggcccctgta

SEQ ID NO: 790742 - DNA, 20 bp, mouse
gacgcgagcttgtgcggcaa

SEQ ID NO: 790743 - DNA, 20 bp, mouse
gaatgagatgtttttcccga

SEQ ID NO: 790744 - DNA, 20 bp, mouse
gtgccaatgagagtcgaggg

SEQ ID NO: 790745 - DNA, 20 bp, mouse
gtagctgccaatgagagtcg

SEQ ID NO: 790746 - DNA, 20 bp, mouse
gtccctgcgcgtggaggctc

SEQ ID NO: 790747 - DNA, 20 bp, mouse
gtgagcgcggggcgtggtct

SEQ ID NO: 790748 - DNA, 20 bp, mouse
gccccagccgaaagaaacaa

SEQ ID NO: 790749 - DNA, 20 bp, mouse
gtgacccccattgctggaac

SEQ ID NO: 790750 - DNA, 20 bp, mouse
gggctggggaaaggatgcag

SEQ ID NO: 790751 - DNA, 20 bp, mouse
gccggcctgacccccattgc

SEQ ID NO: 790752 - DNA, 20 bp, mouse
gtcaagtagaactcagagac

SEQ ID NO: 790753 - DNA, 20 bp, mouse
gggggctaaatccaatcagc

SEQ ID NO: 790754 - DNA, 20 bp, mouse
gaggtctgaactccagaaga

SEQ ID NO: 790755 - DNA, 20 bp, mouse
gggcgggccgaaaaaaccaa

SEQ ID NO: 790756 - DNA, 20 bp, mouse
ggggcgaaagcaagacaaga

SEQ ID NO: 790757 - DNA, 20 bp, mouse
gccaagccgcggtgcccaag

SEQ ID NO: 790758 - DNA, 20 bp, mouse
gtacggcttgggacagtgag

SEQ ID NO: 790759 - DNA, 20 bp, mouse
gcctccggggctcacccaca

SEQ ID NO: 790760 - DNA, 20 bp, mouse
gaccttctcaaggatcctag

SEQ ID NO: 790761 - DNA, 20 bp, mouse
gcgcggtgcccaagtggcca

SEQ ID NO: 790762 - DNA, 20 bp, mouse
ggagccaaggccggaacttt

SEQ ID NO: 790763 - DNA, 20 bp, mouse
ggtcccaagccgtagagcca

SEQ ID NO: 790764 - DNA, 20 bp, mouse
gtgaccctgtgggtgagccc

SEQ ID NO: 790765 - DNA, 20 bp, mouse
gtcaaggatcctagcgggcg

SEQ ID NO: 790766 - DNA, 20 bp, mouse
ggtgcagccggacacgggag

SEQ ID NO: 790767 - DNA, 20 bp, mouse
gccgcagtgccatggatctc

SEQ ID NO: 790768 - DNA, 20 bp, mouse
gggaggggttggctattcaa

SEQ ID NO: 790769 - DNA, 20 bp, mouse
gacacacgggagaaaggtag

SEQ ID NO: 790770 - DNA, 20 bp, mouse
gacagcatagtgttctgccc

SEQ ID NO: 790771 - DNA, 20 bp, mouse
ggccggacacgggagtggtg

SEQ ID NO: 790772 - DNA, 20 bp, mouse
gtagcagtgcagccggacac

SEQ ID NO: 790773 - DNA, 20 bp, mouse
gttgaggagtcaggggtgca

SEQ ID NO: 790774 - DNA, 20 bp, mouse
gaaacggacacacgggagaa

SEQ ID NO: 790775 - DNA, 20 bp, mouse
ggaagcttcagccaatgaag

SEQ ID NO: 790776 - DNA, 20 bp, mouse
ggttccggaggtgaccgctg

SEQ ID NO: 790777 - DNA, 20 bp, mouse
ggagccgagccccgccacag

SEQ ID NO: 790778 - DNA, 20 bp, mouse
ggaggcgtgcagcggaggga

SEQ ID NO: 790779 - DNA, 20 bp, mouse
gccgccacagcggtcacctc

SEQ ID NO: 790780 - DNA, 20 bp, mouse
ggagctggataattcgtctg

SEQ ID NO: 790781 - DNA, 20 bp, mouse
gtccgggcgcctggcggtgg

SEQ ID NO: 790782 - DNA, 20 bp, mouse
gtggccaggtgttgcaataa

SEQ ID NO: 790783 - DNA, 20 bp, mouse
gtaggtgtccctggttccgg

SEQ ID NO: 790784 - DNA, 20 bp, mouse
gcgcccggacgcagcgcgaa

SEQ ID NO: 790785 - DNA, 20 bp, mouse
ggcggagaggcgtgcagcgg

SEQ ID NO: 790786 - DNA, 20 bp, mouse
gcccccgcggcactgaccgt

SEQ ID NO: 790787 - DNA, 20 bp, mouse
ggccgctgcggtccaaggag

SEQ ID NO: 790788 - DNA, 20 bp, mouse
gggccgcagaagaaagtctg

SEQ ID NO: 790789 - DNA, 20 bp, mouse
gtcctctccttggaccgcag

SEQ ID NO: 790790 - DNA, 20 bp, mouse
ggccttctcgagtcgtgtca

SEQ ID NO: 790791 - DNA, 20 bp, mouse
gggctggactggatgctcga

SEQ ID NO: 790792 - DNA, 20 bp, mouse
ggtgtcttggactagtccgc

SEQ ID NO: 790793 - DNA, 20 bp, mouse
ggaggccttaagaacgtaga

SEQ ID NO: 790794 - DNA, 20 bp, mouse
gcggcactgaccgtcggagg

SEQ ID NO: 790795 - DNA, 20 bp, mouse
ggtccgctggcagatagagg

SEQ ID NO: 790796 - DNA, 20 bp, mouse
ggaacccagcacggccaggt

SEQ ID NO: 790797 - DNA, 20 bp, mouse
gaaggctattcgcactattt

SEQ ID NO: 790798 - DNA, 20 bp, mouse
gggcctgtggcgctagtggg

SEQ ID NO: 790799 - DNA, 20 bp, mouse
ggctctcgcagtgcccctca

SEQ ID NO: 790800 - DNA, 20 bp, mouse
gcctcagggccccctttcgg

SEQ ID NO: 790801 - DNA, 20 bp, mouse
gccgagggggcgtgtctggt

SEQ ID NO: 790802 - DNA, 20 bp, mouse
gactaagtaaatcacagcgg

SEQ ID NO: 790803 - DNA, 20 bp, mouse
gcactctccttcctccgaaa

SEQ ID NO: 790804 - DNA, 20 bp, mouse
ggagtgggaggaacccagca

SEQ ID NO: 790805 - DNA, 20 bp, mouse
gagcaggacagttatcgaag

SEQ ID NO: 790806 - DNA, 20 bp, mouse
gcgcgctgaacgtggtgctg

SEQ ID NO: 790807 - DNA, 20 bp, mouse
gctagcgtgatcgccgtatc

SEQ ID NO: 790808 - DNA, 20 bp, mouse
ggctgcgtctattacatcgt

SEQ ID NO: 790809 - DNA, 20 bp, mouse
gtggacgccatcttgggcac

SEQ ID NO: 790810 - DNA, 20 bp, mouse
gtgggcacgggcggaagcct

SEQ ID NO: 790811 - DNA, 20 bp, mouse
ggacgcctggacgccatctt

SEQ ID NO: 790812 - DNA, 20 bp, mouse
gcttccgcccgtgcccaaga

SEQ ID NO: 790813 - DNA, 20 bp, mouse
gacgccatcttgggcacggg

SEQ ID NO: 790814 - DNA, 20 bp, mouse
gaaagatgctgtagctattc

SEQ ID NO: 790815 - DNA, 20 bp, mouse
gcgtgcgcgccacaggttac

SEQ ID NO: 790816 - DNA, 20 bp, mouse
ggtcaccgacgcgacagatg

SEQ ID NO: 790817 - DNA, 20 bp, mouse
gcgacgcgacagatgtgggg

SEQ ID NO: 790818 - DNA, 20 bp, mouse
gaacccgtgtcgccatcacc

SEQ ID NO: 790819 - DNA, 20 bp, mouse
gcggccgtgggttccacgag

SEQ ID NO: 790820 - DNA, 20 bp, mouse
gcgaatcccggaagaacgtg

SEQ ID NO: 790821 - DNA, 20 bp, mouse
gatacaggcgcggggagtga

SEQ ID NO: 790822 - DNA, 20 bp, mouse
gagaacggaagagctgcggt

SEQ ID NO: 790823 - DNA, 20 bp, mouse
gggttacgcgacaacggaag

SEQ ID NO: 790824 - DNA, 20 bp, mouse
gtccacgagaggctgcgttc

SEQ ID NO: 790825 - DNA, 20 bp, mouse
ggcagagaacggaagagctg

SEQ ID NO: 790826 - DNA, 20 bp, mouse
gcatgcacaaagaagatgac

SEQ ID NO: 790827 - DNA, 20 bp, mouse
gagaacacaactgttgactg

SEQ ID NO: 790828 - DNA, 20 bp, mouse
gtatggcagcagtattcttg

SEQ ID NO: 790829 - DNA, 20 bp, mouse
gccgacgccccgcacaaaca

SEQ ID NO: 790830 - DNA, 20 bp, mouse
gcagctaaggtggctttcgg

SEQ ID NO: 790831 - DNA, 20 bp, mouse
gtctcagattgcttgggtgg

SEQ ID NO: 790832 - DNA, 20 bp, mouse
ggtgatggagggaataggta

SEQ ID NO: 790833 - DNA, 20 bp, mouse
gtgcaagccaactgcggcgc

SEQ ID NO: 790834 - DNA, 20 bp, mouse
gaccgcctcgacagctaagg

SEQ ID NO: 790835 - DNA, 20 bp, mouse
gcccaccaacggccgtctcg

SEQ ID NO: 790836 - DNA, 20 bp, mouse
gccccctccggagactccgg

SEQ ID NO: 790837 - DNA, 20 bp, mouse
gggccaatcgcagggctaag

SEQ ID NO: 790838 - DNA, 20 bp, mouse
gaggggctacgtgacagacg

SEQ ID NO: 790839 - DNA, 20 bp, mouse
gtagcctccggagtctccgg

SEQ ID NO: 790840 - DNA, 20 bp, mouse
gcctccctcccacccagcta

SEQ ID NO: 790841 - DNA, 20 bp, mouse
gagtgccctcggccaatcgc

SEQ ID NO: 790842 - DNA, 20 bp, mouse
ggcaagtgaaggcagtgagc

SEQ ID NO: 790843 - DNA, 20 bp, mouse
gcactagcctccggagtctc

SEQ ID NO: 790844 - DNA, 20 bp, mouse
gccagcctggagcctagcgc

SEQ ID NO: 790845 - DNA, 20 bp, mouse
gaggacctcccccgggccgc

SEQ ID NO: 790846 - DNA, 20 bp, mouse
gaaaacctgcaagcagactg

SEQ ID NO: 790847 - DNA, 20 bp, mouse
gtctggaagggacactgtgt

SEQ ID NO: 790848 - DNA, 20 bp, mouse
gcacctccctccgctagggg

SEQ ID NO: 790849 - DNA, 20 bp, mouse
gcccgcacctccctccgcta

SEQ ID NO: 790850 - DNA, 20 bp, mouse
gagttcctcccctagctccg

SEQ ID NO: 790851 - DNA, 20 bp, mouse
gcgggagtccagttctgagc

SEQ ID NO: 790852 - DNA, 20 bp, mouse
gctgacgcagccccccctag

SEQ ID NO: 790853 - DNA, 20 bp, mouse
gacgcagccccccctagcgg

SEQ ID NO: 790854 - DNA, 20 bp, mouse
gtagtccccaccctgcttaa

SEQ ID NO: 790855 - DNA, 20 bp, mouse
gggactcccgaattctggaa

SEQ ID NO: 790856 - DNA, 20 bp, mouse
ggtgccaccctctaagagct

SEQ ID NO: 790857 - DNA, 20 bp, mouse
ggcggaaagagcgttctgtt

SEQ ID NO: 790858 - DNA, 20 bp, mouse
gccaagagcggccagaagaa

SEQ ID NO: 790859 - DNA, 20 bp, mouse
gggaaagccggaaaatgccc

SEQ ID NO: 790860 - DNA, 20 bp, mouse
ggctgcttcgtgatgtcact

SEQ ID NO: 790861 - DNA, 20 bp, mouse
ggaacggtagatcttggaga

SEQ ID NO: 790862 - DNA, 20 bp, mouse
gtcttagagggtggcaccgg

SEQ ID NO: 790863 - DNA, 20 bp, mouse
ggaactggggggaaccagtt

SEQ ID NO: 790864 - DNA, 20 bp, mouse
gctctgcagctggagggaac

SEQ ID NO: 790865 - DNA, 20 bp, mouse
gataagagctgagaggtaga

SEQ ID NO: 790866 - DNA, 20 bp, mouse
gtctgggagccgaaccctgg

SEQ ID NO: 790867 - DNA, 20 bp, mouse
gagtacaaaccgccagggtt

SEQ ID NO: 790868 - DNA, 20 bp, mouse
ggggaaggagcagagctcaa

SEQ ID NO: 790869 - DNA, 20 bp, mouse
gtcccgccctgaaaagggtc

SEQ ID NO: 790870 - DNA, 20 bp, mouse
gacgacgcacaaggcgacgc

SEQ ID NO: 790871 - DNA, 20 bp, mouse
gagggcaggtagaagagcag

SEQ ID NO: 790872 - DNA, 20 bp, mouse
gagagccacttctggaggga

SEQ ID NO: 790873 - DNA, 20 bp, mouse
ggaggcggctcctggttctc

SEQ ID NO: 790874 - DNA, 20 bp, mouse
gagggttcggctcccagaat

SEQ ID NO: 790875 - DNA, 20 bp, mouse
ggcctcctcggattggtcat

SEQ ID NO: 790876 - DNA, 20 bp, mouse
gactcccaggccagcacgtt

SEQ ID NO: 790877 - DNA, 20 bp, mouse
gaagggacggggccctcgat

SEQ ID NO: 790878 - DNA, 20 bp, mouse
gctgagagctggtcggggat

SEQ ID NO: 790879 - DNA, 20 bp, mouse
gccgcgcctcgcccaatcga

SEQ ID NO: 790880 - DNA, 20 bp, mouse
gaggcctgaggagagctcgg

SEQ ID NO: 790881 - DNA, 20 bp, mouse
gccgccagggcgcctgaagt

SEQ ID NO: 790882 - DNA, 20 bp, mouse
gcgcccgccgagctctcctc

SEQ ID NO: 790883 - DNA, 20 bp, mouse
gagcacgttcggctgagagc

SEQ ID NO: 790884 - DNA, 20 bp, mouse
gttcggctgagagctggtcg

SEQ ID NO: 790885 - DNA, 20 bp, mouse
ggggggggcggggaaacagg

SEQ ID NO: 790886 - DNA, 20 bp, mouse
gagcttgcgaggtgcaacgt

SEQ ID NO: 790887 - DNA, 20 bp, mouse
gcgcggcggcgggacgtcta

SEQ ID NO: 790888 - DNA, 20 bp, mouse
gtccctcatcgctaaggcgg

SEQ ID NO: 790889 - DNA, 20 bp, mouse
ggggtgccagtcagtcccgt

SEQ ID NO: 790890 - DNA, 20 bp, mouse
gggccctaaggcggaccccg

SEQ ID NO: 790891 - DNA, 20 bp, mouse
gcagcggcgccgcgaggcag

SEQ ID NO: 790892 - DNA, 20 bp, mouse
gtcgctgccgcagctgtcca

SEQ ID NO: 790893 - DNA, 20 bp, mouse
gcaacgtggggcgggcccta

SEQ ID NO: 790894 - DNA, 20 bp, mouse
gaccaccgccttagcgatga

SEQ ID NO: 790895 - DNA, 20 bp, mouse
ggcaggcccacgggactgac

SEQ ID NO: 790896 - DNA, 20 bp, mouse
gaggttgcagattaaactga

SEQ ID NO: 790897 - DNA, 20 bp, mouse
ggacttgagcaaaattaccg

SEQ ID NO: 790898 - DNA, 20 bp, mouse
gggaaacagtccaagggatc

SEQ ID NO: 790899 - DNA, 20 bp, mouse
gagaaacggaaacagtccaa

SEQ ID NO: 790900 - DNA, 20 bp, mouse
gatcgcgcgtgcaggggcgg

SEQ ID NO: 790901 - DNA, 20 bp, mouse
ggcggcgccgccggggaaca

SEQ ID NO: 790902 - DNA, 20 bp, mouse
ggggctgttgataaaatgca

SEQ ID NO: 790903 - DNA, 20 bp, mouse
ggggggcgggacaagctcca

SEQ ID NO: 790904 - DNA, 20 bp, mouse
gggtccgccatgttccccgg

SEQ ID NO: 790905 - DNA, 20 bp, mouse
gcggcgccgccgcttggctc

SEQ ID NO: 790906 - DNA, 20 bp, mouse
gtcgcgtggggcagatgctc

SEQ ID NO: 790907 - DNA, 20 bp, mouse
gcggcggtcagcagtgaatc

SEQ ID NO: 790908 - DNA, 20 bp, mouse
gccccacgcgaggcggacgg

SEQ ID NO: 790909 - DNA, 20 bp, mouse
gaccgccgtccgcctcgcgt

SEQ ID NO: 790910 - DNA, 20 bp, mouse
ggctgcttccgaggtcccag

SEQ ID NO: 790911 - DNA, 20 bp, mouse
ggcatctgccccacgcgagg

SEQ ID NO: 790912 - DNA, 20 bp, mouse
gggatctcgggtctcagctc

SEQ ID NO: 790913 - DNA, 20 bp, mouse
gcgcgctcacaacttcccgg

SEQ ID NO: 790914 - DNA, 20 bp, mouse
gctgccccacgcgaggcgga

SEQ ID NO: 790915 - DNA, 20 bp, mouse
gaggggctctctctgatgag

SEQ ID NO: 790916 - DNA, 20 bp, mouse
gcggcaggaggaagactcct

SEQ ID NO: 790917 - DNA, 20 bp, mouse
gggtacgcaaaaagcgctgg

SEQ ID NO: 790918 - DNA, 20 bp, mouse
gactcctgggaggagaaaat

SEQ ID NO: 790919 - DNA, 20 bp, mouse
gcggggctctgcgagcaatc

SEQ ID NO: 790920 - DNA, 20 bp, mouse
ggggcagacgtcttgacgtt

SEQ ID NO: 790921 - DNA, 20 bp, mouse
ggctctgcgagcaatccggt

SEQ ID NO: 790922 - DNA, 20 bp, mouse
gcgtgcacacgctctccaac

SEQ ID NO: 790923 - DNA, 20 bp, mouse
gcgctggcggagcgctagcg

SEQ ID NO: 790924 - DNA, 20 bp, mouse
ggcgccgggggacatggaga

SEQ ID NO: 790925 - DNA, 20 bp, mouse
gggtcacatgacaggaagcg

SEQ ID NO: 790926 - DNA, 20 bp, mouse
ggggaccggaggacaaagtg

SEQ ID NO: 790927 - DNA, 20 bp, mouse
ggcgagggatagctgtaact

SEQ ID NO: 790928 - DNA, 20 bp, mouse
gggacaaagtggggctaccc

SEQ ID NO: 790929 - DNA, 20 bp, mouse
gagtggggctacccaggcga

SEQ ID NO: 790930 - DNA, 20 bp, mouse
gagaggctggaggggaccgg

SEQ ID NO: 790931 - DNA, 20 bp, mouse
gtgggctgtcctctctaatg

SEQ ID NO: 790932 - DNA, 20 bp, mouse
ggtagccccactttgtcctc

SEQ ID NO: 790933 - DNA, 20 bp, mouse
gcagggaaaccgcattagag

SEQ ID NO: 790934 - DNA, 20 bp, mouse
gtcagctagaacagcaaggc

SEQ ID NO: 790935 - DNA, 20 bp, mouse
ggcagcacgcgagagcacga

SEQ ID NO: 790936 - DNA, 20 bp, mouse
gggcgggcgaagttggttgg

SEQ ID NO: 790937 - DNA, 20 bp, mouse
gaagagaagtagccggaagt

SEQ ID NO: 790938 - DNA, 20 bp, mouse
gcctcgctgaggcaccggga

SEQ ID NO: 790939 - DNA, 20 bp, mouse
gggaagtgggcgggcgaagt

SEQ ID NO: 790940 - DNA, 20 bp, mouse
gaggccggaagtagaagcgg

SEQ ID NO: 790941 - DNA, 20 bp, mouse
gagaagtagccggaagtggg

SEQ ID NO: 790942 - DNA, 20 bp, mouse
gtgagatgagaagcctaccg

SEQ ID NO: 790943 - DNA, 20 bp, mouse
gcacgagccacgcctcgctg

SEQ ID NO: 790944 - DNA, 20 bp, mouse
gaaggctgatcgtggatact

SEQ ID NO: 790945 - DNA, 20 bp, mouse
ggcgaggccggaagtagaag

SEQ ID NO: 790946 - DNA, 20 bp, mouse
gcgagcctcccgcctccgag

SEQ ID NO: 790947 - DNA, 20 bp, mouse
gacgcacgagcaggtctggg

SEQ ID NO: 790948 - DNA, 20 bp, mouse
gttaacgtgccgcgccgcac

SEQ ID NO: 790949 - DNA, 20 bp, mouse
ggccgcacgggaaggcaggc

SEQ ID NO: 790950 - DNA, 20 bp, mouse
gcaaaccgtcgtccggcccg

SEQ ID NO: 790951 - DNA, 20 bp, mouse
gcggcgcttcctccactcgg

SEQ ID NO: 790952 - DNA, 20 bp, mouse
gccgcgccgcacgggaaggc

SEQ ID NO: 790953 - DNA, 20 bp, mouse
gcggggaatggcagactgtc

SEQ ID NO: 790954 - DNA, 20 bp, mouse
gggcgacgcacgagcaggtc

SEQ ID NO: 790955 - DNA, 20 bp, mouse
gcgctcagggtcagctcggg

SEQ ID NO: 790956 - DNA, 20 bp, mouse
gtgtactgatggggaaacgg

SEQ ID NO: 790957 - DNA, 20 bp, mouse
gtgcggacgccgctgaacag

SEQ ID NO: 790958 - DNA, 20 bp, mouse
ggcggaggcgcacgggatcg

SEQ ID NO: 790959 - DNA, 20 bp, mouse
gagcgcgcagctccagccgc

SEQ ID NO: 790960 - DNA, 20 bp, mouse
gcccgcccagtgcgcgtgcg

SEQ ID NO: 790961 - DNA, 20 bp, mouse
gcgggatcgaggcgcgagtt

SEQ ID NO: 790962 - DNA, 20 bp, mouse
gggcgcgaggacgacagctg

SEQ ID NO: 790963 - DNA, 20 bp, mouse
gcgtgcgcggcggaggcgca

SEQ ID NO: 790964 - DNA, 20 bp, mouse
gacactcttcctctgttcag

SEQ ID NO: 790965 - DNA, 20 bp, mouse
ggcgccttcagtgtactgat

SEQ ID NO: 790966 - DNA, 20 bp, mouse
ggcaacgacgctccctggtc

SEQ ID NO: 790967 - DNA, 20 bp, mouse
gggcccagggagccggacca

SEQ ID NO: 790968 - DNA, 20 bp, mouse
ggggctcgccccataagggt

SEQ ID NO: 790969 - DNA, 20 bp, mouse
gggcggggctcgccccataa

SEQ ID NO: 790970 - DNA, 20 bp, mouse
ggcccccgccccacccttat

SEQ ID NO: 790971 - DNA, 20 bp, mouse
ggccgcgcaacgacgctccc

SEQ ID NO: 790972 - DNA, 20 bp, mouse
gagctctccgcgtccccagg

SEQ ID NO: 790973 - DNA, 20 bp, mouse
gccctcggtgcgctgctctc

SEQ ID NO: 790974 - DNA, 20 bp, mouse
gtcctggccgcctggggacg

SEQ ID NO: 790975 - DNA, 20 bp, mouse
gctccctggtccggctccct

SEQ ID NO: 790976 - DNA, 20 bp, mouse
gttgtcctcccggcgctctg

SEQ ID NO: 790977 - DNA, 20 bp, mouse
gtacaagtacaagtacggtc

SEQ ID NO: 790978 - DNA, 20 bp, mouse
gcggcctgcccccatccaca

SEQ ID NO: 790979 - DNA, 20 bp, mouse
ggtacggtctggataccctc

SEQ ID NO: 790980 - DNA, 20 bp, mouse
gccgcccccagagcgccggg

SEQ ID NO: 790981 - DNA, 20 bp, mouse
ggggccttgtggatgggggc

SEQ ID NO: 790982 - DNA, 20 bp, mouse
ggggttgcgttgcctccggc

SEQ ID NO: 790983 - DNA, 20 bp, mouse
ggacacttgtgcggcagcgg

SEQ ID NO: 790984 - DNA, 20 bp, mouse
ggacgccgcgcaggcgcgtc

SEQ ID NO: 790985 - DNA, 20 bp, mouse
gcgcgtcaggagtgcctttg

SEQ ID NO: 790986 - DNA, 20 bp, mouse
gagagagagcggaacgggtc

SEQ ID NO: 790987 - DNA, 20 bp, mouse
ggagagctacgggtcccagt

SEQ ID NO: 790988 - DNA, 20 bp, mouse
gtatctccaagagaacccgg

SEQ ID NO: 790989 - DNA, 20 bp, mouse
ggaggtgaagtctgttgcca

SEQ ID NO: 790990 - DNA, 20 bp, mouse
gccccgcggcagagagctac

SEQ ID NO: 790991 - DNA, 20 bp, mouse
ggcagcggctgtagtagcgg

SEQ ID NO: 790992 - DNA, 20 bp, mouse
ggacccgtagctctctgccg

SEQ ID NO: 790993 - DNA, 20 bp, mouse
ggctgtagtagcggaggcag

SEQ ID NO: 790994 - DNA, 20 bp, mouse
ggaagtctgttgccaaggat

SEQ ID NO: 790995 - DNA, 20 bp, mouse
gcagcggcggaggccgaatc

SEQ ID NO: 790996 - DNA, 20 bp, mouse
ggggccctctaggtttattc

SEQ ID NO: 790997 - DNA, 20 bp, mouse
gcagccgcggagttccggag

SEQ ID NO: 790998 - DNA, 20 bp, mouse
gcgggaggacgcaagaagac

SEQ ID NO: 790999 - DNA, 20 bp, mouse
gcgcccactccggaactccg

SEQ ID NO: 791000 - DNA, 20 bp, mouse
gaagccgaggggacgggcgt

SEQ ID NO: 791001 - DNA, 20 bp, mouse
gcggggagacccagccgctt

SEQ ID NO: 791002 - DNA, 20 bp, mouse
gagagaacattggcaaccgt

SEQ ID NO: 791003 - DNA, 20 bp, mouse
gacggacagccgcggagttc

SEQ ID NO: 791004 - DNA, 20 bp, mouse
gtcggaggccttaaggtgga

SEQ ID NO: 791005 - DNA, 20 bp, mouse
ggcccagaacccgcccactc

SEQ ID NO: 791006 - DNA, 20 bp, mouse
gagaaggtaggtcagataag

SEQ ID NO: 791007 - DNA, 20 bp, mouse
ggggactcaagcactgtagt

SEQ ID NO: 791008 - DNA, 20 bp, mouse
gagcaaagtgagagccccta

SEQ ID NO: 791009 - DNA, 20 bp, mouse
gacttgggagacagatgtgt

SEQ ID NO: 791010 - DNA, 20 bp, mouse
gtccccgccctgaaaaggat

SEQ ID NO: 791011 - DNA, 20 bp, mouse
ggtacatcatggctgagggt

SEQ ID NO: 791012 - DNA, 20 bp, mouse
ggatgtacccaaagtccaag

SEQ ID NO: 791013 - DNA, 20 bp, mouse
gcagggcggggagacattcc

SEQ ID NO: 791014 - DNA, 20 bp, mouse
gtacagtgcttgagtcccta

SEQ ID NO: 791015 - DNA, 20 bp, mouse
ggcacagaggaaaggacccc

SEQ ID NO: 791016 - DNA, 20 bp, mouse
ggggcggtccaataggttgt

SEQ ID NO: 791017 - DNA, 20 bp, mouse
gacctcaaagccaatcgaag

SEQ ID NO: 791018 - DNA, 20 bp, mouse
gaggccccgctgttgctacg

SEQ ID NO: 791019 - DNA, 20 bp, mouse
ggccccttcacacggatcat

SEQ ID NO: 791020 - DNA, 20 bp, mouse
gccgccccgcagccaatcac

SEQ ID NO: 791021 - DNA, 20 bp, mouse
gccctcgactccacttcgat

SEQ ID NO: 791022 - DNA, 20 bp, mouse
gaaccgctgggcggtccaat

SEQ ID NO: 791023 - DNA, 20 bp, mouse
gaacctattggaccgcccag

SEQ ID NO: 791024 - DNA, 20 bp, mouse
gcagaaattgggagaagctt

SEQ ID NO: 791025 - DNA, 20 bp, mouse
gtggctgcggggcggccgga

SEQ ID NO: 791026 - DNA, 20 bp, mouse
ggcctcgcccagccgattgt

SEQ ID NO: 791027 - DNA, 20 bp, mouse
gaaggccctgacctccctcg

SEQ ID NO: 791028 - DNA, 20 bp, mouse
gaattcccagaaatcctcga

SEQ ID NO: 791029 - DNA, 20 bp, mouse
ggccacgcactccaccgcca

SEQ ID NO: 791030 - DNA, 20 bp, mouse
ggcaacctggaaaaagataa

SEQ ID NO: 791031 - DNA, 20 bp, mouse
ggatggggcgtcagggactc

SEQ ID NO: 791032 - DNA, 20 bp, mouse
gaaatcctcgagggaggtca

SEQ ID NO: 791033 - DNA, 20 bp, mouse
gaagcgccgtatgggaccgg

SEQ ID NO: 791034 - DNA, 20 bp, mouse
gggggcgcgggtccacgtgg

SEQ ID NO: 791035 - DNA, 20 bp, mouse
gcggggaagggatgtccacg

SEQ ID NO: 791036 - DNA, 20 bp, mouse
gagaaggcaaagttccgtag

SEQ ID NO: 791037 - DNA, 20 bp, mouse
gcaaagttccgtagggggaa

SEQ ID NO: 791038 - DNA, 20 bp, mouse
ggaagggggaattgtcacct

SEQ ID NO: 791039 - DNA, 20 bp, mouse
gtggaccaaagtaattccgg

SEQ ID NO: 791040 - DNA, 20 bp, mouse
ggctcctgcaagcggttctc

SEQ ID NO: 791041 - DNA, 20 bp, mouse
ggaagaaaaggctcagtgtc

SEQ ID NO: 791042 - DNA, 20 bp, mouse
ggcttgcaggagcggtcaga

SEQ ID NO: 791043 - DNA, 20 bp, mouse
gtgggcgtttcatatgtgta

SEQ ID NO: 791044 - DNA, 20 bp, mouse
gttgtcacctaggcgtcctt

SEQ ID NO: 791045 - DNA, 20 bp, mouse
ggtggccaccggaattactt

SEQ ID NO: 791046 - DNA, 20 bp, mouse
gtcccctgcaacgcggacag

SEQ ID NO: 791047 - DNA, 20 bp, mouse
ggacgctcgccctgttgcca

SEQ ID NO: 791048 - DNA, 20 bp, mouse
gagagcgcgcagtgggatga

SEQ ID NO: 791049 - DNA, 20 bp, mouse
gaacgcggacagcggaccgg

SEQ ID NO: 791050 - DNA, 20 bp, mouse
gccccctcgcacgttttctt

SEQ ID NO: 791051 - DNA, 20 bp, mouse
gagcccaagaaaacgtgcga

SEQ ID NO: 791052 - DNA, 20 bp, mouse
gcatttagccggatggggag

SEQ ID NO: 791053 - DNA, 20 bp, mouse
ggaatgttccattgcccctc

SEQ ID NO: 791054 - DNA, 20 bp, mouse
gaaagtgggccgcattaagg

SEQ ID NO: 791055 - DNA, 20 bp, mouse
gtccgctgtccgcgttgcag

SEQ ID NO: 791056 - DNA, 20 bp, mouse
ggagcgtgcgcaaagggtgt

SEQ ID NO: 791057 - DNA, 20 bp, mouse
gggaatcgagcgtgcgcaaa

SEQ ID NO: 791058 - DNA, 20 bp, mouse
gcgcagccctatgtagtcac

SEQ ID NO: 791059 - DNA, 20 bp, mouse
gcgattccggtgactacata

SEQ ID NO: 791060 - DNA, 20 bp, mouse
gtggacctgagccgcggaga

SEQ ID NO: 791061 - DNA, 20 bp, mouse
gcatagggctgcgagtccga

SEQ ID NO: 791062 - DNA, 20 bp, mouse
ggtgtgggcgcagtgtctcc

SEQ ID NO: 791063 - DNA, 20 bp, mouse
gttaagagttatagtcgctt

SEQ ID NO: 791064 - DNA, 20 bp, mouse
gcggtagactgggttgttgg

SEQ ID NO: 791065 - DNA, 20 bp, mouse
gctctggtaaatctaactcc

SEQ ID NO: 791066 - DNA, 20 bp, mouse
ggactgaagtgagttgaaac

SEQ ID NO: 791067 - DNA, 20 bp, mouse
ggcagcgcgcgtaaacagcg

SEQ ID NO: 791068 - DNA, 20 bp, mouse
ggccggaagcgctttttgat

SEQ ID NO: 791069 - DNA, 20 bp, mouse
gcgtaagcgtccgatctagg

SEQ ID NO: 791070 - DNA, 20 bp, mouse
gtgtgttgacgagagcgctg

SEQ ID NO: 791071 - DNA, 20 bp, mouse
gacccaggtaccccctagat

SEQ ID NO: 791072 - DNA, 20 bp, mouse
gaggccccagttttctgtca

SEQ ID NO: 791073 - DNA, 20 bp, mouse
gagcaggcaggtggagacgc

SEQ ID NO: 791074 - DNA, 20 bp, mouse
gacggacaaaagctgcgccg

SEQ ID NO: 791075 - DNA, 20 bp, mouse
ggtaggttctagaacagcat

SEQ ID NO: 791076 - DNA, 20 bp, mouse
ggggcactgtggccagaaac

SEQ ID NO: 791077 - DNA, 20 bp, mouse
gacaggaggcggggactctg

SEQ ID NO: 791078 - DNA, 20 bp, mouse
gtcagcattctagatgtcgg

SEQ ID NO: 791079 - DNA, 20 bp, mouse
ggcgactggggttgtctctg

SEQ ID NO: 791080 - DNA, 20 bp, mouse
gggggtgctgaggactataa

SEQ ID NO: 791081 - DNA, 20 bp, mouse
ggaccatgacaaggtctcat

SEQ ID NO: 791082 - DNA, 20 bp, mouse
gtgcccgtgtttcagaaacc

SEQ ID NO: 791083 - DNA, 20 bp, mouse
ggaggccatgctgaggctag

SEQ ID NO: 791084 - DNA, 20 bp, mouse
gatcctaaagccacttggaa

SEQ ID NO: 791085 - DNA, 20 bp, mouse
ggggggtccgtatccagctt

SEQ ID NO: 791086 - DNA, 20 bp, mouse
gcctccatggcgccagagtc

SEQ ID NO: 791087 - DNA, 20 bp, mouse
gactgcgccaggccggactc

SEQ ID NO: 791088 - DNA, 20 bp, mouse
gcgacgctcaggcggacaac

SEQ ID NO: 791089 - DNA, 20 bp, mouse
ggaaccaaggcgctaggatg

SEQ ID NO: 791090 - DNA, 20 bp, mouse
gtccggcctggcgcagtcgg

SEQ ID NO: 791091 - DNA, 20 bp, mouse
gtgggcgtttcggagcggga

SEQ ID NO: 791092 - DNA, 20 bp, mouse
gctggcgcagtcggtggcgc

SEQ ID NO: 791093 - DNA, 20 bp, mouse
gaggccggactctggcgcca

SEQ ID NO: 791094 - DNA, 20 bp, mouse
gaacgggaggcgggcgggga

SEQ ID NO: 791095 - DNA, 20 bp, mouse
gtcagagcttgtgggcgttt

SEQ ID NO: 791096 - DNA, 20 bp, mouse
gcgcgcgctcgcgaccgggt

SEQ ID NO: 791097 - DNA, 20 bp, mouse
gccgggtgggacagaagagg

SEQ ID NO: 791098 - DNA, 20 bp, mouse
gccgccccgtggcgtcacaa

SEQ ID NO: 791099 - DNA, 20 bp, mouse
gctgctgcgtgtcccagatt

SEQ ID NO: 791100 - DNA, 20 bp, mouse
ggcgcacgcgcgctcgcgac

SEQ ID NO: 791101 - DNA, 20 bp, mouse
gcctgaaagcgcctccccgt

SEQ ID NO: 791102 - DNA, 20 bp, mouse
gcgcgcgttaggacccagcg

SEQ ID NO: 791103 - DNA, 20 bp, mouse
gcacggggcggggcttcctc

SEQ ID NO: 791104 - DNA, 20 bp, mouse
gccccgtggcgtcacaatgg

SEQ ID NO: 791105 - DNA, 20 bp, mouse
ggtcccgcggctaccccgct

SEQ ID NO: 791106 - DNA, 20 bp, mouse
gcaccgtagcgggccggaga

SEQ ID NO: 791107 - DNA, 20 bp, mouse
ggaggccgggacatggcgag

SEQ ID NO: 791108 - DNA, 20 bp, mouse
ggcagcgcggcccacggctc

SEQ ID NO: 791109 - DNA, 20 bp, mouse
ggcgctccgggacttcggtc

SEQ ID NO: 791110 - DNA, 20 bp, mouse
gggacgcccgaccgaagtcc

SEQ ID NO: 791111 - DNA, 20 bp, mouse
gcggagaggggcgccagagg

SEQ ID NO: 791112 - DNA, 20 bp, mouse
gtgctgggcaccatggagat

SEQ ID NO: 791113 - DNA, 20 bp, mouse
gctgtggccgcgctccagga

SEQ ID NO: 791114 - DNA, 20 bp, mouse
ggcccctctccggcccgcta

SEQ ID NO: 791115 - DNA, 20 bp, mouse
gtggccgtcgcagtacatga

SEQ ID NO: 791116 - DNA, 20 bp, mouse
gggcgcggaacagactaaag

SEQ ID NO: 791117 - DNA, 20 bp, mouse
ggggtagggagcatcttgag

SEQ ID NO: 791118 - DNA, 20 bp, mouse
gtgggcggggcgcacgggcg

SEQ ID NO: 791119 - DNA, 20 bp, mouse
gctaggagcggagcagactg

SEQ ID NO: 791120 - DNA, 20 bp, mouse
gggaacagactaaaggggta

SEQ ID NO: 791121 - DNA, 20 bp, mouse
gggagcggagcagactgggg

SEQ ID NO: 791122 - DNA, 20 bp, mouse
ggactctgggcggggcgcac

SEQ ID NO: 791123 - DNA, 20 bp, mouse
gtccgagcggagcagactct

SEQ ID NO: 791124 - DNA, 20 bp, mouse
gagcgcacccagctcggagt

SEQ ID NO: 791125 - DNA, 20 bp, mouse
gcttgagtggagcagactcg

SEQ ID NO: 791126 - DNA, 20 bp, mouse
ggggaggcgcgtctataagg

SEQ ID NO: 791127 - DNA, 20 bp, mouse
gtccgggaggcgcgtctata

SEQ ID NO: 791128 - DNA, 20 bp, mouse
gcgcccggttccacttctcc

SEQ ID NO: 791129 - DNA, 20 bp, mouse
gtggccaggagaagtggaac

SEQ ID NO: 791130 - DNA, 20 bp, mouse
gtctataaggaggagtgcgg

SEQ ID NO: 791131 - DNA, 20 bp, mouse
gtctcctggccaataggaag

SEQ ID NO: 791132 - DNA, 20 bp, mouse
gaaagtgcggccacacgaac

SEQ ID NO: 791133 - DNA, 20 bp, mouse
ggccctaggccacttcctat

SEQ ID NO: 791134 - DNA, 20 bp, mouse
ggcccaccgcaggttccggg

SEQ ID NO: 791135 - DNA, 20 bp, mouse
gcgaggcccgtctctgcctg

SEQ ID NO: 791136 - DNA, 20 bp, mouse
ggggcaccaccggacagtac

SEQ ID NO: 791137 - DNA, 20 bp, mouse
gtgaccagaaactaccaact

SEQ ID NO: 791138 - DNA, 20 bp, mouse
gtaaccttctaggaacctgt

SEQ ID NO: 791139 - DNA, 20 bp, mouse
gaaagcacgccccacccttg

SEQ ID NO: 791140 - DNA, 20 bp, mouse
gctggcttccacttcccgac

SEQ ID NO: 791141 - DNA, 20 bp, mouse
gccaccggacagtacaggct

SEQ ID NO: 791142 - DNA, 20 bp, mouse
gccggtggtgccccgcccag

SEQ ID NO: 791143 - DNA, 20 bp, mouse
gcagtctctgctacccgagt

SEQ ID NO: 791144 - DNA, 20 bp, mouse
ggaaaccaagcgtcgccacg

SEQ ID NO: 791145 - DNA, 20 bp, mouse
gggtgctgtgagtgataact

SEQ ID NO: 791146 - DNA, 20 bp, mouse
gccccaaagtgttaaaacta

SEQ ID NO: 791147 - DNA, 20 bp, mouse
gagggaatcaagaggctagt

SEQ ID NO: 791148 - DNA, 20 bp, mouse
gactcaaggaggggacagaa

SEQ ID NO: 791149 - DNA, 20 bp, mouse
gggagctgttgggctgggga

SEQ ID NO: 791150 - DNA, 20 bp, mouse
gacaccaagtcggagctgtt

SEQ ID NO: 791151 - DNA, 20 bp, mouse
ggtgctttatagatgtgctt

SEQ ID NO: 791152 - DNA, 20 bp, mouse
gacaagctttgtctctgaag

SEQ ID NO: 791153 - DNA, 20 bp, mouse
gggtctaatgacctgacttt

SEQ ID NO: 791154 - DNA, 20 bp, mouse
gcaccttagtggggatttta

SEQ ID NO: 791155 - DNA, 20 bp, mouse
gaagaggtagacctaggata

SEQ ID NO: 791156 - DNA, 20 bp, mouse
gtcgaggtagagtagaacgt

SEQ ID NO: 791157 - DNA, 20 bp, mouse
gcccaaaggtagaggtggtt

SEQ ID NO: 791158 - DNA, 20 bp, mouse
gccgacaataagttatggac

SEQ ID NO: 791159 - DNA, 20 bp, mouse
gaggtagagtagaacgtggg

SEQ ID NO: 791160 - DNA, 20 bp, mouse
gctgttggcgcaatatcagt

SEQ ID NO: 791161 - DNA, 20 bp, mouse
gggttaggaattggtgatta

SEQ ID NO: 791162 - DNA, 20 bp, mouse
ggaggtacaatggaagttac

SEQ ID NO: 791163 - DNA, 20 bp, mouse
gtattgcgccaacaggtcat

SEQ ID NO: 791164 - DNA, 20 bp, mouse
gcattggtctcgaggtacaa

SEQ ID NO: 791165 - DNA, 20 bp, mouse
gcaacaggtcattggtctcg

SEQ ID NO: 791166 - DNA, 20 bp, mouse
gcagaccagccgcattttta

SEQ ID NO: 791167 - DNA, 20 bp, mouse
gaactgaattcccctgacca

SEQ ID NO: 791168 - DNA, 20 bp, mouse
ggaaggctttccagacttaa

SEQ ID NO: 791169 - DNA, 20 bp, mouse
gaatgcggctggtctgtgcg

SEQ ID NO: 791170 - DNA, 20 bp, mouse
gttgaattgacccttaagtc

SEQ ID NO: 791171 - DNA, 20 bp, mouse
gccctcattccgtaaaaatg

SEQ ID NO: 791172 - DNA, 20 bp, mouse
gggcctctcactcagttgaa

SEQ ID NO: 791173 - DNA, 20 bp, mouse
gggtcaattcaaagacgcca

SEQ ID NO: 791174 - DNA, 20 bp, mouse
gcttagtctgccctggtcag

SEQ ID NO: 791175 - DNA, 20 bp, mouse
gtgaattagaggccaagtct

SEQ ID NO: 791176 - DNA, 20 bp, mouse
gacatgctgcccataagggg

SEQ ID NO: 791177 - DNA, 20 bp, mouse
ggctccacatgctgcccata

SEQ ID NO: 791178 - DNA, 20 bp, mouse
gaaaagcaacctccccttat

SEQ ID NO: 791179 - DNA, 20 bp, mouse
gttccatcctctctgaaagg

SEQ ID NO: 791180 - DNA, 20 bp, mouse
gttcgttgaaagcagaatac

SEQ ID NO: 791181 - DNA, 20 bp, mouse
gttttcaagactgtatctcg

SEQ ID NO: 791182 - DNA, 20 bp, mouse
gcagaagagaatgtgttttc

SEQ ID NO: 791183 - DNA, 20 bp, mouse
gtatctcggggtaacagccc

SEQ ID NO: 791184 - DNA, 20 bp, mouse
gtctcttctgaattttctcc

SEQ ID NO: 791185 - DNA, 20 bp, mouse
gtgtccaggaactgactttt

SEQ ID NO: 791186 - DNA, 20 bp, mouse
ggccaaagttaccatctgat

SEQ ID NO: 791187 - DNA, 20 bp, mouse
gtcctatcagatggtaactt

SEQ ID NO: 791188 - DNA, 20 bp, mouse
gcaaaagatctaatcatact

SEQ ID NO: 791189 - DNA, 20 bp, mouse
gacagagaaagagatgtatt

SEQ ID NO: 791190 - DNA, 20 bp, mouse
gtggaagaataaaaagtccc

SEQ ID NO: 791191 - DNA, 20 bp, mouse
gacaggattgacttggtagt

SEQ ID NO: 791192 - DNA, 20 bp, mouse
ggacttggtagtaggagata

SEQ ID NO: 791193 - DNA, 20 bp, mouse
gaagtatcctggatgggctt

SEQ ID NO: 791194 - DNA, 20 bp, mouse
gtatggtcccaagcccatcc

SEQ ID NO: 791195 - DNA, 20 bp, mouse
gtttgagaagtatcctggat

SEQ ID NO: 791196 - DNA, 20 bp, mouse
gtgggaggactcaatgagga

SEQ ID NO: 791197 - DNA, 20 bp, mouse
gaatgaggagggaagatggt

SEQ ID NO: 791198 - DNA, 20 bp, mouse
gactcaatgaggagggaaga

SEQ ID NO: 791199 - DNA, 20 bp, mouse
ggaggagggaagatggtggg

SEQ ID NO: 791200 - DNA, 20 bp, mouse
gtgggcagattataatgcct

SEQ ID NO: 791201 - DNA, 20 bp, mouse
gtgcctgggaggactcaatg

SEQ ID NO: 791202 - DNA, 20 bp, mouse
gctgttctgatgaagttggg

SEQ ID NO: 791203 - DNA, 20 bp, mouse
ggcagattataatgcctggg

SEQ ID NO: 791204 - DNA, 20 bp, mouse
gacatcatggtttatgtaat

SEQ ID NO: 791205 - DNA, 20 bp, mouse
ggtttatgtaattgggaagg

SEQ ID NO: 791206 - DNA, 20 bp, mouse
gcggaagtgcgagacagata

SEQ ID NO: 791207 - DNA, 20 bp, mouse
ggaacccggaagtgtgggac

SEQ ID NO: 791208 - DNA, 20 bp, mouse
gaatacgcggaccgagccgg

SEQ ID NO: 791209 - DNA, 20 bp, mouse
gaaacggaacccggaagtgt

SEQ ID NO: 791210 - DNA, 20 bp, mouse
gggaagtgtgggaccggata

SEQ ID NO: 791211 - DNA, 20 bp, mouse
gaggacggcttgtggttgac

SEQ ID NO: 791212 - DNA, 20 bp, mouse
gggaagtataaaacggaacc

SEQ ID NO: 791213 - DNA, 20 bp, mouse
gagaaaacgcccagacgtgg

SEQ ID NO: 791214 - DNA, 20 bp, mouse
gacggcttgtggttgacagg

SEQ ID NO: 791215 - DNA, 20 bp, mouse
gccacaagccgtcctctgat

SEQ ID NO: 791216 - DNA, 20 bp, mouse
ggggcccgagcttatttcag

SEQ ID NO: 791217 - DNA, 20 bp, mouse
gggagggagacttacagcgt

SEQ ID NO: 791218 - DNA, 20 bp, mouse
gggcgaaatcccgtgaaagt

SEQ ID NO: 791219 - DNA, 20 bp, mouse
gcaagtggcggcttgtatgg

SEQ ID NO: 791220 - DNA, 20 bp, mouse
gaggctccgcccactttcac

SEQ ID NO: 791221 - DNA, 20 bp, mouse
gaaaaagcgttggaggagtg

SEQ ID NO: 791222 - DNA, 20 bp, mouse
ggagacttacagcgttggcc

SEQ ID NO: 791223 - DNA, 20 bp, mouse
gacttacagcgttggccagg

SEQ ID NO: 791224 - DNA, 20 bp, mouse
gtctagattcaaaaaagcgt

SEQ ID NO: 791225 - DNA, 20 bp, mouse
ggaaatcccgtgaaagtggg

SEQ ID NO: 791226 - DNA, 20 bp, mouse
gtatcaccgtccttatcttc

SEQ ID NO: 791227 - DNA, 20 bp, mouse
gctggtgagctttctaattt

SEQ ID NO: 791228 - DNA, 20 bp, mouse
gaatagtcacagtgaaaatc

SEQ ID NO: 791229 - DNA, 20 bp, mouse
gggtgatatctccaaattca

SEQ ID NO: 791230 - DNA, 20 bp, mouse
gcctcccagcctccaggtta

SEQ ID NO: 791231 - DNA, 20 bp, mouse
gtccaaattcaaggccatct

SEQ ID NO: 791232 - DNA, 20 bp, mouse
gctatggattccagaagata

SEQ ID NO: 791233 - DNA, 20 bp, mouse
gggattccagaagataagga

SEQ ID NO: 791234 - DNA, 20 bp, mouse
gggtataaaagactctgtag

SEQ ID NO: 791235 - DNA, 20 bp, mouse
gaaactgctttccaaggaac

SEQ ID NO: 791236 - DNA, 20 bp, mouse
gcagaggaccgaccaatcac

SEQ ID NO: 791237 - DNA, 20 bp, mouse
gcatcagaccagtgattggt

SEQ ID NO: 791238 - DNA, 20 bp, mouse
ggattggtcggtcctctgcc

SEQ ID NO: 791239 - DNA, 20 bp, mouse
gggcttttggttttagaaac

SEQ ID NO: 791240 - DNA, 20 bp, mouse
gcacttgattctgacacttt

SEQ ID NO: 791241 - DNA, 20 bp, mouse
ggggaatattggatcggaat

SEQ ID NO: 791242 - DNA, 20 bp, mouse
gatggaagatgtgtggaaat

SEQ ID NO: 791243 - DNA, 20 bp, mouse
gcggaatgggcagaatatca

SEQ ID NO: 791244 - DNA, 20 bp, mouse
gtaggactcacagggaatat

SEQ ID NO: 791245 - DNA, 20 bp, mouse
ggaggaccttgaaggaatgg

SEQ ID NO: 791246 - DNA, 20 bp, mouse
gtccttccaacacccttata

SEQ ID NO: 791247 - DNA, 20 bp, mouse
gctgctccatataagggtgt

SEQ ID NO: 791248 - DNA, 20 bp, mouse
gtccatataagggtgttgga

SEQ ID NO: 791249 - DNA, 20 bp, mouse
ggataaggacagggagttca

SEQ ID NO: 791250 - DNA, 20 bp, mouse
ggattccagaagataaggac

SEQ ID NO: 791251 - DNA, 20 bp, mouse
gactccctgtccttatcttc

SEQ ID NO: 791252 - DNA, 20 bp, mouse
gacaccttctgctccatata

SEQ ID NO: 791253 - DNA, 20 bp, mouse
gcaaagaaatacaaagtcac

SEQ ID NO: 791254 - DNA, 20 bp, mouse
gcagggagttcaaggccatc

SEQ ID NO: 791255 - DNA, 20 bp, mouse
gcctcccagcctccaggtta

SEQ ID NO: 791256 - DNA, 20 bp, mouse
gcaggcagaggaccaatcac

SEQ ID NO: 791257 - DNA, 20 bp, mouse
ggattctgacacttttgttt

SEQ ID NO: 791258 - DNA, 20 bp, mouse
gtctgaattcgagaccatcc

SEQ ID NO: 791259 - DNA, 20 bp, mouse
gacacttttgttttggtttt

SEQ ID NO: 791260 - DNA, 20 bp, mouse
ggggaatattggatcggaat

SEQ ID NO: 791261 - DNA, 20 bp, mouse
gatggaagatgtgtggaaat

SEQ ID NO: 791262 - DNA, 20 bp, mouse
gcggaatgggcagaatatca

SEQ ID NO: 791263 - DNA, 20 bp, mouse
gtaggactcacagggaatat

SEQ ID NO: 791264 - DNA, 20 bp, mouse
ggaggaccttgaaggaatgg

SEQ ID NO: 791265 - DNA, 20 bp, mouse
gctgcctggtttatgtattt

SEQ ID NO: 791266 - DNA, 20 bp, mouse
gaatgcaccagactgagaag

SEQ ID NO: 791267 - DNA, 20 bp, mouse
gtctgagctatggtaggaat

SEQ ID NO: 791268 - DNA, 20 bp, mouse
gctgagaggatgcagactgt

SEQ ID NO: 791269 - DNA, 20 bp, mouse
gatcagtgctgtgatggtag

SEQ ID NO: 791270 - DNA, 20 bp, mouse
gctgaccctgcctggaacat

SEQ ID NO: 791271 - DNA, 20 bp, mouse
gggaattggatgtgtgtatt

SEQ ID NO: 791272 - DNA, 20 bp, mouse
ggaaaacacaaagacttctc

SEQ ID NO: 791273 - DNA, 20 bp, mouse
ggaaagagcacactttggag

SEQ ID NO: 791274 - DNA, 20 bp, mouse
gggtgcattcatctgagcta

SEQ ID NO: 791275 - DNA, 20 bp, mouse
gtgaacatttatcatcaagt

SEQ ID NO: 791276 - DNA, 20 bp, mouse
gccaccttgatatacagagt

SEQ ID NO: 791277 - DNA, 20 bp, mouse
gagtcccactctgtatatca

SEQ ID NO: 791278 - DNA, 20 bp, mouse
gttctgggtttactaggtga

SEQ ID NO: 791279 - DNA, 20 bp, mouse
gcaaaaattgacttgtgtgc

SEQ ID NO: 791280 - DNA, 20 bp, mouse
gttgactactgatcttttct

SEQ ID NO: 791281 - DNA, 20 bp, mouse
gacaagaacaaaaacatagg

SEQ ID NO: 791282 - DNA, 20 bp, mouse
gctccaggaaggaaattctg

SEQ ID NO: 791283 - DNA, 20 bp, mouse
gattctgaggggagtttgag

SEQ ID NO: 791284 - DNA, 20 bp, mouse
gtaggtgaaggttttgagac

SEQ ID NO: 791285 - DNA, 20 bp, mouse
gcccctcagaatttccttcc

SEQ ID NO: 791286 - DNA, 20 bp, mouse
ggcaaaagttggaactggat

SEQ ID NO: 791287 - DNA, 20 bp, mouse
ggtcaccatggtagccatgt

SEQ ID NO: 791288 - DNA, 20 bp, mouse
gaaacaggaatggttgagag

SEQ ID NO: 791289 - DNA, 20 bp, mouse
ggacagatgcctactatgag

SEQ ID NO: 791290 - DNA, 20 bp, mouse
gtacacatgctgcatgtatg

SEQ ID NO: 791291 - DNA, 20 bp, mouse
gagcaaatagtgagtgaaat

SEQ ID NO: 791292 - DNA, 20 bp, mouse
ggtctccaacatggctacca

SEQ ID NO: 791293 - DNA, 20 bp, mouse
ggaatagcaaaagttggaac

SEQ ID NO: 791294 - DNA, 20 bp, mouse
gtctgaatcccaaattcctt

SEQ ID NO: 791295 - DNA, 20 bp, mouse
gggctctgattacttcctcc

SEQ ID NO: 791296 - DNA, 20 bp, mouse
ggggagatcaaaagtctcct

SEQ ID NO: 791297 - DNA, 20 bp, mouse
gggaagtctagtgctaaagt

SEQ ID NO: 791298 - DNA, 20 bp, mouse
ggtctggagtatagcataga

SEQ ID NO: 791299 - DNA, 20 bp, mouse
gagtgggcaggtcttagaac

SEQ ID NO: 791300 - DNA, 20 bp, mouse
gggtcttagaactggcaggt

SEQ ID NO: 791301 - DNA, 20 bp, mouse
ggagggctgaggcataacag

SEQ ID NO: 791302 - DNA, 20 bp, mouse
gtggtcagacacacccatgt

SEQ ID NO: 791303 - DNA, 20 bp, mouse
gtctgctcacgctacatggt

SEQ ID NO: 791304 - DNA, 20 bp, mouse
gtgcctatctatgcaggaga

SEQ ID NO: 791305 - DNA, 20 bp, mouse
ggagttagttagtggtgctg

SEQ ID NO: 791306 - DNA, 20 bp, mouse
gagggcattggggagagtat

SEQ ID NO: 791307 - DNA, 20 bp, mouse
gcccagtagagaggaaaacc

SEQ ID NO: 791308 - DNA, 20 bp, mouse
gtcctggttttcctctctac

SEQ ID NO: 791309 - DNA, 20 bp, mouse
gaagaaatgggagtgtttgt

SEQ ID NO: 791310 - DNA, 20 bp, mouse
gacctattggtgggatcaca

SEQ ID NO: 791311 - DNA, 20 bp, mouse
gtgggatcacagggacccag

SEQ ID NO: 791312 - DNA, 20 bp, mouse
gtccctgtgatcccaccaat

SEQ ID NO: 791313 - DNA, 20 bp, mouse
gggtagggaagtagggcatt

SEQ ID NO: 791314 - DNA, 20 bp, mouse
ggagagtataggggtttttc

SEQ ID NO: 791315 - DNA, 20 bp, mouse
gagcctagcaggatgcagta

SEQ ID NO: 791316 - DNA, 20 bp, mouse
ggggtccaacggctcgagag

SEQ ID NO: 791317 - DNA, 20 bp, mouse
gcagagaccgcctagggcgt

SEQ ID NO: 791318 - DNA, 20 bp, mouse
ggtcccgcccctcctgcgaa

SEQ ID NO: 791319 - DNA, 20 bp, mouse
ggcacctatgcccgcctcaa

SEQ ID NO: 791320 - DNA, 20 bp, mouse
ggcgtgggaagcgcttgcac

SEQ ID NO: 791321 - DNA, 20 bp, mouse
gcaagcgcttcccacgccct

SEQ ID NO: 791322 - DNA, 20 bp, mouse
gcctatgcccgcctcaaggg

SEQ ID NO: 791323 - DNA, 20 bp, mouse
ggggatacagagaccgccta

SEQ ID NO: 791324 - DNA, 20 bp, mouse
gccaacggcagcaactcagt

SEQ ID NO: 791325 - DNA, 20 bp, mouse
gaggaggggcgggacgaggg

SEQ ID NO: 791326 - DNA, 20 bp, mouse
gagtctaaaggtggcgtaaa

SEQ ID NO: 791327 - DNA, 20 bp, mouse
gggcgggaattgcagtctaa

SEQ ID NO: 791328 - DNA, 20 bp, mouse
gagttcccggaggtagagaa

SEQ ID NO: 791329 - DNA, 20 bp, mouse
ggctaccgcgctgatccatg

SEQ ID NO: 791330 - DNA, 20 bp, mouse
gagtctgtgaggtgagtagt

SEQ ID NO: 791331 - DNA, 20 bp, mouse
gctctgatgcagtgattcct

SEQ ID NO: 791332 - DNA, 20 bp, mouse
gaactcagtgcaaagcatgg

SEQ ID NO: 791333 - DNA, 20 bp, mouse
gctttgcactgagttcccgg

SEQ ID NO: 791334 - DNA, 20 bp, mouse
gatggggcttgtagtaacat

SEQ ID NO: 791335 - DNA, 20 bp, mouse
gcagagcagctaaggattat

SEQ ID NO: 791336 - DNA, 20 bp, mouse
ggggagccatagataaggat

SEQ ID NO: 791337 - DNA, 20 bp, mouse
gtagagtgtgacctcagtgg

SEQ ID NO: 791338 - DNA, 20 bp, mouse
gacgtagagtgtgacctcag

SEQ ID NO: 791339 - DNA, 20 bp, mouse
gataacctagggtagcgata

SEQ ID NO: 791340 - DNA, 20 bp, mouse
gtagggtagcgatagggctt

SEQ ID NO: 791341 - DNA, 20 bp, mouse
ggagagctggggtgttacgt

SEQ ID NO: 791342 - DNA, 20 bp, mouse
gtggcgagtggcaagtgtgg

SEQ ID NO: 791343 - DNA, 20 bp, mouse
gtgtggaggcaacgcctttg

SEQ ID NO: 791344 - DNA, 20 bp, mouse
gggggatatggcataaccta

SEQ ID NO: 791345 - DNA, 20 bp, mouse
gccgccccgtgccattataa

SEQ ID NO: 791346 - DNA, 20 bp, mouse
gccgtgcagcgtggggttca

SEQ ID NO: 791347 - DNA, 20 bp, mouse
gcagcccagccgtgcagcgt

SEQ ID NO: 791348 - DNA, 20 bp, mouse
ggccgcgggtcgcagtcggt

SEQ ID NO: 791349 - DNA, 20 bp, mouse
ggcgggtcgcagtcggtggg

SEQ ID NO: 791350 - DNA, 20 bp, mouse
gaaccccacgctgcacggct

SEQ ID NO: 791351 - DNA, 20 bp, mouse
gcaaacagaggaagctgccg

SEQ ID NO: 791352 - DNA, 20 bp, mouse
ggtagtgtgggtaaacatgg

SEQ ID NO: 791353 - DNA, 20 bp, mouse
ggagggcaagcgcctgcaaa

SEQ ID NO: 791354 - DNA, 20 bp, mouse
gtgcggccacgcccccatcg

SEQ ID NO: 791355 - DNA, 20 bp, mouse
gggtaaagaagtctgcggca

SEQ ID NO: 791356 - DNA, 20 bp, mouse
gcctgcctgtggggaatctg

SEQ ID NO: 791357 - DNA, 20 bp, mouse
gtggaaataaagaacgcaag

SEQ ID NO: 791358 - DNA, 20 bp, mouse
gaaagaacgcaaggggggtg

SEQ ID NO: 791359 - DNA, 20 bp, mouse
gataagaatttgcacaacta

SEQ ID NO: 791360 - DNA, 20 bp, mouse
gactatggagcagaaaagac

SEQ ID NO: 791361 - DNA, 20 bp, mouse
ggatcaggggccctgcctgt

SEQ ID NO: 791362 - DNA, 20 bp, mouse
gcataccaaagctttaaaat

SEQ ID NO: 791363 - DNA, 20 bp, mouse
gctgtggggaatctgtggtc

SEQ ID NO: 791364 - DNA, 20 bp, mouse
ggtcccccattttaaagctt

SEQ ID NO: 791365 - DNA, 20 bp, mouse
gttagctttctcctttttag

SEQ ID NO: 791366 - DNA, 20 bp, mouse
gccaggaggcaccctcggat

SEQ ID NO: 791367 - DNA, 20 bp, mouse
gggggagggcgacgctgcgg

SEQ ID NO: 791368 - DNA, 20 bp, mouse
gcacggggagggcgacgctg

SEQ ID NO: 791369 - DNA, 20 bp, mouse
gtccccgccgcgcgccccac

SEQ ID NO: 791370 - DNA, 20 bp, mouse
gcaacccaataaatagtcag

SEQ ID NO: 791371 - DNA, 20 bp, mouse
ggacccccagaaagtatccc

SEQ ID NO: 791372 - DNA, 20 bp, mouse
ggtgcctgggatactttctg

SEQ ID NO: 791373 - DNA, 20 bp, mouse
ggacgcgcgagctcccgcgc

SEQ ID NO: 791374 - DNA, 20 bp, mouse
gtgcccggcttcgacgttgt

SEQ ID NO: 791375 - DNA, 20 bp, mouse
gccggaagaggaccctgtaa

SEQ ID NO: 791376 - DNA, 20 bp, mouse
gcctgcctggagcttcccac

SEQ ID NO: 791377 - DNA, 20 bp, mouse
gagcttcccacggggagaag

SEQ ID NO: 791378 - DNA, 20 bp, mouse
gccgacagcgcgaggggcgg

SEQ ID NO: 791379 - DNA, 20 bp, mouse
ggggacgggtgttgaagtag

SEQ ID NO: 791380 - DNA, 20 bp, mouse
gtctccccgtgggaagctcc

SEQ ID NO: 791381 - DNA, 20 bp, mouse
gcccctcgcgctgtcggtga

SEQ ID NO: 791382 - DNA, 20 bp, mouse
gtgtacccggccaggctcga

SEQ ID NO: 791383 - DNA, 20 bp, mouse
ggggagggaggctcaactcg

SEQ ID NO: 791384 - DNA, 20 bp, mouse
ggcggcccggagcgaggaag

SEQ ID NO: 791385 - DNA, 20 bp, mouse
ggctaaggggaggacggtcc

SEQ ID NO: 791386 - DNA, 20 bp, mouse
gccgagagggtcacatggag

SEQ ID NO: 791387 - DNA, 20 bp, mouse
gcataatcgaggcctctgaa

SEQ ID NO: 791388 - DNA, 20 bp, mouse
gcagaggcctcgattatgca

SEQ ID NO: 791389 - DNA, 20 bp, mouse
gaaaggcgctggtgaatcaa

SEQ ID NO: 791390 - DNA, 20 bp, mouse
gtcagccccctgcataatcg

SEQ ID NO: 791391 - DNA, 20 bp, mouse
gtctgtccgcggagtgacgt

SEQ ID NO: 791392 - DNA, 20 bp, mouse
gccatgtgaccctctcgggt

SEQ ID NO: 791393 - DNA, 20 bp, mouse
gtgcagagtcccacccgaga

SEQ ID NO: 791394 - DNA, 20 bp, mouse
gaagacgcacgtcggggtgc

SEQ ID NO: 791395 - DNA, 20 bp, mouse
gggctagcacacaatggtcc

SEQ ID NO: 791396 - DNA, 20 bp, mouse
gatgggcaatcgcacttcac

SEQ ID NO: 791397 - DNA, 20 bp, mouse
gaggttaagtgggtgatctc

SEQ ID NO: 791398 - DNA, 20 bp, mouse
gaacggtcaagagaactgtt

SEQ ID NO: 791399 - DNA, 20 bp, mouse
ggggcggggagaagactatc

SEQ ID NO: 791400 - DNA, 20 bp, mouse
gaacacctgcctgtgcaaga

SEQ ID NO: 791401 - DNA, 20 bp, mouse
gtgggtgatctctggggacc

SEQ ID NO: 791402 - DNA, 20 bp, mouse
gagttctcttgaccgttccc

SEQ ID NO: 791403 - DNA, 20 bp, mouse
gagcgcttggattcctcccc

SEQ ID NO: 791404 - DNA, 20 bp, mouse
gccccgcccaccacactcat

SEQ ID NO: 791405 - DNA, 20 bp, mouse
gacgtcaggaaatcatagtg

SEQ ID NO: 791406 - DNA, 20 bp, mouse
gataaagaactgcgtgttgt

SEQ ID NO: 791407 - DNA, 20 bp, mouse
ggcgtgattgaggaacccat

SEQ ID NO: 791408 - DNA, 20 bp, mouse
ggctgtgttaacagggagtc

SEQ ID NO: 791409 - DNA, 20 bp, mouse
gtggttgcagatatggagga

SEQ ID NO: 791410 - DNA, 20 bp, mouse
gggaatgtgcagagcggggt

SEQ ID NO: 791411 - DNA, 20 bp, mouse
ggagccctgggcccgcccgt

SEQ ID NO: 791412 - DNA, 20 bp, mouse
gacccgctccccattcagga

SEQ ID NO: 791413 - DNA, 20 bp, mouse
gaacttcgggctgtgttaac

SEQ ID NO: 791414 - DNA, 20 bp, mouse
ggtggggcagcggcgagcat

SEQ ID NO: 791415 - DNA, 20 bp, mouse
gacctggagctgggaacttc

SEQ ID NO: 791416 - DNA, 20 bp, mouse
gcggcggcggcgcgacgaag

SEQ ID NO: 791417 - DNA, 20 bp, mouse
gtccgagctgcgctgaaaag

SEQ ID NO: 791418 - DNA, 20 bp, mouse
ggcctcggcgcgggattggg

SEQ ID NO: 791419 - DNA, 20 bp, mouse
ggagctgcgctgaaaagggg

SEQ ID NO: 791420 - DNA, 20 bp, mouse
gccgcccggggcccgcaccc

SEQ ID NO: 791421 - DNA, 20 bp, mouse
gaccatgcgatccaaggcga

SEQ ID NO: 791422 - DNA, 20 bp, mouse
ggccgcctcggcgcgggatt

SEQ ID NO: 791423 - DNA, 20 bp, mouse
gacgcggcgcggtcgagcgc

SEQ ID NO: 791424 - DNA, 20 bp, mouse
ggggctctccgaggccttct

SEQ ID NO: 791425 - DNA, 20 bp, mouse
ggccttggatcgcatggtgt

SEQ ID NO: 791426 - DNA, 20 bp, mouse
gcgacggtcaggcgtgaccc

SEQ ID NO: 791427 - DNA, 20 bp, mouse
gcggtcaggcgtgaccccgg

SEQ ID NO: 791428 - DNA, 20 bp, mouse
gccaccacgccagtcagtcg

SEQ ID NO: 791429 - DNA, 20 bp, mouse
gtcgccctctctgtcaatca

SEQ ID NO: 791430 - DNA, 20 bp, mouse
gagggcgacacagtccgccg

SEQ ID NO: 791431 - DNA, 20 bp, mouse
ggagtccgtgattgacagag

SEQ ID NO: 791432 - DNA, 20 bp, mouse
gcctgaccactatagagtta

SEQ ID NO: 791433 - DNA, 20 bp, mouse
gcccgaggagctcaacacga

SEQ ID NO: 791434 - DNA, 20 bp, mouse
gtacgcgcggggtcggggtc

SEQ ID NO: 791435 - DNA, 20 bp, mouse
gaataacgctctggggcgag

SEQ ID NO: 791436 - DNA, 20 bp, mouse
gtgggtgccgatccaatcga

SEQ ID NO: 791437 - DNA, 20 bp, mouse
gagggggcggtgcgtatccc

SEQ ID NO: 791438 - DNA, 20 bp, mouse
gtatccccggaagagcgggt

SEQ ID NO: 791439 - DNA, 20 bp, mouse
gtggctgggaagccggaaac

SEQ ID NO: 791440 - DNA, 20 bp, mouse
gtgagctgcaacactctggg

SEQ ID NO: 791441 - DNA, 20 bp, mouse
ggtgtggcccaggagtaatc

SEQ ID NO: 791442 - DNA, 20 bp, mouse
gaccgcagagccccgggagt

SEQ ID NO: 791443 - DNA, 20 bp, mouse
gagaactgatacacgtgcta

SEQ ID NO: 791444 - DNA, 20 bp, mouse
ggtgcgtatccccggaagag

SEQ ID NO: 791445 - DNA, 20 bp, mouse
gtggagaaccgcagagcccc

SEQ ID NO: 791446 - DNA, 20 bp, mouse
gaacgcagagatggtgagga

SEQ ID NO: 791447 - DNA, 20 bp, mouse
gggcccaaagtttgtggcgc

SEQ ID NO: 791448 - DNA, 20 bp, mouse
gagccggcgccacaaacttt

SEQ ID NO: 791449 - DNA, 20 bp, mouse
ggtggggagcccaggccacc

SEQ ID NO: 791450 - DNA, 20 bp, mouse
ggccgaacgcagagatggtg

SEQ ID NO: 791451 - DNA, 20 bp, mouse
gagcttccagctccgagatg

SEQ ID NO: 791452 - DNA, 20 bp, mouse
gcctgggctccccaccgctc

SEQ ID NO: 791453 - DNA, 20 bp, mouse
gtgggccaatcagcgcggcc

SEQ ID NO: 791454 - DNA, 20 bp, mouse
gcctctgccgaacgcagaga

SEQ ID NO: 791455 - DNA, 20 bp, mouse
ggctccggccgcgcctgccc

SEQ ID NO: 791456 - DNA, 20 bp, mouse
ggactgagagcaaccggcgg

SEQ ID NO: 791457 - DNA, 20 bp, mouse
gccaggctgcggggtctcta

SEQ ID NO: 791458 - DNA, 20 bp, mouse
ggtacggtggggctggaccg

SEQ ID NO: 791459 - DNA, 20 bp, mouse
gggtctggggcaaggggcgg

SEQ ID NO: 791460 - DNA, 20 bp, mouse
gtaaggctctccgtgccctc

SEQ ID NO: 791461 - DNA, 20 bp, mouse
ggtccagccccaccgtacct

SEQ ID NO: 791462 - DNA, 20 bp, mouse
ggcgctgcgccacttcgcct

SEQ ID NO: 791463 - DNA, 20 bp, mouse
gtcagtccccaggtacggtg

SEQ ID NO: 791464 - DNA, 20 bp, mouse
ggggagctgggttcgctcgc

SEQ ID NO: 791465 - DNA, 20 bp, mouse
ggggctaacgttcctgtgtg

SEQ ID NO: 791466 - DNA, 20 bp, mouse
gaggctatgccacttcggga

SEQ ID NO: 791467 - DNA, 20 bp, mouse
gaccggcaagagttaaaggg

SEQ ID NO: 791468 - DNA, 20 bp, mouse
gccacttcgggaaggagctt

SEQ ID NO: 791469 - DNA, 20 bp, mouse
gcgggcagtccagaaaaacc

SEQ ID NO: 791470 - DNA, 20 bp, mouse
gggccaggatgctctcgggg

SEQ ID NO: 791471 - DNA, 20 bp, mouse
ggcaggccaggatgctctcg

SEQ ID NO: 791472 - DNA, 20 bp, mouse
gagttaaagggaggggacgt

SEQ ID NO: 791473 - DNA, 20 bp, mouse
gccaacccaggtgtcccaga

SEQ ID NO: 791474 - DNA, 20 bp, mouse
gccagaccggcaagagttaa

SEQ ID NO: 791475 - DNA, 20 bp, mouse
gtgggctgtcacgcgtcatt

SEQ ID NO: 791476 - DNA, 20 bp, mouse
gggcctggcaatcccagcga

SEQ ID NO: 791477 - DNA, 20 bp, mouse
gccaggcccctgcacgaatc

SEQ ID NO: 791478 - DNA, 20 bp, mouse
gtggcaatcccagcgagggg

SEQ ID NO: 791479 - DNA, 20 bp, mouse
gcgggaacaagaaaagcgga

SEQ ID NO: 791480 - DNA, 20 bp, mouse
gagggtgcaattcctgcccg

SEQ ID NO: 791481 - DNA, 20 bp, mouse
ggaacaagaaaagcggaggg

SEQ ID NO: 791482 - DNA, 20 bp, mouse
gcagcctcggaactcctcag

SEQ ID NO: 791483 - DNA, 20 bp, mouse
gccctgcacgaatcaggtag

SEQ ID NO: 791484 - DNA, 20 bp, mouse
ggaattgcaccctgactgac

SEQ ID NO: 791485 - DNA, 20 bp, mouse
gaggctgcccctcccctcgc

SEQ ID NO: 791486 - DNA, 20 bp, mouse
gcaccctggccggcctacgg

SEQ ID NO: 791487 - DNA, 20 bp, mouse
gtccactccaggcccatcca

SEQ ID NO: 791488 - DNA, 20 bp, mouse
ggggagaaggaaccagtgat

SEQ ID NO: 791489 - DNA, 20 bp, mouse
ggagtggagggggtctccag

SEQ ID NO: 791490 - DNA, 20 bp, mouse
gtccctggatgggcctggag

SEQ ID NO: 791491 - DNA, 20 bp, mouse
gactcagcgctttccctgga

SEQ ID NO: 791492 - DNA, 20 bp, mouse
ggctcgtcccgggcgatcac

SEQ ID NO: 791493 - DNA, 20 bp, mouse
gtcagtgatgctgttcccag

SEQ ID NO: 791494 - DNA, 20 bp, mouse
ggggaccggccagagggaga

SEQ ID NO: 791495 - DNA, 20 bp, mouse
gatcccccgtaggccggcca

SEQ ID NO: 791496 - DNA, 20 bp, mouse
gccacggggcgcgttggggt

SEQ ID NO: 791497 - DNA, 20 bp, mouse
gggtccacacgctttcacaa

SEQ ID NO: 791498 - DNA, 20 bp, mouse
gtgggtggggtgtgcccttt

SEQ ID NO: 791499 - DNA, 20 bp, mouse
gacccccccggcagccgcaa

SEQ ID NO: 791500 - DNA, 20 bp, mouse
gttggggtcggttggaatcc

SEQ ID NO: 791501 - DNA, 20 bp, mouse
gtcggccacggggcgcgttg

SEQ ID NO: 791502 - DNA, 20 bp, mouse
ggccgcggtcggatccattg

SEQ ID NO: 791503 - DNA, 20 bp, mouse
gcaacggagccaagtggctc

SEQ ID NO: 791504 - DNA, 20 bp, mouse
gacaatcttggcgtccgaaa

SEQ ID NO: 791505 - DNA, 20 bp, mouse
gaccgtgcgggccaaagtat

SEQ ID NO: 791506 - DNA, 20 bp, mouse
ggctggaaggagtggttcta

SEQ ID NO: 791507 - DNA, 20 bp, mouse
gggggcttacgaggagtggg

SEQ ID NO: 791508 - DNA, 20 bp, mouse
gctgaggccccgccctcata

SEQ ID NO: 791509 - DNA, 20 bp, mouse
gcaggtattcaggaggtcaa

SEQ ID NO: 791510 - DNA, 20 bp, mouse
gggcggggcttacgaggagt

SEQ ID NO: 791511 - DNA, 20 bp, mouse
ggctccgggcttccctatga

SEQ ID NO: 791512 - DNA, 20 bp, mouse
gtatgcaaagaggctggacc

SEQ ID NO: 791513 - DNA, 20 bp, mouse
gaagcacacccggcgtgctc

SEQ ID NO: 791514 - DNA, 20 bp, mouse
gcgtaagccccgcctcgctg

SEQ ID NO: 791515 - DNA, 20 bp, mouse
gaataggaatccaagcattc

SEQ ID NO: 791516 - DNA, 20 bp, mouse
gcaggcgcagaagcccactg

SEQ ID NO: 791517 - DNA, 20 bp, mouse
gaagctccgccccccccagt

SEQ ID NO: 791518 - DNA, 20 bp, mouse
gacagggacagtcagtgctc

SEQ ID NO: 791519 - DNA, 20 bp, mouse
gttgcgcccacgtggcggag

SEQ ID NO: 791520 - DNA, 20 bp, mouse
gggaagctctgttacagaga

SEQ ID NO: 791521 - DNA, 20 bp, mouse
ggctctggagatcagtcact

SEQ ID NO: 791522 - DNA, 20 bp, mouse
gtaacaaaagaagtttgcac

SEQ ID NO: 791523 - DNA, 20 bp, mouse
gtgactgtccctgtccttga

SEQ ID NO: 791524 - DNA, 20 bp, mouse
ggttagtgtgaacttgtgag

SEQ ID NO: 791525 - DNA, 20 bp, mouse
gcttgtgaggggatgatgtg

SEQ ID NO: 791526 - DNA, 20 bp, mouse
gcgacgcggcggggctctca

SEQ ID NO: 791527 - DNA, 20 bp, mouse
gtagccgcaaacagaggtcg

SEQ ID NO: 791528 - DNA, 20 bp, mouse
gcccctctaagccggcgctg

SEQ ID NO: 791529 - DNA, 20 bp, mouse
gacagaggtcggggatgatc

SEQ ID NO: 791530 - DNA, 20 bp, mouse
ggggtcacgaactgtcacgt

SEQ ID NO: 791531 - DNA, 20 bp, mouse
ggacgcactacgacgcggcg

SEQ ID NO: 791532 - DNA, 20 bp, mouse
gcatccccgacctctgtttg

SEQ ID NO: 791533 - DNA, 20 bp, mouse
gggcgctgtggctgcgacgt

SEQ ID NO: 791534 - DNA, 20 bp, mouse
ggccacagcgccggcttaga

SEQ ID NO: 791535 - DNA, 20 bp, mouse
gggtccggcgaagagttcaa

SEQ ID NO: 791536 - DNA, 20 bp, mouse
gttgcaggcaagggagattc

SEQ ID NO: 791537 - DNA, 20 bp, mouse
gaaggccacgtgcaatagga

SEQ ID NO: 791538 - DNA, 20 bp, mouse
gcggagacctagatcagtgc

SEQ ID NO: 791539 - DNA, 20 bp, mouse
gggggcgaccgcgagtctgg

SEQ ID NO: 791540 - DNA, 20 bp, mouse
ggagattctggagctaaaga

SEQ ID NO: 791541 - DNA, 20 bp, mouse
gcacgtggagcttgcaggca

SEQ ID NO: 791542 - DNA, 20 bp, mouse
gaccgcgagtctggcggctg

SEQ ID NO: 791543 - DNA, 20 bp, mouse
gactatgagcatctagtagt

SEQ ID NO: 791544 - DNA, 20 bp, mouse
gggtggggcgaccgcgagtc

SEQ ID NO: 791545 - DNA, 20 bp, mouse
gagcgcaagaccgagaattg

SEQ ID NO: 791546 - DNA, 20 bp, mouse
gaaggatggggaacaactaa

SEQ ID NO: 791547 - DNA, 20 bp, mouse
gagtcagtgtggacatgtct

SEQ ID NO: 791548 - DNA, 20 bp, mouse
gatgtcttggaaatatagat

SEQ ID NO: 791549 - DNA, 20 bp, mouse
ggagttacagaccgttgggg

SEQ ID NO: 791550 - DNA, 20 bp, mouse
gaaagtgaggccatagggca

SEQ ID NO: 791551 - DNA, 20 bp, mouse
gtccaagacatcaaggttcg

SEQ ID NO: 791552 - DNA, 20 bp, mouse
gcttggaaatatagatgggg

SEQ ID NO: 791553 - DNA, 20 bp, mouse
ggagctgtgaacttccaact

SEQ ID NO: 791554 - DNA, 20 bp, mouse
gtggtcttgaaaatctgacc

SEQ ID NO: 791555 - DNA, 20 bp, mouse
gcatgtatgtctgcaacaca

SEQ ID NO: 791556 - DNA, 20 bp, mouse
gctagcgggacgcgctgtca

SEQ ID NO: 791557 - DNA, 20 bp, mouse
ggcagcttcatcgtcattcg

SEQ ID NO: 791558 - DNA, 20 bp, mouse
gcgtcccgctagtgctgacg

SEQ ID NO: 791559 - DNA, 20 bp, mouse
gggaaccctggcgtcggatc

SEQ ID NO: 791560 - DNA, 20 bp, mouse
gggacccggatccgacgcca

SEQ ID NO: 791561 - DNA, 20 bp, mouse
gtgtcacggaaccctggcgt

SEQ ID NO: 791562 - DNA, 20 bp, mouse
gacgcgctgtcacggaaccc

SEQ ID NO: 791563 - DNA, 20 bp, mouse
gaatccgcgtcagcactagc

SEQ ID NO: 791564 - DNA, 20 bp, mouse
gaacgcctgcaagacccagt

SEQ ID NO: 791565 - DNA, 20 bp, mouse
gggaggatgctctcaaagtg

SEQ ID NO: 791566 - DNA, 20 bp, mouse
gtgagcaccgcagggctctg

SEQ ID NO: 791567 - DNA, 20 bp, mouse
gcgcgcgggtgagcaccgca

SEQ ID NO: 791568 - DNA, 20 bp, mouse
gaactccaaacagcacctct

SEQ ID NO: 791569 - DNA, 20 bp, mouse
ggggttaccgactgaatctg

SEQ ID NO: 791570 - DNA, 20 bp, mouse
ggaccgggcgtcccgcctct

SEQ ID NO: 791571 - DNA, 20 bp, mouse
gcccttggggttggggtctg

SEQ ID NO: 791572 - DNA, 20 bp, mouse
ggccgcgcggaccctgaagt

SEQ ID NO: 791573 - DNA, 20 bp, mouse
ggggccgcctcacccacttc

SEQ ID NO: 791574 - DNA, 20 bp, mouse
gccgaagctccgctgcgccg

SEQ ID NO: 791575 - DNA, 20 bp, mouse
ggaccctgaagtgggtgagg

SEQ ID NO: 791576 - DNA, 20 bp, mouse
gaggcccagccctacgtctc

SEQ ID NO: 791577 - DNA, 20 bp, mouse
ggttgcagggtgtaactggg

SEQ ID NO: 791578 - DNA, 20 bp, mouse
gtacgcccacgtcccctccc

SEQ ID NO: 791579 - DNA, 20 bp, mouse
gacacgctttcaagctgctg

SEQ ID NO: 791580 - DNA, 20 bp, mouse
ggagacaaggcactatctgc

SEQ ID NO: 791581 - DNA, 20 bp, mouse
gacctatagccttgtctcgg

SEQ ID NO: 791582 - DNA, 20 bp, mouse
gtccctggtgagcgctttat

SEQ ID NO: 791583 - DNA, 20 bp, mouse
gctatctgcaggcgtggcca

SEQ ID NO: 791584 - DNA, 20 bp, mouse
gttataggacgtaagtgaaa

SEQ ID NO: 791585 - DNA, 20 bp, mouse
gtgaacgcccctttggccga

SEQ ID NO: 791586 - DNA, 20 bp, mouse
gcgggcatcgggtgtggatg

SEQ ID NO: 791587 - DNA, 20 bp, mouse
gcacacccgatgcccgctaa

SEQ ID NO: 791588 - DNA, 20 bp, mouse
ggggcagatcagagggggga

SEQ ID NO: 791589 - DNA, 20 bp, mouse
ggctgctgctgctctggaga

SEQ ID NO: 791590 - DNA, 20 bp, mouse
ggggaggggcagatcagagg

SEQ ID NO: 791591 - DNA, 20 bp, mouse
ggggtggggaggttagtttg

SEQ ID NO: 791592 - DNA, 20 bp, mouse
gtgagccgttagcgggcatc

SEQ ID NO: 791593 - DNA, 20 bp, mouse
gtgcagtgggctgatataag

SEQ ID NO: 791594 - DNA, 20 bp, mouse
gcagcccagaagcttgctaa

SEQ ID NO: 791595 - DNA, 20 bp, mouse
gctaacctccccaccccaat

SEQ ID NO: 791596 - DNA, 20 bp, mouse
gggcccaagcggcgacaaga

SEQ ID NO: 791597 - DNA, 20 bp, mouse
ggggcccgcccgccggggag

SEQ ID NO: 791598 - DNA, 20 bp, mouse
gtgcacgggcggactcacgg

SEQ ID NO: 791599 - DNA, 20 bp, mouse
gaaggccgggagcccctccc

SEQ ID NO: 791600 - DNA, 20 bp, mouse
gggaaagccggcctaggtca

SEQ ID NO: 791601 - DNA, 20 bp, mouse
gaggggaggcggcgtagcgc

SEQ ID NO: 791602 - DNA, 20 bp, mouse
ggccgcgcgggcgccggaac

SEQ ID NO: 791603 - DNA, 20 bp, mouse
gcccggcgggcgggcccaag

SEQ ID NO: 791604 - DNA, 20 bp, mouse
ggggagctgtgcgcccgttc

SEQ ID NO: 791605 - DNA, 20 bp, mouse
ggggagcggagtcgccgcgc

SEQ ID NO: 791606 - DNA, 20 bp, mouse
gagggcgagccggagtggga

SEQ ID NO: 791607 - DNA, 20 bp, mouse
ggaaatgcggaattcgggga

SEQ ID NO: 791608 - DNA, 20 bp, mouse
ggcgaaatgcgcttccctat

SEQ ID NO: 791609 - DNA, 20 bp, mouse
ggtcctgacagggaagaagt

SEQ ID NO: 791610 - DNA, 20 bp, mouse
gggctcgccctcacttaaga

SEQ ID NO: 791611 - DNA, 20 bp, mouse
gccacagtcccctcccactc

SEQ ID NO: 791612 - DNA, 20 bp, mouse
ggccagaggccgggcgtcac

SEQ ID NO: 791613 - DNA, 20 bp, mouse
gagtgagggcgagccggagt

SEQ ID NO: 791614 - DNA, 20 bp, mouse
gcagagctgactggacccgg

SEQ ID NO: 791615 - DNA, 20 bp, mouse
gtgtggaatagctgcagaca

SEQ ID NO: 791616 - DNA, 20 bp, mouse
gggcggggccttggtagaga

SEQ ID NO: 791617 - DNA, 20 bp, mouse
ggaaactgggcggggactaa

SEQ ID NO: 791618 - DNA, 20 bp, mouse
ggcggggtcaatctgctagt

SEQ ID NO: 791619 - DNA, 20 bp, mouse
ggggtcaatctgctagtggg

SEQ ID NO: 791620 - DNA, 20 bp, mouse
gtgggcggggtcatggtgta

SEQ ID NO: 791621 - DNA, 20 bp, mouse
gtgtagaaaatggacggggt

SEQ ID NO: 791622 - DNA, 20 bp, mouse
gagccccctcccggcttcca

SEQ ID NO: 791623 - DNA, 20 bp, mouse
gggcacctcatgcggaaact

SEQ ID NO: 791624 - DNA, 20 bp, mouse
gcggggtcatggtgtatggg

SEQ ID NO: 791625 - DNA, 20 bp, mouse
gggtggggcggcacctcatg

SEQ ID NO: 791626 - DNA, 20 bp, mouse
ggaggcggctccagccacag

SEQ ID NO: 791627 - DNA, 20 bp, mouse
gaaaaggaaacacaaccctg

SEQ ID NO: 791628 - DNA, 20 bp, mouse
gggcaggatacacttcccca

SEQ ID NO: 791629 - DNA, 20 bp, mouse
ggtaaagggtcggagtcaca

SEQ ID NO: 791630 - DNA, 20 bp, mouse
gacaggatggaactaatccg

SEQ ID NO: 791631 - DNA, 20 bp, mouse
gcgaggttcccaaacctaga

SEQ ID NO: 791632 - DNA, 20 bp, mouse
gtcaaacgcgggagggtcag

SEQ ID NO: 791633 - DNA, 20 bp, mouse
gccctcacaagtgtccttct

SEQ ID NO: 791634 - DNA, 20 bp, mouse
gtgaatcagtgcataggtaa

SEQ ID NO: 791635 - DNA, 20 bp, mouse
gccgctgctccggcctcacg

SEQ ID NO: 791636 - DNA, 20 bp, mouse
gcggatgaggaggtgacaac

SEQ ID NO: 791637 - DNA, 20 bp, mouse
gaacctgtgaccacactctg

SEQ ID NO: 791638 - DNA, 20 bp, mouse
ggaggaggtgacaacagggt

SEQ ID NO: 791639 - DNA, 20 bp, mouse
ggcccccagagtgtggtcac

SEQ ID NO: 791640 - DNA, 20 bp, mouse
gcctgaaggctgtcacaagc

SEQ ID NO: 791641 - DNA, 20 bp, mouse
gtgtcacaagccggatgagg

SEQ ID NO: 791642 - DNA, 20 bp, mouse
ggaagcagggagcagtcagt

SEQ ID NO: 791643 - DNA, 20 bp, mouse
gttccctcctccctgggagt

SEQ ID NO: 791644 - DNA, 20 bp, mouse
gagttgctgaagagtggcct

SEQ ID NO: 791645 - DNA, 20 bp, mouse
gaagacatggtgcagtgctt

SEQ ID NO: 791646 - DNA, 20 bp, mouse
gccttagtcaccacatgtgg

SEQ ID NO: 791647 - DNA, 20 bp, mouse
gaaagagcaaaactggtcaa

SEQ ID NO: 791648 - DNA, 20 bp, mouse
gccctaggggacttcctcca

SEQ ID NO: 791649 - DNA, 20 bp, mouse
gaagcaggagaaccacaaat

SEQ ID NO: 791650 - DNA, 20 bp, mouse
gtgggagcacctccaatttg

SEQ ID NO: 791651 - DNA, 20 bp, mouse
gaatccttagtcaccacatg

SEQ ID NO: 791652 - DNA, 20 bp, mouse
gcaatgcttccctccacatg

SEQ ID NO: 791653 - DNA, 20 bp, mouse
gaccttggaggaagtcccct

SEQ ID NO: 791654 - DNA, 20 bp, mouse
ggaagtcccctagggaagga

SEQ ID NO: 791655 - DNA, 20 bp, mouse
gggtctgtaaagagcaaaac

SEQ ID NO: 791656 - DNA, 20 bp, mouse
gtgagcagaaagcaggatct

SEQ ID NO: 791657 - DNA, 20 bp, mouse
gtgacagagccctgctttca

SEQ ID NO: 791658 - DNA, 20 bp, mouse
ggaaataaactggtggacat

SEQ ID NO: 791659 - DNA, 20 bp, mouse
ggggccagggtgattgcccc

SEQ ID NO: 791660 - DNA, 20 bp, mouse
ggagcagctaggaactataa

SEQ ID NO: 791661 - DNA, 20 bp, mouse
gcagcctggggcaatcaccc

SEQ ID NO: 791662 - DNA, 20 bp, mouse
gagcctgagcatccatatga

SEQ ID NO: 791663 - DNA, 20 bp, mouse
ggtccaccagtttatttcag

SEQ ID NO: 791664 - DNA, 20 bp, mouse
gggacatgggtttccattta

SEQ ID NO: 791665 - DNA, 20 bp, mouse
gataaagggaaggacggaga

SEQ ID NO: 791666 - DNA, 20 bp, mouse
ggtcccagacgactagactt

SEQ ID NO: 791667 - DNA, 20 bp, mouse
gggacctcatccaacaaatg

SEQ ID NO: 791668 - DNA, 20 bp, mouse
gacagcgctaatgttagctt

SEQ ID NO: 791669 - DNA, 20 bp, mouse
ggaggaaagcttgatttcat

SEQ ID NO: 791670 - DNA, 20 bp, mouse
gtgcctaagtctagtcgtct

SEQ ID NO: 791671 - DNA, 20 bp, mouse
ggtatcagaagcacctcact

SEQ ID NO: 791672 - DNA, 20 bp, mouse
gagaaattagaaatgtgttt

SEQ ID NO: 791673 - DNA, 20 bp, mouse
gttggcagttaaacccagtg

SEQ ID NO: 791674 - DNA, 20 bp, mouse
gctgagatggtaaacccttc

SEQ ID NO: 791675 - DNA, 20 bp, mouse
gaactctaaactcctcaagc

SEQ ID NO: 791676 - DNA, 20 bp, mouse
gtaggagtttttttctagta

SEQ ID NO: 791677 - DNA, 20 bp, mouse
gagtggttaagctatcctac

SEQ ID NO: 791678 - DNA, 20 bp, mouse
gcctgaggcttagtatgtta

SEQ ID NO: 791679 - DNA, 20 bp, mouse
ggtcaatttttctgaccagt

SEQ ID NO: 791680 - DNA, 20 bp, mouse
ggaacacgtataaacgacag

SEQ ID NO: 791681 - DNA, 20 bp, mouse
gaaattgaccatattaaatt

SEQ ID NO: 791682 - DNA, 20 bp, mouse
gtttgtgtgtcagtgtgcat

SEQ ID NO: 791683 - DNA, 20 bp, mouse
gcatataacccagatattga

SEQ ID NO: 791684 - DNA, 20 bp, mouse
gaacacaataactacaacag

SEQ ID NO: 791685 - DNA, 20 bp, mouse
gagtcattaccttcaatatc

SEQ ID NO: 791686 - DNA, 20 bp, mouse
gcgcccacgcgcacagtgcg

SEQ ID NO: 791687 - DNA, 20 bp, mouse
gaaaaagggcacagaatcgg

SEQ ID NO: 791688 - DNA, 20 bp, mouse
gcacagaatcggaggcgggg

SEQ ID NO: 791689 - DNA, 20 bp, mouse
gccctcccgcgaggcagcac

SEQ ID NO: 791690 - DNA, 20 bp, mouse
gccggccggtgctgcctcgc

SEQ ID NO: 791691 - DNA, 20 bp, mouse
gggggcggggcggagactgg

SEQ ID NO: 791692 - DNA, 20 bp, mouse
gtacacgcccccaaaggaaa

SEQ ID NO: 791693 - DNA, 20 bp, mouse
gtgccagataggaaaggtga

SEQ ID NO: 791694 - DNA, 20 bp, mouse
ggggcctgcagaccgcagcc

SEQ ID NO: 791695 - DNA, 20 bp, mouse
gggccgcgatccctcccgcg

SEQ ID NO: 791696 - DNA, 20 bp, mouse
gctagggaggagctcgatga

SEQ ID NO: 791697 - DNA, 20 bp, mouse
gggcgcaggcgagtgtgcaa

SEQ ID NO: 791698 - DNA, 20 bp, mouse
gctccctagcccagcgtgtg

SEQ ID NO: 791699 - DNA, 20 bp, mouse
gggccccacacgctgggcta

SEQ ID NO: 791700 - DNA, 20 bp, mouse
gactcgcggccccacacgct

SEQ ID NO: 791701 - DNA, 20 bp, mouse
gacccagttctcacttggaa

SEQ ID NO: 791702 - DNA, 20 bp, mouse
ggcgcccgcgcgtgcacctg

SEQ ID NO: 791703 - DNA, 20 bp, mouse
ggtgtggggccgcgagttcg

SEQ ID NO: 791704 - DNA, 20 bp, mouse
gtgtaagctgtagccccttg

SEQ ID NO: 791705 - DNA, 20 bp, mouse
gagctgtagccccttggggc

SEQ ID NO: 791706 - DNA, 20 bp, mouse
ggcggggagcgagctgcaga

SEQ ID NO: 791707 - DNA, 20 bp, mouse
ggcctcagctggtgccagag

SEQ ID NO: 791708 - DNA, 20 bp, mouse
gggcggggagctcgccgaga

SEQ ID NO: 791709 - DNA, 20 bp, mouse
gggagctcgccgagagggga

SEQ ID NO: 791710 - DNA, 20 bp, mouse
gtgagcggaagagcttttag

SEQ ID NO: 791711 - DNA, 20 bp, mouse
gcagctggtgccagagagga

SEQ ID NO: 791712 - DNA, 20 bp, mouse
gtagctgtcccgcctggttc

SEQ ID NO: 791713 - DNA, 20 bp, mouse
gccaaagagttctccccaga

SEQ ID NO: 791714 - DNA, 20 bp, mouse
gctgctggtccctcccctct

SEQ ID NO: 791715 - DNA, 20 bp, mouse
gcactctggtccctgaagtt

SEQ ID NO: 791716 - DNA, 20 bp, mouse
gtgtgcccagctaagatctc

SEQ ID NO: 791717 - DNA, 20 bp, mouse
gtgagcctttgcattagcaa

SEQ ID NO: 791718 - DNA, 20 bp, mouse
gcaaccctgggcggccagac

SEQ ID NO: 791719 - DNA, 20 bp, mouse
gcatcctccgcatgctaatg

SEQ ID NO: 791720 - DNA, 20 bp, mouse
ggctgggcacagttatagtt

SEQ ID NO: 791721 - DNA, 20 bp, mouse
ggtcccagtctggccgccca

SEQ ID NO: 791722 - DNA, 20 bp, mouse
gaaaaaatcacatctcagag

SEQ ID NO: 791723 - DNA, 20 bp, mouse
gtgatctagttctggctgta

SEQ ID NO: 791724 - DNA, 20 bp, mouse
gagagagattgatctagttc

SEQ ID NO: 791725 - DNA, 20 bp, mouse
gaataaatctcaaccctggg

SEQ ID NO: 791726 - DNA, 20 bp, mouse
gcggcaccgagggatactga

SEQ ID NO: 791727 - DNA, 20 bp, mouse
gttgctggaaagcccattat

SEQ ID NO: 791728 - DNA, 20 bp, mouse
ggggaggagcacgctttcta

SEQ ID NO: 791729 - DNA, 20 bp, mouse
gctgctccggctctagccct

SEQ ID NO: 791730 - DNA, 20 bp, mouse
gagacactacacaggccgtg

SEQ ID NO: 791731 - DNA, 20 bp, mouse
gtgggatgaacgccaataat

SEQ ID NO: 791732 - DNA, 20 bp, mouse
gaaaggccatgcggcaccga

SEQ ID NO: 791733 - DNA, 20 bp, mouse
gggtgactgagacactacac

SEQ ID NO: 791734 - DNA, 20 bp, mouse
gaagccggaagcaaacggtt

SEQ ID NO: 791735 - DNA, 20 bp, mouse
gctaaaggtgagtgccttgc

SEQ ID NO: 791736 - DNA, 20 bp, mouse
gcgggacggggacagaggta

SEQ ID NO: 791737 - DNA, 20 bp, mouse
gtcctccaaagggaccttct

SEQ ID NO: 791738 - DNA, 20 bp, mouse
gcccgcgactaggactcctg

SEQ ID NO: 791739 - DNA, 20 bp, mouse
gccaggaggggaagtggcga

SEQ ID NO: 791740 - DNA, 20 bp, mouse
gcgacccgagccggggcaac

SEQ ID NO: 791741 - DNA, 20 bp, mouse
ggcgtggcctgtctggagaa

SEQ ID NO: 791742 - DNA, 20 bp, mouse
gagcatgcgcagacgccaga

SEQ ID NO: 791743 - DNA, 20 bp, mouse
gtccgcccgcagcgtctcgt

SEQ ID NO: 791744 - DNA, 20 bp, mouse
gggcggaccgacccgagccg

SEQ ID NO: 791745 - DNA, 20 bp, mouse
ggcgctcggggcccgcgact

SEQ ID NO: 791746 - DNA, 20 bp, mouse
gcatgcgcgcgcagggatgg

SEQ ID NO: 791747 - DNA, 20 bp, mouse
ggatgcagatggactctaaa

SEQ ID NO: 791748 - DNA, 20 bp, mouse
gggactctaaaaggagcagt

SEQ ID NO: 791749 - DNA, 20 bp, mouse
gtaaaggtctctccttttcg

SEQ ID NO: 791750 - DNA, 20 bp, mouse
ggaattggcgggaacaagac

SEQ ID NO: 791751 - DNA, 20 bp, mouse
gtagttcttgcagatctcgc

SEQ ID NO: 791752 - DNA, 20 bp, mouse
ggtccatgcgcgcgcaggga

SEQ ID NO: 791753 - DNA, 20 bp, mouse
gcatggacctgcgccgccgg

SEQ ID NO: 791754 - DNA, 20 bp, mouse
gcgccgccggagggactgct

SEQ ID NO: 791755 - DNA, 20 bp, mouse
gaacaggattgtccccgaaa

SEQ ID NO: 791756 - DNA, 20 bp, mouse
gactgaaggtagtgcgcgtc

SEQ ID NO: 791757 - DNA, 20 bp, mouse
ggcccaggctaacttggaat

SEQ ID NO: 791758 - DNA, 20 bp, mouse
gtgggcttcggtgcgagaca

SEQ ID NO: 791759 - DNA, 20 bp, mouse
gccagcatcaaaaagtcggt

SEQ ID NO: 791760 - DNA, 20 bp, mouse
gcgcgcagagagggcacctg

SEQ ID NO: 791761 - DNA, 20 bp, mouse
gcggagacgcctttgggctt

SEQ ID NO: 791762 - DNA, 20 bp, mouse
gaaaaccagcatcaaaaagt

SEQ ID NO: 791763 - DNA, 20 bp, mouse
ggtggcgcggtagcgactga

SEQ ID NO: 791764 - DNA, 20 bp, mouse
ggggcggggcgccagggggt

SEQ ID NO: 791765 - DNA, 20 bp, mouse
gacagaggggaggccacccc

SEQ ID NO: 791766 - DNA, 20 bp, mouse
ggcagctgatctgggagacc

SEQ ID NO: 791767 - DNA, 20 bp, mouse
gcctccagggcagctgatct

SEQ ID NO: 791768 - DNA, 20 bp, mouse
gtctcccagatcagctgccc

SEQ ID NO: 791769 - DNA, 20 bp, mouse
gagggtggggaaagtgtcct

SEQ ID NO: 791770 - DNA, 20 bp, mouse
ggatctgggagaccggggcg

SEQ ID NO: 791771 - DNA, 20 bp, mouse
gcacttgcagaggacgagcg

SEQ ID NO: 791772 - DNA, 20 bp, mouse
ggactcctgcggcccgctcg

SEQ ID NO: 791773 - DNA, 20 bp, mouse
gcccgctcgcggaggacccg

SEQ ID NO: 791774 - DNA, 20 bp, mouse
gtgcctgggctgcccgacct

SEQ ID NO: 791775 - DNA, 20 bp, mouse
gagaggccccgcctagaggg

SEQ ID NO: 791776 - DNA, 20 bp, mouse
gccgccgcctagcccgccag

SEQ ID NO: 791777 - DNA, 20 bp, mouse
gcgcactcgctccccctggc

SEQ ID NO: 791778 - DNA, 20 bp, mouse
ggccggctgcggggactgcg

SEQ ID NO: 791779 - DNA, 20 bp, mouse
gcggccacccgagggtctgt

SEQ ID NO: 791780 - DNA, 20 bp, mouse
gctcccgcgcgcagaagcgc

SEQ ID NO: 791781 - DNA, 20 bp, mouse
gggcgcgcgcagagggatgc

SEQ ID NO: 791782 - DNA, 20 bp, mouse
ggcggcgccggtactcgcct

SEQ ID NO: 791783 - DNA, 20 bp, mouse
gggggcgccgaggcgagtac

SEQ ID NO: 791784 - DNA, 20 bp, mouse
gcacccccgtaattcccagg

SEQ ID NO: 791785 - DNA, 20 bp, mouse
ggccgaccgcggccacccga

SEQ ID NO: 791786 - DNA, 20 bp, mouse
ggggacgcccggggcgcggt

SEQ ID NO: 791787 - DNA, 20 bp, mouse
ggagatggaaggagaatctg

SEQ ID NO: 791788 - DNA, 20 bp, mouse
ggcccggcgcgtgtggacgc

SEQ ID NO: 791789 - DNA, 20 bp, mouse
gtgagcgcgaccgagatgga

SEQ ID NO: 791790 - DNA, 20 bp, mouse
ggcgtcccgagaaaagccca

SEQ ID NO: 791791 - DNA, 20 bp, mouse
gtcccgagaaaagcccaggg

SEQ ID NO: 791792 - DNA, 20 bp, mouse
gaagcccagggcggtgaaga

SEQ ID NO: 791793 - DNA, 20 bp, mouse
gaatctgagcgcgaccgaga

SEQ ID NO: 791794 - DNA, 20 bp, mouse
gggtcccgaggcatggctca

SEQ ID NO: 791795 - DNA, 20 bp, mouse
gagcctgcgtccacacgcgc

SEQ ID NO: 791796 - DNA, 20 bp, mouse
gagcagggaagaggcggaaa

SEQ ID NO: 791797 - DNA, 20 bp, mouse
gagcggtcgcgggtggttcg

SEQ ID NO: 791798 - DNA, 20 bp, mouse
gatggagcgctctcggagtt

SEQ ID NO: 791799 - DNA, 20 bp, mouse
gaatgccagaatgccatgga

SEQ ID NO: 791800 - DNA, 20 bp, mouse
ggctacgaagctcgatctgg

SEQ ID NO: 791801 - DNA, 20 bp, mouse
gcggaagcggaagtggctaa

SEQ ID NO: 791802 - DNA, 20 bp, mouse
gcgaaacgcgaaacccacgg

SEQ ID NO: 791803 - DNA, 20 bp, mouse
gggtcctggcgcttccatgg

SEQ ID NO: 791804 - DNA, 20 bp, mouse
gagcgcgaagcggtcgcggg

SEQ ID NO: 791805 - DNA, 20 bp, mouse
gcaacttggagtgaggtggt

SEQ ID NO: 791806 - DNA, 20 bp, mouse
gaggcaggcgacccaggctg

SEQ ID NO: 791807 - DNA, 20 bp, mouse
gctagagaggcaggcgaccc

SEQ ID NO: 791808 - DNA, 20 bp, mouse
gggcggaacaagaggctcgg

SEQ ID NO: 791809 - DNA, 20 bp, mouse
gcacgcacccaccacagagg

SEQ ID NO: 791810 - DNA, 20 bp, mouse
gccgacccggaccccaccct

SEQ ID NO: 791811 - DNA, 20 bp, mouse
gcccaccacagaggcggtgc

SEQ ID NO: 791812 - DNA, 20 bp, mouse
gccgcccagggcttgatagt

SEQ ID NO: 791813 - DNA, 20 bp, mouse
gaccagcaccgcctctgtgg

SEQ ID NO: 791814 - DNA, 20 bp, mouse
gcgccccactatcaagccct

SEQ ID NO: 791815 - DNA, 20 bp, mouse
gtgctggtggctagagaggc

SEQ ID NO: 791816 - DNA, 20 bp, mouse
ggcgggcgaacgcacgtgat

SEQ ID NO: 791817 - DNA, 20 bp, mouse
gcccctgcgaagccgtcgat

SEQ ID NO: 791818 - DNA, 20 bp, mouse
gggcgcgggagggttccgga

SEQ ID NO: 791819 - DNA, 20 bp, mouse
gcagactctccgccactcac

SEQ ID NO: 791820 - DNA, 20 bp, mouse
gccgcgccaccataggctcc

SEQ ID NO: 791821 - DNA, 20 bp, mouse
gcaactcgcgtcactcatcc

SEQ ID NO: 791822 - DNA, 20 bp, mouse
gggcctcacgagcccgtgag

SEQ ID NO: 791823 - DNA, 20 bp, mouse
gcccggctagtgtcagtccc

SEQ ID NO: 791824 - DNA, 20 bp, mouse
ggcccaccgcccattggttc

SEQ ID NO: 791825 - DNA, 20 bp, mouse
gccgctgtccattggccctc

SEQ ID NO: 791826 - DNA, 20 bp, mouse
gtgcctgggaagaccctctt

SEQ ID NO: 791827 - DNA, 20 bp, mouse
gcaactgccgatgatagcaa

SEQ ID NO: 791828 - DNA, 20 bp, mouse
gaaactgatccagtcactga

SEQ ID NO: 791829 - DNA, 20 bp, mouse
ggacccatagggagagtggc

SEQ ID NO: 791830 - DNA, 20 bp, mouse
gtgcccaagagggtcttccc

SEQ ID NO: 791831 - DNA, 20 bp, mouse
gggaaaggtcagacctcagg

SEQ ID NO: 791832 - DNA, 20 bp, mouse
gaagtccctggggtatggac

SEQ ID NO: 791833 - DNA, 20 bp, mouse
gtcagccagtccatacccca

SEQ ID NO: 791834 - DNA, 20 bp, mouse
ggactggatcagtttgtctt

SEQ ID NO: 791835 - DNA, 20 bp, mouse
ggaaatgcccaagtggggca

SEQ ID NO: 791836 - DNA, 20 bp, mouse
gtgcatgtctagcagagatg

SEQ ID NO: 791837 - DNA, 20 bp, mouse
gggcctctggttatttgcat

SEQ ID NO: 791838 - DNA, 20 bp, mouse
gtgttctgatactaatatgc

SEQ ID NO: 791839 - DNA, 20 bp, mouse
gggtttgcaaaccactactg

SEQ ID NO: 791840 - DNA, 20 bp, mouse
gttgctaactcactgactca

SEQ ID NO: 791841 - DNA, 20 bp, mouse
ggctaaacttcctgtcagca

SEQ ID NO: 791842 - DNA, 20 bp, mouse
gatgaacacagtaactataa

SEQ ID NO: 791843 - DNA, 20 bp, mouse
gtagctcttagcgtcttggt

SEQ ID NO: 791844 - DNA, 20 bp, mouse
gaatatctgctaaaggttct

SEQ ID NO: 791845 - DNA, 20 bp, mouse
gaccccatgcaaataaccag

SEQ ID NO: 791846 - DNA, 20 bp, mouse
gaagatctggccaacggcga

SEQ ID NO: 791847 - DNA, 20 bp, mouse
ggaacccacccttccggcgg

SEQ ID NO: 791848 - DNA, 20 bp, mouse
gtggccaacggcgagggtca

SEQ ID NO: 791849 - DNA, 20 bp, mouse
gggcgagggtcatgggacag

SEQ ID NO: 791850 - DNA, 20 bp, mouse
gtggccagatcttaaggtcc

SEQ ID NO: 791851 - DNA, 20 bp, mouse
gtctccaggaccttaagatc

SEQ ID NO: 791852 - DNA, 20 bp, mouse
gcagccaccgccggaagggt

SEQ ID NO: 791853 - DNA, 20 bp, mouse
gccaaggacaggggcgctgg

SEQ ID NO: 791854 - DNA, 20 bp, mouse
ggaaggttacccaataaacc

SEQ ID NO: 791855 - DNA, 20 bp, mouse
gggggaacccacccttccgg

SEQ ID NO: 791856 - DNA, 20 bp, mouse
gacccggagggcctcctctt

SEQ ID NO: 791857 - DNA, 20 bp, mouse
gagggagcctgggacccgga

SEQ ID NO: 791858 - DNA, 20 bp, mouse
ggaccacccgggggcagcgt

SEQ ID NO: 791859 - DNA, 20 bp, mouse
gccgggtctggcaccaacgt

SEQ ID NO: 791860 - DNA, 20 bp, mouse
gtgacccggggcttcaatcg

SEQ ID NO: 791861 - DNA, 20 bp, mouse
gagtgcacggcgaccacccg

SEQ ID NO: 791862 - DNA, 20 bp, mouse
gagcgctgggcggtggcagg

SEQ ID NO: 791863 - DNA, 20 bp, mouse
gggcgcgccccagcccctag

SEQ ID NO: 791864 - DNA, 20 bp, mouse
gcctaggggagaatagggca

SEQ ID NO: 791865 - DNA, 20 bp, mouse
gcagcccctaggggagaata

SEQ ID NO: 791866 - DNA, 20 bp, mouse
ggggtggcaggacccaaaat

SEQ ID NO: 791867 - DNA, 20 bp, mouse
gttcccgcactgcagcttgg

SEQ ID NO: 791868 - DNA, 20 bp, mouse
ggcgcccccaagctgcagtg

SEQ ID NO: 791869 - DNA, 20 bp, mouse
gcggcagggtggcactattc

SEQ ID NO: 791870 - DNA, 20 bp, mouse
gcaaacttccctagcctagg

SEQ ID NO: 791871 - DNA, 20 bp, mouse
gagagaacccgatctctcaa

SEQ ID NO: 791872 - DNA, 20 bp, mouse
gtaggctagggaagtttgca

SEQ ID NO: 791873 - DNA, 20 bp, mouse
gtacactcgaggatagagaa

SEQ ID NO: 791874 - DNA, 20 bp, mouse
gcggcaggcccttgagagat

SEQ ID NO: 791875 - DNA, 20 bp, mouse
gtaggtgggatgagttagaa

SEQ ID NO: 791876 - DNA, 20 bp, mouse
gggtgggagtagccggtggt

SEQ ID NO: 791877 - DNA, 20 bp, mouse
gccaccgaggaaccgaggag

SEQ ID NO: 791878 - DNA, 20 bp, mouse
gactccgccctgggtgctat

SEQ ID NO: 791879 - DNA, 20 bp, mouse
ggggacgattcggtgacagg

SEQ ID NO: 791880 - DNA, 20 bp, mouse
ggacgacgggctaagggtag

SEQ ID NO: 791881 - DNA, 20 bp, mouse
gtcaccgaatcgtcccacgt

SEQ ID NO: 791882 - DNA, 20 bp, mouse
gtctgcggtaggagggtcga

SEQ ID NO: 791883 - DNA, 20 bp, mouse
gtagccggtggtgggcttga

SEQ ID NO: 791884 - DNA, 20 bp, mouse
gcgacaagataaagatggag

SEQ ID NO: 791885 - DNA, 20 bp, mouse
gcggtaggagggtcgaaggg

SEQ ID NO: 791886 - DNA, 20 bp, mouse
gggcctgcgcgacagagctc

SEQ ID NO: 791887 - DNA, 20 bp, mouse
gcgggctagcttaggaagag

SEQ ID NO: 791888 - DNA, 20 bp, mouse
gacagctgtggggcggtccc

SEQ ID NO: 791889 - DNA, 20 bp, mouse
gtggggaggacagcggtcgg

SEQ ID NO: 791890 - DNA, 20 bp, mouse
gagccaggtcgggctagctt

SEQ ID NO: 791891 - DNA, 20 bp, mouse
ggagcggcgccagccaggtc

SEQ ID NO: 791892 - DNA, 20 bp, mouse
ggggaacagggtgtgagcac

SEQ ID NO: 791893 - DNA, 20 bp, mouse
gggagcagatggcgcaggac

SEQ ID NO: 791894 - DNA, 20 bp, mouse
gcatctaggcccggaaggag

SEQ ID NO: 791895 - DNA, 20 bp, mouse
gtgagtcaggacaggtgagt

SEQ ID NO: 791896 - DNA, 20 bp, mouse
gcctcccgcaccttgaccat

SEQ ID NO: 791897 - DNA, 20 bp, mouse
ggccgcgtgcgtcacaaccc

SEQ ID NO: 791898 - DNA, 20 bp, mouse
gcagcccatggtcaaggtgc

SEQ ID NO: 791899 - DNA, 20 bp, mouse
gagatgaggaaagagtggcc

SEQ ID NO: 791900 - DNA, 20 bp, mouse
gtggccctccactagagcag

SEQ ID NO: 791901 - DNA, 20 bp, mouse
gaccctggcactcctttaag

SEQ ID NO: 791902 - DNA, 20 bp, mouse
gtcggagcagcccatggtca

SEQ ID NO: 791903 - DNA, 20 bp, mouse
gtagagcaggggtcaaggtg

SEQ ID NO: 791904 - DNA, 20 bp, mouse
ggggctgctccgagagcggg

SEQ ID NO: 791905 - DNA, 20 bp, mouse
ggagtggcccggctgcgagg

SEQ ID NO: 791906 - DNA, 20 bp, mouse
gcgcgcgcccacgtgatccc

SEQ ID NO: 791907 - DNA, 20 bp, mouse
gagcgagcacagcccgggga

SEQ ID NO: 791908 - DNA, 20 bp, mouse
gtcaggctgcctccaccctg

SEQ ID NO: 791909 - DNA, 20 bp, mouse
gcaccctggggccacttgag

SEQ ID NO: 791910 - DNA, 20 bp, mouse
gcccgcccgccgggttgcca

SEQ ID NO: 791911 - DNA, 20 bp, mouse
gcctggggccacttgagagg

SEQ ID NO: 791912 - DNA, 20 bp, mouse
gagcactgccgcctctcaag

SEQ ID NO: 791913 - DNA, 20 bp, mouse
ggacagggagaaaggtgcgt

SEQ ID NO: 791914 - DNA, 20 bp, mouse
gagcacagcccggggagggt

SEQ ID NO: 791915 - DNA, 20 bp, mouse
gcaccacgcacgtttctctt

SEQ ID NO: 791916 - DNA, 20 bp, mouse
gtgagccccgccaactgccg

SEQ ID NO: 791917 - DNA, 20 bp, mouse
gccgccctcggcagttggcg

SEQ ID NO: 791918 - DNA, 20 bp, mouse
ggcctggagtaggagcgcgc

SEQ ID NO: 791919 - DNA, 20 bp, mouse
gtactcgcggcggcaagagg

SEQ ID NO: 791920 - DNA, 20 bp, mouse
gagctggacacgcagactgg

SEQ ID NO: 791921 - DNA, 20 bp, mouse
gcagaggcccaaggctcgcc

SEQ ID NO: 791922 - DNA, 20 bp, mouse
gagtaggagcgcgcgggacg

SEQ ID NO: 791923 - DNA, 20 bp, mouse
gcccctcccggcttcttcct

SEQ ID NO: 791924 - DNA, 20 bp, mouse
gacgcgcgccgggcgagcct

SEQ ID NO: 791925 - DNA, 20 bp, mouse
ggcccggcaccacgagcgga

SEQ ID NO: 791926 - DNA, 20 bp, mouse
gtctctgctggtggtactgg

SEQ ID NO: 791927 - DNA, 20 bp, mouse
ggggaggcggggttacactg

SEQ ID NO: 791928 - DNA, 20 bp, mouse
gcggccctgcggtccccggg

SEQ ID NO: 791929 - DNA, 20 bp, mouse
gcaccccagggcctaggaca

SEQ ID NO: 791930 - DNA, 20 bp, mouse
gccggggccgccacctctcg

SEQ ID NO: 791931 - DNA, 20 bp, mouse
gcggccgcgcgcgcgtagct

SEQ ID NO: 791932 - DNA, 20 bp, mouse
gtaaagcagctggcggctct

SEQ ID NO: 791933 - DNA, 20 bp, mouse
ggcggctaagaacacttggc

SEQ ID NO: 791934 - DNA, 20 bp, mouse
gccgctggccccagctgcgg

SEQ ID NO: 791935 - DNA, 20 bp, mouse
ggcccctggcaccctgtcct

SEQ ID NO: 791936 - DNA, 20 bp, mouse
gactccgaggccaagttggg

SEQ ID NO: 791937 - DNA, 20 bp, mouse
ggcgccacaagagccagaga

SEQ ID NO: 791938 - DNA, 20 bp, mouse
ggacccccagctcacgtggg

SEQ ID NO: 791939 - DNA, 20 bp, mouse
gtcaggggactaatttatag

SEQ ID NO: 791940 - DNA, 20 bp, mouse
ggagacggctaacagatctg

SEQ ID NO: 791941 - DNA, 20 bp, mouse
gaaggacttgcaactcaaag

SEQ ID NO: 791942 - DNA, 20 bp, mouse
ggtggcgcctcgcctgccag

SEQ ID NO: 791943 - DNA, 20 bp, mouse
ggctccgcccacgtgagctg

SEQ ID NO: 791944 - DNA, 20 bp, mouse
gagcccaggaggcaccgacg

SEQ ID NO: 791945 - DNA, 20 bp, mouse
gacgcaggccatcccatctc

SEQ ID NO: 791946 - DNA, 20 bp, mouse
gggtccaggagcagtgtaca

SEQ ID NO: 791947 - DNA, 20 bp, mouse
gaggaaatatcactgggtct

SEQ ID NO: 791948 - DNA, 20 bp, mouse
gctgctaggtcacatggtcc

SEQ ID NO: 791949 - DNA, 20 bp, mouse
gcacaccctgctaggtcaca

SEQ ID NO: 791950 - DNA, 20 bp, mouse
gataccctgggtgcaaagtg

SEQ ID NO: 791951 - DNA, 20 bp, mouse
ggcaaagtggggcggggctt

SEQ ID NO: 791952 - DNA, 20 bp, mouse
gatccagcccacaccctgct

SEQ ID NO: 791953 - DNA, 20 bp, mouse
gtctatcaggtgtagtggtg

SEQ ID NO: 791954 - DNA, 20 bp, mouse
ggaaggagccgagatagaag

SEQ ID NO: 791955 - DNA, 20 bp, mouse
gcttcactacagtctcaaga

SEQ ID NO: 791956 - DNA, 20 bp, mouse
gaggaggccgagcaaggggg

SEQ ID NO: 791957 - DNA, 20 bp, mouse
gtggaaggcaggggtgttaa

SEQ ID NO: 791958 - DNA, 20 bp, mouse
gagggggcggaatgtccaaa

SEQ ID NO: 791959 - DNA, 20 bp, mouse
ggaagatgccaactcccgcc

SEQ ID NO: 791960 - DNA, 20 bp, mouse
gccaaagggggctctttcga

SEQ ID NO: 791961 - DNA, 20 bp, mouse
gttactcgcagatcccgggg

SEQ ID NO: 791962 - DNA, 20 bp, mouse
gtcacggcctgaactagggg

SEQ ID NO: 791963 - DNA, 20 bp, mouse
gcgggagttggcatcttccg

SEQ ID NO: 791964 - DNA, 20 bp, mouse
ggagccccaacgctgggcgg

SEQ ID NO: 791965 - DNA, 20 bp, mouse
gttcctggtgggcttctttc

SEQ ID NO: 791966 - DNA, 20 bp, mouse
gcgcgcgcgcgccactgttt

SEQ ID NO: 791967 - DNA, 20 bp, mouse
gatcgagggaagcagatcgc

SEQ ID NO: 791968 - DNA, 20 bp, mouse
ggcgccacggcaaacggacc

SEQ ID NO: 791969 - DNA, 20 bp, mouse
ggtgcgggagcgactgtcgc

SEQ ID NO: 791970 - DNA, 20 bp, mouse
gccggttgggggagcaatac

SEQ ID NO: 791971 - DNA, 20 bp, mouse
gcgcgcggaacccaggagtg

SEQ ID NO: 791972 - DNA, 20 bp, mouse
gctctcctggtgcagatccg

SEQ ID NO: 791973 - DNA, 20 bp, mouse
gcaggagtgtggcgtcgcgg

SEQ ID NO: 791974 - DNA, 20 bp, mouse
gccagggcagagtgacaaat

SEQ ID NO: 791975 - DNA, 20 bp, mouse
ggatctgcaccaggagagcg

SEQ ID NO: 791976 - DNA, 20 bp, mouse
gcggaatggaagtgtgcatg

SEQ ID NO: 791977 - DNA, 20 bp, mouse
gtactcatgcggctgagtgg

SEQ ID NO: 791978 - DNA, 20 bp, mouse
gccgcaggctctatgcaagg

SEQ ID NO: 791979 - DNA, 20 bp, mouse
gctgacaaaacctactcatg

SEQ ID NO: 791980 - DNA, 20 bp, mouse
ggaggggcatctgtcccggg

SEQ ID NO: 791981 - DNA, 20 bp, mouse
gagtgtgcatgtggagagga

SEQ ID NO: 791982 - DNA, 20 bp, mouse
gttgcatagagcctgcggaa

SEQ ID NO: 791983 - DNA, 20 bp, mouse
gccaagatgactgactgact

SEQ ID NO: 791984 - DNA, 20 bp, mouse
gtgtcaggatctagaatctg

SEQ ID NO: 791985 - DNA, 20 bp, mouse
ggagggaggggcatctgtcc

SEQ ID NO: 791986 - DNA, 20 bp, mouse
gcacgcccccggggtccgga

SEQ ID NO: 791987 - DNA, 20 bp, mouse
gaaggcgtggcagcccgcac

SEQ ID NO: 791988 - DNA, 20 bp, mouse
ggcgccacgcccccggggtc

SEQ ID NO: 791989 - DNA, 20 bp, mouse
gaccgcccctggggtgagtg

SEQ ID NO: 791990 - DNA, 20 bp, mouse
ggcagcaccgccttgagggg

SEQ ID NO: 791991 - DNA, 20 bp, mouse
ggcggtgcgccacgcccccg

SEQ ID NO: 791992 - DNA, 20 bp, mouse
gcacgccttccggaccccgg

SEQ ID NO: 791993 - DNA, 20 bp, mouse
ggggctggaggctgccctaa

SEQ ID NO: 791994 - DNA, 20 bp, mouse
ggggcaggaggaacgggcgg

SEQ ID NO: 791995 - DNA, 20 bp, mouse
gggagagcgtgagcccgcgg

SEQ ID NO: 791996 - DNA, 20 bp, mouse
gcgctctcatcctcacgggg

SEQ ID NO: 791997 - DNA, 20 bp, mouse
ggggagaagaggctagcaga

SEQ ID NO: 791998 - DNA, 20 bp, mouse
ggggaagcaaccttgagcgt

SEQ ID NO: 791999 - DNA, 20 bp, mouse
gccggcgctctcatcctcac

SEQ ID NO: 792000 - DNA, 20 bp, mouse
gctgccgcggaatgcggcct

SEQ ID NO: 792001 - DNA, 20 bp, mouse
gctcccaaggccgcattccg

SEQ ID NO: 792002 - DNA, 20 bp, mouse
gcgtctgttagtaggctggt

SEQ ID NO: 792003 - DNA, 20 bp, mouse
gctaacagacgctctgaaat

SEQ ID NO: 792004 - DNA, 20 bp, mouse
ggcctcttctcccccccgtg

SEQ ID NO: 792005 - DNA, 20 bp, mouse
gctcaggagtcgcggagccc

SEQ ID NO: 792006 - DNA, 20 bp, mouse
gtgggaagggctaaggtcgc

SEQ ID NO: 792007 - DNA, 20 bp, mouse
gcgcctgagtgccagaaagg

SEQ ID NO: 792008 - DNA, 20 bp, mouse
gagcctccgggtcccagtcg

SEQ ID NO: 792009 - DNA, 20 bp, mouse
gtgccgcgactgggacccgg

SEQ ID NO: 792010 - DNA, 20 bp, mouse
gtgtgtccaaacacactcgt

SEQ ID NO: 792011 - DNA, 20 bp, mouse
gtagtggcatagaggcttct

SEQ ID NO: 792012 - DNA, 20 bp, mouse
ggatgaagcagtcaccgggc

SEQ ID NO: 792013 - DNA, 20 bp, mouse
gcgacccaagggtactccgg

SEQ ID NO: 792014 - DNA, 20 bp, mouse
gtggcatagaggcttcttgg

SEQ ID NO: 792015 - DNA, 20 bp, mouse
gcgccgcaggcagcgcgaag

SEQ ID NO: 792016 - DNA, 20 bp, mouse
ggaagtgtagcgcttaatgg

SEQ ID NO: 792017 - DNA, 20 bp, mouse
gtaacccgccactcccaaga

SEQ ID NO: 792018 - DNA, 20 bp, mouse
ggtgacgcctgcgtgttcgc

SEQ ID NO: 792019 - DNA, 20 bp, mouse
gacacttccgatctgttcta

SEQ ID NO: 792020 - DNA, 20 bp, mouse
gaagagaggcgcgagcgtag

SEQ ID NO: 792021 - DNA, 20 bp, mouse
gtacactccactgctcttat

SEQ ID NO: 792022 - DNA, 20 bp, mouse
gaaaacggaagtgacgtatc

SEQ ID NO: 792023 - DNA, 20 bp, mouse
gcgggacgccatgttaggag

SEQ ID NO: 792024 - DNA, 20 bp, mouse
gagagcagtggagtgtaacg

SEQ ID NO: 792025 - DNA, 20 bp, mouse
ggtaacgcgggcggtttcct

SEQ ID NO: 792026 - DNA, 20 bp, mouse
gagcctgccggacaggatga

SEQ ID NO: 792027 - DNA, 20 bp, mouse
ggcacccagaatcccagccg

SEQ ID NO: 792028 - DNA, 20 bp, mouse
gccagccggggctgatggga

SEQ ID NO: 792029 - DNA, 20 bp, mouse
ggggtccttcccatcagccc

SEQ ID NO: 792030 - DNA, 20 bp, mouse
gaatcccagccggggctgat

SEQ ID NO: 792031 - DNA, 20 bp, mouse
gggaaggaccctagccgcct

SEQ ID NO: 792032 - DNA, 20 bp, mouse
gacaggatgagggctggcca

SEQ ID NO: 792033 - DNA, 20 bp, mouse
gaactccaggcatggcaata

SEQ ID NO: 792034 - DNA, 20 bp, mouse
gctaaaacacggcgtggata

SEQ ID NO: 792035 - DNA, 20 bp, mouse
gcagccccggctgggattct

SEQ ID NO: 792036 - DNA, 20 bp, mouse
gcacctgggccaatcctcgg

SEQ ID NO: 792037 - DNA, 20 bp, mouse
ggccccccgaggattggccc

SEQ ID NO: 792038 - DNA, 20 bp, mouse
gcggcgacccgaatagtcca

SEQ ID NO: 792039 - DNA, 20 bp, mouse
gcgcgcggccccccgaggat

SEQ ID NO: 792040 - DNA, 20 bp, mouse
gctccccggggccgccacct

SEQ ID NO: 792041 - DNA, 20 bp, mouse
gaggcacctgtggccaatga

SEQ ID NO: 792042 - DNA, 20 bp, mouse
gggcccaataaccagagtgc

SEQ ID NO: 792043 - DNA, 20 bp, mouse
gacgaggcgggaggcacctg

SEQ ID NO: 792044 - DNA, 20 bp, mouse
ggggagccctcattggccac

SEQ ID NO: 792045 - DNA, 20 bp, mouse
gaatgggagcgcgcacgtag

SEQ ID NO: 792046 - DNA, 20 bp, mouse
gcctgtgcgggcgcttggaa

SEQ ID NO: 792047 - DNA, 20 bp, mouse
ggccgccccagcccactcgg

SEQ ID NO: 792048 - DNA, 20 bp, mouse
gcgcccgcacaggagtggac

SEQ ID NO: 792049 - DNA, 20 bp, mouse
ggggaggcgcccagctactg

SEQ ID NO: 792050 - DNA, 20 bp, mouse
ggggctccggttcccctcgt

SEQ ID NO: 792051 - DNA, 20 bp, mouse
ggcagccgccccagcccact

SEQ ID NO: 792052 - DNA, 20 bp, mouse
gggtcaggactgccctgaat

SEQ ID NO: 792053 - DNA, 20 bp, mouse
ggctttagagtccgccgagt

SEQ ID NO: 792054 - DNA, 20 bp, mouse
gtccgccgagtgggctgggg

SEQ ID NO: 792055 - DNA, 20 bp, mouse
gggccctttaacaaactcga

SEQ ID NO: 792056 - DNA, 20 bp, mouse
gcggcccagaaggaagtctc

SEQ ID NO: 792057 - DNA, 20 bp, mouse
gttactgggacggaagggga

SEQ ID NO: 792058 - DNA, 20 bp, mouse
gcgcgtgccgcggtgaactg

SEQ ID NO: 792059 - DNA, 20 bp, mouse
gtcaccgcggcacgcgagag

SEQ ID NO: 792060 - DNA, 20 bp, mouse
gggaccccgcaccagggagt

SEQ ID NO: 792061 - DNA, 20 bp, mouse
ggggccttactgggacggaa

SEQ ID NO: 792062 - DNA, 20 bp, mouse
gcggcgcccaccgcagggaa

SEQ ID NO: 792063 - DNA, 20 bp, mouse
gaaggcgggaccccgcacca

SEQ ID NO: 792064 - DNA, 20 bp, mouse
gaaggaagtctcaggagcga

SEQ ID NO: 792065 - DNA, 20 bp, mouse
gtgggggtaggagggcggaa

SEQ ID NO: 792066 - DNA, 20 bp, mouse
gcgcccggtggggacctctg

SEQ ID NO: 792067 - DNA, 20 bp, mouse
gcgcgcgcggttggtgggtc

SEQ ID NO: 792068 - DNA, 20 bp, mouse
gcccgccgcgcgcggttggt

SEQ ID NO: 792069 - DNA, 20 bp, mouse
ggcccccgggaacgccgaaa

SEQ ID NO: 792070 - DNA, 20 bp, mouse
gcgcgctccgagcgcccggt

SEQ ID NO: 792071 - DNA, 20 bp, mouse
gctccggcctcgagacggga

SEQ ID NO: 792072 - DNA, 20 bp, mouse
ggctggcagtcggtgacaag

SEQ ID NO: 792073 - DNA, 20 bp, mouse
gactgccagcgcccgcctag

SEQ ID NO: 792074 - DNA, 20 bp, mouse
gttggtgggtctggctccga

SEQ ID NO: 792075 - DNA, 20 bp, mouse
ggctccgagggggcgcgcgg

SEQ ID NO: 792076 - DNA, 20 bp, mouse
gggggcgtgcaagtgaatct

SEQ ID NO: 792077 - DNA, 20 bp, mouse
gcggtcgagaactccccctc

SEQ ID NO: 792078 - DNA, 20 bp, mouse
gctggcccatccaaggcgag

SEQ ID NO: 792079 - DNA, 20 bp, mouse
gcacccccgcgagagtataa

SEQ ID NO: 792080 - DNA, 20 bp, mouse
gcacgcccctcgccttggat

SEQ ID NO: 792081 - DNA, 20 bp, mouse
gggggggtgaagacgcgcac

SEQ ID NO: 792082 - DNA, 20 bp, mouse
gttaaacgctacagatctgc

SEQ ID NO: 792083 - DNA, 20 bp, mouse
gtgtacacatcggaatgcaa

SEQ ID NO: 792084 - DNA, 20 bp, mouse
gttgcagtggcgccttccgg

SEQ ID NO: 792085 - DNA, 20 bp, mouse
gctgcaggctggcccatcca

SEQ ID NO: 792086 - DNA, 20 bp, mouse
gggtaccaaaagaagggagt

SEQ ID NO: 792087 - DNA, 20 bp, mouse
gtaactggatcctgcggggg

SEQ ID NO: 792088 - DNA, 20 bp, mouse
gatgacgcagtgcttgtaac

SEQ ID NO: 792089 - DNA, 20 bp, mouse
ggactgggaaagggggacga

SEQ ID NO: 792090 - DNA, 20 bp, mouse
gaagctcagaggggaggatg

SEQ ID NO: 792091 - DNA, 20 bp, mouse
gctaatccctagcgtctctg

SEQ ID NO: 792092 - DNA, 20 bp, mouse
ggaaaccaggctctttcggt

SEQ ID NO: 792093 - DNA, 20 bp, mouse
ggaggaagggcggctctaat

SEQ ID NO: 792094 - DNA, 20 bp, mouse
gccaccccaccgaaagagcc

SEQ ID NO: 792095 - DNA, 20 bp, mouse
ggatgaggcgtctaaaagga

SEQ ID NO: 792096 - DNA, 20 bp, mouse
gaggctggaggcacaagggt

SEQ ID NO: 792097 - DNA, 20 bp, mouse
gccggcgcgaacctgtactc

SEQ ID NO: 792098 - DNA, 20 bp, mouse
gagcccgcttccttgaaggt

SEQ ID NO: 792099 - DNA, 20 bp, mouse
gcgaacctgtactccggagc

SEQ ID NO: 792100 - DNA, 20 bp, mouse
gggcgtgaggcaacttaagt

SEQ ID NO: 792101 - DNA, 20 bp, mouse
gcaggccggctccggagtac

SEQ ID NO: 792102 - DNA, 20 bp, mouse
gggtcagcccggcgtggcgt

SEQ ID NO: 792103 - DNA, 20 bp, mouse
gacaccagagagcatggcca

SEQ ID NO: 792104 - DNA, 20 bp, mouse
gaaggtggggtcacccgcgc

SEQ ID NO: 792105 - DNA, 20 bp, mouse
ggcgggtgaccccaccttca

SEQ ID NO: 792106 - DNA, 20 bp, mouse
ggagcccgaggaacgggaaa

SEQ ID NO: 792107 - DNA, 20 bp, mouse
gaacccaactagagagcggg

SEQ ID NO: 792108 - DNA, 20 bp, mouse
gtgggaacccaactagagag

SEQ ID NO: 792109 - DNA, 20 bp, mouse
ggaaactcggggaaccgaag

SEQ ID NO: 792110 - DNA, 20 bp, mouse
gtaccgcccgctctctagtt

SEQ ID NO: 792111 - DNA, 20 bp, mouse
gagtggagcaagaacatcga

SEQ ID NO: 792112 - DNA, 20 bp, mouse
gcgctcagaagctttggaag

SEQ ID NO: 792113 - DNA, 20 bp, mouse
ggggacatgcaatggaggcg

SEQ ID NO: 792114 - DNA, 20 bp, mouse
gagccaggtcgcaggagggg

SEQ ID NO: 792115 - DNA, 20 bp, mouse
ggagcccggactggcagaga

SEQ ID NO: 792116 - DNA, 20 bp, mouse
gcatgaacgcgaggtcagtg

SEQ ID NO: 792117 - DNA, 20 bp, mouse
gggactgcctcgtacctccg

SEQ ID NO: 792118 - DNA, 20 bp, mouse
gcgcatgcgcactctctcct

SEQ ID NO: 792119 - DNA, 20 bp, mouse
ggggacctgagacgtcgcct

SEQ ID NO: 792120 - DNA, 20 bp, mouse
gtggccccaggcgacgtctc

SEQ ID NO: 792121 - DNA, 20 bp, mouse
gggagcgagcgaaactggga

SEQ ID NO: 792122 - DNA, 20 bp, mouse
gaagctgtgcgaagtccttg

SEQ ID NO: 792123 - DNA, 20 bp, mouse
ggaaggagacgatatggaga

SEQ ID NO: 792124 - DNA, 20 bp, mouse
gcgcactctcaaacccccgg

SEQ ID NO: 792125 - DNA, 20 bp, mouse
ggctgcctgattctcacatc

SEQ ID NO: 792126 - DNA, 20 bp, mouse
gcgggcatgcgcactcgaga

SEQ ID NO: 792127 - DNA, 20 bp, mouse
gagggcaccctccagcgcca

SEQ ID NO: 792128 - DNA, 20 bp, mouse
gcagcgccagggtgcattgt

SEQ ID NO: 792129 - DNA, 20 bp, mouse
gaggcggtagcgtcccgggc

SEQ ID NO: 792130 - DNA, 20 bp, mouse
gaaggaggcggtagcgtccc

SEQ ID NO: 792131 - DNA, 20 bp, mouse
gcatgcgcactcgagagggt

SEQ ID NO: 792132 - DNA, 20 bp, mouse
gctggcgcgcgaagccgcga

SEQ ID NO: 792133 - DNA, 20 bp, mouse
gaatgcaccctggcgctgga

SEQ ID NO: 792134 - DNA, 20 bp, mouse
gggttgcgctcgccagtccc

SEQ ID NO: 792135 - DNA, 20 bp, mouse
ggggcgggggcggatagctg

SEQ ID NO: 792136 - DNA, 20 bp, mouse
ggggtgagtaacaataggca

SEQ ID NO: 792137 - DNA, 20 bp, mouse
gccgcggggcccacgcccat

SEQ ID NO: 792138 - DNA, 20 bp, mouse
gcccgcgggtgagtaacaat

SEQ ID NO: 792139 - DNA, 20 bp, mouse
gtggtgcaggtacatcccat

SEQ ID NO: 792140 - DNA, 20 bp, mouse
gaaagtaaaagtaatggagg

SEQ ID NO: 792141 - DNA, 20 bp, mouse
gaatggagggggctgcactg

SEQ ID NO: 792142 - DNA, 20 bp, mouse
ggggtgtctggatgacgcga

SEQ ID NO: 792143 - DNA, 20 bp, mouse
gagagcccgggctttcggga

SEQ ID NO: 792144 - DNA, 20 bp, mouse
gggcagggttgggccaacgc

SEQ ID NO: 792145 - DNA, 20 bp, mouse
gttcccgcttcctgccaagg

SEQ ID NO: 792146 - DNA, 20 bp, mouse
gacggaaatagatgattgga

SEQ ID NO: 792147 - DNA, 20 bp, mouse
gaatcaaaatccttcatttc

SEQ ID NO: 792148 - DNA, 20 bp, mouse
gagacattggccagaaatga

SEQ ID NO: 792149 - DNA, 20 bp, mouse
ggcagattctgtgaagaaat

SEQ ID NO: 792150 - DNA, 20 bp, mouse
gatgggggctatcttaatga

SEQ ID NO: 792151 - DNA, 20 bp, mouse
gttatttcttattcatattc

SEQ ID NO: 792152 - DNA, 20 bp, mouse
gtaccagtgatatgcctgat

SEQ ID NO: 792153 - DNA, 20 bp, mouse
gtgtgctaagttaaaagcca

SEQ ID NO: 792154 - DNA, 20 bp, mouse
ggaaatgggggtaattttga

SEQ ID NO: 792155 - DNA, 20 bp, mouse
ggaatctgcaatatgtacca

SEQ ID NO: 792156 - DNA, 20 bp, mouse
gtcaaggccatatattgcta

SEQ ID NO: 792157 - DNA, 20 bp, mouse
gcttaatcatcattgcaatt

SEQ ID NO: 792158 - DNA, 20 bp, mouse
ggtggtatgaaacactatat

SEQ ID NO: 792159 - DNA, 20 bp, mouse
ggtatgaaacactatatagg

SEQ ID NO: 792160 - DNA, 20 bp, mouse
gtcctttgactctcaccctc

SEQ ID NO: 792161 - DNA, 20 bp, mouse
gttgaattctaaacaattct

SEQ ID NO: 792162 - DNA, 20 bp, mouse
gtctgccccttagcaatata

SEQ ID NO: 792163 - DNA, 20 bp, mouse
ggagtcttttcaaatatcta

SEQ ID NO: 792164 - DNA, 20 bp, mouse
gataatgtaggagtaatgta

SEQ ID NO: 792165 - DNA, 20 bp, mouse
gtgagcaatttcaccgtgtg

SEQ ID NO: 792166 - DNA, 20 bp, mouse
ggaagatgtatgtatgtctc

SEQ ID NO: 792167 - DNA, 20 bp, mouse
gaggatgtgctctactatat

SEQ ID NO: 792168 - DNA, 20 bp, mouse
ggtctctggtcacggataat

SEQ ID NO: 792169 - DNA, 20 bp, mouse
gtcagtagttatcttgtttc

SEQ ID NO: 792170 - DNA, 20 bp, mouse
gcatcctgttagacggcaga

SEQ ID NO: 792171 - DNA, 20 bp, mouse
gtttgaatgagagatgaccg

SEQ ID NO: 792172 - DNA, 20 bp, mouse
gatgtgctctactatatagg

SEQ ID NO: 792173 - DNA, 20 bp, mouse
gcctatgaccttctctgtta

SEQ ID NO: 792174 - DNA, 20 bp, mouse
gcgtccttctgccgtctaac

SEQ ID NO: 792175 - DNA, 20 bp, mouse
gaagaaaatagggaaagtct

SEQ ID NO: 792176 - DNA, 20 bp, mouse
gagtaatggtatcctcaact

SEQ ID NO: 792177 - DNA, 20 bp, mouse
gtaatgatgggtgagagtaa

SEQ ID NO: 792178 - DNA, 20 bp, mouse
gatgtgctgcactatatagg

SEQ ID NO: 792179 - DNA, 20 bp, mouse
ggtgcagcacatcatcccca

SEQ ID NO: 792180 - DNA, 20 bp, mouse
gcaaggccacacactgctag

SEQ ID NO: 792181 - DNA, 20 bp, mouse
gatgatgtgctgcactatat

SEQ ID NO: 792182 - DNA, 20 bp, mouse
ggaggatattagctaatgat

SEQ ID NO: 792183 - DNA, 20 bp, mouse
gataacttcgaccatagtca

SEQ ID NO: 792184 - DNA, 20 bp, mouse
gagtattcttggatcaaaaa

SEQ ID NO: 792185 - DNA, 20 bp, mouse
gtaggaggtggaaagttaac

SEQ ID NO: 792186 - DNA, 20 bp, mouse
gaccataagaccatgaacta

SEQ ID NO: 792187 - DNA, 20 bp, mouse
gactcatcgtcttgtctagc

SEQ ID NO: 792188 - DNA, 20 bp, mouse
ggggtatggtaacaccgaag

SEQ ID NO: 792189 - DNA, 20 bp, mouse
gtaacaggatgaaaattatg

SEQ ID NO: 792190 - DNA, 20 bp, mouse
gtacttggagacatagggta

SEQ ID NO: 792191 - DNA, 20 bp, mouse
gaataatacttggagacata

SEQ ID NO: 792192 - DNA, 20 bp, mouse
gtccttagttcatggtctta

SEQ ID NO: 792193 - DNA, 20 bp, mouse
ggtatacaaggcacattgac

SEQ ID NO: 792194 - DNA, 20 bp, mouse
gccagaagcaaaataatact

SEQ ID NO: 792195 - DNA, 20 bp, mouse
gtaaagcagtcatcaacttt

SEQ ID NO: 792196 - DNA, 20 bp, mouse
gcaggactgtgacaagagta

SEQ ID NO: 792197 - DNA, 20 bp, mouse
gaggggaattaacagatgac

SEQ ID NO: 792198 - DNA, 20 bp, mouse
gaaacaattcatacagaaac

SEQ ID NO: 792199 - DNA, 20 bp, mouse
gctaaaatagaacttatgga

SEQ ID NO: 792200 - DNA, 20 bp, mouse
gcatccaggtcacgaggcag

SEQ ID NO: 792201 - DNA, 20 bp, mouse
gtacctggtctgcgtcacta

SEQ ID NO: 792202 - DNA, 20 bp, mouse
gttccctctgcctcgtgacc

SEQ ID NO: 792203 - DNA, 20 bp, mouse
gattctctccaaggtcatcc

SEQ ID NO: 792204 - DNA, 20 bp, mouse
gaaagctaaaatagaactta

SEQ ID NO: 792205 - DNA, 20 bp, mouse
gttaccacctgaaacacata

SEQ ID NO: 792206 - DNA, 20 bp, mouse
gctgtagtactactactatg

SEQ ID NO: 792207 - DNA, 20 bp, mouse
gacacagagtctcttccttc

SEQ ID NO: 792208 - DNA, 20 bp, mouse
gaaatggctatgagtcatta

SEQ ID NO: 792209 - DNA, 20 bp, mouse
gtatgagtcattatggaaca

SEQ ID NO: 792210 - DNA, 20 bp, mouse
ggaacacaagaatctgtact

SEQ ID NO: 792211 - DNA, 20 bp, mouse
gctgtactaggaaaacatta

SEQ ID NO: 792212 - DNA, 20 bp, mouse
gtatgtggtttctcttgtgt

SEQ ID NO: 792213 - DNA, 20 bp, mouse
ggttacaatatgtgaatctc

SEQ ID NO: 792214 - DNA, 20 bp, mouse
ggaatctttaaagtgttttc

SEQ ID NO: 792215 - DNA, 20 bp, mouse
gagattcttctcaacaatgt

SEQ ID NO: 792216 - DNA, 20 bp, mouse
gctgaacccaaggagagctc

SEQ ID NO: 792217 - DNA, 20 bp, mouse
gttacagtgtttctggttag

SEQ ID NO: 792218 - DNA, 20 bp, mouse
gcagactatacctgaaccca

SEQ ID NO: 792219 - DNA, 20 bp, mouse
gtactcattttccagccagc

SEQ ID NO: 792220 - DNA, 20 bp, mouse
gtaaacccatgaatcttata

SEQ ID NO: 792221 - DNA, 20 bp, mouse
ggtgaccttataagattcat

SEQ ID NO: 792222 - DNA, 20 bp, mouse
gtctcaataaatgaggtaaa

SEQ ID NO: 792223 - DNA, 20 bp, mouse
gatgtttctctcaataaatg

SEQ ID NO: 792224 - DNA, 20 bp, mouse
gctggccccgagctctcctt

SEQ ID NO: 792225 - DNA, 20 bp, mouse
ggacctctccagatcacatg

SEQ ID NO: 792226 - DNA, 20 bp, mouse
gttgcagtgtttctggttaa

SEQ ID NO: 792227 - DNA, 20 bp, mouse
gatatttatctcagtaaatg

SEQ ID NO: 792228 - DNA, 20 bp, mouse
gaggatgctaataatcctta

SEQ ID NO: 792229 - DNA, 20 bp, mouse
ggagaagtcctttctcctgc

SEQ ID NO: 792230 - DNA, 20 bp, mouse
gccaaacccaagcagagctc

SEQ ID NO: 792231 - DNA, 20 bp, mouse
gtttctggccagcaggagaa

SEQ ID NO: 792232 - DNA, 20 bp, mouse
gcttgggtttgggtatagtc

SEQ ID NO: 792233 - DNA, 20 bp, mouse
gtactcattttctggccagc

SEQ ID NO: 792234 - DNA, 20 bp, mouse
ggacctctccagatcacatg

SEQ ID NO: 792235 - DNA, 20 bp, mouse
gtcccccatgtgatctggag

SEQ ID NO: 792236 - DNA, 20 bp, mouse
gtctcaataaatgaggtaaa

SEQ ID NO: 792237 - DNA, 20 bp, mouse
gatgtttctctcaataaatg

SEQ ID NO: 792238 - DNA, 20 bp, mouse
gccaaacccaagcagagctc

SEQ ID NO: 792239 - DNA, 20 bp, mouse
gcttgggtttgggtatagtc

SEQ ID NO: 792240 - DNA, 20 bp, mouse
gtactcattttctggccagc

SEQ ID NO: 792241 - DNA, 20 bp, mouse
ggacctctccagatcacatg

SEQ ID NO: 792242 - DNA, 20 bp, mouse
gtcccccatgtgatctggag

SEQ ID NO: 792243 - DNA, 20 bp, mouse
gaggatgctaataatcctca

SEQ ID NO: 792244 - DNA, 20 bp, mouse
gctggccccgagctctgctt

SEQ ID NO: 792245 - DNA, 20 bp, mouse
gttgaattaaggtgatgtat

SEQ ID NO: 792246 - DNA, 20 bp, mouse
gtactagggaactggaggaa

SEQ ID NO: 792247 - DNA, 20 bp, mouse
ggcacatataactaggtctg

SEQ ID NO: 792248 - DNA, 20 bp, mouse
ggtagtgtatggcctgaagg

SEQ ID NO: 792249 - DNA, 20 bp, mouse
gtcagccattgtcgtgaaat

SEQ ID NO: 792250 - DNA, 20 bp, mouse
gcctgagggagtacagtcac

SEQ ID NO: 792251 - DNA, 20 bp, mouse
gattgtcgtgaaataggcaa

SEQ ID NO: 792252 - DNA, 20 bp, mouse
gcagggtattgtaactgtaa

SEQ ID NO: 792253 - DNA, 20 bp, mouse
gcagtcacaggactctcatt

SEQ ID NO: 792254 - DNA, 20 bp, mouse
gtacactactagggaactgg

SEQ ID NO: 792255 - DNA, 20 bp, mouse
gtgcttacctctctatacta

SEQ ID NO: 792256 - DNA, 20 bp, mouse
ggggcagttaacattccctg

SEQ ID NO: 792257 - DNA, 20 bp, mouse
gagggcctcatgacccctca

SEQ ID NO: 792258 - DNA, 20 bp, mouse
gggtcatgaggccctcatct

SEQ ID NO: 792259 - DNA, 20 bp, mouse
gacaactacagtaatgttga

SEQ ID NO: 792260 - DNA, 20 bp, mouse
ggacatgaacatcagacatc

SEQ ID NO: 792261 - DNA, 20 bp, mouse
gcatgtctggcaaactatat

SEQ ID NO: 792262 - DNA, 20 bp, mouse
gtgaggccctcatctaggat

SEQ ID NO: 792263 - DNA, 20 bp, mouse
ggtcacgtccggagaaatgt

SEQ ID NO: 792264 - DNA, 20 bp, mouse
ggatgaacatgggcgcctga

SEQ ID NO: 792265 - DNA, 20 bp, mouse
gcatagctttggggcatgtc

SEQ ID NO: 792266 - DNA, 20 bp, mouse
gaaggcaggtctatgatagt

SEQ ID NO: 792267 - DNA, 20 bp, mouse
gcaaggagtagagaaggctc

SEQ ID NO: 792268 - DNA, 20 bp, mouse
gcctgaagcaggacagtaat

SEQ ID NO: 792269 - DNA, 20 bp, mouse
gcctgatcaaggagtagaga

SEQ ID NO: 792270 - DNA, 20 bp, mouse
ggggtcattatccctgatca

SEQ ID NO: 792271 - DNA, 20 bp, mouse
gccccaaggccatgtactac

SEQ ID NO: 792272 - DNA, 20 bp, mouse
gtggcagaaacatttagata

SEQ ID NO: 792273 - DNA, 20 bp, mouse
gtccagtagtacatggcctt

SEQ ID NO: 792274 - DNA, 20 bp, mouse
gtatagttataccctgtaaa

SEQ ID NO: 792275 - DNA, 20 bp, mouse
ggaaagaatgcaagtatctg

SEQ ID NO: 792276 - DNA, 20 bp, mouse
ggtggtttgcaacttaactt

SEQ ID NO: 792277 - DNA, 20 bp, mouse
gggccttggggatgattcaa

SEQ ID NO: 792278 - DNA, 20 bp, mouse
gttgagtcatcatgatcttg

SEQ ID NO: 792279 - DNA, 20 bp, mouse
gtagcagtgttgtggccttg

SEQ ID NO: 792280 - DNA, 20 bp, mouse
gggtaagaagaagtaacatc

SEQ ID NO: 792281 - DNA, 20 bp, mouse
gtaatctaaactaatctaaa

SEQ ID NO: 792282 - DNA, 20 bp, mouse
ggacatctcttctccataaa

SEQ ID NO: 792283 - DNA, 20 bp, mouse
gaggccacaacactgctagg

SEQ ID NO: 792284 - DNA, 20 bp, mouse
gctgaagataaagagtcata

SEQ ID NO: 792285 - DNA, 20 bp, mouse
gtaggaaacctacaaaatat

SEQ ID NO: 792286 - DNA, 20 bp, mouse
gtgccctggggatcgttcaa

SEQ ID NO: 792287 - DNA, 20 bp, mouse
gcccagggcaacatactgct

SEQ ID NO: 792288 - DNA, 20 bp, mouse
gggccattgaacgatcccca

SEQ ID NO: 792289 - DNA, 20 bp, mouse
ggtcttgaaacaagctaaaa

SEQ ID NO: 792290 - DNA, 20 bp, mouse
gtagggatggataaagcaat

SEQ ID NO: 792291 - DNA, 20 bp, mouse
gtccaggatccagggaacat

SEQ ID NO: 792292 - DNA, 20 bp, mouse
gtgtttcaagactataacta

SEQ ID NO: 792293 - DNA, 20 bp, mouse
gagggcaacatactgctagg

SEQ ID NO: 792294 - DNA, 20 bp, mouse
gataccaacctttatcaaat

SEQ ID NO: 792295 - DNA, 20 bp, mouse
ggatccagggaacataggat

SEQ ID NO: 792296 - DNA, 20 bp, mouse
ggtggatcatgaagtcaact

SEQ ID NO: 792297 - DNA, 20 bp, mouse
gaagaacagcatactacgtc

SEQ ID NO: 792298 - DNA, 20 bp, mouse
ggtacactctatgacttctg

SEQ ID NO: 792299 - DNA, 20 bp, mouse
gtacagcagtaagtggcctg

SEQ ID NO: 792300 - DNA, 20 bp, mouse
gggccacttactgctgtaac

SEQ ID NO: 792301 - DNA, 20 bp, mouse
gcctgaacatggtggtccaa

SEQ ID NO: 792302 - DNA, 20 bp, mouse
gaacatggtggtccaagggt

SEQ ID NO: 792303 - DNA, 20 bp, mouse
gatagagtgtacaaaaggtt

SEQ ID NO: 792304 - DNA, 20 bp, mouse
gttcctgttacagcagtaag

SEQ ID NO: 792305 - DNA, 20 bp, mouse
gaacattgtgatttgattaa

SEQ ID NO: 792306 - DNA, 20 bp, mouse
ggagccattgttgcgactgc

SEQ ID NO: 792307 - DNA, 20 bp, mouse
gacacctgcagtcgcaacaa

SEQ ID NO: 792308 - DNA, 20 bp, mouse
gtagtctcttctccatcatt

SEQ ID NO: 792309 - DNA, 20 bp, mouse
gaccttagtcccaattgtta

SEQ ID NO: 792310 - DNA, 20 bp, mouse
gagtctcagcagatactcat

SEQ ID NO: 792311 - DNA, 20 bp, mouse
gtcaaaagcaccataacaat

SEQ ID NO: 792312 - DNA, 20 bp, mouse
gcaatggctccatatttcgt

SEQ ID NO: 792313 - DNA, 20 bp, mouse
gaccataacaattgggacta

SEQ ID NO: 792314 - DNA, 20 bp, mouse
gtgtcagaatttcatgacct

SEQ ID NO: 792315 - DNA, 20 bp, mouse
gaaggccacaagctgctatg

SEQ ID NO: 792316 - DNA, 20 bp, mouse
gacagttagttctatgtaca

SEQ ID NO: 792317 - DNA, 20 bp, mouse
gaaggtcatatatatttcat

SEQ ID NO: 792318 - DNA, 20 bp, mouse
gtcattggttttagaccgtt

SEQ ID NO: 792319 - DNA, 20 bp, mouse
gatagacctttttaccttca

SEQ ID NO: 792320 - DNA, 20 bp, mouse
gaccctgagggaaaaataat

SEQ ID NO: 792321 - DNA, 20 bp, mouse
gttgcttgatttttcatatt

SEQ ID NO: 792322 - DNA, 20 bp, mouse
gagaatatataaaaccctga

SEQ ID NO: 792323 - DNA, 20 bp, mouse
gttcaatgacacttggatga

SEQ ID NO: 792324 - DNA, 20 bp, mouse
gacacactggcaggaggaaa

SEQ ID NO: 792325 - DNA, 20 bp, mouse
ggaggttacacactggcagg

SEQ ID NO: 792326 - DNA, 20 bp, mouse
gaaatcatccagacacgtat

SEQ ID NO: 792327 - DNA, 20 bp, mouse
gtgtcattaggcaggtaaga

SEQ ID NO: 792328 - DNA, 20 bp, mouse
gttctagcacataatcccaa

SEQ ID NO: 792329 - DNA, 20 bp, mouse
gcaacacacctatacgtgtc

SEQ ID NO: 792330 - DNA, 20 bp, mouse
gccatgtctttctatcttca

SEQ ID NO: 792331 - DNA, 20 bp, mouse
ggacatgacattctgtcatt

SEQ ID NO: 792332 - DNA, 20 bp, mouse
gtgacattctgtcattaggc

SEQ ID NO: 792333 - DNA, 20 bp, mouse
ggagattcaggatatcacta

SEQ ID NO: 792334 - DNA, 20 bp, mouse
gggaaaatttactaattcta

SEQ ID NO: 792335 - DNA, 20 bp, mouse
gcatgcttaattttgatatt

SEQ ID NO: 792336 - DNA, 20 bp, mouse
gttccctgaaaatagacaga

SEQ ID NO: 792337 - DNA, 20 bp, mouse
ggacagatggttcatgaatg

SEQ ID NO: 792338 - DNA, 20 bp, mouse
gtatctcagtggcctgatga

SEQ ID NO: 792339 - DNA, 20 bp, mouse
ggttttacagataaccctga

SEQ ID NO: 792340 - DNA, 20 bp, mouse
ggaaccatctgtctattttc

SEQ ID NO: 792341 - DNA, 20 bp, mouse
gatctctgaagctatctcag

SEQ ID NO: 792342 - DNA, 20 bp, mouse
ggcctgatgatgggatggtc

SEQ ID NO: 792343 - DNA, 20 bp, mouse
ggtagaactagcctaatgta

SEQ ID NO: 792344 - DNA, 20 bp, mouse
gacctgaccatcccatcatc

SEQ ID NO: 792345 - DNA, 20 bp, mouse
gttatctgtaaaactatata

SEQ ID NO: 792346 - DNA, 20 bp, mouse
gtgctcgattatataggaac

SEQ ID NO: 792347 - DNA, 20 bp, mouse
ggtaaattatccctagtgag

SEQ ID NO: 792348 - DNA, 20 bp, mouse
gacatgtaggaacacgcaaa

SEQ ID NO: 792349 - DNA, 20 bp, mouse
gttcaggattcctctcacta

SEQ ID NO: 792350 - DNA, 20 bp, mouse
gtagaagttcacttaataga

SEQ ID NO: 792351 - DNA, 20 bp, mouse
gcaacatattcatatatgtc

SEQ ID NO: 792352 - DNA, 20 bp, mouse
gaatcgagcagataacctca

SEQ ID NO: 792353 - DNA, 20 bp, mouse
ggacatgaatatctttaatc

SEQ ID NO: 792354 - DNA, 20 bp, mouse
gctatgtctttctatcttta

SEQ ID NO: 792355 - DNA, 20 bp, mouse
ggttatctgctcgattatat

SEQ ID NO: 792356 - DNA, 20 bp, mouse
gtctctgtccataatgattg

SEQ ID NO: 792357 - DNA, 20 bp, mouse
ggctggctgtacatgccctt

SEQ ID NO: 792358 - DNA, 20 bp, mouse
gtgtaactcatgctgtctca

SEQ ID NO: 792359 - DNA, 20 bp, mouse
gcagcatagccagtgattac

SEQ ID NO: 792360 - DNA, 20 bp, mouse
gttactgttcctatatattc

SEQ ID NO: 792361 - DNA, 20 bp, mouse
gaagtatgttgtaataagtc

SEQ ID NO: 792362 - DNA, 20 bp, mouse
gaatccttgccagtaatcac

SEQ ID NO: 792363 - DNA, 20 bp, mouse
gcaacatacttatgagcatc

SEQ ID NO: 792364 - DNA, 20 bp, mouse
gatacttatgagcatctgga

SEQ ID NO: 792365 - DNA, 20 bp, mouse
gactcatgctgtctcatggc

SEQ ID NO: 792366 - DNA, 20 bp, mouse
gatgagtgccaatttcctca

SEQ ID NO: 792367 - DNA, 20 bp, mouse
gtagagtagtcagtgattac

SEQ ID NO: 792368 - DNA, 20 bp, mouse
gattctagcagatatctcca

SEQ ID NO: 792369 - DNA, 20 bp, mouse
gacagagagcaagtctttat

SEQ ID NO: 792370 - DNA, 20 bp, mouse
gcaaagaatgtatggttcta

SEQ ID NO: 792371 - DNA, 20 bp, mouse
gtatcagaccatgaggaaat

SEQ ID NO: 792372 - DNA, 20 bp, mouse
gatgatcatatcagaccatg

SEQ ID NO: 792373 - DNA, 20 bp, mouse
gctgtgtgcttaaattaatt

SEQ ID NO: 792374 - DNA, 20 bp, mouse
gtaagtatgttgtaataaaa

SEQ ID NO: 792375 - DNA, 20 bp, mouse
gcacgtagaaaaacattcat

SEQ ID NO: 792376 - DNA, 20 bp, mouse
ggtgcgtgtccgtgcctatg

SEQ ID NO: 792377 - DNA, 20 bp, mouse
ggtgcacaggtggctgtctt

SEQ ID NO: 792378 - DNA, 20 bp, mouse
gaacaacctagggtccctcc

SEQ ID NO: 792379 - DNA, 20 bp, mouse
gctcagaggtagctaggagt

SEQ ID NO: 792380 - DNA, 20 bp, mouse
gagagccaggcaggcaatgg

SEQ ID NO: 792381 - DNA, 20 bp, mouse
ggctgtcttgggacatcctt

SEQ ID NO: 792382 - DNA, 20 bp, mouse
gagaggtgtgagctgtgcac

SEQ ID NO: 792383 - DNA, 20 bp, mouse
ggcagccttgtggtcagcag

SEQ ID NO: 792384 - DNA, 20 bp, mouse
gtgtatgcacaaagccagga

SEQ ID NO: 792385 - DNA, 20 bp, mouse
gtagacacccaggccttggt

SEQ ID NO: 792386 - DNA, 20 bp, mouse
gaacctgggccccacgctcc

SEQ ID NO: 792387 - DNA, 20 bp, mouse
gtgaagggagagctgaagtc

SEQ ID NO: 792388 - DNA, 20 bp, mouse
ggcactgcacacttccgaag

SEQ ID NO: 792389 - DNA, 20 bp, mouse
ggaggagcagcatgtgtagt

SEQ ID NO: 792390 - DNA, 20 bp, mouse
gttccagaggggcgtgtccc

SEQ ID NO: 792391 - DNA, 20 bp, mouse
ggggatgacagaggaggtgc

SEQ ID NO: 792392 - DNA, 20 bp, mouse
gtccagggtgatctccactt

SEQ ID NO: 792393 - DNA, 20 bp, mouse
gggagatcaccctggagcgt

SEQ ID NO: 792394 - DNA, 20 bp, mouse
gctctggaacagcttctcca

SEQ ID NO: 792395 - DNA, 20 bp, mouse
gtctcccttcaatggaagat

SEQ ID NO: 792396 - DNA, 20 bp, mouse
gaggtgacggagatagttgg

SEQ ID NO: 792397 - DNA, 20 bp, mouse
gataaggtgacggagatagt

SEQ ID NO: 792398 - DNA, 20 bp, mouse
gaatacttgagggggctcta

SEQ ID NO: 792399 - DNA, 20 bp, mouse
ggtcccctgatcatgcgaaa

SEQ ID NO: 792400 - DNA, 20 bp, mouse
gtgatcatgcgaaacggatc

SEQ ID NO: 792401 - DNA, 20 bp, mouse
ggggagaaataccatctttg

SEQ ID NO: 792402 - DNA, 20 bp, mouse
gagtcagaggaaagtggtcg

SEQ ID NO: 792403 - DNA, 20 bp, mouse
gtgcagagaaaaggtggaca

SEQ ID NO: 792404 - DNA, 20 bp, mouse
gaataaacagggacccttaa

SEQ ID NO: 792405 - DNA, 20 bp, mouse
gggtcgaggaagaataaaca

SEQ ID NO: 792406 - DNA, 20 bp, mouse
gtagcctagaagcaggtgtg

SEQ ID NO: 792407 - DNA, 20 bp, mouse
gaacccaaggccaggcaggt

SEQ ID NO: 792408 - DNA, 20 bp, mouse
ggtccaaatatgggcatgag

SEQ ID NO: 792409 - DNA, 20 bp, mouse
gtacaggtcctcactggcca

SEQ ID NO: 792410 - DNA, 20 bp, mouse
gtatacctgaagcacttgat

SEQ ID NO: 792411 - DNA, 20 bp, mouse
gctgtaccatgtccaaatat

SEQ ID NO: 792412 - DNA, 20 bp, mouse
gtcacagaccatggccagtg

SEQ ID NO: 792413 - DNA, 20 bp, mouse
ggtgccacacacctgcttct

SEQ ID NO: 792414 - DNA, 20 bp, mouse
gaccaggacctcacagacca

SEQ ID NO: 792415 - DNA, 20 bp, mouse
gaggccccatcaagtgcttc

SEQ ID NO: 792416 - DNA, 20 bp, mouse
ggggccgacaggtcacagtg

SEQ ID NO: 792417 - DNA, 20 bp, mouse
gcccaaccaaggccatgcat

SEQ ID NO: 792418 - DNA, 20 bp, mouse
ggggtgggaacaatcaatca

SEQ ID NO: 792419 - DNA, 20 bp, mouse
gagggcggcacagggtttgc

SEQ ID NO: 792420 - DNA, 20 bp, mouse
gggaacaatcaatcaggggt

SEQ ID NO: 792421 - DNA, 20 bp, mouse
gcctgggaggtaaagggacc

SEQ ID NO: 792422 - DNA, 20 bp, mouse
gctgtgccgccctcacagag

SEQ ID NO: 792423 - DNA, 20 bp, mouse
gggaagcttttgctaggagt

SEQ ID NO: 792424 - DNA, 20 bp, mouse
gccgccctcacagaggggac

SEQ ID NO: 792425 - DNA, 20 bp, mouse
gaaaccccactgtgacctgt

SEQ ID NO: 792426 - DNA, 20 bp, mouse
gtggagagggcacaaactag

SEQ ID NO: 792427 - DNA, 20 bp, mouse
ggtagagtagacgctggaga

SEQ ID NO: 792428 - DNA, 20 bp, mouse
gattggggtagagtagacgc

SEQ ID NO: 792429 - DNA, 20 bp, mouse
gtagcgagagagtgtgagac

SEQ ID NO: 792430 - DNA, 20 bp, mouse
gtctgagccctgagctgcca

SEQ ID NO: 792431 - DNA, 20 bp, mouse
gcactcctacagctactgtc

SEQ ID NO: 792432 - DNA, 20 bp, mouse
gatagctccaaattctgggg

SEQ ID NO: 792433 - DNA, 20 bp, mouse
ggtgaactaaaatgaagagc

SEQ ID NO: 792434 - DNA, 20 bp, mouse
ggtgccttggagcctttgtg

SEQ ID NO: 792435 - DNA, 20 bp, mouse
gtgtggcactgacctcacaa

SEQ ID NO: 792436 - DNA, 20 bp, mouse
gagcccgccgggaagctcca

SEQ ID NO: 792437 - DNA, 20 bp, mouse
gccccgccataagttctcat

SEQ ID NO: 792438 - DNA, 20 bp, mouse
gccgccgggaagctccaggg

SEQ ID NO: 792439 - DNA, 20 bp, mouse
gagaaaggggcgggaagatc

SEQ ID NO: 792440 - DNA, 20 bp, mouse
gagaacttatggcggggtat

SEQ ID NO: 792441 - DNA, 20 bp, mouse
ggggcggagctggccagaaa

SEQ ID NO: 792442 - DNA, 20 bp, mouse
gacttatggcggggtatcgg

SEQ ID NO: 792443 - DNA, 20 bp, mouse
gccgccccctcctgtccgct

SEQ ID NO: 792444 - DNA, 20 bp, mouse
ggaaatatgaagctctcaga

SEQ ID NO: 792445 - DNA, 20 bp, mouse
ggggcctttaaacgctaggg

SEQ ID NO: 792446 - DNA, 20 bp, mouse
gcgcagccgcactctccagg

SEQ ID NO: 792447 - DNA, 20 bp, mouse
gcacaagcaggactagagca

SEQ ID NO: 792448 - DNA, 20 bp, mouse
gccgcggcccactatggtct

SEQ ID NO: 792449 - DNA, 20 bp, mouse
gtggtgcgatgagattcaga

SEQ ID NO: 792450 - DNA, 20 bp, mouse
ggccctgtccgccgctggga

SEQ ID NO: 792451 - DNA, 20 bp, mouse
gagcgccccgcggcccacta

SEQ ID NO: 792452 - DNA, 20 bp, mouse
gaggctgtaaagtcattttc

SEQ ID NO: 792453 - DNA, 20 bp, mouse
gggaagccccgccttcccag

SEQ ID NO: 792454 - DNA, 20 bp, mouse
gctgtgatgacgtcacacca

SEQ ID NO: 792455 - DNA, 20 bp, mouse
gcaaggttgaacagtgggat

SEQ ID NO: 792456 - DNA, 20 bp, mouse
ggacttaccgggagatctgt

SEQ ID NO: 792457 - DNA, 20 bp, mouse
gctgtgggaagactggactc

SEQ ID NO: 792458 - DNA, 20 bp, mouse
gacgcaggtgagaaagtgta

SEQ ID NO: 792459 - DNA, 20 bp, mouse
ggtagatagtcttgagacag

SEQ ID NO: 792460 - DNA, 20 bp, mouse
ggcgcggtctacaccacctg

SEQ ID NO: 792461 - DNA, 20 bp, mouse
gctgggcggggcgtgctctt

SEQ ID NO: 792462 - DNA, 20 bp, mouse
gccacctgtggcctccaacc

SEQ ID NO: 792463 - DNA, 20 bp, mouse
gaaccgaggcaacaattggc

SEQ ID NO: 792464 - DNA, 20 bp, mouse
gaatgcgaccggccggaagc

SEQ ID NO: 792465 - DNA, 20 bp, mouse
gagtgtaaggatcgacttac

SEQ ID NO: 792466 - DNA, 20 bp, mouse
gagagggcgctgcgataagt

SEQ ID NO: 792467 - DNA, 20 bp, mouse
gcaatgcaggccaggctcgg

SEQ ID NO: 792468 - DNA, 20 bp, mouse
gaggccaggctcggaggctc

SEQ ID NO: 792469 - DNA, 20 bp, mouse
gcccacatacatcagcatac

SEQ ID NO: 792470 - DNA, 20 bp, mouse
ggagcgcttccgggtcacgt

SEQ ID NO: 792471 - DNA, 20 bp, mouse
gaacccctagtaggggtgtg

SEQ ID NO: 792472 - DNA, 20 bp, mouse
gggggcggggcaccgctctc

SEQ ID NO: 792473 - DNA, 20 bp, mouse
gcggcagagatggccaatgc

SEQ ID NO: 792474 - DNA, 20 bp, mouse
gggccatctctgccgccaga

SEQ ID NO: 792475 - DNA, 20 bp, mouse
gtgccctgcctgtggggtta

SEQ ID NO: 792476 - DNA, 20 bp, mouse
gtacagctccagagcggagg

SEQ ID NO: 792477 - DNA, 20 bp, mouse
gcacgtcactgtgagaattg

SEQ ID NO: 792478 - DNA, 20 bp, mouse
gggtccctccgcctccgctc

SEQ ID NO: 792479 - DNA, 20 bp, mouse
gcactgtgagaattgcggat

SEQ ID NO: 792480 - DNA, 20 bp, mouse
gggccgcactgcaatgtctg

SEQ ID NO: 792481 - DNA, 20 bp, mouse
ggtgagaattgcggattggt

SEQ ID NO: 792482 - DNA, 20 bp, mouse
gtggagctgtaaagacgctc

SEQ ID NO: 792483 - DNA, 20 bp, mouse
gtctcacagtgacgtgggcg

SEQ ID NO: 792484 - DNA, 20 bp, mouse
ggtgaagagtccccaggagg

SEQ ID NO: 792485 - DNA, 20 bp, mouse
ggatacttcaggtttttctg

SEQ ID NO: 792486 - DNA, 20 bp, mouse
gaaccctgacaaggggtaaa

SEQ ID NO: 792487 - DNA, 20 bp, mouse
gggtgtgccaagattgactc

SEQ ID NO: 792488 - DNA, 20 bp, mouse
gcaaaaactgaaaggatctc

SEQ ID NO: 792489 - DNA, 20 bp, mouse
gcctgcatcccgcttcctga

SEQ ID NO: 792490 - DNA, 20 bp, mouse
gggaaagggcaaaaactgaa

SEQ ID NO: 792491 - DNA, 20 bp, mouse
gcgcaggctcagagtccccg

SEQ ID NO: 792492 - DNA, 20 bp, mouse
ggctcaaccagagtcaatct

SEQ ID NO: 792493 - DNA, 20 bp, mouse
gggaagcgggatgcaggaag

SEQ ID NO: 792494 - DNA, 20 bp, mouse
gtctagagaaccctgacaag

SEQ ID NO: 792495 - DNA, 20 bp, mouse
gaccgcgcaacgaatgctgg

SEQ ID NO: 792496 - DNA, 20 bp, mouse
gcccgccgaggcgctcgtgc

SEQ ID NO: 792497 - DNA, 20 bp, mouse
gagcagcgaggtcgagtcgg

SEQ ID NO: 792498 - DNA, 20 bp, mouse
gcggctcgggagacgccaga

SEQ ID NO: 792499 - DNA, 20 bp, mouse
gtactccgcgatcgccgcta

SEQ ID NO: 792500 - DNA, 20 bp, mouse
ggagtactgtgggaaggcgc

SEQ ID NO: 792501 - DNA, 20 bp, mouse
gacgccagagggccaggagg

SEQ ID NO: 792502 - DNA, 20 bp, mouse
gcggagcagcgaggtcgagt

SEQ ID NO: 792503 - DNA, 20 bp, mouse
gatcgcggagtactgtggga

SEQ ID NO: 792504 - DNA, 20 bp, mouse
gcgcaacaccgcagtcctgc

SEQ ID NO: 792505 - DNA, 20 bp, mouse
gctgctccgggggcgtttac

SEQ ID NO: 792506 - DNA, 20 bp, mouse
gaggaatcgaccgggtgggg

SEQ ID NO: 792507 - DNA, 20 bp, mouse
gggtgaggggcgtagacatt

SEQ ID NO: 792508 - DNA, 20 bp, mouse
gaccggacaagactcagcca

SEQ ID NO: 792509 - DNA, 20 bp, mouse
ggatccaggaatcgaccggg

SEQ ID NO: 792510 - DNA, 20 bp, mouse
gacacctggcgcgggggcta

SEQ ID NO: 792511 - DNA, 20 bp, mouse
gaccccgcggtcccgggcac

SEQ ID NO: 792512 - DNA, 20 bp, mouse
gacagggtgggtgtctggat

SEQ ID NO: 792513 - DNA, 20 bp, mouse
gagaccctccagcagcctcg

SEQ ID NO: 792514 - DNA, 20 bp, mouse
gactgtttggggcatgaaca

SEQ ID NO: 792515 - DNA, 20 bp, mouse
gcgtccacgaggctgctgga

SEQ ID NO: 792516 - DNA, 20 bp, mouse
gtggccgagggaaggtgttc

SEQ ID NO: 792517 - DNA, 20 bp, mouse
gcgcctatatagctgagtgg

SEQ ID NO: 792518 - DNA, 20 bp, mouse
gggtcctgctgtggagggaa

SEQ ID NO: 792519 - DNA, 20 bp, mouse
gaaggtgttccggagaagtg

SEQ ID NO: 792520 - DNA, 20 bp, mouse
gggccaccactcagctatat

SEQ ID NO: 792521 - DNA, 20 bp, mouse
ggaagggctaccctatttgg

SEQ ID NO: 792522 - DNA, 20 bp, mouse
gaggctccaaccttccaggg

SEQ ID NO: 792523 - DNA, 20 bp, mouse
gcctccctgcctgggacagg

SEQ ID NO: 792524 - DNA, 20 bp, mouse
gagggaagggctaccctatt

SEQ ID NO: 792525 - DNA, 20 bp, mouse
gccacagcaggaccaatcaa

SEQ ID NO: 792526 - DNA, 20 bp, mouse
ggccgcgccgcgtctctcgc

SEQ ID NO: 792527 - DNA, 20 bp, mouse
gtaacgggagcattgggtac

SEQ ID NO: 792528 - DNA, 20 bp, mouse
gggggaatgagtcaccgctc

SEQ ID NO: 792529 - DNA, 20 bp, mouse
ggtcagggagtgctgacact

SEQ ID NO: 792530 - DNA, 20 bp, mouse
ggcgccgcgtctctcgcggg

SEQ ID NO: 792531 - DNA, 20 bp, mouse
gagagacgcggcgcggccat

SEQ ID NO: 792532 - DNA, 20 bp, mouse
ggggagctaggctgggcgag

SEQ ID NO: 792533 - DNA, 20 bp, mouse
gggggcgtgatgctcaccaa

SEQ ID NO: 792534 - DNA, 20 bp, mouse
gggaagccatcgttgaactt

SEQ ID NO: 792535 - DNA, 20 bp, mouse
gcgtctctcgcgggggggtg

SEQ ID NO: 792536 - DNA, 20 bp, mouse
gcggccgacaggcatgtgag

SEQ ID NO: 792537 - DNA, 20 bp, mouse
gcaggtgcagcgtggaggtg

SEQ ID NO: 792538 - DNA, 20 bp, mouse
gcgacaggcatgtgagagga

SEQ ID NO: 792539 - DNA, 20 bp, mouse
gctccacgctgcacctgtgt

SEQ ID NO: 792540 - DNA, 20 bp, mouse
gaccccgcggcatccaggcg

SEQ ID NO: 792541 - DNA, 20 bp, mouse
gctgccaaggccgctagctc

SEQ ID NO: 792542 - DNA, 20 bp, mouse
ggtgcaggagccaccagcgg

SEQ ID NO: 792543 - DNA, 20 bp, mouse
gagttggggggctgaggata

SEQ ID NO: 792544 - DNA, 20 bp, mouse
ggttggagaaagttcggcat

SEQ ID NO: 792545 - DNA, 20 bp, mouse
ggcagagaaacctaagctgt

SEQ ID NO: 792546 - DNA, 20 bp, mouse
gtgagcgtgttcaaacttat

SEQ ID NO: 792547 - DNA, 20 bp, mouse
gaggaattgtctatcagaaa

SEQ ID NO: 792548 - DNA, 20 bp, mouse
gaacagatatagcttgttcg

SEQ ID NO: 792549 - DNA, 20 bp, mouse
gcccccaccggtcaaataga

SEQ ID NO: 792550 - DNA, 20 bp, mouse
gtgagagaaaggagtgactc

SEQ ID NO: 792551 - DNA, 20 bp, mouse
ggagggaggttcggcaccaa

SEQ ID NO: 792552 - DNA, 20 bp, mouse
gccatcaatcaggacaagta

SEQ ID NO: 792553 - DNA, 20 bp, mouse
gttttgcccgcagtggctga

SEQ ID NO: 792554 - DNA, 20 bp, mouse
gagctcccagctgagaagtc

SEQ ID NO: 792555 - DNA, 20 bp, mouse
gtctcatccctcagccactg

SEQ ID NO: 792556 - DNA, 20 bp, mouse
gccactggtacagacacttc

SEQ ID NO: 792557 - DNA, 20 bp, mouse
gagtacagaaagtgcagtga

SEQ ID NO: 792558 - DNA, 20 bp, mouse
gacaactgggcagatcagag

SEQ ID NO: 792559 - DNA, 20 bp, mouse
gaagtgcagtgaaggatttc

SEQ ID NO: 792560 - DNA, 20 bp, mouse
gtcacacagccggttctgca

SEQ ID NO: 792561 - DNA, 20 bp, mouse
gggaatgttgctgacagcag

SEQ ID NO: 792562 - DNA, 20 bp, mouse
ggatctgcccagttgtccgc

SEQ ID NO: 792563 - DNA, 20 bp, mouse
gagtgtctgtaccagtggcc

SEQ ID NO: 792564 - DNA, 20 bp, mouse
gagaattctgaataggactt

SEQ ID NO: 792565 - DNA, 20 bp, mouse
ggcacagcctgcggacaact

SEQ ID NO: 792566 - DNA, 20 bp, mouse
ggcgttaagggtgtgacgaa

SEQ ID NO: 792567 - DNA, 20 bp, mouse
gactgagtgctgggtctgta

SEQ ID NO: 792568 - DNA, 20 bp, mouse
gccagcaaggtgctaagtat

SEQ ID NO: 792569 - DNA, 20 bp, mouse
gccgactgacgcttagaccc

SEQ ID NO: 792570 - DNA, 20 bp, mouse
gtgctgggtctgtaaggtaa

SEQ ID NO: 792571 - DNA, 20 bp, mouse
gggccagcaactgttgtggg

SEQ ID NO: 792572 - DNA, 20 bp, mouse
gtggaaggagctggagatcc

SEQ ID NO: 792573 - DNA, 20 bp, mouse
ggcggggccagcaactgttg

SEQ ID NO: 792574 - DNA, 20 bp, mouse
gaaagcccgtactggcgtta

SEQ ID NO: 792575 - DNA, 20 bp, mouse
ggggttgggcaagcatgagg

SEQ ID NO: 792576 - DNA, 20 bp, mouse
gaggtcgccgctgagtcagg

SEQ ID NO: 792577 - DNA, 20 bp, mouse
gctcccgctgcttgcttccg

SEQ ID NO: 792578 - DNA, 20 bp, mouse
gccccacccccctgactcag

SEQ ID NO: 792579 - DNA, 20 bp, mouse
gaagggcttggcgagaagtc

SEQ ID NO: 792580 - DNA, 20 bp, mouse
gggagggcccacagctggga

SEQ ID NO: 792581 - DNA, 20 bp, mouse
gtccgaggcttgaggaggag

SEQ ID NO: 792582 - DNA, 20 bp, mouse
ggcttggcgagaagtccggt

SEQ ID NO: 792583 - DNA, 20 bp, mouse
gttgaggaggagcggaaaag

SEQ ID NO: 792584 - DNA, 20 bp, mouse
ggcgagccaggccccctagt

SEQ ID NO: 792585 - DNA, 20 bp, mouse
gagcctcggaagcaagcagc

SEQ ID NO: 792586 - DNA, 20 bp, mouse
gcaagccttccctggcgctc

SEQ ID NO: 792587 - DNA, 20 bp, mouse
ggggacggggtcttgagggt

SEQ ID NO: 792588 - DNA, 20 bp, mouse
ggcaggggtggagtgacgat

SEQ ID NO: 792589 - DNA, 20 bp, mouse
ggcgccagggaaggcttggg

SEQ ID NO: 792590 - DNA, 20 bp, mouse
gcctcaagaccccgtccctt

SEQ ID NO: 792591 - DNA, 20 bp, mouse
gcttccctggcgctctggtt

SEQ ID NO: 792592 - DNA, 20 bp, mouse
gacgccaaaccagagcgcca

SEQ ID NO: 792593 - DNA, 20 bp, mouse
ggggtggagtgacgatgggg

SEQ ID NO: 792594 - DNA, 20 bp, mouse
gtccgggaatggggcgtgat

SEQ ID NO: 792595 - DNA, 20 bp, mouse
gcgggtgtgccaggctgtca

SEQ ID NO: 792596 - DNA, 20 bp, mouse
gtcaggctgaaaggttattg

SEQ ID NO: 792597 - DNA, 20 bp, mouse
ggggcagttactgattaact

SEQ ID NO: 792598 - DNA, 20 bp, mouse
gtttaggatagcagtctctt

SEQ ID NO: 792599 - DNA, 20 bp, mouse
gcccgagagcagggaactcc

SEQ ID NO: 792600 - DNA, 20 bp, mouse
gtgagatctgtcgtactgtc

SEQ ID NO: 792601 - DNA, 20 bp, mouse
ggggttaataattaatggtt

SEQ ID NO: 792602 - DNA, 20 bp, mouse
gctgggtgaggcattgaggt

SEQ ID NO: 792603 - DNA, 20 bp, mouse
gagcagttgggcccgagagc

SEQ ID NO: 792604 - DNA, 20 bp, mouse
gcagctgggcaaggggcatt

SEQ ID NO: 792605 - DNA, 20 bp, mouse
ggggactgggtgaggcattg

SEQ ID NO: 792606 - DNA, 20 bp, mouse
gagctccccaggcaaaagtc

SEQ ID NO: 792607 - DNA, 20 bp, mouse
gacaggagggcaggtacagc

SEQ ID NO: 792608 - DNA, 20 bp, mouse
gtaccttccaggtagaaggt

SEQ ID NO: 792609 - DNA, 20 bp, mouse
gaagcagaggctcaggccag

SEQ ID NO: 792610 - DNA, 20 bp, mouse
gcgtgtacctacatgacagg

SEQ ID NO: 792611 - DNA, 20 bp, mouse
gtacacgcagggtcataaac

SEQ ID NO: 792612 - DNA, 20 bp, mouse
gtctacctggaaggtaaata

SEQ ID NO: 792613 - DNA, 20 bp, mouse
gtaagagaagcactgttttt

SEQ ID NO: 792614 - DNA, 20 bp, mouse
gggcactgagtctgtcactc

SEQ ID NO: 792615 - DNA, 20 bp, mouse
gctccaaccttctacctgga

SEQ ID NO: 792616 - DNA, 20 bp, mouse
ggcttcaggaaggctggcta

SEQ ID NO: 792617 - DNA, 20 bp, mouse
gcacgcgcaaagcgccacgc

SEQ ID NO: 792618 - DNA, 20 bp, mouse
gcacgcgggcagagcccccg

SEQ ID NO: 792619 - DNA, 20 bp, mouse
gcacgcgtccccaacgtccc

SEQ ID NO: 792620 - DNA, 20 bp, mouse
gctggaaaacaggacggcga

SEQ ID NO: 792621 - DNA, 20 bp, mouse
ggaaaacaggacggcgaagg

SEQ ID NO: 792622 - DNA, 20 bp, mouse
gcgtgtgcgcgtggagcgcg

SEQ ID NO: 792623 - DNA, 20 bp, mouse
gcacgcggggggcacggcgc

SEQ ID NO: 792624 - DNA, 20 bp, mouse
gagcctggcggcggttataa

SEQ ID NO: 792625 - DNA, 20 bp, mouse
ggatgtgcctctgcgagtgt

SEQ ID NO: 792626 - DNA, 20 bp, mouse
ggacaggtccctaagtcgag

SEQ ID NO: 792627 - DNA, 20 bp, mouse
ggggatagagagtgaaagat

SEQ ID NO: 792628 - DNA, 20 bp, mouse
gggtgccaggggctcaagaa

SEQ ID NO: 792629 - DNA, 20 bp, mouse
gcgcctgagcaccaactcta

SEQ ID NO: 792630 - DNA, 20 bp, mouse
gcctaagtcgagtggaactg

SEQ ID NO: 792631 - DNA, 20 bp, mouse
gtgggcgggaacatcggggc

SEQ ID NO: 792632 - DNA, 20 bp, mouse
gaatatgggcgggaacatcg

SEQ ID NO: 792633 - DNA, 20 bp, mouse
gagacagcgtgctgtgggcg

SEQ ID NO: 792634 - DNA, 20 bp, mouse
gcgagtgggcggactggtca

SEQ ID NO: 792635 - DNA, 20 bp, mouse
gagtgaaagatgggaacaga

SEQ ID NO: 792636 - DNA, 20 bp, mouse
gcagctgctgaggtcacaac

SEQ ID NO: 792637 - DNA, 20 bp, mouse
gagggtctcagacttccggg

SEQ ID NO: 792638 - DNA, 20 bp, mouse
gcgggaggggcgggacacct

SEQ ID NO: 792639 - DNA, 20 bp, mouse
gttccgggtggtccttccaa

SEQ ID NO: 792640 - DNA, 20 bp, mouse
ggggtctcggggggcggagt

SEQ ID NO: 792641 - DNA, 20 bp, mouse
gaccctaattcagtagatct

SEQ ID NO: 792642 - DNA, 20 bp, mouse
gtccaactctgcacacttag

SEQ ID NO: 792643 - DNA, 20 bp, mouse
gcagctggccatccttgaga

SEQ ID NO: 792644 - DNA, 20 bp, mouse
gaattagggtctcagacttc

SEQ ID NO: 792645 - DNA, 20 bp, mouse
ggacacctgggctgggtccg

SEQ ID NO: 792646 - DNA, 20 bp, mouse
gtggaactctgcagtgtagg

SEQ ID NO: 792647 - DNA, 20 bp, mouse
gtgacccagcactgtctagc

SEQ ID NO: 792648 - DNA, 20 bp, mouse
gggtggaattgccaaggtga

SEQ ID NO: 792649 - DNA, 20 bp, mouse
gaccttggcaattccaccca

SEQ ID NO: 792650 - DNA, 20 bp, mouse
gtgctgggtcacagtgccat

SEQ ID NO: 792651 - DNA, 20 bp, mouse
ggctctaggctcaacaacat

SEQ ID NO: 792652 - DNA, 20 bp, mouse
gcaacctgctagacagtgct

SEQ ID NO: 792653 - DNA, 20 bp, mouse
ggaagagtgggaaactaaaa

SEQ ID NO: 792654 - DNA, 20 bp, mouse
ggctacacatcattattatg

SEQ ID NO: 792655 - DNA, 20 bp, mouse
ggaaaacagcagaaagactt

SEQ ID NO: 792656 - DNA, 20 bp, mouse
gagaccctagaggacgcaac

SEQ ID NO: 792657 - DNA, 20 bp, mouse
gcggggcggagcagtgggac

SEQ ID NO: 792658 - DNA, 20 bp, mouse
gccactgctccgccccgggt

SEQ ID NO: 792659 - DNA, 20 bp, mouse
gagtcccgtggtcctgactc

SEQ ID NO: 792660 - DNA, 20 bp, mouse
gcctctgccagagaccctag

SEQ ID NO: 792661 - DNA, 20 bp, mouse
gccacgggactccaggactc

SEQ ID NO: 792662 - DNA, 20 bp, mouse
ggtgcctgagtcaggaccac

SEQ ID NO: 792663 - DNA, 20 bp, mouse
gacccttagccaacccgggg

SEQ ID NO: 792664 - DNA, 20 bp, mouse
ggggtctctggcagaggttt

SEQ ID NO: 792665 - DNA, 20 bp, mouse
ggaacctgttgcgtcctcta

SEQ ID NO: 792666 - DNA, 20 bp, mouse
gtcccagcagcccaacctga

SEQ ID NO: 792667 - DNA, 20 bp, mouse
gcaggggcggaggccagata

SEQ ID NO: 792668 - DNA, 20 bp, mouse
gcccgcccggagcgtaggaa

SEQ ID NO: 792669 - DNA, 20 bp, mouse
gccttgcccagcatgttagg

SEQ ID NO: 792670 - DNA, 20 bp, mouse
gccggagcgtaggaagggca

SEQ ID NO: 792671 - DNA, 20 bp, mouse
gacttcactgagaaagccaa

SEQ ID NO: 792672 - DNA, 20 bp, mouse
gccgggccctgccccctatc

SEQ ID NO: 792673 - DNA, 20 bp, mouse
gactctgaggtactcctgga

SEQ ID NO: 792674 - DNA, 20 bp, mouse
gaaaccctggcccactgact

SEQ ID NO: 792675 - DNA, 20 bp, mouse
ggagcccaaacctgtcgggc

SEQ ID NO: 792676 - DNA, 20 bp, mouse
gagagaaggtgctctgtcag

SEQ ID NO: 792677 - DNA, 20 bp, mouse
gtcagagggtccaggggctg

SEQ ID NO: 792678 - DNA, 20 bp, mouse
ggccaagagctcatattccc

SEQ ID NO: 792679 - DNA, 20 bp, mouse
gtgctctgtcagagggtcca

SEQ ID NO: 792680 - DNA, 20 bp, mouse
gggagcaggcaggggacggg

SEQ ID NO: 792681 - DNA, 20 bp, mouse
gagaggaggggtgtctcaat

SEQ ID NO: 792682 - DNA, 20 bp, mouse
ggaccaagaagtgattggat

SEQ ID NO: 792683 - DNA, 20 bp, mouse
gtcccctgcctgctcccaga

SEQ ID NO: 792684 - DNA, 20 bp, mouse
gcccagaagggggatttaac

SEQ ID NO: 792685 - DNA, 20 bp, mouse
gtccctacagtggggttcag

SEQ ID NO: 792686 - DNA, 20 bp, mouse
ggggcagacggggcgtgtgg

SEQ ID NO: 792687 - DNA, 20 bp, mouse
gcagacggggcgtgtggagg

SEQ ID NO: 792688 - DNA, 20 bp, mouse
gaatgtgtttgcatgtaagg

SEQ ID NO: 792689 - DNA, 20 bp, mouse
ggggaaatgaaaactgcgag

SEQ ID NO: 792690 - DNA, 20 bp, mouse
gggaacacttcatcctcttg

SEQ ID NO: 792691 - DNA, 20 bp, mouse
gtgtctatcaatgacgtctc

SEQ ID NO: 792692 - DNA, 20 bp, mouse
gtgcaggaacttgagctcgt

SEQ ID NO: 792693 - DNA, 20 bp, mouse
gaagtcaagaagttcacccc

SEQ ID NO: 792694 - DNA, 20 bp, mouse
ggaacttgagctcgtgggaa

SEQ ID NO: 792695 - DNA, 20 bp, mouse
gtgtttgcatgtaaggggga

SEQ ID NO: 792696 - DNA, 20 bp, mouse
gtgccggggtcggaaagctc

SEQ ID NO: 792697 - DNA, 20 bp, mouse
gcactggaggctcaggtggt

SEQ ID NO: 792698 - DNA, 20 bp, mouse
gggaagtgccacggcttcgg

SEQ ID NO: 792699 - DNA, 20 bp, mouse
gtcacaagctacagttgttg

SEQ ID NO: 792700 - DNA, 20 bp, mouse
gctctcggcggcccaaagat

SEQ ID NO: 792701 - DNA, 20 bp, mouse
ggggttccattgctcggccg

SEQ ID NO: 792702 - DNA, 20 bp, mouse
gtgttatgggcgttagttac

SEQ ID NO: 792703 - DNA, 20 bp, mouse
gacctgagcctccagtgccg

SEQ ID NO: 792704 - DNA, 20 bp, mouse
gcattgccgcggccgagcaa

SEQ ID NO: 792705 - DNA, 20 bp, mouse
gggcggcccaaagatgggtc

SEQ ID NO: 792706 - DNA, 20 bp, mouse
ggccgcgggaaggaggtcgg

SEQ ID NO: 792707 - DNA, 20 bp, mouse
gcgggaggggaagcggtgac

SEQ ID NO: 792708 - DNA, 20 bp, mouse
gctagagaaggtaggagcag

SEQ ID NO: 792709 - DNA, 20 bp, mouse
ggaaggaggtcggaggccga

SEQ ID NO: 792710 - DNA, 20 bp, mouse
gcgggcggagcagccagggg

SEQ ID NO: 792711 - DNA, 20 bp, mouse
gggggagggccgcgggaagg

SEQ ID NO: 792712 - DNA, 20 bp, mouse
gcgagggaagcttatcagag

SEQ ID NO: 792713 - DNA, 20 bp, mouse
ggcctccgacctccttcccg

SEQ ID NO: 792714 - DNA, 20 bp, mouse
gcggagcagccaggggcgga

SEQ ID NO: 792715 - DNA, 20 bp, mouse
ggaagctcttcgcagctggg

SEQ ID NO: 792716 - DNA, 20 bp, mouse
ggcgggcgccatcttgggga

SEQ ID NO: 792717 - DNA, 20 bp, mouse
ggggtggccaacctccgctg

SEQ ID NO: 792718 - DNA, 20 bp, mouse
gagcccttgaactccctagg

SEQ ID NO: 792719 - DNA, 20 bp, mouse
gccaggcgggcgccatcttg

SEQ ID NO: 792720 - DNA, 20 bp, mouse
gcggaggttggccacccagg

SEQ ID NO: 792721 - DNA, 20 bp, mouse
gggggaaggcggaggttacc

SEQ ID NO: 792722 - DNA, 20 bp, mouse
gcctaggaggctttcagtcc

SEQ ID NO: 792723 - DNA, 20 bp, mouse
gccaacctccgctggggaag

SEQ ID NO: 792724 - DNA, 20 bp, mouse
gaagcctcctagggagttca

SEQ ID NO: 792725 - DNA, 20 bp, mouse
gcctccgctggggaagtggc

SEQ ID NO: 792726 - DNA, 20 bp, mouse
gggagctggtggggcattta

SEQ ID NO: 792727 - DNA, 20 bp, mouse
gaggcctgaagccggctcta

SEQ ID NO: 792728 - DNA, 20 bp, mouse
ggggggcggggtcctagtgt

SEQ ID NO: 792729 - DNA, 20 bp, mouse
gcgcactaggagccggacga

SEQ ID NO: 792730 - DNA, 20 bp, mouse
ggcgcgacacgctctatcaa

SEQ ID NO: 792731 - DNA, 20 bp, mouse
ggacacccggaattagtctt

SEQ ID NO: 792732 - DNA, 20 bp, mouse
gggggccagagccttgcgaa

SEQ ID NO: 792733 - DNA, 20 bp, mouse
gtcggggcggagcaaggagc

SEQ ID NO: 792734 - DNA, 20 bp, mouse
ggggaccagggtcactcgct

SEQ ID NO: 792735 - DNA, 20 bp, mouse
gctagtggccaggagcacct

SEQ ID NO: 792736 - DNA, 20 bp, mouse
ggggacgcgcagactacctc

SEQ ID NO: 792737 - DNA, 20 bp, mouse
gcgtccccgcgatacttaaa

SEQ ID NO: 792738 - DNA, 20 bp, mouse
gcgccaggaacgcgcggcag

SEQ ID NO: 792739 - DNA, 20 bp, mouse
gcggcagaggtgcagagcgc

SEQ ID NO: 792740 - DNA, 20 bp, mouse
gcacctctgccgcgcgttcc

SEQ ID NO: 792741 - DNA, 20 bp, mouse
gcctctggccgactggagtc

SEQ ID NO: 792742 - DNA, 20 bp, mouse
gtagaccgagaaggcctgac

SEQ ID NO: 792743 - DNA, 20 bp, mouse
gaggcacagccaagggcttt

SEQ ID NO: 792744 - DNA, 20 bp, mouse
gctggcggccggactccagt

SEQ ID NO: 792745 - DNA, 20 bp, mouse
gggtgcagagcgctgggcgg

SEQ ID NO: 792746 - DNA, 20 bp, mouse
ggaggcgccttcggattcaa

SEQ ID NO: 792747 - DNA, 20 bp, mouse
gcgaggcaagagaacttgtg

SEQ ID NO: 792748 - DNA, 20 bp, mouse
ggcgccttcggattcaaggg

SEQ ID NO: 792749 - DNA, 20 bp, mouse
gctgggaccgggtacgtcag

SEQ ID NO: 792750 - DNA, 20 bp, mouse
gggcgccccaagcagtggca

SEQ ID NO: 792751 - DNA, 20 bp, mouse
gtatccccccttgaatccga

SEQ ID NO: 792752 - DNA, 20 bp, mouse
gaacgcccgcagatggctcg

SEQ ID NO: 792753 - DNA, 20 bp, mouse
gagcagtggcagggcggggt

SEQ ID NO: 792754 - DNA, 20 bp, mouse
gcatatatataaaaggggtg

SEQ ID NO: 792755 - DNA, 20 bp, mouse
ggccgccgcgagccatctgc

SEQ ID NO: 792756 - DNA, 20 bp, mouse
gcatgctccagatcttcaaa

SEQ ID NO: 792757 - DNA, 20 bp, mouse
gcctggaggtgggaaatcac

SEQ ID NO: 792758 - DNA, 20 bp, mouse
gtcaagaaactgtctgagcg

SEQ ID NO: 792759 - DNA, 20 bp, mouse
gtgaaaattcttagcggaga

SEQ ID NO: 792760 - DNA, 20 bp, mouse
ggaacttggaggccgagatc

SEQ ID NO: 792761 - DNA, 20 bp, mouse
ggacccctccagcaatctca

SEQ ID NO: 792762 - DNA, 20 bp, mouse
gggtcagccaaccagctcgg

SEQ ID NO: 792763 - DNA, 20 bp, mouse
ggggctctgaaaattcttag

SEQ ID NO: 792764 - DNA, 20 bp, mouse
gctcacaacggggaacttgg

SEQ ID NO: 792765 - DNA, 20 bp, mouse
gccccctgagattgctggag

SEQ ID NO: 792766 - DNA, 20 bp, mouse
gaggggatctctgcacaggt

SEQ ID NO: 792767 - DNA, 20 bp, mouse
ggtggaggggatctctgcac

SEQ ID NO: 792768 - DNA, 20 bp, mouse
gacccagaggctcggggagg

SEQ ID NO: 792769 - DNA, 20 bp, mouse
gtccgggcacagcagtgagt

SEQ ID NO: 792770 - DNA, 20 bp, mouse
ggctgtgcccggacccagga

SEQ ID NO: 792771 - DNA, 20 bp, mouse
gcccaggaaggcgccttgtg

SEQ ID NO: 792772 - DNA, 20 bp, mouse
gccccgagcctctgggtcca

SEQ ID NO: 792773 - DNA, 20 bp, mouse
ggaggcaggtagcattaaca

SEQ ID NO: 792774 - DNA, 20 bp, mouse
gacagtaaatccggaaggag

SEQ ID NO: 792775 - DNA, 20 bp, mouse
gccttccggatttactgtta

SEQ ID NO: 792776 - DNA, 20 bp, mouse
gtaggagtttttttctagta

SEQ ID NO: 792777 - DNA, 20 bp, mouse
gagtggttaagctatcctac

SEQ ID NO: 792778 - DNA, 20 bp, mouse
gcctgaggcttagtatgtta

SEQ ID NO: 792779 - DNA, 20 bp, mouse
ggtcaatttttctgaccagt

SEQ ID NO: 792780 - DNA, 20 bp, mouse
ggaacacgtataaacgacag

SEQ ID NO: 792781 - DNA, 20 bp, mouse
gaaattgaccatattaaatt

SEQ ID NO: 792782 - DNA, 20 bp, mouse
gtttgtgtgtcagtgtgcat

SEQ ID NO: 792783 - DNA, 20 bp, mouse
gcatataacccagatattga

SEQ ID NO: 792784 - DNA, 20 bp, mouse
gaacacaataactacaacag

SEQ ID NO: 792785 - DNA, 20 bp, mouse
gagtcattaccttcaatatc

SEQ ID NO: 792786 - DNA, 20 bp, mouse
gagggggcaacaatactcag

SEQ ID NO: 792787 - DNA, 20 bp, mouse
ggaaatcacaagtgtgtatc

SEQ ID NO: 792788 - DNA, 20 bp, mouse
gggaaatcaggatgaacgaa

SEQ ID NO: 792789 - DNA, 20 bp, mouse
ggagtattgttgccccctag

SEQ ID NO: 792790 - DNA, 20 bp, mouse
gggccgggcaaaggtagcac

SEQ ID NO: 792791 - DNA, 20 bp, mouse
ggccgcttccggcggaaatc

SEQ ID NO: 792792 - DNA, 20 bp, mouse
gagaacaaaaggccgggcaa

SEQ ID NO: 792793 - DNA, 20 bp, mouse
ggcgcccctcggcgcgaacg

SEQ ID NO: 792794 - DNA, 20 bp, mouse
gtatacaagctggttcaatc

SEQ ID NO: 792795 - DNA, 20 bp, mouse
gcacttgtgatttcagtaac

SEQ ID NO: 792796 - DNA, 20 bp, mouse
ggcggtccccgcagcctcat

SEQ ID NO: 792797 - DNA, 20 bp, mouse
ggaggctgcggggaccgcca

SEQ ID NO: 792798 - DNA, 20 bp, mouse
gcgctccaagaggcctgagg

SEQ ID NO: 792799 - DNA, 20 bp, mouse
gggaagaagccgagccaatg

SEQ ID NO: 792800 - DNA, 20 bp, mouse
gcatgcctacagactctcta

SEQ ID NO: 792801 - DNA, 20 bp, mouse
gagagtctgtaggcatgatt

SEQ ID NO: 792802 - DNA, 20 bp, mouse
ggagcgctccaagaggcctg

SEQ ID NO: 792803 - DNA, 20 bp, mouse
gcaagaggcctgaggcggga

SEQ ID NO: 792804 - DNA, 20 bp, mouse
gactctctaaggcagactct

SEQ ID NO: 792805 - DNA, 20 bp, mouse
gtcccagcatgcaaccgagc

SEQ ID NO: 792806 - DNA, 20 bp, mouse
ggatcctaaagcctagtccg

SEQ ID NO: 792807 - DNA, 20 bp, mouse
gctaacgttggcatcgctcc

SEQ ID NO: 792808 - DNA, 20 bp, mouse
gccgcggggcgcacgcgccg

SEQ ID NO: 792809 - DNA, 20 bp, mouse
gaacccgcggactaggcttt

SEQ ID NO: 792810 - DNA, 20 bp, mouse
gagccgcggtatcaaggtgc

SEQ ID NO: 792811 - DNA, 20 bp, mouse
gggccggcaccttgataccg

SEQ ID NO: 792812 - DNA, 20 bp, mouse
gtccctacggcacgtgacta

SEQ ID NO: 792813 - DNA, 20 bp, mouse
gcctagtccgcgggttgtcc

SEQ ID NO: 792814 - DNA, 20 bp, mouse
gtcccggagcagaaatcggt

SEQ ID NO: 792815 - DNA, 20 bp, mouse
gctgcgcagccgcggtatca

SEQ ID NO: 792816 - DNA, 20 bp, mouse
ggcctcgcgggacggcgacc

SEQ ID NO: 792817 - DNA, 20 bp, mouse
gggacggcgaccgggagtgc

SEQ ID NO: 792818 - DNA, 20 bp, mouse
gtggagtcgggtgcaaacga

SEQ ID NO: 792819 - DNA, 20 bp, mouse
gaggtgacaacgtggacgat

SEQ ID NO: 792820 - DNA, 20 bp, mouse
ggggaagtcgtacgtcgccg

SEQ ID NO: 792821 - DNA, 20 bp, mouse
gagtaaagaaggtgacaacg

SEQ ID NO: 792822 - DNA, 20 bp, mouse
ggtgctgggttctagggcta

SEQ ID NO: 792823 - DNA, 20 bp, mouse
gtagcagccgcctcgcggga

SEQ ID NO: 792824 - DNA, 20 bp, mouse
gctgccggaaatgtcgtaaa

SEQ ID NO: 792825 - DNA, 20 bp, mouse
ggcgctagaggataaaccga

SEQ ID NO: 792826 - DNA, 20 bp, mouse
gtgggcggggtttcggttag

SEQ ID NO: 792827 - DNA, 20 bp, mouse
gtgcctggactgcaaagcgt

SEQ ID NO: 792828 - DNA, 20 bp, mouse
gacgtcatgaacccccggga

SEQ ID NO: 792829 - DNA, 20 bp, mouse
gtcagctgactaagaactga

SEQ ID NO: 792830 - DNA, 20 bp, mouse
gcgtccaggtctggctcctc

SEQ ID NO: 792831 - DNA, 20 bp, mouse
ggactaagaactgaaggcac

SEQ ID NO: 792832 - DNA, 20 bp, mouse
gtgtagccgtggtctcccgg

SEQ ID NO: 792833 - DNA, 20 bp, mouse
ggagtgcgggtcgttgtcca

SEQ ID NO: 792834 - DNA, 20 bp, mouse
gactcgccacgccctcccgg

SEQ ID NO: 792835 - DNA, 20 bp, mouse
gctcccggaggagccagacc

SEQ ID NO: 792836 - DNA, 20 bp, mouse
gccccctgggccaaagtccc

SEQ ID NO: 792837 - DNA, 20 bp, mouse
ggggctggtggcttcctcct

SEQ ID NO: 792838 - DNA, 20 bp, mouse
gcgcccgggcgttcgagcta

SEQ ID NO: 792839 - DNA, 20 bp, mouse
gaggtcgttgcgtgttggct

SEQ ID NO: 792840 - DNA, 20 bp, mouse
gaatagcctgcacacacggg

SEQ ID NO: 792841 - DNA, 20 bp, mouse
ggcgcgaggtcgttgcgtgt

SEQ ID NO: 792842 - DNA, 20 bp, mouse
ggcccctgggaacaagatgg

SEQ ID NO: 792843 - DNA, 20 bp, mouse
gcgtgttggctcggctccgg

SEQ ID NO: 792844 - DNA, 20 bp, mouse
gttgcgtgttggctcggctc

SEQ ID NO: 792845 - DNA, 20 bp, mouse
gaacaagatggcggggccag

SEQ ID NO: 792846 - DNA, 20 bp, mouse
gagcacaaccggcttcgcta

SEQ ID NO: 792847 - DNA, 20 bp, mouse
gctaaacctcaaaacagtat

SEQ ID NO: 792848 - DNA, 20 bp, mouse
ggggaagctaagtttgcgac

SEQ ID NO: 792849 - DNA, 20 bp, mouse
gactggaggccacccggggc

SEQ ID NO: 792850 - DNA, 20 bp, mouse
gtcccaaaccatagcgaagc

SEQ ID NO: 792851 - DNA, 20 bp, mouse
gaaccggcttcgctatggtt

SEQ ID NO: 792852 - DNA, 20 bp, mouse
gaagctaagtttgcgactgg

SEQ ID NO: 792853 - DNA, 20 bp, mouse
gcacgtgacgcgcgcaaccg

SEQ ID NO: 792854 - DNA, 20 bp, mouse
ggtgtaaagccttggcggtt

SEQ ID NO: 792855 - DNA, 20 bp, mouse
gaggatataaacaactgaag

SEQ ID NO: 792856 - DNA, 20 bp, mouse
gcgcgggagaagaggagcat

SEQ ID NO: 792857 - DNA, 20 bp, mouse
gcagcctgggaggtgtagtt

SEQ ID NO: 792858 - DNA, 20 bp, mouse
gcagagctacacaacctcgc

SEQ ID NO: 792859 - DNA, 20 bp, mouse
gaaaggtcggctggagtcga

SEQ ID NO: 792860 - DNA, 20 bp, mouse
gactacgtgcgaagtatctt

SEQ ID NO: 792861 - DNA, 20 bp, mouse
gagcccaaactacacctccc

SEQ ID NO: 792862 - DNA, 20 bp, mouse
ggtagttgccaaaggtcggc

SEQ ID NO: 792863 - DNA, 20 bp, mouse
gggggcccctcgtaactcgg

SEQ ID NO: 792864 - DNA, 20 bp, mouse
ggtgcgaagtatcttgggaa

SEQ ID NO: 792865 - DNA, 20 bp, mouse
gtgggaatggtagttgccaa

SEQ ID NO: 792866 - DNA, 20 bp, mouse
gtcggcgtcgcctgcatgga

SEQ ID NO: 792867 - DNA, 20 bp, mouse
gcgccggggccaaagggtaa

SEQ ID NO: 792868 - DNA, 20 bp, mouse
gagctgcggggcgggatcag

SEQ ID NO: 792869 - DNA, 20 bp, mouse
ggcgcgcccggcatagtgaa

SEQ ID NO: 792870 - DNA, 20 bp, mouse
gcggaggcgcgaactgtatc

SEQ ID NO: 792871 - DNA, 20 bp, mouse
ggcggggccaataaactgac

SEQ ID NO: 792872 - DNA, 20 bp, mouse
ggatcccgccccgcagctca

SEQ ID NO: 792873 - DNA, 20 bp, mouse
gcgcgcgcgcggttgccctg

SEQ ID NO: 792874 - DNA, 20 bp, mouse
ggcgaacgtaactagggcga

SEQ ID NO: 792875 - DNA, 20 bp, mouse
gggcccgaacccgggaatct

SEQ ID NO: 792876 - DNA, 20 bp, mouse
gcccacgtgcgcagaatcct

SEQ ID NO: 792877 - DNA, 20 bp, mouse
gcgcctgggcccacccccgg

SEQ ID NO: 792878 - DNA, 20 bp, mouse
gccagcgcgcggtcagtccc

SEQ ID NO: 792879 - DNA, 20 bp, mouse
ggaggagcggagcccccaac

SEQ ID NO: 792880 - DNA, 20 bp, mouse
gggagtcgcgggcaagaagg

SEQ ID NO: 792881 - DNA, 20 bp, mouse
ggagccgggccgggcacacc

SEQ ID NO: 792882 - DNA, 20 bp, mouse
gcagggcggcgtggctctcc

SEQ ID NO: 792883 - DNA, 20 bp, mouse
gcggcccggtgtgcccggcc

SEQ ID NO: 792884 - DNA, 20 bp, mouse
gcgggcacaccgggccggtt

SEQ ID NO: 792885 - DNA, 20 bp, mouse
gcggagccccggccacgaag

SEQ ID NO: 792886 - DNA, 20 bp, mouse
ggagacagcagcaaagaaag

SEQ ID NO: 792887 - DNA, 20 bp, mouse
ggcgcggaacgtaacttccg

SEQ ID NO: 792888 - DNA, 20 bp, mouse
gtgtaagtgtagggacctgc

SEQ ID NO: 792889 - DNA, 20 bp, mouse
gaacgtaacttccggggcta

SEQ ID NO: 792890 - DNA, 20 bp, mouse
gggagtccgcgctaagaatc

SEQ ID NO: 792891 - DNA, 20 bp, mouse
gacaggcagccgcgcatgtg

SEQ ID NO: 792892 - DNA, 20 bp, mouse
gggctagggggcgggccgtg

SEQ ID NO: 792893 - DNA, 20 bp, mouse
ggacgccgagtttttctatc

SEQ ID NO: 792894 - DNA, 20 bp, mouse
gaaaactcggcgtccggggg

SEQ ID NO: 792895 - DNA, 20 bp, mouse
gggggacctggcagatattc

SEQ ID NO: 792896 - DNA, 20 bp, mouse
ggggcggaagtcaaagatgt

SEQ ID NO: 792897 - DNA, 20 bp, mouse
ggtatcgcgccacaaggacg

SEQ ID NO: 792898 - DNA, 20 bp, mouse
gaagacgcgcgtgcgcgtga

SEQ ID NO: 792899 - DNA, 20 bp, mouse
gtagtctgaagtggttatgg

SEQ ID NO: 792900 - DNA, 20 bp, mouse
gtgtgtgcagtgtttgttgc

SEQ ID NO: 792901 - DNA, 20 bp, mouse
ggagcgttccggtgcaagca

SEQ ID NO: 792902 - DNA, 20 bp, mouse
ggcaccggaagtagagagct

SEQ ID NO: 792903 - DNA, 20 bp, mouse
gtccgcccgaagctctaggt

SEQ ID NO: 792904 - DNA, 20 bp, mouse
ggcgttccggctccgcgtca

SEQ ID NO: 792905 - DNA, 20 bp, mouse
gcatacggttcagtacagta

SEQ ID NO: 792906 - DNA, 20 bp, mouse
gtagacccgcctctccggct

SEQ ID NO: 792907 - DNA, 20 bp, mouse
gggagaggcgggtctaaaag

SEQ ID NO: 792908 - DNA, 20 bp, mouse
gggtctaaaagcggatttca

SEQ ID NO: 792909 - DNA, 20 bp, mouse
gagagggctcctaaactgac

SEQ ID NO: 792910 - DNA, 20 bp, mouse
gcagggcgaggggtgtggtc

SEQ ID NO: 792911 - DNA, 20 bp, mouse
gaaagcggatttcagggcga

SEQ ID NO: 792912 - DNA, 20 bp, mouse
gtaaactgactggcagaagg

SEQ ID NO: 792913 - DNA, 20 bp, mouse
ggttgcagcccgagccggag

SEQ ID NO: 792914 - DNA, 20 bp, mouse
gagacgccgagatgctctga

SEQ ID NO: 792915 - DNA, 20 bp, mouse
gagagcatctcggcgtctat

SEQ ID NO: 792916 - DNA, 20 bp, mouse
gggtgccagcaaccaggaga

SEQ ID NO: 792917 - DNA, 20 bp, mouse
gaggcagggtgccagcaacc

SEQ ID NO: 792918 - DNA, 20 bp, mouse
gcaacgctggagcctagaat

SEQ ID NO: 792919 - DNA, 20 bp, mouse
gggatctcagccagcaacaa

SEQ ID NO: 792920 - DNA, 20 bp, mouse
gccccctccccggagaccgc

SEQ ID NO: 792921 - DNA, 20 bp, mouse
gagccctgcggtctccgggg

SEQ ID NO: 792922 - DNA, 20 bp, mouse
ggcgttggatgcatgctcta

SEQ ID NO: 792923 - DNA, 20 bp, mouse
gagggggaatcaagcaggca

SEQ ID NO: 792924 - DNA, 20 bp, mouse
gaggctgaagtcaggccagt

SEQ ID NO: 792925 - DNA, 20 bp, mouse
gggtgccctctcagaagagg

SEQ ID NO: 792926 - DNA, 20 bp, mouse
ggagtctgaggccaagagag

SEQ ID NO: 792927 - DNA, 20 bp, mouse
gtctccgtgtatatacatgc

SEQ ID NO: 792928 - DNA, 20 bp, mouse
gctggctaaaagaataggct

SEQ ID NO: 792929 - DNA, 20 bp, mouse
gggtccagcatgtatataca

SEQ ID NO: 792930 - DNA, 20 bp, mouse
gaatacaaaacatggccagg

SEQ ID NO: 792931 - DNA, 20 bp, mouse
gcttacagagagttcagact

SEQ ID NO: 792932 - DNA, 20 bp, mouse
gcgcctcagtgaggttcttt

SEQ ID NO: 792933 - DNA, 20 bp, mouse
gtatacacggagactcctcc

SEQ ID NO: 792934 - DNA, 20 bp, mouse
ggaacctcactgaggcgtgc

SEQ ID NO: 792935 - DNA, 20 bp, mouse
ggctatgccaatacaaaaca

SEQ ID NO: 792936 - DNA, 20 bp, mouse
ggaacacagggccctagtgg

SEQ ID NO: 792937 - DNA, 20 bp, mouse
gggcttcatagtttctcaga

SEQ ID NO: 792938 - DNA, 20 bp, mouse
gagggcatatgggagagtat

SEQ ID NO: 792939 - DNA, 20 bp, mouse
gttagggaagtagggcatat

SEQ ID NO: 792940 - DNA, 20 bp, mouse
ggtttctcagatggcctatt

SEQ ID NO: 792941 - DNA, 20 bp, mouse
gatgggagtgtgtgggttta

SEQ ID NO: 792942 - DNA, 20 bp, mouse
gtctagagacatggtctctg

SEQ ID NO: 792943 - DNA, 20 bp, mouse
gacatggtctctggggttgc

SEQ ID NO: 792944 - DNA, 20 bp, mouse
gatggaacacagggccctag

SEQ ID NO: 792945 - DNA, 20 bp, mouse
gatcaagaaatgggagtgtg

SEQ ID NO: 792946 - DNA, 20 bp, mouse
gcaggcgcatcgcaggcaaa

SEQ ID NO: 792947 - DNA, 20 bp, mouse
gttgccgcccaaccactctc

SEQ ID NO: 792948 - DNA, 20 bp, mouse
gcctaggggaaagtgactga

SEQ ID NO: 792949 - DNA, 20 bp, mouse
gggttgggcggcaacattac

SEQ ID NO: 792950 - DNA, 20 bp, mouse
gtctctggtaatttgttcag

SEQ ID NO: 792951 - DNA, 20 bp, mouse
gacctggaaggcaagcccta

SEQ ID NO: 792952 - DNA, 20 bp, mouse
gccgtccaaccaatcagaaa

SEQ ID NO: 792953 - DNA, 20 bp, mouse
gacaaagatagccacaacgc

SEQ ID NO: 792954 - DNA, 20 bp, mouse
gcacaacgcaggcgcatcgc

SEQ ID NO: 792955 - DNA, 20 bp, mouse
gaccaagtgtactttctacc

SEQ ID NO: 792956 - DNA, 20 bp, mouse
gggggaaatgtgtggttctc

SEQ ID NO: 792957 - DNA, 20 bp, mouse
gggaaaggaaggcgacctcg

SEQ ID NO: 792958 - DNA, 20 bp, mouse
ggagggctcaaggatggttc

SEQ ID NO: 792959 - DNA, 20 bp, mouse
gcgctaactggggaaatgtg

SEQ ID NO: 792960 - DNA, 20 bp, mouse
gacctcgaggtcgcgttctg

SEQ ID NO: 792961 - DNA, 20 bp, mouse
gcgaggtcgcgttctgtggg

SEQ ID NO: 792962 - DNA, 20 bp, mouse
gtccgggctgctggaaagga

SEQ ID NO: 792963 - DNA, 20 bp, mouse
gaaccagtgcgcgctaactg

SEQ ID NO: 792964 - DNA, 20 bp, mouse
ggggcttccggcgagctgga

SEQ ID NO: 792965 - DNA, 20 bp, mouse
gtcccatggagtatcttcac

SEQ ID NO: 792966 - DNA, 20 bp, mouse
gcagctgaagagtcgctgga

SEQ ID NO: 792967 - DNA, 20 bp, mouse
gtcaaccaaccagataaagt

SEQ ID NO: 792968 - DNA, 20 bp, mouse
gccagatgcccagcctgcgt

SEQ ID NO: 792969 - DNA, 20 bp, mouse
gggagcagctgaagagtcgc

SEQ ID NO: 792970 - DNA, 20 bp, mouse
gctacggagcaactgtactt

SEQ ID NO: 792971 - DNA, 20 bp, mouse
gaacgcagcagcaggatcta

SEQ ID NO: 792972 - DNA, 20 bp, mouse
gaagcccaggtatcacctct

SEQ ID NO: 792973 - DNA, 20 bp, mouse
gcagcagcaggatctagggg

SEQ ID NO: 792974 - DNA, 20 bp, mouse
gtgtgcccactttatctggt

SEQ ID NO: 792975 - DNA, 20 bp, mouse
gtcactgtgcccactttatc

SEQ ID NO: 792976 - DNA, 20 bp, mouse
gcccgccgccatctcggaaa

SEQ ID NO: 792977 - DNA, 20 bp, mouse
gctgccgcggggtccgaagg

SEQ ID NO: 792978 - DNA, 20 bp, mouse
gaggcgaacacgcgagtcag

SEQ ID NO: 792979 - DNA, 20 bp, mouse
gcaagcgtggaggggagcgc

SEQ ID NO: 792980 - DNA, 20 bp, mouse
ggacacagatataacgtcta

SEQ ID NO: 792981 - DNA, 20 bp, mouse
ggcggcgcctgtgtcagaac

SEQ ID NO: 792982 - DNA, 20 bp, mouse
gatctcggaaaagggcaggg

SEQ ID NO: 792983 - DNA, 20 bp, mouse
gcggctggctggggttgagg

SEQ ID NO: 792984 - DNA, 20 bp, mouse
ggctgcacctcccagaatag

SEQ ID NO: 792985 - DNA, 20 bp, mouse
gggagagcctgttctgacac

SEQ ID NO: 792986 - DNA, 20 bp, mouse
ggggcgggaggatgttgtgt

SEQ ID NO: 792987 - DNA, 20 bp, mouse
gtggtcagactcgaggaaag

SEQ ID NO: 792988 - DNA, 20 bp, mouse
ggaggggcggggcagaaagt

SEQ ID NO: 792989 - DNA, 20 bp, mouse
ggtcgaggggcgtggtctgg

SEQ ID NO: 792990 - DNA, 20 bp, mouse
ggcgtggccgccagagtggg

SEQ ID NO: 792991 - DNA, 20 bp, mouse
ggcaatgcatttgatgctgt

SEQ ID NO: 792992 - DNA, 20 bp, mouse
ggcagtacccccatctcctg

SEQ ID NO: 792993 - DNA, 20 bp, mouse
gggaggatgttgtgtgggcg

SEQ ID NO: 792994 - DNA, 20 bp, mouse
gtcagactcgaggaaagtgg

SEQ ID NO: 792995 - DNA, 20 bp, mouse
gagtgggcgaggccgtcgag

SEQ ID NO: 792996 - DNA, 20 bp, mouse
gcggggaagccggagagaaa

SEQ ID NO: 792997 - DNA, 20 bp, mouse
gaggaaaggcgggcgagaag

SEQ ID NO: 792998 - DNA, 20 bp, mouse
gcgtagacgtggtctctaca

SEQ ID NO: 792999 - DNA, 20 bp, mouse
gacgtcgcctaggcccgcag

SEQ ID NO: 793000 - DNA, 20 bp, mouse
gtctacgattggtcgctcgt

SEQ ID NO: 793001 - DNA, 20 bp, mouse
ggaagcgcctcagttccgat

SEQ ID NO: 793002 - DNA, 20 bp, mouse
gtcctggccaatcggaactg

SEQ ID NO: 793003 - DNA, 20 bp, mouse
gggcgcttcttgtatgaata

SEQ ID NO: 793004 - DNA, 20 bp, mouse
gccaaaagagcatcacatcc

SEQ ID NO: 793005 - DNA, 20 bp, mouse
ggcatcacatcctggccaat

SEQ ID NO: 793006 - DNA, 20 bp, mouse
ggggacgcgcgctccggagg

SEQ ID NO: 793007 - DNA, 20 bp, mouse
gagcgcaccagcggagcctg

SEQ ID NO: 793008 - DNA, 20 bp, mouse
ggaactgaatctctgtgtac

SEQ ID NO: 793009 - DNA, 20 bp, mouse
gtggggaaatacacgaagtc

SEQ ID NO: 793010 - DNA, 20 bp, mouse
gccagcgcccgcacccactc

SEQ ID NO: 793011 - DNA, 20 bp, mouse
ggcaaatgcgcccagaaagg

SEQ ID NO: 793012 - DNA, 20 bp, mouse
gccccctggaggagggaaag

SEQ ID NO: 793013 - DNA, 20 bp, mouse
ggagcgcgagcgagcactag

SEQ ID NO: 793014 - DNA, 20 bp, mouse
gctagcggagcctgggaggc

SEQ ID NO: 793015 - DNA, 20 bp, mouse
gcgctgtgccctacaccccc

SEQ ID NO: 793016 - DNA, 20 bp, mouse
ggccgccaggcggagcctta

SEQ ID NO: 793017 - DNA, 20 bp, mouse
ggctgtggtccaactaaaca

SEQ ID NO: 793018 - DNA, 20 bp, mouse
ggcggggtcagctccaagca

SEQ ID NO: 793019 - DNA, 20 bp, mouse
gccgcctcggtcccgcccta

SEQ ID NO: 793020 - DNA, 20 bp, mouse
gaggcagaggcaggcgaatg

SEQ ID NO: 793021 - DNA, 20 bp, mouse
gaaggaggaaaccgttgcgc

SEQ ID NO: 793022 - DNA, 20 bp, mouse
gaagaggagagatggaattt

SEQ ID NO: 793023 - DNA, 20 bp, mouse
ggcagcggaaatgctcctta

SEQ ID NO: 793024 - DNA, 20 bp, mouse
ggtggtccaactaaacaagg

SEQ ID NO: 793025 - DNA, 20 bp, mouse
gcaccaagtgcctgcttgat

SEQ ID NO: 793026 - DNA, 20 bp, mouse
gcggtgagaggcgtagggga

SEQ ID NO: 793027 - DNA, 20 bp, mouse
gtgccggttccggtcttccg

SEQ ID NO: 793028 - DNA, 20 bp, mouse
gagactgccctcaattaaaa

SEQ ID NO: 793029 - DNA, 20 bp, mouse
gtgcccgccataatacgtag

SEQ ID NO: 793030 - DNA, 20 bp, mouse
ggcaccgccattttaattga

SEQ ID NO: 793031 - DNA, 20 bp, mouse
gaagctgcggtgagaggcgt

SEQ ID NO: 793032 - DNA, 20 bp, mouse
gaccggaaccggcaattggg

SEQ ID NO: 793033 - DNA, 20 bp, mouse
gggacagcgctgcataaggc

SEQ ID NO: 793034 - DNA, 20 bp, mouse
gcggggcggggatccaagta

SEQ ID NO: 793035 - DNA, 20 bp, mouse
gaagaccggaaccggcaatt

SEQ ID NO: 793036 - DNA, 20 bp, mouse
gggcgcgcgcgcaatccgga

SEQ ID NO: 793037 - DNA, 20 bp, mouse
gcgtgtctggagctagcgga

SEQ ID NO: 793038 - DNA, 20 bp, mouse
ggtggacagatgccactcta

SEQ ID NO: 793039 - DNA, 20 bp, mouse
gcaaagccagccatgcggac

SEQ ID NO: 793040 - DNA, 20 bp, mouse
gtgccaggatggaagcagac

SEQ ID NO: 793041 - DNA, 20 bp, mouse
gtggagctagcggagggtgg

SEQ ID NO: 793042 - DNA, 20 bp, mouse
ggccgggaagagccgccctc

SEQ ID NO: 793043 - DNA, 20 bp, mouse
gtccggagggcggctcttcc

SEQ ID NO: 793044 - DNA, 20 bp, mouse
ggcacggcgcgcgcgcaatc

SEQ ID NO: 793045 - DNA, 20 bp, mouse
ggcgcgcgcaatccggaggg

SEQ ID NO: 793046 - DNA, 20 bp, mouse
gaggcgtccccgcccttctg

SEQ ID NO: 793047 - DNA, 20 bp, mouse
gcagccctgcggactctgat

SEQ ID NO: 793048 - DNA, 20 bp, mouse
gctggggaccagattggacg

SEQ ID NO: 793049 - DNA, 20 bp, mouse
ggccgccaggctacaggtgc

SEQ ID NO: 793050 - DNA, 20 bp, mouse
gcaagaacggaacgcgagca

SEQ ID NO: 793051 - DNA, 20 bp, mouse
gtctccaatcagagtccgca

SEQ ID NO: 793052 - DNA, 20 bp, mouse
gttggacgaggttgcaaacg

SEQ ID NO: 793053 - DNA, 20 bp, mouse
gacaccagaactgaggagga

SEQ ID NO: 793054 - DNA, 20 bp, mouse
gcccgatgacagcaacgaca

SEQ ID NO: 793055 - DNA, 20 bp, mouse
gccaggctacaggtgcaggt

SEQ ID NO: 793056 - DNA, 20 bp, mouse
gctggaggacgggatcccga

SEQ ID NO: 793057 - DNA, 20 bp, mouse
gcctcctgggatcaccaagc

SEQ ID NO: 793058 - DNA, 20 bp, mouse
gtgcatccacccaggagcca

SEQ ID NO: 793059 - DNA, 20 bp, mouse
ggatcaccaagctggaggac

SEQ ID NO: 793060 - DNA, 20 bp, mouse
gtgggtggatgcaggggcac

SEQ ID NO: 793061 - DNA, 20 bp, mouse
gcactgggattggatttctg

SEQ ID NO: 793062 - DNA, 20 bp, mouse
gcccgagggacgtctgggat

SEQ ID NO: 793063 - DNA, 20 bp, mouse
gtggtggcccatgtcgagga

SEQ ID NO: 793064 - DNA, 20 bp, mouse
ggggatcccgtcctccagct

SEQ ID NO: 793065 - DNA, 20 bp, mouse
gcctgggatcaccaagctgg

SEQ ID NO: 793066 - DNA, 20 bp, mouse
gcacactcgcgggtggagag

SEQ ID NO: 793067 - DNA, 20 bp, mouse
gtgctcgcgcgcacactcgc

SEQ ID NO: 793068 - DNA, 20 bp, mouse
gcaccatgacgcttccgaag

SEQ ID NO: 793069 - DNA, 20 bp, mouse
gaccccagcaggatgtaccc

SEQ ID NO: 793070 - DNA, 20 bp, mouse
gcagcaggatgtacccaggg

SEQ ID NO: 793071 - DNA, 20 bp, mouse
gggtctctcccagacctctt

SEQ ID NO: 793072 - DNA, 20 bp, mouse
gctgtcagctgcaccgccct

SEQ ID NO: 793073 - DNA, 20 bp, mouse
gggaagcgtcatggtgcccg

SEQ ID NO: 793074 - DNA, 20 bp, mouse
ggtctgggagagaccccagc

SEQ ID NO: 793075 - DNA, 20 bp, mouse
ggacgcttccgaagaggtct

SEQ ID NO: 793076 - DNA, 20 bp, mouse
gaggagagacttggggtact

SEQ ID NO: 793077 - DNA, 20 bp, mouse
ggaggagcgcacgctggcaa

SEQ ID NO: 793078 - DNA, 20 bp, mouse
gctcccgcccctgcgaatgt

SEQ ID NO: 793079 - DNA, 20 bp, mouse
gagccatgggagaacgagag

SEQ ID NO: 793080 - DNA, 20 bp, mouse
ggcagagagctaggtctcaa

SEQ ID NO: 793081 - DNA, 20 bp, mouse
gaaagccgccagtaccgggt

SEQ ID NO: 793082 - DNA, 20 bp, mouse
gtgcccgacattcgcagggg

SEQ ID NO: 793083 - DNA, 20 bp, mouse
ggccaagtcccgggctgcta

SEQ ID NO: 793084 - DNA, 20 bp, mouse
gcccgggctgctaggggctg

SEQ ID NO: 793085 - DNA, 20 bp, mouse
gcgtctcggaggtgcgatcc

SEQ ID NO: 793086 - DNA, 20 bp, mouse
ggaacctagcaccttccact

SEQ ID NO: 793087 - DNA, 20 bp, mouse
ggaggggcggactctggaca

SEQ ID NO: 793088 - DNA, 20 bp, mouse
gtgaggagaggggcggactc

SEQ ID NO: 793089 - DNA, 20 bp, mouse
ggggccataactgtcaatct

SEQ ID NO: 793090 - DNA, 20 bp, mouse
ggtgcctcgtgcttctccct

SEQ ID NO: 793091 - DNA, 20 bp, mouse
gtctccctgggcaaggggcg

SEQ ID NO: 793092 - DNA, 20 bp, mouse
gcaaggggagcgcatgcgtg

SEQ ID NO: 793093 - DNA, 20 bp, mouse
gaatcagcattgtgtaaggc

SEQ ID NO: 793094 - DNA, 20 bp, mouse
gcagcattgtgtaaggcggg

SEQ ID NO: 793095 - DNA, 20 bp, mouse
ggcggactctggacagggct

SEQ ID NO: 793096 - DNA, 20 bp, mouse
gacctggctcagggagcaga

SEQ ID NO: 793097 - DNA, 20 bp, mouse
ggaaggcagcagcagcgacc

SEQ ID NO: 793098 - DNA, 20 bp, mouse
gcagggcaggctcatcactt

SEQ ID NO: 793099 - DNA, 20 bp, mouse
gaaccctccacctagcaacg

SEQ ID NO: 793100 - DNA, 20 bp, mouse
gagcagcagcgacctggctc

SEQ ID NO: 793101 - DNA, 20 bp, mouse
gaggctcatcacttgggttc

SEQ ID NO: 793102 - DNA, 20 bp, mouse
gtgccccgttgctaggtgga

SEQ ID NO: 793103 - DNA, 20 bp, mouse
gaattaggtgacttgcgtga

SEQ ID NO: 793104 - DNA, 20 bp, mouse
gggtgagtgcctaggattcc

SEQ ID NO: 793105 - DNA, 20 bp, mouse
gccaagcagcatctcactgt

SEQ ID NO: 793106 - DNA, 20 bp, mouse
gtcagtgcgtggcaatgggt

SEQ ID NO: 793107 - DNA, 20 bp, mouse
ggcgcgggaaatcacgtcga

SEQ ID NO: 793108 - DNA, 20 bp, mouse
gcgaaggcctacaaactaaa

SEQ ID NO: 793109 - DNA, 20 bp, mouse
gcctgggcggagcctagaag

SEQ ID NO: 793110 - DNA, 20 bp, mouse
ggtaggtcagtgcgtggcaa

SEQ ID NO: 793111 - DNA, 20 bp, mouse
gtcatgctgaccaatggctg

SEQ ID NO: 793112 - DNA, 20 bp, mouse
gtgggttggtcgcactgcat

SEQ ID NO: 793113 - DNA, 20 bp, mouse
gtcagcatgacgctcctggg

SEQ ID NO: 793114 - DNA, 20 bp, mouse
gtggtcagcatgacgctcct

SEQ ID NO: 793115 - DNA, 20 bp, mouse
gagtgtgatgaaagcataca

SEQ ID NO: 793116 - DNA, 20 bp, mouse
gggttcgattagcgcggaga

SEQ ID NO: 793117 - DNA, 20 bp, mouse
gggtgggtcagaggcggtag

SEQ ID NO: 793118 - DNA, 20 bp, mouse
gccctcggggcccacctcta

SEQ ID NO: 793119 - DNA, 20 bp, mouse
gaggcggtaggggcgtgtct

SEQ ID NO: 793120 - DNA, 20 bp, mouse
gcctctgcccgccggagcta

SEQ ID NO: 793121 - DNA, 20 bp, mouse
gacaaggcgtggtcctggaa

SEQ ID NO: 793122 - DNA, 20 bp, mouse
gcagtcggtcgaagaaggaa

SEQ ID NO: 793123 - DNA, 20 bp, mouse
gggccagcaggggtgatgga

SEQ ID NO: 793124 - DNA, 20 bp, mouse
gcctagaggcgagggatcca

SEQ ID NO: 793125 - DNA, 20 bp, mouse
ggcgagacggcctgcggggt

SEQ ID NO: 793126 - DNA, 20 bp, mouse
gcagacggacacgtcggatg

SEQ ID NO: 793127 - DNA, 20 bp, mouse
gtcaaccagcaaccttccca

SEQ ID NO: 793128 - DNA, 20 bp, mouse
gccccaaccccgtcccggat

SEQ ID NO: 793129 - DNA, 20 bp, mouse
ggaggagcagacggacacgt

SEQ ID NO: 793130 - DNA, 20 bp, mouse
gagcctgtccggtgtctcac

SEQ ID NO: 793131 - DNA, 20 bp, mouse
gggctctcgcgatcccgcgt

SEQ ID NO: 793132 - DNA, 20 bp, mouse
gccgctcccggctaccgctg

SEQ ID NO: 793133 - DNA, 20 bp, mouse
gggtgagcgaggcaccttgt

SEQ ID NO: 793134 - DNA, 20 bp, mouse
gtggagaggaactgcacaag

SEQ ID NO: 793135 - DNA, 20 bp, mouse
ggggagcggaagcgaggtca

SEQ ID NO: 793136 - DNA, 20 bp, mouse
ggccaaagggccagctcaag

SEQ ID NO: 793137 - DNA, 20 bp, mouse
gctgtgtggtggcttccgaa

SEQ ID NO: 793138 - DNA, 20 bp, mouse
gaccatgcacagggactcat

SEQ ID NO: 793139 - DNA, 20 bp, mouse
gggtctggatagatctctgt

SEQ ID NO: 793140 - DNA, 20 bp, mouse
ggggtgccgggtggacagtt

SEQ ID NO: 793141 - DNA, 20 bp, mouse
ggtggcttccgaagggaaga

SEQ ID NO: 793142 - DNA, 20 bp, mouse
gccggccccgccctcccaac

SEQ ID NO: 793143 - DNA, 20 bp, mouse
gagcctgtgtccacgtgaag

SEQ ID NO: 793144 - DNA, 20 bp, mouse
gcggcacccaaccaaccctg

SEQ ID NO: 793145 - DNA, 20 bp, mouse
gggcgtcttggagccctctg

SEQ ID NO: 793146 - DNA, 20 bp, mouse
gcggacacgcccatcatctc

SEQ ID NO: 793147 - DNA, 20 bp, mouse
gactccaggagcctcctaca

SEQ ID NO: 793148 - DNA, 20 bp, mouse
gcacgcagtagtatacaagg

SEQ ID NO: 793149 - DNA, 20 bp, mouse
ggccgctctcccgagatgat

SEQ ID NO: 793150 - DNA, 20 bp, mouse
ggctccgcgggcgtggtctc

SEQ ID NO: 793151 - DNA, 20 bp, mouse
gtgggatgctcaatgggctg

SEQ ID NO: 793152 - DNA, 20 bp, mouse
gactgggcggggtctcgcag

SEQ ID NO: 793153 - DNA, 20 bp, mouse
gacccccagaacacatcctt

SEQ ID NO: 793154 - DNA, 20 bp, mouse
gcagaattgggatgctcaat

SEQ ID NO: 793155 - DNA, 20 bp, mouse
gccaggagcctcctacaggg

SEQ ID NO: 793156 - DNA, 20 bp, mouse
gaaaccacagcgatgtgcac

SEQ ID NO: 793157 - DNA, 20 bp, mouse
gtggtcctaaaaagcagggg

SEQ ID NO: 793158 - DNA, 20 bp, mouse
ggggaggatgctgcaaatca

SEQ ID NO: 793159 - DNA, 20 bp, mouse
ggtctcccactgttaaaccc

SEQ ID NO: 793160 - DNA, 20 bp, mouse
gctccaacaacaagagtagg

SEQ ID NO: 793161 - DNA, 20 bp, mouse
ggccgtaagttgagagagga

SEQ ID NO: 793162 - DNA, 20 bp, mouse
gcctctccaacaacaagagt

SEQ ID NO: 793163 - DNA, 20 bp, mouse
gtgtccggtgcacatcgctg

SEQ ID NO: 793164 - DNA, 20 bp, mouse
ggatgggggtgaagcgaggc

SEQ ID NO: 793165 - DNA, 20 bp, mouse
ggtgcaccggacaggaaaag

SEQ ID NO: 793166 - DNA, 20 bp, mouse
gctgctgcgagggaaggggt

SEQ ID NO: 793167 - DNA, 20 bp, mouse
gcagacgcggcagaggatgt

SEQ ID NO: 793168 - DNA, 20 bp, mouse
gcaaggctgctgcgagggaa

SEQ ID NO: 793169 - DNA, 20 bp, mouse
ggccgccaaggctgctgcga

SEQ ID NO: 793170 - DNA, 20 bp, mouse
gcacctgccgcacgcagacg

SEQ ID NO: 793171 - DNA, 20 bp, mouse
gcctctgccgcgtctgcgtg

SEQ ID NO: 793172 - DNA, 20 bp, mouse
gtgcgtgcggcaggtgggtc

SEQ ID NO: 793173 - DNA, 20 bp, mouse
gtgtgggctcgcaataccaa

SEQ ID NO: 793174 - DNA, 20 bp, mouse
gaggcaacaggctatctaaa

SEQ ID NO: 793175 - DNA, 20 bp, mouse
gcagccttggcggcgtgagg

SEQ ID NO: 793176 - DNA, 20 bp, mouse
gaacccagaggccaaaatgt

SEQ ID NO: 793177 - DNA, 20 bp, mouse
gaggtctggtgagaacccag

SEQ ID NO: 793178 - DNA, 20 bp, mouse
gtgggctaaagtcgtaattg

SEQ ID NO: 793179 - DNA, 20 bp, mouse
ggaggactgacaggccacgt

SEQ ID NO: 793180 - DNA, 20 bp, mouse
gggcaaagatgtgatgagga

SEQ ID NO: 793181 - DNA, 20 bp, mouse
gagcctacattttggcctct

SEQ ID NO: 793182 - DNA, 20 bp, mouse
gtgttggcaaagatgtgatg

SEQ ID NO: 793183 - DNA, 20 bp, mouse
gagcctcctggaggactgac

SEQ ID NO: 793184 - DNA, 20 bp, mouse
gttatctgtctgttaaacca

SEQ ID NO: 793185 - DNA, 20 bp, mouse
gaaaatgtaggctgattaac

SEQ ID NO: 793186 - DNA, 20 bp, mouse
gggtggggacagaacgacga

SEQ ID NO: 793187 - DNA, 20 bp, mouse
ggtgcacccgggccagttgt

SEQ ID NO: 793188 - DNA, 20 bp, mouse
gctactgggcacgagaagga

SEQ ID NO: 793189 - DNA, 20 bp, mouse
gcacccgggccagttgtggg

SEQ ID NO: 793190 - DNA, 20 bp, mouse
gccggccgaggggcgtgtcg

SEQ ID NO: 793191 - DNA, 20 bp, mouse
gctcgtgcccagtagctctc

SEQ ID NO: 793192 - DNA, 20 bp, mouse
gctcctgctgtgacaggggt

SEQ ID NO: 793193 - DNA, 20 bp, mouse
gccctcggccggcctccacc

SEQ ID NO: 793194 - DNA, 20 bp, mouse
ggacagaacgacgagggcgg

SEQ ID NO: 793195 - DNA, 20 bp, mouse
gcgagggcggcggtgcaccc

SEQ ID NO: 793196 - DNA, 20 bp, mouse
gcggaggggtcggagagtaa

SEQ ID NO: 793197 - DNA, 20 bp, mouse
ggaagggattagttagtcga

SEQ ID NO: 793198 - DNA, 20 bp, mouse
gccctgaagagcggaggggt

SEQ ID NO: 793199 - DNA, 20 bp, mouse
ggacagccctgaagagcgga

SEQ ID NO: 793200 - DNA, 20 bp, mouse
gcgcatgcgtagttggtccg

SEQ ID NO: 793201 - DNA, 20 bp, mouse
gctaggacgccggttggcta

SEQ ID NO: 793202 - DNA, 20 bp, mouse
ggccccctatgcaaataagg

SEQ ID NO: 793203 - DNA, 20 bp, mouse
ggggagccgagagacacgca

SEQ ID NO: 793204 - DNA, 20 bp, mouse
gtagggagacgtcttggcgt

SEQ ID NO: 793205 - DNA, 20 bp, mouse
ggggcggaatgcgaggccgt

SEQ ID NO: 793206 - DNA, 20 bp, mouse
ggacaggggcgacgcagcag

SEQ ID NO: 793207 - DNA, 20 bp, mouse
gcagaggggctgcggaagag

SEQ ID NO: 793208 - DNA, 20 bp, mouse
gaggaggccgaggtggagaa

SEQ ID NO: 793209 - DNA, 20 bp, mouse
ggcgtcgcccctgtcccggg

SEQ ID NO: 793210 - DNA, 20 bp, mouse
gagctgggccgcggtgcaga

SEQ ID NO: 793211 - DNA, 20 bp, mouse
ggatggacaaggggcttacg

SEQ ID NO: 793212 - DNA, 20 bp, mouse
gcgggccaccgtgcgggcgg

SEQ ID NO: 793213 - DNA, 20 bp, mouse
gaggaagccctggtgcaaag

SEQ ID NO: 793214 - DNA, 20 bp, mouse
gcgcccctgtcccgggaggg

SEQ ID NO: 793215 - DNA, 20 bp, mouse
gccgcagcccctctgcaccg

SEQ ID NO: 793216 - DNA, 20 bp, mouse
gcgccgcagtcgagaagcgg

SEQ ID NO: 793217 - DNA, 20 bp, mouse
gcgcagtcgagaagcggcgg

SEQ ID NO: 793218 - DNA, 20 bp, mouse
gtccgcaagaccgccccggg

SEQ ID NO: 793219 - DNA, 20 bp, mouse
gctccgccgcagtcgagaag

SEQ ID NO: 793220 - DNA, 20 bp, mouse
gcgccccggggggggtggag

SEQ ID NO: 793221 - DNA, 20 bp, mouse
gactccctccttccagtagg

SEQ ID NO: 793222 - DNA, 20 bp, mouse
ggctacctcctactggaagg

SEQ ID NO: 793223 - DNA, 20 bp, mouse
ggggcaacgctacctcctac

SEQ ID NO: 793224 - DNA, 20 bp, mouse
gcattgacaacaactgatgg

SEQ ID NO: 793225 - DNA, 20 bp, mouse
gaacgctacctcctactgga

SEQ ID NO: 793226 - DNA, 20 bp, mouse
gtggccaggcagggcgggaa

SEQ ID NO: 793227 - DNA, 20 bp, mouse
gagtttggggaggcatagaa

SEQ ID NO: 793228 - DNA, 20 bp, mouse
ggcagctgctgctgatgcga

SEQ ID NO: 793229 - DNA, 20 bp, mouse
gcatctaaatggcttgggaa

SEQ ID NO: 793230 - DNA, 20 bp, mouse
gtttgcacctggcctagttt

SEQ ID NO: 793231 - DNA, 20 bp, mouse
gtaaaggcagcttttctagc

SEQ ID NO: 793232 - DNA, 20 bp, mouse
gtattcagagaagggtgctg

SEQ ID NO: 793233 - DNA, 20 bp, mouse
gctcctggctccggctctag

SEQ ID NO: 793234 - DNA, 20 bp, mouse
gtgcctccccaaactaggcc

SEQ ID NO: 793235 - DNA, 20 bp, mouse
gtgctgatgcgaagggcaat

SEQ ID NO: 793236 - DNA, 20 bp, mouse
ggtaagctgcaggcggtgag

SEQ ID NO: 793237 - DNA, 20 bp, mouse
gtacctcaagagcggttatc

SEQ ID NO: 793238 - DNA, 20 bp, mouse
ggactcgggctggacaagta

SEQ ID NO: 793239 - DNA, 20 bp, mouse
gaacgtgagtgactactcga

SEQ ID NO: 793240 - DNA, 20 bp, mouse
gaagggacaaagtacttaaa

SEQ ID NO: 793241 - DNA, 20 bp, mouse
gcctgtcgggcggaagtagg

SEQ ID NO: 793242 - DNA, 20 bp, mouse
gtggtgggaagggaattctt

SEQ ID NO: 793243 - DNA, 20 bp, mouse
gcgctcttgaggtaagctgc

SEQ ID NO: 793244 - DNA, 20 bp, mouse
gcgtctgtagagagagactc

SEQ ID NO: 793245 - DNA, 20 bp, mouse
ggaagcgcctccgcgactag

SEQ ID NO: 793246 - DNA, 20 bp, mouse
gcgcccgcgcccaactccgc

SEQ ID NO: 793247 - DNA, 20 bp, mouse
ggatggggcgccaggggcgg

SEQ ID NO: 793248 - DNA, 20 bp, mouse
gggtgccgaggtaatgggca

SEQ ID NO: 793249 - DNA, 20 bp, mouse
gcctgtgcgcttggctgcga

SEQ ID NO: 793250 - DNA, 20 bp, mouse
gggtgggagggaagcgggac

SEQ ID NO: 793251 - DNA, 20 bp, mouse
gtggaggccaggggtcccca

SEQ ID NO: 793252 - DNA, 20 bp, mouse
gcggtgcagcgcgacaattg

SEQ ID NO: 793253 - DNA, 20 bp, mouse
ggcgggcgatggggcgccag

SEQ ID NO: 793254 - DNA, 20 bp, mouse
ggcagcacgggcgcagtcag

SEQ ID NO: 793255 - DNA, 20 bp, mouse
ggggcggcgccggcggagtt

SEQ ID NO: 793256 - DNA, 20 bp, mouse
gaccgaaggtaacctcggga

SEQ ID NO: 793257 - DNA, 20 bp, mouse
gtgcgagaacagctgaccga

SEQ ID NO: 793258 - DNA, 20 bp, mouse
gccaccgctaccggacgagg

SEQ ID NO: 793259 - DNA, 20 bp, mouse
gaagggctggggaccgagag

SEQ ID NO: 793260 - DNA, 20 bp, mouse
gctcgggagggcgctctgat

SEQ ID NO: 793261 - DNA, 20 bp, mouse
gaggcgcccaggatccgcgc

SEQ ID NO: 793262 - DNA, 20 bp, mouse
ggccctcccgaggttacctt

SEQ ID NO: 793263 - DNA, 20 bp, mouse
gtgttctcgcagggtggtcc

SEQ ID NO: 793264 - DNA, 20 bp, mouse
gaccggacgaggaggtcacc

SEQ ID NO: 793265 - DNA, 20 bp, mouse
ggcgcccggggacacaggtg

SEQ ID NO: 793266 - DNA, 20 bp, mouse
gagcagggactgcttgaacg

SEQ ID NO: 793267 - DNA, 20 bp, mouse
ggaaaccgggaggcaagacc

SEQ ID NO: 793268 - DNA, 20 bp, mouse
gagaaaccgagtttttcggg

SEQ ID NO: 793269 - DNA, 20 bp, mouse
ggaggcaagaccaggcaagg

SEQ ID NO: 793270 - DNA, 20 bp, mouse
gtccaagggagctaaactgg

SEQ ID NO: 793271 - DNA, 20 bp, mouse
gaagaccaggcaaggcgggt

SEQ ID NO: 793272 - DNA, 20 bp, mouse
gggggagcttaaagggaccg

SEQ ID NO: 793273 - DNA, 20 bp, mouse
gaactccaagggagctaaac

SEQ ID NO: 793274 - DNA, 20 bp, mouse
gtatcttgcaggatgttctg

SEQ ID NO: 793275 - DNA, 20 bp, mouse
gggctgggggggagcttaaa

SEQ ID NO: 793276 - DNA, 20 bp, mouse
gaggggcaggaggcgtgcta

SEQ ID NO: 793277 - DNA, 20 bp, mouse
gcggcagcagtggagcttag

SEQ ID NO: 793278 - DNA, 20 bp, mouse
gtaacacggggcctggcacg

SEQ ID NO: 793279 - DNA, 20 bp, mouse
gcctggcacgaggttctctt

SEQ ID NO: 793280 - DNA, 20 bp, mouse
ggccaggccccgtgttacct

SEQ ID NO: 793281 - DNA, 20 bp, mouse
ggccgaggacttaggaagaa

SEQ ID NO: 793282 - DNA, 20 bp, mouse
gacagggagggggcgagaaa

SEQ ID NO: 793283 - DNA, 20 bp, mouse
ggcaggaggcgtgctagggg

SEQ ID NO: 793284 - DNA, 20 bp, mouse
gcgcgtgagaaaggacaggg

SEQ ID NO: 793285 - DNA, 20 bp, mouse
gccctcccgccaacggtcac

SEQ ID NO: 793286 - DNA, 20 bp, mouse
gaacactgcagaaccccaca

SEQ ID NO: 793287 - DNA, 20 bp, mouse
gagaccgttcccaaaggaaa

SEQ ID NO: 793288 - DNA, 20 bp, mouse
gcagggctctgacaccatct

SEQ ID NO: 793289 - DNA, 20 bp, mouse
gaaagcgggctgtagctaga

SEQ ID NO: 793290 - DNA, 20 bp, mouse
gatcccgcgctcctgtgggc

SEQ ID NO: 793291 - DNA, 20 bp, mouse
ggaacagagaccgttcccaa

SEQ ID NO: 793292 - DNA, 20 bp, mouse
gagcccgcccacaggagcgc

SEQ ID NO: 793293 - DNA, 20 bp, mouse
gctgtgctgcttgtgagaaa

SEQ ID NO: 793294 - DNA, 20 bp, mouse
gtaaccctttcctttgggaa

SEQ ID NO: 793295 - DNA, 20 bp, mouse
gttgtgagaaaggggcggtg

SEQ ID NO: 793296 - DNA, 20 bp, mouse
ggcctcctacgcttcttcgc

SEQ ID NO: 793297 - DNA, 20 bp, mouse
gcgtaggaggccttcctcgg

SEQ ID NO: 793298 - DNA, 20 bp, mouse
gttggcctgcgaagaagcgt

SEQ ID NO: 793299 - DNA, 20 bp, mouse
gaaccaccaggtggtgaaga

SEQ ID NO: 793300 - DNA, 20 bp, mouse
gcacacatgcaacagtagtc

SEQ ID NO: 793301 - DNA, 20 bp, mouse
gctggcagccacaggctcgg

SEQ ID NO: 793302 - DNA, 20 bp, mouse
gtgcaacagtagtctggcat

SEQ ID NO: 793303 - DNA, 20 bp, mouse
ggcccagtgccctcgcctga

SEQ ID NO: 793304 - DNA, 20 bp, mouse
gtcgcctgagggtgtttctc

SEQ ID NO: 793305 - DNA, 20 bp, mouse
gtcgggaatggcgtgcttgt

SEQ ID NO: 793306 - DNA, 20 bp, mouse
gctctgtgatactactgcaa

SEQ ID NO: 793307 - DNA, 20 bp, mouse
gacccgcagtcactttaaaa

SEQ ID NO: 793308 - DNA, 20 bp, mouse
ggcaaatgagatattccaag

SEQ ID NO: 793309 - DNA, 20 bp, mouse
ggggagagtctgagactgaa

SEQ ID NO: 793310 - DNA, 20 bp, mouse
gcccgttttaaagtgactgc

SEQ ID NO: 793311 - DNA, 20 bp, mouse
gtgcaggaaaagttactggg

SEQ ID NO: 793312 - DNA, 20 bp, mouse
ggagccaaacgagctttaat

SEQ ID NO: 793313 - DNA, 20 bp, mouse
gtaaagtgactgcgggtttc

SEQ ID NO: 793314 - DNA, 20 bp, mouse
gcaagagcgataataacggg

SEQ ID NO: 793315 - DNA, 20 bp, mouse
ggatttgtttgagatcctct

SEQ ID NO: 793316 - DNA, 20 bp, mouse
gacggcgcaggacgcgggga

SEQ ID NO: 793317 - DNA, 20 bp, mouse
ggacgcggggaggggagcca

SEQ ID NO: 793318 - DNA, 20 bp, mouse
ggcgaggtccgccccgacaa

SEQ ID NO: 793319 - DNA, 20 bp, mouse
gtctgggagtccgaggaccc

SEQ ID NO: 793320 - DNA, 20 bp, mouse
gctcccagaagcagtttagg

SEQ ID NO: 793321 - DNA, 20 bp, mouse
gtctctggaggtgatgggtg

SEQ ID NO: 793322 - DNA, 20 bp, mouse
gccggacggcgcaggacgcg

SEQ ID NO: 793323 - DNA, 20 bp, mouse
gcacacgccccttgtcgggg

SEQ ID NO: 793324 - DNA, 20 bp, mouse
gtgcccaaatcccgtgggga

SEQ ID NO: 793325 - DNA, 20 bp, mouse
gtcctgcgccgtccggcggg

SEQ ID NO: 793326 - DNA, 20 bp, mouse
ggccagccgagccccgcgtg

SEQ ID NO: 793327 - DNA, 20 bp, mouse
gtataaaggcgagtgctgag

SEQ ID NO: 793328 - DNA, 20 bp, mouse
gagtctccaggcctctgaca

SEQ ID NO: 793329 - DNA, 20 bp, mouse
gctgtctacagcgagtaact

SEQ ID NO: 793330 - DNA, 20 bp, mouse
gagaagggttgagactgagg

SEQ ID NO: 793331 - DNA, 20 bp, mouse
ggtaacttggataggtctat

SEQ ID NO: 793332 - DNA, 20 bp, mouse
gtggcgctgctggcgcccgc

SEQ ID NO: 793333 - DNA, 20 bp, mouse
gacccccaaaacccatccgg

SEQ ID NO: 793334 - DNA, 20 bp, mouse
gagtacccccaaaacccatc

SEQ ID NO: 793335 - DNA, 20 bp, mouse
ggctggaaataatcagatta

SEQ ID NO: 793336 - DNA, 20 bp, mouse
gcagacacgatttgtattgt

SEQ ID NO: 793337 - DNA, 20 bp, mouse
ggggagaagtagggactaag

SEQ ID NO: 793338 - DNA, 20 bp, mouse
gttaaaatatgaagcaatat

SEQ ID NO: 793339 - DNA, 20 bp, mouse
ggcaggtgattcttgaaagg

SEQ ID NO: 793340 - DNA, 20 bp, mouse
gagaagtagggactaagggg

SEQ ID NO: 793341 - DNA, 20 bp, mouse
ggtgattcttgaaaggaggc

SEQ ID NO: 793342 - DNA, 20 bp, mouse
ggtgcttgtatagaagcagt

SEQ ID NO: 793343 - DNA, 20 bp, mouse
gaaagcaggtgattcttgaa

SEQ ID NO: 793344 - DNA, 20 bp, mouse
gctgggaaggggaaacccac

SEQ ID NO: 793345 - DNA, 20 bp, mouse
gtgggtaggtgataaggaca

SEQ ID NO: 793346 - DNA, 20 bp, mouse
gggcagctggaggatcacac

SEQ ID NO: 793347 - DNA, 20 bp, mouse
gggtcagccccgcgaagcaa

SEQ ID NO: 793348 - DNA, 20 bp, mouse
gccaacgcgggggaaggtct

SEQ ID NO: 793349 - DNA, 20 bp, mouse
gaggcgggagccgacagaca

SEQ ID NO: 793350 - DNA, 20 bp, mouse
gggaaccaccgagaacggga

SEQ ID NO: 793351 - DNA, 20 bp, mouse
gtggggtggaggtcggactc

SEQ ID NO: 793352 - DNA, 20 bp, mouse
ggctctcggtgccaacgcgg

SEQ ID NO: 793353 - DNA, 20 bp, mouse
ggcggcgcgagcgtgggagg

SEQ ID NO: 793354 - DNA, 20 bp, mouse
gcggtccctcccgttctcgg

SEQ ID NO: 793355 - DNA, 20 bp, mouse
gtccgcctgacagccgaggg

SEQ ID NO: 793356 - DNA, 20 bp, mouse
gcgccagagtctgtagaggc

SEQ ID NO: 793357 - DNA, 20 bp, mouse
gcagacgccagagtctgtag

SEQ ID NO: 793358 - DNA, 20 bp, mouse
gggagggtaaagtataaatg

SEQ ID NO: 793359 - DNA, 20 bp, mouse
gaccagaagaggagatgcgg

SEQ ID NO: 793360 - DNA, 20 bp, mouse
ggaaaaggctgattgtggca

SEQ ID NO: 793361 - DNA, 20 bp, mouse
ggaggggaaaaggctgattg

SEQ ID NO: 793362 - DNA, 20 bp, mouse
ggaaaacgggaagaaaccgg

SEQ ID NO: 793363 - DNA, 20 bp, mouse
gagagtggtgaacatgatat

SEQ ID NO: 793364 - DNA, 20 bp, mouse
gggctgtaggtcagagagag

SEQ ID NO: 793365 - DNA, 20 bp, mouse
gaaactgggcgtgcaagaag

SEQ ID NO: 793366 - DNA, 20 bp, mouse
ggtagctcgccatgtgacaa

SEQ ID NO: 793367 - DNA, 20 bp, mouse
gggcgagctacaggtgacaa

SEQ ID NO: 793368 - DNA, 20 bp, mouse
gaggacaattgcttcttgga

SEQ ID NO: 793369 - DNA, 20 bp, mouse
gcaaagctgatgcaagactc

SEQ ID NO: 793370 - DNA, 20 bp, mouse
gacaagggaacttttttctc

SEQ ID NO: 793371 - DNA, 20 bp, mouse
gaatgaagtcaggatgtcta

SEQ ID NO: 793372 - DNA, 20 bp, mouse
gcttaggcttaggtgataag

SEQ ID NO: 793373 - DNA, 20 bp, mouse
gagtcaggttcatagataag

SEQ ID NO: 793374 - DNA, 20 bp, mouse
gaaatcccactgtggagaca

SEQ ID NO: 793375 - DNA, 20 bp, mouse
gctccacagtgggatttctt

SEQ ID NO: 793376 - DNA, 20 bp, mouse
ggggcagaaggcaacagggg

SEQ ID NO: 793377 - DNA, 20 bp, mouse
gcctaggcccaaggattgtc

SEQ ID NO: 793378 - DNA, 20 bp, mouse
gtgatcctgaaggaagtcgt

SEQ ID NO: 793379 - DNA, 20 bp, mouse
gggactgctcccgttcacta

SEQ ID NO: 793380 - DNA, 20 bp, mouse
gacgccaatccctaggccca

SEQ ID NO: 793381 - DNA, 20 bp, mouse
ggcacagcaaccttagtgaa

SEQ ID NO: 793382 - DNA, 20 bp, mouse
gactgagctcagaatacaca

SEQ ID NO: 793383 - DNA, 20 bp, mouse
gctgaaggaagtcgtgggca

SEQ ID NO: 793384 - DNA, 20 bp, mouse
gcggtccccagacaatcctt

SEQ ID NO: 793385 - DNA, 20 bp, mouse
gtggcgtagcaggaagtaag

SEQ ID NO: 793386 - DNA, 20 bp, mouse
gaggaggtggggttgccaga

SEQ ID NO: 793387 - DNA, 20 bp, mouse
gcccgggcatacaactgatc

SEQ ID NO: 793388 - DNA, 20 bp, mouse
gccccatgcagggtgacccc

SEQ ID NO: 793389 - DNA, 20 bp, mouse
gaaccagttactgggttcta

SEQ ID NO: 793390 - DNA, 20 bp, mouse
gagactgtgggtcaaggagg

SEQ ID NO: 793391 - DNA, 20 bp, mouse
gactgggccacccagactgt

SEQ ID NO: 793392 - DNA, 20 bp, mouse
gtcaccctgcatggggggtt

SEQ ID NO: 793393 - DNA, 20 bp, mouse
gagggatgctaccaggagac

SEQ ID NO: 793394 - DNA, 20 bp, mouse
ggggttctagggatgctacc

SEQ ID NO: 793395 - DNA, 20 bp, mouse
gtggcccagtctcaggcacc

SEQ ID NO: 793396 - DNA, 20 bp, mouse
gggcaggcggctaggggaag

SEQ ID NO: 793397 - DNA, 20 bp, mouse
gggtgcaggggcatcgagta

SEQ ID NO: 793398 - DNA, 20 bp, mouse
ggcgcggggcccgagggttc

SEQ ID NO: 793399 - DNA, 20 bp, mouse
gccacctgcgcggggcccga

SEQ ID NO: 793400 - DNA, 20 bp, mouse
gctgaatagcagggtgacgc

SEQ ID NO: 793401 - DNA, 20 bp, mouse
ggggagagtgcaagagtcac

SEQ ID NO: 793402 - DNA, 20 bp, mouse
gtggctggaggcaggcggct

SEQ ID NO: 793403 - DNA, 20 bp, mouse
gtgcggagacccacctgcgc

SEQ ID NO: 793404 - DNA, 20 bp, mouse
ggagtgcaagagtcactggt

SEQ ID NO: 793405 - DNA, 20 bp, mouse
gcacgcacccggggtgctgg

SEQ ID NO: 793406 - DNA, 20 bp, mouse
gacccggccctgaactccag

SEQ ID NO: 793407 - DNA, 20 bp, mouse
ggaaggtagtgagtcctctg

SEQ ID NO: 793408 - DNA, 20 bp, mouse
gggtctggcccctggagttc

SEQ ID NO: 793409 - DNA, 20 bp, mouse
gcagggccgggtcatagagt

SEQ ID NO: 793410 - DNA, 20 bp, mouse
gacctatggtcaattgagga

SEQ ID NO: 793411 - DNA, 20 bp, mouse
gacatagaaggtctcttgga

SEQ ID NO: 793412 - DNA, 20 bp, mouse
gtgcccagctcctctttggc

SEQ ID NO: 793413 - DNA, 20 bp, mouse
gtgcctgcccagctcctctt

SEQ ID NO: 793414 - DNA, 20 bp, mouse
gaatgaatgaatgacataga

SEQ ID NO: 793415 - DNA, 20 bp, mouse
gagttacaaaggaaggggtc

SEQ ID NO: 793416 - DNA, 20 bp, mouse
gagggagcagagaccgtctc

SEQ ID NO: 793417 - DNA, 20 bp, mouse
gtagccttggcacctgcgtc

SEQ ID NO: 793418 - DNA, 20 bp, mouse
gtgcgtcaggctgtcttaac

SEQ ID NO: 793419 - DNA, 20 bp, mouse
gcagcctgacgcaggtgcca

SEQ ID NO: 793420 - DNA, 20 bp, mouse
ggaaccagaacaccagatcc

SEQ ID NO: 793421 - DNA, 20 bp, mouse
gtgacagtgcctagagaaga

SEQ ID NO: 793422 - DNA, 20 bp, mouse
ggtgagggctaacatggaca

SEQ ID NO: 793423 - DNA, 20 bp, mouse
ggctaacatggacatggtca

SEQ ID NO: 793424 - DNA, 20 bp, mouse
gaactggcaaggtggcagtg

SEQ ID NO: 793425 - DNA, 20 bp, mouse
ggctgtcttaactggcaagg

SEQ ID NO: 793426 - DNA, 20 bp, mouse
gcactcgagcagttcccgtc

SEQ ID NO: 793427 - DNA, 20 bp, mouse
gctggtcaggaccctctcac

SEQ ID NO: 793428 - DNA, 20 bp, mouse
gaagcacaactgttagcaaa

SEQ ID NO: 793429 - DNA, 20 bp, mouse
gtagcaaaggggcgatagac

SEQ ID NO: 793430 - DNA, 20 bp, mouse
ggggacaaggcaacagcact

SEQ ID NO: 793431 - DNA, 20 bp, mouse
gaggacttctgttgcaagaa

SEQ ID NO: 793432 - DNA, 20 bp, mouse
ggacatgctaacagtgtttg

SEQ ID NO: 793433 - DNA, 20 bp, mouse
gcatcatcacattcaatgac

SEQ ID NO: 793434 - DNA, 20 bp, mouse
gggtagccacatccttctaa

SEQ ID NO: 793435 - DNA, 20 bp, mouse
gcaacagcactgggatacca

SEQ ID NO: 793436 - DNA, 20 bp, mouse
gactgatagaatctttttgt

SEQ ID NO: 793437 - DNA, 20 bp, mouse
gtagaagttgaggagctcta

SEQ ID NO: 793438 - DNA, 20 bp, mouse
gtgaaaaggccacacatttc

SEQ ID NO: 793439 - DNA, 20 bp, mouse
gatagagttcctgaaatgtg

SEQ ID NO: 793440 - DNA, 20 bp, mouse
gatcattgagatttaagtgc

SEQ ID NO: 793441 - DNA, 20 bp, mouse
gcttggggttcaaacatgga

SEQ ID NO: 793442 - DNA, 20 bp, mouse
ggcccaattctggtagctat

SEQ ID NO: 793443 - DNA, 20 bp, mouse
gtaataaaatatagaagttg

SEQ ID NO: 793444 - DNA, 20 bp, mouse
gagaaagcataagaatgaaa

SEQ ID NO: 793445 - DNA, 20 bp, mouse
ggaatgtctaaaactgaaag

SEQ ID NO: 793446 - DNA, 20 bp, mouse
gtgaaggccaggaaactcag

SEQ ID NO: 793447 - DNA, 20 bp, mouse
gtttcctgtaccaacctcac

SEQ ID NO: 793448 - DNA, 20 bp, mouse
ggtacaggaaagtctcaccc

SEQ ID NO: 793449 - DNA, 20 bp, mouse
gaggcggctcctatcgcctc

SEQ ID NO: 793450 - DNA, 20 bp, mouse
gccacctgtgaggttggtac

SEQ ID NO: 793451 - DNA, 20 bp, mouse
gtgaccaacaggactcccat

SEQ ID NO: 793452 - DNA, 20 bp, mouse
gaataggagtctgattgggc

SEQ ID NO: 793453 - DNA, 20 bp, mouse
ggcagaataggagtctgatt

SEQ ID NO: 793454 - DNA, 20 bp, mouse
gggctcctagttcttaaata

SEQ ID NO: 793455 - DNA, 20 bp, mouse
gagggacaaaagacagacta

SEQ ID NO: 793456 - DNA, 20 bp, mouse
gccagagcatgaagcatgta

SEQ ID NO: 793457 - DNA, 20 bp, mouse
ggccctctggtggacagcga

SEQ ID NO: 793458 - DNA, 20 bp, mouse
gtaggcccatggctgccctc

SEQ ID NO: 793459 - DNA, 20 bp, mouse
ggaagcatgtagggaagtca

SEQ ID NO: 793460 - DNA, 20 bp, mouse
gtggacagcgatggacacga

SEQ ID NO: 793461 - DNA, 20 bp, mouse
gcagaagggcatgccagcat

SEQ ID NO: 793462 - DNA, 20 bp, mouse
gtggacacgaaggctcccga

SEQ ID NO: 793463 - DNA, 20 bp, mouse
gcggttcctggatcaggaag

SEQ ID NO: 793464 - DNA, 20 bp, mouse
gccaggaaccgcagcatcca

SEQ ID NO: 793465 - DNA, 20 bp, mouse
gtcacatgtccactgtccct

SEQ ID NO: 793466 - DNA, 20 bp, mouse
gggcctaggatctagagtgt

SEQ ID NO: 793467 - DNA, 20 bp, mouse
ggacccacactctagatcct

SEQ ID NO: 793468 - DNA, 20 bp, mouse
ggaggcccaggtaattatca

SEQ ID NO: 793469 - DNA, 20 bp, mouse
gcagcactatgcactatcag

SEQ ID NO: 793470 - DNA, 20 bp, mouse
ggctttgagcataacttaag

SEQ ID NO: 793471 - DNA, 20 bp, mouse
gaggggaatggtgtactctt

SEQ ID NO: 793472 - DNA, 20 bp, mouse
gacttaagaggtgcaggaaa

SEQ ID NO: 793473 - DNA, 20 bp, mouse
gtgaggccacagctccgcct

SEQ ID NO: 793474 - DNA, 20 bp, mouse
gcttgtgaaaccagctgctg

SEQ ID NO: 793475 - DNA, 20 bp, mouse
gggggagctgcggttaggcc

SEQ ID NO: 793476 - DNA, 20 bp, mouse
gctgctgtgccttgggtgtg

SEQ ID NO: 793477 - DNA, 20 bp, mouse
gggcaagttcactgcctccc

SEQ ID NO: 793478 - DNA, 20 bp, mouse
gcaggcagagcgggctgtgc

SEQ ID NO: 793479 - DNA, 20 bp, mouse
ggcctgacccatctaccgca

SEQ ID NO: 793480 - DNA, 20 bp, mouse
ggacccatctaccgcagggc

SEQ ID NO: 793481 - DNA, 20 bp, mouse
gagcacaaagctggattcta

SEQ ID NO: 793482 - DNA, 20 bp, mouse
gagcctgccctgcggtagat

SEQ ID NO: 793483 - DNA, 20 bp, mouse
ggatatgaattgaccagtca

SEQ ID NO: 793484 - DNA, 20 bp, mouse
gacagcccgctctgcctgcc

SEQ ID NO: 793485 - DNA, 20 bp, mouse
gccacacatgtctttccttg

SEQ ID NO: 793486 - DNA, 20 bp, mouse
gcatccctgctgcacaccga

SEQ ID NO: 793487 - DNA, 20 bp, mouse
ggacgctgacttagagggga

SEQ ID NO: 793488 - DNA, 20 bp, mouse
gaatgggttcgcaagaatgt

SEQ ID NO: 793489 - DNA, 20 bp, mouse
gctagaaaaaaactctaaat

SEQ ID NO: 793490 - DNA, 20 bp, mouse
gcatctaaggccaaaggcag

SEQ ID NO: 793491 - DNA, 20 bp, mouse
gtgtcccagtgtcccagcgt

SEQ ID NO: 793492 - DNA, 20 bp, mouse
gacgaagggagtaaaggtta

SEQ ID NO: 793493 - DNA, 20 bp, mouse
ggcaagaatgtaggcaccca

SEQ ID NO: 793494 - DNA, 20 bp, mouse
gagtctccatctaaggccaa

SEQ ID NO: 793495 - DNA, 20 bp, mouse
gggcgatgacgctgacttag

SEQ ID NO: 793496 - DNA, 20 bp, mouse
gtggaggcgcagctgttgaa

SEQ ID NO: 793497 - DNA, 20 bp, mouse
ggagcagcgaggggtcaatg

SEQ ID NO: 793498 - DNA, 20 bp, mouse
gggagcccggggcgagttct

SEQ ID NO: 793499 - DNA, 20 bp, mouse
gcagctgcgcgctggagccc

SEQ ID NO: 793500 - DNA, 20 bp, mouse
ggggctgggcagatacgaat

SEQ ID NO: 793501 - DNA, 20 bp, mouse
ggggcggagcggaacccacg

SEQ ID NO: 793502 - DNA, 20 bp, mouse
ggccgcgcggggccaaggac

SEQ ID NO: 793503 - DNA, 20 bp, mouse
gtcaatgcggccgcccgcgt

SEQ ID NO: 793504 - DNA, 20 bp, mouse
gtctctcccagaactcgccc

SEQ ID NO: 793505 - DNA, 20 bp, mouse
gcgggacaaagcaagtgcgg

SEQ ID NO: 793506 - DNA, 20 bp, mouse
ggggtgcatgaagtgaccat

SEQ ID NO: 793507 - DNA, 20 bp, mouse
gacctttgacagttaggaaa

SEQ ID NO: 793508 - DNA, 20 bp, mouse
gggaactcaggcactcacag

SEQ ID NO: 793509 - DNA, 20 bp, mouse
gtcaccagctgggtctcttt

SEQ ID NO: 793510 - DNA, 20 bp, mouse
gggagaaaatagcacagggt

SEQ ID NO: 793511 - DNA, 20 bp, mouse
gaaagatgggaggggctaag

SEQ ID NO: 793512 - DNA, 20 bp, mouse
gatatgaaatgaaagctcac

SEQ ID NO: 793513 - DNA, 20 bp, mouse
ggtgacagatgtaacaaaga

SEQ ID NO: 793514 - DNA, 20 bp, mouse
gcagctcagtgatgctgatc

SEQ ID NO: 793515 - DNA, 20 bp, mouse
ggatgtaacaaagatgggag

SEQ ID NO: 793516 - DNA, 20 bp, mouse
gggaaggaacctgaactgtg

SEQ ID NO: 793517 - DNA, 20 bp, mouse
gcactggtgaggacgtgaac

SEQ ID NO: 793518 - DNA, 20 bp, mouse
gctaacctcacctcaggtac

SEQ ID NO: 793519 - DNA, 20 bp, mouse
ggtcgcccgtacctgaggtg

SEQ ID NO: 793520 - DNA, 20 bp, mouse
ggaggtgaggttaggtcgtc

SEQ ID NO: 793521 - DNA, 20 bp, mouse
gccaacgcatccaggatcca

SEQ ID NO: 793522 - DNA, 20 bp, mouse
gttgaactagcggatgtgga

SEQ ID NO: 793523 - DNA, 20 bp, mouse
gacgtgaactggacacgtga

SEQ ID NO: 793524 - DNA, 20 bp, mouse
gcgtgacggcccctggatcc

SEQ ID NO: 793525 - DNA, 20 bp, mouse
gatcagcctccacacagttc

SEQ ID NO: 793526 - DNA, 20 bp, mouse
gaagagcataaggacaaccc

SEQ ID NO: 793527 - DNA, 20 bp, mouse
gcatgggaggcaggccacac

SEQ ID NO: 793528 - DNA, 20 bp, mouse
gcaggaggtgcgtatgttta

SEQ ID NO: 793529 - DNA, 20 bp, mouse
gaaacacctaggtccatggg

SEQ ID NO: 793530 - DNA, 20 bp, mouse
gaggtcggagtgggcgagag

SEQ ID NO: 793531 - DNA, 20 bp, mouse
gagctcgcgcgaggtcggag

SEQ ID NO: 793532 - DNA, 20 bp, mouse
gctcccctgaagagctgtgg

SEQ ID NO: 793533 - DNA, 20 bp, mouse
gtgcccgctgggactagtat

SEQ ID NO: 793534 - DNA, 20 bp, mouse
gttcccccacagctcttcag

SEQ ID NO: 793535 - DNA, 20 bp, mouse
ggcctgcctcccatggacct

SEQ ID NO: 793536 - DNA, 20 bp, mouse
gggcccatggtcctcttctc

SEQ ID NO: 793537 - DNA, 20 bp, mouse
gagaaactctgggatgtagt

SEQ ID NO: 793538 - DNA, 20 bp, mouse
gcatgcactcaaaacacgat

SEQ ID NO: 793539 - DNA, 20 bp, mouse
gagccagagaagaggaccat

SEQ ID NO: 793540 - DNA, 20 bp, mouse
ggcccaccccacctccctcg

SEQ ID NO: 793541 - DNA, 20 bp, mouse
gagctcccgcgagggaggtg

SEQ ID NO: 793542 - DNA, 20 bp, mouse
ggagcaaaaacctaggccca

SEQ ID NO: 793543 - DNA, 20 bp, mouse
gtagcttctgactctggatt

SEQ ID NO: 793544 - DNA, 20 bp, mouse
gcccatatgcacatggacgt

SEQ ID NO: 793545 - DNA, 20 bp, mouse
ggactccgtggatagatgga

SEQ ID NO: 793546 - DNA, 20 bp, mouse
ggatccccatacagtgtgta

SEQ ID NO: 793547 - DNA, 20 bp, mouse
gccctctaggggacaggtca

SEQ ID NO: 793548 - DNA, 20 bp, mouse
gtgctggatgcactgaacaa

SEQ ID NO: 793549 - DNA, 20 bp, mouse
ggacaagaaaaagatgactg

SEQ ID NO: 793550 - DNA, 20 bp, mouse
ggagtcaagccgggaaacgg

SEQ ID NO: 793551 - DNA, 20 bp, mouse
gctggagtcaagccgggaaa

SEQ ID NO: 793552 - DNA, 20 bp, mouse
gaggggacaggtcagggagt

SEQ ID NO: 793553 - DNA, 20 bp, mouse
ggaccgctctggagtcaagc

SEQ ID NO: 793554 - DNA, 20 bp, mouse
gcacaaggcagcatacccta

SEQ ID NO: 793555 - DNA, 20 bp, mouse
gttgctcggccaccgtttcc

SEQ ID NO: 793556 - DNA, 20 bp, mouse
ggggaggtctctatcaagga

SEQ ID NO: 793557 - DNA, 20 bp, mouse
ggaagtaaggggtcctgaat

SEQ ID NO: 793558 - DNA, 20 bp, mouse
gtaaggggtcctgaattggg

SEQ ID NO: 793559 - DNA, 20 bp, mouse
gaattgggaggtctctatca

SEQ ID NO: 793560 - DNA, 20 bp, mouse
gggaggcgccagtgagtcag

SEQ ID NO: 793561 - DNA, 20 bp, mouse
gttccctctgtcccaggccg

SEQ ID NO: 793562 - DNA, 20 bp, mouse
gcaagctccacaggaagtaa

SEQ ID NO: 793563 - DNA, 20 bp, mouse
gggccgccctccgttctgtc

SEQ ID NO: 793564 - DNA, 20 bp, mouse
gaagtctggtgaatgaatct

SEQ ID NO: 793565 - DNA, 20 bp, mouse
ggggcggccacgtgagcctg

SEQ ID NO: 793566 - DNA, 20 bp, mouse
gtacccagttagcttttgag

SEQ ID NO: 793567 - DNA, 20 bp, mouse
gcctgcacgagacactactg

SEQ ID NO: 793568 - DNA, 20 bp, mouse
gtgtgtgtgcctggagtcgc

SEQ ID NO: 793569 - DNA, 20 bp, mouse
ggagttaagcccgaagatgt

SEQ ID NO: 793570 - DNA, 20 bp, mouse
gccacagccgtcctgcccac

SEQ ID NO: 793571 - DNA, 20 bp, mouse
gggtggggctggagattaaa

SEQ ID NO: 793572 - DNA, 20 bp, mouse
gaggtctgaatctgcaagcg

SEQ ID NO: 793573 - DNA, 20 bp, mouse
gctgaggcatccaacatctt

SEQ ID NO: 793574 - DNA, 20 bp, mouse
gtcgtgcaggtgccttcctg

SEQ ID NO: 793575 - DNA, 20 bp, mouse
gatgttccttattacactgg

SEQ ID NO: 793576 - DNA, 20 bp, mouse
gagagtggagaactgggatc

SEQ ID NO: 793577 - DNA, 20 bp, mouse
gtgggagtcagtcgtggatc

SEQ ID NO: 793578 - DNA, 20 bp, mouse
gctaggcaacggccacgtgg

SEQ ID NO: 793579 - DNA, 20 bp, mouse
gaacggccacgtggaggagg

SEQ ID NO: 793580 - DNA, 20 bp, mouse
gcagttctgcaggaaacggg

SEQ ID NO: 793581 - DNA, 20 bp, mouse
ggagtcagtcgtggatcagg

SEQ ID NO: 793582 - DNA, 20 bp, mouse
gaggctacgcacagttctgc

SEQ ID NO: 793583 - DNA, 20 bp, mouse
gagcctaggcaacggccacg

SEQ ID NO: 793584 - DNA, 20 bp, mouse
gctgtgcgtagcctaggcaa

SEQ ID NO: 793585 - DNA, 20 bp, mouse
ggttcctaatcactgcgaca

SEQ ID NO: 793586 - DNA, 20 bp, mouse
gaagacccagtcccagtcaa

SEQ ID NO: 793587 - DNA, 20 bp, mouse
ggacctgaagaggcacggtc

SEQ ID NO: 793588 - DNA, 20 bp, mouse
ggggatctgaagtcatatta

SEQ ID NO: 793589 - DNA, 20 bp, mouse
gaggggtgctgtcatagatc

SEQ ID NO: 793590 - DNA, 20 bp, mouse
gtccagatgccagaactcaa

SEQ ID NO: 793591 - DNA, 20 bp, mouse
gtaactggtcaaagatccct

SEQ ID NO: 793592 - DNA, 20 bp, mouse
ggagaacaaggtataccctg

SEQ ID NO: 793593 - DNA, 20 bp, mouse
gtcatattaaggacgagagt

SEQ ID NO: 793594 - DNA, 20 bp, mouse
gagcctgaccgtgcctcttc

SEQ ID NO: 793595 - DNA, 20 bp, mouse
gcaggatcttagagcactag

SEQ ID NO: 793596 - DNA, 20 bp, mouse
ggtaatggaccaggcatggt

SEQ ID NO: 793597 - DNA, 20 bp, mouse
gcaacaagggacaaggtcac

SEQ ID NO: 793598 - DNA, 20 bp, mouse
gcctgctgatgcagccttaa

SEQ ID NO: 793599 - DNA, 20 bp, mouse
gaggctgtcggacgccaccc

SEQ ID NO: 793600 - DNA, 20 bp, mouse
gcccccaaagcaccattcca

SEQ ID NO: 793601 - DNA, 20 bp, mouse
ggtcggacgccaccctggaa

SEQ ID NO: 793602 - DNA, 20 bp, mouse
gtgatgcagccttaagggga

SEQ ID NO: 793603 - DNA, 20 bp, mouse
gcagcctccctccacggctg

SEQ ID NO: 793604 - DNA, 20 bp, mouse
ggcatggtcggattggtcac

SEQ ID NO: 793605 - DNA, 20 bp, mouse
gggaccaggcatggtcggat

SEQ ID NO: 793606 - DNA, 20 bp, mouse
gtggctcccccaagacagta

SEQ ID NO: 793607 - DNA, 20 bp, mouse
ggcagcgccccctactgtct

SEQ ID NO: 793608 - DNA, 20 bp, mouse
gcgcctgggccggactgcaa

SEQ ID NO: 793609 - DNA, 20 bp, mouse
ggatttaagccgagcggctg

SEQ ID NO: 793610 - DNA, 20 bp, mouse
ggcacagtcccgcagccgct

SEQ ID NO: 793611 - DNA, 20 bp, mouse
ggcagtccggcccaggcgaa

SEQ ID NO: 793612 - DNA, 20 bp, mouse
ggcaagggatttaagccgag

SEQ ID NO: 793613 - DNA, 20 bp, mouse
gctgagaagtagccgcggaa

SEQ ID NO: 793614 - DNA, 20 bp, mouse
gaccagctgctcccgctagg

SEQ ID NO: 793615 - DNA, 20 bp, mouse
gcatagcacaaagtggaagt

SEQ ID NO: 793616 - DNA, 20 bp, mouse
ggctgctggtggagaaagca

SEQ ID NO: 793617 - DNA, 20 bp, mouse
gtaggggtatcgacacgtcg

SEQ ID NO: 793618 - DNA, 20 bp, mouse
gccagcgaatggcatctagg

SEQ ID NO: 793619 - DNA, 20 bp, mouse
gagcgcaggccgttgtctca

SEQ ID NO: 793620 - DNA, 20 bp, mouse
gaaggcatggatgccggcag

SEQ ID NO: 793621 - DNA, 20 bp, mouse
gggtatcgacacgtcgggga

SEQ ID NO: 793622 - DNA, 20 bp, mouse
ggctggggcgctcccgctaa

SEQ ID NO: 793623 - DNA, 20 bp, mouse
gcatggatgccggcagagga

SEQ ID NO: 793624 - DNA, 20 bp, mouse
gctcccgctaaaggcgcgca

SEQ ID NO: 793625 - DNA, 20 bp, mouse
gctctcgctgctgcggctgc

SEQ ID NO: 793626 - DNA, 20 bp, mouse
gaagggactgataaccagga

SEQ ID NO: 793627 - DNA, 20 bp, mouse
gagtaaagagcttgggtctc

SEQ ID NO: 793628 - DNA, 20 bp, mouse
gagagccaagtccctctccc

SEQ ID NO: 793629 - DNA, 20 bp, mouse
gacaaagtgcttagagtcaa

SEQ ID NO: 793630 - DNA, 20 bp, mouse
gttcccaagtcactatgcaa

SEQ ID NO: 793631 - DNA, 20 bp, mouse
gtgcaaagggactgataacc

SEQ ID NO: 793632 - DNA, 20 bp, mouse
gaccaggaaggcctgggaga

SEQ ID NO: 793633 - DNA, 20 bp, mouse
gcacttgtgatgcacaactg

SEQ ID NO: 793634 - DNA, 20 bp, mouse
gcctccagccagctcatgat

SEQ ID NO: 793635 - DNA, 20 bp, mouse
gctgataaccaggaaggcct

SEQ ID NO: 793636 - DNA, 20 bp, mouse
gaggaagggtgtaatgacct

SEQ ID NO: 793637 - DNA, 20 bp, mouse
ggataccagtgcacactctg

SEQ ID NO: 793638 - DNA, 20 bp, mouse
ggcctctagccattgtgtcc

SEQ ID NO: 793639 - DNA, 20 bp, mouse
ggactcccccaacgtcctat

SEQ ID NO: 793640 - DNA, 20 bp, mouse
ggtaatgacctgggtgacag

SEQ ID NO: 793641 - DNA, 20 bp, mouse
gcagtggaatcccaacagac

SEQ ID NO: 793642 - DNA, 20 bp, mouse
gggcacagccttgatgaata

SEQ ID NO: 793643 - DNA, 20 bp, mouse
gggccaccctaagcagcagg

SEQ ID NO: 793644 - DNA, 20 bp, mouse
gcagccttgatgaataagga

SEQ ID NO: 793645 - DNA, 20 bp, mouse
gtgagcactgagatcacaat

SEQ ID NO: 793646 - DNA, 20 bp, mouse
ggatttgaactggaggagta

SEQ ID NO: 793647 - DNA, 20 bp, mouse
ggaggaactaggatttgaac

SEQ ID NO: 793648 - DNA, 20 bp, mouse
ggtaagggccacacaaccac

SEQ ID NO: 793649 - DNA, 20 bp, mouse
gaaaagtaacacctgactgg

SEQ ID NO: 793650 - DNA, 20 bp, mouse
gtgtggcccttacccctctc

SEQ ID NO: 793651 - DNA, 20 bp, mouse
gaaggccacctgggtctccc

SEQ ID NO: 793652 - DNA, 20 bp, mouse
gatggtgtgaactgccctat

SEQ ID NO: 793653 - DNA, 20 bp, mouse
gtatgactggtgccttggga

SEQ ID NO: 793654 - DNA, 20 bp, mouse
gggagaacttaattacttaa

SEQ ID NO: 793655 - DNA, 20 bp, mouse
ggaactaggatttgaactgg

SEQ ID NO: 793656 - DNA, 20 bp, mouse
ggacctcagcatcttgcaaa

SEQ ID NO: 793657 - DNA, 20 bp, mouse
gtgaacccgagaacttaaga

SEQ ID NO: 793658 - DNA, 20 bp, mouse
gcagcagatggctacaacca

SEQ ID NO: 793659 - DNA, 20 bp, mouse
gagaacttaagagggacagg

SEQ ID NO: 793660 - DNA, 20 bp, mouse
ggaccttgatggggttattt

SEQ ID NO: 793661 - DNA, 20 bp, mouse
gaagacaggcagttctgggg

SEQ ID NO: 793662 - DNA, 20 bp, mouse
gacaggcaacttgcataaat

SEQ ID NO: 793663 - DNA, 20 bp, mouse
gttgagtccccctgccagta

SEQ ID NO: 793664 - DNA, 20 bp, mouse
ggagtccaagccacactact

SEQ ID NO: 793665 - DNA, 20 bp, mouse
gttccgaaataaccccatca

SEQ ID NO: 793666 - DNA, 20 bp, mouse
gcacagagggatgggtgatc

SEQ ID NO: 793667 - DNA, 20 bp, mouse
gaaagccaagtgttcacaga

SEQ ID NO: 793668 - DNA, 20 bp, mouse
ggggcatacccatggaagtc

SEQ ID NO: 793669 - DNA, 20 bp, mouse
gggatgggtgatcaggatga

SEQ ID NO: 793670 - DNA, 20 bp, mouse
gcaggctgccgatgtcataa

SEQ ID NO: 793671 - DNA, 20 bp, mouse
gccaagtgttcacagaggga

SEQ ID NO: 793672 - DNA, 20 bp, mouse
ggggtatgccccaatgtgat

SEQ ID NO: 793673 - DNA, 20 bp, mouse
gcatggaagtcaggtgagtc

SEQ ID NO: 793674 - DNA, 20 bp, mouse
gagctgtaccagaaattcca

SEQ ID NO: 793675 - DNA, 20 bp, mouse
gaactcatataaagtcatga

SEQ ID NO: 793676 - DNA, 20 bp, mouse
ggggctggagaactgaccgt

SEQ ID NO: 793677 - DNA, 20 bp, mouse
gaagtggggagacgcagagt

SEQ ID NO: 793678 - DNA, 20 bp, mouse
gtgggacgatgagacttcaa

SEQ ID NO: 793679 - DNA, 20 bp, mouse
gtcctgcggttgcttcaaag

SEQ ID NO: 793680 - DNA, 20 bp, mouse
ggaagcaaccgcaggaacaa

SEQ ID NO: 793681 - DNA, 20 bp, mouse
gtgcctggcccccagcccaa

SEQ ID NO: 793682 - DNA, 20 bp, mouse
gagaggggctggaagttcaa

SEQ ID NO: 793683 - DNA, 20 bp, mouse
gagaactgaccgttgggctg

SEQ ID NO: 793684 - DNA, 20 bp, mouse
gcagaggggtgtgtgtgcgt

SEQ ID NO: 793685 - DNA, 20 bp, mouse
gcagagggagactggtgggc

SEQ ID NO: 793686 - DNA, 20 bp, mouse
gctgacctcaggttcatgat

SEQ ID NO: 793687 - DNA, 20 bp, mouse
gaacgcattcagaccttctc

SEQ ID NO: 793688 - DNA, 20 bp, mouse
gaatctagtaggaaggtaca

SEQ ID NO: 793689 - DNA, 20 bp, mouse
gaaggtctgaatgcgttcag

SEQ ID NO: 793690 - DNA, 20 bp, mouse
gagtggccagataatctagt

SEQ ID NO: 793691 - DNA, 20 bp, mouse
gttggggagggctctgagtt

SEQ ID NO: 793692 - DNA, 20 bp, mouse
ggtggtctgtggtcagaagg

SEQ ID NO: 793693 - DNA, 20 bp, mouse
gaggtgcaggaggcacccaa

SEQ ID NO: 793694 - DNA, 20 bp, mouse
ggcccagcacatatcctgat

SEQ ID NO: 793695 - DNA, 20 bp, mouse
ggccagataatctagtagga

SEQ ID NO: 793696 - DNA, 20 bp, mouse
gacactgagtgccaagcaag

SEQ ID NO: 793697 - DNA, 20 bp, mouse
gacatattccagctctggta

SEQ ID NO: 793698 - DNA, 20 bp, mouse
gctgacagtaaccacttgct

SEQ ID NO: 793699 - DNA, 20 bp, mouse
gagagtcacacaaatgggat

SEQ ID NO: 793700 - DNA, 20 bp, mouse
gcatcatcatagaggtggga

SEQ ID NO: 793701 - DNA, 20 bp, mouse
gagctctggtaaggtttgca

SEQ ID NO: 793702 - DNA, 20 bp, mouse
gttagacccacattcaaatc

SEQ ID NO: 793703 - DNA, 20 bp, mouse
gaagacaaaacactcagtaa

SEQ ID NO: 793704 - DNA, 20 bp, mouse
gctggaatatgtgtttttgt

SEQ ID NO: 793705 - DNA, 20 bp, mouse
gataccagtgtgtttgtgtc

SEQ ID NO: 793706 - DNA, 20 bp, mouse
gaagacctggggtacttggc

SEQ ID NO: 793707 - DNA, 20 bp, mouse
gacccactgcgaaaggatcc

SEQ ID NO: 793708 - DNA, 20 bp, mouse
gtgtcggggaagaggggact

SEQ ID NO: 793709 - DNA, 20 bp, mouse
gtcaggagccaaccacctgt

SEQ ID NO: 793710 - DNA, 20 bp, mouse
gccaggttgtcggggaagag

SEQ ID NO: 793711 - DNA, 20 bp, mouse
ggtcactgcagagagactaa

SEQ ID NO: 793712 - DNA, 20 bp, mouse
gcaagtaccccaggtcttat

SEQ ID NO: 793713 - DNA, 20 bp, mouse
gcagtgggtgcttttgatac

SEQ ID NO: 793714 - DNA, 20 bp, mouse
ggagtgaccaataagacctg

SEQ ID NO: 793715 - DNA, 20 bp, mouse
gaagcagtcccaggcaggac

SEQ ID NO: 793716 - DNA, 20 bp, mouse
ggggccccgcacggcgaggt

SEQ ID NO: 793717 - DNA, 20 bp, mouse
gccgctggacaatgcacctg

SEQ ID NO: 793718 - DNA, 20 bp, mouse
gtggccgcggccaggaggat

SEQ ID NO: 793719 - DNA, 20 bp, mouse
gcctgggcgaccccggggac

SEQ ID NO: 793720 - DNA, 20 bp, mouse
gggacacgctgagatcgcct

SEQ ID NO: 793721 - DNA, 20 bp, mouse
gggagggagaagggccccgg

SEQ ID NO: 793722 - DNA, 20 bp, mouse
gcgaccccggggacaggggg

SEQ ID NO: 793723 - DNA, 20 bp, mouse
gggccctccccctgtccccg

SEQ ID NO: 793724 - DNA, 20 bp, mouse
ggggcgggggcttgaccccc

SEQ ID NO: 793725 - DNA, 20 bp, mouse
gtggccgcggccagcccccc

SEQ ID NO: 793726 - DNA, 20 bp, mouse
ggggtgtatcacaggatctg

SEQ ID NO: 793727 - DNA, 20 bp, mouse
gagctgagtgggtactaaag

SEQ ID NO: 793728 - DNA, 20 bp, mouse
gaatggggagggtcatcgat

SEQ ID NO: 793729 - DNA, 20 bp, mouse
ggcacgctctgggtggcaga

SEQ ID NO: 793730 - DNA, 20 bp, mouse
gaggacgcagggggtctctc

SEQ ID NO: 793731 - DNA, 20 bp, mouse
gaccctcagcacgctctggg

SEQ ID NO: 793732 - DNA, 20 bp, mouse
gggggtctctctggaggcac

SEQ ID NO: 793733 - DNA, 20 bp, mouse
gtgcagtagggcaggacgca

SEQ ID NO: 793734 - DNA, 20 bp, mouse
gaggaccctcagcacgctct

SEQ ID NO: 793735 - DNA, 20 bp, mouse
gtgccacccagagcgtgctg

SEQ ID NO: 793736 - DNA, 20 bp, mouse
ggggtctgtgggcacggtca

SEQ ID NO: 793737 - DNA, 20 bp, mouse
gaacgcatggggaagagctg

SEQ ID NO: 793738 - DNA, 20 bp, mouse
gtccccagggaagggtctgt

SEQ ID NO: 793739 - DNA, 20 bp, mouse
gacgccccctagtcgctcac

SEQ ID NO: 793740 - DNA, 20 bp, mouse
gcctcccagagggcgtggtc

SEQ ID NO: 793741 - DNA, 20 bp, mouse
gcccccagtgagcgactagg

SEQ ID NO: 793742 - DNA, 20 bp, mouse
gggaaggggaagagactatg

SEQ ID NO: 793743 - DNA, 20 bp, mouse
gctctgggaggaatccaggt

SEQ ID NO: 793744 - DNA, 20 bp, mouse
gttccctggggaattctaga

SEQ ID NO: 793745 - DNA, 20 bp, mouse
gtcccttctagaattcccca

SEQ ID NO: 793746 - DNA, 20 bp, mouse
ggggacgtcaaggaggagta

SEQ ID NO: 793747 - DNA, 20 bp, mouse
ggactcatgggacgtcaagg

SEQ ID NO: 793748 - DNA, 20 bp, mouse
gcaagtgagcagttttcgga

SEQ ID NO: 793749 - DNA, 20 bp, mouse
gaacccagcctctgccgctg

SEQ ID NO: 793750 - DNA, 20 bp, mouse
ggcgttgccccgccccccag

SEQ ID NO: 793751 - DNA, 20 bp, mouse
ggtatatcgcggtgcctcct

SEQ ID NO: 793752 - DNA, 20 bp, mouse
gcggggcaacgccggactcc

SEQ ID NO: 793753 - DNA, 20 bp, mouse
gaaagactcatgggacgtca

SEQ ID NO: 793754 - DNA, 20 bp, mouse
gtcggcctccgaaccccagg

SEQ ID NO: 793755 - DNA, 20 bp, mouse
gtcctcaagtgagcagtttt

SEQ ID NO: 793756 - DNA, 20 bp, mouse
gctgacgcggggcagctggt

SEQ ID NO: 793757 - DNA, 20 bp, mouse
gccgcggtggcctcctgacg

SEQ ID NO: 793758 - DNA, 20 bp, mouse
gctggctgctggctgccttg

SEQ ID NO: 793759 - DNA, 20 bp, mouse
gcaggctggtggcggtccct

SEQ ID NO: 793760 - DNA, 20 bp, mouse
gtggcacgcgcgcgcctcgg

SEQ ID NO: 793761 - DNA, 20 bp, mouse
ggcagccagcaaggaaaggt

SEQ ID NO: 793762 - DNA, 20 bp, mouse
gcgcctcgggggccctgacg

SEQ ID NO: 793763 - DNA, 20 bp, mouse
gtggagctgccgcggggcgt

SEQ ID NO: 793764 - DNA, 20 bp, mouse
gcacttctgggcgctgtcca

SEQ ID NO: 793765 - DNA, 20 bp, mouse
gcgcgcgcgtgccagcaggc

SEQ ID NO: 793766 - DNA, 20 bp, mouse
ggggtgctgagtattcgaat

SEQ ID NO: 793767 - DNA, 20 bp, mouse
gaaggctggggtggaggtct

SEQ ID NO: 793768 - DNA, 20 bp, mouse
gcatccatctgcaagggcgt

SEQ ID NO: 793769 - DNA, 20 bp, mouse
gggggtggaggtctgggctc

SEQ ID NO: 793770 - DNA, 20 bp, mouse
gaccccacccccatcatctc

SEQ ID NO: 793771 - DNA, 20 bp, mouse
gatgtcacccaaagggtggg

SEQ ID NO: 793772 - DNA, 20 bp, mouse
gtcttgaactaaggctgggg

SEQ ID NO: 793773 - DNA, 20 bp, mouse
gtggatgtagtgcacagaag

SEQ ID NO: 793774 - DNA, 20 bp, mouse
gctgctgtgatgtcacccaa

SEQ ID NO: 793775 - DNA, 20 bp, mouse
gaattcttgaactaaggctg

SEQ ID NO: 793776 - DNA, 20 bp, mouse
gagtaggcggggcaagatca

SEQ ID NO: 793777 - DNA, 20 bp, mouse
gcggggcaagatcatggggc

SEQ ID NO: 793778 - DNA, 20 bp, mouse
gaccactgggttaaatccct

SEQ ID NO: 793779 - DNA, 20 bp, mouse
gaggatttctaggacgttct

SEQ ID NO: 793780 - DNA, 20 bp, mouse
gctttaaggaggatctctga

SEQ ID NO: 793781 - DNA, 20 bp, mouse
gtagtcccagtactttaagg

SEQ ID NO: 793782 - DNA, 20 bp, mouse
gggactagaagtgccaaatt

SEQ ID NO: 793783 - DNA, 20 bp, mouse
gaagaggggatgagtaggcg

SEQ ID NO: 793784 - DNA, 20 bp, mouse
gcatgcgggatggaagaatg

SEQ ID NO: 793785 - DNA, 20 bp, mouse
gagatcctccttaaagtact

SEQ ID NO: 793786 - DNA, 20 bp, mouse
gcccagggaaggtggcggga

SEQ ID NO: 793787 - DNA, 20 bp, mouse
gagcaggctgaaaacgccca

SEQ ID NO: 793788 - DNA, 20 bp, mouse
ggagcacaagatgcagttca

SEQ ID NO: 793789 - DNA, 20 bp, mouse
gagaggcgttagataccgtt

SEQ ID NO: 793790 - DNA, 20 bp, mouse
gcgtctgcggcgaggttggg

SEQ ID NO: 793791 - DNA, 20 bp, mouse
ggcctgcgcactggcgtctg

SEQ ID NO: 793792 - DNA, 20 bp, mouse
gcgcgggccccgcccaaact

SEQ ID NO: 793793 - DNA, 20 bp, mouse
gttaaaagatgctggggctc

SEQ ID NO: 793794 - DNA, 20 bp, mouse
gaagctgcgcccagtttggg

SEQ ID NO: 793795 - DNA, 20 bp, mouse
ggccgcagacgccagtgcgc

SEQ ID NO: 793796 - DNA, 20 bp, mouse
gggtgctggcccgtcctctc

SEQ ID NO: 793797 - DNA, 20 bp, mouse
ggacgggccagcacccaggc

SEQ ID NO: 793798 - DNA, 20 bp, mouse
gagtcagagccccacctgcc

SEQ ID NO: 793799 - DNA, 20 bp, mouse
gtgaaaatagggattattca

SEQ ID NO: 793800 - DNA, 20 bp, mouse
ggggccagcacccaggcagg

SEQ ID NO: 793801 - DNA, 20 bp, mouse
ggtggggctctgactcaggt

SEQ ID NO: 793802 - DNA, 20 bp, mouse
gctaggaatttggttcttct

SEQ ID NO: 793803 - DNA, 20 bp, mouse
gaagaaccaaattcctagag

SEQ ID NO: 793804 - DNA, 20 bp, mouse
ggctctgactcaggttgggg

SEQ ID NO: 793805 - DNA, 20 bp, mouse
ggaagctagactttgaaaat

SEQ ID NO: 793806 - DNA, 20 bp, mouse
gatagtgagcgtggccaata

SEQ ID NO: 793807 - DNA, 20 bp, mouse
gccacctcgaagttgttcag

SEQ ID NO: 793808 - DNA, 20 bp, mouse
gcagaagctcccctccctat

SEQ ID NO: 793809 - DNA, 20 bp, mouse
gggtcaacgcaagagagcag

SEQ ID NO: 793810 - DNA, 20 bp, mouse
ggaacagtggggactggctc

SEQ ID NO: 793811 - DNA, 20 bp, mouse
gtgcgcccagaggtgcgcga

SEQ ID NO: 793812 - DNA, 20 bp, mouse
gcccgcgtctccggatgcaa

SEQ ID NO: 793813 - DNA, 20 bp, mouse
ggtgagcgtggccaataggg

SEQ ID NO: 793814 - DNA, 20 bp, mouse
gcctgccaagctgccacact

SEQ ID NO: 793815 - DNA, 20 bp, mouse
gggaggtgggccaggagcaa

SEQ ID NO: 793816 - DNA, 20 bp, mouse
gtgagagatcagattggaat

SEQ ID NO: 793817 - DNA, 20 bp, mouse
gtctgtgggtgcctaagaaa

SEQ ID NO: 793818 - DNA, 20 bp, mouse
gggaaggcaggagccgttat

SEQ ID NO: 793819 - DNA, 20 bp, mouse
gacggctcctgccttcctcg

SEQ ID NO: 793820 - DNA, 20 bp, mouse
gacccacagtcaacagtgac

SEQ ID NO: 793821 - DNA, 20 bp, mouse
gtggtctcagctagtagggg

SEQ ID NO: 793822 - DNA, 20 bp, mouse
gttgctagaagccctttctt

SEQ ID NO: 793823 - DNA, 20 bp, mouse
gaactggtcacacttccccg

SEQ ID NO: 793824 - DNA, 20 bp, mouse
ggcaggagccgttatgggta

SEQ ID NO: 793825 - DNA, 20 bp, mouse
gcttaggcacccacagaaca

SEQ ID NO: 793826 - DNA, 20 bp, mouse
gcatgcgtggggtctcgcca

SEQ ID NO: 793827 - DNA, 20 bp, mouse
ggagcccggcgccgtgggga

SEQ ID NO: 793828 - DNA, 20 bp, mouse
ggggccgagctcgcgctctc

SEQ ID NO: 793829 - DNA, 20 bp, mouse
gcctcccgagagcgcgagct

SEQ ID NO: 793830 - DNA, 20 bp, mouse
gatgacctcgtccaaccctt

SEQ ID NO: 793831 - DNA, 20 bp, mouse
gggccagcgagtctcagaca

SEQ ID NO: 793832 - DNA, 20 bp, mouse
ggggagggccggcggccagc

SEQ ID NO: 793833 - DNA, 20 bp, mouse
gcagacagggccacaggagt

SEQ ID NO: 793834 - DNA, 20 bp, mouse
gccagcgggggcgcatgcgt

SEQ ID NO: 793835 - DNA, 20 bp, mouse
gggcgcgagcccggcgccgt

SEQ ID NO: 793836 - DNA, 20 bp, mouse
gagacacaagagggtgaagg

SEQ ID NO: 793837 - DNA, 20 bp, mouse
gagcaccggaaagacacaag

SEQ ID NO: 793838 - DNA, 20 bp, mouse
gtctcagtctacttggggaa

SEQ ID NO: 793839 - DNA, 20 bp, mouse
gcagaggcgcgaacaaaggg

SEQ ID NO: 793840 - DNA, 20 bp, mouse
gccccaagtagactgagacg

SEQ ID NO: 793841 - DNA, 20 bp, mouse
gggggaaggggtagcctgga

SEQ ID NO: 793842 - DNA, 20 bp, mouse
gagtaatgaggtagtgtaga

SEQ ID NO: 793843 - DNA, 20 bp, mouse
gatctctgcaagattgatgt

SEQ ID NO: 793844 - DNA, 20 bp, mouse
gcaggcaaatcgaggctcta

SEQ ID NO: 793845 - DNA, 20 bp, mouse
ggggagaaagctccctaacc

SEQ ID NO: 793846 - DNA, 20 bp, mouse
gggcgcgcccgcagcctgga

SEQ ID NO: 793847 - DNA, 20 bp, mouse
gtgggcgccccgcacaaggt

SEQ ID NO: 793848 - DNA, 20 bp, mouse
ggatgggaatggggattctg

SEQ ID NO: 793849 - DNA, 20 bp, mouse
gcgccgcgggtgggccctcc

SEQ ID NO: 793850 - DNA, 20 bp, mouse
gcaccaggagggcccacccg

SEQ ID NO: 793851 - DNA, 20 bp, mouse
gccggtggccgtgttctggt

SEQ ID NO: 793852 - DNA, 20 bp, mouse
gcgcagcctggaggggaccg

SEQ ID NO: 793853 - DNA, 20 bp, mouse
gaggcagggccgggctagga

SEQ ID NO: 793854 - DNA, 20 bp, mouse
ggaagccggtggccgtgttc

SEQ ID NO: 793855 - DNA, 20 bp, mouse
gcgcttgtgcccaggcgccg

SEQ ID NO: 793856 - DNA, 20 bp, mouse
gcacacacgagccactgtgt

SEQ ID NO: 793857 - DNA, 20 bp, mouse
ggaaaccccaacagtaaaca

SEQ ID NO: 793858 - DNA, 20 bp, mouse
gaaggggaataaagctggaa

SEQ ID NO: 793859 - DNA, 20 bp, mouse
gtcacccttgatagagcaga

SEQ ID NO: 793860 - DNA, 20 bp, mouse
ggctctatcaagggtgaaca

SEQ ID NO: 793861 - DNA, 20 bp, mouse
ggaggtgttatctcccttga

SEQ ID NO: 793862 - DNA, 20 bp, mouse
gcagatggtatggtccctca

SEQ ID NO: 793863 - DNA, 20 bp, mouse
ggtggggacactgaagtaat

SEQ ID NO: 793864 - DNA, 20 bp, mouse
gataccatctgctctatcaa

SEQ ID NO: 793865 - DNA, 20 bp, mouse
gtatcaagggtgaacaaggc

SEQ ID NO: 793866 - DNA, 20 bp, mouse
ggtgacgcagggttagggtg

SEQ ID NO: 793867 - DNA, 20 bp, mouse
ggctgctaaggtaggactta

SEQ ID NO: 793868 - DNA, 20 bp, mouse
gagcttgtgacgcagggtta

SEQ ID NO: 793869 - DNA, 20 bp, mouse
ggaggagcctgcctcagacc

SEQ ID NO: 793870 - DNA, 20 bp, mouse
ggccttcgggtccaggtctg

SEQ ID NO: 793871 - DNA, 20 bp, mouse
ggcaggggctctgctgcaag

SEQ ID NO: 793872 - DNA, 20 bp, mouse
gtgcgtcacaagctggaggg

SEQ ID NO: 793873 - DNA, 20 bp, mouse
gtcgggtccaggtctgaggc

SEQ ID NO: 793874 - DNA, 20 bp, mouse
gagcagcagccttcgggtcc

SEQ ID NO: 793875 - DNA, 20 bp, mouse
gagcagcagcttctagtgta

SEQ ID NO: 793876 - DNA, 20 bp, mouse
gccggctccagcatcttcca

SEQ ID NO: 793877 - DNA, 20 bp, mouse
gaggccctggtgttgtgggg

SEQ ID NO: 793878 - DNA, 20 bp, mouse
gcttgtgggcaggaagtatg

SEQ ID NO: 793879 - DNA, 20 bp, mouse
gctgtggcaggttctttctg

SEQ ID NO: 793880 - DNA, 20 bp, mouse
gggagccctggggagcggga

SEQ ID NO: 793881 - DNA, 20 bp, mouse
gaggagcagacacatagata

SEQ ID NO: 793882 - DNA, 20 bp, mouse
gttgtggggaggctaatctg

SEQ ID NO: 793883 - DNA, 20 bp, mouse
gtagcctccccacaacacca

SEQ ID NO: 793884 - DNA, 20 bp, mouse
gcttcctgcccacaagacaa

SEQ ID NO: 793885 - DNA, 20 bp, mouse
gagcgagctacttacactga

SEQ ID NO: 793886 - DNA, 20 bp, mouse
gttggcccctagacccggga

SEQ ID NO: 793887 - DNA, 20 bp, mouse
gtggcgcgcgcaggccacga

SEQ ID NO: 793888 - DNA, 20 bp, mouse
gaggccggaagttgcgacac

SEQ ID NO: 793889 - DNA, 20 bp, mouse
gccgtcccctcccgggtcta

SEQ ID NO: 793890 - DNA, 20 bp, mouse
gtaaggatgtgcgcgacctg

SEQ ID NO: 793891 - DNA, 20 bp, mouse
gctccagcccccagccctcg

SEQ ID NO: 793892 - DNA, 20 bp, mouse
gggaagctccgtcccctccc

SEQ ID NO: 793893 - DNA, 20 bp, mouse
gcgcgcaggccacgagggct

SEQ ID NO: 793894 - DNA, 20 bp, mouse
ggacgttggcccctagaccc

SEQ ID NO: 793895 - DNA, 20 bp, mouse
ggacaccggtgagacctcta

SEQ ID NO: 793896 - DNA, 20 bp, mouse
gggaacctggcaccgcccaa

SEQ ID NO: 793897 - DNA, 20 bp, mouse
gaccgcccaagggacgggac

SEQ ID NO: 793898 - DNA, 20 bp, mouse
gtgggcgtgtcccccaccgg

SEQ ID NO: 793899 - DNA, 20 bp, mouse
ggatgaaggcgcaagtgcac

SEQ ID NO: 793900 - DNA, 20 bp, mouse
gcgcccctgtcccgtccctt

SEQ ID NO: 793901 - DNA, 20 bp, mouse
gccagggcaagacacagcga

SEQ ID NO: 793902 - DNA, 20 bp, mouse
gctggcaccgcccaagggac

SEQ ID NO: 793903 - DNA, 20 bp, mouse
ggcacttgcgccttcatcgt

SEQ ID NO: 793904 - DNA, 20 bp, mouse
ggcagcgccactgggacaag

SEQ ID NO: 793905 - DNA, 20 bp, mouse
gcctcagacacgcccccggt

SEQ ID NO: 793906 - DNA, 20 bp, mouse
ggggtgaagttcagggacac

SEQ ID NO: 793907 - DNA, 20 bp, mouse
gaataatggtgctcagtgag

SEQ ID NO: 793908 - DNA, 20 bp, mouse
gattgccagtgttgcttgag

SEQ ID NO: 793909 - DNA, 20 bp, mouse
gcaagcaacactggcaataa

SEQ ID NO: 793910 - DNA, 20 bp, mouse
gaagttcagggacactggct

SEQ ID NO: 793911 - DNA, 20 bp, mouse
gatcgaggctgggggtcagg

SEQ ID NO: 793912 - DNA, 20 bp, mouse
ggaggattgcaaaaggacaa

SEQ ID NO: 793913 - DNA, 20 bp, mouse
gccgaggctgtgctcaggct

SEQ ID NO: 793914 - DNA, 20 bp, mouse
gcagtgtgaaagctggagac

SEQ ID NO: 793915 - DNA, 20 bp, mouse
ggagcacagcctcgggacag

SEQ ID NO: 793916 - DNA, 20 bp, mouse
gacgcaaggagcaggcgcgt

SEQ ID NO: 793917 - DNA, 20 bp, mouse
ggtgaagggagtagcctctc

SEQ ID NO: 793918 - DNA, 20 bp, mouse
gcaggcgcgttggagtgttc

SEQ ID NO: 793919 - DNA, 20 bp, mouse
gtggagtgttcgggtaaaaa

SEQ ID NO: 793920 - DNA, 20 bp, mouse
gctggacggacagtgttcgt

SEQ ID NO: 793921 - DNA, 20 bp, mouse
gactgtccgtccagcccgta

SEQ ID NO: 793922 - DNA, 20 bp, mouse
gcggggcacttgggtcccta

SEQ ID NO: 793923 - DNA, 20 bp, mouse
gtcagggagccggggcactt

SEQ ID NO: 793924 - DNA, 20 bp, mouse
ggtccagtcccggggaagaa

SEQ ID NO: 793925 - DNA, 20 bp, mouse
gcggaagtgacgcaaggagc

SEQ ID NO: 793926 - DNA, 20 bp, mouse
gggacacatagacagaatgg

SEQ ID NO: 793927 - DNA, 20 bp, mouse
gagtcagcagatgtcggccc

SEQ ID NO: 793928 - DNA, 20 bp, mouse
ggaaaaaatggctcatccca

SEQ ID NO: 793929 - DNA, 20 bp, mouse
gatgacagagatgcctatgt

SEQ ID NO: 793930 - DNA, 20 bp, mouse
gcagggacacatagacagaa

SEQ ID NO: 793931 - DNA, 20 bp, mouse
gttgctcaatgtgttggttg

SEQ ID NO: 793932 - DNA, 20 bp, mouse
gtgactggtgactgtgataa

SEQ ID NO: 793933 - DNA, 20 bp, mouse
ggtgttctggagaggactat

SEQ ID NO: 793934 - DNA, 20 bp, mouse
gggtaagcctagattctctc

SEQ ID NO: 793935 - DNA, 20 bp, mouse
gtgaaacttcccataggagt

SEQ ID NO: 793936 - DNA, 20 bp, mouse
ggaacaagatggaatgggga

SEQ ID NO: 793937 - DNA, 20 bp, mouse
gaacctggaacaagatggaa

SEQ ID NO: 793938 - DNA, 20 bp, mouse
gagtccgcagcgttataaaa

SEQ ID NO: 793939 - DNA, 20 bp, mouse
gatagcccagagtgtccact

SEQ ID NO: 793940 - DNA, 20 bp, mouse
ggaggtcttggagctctgga

SEQ ID NO: 793941 - DNA, 20 bp, mouse
ggcaccattttataacgctg

SEQ ID NO: 793942 - DNA, 20 bp, mouse
ggaaaactgggctgctttta

SEQ ID NO: 793943 - DNA, 20 bp, mouse
ggacagaacctggaacaaga

SEQ ID NO: 793944 - DNA, 20 bp, mouse
ggatgctggcaactgaagca

SEQ ID NO: 793945 - DNA, 20 bp, mouse
ggtgaagtagaattaggagt

SEQ ID NO: 793946 - DNA, 20 bp, mouse
gagacacgtaggaaagttgg

SEQ ID NO: 793947 - DNA, 20 bp, mouse
gggaccagttatgtgatgat

SEQ ID NO: 793948 - DNA, 20 bp, mouse
gtcaaagaacaactcatcta

SEQ ID NO: 793949 - DNA, 20 bp, mouse
gcagagacacgtaggaaagt

SEQ ID NO: 793950 - DNA, 20 bp, mouse
gcccccaatcatcacataac

SEQ ID NO: 793951 - DNA, 20 bp, mouse
gcataaggctgcaaggtcca

SEQ ID NO: 793952 - DNA, 20 bp, mouse
gaccttgcagccttatgagt

SEQ ID NO: 793953 - DNA, 20 bp, mouse
gatctgtgctaccctcctgc

SEQ ID NO: 793954 - DNA, 20 bp, mouse
gacagaggcccgggaacagc

SEQ ID NO: 793955 - DNA, 20 bp, mouse
ggtcagctctgcccttttct

SEQ ID NO: 793956 - DNA, 20 bp, mouse
ggaagctgggcttttgcagc

SEQ ID NO: 793957 - DNA, 20 bp, mouse
ggggagactagagagcagtt

SEQ ID NO: 793958 - DNA, 20 bp, mouse
gggttggttggactgtgtgt

SEQ ID NO: 793959 - DNA, 20 bp, mouse
gtctagcattatgggttggt

SEQ ID NO: 793960 - DNA, 20 bp, mouse
gactgtgggctcctcaccta

SEQ ID NO: 793961 - DNA, 20 bp, mouse
gtggaaacagtccataggtg

SEQ ID NO: 793962 - DNA, 20 bp, mouse
gatttaatgttctttgtaat

SEQ ID NO: 793963 - DNA, 20 bp, mouse
gcacagatgtctgtgatgtt

SEQ ID NO: 793964 - DNA, 20 bp, mouse
gagtactgagagcagctgtg

SEQ ID NO: 793965 - DNA, 20 bp, mouse
gctgggcttttgcagcagga

SEQ ID NO: 793966 - DNA, 20 bp, mouse
gatgagttgttgttctcgga

SEQ ID NO: 793967 - DNA, 20 bp, mouse
ggggtcaggatcttggctgg

SEQ ID NO: 793968 - DNA, 20 bp, mouse
gtatccagtcatcagacaac

SEQ ID NO: 793969 - DNA, 20 bp, mouse
gcccaattaacccataatgc

SEQ ID NO: 793970 - DNA, 20 bp, mouse
gtctcctatggactatttcc

SEQ ID NO: 793971 - DNA, 20 bp, mouse
gaggtgacagatgtctgtga

SEQ ID NO: 793972 - DNA, 20 bp, mouse
gctgtcttgggtcaggatct

SEQ ID NO: 793973 - DNA, 20 bp, mouse
gaggaggaccagagagcagt

SEQ ID NO: 793974 - DNA, 20 bp, mouse
gagtctgtcagcatcaaaaa

SEQ ID NO: 793975 - DNA, 20 bp, mouse
gtgacctgtgtgtcctagaa

SEQ ID NO: 793976 - DNA, 20 bp, mouse
gggacacattggaaagacag

SEQ ID NO: 793977 - DNA, 20 bp, mouse
gcctgctgactcctcgatat

SEQ ID NO: 793978 - DNA, 20 bp, mouse
gggaagggggattttccatc

SEQ ID NO: 793979 - DNA, 20 bp, mouse
ggcagacttggttctgatcc

SEQ ID NO: 793980 - DNA, 20 bp, mouse
gtcagaaccaagtctgccct

SEQ ID NO: 793981 - DNA, 20 bp, mouse
gatgcatgtcaccttcctga

SEQ ID NO: 793982 - DNA, 20 bp, mouse
gcagcattatgggttggtca

SEQ ID NO: 793983 - DNA, 20 bp, mouse
gggtcttccttcagtgctct

SEQ ID NO: 793984 - DNA, 20 bp, mouse
gcatgcatgtctgtgacatt

SEQ ID NO: 793985 - DNA, 20 bp, mouse
gtggtaacagtctatacgag

SEQ ID NO: 793986 - DNA, 20 bp, mouse
ggggcaatctttgaatctca

SEQ ID NO: 793987 - DNA, 20 bp, mouse
gttctgtgtcaccttccttt

SEQ ID NO: 793988 - DNA, 20 bp, mouse
ggggcagactgggagctctc

SEQ ID NO: 793989 - DNA, 20 bp, mouse
gggttggttgaactgtgtgt

SEQ ID NO: 793990 - DNA, 20 bp, mouse
ggctgtgcccaactgccctc

SEQ ID NO: 793991 - DNA, 20 bp, mouse
ggaaaataggatttcccaaa

SEQ ID NO: 793992 - DNA, 20 bp, mouse
gtgaatctcagggacactta

SEQ ID NO: 793993 - DNA, 20 bp, mouse
gtctgctgactcctggacgt

SEQ ID NO: 793994 - DNA, 20 bp, mouse
gggtgacacagaagtcagtg

SEQ ID NO: 793995 - DNA, 20 bp, mouse
gctgttgcacaaggtcattt

SEQ ID NO: 793996 - DNA, 20 bp, mouse
gctggggctgtgtgactcag

SEQ ID NO: 793997 - DNA, 20 bp, mouse
gtggatgagttgttgttctc

SEQ ID NO: 793998 - DNA, 20 bp, mouse
gatgagttgttgttctctgg

SEQ ID NO: 793999 - DNA, 20 bp, mouse
gagtctgtcagtattaaaaa

SEQ ID NO: 794000 - DNA, 20 bp, mouse
gtgaggacacaaggtagact

SEQ ID NO: 794001 - DNA, 20 bp, mouse
ggtgtgactcaggggcacat

SEQ ID NO: 794002 - DNA, 20 bp, mouse
gggttggttgacctgtatgt

SEQ ID NO: 794003 - DNA, 20 bp, mouse
gaccaacccataatgcagga

SEQ ID NO: 794004 - DNA, 20 bp, mouse
gataatgcaggaaggttgtc

SEQ ID NO: 794005 - DNA, 20 bp, mouse
gtcctcatacagctgtttcc

SEQ ID NO: 794006 - DNA, 20 bp, mouse
gttggcaatctttgagtctc

SEQ ID NO: 794007 - DNA, 20 bp, mouse
gcctgcaaacagttcataag

SEQ ID NO: 794008 - DNA, 20 bp, mouse
gtatgtcctggaaagcctgt

SEQ ID NO: 794009 - DNA, 20 bp, mouse
gaggagcccacaggctttcc

SEQ ID NO: 794010 - DNA, 20 bp, mouse
ggttcataagaggagcccac

SEQ ID NO: 794011 - DNA, 20 bp, mouse
ggcagactgggagctctcat

SEQ ID NO: 794012 - DNA, 20 bp, mouse
gggttggttgaactgtgtgt

SEQ ID NO: 794013 - DNA, 20 bp, mouse
gggaagaccagagggcagtt

SEQ ID NO: 794014 - DNA, 20 bp, mouse
gtgagtctcagggacactta

SEQ ID NO: 794015 - DNA, 20 bp, mouse
gtctgctgactcctggacgt

SEQ ID NO: 794016 - DNA, 20 bp, mouse
gtgtctgtcagcatcagaga

SEQ ID NO: 794017 - DNA, 20 bp, mouse
gcagagttgtgtgacaactg

SEQ ID NO: 794018 - DNA, 20 bp, mouse
gtgaagcagtcagtaggaag

SEQ ID NO: 794019 - DNA, 20 bp, mouse
gaggaactcagtcttgagtc

SEQ ID NO: 794020 - DNA, 20 bp, mouse
gggtaaccttccagaattat

SEQ ID NO: 794021 - DNA, 20 bp, mouse
gaacaaaaccttgagtaaca

SEQ ID NO: 794022 - DNA, 20 bp, mouse
gttcaaccaacccataattc

SEQ ID NO: 794023 - DNA, 20 bp, mouse
gtatttgtcaccatcctgtt

SEQ ID NO: 794024 - DNA, 20 bp, mouse
ggtgatgagatttatgttct

SEQ ID NO: 794025 - DNA, 20 bp, mouse
gggacacataggaaagatga

SEQ ID NO: 794026 - DNA, 20 bp, mouse
gcagagaacaactcatccat

SEQ ID NO: 794027 - DNA, 20 bp, mouse
gagtcacagatgtcagccca

SEQ ID NO: 794028 - DNA, 20 bp, mouse
gcacagatgtctgagatggt

SEQ ID NO: 794029 - DNA, 20 bp, mouse
gggaccagatctgcgatgat

SEQ ID NO: 794030 - DNA, 20 bp, mouse
gtggaaagagtctgtaggtg

SEQ ID NO: 794031 - DNA, 20 bp, mouse
gttgcctggaaagagtctgt

SEQ ID NO: 794032 - DNA, 20 bp, mouse
gatgctgacagacttatgcc

SEQ ID NO: 794033 - DNA, 20 bp, mouse
ggtgggcttttgcagcagaa

SEQ ID NO: 794034 - DNA, 20 bp, mouse
gctcagtactgtctcaagtc

SEQ ID NO: 794035 - DNA, 20 bp, mouse
gaccttctagcattatgagt

SEQ ID NO: 794036 - DNA, 20 bp, mouse
gggtcccttccaaacttcac

SEQ ID NO: 794037 - DNA, 20 bp, mouse
ggctgactgggagctcatct

SEQ ID NO: 794038 - DNA, 20 bp, mouse
gcccagcaggaaggtgacac

SEQ ID NO: 794039 - DNA, 20 bp, mouse
gcccagagtactgaagacac

SEQ ID NO: 794040 - DNA, 20 bp, mouse
gcacaggtgccagtgaagtt

SEQ ID NO: 794041 - DNA, 20 bp, mouse
gggtgccagtgaagtttgga

SEQ ID NO: 794042 - DNA, 20 bp, mouse
gccctgtgtcttcagtactc

SEQ ID NO: 794043 - DNA, 20 bp, mouse
gttgcctgcaaactgtccat

SEQ ID NO: 794044 - DNA, 20 bp, mouse
ggaattcatcttcttggtgt

SEQ ID NO: 794045 - DNA, 20 bp, mouse
gactgttggcttctatccta

SEQ ID NO: 794046 - DNA, 20 bp, mouse
gcaaagatgtctgtgatggt

SEQ ID NO: 794047 - DNA, 20 bp, mouse
gtgtactcagagctctggta

SEQ ID NO: 794048 - DNA, 20 bp, mouse
gggttggttggactgtgtgt

SEQ ID NO: 794049 - DNA, 20 bp, mouse
ggggagactagagagcagtt

SEQ ID NO: 794050 - DNA, 20 bp, mouse
gactcagagctctggtaagg

SEQ ID NO: 794051 - DNA, 20 bp, mouse
gtaaggtgggtttttgcagc

SEQ ID NO: 794052 - DNA, 20 bp, mouse
gtctagcattatgggttggt

SEQ ID NO: 794053 - DNA, 20 bp, mouse
gacagagtactgagagcagc

SEQ ID NO: 794054 - DNA, 20 bp, mouse
ggacagactaggaactcagc

SEQ ID NO: 794055 - DNA, 20 bp, mouse
gactgtgggctcctaaccta

SEQ ID NO: 794056 - DNA, 20 bp, mouse
gtacagcagaagtcagtcct

SEQ ID NO: 794057 - DNA, 20 bp, mouse
ggggaacaacagctcatccc

SEQ ID NO: 794058 - DNA, 20 bp, mouse
ggcagactgggagttcaggt

SEQ ID NO: 794059 - DNA, 20 bp, mouse
gatgagctgttgttccctga

SEQ ID NO: 794060 - DNA, 20 bp, mouse
ggcaacacattgaggaaaca

SEQ ID NO: 794061 - DNA, 20 bp, mouse
gaccagctgagtgataacta

SEQ ID NO: 794062 - DNA, 20 bp, mouse
gttagaacacagagcagact

SEQ ID NO: 794063 - DNA, 20 bp, mouse
gttctgctgtaatctgtcct

SEQ ID NO: 794064 - DNA, 20 bp, mouse
gctctgtgttctaagtgctt

SEQ ID NO: 794065 - DNA, 20 bp, mouse
gacataaagggaagctgaga

SEQ ID NO: 794066 - DNA, 20 bp, mouse
ggcaagcagatgccgtggga

SEQ ID NO: 794067 - DNA, 20 bp, mouse
gccgccgagcgtcgtggctc

SEQ ID NO: 794068 - DNA, 20 bp, mouse
gagaggggaggcccggagag

SEQ ID NO: 794069 - DNA, 20 bp, mouse
gcagatgccgtgggagggga

SEQ ID NO: 794070 - DNA, 20 bp, mouse
gcgcaaccaggggcacctgt

SEQ ID NO: 794071 - DNA, 20 bp, mouse
gggcccggagagaggcacgc

SEQ ID NO: 794072 - DNA, 20 bp, mouse
ggtcgtggctcgggagctga

SEQ ID NO: 794073 - DNA, 20 bp, mouse
gctacagccgccgagcgtcg

SEQ ID NO: 794074 - DNA, 20 bp, mouse
gcactgtgccagccgtgggg

SEQ ID NO: 794075 - DNA, 20 bp, mouse
ggggcacctgtgggctctag

SEQ ID NO: 794076 - DNA, 20 bp, mouse
ggctccccagcggtgtctag

SEQ ID NO: 794077 - DNA, 20 bp, mouse
gccaatcaacgtcttcgggg

SEQ ID NO: 794078 - DNA, 20 bp, mouse
gcgaacgcaagtgtgtgtag

SEQ ID NO: 794079 - DNA, 20 bp, mouse
ggcctgccaatcaacgtctt

SEQ ID NO: 794080 - DNA, 20 bp, mouse
ggggcggccaagggacggaa

SEQ ID NO: 794081 - DNA, 20 bp, mouse
gcggccaagggacggaaggg

SEQ ID NO: 794082 - DNA, 20 bp, mouse
gtccacaaatggctccccag

SEQ ID NO: 794083 - DNA, 20 bp, mouse
gggagtgtgtcatcacgcca

SEQ ID NO: 794084 - DNA, 20 bp, mouse
gcggagcagagctcttttcc

SEQ ID NO: 794085 - DNA, 20 bp, mouse
gaacttgggcggccaaggga

SEQ ID NO: 794086 - DNA, 20 bp, mouse
gaaagctgagaacgtgggat

SEQ ID NO: 794087 - DNA, 20 bp, mouse
gaatgcgcagagaaagcggg

SEQ ID NO: 794088 - DNA, 20 bp, mouse
gtgggattggcaggaagctc

SEQ ID NO: 794089 - DNA, 20 bp, mouse
gccctccagccttaagtggg

SEQ ID NO: 794090 - DNA, 20 bp, mouse
gctgcgaaagctgagaacgt

SEQ ID NO: 794091 - DNA, 20 bp, mouse
gcacttaaggctggagggcg

SEQ ID NO: 794092 - DNA, 20 bp, mouse
ggaagcctgcggagtcttga

SEQ ID NO: 794093 - DNA, 20 bp, mouse
ggaacgtcgccacctagctc

SEQ ID NO: 794094 - DNA, 20 bp, mouse
ggcagattcccgccaactct

SEQ ID NO: 794095 - DNA, 20 bp, mouse
gttggcaggaagctccgggg

SEQ ID NO: 794096 - DNA, 20 bp, mouse
gagcgaggaggcggggaagt

SEQ ID NO: 794097 - DNA, 20 bp, mouse
gcatgctctgagcgaggagg

SEQ ID NO: 794098 - DNA, 20 bp, mouse
gccctcttgcgcatgcgcaa

SEQ ID NO: 794099 - DNA, 20 bp, mouse
ggcgcatgctctgagcgagg

SEQ ID NO: 794100 - DNA, 20 bp, mouse
gcctgcgcatgctctgagcg

SEQ ID NO: 794101 - DNA, 20 bp, mouse
gattggaggagagtcaccta

SEQ ID NO: 794102 - DNA, 20 bp, mouse
gacccttgcgcatgcgcaag

SEQ ID NO: 794103 - DNA, 20 bp, mouse
gttgtagcgtggtttttggt

SEQ ID NO: 794104 - DNA, 20 bp, mouse
gtccgtaaggagagagttcg

SEQ ID NO: 794105 - DNA, 20 bp, mouse
ggagagagttcgtggaaaga

SEQ ID NO: 794106 - DNA, 20 bp, mouse
gtgcgcagaaaccatagagg

SEQ ID NO: 794107 - DNA, 20 bp, mouse
ggggctgggacgaaaactgt

SEQ ID NO: 794108 - DNA, 20 bp, mouse
gctccagggaaccgcctcta

SEQ ID NO: 794109 - DNA, 20 bp, mouse
gtgtgtgggctacagaggac

SEQ ID NO: 794110 - DNA, 20 bp, mouse
gtgtcaactgaaactggtat

SEQ ID NO: 794111 - DNA, 20 bp, mouse
gaaccatagaggcggttccc

SEQ ID NO: 794112 - DNA, 20 bp, mouse
gctcttgcggcttgttccgt

SEQ ID NO: 794113 - DNA, 20 bp, mouse
gcacagtagcaacttctcca

SEQ ID NO: 794114 - DNA, 20 bp, mouse
ggtagctaataatcctaagg

SEQ ID NO: 794115 - DNA, 20 bp, mouse
gctactgtgtcaactgaaac

SEQ ID NO: 794116 - DNA, 20 bp, mouse
gtggctgcggtctgtattag

SEQ ID NO: 794117 - DNA, 20 bp, mouse
gaaagtggagtgcaaagcgt

SEQ ID NO: 794118 - DNA, 20 bp, mouse
ggcaaagcgtaggaggaatc

SEQ ID NO: 794119 - DNA, 20 bp, mouse
gctgcggtctgtattagagg

SEQ ID NO: 794120 - DNA, 20 bp, mouse
ggagggaagcgtctataccg

SEQ ID NO: 794121 - DNA, 20 bp, mouse
gaggctaagaggaagaacaa

SEQ ID NO: 794122 - DNA, 20 bp, mouse
gacagaagagaaaacgaaag

SEQ ID NO: 794123 - DNA, 20 bp, mouse
gactctggcctccattagaa

SEQ ID NO: 794124 - DNA, 20 bp, mouse
ggtattagaggaggactgga

SEQ ID NO: 794125 - DNA, 20 bp, mouse
ggtggagtgcaaagcgtagg

SEQ ID NO: 794126 - DNA, 20 bp, mouse
gccagcgcccgtagcaacca

SEQ ID NO: 794127 - DNA, 20 bp, mouse
gcgagcgcgaagtaagagac

SEQ ID NO: 794128 - DNA, 20 bp, mouse
gcgacgaggttcactctcac

SEQ ID NO: 794129 - DNA, 20 bp, mouse
gcggacctgggttaacaggg

SEQ ID NO: 794130 - DNA, 20 bp, mouse
gaaccaagggtgacggaaag

SEQ ID NO: 794131 - DNA, 20 bp, mouse
gagacagcgaagagctgggc

SEQ ID NO: 794132 - DNA, 20 bp, mouse
gagagtgaacctcgtcgtcg

SEQ ID NO: 794133 - DNA, 20 bp, mouse
gtccgcctccctgttaaccc

SEQ ID NO: 794134 - DNA, 20 bp, mouse
ggtaagagaccggtgtcccc

SEQ ID NO: 794135 - DNA, 20 bp, mouse
gccgtagcaaccaagggtga

SEQ ID NO: 794136 - DNA, 20 bp, mouse
gcgagggcccgcctactcag

SEQ ID NO: 794137 - DNA, 20 bp, mouse
gcgcccggcctgcggtccgc

SEQ ID NO: 794138 - DNA, 20 bp, mouse
gccctcgcgcgcccggcctg

SEQ ID NO: 794139 - DNA, 20 bp, mouse
gctactcaggggcagtgctt

SEQ ID NO: 794140 - DNA, 20 bp, mouse
ggcgacccagagccaccacc

SEQ ID NO: 794141 - DNA, 20 bp, mouse
gaagcccgcggaccgcaggc

SEQ ID NO: 794142 - DNA, 20 bp, mouse
gtccagaacgcactaacggc

SEQ ID NO: 794143 - DNA, 20 bp, mouse
gactggcggtgtttccggtg

SEQ ID NO: 794144 - DNA, 20 bp, mouse
ggaagtggctggtaaaatga

SEQ ID NO: 794145 - DNA, 20 bp, mouse
ggctgcttccgctctggtga

SEQ ID NO: 794146 - DNA, 20 bp, mouse
gaggcagtcgcgtaaggcgt

SEQ ID NO: 794147 - DNA, 20 bp, mouse
gtggacgaagagcgcaggcc

SEQ ID NO: 794148 - DNA, 20 bp, mouse
gcccccgctctgcggagaat

SEQ ID NO: 794149 - DNA, 20 bp, mouse
gccggctggacgaagagcgc

SEQ ID NO: 794150 - DNA, 20 bp, mouse
gtgtccccgcccccgctctg

SEQ ID NO: 794151 - DNA, 20 bp, mouse
gagcacagggggcggtgtac

SEQ ID NO: 794152 - DNA, 20 bp, mouse
gtccgcgcggtatcctgacc

SEQ ID NO: 794153 - DNA, 20 bp, mouse
gccttacgcgactgcctccc

SEQ ID NO: 794154 - DNA, 20 bp, mouse
gctgctggcgtctggcgtca

SEQ ID NO: 794155 - DNA, 20 bp, mouse
gcgcgactgcctcccaggtc

SEQ ID NO: 794156 - DNA, 20 bp, mouse
gaaaggcgctcagacttggg

SEQ ID NO: 794157 - DNA, 20 bp, mouse
ggccaaaggcgctcagactt

SEQ ID NO: 794158 - DNA, 20 bp, mouse
gcaaccgcctccggaagtcc

SEQ ID NO: 794159 - DNA, 20 bp, mouse
gaggacttctcgtgtagccg

SEQ ID NO: 794160 - DNA, 20 bp, mouse
gcttgtgtggcctgaaggat

SEQ ID NO: 794161 - DNA, 20 bp, mouse
gccaaaaagtcctgcttgtg

SEQ ID NO: 794162 - DNA, 20 bp, mouse
gctgtgcgcccaaccgcctc

SEQ ID NO: 794163 - DNA, 20 bp, mouse
ggggcgggcgttagcacgtg

SEQ ID NO: 794164 - DNA, 20 bp, mouse
gggaactccaggacttccgg

SEQ ID NO: 794165 - DNA, 20 bp, mouse
ggtcctggagttccagactt

SEQ ID NO: 794166 - DNA, 20 bp, mouse
gaggacgcatgtcaactgtg

SEQ ID NO: 794167 - DNA, 20 bp, mouse
gttgtcgttgctctgtaatt

SEQ ID NO: 794168 - DNA, 20 bp, mouse
ggacaactcggatgtcacat

SEQ ID NO: 794169 - DNA, 20 bp, mouse
gcaagagcaacgacgagtgc

SEQ ID NO: 794170 - DNA, 20 bp, mouse
gtaaatccaaacgttttctt

SEQ ID NO: 794171 - DNA, 20 bp, mouse
ggtggcacagcgtttgagac

SEQ ID NO: 794172 - DNA, 20 bp, mouse
gaggctagaggagcctaggg

SEQ ID NO: 794173 - DNA, 20 bp, mouse
gaacgacgagtgcaggctag

SEQ ID NO: 794174 - DNA, 20 bp, mouse
gaaatctggtattgcttcct

SEQ ID NO: 794175 - DNA, 20 bp, mouse
ggtacgcagccacgagaccc

SEQ ID NO: 794176 - DNA, 20 bp, mouse
gctaaggcgcaccataggtc

SEQ ID NO: 794177 - DNA, 20 bp, mouse
gagggggtgtcagcagagat

SEQ ID NO: 794178 - DNA, 20 bp, mouse
ggacaccccctgagcactgc

SEQ ID NO: 794179 - DNA, 20 bp, mouse
ggatgggaatggaggatcta

SEQ ID NO: 794180 - DNA, 20 bp, mouse
gacactccttgccagaccta

SEQ ID NO: 794181 - DNA, 20 bp, mouse
gtcccagataacttgaggaa

SEQ ID NO: 794182 - DNA, 20 bp, mouse
gtggtggcacgcccacatgg

SEQ ID NO: 794183 - DNA, 20 bp, mouse
ggccccttcctcaagttatc

SEQ ID NO: 794184 - DNA, 20 bp, mouse
gaggatctaaggcgcaccat

SEQ ID NO: 794185 - DNA, 20 bp, mouse
ggctagtcccagataacttg

SEQ ID NO: 794186 - DNA, 20 bp, mouse
gcacctcagagaactgccaa

SEQ ID NO: 794187 - DNA, 20 bp, mouse
gaggacgctgtggagaagct

SEQ ID NO: 794188 - DNA, 20 bp, mouse
gtgggctgcagccagaacca

SEQ ID NO: 794189 - DNA, 20 bp, mouse
gggaaggtcacgctgacagg

SEQ ID NO: 794190 - DNA, 20 bp, mouse
gtcatccggcatctacccaa

SEQ ID NO: 794191 - DNA, 20 bp, mouse
gcccccctttgggtagatgc

SEQ ID NO: 794192 - DNA, 20 bp, mouse
gagagtgtaggaaccgcagc

SEQ ID NO: 794193 - DNA, 20 bp, mouse
gtgaggcctgggtcagcatg

SEQ ID NO: 794194 - DNA, 20 bp, mouse
gcagaaaagcaggttactta

SEQ ID NO: 794195 - DNA, 20 bp, mouse
gggcagttctctgaggtggg

SEQ ID NO: 794196 - DNA, 20 bp, mouse
gcgcgctgagattgcggagt

SEQ ID NO: 794197 - DNA, 20 bp, mouse
gctggtctagaggtgtggtt

SEQ ID NO: 794198 - DNA, 20 bp, mouse
gagagagcaggcgggagctt

SEQ ID NO: 794199 - DNA, 20 bp, mouse
gaaacgtagctgtgggtgat

SEQ ID NO: 794200 - DNA, 20 bp, mouse
gctgagattgcggagtgggc

SEQ ID NO: 794201 - DNA, 20 bp, mouse
gcaaactctaaaattcgact

SEQ ID NO: 794202 - DNA, 20 bp, mouse
gtgtgggtgctacagaggag

SEQ ID NO: 794203 - DNA, 20 bp, mouse
ggtacttcttacacagggta

SEQ ID NO: 794204 - DNA, 20 bp, mouse
gtcgcgagaggtgacgtcat

SEQ ID NO: 794205 - DNA, 20 bp, mouse
gtggtttggaaacgtagctg

SEQ ID NO: 794206 - DNA, 20 bp, mouse
gccaacatgccccggaccgt

SEQ ID NO: 794207 - DNA, 20 bp, mouse
gggcggagtttgcaacacgt

SEQ ID NO: 794208 - DNA, 20 bp, mouse
gtgcggaagagcctacggtc

SEQ ID NO: 794209 - DNA, 20 bp, mouse
gctggtgctgtaagcagagt

SEQ ID NO: 794210 - DNA, 20 bp, mouse
gtgaatgaacactggaagtc

SEQ ID NO: 794211 - DNA, 20 bp, mouse
gggttgagacaccaaaacgg

SEQ ID NO: 794212 - DNA, 20 bp, mouse
gcaacacgtgggcttgggac

SEQ ID NO: 794213 - DNA, 20 bp, mouse
gccggggcatgttgggatct

SEQ ID NO: 794214 - DNA, 20 bp, mouse
ggcaaactccgcccctaaac

SEQ ID NO: 794215 - DNA, 20 bp, mouse
ggtaagcagagtaggtaagc

SEQ ID NO: 794216 - DNA, 20 bp, mouse
gcccgtatcccactgcagta

SEQ ID NO: 794217 - DNA, 20 bp, mouse
gtaggcatccctactgcagt

SEQ ID NO: 794218 - DNA, 20 bp, mouse
ggcagtgggatacggggatg

SEQ ID NO: 794219 - DNA, 20 bp, mouse
gtggaccaggactcctcaaa

SEQ ID NO: 794220 - DNA, 20 bp, mouse
gctgacaattcaggaggagc

SEQ ID NO: 794221 - DNA, 20 bp, mouse
gttggcggctactctggacc

SEQ ID NO: 794222 - DNA, 20 bp, mouse
ggagccggagtcctgaccca

SEQ ID NO: 794223 - DNA, 20 bp, mouse
gaagaagagaggcgtggcaa

SEQ ID NO: 794224 - DNA, 20 bp, mouse
gtccctactgcagtgggata

SEQ ID NO: 794225 - DNA, 20 bp, mouse
gtaaaacagtaagagagctt

SEQ ID NO: 794226 - DNA, 20 bp, mouse
gggtctgtgttcacctagga

SEQ ID NO: 794227 - DNA, 20 bp, mouse
gtgtgttcacctaggaagga

SEQ ID NO: 794228 - DNA, 20 bp, mouse
gcctaggaaggatggctgag

SEQ ID NO: 794229 - DNA, 20 bp, mouse
ggaccggcgctggtatttag

SEQ ID NO: 794230 - DNA, 20 bp, mouse
gtggttgcccggagtaaaaa

SEQ ID NO: 794231 - DNA, 20 bp, mouse
gcgccggtctgtgttcacct

SEQ ID NO: 794232 - DNA, 20 bp, mouse
gcgagtgagggaagcgaatt

SEQ ID NO: 794233 - DNA, 20 bp, mouse
gcacctctaaataccagcgc

SEQ ID NO: 794234 - DNA, 20 bp, mouse
ggcggcgccatttttactcc

SEQ ID NO: 794235 - DNA, 20 bp, mouse
ggaatgttcttctcgagtga

SEQ ID NO: 794236 - DNA, 20 bp, mouse
gtgggagcgaagctgcttga

SEQ ID NO: 794237 - DNA, 20 bp, mouse
gaagctgcttgacggcagaa

SEQ ID NO: 794238 - DNA, 20 bp, mouse
gagagtcagtgggcacttta

SEQ ID NO: 794239 - DNA, 20 bp, mouse
ggaggcgggtctaggaaggg

SEQ ID NO: 794240 - DNA, 20 bp, mouse
gaaagaggcgggtctaggaa

SEQ ID NO: 794241 - DNA, 20 bp, mouse
ggagccacaagcctctggtg

SEQ ID NO: 794242 - DNA, 20 bp, mouse
gaactcgtcgttagagtcag

SEQ ID NO: 794243 - DNA, 20 bp, mouse
gttgtggctcccggaggcaa

SEQ ID NO: 794244 - DNA, 20 bp, mouse
gcaaagatttgcctcaccag

SEQ ID NO: 794245 - DNA, 20 bp, mouse
ggtgacggagcgctttacga

SEQ ID NO: 794246 - DNA, 20 bp, mouse
ggaaactgacgatcagccga

SEQ ID NO: 794247 - DNA, 20 bp, mouse
gcaaagacccaagcctctct

SEQ ID NO: 794248 - DNA, 20 bp, mouse
gggcggggcaaacttcgaac

SEQ ID NO: 794249 - DNA, 20 bp, mouse
ggcgagagaccgggacgaga

SEQ ID NO: 794250 - DNA, 20 bp, mouse
gcgtcaggagatttggttat

SEQ ID NO: 794251 - DNA, 20 bp, mouse
gtccggcgccgcgagagacc

SEQ ID NO: 794252 - DNA, 20 bp, mouse
gagggacatccacacacccc

SEQ ID NO: 794253 - DNA, 20 bp, mouse
gggaaataagggagttgaaa

SEQ ID NO: 794254 - DNA, 20 bp, mouse
ggagaccgggacgagagggc

SEQ ID NO: 794255 - DNA, 20 bp, mouse
gtcccggtctctcgcggcgc

SEQ ID NO: 794256 - DNA, 20 bp, mouse
gccagctagagaatgggctg

SEQ ID NO: 794257 - DNA, 20 bp, mouse
ggaacagcggaggactgaat

SEQ ID NO: 794258 - DNA, 20 bp, mouse
gcgtgaagacccacaggcgg

SEQ ID NO: 794259 - DNA, 20 bp, mouse
gggaagaagaggtgcgcctt

SEQ ID NO: 794260 - DNA, 20 bp, mouse
ggggcatcttctgggaacag

SEQ ID NO: 794261 - DNA, 20 bp, mouse
ggtgaaaccagctagagaat

SEQ ID NO: 794262 - DNA, 20 bp, mouse
gcggaggccgcctagcagtg

SEQ ID NO: 794263 - DNA, 20 bp, mouse
gcacgcaccccactgctagg

SEQ ID NO: 794264 - DNA, 20 bp, mouse
gagaagaggtgcgccttcgg

SEQ ID NO: 794265 - DNA, 20 bp, mouse
ggtgcgtgaagacccacagg

SEQ ID NO: 794266 - DNA, 20 bp, mouse
ggggtcctgccctcaatctg

SEQ ID NO: 794267 - DNA, 20 bp, mouse
gctgccctcaatctggggtg

SEQ ID NO: 794268 - DNA, 20 bp, mouse
gcaggccccaccccagattg

SEQ ID NO: 794269 - DNA, 20 bp, mouse
gggcgtgcgcgtaaagtccc

SEQ ID NO: 794270 - DNA, 20 bp, mouse
gggcaaatctgcccagagac

SEQ ID NO: 794271 - DNA, 20 bp, mouse
gttcacgcaagcaagttaag

SEQ ID NO: 794272 - DNA, 20 bp, mouse
gcgcggacgtcgagagtccc

SEQ ID NO: 794273 - DNA, 20 bp, mouse
ggagttctgcctagcagccc

SEQ ID NO: 794274 - DNA, 20 bp, mouse
gcccagagcaaacctgagca

SEQ ID NO: 794275 - DNA, 20 bp, mouse
gaagcaagttaagggggctg

SEQ ID NO: 794276 - DNA, 20 bp, mouse
ggggcgaagttgagcacgaa

SEQ ID NO: 794277 - DNA, 20 bp, mouse
gcacgaagggcttatttcgg

SEQ ID NO: 794278 - DNA, 20 bp, mouse
gtgaggaagttggtcccgat

SEQ ID NO: 794279 - DNA, 20 bp, mouse
ggacaagggactgatgatgg

SEQ ID NO: 794280 - DNA, 20 bp, mouse
ggggaagaagtatttatgtc

SEQ ID NO: 794281 - DNA, 20 bp, mouse
gacttcgcccgtgaggaagt

SEQ ID NO: 794282 - DNA, 20 bp, mouse
gtcaggcaggaatggcgctt

SEQ ID NO: 794283 - DNA, 20 bp, mouse
gcttggacgttggagacttg

SEQ ID NO: 794284 - DNA, 20 bp, mouse
gattctaagtagctgatctt

SEQ ID NO: 794285 - DNA, 20 bp, mouse
ggtgctcaacttcgcccgtg

SEQ ID NO: 794286 - DNA, 20 bp, mouse
gaggagcagcatgctggttg

SEQ ID NO: 794287 - DNA, 20 bp, mouse
gaccacaggtagtgcggacg

SEQ ID NO: 794288 - DNA, 20 bp, mouse
gggacgccgcggctcacggc

SEQ ID NO: 794289 - DNA, 20 bp, mouse
gggcgtaaagcctaggcgcg

SEQ ID NO: 794290 - DNA, 20 bp, mouse
gggcgcgaggccgtgggggt

SEQ ID NO: 794291 - DNA, 20 bp, mouse
gcgcggagggccctgcctgc

SEQ ID NO: 794292 - DNA, 20 bp, mouse
gtccgcgtccgcactacctg

SEQ ID NO: 794293 - DNA, 20 bp, mouse
ggctccggggcgtaaagcct

SEQ ID NO: 794294 - DNA, 20 bp, mouse
ggcggtgccctggccctccg

SEQ ID NO: 794295 - DNA, 20 bp, mouse
gaatctgctccgggactcgg

SEQ ID NO: 794296 - DNA, 20 bp, mouse
ggcggggcttgctgcacaac

SEQ ID NO: 794297 - DNA, 20 bp, mouse
gggccggcgtacaggcgggg

SEQ ID NO: 794298 - DNA, 20 bp, mouse
ggggccctgtagcctcggtt

SEQ ID NO: 794299 - DNA, 20 bp, mouse
gcgcgggtgaagttctccac

SEQ ID NO: 794300 - DNA, 20 bp, mouse
gagtgcgcacgagcccctga

SEQ ID NO: 794301 - DNA, 20 bp, mouse
ggctgcgctgggctccctca

SEQ ID NO: 794302 - DNA, 20 bp, mouse
gcaaccggcgagccacgggg

SEQ ID NO: 794303 - DNA, 20 bp, mouse
ggggctgggctgctattggc

SEQ ID NO: 794304 - DNA, 20 bp, mouse
gctgcacaaccggaagaggc

SEQ ID NO: 794305 - DNA, 20 bp, mouse
gagaaagccgcggagtcttt

SEQ ID NO: 794306 - DNA, 20 bp, mouse
ggaccccgtagccctagtag

SEQ ID NO: 794307 - DNA, 20 bp, mouse
gtcggcctaacagggtctgg

SEQ ID NO: 794308 - DNA, 20 bp, mouse
gagggctacggggtcccgga

SEQ ID NO: 794309 - DNA, 20 bp, mouse
gagtccccggccttagtgac

SEQ ID NO: 794310 - DNA, 20 bp, mouse
gggtctggcggcttatagaa

SEQ ID NO: 794311 - DNA, 20 bp, mouse
gacggggtcccggaaggtcc

SEQ ID NO: 794312 - DNA, 20 bp, mouse
gaaaactagtcccactcctg

SEQ ID NO: 794313 - DNA, 20 bp, mouse
gggccgctgacctgtcacta

SEQ ID NO: 794314 - DNA, 20 bp, mouse
ggggcccgcagtgctgcctg

SEQ ID NO: 794315 - DNA, 20 bp, mouse
gtgacctgtcactaaggccg

SEQ ID NO: 794316 - DNA, 20 bp, mouse
gcgcacgcgcaacatccttg

SEQ ID NO: 794317 - DNA, 20 bp, mouse
ggagcgcaggaacccatctt

SEQ ID NO: 794318 - DNA, 20 bp, mouse
gacgggccggataacaggaa

SEQ ID NO: 794319 - DNA, 20 bp, mouse
gcgcctggagcgcagagcgc

SEQ ID NO: 794320 - DNA, 20 bp, mouse
gctgggctccgcccccaaga

SEQ ID NO: 794321 - DNA, 20 bp, mouse
gggcccgtcgcgcgttgtga

SEQ ID NO: 794322 - DNA, 20 bp, mouse
gggccggataacaggaaggg

SEQ ID NO: 794323 - DNA, 20 bp, mouse
ggcgggaaactcttagccct

SEQ ID NO: 794324 - DNA, 20 bp, mouse
ggcgcgcgcgcggacccgca

SEQ ID NO: 794325 - DNA, 20 bp, mouse
gccgtcaggtcaacccgcag

SEQ ID NO: 794326 - DNA, 20 bp, mouse
gacagtggctgtattagtag

SEQ ID NO: 794327 - DNA, 20 bp, mouse
ggacccggaactgttctcgg

SEQ ID NO: 794328 - DNA, 20 bp, mouse
gtgtggcgatacaaacacag

SEQ ID NO: 794329 - DNA, 20 bp, mouse
ggaggcgaaagcatgcgccc

SEQ ID NO: 794330 - DNA, 20 bp, mouse
gtgaagagatatagaacttc

SEQ ID NO: 794331 - DNA, 20 bp, mouse
gagttccgggtcaatgggcg

SEQ ID NO: 794332 - DNA, 20 bp, mouse
gagaacagttccgggtcaat

SEQ ID NO: 794333 - DNA, 20 bp, mouse
gcctgcgcgatagagtgact

SEQ ID NO: 794334 - DNA, 20 bp, mouse
gaactcgtatcctaaacgct

SEQ ID NO: 794335 - DNA, 20 bp, mouse
gtgttctcggtggtgaccca

SEQ ID NO: 794336 - DNA, 20 bp, mouse
gctgcaggggacagtgtgac

SEQ ID NO: 794337 - DNA, 20 bp, mouse
gaagcgcagaagatcgtctc

SEQ ID NO: 794338 - DNA, 20 bp, mouse
gcctggggcgggaccgtgac

SEQ ID NO: 794339 - DNA, 20 bp, mouse
ggcgcagaggcggcctgggg

SEQ ID NO: 794340 - DNA, 20 bp, mouse
gagaggcgggccagccggaa

SEQ ID NO: 794341 - DNA, 20 bp, mouse
gcgaagtcagtcacctagag

SEQ ID NO: 794342 - DNA, 20 bp, mouse
gtgactggctccgccccttc

SEQ ID NO: 794343 - DNA, 20 bp, mouse
gcgctgcagaatgagtgcta

SEQ ID NO: 794344 - DNA, 20 bp, mouse
gagggcgcagaggcggcctg

SEQ ID NO: 794345 - DNA, 20 bp, mouse
ggctggcccgcctctggctc

SEQ ID NO: 794346 - DNA, 20 bp, mouse
gagtgggcctctctttgcaa

SEQ ID NO: 794347 - DNA, 20 bp, mouse
gctagggcgggcggggtcct

SEQ ID NO: 794348 - DNA, 20 bp, mouse
ggctaagagaatgagtgtta

SEQ ID NO: 794349 - DNA, 20 bp, mouse
gctgcccgcatctccgcctg

SEQ ID NO: 794350 - DNA, 20 bp, mouse
gggagatgcgggcagcccta

SEQ ID NO: 794351 - DNA, 20 bp, mouse
ggcaatggcgggtgatgagt

SEQ ID NO: 794352 - DNA, 20 bp, mouse
gcataaaagacacagcgtgg

SEQ ID NO: 794353 - DNA, 20 bp, mouse
gctccgtgaagtcagagatc

SEQ ID NO: 794354 - DNA, 20 bp, mouse
gcgggcagccctagggcggg

SEQ ID NO: 794355 - DNA, 20 bp, mouse
gaagcctcaggcggagatgc

SEQ ID NO: 794356 - DNA, 20 bp, mouse
gtccaccggcaacttgacta

SEQ ID NO: 794357 - DNA, 20 bp, mouse
gccaggcctggaggcgtctt

SEQ ID NO: 794358 - DNA, 20 bp, mouse
ggacttccaaagacgcctcc

SEQ ID NO: 794359 - DNA, 20 bp, mouse
gcggaacaggaaatgcgagt

SEQ ID NO: 794360 - DNA, 20 bp, mouse
gcccagaagctccaggctat

SEQ ID NO: 794361 - DNA, 20 bp, mouse
gttgactacggctttctcta

SEQ ID NO: 794362 - DNA, 20 bp, mouse
gagggtgggtggtctttggt

SEQ ID NO: 794363 - DNA, 20 bp, mouse
ggaagctccaggctatgggc

SEQ ID NO: 794364 - DNA, 20 bp, mouse
gcccgagggacaagatctgt

SEQ ID NO: 794365 - DNA, 20 bp, mouse
gaaagccgtagtcaagttgc

SEQ ID NO: 794366 - DNA, 20 bp, mouse
gggccgcgagatggcgatgg

SEQ ID NO: 794367 - DNA, 20 bp, mouse
ggagtggtggggattaattt

SEQ ID NO: 794368 - DNA, 20 bp, mouse
ggatggccgcgagatggcga

SEQ ID NO: 794369 - DNA, 20 bp, mouse
gtcccggggtgctcggagaa

SEQ ID NO: 794370 - DNA, 20 bp, mouse
ggacgccggaaacacacacc

SEQ ID NO: 794371 - DNA, 20 bp, mouse
ggacgctcctgggccaccca

SEQ ID NO: 794372 - DNA, 20 bp, mouse
gtcttctggtaggaacgcga

SEQ ID NO: 794373 - DNA, 20 bp, mouse
gaaaagaggctgagtactca

SEQ ID NO: 794374 - DNA, 20 bp, mouse
gagagagactacaactcccg

SEQ ID NO: 794375 - DNA, 20 bp, mouse
gtctgccccgtgggtggccc

SEQ ID NO: 794376 - DNA, 20 bp, mouse
gaatgggcggggttttgtga

SEQ ID NO: 794377 - DNA, 20 bp, mouse
gcaggggcaggcccaagaat

SEQ ID NO: 794378 - DNA, 20 bp, mouse
ggggcaggcccaagaatggg

SEQ ID NO: 794379 - DNA, 20 bp, mouse
ggaggcggggcgtatggcgc

SEQ ID NO: 794380 - DNA, 20 bp, mouse
gcaaaaccccgcccattctt

SEQ ID NO: 794381 - DNA, 20 bp, mouse
ggacgcctagaacctagctt

SEQ ID NO: 794382 - DNA, 20 bp, mouse
gtgtgagggcggggctttgg

SEQ ID NO: 794383 - DNA, 20 bp, mouse
gctagcttgggcgaggagac

SEQ ID NO: 794384 - DNA, 20 bp, mouse
gtctaggcgtccgtgtctga

SEQ ID NO: 794385 - DNA, 20 bp, mouse
gctagaacctagcttgggcg

SEQ ID NO: 794386 - DNA, 20 bp, mouse
gaggctacgtgaccagtcag

SEQ ID NO: 794387 - DNA, 20 bp, mouse
ggggacagctagccactgac

SEQ ID NO: 794388 - DNA, 20 bp, mouse
gaaacccgggagaagtttag

SEQ ID NO: 794389 - DNA, 20 bp, mouse
gtactcaaggaggtcgagag

SEQ ID NO: 794390 - DNA, 20 bp, mouse
gagggcagggccagaaaccc

SEQ ID NO: 794391 - DNA, 20 bp, mouse
gttagcggaagtcaagaacg

SEQ ID NO: 794392 - DNA, 20 bp, mouse
gttaaagagtagaggtgcct

SEQ ID NO: 794393 - DNA, 20 bp, mouse
gagcgtcccactagcctcac

SEQ ID NO: 794394 - DNA, 20 bp, mouse
gtaagagtgccgagagggcg

SEQ ID NO: 794395 - DNA, 20 bp, mouse
gttgacgaccgcaacccgtg

SEQ ID NO: 794396 - DNA, 20 bp, mouse
gtccccgcgaggcggaagtc

SEQ ID NO: 794397 - DNA, 20 bp, mouse
gggtcccggtccccgcgagg

SEQ ID NO: 794398 - DNA, 20 bp, mouse
gcgcgcaggccgcctggtcc

SEQ ID NO: 794399 - DNA, 20 bp, mouse
gactgtgaaaaaaaccagga

SEQ ID NO: 794400 - DNA, 20 bp, mouse
gcgcggggaccgggaccagg

SEQ ID NO: 794401 - DNA, 20 bp, mouse
ggccaagtctagcctccaca

SEQ ID NO: 794402 - DNA, 20 bp, mouse
gaggaaggccacaaaggcga

SEQ ID NO: 794403 - DNA, 20 bp, mouse
gcgccggctccactccccgg

SEQ ID NO: 794404 - DNA, 20 bp, mouse
gctccccggcggactccaat

SEQ ID NO: 794405 - DNA, 20 bp, mouse
gtcgcctgacttccgcctcg

SEQ ID NO: 794406 - DNA, 20 bp, mouse
gaggacgggaattactgttc

SEQ ID NO: 794407 - DNA, 20 bp, mouse
gttccggcttccagcccgaa

SEQ ID NO: 794408 - DNA, 20 bp, mouse
gccgcagggcgcttccggtc

SEQ ID NO: 794409 - DNA, 20 bp, mouse
ggatcccgagtcccgccctc

SEQ ID NO: 794410 - DNA, 20 bp, mouse
gggtgtctctgtgcgtgcaa

SEQ ID NO: 794411 - DNA, 20 bp, mouse
gtaactcaacagtagccgtt

SEQ ID NO: 794412 - DNA, 20 bp, mouse
gcaaaggctgaagaagtcat

SEQ ID NO: 794413 - DNA, 20 bp, mouse
gccgccctctggagcaggac

SEQ ID NO: 794414 - DNA, 20 bp, mouse
ggtctctgtgcgtgcaaggg

SEQ ID NO: 794415 - DNA, 20 bp, mouse
gagaaggtcatcctgaagac

SEQ ID NO: 794416 - DNA, 20 bp, mouse
gcagccgaggtgcacgatga

SEQ ID NO: 794417 - DNA, 20 bp, mouse
gactcctcccagttcctaga

SEQ ID NO: 794418 - DNA, 20 bp, mouse
gggagtctgcaggaatttgt

SEQ ID NO: 794419 - DNA, 20 bp, mouse
gagatggccgagtccaggga

SEQ ID NO: 794420 - DNA, 20 bp, mouse
gggaccttctaggaactggg

SEQ ID NO: 794421 - DNA, 20 bp, mouse
gccaaagatgtacactagag

SEQ ID NO: 794422 - DNA, 20 bp, mouse
gggatcttctaggaagtggg

SEQ ID NO: 794423 - DNA, 20 bp, mouse
gagtcttcaagaaacgatga

SEQ ID NO: 794424 - DNA, 20 bp, mouse
gccgaggtgcacgatgaagg

SEQ ID NO: 794425 - DNA, 20 bp, mouse
gacctatcggagctcagatg

SEQ ID NO: 794426 - DNA, 20 bp, mouse
ggcgccccgcggtgtgttct

SEQ ID NO: 794427 - DNA, 20 bp, mouse
ggttccggaagctgctgcga

SEQ ID NO: 794428 - DNA, 20 bp, mouse
gagtcccagaacacaccgcg

SEQ ID NO: 794429 - DNA, 20 bp, mouse
gcaacactccagtgtgaggc

SEQ ID NO: 794430 - DNA, 20 bp, mouse
ggttggttatccaatagagt

SEQ ID NO: 794431 - DNA, 20 bp, mouse
gacaccgcggggcgcggagg

SEQ ID NO: 794432 - DNA, 20 bp, mouse
ggcagcaacactccagtgtg

SEQ ID NO: 794433 - DNA, 20 bp, mouse
gcttgtaggcgccacagaaa

SEQ ID NO: 794434 - DNA, 20 bp, mouse
gtaagctctctgcactcgcc

SEQ ID NO: 794435 - DNA, 20 bp, mouse
gtgttgttacggtttgaaaa

SEQ ID NO: 794436 - DNA, 20 bp, mouse
ggaggcctccgtgacggaac

SEQ ID NO: 794437 - DNA, 20 bp, mouse
gactccgggccccaaagaaa

SEQ ID NO: 794438 - DNA, 20 bp, mouse
gcggtccccgcccctttctt

SEQ ID NO: 794439 - DNA, 20 bp, mouse
ggaccgcccaggggatcaag

SEQ ID NO: 794440 - DNA, 20 bp, mouse
gtctgaggccagcccctcca

SEQ ID NO: 794441 - DNA, 20 bp, mouse
gccggcacgcgcaagactcc

SEQ ID NO: 794442 - DNA, 20 bp, mouse
gatgactgaacccgagtccg

SEQ ID NO: 794443 - DNA, 20 bp, mouse
ggccccacgtccaagttttc

SEQ ID NO: 794444 - DNA, 20 bp, mouse
ggcggggaccgcgttgagaa

SEQ ID NO: 794445 - DNA, 20 bp, mouse
ggaaggagcaggccatggag

SEQ ID NO: 794446 - DNA, 20 bp, mouse
gcgaccggaagtcagactgg

SEQ ID NO: 794447 - DNA, 20 bp, mouse
ggtcccctgctggacatcgg

SEQ ID NO: 794448 - DNA, 20 bp, mouse
ggctcccgccgatgtccagc

SEQ ID NO: 794449 - DNA, 20 bp, mouse
gacgcgaccggaagtcagac

SEQ ID NO: 794450 - DNA, 20 bp, mouse
ggtccagcaggggacgctgc

SEQ ID NO: 794451 - DNA, 20 bp, mouse
ggcggagccagagacgcgac

SEQ ID NO: 794452 - DNA, 20 bp, mouse
gaagcaggaggagtcgtcac

SEQ ID NO: 794453 - DNA, 20 bp, mouse
gggacatcggcgggagcacc

SEQ ID NO: 794454 - DNA, 20 bp, mouse
gatggctacagcacaggagc

SEQ ID NO: 794455 - DNA, 20 bp, mouse
gcacagccctgggccaccag

SEQ ID NO: 794456 - DNA, 20 bp, mouse
gcgtgcccgccctgtcgcca

SEQ ID NO: 794457 - DNA, 20 bp, mouse
gggggcgccatcttgagaaa

SEQ ID NO: 794458 - DNA, 20 bp, mouse
gcagcggcggtcaaaccgga

SEQ ID NO: 794459 - DNA, 20 bp, mouse
ggaagtcgactgtgcagcgg

SEQ ID NO: 794460 - DNA, 20 bp, mouse
ggtgagctggcaaacaactg

SEQ ID NO: 794461 - DNA, 20 bp, mouse
gcacgagcgcaaagcgctct

SEQ ID NO: 794462 - DNA, 20 bp, mouse
ggcgcccctggcgacagggc

SEQ ID NO: 794463 - DNA, 20 bp, mouse
gtgtgcagcggcggtcaaac

SEQ ID NO: 794464 - DNA, 20 bp, mouse
gaaaccggaaggggaggtgc

SEQ ID NO: 794465 - DNA, 20 bp, mouse
gttaggctattgacgaagct

SEQ ID NO: 794466 - DNA, 20 bp, mouse
ggtaccgcctctacgtcaag

SEQ ID NO: 794467 - DNA, 20 bp, mouse
gttgtcaggtgtcactacat

SEQ ID NO: 794468 - DNA, 20 bp, mouse
gtcaccatggccaccctcgc

SEQ ID NO: 794469 - DNA, 20 bp, mouse
gcacaggccgaagccagcga

SEQ ID NO: 794470 - DNA, 20 bp, mouse
gtggccaccctcgctggctt

SEQ ID NO: 794471 - DNA, 20 bp, mouse
gtacataggcaggctgagag

SEQ ID NO: 794472 - DNA, 20 bp, mouse
gaggctgagagaggactagc

SEQ ID NO: 794473 - DNA, 20 bp, mouse
gccgcctctacgtcaagggg

SEQ ID NO: 794474 - DNA, 20 bp, mouse
gtggccatggtgactacagg

SEQ ID NO: 794475 - DNA, 20 bp, mouse
gtgtggaatgtccatcttaa

SEQ ID NO: 794476 - DNA, 20 bp, mouse
gtgacccggtagagataaat

SEQ ID NO: 794477 - DNA, 20 bp, mouse
ggggtcatctgaaaaccacg

SEQ ID NO: 794478 - DNA, 20 bp, mouse
gtacggaaacagatgaaggg

SEQ ID NO: 794479 - DNA, 20 bp, mouse
gtggggaaacggacggatgg

SEQ ID NO: 794480 - DNA, 20 bp, mouse
gaggctacgggtcctccccg

SEQ ID NO: 794481 - DNA, 20 bp, mouse
gaagtacggaaacagatgaa

SEQ ID NO: 794482 - DNA, 20 bp, mouse
gctgtcttgaaaaacggggt

SEQ ID NO: 794483 - DNA, 20 bp, mouse
ggggtggggaaacggacgga

SEQ ID NO: 794484 - DNA, 20 bp, mouse
ggggggggtggggaaacgga

SEQ ID NO: 794485 - DNA, 20 bp, mouse
gtggagcttggaagtgggcg

SEQ ID NO: 794486 - DNA, 20 bp, mouse
gacagcctactgagaggcgg

SEQ ID NO: 794487 - DNA, 20 bp, mouse
ggggaaatggcaggcgagga

SEQ ID NO: 794488 - DNA, 20 bp, mouse
ggggacagcctactgagagg

SEQ ID NO: 794489 - DNA, 20 bp, mouse
gtgccgggaaatggcaggcg

SEQ ID NO: 794490 - DNA, 20 bp, mouse
gccgggcggaaacgctactc

SEQ ID NO: 794491 - DNA, 20 bp, mouse
gggagcccccgcctctcagt

SEQ ID NO: 794492 - DNA, 20 bp, mouse
ggggcgggagtatattaggc

SEQ ID NO: 794493 - DNA, 20 bp, mouse
gtcccccacagcagggactc

SEQ ID NO: 794494 - DNA, 20 bp, mouse
gggtgctggcgttggttggg

SEQ ID NO: 794495 - DNA, 20 bp, mouse
gctggccctagcagaagcag

SEQ ID NO: 794496 - DNA, 20 bp, mouse
gggaggagctaggaaagcgt

SEQ ID NO: 794497 - DNA, 20 bp, mouse
gagaggcggcctctcgagaa

SEQ ID NO: 794498 - DNA, 20 bp, mouse
gggaagtactggactgagag

SEQ ID NO: 794499 - DNA, 20 bp, mouse
gagggtgggacaataggaaa

SEQ ID NO: 794500 - DNA, 20 bp, mouse
gtactggactgagagagggt

SEQ ID NO: 794501 - DNA, 20 bp, mouse
gctaggaaagcgtgggacgg

SEQ ID NO: 794502 - DNA, 20 bp, mouse
ggagctaggaaagcgtggga

SEQ ID NO: 794503 - DNA, 20 bp, mouse
gacggcggagactcaaatag

SEQ ID NO: 794504 - DNA, 20 bp, mouse
gactgaggaggggaccaagt

SEQ ID NO: 794505 - DNA, 20 bp, mouse
gccactaggaagggcggtgt

SEQ ID NO: 794506 - DNA, 20 bp, mouse
ggagaagtgaccacctggga

SEQ ID NO: 794507 - DNA, 20 bp, mouse
gaacaaatcacaggaggaac

SEQ ID NO: 794508 - DNA, 20 bp, mouse
gacagatgctaacaaatcac

SEQ ID NO: 794509 - DNA, 20 bp, mouse
ggatgctaacaaatcacagg

SEQ ID NO: 794510 - DNA, 20 bp, mouse
gaagatgaaggcccaaagca

SEQ ID NO: 794511 - DNA, 20 bp, mouse
gcctggataccgcaacacac

SEQ ID NO: 794512 - DNA, 20 bp, mouse
gagaggagaagtgaccacct

SEQ ID NO: 794513 - DNA, 20 bp, mouse
gtgttatagctgtctctgtc

SEQ ID NO: 794514 - DNA, 20 bp, mouse
gtggcagtcagagccctccc

SEQ ID NO: 794515 - DNA, 20 bp, mouse
ggtgagcgcaaagactgcag

SEQ ID NO: 794516 - DNA, 20 bp, mouse
gtggtggtcaacctaggaca

SEQ ID NO: 794517 - DNA, 20 bp, mouse
gggcacgtgctcatcctccc

SEQ ID NO: 794518 - DNA, 20 bp, mouse
gaagctccgacagcccctcc

SEQ ID NO: 794519 - DNA, 20 bp, mouse
ggccctgtggtggtcaacct

SEQ ID NO: 794520 - DNA, 20 bp, mouse
gtctccggctcacgtcacta

SEQ ID NO: 794521 - DNA, 20 bp, mouse
ggctgagatccaaacctcct

SEQ ID NO: 794522 - DNA, 20 bp, mouse
gcaccacagggcacaaggcc

SEQ ID NO: 794523 - DNA, 20 bp, mouse
gaggggctgtcggagcttcc

SEQ ID NO: 794524 - DNA, 20 bp, mouse
gagcccggaaccttaaacta

SEQ ID NO: 794525 - DNA, 20 bp, mouse
gaatcgccggcactccgggg

SEQ ID NO: 794526 - DNA, 20 bp, mouse
ggatcctgctggagcagagt

SEQ ID NO: 794527 - DNA, 20 bp, mouse
gaggcggggaggaggtaacc

SEQ ID NO: 794528 - DNA, 20 bp, mouse
gccgccccggaagtgacttg

SEQ ID NO: 794529 - DNA, 20 bp, mouse
gcagtcgctgacaccaaact

SEQ ID NO: 794530 - DNA, 20 bp, mouse
gagggtctcttgtttctcgc

SEQ ID NO: 794531 - DNA, 20 bp, mouse
gtagtcggattccgtgtctc

SEQ ID NO: 794532 - DNA, 20 bp, mouse
gcggcctcaagtcacttccg

SEQ ID NO: 794533 - DNA, 20 bp, mouse
gcgactggggttgccacgcg

SEQ ID NO: 794534 - DNA, 20 bp, mouse
gttccggggcggggccacgg

SEQ ID NO: 794535 - DNA, 20 bp, mouse
ggcgccgggaggttccggac

SEQ ID NO: 794536 - DNA, 20 bp, mouse
gctaagaagcgcgcaggcta

SEQ ID NO: 794537 - DNA, 20 bp, mouse
gtcgcctgctgcaggcaaaa

SEQ ID NO: 794538 - DNA, 20 bp, mouse
ggcgaagtggagtgtgtact

SEQ ID NO: 794539 - DNA, 20 bp, mouse
gtgccaggctgttcgttcct

SEQ ID NO: 794540 - DNA, 20 bp, mouse
gttagtggaaccttctagtt

SEQ ID NO: 794541 - DNA, 20 bp, mouse
gtcgcggtcccgcttctctt

SEQ ID NO: 794542 - DNA, 20 bp, mouse
gacagagccgaaagcgaagg

SEQ ID NO: 794543 - DNA, 20 bp, mouse
gtccccaggaacgaacagcc

SEQ ID NO: 794544 - DNA, 20 bp, mouse
gatgagaagtctactgtagt

SEQ ID NO: 794545 - DNA, 20 bp, mouse
gggagtgtgtactaggccgg

SEQ ID NO: 794546 - DNA, 20 bp, mouse
gcgccgcgggacatttctcg

SEQ ID NO: 794547 - DNA, 20 bp, mouse
ggctgcgtgccccggttaac

SEQ ID NO: 794548 - DNA, 20 bp, mouse
ggccccggttaacaggatga

SEQ ID NO: 794549 - DNA, 20 bp, mouse
gaaggcgtatcctcgctcgg

SEQ ID NO: 794550 - DNA, 20 bp, mouse
gtccttgcaggagggtcgcc

SEQ ID NO: 794551 - DNA, 20 bp, mouse
ggcagcgcccgctccacacc

SEQ ID NO: 794552 - DNA, 20 bp, mouse
gtgcaaggacccacccgtgg

SEQ ID NO: 794553 - DNA, 20 bp, mouse
gtgaagcacagacagctcca

SEQ ID NO: 794554 - DNA, 20 bp, mouse
gcgcttgcagtcatcaaccc

SEQ ID NO: 794555 - DNA, 20 bp, mouse
gtccgtcatcctgttaaccg

SEQ ID NO: 794556 - DNA, 20 bp, mouse
gactggcgacggaggacgtg

SEQ ID NO: 794557 - DNA, 20 bp, mouse
ggggatccgcgaggacgagg

SEQ ID NO: 794558 - DNA, 20 bp, mouse
ggtggacggcgtcgatcagg

SEQ ID NO: 794559 - DNA, 20 bp, mouse
ggtaggtcgaggactggcga

SEQ ID NO: 794560 - DNA, 20 bp, mouse
ggggggcgtaggtcgaggac

SEQ ID NO: 794561 - DNA, 20 bp, mouse
gcggccgcgtcagacctggc

SEQ ID NO: 794562 - DNA, 20 bp, mouse
gccccggggggcgtaggtcg

SEQ ID NO: 794563 - DNA, 20 bp, mouse
ggctgcgcgcccgggacgac

SEQ ID NO: 794564 - DNA, 20 bp, mouse
ggaggaggcggagcggtgga

SEQ ID NO: 794565 - DNA, 20 bp, mouse
gcggcggagcccgtcgtccc

SEQ ID NO: 794566 - DNA, 20 bp, mouse
gagctccaggatctcggtgg

SEQ ID NO: 794567 - DNA, 20 bp, mouse
gtctccgagctccaggatct

SEQ ID NO: 794568 - DNA, 20 bp, mouse
ggacacaaagctccctacac

SEQ ID NO: 794569 - DNA, 20 bp, mouse
gccgagctccaggatctcgg

SEQ ID NO: 794570 - DNA, 20 bp, mouse
gggtgcttgaccacctgtgt

SEQ ID NO: 794571 - DNA, 20 bp, mouse
gtgctgcaaaggagccgtcc

SEQ ID NO: 794572 - DNA, 20 bp, mouse
gcgtccaggcttcgtgttaa

SEQ ID NO: 794573 - DNA, 20 bp, mouse
gctaaggttccgtgctgcaa

SEQ ID NO: 794574 - DNA, 20 bp, mouse
gacggcagtcccagggccta

SEQ ID NO: 794575 - DNA, 20 bp, mouse
gaggcccaacggacaggaac

SEQ ID NO: 794576 - DNA, 20 bp, mouse
gcgcgcgccgaggtggggtg

SEQ ID NO: 794577 - DNA, 20 bp, mouse
gaggacagaggtagttcagt

SEQ ID NO: 794578 - DNA, 20 bp, mouse
gagtgggcggggcctagaac

SEQ ID NO: 794579 - DNA, 20 bp, mouse
gagatcgctggcagactcct

SEQ ID NO: 794580 - DNA, 20 bp, mouse
gaggcgaggctgaaggtacc

SEQ ID NO: 794581 - DNA, 20 bp, mouse
ggagtctgccagcgatctct

SEQ ID NO: 794582 - DNA, 20 bp, mouse
ggggtggggcgagcatgagt

SEQ ID NO: 794583 - DNA, 20 bp, mouse
gtcccaggagcgcatgttag

SEQ ID NO: 794584 - DNA, 20 bp, mouse
gtccactaacatgcgctcct

SEQ ID NO: 794585 - DNA, 20 bp, mouse
gggtaccaggctagagcagg

SEQ ID NO: 794586 - DNA, 20 bp, mouse
gtgcccccggcccccgggac

SEQ ID NO: 794587 - DNA, 20 bp, mouse
gttctgtcccccagtcccgg

SEQ ID NO: 794588 - DNA, 20 bp, mouse
gaacaagggtggagcctcct

SEQ ID NO: 794589 - DNA, 20 bp, mouse
gtcctgccgggtgtggatgg

SEQ ID NO: 794590 - DNA, 20 bp, mouse
gccccggcccccgggactgg

SEQ ID NO: 794591 - DNA, 20 bp, mouse
gaagagggatgcttactggc

SEQ ID NO: 794592 - DNA, 20 bp, mouse
gagaaaagagggatgcttac

SEQ ID NO: 794593 - DNA, 20 bp, mouse
gtctgggtcactgatagacc

SEQ ID NO: 794594 - DNA, 20 bp, mouse
ggattcctgccgggtgtgga

SEQ ID NO: 794595 - DNA, 20 bp, mouse
gagggggtggccagtctgtg

SEQ ID NO: 794596 - DNA, 20 bp, mouse
gtccctaggagtggactcta

SEQ ID NO: 794597 - DNA, 20 bp, mouse
ggtctgacctaggtgtccca

SEQ ID NO: 794598 - DNA, 20 bp, mouse
gcaatagtctgcactatctt

SEQ ID NO: 794599 - DNA, 20 bp, mouse
gagccttagagtccactcct

SEQ ID NO: 794600 - DNA, 20 bp, mouse
gtcccagggctgagtccgga

SEQ ID NO: 794601 - DNA, 20 bp, mouse
gatggcgcgtgcgcaaactg

SEQ ID NO: 794602 - DNA, 20 bp, mouse
gaccctccggactcagccct

SEQ ID NO: 794603 - DNA, 20 bp, mouse
gcaggcgcgccgtggagggg

SEQ ID NO: 794604 - DNA, 20 bp, mouse
gcaagagtcccgcccctcca

SEQ ID NO: 794605 - DNA, 20 bp, mouse
gtgcgcaggcgcgccgtgga

SEQ ID NO: 794606 - DNA, 20 bp, mouse
ggagggtcgccacccaatgg

SEQ ID NO: 794607 - DNA, 20 bp, mouse
gcccacagagcacctccatt

SEQ ID NO: 794608 - DNA, 20 bp, mouse
gcaggagggtcgccacccaa

SEQ ID NO: 794609 - DNA, 20 bp, mouse
ggtaaagaccctaaatccga

SEQ ID NO: 794610 - DNA, 20 bp, mouse
ggctaggccagccatggcgg

SEQ ID NO: 794611 - DNA, 20 bp, mouse
gggagctaggccagccatgg

SEQ ID NO: 794612 - DNA, 20 bp, mouse
ggagaacaacgtgctctctg

SEQ ID NO: 794613 - DNA, 20 bp, mouse
gaaactggttctcccgtcat

SEQ ID NO: 794614 - DNA, 20 bp, mouse
gctggcggtgaacatcagcg

SEQ ID NO: 794615 - DNA, 20 bp, mouse
gtaagcccgggctggcggga

SEQ ID NO: 794616 - DNA, 20 bp, mouse
gtcccggggaagccgttggg

SEQ ID NO: 794617 - DNA, 20 bp, mouse
gggtgagccatcaattctta

SEQ ID NO: 794618 - DNA, 20 bp, mouse
ggggtcatgtggtgccaata

SEQ ID NO: 794619 - DNA, 20 bp, mouse
gagtgtcagaaatgggttta

SEQ ID NO: 794620 - DNA, 20 bp, mouse
gcttccgcggacagcaggtg

SEQ ID NO: 794621 - DNA, 20 bp, mouse
gggtttatggaatgtctggg

SEQ ID NO: 794622 - DNA, 20 bp, mouse
gtgtgacactcataaatcag

SEQ ID NO: 794623 - DNA, 20 bp, mouse
gtaccccccaacggcttccc

SEQ ID NO: 794624 - DNA, 20 bp, mouse
gggcatcagagtgtcagaaa

SEQ ID NO: 794625 - DNA, 20 bp, mouse
gaatgggtttatggaatgtc

SEQ ID NO: 794626 - DNA, 20 bp, mouse
gtccaagggacaatcttctc

SEQ ID NO: 794627 - DNA, 20 bp, mouse
ggagcagtcgggatgtcagc

SEQ ID NO: 794628 - DNA, 20 bp, mouse
gtagactgtgaagcgaggtg

SEQ ID NO: 794629 - DNA, 20 bp, mouse
ggggaggagccgtgagtgcg

SEQ ID NO: 794630 - DNA, 20 bp, mouse
gaggagccgtgagtgcgcgg

SEQ ID NO: 794631 - DNA, 20 bp, mouse
gagaactgtcgaaccaatgt

SEQ ID NO: 794632 - DNA, 20 bp, mouse
gtggtgagtccaagggggca

SEQ ID NO: 794633 - DNA, 20 bp, mouse
gtaaccgcgagtcagacaag

SEQ ID NO: 794634 - DNA, 20 bp, mouse
gggcacttcccaaaaagggt

SEQ ID NO: 794635 - DNA, 20 bp, mouse
gacagcgattggtgagtcca

SEQ ID NO: 794636 - DNA, 20 bp, mouse
gagggcgcggcgtggtgctg

SEQ ID NO: 794637 - DNA, 20 bp, mouse
gacacctggcctagggtact

SEQ ID NO: 794638 - DNA, 20 bp, mouse
gtgaggaggagcaacaagcg

SEQ ID NO: 794639 - DNA, 20 bp, mouse
ggcgccctctggcgacgttg

SEQ ID NO: 794640 - DNA, 20 bp, mouse
gtgagtagcagcctggacta

SEQ ID NO: 794641 - DNA, 20 bp, mouse
gaccctaggccaggtgtcct

SEQ ID NO: 794642 - DNA, 20 bp, mouse
gaaagtgcgggacatcaaat

SEQ ID NO: 794643 - DNA, 20 bp, mouse
gaaccctaatggcttgaagg

SEQ ID NO: 794644 - DNA, 20 bp, mouse
gcacccggcgcaaaggtttc

SEQ ID NO: 794645 - DNA, 20 bp, mouse
gccccaccttcaagccatta

SEQ ID NO: 794646 - DNA, 20 bp, mouse
ggggtggcaggtggcaggcg

SEQ ID NO: 794647 - DNA, 20 bp, mouse
ggagggtaggacctagtcta

SEQ ID NO: 794648 - DNA, 20 bp, mouse
gcccaagaggttaggttctt

SEQ ID NO: 794649 - DNA, 20 bp, mouse
gtcgccggccccaagaggtt

SEQ ID NO: 794650 - DNA, 20 bp, mouse
gacttgagcaggcagcaggg

SEQ ID NO: 794651 - DNA, 20 bp, mouse
ggcgcagggctctaacccac

SEQ ID NO: 794652 - DNA, 20 bp, mouse
gctcccccagggcaggcgca

SEQ ID NO: 794653 - DNA, 20 bp, mouse
gccgtgctgtgagcaacttg

SEQ ID NO: 794654 - DNA, 20 bp, mouse
ggagccctgcgcctgccctg

SEQ ID NO: 794655 - DNA, 20 bp, mouse
gctgtgagcaacttgagggt

SEQ ID NO: 794656 - DNA, 20 bp, mouse
gcggccgcgccctagggtca

SEQ ID NO: 794657 - DNA, 20 bp, mouse
ggccacccgccctgacccta

SEQ ID NO: 794658 - DNA, 20 bp, mouse
gccagcagctctgcggaggg

SEQ ID NO: 794659 - DNA, 20 bp, mouse
gccgcgccctagggtcaggg

SEQ ID NO: 794660 - DNA, 20 bp, mouse
gtaggcgaaggcatctccta

SEQ ID NO: 794661 - DNA, 20 bp, mouse
gtaggtcgggagggcttgat

SEQ ID NO: 794662 - DNA, 20 bp, mouse
gggccggtccagcagctctg

SEQ ID NO: 794663 - DNA, 20 bp, mouse
gagtccagtgggcagccgaa

SEQ ID NO: 794664 - DNA, 20 bp, mouse
gctggaccggccgcgcccta

SEQ ID NO: 794665 - DNA, 20 bp, mouse
gtcagacgtccggcaggctg

SEQ ID NO: 794666 - DNA, 20 bp, mouse
gacagagagggtgtcagaca

SEQ ID NO: 794667 - DNA, 20 bp, mouse
ggagaaggcgagaggggtag

SEQ ID NO: 794668 - DNA, 20 bp, mouse
ggtaaacaggagcgcatggg

SEQ ID NO: 794669 - DNA, 20 bp, mouse
gaaagagagtcagaaaggag

SEQ ID NO: 794670 - DNA, 20 bp, mouse
gaaacagttggcacgaggag

SEQ ID NO: 794671 - DNA, 20 bp, mouse
gttcctgtggcatctggtgg

SEQ ID NO: 794672 - DNA, 20 bp, mouse
gcccctccaccagatgccac

SEQ ID NO: 794673 - DNA, 20 bp, mouse
gagactgggcagggaatccc

SEQ ID NO: 794674 - DNA, 20 bp, mouse
gctggctggctcagtccgtg

SEQ ID NO: 794675 - DNA, 20 bp, mouse
gacctctgcagtactgagtc

SEQ ID NO: 794676 - DNA, 20 bp, mouse
gtaaaggccactctgggaca

SEQ ID NO: 794677 - DNA, 20 bp, mouse
gttacccagggacctccgga

SEQ ID NO: 794678 - DNA, 20 bp, mouse
gaagagccggcccaacccag

SEQ ID NO: 794679 - DNA, 20 bp, mouse
gttcaccggcccacccgggg

SEQ ID NO: 794680 - DNA, 20 bp, mouse
gctgacccggaagtgctcgg

SEQ ID NO: 794681 - DNA, 20 bp, mouse
gacggctgctcggagaagtg

SEQ ID NO: 794682 - DNA, 20 bp, mouse
ggctgctcggagaagtgcgg

SEQ ID NO: 794683 - DNA, 20 bp, mouse
gtgggccggctcttcgagct

SEQ ID NO: 794684 - DNA, 20 bp, mouse
ggctgcggccctccctgacc

SEQ ID NO: 794685 - DNA, 20 bp, mouse
gtgcaccaggcccgcttcac

SEQ ID NO: 794686 - DNA, 20 bp, mouse
gggacggccgtcagtcaaga

SEQ ID NO: 794687 - DNA, 20 bp, mouse
gggttcccgctgcggtctgt

SEQ ID NO: 794688 - DNA, 20 bp, mouse
gggtcaaaaggttactccaa

SEQ ID NO: 794689 - DNA, 20 bp, mouse
gaccgcagcgggaaccaatg

SEQ ID NO: 794690 - DNA, 20 bp, mouse
gcgaacaaaggctcgctcat

SEQ ID NO: 794691 - DNA, 20 bp, mouse
gcgtcagtcaagacggaaga

SEQ ID NO: 794692 - DNA, 20 bp, mouse
gccagacagcagacagctgt

SEQ ID NO: 794693 - DNA, 20 bp, mouse
ggggccttctattggtcaaa

SEQ ID NO: 794694 - DNA, 20 bp, mouse
gaccccgcctgcccccgcca

SEQ ID NO: 794695 - DNA, 20 bp, mouse
gaagacggaaacggccggtg

SEQ ID NO: 794696 - DNA, 20 bp, mouse
gcggaggcagccaacggcgg

SEQ ID NO: 794697 - DNA, 20 bp, mouse
ggggcggaggcagccaacgg

SEQ ID NO: 794698 - DNA, 20 bp, mouse
gggagacgagcccgctgcag

SEQ ID NO: 794699 - DNA, 20 bp, mouse
ggcagcgggctcgtctccga

SEQ ID NO: 794700 - DNA, 20 bp, mouse
ggagtgggcgcctccgccgt

SEQ ID NO: 794701 - DNA, 20 bp, mouse
ggtcccactcacaccgccca

SEQ ID NO: 794702 - DNA, 20 bp, mouse
gagcagcagggttgcagtcc

SEQ ID NO: 794703 - DNA, 20 bp, mouse
ggcgcactgcctcccgccct

SEQ ID NO: 794704 - DNA, 20 bp, mouse
gagacgagcggcggggcaca

SEQ ID NO: 794705 - DNA, 20 bp, mouse
gcgagcgcgcgggcgcccgg

SEQ ID NO: 794706 - DNA, 20 bp, mouse
gcgcacgcgcgcggaggcat

SEQ ID NO: 794707 - DNA, 20 bp, mouse
ggggcggggcaaagaggcga

SEQ ID NO: 794708 - DNA, 20 bp, mouse
gggcccgcgggcttgtagga

SEQ ID NO: 794709 - DNA, 20 bp, mouse
gcgcgcgcggaggcatgggc

SEQ ID NO: 794710 - DNA, 20 bp, mouse
ggtgtcggggcggggcaaag

SEQ ID NO: 794711 - DNA, 20 bp, mouse
ggggtggtggtgtcggggcg

SEQ ID NO: 794712 - DNA, 20 bp, mouse
gggggctcggctggactcca

SEQ ID NO: 794713 - DNA, 20 bp, mouse
gaagaggcgaaggcgggaag

SEQ ID NO: 794714 - DNA, 20 bp, mouse
gtcgcgaagcgggaagcaca

SEQ ID NO: 794715 - DNA, 20 bp, mouse
gtcggcgtcgacgccctccc

SEQ ID NO: 794716 - DNA, 20 bp, mouse
gcggtggcggcaagcgagaa

SEQ ID NO: 794717 - DNA, 20 bp, mouse
gccgccccgcgagggatgcc

SEQ ID NO: 794718 - DNA, 20 bp, mouse
ggaaacaggcgatcggtcgg

SEQ ID NO: 794719 - DNA, 20 bp, mouse
ggctcccggcatccctcgcg

SEQ ID NO: 794720 - DNA, 20 bp, mouse
gggcaagcgagaaggggacg

SEQ ID NO: 794721 - DNA, 20 bp, mouse
gtagcgtgagttgcggagag

SEQ ID NO: 794722 - DNA, 20 bp, mouse
gagcggctgagagacctgag

SEQ ID NO: 794723 - DNA, 20 bp, mouse
gtgggaaaaaagggccggcg

SEQ ID NO: 794724 - DNA, 20 bp, mouse
gctagtcaggcctgaaggag

SEQ ID NO: 794725 - DNA, 20 bp, mouse
ggatcggtcggcggctagtc

SEQ ID NO: 794726 - DNA, 20 bp, mouse
gggctcccatggtgcggtgt

SEQ ID NO: 794727 - DNA, 20 bp, mouse
gttggagcgcaccaagtgga

SEQ ID NO: 794728 - DNA, 20 bp, mouse
gcataagtgcgtctgggatc

SEQ ID NO: 794729 - DNA, 20 bp, mouse
gcagcagccaccaacctgcg

SEQ ID NO: 794730 - DNA, 20 bp, mouse
ggcatcccacaccgcaccat

SEQ ID NO: 794731 - DNA, 20 bp, mouse
gagcgcaccaagtggaaggc

SEQ ID NO: 794732 - DNA, 20 bp, mouse
gccaagtggaaggcgggcgt

SEQ ID NO: 794733 - DNA, 20 bp, mouse
gcacttggtgcgctccaaga

SEQ ID NO: 794734 - DNA, 20 bp, mouse
gccaccaacctgcgaggcaa

SEQ ID NO: 794735 - DNA, 20 bp, mouse
ggtggtaggaccacttccgg

SEQ ID NO: 794736 - DNA, 20 bp, mouse
gcctccgcctccagggtcga

SEQ ID NO: 794737 - DNA, 20 bp, mouse
gtttgctttcggggtgggta

SEQ ID NO: 794738 - DNA, 20 bp, mouse
gactcaagtggcgttctctg

SEQ ID NO: 794739 - DNA, 20 bp, mouse
gcgcttgcgtgcgagaaccg

SEQ ID NO: 794740 - DNA, 20 bp, mouse
ggaaccgcggcttggcaaat

SEQ ID NO: 794741 - DNA, 20 bp, mouse
ggtggtcacaaggtcctgtt

SEQ ID NO: 794742 - DNA, 20 bp, mouse
ggcctccagggtcgaggggc

SEQ ID NO: 794743 - DNA, 20 bp, mouse
gggaacgtctcatctccaaa

SEQ ID NO: 794744 - DNA, 20 bp, mouse
gagctcaagtaaggagttag

SEQ ID NO: 794745 - DNA, 20 bp, mouse
ggcggcttggcaaattggct

SEQ ID NO: 794746 - DNA, 20 bp, mouse
gcctcccaggacggctggga

SEQ ID NO: 794747 - DNA, 20 bp, mouse
ggggcggccagagctcgcta

SEQ ID NO: 794748 - DNA, 20 bp, mouse
ggcagcctgtttacccagga

SEQ ID NO: 794749 - DNA, 20 bp, mouse
gctatcagcgcagccctcct

SEQ ID NO: 794750 - DNA, 20 bp, mouse
ggcagtgcggggggtccctg

SEQ ID NO: 794751 - DNA, 20 bp, mouse
gccataggcaggacctgtca

SEQ ID NO: 794752 - DNA, 20 bp, mouse
gggcgcctcccaggacggct

SEQ ID NO: 794753 - DNA, 20 bp, mouse
ggccgcggggggcgctcagg

SEQ ID NO: 794754 - DNA, 20 bp, mouse
gggtccatggccctcggcgt

SEQ ID NO: 794755 - DNA, 20 bp, mouse
ggagggcagcctgtttaccc

SEQ ID NO: 794756 - DNA, 20 bp, mouse
gcccgcggggccctaaggag

SEQ ID NO: 794757 - DNA, 20 bp, mouse
gagcccgggaggcgaggcaa

SEQ ID NO: 794758 - DNA, 20 bp, mouse
gcaaaggggtggccctgcct

SEQ ID NO: 794759 - DNA, 20 bp, mouse
gtaacggcgccgcagggggc

SEQ ID NO: 794760 - DNA, 20 bp, mouse
gcggggtgacgccctcccat

SEQ ID NO: 794761 - DNA, 20 bp, mouse
ggcccgcccgcggggcccta

SEQ ID NO: 794762 - DNA, 20 bp, mouse
ggacgccctcccattggcta

SEQ ID NO: 794763 - DNA, 20 bp, mouse
gcggcgccgttacctagcaa

SEQ ID NO: 794764 - DNA, 20 bp, mouse
gggatccggctgcaaggcag

SEQ ID NO: 794765 - DNA, 20 bp, mouse
gggagaagggagggtgatcc

SEQ ID NO: 794766 - DNA, 20 bp, mouse
gctccgcgccatcccgtcgt

SEQ ID NO: 794767 - DNA, 20 bp, mouse
gttcccgctcagagcgggcg

SEQ ID NO: 794768 - DNA, 20 bp, mouse
ggtgtcgcgtgtcgcccccc

SEQ ID NO: 794769 - DNA, 20 bp, mouse
gggagggggagtacactgag

SEQ ID NO: 794770 - DNA, 20 bp, mouse
gccggccaagctgagggagg

SEQ ID NO: 794771 - DNA, 20 bp, mouse
ggatccccgaagccaacgac

SEQ ID NO: 794772 - DNA, 20 bp, mouse
gccatcccgtcgttggcttc

SEQ ID NO: 794773 - DNA, 20 bp, mouse
gcggaggccgccaagctggg

SEQ ID NO: 794774 - DNA, 20 bp, mouse
gccccaccctaccccctaac

SEQ ID NO: 794775 - DNA, 20 bp, mouse
ggggatggcgcggagagcgg

SEQ ID NO: 794776 - DNA, 20 bp, mouse
ggggggaggcgcgactctaa

SEQ ID NO: 794777 - DNA, 20 bp, mouse
gctgcgtcaccgtccggctt

SEQ ID NO: 794778 - DNA, 20 bp, mouse
gcggcgcctggcggcggaat

SEQ ID NO: 794779 - DNA, 20 bp, mouse
ggcggagagcaagcctaagc

SEQ ID NO: 794780 - DNA, 20 bp, mouse
gcgggctctgcgtcaccgtc

SEQ ID NO: 794781 - DNA, 20 bp, mouse
gccgccgccaggcgccgccc

SEQ ID NO: 794782 - DNA, 20 bp, mouse
gctggaggcgccagtggacg

SEQ ID NO: 794783 - DNA, 20 bp, mouse
gccaccacgcggctcccgca

SEQ ID NO: 794784 - DNA, 20 bp, mouse
ggggtgcccagaaacctcgg

SEQ ID NO: 794785 - DNA, 20 bp, mouse
gcctccagcatcagcgcctg

SEQ ID NO: 794786 - DNA, 20 bp, mouse
gggtagagggaatgcgccat

SEQ ID NO: 794787 - DNA, 20 bp, mouse
gttagtaccagatccgtcct

SEQ ID NO: 794788 - DNA, 20 bp, mouse
gtgcccggatgcggaggcga

SEQ ID NO: 794789 - DNA, 20 bp, mouse
gtggtaagtacaggggtaga

SEQ ID NO: 794790 - DNA, 20 bp, mouse
gctagacggtcagaaccccg

SEQ ID NO: 794791 - DNA, 20 bp, mouse
gctggtgcagatctgttcca

SEQ ID NO: 794792 - DNA, 20 bp, mouse
ggaacagatctgcaccagga

SEQ ID NO: 794793 - DNA, 20 bp, mouse
gagagggaatgcgccatagg

SEQ ID NO: 794794 - DNA, 20 bp, mouse
gtctgtgccaaggacggatc

SEQ ID NO: 794795 - DNA, 20 bp, mouse
gtgaagttgtcccagccact

SEQ ID NO: 794796 - DNA, 20 bp, mouse
gccaggctccagtgtagtct

SEQ ID NO: 794797 - DNA, 20 bp, mouse
gaaagccctcgcatgctttg

SEQ ID NO: 794798 - DNA, 20 bp, mouse
gctggcaggcctcagctcag

SEQ ID NO: 794799 - DNA, 20 bp, mouse
gcagcctggaaagtgttgca

SEQ ID NO: 794800 - DNA, 20 bp, mouse
ggtagtctgggatctctggc

SEQ ID NO: 794801 - DNA, 20 bp, mouse
gcagtgtagtctgggatctc

SEQ ID NO: 794802 - DNA, 20 bp, mouse
gaggggaccagtgtgtggcc

SEQ ID NO: 794803 - DNA, 20 bp, mouse
gactggagcctgggtctctc

SEQ ID NO: 794804 - DNA, 20 bp, mouse
ggccaaaagacagaattcga

SEQ ID NO: 794805 - DNA, 20 bp, mouse
gggaggcggaagccagtgtt

SEQ ID NO: 794806 - DNA, 20 bp, mouse
gagggtacgccagctctcag

SEQ ID NO: 794807 - DNA, 20 bp, mouse
gggaaggtgggtctcgagag

SEQ ID NO: 794808 - DNA, 20 bp, mouse
gccagctctcagcggttacc

SEQ ID NO: 794809 - DNA, 20 bp, mouse
gttaaagagtctaaggactg

SEQ ID NO: 794810 - DNA, 20 bp, mouse
gagccgaaacaggcttttct

SEQ ID NO: 794811 - DNA, 20 bp, mouse
gtatgtgaaaaggagtgcac

SEQ ID NO: 794812 - DNA, 20 bp, mouse
gaacctagaaaagcctgttt

SEQ ID NO: 794813 - DNA, 20 bp, mouse
gcggttggttaaagagtcta

SEQ ID NO: 794814 - DNA, 20 bp, mouse
gaaggacttccgcaggaagc

SEQ ID NO: 794815 - DNA, 20 bp, mouse
gcagcaccaagctagaggtt

SEQ ID NO: 794816 - DNA, 20 bp, mouse
gaacaccagccagtgccagc

SEQ ID NO: 794817 - DNA, 20 bp, mouse
gtgtacaagccggctggcac

SEQ ID NO: 794818 - DNA, 20 bp, mouse
gctgcccggcggggtctccg

SEQ ID NO: 794819 - DNA, 20 bp, mouse
gggcttgtacagtctctgtc

SEQ ID NO: 794820 - DNA, 20 bp, mouse
gcggtgggagggacgcggtc

SEQ ID NO: 794821 - DNA, 20 bp, mouse
gcccagagattatatgtctt

SEQ ID NO: 794822 - DNA, 20 bp, mouse
gtctccgcgggagtggggcg

SEQ ID NO: 794823 - DNA, 20 bp, mouse
gaagccctaaactgcccggt

SEQ ID NO: 794824 - DNA, 20 bp, mouse
gcggccccgccccactcccg

SEQ ID NO: 794825 - DNA, 20 bp, mouse
ggggacgcggtccggttgct

SEQ ID NO: 794826 - DNA, 20 bp, mouse
ggcggggcggggcgtcggaa

SEQ ID NO: 794827 - DNA, 20 bp, mouse
ggcgcctcggaaagccggag

SEQ ID NO: 794828 - DNA, 20 bp, mouse
gccgccccgccgggagagca

SEQ ID NO: 794829 - DNA, 20 bp, mouse
ggcggggcgtcggaagggac

SEQ ID NO: 794830 - DNA, 20 bp, mouse
ggcagggcgcctcggaaagc

SEQ ID NO: 794831 - DNA, 20 bp, mouse
gcctcggaaagccggagggg

SEQ ID NO: 794832 - DNA, 20 bp, mouse
gacaggggcggggaacgccg

SEQ ID NO: 794833 - DNA, 20 bp, mouse
gccgaggcgccctgctctcc

SEQ ID NO: 794834 - DNA, 20 bp, mouse
gcgtcggaagggacaggggc

SEQ ID NO: 794835 - DNA, 20 bp, mouse
gccggcgcacggtgatgtgg

SEQ ID NO: 794836 - DNA, 20 bp, mouse
gagtggacatgcaaagtggg

SEQ ID NO: 794837 - DNA, 20 bp, mouse
ggcaaagtgggaggatcgga

SEQ ID NO: 794838 - DNA, 20 bp, mouse
gggagtgacttagggtcagt

SEQ ID NO: 794839 - DNA, 20 bp, mouse
ggggtcagtgggcggggaaa

SEQ ID NO: 794840 - DNA, 20 bp, mouse
ggctagtggacatgcaaagt

SEQ ID NO: 794841 - DNA, 20 bp, mouse
ggcagctaaactgctctcag

SEQ ID NO: 794842 - DNA, 20 bp, mouse
ggcagggtgaggcgatgatg

SEQ ID NO: 794843 - DNA, 20 bp, mouse
ggagctggcgcgggctcaca

SEQ ID NO: 794844 - DNA, 20 bp, mouse
ggggtgaggcgatgatgcgg

SEQ ID NO: 794845 - DNA, 20 bp, mouse
gtctgagtgggagtgactta

SEQ ID NO: 794846 - DNA, 20 bp, mouse
gactgaggacagcgtccctg

SEQ ID NO: 794847 - DNA, 20 bp, mouse
ggggaggggacccgcaggac

SEQ ID NO: 794848 - DNA, 20 bp, mouse
gccgcactggctgggaactg

SEQ ID NO: 794849 - DNA, 20 bp, mouse
gctcccgctcctacgttctt

SEQ ID NO: 794850 - DNA, 20 bp, mouse
gtaccaaagaacgtaggagc

SEQ ID NO: 794851 - DNA, 20 bp, mouse
gcaatcagagcgcggggcgc

SEQ ID NO: 794852 - DNA, 20 bp, mouse
ggcacctcattctgccgcac

SEQ ID NO: 794853 - DNA, 20 bp, mouse
gcctgcggctgccagtcctg

SEQ ID NO: 794854 - DNA, 20 bp, mouse
gagcggccgcgcgcactcca

SEQ ID NO: 794855 - DNA, 20 bp, mouse
gggccctcagctccagcaag

SEQ ID NO: 794856 - DNA, 20 bp, mouse
gaaggagaggggaaccgagt

SEQ ID NO: 794857 - DNA, 20 bp, mouse
gaaccgagtaggagcagtgg

SEQ ID NO: 794858 - DNA, 20 bp, mouse
gctagagtcagaaggagatg

SEQ ID NO: 794859 - DNA, 20 bp, mouse
ggggaaccgagtaggagcag

SEQ ID NO: 794860 - DNA, 20 bp, mouse
gcagcgcgggatactcacag

SEQ ID NO: 794861 - DNA, 20 bp, mouse
gctgaggagcctagatagga

SEQ ID NO: 794862 - DNA, 20 bp, mouse
gcccagaatctgagtgtcta

SEQ ID NO: 794863 - DNA, 20 bp, mouse
gtccttctgactctaggtac

SEQ ID NO: 794864 - DNA, 20 bp, mouse
gcctgatgcacagggtccta

SEQ ID NO: 794865 - DNA, 20 bp, mouse
gggaaaggaaagccaggtgc

SEQ ID NO: 794866 - DNA, 20 bp, mouse
ggggtcatgggacttggaga

SEQ ID NO: 794867 - DNA, 20 bp, mouse
gcagcctgctagaaagggag

SEQ ID NO: 794868 - DNA, 20 bp, mouse
gcccaaggactgcccactga

SEQ ID NO: 794869 - DNA, 20 bp, mouse
gccagctccagaggcagaac

SEQ ID NO: 794870 - DNA, 20 bp, mouse
gtgctccatgagcccctcat

SEQ ID NO: 794871 - DNA, 20 bp, mouse
ggggcctgatgccagcaatg

SEQ ID NO: 794872 - DNA, 20 bp, mouse
gtgagccagcctgctagaaa

SEQ ID NO: 794873 - DNA, 20 bp, mouse
gcggcaccatccccactgtg

SEQ ID NO: 794874 - DNA, 20 bp, mouse
gcgtgatgttggtgtgaggg

SEQ ID NO: 794875 - DNA, 20 bp, mouse
gggacttggagagggatgat

SEQ ID NO: 794876 - DNA, 20 bp, mouse
gaaactgctggcaacagtca

SEQ ID NO: 794877 - DNA, 20 bp, mouse
gagagcagacatgcatgggg

SEQ ID NO: 794878 - DNA, 20 bp, mouse
gccagagagcagacatgcat

SEQ ID NO: 794879 - DNA, 20 bp, mouse
gggggctgggagccttgagt

SEQ ID NO: 794880 - DNA, 20 bp, mouse
gggcaacagtcagggcaact

SEQ ID NO: 794881 - DNA, 20 bp, mouse
ggggcaagaggcccgggtga

SEQ ID NO: 794882 - DNA, 20 bp, mouse
gcgcacttcactggcctcca

SEQ ID NO: 794883 - DNA, 20 bp, mouse
ggcctccacccgcacttcac

SEQ ID NO: 794884 - DNA, 20 bp, mouse
gctcctgccccgctgagagg

SEQ ID NO: 794885 - DNA, 20 bp, mouse
gagggctatgagttcccgtg

SEQ ID NO: 794886 - DNA, 20 bp, mouse
gtgcctcctccacacctcac

SEQ ID NO: 794887 - DNA, 20 bp, mouse
gttaataagactggggtaac

SEQ ID NO: 794888 - DNA, 20 bp, mouse
ggaaggcaaaggccactctg

SEQ ID NO: 794889 - DNA, 20 bp, mouse
gcataaggtcttccttccta

SEQ ID NO: 794890 - DNA, 20 bp, mouse
ggactctcttaacctcagtt

SEQ ID NO: 794891 - DNA, 20 bp, mouse
gcaccctgagctggcccata

SEQ ID NO: 794892 - DNA, 20 bp, mouse
gacaggaactcaccaaactg

SEQ ID NO: 794893 - DNA, 20 bp, mouse
gcaacttccaacccatagga

SEQ ID NO: 794894 - DNA, 20 bp, mouse
gaggtgggacaaaaactgga

SEQ ID NO: 794895 - DNA, 20 bp, mouse
gttagccctagcagaaggct

SEQ ID NO: 794896 - DNA, 20 bp, mouse
gagctggagaggcagaccta

SEQ ID NO: 794897 - DNA, 20 bp, mouse
gggcaggcgaagggcggtgt

SEQ ID NO: 794898 - DNA, 20 bp, mouse
gcgagtaggcaggcgaaggg

SEQ ID NO: 794899 - DNA, 20 bp, mouse
gccagtgtcacgtaacccaa

SEQ ID NO: 794900 - DNA, 20 bp, mouse
gctgcgagtaggcaggcgaa

SEQ ID NO: 794901 - DNA, 20 bp, mouse
gcgcctcccgcgctaggctg

SEQ ID NO: 794902 - DNA, 20 bp, mouse
ggcgaagggcggtgtgggct

SEQ ID NO: 794903 - DNA, 20 bp, mouse
gtaggctgcggggactggac

SEQ ID NO: 794904 - DNA, 20 bp, mouse
ggaggggcggtgctgcgagt

SEQ ID NO: 794905 - DNA, 20 bp, mouse
gcccgcgccttggagctcga

SEQ ID NO: 794906 - DNA, 20 bp, mouse
gagagctgcggaggtctgga

SEQ ID NO: 794907 - DNA, 20 bp, mouse
ggcgcggcccgggcttccat

SEQ ID NO: 794908 - DNA, 20 bp, mouse
gagcccggtgatggagggcg

SEQ ID NO: 794909 - DNA, 20 bp, mouse
gacctcctctagcaccgcct

SEQ ID NO: 794910 - DNA, 20 bp, mouse
gccgcctaggagcccggtga

SEQ ID NO: 794911 - DNA, 20 bp, mouse
gaggtctggagggacctgcg

SEQ ID NO: 794912 - DNA, 20 bp, mouse
ggcggagagctgcggaggtc

SEQ ID NO: 794913 - DNA, 20 bp, mouse
gcccctccggggaaacttgc

SEQ ID NO: 794914 - DNA, 20 bp, mouse
ggacctgcgggggtgccacc

SEQ ID NO: 794915 - DNA, 20 bp, mouse
gccgccccgccctccatcac

SEQ ID NO: 794916 - DNA, 20 bp, mouse
gcctgagccaaggatggcgt

SEQ ID NO: 794917 - DNA, 20 bp, mouse
gccccctgctcaagtcaaga

SEQ ID NO: 794918 - DNA, 20 bp, mouse
ggggccaagtcctgagtagg

SEQ ID NO: 794919 - DNA, 20 bp, mouse
gctgctccaagtgtccgggt

SEQ ID NO: 794920 - DNA, 20 bp, mouse
gcacttggagcagaagtctc

SEQ ID NO: 794921 - DNA, 20 bp, mouse
gaggtgtcccacgccatcct

SEQ ID NO: 794922 - DNA, 20 bp, mouse
gggcctgctgcgggtgatca

SEQ ID NO: 794923 - DNA, 20 bp, mouse
gaaacactctatgtagtctg

SEQ ID NO: 794924 - DNA, 20 bp, mouse
gcaccctgatcacccgcagc

SEQ ID NO: 794925 - DNA, 20 bp, mouse
gacttctgctccaagtgtcc

SEQ ID NO: 794926 - DNA, 20 bp, mouse
ggggacatgtggtttttaat

SEQ ID NO: 794927 - DNA, 20 bp, mouse
gtcggtgggaggtacttgaa

SEQ ID NO: 794928 - DNA, 20 bp, mouse
gaattcgcacaggcactgat

SEQ ID NO: 794929 - DNA, 20 bp, mouse
gcttctaaccaaattcgcac

SEQ ID NO: 794930 - DNA, 20 bp, mouse
gggccatgattcagaaaagg

SEQ ID NO: 794931 - DNA, 20 bp, mouse
gcatgattcagaaaaggtgg

SEQ ID NO: 794932 - DNA, 20 bp, mouse
gagcacttgagatcggcagg

SEQ ID NO: 794933 - DNA, 20 bp, mouse
gtgggaggtacttgaaagga

SEQ ID NO: 794934 - DNA, 20 bp, mouse
gttagaaaagagaaactagg

SEQ ID NO: 794935 - DNA, 20 bp, mouse
ggtgggtatgaatggatagg

SEQ ID NO: 794936 - DNA, 20 bp, mouse
gggtaacgatgacgccaagt

SEQ ID NO: 794937 - DNA, 20 bp, mouse
gagaggcagaagcacacccc

SEQ ID NO: 794938 - DNA, 20 bp, mouse
gccacatcgtgcatctacga

SEQ ID NO: 794939 - DNA, 20 bp, mouse
gcggctctaggattccttaa

SEQ ID NO: 794940 - DNA, 20 bp, mouse
gaagccacttcctaagcccc

SEQ ID NO: 794941 - DNA, 20 bp, mouse
gatgacctgtaactcgtggt

SEQ ID NO: 794942 - DNA, 20 bp, mouse
ggagcgcatgcctgtctgag

SEQ ID NO: 794943 - DNA, 20 bp, mouse
gaccgcgtcggaccttttct

SEQ ID NO: 794944 - DNA, 20 bp, mouse
gcaaaatggcccaaccaggg

SEQ ID NO: 794945 - DNA, 20 bp, mouse
gtgcgctctcagatccctca

SEQ ID NO: 794946 - DNA, 20 bp, mouse
gggcgcgggaaggatcgcga

SEQ ID NO: 794947 - DNA, 20 bp, mouse
ggggcagccggagggtcgag

SEQ ID NO: 794948 - DNA, 20 bp, mouse
gcgcgaacggggcagccgga

SEQ ID NO: 794949 - DNA, 20 bp, mouse
ggaccggagcccgggaagac

SEQ ID NO: 794950 - DNA, 20 bp, mouse
ggggaagacaggcgcgaacg

SEQ ID NO: 794951 - DNA, 20 bp, mouse
gtaacgcgagaccggagccc

SEQ ID NO: 794952 - DNA, 20 bp, mouse
gagcgtgctcaggcggttgg

SEQ ID NO: 794953 - DNA, 20 bp, mouse
gaaccgcctgagcacgctcg

SEQ ID NO: 794954 - DNA, 20 bp, mouse
ggcccctcccctcgaccctc

SEQ ID NO: 794955 - DNA, 20 bp, mouse
ggaccccaaggcgatgtgtg

SEQ ID NO: 794956 - DNA, 20 bp, mouse
gcaggcggggagtttgtggg

SEQ ID NO: 794957 - DNA, 20 bp, mouse
gatgcaggcggggagtttgt

SEQ ID NO: 794958 - DNA, 20 bp, mouse
ggacacggaccgaggtagaa

SEQ ID NO: 794959 - DNA, 20 bp, mouse
ggaccgaggtagaaagggtg

SEQ ID NO: 794960 - DNA, 20 bp, mouse
ggtgatgctgacacggaccg

SEQ ID NO: 794961 - DNA, 20 bp, mouse
ggggaccggccacgggtgcg

SEQ ID NO: 794962 - DNA, 20 bp, mouse
gcggatgaagatgatgcagg

SEQ ID NO: 794963 - DNA, 20 bp, mouse
gggctggcagacccttgtgg

SEQ ID NO: 794964 - DNA, 20 bp, mouse
gcatccgcatccggaactag

SEQ ID NO: 794965 - DNA, 20 bp, mouse
gaccgagctggaagtactat

SEQ ID NO: 794966 - DNA, 20 bp, mouse
ggggcgggccctcccgagat

SEQ ID NO: 794967 - DNA, 20 bp, mouse
ggtaggaggaagggttgcga

SEQ ID NO: 794968 - DNA, 20 bp, mouse
gcgggccctcccgagattgg

SEQ ID NO: 794969 - DNA, 20 bp, mouse
gtactctctatccagggaaa

SEQ ID NO: 794970 - DNA, 20 bp, mouse
gcactcctccaatctcggga

SEQ ID NO: 794971 - DNA, 20 bp, mouse
gacccgcccaccactcgtcc

SEQ ID NO: 794972 - DNA, 20 bp, mouse
gaacgctcccggtgtccttc

SEQ ID NO: 794973 - DNA, 20 bp, mouse
gtggactccagaaggacacc

SEQ ID NO: 794974 - DNA, 20 bp, mouse
gaacgccgcccgcacgtcag

SEQ ID NO: 794975 - DNA, 20 bp, mouse
gggaagcctggacgagtggt

SEQ ID NO: 794976 - DNA, 20 bp, mouse
gtctctgcccgcacagggtg

SEQ ID NO: 794977 - DNA, 20 bp, mouse
gcctgtgcgggcagagaaag

SEQ ID NO: 794978 - DNA, 20 bp, mouse
ggcacggtcctctgatgctt

SEQ ID NO: 794979 - DNA, 20 bp, mouse
gtcggtggccaaagcatcag

SEQ ID NO: 794980 - DNA, 20 bp, mouse
gggcggagaggagagagacg

SEQ ID NO: 794981 - DNA, 20 bp, mouse
ggatgctcccagcctctgca

SEQ ID NO: 794982 - DNA, 20 bp, mouse
ggacgcggaaatctgggtaa

SEQ ID NO: 794983 - DNA, 20 bp, mouse
ggcagagaaagtgggcggag

SEQ ID NO: 794984 - DNA, 20 bp, mouse
gcctccaccctgcagaggct

SEQ ID NO: 794985 - DNA, 20 bp, mouse
gtttagccaccaggcaacta

SEQ ID NO: 794986 - DNA, 20 bp, mouse
ggggaaggctgagtgggctc

SEQ ID NO: 794987 - DNA, 20 bp, mouse
gtcggaggaaagtttttcga

SEQ ID NO: 794988 - DNA, 20 bp, mouse
gctggggccacccgcttaaa

SEQ ID NO: 794989 - DNA, 20 bp, mouse
gaaggaatgccgggcgtccc

SEQ ID NO: 794990 - DNA, 20 bp, mouse
gccgctccaggtaacggagg

SEQ ID NO: 794991 - DNA, 20 bp, mouse
gccctccccgctccaggtaa

SEQ ID NO: 794992 - DNA, 20 bp, mouse
ggacgcccggcattccttcg

SEQ ID NO: 794993 - DNA, 20 bp, mouse
gtggctgcgagacactcgtg

SEQ ID NO: 794994 - DNA, 20 bp, mouse
gtccccgctccaggtaacgg

SEQ ID NO: 794995 - DNA, 20 bp, mouse
ggcccgaggggaaggctgag

SEQ ID NO: 794996 - DNA, 20 bp, mouse
gggagatggggtacaagcca

SEQ ID NO: 794997 - DNA, 20 bp, mouse
gggtctccagaggccccctc

SEQ ID NO: 794998 - DNA, 20 bp, mouse
gaaagcaggcagggagcccg

SEQ ID NO: 794999 - DNA, 20 bp, mouse
ggggagggcgggccctagga

SEQ ID NO: 795000 - DNA, 20 bp, mouse
gcacgtatgaaaaacagaaa

SEQ ID NO: 795001 - DNA, 20 bp, mouse
gctctggagaccagcacagg

SEQ ID NO: 795002 - DNA, 20 bp, mouse
gggatactcagagcaggaga

SEQ ID NO: 795003 - DNA, 20 bp, mouse
gctgtgctgtggactgtatg

SEQ ID NO: 795004 - DNA, 20 bp, mouse
gcgccctcctccccctgtgc

SEQ ID NO: 795005 - DNA, 20 bp, mouse
gatactaggtaacacgaaga

SEQ ID NO: 795006 - DNA, 20 bp, mouse
gggcccctggtggtggtgga

SEQ ID NO: 795007 - DNA, 20 bp, mouse
gggggacagggctggcgtgg

SEQ ID NO: 795008 - DNA, 20 bp, mouse
gggcttggggcagtcttgtg

SEQ ID NO: 795009 - DNA, 20 bp, mouse
gaggctcccctggtccgctt

SEQ ID NO: 795010 - DNA, 20 bp, mouse
gggaggagactggaccaaag

SEQ ID NO: 795011 - DNA, 20 bp, mouse
gtgcgatcgtcaccacagtc

SEQ ID NO: 795012 - DNA, 20 bp, mouse
gggccacattcttgcaacca

SEQ ID NO: 795013 - DNA, 20 bp, mouse
gggggatgggctgggaaccg

SEQ ID NO: 795014 - DNA, 20 bp, mouse
gagctggggtaacaacttgg

SEQ ID NO: 795015 - DNA, 20 bp, mouse
ggagggggacagggctggcg

SEQ ID NO: 795016 - DNA, 20 bp, mouse
gcagggaagggacattggga

SEQ ID NO: 795017 - DNA, 20 bp, mouse
gtatactgggcggtcggtga

SEQ ID NO: 795018 - DNA, 20 bp, mouse
gtcccttccctgctgtgtgt

SEQ ID NO: 795019 - DNA, 20 bp, mouse
gctagcaccggcctcacgac

SEQ ID NO: 795020 - DNA, 20 bp, mouse
ggcggggcttctccagggag

SEQ ID NO: 795021 - DNA, 20 bp, mouse
ggaacgggattcttgatctg

SEQ ID NO: 795022 - DNA, 20 bp, mouse
ggggcaacttctggaagctt

SEQ ID NO: 795023 - DNA, 20 bp, mouse
gggaaaaatcctaccacctc

SEQ ID NO: 795024 - DNA, 20 bp, mouse
ggcccacacacagcagggaa

SEQ ID NO: 795025 - DNA, 20 bp, mouse
gctgggcggtcggtgagggc

SEQ ID NO: 795026 - DNA, 20 bp, mouse
gccggccctaggagacgaga

SEQ ID NO: 795027 - DNA, 20 bp, mouse
gcgcaagcgcaggactaagc

SEQ ID NO: 795028 - DNA, 20 bp, mouse
gcttgcgcagtgtggtccta

SEQ ID NO: 795029 - DNA, 20 bp, mouse
gcggccacggagccctaatg

SEQ ID NO: 795030 - DNA, 20 bp, mouse
ggacgcgggttcaacctctg

SEQ ID NO: 795031 - DNA, 20 bp, mouse
gcctaggagacgagagggca

SEQ ID NO: 795032 - DNA, 20 bp, mouse
gcagtgtggtcctagggcta

SEQ ID NO: 795033 - DNA, 20 bp, mouse
ggaccacactgcgcaagcgc

SEQ ID NO: 795034 - DNA, 20 bp, mouse
ggcggcacgaccttagccct

SEQ ID NO: 795035 - DNA, 20 bp, mouse
gcgtctgcctagaccgtgcc

SEQ ID NO: 795036 - DNA, 20 bp, mouse
gaggggacctgccagtgctg

SEQ ID NO: 795037 - DNA, 20 bp, mouse
gtgtcagaggtgacaactgg

SEQ ID NO: 795038 - DNA, 20 bp, mouse
gactcacgactcatgactct

SEQ ID NO: 795039 - DNA, 20 bp, mouse
gacgcgtgggggcaccactg

SEQ ID NO: 795040 - DNA, 20 bp, mouse
gttggcggtcagcctgtcag

SEQ ID NO: 795041 - DNA, 20 bp, mouse
gtgggggtggagccgtgaga

SEQ ID NO: 795042 - DNA, 20 bp, mouse
ggatgtgcaatgccaacggc

SEQ ID NO: 795043 - DNA, 20 bp, mouse
ggtggagccgtgagatgggt

SEQ ID NO: 795044 - DNA, 20 bp, mouse
gaaaacgtcttggctaaggc

SEQ ID NO: 795045 - DNA, 20 bp, mouse
gcacgcgtcccggaattcgg

SEQ ID NO: 795046 - DNA, 20 bp, mouse
ggaagccgggaagctgccct

SEQ ID NO: 795047 - DNA, 20 bp, mouse
gagttgcgcaagaaccgcag

SEQ ID NO: 795048 - DNA, 20 bp, mouse
gcaccacctggggcagccaa

SEQ ID NO: 795049 - DNA, 20 bp, mouse
gcgaaccacagggcgcctgg

SEQ ID NO: 795050 - DNA, 20 bp, mouse
gccccagtggggagaggtga

SEQ ID NO: 795051 - DNA, 20 bp, mouse
gcatccctccaggcgccctg

SEQ ID NO: 795052 - DNA, 20 bp, mouse
gcggactccacgtgacgtag

SEQ ID NO: 795053 - DNA, 20 bp, mouse
gaggaccttagatcccggga

SEQ ID NO: 795054 - DNA, 20 bp, mouse
ggggtaaaagcctgccgctg

SEQ ID NO: 795055 - DNA, 20 bp, mouse
gtgcgcgactgggaggaaac

SEQ ID NO: 795056 - DNA, 20 bp, mouse
gaacagccacataccctcat

SEQ ID NO: 795057 - DNA, 20 bp, mouse
ggccacataccctcatgggg

SEQ ID NO: 795058 - DNA, 20 bp, mouse
ggatgtcactcctggttctc

SEQ ID NO: 795059 - DNA, 20 bp, mouse
gtagttatctgaaactttag

SEQ ID NO: 795060 - DNA, 20 bp, mouse
gtatgtcaaaaatttctagg

SEQ ID NO: 795061 - DNA, 20 bp, mouse
gtctgaaactttagaggagt

SEQ ID NO: 795062 - DNA, 20 bp, mouse
gtcttgagttttagccatcc

SEQ ID NO: 795063 - DNA, 20 bp, mouse
gcgcaagtgtatttataatg

SEQ ID NO: 795064 - DNA, 20 bp, mouse
gagaatagctttgtcatatt

SEQ ID NO: 795065 - DNA, 20 bp, mouse
gttctctggctctcaatcac

SEQ ID NO: 795066 - DNA, 20 bp, mouse
gtgggcgtggagcgaagcca

SEQ ID NO: 795067 - DNA, 20 bp, mouse
gcggggtcgcggtctgcggg

SEQ ID NO: 795068 - DNA, 20 bp, mouse
gttcgctccacgcccagtgg

SEQ ID NO: 795069 - DNA, 20 bp, mouse
ggggtgagcaacaaggtcac

SEQ ID NO: 795070 - DNA, 20 bp, mouse
gtgcgcggggcgtgcaacta

SEQ ID NO: 795071 - DNA, 20 bp, mouse
ggctcccagttcccccaaag

SEQ ID NO: 795072 - DNA, 20 bp, mouse
gggtcggggtcgcggtctgc

SEQ ID NO: 795073 - DNA, 20 bp, mouse
gtctcccgcggcatcgtggc

SEQ ID NO: 795074 - DNA, 20 bp, mouse
gtggcggcagaaacgccgaa

SEQ ID NO: 795075 - DNA, 20 bp, mouse
gcccctgttgcccactgccg

SEQ ID NO: 795076 - DNA, 20 bp, mouse
gaactgaggcagaggctcgc

SEQ ID NO: 795077 - DNA, 20 bp, mouse
gtgaggcagaggctcgctgg

SEQ ID NO: 795078 - DNA, 20 bp, mouse
gagcctggaaggcaaaccct

SEQ ID NO: 795079 - DNA, 20 bp, mouse
ggcaaggcttggaagggcga

SEQ ID NO: 795080 - DNA, 20 bp, mouse
gaagacttcagaacactggc

SEQ ID NO: 795081 - DNA, 20 bp, mouse
gccctccccttaacccccaa

SEQ ID NO: 795082 - DNA, 20 bp, mouse
ggctactcctcagaaatccc

SEQ ID NO: 795083 - DNA, 20 bp, mouse
ggcaaacccttgggggttaa

SEQ ID NO: 795084 - DNA, 20 bp, mouse
gtgtcttagcaaggcttgga

SEQ ID NO: 795085 - DNA, 20 bp, mouse
gcactggcaggcttggggtc

SEQ ID NO: 795086 - DNA, 20 bp, mouse
gcatacctggcatgtttcaa

SEQ ID NO: 795087 - DNA, 20 bp, mouse
gggctcccaaggccacccta

SEQ ID NO: 795088 - DNA, 20 bp, mouse
gagggccaaccattcatacc

SEQ ID NO: 795089 - DNA, 20 bp, mouse
gctccctacaagggacatgg

SEQ ID NO: 795090 - DNA, 20 bp, mouse
ggaaacatgccaggtatgaa

SEQ ID NO: 795091 - DNA, 20 bp, mouse
gagtgtacggcaccataggg

SEQ ID NO: 795092 - DNA, 20 bp, mouse
gagcccccttgaaacatgcc

SEQ ID NO: 795093 - DNA, 20 bp, mouse
gctgagtgtacggcaccata

SEQ ID NO: 795094 - DNA, 20 bp, mouse
gctgtggaggtaggaatcca

SEQ ID NO: 795095 - DNA, 20 bp, mouse
gagactgtcttaaagagggg

SEQ ID NO: 795096 - DNA, 20 bp, mouse
gaatcggagaacttgtgctg

SEQ ID NO: 795097 - DNA, 20 bp, mouse
ggagtccccaagccatctct

SEQ ID NO: 795098 - DNA, 20 bp, mouse
ggccatgcgatcccgaagca

SEQ ID NO: 795099 - DNA, 20 bp, mouse
gacacaccgagagtcaagcc

SEQ ID NO: 795100 - DNA, 20 bp, mouse
gggtcagtgcgcatctgggc

SEQ ID NO: 795101 - DNA, 20 bp, mouse
gcatctgagctcctgggttg

SEQ ID NO: 795102 - DNA, 20 bp, mouse
gcggactgagtgactggcaa

SEQ ID NO: 795103 - DNA, 20 bp, mouse
gtgggcaggaggaaagtttt

SEQ ID NO: 795104 - DNA, 20 bp, mouse
ggccctgcttcgggatcgca

SEQ ID NO: 795105 - DNA, 20 bp, mouse
ggggttgcggactgagtgac

SEQ ID NO: 795106 - DNA, 20 bp, mouse
gtggccgcgagggcgggttc

SEQ ID NO: 795107 - DNA, 20 bp, mouse
ggcgcctgcaacttgttcaa

SEQ ID NO: 795108 - DNA, 20 bp, mouse
ggcgcgtgtcgtggatgcga

SEQ ID NO: 795109 - DNA, 20 bp, mouse
gcgagggcgggttccggcag

SEQ ID NO: 795110 - DNA, 20 bp, mouse
gcagctggggcggcgcaggt

SEQ ID NO: 795111 - DNA, 20 bp, mouse
gcccacgcgggccaggactg

SEQ ID NO: 795112 - DNA, 20 bp, mouse
gtgagcgagtcgcaaagagg

SEQ ID NO: 795113 - DNA, 20 bp, mouse
ggcgggttccggcagcgggg

SEQ ID NO: 795114 - DNA, 20 bp, mouse
gaagtgagcgagtcgcaaag

SEQ ID NO: 795115 - DNA, 20 bp, mouse
ggcaaccagcccaccgaagg

SEQ ID NO: 795116 - DNA, 20 bp, mouse
ggaccctggggcggccacag

SEQ ID NO: 795117 - DNA, 20 bp, mouse
gagcgcgcgcccacacctcg

SEQ ID NO: 795118 - DNA, 20 bp, mouse
ggcgccggactgctctgcgc

SEQ ID NO: 795119 - DNA, 20 bp, mouse
gccctcgggccgtgctgagt

SEQ ID NO: 795120 - DNA, 20 bp, mouse
ggcctagtccgcagaccctg

SEQ ID NO: 795121 - DNA, 20 bp, mouse
gtagtccgcagaccctgggg

SEQ ID NO: 795122 - DNA, 20 bp, mouse
gcgcgcgtgcgccgtggctg

SEQ ID NO: 795123 - DNA, 20 bp, mouse
gcagagcagtccggcgcgcc

SEQ ID NO: 795124 - DNA, 20 bp, mouse
gagagctctgcgctgaggtg

SEQ ID NO: 795125 - DNA, 20 bp, mouse
gggcgcggtccgcactgcgc

SEQ ID NO: 795126 - DNA, 20 bp, mouse
ggggcagctccaggaattgc

SEQ ID NO: 795127 - DNA, 20 bp, mouse
ggcacctgaggaccccaatt

SEQ ID NO: 795128 - DNA, 20 bp, mouse
ggagctgcccggctgacccg

SEQ ID NO: 795129 - DNA, 20 bp, mouse
gggtcaggtctggtgactaa

SEQ ID NO: 795130 - DNA, 20 bp, mouse
gtcaaggtgtggagccatgg

SEQ ID NO: 795131 - DNA, 20 bp, mouse
gcagctccaggaattgcagg

SEQ ID NO: 795132 - DNA, 20 bp, mouse
ggggccactgctgagaacat

SEQ ID NO: 795133 - DNA, 20 bp, mouse
gactgctgagaacatgggtc

SEQ ID NO: 795134 - DNA, 20 bp, mouse
gggccagagcccattgcctt

SEQ ID NO: 795135 - DNA, 20 bp, mouse
gaattggggccctaaggcaa

SEQ ID NO: 795136 - DNA, 20 bp, mouse
ggcctaggagccagtgtcgg

SEQ ID NO: 795137 - DNA, 20 bp, mouse
gccagtgtcggaggagaaca

SEQ ID NO: 795138 - DNA, 20 bp, mouse
gcctccagctgcttcgactg

SEQ ID NO: 795139 - DNA, 20 bp, mouse
gccagctgcttcgactgggg

SEQ ID NO: 795140 - DNA, 20 bp, mouse
ggagtgaggctgtgataaat

SEQ ID NO: 795141 - DNA, 20 bp, mouse
gtggcacacccacaagaccc

SEQ ID NO: 795142 - DNA, 20 bp, mouse
ggggctgttgtatccatcct

SEQ ID NO: 795143 - DNA, 20 bp, mouse
gcacatgaggcagctgcgag

SEQ ID NO: 795144 - DNA, 20 bp, mouse
gcctggatgttttatcaaac

SEQ ID NO: 795145 - DNA, 20 bp, mouse
gctgcctcatgtgctaagtg

SEQ ID NO: 795146 - DNA, 20 bp, mouse
gctagaagggccttcggggt

SEQ ID NO: 795147 - DNA, 20 bp, mouse
ggggtctagaagggccttcg

SEQ ID NO: 795148 - DNA, 20 bp, mouse
ggtggacaaaagaagataca

SEQ ID NO: 795149 - DNA, 20 bp, mouse
gtggacacttagtactggta

SEQ ID NO: 795150 - DNA, 20 bp, mouse
gacccagcactgattagaga

SEQ ID NO: 795151 - DNA, 20 bp, mouse
gtgtggctaggtcttgtcaa

SEQ ID NO: 795152 - DNA, 20 bp, mouse
ggagacagcgagcacaacac

SEQ ID NO: 795153 - DNA, 20 bp, mouse
ggaagatacagggtctagaa

SEQ ID NO: 795154 - DNA, 20 bp, mouse
gctgcccatcataaggaagt

SEQ ID NO: 795155 - DNA, 20 bp, mouse
gagtactggtaggggtagga

SEQ ID NO: 795156 - DNA, 20 bp, mouse
gctccggcactcccctaaga

SEQ ID NO: 795157 - DNA, 20 bp, mouse
gcccccttccccgccgtcga

SEQ ID NO: 795158 - DNA, 20 bp, mouse
ggcggggaagggggcgtcag

SEQ ID NO: 795159 - DNA, 20 bp, mouse
gagcagcagtggccgtctta

SEQ ID NO: 795160 - DNA, 20 bp, mouse
gtcccagtggatagattagg

SEQ ID NO: 795161 - DNA, 20 bp, mouse
ggccgtgcaggcggagagga

SEQ ID NO: 795162 - DNA, 20 bp, mouse
ggcggcggcggcgcgctcga

SEQ ID NO: 795163 - DNA, 20 bp, mouse
gcccctcgacggcggggaag

SEQ ID NO: 795164 - DNA, 20 bp, mouse
gtgccagctcctcccctcga

SEQ ID NO: 795165 - DNA, 20 bp, mouse
ggggcggggcgccgtgcagg

SEQ ID NO: 795166 - DNA, 20 bp, mouse
gcacgcgcgcgacccccctc

SEQ ID NO: 795167 - DNA, 20 bp, mouse
gctgaatgacagtgcggcgg

SEQ ID NO: 795168 - DNA, 20 bp, mouse
gcgactgctcggaagaagga

SEQ ID NO: 795169 - DNA, 20 bp, mouse
gactctgaatgacagtgcgg

SEQ ID NO: 795170 - DNA, 20 bp, mouse
gggagcgggcgtcctctcat

SEQ ID NO: 795171 - DNA, 20 bp, mouse
gaatagcgccgggactaggg

SEQ ID NO: 795172 - DNA, 20 bp, mouse
gtccgagcagtcgcgaggga

SEQ ID NO: 795173 - DNA, 20 bp, mouse
gcccgggcgcgggaaccacg

SEQ ID NO: 795174 - DNA, 20 bp, mouse
gggaggggaaggcgagcgat

SEQ ID NO: 795175 - DNA, 20 bp, mouse
ggacgcagaaagctaaagcg

SEQ ID NO: 795176 - DNA, 20 bp, mouse
gggcggcagcggctggtcgg

SEQ ID NO: 795177 - DNA, 20 bp, mouse
gggtggggcaggcgagagcg

SEQ ID NO: 795178 - DNA, 20 bp, mouse
gggagagcgagcgggacagg

SEQ ID NO: 795179 - DNA, 20 bp, mouse
gaatggagagactgacggtt

SEQ ID NO: 795180 - DNA, 20 bp, mouse
ggataggaggatgaaagcga

SEQ ID NO: 795181 - DNA, 20 bp, mouse
gggaggatgaaagcgaaggg

SEQ ID NO: 795182 - DNA, 20 bp, mouse
gggcaggcgggaggacgatg

SEQ ID NO: 795183 - DNA, 20 bp, mouse
gaggaaggacgagaccgggc

SEQ ID NO: 795184 - DNA, 20 bp, mouse
gcggagtggggcgaggaggt

SEQ ID NO: 795185 - DNA, 20 bp, mouse
gccgacgggaggggcttccc

SEQ ID NO: 795186 - DNA, 20 bp, mouse
ggaaaagcaggctactctgg

SEQ ID NO: 795187 - DNA, 20 bp, mouse
gcgagctatggacccatggg

SEQ ID NO: 795188 - DNA, 20 bp, mouse
ggcagggtgtagttgagtga

SEQ ID NO: 795189 - DNA, 20 bp, mouse
ggctatggacccatgggagg

SEQ ID NO: 795190 - DNA, 20 bp, mouse
ggaagcaggctgtgcgaggg

SEQ ID NO: 795191 - DNA, 20 bp, mouse
gcaactacaccctgccgggg

SEQ ID NO: 795192 - DNA, 20 bp, mouse
gagaagaagcaggctgtgcg

SEQ ID NO: 795193 - DNA, 20 bp, mouse
gttgcccccgaaatctgatt

SEQ ID NO: 795194 - DNA, 20 bp, mouse
gggtgggtgctaagaacaaa

SEQ ID NO: 795195 - DNA, 20 bp, mouse
gagccgagctatggacccat

SEQ ID NO: 795196 - DNA, 20 bp, mouse
ggaccaacgccggggagagg

SEQ ID NO: 795197 - DNA, 20 bp, mouse
gagagccgggaccaacgccg

SEQ ID NO: 795198 - DNA, 20 bp, mouse
gcagcgctgacaaacaggga

SEQ ID NO: 795199 - DNA, 20 bp, mouse
ggagccagcgctgacaaaca

SEQ ID NO: 795200 - DNA, 20 bp, mouse
gccccagctccatagtctgt

SEQ ID NO: 795201 - DNA, 20 bp, mouse
ggggctggcgcctaccaacg

SEQ ID NO: 795202 - DNA, 20 bp, mouse
gggcgctaaccaacagacta

SEQ ID NO: 795203 - DNA, 20 bp, mouse
gcgggaccaacgccggggag

SEQ ID NO: 795204 - DNA, 20 bp, mouse
gtggctggagcaaaccaaga

SEQ ID NO: 795205 - DNA, 20 bp, mouse
gcctaccaacgtggaagaag

SEQ ID NO: 795206 - DNA, 20 bp, mouse
ggtgcgaaccggttgatgaa

SEQ ID NO: 795207 - DNA, 20 bp, mouse
ggggacgcagacgtcactcg

SEQ ID NO: 795208 - DNA, 20 bp, mouse
gaactcgcggctctagcgac

SEQ ID NO: 795209 - DNA, 20 bp, mouse
gggagaggcgttccaagttg

SEQ ID NO: 795210 - DNA, 20 bp, mouse
gtcctcgccaccaaacgctc

SEQ ID NO: 795211 - DNA, 20 bp, mouse
gggccagcgcgacagagcta

SEQ ID NO: 795212 - DNA, 20 bp, mouse
gcggcagccaatcacggcgc

SEQ ID NO: 795213 - DNA, 20 bp, mouse
gcggtcatgcgacatcaata

SEQ ID NO: 795214 - DNA, 20 bp, mouse
gcgtcgcgccggctataaag

SEQ ID NO: 795215 - DNA, 20 bp, mouse
gaatggcgcggtgtgctggc

SEQ ID NO: 795216 - DNA, 20 bp, mouse
gggtagcggggtgacgaacg

SEQ ID NO: 795217 - DNA, 20 bp, mouse
gcagtgggtcaaagctctgt

SEQ ID NO: 795218 - DNA, 20 bp, mouse
ggggaggcgcccagggcagt

SEQ ID NO: 795219 - DNA, 20 bp, mouse
gagcgcagcaagccacgcgg

SEQ ID NO: 795220 - DNA, 20 bp, mouse
gctctgtaggcagagtgggt

SEQ ID NO: 795221 - DNA, 20 bp, mouse
gggaaccgatgattggctgc

SEQ ID NO: 795222 - DNA, 20 bp, mouse
ggggtgacgaacgtggctga

SEQ ID NO: 795223 - DNA, 20 bp, mouse
gggagcgcgggaggcgccca

SEQ ID NO: 795224 - DNA, 20 bp, mouse
gcgccctcggaaccgatgat

SEQ ID NO: 795225 - DNA, 20 bp, mouse
gggctgccggcggctcgcgg

SEQ ID NO: 795226 - DNA, 20 bp, mouse
gtacccagcaggatgcagag

SEQ ID NO: 795227 - DNA, 20 bp, mouse
ggcgcggccagcagaggaag

SEQ ID NO: 795228 - DNA, 20 bp, mouse
gatggcaggcgggtccgcgg

SEQ ID NO: 795229 - DNA, 20 bp, mouse
ggggatggcaggcgggtccg

SEQ ID NO: 795230 - DNA, 20 bp, mouse
ggtggcccctctgcagaagg

SEQ ID NO: 795231 - DNA, 20 bp, mouse
gggctcttaaggtgaagtgt

SEQ ID NO: 795232 - DNA, 20 bp, mouse
gtgcgggagccgctgtgagt

SEQ ID NO: 795233 - DNA, 20 bp, mouse
gacaaaggcgcggccagcag

SEQ ID NO: 795234 - DNA, 20 bp, mouse
gagcgcccggcgtcacgtgg

SEQ ID NO: 795235 - DNA, 20 bp, mouse
gtacacaggctcatctccaa

SEQ ID NO: 795236 - DNA, 20 bp, mouse
gtgcaccggtacactcccat

SEQ ID NO: 795237 - DNA, 20 bp, mouse
gcgcgcgcgcgtggtctcag

SEQ ID NO: 795238 - DNA, 20 bp, mouse
gggcgcgcaccgggtcacgt

SEQ ID NO: 795239 - DNA, 20 bp, mouse
ggcctggggtgcctaggcta

SEQ ID NO: 795240 - DNA, 20 bp, mouse
gcgtgggggcacgacccaat

SEQ ID NO: 795241 - DNA, 20 bp, mouse
gcgacccaatgggagtgtac

SEQ ID NO: 795242 - DNA, 20 bp, mouse
gcctaggcaccccaggccag

SEQ ID NO: 795243 - DNA, 20 bp, mouse
gcgcgtgcgacagcgtgcac

SEQ ID NO: 795244 - DNA, 20 bp, mouse
ggaagggcgcctcggagatc

SEQ ID NO: 795245 - DNA, 20 bp, mouse
gccccgagacggcgacgccg

SEQ ID NO: 795246 - DNA, 20 bp, mouse
gccgctgggaagccgagctg

SEQ ID NO: 795247 - DNA, 20 bp, mouse
gacgcggcggacagcttcta

SEQ ID NO: 795248 - DNA, 20 bp, mouse
gctggggcttgagtggtcgc

SEQ ID NO: 795249 - DNA, 20 bp, mouse
ggaccctcagggccatgaga

SEQ ID NO: 795250 - DNA, 20 bp, mouse
gaaagcccggaggaccctca

SEQ ID NO: 795251 - DNA, 20 bp, mouse
gagccccggtgcagagtcgc

SEQ ID NO: 795252 - DNA, 20 bp, mouse
gaagctgtccgccgcgtcac

SEQ ID NO: 795253 - DNA, 20 bp, mouse
gggcgcgcgcaaggccgcgg

SEQ ID NO: 795254 - DNA, 20 bp, mouse
gactctgcaccggggctcgt

SEQ ID NO: 795255 - DNA, 20 bp, mouse
ggctccggctattggctgtt

SEQ ID NO: 795256 - DNA, 20 bp, mouse
gggtgggccagccggggtca

SEQ ID NO: 795257 - DNA, 20 bp, mouse
gcctgcccggcctcccgcga

SEQ ID NO: 795258 - DNA, 20 bp, mouse
gagtgcggacagctctcccg

SEQ ID NO: 795259 - DNA, 20 bp, mouse
gagggccctagccccggggt

SEQ ID NO: 795260 - DNA, 20 bp, mouse
gcgccccggcgccgcctctc

SEQ ID NO: 795261 - DNA, 20 bp, mouse
gctggcccaccccggggcta

SEQ ID NO: 795262 - DNA, 20 bp, mouse
ggcgctcagggccctagccc

SEQ ID NO: 795263 - DNA, 20 bp, mouse
ggcttccaggcagtgtcacg

SEQ ID NO: 795264 - DNA, 20 bp, mouse
gtctcgggagcgcgcgctca

SEQ ID NO: 795265 - DNA, 20 bp, mouse
gagcggggcacccactgcca

SEQ ID NO: 795266 - DNA, 20 bp, mouse
gggctgcgccacgtgatcag

SEQ ID NO: 795267 - DNA, 20 bp, mouse
gagaggacggggcgggacgt

SEQ ID NO: 795268 - DNA, 20 bp, mouse
gggcggggcgaacccagcga

SEQ ID NO: 795269 - DNA, 20 bp, mouse
ggacctctctgaagcgccac

SEQ ID NO: 795270 - DNA, 20 bp, mouse
gtcagtggccttcggatcag

SEQ ID NO: 795271 - DNA, 20 bp, mouse
ggcgccacaggaggtaagcg

SEQ ID NO: 795272 - DNA, 20 bp, mouse
gctacaaagaaagggcggat

SEQ ID NO: 795273 - DNA, 20 bp, mouse
gtcagcggctcagtggcctt

SEQ ID NO: 795274 - DNA, 20 bp, mouse
gcccagcgagggagaggacg

SEQ ID NO: 795275 - DNA, 20 bp, mouse
gcaaagaaagggcggattgg

SEQ ID NO: 795276 - DNA, 20 bp, mouse
gatcccaggctactgatctg

SEQ ID NO: 795277 - DNA, 20 bp, mouse
gtgcctggccagctctccta

SEQ ID NO: 795278 - DNA, 20 bp, mouse
gtctcctagggcagcatggc

SEQ ID NO: 795279 - DNA, 20 bp, mouse
gtataggcaggtgaacttag

SEQ ID NO: 795280 - DNA, 20 bp, mouse
gtgggctgggaaagcggtag

SEQ ID NO: 795281 - DNA, 20 bp, mouse
gaagccctaaggtaggagaa

SEQ ID NO: 795282 - DNA, 20 bp, mouse
ggtaggagaacggttcagga

SEQ ID NO: 795283 - DNA, 20 bp, mouse
gggtaggggcgggacgcctc

SEQ ID NO: 795284 - DNA, 20 bp, mouse
ggatcagtttggaaagcctc

SEQ ID NO: 795285 - DNA, 20 bp, mouse
ggaaccgttctcctacctta

SEQ ID NO: 795286 - DNA, 20 bp, mouse
ggggccgccatcttggatga

SEQ ID NO: 795287 - DNA, 20 bp, mouse
gtccggcgcacaatccgtgt

SEQ ID NO: 795288 - DNA, 20 bp, mouse
gacccaactgggctctacga

SEQ ID NO: 795289 - DNA, 20 bp, mouse
ggtagccgccatcttggata

SEQ ID NO: 795290 - DNA, 20 bp, mouse
gcccacgggggccgccatct

SEQ ID NO: 795291 - DNA, 20 bp, mouse
gggattgtgcgccggaagtt

SEQ ID NO: 795292 - DNA, 20 bp, mouse
gcgtgtgggcatccagcgcc

SEQ ID NO: 795293 - DNA, 20 bp, mouse
ggtctccgtagccgccatct

SEQ ID NO: 795294 - DNA, 20 bp, mouse
gccccctcgtagagcccagt

SEQ ID NO: 795295 - DNA, 20 bp, mouse
gtagagcccagttgggtctg

SEQ ID NO: 795296 - DNA, 20 bp, mouse
gcctccggagcgcggaaccc

SEQ ID NO: 795297 - DNA, 20 bp, mouse
gtgggccgaggcgggactcg

SEQ ID NO: 795298 - DNA, 20 bp, mouse
gaggcggggcatcgcggacg

SEQ ID NO: 795299 - DNA, 20 bp, mouse
gcgcagcaagtctgctcctc

SEQ ID NO: 795300 - DNA, 20 bp, mouse
gttgctgcgcgcgccgcgtg

SEQ ID NO: 795301 - DNA, 20 bp, mouse
gttgcccaagcgacccccgg

SEQ ID NO: 795302 - DNA, 20 bp, mouse
ggcaacgggcgcgcgccctc

SEQ ID NO: 795303 - DNA, 20 bp, mouse
gcaagtctgctcctcgggtt

SEQ ID NO: 795304 - DNA, 20 bp, mouse
gcggcgcgcccacggcgcgt

SEQ ID NO: 795305 - DNA, 20 bp, mouse
gcggttgagtcaggcggcga

SEQ ID NO: 795306 - DNA, 20 bp, mouse
gcggaagcagatagtggccg

SEQ ID NO: 795307 - DNA, 20 bp, mouse
gtgagcagtgctagggagtt

SEQ ID NO: 795308 - DNA, 20 bp, mouse
gcctggacgattcttctaaa

SEQ ID NO: 795309 - DNA, 20 bp, mouse
gggggccctgagcagtgcta

SEQ ID NO: 795310 - DNA, 20 bp, mouse
gaagcagatagtggccgtgg

SEQ ID NO: 795311 - DNA, 20 bp, mouse
ggggcggccgcgcagtgtcc

SEQ ID NO: 795312 - DNA, 20 bp, mouse
ggcaaaccggaagcagatag

SEQ ID NO: 795313 - DNA, 20 bp, mouse
gagtgctagggagtttggtg

SEQ ID NO: 795314 - DNA, 20 bp, mouse
gtgctcagggccccgcaaac

SEQ ID NO: 795315 - DNA, 20 bp, mouse
gaaacggggacgtcgcacat

SEQ ID NO: 795316 - DNA, 20 bp, mouse
gagcccgcgcgtctgggtgg

SEQ ID NO: 795317 - DNA, 20 bp, mouse
gcggcgagcgccctaggaga

SEQ ID NO: 795318 - DNA, 20 bp, mouse
ggcgcgcccgtggggagagg

SEQ ID NO: 795319 - DNA, 20 bp, mouse
gccgtggggagaggcggctg

SEQ ID NO: 795320 - DNA, 20 bp, mouse
gcccgcccgctctgagtggc

SEQ ID NO: 795321 - DNA, 20 bp, mouse
ggggcccgggcgggcgtgcg

SEQ ID NO: 795322 - DNA, 20 bp, mouse
gggcggctgggtcttcgctc

SEQ ID NO: 795323 - DNA, 20 bp, mouse
gtggctggaagccgcttccg

SEQ ID NO: 795324 - DNA, 20 bp, mouse
ggggggaggcagaaccggga

SEQ ID NO: 795325 - DNA, 20 bp, mouse
ggagggccacgccccggaag

SEQ ID NO: 795326 - DNA, 20 bp, mouse
gcgcgcgcggacaggaccgc

SEQ ID NO: 795327 - DNA, 20 bp, mouse
gcgggcggggttgactgaca

SEQ ID NO: 795328 - DNA, 20 bp, mouse
ggactcggtcccaagggagg

SEQ ID NO: 795329 - DNA, 20 bp, mouse
gcgacccaggcaatgaaaga

SEQ ID NO: 795330 - DNA, 20 bp, mouse
gcccagagactcggtcccaa

SEQ ID NO: 795331 - DNA, 20 bp, mouse
gacaaccggtgccttgggtc

SEQ ID NO: 795332 - DNA, 20 bp, mouse
gggctcctggcggaccaatg

SEQ ID NO: 795333 - DNA, 20 bp, mouse
gcggggccaaaagaagagtg

SEQ ID NO: 795334 - DNA, 20 bp, mouse
gtcggtcccaagggaggagg

SEQ ID NO: 795335 - DNA, 20 bp, mouse
gtctggggagacctgcgccc

SEQ ID NO: 795336 - DNA, 20 bp, mouse
gcgggccaggaatgcgtccg

SEQ ID NO: 795337 - DNA, 20 bp, mouse
gccaggaatgcgtccgggga

SEQ ID NO: 795338 - DNA, 20 bp, mouse
ggggaccgtgcgcccgcagc

SEQ ID NO: 795339 - DNA, 20 bp, mouse
gaagcgcgagcggccgggga

SEQ ID NO: 795340 - DNA, 20 bp, mouse
gcgcgccctgcgctgaaaag

SEQ ID NO: 795341 - DNA, 20 bp, mouse
gccagcgctgtgacgtccct

SEQ ID NO: 795342 - DNA, 20 bp, mouse
ggagggcgcgcgccagcctc

SEQ ID NO: 795343 - DNA, 20 bp, mouse
ggcgcggggcgctcgctggg

SEQ ID NO: 795344 - DNA, 20 bp, mouse
ggcactgcggagcagagccc

SEQ ID NO: 795345 - DNA, 20 bp, mouse
gcgggtgggaggggacgagc

SEQ ID NO: 795346 - DNA, 20 bp, mouse
ggaaggggcgggccacctga

SEQ ID NO: 795347 - DNA, 20 bp, mouse
gtcctgctgtggggattcta

SEQ ID NO: 795348 - DNA, 20 bp, mouse
gggactagggaggacgcatg

SEQ ID NO: 795349 - DNA, 20 bp, mouse
gagattggcaagtgggacta

SEQ ID NO: 795350 - DNA, 20 bp, mouse
gttggcaagtgggactaggg

SEQ ID NO: 795351 - DNA, 20 bp, mouse
gtctcattgtaggagggttg

SEQ ID NO: 795352 - DNA, 20 bp, mouse
gacagggccagattggcaag

SEQ ID NO: 795353 - DNA, 20 bp, mouse
gtccccacagcaggagggac

SEQ ID NO: 795354 - DNA, 20 bp, mouse
ggtctctgtctcattgtagg

SEQ ID NO: 795355 - DNA, 20 bp, mouse
ggtcttcagagcaggaaagg

SEQ ID NO: 795356 - DNA, 20 bp, mouse
gcacctatgggcgggacgaa

SEQ ID NO: 795357 - DNA, 20 bp, mouse
gcggtggcagccagcaccta

SEQ ID NO: 795358 - DNA, 20 bp, mouse
ggggtcccgcaattccccac

SEQ ID NO: 795359 - DNA, 20 bp, mouse
gtggacggccagttcggctg

SEQ ID NO: 795360 - DNA, 20 bp, mouse
ggctgcgctctcaatctcgc

SEQ ID NO: 795361 - DNA, 20 bp, mouse
ggaagcacccgaggcgccag

SEQ ID NO: 795362 - DNA, 20 bp, mouse
ggctacttggacggccagtt

SEQ ID NO: 795363 - DNA, 20 bp, mouse
gacggccagttcggctgcgg

SEQ ID NO: 795364 - DNA, 20 bp, mouse
ggcagccagcacctatgggc

SEQ ID NO: 795365 - DNA, 20 bp, mouse
gaggcgccagtggggaattg

SEQ ID NO: 795366 - DNA, 20 bp, mouse
gcggccccgcccccccacct

SEQ ID NO: 795367 - DNA, 20 bp, mouse
gcggccttggggaaagtacc

SEQ ID NO: 795368 - DNA, 20 bp, mouse
gagagactgcccaggtgggg

SEQ ID NO: 795369 - DNA, 20 bp, mouse
ggggtcggacgtcgtggagg

SEQ ID NO: 795370 - DNA, 20 bp, mouse
gcgctgcctgggcgccgcgt

SEQ ID NO: 795371 - DNA, 20 bp, mouse
ggggaaagtacctggaacgt

SEQ ID NO: 795372 - DNA, 20 bp, mouse
gggtccagagactgcccagg

SEQ ID NO: 795373 - DNA, 20 bp, mouse
gcgggcgccaccctggagct

SEQ ID NO: 795374 - DNA, 20 bp, mouse
gcgccaccctggagctaggt

SEQ ID NO: 795375 - DNA, 20 bp, mouse
gccgcgtgggtcggacgtcg

SEQ ID NO: 795376 - DNA, 20 bp, mouse
gtaactgcaggactcacagt

SEQ ID NO: 795377 - DNA, 20 bp, mouse
ggtgaccagcaggggaatca

SEQ ID NO: 795378 - DNA, 20 bp, mouse
gaatcccaagggagtgagat

SEQ ID NO: 795379 - DNA, 20 bp, mouse
gcaggctcgtggcagtctcc

SEQ ID NO: 795380 - DNA, 20 bp, mouse
ggccgcctgctgaatcccaa

SEQ ID NO: 795381 - DNA, 20 bp, mouse
gaccaggtttacaccagctc

SEQ ID NO: 795382 - DNA, 20 bp, mouse
ggtgggcgctgaagttcctc

SEQ ID NO: 795383 - DNA, 20 bp, mouse
gagggaaatgcacaggctgc

SEQ ID NO: 795384 - DNA, 20 bp, mouse
gttccccatctcactccctt

SEQ ID NO: 795385 - DNA, 20 bp, mouse
gtccgggattggacacatcg

SEQ ID NO: 795386 - DNA, 20 bp, mouse
gtggttgcattattaggtgg

SEQ ID NO: 795387 - DNA, 20 bp, mouse
gcagctgcggccggccaccg

SEQ ID NO: 795388 - DNA, 20 bp, mouse
gtgcggccggccaccgggga

SEQ ID NO: 795389 - DNA, 20 bp, mouse
gcacttaaagcgggtagggt

SEQ ID NO: 795390 - DNA, 20 bp, mouse
ggtggccggccgcagctgtc

SEQ ID NO: 795391 - DNA, 20 bp, mouse
gcaggcacttaaagcgggta

SEQ ID NO: 795392 - DNA, 20 bp, mouse
ggaggagcaggcacttaaag

SEQ ID NO: 795393 - DNA, 20 bp, mouse
ggcttggttgcattattagg

SEQ ID NO: 795394 - DNA, 20 bp, mouse
ggcagtgtgtgcttgatggg

SEQ ID NO: 795395 - DNA, 20 bp, mouse
gagtccaggtagaaagggct

SEQ ID NO: 795396 - DNA, 20 bp, mouse
gggcccctgtgatcggagga

SEQ ID NO: 795397 - DNA, 20 bp, mouse
gtgagagtggaggcagtgtg

SEQ ID NO: 795398 - DNA, 20 bp, mouse
gcaatctctccctgcctgta

SEQ ID NO: 795399 - DNA, 20 bp, mouse
ggggccggcgttagccctac

SEQ ID NO: 795400 - DNA, 20 bp, mouse
ggaccggcccctgtgatcgg

SEQ ID NO: 795401 - DNA, 20 bp, mouse
gagggggcgagcaacaactt

SEQ ID NO: 795402 - DNA, 20 bp, mouse
ggaggagggtggatttaaag

SEQ ID NO: 795403 - DNA, 20 bp, mouse
gtcgcacccaaataggtaat

SEQ ID NO: 795404 - DNA, 20 bp, mouse
gaaggaccggcccctgtgat

SEQ ID NO: 795405 - DNA, 20 bp, mouse
gtgcggccgcggacgtttcc

SEQ ID NO: 795406 - DNA, 20 bp, mouse
ggaaggcgctagggccctgc

SEQ ID NO: 795407 - DNA, 20 bp, mouse
gcctgcagcagggcataggt

SEQ ID NO: 795408 - DNA, 20 bp, mouse
gctctcctgcagcagggcat

SEQ ID NO: 795409 - DNA, 20 bp, mouse
gaatggtccgggtcggagat

SEQ ID NO: 795410 - DNA, 20 bp, mouse
gtcttccattcccagaagaa

SEQ ID NO: 795411 - DNA, 20 bp, mouse
gagtacaaaactagcttctg

SEQ ID NO: 795412 - DNA, 20 bp, mouse
gcagaccacagtttgtgttc

SEQ ID NO: 795413 - DNA, 20 bp, mouse
gttgagaaaggaaggcgcta

SEQ ID NO: 795414 - DNA, 20 bp, mouse
gcccgtgactggggaagtac

SEQ ID NO: 795415 - DNA, 20 bp, mouse
gaaagccatcatctccctgc

SEQ ID NO: 795416 - DNA, 20 bp, mouse
gttctcgcgcgaagggtctt

SEQ ID NO: 795417 - DNA, 20 bp, mouse
gcccagaagccccttcaccg

SEQ ID NO: 795418 - DNA, 20 bp, mouse
gagaccgagcatgcgcgaag

SEQ ID NO: 795419 - DNA, 20 bp, mouse
gagccccttcaccgtggatt

SEQ ID NO: 795420 - DNA, 20 bp, mouse
gcgacccaatccacggtgaa

SEQ ID NO: 795421 - DNA, 20 bp, mouse
gccggactgcacctcccaac

SEQ ID NO: 795422 - DNA, 20 bp, mouse
gtcgcgcgaagggtcttggg

SEQ ID NO: 795423 - DNA, 20 bp, mouse
gtgcaaaaagactaccgggg

SEQ ID NO: 795424 - DNA, 20 bp, mouse
gcaaccccgcccctccacgc

SEQ ID NO: 795425 - DNA, 20 bp, mouse
gactccccccgcagcctgtt

SEQ ID NO: 795426 - DNA, 20 bp, mouse
ggggcccggggcaaactcgt

SEQ ID NO: 795427 - DNA, 20 bp, mouse
ggctcccgccggcccggctg

SEQ ID NO: 795428 - DNA, 20 bp, mouse
gcaaactcccgcagacctcc

SEQ ID NO: 795429 - DNA, 20 bp, mouse
ggcatgcctaagaatggcaa

SEQ ID NO: 795430 - DNA, 20 bp, mouse
ggacagcgagccttgcgcgg

SEQ ID NO: 795431 - DNA, 20 bp, mouse
gtggctgcgtgcgtgagcca

SEQ ID NO: 795432 - DNA, 20 bp, mouse
gatggggaggaaggtgcagt

SEQ ID NO: 795433 - DNA, 20 bp, mouse
gccgccactaggggccctat

SEQ ID NO: 795434 - DNA, 20 bp, mouse
gaaaagacgtcctacctcga

SEQ ID NO: 795435 - DNA, 20 bp, mouse
gtctgcgggagtttggcagg

SEQ ID NO: 795436 - DNA, 20 bp, mouse
gtgccgaggccgccgttccg

SEQ ID NO: 795437 - DNA, 20 bp, mouse
gcggggctctgactggtcgg

SEQ ID NO: 795438 - DNA, 20 bp, mouse
gcggcctcggcaacaggagg

SEQ ID NO: 795439 - DNA, 20 bp, mouse
gagaccgcctcctgttgccg

SEQ ID NO: 795440 - DNA, 20 bp, mouse
ggaggaggcggtggaggcga

SEQ ID NO: 795441 - DNA, 20 bp, mouse
gagtcagagccccggaacgg

SEQ ID NO: 795442 - DNA, 20 bp, mouse
gggcgcccgcgctccgaaac

SEQ ID NO: 795443 - DNA, 20 bp, mouse
ggctgcctggcgatggggtg

SEQ ID NO: 795444 - DNA, 20 bp, mouse
gtccgaaaccgggtaggagg

SEQ ID NO: 795445 - DNA, 20 bp, mouse
gaccagtcagagccccggaa

SEQ ID NO: 795446 - DNA, 20 bp, mouse
ggcaaggagagcgggactga

SEQ ID NO: 795447 - DNA, 20 bp, mouse
ggagccctgcgcaattcccg

SEQ ID NO: 795448 - DNA, 20 bp, mouse
gttggtggggcgattgggca

SEQ ID NO: 795449 - DNA, 20 bp, mouse
ggcgcaagcccgtccggggg

SEQ ID NO: 795450 - DNA, 20 bp, mouse
gcagttcaggcgcatttggt

SEQ ID NO: 795451 - DNA, 20 bp, mouse
gagcggcgcaagcccgtccg

SEQ ID NO: 795452 - DNA, 20 bp, mouse
ggctccccgggaattgcgca

SEQ ID NO: 795453 - DNA, 20 bp, mouse
gcacccgccacaactctgta

SEQ ID NO: 795454 - DNA, 20 bp, mouse
gcgcccgcttggcggggtgg

SEQ ID NO: 795455 - DNA, 20 bp, mouse
gatcgcctagggctctagag

SEQ ID NO: 795456 - DNA, 20 bp, mouse
gtggcctggggcagccagca

SEQ ID NO: 795457 - DNA, 20 bp, mouse
gcgagggaagaggagctgga

SEQ ID NO: 795458 - DNA, 20 bp, mouse
gggtaaggcacacgtgtggc

SEQ ID NO: 795459 - DNA, 20 bp, mouse
gtcccacagtctgccaacaa

SEQ ID NO: 795460 - DNA, 20 bp, mouse
gggcgcggccgaccccttag

SEQ ID NO: 795461 - DNA, 20 bp, mouse
gagcagggcggagacaggaa

SEQ ID NO: 795462 - DNA, 20 bp, mouse
ggtgacctgtaactcacagg

SEQ ID NO: 795463 - DNA, 20 bp, mouse
gaagaggtaaggcacacgtg

SEQ ID NO: 795464 - DNA, 20 bp, mouse
gacttctcttttcagagcga

SEQ ID NO: 795465 - DNA, 20 bp, mouse
ggtctgccaacaaaggcaca

SEQ ID NO: 795466 - DNA, 20 bp, mouse
ggctgtcccgccaccctcac

SEQ ID NO: 795467 - DNA, 20 bp, mouse
gaggaggcccgaggtggtca

SEQ ID NO: 795468 - DNA, 20 bp, mouse
gcccgcagttgggtgtgcgt

SEQ ID NO: 795469 - DNA, 20 bp, mouse
gtggaagccaggaggggcgg

SEQ ID NO: 795470 - DNA, 20 bp, mouse
gtcgccgcttcccagagcct

SEQ ID NO: 795471 - DNA, 20 bp, mouse
gtcactggatgccaaggctc

SEQ ID NO: 795472 - DNA, 20 bp, mouse
gcctggtggcagcttgtggc

SEQ ID NO: 795473 - DNA, 20 bp, mouse
gtgcagaggcgggagactgg

SEQ ID NO: 795474 - DNA, 20 bp, mouse
gacccagaggaggaggcccg

SEQ ID NO: 795475 - DNA, 20 bp, mouse
gcagaggaggaggcccgagg

SEQ ID NO: 795476 - DNA, 20 bp, mouse
gtctccctcccgctcccgta

SEQ ID NO: 795477 - DNA, 20 bp, mouse
gcgcccgtgaataccgggaa

SEQ ID NO: 795478 - DNA, 20 bp, mouse
gcggggacgttgtccgagag

SEQ ID NO: 795479 - DNA, 20 bp, mouse
gacgagaggcgactccccta

SEQ ID NO: 795480 - DNA, 20 bp, mouse
gggcgactcccctacgggag

SEQ ID NO: 795481 - DNA, 20 bp, mouse
gctcccctacgggagcggga

SEQ ID NO: 795482 - DNA, 20 bp, mouse
gagcgggagggagacgcgac

SEQ ID NO: 795483 - DNA, 20 bp, mouse
gtgcccttcccggtattcac

SEQ ID NO: 795484 - DNA, 20 bp, mouse
gagaagccgcccgtgaatac

SEQ ID NO: 795485 - DNA, 20 bp, mouse
gtgagcggaacggagcggcg

SEQ ID NO: 795486 - DNA, 20 bp, mouse
gggtctccgggtaacaggac

SEQ ID NO: 795487 - DNA, 20 bp, mouse
gacgtgtgccaggggaggat

SEQ ID NO: 795488 - DNA, 20 bp, mouse
gctgcgccgcggagttcccc

SEQ ID NO: 795489 - DNA, 20 bp, mouse
gggtgggagacgtgtgccag

SEQ ID NO: 795490 - DNA, 20 bp, mouse
ggaaaaaagcccatgcccgg

SEQ ID NO: 795491 - DNA, 20 bp, mouse
ggtgcgcccggggaactccg

SEQ ID NO: 795492 - DNA, 20 bp, mouse
gagttccccgggcgcactgg

SEQ ID NO: 795493 - DNA, 20 bp, mouse
ggggagacgtgtgccagggg

SEQ ID NO: 795494 - DNA, 20 bp, mouse
gcctaggaccgtgactaggt

SEQ ID NO: 795495 - DNA, 20 bp, mouse
gcgcggggtgtgttagagag

SEQ ID NO: 795496 - DNA, 20 bp, mouse
gacaatgctcgggagaggga

SEQ ID NO: 795497 - DNA, 20 bp, mouse
gcggcccaggaagggattct

SEQ ID NO: 795498 - DNA, 20 bp, mouse
gcgggtcagaatggcagcgt

SEQ ID NO: 795499 - DNA, 20 bp, mouse
gcctgaggagccaacgcctg

SEQ ID NO: 795500 - DNA, 20 bp, mouse
gacgcctgaggctgccaagg

SEQ ID NO: 795501 - DNA, 20 bp, mouse
gggcgggaggggtggcagct

SEQ ID NO: 795502 - DNA, 20 bp, mouse
ggggctctgggtgtgcagaa

SEQ ID NO: 795503 - DNA, 20 bp, mouse
gcggcaaaggaacaatgctc

SEQ ID NO: 795504 - DNA, 20 bp, mouse
gaaggaacaatgctcgggag

SEQ ID NO: 795505 - DNA, 20 bp, mouse
ggaggcagcgcgggtcagaa

SEQ ID NO: 795506 - DNA, 20 bp, mouse
gtggaagcttgtcatatctt

SEQ ID NO: 795507 - DNA, 20 bp, mouse
gcaagtaattatgctgttag

SEQ ID NO: 795508 - DNA, 20 bp, mouse
gagtataacaacataggggt

SEQ ID NO: 795509 - DNA, 20 bp, mouse
gtcgttcaaagtcagtgcaa

SEQ ID NO: 795510 - DNA, 20 bp, mouse
gggaccctttacagtatttt

SEQ ID NO: 795511 - DNA, 20 bp, mouse
gtctccaaaaatactgtaaa

SEQ ID NO: 795512 - DNA, 20 bp, mouse
gtaaaactgttttcctttag

SEQ ID NO: 795513 - DNA, 20 bp, mouse
gcgtctcaattttcctctaa

SEQ ID NO: 795514 - DNA, 20 bp, mouse
gccctgaaaaacaaattggg

SEQ ID NO: 795515 - DNA, 20 bp, mouse
gcacatgagtataacaacat

SEQ ID NO: 795516 - DNA, 20 bp, mouse
gacctgtctgggtaatcctg

SEQ ID NO: 795517 - DNA, 20 bp, mouse
gtgaccagaactccaaaggg

SEQ ID NO: 795518 - DNA, 20 bp, mouse
gctctctctaggtgaggctg

SEQ ID NO: 795519 - DNA, 20 bp, mouse
gtggggtactgggactaagt

SEQ ID NO: 795520 - DNA, 20 bp, mouse
gagaagatctaatacctgtc

SEQ ID NO: 795521 - DNA, 20 bp, mouse
gtctgtgaccagaactccaa

SEQ ID NO: 795522 - DNA, 20 bp, mouse
gaggtgaaaaggccagggaa

SEQ ID NO: 795523 - DNA, 20 bp, mouse
gtgggtggggcattttgggc

SEQ ID NO: 795524 - DNA, 20 bp, mouse
gtctctgtatggtggaattc

SEQ ID NO: 795525 - DNA, 20 bp, mouse
gaagctacataatgtatagg

SEQ ID NO: 795526 - DNA, 20 bp, mouse
gtcctcgcgcgcggctgctc

SEQ ID NO: 795527 - DNA, 20 bp, mouse
gcgggaggagcgtggaacag

SEQ ID NO: 795528 - DNA, 20 bp, mouse
gctgctccggcgcgctgctg

SEQ ID NO: 795529 - DNA, 20 bp, mouse
gaggaaacgggagaggcgga

SEQ ID NO: 795530 - DNA, 20 bp, mouse
gaaacgggagaggcggaggg

SEQ ID NO: 795531 - DNA, 20 bp, mouse
ggcggagcagcgtggaggag

SEQ ID NO: 795532 - DNA, 20 bp, mouse
gctgaggcccgctggggtga

SEQ ID NO: 795533 - DNA, 20 bp, mouse
gggaggaggcgagacgcggc

SEQ ID NO: 795534 - DNA, 20 bp, mouse
gaggagcgtggaacagcggg

SEQ ID NO: 795535 - DNA, 20 bp, mouse
gacacggcgctggcaaaggg

SEQ ID NO: 795536 - DNA, 20 bp, mouse
gcggggccgtggagctgcga

SEQ ID NO: 795537 - DNA, 20 bp, mouse
gctgactggacactctatca

SEQ ID NO: 795538 - DNA, 20 bp, mouse
gactggacactctatcaggg

SEQ ID NO: 795539 - DNA, 20 bp, mouse
gacgcctggtgcctggctct

SEQ ID NO: 795540 - DNA, 20 bp, mouse
gggacgttgagttttctcta

SEQ ID NO: 795541 - DNA, 20 bp, mouse
gtatcagggaggatcctaaa

SEQ ID NO: 795542 - DNA, 20 bp, mouse
ggtggagctgcgaggggcga

SEQ ID NO: 795543 - DNA, 20 bp, mouse
gtccagctccagctccgcgg

SEQ ID NO: 795544 - DNA, 20 bp, mouse
ggctcaccctcctggagctt

SEQ ID NO: 795545 - DNA, 20 bp, mouse
gccaggagggtgagcgcccg

SEQ ID NO: 795546 - DNA, 20 bp, mouse
gtggagctgtaggcccaacg

SEQ ID NO: 795547 - DNA, 20 bp, mouse
gacaagcgagagtgcacgag

SEQ ID NO: 795548 - DNA, 20 bp, mouse
gccggggacgcgcacggcag

SEQ ID NO: 795549 - DNA, 20 bp, mouse
gcgagagtgcacgaggggag

SEQ ID NO: 795550 - DNA, 20 bp, mouse
gttccaggcggtttagactt

SEQ ID NO: 795551 - DNA, 20 bp, mouse
gtgtagaggagtggagctgt

SEQ ID NO: 795552 - DNA, 20 bp, mouse
gtaaacctcaggaacgagcg

SEQ ID NO: 795553 - DNA, 20 bp, mouse
gcgtgcactctcgcttgtag

SEQ ID NO: 795554 - DNA, 20 bp, mouse
gtgtacgtaatacttctcta

SEQ ID NO: 795555 - DNA, 20 bp, mouse
gactctcgcttgtagaggag

SEQ ID NO: 795556 - DNA, 20 bp, mouse
ggccctaggcacgcctggag

SEQ ID NO: 795557 - DNA, 20 bp, mouse
ggggcgcgcgtctcttaaag

SEQ ID NO: 795558 - DNA, 20 bp, mouse
gagtgcaagtccttggaagc

SEQ ID NO: 795559 - DNA, 20 bp, mouse
gggagagtagtgcaagtcct

SEQ ID NO: 795560 - DNA, 20 bp, mouse
gagagcgcggggctggaaac

SEQ ID NO: 795561 - DNA, 20 bp, mouse
gtcctctccaggcgtgccta

SEQ ID NO: 795562 - DNA, 20 bp, mouse
gcaggcgtgcctagggctat

SEQ ID NO: 795563 - DNA, 20 bp, mouse
gagacgcgcgcccccgccgg

SEQ ID NO: 795564 - DNA, 20 bp, mouse
ggggctatgggtgtgcgttt

SEQ ID NO: 795565 - DNA, 20 bp, mouse
gatccccgagctgccgccgg

SEQ ID NO: 795566 - DNA, 20 bp, mouse
gtctgtgtggggggccgaga

SEQ ID NO: 795567 - DNA, 20 bp, mouse
gcctctgcctccagggatct

SEQ ID NO: 795568 - DNA, 20 bp, mouse
ggacagggcagggcccaact

SEQ ID NO: 795569 - DNA, 20 bp, mouse
gaggctgcaatgggcggagg

SEQ ID NO: 795570 - DNA, 20 bp, mouse
gaatgcctacgttattagct

SEQ ID NO: 795571 - DNA, 20 bp, mouse
gagtggagatgaagcttctg

SEQ ID NO: 795572 - DNA, 20 bp, mouse
gaggctgaggctgcaatggg

SEQ ID NO: 795573 - DNA, 20 bp, mouse
ggagactgaggattccagac

SEQ ID NO: 795574 - DNA, 20 bp, mouse
gccagcctagggtataagtc

SEQ ID NO: 795575 - DNA, 20 bp, mouse
gttcctgaataatgacttga

SEQ ID NO: 795576 - DNA, 20 bp, mouse
ggcccccgcccccagcgagc

SEQ ID NO: 795577 - DNA, 20 bp, mouse
gcggccgctgccgtgctccg

SEQ ID NO: 795578 - DNA, 20 bp, mouse
ggagacgccagagcgtgcac

SEQ ID NO: 795579 - DNA, 20 bp, mouse
gtccgcgcgtcatgcggctc

SEQ ID NO: 795580 - DNA, 20 bp, mouse
ggacgcgcggaggaggcaga

SEQ ID NO: 795581 - DNA, 20 bp, mouse
gtgggagggctaggcggaca

SEQ ID NO: 795582 - DNA, 20 bp, mouse
gcctcgccgccctctcgccg

SEQ ID NO: 795583 - DNA, 20 bp, mouse
ggcttcctccggccgcggga

SEQ ID NO: 795584 - DNA, 20 bp, mouse
gcgcccgccgccagctcgct

SEQ ID NO: 795585 - DNA, 20 bp, mouse
ggtcccgggtcccgagtccc

SEQ ID NO: 795586 - DNA, 20 bp, mouse
gcccaggtggcgaacaaagg

SEQ ID NO: 795587 - DNA, 20 bp, mouse
ggagcccaggtggcgaacaa

SEQ ID NO: 795588 - DNA, 20 bp, mouse
gccactgccgcctcctgcta

SEQ ID NO: 795589 - DNA, 20 bp, mouse
gtggccgcgcggctctctgg

SEQ ID NO: 795590 - DNA, 20 bp, mouse
gtggcgcgcgtctccctagc

SEQ ID NO: 795591 - DNA, 20 bp, mouse
gccgcgcggccaccgagccc

SEQ ID NO: 795592 - DNA, 20 bp, mouse
gacctggcgcagctccctgc

SEQ ID NO: 795593 - DNA, 20 bp, mouse
gtggcggcgagcgggaaagg

SEQ ID NO: 795594 - DNA, 20 bp, mouse
gcggcagcttcggaggaatg

SEQ ID NO: 795595 - DNA, 20 bp, mouse
gccgcgggctccggcagctt

SEQ ID NO: 795596 - DNA, 20 bp, mouse
ggcgctgcggaggcgagcta

SEQ ID NO: 795597 - DNA, 20 bp, mouse
gcgggcaggagcaacctccc

SEQ ID NO: 795598 - DNA, 20 bp, mouse
gtgggaaacccgaggcgctg

SEQ ID NO: 795599 - DNA, 20 bp, mouse
gcggcctgcgcggcgcctgc

SEQ ID NO: 795600 - DNA, 20 bp, mouse
gggaggcgagctagggtcga

SEQ ID NO: 795601 - DNA, 20 bp, mouse
gcccgcccgcatcttgctgg

SEQ ID NO: 795602 - DNA, 20 bp, mouse
ggccaccagcaagatgcggg

SEQ ID NO: 795603 - DNA, 20 bp, mouse
gggcgagctagggtcgaggg

SEQ ID NO: 795604 - DNA, 20 bp, mouse
ggtcacggacggcgagtagt

SEQ ID NO: 795605 - DNA, 20 bp, mouse
ggcggccaccagcaagatgc

SEQ ID NO: 795606 - DNA, 20 bp, mouse
gtaggtccccggctaagagg

SEQ ID NO: 795607 - DNA, 20 bp, mouse
gggacccagtgggaattcta

SEQ ID NO: 795608 - DNA, 20 bp, mouse
gaggcgacccggccaactgc

SEQ ID NO: 795609 - DNA, 20 bp, mouse
gggccgggtcgcctcaagag

SEQ ID NO: 795610 - DNA, 20 bp, mouse
gcaaataggcataagagccg

SEQ ID NO: 795611 - DNA, 20 bp, mouse
ggggaacaggaaagatacgt

SEQ ID NO: 795612 - DNA, 20 bp, mouse
gtgcccctcttgaggcgacc

SEQ ID NO: 795613 - DNA, 20 bp, mouse
ggacctgaaaaatacaggtc

SEQ ID NO: 795614 - DNA, 20 bp, mouse
gtagaccccgccttggaggt

SEQ ID NO: 795615 - DNA, 20 bp, mouse
gagactccgcctaggctcct

SEQ ID NO: 795616 - DNA, 20 bp, mouse
ggggcgtgcctgaacgtgca

SEQ ID NO: 795617 - DNA, 20 bp, mouse
gtagaacccgcttctcggga

SEQ ID NO: 795618 - DNA, 20 bp, mouse
gtgcctatcccccgcgaggt

SEQ ID NO: 795619 - DNA, 20 bp, mouse
gcaccctgcagtgtccagat

SEQ ID NO: 795620 - DNA, 20 bp, mouse
gttcaggcacgcccacctcg

SEQ ID NO: 795621 - DNA, 20 bp, mouse
gtcgaagatcccaagcagaa

SEQ ID NO: 795622 - DNA, 20 bp, mouse
gaggcacgcccacctcgcgg

SEQ ID NO: 795623 - DNA, 20 bp, mouse
gccgcatggggtacactcca

SEQ ID NO: 795624 - DNA, 20 bp, mouse
gtaagtggtggcagctgttg

SEQ ID NO: 795625 - DNA, 20 bp, mouse
gctcgcgggggataggcagg

SEQ ID NO: 795626 - DNA, 20 bp, mouse
gcaagggcaaaggaacgggg

SEQ ID NO: 795627 - DNA, 20 bp, mouse
ggggaattgaactgaggtcg

SEQ ID NO: 795628 - DNA, 20 bp, mouse
gctaggcagccccccagacc

SEQ ID NO: 795629 - DNA, 20 bp, mouse
gccctcaaacaactcttcct

SEQ ID NO: 795630 - DNA, 20 bp, mouse
gctgaggcggagcctggtct

SEQ ID NO: 795631 - DNA, 20 bp, mouse
gttcccctctctcttatctc

SEQ ID NO: 795632 - DNA, 20 bp, mouse
gggaggcaggggtcggcgtg

SEQ ID NO: 795633 - DNA, 20 bp, mouse
ggcaggcagacaaccctccg

SEQ ID NO: 795634 - DNA, 20 bp, mouse
gtgggcagcaggataagagg

SEQ ID NO: 795635 - DNA, 20 bp, mouse
gctatgggggaattgaactg

SEQ ID NO: 795636 - DNA, 20 bp, mouse
gcggctcatggcaggctcca

SEQ ID NO: 795637 - DNA, 20 bp, mouse
gtctccccacggctcatggc

SEQ ID NO: 795638 - DNA, 20 bp, mouse
gcttggaggtggagagtatc

SEQ ID NO: 795639 - DNA, 20 bp, mouse
gttactatcacagatcttgg

SEQ ID NO: 795640 - DNA, 20 bp, mouse
gctattcatgaactcttgga

SEQ ID NO: 795641 - DNA, 20 bp, mouse
gaaaaccctgaaaaccataa

SEQ ID NO: 795642 - DNA, 20 bp, mouse
gtaattgtgtacttgccagg

SEQ ID NO: 795643 - DNA, 20 bp, mouse
ggagcctgccatgagccgtg

SEQ ID NO: 795644 - DNA, 20 bp, mouse
gcagagctattgagtaatcc

SEQ ID NO: 795645 - DNA, 20 bp, mouse
gtcatgaactcttggatgga

SEQ ID NO: 795646 - DNA, 20 bp, mouse
ggggctggaggctagcttta

SEQ ID NO: 795647 - DNA, 20 bp, mouse
gaacccaaggagggaagtgg

SEQ ID NO: 795648 - DNA, 20 bp, mouse
gccaaggagggaagtggagg

SEQ ID NO: 795649 - DNA, 20 bp, mouse
gtctcagctaagacccggag

SEQ ID NO: 795650 - DNA, 20 bp, mouse
gaacaagctccacgaggagg

SEQ ID NO: 795651 - DNA, 20 bp, mouse
gcggggggaggagttgagtg

SEQ ID NO: 795652 - DNA, 20 bp, mouse
ggtcttagctgagactgcga

SEQ ID NO: 795653 - DNA, 20 bp, mouse
gtggggacatactgggaaac

SEQ ID NO: 795654 - DNA, 20 bp, mouse
gccccccgcccagatttagg

SEQ ID NO: 795655 - DNA, 20 bp, mouse
gtcctcctaaatctgggcgg

SEQ ID NO: 795656 - DNA, 20 bp, mouse
gtgctccccgggccttctac

SEQ ID NO: 795657 - DNA, 20 bp, mouse
gcggggagcacgtgggacgt

SEQ ID NO: 795658 - DNA, 20 bp, mouse
ggaaggcccggggagcacgt

SEQ ID NO: 795659 - DNA, 20 bp, mouse
gtggcccggcctgtctcctc

SEQ ID NO: 795660 - DNA, 20 bp, mouse
gcgcagatgcctgcccagtg

SEQ ID NO: 795661 - DNA, 20 bp, mouse
gctgctgggtcacgtgcttc

SEQ ID NO: 795662 - DNA, 20 bp, mouse
gcaggagcctgtagaaggcc

SEQ ID NO: 795663 - DNA, 20 bp, mouse
gtgggcaggcatctgcgcgc

SEQ ID NO: 795664 - DNA, 20 bp, mouse
gccagcagcgcctcctcact

SEQ ID NO: 795665 - DNA, 20 bp, mouse
gtgtacacggccaggcccca

SEQ ID NO: 795666 - DNA, 20 bp, mouse
gcggacccagagattccgaa

SEQ ID NO: 795667 - DNA, 20 bp, mouse
gagccggggagaggcttcta

SEQ ID NO: 795668 - DNA, 20 bp, mouse
gcgaggcccaaccccctagg

SEQ ID NO: 795669 - DNA, 20 bp, mouse
ggcctcgtagcggcaggcaa

SEQ ID NO: 795670 - DNA, 20 bp, mouse
gggcaggcaagggcagattc

SEQ ID NO: 795671 - DNA, 20 bp, mouse
gcgggaggaatggggagccg

SEQ ID NO: 795672 - DNA, 20 bp, mouse
gtctaaggaagccgcctagg

SEQ ID NO: 795673 - DNA, 20 bp, mouse
ggggcagattcgggaggaat

SEQ ID NO: 795674 - DNA, 20 bp, mouse
ggctgagggcagatgcagaa

SEQ ID NO: 795675 - DNA, 20 bp, mouse
gctacgaggcccaaccccct

SEQ ID NO: 795676 - DNA, 20 bp, mouse
gagcccgcgagtggcagccg

SEQ ID NO: 795677 - DNA, 20 bp, mouse
gagcccgggagagggtgcgt

SEQ ID NO: 795678 - DNA, 20 bp, mouse
ggcccgcggctgccactcgc

SEQ ID NO: 795679 - DNA, 20 bp, mouse
gggcgtgtgccaggcgcggg

SEQ ID NO: 795680 - DNA, 20 bp, mouse
gccgcccgggcgctccgcct

SEQ ID NO: 795681 - DNA, 20 bp, mouse
gtcccgggctggccggctcg

SEQ ID NO: 795682 - DNA, 20 bp, mouse
gtgtgtgtgcgtggccgagg

SEQ ID NO: 795683 - DNA, 20 bp, mouse
ggggctgtgaattgcgggag

SEQ ID NO: 795684 - DNA, 20 bp, mouse
gcagctgggtggtgtggcgc

SEQ ID NO: 795685 - DNA, 20 bp, mouse
gcgaactgaggcgcgaggct

SEQ ID NO: 795686 - DNA, 20 bp, mouse
gccggcgggcccagggaacc

SEQ ID NO: 795687 - DNA, 20 bp, mouse
gtcaacgcatccgttgccca

SEQ ID NO: 795688 - DNA, 20 bp, mouse
gcccccgggcgcgagttccg

SEQ ID NO: 795689 - DNA, 20 bp, mouse
gccgacctgaacaccggcac

SEQ ID NO: 795690 - DNA, 20 bp, mouse
gtgtcgacggggtgcgagag

SEQ ID NO: 795691 - DNA, 20 bp, mouse
gggccgatggatcttgtcga

SEQ ID NO: 795692 - DNA, 20 bp, mouse
ggtctcgaggcgtcccctgc

SEQ ID NO: 795693 - DNA, 20 bp, mouse
gagagtgccgacctgaacac

SEQ ID NO: 795694 - DNA, 20 bp, mouse
gcgacggggtgcgagagtgg

SEQ ID NO: 795695 - DNA, 20 bp, mouse
gcgcgcgacaccaccagcag

SEQ ID NO: 795696 - DNA, 20 bp, mouse
gctggaggtggaacccgctg

SEQ ID NO: 795697 - DNA, 20 bp, mouse
gtcgcgcagcagcagaaaga

SEQ ID NO: 795698 - DNA, 20 bp, mouse
gccaagctgtgcgggacaat

SEQ ID NO: 795699 - DNA, 20 bp, mouse
gcacctccagccctgggcgg

SEQ ID NO: 795700 - DNA, 20 bp, mouse
gggtcggccccaagctgtgc

SEQ ID NO: 795701 - DNA, 20 bp, mouse
ggaattgcggggacgcgctc

SEQ ID NO: 795702 - DNA, 20 bp, mouse
ggggagcaggagcgcaggcg

SEQ ID NO: 795703 - DNA, 20 bp, mouse
gctggggcttagaatcttcg

SEQ ID NO: 795704 - DNA, 20 bp, mouse
gcagagcaggacagaatgat

SEQ ID NO: 795705 - DNA, 20 bp, mouse
gcagaaagaggggcgtggcg

SEQ ID NO: 795706 - DNA, 20 bp, mouse
gtgggcgccccaccctgttc

SEQ ID NO: 795707 - DNA, 20 bp, mouse
gccaccctgttcaggatggt

SEQ ID NO: 795708 - DNA, 20 bp, mouse
ggaggggagaccaaccccgg

SEQ ID NO: 795709 - DNA, 20 bp, mouse
ggaggctgcggcagcgggac

SEQ ID NO: 795710 - DNA, 20 bp, mouse
gcgccccaccctgttcagga

SEQ ID NO: 795711 - DNA, 20 bp, mouse
gggtggggcgcccagctctt

SEQ ID NO: 795712 - DNA, 20 bp, mouse
gcccctctgctgcccctccg

SEQ ID NO: 795713 - DNA, 20 bp, mouse
gggctggccccaccccagaa

SEQ ID NO: 795714 - DNA, 20 bp, mouse
gcccagaaagggaggaaccg

SEQ ID NO: 795715 - DNA, 20 bp, mouse
gcagaggggaacccaagagc

SEQ ID NO: 795716 - DNA, 20 bp, mouse
gccgccccgcagagacatgg

SEQ ID NO: 795717 - DNA, 20 bp, mouse
gacagggtgacgcgtcgcgg

SEQ ID NO: 795718 - DNA, 20 bp, mouse
ggtccagcgacgcccaatcc

SEQ ID NO: 795719 - DNA, 20 bp, mouse
ggcgggcccgggcgagtgtc

SEQ ID NO: 795720 - DNA, 20 bp, mouse
gcatacagggtgacgcgtcg

SEQ ID NO: 795721 - DNA, 20 bp, mouse
gggtaccagccctcgagcaa

SEQ ID NO: 795722 - DNA, 20 bp, mouse
gggcggaagtgggtggatcg

SEQ ID NO: 795723 - DNA, 20 bp, mouse
ggaccccgccccttgacgtc

SEQ ID NO: 795724 - DNA, 20 bp, mouse
gtgcacccagacactcgccc

SEQ ID NO: 795725 - DNA, 20 bp, mouse
ggccaaacccagcctggatt

SEQ ID NO: 795726 - DNA, 20 bp, mouse
gcccgcgaggaacctcccgg

SEQ ID NO: 795727 - DNA, 20 bp, mouse
ggacgcgagcgagttccggt

SEQ ID NO: 795728 - DNA, 20 bp, mouse
gtcccggtggccgaaaggag

SEQ ID NO: 795729 - DNA, 20 bp, mouse
gctgtgggaaagctcggctt

SEQ ID NO: 795730 - DNA, 20 bp, mouse
gaagtgacgcgagcgagttc

SEQ ID NO: 795731 - DNA, 20 bp, mouse
gtcctcgcgggatttcggtt

SEQ ID NO: 795732 - DNA, 20 bp, mouse
ggaacctcccggtggccgaa

SEQ ID NO: 795733 - DNA, 20 bp, mouse
ggatcgcaggatcctggaag

SEQ ID NO: 795734 - DNA, 20 bp, mouse
gtgagcgaaagcggggagtc

SEQ ID NO: 795735 - DNA, 20 bp, mouse
gaatcccgcgaggaacctcc

SEQ ID NO: 795736 - DNA, 20 bp, mouse
gaagcccggctggaccatag

SEQ ID NO: 795737 - DNA, 20 bp, mouse
gtggaccatagtggccacgg

SEQ ID NO: 795738 - DNA, 20 bp, mouse
gaaagcactctgggatcagt

SEQ ID NO: 795739 - DNA, 20 bp, mouse
ggtggccacggcggtgaggt

SEQ ID NO: 795740 - DNA, 20 bp, mouse
gttaaactgcatcctgagtg

SEQ ID NO: 795741 - DNA, 20 bp, mouse
gcgccaaagctccctcactc

SEQ ID NO: 795742 - DNA, 20 bp, mouse
gggtgaggtaggcgtggaca

SEQ ID NO: 795743 - DNA, 20 bp, mouse
gcacgcctacctcaccgccg

SEQ ID NO: 795744 - DNA, 20 bp, mouse
gtccggccagtctgatgatc

SEQ ID NO: 795745 - DNA, 20 bp, mouse
ggggacactttgcttatccc

SEQ ID NO: 795746 - DNA, 20 bp, mouse
gcacccttcggccgacttgg

SEQ ID NO: 795747 - DNA, 20 bp, mouse
gtgggtgggtgagaagccag

SEQ ID NO: 795748 - DNA, 20 bp, mouse
gcggctgcgcagtgcaaact

SEQ ID NO: 795749 - DNA, 20 bp, mouse
gaggcagtcagaaatacctg

SEQ ID NO: 795750 - DNA, 20 bp, mouse
ggcgagtcgaaaccactccc

SEQ ID NO: 795751 - DNA, 20 bp, mouse
ggctggagaacatctgataa

SEQ ID NO: 795752 - DNA, 20 bp, mouse
gccgaaagcactcctgggag

SEQ ID NO: 795753 - DNA, 20 bp, mouse
gctagtgtttgcctccaagt

SEQ ID NO: 795754 - DNA, 20 bp, mouse
gttcgactcgcggcaccctt

SEQ ID NO: 795755 - DNA, 20 bp, mouse
gagaaatacctggggccagt

SEQ ID NO: 795756 - DNA, 20 bp, mouse
gagacgcgagagctgggcgg

SEQ ID NO: 795757 - DNA, 20 bp, mouse
gtgggtgagtaccttctcgc

SEQ ID NO: 795758 - DNA, 20 bp, mouse
gggtccctccgagaggaggt

SEQ ID NO: 795759 - DNA, 20 bp, mouse
gctacagcctgagaaccaat

SEQ ID NO: 795760 - DNA, 20 bp, mouse
gacgacatggacctgcgaga

SEQ ID NO: 795761 - DNA, 20 bp, mouse
gtgtccaaaactcctgtgag

SEQ ID NO: 795762 - DNA, 20 bp, mouse
gtggagacagacgcgagagc

SEQ ID NO: 795763 - DNA, 20 bp, mouse
ggttgctcccattggttctc

SEQ ID NO: 795764 - DNA, 20 bp, mouse
gggccccacctcctctcgga

SEQ ID NO: 795765 - DNA, 20 bp, mouse
ggacagacgcgagagctggg

SEQ ID NO: 795766 - DNA, 20 bp, mouse
ggctgctggaactgcgggga

SEQ ID NO: 795767 - DNA, 20 bp, mouse
gcgtaggcgggcggaggtca

SEQ ID NO: 795768 - DNA, 20 bp, mouse
gtgcgcgctgctggaactgc

SEQ ID NO: 795769 - DNA, 20 bp, mouse
ggcggggagggagcaataac

SEQ ID NO: 795770 - DNA, 20 bp, mouse
ggactctgaggcgggttctg

SEQ ID NO: 795771 - DNA, 20 bp, mouse
ggctacagagcagttgtgtt

SEQ ID NO: 795772 - DNA, 20 bp, mouse
gaagcctcagctgcgcccgt

SEQ ID NO: 795773 - DNA, 20 bp, mouse
ggaagctttgccacttgctc

SEQ ID NO: 795774 - DNA, 20 bp, mouse
ggcgcgctgctctgacgctc

SEQ ID NO: 795775 - DNA, 20 bp, mouse
gcctcagctgcgcccgtagg

SEQ ID NO: 795776 - DNA, 20 bp, mouse
gaggcgagtcagggggagaa

SEQ ID NO: 795777 - DNA, 20 bp, mouse
gctgcaggcagattaattag

SEQ ID NO: 795778 - DNA, 20 bp, mouse
gccaccgaggtccacactgc

SEQ ID NO: 795779 - DNA, 20 bp, mouse
gtaattagaggcgagtcagg

SEQ ID NO: 795780 - DNA, 20 bp, mouse
gtgaggagcacagaggtaca

SEQ ID NO: 795781 - DNA, 20 bp, mouse
ggaagtgctagcgctttggg

SEQ ID NO: 795782 - DNA, 20 bp, mouse
ggagggaagctggacttttc

SEQ ID NO: 795783 - DNA, 20 bp, mouse
gttacagcaactaatcctca

SEQ ID NO: 795784 - DNA, 20 bp, mouse
ggctttggagcgtttattaa

SEQ ID NO: 795785 - DNA, 20 bp, mouse
gcagcgcgagggagttcccc

SEQ ID NO: 795786 - DNA, 20 bp, mouse
gagacaggactcataagaca

SEQ ID NO: 795787 - DNA, 20 bp, mouse
gcatctgccttcaatccagt

SEQ ID NO: 795788 - DNA, 20 bp, mouse
gcaggcacaaacagcttctt

SEQ ID NO: 795789 - DNA, 20 bp, mouse
gccaaagcccactggattga

SEQ ID NO: 795790 - DNA, 20 bp, mouse
gagggaaacgagcttcaaac

SEQ ID NO: 795791 - DNA, 20 bp, mouse
gtcgggttcccaaagcccac

SEQ ID NO: 795792 - DNA, 20 bp, mouse
gctaacagcagcacctagac

SEQ ID NO: 795793 - DNA, 20 bp, mouse
gttgggaacccgaggttccc

SEQ ID NO: 795794 - DNA, 20 bp, mouse
gacaggggttgagcatggtc

SEQ ID NO: 795795 - DNA, 20 bp, mouse
gcagctgtgcactggtgccc

SEQ ID NO: 795796 - DNA, 20 bp, mouse
gagagccctcccctggtcgg

SEQ ID NO: 795797 - DNA, 20 bp, mouse
gcccccccccgaccagggga

SEQ ID NO: 795798 - DNA, 20 bp, mouse
gtcctcctccggtacattaa

SEQ ID NO: 795799 - DNA, 20 bp, mouse
gggcccgccccgtcctcctc

SEQ ID NO: 795800 - DNA, 20 bp, mouse
ggagcaggccgttaatgtac

SEQ ID NO: 795801 - DNA, 20 bp, mouse
gaatgtaccggaggaggacg

SEQ ID NO: 795802 - DNA, 20 bp, mouse
gcaggccgttaatgtaccgg

SEQ ID NO: 795803 - DNA, 20 bp, mouse
gacggggcgggccggggttt

SEQ ID NO: 795804 - DNA, 20 bp, mouse
gcggagagccctcccctggt

SEQ ID NO: 795805 - DNA, 20 bp, mouse
gtacggcatagctacgagag

SEQ ID NO: 795806 - DNA, 20 bp, mouse
ggcagggcctgtgtgaactc

SEQ ID NO: 795807 - DNA, 20 bp, mouse
gtgaactcggggaaactcgc

SEQ ID NO: 795808 - DNA, 20 bp, mouse
ggggaggggacgccaacctg

SEQ ID NO: 795809 - DNA, 20 bp, mouse
ggggcgggcggctctggaac

SEQ ID NO: 795810 - DNA, 20 bp, mouse
gggcgggcacagcggttgtg

SEQ ID NO: 795811 - DNA, 20 bp, mouse
gagtgcccgggctgccgtgg

SEQ ID NO: 795812 - DNA, 20 bp, mouse
gccgctgtgcccgcccgctg

SEQ ID NO: 795813 - DNA, 20 bp, mouse
gtggggctgtgcctgaacct

SEQ ID NO: 795814 - DNA, 20 bp, mouse
ggagcgcgcacggagtgccc

SEQ ID NO: 795815 - DNA, 20 bp, mouse
gttcacacaggccctgccgt

SEQ ID NO: 795816 - DNA, 20 bp, mouse
gccgggaagtgcacgcccga

SEQ ID NO: 795817 - DNA, 20 bp, mouse
ggagcagagcgccagaggtc

SEQ ID NO: 795818 - DNA, 20 bp, mouse
gtggcgcggcgctctcctcg

SEQ ID NO: 795819 - DNA, 20 bp, mouse
gaagcactgcgggagaaagg

SEQ ID NO: 795820 - DNA, 20 bp, mouse
gcccgggagcagagcgccag

SEQ ID NO: 795821 - DNA, 20 bp, mouse
gcaccgaagtaccgagggtg

SEQ ID NO: 795822 - DNA, 20 bp, mouse
gggcctgcacgccggacctc

SEQ ID NO: 795823 - DNA, 20 bp, mouse
gggccgcgcgcaaagcactg

SEQ ID NO: 795824 - DNA, 20 bp, mouse
ggaggcgcgtgaccagcccc

SEQ ID NO: 795825 - DNA, 20 bp, mouse
gggcgctctcctcgcgggtg

SEQ ID NO: 795826 - DNA, 20 bp, mouse
gctcccggggcgcccctagg

SEQ ID NO: 795827 - DNA, 20 bp, mouse
gaggccccggggcgcgtccg

SEQ ID NO: 795828 - DNA, 20 bp, mouse
ggcctcgcgaacggcggcaa

SEQ ID NO: 795829 - DNA, 20 bp, mouse
ggacgcgccaacggcagcga

SEQ ID NO: 795830 - DNA, 20 bp, mouse
ggcaagggatgagcccccta

SEQ ID NO: 795831 - DNA, 20 bp, mouse
gaacgcgccctcgctgccgt

SEQ ID NO: 795832 - DNA, 20 bp, mouse
ggccaccggggcccagtcct

SEQ ID NO: 795833 - DNA, 20 bp, mouse
gcccgccgagaggggattga

SEQ ID NO: 795834 - DNA, 20 bp, mouse
ggagccgcgagcgcgagcca

SEQ ID NO: 795835 - DNA, 20 bp, mouse
gcgcgagcgcgagccacgga

SEQ ID NO: 795836 - DNA, 20 bp, mouse
gggcgcagaggtgacgtcgc

SEQ ID NO: 795837 - DNA, 20 bp, mouse
gcggggcggagtgacgtcac

SEQ ID NO: 795838 - DNA, 20 bp, mouse
gccgccggcgtggtgtgtgt

SEQ ID NO: 795839 - DNA, 20 bp, mouse
gaaccagcggacagaaacat

SEQ ID NO: 795840 - DNA, 20 bp, mouse
gtagccgcagaacgccttgc

SEQ ID NO: 795841 - DNA, 20 bp, mouse
ggcgcggaggcgatgggggg

SEQ ID NO: 795842 - DNA, 20 bp, mouse
ggcggggcgcggaggcgatg

SEQ ID NO: 795843 - DNA, 20 bp, mouse
gcgcgcccgccgctcatcgc

SEQ ID NO: 795844 - DNA, 20 bp, mouse
gcgcccccgcggcttccgtg

SEQ ID NO: 795845 - DNA, 20 bp, mouse
ggccccccagcctcgcccgc

SEQ ID NO: 795846 - DNA, 20 bp, mouse
ggcctccgggcgcgccctga

SEQ ID NO: 795847 - DNA, 20 bp, mouse
ggggactcgggctctgcctc

SEQ ID NO: 795848 - DNA, 20 bp, mouse
gcagacagcgcgcggggacc

SEQ ID NO: 795849 - DNA, 20 bp, mouse
gagagagccggcaggagagg

SEQ ID NO: 795850 - DNA, 20 bp, mouse
gcctccccgcggcgtcgggc

SEQ ID NO: 795851 - DNA, 20 bp, mouse
gggtgcccgaatccaggcag

SEQ ID NO: 795852 - DNA, 20 bp, mouse
gaggcggggagctgcctgag

SEQ ID NO: 795853 - DNA, 20 bp, mouse
gctgacggcagacagcgcgc

SEQ ID NO: 795854 - DNA, 20 bp, mouse
gcgcaggtgcgggtgagtcg

SEQ ID NO: 795855 - DNA, 20 bp, mouse
gcggggtggctgcggtgggt

SEQ ID NO: 795856 - DNA, 20 bp, mouse
ggaggggaaaggctctacgt

SEQ ID NO: 795857 - DNA, 20 bp, mouse
gtggaaaacggcatctagac

SEQ ID NO: 795858 - DNA, 20 bp, mouse
gctagcggggtggacccagt

SEQ ID NO: 795859 - DNA, 20 bp, mouse
gcagccggcgcgctcgagga

SEQ ID NO: 795860 - DNA, 20 bp, mouse
gtgcacgtggtcagcttcgg

SEQ ID NO: 795861 - DNA, 20 bp, mouse
gctgcggcgccccagatcct

SEQ ID NO: 795862 - DNA, 20 bp, mouse
gccggcgcgctcgaggaggg

SEQ ID NO: 795863 - DNA, 20 bp, mouse
ggaaaggctctacgtcggcg

SEQ ID NO: 795864 - DNA, 20 bp, mouse
gtggacaacagcggcaactc

SEQ ID NO: 795865 - DNA, 20 bp, mouse
ggcgccgtgagtgggtccgg

SEQ ID NO: 795866 - DNA, 20 bp, mouse
gctcagggaagcgactgcga

SEQ ID NO: 795867 - DNA, 20 bp, mouse
gtaggtgccgagtccgtcgg

SEQ ID NO: 795868 - DNA, 20 bp, mouse
gcacgcctgacgtcaggcca

SEQ ID NO: 795869 - DNA, 20 bp, mouse
ggcgtgtggtcaggcgaagc

SEQ ID NO: 795870 - DNA, 20 bp, mouse
ggcagcagctactacgacct

SEQ ID NO: 795871 - DNA, 20 bp, mouse
gggaaccccctcgtcttaca

SEQ ID NO: 795872 - DNA, 20 bp, mouse
gcaggccaaggcgtgtggtc

SEQ ID NO: 795873 - DNA, 20 bp, mouse
gccagctccgctccggctca

SEQ ID NO: 795874 - DNA, 20 bp, mouse
gcccgcccacgcctgacgtc

SEQ ID NO: 795875 - DNA, 20 bp, mouse
gttaaagggtcggccggcaa

SEQ ID NO: 795876 - DNA, 20 bp, mouse
gggggtggcagcacgtgcca

SEQ ID NO: 795877 - DNA, 20 bp, mouse
gactcccgagggaagtcccc

SEQ ID NO: 795878 - DNA, 20 bp, mouse
gtggggaggcgacgccgggg

SEQ ID NO: 795879 - DNA, 20 bp, mouse
gctagaacagggactcccga

SEQ ID NO: 795880 - DNA, 20 bp, mouse
gagaaacctgcgcatgcggt

SEQ ID NO: 795881 - DNA, 20 bp, mouse
gggtcccggagcctgaccat

SEQ ID NO: 795882 - DNA, 20 bp, mouse
gcactgcgccgcgccacggg

SEQ ID NO: 795883 - DNA, 20 bp, mouse
gagttcggaaggcacggtgt

SEQ ID NO: 795884 - DNA, 20 bp, mouse
gcccggccggcgtttagagc

SEQ ID NO: 795885 - DNA, 20 bp, mouse
gagagcggagaccgcagcta

SEQ ID NO: 795886 - DNA, 20 bp, mouse
gataaggcaagtcacttccc

SEQ ID NO: 795887 - DNA, 20 bp, mouse
gccgatgggcggagcgtcct

SEQ ID NO: 795888 - DNA, 20 bp, mouse
gggcggagcgtcctcgggag

SEQ ID NO: 795889 - DNA, 20 bp, mouse
gcaccggccctccgctcccg

SEQ ID NO: 795890 - DNA, 20 bp, mouse
gggagcttctttcacagcta

SEQ ID NO: 795891 - DNA, 20 bp, mouse
gtcacttcccaggcgccgat

SEQ ID NO: 795892 - DNA, 20 bp, mouse
ggctccgcccatcggcgcct

SEQ ID NO: 795893 - DNA, 20 bp, mouse
gccccgccccggggcgtggt

SEQ ID NO: 795894 - DNA, 20 bp, mouse
gccgcgccgaccacgccccg

SEQ ID NO: 795895 - DNA, 20 bp, mouse
gcgcacgtgtgcgagcccgg

SEQ ID NO: 795896 - DNA, 20 bp, mouse
gagggagggcaggtcagcta

SEQ ID NO: 795897 - DNA, 20 bp, mouse
gcagctaagggtgagagtat

SEQ ID NO: 795898 - DNA, 20 bp, mouse
ggggcatcatatccccctgt

SEQ ID NO: 795899 - DNA, 20 bp, mouse
gaagggtgagagtatagggg

SEQ ID NO: 795900 - DNA, 20 bp, mouse
gagggaaaggcgtggccttc

SEQ ID NO: 795901 - DNA, 20 bp, mouse
gtataggggcggagccaatc

SEQ ID NO: 795902 - DNA, 20 bp, mouse
gggggcggagccaatccgga

SEQ ID NO: 795903 - DNA, 20 bp, mouse
ggggatgctgcgggtcaccg

SEQ ID NO: 795904 - DNA, 20 bp, mouse
gaaggcgtggccttccggat

SEQ ID NO: 795905 - DNA, 20 bp, mouse
gcctgggtggagctcgggga

SEQ ID NO: 795906 - DNA, 20 bp, mouse
gctcacaggggcgcgatgat

SEQ ID NO: 795907 - DNA, 20 bp, mouse
gccggcccgtggaccgtctg

SEQ ID NO: 795908 - DNA, 20 bp, mouse
gcgacggcggcggggagatc

SEQ ID NO: 795909 - DNA, 20 bp, mouse
gccacccgctgtcacctccg

SEQ ID NO: 795910 - DNA, 20 bp, mouse
gcgcaggcgccgtccctgct

SEQ ID NO: 795911 - DNA, 20 bp, mouse
gcccacttcaggcatcacgg

SEQ ID NO: 795912 - DNA, 20 bp, mouse
gggcctcggcggttgggctt

SEQ ID NO: 795913 - DNA, 20 bp, mouse
gcgaggacaggaaacatagc

SEQ ID NO: 795914 - DNA, 20 bp, mouse
gcggagccaagcttagggat

SEQ ID NO: 795915 - DNA, 20 bp, mouse
gcgggggcggagccaagctt

SEQ ID NO: 795916 - DNA, 20 bp, mouse
gagtgctgggtgctgtaggg

SEQ ID NO: 795917 - DNA, 20 bp, mouse
gacactcagcaccgtggctg

SEQ ID NO: 795918 - DNA, 20 bp, mouse
gccacctcccaaaatagcca

SEQ ID NO: 795919 - DNA, 20 bp, mouse
ggctggggagtacctgacac

SEQ ID NO: 795920 - DNA, 20 bp, mouse
ggtcaggtactccccagcca

SEQ ID NO: 795921 - DNA, 20 bp, mouse
gtggctcaataggcctggat

SEQ ID NO: 795922 - DNA, 20 bp, mouse
ggggagtacctgacaccgga

SEQ ID NO: 795923 - DNA, 20 bp, mouse
gtggaaacaagggttgctag

SEQ ID NO: 795924 - DNA, 20 bp, mouse
gttaataggcctggctcaat

SEQ ID NO: 795925 - DNA, 20 bp, mouse
gacctgacaccggaagggga

SEQ ID NO: 795926 - DNA, 20 bp, mouse
ggctgtcaagggcatacggg

SEQ ID NO: 795927 - DNA, 20 bp, mouse
gctgaatgcccggaccccat

SEQ ID NO: 795928 - DNA, 20 bp, mouse
gcccctggcggcggggtcct

SEQ ID NO: 795929 - DNA, 20 bp, mouse
gcggcctggctccgcgccag

SEQ ID NO: 795930 - DNA, 20 bp, mouse
gaggagatggcccctggcgg

SEQ ID NO: 795931 - DNA, 20 bp, mouse
ggagcgggccacatgcccat

SEQ ID NO: 795932 - DNA, 20 bp, mouse
gggccatctcctgatctaaa

SEQ ID NO: 795933 - DNA, 20 bp, mouse
gtagcccaggggccacatcg

SEQ ID NO: 795934 - DNA, 20 bp, mouse
gccacatgcccatggggtcc

SEQ ID NO: 795935 - DNA, 20 bp, mouse
ggcccaggaccccgccgcca

SEQ ID NO: 795936 - DNA, 20 bp, mouse
gccagcacctgagtcgggtg

SEQ ID NO: 795937 - DNA, 20 bp, mouse
gtcatcccagcacctgagtc

SEQ ID NO: 795938 - DNA, 20 bp, mouse
gagtcgggtggggaggatgg

SEQ ID NO: 795939 - DNA, 20 bp, mouse
gacagccaagcacgtctgcc

SEQ ID NO: 795940 - DNA, 20 bp, mouse
gacgaggctggatttgtcta

SEQ ID NO: 795941 - DNA, 20 bp, mouse
gccagcccggcagacgtgct

SEQ ID NO: 795942 - DNA, 20 bp, mouse
ggcacctgagtcgggtgggg

SEQ ID NO: 795943 - DNA, 20 bp, mouse
gcctagggacggcccattga

SEQ ID NO: 795944 - DNA, 20 bp, mouse
gttacagaacactaatcgtc

SEQ ID NO: 795945 - DNA, 20 bp, mouse
gtcactgtgtaactcagacg

SEQ ID NO: 795946 - DNA, 20 bp, mouse
ggggcccaggcggtggtgtg

SEQ ID NO: 795947 - DNA, 20 bp, mouse
gccgccccgaccgacggctg

SEQ ID NO: 795948 - DNA, 20 bp, mouse
gcggcgcaggctcccggccc

SEQ ID NO: 795949 - DNA, 20 bp, mouse
gtccacgcaaagcccggctg

SEQ ID NO: 795950 - DNA, 20 bp, mouse
gtaccgggctagcgcggcgc

SEQ ID NO: 795951 - DNA, 20 bp, mouse
gagcctgcgccgcgctagcc

SEQ ID NO: 795952 - DNA, 20 bp, mouse
gccgtcggtcggggcggggt

SEQ ID NO: 795953 - DNA, 20 bp, mouse
gtgccgccggctcagagcct

SEQ ID NO: 795954 - DNA, 20 bp, mouse
gcagccgcagccgtcggtcg

SEQ ID NO: 795955 - DNA, 20 bp, mouse
gccgctcggctccaacttgc

SEQ ID NO: 795956 - DNA, 20 bp, mouse
gaaggcggagatagaatcgt

SEQ ID NO: 795957 - DNA, 20 bp, mouse
gggagcctgagccctaggat

SEQ ID NO: 795958 - DNA, 20 bp, mouse
ggatcctgagagccaggcga

SEQ ID NO: 795959 - DNA, 20 bp, mouse
gtcaggctccgcccctctca

SEQ ID NO: 795960 - DNA, 20 bp, mouse
gtgaccacgcccactcgaca

SEQ ID NO: 795961 - DNA, 20 bp, mouse
gccagacaggtgtgggacgc

SEQ ID NO: 795962 - DNA, 20 bp, mouse
gtggtcaaatagttaattcc

SEQ ID NO: 795963 - DNA, 20 bp, mouse
ggcgaccggaagtttagaag

SEQ ID NO: 795964 - DNA, 20 bp, mouse
ggtgtgggacgcgggatggg

SEQ ID NO: 795965 - DNA, 20 bp, mouse
ggtcttagccctgagagggg

SEQ ID NO: 795966 - DNA, 20 bp, mouse
gagggtgggaggagactcgg

SEQ ID NO: 795967 - DNA, 20 bp, mouse
gcggcgtccaggcagcccgg

SEQ ID NO: 795968 - DNA, 20 bp, mouse
ggggctcgtcccggtagtga

SEQ ID NO: 795969 - DNA, 20 bp, mouse
gagggagggcgggctcgtcc

SEQ ID NO: 795970 - DNA, 20 bp, mouse
gtcccggtagtgagggtcgg

SEQ ID NO: 795971 - DNA, 20 bp, mouse
gggaagtgggaggagcgtgt

SEQ ID NO: 795972 - DNA, 20 bp, mouse
gagcccgccctccctgccgc

SEQ ID NO: 795973 - DNA, 20 bp, mouse
gagcccggcggcagggaggg

SEQ ID NO: 795974 - DNA, 20 bp, mouse
gtcgtcccggtagtgagggt

SEQ ID NO: 795975 - DNA, 20 bp, mouse
gggaccagggataaccaggg

SEQ ID NO: 795976 - DNA, 20 bp, mouse
gagctaatgggcgccagggt

SEQ ID NO: 795977 - DNA, 20 bp, mouse
gcccgcacctccccaattag

SEQ ID NO: 795978 - DNA, 20 bp, mouse
ggatctgagtgcgggcagtg

SEQ ID NO: 795979 - DNA, 20 bp, mouse
gaaggcccctgtgtgagaaa

SEQ ID NO: 795980 - DNA, 20 bp, mouse
gacggcctgggctagctaat

SEQ ID NO: 795981 - DNA, 20 bp, mouse
gtagctagcccaggccgtgg

SEQ ID NO: 795982 - DNA, 20 bp, mouse
gccaggtaaagcccctgttg

SEQ ID NO: 795983 - DNA, 20 bp, mouse
gccaactgtgatcccctaat

SEQ ID NO: 795984 - DNA, 20 bp, mouse
gggctagctaatgggcgcca

SEQ ID NO: 795985 - DNA, 20 bp, mouse
gagaacaggtgcgtctccgg

SEQ ID NO: 795986 - DNA, 20 bp, mouse
gcgcaggcgccaaggggaag

SEQ ID NO: 795987 - DNA, 20 bp, mouse
gaggggaatttgcatgagat

SEQ ID NO: 795988 - DNA, 20 bp, mouse
gaatttgcatgagatgggcg

SEQ ID NO: 795989 - DNA, 20 bp, mouse
ggggaacaacgcgcaggcgc

SEQ ID NO: 795990 - DNA, 20 bp, mouse
ggctcgctgacgtcactcgc

SEQ ID NO: 795991 - DNA, 20 bp, mouse
ggtcactcgcaggcgccaag

SEQ ID NO: 795992 - DNA, 20 bp, mouse
ggcggaggggaacaacgcgc

SEQ ID NO: 795993 - DNA, 20 bp, mouse
gtggaaatctgcaaagtggg

SEQ ID NO: 795994 - DNA, 20 bp, mouse
gaatctacgactgcttcctg

SEQ ID NO: 795995 - DNA, 20 bp, mouse
gctgtctgaatcagctactg

SEQ ID NO: 795996 - DNA, 20 bp, mouse
gctagctgagaccgctagga

SEQ ID NO: 795997 - DNA, 20 bp, mouse
gcaccaccctgcctctacgc

SEQ ID NO: 795998 - DNA, 20 bp, mouse
gtgaactagctgagaccgct

SEQ ID NO: 795999 - DNA, 20 bp, mouse
gcagggtggtggcgggagtg

SEQ ID NO: 796000 - DNA, 20 bp, mouse
gccgctaggacggtggagaa

SEQ ID NO: 796001 - DNA, 20 bp, mouse
ggctgagaccgctaggacgg

SEQ ID NO: 796002 - DNA, 20 bp, mouse
gaaaacgcgcacttccgggg

SEQ ID NO: 796003 - DNA, 20 bp, mouse
gcagcgcctgcgtagaggca

SEQ ID NO: 796004 - DNA, 20 bp, mouse
gcgcctgcgtagaggcaggg

SEQ ID NO: 796005 - DNA, 20 bp, mouse
ggagaatggagctaagttct

SEQ ID NO: 796006 - DNA, 20 bp, mouse
gagaaggagccgtctgtcgc

SEQ ID NO: 796007 - DNA, 20 bp, mouse
gggactcagcccgcgacaga

SEQ ID NO: 796008 - DNA, 20 bp, mouse
gttgacagaagtgcggaagg

SEQ ID NO: 796009 - DNA, 20 bp, mouse
gccgccccctccctcagagt

SEQ ID NO: 796010 - DNA, 20 bp, mouse
gcgcacttctgtcaacccat

SEQ ID NO: 796011 - DNA, 20 bp, mouse
ggacgagagtgttagcggga

SEQ ID NO: 796012 - DNA, 20 bp, mouse
gtaggaacttcccattggtc

SEQ ID NO: 796013 - DNA, 20 bp, mouse
gtgaggggcgggctgaagga

SEQ ID NO: 796014 - DNA, 20 bp, mouse
gaatcacgagcatcagggaa

SEQ ID NO: 796015 - DNA, 20 bp, mouse
ggatacaggctgtaagcaca

SEQ ID NO: 796016 - DNA, 20 bp, mouse
gtgcgctcccaggagccgga

SEQ ID NO: 796017 - DNA, 20 bp, mouse
gcggaccgccccacgccctc

SEQ ID NO: 796018 - DNA, 20 bp, mouse
gccccagcctagctccgcgg

SEQ ID NO: 796019 - DNA, 20 bp, mouse
gcccaggagccggagggcgt

SEQ ID NO: 796020 - DNA, 20 bp, mouse
gccccaccgggcggggagaa

SEQ ID NO: 796021 - DNA, 20 bp, mouse
ggggtagcggggacactccc

SEQ ID NO: 796022 - DNA, 20 bp, mouse
gccccctaggaggccttgcc

SEQ ID NO: 796023 - DNA, 20 bp, mouse
gtgtgggcgcacgctgcggg

SEQ ID NO: 796024 - DNA, 20 bp, mouse
gtcacgcggggctgacccgg

SEQ ID NO: 796025 - DNA, 20 bp, mouse
gcaggcttggaatgccccct

SEQ ID NO: 796026 - DNA, 20 bp, mouse
gaatcccgaggatccagagt

SEQ ID NO: 796027 - DNA, 20 bp, mouse
gaccgcccgcggcgggtcag

SEQ ID NO: 796028 - DNA, 20 bp, mouse
ggacccgccgcgggcggtcc

SEQ ID NO: 796029 - DNA, 20 bp, mouse
gagagtgctcaactcggggc

SEQ ID NO: 796030 - DNA, 20 bp, mouse
gcctagcagttggcagacca

SEQ ID NO: 796031 - DNA, 20 bp, mouse
gactctgccaggcccacacg

SEQ ID NO: 796032 - DNA, 20 bp, mouse
gtggcagagtgctcaactcg

SEQ ID NO: 796033 - DNA, 20 bp, mouse
gtcccggggcggcgccgcat

SEQ ID NO: 796034 - DNA, 20 bp, mouse
gagaaagtcgccttgcgcgc

SEQ ID NO: 796035 - DNA, 20 bp, mouse
gttgcgcgcggggagagcgc

SEQ ID NO: 796036 - DNA, 20 bp, mouse
gcctctgcgaagctaagagg

SEQ ID NO: 796037 - DNA, 20 bp, mouse
gccctgctgcacctccgaga

SEQ ID NO: 796038 - DNA, 20 bp, mouse
gttagcttcgcagagggcgg

SEQ ID NO: 796039 - DNA, 20 bp, mouse
gaggtgcagaggtgtcgctt

SEQ ID NO: 796040 - DNA, 20 bp, mouse
ggggggctgggcaatcacca

SEQ ID NO: 796041 - DNA, 20 bp, mouse
gcacacagactccactgtgg

SEQ ID NO: 796042 - DNA, 20 bp, mouse
gcagggagaaaggatgataa

SEQ ID NO: 796043 - DNA, 20 bp, mouse
gtgaacctagcgacccttct

SEQ ID NO: 796044 - DNA, 20 bp, mouse
gacctccgagaagggtcgct

SEQ ID NO: 796045 - DNA, 20 bp, mouse
gacctagcgacccttctcgg

SEQ ID NO: 796046 - DNA, 20 bp, mouse
gccagtctgcccgacctcgc

SEQ ID NO: 796047 - DNA, 20 bp, mouse
ggctaggacccagcgaggtc

SEQ ID NO: 796048 - DNA, 20 bp, mouse
ggcagactggtgttgacagc

SEQ ID NO: 796049 - DNA, 20 bp, mouse
ggactgctatcgtcgtccca

SEQ ID NO: 796050 - DNA, 20 bp, mouse
gacatctcgcactgcttctc

SEQ ID NO: 796051 - DNA, 20 bp, mouse
gccgttcttcacggcagggt

SEQ ID NO: 796052 - DNA, 20 bp, mouse
ggaagcagtgcgagatgtgg

SEQ ID NO: 796053 - DNA, 20 bp, mouse
ggtgcgagatgtggtggtaa

SEQ ID NO: 796054 - DNA, 20 bp, mouse
gacggcgctaggacccagcg

SEQ ID NO: 796055 - DNA, 20 bp, mouse
gtactgagtatacgctgcgg

SEQ ID NO: 796056 - DNA, 20 bp, mouse
gtgaggccgcgccttctcat

SEQ ID NO: 796057 - DNA, 20 bp, mouse
gagcgcagagggtgggtcgc

SEQ ID NO: 796058 - DNA, 20 bp, mouse
gctcgctgagggcggaggaa

SEQ ID NO: 796059 - DNA, 20 bp, mouse
gggtgggtcgcagggaccgg

SEQ ID NO: 796060 - DNA, 20 bp, mouse
gcaccctctgcgctcgccgg

SEQ ID NO: 796061 - DNA, 20 bp, mouse
gggacggccgggctcgctga

SEQ ID NO: 796062 - DNA, 20 bp, mouse
gcctcggctctccaatcctc

SEQ ID NO: 796063 - DNA, 20 bp, mouse
ggggaaaagagtgcactagc

SEQ ID NO: 796064 - DNA, 20 bp, mouse
gcctccgccctcagcgagcc

SEQ ID NO: 796065 - DNA, 20 bp, mouse
gtctgcgctcgccggaggat

SEQ ID NO: 796066 - DNA, 20 bp, mouse
ggccctgccgttgtgtccat

SEQ ID NO: 796067 - DNA, 20 bp, mouse
gagaaaactgccttctcatt

SEQ ID NO: 796068 - DNA, 20 bp, mouse
ggactcagaaggtctcacgc

SEQ ID NO: 796069 - DNA, 20 bp, mouse
gggctctcttctatgattga

SEQ ID NO: 796070 - DNA, 20 bp, mouse
ggagaagtttgtttaattgt

SEQ ID NO: 796071 - DNA, 20 bp, mouse
ggacaaatgagctctatgac

SEQ ID NO: 796072 - DNA, 20 bp, mouse
gaaggtacccagcatgtggg

SEQ ID NO: 796073 - DNA, 20 bp, mouse
gccttctgagtcatggtgat

SEQ ID NO: 796074 - DNA, 20 bp, mouse
gagagctcatttgtctgcaa

SEQ ID NO: 796075 - DNA, 20 bp, mouse
gttcgaaatatctgtctgat

SEQ ID NO: 796076 - DNA, 20 bp, mouse
gcgccccctggcggctggac

SEQ ID NO: 796077 - DNA, 20 bp, mouse
gccagcacgcccaatcccgc

SEQ ID NO: 796078 - DNA, 20 bp, mouse
gcgggtcagactgaacgcag

SEQ ID NO: 796079 - DNA, 20 bp, mouse
gggaggtgacctacagggac

SEQ ID NO: 796080 - DNA, 20 bp, mouse
gcccgcagggggcgaaagct

SEQ ID NO: 796081 - DNA, 20 bp, mouse
gagcctgtccagccgccagg

SEQ ID NO: 796082 - DNA, 20 bp, mouse
gtcctgggaggtgacctaca

SEQ ID NO: 796083 - DNA, 20 bp, mouse
gcgaaagctgggcgtggtcg

SEQ ID NO: 796084 - DNA, 20 bp, mouse
gcctcccaggaggattaaat

SEQ ID NO: 796085 - DNA, 20 bp, mouse
gacaggctggtggcgtctat

SEQ ID NO: 796086 - DNA, 20 bp, mouse
gaccgagggagggtgcggga

SEQ ID NO: 796087 - DNA, 20 bp, mouse
gaggcggagctcctgaatag

SEQ ID NO: 796088 - DNA, 20 bp, mouse
ggagtctttagaagaacggg

SEQ ID NO: 796089 - DNA, 20 bp, mouse
gtccctcccgcaccctccct

SEQ ID NO: 796090 - DNA, 20 bp, mouse
gtccaaacagcggtcggtag

SEQ ID NO: 796091 - DNA, 20 bp, mouse
gtgggaaggaagtaccaagg

SEQ ID NO: 796092 - DNA, 20 bp, mouse
gggaggagctgcctctattc

SEQ ID NO: 796093 - DNA, 20 bp, mouse
gcaatgggaaggaagtacca

SEQ ID NO: 796094 - DNA, 20 bp, mouse
ggtcccagcgtccaaccggg

SEQ ID NO: 796095 - DNA, 20 bp, mouse
ggaggagtctttagaagaac

SEQ ID NO: 796096 - DNA, 20 bp, mouse
gtggctaggctgaagaaact

SEQ ID NO: 796097 - DNA, 20 bp, mouse
ggaagaaactaggtggaggt

SEQ ID NO: 796098 - DNA, 20 bp, mouse
gagtctgaaagtcttagggg

SEQ ID NO: 796099 - DNA, 20 bp, mouse
gggctgaagaaactaggtgg

SEQ ID NO: 796100 - DNA, 20 bp, mouse
gtggagctaagttgttactc

SEQ ID NO: 796101 - DNA, 20 bp, mouse
gagccaagtctgaaagtctt

SEQ ID NO: 796102 - DNA, 20 bp, mouse
ggagtggatcctaagatctg

SEQ ID NO: 796103 - DNA, 20 bp, mouse
gctaggctgaagaaactagg

SEQ ID NO: 796104 - DNA, 20 bp, mouse
gccaccttctagcagatgtg

SEQ ID NO: 796105 - DNA, 20 bp, mouse
gacctgggctcatgatgggt

SEQ ID NO: 796106 - DNA, 20 bp, mouse
ggcaactactgctcacctca

SEQ ID NO: 796107 - DNA, 20 bp, mouse
gaagtgagggcggggccggt

SEQ ID NO: 796108 - DNA, 20 bp, mouse
gaggtactgtaggatggagg

SEQ ID NO: 796109 - DNA, 20 bp, mouse
gcacagggcgcacagctcat

SEQ ID NO: 796110 - DNA, 20 bp, mouse
gtggagagctgaggtactgt

SEQ ID NO: 796111 - DNA, 20 bp, mouse
gtgcaaaaagacaacagagg

SEQ ID NO: 796112 - DNA, 20 bp, mouse
gggcctgaaactcctctaag

SEQ ID NO: 796113 - DNA, 20 bp, mouse
gtccccaactcccttagagg

SEQ ID NO: 796114 - DNA, 20 bp, mouse
gaggtggtttgggaagttaa

SEQ ID NO: 796115 - DNA, 20 bp, mouse
gtacctcagctctccaacta

SEQ ID NO: 796116 - DNA, 20 bp, mouse
gccaagcagacccgcaccag

SEQ ID NO: 796117 - DNA, 20 bp, mouse
ggtagcctggtgtccatgag

SEQ ID NO: 796118 - DNA, 20 bp, mouse
gccagacccgagcctcggat

SEQ ID NO: 796119 - DNA, 20 bp, mouse
gggtctgcttggccctgcct

SEQ ID NO: 796120 - DNA, 20 bp, mouse
gaccaatcggcatcgccgtc

SEQ ID NO: 796121 - DNA, 20 bp, mouse
gggaaggagcatgccgaagc

SEQ ID NO: 796122 - DNA, 20 bp, mouse
ggggtctggggcggaccaat

SEQ ID NO: 796123 - DNA, 20 bp, mouse
gcaggaattaccagtgtccc

SEQ ID NO: 796124 - DNA, 20 bp, mouse
gcacccgctgcgcgatcagg

SEQ ID NO: 796125 - DNA, 20 bp, mouse
gccgcaccagcggagctaac

SEQ ID NO: 796126 - DNA, 20 bp, mouse
gaggggagctagtcctaagc

SEQ ID NO: 796127 - DNA, 20 bp, mouse
gggtcagtgattttgctgag

SEQ ID NO: 796128 - DNA, 20 bp, mouse
gcggggcgggcgcagacact

SEQ ID NO: 796129 - DNA, 20 bp, mouse
gcagcaaaatcactgaccaa

SEQ ID NO: 796130 - DNA, 20 bp, mouse
gaccgacagaagcgactggg

SEQ ID NO: 796131 - DNA, 20 bp, mouse
gagaaccagaacccactccg

SEQ ID NO: 796132 - DNA, 20 bp, mouse
gagagactctagctagcttc

SEQ ID NO: 796133 - DNA, 20 bp, mouse
gtcaaagcagttctagtggg

SEQ ID NO: 796134 - DNA, 20 bp, mouse
gtagcttcaggcttctcagg

SEQ ID NO: 796135 - DNA, 20 bp, mouse
ggaagcgactgggcgggttt

SEQ ID NO: 796136 - DNA, 20 bp, mouse
gagttctataatcaggaggg

SEQ ID NO: 796137 - DNA, 20 bp, mouse
gcttagttctataatcagga

SEQ ID NO: 796138 - DNA, 20 bp, mouse
gtctataatcaggagggagg

SEQ ID NO: 796139 - DNA, 20 bp, mouse
ggttgccagctgcatgtgaa

SEQ ID NO: 796140 - DNA, 20 bp, mouse
gacagcttagttctataatc

SEQ ID NO: 796141 - DNA, 20 bp, mouse
gatgcctttctatttatttg

SEQ ID NO: 796142 - DNA, 20 bp, mouse
gtgcatgtgaatgggtttca

SEQ ID NO: 796143 - DNA, 20 bp, mouse
gtgtttgtaacattatgctc

SEQ ID NO: 796144 - DNA, 20 bp, mouse
gaagtgttttcagagagaga

SEQ ID NO: 796145 - DNA, 20 bp, mouse
gctctcagaaggtgatccag

SEQ ID NO: 796146 - DNA, 20 bp, mouse
gtggatgcatagatgctaca

SEQ ID NO: 796147 - DNA, 20 bp, mouse
gttggttattgtttacaaga

SEQ ID NO: 796148 - DNA, 20 bp, mouse
gtgtttgtaatgttatgctc

SEQ ID NO: 796149 - DNA, 20 bp, mouse
gatctaagtgaaacagctcc

SEQ ID NO: 796150 - DNA, 20 bp, mouse
gcaacctcaaatagatagaa

SEQ ID NO: 796151 - DNA, 20 bp, mouse
gaagaagaggcttggtgact

SEQ ID NO: 796152 - DNA, 20 bp, mouse
gtcaggacagagtcagtatc

SEQ ID NO: 796153 - DNA, 20 bp, mouse
gtcttctttcttttctgctc

SEQ ID NO: 796154 - DNA, 20 bp, mouse
gtgcatgtaaatgagtttca

SEQ ID NO: 796155 - DNA, 20 bp, mouse
gtctatttgaggttgcagct

SEQ ID NO: 796156 - DNA, 20 bp, mouse
ggggccctgtggatgggcgt

SEQ ID NO: 796157 - DNA, 20 bp, mouse
gagagaacgtggacgctcga

SEQ ID NO: 796158 - DNA, 20 bp, mouse
gcaatcaggctgtttcagcc

SEQ ID NO: 796159 - DNA, 20 bp, mouse
ggtggacgctcgaggggaaa

SEQ ID NO: 796160 - DNA, 20 bp, mouse
gtgggcgtgggctgatctgg

SEQ ID NO: 796161 - DNA, 20 bp, mouse
ggagaaagagcccgtcaatc

SEQ ID NO: 796162 - DNA, 20 bp, mouse
gcggccctctcgcaaagcgc

SEQ ID NO: 796163 - DNA, 20 bp, mouse
gcataaaagtggtaaatctt

SEQ ID NO: 796164 - DNA, 20 bp, mouse
gcagcggaggccggctcata

SEQ ID NO: 796165 - DNA, 20 bp, mouse
gttcagccgggaagagaacg

SEQ ID NO: 796166 - DNA, 20 bp, mouse
ggagccccagggcggtgctg

SEQ ID NO: 796167 - DNA, 20 bp, mouse
ggacctggacgttctgggag

SEQ ID NO: 796168 - DNA, 20 bp, mouse
gggccgctcccagaacgtcc

SEQ ID NO: 796169 - DNA, 20 bp, mouse
gtcaccctgggaagcaaccg

SEQ ID NO: 796170 - DNA, 20 bp, mouse
gtctgggagcggccgagggg

SEQ ID NO: 796171 - DNA, 20 bp, mouse
ggggctcccacgcccccctg

SEQ ID NO: 796172 - DNA, 20 bp, mouse
gccagagtgacgccccccca

SEQ ID NO: 796173 - DNA, 20 bp, mouse
gggtgggcgggaacccggag

SEQ ID NO: 796174 - DNA, 20 bp, mouse
gaggctctgaccgcgtctct

SEQ ID NO: 796175 - DNA, 20 bp, mouse
gcaggtcacgtagtgcgcaa

SEQ ID NO: 796176 - DNA, 20 bp, mouse
ggctctccacagcccagaga

SEQ ID NO: 796177 - DNA, 20 bp, mouse
gctgtgaacacacccctctc

SEQ ID NO: 796178 - DNA, 20 bp, mouse
gggataagaccagaaggctt

SEQ ID NO: 796179 - DNA, 20 bp, mouse
gcaagaccctcccacgtccg

SEQ ID NO: 796180 - DNA, 20 bp, mouse
gcacacccctctctgggctg

SEQ ID NO: 796181 - DNA, 20 bp, mouse
ggccacgcctccccggacgt

SEQ ID NO: 796182 - DNA, 20 bp, mouse
ggccagtggataagaccaga

SEQ ID NO: 796183 - DNA, 20 bp, mouse
gggtcttggccgtgaagctc

SEQ ID NO: 796184 - DNA, 20 bp, mouse
gtggaacagggggaccaatt

SEQ ID NO: 796185 - DNA, 20 bp, mouse
ggctcagggagctattttgg

SEQ ID NO: 796186 - DNA, 20 bp, mouse
gctacagtgcattggagctg

SEQ ID NO: 796187 - DNA, 20 bp, mouse
gaagacaaaagacgaatctg

SEQ ID NO: 796188 - DNA, 20 bp, mouse
gaagctggggacccctttgt

SEQ ID NO: 796189 - DNA, 20 bp, mouse
gctgggaagacctgaggccc

SEQ ID NO: 796190 - DNA, 20 bp, mouse
gagtgtttctatctacgaag

SEQ ID NO: 796191 - DNA, 20 bp, mouse
gggtcttcccagcttttctc

SEQ ID NO: 796192 - DNA, 20 bp, mouse
gtttctatctacgaagtggt

SEQ ID NO: 796193 - DNA, 20 bp, mouse
gtttgtggggagctgattac

SEQ ID NO: 796194 - DNA, 20 bp, mouse
gcaaaagacgaatctggggc

SEQ ID NO: 796195 - DNA, 20 bp, mouse
gctgccgaagctcaggaatt

SEQ ID NO: 796196 - DNA, 20 bp, mouse
ggggctgtggagcacaggca

SEQ ID NO: 796197 - DNA, 20 bp, mouse
gagggcgcgaggtgagtgca

SEQ ID NO: 796198 - DNA, 20 bp, mouse
gggtccccgcccccgaagcc

SEQ ID NO: 796199 - DNA, 20 bp, mouse
gccgaaaccctgtgcgggtg

SEQ ID NO: 796200 - DNA, 20 bp, mouse
ggcctgcagcggccgctcgg

SEQ ID NO: 796201 - DNA, 20 bp, mouse
gctgtggagcacaggcaggg

SEQ ID NO: 796202 - DNA, 20 bp, mouse
gggaaggctccgctgcgctc

SEQ ID NO: 796203 - DNA, 20 bp, mouse
ggagccttccagcgaggccg

SEQ ID NO: 796204 - DNA, 20 bp, mouse
ggggccgcggcctcgctgga

SEQ ID NO: 796205 - DNA, 20 bp, mouse
gccgaagcccggccccgtgc

SEQ ID NO: 796206 - DNA, 20 bp, mouse
gggcgacaggcgcacttcgg

SEQ ID NO: 796207 - DNA, 20 bp, mouse
gggaacgcaccactcgacag

SEQ ID NO: 796208 - DNA, 20 bp, mouse
gacgccgcacccaggaaggc

SEQ ID NO: 796209 - DNA, 20 bp, mouse
ggggtcaccaccacggaacg

SEQ ID NO: 796210 - DNA, 20 bp, mouse
gggcggcgacaggcgcactt

SEQ ID NO: 796211 - DNA, 20 bp, mouse
gcaggcgcacttcggaggag

SEQ ID NO: 796212 - DNA, 20 bp, mouse
gccagacgccgcacccagga

SEQ ID NO: 796213 - DNA, 20 bp, mouse
gccacggaacgcggtgggga

SEQ ID NO: 796214 - DNA, 20 bp, mouse
gtcgcacggcccctgtcgag

SEQ ID NO: 796215 - DNA, 20 bp, mouse
gcaaggcgactggctcgcgg

SEQ ID NO: 796216 - DNA, 20 bp, mouse
gaaacaggaagttcccctcc

SEQ ID NO: 796217 - DNA, 20 bp, mouse
ggagatgcactctgccggga

SEQ ID NO: 796218 - DNA, 20 bp, mouse
gttctaacagcatggtactc

SEQ ID NO: 796219 - DNA, 20 bp, mouse
gctttctgcttacgtgagat

SEQ ID NO: 796220 - DNA, 20 bp, mouse
gggcagaagagctaagaaac

SEQ ID NO: 796221 - DNA, 20 bp, mouse
gataaagatgaactcccaaa

SEQ ID NO: 796222 - DNA, 20 bp, mouse
gacgtaagcagaaaggattt

SEQ ID NO: 796223 - DNA, 20 bp, mouse
gtcatatgtttctaacagca

SEQ ID NO: 796224 - DNA, 20 bp, mouse
ggatgcagtgcttttatatt

SEQ ID NO: 796225 - DNA, 20 bp, mouse
gttcctgctcaggatgcaaa

SEQ ID NO: 796226 - DNA, 20 bp, mouse
gcaaccagagttcaagatgt

SEQ ID NO: 796227 - DNA, 20 bp, mouse
gctcgcatgaaagtccccta

SEQ ID NO: 796228 - DNA, 20 bp, mouse
gaatctggaggcagactttc

SEQ ID NO: 796229 - DNA, 20 bp, mouse
gtcccctacagaataagaag

SEQ ID NO: 796230 - DNA, 20 bp, mouse
gagcgccggaagtgatttgt

SEQ ID NO: 796231 - DNA, 20 bp, mouse
gacgcccacatcttgaactc

SEQ ID NO: 796232 - DNA, 20 bp, mouse
gatgtgggcgtggtaacagc

SEQ ID NO: 796233 - DNA, 20 bp, mouse
gtgtgggcagcgtctcttcc

SEQ ID NO: 796234 - DNA, 20 bp, mouse
gtatcccattgctatgtgaa

SEQ ID NO: 796235 - DNA, 20 bp, mouse
ggggaagaactcgaatcctc

SEQ ID NO: 796236 - DNA, 20 bp, mouse
ggggccgagatcctaagctg

SEQ ID NO: 796237 - DNA, 20 bp, mouse
ggaaggcggggcctctgcgt

SEQ ID NO: 796238 - DNA, 20 bp, mouse
gaggcccggtagtgggctaa

SEQ ID NO: 796239 - DNA, 20 bp, mouse
gcctagaggagggggcatgt

SEQ ID NO: 796240 - DNA, 20 bp, mouse
gcccagggtccgagcttctg

SEQ ID NO: 796241 - DNA, 20 bp, mouse
gaaacggtggcccaaggcca

SEQ ID NO: 796242 - DNA, 20 bp, mouse
gtagtgggctaagggagaag

SEQ ID NO: 796243 - DNA, 20 bp, mouse
gttctcccaggcccggtagt

SEQ ID NO: 796244 - DNA, 20 bp, mouse
ggaggagtcaagcgagtagg

SEQ ID NO: 796245 - DNA, 20 bp, mouse
gcactgaaagatgactgggg

SEQ ID NO: 796246 - DNA, 20 bp, mouse
gccactgacccggggaatgt

SEQ ID NO: 796247 - DNA, 20 bp, mouse
gtggtgcagccactgacccg

SEQ ID NO: 796248 - DNA, 20 bp, mouse
gccagcacagcttgagtcgg

SEQ ID NO: 796249 - DNA, 20 bp, mouse
gacagcttgagtcggtggtg

SEQ ID NO: 796250 - DNA, 20 bp, mouse
gagggcagaccgacattccc

SEQ ID NO: 796251 - DNA, 20 bp, mouse
gtcgccagcacagcttgagt

SEQ ID NO: 796252 - DNA, 20 bp, mouse
ggtgccaattagtcagggac

SEQ ID NO: 796253 - DNA, 20 bp, mouse
gcaaaggtgccaattagtca

SEQ ID NO: 796254 - DNA, 20 bp, mouse
gtcagtagggctaatcacaa

SEQ ID NO: 796255 - DNA, 20 bp, mouse
gaagccgagctccgtgtgac

SEQ ID NO: 796256 - DNA, 20 bp, mouse
gaggaccccagtccgaagat

SEQ ID NO: 796257 - DNA, 20 bp, mouse
ggtggagagacagcacgtac

SEQ ID NO: 796258 - DNA, 20 bp, mouse
gcacctcagcagaagctgag

SEQ ID NO: 796259 - DNA, 20 bp, mouse
gccatcctatgaacaggcta

SEQ ID NO: 796260 - DNA, 20 bp, mouse
ggagggggcagtcccatctt

SEQ ID NO: 796261 - DNA, 20 bp, mouse
gtgggtgtaaagtcagcgat

SEQ ID NO: 796262 - DNA, 20 bp, mouse
ggcaaggcaccctttccaga

SEQ ID NO: 796263 - DNA, 20 bp, mouse
gcaaactctagattgcctta

SEQ ID NO: 796264 - DNA, 20 bp, mouse
gtaaagtcagcgattggcag

SEQ ID NO: 796265 - DNA, 20 bp, mouse
gggcagtcccatcttcggac

SEQ ID NO: 796266 - DNA, 20 bp, mouse
ggcaggctgccactagctca

SEQ ID NO: 796267 - DNA, 20 bp, mouse
gcatagatagtcctagaaaa

SEQ ID NO: 796268 - DNA, 20 bp, mouse
gtttgaaagatggtgcttgc

SEQ ID NO: 796269 - DNA, 20 bp, mouse
gatagtcctagaaaatggtc

SEQ ID NO: 796270 - DNA, 20 bp, mouse
gcaccatctttcaaacattt

SEQ ID NO: 796271 - DNA, 20 bp, mouse
ggtaaagccaagttagactt

SEQ ID NO: 796272 - DNA, 20 bp, mouse
gctcacggttaataatacac

SEQ ID NO: 796273 - DNA, 20 bp, mouse
gcaattccagaccattttct

SEQ ID NO: 796274 - DNA, 20 bp, mouse
ggaatgcaatactccaagtt

SEQ ID NO: 796275 - DNA, 20 bp, mouse
ggctttttattttacctgat

SEQ ID NO: 796276 - DNA, 20 bp, mouse
gcaactgcctagaaccggga

SEQ ID NO: 796277 - DNA, 20 bp, mouse
gcggttctaggcagttgaca

SEQ ID NO: 796278 - DNA, 20 bp, mouse
gaaggcggaagctaactgcc

SEQ ID NO: 796279 - DNA, 20 bp, mouse
gtcgctctctgactcataaa

SEQ ID NO: 796280 - DNA, 20 bp, mouse
ggtggccttcctcggtgaaa

SEQ ID NO: 796281 - DNA, 20 bp, mouse
gctgcctagaaccgggaagg

SEQ ID NO: 796282 - DNA, 20 bp, mouse
gaagccttgaagagaaccaa

SEQ ID NO: 796283 - DNA, 20 bp, mouse
gccgacaagaggatagtgtc

SEQ ID NO: 796284 - DNA, 20 bp, mouse
gggccccgcccctttcaccg

SEQ ID NO: 796285 - DNA, 20 bp, mouse
gagtcagagagcgagcggac

SEQ ID NO: 796286 - DNA, 20 bp, mouse
gagggcgtggaaggtaggcg

SEQ ID NO: 796287 - DNA, 20 bp, mouse
ggtagagcgcgtgtgtctcg

SEQ ID NO: 796288 - DNA, 20 bp, mouse
ggcctcctgcttcgaccaat

SEQ ID NO: 796289 - DNA, 20 bp, mouse
gaggtgaaggcggggcagat

SEQ ID NO: 796290 - DNA, 20 bp, mouse
gccaaagctccgcctcgagg

SEQ ID NO: 796291 - DNA, 20 bp, mouse
gggtggagacggagacattg

SEQ ID NO: 796292 - DNA, 20 bp, mouse
gaggcaggggcgggtgttct

SEQ ID NO: 796293 - DNA, 20 bp, mouse
gcaagcctattggtcgaagc

SEQ ID NO: 796294 - DNA, 20 bp, mouse
ggtgcagtgaaccctaccta

SEQ ID NO: 796295 - DNA, 20 bp, mouse
gtcacctccctggagccaat

SEQ ID NO: 796296 - DNA, 20 bp, mouse
gcgggcgcggtcgggtgcgg

SEQ ID NO: 796297 - DNA, 20 bp, mouse
gcggctgagaggaatcccgg

SEQ ID NO: 796298 - DNA, 20 bp, mouse
gggcggcggcgctggctcgt

SEQ ID NO: 796299 - DNA, 20 bp, mouse
ggggccggggtcgcggctga

SEQ ID NO: 796300 - DNA, 20 bp, mouse
gtccccctcagccgcgaccc

SEQ ID NO: 796301 - DNA, 20 bp, mouse
gcggcgggcgcggtcgggtg

SEQ ID NO: 796302 - DNA, 20 bp, mouse
ggtcgcggctgagggggacg

SEQ ID NO: 796303 - DNA, 20 bp, mouse
gcgccgccaagtgagtgagg

SEQ ID NO: 796304 - DNA, 20 bp, mouse
gccgcggcccggccctgcgc

SEQ ID NO: 796305 - DNA, 20 bp, mouse
ggcggagcgaccctcggaag

SEQ ID NO: 796306 - DNA, 20 bp, mouse
ggccacaggaggcgactggg

SEQ ID NO: 796307 - DNA, 20 bp, mouse
gctgcacagcgggaggccac

SEQ ID NO: 796308 - DNA, 20 bp, mouse
gccaaagctcctgtcaccca

SEQ ID NO: 796309 - DNA, 20 bp, mouse
gcacagcgggaggccacagg

SEQ ID NO: 796310 - DNA, 20 bp, mouse
gaggcagacacaatcaatcc

SEQ ID NO: 796311 - DNA, 20 bp, mouse
gtcaatccaggggtggagaa

SEQ ID NO: 796312 - DNA, 20 bp, mouse
gaggccctgggggctataag

SEQ ID NO: 796313 - DNA, 20 bp, mouse
gggaggccacaggaggcgac

SEQ ID NO: 796314 - DNA, 20 bp, mouse
gtgtgcttgcgctgcacagc

SEQ ID NO: 796315 - DNA, 20 bp, mouse
gaaaccacttatagccccca

SEQ ID NO: 796316 - DNA, 20 bp, mouse
gaggcccgcctccacggaag

SEQ ID NO: 796317 - DNA, 20 bp, mouse
gcggaagaggaccagtcaat

SEQ ID NO: 796318 - DNA, 20 bp, mouse
ggactggtcctcttccgtgg

SEQ ID NO: 796319 - DNA, 20 bp, mouse
gaaggagggcggaaacctta

SEQ ID NO: 796320 - DNA, 20 bp, mouse
gtcttgatcgacttccgtga

SEQ ID NO: 796321 - DNA, 20 bp, mouse
gccccacccaaaaaggaggg

SEQ ID NO: 796322 - DNA, 20 bp, mouse
gtcggacgcagcccattgac

SEQ ID NO: 796323 - DNA, 20 bp, mouse
gtccctgagacgattgcgat

SEQ ID NO: 796324 - DNA, 20 bp, mouse
gagcgccgccccacccaaaa

SEQ ID NO: 796325 - DNA, 20 bp, mouse
gcgcggggtcacgcccctca

SEQ ID NO: 796326 - DNA, 20 bp, mouse
ggattctggggttcgcagtg

SEQ ID NO: 796327 - DNA, 20 bp, mouse
gccaaagaggtgtaccgtga

SEQ ID NO: 796328 - DNA, 20 bp, mouse
gctggggttcgcagtggggc

SEQ ID NO: 796329 - DNA, 20 bp, mouse
ggactcctctggcaccaaac

SEQ ID NO: 796330 - DNA, 20 bp, mouse
gagtgcagggccatgaatgc

SEQ ID NO: 796331 - DNA, 20 bp, mouse
gggacctcactctcctatga

SEQ ID NO: 796332 - DNA, 20 bp, mouse
gggccggaaagccttgttag

SEQ ID NO: 796333 - DNA, 20 bp, mouse
gggctggaagtggagaaaac

SEQ ID NO: 796334 - DNA, 20 bp, mouse
gctccgagggagctccagca

SEQ ID NO: 796335 - DNA, 20 bp, mouse
gcctctctctggtggggtta

SEQ ID NO: 796336 - DNA, 20 bp, mouse
gtaagcccaccgtctctgga

SEQ ID NO: 796337 - DNA, 20 bp, mouse
ggatgtggtctgatgaagag

SEQ ID NO: 796338 - DNA, 20 bp, mouse
gtggtctgatgaagagtggc

SEQ ID NO: 796339 - DNA, 20 bp, mouse
gcagccccaaaggaatcctg

SEQ ID NO: 796340 - DNA, 20 bp, mouse
ggtgaaggaaggggcaccgt

SEQ ID NO: 796341 - DNA, 20 bp, mouse
gcaaggcagggccaccatca

SEQ ID NO: 796342 - DNA, 20 bp, mouse
gcaaccgcgggctcagacac

SEQ ID NO: 796343 - DNA, 20 bp, mouse
gagacactggaggttcccgg

SEQ ID NO: 796344 - DNA, 20 bp, mouse
ggcacagagagcatcatcac

SEQ ID NO: 796345 - DNA, 20 bp, mouse
gtctgtaagcccaccgtctc

SEQ ID NO: 796346 - DNA, 20 bp, mouse
ggaagctgatagcaggtggg

SEQ ID NO: 796347 - DNA, 20 bp, mouse
gctaaggctggtgaggattg

SEQ ID NO: 796348 - DNA, 20 bp, mouse
gctggagagccgcctaaggc

SEQ ID NO: 796349 - DNA, 20 bp, mouse
ggctaagagaagctgatagc

SEQ ID NO: 796350 - DNA, 20 bp, mouse
gaagtctggagagccgccta

SEQ ID NO: 796351 - DNA, 20 bp, mouse
gaagagaagctgatagcagg

SEQ ID NO: 796352 - DNA, 20 bp, mouse
ggaggagactcgatgagaaa

SEQ ID NO: 796353 - DNA, 20 bp, mouse
gtgcaactgtacgcccagag

SEQ ID NO: 796354 - DNA, 20 bp, mouse
gagcggagtgaggggtacaa

SEQ ID NO: 796355 - DNA, 20 bp, mouse
gttcaacctaacaagaccat

SEQ ID NO: 796356 - DNA, 20 bp, mouse
gggcacccctccatgcgggg

SEQ ID NO: 796357 - DNA, 20 bp, mouse
ggcgctccttcccacaacga

SEQ ID NO: 796358 - DNA, 20 bp, mouse
gcggggcggggcttaggccc

SEQ ID NO: 796359 - DNA, 20 bp, mouse
ggggccggcgggtagaacgg

SEQ ID NO: 796360 - DNA, 20 bp, mouse
gcgcatggaggggtgcccat

SEQ ID NO: 796361 - DNA, 20 bp, mouse
gagagcgtacccctcgttgt

SEQ ID NO: 796362 - DNA, 20 bp, mouse
gagccccgccccgcatggag

SEQ ID NO: 796363 - DNA, 20 bp, mouse
gagccacagagggaaccggt

SEQ ID NO: 796364 - DNA, 20 bp, mouse
gggcaggggcaaaatacccc

SEQ ID NO: 796365 - DNA, 20 bp, mouse
gcggggacgcagcaaggctc

SEQ ID NO: 796366 - DNA, 20 bp, mouse
gtgaagggagcgcatgtgct

SEQ ID NO: 796367 - DNA, 20 bp, mouse
gcgtgcacgtgcacattgca

SEQ ID NO: 796368 - DNA, 20 bp, mouse
gcctctgaagaaagccagaa

SEQ ID NO: 796369 - DNA, 20 bp, mouse
ggattggtgacaacatccag

SEQ ID NO: 796370 - DNA, 20 bp, mouse
gaagccagaatggatttgaa

SEQ ID NO: 796371 - DNA, 20 bp, mouse
gatccccgagaggtgaggtg

SEQ ID NO: 796372 - DNA, 20 bp, mouse
ggccgtcagaccctacatca

SEQ ID NO: 796373 - DNA, 20 bp, mouse
gcagatgtcccctggaggga

SEQ ID NO: 796374 - DNA, 20 bp, mouse
gtaccagcatgtagggggat

SEQ ID NO: 796375 - DNA, 20 bp, mouse
gacctcttggatgcccccaa

SEQ ID NO: 796376 - DNA, 20 bp, mouse
gcaagcagggagtcctcaga

SEQ ID NO: 796377 - DNA, 20 bp, mouse
gcggacaggcaaggagaccg

SEQ ID NO: 796378 - DNA, 20 bp, mouse
gccgcggccggggtcgtgtc

SEQ ID NO: 796379 - DNA, 20 bp, mouse
gcaggcaaggagaccgcggc

SEQ ID NO: 796380 - DNA, 20 bp, mouse
gtccgcgcgcctccggtcgc

SEQ ID NO: 796381 - DNA, 20 bp, mouse
gaacaaggctagcaattcct

SEQ ID NO: 796382 - DNA, 20 bp, mouse
gtgcgcccatgtaacgccgg

SEQ ID NO: 796383 - DNA, 20 bp, mouse
gcggattcctgacacgaccc

SEQ ID NO: 796384 - DNA, 20 bp, mouse
gtacatgggcgcagacatct

SEQ ID NO: 796385 - DNA, 20 bp, mouse
gggtgcgacggtggagagaa

SEQ ID NO: 796386 - DNA, 20 bp, mouse
gcgcgccggagcacccgcat

SEQ ID NO: 796387 - DNA, 20 bp, mouse
gcatgggtgcggacaggaga

SEQ ID NO: 796388 - DNA, 20 bp, mouse
gcgccctagcggtgaagaga

SEQ ID NO: 796389 - DNA, 20 bp, mouse
gcacccgcatgggtgcggac

SEQ ID NO: 796390 - DNA, 20 bp, mouse
gcggagcacccgcatgggtg

SEQ ID NO: 796391 - DNA, 20 bp, mouse
gtgctccgtggacgccctag

SEQ ID NO: 796392 - DNA, 20 bp, mouse
ggagcagccctcgtccggcc

SEQ ID NO: 796393 - DNA, 20 bp, mouse
gccggacgagggctgctccg

SEQ ID NO: 796394 - DNA, 20 bp, mouse
ggaagagaaggcctacgcgc

SEQ ID NO: 796395 - DNA, 20 bp, mouse
gccccggccgcgccatgtga

SEQ ID NO: 796396 - DNA, 20 bp, mouse
gcggaggtctggctcgccgg

SEQ ID NO: 796397 - DNA, 20 bp, mouse
ggcggagcgcccaccagcac

SEQ ID NO: 796398 - DNA, 20 bp, mouse
gccgaggcggggccgactcc

SEQ ID NO: 796399 - DNA, 20 bp, mouse
gcccccgtatcctacggaag

SEQ ID NO: 796400 - DNA, 20 bp, mouse
gcccaccagcaccgggaccc

SEQ ID NO: 796401 - DNA, 20 bp, mouse
gcgagccagacctccgagct

SEQ ID NO: 796402 - DNA, 20 bp, mouse
gagtcggccccgcctcgggg

SEQ ID NO: 796403 - DNA, 20 bp, mouse
gtggcagctcacacgctcgc

SEQ ID NO: 796404 - DNA, 20 bp, mouse
gaagaggctccgccccgagg

SEQ ID NO: 796405 - DNA, 20 bp, mouse
gccctcaacgacctcgagtg

SEQ ID NO: 796406 - DNA, 20 bp, mouse
gaggcggggcctacattctg

SEQ ID NO: 796407 - DNA, 20 bp, mouse
ggggcgggaacaatgttcgg

SEQ ID NO: 796408 - DNA, 20 bp, mouse
gctggggcgggaacaatgtt

SEQ ID NO: 796409 - DNA, 20 bp, mouse
gcaggggcggagcagactta

SEQ ID NO: 796410 - DNA, 20 bp, mouse
gagaacgaagagtagtgcct

SEQ ID NO: 796411 - DNA, 20 bp, mouse
gggggccaggagcacagggg

SEQ ID NO: 796412 - DNA, 20 bp, mouse
ggaggggggtcaaattacga

SEQ ID NO: 796413 - DNA, 20 bp, mouse
gccccagcactggtcattcc

SEQ ID NO: 796414 - DNA, 20 bp, mouse
gggaagattagcggattcgg

SEQ ID NO: 796415 - DNA, 20 bp, mouse
gctagtgcctagggcgggac

SEQ ID NO: 796416 - DNA, 20 bp, mouse
gaagcccgatgacctgtctc

SEQ ID NO: 796417 - DNA, 20 bp, mouse
gcatagctgtcaccgttcta

SEQ ID NO: 796418 - DNA, 20 bp, mouse
gatcccagagacaggtcatc

SEQ ID NO: 796419 - DNA, 20 bp, mouse
gaggaatctcaagatttcag

SEQ ID NO: 796420 - DNA, 20 bp, mouse
gtgcagttggagatcgacac

SEQ ID NO: 796421 - DNA, 20 bp, mouse
gatggcactgggccttagaa

SEQ ID NO: 796422 - DNA, 20 bp, mouse
gggtgtggcgtcagttgcta

SEQ ID NO: 796423 - DNA, 20 bp, mouse
gacgcccatgcgaatttgaa

SEQ ID NO: 796424 - DNA, 20 bp, mouse
gcagccattcaaattcgcat

SEQ ID NO: 796425 - DNA, 20 bp, mouse
gcggtgacagctatgggatc

SEQ ID NO: 796426 - DNA, 20 bp, mouse
gttcccgcgcaacgcctcct

SEQ ID NO: 796427 - DNA, 20 bp, mouse
gagacaggggtcagacattc

SEQ ID NO: 796428 - DNA, 20 bp, mouse
gccacctagcagctagacag

SEQ ID NO: 796429 - DNA, 20 bp, mouse
gaaccacctgaaagcagtct

SEQ ID NO: 796430 - DNA, 20 bp, mouse
gactcccaggaggcgttgcg

SEQ ID NO: 796431 - DNA, 20 bp, mouse
gggtgatgacgcagaaattc

SEQ ID NO: 796432 - DNA, 20 bp, mouse
ggctgctggcgccccaggga

SEQ ID NO: 796433 - DNA, 20 bp, mouse
gttccggaactactactccc

SEQ ID NO: 796434 - DNA, 20 bp, mouse
gcacgctgttactatggcat

SEQ ID NO: 796435 - DNA, 20 bp, mouse
ggttactatggcatcggcgg

SEQ ID NO: 796436 - DNA, 20 bp, mouse
ggctctaacccaaacgcata

SEQ ID NO: 796437 - DNA, 20 bp, mouse
gaggggacgctcaggctctt

SEQ ID NO: 796438 - DNA, 20 bp, mouse
gtctcctcccggcctcacga

SEQ ID NO: 796439 - DNA, 20 bp, mouse
gagggaagccctatgcgttt

SEQ ID NO: 796440 - DNA, 20 bp, mouse
gactaagcaattattctctt

SEQ ID NO: 796441 - DNA, 20 bp, mouse
gtgcttagttgcttctttga

SEQ ID NO: 796442 - DNA, 20 bp, mouse
gcggaattagcgccatcgtg

SEQ ID NO: 796443 - DNA, 20 bp, mouse
gggaaaatagagacccaaaa

SEQ ID NO: 796444 - DNA, 20 bp, mouse
gaagaaggggaacctctctc

SEQ ID NO: 796445 - DNA, 20 bp, mouse
ggagttacacaagtcaaaag

SEQ ID NO: 796446 - DNA, 20 bp, mouse
ggcggggccggcaaatggag

SEQ ID NO: 796447 - DNA, 20 bp, mouse
gtgagcgctttcacagctga

SEQ ID NO: 796448 - DNA, 20 bp, mouse
gagcccctgtcgcgtcgcgt

SEQ ID NO: 796449 - DNA, 20 bp, mouse
gcccccacgcgacgcgacag

SEQ ID NO: 796450 - DNA, 20 bp, mouse
gggccggcaaatggagaggg

SEQ ID NO: 796451 - DNA, 20 bp, mouse
gtggacgatacaggagatag

SEQ ID NO: 796452 - DNA, 20 bp, mouse
ggacacggttatgattgagc

SEQ ID NO: 796453 - DNA, 20 bp, mouse
ggcaaatggagagggcggga

SEQ ID NO: 796454 - DNA, 20 bp, mouse
gtcgcgtcgcgtggggggcg

SEQ ID NO: 796455 - DNA, 20 bp, mouse
gccaggaggtcccgcggcgt

SEQ ID NO: 796456 - DNA, 20 bp, mouse
gtgtcccgcagtgataatgg

SEQ ID NO: 796457 - DNA, 20 bp, mouse
gggccagtgcgtggtgggaa

SEQ ID NO: 796458 - DNA, 20 bp, mouse
gaatgggggtggagcgaaag

SEQ ID NO: 796459 - DNA, 20 bp, mouse
gttgacctagcgtatgaggt

SEQ ID NO: 796460 - DNA, 20 bp, mouse
gcgctgtcccgcagtgataa

SEQ ID NO: 796461 - DNA, 20 bp, mouse
gtccacccccattatcactg

SEQ ID NO: 796462 - DNA, 20 bp, mouse
gcagggacgacaacttgccc

SEQ ID NO: 796463 - DNA, 20 bp, mouse
gacgacaacttgcccgggat

SEQ ID NO: 796464 - DNA, 20 bp, mouse
ggtcctcctagctttatcat

SEQ ID NO: 796465 - DNA, 20 bp, mouse
ggagaggcggggccagtgcg

SEQ ID NO: 796466 - DNA, 20 bp, mouse
gtaggtggtagagagactct

SEQ ID NO: 796467 - DNA, 20 bp, mouse
gcaagggcagcatttacaaa

SEQ ID NO: 796468 - DNA, 20 bp, mouse
ggatttctgagaaacaggaa

SEQ ID NO: 796469 - DNA, 20 bp, mouse
gaaccactcaggacgacata

SEQ ID NO: 796470 - DNA, 20 bp, mouse
gactggctccgtcatcctga

SEQ ID NO: 796471 - DNA, 20 bp, mouse
gaatcttgcgtgtgcaccca

SEQ ID NO: 796472 - DNA, 20 bp, mouse
gacacacctgtgaaccactc

SEQ ID NO: 796473 - DNA, 20 bp, mouse
gataaaagaaattaatccaa

SEQ ID NO: 796474 - DNA, 20 bp, mouse
ggtcgtcctgagtggttcac

SEQ ID NO: 796475 - DNA, 20 bp, mouse
ggacacacctgtgaaccatc

SEQ ID NO: 796476 - DNA, 20 bp, mouse
gccacccgggaggagacggt

SEQ ID NO: 796477 - DNA, 20 bp, mouse
ggacaaagtctgagccaccc

SEQ ID NO: 796478 - DNA, 20 bp, mouse
ggcgactgcggagatgcgaa

SEQ ID NO: 796479 - DNA, 20 bp, mouse
gagccccgcgaacagtccca

SEQ ID NO: 796480 - DNA, 20 bp, mouse
gtgacaccgccccatgtcta

SEQ ID NO: 796481 - DNA, 20 bp, mouse
gtgagccacccgggaggaga

SEQ ID NO: 796482 - DNA, 20 bp, mouse
gcgccccatgtctacggaga

SEQ ID NO: 796483 - DNA, 20 bp, mouse
gcatctccgcagtcgccccg

SEQ ID NO: 796484 - DNA, 20 bp, mouse
ggctccttggggcgcagatg

SEQ ID NO: 796485 - DNA, 20 bp, mouse
ggtggggcacaccagccccg

SEQ ID NO: 796486 - DNA, 20 bp, mouse
gctactgagcccaacattat

SEQ ID NO: 796487 - DNA, 20 bp, mouse
gagccctggctttgaggtgg

SEQ ID NO: 796488 - DNA, 20 bp, mouse
gtgccaccacctcaaagcca

SEQ ID NO: 796489 - DNA, 20 bp, mouse
gaagtggcctcaggatggac

SEQ ID NO: 796490 - DNA, 20 bp, mouse
gtggacggggtgacatggga

SEQ ID NO: 796491 - DNA, 20 bp, mouse
ggctaattcagactgggctt

SEQ ID NO: 796492 - DNA, 20 bp, mouse
ggacagacggccatcccctc

SEQ ID NO: 796493 - DNA, 20 bp, mouse
ggggatggccgtctgtctcc

SEQ ID NO: 796494 - DNA, 20 bp, mouse
ggacagatgcgacagagccc

SEQ ID NO: 796495 - DNA, 20 bp, mouse
gaggatggacggggtgacat

SEQ ID NO: 796496 - DNA, 20 bp, mouse
gcgggcccgcgctctcaacg

SEQ ID NO: 796497 - DNA, 20 bp, mouse
gaggcgggcgggaagtgcgc

SEQ ID NO: 796498 - DNA, 20 bp, mouse
gcacccacacccacccgcta

SEQ ID NO: 796499 - DNA, 20 bp, mouse
gcaccctagcgggtgggtgt

SEQ ID NO: 796500 - DNA, 20 bp, mouse
gtctcaacgcggtcgatccc

SEQ ID NO: 796501 - DNA, 20 bp, mouse
ggttacgctcgtccttcttc

SEQ ID NO: 796502 - DNA, 20 bp, mouse
gaagcgtggagacgatgctc

SEQ ID NO: 796503 - DNA, 20 bp, mouse
ggagagcgcgggcccgcccc

SEQ ID NO: 796504 - DNA, 20 bp, mouse
gacgagcgtaacgtctgctg

SEQ ID NO: 796505 - DNA, 20 bp, mouse
gcgccttcccaggcctgggg

SEQ ID NO: 796506 - DNA, 20 bp, mouse
gcaggcgcgctgaggatttg

SEQ ID NO: 796507 - DNA, 20 bp, mouse
gcggaagttgcaggtatttg

SEQ ID NO: 796508 - DNA, 20 bp, mouse
ggctgccgacgtcacctgat

SEQ ID NO: 796509 - DNA, 20 bp, mouse
ggtcacctgatgggagacgc

SEQ ID NO: 796510 - DNA, 20 bp, mouse
gcgcgcctgcgtctcccatc

SEQ ID NO: 796511 - DNA, 20 bp, mouse
ggcggcgccccgcctactcc

SEQ ID NO: 796512 - DNA, 20 bp, mouse
ggtctcccatcaggtgacgt

SEQ ID NO: 796513 - DNA, 20 bp, mouse
gtcactgcagaactgtcttg

SEQ ID NO: 796514 - DNA, 20 bp, mouse
gcccgcctactccgggaacg

SEQ ID NO: 796515 - DNA, 20 bp, mouse
ggcaaaagctcggaagttgc

SEQ ID NO: 796516 - DNA, 20 bp, mouse
gagggtggcaagtccctgag

SEQ ID NO: 796517 - DNA, 20 bp, mouse
ggagctccggtccgctacgg

SEQ ID NO: 796518 - DNA, 20 bp, mouse
gaacccggcatcgcgttccg

SEQ ID NO: 796519 - DNA, 20 bp, mouse
gacacccgagtgtccgtgaa

SEQ ID NO: 796520 - DNA, 20 bp, mouse
gcactcaaaggaacgatcgc

SEQ ID NO: 796521 - DNA, 20 bp, mouse
gccgctacgggggccgagaa

SEQ ID NO: 796522 - DNA, 20 bp, mouse
gtgagtgcgcatttgcacat

SEQ ID NO: 796523 - DNA, 20 bp, mouse
gttggctgtggtggaagtag

SEQ ID NO: 796524 - DNA, 20 bp, mouse
gccatggcgggcgatctgga

SEQ ID NO: 796525 - DNA, 20 bp, mouse
gagatcgcccgccatggcta

SEQ ID NO: 796526 - DNA, 20 bp, mouse
gcctgggccttgacggatgt

SEQ ID NO: 796527 - DNA, 20 bp, mouse
gcatggccccatctgagcat

SEQ ID NO: 796528 - DNA, 20 bp, mouse
gtcatggcccacatccgtca

SEQ ID NO: 796529 - DNA, 20 bp, mouse
gatgtgggccatgagtcatt

SEQ ID NO: 796530 - DNA, 20 bp, mouse
ggaaactaatgccataagag

SEQ ID NO: 796531 - DNA, 20 bp, mouse
gcaaatgtagccttggactc

SEQ ID NO: 796532 - DNA, 20 bp, mouse
gacgatctcacacacttaag

SEQ ID NO: 796533 - DNA, 20 bp, mouse
gttaagtaggaggtgcccag

SEQ ID NO: 796534 - DNA, 20 bp, mouse
ggttctacctatgctcagat

SEQ ID NO: 796535 - DNA, 20 bp, mouse
ggtctaagcctaatgactca

SEQ ID NO: 796536 - DNA, 20 bp, mouse
gagcccgagttcctaaggat

SEQ ID NO: 796537 - DNA, 20 bp, mouse
ggtgacagcccgagttccta

SEQ ID NO: 796538 - DNA, 20 bp, mouse
gtgtcactcgtgctccctcc

SEQ ID NO: 796539 - DNA, 20 bp, mouse
gatagccctccttccgcaaa

SEQ ID NO: 796540 - DNA, 20 bp, mouse
gagactggttgctacggggt

SEQ ID NO: 796541 - DNA, 20 bp, mouse
gttcctatccttaggaactc

SEQ ID NO: 796542 - DNA, 20 bp, mouse
gtcttcttcccaagggaata

SEQ ID NO: 796543 - DNA, 20 bp, mouse
gaagaagactggttgctacg

SEQ ID NO: 796544 - DNA, 20 bp, mouse
gggaaaagacttgacatcac

SEQ ID NO: 796545 - DNA, 20 bp, mouse
gccgtgggaagcgttatgaa

SEQ ID NO: 796546 - DNA, 20 bp, mouse
gcggagcccggtgacagttg

SEQ ID NO: 796547 - DNA, 20 bp, mouse
gcaggggcgtcgcgagaagg

SEQ ID NO: 796548 - DNA, 20 bp, mouse
ggaaaagtggccgccgccag

SEQ ID NO: 796549 - DNA, 20 bp, mouse
ggagaaggcggggccccgtg

SEQ ID NO: 796550 - DNA, 20 bp, mouse
gcgccaggggcgtcgcgaga

SEQ ID NO: 796551 - DNA, 20 bp, mouse
gtggcactcggtggggctct

SEQ ID NO: 796552 - DNA, 20 bp, mouse
gctggagcccgtggtgtcgc

SEQ ID NO: 796553 - DNA, 20 bp, mouse
gtcaccgggctccgctgcgt

SEQ ID NO: 796554 - DNA, 20 bp, mouse
ggccgcgcgcacctgcgagt

SEQ ID NO: 796555 - DNA, 20 bp, mouse
ggctccgcctggcactcggt

SEQ ID NO: 796556 - DNA, 20 bp, mouse
gtccttgcaccttccactgt

SEQ ID NO: 796557 - DNA, 20 bp, mouse
gtgggtaatgcgattggttt

SEQ ID NO: 796558 - DNA, 20 bp, mouse
gcttatgtgcagaaatgcta

SEQ ID NO: 796559 - DNA, 20 bp, mouse
gcagaagggtatttcctaga

SEQ ID NO: 796560 - DNA, 20 bp, mouse
gagtagaagtcacctaacct

SEQ ID NO: 796561 - DNA, 20 bp, mouse
gatgctatgggtaatgcgat

SEQ ID NO: 796562 - DNA, 20 bp, mouse
gtcggatcccagaaccacaa

SEQ ID NO: 796563 - DNA, 20 bp, mouse
gtacagtaaccagcgtggga

SEQ ID NO: 796564 - DNA, 20 bp, mouse
ggcaatacagtaaccagcgt

SEQ ID NO: 796565 - DNA, 20 bp, mouse
gaaaaaaaaagttgacttag

SEQ ID NO: 796566 - DNA, 20 bp, mouse
ggtgaacaacccagttctgt

SEQ ID NO: 796567 - DNA, 20 bp, mouse
gaactgggttgttcacctgc

SEQ ID NO: 796568 - DNA, 20 bp, mouse
ggataaacatcactgtgaaa

SEQ ID NO: 796569 - DNA, 20 bp, mouse
gaaagtgcgagttttccatg

SEQ ID NO: 796570 - DNA, 20 bp, mouse
gcaggctaacattgcgtgct

SEQ ID NO: 796571 - DNA, 20 bp, mouse
gtcacagtcaggataccagc

SEQ ID NO: 796572 - DNA, 20 bp, mouse
ggactgtgattccttgaagt

SEQ ID NO: 796573 - DNA, 20 bp, mouse
gagagctcctgggatcgcag

SEQ ID NO: 796574 - DNA, 20 bp, mouse
ggtagcaggcagggtcacca

SEQ ID NO: 796575 - DNA, 20 bp, mouse
gatatgctgcgtagcaggca

SEQ ID NO: 796576 - DNA, 20 bp, mouse
gggtgaatcccttccttctt

SEQ ID NO: 796577 - DNA, 20 bp, mouse
ggaaggaagggattcaccta

SEQ ID NO: 796578 - DNA, 20 bp, mouse
gacagcaagcccaagaagga

SEQ ID NO: 796579 - DNA, 20 bp, mouse
ggaagcatccaccacaacag

SEQ ID NO: 796580 - DNA, 20 bp, mouse
gcctgagcacagaaactgga

SEQ ID NO: 796581 - DNA, 20 bp, mouse
gaggaaacagtcccctgttg

SEQ ID NO: 796582 - DNA, 20 bp, mouse
gaaacagtcccctgttgtgg

SEQ ID NO: 796583 - DNA, 20 bp, mouse
gggctctgaagaccgttcag

SEQ ID NO: 796584 - DNA, 20 bp, mouse
ggagtgtcctaagcaacatg

SEQ ID NO: 796585 - DNA, 20 bp, mouse
gagtcagctcagttgaagtg

SEQ ID NO: 796586 - DNA, 20 bp, mouse
gtgggaggtccagtgaatcc

SEQ ID NO: 796587 - DNA, 20 bp, mouse
gagtgttgcaaggatgacaa

SEQ ID NO: 796588 - DNA, 20 bp, mouse
gattctgcagtcaatctggg

SEQ ID NO: 796589 - DNA, 20 bp, mouse
ggagggaggcagaatcaagc

SEQ ID NO: 796590 - DNA, 20 bp, mouse
gggtgtggctggaaagttgt

SEQ ID NO: 796591 - DNA, 20 bp, mouse
gtgggattctgcagtcaatc

SEQ ID NO: 796592 - DNA, 20 bp, mouse
ggggagggaccaataatcag

SEQ ID NO: 796593 - DNA, 20 bp, mouse
ggctggaaagttgtaggtga

SEQ ID NO: 796594 - DNA, 20 bp, mouse
gcacacaaagcaacattcag

SEQ ID NO: 796595 - DNA, 20 bp, mouse
ggtcataccttgagaaggtg

SEQ ID NO: 796596 - DNA, 20 bp, mouse
ggggcgccggggtcaaggaa

SEQ ID NO: 796597 - DNA, 20 bp, mouse
gtacagcattggcggggagt

SEQ ID NO: 796598 - DNA, 20 bp, mouse
gtaaggtccaagttggttct

SEQ ID NO: 796599 - DNA, 20 bp, mouse
gaatcatgggagaaccttat

SEQ ID NO: 796600 - DNA, 20 bp, mouse
gtctctgggcgccggggtca

SEQ ID NO: 796601 - DNA, 20 bp, mouse
gggagaaccttatagggcag

SEQ ID NO: 796602 - DNA, 20 bp, mouse
gcccaagccaagaaccaact

SEQ ID NO: 796603 - DNA, 20 bp, mouse
gggcccagggatagcacgag

SEQ ID NO: 796604 - DNA, 20 bp, mouse
gggtttgaggtgttcgttta

SEQ ID NO: 796605 - DNA, 20 bp, mouse
gctggtctgggcttcgtaag

SEQ ID NO: 796606 - DNA, 20 bp, mouse
gtgagggaatcgggacgggg

SEQ ID NO: 796607 - DNA, 20 bp, mouse
gtcagggcgcggggcctagt

SEQ ID NO: 796608 - DNA, 20 bp, mouse
gggcagcccgaccgggccga

SEQ ID NO: 796609 - DNA, 20 bp, mouse
gagcaggaagggcggggtgt

SEQ ID NO: 796610 - DNA, 20 bp, mouse
gagggtctgaggctgctcta

SEQ ID NO: 796611 - DNA, 20 bp, mouse
gccagcaggccagcggggag

SEQ ID NO: 796612 - DNA, 20 bp, mouse
gcgaaagtgcgcatgcgttc

SEQ ID NO: 796613 - DNA, 20 bp, mouse
gccccctagcggattggcta

SEQ ID NO: 796614 - DNA, 20 bp, mouse
gcggccttagccaatccgct

SEQ ID NO: 796615 - DNA, 20 bp, mouse
gggggtgagggaatcgggac

SEQ ID NO: 796616 - DNA, 20 bp, mouse
ggccgcgggcgcgctcccta

SEQ ID NO: 796617 - DNA, 20 bp, mouse
ggggcgagggcgcgagagaa

SEQ ID NO: 796618 - DNA, 20 bp, mouse
gtcaagccgctcacccaatc

SEQ ID NO: 796619 - DNA, 20 bp, mouse
gtgagagggcacggggaaaa

SEQ ID NO: 796620 - DNA, 20 bp, mouse
gaggcgggccgcaggggcga

SEQ ID NO: 796621 - DNA, 20 bp, mouse
ggcgcgcgggcgggcaagta

SEQ ID NO: 796622 - DNA, 20 bp, mouse
gcacccaatcaggaggccgt

SEQ ID NO: 796623 - DNA, 20 bp, mouse
gcgagcgagctctacgtcga

SEQ ID NO: 796624 - DNA, 20 bp, mouse
gaaaccccgcgctaggacac

SEQ ID NO: 796625 - DNA, 20 bp, mouse
ggggcaagtagggcacgcgg

SEQ ID NO: 796626 - DNA, 20 bp, mouse
gtaggcagggtggaatgcgc

SEQ ID NO: 796627 - DNA, 20 bp, mouse
gccaaagccgggtgagaatg

SEQ ID NO: 796628 - DNA, 20 bp, mouse
gcccgcccataagctaggca

SEQ ID NO: 796629 - DNA, 20 bp, mouse
gtggacaccacattctcacc

SEQ ID NO: 796630 - DNA, 20 bp, mouse
gggcaccccgcccataagct

SEQ ID NO: 796631 - DNA, 20 bp, mouse
gccctcgcagaaagtacttc

SEQ ID NO: 796632 - DNA, 20 bp, mouse
gttctcacccggctttggga

SEQ ID NO: 796633 - DNA, 20 bp, mouse
gaccctgcctagcttatggg

SEQ ID NO: 796634 - DNA, 20 bp, mouse
gcggggctcgtcaccgggtc

SEQ ID NO: 796635 - DNA, 20 bp, mouse
gggaagtgacgcatacaggg

SEQ ID NO: 796636 - DNA, 20 bp, mouse
gagaccgagggctagaaggg

SEQ ID NO: 796637 - DNA, 20 bp, mouse
ggggagaccgagggctagaa

SEQ ID NO: 796638 - DNA, 20 bp, mouse
gtctcccggagaaaggcgga

SEQ ID NO: 796639 - DNA, 20 bp, mouse
gggctagaagggtggatccc

SEQ ID NO: 796640 - DNA, 20 bp, mouse
gccagcgaacctgtagggga

SEQ ID NO: 796641 - DNA, 20 bp, mouse
ggcacctggacaagccaatc

SEQ ID NO: 796642 - DNA, 20 bp, mouse
gccttccagcgaacctgtag

SEQ ID NO: 796643 - DNA, 20 bp, mouse
gaggctgagaaaccgagctc

SEQ ID NO: 796644 - DNA, 20 bp, mouse
gtcggtctcccggagaaagg

SEQ ID NO: 796645 - DNA, 20 bp, mouse
ggagaaaggcggaaggaatg

SEQ ID NO: 796646 - DNA, 20 bp, mouse
gggagaaggcggggacctaa

SEQ ID NO: 796647 - DNA, 20 bp, mouse
gggggacctaaaggtcacgt

SEQ ID NO: 796648 - DNA, 20 bp, mouse
gggggcgggcctcgcggaga

SEQ ID NO: 796649 - DNA, 20 bp, mouse
gcgcgcgccacctgccctgg

SEQ ID NO: 796650 - DNA, 20 bp, mouse
gcgggcgcagggggcgtggt

SEQ ID NO: 796651 - DNA, 20 bp, mouse
ggggcctcgcggagaaggcg

SEQ ID NO: 796652 - DNA, 20 bp, mouse
gtccgcgaggcccgccccca

SEQ ID NO: 796653 - DNA, 20 bp, mouse
gacctaaaggtcacgtgggc

SEQ ID NO: 796654 - DNA, 20 bp, mouse
gatacggactcagacaactg

SEQ ID NO: 796655 - DNA, 20 bp, mouse
gactgtgtcggggaagcgga

SEQ ID NO: 796656 - DNA, 20 bp, mouse
ggggaactgtgagcccgcag

SEQ ID NO: 796657 - DNA, 20 bp, mouse
gagcccgcagaggccgacaa

SEQ ID NO: 796658 - DNA, 20 bp, mouse
ggaggccgacaaggggttct

SEQ ID NO: 796659 - DNA, 20 bp, mouse
ggatgcgcgcgctggacggt

SEQ ID NO: 796660 - DNA, 20 bp, mouse
gaaccccttgtcggcctctg

SEQ ID NO: 796661 - DNA, 20 bp, mouse
gaccgcgcgccccgtcgtca

SEQ ID NO: 796662 - DNA, 20 bp, mouse
ggccgacaaggggttctggg

SEQ ID NO: 796663 - DNA, 20 bp, mouse
gcaatagcgggcggtgtata

SEQ ID NO: 796664 - DNA, 20 bp, mouse
gccagcccgctgcaaccgac

SEQ ID NO: 796665 - DNA, 20 bp, mouse
gccaacctgtcggttgcagc

SEQ ID NO: 796666 - DNA, 20 bp, mouse
gcccactcgcgcaaatcgta

SEQ ID NO: 796667 - DNA, 20 bp, mouse
gggggcgtgatcaggttaca

SEQ ID NO: 796668 - DNA, 20 bp, mouse
ggggcacagcttaggggcga

SEQ ID NO: 796669 - DNA, 20 bp, mouse
gtcgaagagggcacagctta

SEQ ID NO: 796670 - DNA, 20 bp, mouse
gcgtacggaaaactcgaatt

SEQ ID NO: 796671 - DNA, 20 bp, mouse
gtaacctgatcacgccccca

SEQ ID NO: 796672 - DNA, 20 bp, mouse
ggagtgaagtgttctgtcgc

SEQ ID NO: 796673 - DNA, 20 bp, mouse
gggaagaggcgcccgagaat

SEQ ID NO: 796674 - DNA, 20 bp, mouse
gcccccatggattgctataa

SEQ ID NO: 796675 - DNA, 20 bp, mouse
gataaaggtgagttcgaaga

SEQ ID NO: 796676 - DNA, 20 bp, mouse
gggcgcgcggcagacacgag

SEQ ID NO: 796677 - DNA, 20 bp, mouse
gagacctgagctggagttgg

SEQ ID NO: 796678 - DNA, 20 bp, mouse
gccagcgctgacaaaggacg

SEQ ID NO: 796679 - DNA, 20 bp, mouse
gggtgcacactggctagccg

SEQ ID NO: 796680 - DNA, 20 bp, mouse
gtcaggggtctccgcttcca

SEQ ID NO: 796681 - DNA, 20 bp, mouse
gaaagcagcaatcgaatact

SEQ ID NO: 796682 - DNA, 20 bp, mouse
gcgctgacaaaggacgcggc

SEQ ID NO: 796683 - DNA, 20 bp, mouse
gggctagccgcggggtgcac

SEQ ID NO: 796684 - DNA, 20 bp, mouse
ggggtggttggaactcagcg

SEQ ID NO: 796685 - DNA, 20 bp, mouse
gactccagctcaggtctagg

SEQ ID NO: 796686 - DNA, 20 bp, mouse
gaggccgcgcccttctgcac

SEQ ID NO: 796687 - DNA, 20 bp, mouse
ggcggcctctgcaaagatgt

SEQ ID NO: 796688 - DNA, 20 bp, mouse
gcggcctctgcgtgtgttgg

SEQ ID NO: 796689 - DNA, 20 bp, mouse
gcactggcccagcccctctg

SEQ ID NO: 796690 - DNA, 20 bp, mouse
ggcctctgcaaagatgtggg

SEQ ID NO: 796691 - DNA, 20 bp, mouse
gagcttgaggttcccccaga

SEQ ID NO: 796692 - DNA, 20 bp, mouse
gctcccgctgctcttctaaa

SEQ ID NO: 796693 - DNA, 20 bp, mouse
gtaggcggggcgtgacgtcg

SEQ ID NO: 796694 - DNA, 20 bp, mouse
gtgctcttctaaaaggtgac

SEQ ID NO: 796695 - DNA, 20 bp, mouse
ggggcggccggccgcccggg

SEQ ID NO: 796696 - DNA, 20 bp, mouse
gaaagtgcgccgagtgggga

SEQ ID NO: 796697 - DNA, 20 bp, mouse
ggggagggccgagggaacag

SEQ ID NO: 796698 - DNA, 20 bp, mouse
ggagcccgccccctgtcggt

SEQ ID NO: 796699 - DNA, 20 bp, mouse
gagtgaaagtgcgccgagtg

SEQ ID NO: 796700 - DNA, 20 bp, mouse
gcggccctgccagggtacgt

SEQ ID NO: 796701 - DNA, 20 bp, mouse
gccgtgcgctccgctccgtg

SEQ ID NO: 796702 - DNA, 20 bp, mouse
gcggtcctccgaccgacagg

SEQ ID NO: 796703 - DNA, 20 bp, mouse
gcccgccccctgtcggtcgg

SEQ ID NO: 796704 - DNA, 20 bp, mouse
gaattctggaagatgatcac

SEQ ID NO: 796705 - DNA, 20 bp, mouse
gactggagcccgccccctgt

SEQ ID NO: 796706 - DNA, 20 bp, mouse
gctccactggcgaagagggg

SEQ ID NO: 796707 - DNA, 20 bp, mouse
gaggggtggagccgagagca

SEQ ID NO: 796708 - DNA, 20 bp, mouse
ggagagggaggaaaacttcc

SEQ ID NO: 796709 - DNA, 20 bp, mouse
gcctctccactggcgaagag

SEQ ID NO: 796710 - DNA, 20 bp, mouse
gaaactggccctccgaggct

SEQ ID NO: 796711 - DNA, 20 bp, mouse
ggctgcctccccagcctcgg

SEQ ID NO: 796712 - DNA, 20 bp, mouse
gtagggaaactggccctccg

SEQ ID NO: 796713 - DNA, 20 bp, mouse
gactggtaggcgggatccga

SEQ ID NO: 796714 - DNA, 20 bp, mouse
gtcaaagagattaggggaag

SEQ ID NO: 796715 - DNA, 20 bp, mouse
gcccggggcctgggcggaga

SEQ ID NO: 796716 - DNA, 20 bp, mouse
ggaggggcgaactgacgaag

SEQ ID NO: 796717 - DNA, 20 bp, mouse
gagcggagcccggaagaggg

SEQ ID NO: 796718 - DNA, 20 bp, mouse
gggccggaccacaaaagaag

SEQ ID NO: 796719 - DNA, 20 bp, mouse
ggaggcgggtctactccgga

SEQ ID NO: 796720 - DNA, 20 bp, mouse
gacgaaggggcgtggccgtc

SEQ ID NO: 796721 - DNA, 20 bp, mouse
gtggtcctcacgcctgaagg

SEQ ID NO: 796722 - DNA, 20 bp, mouse
gaggatgcgcgcgcagccag

SEQ ID NO: 796723 - DNA, 20 bp, mouse
ggaggccctggcaggtaggc

SEQ ID NO: 796724 - DNA, 20 bp, mouse
gggccgaggcgggtctactc

SEQ ID NO: 796725 - DNA, 20 bp, mouse
ggctccctcaggatcttcct

SEQ ID NO: 796726 - DNA, 20 bp, mouse
gaagtcaaggttggggatct

SEQ ID NO: 796727 - DNA, 20 bp, mouse
gacccgggcagggttcggaa

SEQ ID NO: 796728 - DNA, 20 bp, mouse
gcggcggtgcaggggacggg

SEQ ID NO: 796729 - DNA, 20 bp, mouse
gccgcctctcagatcgtcgg

SEQ ID NO: 796730 - DNA, 20 bp, mouse
gtgaaggggcaacctaggta

SEQ ID NO: 796731 - DNA, 20 bp, mouse
gggaccgggaagtcaaggtt

SEQ ID NO: 796732 - DNA, 20 bp, mouse
gcagcggcggtgcaggggac

SEQ ID NO: 796733 - DNA, 20 bp, mouse
ggggtgcccggacccgggca

SEQ ID NO: 796734 - DNA, 20 bp, mouse
gttggggatctgggctgggt

SEQ ID NO: 796735 - DNA, 20 bp, mouse
ggccgctgaaggggcaacct

SEQ ID NO: 796736 - DNA, 20 bp, mouse
gctggaaagggctgaaattc

SEQ ID NO: 796737 - DNA, 20 bp, mouse
gcggggccagagcctgggat

SEQ ID NO: 796738 - DNA, 20 bp, mouse
gctggcatgcggcctcaaac

SEQ ID NO: 796739 - DNA, 20 bp, mouse
gggccccggccctgcccatc

SEQ ID NO: 796740 - DNA, 20 bp, mouse
gttgaggccgcatgccagat

SEQ ID NO: 796741 - DNA, 20 bp, mouse
ggccctgcccatctggcatg

SEQ ID NO: 796742 - DNA, 20 bp, mouse
ggggctggaggatccccaga

SEQ ID NO: 796743 - DNA, 20 bp, mouse
ggccccctcccccacttaaa

SEQ ID NO: 796744 - DNA, 20 bp, mouse
ggccgcatgccagatgggca

SEQ ID NO: 796745 - DNA, 20 bp, mouse
gtcagggctgcagctcggtg

SEQ ID NO: 796746 - DNA, 20 bp, mouse
gggtgtgcgcaggggcagat

SEQ ID NO: 796747 - DNA, 20 bp, mouse
gtggctcctggtgtgcgcag

SEQ ID NO: 796748 - DNA, 20 bp, mouse
gctagcgcctggaaggccgt

SEQ ID NO: 796749 - DNA, 20 bp, mouse
gacggaagcgggaggagtta

SEQ ID NO: 796750 - DNA, 20 bp, mouse
gagggaggcggtggtcacag

SEQ ID NO: 796751 - DNA, 20 bp, mouse
ggctgcccaaacatcctgta

SEQ ID NO: 796752 - DNA, 20 bp, mouse
gaagcgggaggagttacggc

SEQ ID NO: 796753 - DNA, 20 bp, mouse
gtctgcgtctgcgtactccc

SEQ ID NO: 796754 - DNA, 20 bp, mouse
gtcaaggctactgttgtggt

SEQ ID NO: 796755 - DNA, 20 bp, mouse
ggaaaaacgcctgcgctcca

SEQ ID NO: 796756 - DNA, 20 bp, mouse
ggagcctgaagccccaggtg

SEQ ID NO: 796757 - DNA, 20 bp, mouse
gcgggtgtctgttgagtgaa

SEQ ID NO: 796758 - DNA, 20 bp, mouse
gcccctggagtcaagttcgg

SEQ ID NO: 796759 - DNA, 20 bp, mouse
gccaaacaagcggatcagga

SEQ ID NO: 796760 - DNA, 20 bp, mouse
gctcctgatctgatgaacac

SEQ ID NO: 796761 - DNA, 20 bp, mouse
gcaggaaggatgttcgatga

SEQ ID NO: 796762 - DNA, 20 bp, mouse
ggaaagctagctgtctgcgc

SEQ ID NO: 796763 - DNA, 20 bp, mouse
gtccaccgaacttgactcca

SEQ ID NO: 796764 - DNA, 20 bp, mouse
gcccaggtgaggtgctggcc

SEQ ID NO: 796765 - DNA, 20 bp, mouse
gctgcgctgggccctgtacc

SEQ ID NO: 796766 - DNA, 20 bp, mouse
ggctgcgcaggcgcaactca

SEQ ID NO: 796767 - DNA, 20 bp, mouse
gggcgcgggcggggcctcta

SEQ ID NO: 796768 - DNA, 20 bp, mouse
gacccgcgaacggccttctg

SEQ ID NO: 796769 - DNA, 20 bp, mouse
gaccccagaaggccgttcgc

SEQ ID NO: 796770 - DNA, 20 bp, mouse
ggtggcttctggagagtgca

SEQ ID NO: 796771 - DNA, 20 bp, mouse
gcgaaccgagagggtaaaag

SEQ ID NO: 796772 - DNA, 20 bp, mouse
gcggcgcaacccgagtcgga

SEQ ID NO: 796773 - DNA, 20 bp, mouse
gcgcaactcagggaacagag

SEQ ID NO: 796774 - DNA, 20 bp, mouse
gtccagaagccacccgcgaa

SEQ ID NO: 796775 - DNA, 20 bp, mouse
ggtggcaagtcgaatatcca

SEQ ID NO: 796776 - DNA, 20 bp, mouse
ggtgatggggagtgtggaag

SEQ ID NO: 796777 - DNA, 20 bp, mouse
gggaacgaggcaggggtgat

SEQ ID NO: 796778 - DNA, 20 bp, mouse
gcgtggggctgagatttagc

SEQ ID NO: 796779 - DNA, 20 bp, mouse
gatagggagtaataggaacg

SEQ ID NO: 796780 - DNA, 20 bp, mouse
gggagtaataggaacgaggc

SEQ ID NO: 796781 - DNA, 20 bp, mouse
ggacgcaggacggtccttga

SEQ ID NO: 796782 - DNA, 20 bp, mouse
gaatttggggaaggagagat

SEQ ID NO: 796783 - DNA, 20 bp, mouse
ggggcacccacgtggtcgca

SEQ ID NO: 796784 - DNA, 20 bp, mouse
gctggagaagggcttggaga

SEQ ID NO: 796785 - DNA, 20 bp, mouse
gtggcggccgggcacccacg

SEQ ID NO: 796786 - DNA, 20 bp, mouse
gcatcccgggaatcctgcgg

SEQ ID NO: 796787 - DNA, 20 bp, mouse
gcaccgcggtcacgtgacga

SEQ ID NO: 796788 - DNA, 20 bp, mouse
gcccagagaaagagactcaa

SEQ ID NO: 796789 - DNA, 20 bp, mouse
gggaaggagacgccattaga

SEQ ID NO: 796790 - DNA, 20 bp, mouse
gcagcatcccgggaatcctg

SEQ ID NO: 796791 - DNA, 20 bp, mouse
gtctctgggcgcacaaatcc

SEQ ID NO: 796792 - DNA, 20 bp, mouse
ggtgacgaggggtgtgacgt

SEQ ID NO: 796793 - DNA, 20 bp, mouse
gccgaggaatggtcccaaag

SEQ ID NO: 796794 - DNA, 20 bp, mouse
gttcccaccgcaggattccc

SEQ ID NO: 796795 - DNA, 20 bp, mouse
gacgaggggtgtgacgtagg

SEQ ID NO: 796796 - DNA, 20 bp, mouse
gggagggtggggcgacgctg

SEQ ID NO: 796797 - DNA, 20 bp, mouse
gccactccttagagaagatg

SEQ ID NO: 796798 - DNA, 20 bp, mouse
gtgggcggagcaccaatggg

SEQ ID NO: 796799 - DNA, 20 bp, mouse
ggggtgggcggagcaccaat

SEQ ID NO: 796800 - DNA, 20 bp, mouse
gagaaggtggctgccgaagt

SEQ ID NO: 796801 - DNA, 20 bp, mouse
gtgggcggagcgcgagggat

SEQ ID NO: 796802 - DNA, 20 bp, mouse
gcggccggctcgcagctcac

SEQ ID NO: 796803 - DNA, 20 bp, mouse
gtccacccgtcccaagatgg

SEQ ID NO: 796804 - DNA, 20 bp, mouse
gtcgcagctcacaggcgggt

SEQ ID NO: 796805 - DNA, 20 bp, mouse
gagggatgggcgtggcctct

SEQ ID NO: 796806 - DNA, 20 bp, mouse
gcatcaggccttggtaccca

SEQ ID NO: 796807 - DNA, 20 bp, mouse
gcacagggtcaggtatccgg

SEQ ID NO: 796808 - DNA, 20 bp, mouse
gggatgtgctaacctactga

SEQ ID NO: 796809 - DNA, 20 bp, mouse
ggcgctggcagggaaggcgc

SEQ ID NO: 796810 - DNA, 20 bp, mouse
ggaccctgtgtagggaaaca

SEQ ID NO: 796811 - DNA, 20 bp, mouse
gaacaaggcacaccttcagt

SEQ ID NO: 796812 - DNA, 20 bp, mouse
gggatacctgaccctgtgta

SEQ ID NO: 796813 - DNA, 20 bp, mouse
gactcccgcccgccgcgctg

SEQ ID NO: 796814 - DNA, 20 bp, mouse
gtgctcaccttggtctcctt

SEQ ID NO: 796815 - DNA, 20 bp, mouse
gtcaccacctgagactcacg

SEQ ID NO: 796816 - DNA, 20 bp, mouse
gccaacgccacgtacctata

SEQ ID NO: 796817 - DNA, 20 bp, mouse
gctcgcagctcaatctccgc

SEQ ID NO: 796818 - DNA, 20 bp, mouse
ggtgacgcgggcgccggaag

SEQ ID NO: 796819 - DNA, 20 bp, mouse
gggcgccggatgcataggat

SEQ ID NO: 796820 - DNA, 20 bp, mouse
ggaccgggcgtcccgcctct

SEQ ID NO: 796821 - DNA, 20 bp, mouse
gacggtacccgaatccctat

SEQ ID NO: 796822 - DNA, 20 bp, mouse
gggctaggcgcacgcccgcc

SEQ ID NO: 796823 - DNA, 20 bp, mouse
gggactggaagccaagaggc

SEQ ID NO: 796824 - DNA, 20 bp, mouse
gactggacagagtccgatgt

SEQ ID NO: 796825 - DNA, 20 bp, mouse
ggcgcccgcgtcacgtgacc

SEQ ID NO: 796826 - DNA, 20 bp, mouse
gcacactcccccaaataaga

SEQ ID NO: 796827 - DNA, 20 bp, mouse
gtggtcacagaggtaacagt

SEQ ID NO: 796828 - DNA, 20 bp, mouse
gggctgaagtagacacgggg

SEQ ID NO: 796829 - DNA, 20 bp, mouse
gaccaggccctcttatttgg

SEQ ID NO: 796830 - DNA, 20 bp, mouse
ggtgaccaggccctcttatt

SEQ ID NO: 796831 - DNA, 20 bp, mouse
gaacccagcaatgtacactc

SEQ ID NO: 796832 - DNA, 20 bp, mouse
ggggtggggcagaaacgtac

SEQ ID NO: 796833 - DNA, 20 bp, mouse
gagcccgagtgtacattgct

SEQ ID NO: 796834 - DNA, 20 bp, mouse
gccggggggcatcaggggaa

SEQ ID NO: 796835 - DNA, 20 bp, mouse
ggacgtcagacaggttaaac

SEQ ID NO: 796836 - DNA, 20 bp, mouse
gctcctgggatgcacaccta

SEQ ID NO: 796837 - DNA, 20 bp, mouse
gtcagagcgaccattggcag

SEQ ID NO: 796838 - DNA, 20 bp, mouse
gcaagtgcactgtgctcaaa

SEQ ID NO: 796839 - DNA, 20 bp, mouse
gtggggcaaagagaggacac

SEQ ID NO: 796840 - DNA, 20 bp, mouse
gagtctgtcgctccaggggc

SEQ ID NO: 796841 - DNA, 20 bp, mouse
ggaggtcccaagaaggcctt

SEQ ID NO: 796842 - DNA, 20 bp, mouse
gcgaccattggcagtggtgg

SEQ ID NO: 796843 - DNA, 20 bp, mouse
gtgcacttggagcatgctcc

SEQ ID NO: 796844 - DNA, 20 bp, mouse
ggccaatggtcgctctgagg

SEQ ID NO: 796845 - DNA, 20 bp, mouse
gccccagtcttcaatgtccc

SEQ ID NO: 796846 - DNA, 20 bp, mouse
ggcctcgcctggcacggatc

SEQ ID NO: 796847 - DNA, 20 bp, mouse
gcctgcgggcaggtgacagg

SEQ ID NO: 796848 - DNA, 20 bp, mouse
gaggcgagcagtcgtttctg

SEQ ID NO: 796849 - DNA, 20 bp, mouse
gaggagacccgatccgtgcc

SEQ ID NO: 796850 - DNA, 20 bp, mouse
gcaaggaaaaccaccctctg

SEQ ID NO: 796851 - DNA, 20 bp, mouse
gcccaccgcgctctcctcta

SEQ ID NO: 796852 - DNA, 20 bp, mouse
gcctctacgggaagtgatgt

SEQ ID NO: 796853 - DNA, 20 bp, mouse
gacccgatccgtgccaggcg

SEQ ID NO: 796854 - DNA, 20 bp, mouse
gctcgccttacccggatcct

SEQ ID NO: 796855 - DNA, 20 bp, mouse
gagcgccaagcacccaaaaa

SEQ ID NO: 796856 - DNA, 20 bp, mouse
ggagtgcatgccctggtggc

SEQ ID NO: 796857 - DNA, 20 bp, mouse
gaagaacccggggcagtgtg

SEQ ID NO: 796858 - DNA, 20 bp, mouse
gggtggattctccacgctga

SEQ ID NO: 796859 - DNA, 20 bp, mouse
gtggctggagtccgcctagg

SEQ ID NO: 796860 - DNA, 20 bp, mouse
gctgcaataagaatcacact

SEQ ID NO: 796861 - DNA, 20 bp, mouse
gggcatgcactccctcagcg

SEQ ID NO: 796862 - DNA, 20 bp, mouse
ggcaagctgtgtataagagc

SEQ ID NO: 796863 - DNA, 20 bp, mouse
gcaccagccagactggctcg

SEQ ID NO: 796864 - DNA, 20 bp, mouse
gggctcacctcgagccagtc

SEQ ID NO: 796865 - DNA, 20 bp, mouse
gttcctgatcccagccgcct

SEQ ID NO: 796866 - DNA, 20 bp, mouse
gcaactgtgggcattgttta

SEQ ID NO: 796867 - DNA, 20 bp, mouse
gccacagcaacagtggacta

SEQ ID NO: 796868 - DNA, 20 bp, mouse
gccagcagacagtgtctggg

SEQ ID NO: 796869 - DNA, 20 bp, mouse
gaatctgctgtgtctgccag

SEQ ID NO: 796870 - DNA, 20 bp, mouse
ggccaggggctgccattgag

SEQ ID NO: 796871 - DNA, 20 bp, mouse
gcagcaacagtggactaagg

SEQ ID NO: 796872 - DNA, 20 bp, mouse
gagtggactaaggaggttta

SEQ ID NO: 796873 - DNA, 20 bp, mouse
gctgccattgagaggtttta

SEQ ID NO: 796874 - DNA, 20 bp, mouse
gcctgtcagaaggactgagc

SEQ ID NO: 796875 - DNA, 20 bp, mouse
gacctctcaatggcagcccc

SEQ ID NO: 796876 - DNA, 20 bp, mouse
ggcgtcccggtttgctcgtg

SEQ ID NO: 796877 - DNA, 20 bp, mouse
gccaaccatcacactgcaat

SEQ ID NO: 796878 - DNA, 20 bp, mouse
gtgcccccgaggtggaggac

SEQ ID NO: 796879 - DNA, 20 bp, mouse
gttagagaagagtagctctc

SEQ ID NO: 796880 - DNA, 20 bp, mouse
gtaggggcggggctttccgg

SEQ ID NO: 796881 - DNA, 20 bp, mouse
gaaggtgagcacccaccagg

SEQ ID NO: 796882 - DNA, 20 bp, mouse
gggagtacgtagacgcagac

SEQ ID NO: 796883 - DNA, 20 bp, mouse
gagacgcagaccgggcgtcc

SEQ ID NO: 796884 - DNA, 20 bp, mouse
gggccggcgggctgcacgag

SEQ ID NO: 796885 - DNA, 20 bp, mouse
ggtttgctcgtggggaacat

SEQ ID NO: 796886 - DNA, 20 bp, mouse
gcgcggccgcgccctccggt

SEQ ID NO: 796887 - DNA, 20 bp, mouse
gagccccgcctaccaggccg

SEQ ID NO: 796888 - DNA, 20 bp, mouse
gggcggcgactgaacctagc

SEQ ID NO: 796889 - DNA, 20 bp, mouse
gaggcgggactccgaccgga

SEQ ID NO: 796890 - DNA, 20 bp, mouse
ggggtaggcgggactccgac

SEQ ID NO: 796891 - DNA, 20 bp, mouse
gcaggcggcggcagcacttc

SEQ ID NO: 796892 - DNA, 20 bp, mouse
gcgagccccggcctggtagg

SEQ ID NO: 796893 - DNA, 20 bp, mouse
gtcggggagtcgcgaggaaa

SEQ ID NO: 796894 - DNA, 20 bp, mouse
gccccgagccccggcctggt

SEQ ID NO: 796895 - DNA, 20 bp, mouse
gcggggctcggggagtcgcg

SEQ ID NO: 796896 - DNA, 20 bp, mouse
ggggcagctgggatcgagac

SEQ ID NO: 796897 - DNA, 20 bp, mouse
ggtaccggacgccgcctcta

SEQ ID NO: 796898 - DNA, 20 bp, mouse
gctggagcttggtgggataa

SEQ ID NO: 796899 - DNA, 20 bp, mouse
gcactgggtggccctagagg

SEQ ID NO: 796900 - DNA, 20 bp, mouse
gtggccctagaggcggcgtc

SEQ ID NO: 796901 - DNA, 20 bp, mouse
gatggcatgtagaagagcac

SEQ ID NO: 796902 - DNA, 20 bp, mouse
ggagcactgggtggccctag

SEQ ID NO: 796903 - DNA, 20 bp, mouse
gctcccccagaaatcttcgc

SEQ ID NO: 796904 - DNA, 20 bp, mouse
gccgatccagcgaagatttc

SEQ ID NO: 796905 - DNA, 20 bp, mouse
gcctgactcggtccaatcat

SEQ ID NO: 796906 - DNA, 20 bp, mouse
gaagtccgggagcgacgtag

SEQ ID NO: 796907 - DNA, 20 bp, mouse
gcgtcgctcccggacttcaa

SEQ ID NO: 796908 - DNA, 20 bp, mouse
gggctcgtggagccgaaagg

SEQ ID NO: 796909 - DNA, 20 bp, mouse
gtcggctcgccgcagctcca

SEQ ID NO: 796910 - DNA, 20 bp, mouse
gcggcgagccgaggtttcga

SEQ ID NO: 796911 - DNA, 20 bp, mouse
gctctggagcatggctattg

SEQ ID NO: 796912 - DNA, 20 bp, mouse
ggtagcctctacgtcgctcc

SEQ ID NO: 796913 - DNA, 20 bp, mouse
gctccagggctccaacatgg

SEQ ID NO: 796914 - DNA, 20 bp, mouse
ggcccagagaagaactggac

SEQ ID NO: 796915 - DNA, 20 bp, mouse
gatcccagagtgcacagctc

SEQ ID NO: 796916 - DNA, 20 bp, mouse
gtcagagctgatcacggaag

SEQ ID NO: 796917 - DNA, 20 bp, mouse
gcccgggccccggtccgctt

SEQ ID NO: 796918 - DNA, 20 bp, mouse
gtgcccacaagtcagatgtt

SEQ ID NO: 796919 - DNA, 20 bp, mouse
ggcgacgggtcgtgtgtcca

SEQ ID NO: 796920 - DNA, 20 bp, mouse
gagcacgtgaccgacagcgg

SEQ ID NO: 796921 - DNA, 20 bp, mouse
gctagactagacgtgacggg

SEQ ID NO: 796922 - DNA, 20 bp, mouse
ggggcaagtggtgcccgacc

SEQ ID NO: 796923 - DNA, 20 bp, mouse
gaggctagactagacgtgac

SEQ ID NO: 796924 - DNA, 20 bp, mouse
gtcagatgttgggtggtcac

SEQ ID NO: 796925 - DNA, 20 bp, mouse
gtagcctggccgccgggctt

SEQ ID NO: 796926 - DNA, 20 bp, mouse
gccctgctggccttagacaa

SEQ ID NO: 796927 - DNA, 20 bp, mouse
ggggcgctgtggaccgctca

SEQ ID NO: 796928 - DNA, 20 bp, mouse
gtccaggctccccttgtcta

SEQ ID NO: 796929 - DNA, 20 bp, mouse
ggagcctggaggtcagtgcc

SEQ ID NO: 796930 - DNA, 20 bp, mouse
ggtcaagtaaccaggggtag

SEQ ID NO: 796931 - DNA, 20 bp, mouse
gcccggcacttcctcttccc

SEQ ID NO: 796932 - DNA, 20 bp, mouse
gaccaggctcgccctgtgca

SEQ ID NO: 796933 - DNA, 20 bp, mouse
gcagaacttgcaaaggacta

SEQ ID NO: 796934 - DNA, 20 bp, mouse
ggtcatctgaccactacccc

SEQ ID NO: 796935 - DNA, 20 bp, mouse
ggccttagacaaggggagcc

SEQ ID NO: 796936 - DNA, 20 bp, mouse
gtgggcagtgagcacagctg

SEQ ID NO: 796937 - DNA, 20 bp, mouse
gggcagaaggagacctctca

SEQ ID NO: 796938 - DNA, 20 bp, mouse
ggaaaggaggaggggtgcct

SEQ ID NO: 796939 - DNA, 20 bp, mouse
gaaggggagggtctaagcaa

SEQ ID NO: 796940 - DNA, 20 bp, mouse
gtctgccggtgtgtgagctc

SEQ ID NO: 796941 - DNA, 20 bp, mouse
ggaccccagggacacactgg

SEQ ID NO: 796942 - DNA, 20 bp, mouse
gcaccctcctttcagctcaa

SEQ ID NO: 796943 - DNA, 20 bp, mouse
gagaaagcctaagcacaaca

SEQ ID NO: 796944 - DNA, 20 bp, mouse
gaaggagggtgcactaggaa

SEQ ID NO: 796945 - DNA, 20 bp, mouse
gtgcctttgagctgaaagga

SEQ ID NO: 796946 - DNA, 20 bp, mouse
ggcgctccctggctggactg

SEQ ID NO: 796947 - DNA, 20 bp, mouse
gcggtcagaaggctggagcg

SEQ ID NO: 796948 - DNA, 20 bp, mouse
ggagcggggcggaacggcgt

SEQ ID NO: 796949 - DNA, 20 bp, mouse
gagcgccgacgcatctttcc

SEQ ID NO: 796950 - DNA, 20 bp, mouse
gcggcacatagaggtccctc

SEQ ID NO: 796951 - DNA, 20 bp, mouse
gacgtggcgaggcggtcaga

SEQ ID NO: 796952 - DNA, 20 bp, mouse
gaggcctccgccagtcggtg

SEQ ID NO: 796953 - DNA, 20 bp, mouse
gtgtacctggaaagatgcgt

SEQ ID NO: 796954 - DNA, 20 bp, mouse
ggctcagaaggtccgcccga

SEQ ID NO: 796955 - DNA, 20 bp, mouse
gggaagctgcgcagcccccg

SEQ ID NO: 796956 - DNA, 20 bp, mouse
ggggagaagtcaacagatct

SEQ ID NO: 796957 - DNA, 20 bp, mouse
ggagccgccgaggggaaaag

SEQ ID NO: 796958 - DNA, 20 bp, mouse
ggggtgtcaagatctgaacg

SEQ ID NO: 796959 - DNA, 20 bp, mouse
gggtgagagggatctcctaa

SEQ ID NO: 796960 - DNA, 20 bp, mouse
ggagagggatctcctaacgg

SEQ ID NO: 796961 - DNA, 20 bp, mouse
ggccaggcctggagtcgtgg

SEQ ID NO: 796962 - DNA, 20 bp, mouse
gggaagacgcggctccaaca

SEQ ID NO: 796963 - DNA, 20 bp, mouse
gagatccctctcacctccca

SEQ ID NO: 796964 - DNA, 20 bp, mouse
gagagaaggggcccaaggag

SEQ ID NO: 796965 - DNA, 20 bp, mouse
gtcaacagatctgggacgtc

SEQ ID NO: 796966 - DNA, 20 bp, mouse
ggaagcctggaggtcagcgc

SEQ ID NO: 796967 - DNA, 20 bp, mouse
gcgagcgagcgccgtcgctg

SEQ ID NO: 796968 - DNA, 20 bp, mouse
gtgcgcggagagggcgcggc

SEQ ID NO: 796969 - DNA, 20 bp, mouse
gcccgcgcctgcgcagtggc

SEQ ID NO: 796970 - DNA, 20 bp, mouse
gtaaacggttcggttctccc

SEQ ID NO: 796971 - DNA, 20 bp, mouse
ggtagcgcactgcgcgtgcg

SEQ ID NO: 796972 - DNA, 20 bp, mouse
gacggaagagaggtgacaac

SEQ ID NO: 796973 - DNA, 20 bp, mouse
gcctgcgcagtggcggggcg

SEQ ID NO: 796974 - DNA, 20 bp, mouse
gcgccccacggatcccaatc

SEQ ID NO: 796975 - DNA, 20 bp, mouse
gacagctctcggggacgggc

SEQ ID NO: 796976 - DNA, 20 bp, mouse
gcaaagctcgaggtcccggg

SEQ ID NO: 796977 - DNA, 20 bp, mouse
gcaggcggggccagagcgtg

SEQ ID NO: 796978 - DNA, 20 bp, mouse
gctcgtgccagcgttatcgg

SEQ ID NO: 796979 - DNA, 20 bp, mouse
gccgagaaggagttatgata

SEQ ID NO: 796980 - DNA, 20 bp, mouse
gtcccgaatcccgacgtcgg

SEQ ID NO: 796981 - DNA, 20 bp, mouse
ggtgcaaagctcgaggtccc

SEQ ID NO: 796982 - DNA, 20 bp, mouse
gagagcgtgcggttggctca

SEQ ID NO: 796983 - DNA, 20 bp, mouse
gcgggaggctctcgttgcta

SEQ ID NO: 796984 - DNA, 20 bp, mouse
gaaagcgtagatgagcaggc

SEQ ID NO: 796985 - DNA, 20 bp, mouse
gtatggtgatgactccgcga

SEQ ID NO: 796986 - DNA, 20 bp, mouse
gtcctggctggcgtcgtcga

SEQ ID NO: 796987 - DNA, 20 bp, mouse
gacggagggaggagtctatc

SEQ ID NO: 796988 - DNA, 20 bp, mouse
gtcgcagaatgcacacccta

SEQ ID NO: 796989 - DNA, 20 bp, mouse
gggcgtcgtcgaggggatgg

SEQ ID NO: 796990 - DNA, 20 bp, mouse
gctgcgagtctcagacgtcc

SEQ ID NO: 796991 - DNA, 20 bp, mouse
gtaggctaatgtctctcagg

SEQ ID NO: 796992 - DNA, 20 bp, mouse
gtgagtgtcggtgaaaaagt

SEQ ID NO: 796993 - DNA, 20 bp, mouse
ggctgtaagagcactaaact

SEQ ID NO: 796994 - DNA, 20 bp, mouse
gtcaccactgcgaccttaat

SEQ ID NO: 796995 - DNA, 20 bp, mouse
gtccgagccggttggtggat

SEQ ID NO: 796996 - DNA, 20 bp, mouse
gggagacaagagcaactcct

SEQ ID NO: 796997 - DNA, 20 bp, mouse
gtggagtccgcagagtagga

SEQ ID NO: 796998 - DNA, 20 bp, mouse
gactctgcggactccagagt

SEQ ID NO: 796999 - DNA, 20 bp, mouse
gctgcggactccagagtggg

SEQ ID NO: 797000 - DNA, 20 bp, mouse
gagtccgcagagtaggaagg

SEQ ID NO: 797001 - DNA, 20 bp, mouse
gttctctccccggcagaacg

SEQ ID NO: 797002 - DNA, 20 bp, mouse
gcaggcaaaaggagattaaa

SEQ ID NO: 797003 - DNA, 20 bp, mouse
gaaaatacccaggtcttctg

SEQ ID NO: 797004 - DNA, 20 bp, mouse
ggtgcaaataccagcttgac

SEQ ID NO: 797005 - DNA, 20 bp, mouse
gtcctgggactggaagctaa

SEQ ID NO: 797006 - DNA, 20 bp, mouse
gggccgggccccagctgtaa

SEQ ID NO: 797007 - DNA, 20 bp, mouse
gaggggcgcggcgagagcgt

SEQ ID NO: 797008 - DNA, 20 bp, mouse
gttggaagggaccgtaggta

SEQ ID NO: 797009 - DNA, 20 bp, mouse
gagcgtcggctgaggggata

SEQ ID NO: 797010 - DNA, 20 bp, mouse
gggcggggcctctaactaga

SEQ ID NO: 797011 - DNA, 20 bp, mouse
ggggccccagctgtaagggg

SEQ ID NO: 797012 - DNA, 20 bp, mouse
ggccgcgcccctctagttag

SEQ ID NO: 797013 - DNA, 20 bp, mouse
ggagggcggggccacgagtt

SEQ ID NO: 797014 - DNA, 20 bp, mouse
gggaactgacgttgtagagg

SEQ ID NO: 797015 - DNA, 20 bp, mouse
gtaggggtgtgatcgtgagt

SEQ ID NO: 797016 - DNA, 20 bp, mouse
gagaggagcgcacacaaaaa

SEQ ID NO: 797017 - DNA, 20 bp, mouse
gagcgcacacaaaaacggac

SEQ ID NO: 797018 - DNA, 20 bp, mouse
gtcaccacactgtctgttag

SEQ ID NO: 797019 - DNA, 20 bp, mouse
gagtgatgagtcagagtgcg

SEQ ID NO: 797020 - DNA, 20 bp, mouse
gatattaataggagagtggt

SEQ ID NO: 797021 - DNA, 20 bp, mouse
gtataaccagtggtgtgcaa

SEQ ID NO: 797022 - DNA, 20 bp, mouse
gattagatttgcaattgtaa

SEQ ID NO: 797023 - DNA, 20 bp, mouse
ggtcgaataattgtcttctc

SEQ ID NO: 797024 - DNA, 20 bp, mouse
gttttatattaataggagag

SEQ ID NO: 797025 - DNA, 20 bp, mouse
ggtaattctctgcgtagacg

SEQ ID NO: 797026 - DNA, 20 bp, mouse
gaagctgtgacgttagggga

SEQ ID NO: 797027 - DNA, 20 bp, mouse
gggcctgcgccggcagaaga

SEQ ID NO: 797028 - DNA, 20 bp, mouse
ggacagccgcgggaccacac

SEQ ID NO: 797029 - DNA, 20 bp, mouse
ggcagggcctggtaagccac

SEQ ID NO: 797030 - DNA, 20 bp, mouse
gcgccggcagaagaggggca

SEQ ID NO: 797031 - DNA, 20 bp, mouse
gggctgatgctctcgagcga

SEQ ID NO: 797032 - DNA, 20 bp, mouse
gtgactgctaggtgtttgaa

SEQ ID NO: 797033 - DNA, 20 bp, mouse
gggaccacactggcctgcgc

SEQ ID NO: 797034 - DNA, 20 bp, mouse
gggtaagccactggaagacg

SEQ ID NO: 797035 - DNA, 20 bp, mouse
ggctcgagagcatcagccaa

SEQ ID NO: 797036 - DNA, 20 bp, mouse
gtttcctgacccactgtccc

SEQ ID NO: 797037 - DNA, 20 bp, mouse
gaaaacgggaagctcatact

SEQ ID NO: 797038 - DNA, 20 bp, mouse
gggcccggggacagtgggtc

SEQ ID NO: 797039 - DNA, 20 bp, mouse
gactatgctagaagatgagt

SEQ ID NO: 797040 - DNA, 20 bp, mouse
gggaagctgaggctagccat

SEQ ID NO: 797041 - DNA, 20 bp, mouse
gtttgaggcccggggacagt

SEQ ID NO: 797042 - DNA, 20 bp, mouse
gaagatgagtggggatgctc

SEQ ID NO: 797043 - DNA, 20 bp, mouse
gcggctggcgctgggattta

SEQ ID NO: 797044 - DNA, 20 bp, mouse
gagcagacagtgacccaaat

SEQ ID NO: 797045 - DNA, 20 bp, mouse
gggccttgcagtgacccatt

SEQ ID NO: 797046 - DNA, 20 bp, mouse
gggtgcaaactatagaatgt

SEQ ID NO: 797047 - DNA, 20 bp, mouse
gtgaggctctggctgaagat

SEQ ID NO: 797048 - DNA, 20 bp, mouse
gccgccccgcccctgcgttc

SEQ ID NO: 797049 - DNA, 20 bp, mouse
gggcggggcggatcttacat

SEQ ID NO: 797050 - DNA, 20 bp, mouse
gagcccagaacgcaggggcg

SEQ ID NO: 797051 - DNA, 20 bp, mouse
gcccagatatatagggtgta

SEQ ID NO: 797052 - DNA, 20 bp, mouse
ggggtccaagccccgcccct

SEQ ID NO: 797053 - DNA, 20 bp, mouse
gacaccagcccagaacgcag

SEQ ID NO: 797054 - DNA, 20 bp, mouse
gggcggggcttggacccagc

SEQ ID NO: 797055 - DNA, 20 bp, mouse
gagacctctgagcaccctgt

SEQ ID NO: 797056 - DNA, 20 bp, mouse
gggcgcccctggcacttctt

SEQ ID NO: 797057 - DNA, 20 bp, mouse
gacccagaaagatttccctc

SEQ ID NO: 797058 - DNA, 20 bp, mouse
gagcccgagggaaatctttc

SEQ ID NO: 797059 - DNA, 20 bp, mouse
gcgtgcggggaaaacggcag

SEQ ID NO: 797060 - DNA, 20 bp, mouse
gcccctccagctgcactggg

SEQ ID NO: 797061 - DNA, 20 bp, mouse
ggggaggggccgcttggcac

SEQ ID NO: 797062 - DNA, 20 bp, mouse
gagaggacttgtctcagcga

SEQ ID NO: 797063 - DNA, 20 bp, mouse
gtcagcagaaaggatgttct

SEQ ID NO: 797064 - DNA, 20 bp, mouse
ggcgaaagagcacaatggaa

SEQ ID NO: 797065 - DNA, 20 bp, mouse
gttcacagacagtcatacaa

SEQ ID NO: 797066 - DNA, 20 bp, mouse
gcactcagctaggacttttg

SEQ ID NO: 797067 - DNA, 20 bp, mouse
ggccaacggagccaggagat

SEQ ID NO: 797068 - DNA, 20 bp, mouse
gctcaagaggcgtcagaggt

SEQ ID NO: 797069 - DNA, 20 bp, mouse
gccacctcaagaggcgtcag

SEQ ID NO: 797070 - DNA, 20 bp, mouse
gacaggccacgcccatctcc

SEQ ID NO: 797071 - DNA, 20 bp, mouse
gcgccgggcgccaactctca

SEQ ID NO: 797072 - DNA, 20 bp, mouse
gagaggggtggtagggatct

SEQ ID NO: 797073 - DNA, 20 bp, mouse
gagcgggtggggcctagaag

SEQ ID NO: 797074 - DNA, 20 bp, mouse
gagccttgcaggcggaggtg

SEQ ID NO: 797075 - DNA, 20 bp, mouse
gtgcaggcggaggtggggtc

SEQ ID NO: 797076 - DNA, 20 bp, mouse
gaagcgggcccgcctacaaa

SEQ ID NO: 797077 - DNA, 20 bp, mouse
gaaagggcctgctggaaggt

SEQ ID NO: 797078 - DNA, 20 bp, mouse
gcggggcctcggtgggtggt

SEQ ID NO: 797079 - DNA, 20 bp, mouse
ggtgggtggggccccgaagc

SEQ ID NO: 797080 - DNA, 20 bp, mouse
gacactaagatctttctgtc

SEQ ID NO: 797081 - DNA, 20 bp, mouse
gaggtcttgtgaaagcgcag

SEQ ID NO: 797082 - DNA, 20 bp, mouse
gccgcctacaaagggcctgc

SEQ ID NO: 797083 - DNA, 20 bp, mouse
gtgtaggcgggcccgcttcg

SEQ ID NO: 797084 - DNA, 20 bp, mouse
gcttccagcaggccctttgt

SEQ ID NO: 797085 - DNA, 20 bp, mouse
gcatacgctcttcttcaagg

SEQ ID NO: 797086 - DNA, 20 bp, mouse
gccgagggagggtgcagctt

SEQ ID NO: 797087 - DNA, 20 bp, mouse
gcgggccgagcgggagccga

SEQ ID NO: 797088 - DNA, 20 bp, mouse
gccgagcgggagccgaggga

SEQ ID NO: 797089 - DNA, 20 bp, mouse
ggtgactcgcggtcttgtgg

SEQ ID NO: 797090 - DNA, 20 bp, mouse
gcctggccgcattctttctt

SEQ ID NO: 797091 - DNA, 20 bp, mouse
gcacgtgactcgcggtcttg

SEQ ID NO: 797092 - DNA, 20 bp, mouse
gagcactcctcgcgagggga

SEQ ID NO: 797093 - DNA, 20 bp, mouse
ggctcgcccaagaaagaatg

SEQ ID NO: 797094 - DNA, 20 bp, mouse
gctgtcagcactcctcgcga

SEQ ID NO: 797095 - DNA, 20 bp, mouse
gtgtggcggagagttagacg

SEQ ID NO: 797096 - DNA, 20 bp, mouse
gagcgggctgcggaagacat

SEQ ID NO: 797097 - DNA, 20 bp, mouse
gcgggcggggcctcccagac

SEQ ID NO: 797098 - DNA, 20 bp, mouse
gaagacatgggcctccttcc

SEQ ID NO: 797099 - DNA, 20 bp, mouse
gttgttgaagctcagggcat

SEQ ID NO: 797100 - DNA, 20 bp, mouse
gtgggctgtgggctatgagc

SEQ ID NO: 797101 - DNA, 20 bp, mouse
gagcccacagcccaggaagg

SEQ ID NO: 797102 - DNA, 20 bp, mouse
gtggagagactgcctatctc

SEQ ID NO: 797103 - DNA, 20 bp, mouse
gctcagggcatcggcatgtg

SEQ ID NO: 797104 - DNA, 20 bp, mouse
gagtcttaggatgaaacact

SEQ ID NO: 797105 - DNA, 20 bp, mouse
gtgagcttcaacaagatcgc

SEQ ID NO: 797106 - DNA, 20 bp, mouse
ggggctagaagtctgaatga

SEQ ID NO: 797107 - DNA, 20 bp, mouse
ggaaaggcggaggccagctc

SEQ ID NO: 797108 - DNA, 20 bp, mouse
gatgacccgccagagtgaac

SEQ ID NO: 797109 - DNA, 20 bp, mouse
ggaaccagtcccgttcactc

SEQ ID NO: 797110 - DNA, 20 bp, mouse
gcccaggcagcaagagggac

SEQ ID NO: 797111 - DNA, 20 bp, mouse
gacagggctgggccggcaaa

SEQ ID NO: 797112 - DNA, 20 bp, mouse
ggggtcacgtgtctgagagg

SEQ ID NO: 797113 - DNA, 20 bp, mouse
gcacccccgagagccattgt

SEQ ID NO: 797114 - DNA, 20 bp, mouse
gctggcgggtcattgtcccc

SEQ ID NO: 797115 - DNA, 20 bp, mouse
gggctgggccggcaaagggg

SEQ ID NO: 797116 - DNA, 20 bp, mouse
gactagaggcgggaccggga

SEQ ID NO: 797117 - DNA, 20 bp, mouse
gcgccccctggcgacaggag

SEQ ID NO: 797118 - DNA, 20 bp, mouse
ggacaggaggggctcggtgc

SEQ ID NO: 797119 - DNA, 20 bp, mouse
gaatccacgcgcggagtcca

SEQ ID NO: 797120 - DNA, 20 bp, mouse
gcgagcccctcctgtcgcca

SEQ ID NO: 797121 - DNA, 20 bp, mouse
gcgcccccgccccgggagag

SEQ ID NO: 797122 - DNA, 20 bp, mouse
gactctggctggaaatcctg

SEQ ID NO: 797123 - DNA, 20 bp, mouse
gccgccccgggagagagggc

SEQ ID NO: 797124 - DNA, 20 bp, mouse
ggagagggcgggactagagg

SEQ ID NO: 797125 - DNA, 20 bp, mouse
gggaggatgtgaactctcct

SEQ ID NO: 797126 - DNA, 20 bp, mouse
ggaggcgtaaagaaatagat

SEQ ID NO: 797127 - DNA, 20 bp, mouse
gtcctcccaggagaggcggt

SEQ ID NO: 797128 - DNA, 20 bp, mouse
gtaagccaatggaggtccga

SEQ ID NO: 797129 - DNA, 20 bp, mouse
ggagccagaagaaaccgaag

SEQ ID NO: 797130 - DNA, 20 bp, mouse
ggaagaatggcatagagagg

SEQ ID NO: 797131 - DNA, 20 bp, mouse
gggcccctcgaacgctccac

SEQ ID NO: 797132 - DNA, 20 bp, mouse
gtcggccttcggacctccat

SEQ ID NO: 797133 - DNA, 20 bp, mouse
gcgaacgctccaccggtcgg

SEQ ID NO: 797134 - DNA, 20 bp, mouse
ggtcaagctcccccgaccgg

SEQ ID NO: 797135 - DNA, 20 bp, mouse
gccacgcccaccgcctctcc

SEQ ID NO: 797136 - DNA, 20 bp, mouse
gcggggcgaccgtgacggcc

SEQ ID NO: 797137 - DNA, 20 bp, mouse
gctgggcggcaccttgtgtg

SEQ ID NO: 797138 - DNA, 20 bp, mouse
gggcagggcggggcgaccgt

SEQ ID NO: 797139 - DNA, 20 bp, mouse
gggagggtggccaatggcgg

SEQ ID NO: 797140 - DNA, 20 bp, mouse
gaccttgtgtggggcgacgt

SEQ ID NO: 797141 - DNA, 20 bp, mouse
ggggctgcgcggtgccgtgc

SEQ ID NO: 797142 - DNA, 20 bp, mouse
gtagcagtggcgagtgggca

SEQ ID NO: 797143 - DNA, 20 bp, mouse
gcaggccaatggcccggaga

SEQ ID NO: 797144 - DNA, 20 bp, mouse
gggcagcgggccagtagcag

SEQ ID NO: 797145 - DNA, 20 bp, mouse
ggccagtagcagtggcgagt

SEQ ID NO: 797146 - DNA, 20 bp, mouse
gaatcccggatgtagttggt

SEQ ID NO: 797147 - DNA, 20 bp, mouse
ggtaccagtaacagactcat

SEQ ID NO: 797148 - DNA, 20 bp, mouse
gcaactggtgaggtagagaa

SEQ ID NO: 797149 - DNA, 20 bp, mouse
gtccaggaagggtcaagatc

SEQ ID NO: 797150 - DNA, 20 bp, mouse
gtgatcctggaaggcaatcc

SEQ ID NO: 797151 - DNA, 20 bp, mouse
gtggagaacttgatcctgga

SEQ ID NO: 797152 - DNA, 20 bp, mouse
gaggcaatcccggatgtagt

SEQ ID NO: 797153 - DNA, 20 bp, mouse
gactggtacagcatccagga

SEQ ID NO: 797154 - DNA, 20 bp, mouse
ggccacacagaaactgtctg

SEQ ID NO: 797155 - DNA, 20 bp, mouse
gtcccccatgagtctgttac

SEQ ID NO: 797156 - DNA, 20 bp, mouse
gggtgctcggagaaggatcg

SEQ ID NO: 797157 - DNA, 20 bp, mouse
ggctaggaggtgttggttat

SEQ ID NO: 797158 - DNA, 20 bp, mouse
ggctcggagaaggatcgggg

SEQ ID NO: 797159 - DNA, 20 bp, mouse
gtgcgggcggtgctcggaga

SEQ ID NO: 797160 - DNA, 20 bp, mouse
gaggtgttggttatgggagg

SEQ ID NO: 797161 - DNA, 20 bp, mouse
ggaccgaagcggagttgaag

SEQ ID NO: 797162 - DNA, 20 bp, mouse
ggggagactgggcggtcctg

SEQ ID NO: 797163 - DNA, 20 bp, mouse
gagaagcttagagggagtgc

SEQ ID NO: 797164 - DNA, 20 bp, mouse
gtggggtggtgttgagagaa

SEQ ID NO: 797165 - DNA, 20 bp, mouse
ggcggtgctggggatcaggg

SEQ ID NO: 797166 - DNA, 20 bp, mouse
gcaggcagacagggaggcac

SEQ ID NO: 797167 - DNA, 20 bp, mouse
gcgggagattagatacaaga

SEQ ID NO: 797168 - DNA, 20 bp, mouse
gatgagcagccgtttgcagg

SEQ ID NO: 797169 - DNA, 20 bp, mouse
ggtggaaccctgtacaaagg

SEQ ID NO: 797170 - DNA, 20 bp, mouse
gccccagttggcaggcaact

SEQ ID NO: 797171 - DNA, 20 bp, mouse
gtccccgcctcactttctca

SEQ ID NO: 797172 - DNA, 20 bp, mouse
gagatacaagagggctagga

SEQ ID NO: 797173 - DNA, 20 bp, mouse
gcagttggcaggcaacttgg

SEQ ID NO: 797174 - DNA, 20 bp, mouse
gggcaacttggagggcttcc

SEQ ID NO: 797175 - DNA, 20 bp, mouse
gtgcaaacggctgctcatct

SEQ ID NO: 797176 - DNA, 20 bp, mouse
gtggacaggaggccgcccga

SEQ ID NO: 797177 - DNA, 20 bp, mouse
ggggcggggtcgcaggagga

SEQ ID NO: 797178 - DNA, 20 bp, mouse
gatgaaggaggggaccagga

SEQ ID NO: 797179 - DNA, 20 bp, mouse
gggaggctcctagttggagg

SEQ ID NO: 797180 - DNA, 20 bp, mouse
ggttggaggctcctagttgg

SEQ ID NO: 797181 - DNA, 20 bp, mouse
gtgggaggatctacgggcgc

SEQ ID NO: 797182 - DNA, 20 bp, mouse
gggctcctagttggaggagg

SEQ ID NO: 797183 - DNA, 20 bp, mouse
gggcaggtcactcttaagaa

SEQ ID NO: 797184 - DNA, 20 bp, mouse
ggcccggcgaaggagcccgg

SEQ ID NO: 797185 - DNA, 20 bp, mouse
gggaggggcggggtcgcagg

SEQ ID NO: 797186 - DNA, 20 bp, mouse
ggagaggggccgagtcaaaa

SEQ ID NO: 797187 - DNA, 20 bp, mouse
gcggattggtggcatgagag

SEQ ID NO: 797188 - DNA, 20 bp, mouse
ggataagcggcgcggattgg

SEQ ID NO: 797189 - DNA, 20 bp, mouse
ggcggcgccgggtccagaag

SEQ ID NO: 797190 - DNA, 20 bp, mouse
gagcgattggtggagcaagt

SEQ ID NO: 797191 - DNA, 20 bp, mouse
ggtgggcgggataagcggcg

SEQ ID NO: 797192 - DNA, 20 bp, mouse
gtgcctacgtataaccaata

SEQ ID NO: 797193 - DNA, 20 bp, mouse
gtatacgtaggcacggggcg

SEQ ID NO: 797194 - DNA, 20 bp, mouse
gcgggataagcggcgcggat

SEQ ID NO: 797195 - DNA, 20 bp, mouse
ggctcgcccaacgcagtgat

SEQ ID NO: 797196 - DNA, 20 bp, mouse
gagccggagcccaaagatgt

SEQ ID NO: 797197 - DNA, 20 bp, mouse
gacatccccgggtgcgctaa

SEQ ID NO: 797198 - DNA, 20 bp, mouse
gccgctgccggcctcctggg

SEQ ID NO: 797199 - DNA, 20 bp, mouse
gatcaaggaggcgttagaga

SEQ ID NO: 797200 - DNA, 20 bp, mouse
ggcgctaagggagaatagtt

SEQ ID NO: 797201 - DNA, 20 bp, mouse
gtctgaggggaggagaccga

SEQ ID NO: 797202 - DNA, 20 bp, mouse
gcggggatgtcacgtgactt

SEQ ID NO: 797203 - DNA, 20 bp, mouse
ggccggcagcggcttcctaa

SEQ ID NO: 797204 - DNA, 20 bp, mouse
ggcagagcaaggaagtgagt

SEQ ID NO: 797205 - DNA, 20 bp, mouse
ggccacccagataacaatgg

SEQ ID NO: 797206 - DNA, 20 bp, mouse
gatcacccgcctaccgtggt

SEQ ID NO: 797207 - DNA, 20 bp, mouse
gcaatcttctggagaaaggc

SEQ ID NO: 797208 - DNA, 20 bp, mouse
gcgtccgcccgccaatcttc

SEQ ID NO: 797209 - DNA, 20 bp, mouse
gcccgcctaccgtggtgggt

SEQ ID NO: 797210 - DNA, 20 bp, mouse
ggcccacccaccacggtagg

SEQ ID NO: 797211 - DNA, 20 bp, mouse
gggggcagtgcatcactgac

SEQ ID NO: 797212 - DNA, 20 bp, mouse
ggactcgtaaacatctaatc

SEQ ID NO: 797213 - DNA, 20 bp, mouse
gtttacgagtcgagaggcgg

SEQ ID NO: 797214 - DNA, 20 bp, mouse
gtggagccgccccggcgagg

SEQ ID NO: 797215 - DNA, 20 bp, mouse
gaggcgggtgatcttgcgat

SEQ ID NO: 797216 - DNA, 20 bp, mouse
gccctcgcggcacttggaac

SEQ ID NO: 797217 - DNA, 20 bp, mouse
gagtgcgcgcgagggatggc

SEQ ID NO: 797218 - DNA, 20 bp, mouse
gggagggagagtgcgcgcga

SEQ ID NO: 797219 - DNA, 20 bp, mouse
gtgaagatccggatccggag

SEQ ID NO: 797220 - DNA, 20 bp, mouse
gcggggcagagctgaagatc

SEQ ID NO: 797221 - DNA, 20 bp, mouse
gacaatcaacgcgggaaagg

SEQ ID NO: 797222 - DNA, 20 bp, mouse
gtcccgcgttgattgtgggt

SEQ ID NO: 797223 - DNA, 20 bp, mouse
gtgccgcgagggaaggcgtg

SEQ ID NO: 797224 - DNA, 20 bp, mouse
gtggcagtgacgcgataagc

SEQ ID NO: 797225 - DNA, 20 bp, mouse
gatcctacccacaatcaacg

SEQ ID NO: 797226 - DNA, 20 bp, mouse
gaatcccggctcctcccgtg

SEQ ID NO: 797227 - DNA, 20 bp, mouse
gcctcccgtgcggtggagaa

SEQ ID NO: 797228 - DNA, 20 bp, mouse
gacgcaaggcgattggagga

SEQ ID NO: 797229 - DNA, 20 bp, mouse
gcgcgcgcgcgactctcgcg

SEQ ID NO: 797230 - DNA, 20 bp, mouse
ggtggagaaaggggccgatc

SEQ ID NO: 797231 - DNA, 20 bp, mouse
gggcaggcagctgctaactg

SEQ ID NO: 797232 - DNA, 20 bp, mouse
ggaaaccaggaaagcactgg

SEQ ID NO: 797233 - DNA, 20 bp, mouse
gaggcagctgctaactgagg

SEQ ID NO: 797234 - DNA, 20 bp, mouse
gcgtcgcgccacacttccta

SEQ ID NO: 797235 - DNA, 20 bp, mouse
gaggaggcgggaccgagttc

SEQ ID NO: 797236 - DNA, 20 bp, mouse
ggggctccgcatgacatcag

SEQ ID NO: 797237 - DNA, 20 bp, mouse
ggagccggctgcccgggtgg

SEQ ID NO: 797238 - DNA, 20 bp, mouse
ggacgcccgaagctcggcgc

SEQ ID NO: 797239 - DNA, 20 bp, mouse
gcaaagagggcacctctctt

SEQ ID NO: 797240 - DNA, 20 bp, mouse
gcctgcggctgcgtgtccga

SEQ ID NO: 797241 - DNA, 20 bp, mouse
gacggcggcgacggcggaaa

SEQ ID NO: 797242 - DNA, 20 bp, mouse
ggatgtcatgcggagcccgt

SEQ ID NO: 797243 - DNA, 20 bp, mouse
gcggagcccgtgggtttgcg

SEQ ID NO: 797244 - DNA, 20 bp, mouse
ggtgcagccaacgccaccca

SEQ ID NO: 797245 - DNA, 20 bp, mouse
ggcgcagccctgggtggcgt

SEQ ID NO: 797246 - DNA, 20 bp, mouse
gggccctagcctggcatctg

SEQ ID NO: 797247 - DNA, 20 bp, mouse
gggaacgtgacgcaaggtgg

SEQ ID NO: 797248 - DNA, 20 bp, mouse
gagctggagcgcaccatatt

SEQ ID NO: 797249 - DNA, 20 bp, mouse
ggcgaccggaacgtgacgca

SEQ ID NO: 797250 - DNA, 20 bp, mouse
ggcccgacgccagggttgga

SEQ ID NO: 797251 - DNA, 20 bp, mouse
gtcacgagacgcccgacgcc

SEQ ID NO: 797252 - DNA, 20 bp, mouse
gtctgcacagccttcaaaga

SEQ ID NO: 797253 - DNA, 20 bp, mouse
gagccccagatgccaggcta

SEQ ID NO: 797254 - DNA, 20 bp, mouse
gttgaaggctgtgcagaagc

SEQ ID NO: 797255 - DNA, 20 bp, mouse
gacgtgacgcaaggtggagg

SEQ ID NO: 797256 - DNA, 20 bp, mouse
ggcaggacggggaccggaca

SEQ ID NO: 797257 - DNA, 20 bp, mouse
ggcaagtcgccacactggtc

SEQ ID NO: 797258 - DNA, 20 bp, mouse
ggacttgccacgtacactct

SEQ ID NO: 797259 - DNA, 20 bp, mouse
ggggctcacaacgtttttga

SEQ ID NO: 797260 - DNA, 20 bp, mouse
ggaagacgatggatgaacta

SEQ ID NO: 797261 - DNA, 20 bp, mouse
ggaagtgcgccgccagtggc

SEQ ID NO: 797262 - DNA, 20 bp, mouse
ggagaggaagtggtggggtt

SEQ ID NO: 797263 - DNA, 20 bp, mouse
gcgccgccagtggcaggacg

SEQ ID NO: 797264 - DNA, 20 bp, mouse
gggaaggtgccaatcgcgga

SEQ ID NO: 797265 - DNA, 20 bp, mouse
gtgtgtgtgcggtccgagaa

SEQ ID NO: 797266 - DNA, 20 bp, mouse
ggcagggcctggacgctgaa

SEQ ID NO: 797267 - DNA, 20 bp, mouse
gggctccgggtggcgggcgt

SEQ ID NO: 797268 - DNA, 20 bp, mouse
ggggctctctgcgacaggcg

SEQ ID NO: 797269 - DNA, 20 bp, mouse
gcgtaggcctggatgatgcg

SEQ ID NO: 797270 - DNA, 20 bp, mouse
gtgcccgccgcgcatcatcc

SEQ ID NO: 797271 - DNA, 20 bp, mouse
gaaccaatgggctgtgcagt

SEQ ID NO: 797272 - DNA, 20 bp, mouse
gcaggcctacgcccgccacc

SEQ ID NO: 797273 - DNA, 20 bp, mouse
gaaggcgcgcacgggaaggc

SEQ ID NO: 797274 - DNA, 20 bp, mouse
gcagcccattggttgacgct

SEQ ID NO: 797275 - DNA, 20 bp, mouse
gcccctgggctctctgcgac

SEQ ID NO: 797276 - DNA, 20 bp, mouse
gggggcggagggtgatgaca

SEQ ID NO: 797277 - DNA, 20 bp, mouse
ggagggtgatgacaaggcgc

SEQ ID NO: 797278 - DNA, 20 bp, mouse
ggggcagattggctgggacg

SEQ ID NO: 797279 - DNA, 20 bp, mouse
gcgagcctgtcgcctcaaga

SEQ ID NO: 797280 - DNA, 20 bp, mouse
gcctgtcgcctcaagagggt

SEQ ID NO: 797281 - DNA, 20 bp, mouse
gaaggcgcgggcagattggc

SEQ ID NO: 797282 - DNA, 20 bp, mouse
gactgtccgaacaacctccc

SEQ ID NO: 797283 - DNA, 20 bp, mouse
gtaaagcctcgcggggcgga

SEQ ID NO: 797284 - DNA, 20 bp, mouse
gtgacaaggcgcgggcagat

SEQ ID NO: 797285 - DNA, 20 bp, mouse
gcccataaagcctcgcgggg

SEQ ID NO: 797286 - DNA, 20 bp, mouse
ggctgcgagcccaaccgcta

SEQ ID NO: 797287 - DNA, 20 bp, mouse
gaaaaccagacccgggtcag

SEQ ID NO: 797288 - DNA, 20 bp, mouse
gcaggccaggagctgtaggt

SEQ ID NO: 797289 - DNA, 20 bp, mouse
ggggacctaagtctttaggg

SEQ ID NO: 797290 - DNA, 20 bp, mouse
gggccccgccctaaagactt

SEQ ID NO: 797291 - DNA, 20 bp, mouse
gaccagacccgggtcagggg

SEQ ID NO: 797292 - DNA, 20 bp, mouse
ggggcgggacctaagtcttt

SEQ ID NO: 797293 - DNA, 20 bp, mouse
gacagtggggcgacggggcg

SEQ ID NO: 797294 - DNA, 20 bp, mouse
gaggtcggggtctttcctgt

SEQ ID NO: 797295 - DNA, 20 bp, mouse
gggcctgtggcggtagcacc

SEQ ID NO: 797296 - DNA, 20 bp, mouse
ggggtcccctgcgcagagaa

SEQ ID NO: 797297 - DNA, 20 bp, mouse
gaagacagggagattcaagt

SEQ ID NO: 797298 - DNA, 20 bp, mouse
gtcttgtaaagatggtgccc

SEQ ID NO: 797299 - DNA, 20 bp, mouse
gtgccagagcaattattcaa

SEQ ID NO: 797300 - DNA, 20 bp, mouse
gagcccgcgcccgccagggg

SEQ ID NO: 797301 - DNA, 20 bp, mouse
gcagagaagggggcactagg

SEQ ID NO: 797302 - DNA, 20 bp, mouse
gagcaagaggcggctgcagt

SEQ ID NO: 797303 - DNA, 20 bp, mouse
gtgacttctaatcaattggg

SEQ ID NO: 797304 - DNA, 20 bp, mouse
gtgcccccttctctgcgcag

SEQ ID NO: 797305 - DNA, 20 bp, mouse
ggccctttgaataattgctc

SEQ ID NO: 797306 - DNA, 20 bp, mouse
gttgcctcgcaagacatctt

SEQ ID NO: 797307 - DNA, 20 bp, mouse
ggggagcctctaggcattgt

SEQ ID NO: 797308 - DNA, 20 bp, mouse
gtggcagaaacgtacttccg

SEQ ID NO: 797309 - DNA, 20 bp, mouse
gcagcgtggactacagcagg

SEQ ID NO: 797310 - DNA, 20 bp, mouse
gtgtatgctaagagctcgtc

SEQ ID NO: 797311 - DNA, 20 bp, mouse
gcatcgtggcgtcaagaggc

SEQ ID NO: 797312 - DNA, 20 bp, mouse
gaaagagtcccggctggggt

SEQ ID NO: 797313 - DNA, 20 bp, mouse
ggacagctctgcacggtcca

SEQ ID NO: 797314 - DNA, 20 bp, mouse
ggcgtcgttgggagctctag

SEQ ID NO: 797315 - DNA, 20 bp, mouse
ggtcaggacagaggattttg

SEQ ID NO: 797316 - DNA, 20 bp, mouse
ggcccagggaggaaccgcta

SEQ ID NO: 797317 - DNA, 20 bp, mouse
gaggctgatgagagagctat

SEQ ID NO: 797318 - DNA, 20 bp, mouse
ggaggaggggtccggggcct

SEQ ID NO: 797319 - DNA, 20 bp, mouse
gccacagcctcgggcagaga

SEQ ID NO: 797320 - DNA, 20 bp, mouse
gccggcggctccagccttag

SEQ ID NO: 797321 - DNA, 20 bp, mouse
ggcctcgggcagagacggac

SEQ ID NO: 797322 - DNA, 20 bp, mouse
ggtgacgctggcctaaggga

SEQ ID NO: 797323 - DNA, 20 bp, mouse
gtgtcaggatgaggaggcgg

SEQ ID NO: 797324 - DNA, 20 bp, mouse
gaaagtctggagtctccgta

SEQ ID NO: 797325 - DNA, 20 bp, mouse
gtatgggtgttggagactgg

SEQ ID NO: 797326 - DNA, 20 bp, mouse
gcgctccctggaagctccga

SEQ ID NO: 797327 - DNA, 20 bp, mouse
gcacgaggctgcaagaaagg

SEQ ID NO: 797328 - DNA, 20 bp, mouse
gtcccacgaggctgcaagaa

SEQ ID NO: 797329 - DNA, 20 bp, mouse
gggtctgcggtagtcttctc

SEQ ID NO: 797330 - DNA, 20 bp, mouse
ggacgccgactgcactcgag

SEQ ID NO: 797331 - DNA, 20 bp, mouse
gggcccctgcagagccgatc

SEQ ID NO: 797332 - DNA, 20 bp, mouse
gaacgcgagtcgggttacgg

SEQ ID NO: 797333 - DNA, 20 bp, mouse
ggccgcgcgcagcgtcctct

SEQ ID NO: 797334 - DNA, 20 bp, mouse
gcaggaagccatatgaaaat

SEQ ID NO: 797335 - DNA, 20 bp, mouse
gtctggggataatctgtagt

SEQ ID NO: 797336 - DNA, 20 bp, mouse
gggacccgaaattggagtta

SEQ ID NO: 797337 - DNA, 20 bp, mouse
gctcccggaactctgcgtac

SEQ ID NO: 797338 - DNA, 20 bp, mouse
ggggaggccctgactaagtt

SEQ ID NO: 797339 - DNA, 20 bp, mouse
gcggaactctgcgtactggt

SEQ ID NO: 797340 - DNA, 20 bp, mouse
gccttcagaagtcactacta

SEQ ID NO: 797341 - DNA, 20 bp, mouse
gctgctgtaacaaactccgt

SEQ ID NO: 797342 - DNA, 20 bp, mouse
gtacgcgccaaacttagtca

SEQ ID NO: 797343 - DNA, 20 bp, mouse
ggagacccggaggcgtagag

SEQ ID NO: 797344 - DNA, 20 bp, mouse
gccaaccgctctacgcctcc

SEQ ID NO: 797345 - DNA, 20 bp, mouse
gcatgcaggaaatctcactc

SEQ ID NO: 797346 - DNA, 20 bp, mouse
gggacccaacggaaccggaa

SEQ ID NO: 797347 - DNA, 20 bp, mouse
gctgcccttccggttccgtt

SEQ ID NO: 797348 - DNA, 20 bp, mouse
ggtcctccgagcattccgat

SEQ ID NO: 797349 - DNA, 20 bp, mouse
gccacccgagagccgggcta

SEQ ID NO: 797350 - DNA, 20 bp, mouse
gggaatgctcggaggacgac

SEQ ID NO: 797351 - DNA, 20 bp, mouse
gggcaggcaacctgagccaa

SEQ ID NO: 797352 - DNA, 20 bp, mouse
ggattggcggagatgaccat

SEQ ID NO: 797353 - DNA, 20 bp, mouse
gccccttcccggagccccga

SEQ ID NO: 797354 - DNA, 20 bp, mouse
ggagccaaagggggacccaa

SEQ ID NO: 797355 - DNA, 20 bp, mouse
gaacgcggaaagtccctctc

SEQ ID NO: 797356 - DNA, 20 bp, mouse
gcaggctccgagcccgggtg

SEQ ID NO: 797357 - DNA, 20 bp, mouse
ggcagtcgctgtgttagctg

SEQ ID NO: 797358 - DNA, 20 bp, mouse
gcggcggagcggtagccaga

SEQ ID NO: 797359 - DNA, 20 bp, mouse
gcgcgcaggcgcggatcctg

SEQ ID NO: 797360 - DNA, 20 bp, mouse
gaacgcggggcctatgaagt

SEQ ID NO: 797361 - DNA, 20 bp, mouse
gcgggctcggagcctgcccc

SEQ ID NO: 797362 - DNA, 20 bp, mouse
gccgcctcgcgggagaacgc

SEQ ID NO: 797363 - DNA, 20 bp, mouse
gggaaggaagctccgcctcg

SEQ ID NO: 797364 - DNA, 20 bp, mouse
gtcagccctgcgcgcaggcg

SEQ ID NO: 797365 - DNA, 20 bp, mouse
ggggcctatgaagtggggcg

SEQ ID NO: 797366 - DNA, 20 bp, mouse
ggcggcgtgcgcgctcccga

SEQ ID NO: 797367 - DNA, 20 bp, mouse
gccgccgacttaggcagaga

SEQ ID NO: 797368 - DNA, 20 bp, mouse
gcgccctctgccctctgctc

SEQ ID NO: 797369 - DNA, 20 bp, mouse
ggggcgagctaggagagcgg

SEQ ID NO: 797370 - DNA, 20 bp, mouse
gggcgcgcgcgcgcgtccac

SEQ ID NO: 797371 - DNA, 20 bp, mouse
gtccacaggctcgcttgact

SEQ ID NO: 797372 - DNA, 20 bp, mouse
gagcgcgcacgccgcgccga

SEQ ID NO: 797373 - DNA, 20 bp, mouse
ggcacggcaggaagaggcga

SEQ ID NO: 797374 - DNA, 20 bp, mouse
gcacgccgcgccgaggggcc

SEQ ID NO: 797375 - DNA, 20 bp, mouse
ggtgccttctctgcctaagt

SEQ ID NO: 797376 - DNA, 20 bp, mouse
gccgaaggggcagtccctga

SEQ ID NO: 797377 - DNA, 20 bp, mouse
gcggaggctgtccacccgaa

SEQ ID NO: 797378 - DNA, 20 bp, mouse
gtcggtgtcccctgccctca

SEQ ID NO: 797379 - DNA, 20 bp, mouse
gggactggctggcggctggc

SEQ ID NO: 797380 - DNA, 20 bp, mouse
ggtgacgcttcggacttccg

SEQ ID NO: 797381 - DNA, 20 bp, mouse
ggggacaccgagtgaccgtg

SEQ ID NO: 797382 - DNA, 20 bp, mouse
gcggacttccggggactggc

SEQ ID NO: 797383 - DNA, 20 bp, mouse
gaggggcagtccctgagggc

SEQ ID NO: 797384 - DNA, 20 bp, mouse
ggaagctggtagacggaatg

SEQ ID NO: 797385 - DNA, 20 bp, mouse
gggaaaagattgcaacgctc

SEQ ID NO: 797386 - DNA, 20 bp, mouse
ggccttgaagggactggtat

SEQ ID NO: 797387 - DNA, 20 bp, mouse
gaagggactggtatcggctc

SEQ ID NO: 797388 - DNA, 20 bp, mouse
gcctatacttcgtccctcta

SEQ ID NO: 797389 - DNA, 20 bp, mouse
gtctctcgaagaggggacaa

SEQ ID NO: 797390 - DNA, 20 bp, mouse
ggccgataccagtcccttca

SEQ ID NO: 797391 - DNA, 20 bp, mouse
gtagccacactgggactcgg

SEQ ID NO: 797392 - DNA, 20 bp, mouse
gaccccaagaccaagttttc

SEQ ID NO: 797393 - DNA, 20 bp, mouse
gccacactgggactcggtgg

SEQ ID NO: 797394 - DNA, 20 bp, mouse
gtgcagtttgagttgcgaat

SEQ ID NO: 797395 - DNA, 20 bp, mouse
gctggctagagtccctttcc

SEQ ID NO: 797396 - DNA, 20 bp, mouse
ggagcgacatggggtccttc

SEQ ID NO: 797397 - DNA, 20 bp, mouse
gcgcggccgcggggtccttc

SEQ ID NO: 797398 - DNA, 20 bp, mouse
gacctgcctgaaggactccg

SEQ ID NO: 797399 - DNA, 20 bp, mouse
gcgcccacgccctacgtagc

SEQ ID NO: 797400 - DNA, 20 bp, mouse
gagagcgtggccagctacgt

SEQ ID NO: 797401 - DNA, 20 bp, mouse
gcgtgaccgcggagtccttc

SEQ ID NO: 797402 - DNA, 20 bp, mouse
gtccgcggtcacgatgcagc

SEQ ID NO: 797403 - DNA, 20 bp, mouse
ggggtccttcgggcagagcg

SEQ ID NO: 797404 - DNA, 20 bp, mouse
gaccgcggagtccttcaggc

SEQ ID NO: 797405 - DNA, 20 bp, mouse
ggccggctgcatcgtgaccg

SEQ ID NO: 797406 - DNA, 20 bp, mouse
gagaccaggtatagtgaaaa

SEQ ID NO: 797407 - DNA, 20 bp, mouse
gtaagggcgcctgggagacc

SEQ ID NO: 797408 - DNA, 20 bp, mouse
gtccgtccggcaatagagaa

SEQ ID NO: 797409 - DNA, 20 bp, mouse
gaactcctgacacttccgtc

SEQ ID NO: 797410 - DNA, 20 bp, mouse
gtggcctaagcaaatcacta

SEQ ID NO: 797411 - DNA, 20 bp, mouse
gcgctggcgcaggtccctgg

SEQ ID NO: 797412 - DNA, 20 bp, mouse
ggaggtacagcgagaggcac

SEQ ID NO: 797413 - DNA, 20 bp, mouse
ggaaatatcccaagagttag

SEQ ID NO: 797414 - DNA, 20 bp, mouse
gcacgggcggggcgccccca

SEQ ID NO: 797415 - DNA, 20 bp, mouse
gtgcgcagaggtacagcgag

SEQ ID NO: 797416 - DNA, 20 bp, mouse
gtgggaaccgcaggttggag

SEQ ID NO: 797417 - DNA, 20 bp, mouse
gcatctgttctactgacccg

SEQ ID NO: 797418 - DNA, 20 bp, mouse
gaacacccaaggtcggggaa

SEQ ID NO: 797419 - DNA, 20 bp, mouse
gcatatgcctctccaacctg

SEQ ID NO: 797420 - DNA, 20 bp, mouse
ggggagtgggaaccgcaggt

SEQ ID NO: 797421 - DNA, 20 bp, mouse
gctggcatactggtctgcgg

SEQ ID NO: 797422 - DNA, 20 bp, mouse
gggctctactctctgagaaa

SEQ ID NO: 797423 - DNA, 20 bp, mouse
gccagctcggggtcctggtg

SEQ ID NO: 797424 - DNA, 20 bp, mouse
ggctctggcatactggtctg

SEQ ID NO: 797425 - DNA, 20 bp, mouse
gtgtctgtctggcaccttcc

SEQ ID NO: 797426 - DNA, 20 bp, mouse
gtggctgaagccggtagttg

SEQ ID NO: 797427 - DNA, 20 bp, mouse
gcttgtctcgcaagtggcgt

SEQ ID NO: 797428 - DNA, 20 bp, mouse
gtctcgcaagtggcgtgggc

SEQ ID NO: 797429 - DNA, 20 bp, mouse
gaacgcctaattcctgcgac

SEQ ID NO: 797430 - DNA, 20 bp, mouse
gtgctgagggcggctgtagt

SEQ ID NO: 797431 - DNA, 20 bp, mouse
gcggggtgcggattagcggg

SEQ ID NO: 797432 - DNA, 20 bp, mouse
gcaaaccggtcgcaggaatt

SEQ ID NO: 797433 - DNA, 20 bp, mouse
gtgactgatcgaaagcttcg

SEQ ID NO: 797434 - DNA, 20 bp, mouse
ggatcgaaagcttcggggtg

SEQ ID NO: 797435 - DNA, 20 bp, mouse
gaagcccctgggcgcgtctg

SEQ ID NO: 797436 - DNA, 20 bp, mouse
ggcaacctgagcgttctgga

SEQ ID NO: 797437 - DNA, 20 bp, mouse
gaacagctgcgcagtagccc

SEQ ID NO: 797438 - DNA, 20 bp, mouse
gtggcctacgatggaagctg

SEQ ID NO: 797439 - DNA, 20 bp, mouse
gcggcccagactggcggacg

SEQ ID NO: 797440 - DNA, 20 bp, mouse
gtaccccttccagaacgctc

SEQ ID NO: 797441 - DNA, 20 bp, mouse
gcaggctcccggaactgtca

SEQ ID NO: 797442 - DNA, 20 bp, mouse
gtgaacgctccatagattaa

SEQ ID NO: 797443 - DNA, 20 bp, mouse
gtagcagctcccttaatcta

SEQ ID NO: 797444 - DNA, 20 bp, mouse
gcaggaaaccctgacagttc

SEQ ID NO: 797445 - DNA, 20 bp, mouse
gcagctgttcccggtcgccg

SEQ ID NO: 797446 - DNA, 20 bp, mouse
gggaccgggaagctgatcgt

SEQ ID NO: 797447 - DNA, 20 bp, mouse
gcggctacgggacgctaaaa

SEQ ID NO: 797448 - DNA, 20 bp, mouse
gaggtggagatgctagaaaa

SEQ ID NO: 797449 - DNA, 20 bp, mouse
gagccgcgccggcgccaaga

SEQ ID NO: 797450 - DNA, 20 bp, mouse
gcgggcggagataaagaaac

SEQ ID NO: 797451 - DNA, 20 bp, mouse
gggtccaacgatcagcttcc

SEQ ID NO: 797452 - DNA, 20 bp, mouse
gaacgccaacaggtagaggt

SEQ ID NO: 797453 - DNA, 20 bp, mouse
gagaaacctcgggactcttg

SEQ ID NO: 797454 - DNA, 20 bp, mouse
gtgatcgaggcgaagctcaa

SEQ ID NO: 797455 - DNA, 20 bp, mouse
gaagctgatcgttggaccag

SEQ ID NO: 797456 - DNA, 20 bp, mouse
gcgcccgcccgcgccgttcc

SEQ ID NO: 797457 - DNA, 20 bp, mouse
gagcctgggagctgcgtcga

SEQ ID NO: 797458 - DNA, 20 bp, mouse
gggccgccgagcccgttctc

SEQ ID NO: 797459 - DNA, 20 bp, mouse
gtggaagccaggaacggcgc

SEQ ID NO: 797460 - DNA, 20 bp, mouse
gaatcctggggttacgggtt

SEQ ID NO: 797461 - DNA, 20 bp, mouse
ggggaaagctcggcaacagt

SEQ ID NO: 797462 - DNA, 20 bp, mouse
ggccgagcccgttctccggc

SEQ ID NO: 797463 - DNA, 20 bp, mouse
gtcggctccagccggagaac

SEQ ID NO: 797464 - DNA, 20 bp, mouse
gtgcgtcgacggcaccgagg

SEQ ID NO: 797465 - DNA, 20 bp, mouse
gtccagccggagaacgggct

SEQ ID NO: 797466 - DNA, 20 bp, mouse
gcaccaagggcacttgactt

SEQ ID NO: 797467 - DNA, 20 bp, mouse
ggcccaacctagcacctgtg

SEQ ID NO: 797468 - DNA, 20 bp, mouse
gagaggacctggggccccac

SEQ ID NO: 797469 - DNA, 20 bp, mouse
gtgctgccccacagccttga

SEQ ID NO: 797470 - DNA, 20 bp, mouse
gcaggtgctaggttgggccc

SEQ ID NO: 797471 - DNA, 20 bp, mouse
gggccccacaggtgctaggt

SEQ ID NO: 797472 - DNA, 20 bp, mouse
gctggggccccacaggtgct

SEQ ID NO: 797473 - DNA, 20 bp, mouse
gctcaagaggcgggaggaaa

SEQ ID NO: 797474 - DNA, 20 bp, mouse
gagggtgcctgggttccctt

SEQ ID NO: 797475 - DNA, 20 bp, mouse
ggggggtggagcatgcggtc

SEQ ID NO: 797476 - DNA, 20 bp, mouse
gcctgagccttcggggtcca

SEQ ID NO: 797477 - DNA, 20 bp, mouse
ggaccctcagcctgagcctt

SEQ ID NO: 797478 - DNA, 20 bp, mouse
ggtggcacgtccttgttcct

SEQ ID NO: 797479 - DNA, 20 bp, mouse
gtagtgggtcgtagacacga

SEQ ID NO: 797480 - DNA, 20 bp, mouse
gcggagccccagccagtcct

SEQ ID NO: 797481 - DNA, 20 bp, mouse
gtgctctcaggcaactagga

SEQ ID NO: 797482 - DNA, 20 bp, mouse
ggcaaggggcgagctgcggc

SEQ ID NO: 797483 - DNA, 20 bp, mouse
gtgtctacgacccactacag

SEQ ID NO: 797484 - DNA, 20 bp, mouse
ggggtccgcacccaggaaca

SEQ ID NO: 797485 - DNA, 20 bp, mouse
ggccgagcaccgccgagtgt

SEQ ID NO: 797486 - DNA, 20 bp, mouse
gggcgggcgcaaaacggaat

SEQ ID NO: 797487 - DNA, 20 bp, mouse
gccagggggcgggcgcaaaa

SEQ ID NO: 797488 - DNA, 20 bp, mouse
gacgcaccagccaatcacag

SEQ ID NO: 797489 - DNA, 20 bp, mouse
gtggaatgtgagtcctacac

SEQ ID NO: 797490 - DNA, 20 bp, mouse
gcacgaagacgcaagtgtca

SEQ ID NO: 797491 - DNA, 20 bp, mouse
gcgcaagtgtcagggccagg

SEQ ID NO: 797492 - DNA, 20 bp, mouse
gaaggcggccattttgacta

SEQ ID NO: 797493 - DNA, 20 bp, mouse
ggactgcgtggggaaacagg

SEQ ID NO: 797494 - DNA, 20 bp, mouse
gtagcgagacgcccgaaagg

SEQ ID NO: 797495 - DNA, 20 bp, mouse
gcattagcgagacgcccgaa

SEQ ID NO: 797496 - DNA, 20 bp, mouse
gggcggcgaccaagagaaag

SEQ ID NO: 797497 - DNA, 20 bp, mouse
gacgcggcgaggcgagatgg

SEQ ID NO: 797498 - DNA, 20 bp, mouse
gccgacgcggcgaggcgaga

SEQ ID NO: 797499 - DNA, 20 bp, mouse
gttaactcacagcctaacgt

SEQ ID NO: 797500 - DNA, 20 bp, mouse
gcgtgggctaccatagagat

SEQ ID NO: 797501 - DNA, 20 bp, mouse
gcggtcgctgcctgcacttc

SEQ ID NO: 797502 - DNA, 20 bp, mouse
gcaggccgatgtggccaaag

SEQ ID NO: 797503 - DNA, 20 bp, mouse
ggtgcaggcagcgaccgacg

SEQ ID NO: 797504 - DNA, 20 bp, mouse
gggctaccatagagatcgga

SEQ ID NO: 797505 - DNA, 20 bp, mouse
gccaagagaaagcggcgtgg

SEQ ID NO: 797506 - DNA, 20 bp, mouse
ggcaagcgagcaagggacgt

SEQ ID NO: 797507 - DNA, 20 bp, mouse
gcacgcaccaggaactccgc

SEQ ID NO: 797508 - DNA, 20 bp, mouse
ggcccggcggagggcctcga

SEQ ID NO: 797509 - DNA, 20 bp, mouse
gaggggccggcaagcgagca

SEQ ID NO: 797510 - DNA, 20 bp, mouse
ggaaacgcaggcgggtctcg

SEQ ID NO: 797511 - DNA, 20 bp, mouse
gtcctggtgcgtgccgaggt

SEQ ID NO: 797512 - DNA, 20 bp, mouse
gcccgcctgcgtttcgggtc

SEQ ID NO: 797513 - DNA, 20 bp, mouse
ggatggaagcgtaggacccg

SEQ ID NO: 797514 - DNA, 20 bp, mouse
gggtctcgtgcgcctgtacg

SEQ ID NO: 797515 - DNA, 20 bp, mouse
gccggcttcccaccattaga

SEQ ID NO: 797516 - DNA, 20 bp, mouse
gcaaacgcctgcatcgctcc

SEQ ID NO: 797517 - DNA, 20 bp, mouse
ggaaaaagtgagacattcca

SEQ ID NO: 797518 - DNA, 20 bp, mouse
gatcgctccaggctacgccc

SEQ ID NO: 797519 - DNA, 20 bp, mouse
gcttgtgcgttggacgttag

SEQ ID NO: 797520 - DNA, 20 bp, mouse
gcggcttcggaagaccgaag

SEQ ID NO: 797521 - DNA, 20 bp, mouse
ggcgtagcctggagcgatgc

SEQ ID NO: 797522 - DNA, 20 bp, mouse
ggccgcacgtagctgacgta

SEQ ID NO: 797523 - DNA, 20 bp, mouse
gttgtctctcgggatccaag

SEQ ID NO: 797524 - DNA, 20 bp, mouse
gagctgtagttcttgtgcgt

SEQ ID NO: 797525 - DNA, 20 bp, mouse
gcgcgctcgcggcgagcgca

SEQ ID NO: 797526 - DNA, 20 bp, mouse
gcccacagaaggggcggcgc

SEQ ID NO: 797527 - DNA, 20 bp, mouse
gggtggctggtccagagaca

SEQ ID NO: 797528 - DNA, 20 bp, mouse
gctgaccacttccttgtctc

SEQ ID NO: 797529 - DNA, 20 bp, mouse
gggccacggagcaggcgcaa

SEQ ID NO: 797530 - DNA, 20 bp, mouse
gcgccccccacccacagaag

SEQ ID NO: 797531 - DNA, 20 bp, mouse
gcgcctgctccgtggccaat

SEQ ID NO: 797532 - DNA, 20 bp, mouse
ggcctgcgccgccccttctg

SEQ ID NO: 797533 - DNA, 20 bp, mouse
gcgccccttctgtgggtggg

SEQ ID NO: 797534 - DNA, 20 bp, mouse
gcgcaaagggttccttgaag

SEQ ID NO: 797535 - DNA, 20 bp, mouse
gtccgtggccaataggtggc

SEQ ID NO: 797536 - DNA, 20 bp, mouse
gaatacatttaaacagagtg

SEQ ID NO: 797537 - DNA, 20 bp, mouse
gaaaaaagtggacaaaacta

SEQ ID NO: 797538 - DNA, 20 bp, mouse
gtagtaaaataagtacctaa

SEQ ID NO: 797539 - DNA, 20 bp, mouse
gtaagtacctaaaggtttat

SEQ ID NO: 797540 - DNA, 20 bp, mouse
gttttttcctataaaccttt

SEQ ID NO: 797541 - DNA, 20 bp, mouse
gaaaaaagggagatagaaac

SEQ ID NO: 797542 - DNA, 20 bp, mouse
gtagaatattattaaaacga

SEQ ID NO: 797543 - DNA, 20 bp, mouse
gcaaccacatttttctcttt

SEQ ID NO: 797544 - DNA, 20 bp, mouse
gagtaaaaaaaataccaaaa

SEQ ID NO: 797545 - DNA, 20 bp, mouse
gattaattttctcattaaaa

SEQ ID NO: 797546 - DNA, 20 bp, mouse
gctaagattgcgcatgtcta

SEQ ID NO: 797547 - DNA, 20 bp, mouse
gcatgctctagaggtcgagg

SEQ ID NO: 797548 - DNA, 20 bp, mouse
ggggcgctgcacacttgccc

SEQ ID NO: 797549 - DNA, 20 bp, mouse
ggcagccgcgcatgctctag

SEQ ID NO: 797550 - DNA, 20 bp, mouse
gaatgatgtcaccaagacag

SEQ ID NO: 797551 - DNA, 20 bp, mouse
gcaccagcattccgctgtct

SEQ ID NO: 797552 - DNA, 20 bp, mouse
gcaccaagacagcggaatgc

SEQ ID NO: 797553 - DNA, 20 bp, mouse
ggcgcatgctctagaggtcg

SEQ ID NO: 797554 - DNA, 20 bp, mouse
gtgtcaccggcgctgacgat

SEQ ID NO: 797555 - DNA, 20 bp, mouse
gcaccggcgctgacgatcgg

SEQ ID NO: 797556 - DNA, 20 bp, mouse
ggcagggtggggccatgatg

SEQ ID NO: 797557 - DNA, 20 bp, mouse
gcagggtggcaaggcttgat

SEQ ID NO: 797558 - DNA, 20 bp, mouse
gcccaggagagattagcctt

SEQ ID NO: 797559 - DNA, 20 bp, mouse
gcatggccccaccctgccta

SEQ ID NO: 797560 - DNA, 20 bp, mouse
gccaaggtggggagattagc

SEQ ID NO: 797561 - DNA, 20 bp, mouse
ggggagattagctgggatgc

SEQ ID NO: 797562 - DNA, 20 bp, mouse
gggaagaagaagggaaccta

SEQ ID NO: 797563 - DNA, 20 bp, mouse
gacaacaagaaacgagaatc

SEQ ID NO: 797564 - DNA, 20 bp, mouse
gctatatggtattccttgat

SEQ ID NO: 797565 - DNA, 20 bp, mouse
ggtggggccatgatggggca

SEQ ID NO: 797566 - DNA, 20 bp, mouse
gtggaggcggggcgatgggt

SEQ ID NO: 797567 - DNA, 20 bp, mouse
ggcaacccgtagccggggaa

SEQ ID NO: 797568 - DNA, 20 bp, mouse
gccgcccgggaattggaggc

SEQ ID NO: 797569 - DNA, 20 bp, mouse
gcgccccgcctccaattccc

SEQ ID NO: 797570 - DNA, 20 bp, mouse
ggaacggctacgtggagtcc

SEQ ID NO: 797571 - DNA, 20 bp, mouse
gccactgcaggaccgcggag

SEQ ID NO: 797572 - DNA, 20 bp, mouse
gagcgagcgcggaaccttga

SEQ ID NO: 797573 - DNA, 20 bp, mouse
gcaggaccgcggagcggacc

SEQ ID NO: 797574 - DNA, 20 bp, mouse
gaactccgcccgggaattgg

SEQ ID NO: 797575 - DNA, 20 bp, mouse
ggaattggaggcggggcgat

SEQ ID NO: 797576 - DNA, 20 bp, mouse
gacgacctggggtcacgtgg

SEQ ID NO: 797577 - DNA, 20 bp, mouse
gaccccaggtcgtgcgaggc

SEQ ID NO: 797578 - DNA, 20 bp, mouse
gcgtcaaagcaaacagtgat

SEQ ID NO: 797579 - DNA, 20 bp, mouse
gcatgccccgggcgtgcgag

SEQ ID NO: 797580 - DNA, 20 bp, mouse
gtcccgcctcgcacgacctg

SEQ ID NO: 797581 - DNA, 20 bp, mouse
gcaaagcaaacagtgatagg

SEQ ID NO: 797582 - DNA, 20 bp, mouse
gagtcctaagcaacacgagc

SEQ ID NO: 797583 - DNA, 20 bp, mouse
ggggctgtgcagaccctaac

SEQ ID NO: 797584 - DNA, 20 bp, mouse
gcacgcctctcgcacgcccg

SEQ ID NO: 797585 - DNA, 20 bp, mouse
gagcgacgcttggaagactg

SEQ ID NO: 797586 - DNA, 20 bp, mouse
ggaagccgagtgatttcgta

SEQ ID NO: 797587 - DNA, 20 bp, mouse
gcggatcagaacaatcataa

SEQ ID NO: 797588 - DNA, 20 bp, mouse
gcagaacaatcataaaggaa

SEQ ID NO: 797589 - DNA, 20 bp, mouse
ggtcgggtaaccagaaaggc

SEQ ID NO: 797590 - DNA, 20 bp, mouse
gtcgcagcagaagcggaagt

SEQ ID NO: 797591 - DNA, 20 bp, mouse
gacctgacggacatgccgga

SEQ ID NO: 797592 - DNA, 20 bp, mouse
gtatgaggcgggtcggagaa

SEQ ID NO: 797593 - DNA, 20 bp, mouse
gcagacttgtagtcctcagt

SEQ ID NO: 797594 - DNA, 20 bp, mouse
gaagacgatgtgatcagccc

SEQ ID NO: 797595 - DNA, 20 bp, mouse
gagcggaagtaggtatgagg

SEQ ID NO: 797596 - DNA, 20 bp, mouse
gcgcctgcgtgctgaagaga

SEQ ID NO: 797597 - DNA, 20 bp, mouse
gtggcccgggcacgccatcc

SEQ ID NO: 797598 - DNA, 20 bp, mouse
gaccgctcgcctgcctgagg

SEQ ID NO: 797599 - DNA, 20 bp, mouse
ggcaggcgagcggtgattgg

SEQ ID NO: 797600 - DNA, 20 bp, mouse
gggccacggtgtgtgtgcgc

SEQ ID NO: 797601 - DNA, 20 bp, mouse
gcaggcaggcgagcggtgat

SEQ ID NO: 797602 - DNA, 20 bp, mouse
ggatccaggatggcgtgccc

SEQ ID NO: 797603 - DNA, 20 bp, mouse
ggggcgtggagcgcgacgtc

SEQ ID NO: 797604 - DNA, 20 bp, mouse
gcgaagaagccccttcagtg

SEQ ID NO: 797605 - DNA, 20 bp, mouse
ggcgacgtctggttttcggc

SEQ ID NO: 797606 - DNA, 20 bp, mouse
gtaacggtcaggagcgctaa

SEQ ID NO: 797607 - DNA, 20 bp, mouse
gtaagggcttggacactcac

SEQ ID NO: 797608 - DNA, 20 bp, mouse
gaaacctcggtgtaacggtc

SEQ ID NO: 797609 - DNA, 20 bp, mouse
gcgtggtggaggtgtgacaa

SEQ ID NO: 797610 - DNA, 20 bp, mouse
gtggtggaggtgggactacg

SEQ ID NO: 797611 - DNA, 20 bp, mouse
gggactacgggggcgtgtcg

SEQ ID NO: 797612 - DNA, 20 bp, mouse
gtgcctaagtctggcctcga

SEQ ID NO: 797613 - DNA, 20 bp, mouse
gctggcctcgaggggcgtgg

SEQ ID NO: 797614 - DNA, 20 bp, mouse
gcgtgtcgggggcgtgacca

SEQ ID NO: 797615 - DNA, 20 bp, mouse
ggtgacaagggctggtgcgg

SEQ ID NO: 797616 - DNA, 20 bp, mouse
gtcaagacgaatgtagagga

SEQ ID NO: 797617 - DNA, 20 bp, mouse
ggtgcgagcagcaacatctg

SEQ ID NO: 797618 - DNA, 20 bp, mouse
ggtagtgattgcttaaatcg

SEQ ID NO: 797619 - DNA, 20 bp, mouse
gaattgtagttcagtctcga

SEQ ID NO: 797620 - DNA, 20 bp, mouse
ggccagagaaggttcttttg

SEQ ID NO: 797621 - DNA, 20 bp, mouse
gttcgcgggtaattgtgtga

SEQ ID NO: 797622 - DNA, 20 bp, mouse
gcccccaaaagaaccttctc

SEQ ID NO: 797623 - DNA, 20 bp, mouse
gtgaggggttggaaaaaggg

SEQ ID NO: 797624 - DNA, 20 bp, mouse
gtcatcccaaaacgggaata

SEQ ID NO: 797625 - DNA, 20 bp, mouse
gttgctgctcgcacttttcg

SEQ ID NO: 797626 - DNA, 20 bp, mouse
gcacgcgcggcgtaaggggc

SEQ ID NO: 797627 - DNA, 20 bp, mouse
ggctaccgtctccgcgtctc

SEQ ID NO: 797628 - DNA, 20 bp, mouse
gtgaggaaatatgctgtaca

SEQ ID NO: 797629 - DNA, 20 bp, mouse
gtcccgcgggggagggtcag

SEQ ID NO: 797630 - DNA, 20 bp, mouse
gctgaggaaatcccacacac

SEQ ID NO: 797631 - DNA, 20 bp, mouse
gagcaaggcctcgtgagtct

SEQ ID NO: 797632 - DNA, 20 bp, mouse
gttacatgaaaccagtgtgt

SEQ ID NO: 797633 - DNA, 20 bp, mouse
gtggcgtgacgtcacacgcg

SEQ ID NO: 797634 - DNA, 20 bp, mouse
gtctactacaacttccatcc

SEQ ID NO: 797635 - DNA, 20 bp, mouse
gccgcgggagggcggggttt

SEQ ID NO: 797636 - DNA, 20 bp, mouse
gcgccatctgctgaccatga

SEQ ID NO: 797637 - DNA, 20 bp, mouse
gccctccggccgacgcttcc

SEQ ID NO: 797638 - DNA, 20 bp, mouse
gaggatgcaagtcgaggtga

SEQ ID NO: 797639 - DNA, 20 bp, mouse
ggagtcttgcgagttgggaa

SEQ ID NO: 797640 - DNA, 20 bp, mouse
gtgccctcatggtcagcaga

SEQ ID NO: 797641 - DNA, 20 bp, mouse
gggactggagcgtcttttgt

SEQ ID NO: 797642 - DNA, 20 bp, mouse
gacgctccagtcccggaacc

SEQ ID NO: 797643 - DNA, 20 bp, mouse
gtcccggaacccggaagcgt

SEQ ID NO: 797644 - DNA, 20 bp, mouse
gggaacccggaagcgtcggc

SEQ ID NO: 797645 - DNA, 20 bp, mouse
gcagcgcgggacgaaggggc

SEQ ID NO: 797646 - DNA, 20 bp, mouse
ggcgcctacggaaaccgaag

SEQ ID NO: 797647 - DNA, 20 bp, mouse
gaaaccgaagcggcttgctg

SEQ ID NO: 797648 - DNA, 20 bp, mouse
ggaccctcgcagggcgccta

SEQ ID NO: 797649 - DNA, 20 bp, mouse
gcacaccagggaccctcgca

SEQ ID NO: 797650 - DNA, 20 bp, mouse
ggctccgggcgtcacccagc

SEQ ID NO: 797651 - DNA, 20 bp, mouse
gacccagccgggtcacacca

SEQ ID NO: 797652 - DNA, 20 bp, mouse
gaagccgcttcggtttccgt

SEQ ID NO: 797653 - DNA, 20 bp, mouse
gcgggaaggctgatcgccgc

SEQ ID NO: 797654 - DNA, 20 bp, mouse
ggtccctggtgtgacccggc

SEQ ID NO: 797655 - DNA, 20 bp, mouse
gcagccgcagcaagccgctt

SEQ ID NO: 797656 - DNA, 20 bp, mouse
gcacgtaaaaggaagtgcaa

SEQ ID NO: 797657 - DNA, 20 bp, mouse
ggcgccgagcatgcgcacca

SEQ ID NO: 797658 - DNA, 20 bp, mouse
gctgaagactgaaaccaaat

SEQ ID NO: 797659 - DNA, 20 bp, mouse
gctacagccaaccacgggcc

SEQ ID NO: 797660 - DNA, 20 bp, mouse
ggttgtccaatcagagtcgg

SEQ ID NO: 797661 - DNA, 20 bp, mouse
gtcccgcccccgactctgat

SEQ ID NO: 797662 - DNA, 20 bp, mouse
gcccgtggttggctgtagga

SEQ ID NO: 797663 - DNA, 20 bp, mouse
ggtgggtctaggtttggttc

SEQ ID NO: 797664 - DNA, 20 bp, mouse
gggaccagcactgcacgccg

SEQ ID NO: 797665 - DNA, 20 bp, mouse
gagtgcaaaggtacctgcaa

SEQ ID NO: 797666 - DNA, 20 bp, mouse
gtgccaccacagtcccctat

SEQ ID NO: 797667 - DNA, 20 bp, mouse
gtcactgaacgcagccaata

SEQ ID NO: 797668 - DNA, 20 bp, mouse
gccggcctaaaggaaggggc

SEQ ID NO: 797669 - DNA, 20 bp, mouse
gagccaggaagagggaccgt

SEQ ID NO: 797670 - DNA, 20 bp, mouse
gctagggctgaggctaataa

SEQ ID NO: 797671 - DNA, 20 bp, mouse
gcgatccggcctaaaggaag

SEQ ID NO: 797672 - DNA, 20 bp, mouse
gagccaataggggactgtgg

SEQ ID NO: 797673 - DNA, 20 bp, mouse
gctgaggctaataagggtct

SEQ ID NO: 797674 - DNA, 20 bp, mouse
gtaggcccgccccttccttt

SEQ ID NO: 797675 - DNA, 20 bp, mouse
ggataagccacagctcctag

SEQ ID NO: 797676 - DNA, 20 bp, mouse
gacactaaacggcgattctt

SEQ ID NO: 797677 - DNA, 20 bp, mouse
gtggcgcggaccgcgagcgg

SEQ ID NO: 797678 - DNA, 20 bp, mouse
gggcgattcttgggtgagta

SEQ ID NO: 797679 - DNA, 20 bp, mouse
gtccaggcaggttctagcat

SEQ ID NO: 797680 - DNA, 20 bp, mouse
gcccagggaaagacactaaa

SEQ ID NO: 797681 - DNA, 20 bp, mouse
gccagaaagcttccccctcc

SEQ ID NO: 797682 - DNA, 20 bp, mouse
gtcacagcggaactttgctg

SEQ ID NO: 797683 - DNA, 20 bp, mouse
gcccgggtggccgggtgaga

SEQ ID NO: 797684 - DNA, 20 bp, mouse
ggccgtttagtgtctttccc

SEQ ID NO: 797685 - DNA, 20 bp, mouse
ggaaccacggacaggtaggg

SEQ ID NO: 797686 - DNA, 20 bp, mouse
gggtgtgcagggctcgggtt

SEQ ID NO: 797687 - DNA, 20 bp, mouse
gggcccgggtcacgtgactg

SEQ ID NO: 797688 - DNA, 20 bp, mouse
gggtgggagaatcagacctg

SEQ ID NO: 797689 - DNA, 20 bp, mouse
gcagagctctgcagctccac

SEQ ID NO: 797690 - DNA, 20 bp, mouse
gcctccgcagtcacgtgacc

SEQ ID NO: 797691 - DNA, 20 bp, mouse
gcggtgtcacgtgatctagt

SEQ ID NO: 797692 - DNA, 20 bp, mouse
gtggaccagagccctaacgt

SEQ ID NO: 797693 - DNA, 20 bp, mouse
ggcagggctcgggttcgggt

SEQ ID NO: 797694 - DNA, 20 bp, mouse
gtgaaccaataaggaagcgg

SEQ ID NO: 797695 - DNA, 20 bp, mouse
gaggtgaagggcatactaga

SEQ ID NO: 797696 - DNA, 20 bp, mouse
gcgtgggcggggcaaaggaa

SEQ ID NO: 797697 - DNA, 20 bp, mouse
gtggcaagagcctgtcttac

SEQ ID NO: 797698 - DNA, 20 bp, mouse
gagcctgaggaagagggcgg

SEQ ID NO: 797699 - DNA, 20 bp, mouse
gcattggtggcggaagaagt

SEQ ID NO: 797700 - DNA, 20 bp, mouse
gggtggcggaagaagtgggc

SEQ ID NO: 797701 - DNA, 20 bp, mouse
ggctcaccatcctgtcacca

SEQ ID NO: 797702 - DNA, 20 bp, mouse
gaggatggtgagccccacgg

SEQ ID NO: 797703 - DNA, 20 bp, mouse
ggggtcgaccgaggagcctg

SEQ ID NO: 797704 - DNA, 20 bp, mouse
ggctgcaagaaatcgctcgt

SEQ ID NO: 797705 - DNA, 20 bp, mouse
ggcaagaaatcgctcgtggg

SEQ ID NO: 797706 - DNA, 20 bp, mouse
ggggtcacatgtattagggc

SEQ ID NO: 797707 - DNA, 20 bp, mouse
gcagagacggagcctcgagt

SEQ ID NO: 797708 - DNA, 20 bp, mouse
gggcggggtcacatgtatta

SEQ ID NO: 797709 - DNA, 20 bp, mouse
gctggccgaccgagaaagat

SEQ ID NO: 797710 - DNA, 20 bp, mouse
gtgacacctcagcgcccaat

SEQ ID NO: 797711 - DNA, 20 bp, mouse
gacggagcctcgagtgggcg

SEQ ID NO: 797712 - DNA, 20 bp, mouse
gttaccgttggggaccagaa

SEQ ID NO: 797713 - DNA, 20 bp, mouse
gaggctccgtctctgcccat

SEQ ID NO: 797714 - DNA, 20 bp, mouse
gtcgagtcgtggtatctcaa

SEQ ID NO: 797715 - DNA, 20 bp, mouse
gacagggcgaggcctccgaa

SEQ ID NO: 797716 - DNA, 20 bp, mouse
gaagccctgctgagggcgag

SEQ ID NO: 797717 - DNA, 20 bp, mouse
gagttgcctggcaactgcgc

SEQ ID NO: 797718 - DNA, 20 bp, mouse
gtgcgcagaagccctgctga

SEQ ID NO: 797719 - DNA, 20 bp, mouse
gcatgtgcgcccgccttgag

SEQ ID NO: 797720 - DNA, 20 bp, mouse
ggagccgtccagtaggtgtt

SEQ ID NO: 797721 - DNA, 20 bp, mouse
gtccacaaacgcacaactgc

SEQ ID NO: 797722 - DNA, 20 bp, mouse
gtcccgagcggtatgataag

SEQ ID NO: 797723 - DNA, 20 bp, mouse
gcccggaaagcgtcagagca

SEQ ID NO: 797724 - DNA, 20 bp, mouse
gcagtcccggaagtggctcg

SEQ ID NO: 797725 - DNA, 20 bp, mouse
gcgcgccacgagccacttcc

SEQ ID NO: 797726 - DNA, 20 bp, mouse
ggctggcgcgagggggaaga

SEQ ID NO: 797727 - DNA, 20 bp, mouse
ggcagctgtaaaacagactg

SEQ ID NO: 797728 - DNA, 20 bp, mouse
gctgcactgtatatttgcaa

SEQ ID NO: 797729 - DNA, 20 bp, mouse
gccctcgcgccagcgaatgc

SEQ ID NO: 797730 - DNA, 20 bp, mouse
ggaaaagcaccagcattcgc

SEQ ID NO: 797731 - DNA, 20 bp, mouse
ggactgcagaacttttcacg

SEQ ID NO: 797732 - DNA, 20 bp, mouse
ggctccaggggattccaggc

SEQ ID NO: 797733 - DNA, 20 bp, mouse
ggggtggggttagacggaag

SEQ ID NO: 797734 - DNA, 20 bp, mouse
gcaattagaagcttcttctg

SEQ ID NO: 797735 - DNA, 20 bp, mouse
ggagtgcaggaaatccaacc

SEQ ID NO: 797736 - DNA, 20 bp, mouse
ggctgcatcctctctgtcga

SEQ ID NO: 797737 - DNA, 20 bp, mouse
gtctctgtcgagggcagcag

SEQ ID NO: 797738 - DNA, 20 bp, mouse
ggctggagcatgatatgtca

SEQ ID NO: 797739 - DNA, 20 bp, mouse
gaagacacaacagttagagg

SEQ ID NO: 797740 - DNA, 20 bp, mouse
gcaaagggtgccatcttagt

SEQ ID NO: 797741 - DNA, 20 bp, mouse
gtgtttggtggcatagttca

SEQ ID NO: 797742 - DNA, 20 bp, mouse
gtcacacctaaattgtttgg

SEQ ID NO: 797743 - DNA, 20 bp, mouse
ggagaagacacaacagttag

SEQ ID NO: 797744 - DNA, 20 bp, mouse
gagggcagcagtggttgatg

SEQ ID NO: 797745 - DNA, 20 bp, mouse
gacatccaggcttttaaggc

SEQ ID NO: 797746 - DNA, 20 bp, mouse
gtggctggagaaccacccgg

SEQ ID NO: 797747 - DNA, 20 bp, mouse
gcggcctcgcttgcttccga

SEQ ID NO: 797748 - DNA, 20 bp, mouse
gcagtgggacgtggcttcgg

SEQ ID NO: 797749 - DNA, 20 bp, mouse
gagttctgagccgatcactg

SEQ ID NO: 797750 - DNA, 20 bp, mouse
gtcactgcaaccattctagt

SEQ ID NO: 797751 - DNA, 20 bp, mouse
gtcctggctggagaaccacc

SEQ ID NO: 797752 - DNA, 20 bp, mouse
gaagcaagcgaggccgggcc

SEQ ID NO: 797753 - DNA, 20 bp, mouse
gcagccttcggaagcaagcg

SEQ ID NO: 797754 - DNA, 20 bp, mouse
gaggtccgggttttgcttgt

SEQ ID NO: 797755 - DNA, 20 bp, mouse
gcgggggtgtcagtctgatg

SEQ ID NO: 797756 - DNA, 20 bp, mouse
gcacccgcgaggccctcagc

SEQ ID NO: 797757 - DNA, 20 bp, mouse
gggaggcggggccacattcc

SEQ ID NO: 797758 - DNA, 20 bp, mouse
gtcctgcggccgccatttcg

SEQ ID NO: 797759 - DNA, 20 bp, mouse
gaatgtggccccgcctccgg

SEQ ID NO: 797760 - DNA, 20 bp, mouse
gggctgcagcccaataccac

SEQ ID NO: 797761 - DNA, 20 bp, mouse
gcggcagtccgcttaaaact

SEQ ID NO: 797762 - DNA, 20 bp, mouse
gggcccgctgagggcctcgc

SEQ ID NO: 797763 - DNA, 20 bp, mouse
ggtagcagagtgactgtttc

SEQ ID NO: 797764 - DNA, 20 bp, mouse
ggcgtggcctcgcggtcctg

SEQ ID NO: 797765 - DNA, 20 bp, mouse
ggagacgagtgtcgagcgca

SEQ ID NO: 797766 - DNA, 20 bp, mouse
ggggtctgctggtctgtgat

SEQ ID NO: 797767 - DNA, 20 bp, mouse
gtcttcaggaagtttagctg

SEQ ID NO: 797768 - DNA, 20 bp, mouse
gcacggagcctcagagtcca

SEQ ID NO: 797769 - DNA, 20 bp, mouse
gcatctcctgagaatgccta

SEQ ID NO: 797770 - DNA, 20 bp, mouse
gatatcgtcactctaatctc

SEQ ID NO: 797771 - DNA, 20 bp, mouse
gtgaagagccaggtgccagc

SEQ ID NO: 797772 - DNA, 20 bp, mouse
gcctgagtgcagaaacattc

SEQ ID NO: 797773 - DNA, 20 bp, mouse
gctggagctggggggtctgc

SEQ ID NO: 797774 - DNA, 20 bp, mouse
gctaatctctggtttctccc

SEQ ID NO: 797775 - DNA, 20 bp, mouse
gtggttagccgtctgtggtg

SEQ ID NO: 797776 - DNA, 20 bp, mouse
gcctccctgcacccctgtga

SEQ ID NO: 797777 - DNA, 20 bp, mouse
gtgcacccctgtgatggttg

SEQ ID NO: 797778 - DNA, 20 bp, mouse
gttgagaggaacaccctggt

SEQ ID NO: 797779 - DNA, 20 bp, mouse
gtgtctccctcaaccatcac

SEQ ID NO: 797780 - DNA, 20 bp, mouse
gccagcacaccagtgctcac

SEQ ID NO: 797781 - DNA, 20 bp, mouse
gtaagacagtcattttttgt

SEQ ID NO: 797782 - DNA, 20 bp, mouse
gactggtgtgctggtgtaac

SEQ ID NO: 797783 - DNA, 20 bp, mouse
gacaacgctgcctctgactg

SEQ ID NO: 797784 - DNA, 20 bp, mouse
gtagtgcagactaaggagta

SEQ ID NO: 797785 - DNA, 20 bp, mouse
gaatactattgtgaattaaa

SEQ ID NO: 797786 - DNA, 20 bp, mouse
ggtccccaggcctttctcgc

SEQ ID NO: 797787 - DNA, 20 bp, mouse
gcacgccccatgtctgtctg

SEQ ID NO: 797788 - DNA, 20 bp, mouse
gagacatggggcgtgcagtg

SEQ ID NO: 797789 - DNA, 20 bp, mouse
gaggtgcagcccggcgagaa

SEQ ID NO: 797790 - DNA, 20 bp, mouse
gctgcccccagacagacatg

SEQ ID NO: 797791 - DNA, 20 bp, mouse
gggcgctgtcggggcgcgaa

SEQ ID NO: 797792 - DNA, 20 bp, mouse
gaaggagctggcattgtgta

SEQ ID NO: 797793 - DNA, 20 bp, mouse
gcgcgaggaaaaaagttccc

SEQ ID NO: 797794 - DNA, 20 bp, mouse
ggtggcctcgggtgccaggt

SEQ ID NO: 797795 - DNA, 20 bp, mouse
gacggcccacctggcacccg

SEQ ID NO: 797796 - DNA, 20 bp, mouse
gcccccgacctggatcccgt

SEQ ID NO: 797797 - DNA, 20 bp, mouse
gagcacctcccgcaggtcca

SEQ ID NO: 797798 - DNA, 20 bp, mouse
ggagcccacgggatccaggt

SEQ ID NO: 797799 - DNA, 20 bp, mouse
gaccccgcgtcgggaggagg

SEQ ID NO: 797800 - DNA, 20 bp, mouse
ggcgcccggcggccacgtgg

SEQ ID NO: 797801 - DNA, 20 bp, mouse
gtccgcgcggccccaaattc

SEQ ID NO: 797802 - DNA, 20 bp, mouse
ggtggctagcaactccctcc

SEQ ID NO: 797803 - DNA, 20 bp, mouse
gctgaccccgcgtcgggagg

SEQ ID NO: 797804 - DNA, 20 bp, mouse
gcaacggcagcaccaccacg

SEQ ID NO: 797805 - DNA, 20 bp, mouse
gcgggcgccggcccccgacc

SEQ ID NO: 797806 - DNA, 20 bp, mouse
ggtgatctcgcccacgggga

SEQ ID NO: 797807 - DNA, 20 bp, mouse
gacggggagggcgtggttgt

SEQ ID NO: 797808 - DNA, 20 bp, mouse
gggcggtgcggggtgacaga

SEQ ID NO: 797809 - DNA, 20 bp, mouse
gagcaggagggggtgcgaaa

SEQ ID NO: 797810 - DNA, 20 bp, mouse
gtgtctgtccgcgtgctctc

SEQ ID NO: 797811 - DNA, 20 bp, mouse
gttggtgacagcagcgacag

SEQ ID NO: 797812 - DNA, 20 bp, mouse
gaggccagggccagcgggga

SEQ ID NO: 797813 - DNA, 20 bp, mouse
ggggtgcgaaagggtacccg

SEQ ID NO: 797814 - DNA, 20 bp, mouse
gtcgccgctgggcgcctgaa

SEQ ID NO: 797815 - DNA, 20 bp, mouse
gcctccaggaagccacgggg

SEQ ID NO: 797816 - DNA, 20 bp, mouse
ggaacccggggactcgccgt

SEQ ID NO: 797817 - DNA, 20 bp, mouse
gtggacccacggcgagtccc

SEQ ID NO: 797818 - DNA, 20 bp, mouse
gaacaaaggctctacgggcg

SEQ ID NO: 797819 - DNA, 20 bp, mouse
gtcgccgtgggtccaccggg

SEQ ID NO: 797820 - DNA, 20 bp, mouse
gccgccgcagatcacttccg

SEQ ID NO: 797821 - DNA, 20 bp, mouse
gcagcctcccggtggaccca

SEQ ID NO: 797822 - DNA, 20 bp, mouse
gcagtggtacagcctcccgg

SEQ ID NO: 797823 - DNA, 20 bp, mouse
gaggccgcacttcctggccg

SEQ ID NO: 797824 - DNA, 20 bp, mouse
ggactcgccgtgggtccacc

SEQ ID NO: 797825 - DNA, 20 bp, mouse
gggcgccaggccgcacttcc

SEQ ID NO: 797826 - DNA, 20 bp, mouse
gtggggagccgaaaggaagg

SEQ ID NO: 797827 - DNA, 20 bp, mouse
ggtggcctcggagaacggaa

SEQ ID NO: 797828 - DNA, 20 bp, mouse
gcctcggagaacggaaggga

SEQ ID NO: 797829 - DNA, 20 bp, mouse
gggacagcgggaacgcgctc

SEQ ID NO: 797830 - DNA, 20 bp, mouse
gaatgggtggggccgttccg

SEQ ID NO: 797831 - DNA, 20 bp, mouse
gtggaagtacctcttcggat

SEQ ID NO: 797832 - DNA, 20 bp, mouse
gagaaaacacattgagtgtg

SEQ ID NO: 797833 - DNA, 20 bp, mouse
gacgtgcgcgagtccggctg

SEQ ID NO: 797834 - DNA, 20 bp, mouse
gcggaagggagggctgcctc

SEQ ID NO: 797835 - DNA, 20 bp, mouse
gcagcgggaacgcgctccgg

SEQ ID NO: 797836 - DNA, 20 bp, mouse
gtcctcgcgtggggcacgcc

SEQ ID NO: 797837 - DNA, 20 bp, mouse
gggcgcctgcgcagtgttct

SEQ ID NO: 797838 - DNA, 20 bp, mouse
gaaagtacgcagacgctggg

SEQ ID NO: 797839 - DNA, 20 bp, mouse
gccgagctggaactcgttaa

SEQ ID NO: 797840 - DNA, 20 bp, mouse
ggacaagggccctacagcag

SEQ ID NO: 797841 - DNA, 20 bp, mouse
gcgtgccccacgcgaggacg

SEQ ID NO: 797842 - DNA, 20 bp, mouse
gagccgaggacccgggaagc

SEQ ID NO: 797843 - DNA, 20 bp, mouse
gaaggtgctccgcccagagg

SEQ ID NO: 797844 - DNA, 20 bp, mouse
ggacaccaggccagagcttg

SEQ ID NO: 797845 - DNA, 20 bp, mouse
gggaacagggaacccgcgag

SEQ ID NO: 797846 - DNA, 20 bp, mouse
gagcacttgacgtcagaagg

SEQ ID NO: 797847 - DNA, 20 bp, mouse
gctaggaaccgctgtttaca

SEQ ID NO: 797848 - DNA, 20 bp, mouse
ggtgtctgtagtaatgaaga

SEQ ID NO: 797849 - DNA, 20 bp, mouse
gtgaaatgacgtcagagcca

SEQ ID NO: 797850 - DNA, 20 bp, mouse
gtcagaaggcggttgccacg

SEQ ID NO: 797851 - DNA, 20 bp, mouse
gcggtggcgaacggtccccg

SEQ ID NO: 797852 - DNA, 20 bp, mouse
gggaaaccaagaggctatag

SEQ ID NO: 797853 - DNA, 20 bp, mouse
gaggccaaaaccgagtcgtg

SEQ ID NO: 797854 - DNA, 20 bp, mouse
gaccaagaggctatagaggc

SEQ ID NO: 797855 - DNA, 20 bp, mouse
gctctgccgtcggtggcgaa

SEQ ID NO: 797856 - DNA, 20 bp, mouse
gcggaccagaggcacccgtg

SEQ ID NO: 797857 - DNA, 20 bp, mouse
gagcacttgcggcccatata

SEQ ID NO: 797858 - DNA, 20 bp, mouse
ggaaaacaccgcaatctgat

SEQ ID NO: 797859 - DNA, 20 bp, mouse
gtcctagtgcgtgaacagtc

SEQ ID NO: 797860 - DNA, 20 bp, mouse
gctgggcgcgcgtccccgcg

SEQ ID NO: 797861 - DNA, 20 bp, mouse
ggggccgaacggtcaggggc

SEQ ID NO: 797862 - DNA, 20 bp, mouse
gaccagaggcacccgtgggg

SEQ ID NO: 797863 - DNA, 20 bp, mouse
gttcacgcactaggagcctg

SEQ ID NO: 797864 - DNA, 20 bp, mouse
gcctgaggctaggaacctcg

SEQ ID NO: 797865 - DNA, 20 bp, mouse
gggccaggcagtagagggga

SEQ ID NO: 797866 - DNA, 20 bp, mouse
gtccaccgaagcccgaaagg

SEQ ID NO: 797867 - DNA, 20 bp, mouse
gctgacccgcgacttctgaa

SEQ ID NO: 797868 - DNA, 20 bp, mouse
gaagtctccgagcctggagc

SEQ ID NO: 797869 - DNA, 20 bp, mouse
gttcgcgcggccctctggga

SEQ ID NO: 797870 - DNA, 20 bp, mouse
gcggtcccttcagaagtcgc

SEQ ID NO: 797871 - DNA, 20 bp, mouse
gaccgccccctttcgggctt

SEQ ID NO: 797872 - DNA, 20 bp, mouse
ggccccctttcgggcttcgg

SEQ ID NO: 797873 - DNA, 20 bp, mouse
gcgggcttcggtggagtggg

SEQ ID NO: 797874 - DNA, 20 bp, mouse
gagtgggaggagtaaagtga

SEQ ID NO: 797875 - DNA, 20 bp, mouse
ggtaataaggggctgggcaa

SEQ ID NO: 797876 - DNA, 20 bp, mouse
gaactgaggctacagagcta

SEQ ID NO: 797877 - DNA, 20 bp, mouse
gggcgtgggcctcctctagt

SEQ ID NO: 797878 - DNA, 20 bp, mouse
gctcccagtcacactcttgg

SEQ ID NO: 797879 - DNA, 20 bp, mouse
gcaggcctgccaactagagg

SEQ ID NO: 797880 - DNA, 20 bp, mouse
gaactggaattcccgggaag

SEQ ID NO: 797881 - DNA, 20 bp, mouse
gtatgcaagcgctgtccacc

SEQ ID NO: 797882 - DNA, 20 bp, mouse
gcccccagctgacatcagcg

SEQ ID NO: 797883 - DNA, 20 bp, mouse
gttcctccaagagtgtgact

SEQ ID NO: 797884 - DNA, 20 bp, mouse
ggtgaccctgaggattgatt

SEQ ID NO: 797885 - DNA, 20 bp, mouse
ggctgggggagtggtttcag

SEQ ID NO: 797886 - DNA, 20 bp, mouse
ggacaccaggccgacgtccc

SEQ ID NO: 797887 - DNA, 20 bp, mouse
ggcgattagacctgggacgt

SEQ ID NO: 797888 - DNA, 20 bp, mouse
ggcgccgggcggtggacacc

SEQ ID NO: 797889 - DNA, 20 bp, mouse
gggcccgcccctcgcacctg

SEQ ID NO: 797890 - DNA, 20 bp, mouse
ggcgcaccgaacgcctctct

SEQ ID NO: 797891 - DNA, 20 bp, mouse
ggccccggtgcgcgagctcg

SEQ ID NO: 797892 - DNA, 20 bp, mouse
gagctcgcccgcaggtgcga

SEQ ID NO: 797893 - DNA, 20 bp, mouse
ggtcacgtgcgcgcgccggg

SEQ ID NO: 797894 - DNA, 20 bp, mouse
gccgggagctcgggacgggt

SEQ ID NO: 797895 - DNA, 20 bp, mouse
gggcagaggacttgtggggt

SEQ ID NO: 797896 - DNA, 20 bp, mouse
gcggagacacgcaaatgaac

SEQ ID NO: 797897 - DNA, 20 bp, mouse
gggcgcgcggcaccatacca

SEQ ID NO: 797898 - DNA, 20 bp, mouse
gaggccgcggctggtggggt

SEQ ID NO: 797899 - DNA, 20 bp, mouse
gaaccagcttgccgtagggg

SEQ ID NO: 797900 - DNA, 20 bp, mouse
gtggttggagaaccctggta

SEQ ID NO: 797901 - DNA, 20 bp, mouse
ggacacgcaaatgaaccggc

SEQ ID NO: 797902 - DNA, 20 bp, mouse
gccggccgccgctcaggccc

SEQ ID NO: 797903 - DNA, 20 bp, mouse
gttcggtcttgcagacgctc

SEQ ID NO: 797904 - DNA, 20 bp, mouse
gatgctctgctgttctcgtc

SEQ ID NO: 797905 - DNA, 20 bp, mouse
gtctccaaccagcttgccgt

SEQ ID NO: 797906 - DNA, 20 bp, mouse
ggaggcgcgggcaatggcgg

SEQ ID NO: 797907 - DNA, 20 bp, mouse
ggggtctcggcgcagtctgc

SEQ ID NO: 797908 - DNA, 20 bp, mouse
gctcgcgcggccgggaacgc

SEQ ID NO: 797909 - DNA, 20 bp, mouse
gccaaccgagcgcgctcgcg

SEQ ID NO: 797910 - DNA, 20 bp, mouse
gaggaaaagcgcttcgaggg

SEQ ID NO: 797911 - DNA, 20 bp, mouse
ggccaactgccgccccgtac

SEQ ID NO: 797912 - DNA, 20 bp, mouse
ggcgcctcggacaccggtac

SEQ ID NO: 797913 - DNA, 20 bp, mouse
gaggcgatggggagctgacc

SEQ ID NO: 797914 - DNA, 20 bp, mouse
gcccggcgacccggcgttcc

SEQ ID NO: 797915 - DNA, 20 bp, mouse
gggcggcagcgcacaggtcc

SEQ ID NO: 797916 - DNA, 20 bp, mouse
gccgggctctccaaacgcgt

SEQ ID NO: 797917 - DNA, 20 bp, mouse
gccggcgcgaggggtgtgca

SEQ ID NO: 797918 - DNA, 20 bp, mouse
gaccgagaggagaaccgggt

SEQ ID NO: 797919 - DNA, 20 bp, mouse
gccggggcggggtctagcgt

SEQ ID NO: 797920 - DNA, 20 bp, mouse
gggaaggaggaagatcctaa

SEQ ID NO: 797921 - DNA, 20 bp, mouse
ggcggggtctagcgtggggt

SEQ ID NO: 797922 - DNA, 20 bp, mouse
gcgggtggcaggatcctatt

SEQ ID NO: 797923 - DNA, 20 bp, mouse
gcgccgccccggctcctacc

SEQ ID NO: 797924 - DNA, 20 bp, mouse
gggagagcccggcccgtgca

SEQ ID NO: 797925 - DNA, 20 bp, mouse
ggacgggcgggaggacacga

SEQ ID NO: 797926 - DNA, 20 bp, mouse
gttctctgggagatttgcat

SEQ ID NO: 797927 - DNA, 20 bp, mouse
gacagagtagttacatgcag

SEQ ID NO: 797928 - DNA, 20 bp, mouse
gaacataactaacattggtt

SEQ ID NO: 797929 - DNA, 20 bp, mouse
gaatcacacagtgaaagcca

SEQ ID NO: 797930 - DNA, 20 bp, mouse
gagaaaattctatttttctc

SEQ ID NO: 797931 - DNA, 20 bp, mouse
gtatgcttaccatccataag

SEQ ID NO: 797932 - DNA, 20 bp, mouse
gactgttggaagtcaggctc

SEQ ID NO: 797933 - DNA, 20 bp, mouse
gaaacatgaagaaccttgta

SEQ ID NO: 797934 - DNA, 20 bp, mouse
ggaactcctcctcttatgga

SEQ ID NO: 797935 - DNA, 20 bp, mouse
gccattctcgtaaaattaca

SEQ ID NO: 797936 - DNA, 20 bp, mouse
gaatgtctgcagggccggat

SEQ ID NO: 797937 - DNA, 20 bp, mouse
ggaacccagccgtcagagcg

SEQ ID NO: 797938 - DNA, 20 bp, mouse
gtccccgtggggtgctggag

SEQ ID NO: 797939 - DNA, 20 bp, mouse
gggactagaggggagcctcc

SEQ ID NO: 797940 - DNA, 20 bp, mouse
gggagcgcggctgggactag

SEQ ID NO: 797941 - DNA, 20 bp, mouse
gccacgcccgcggctgtcga

SEQ ID NO: 797942 - DNA, 20 bp, mouse
gcagagcgaggtgctgagtt

SEQ ID NO: 797943 - DNA, 20 bp, mouse
gccggccctgcagacattcc

SEQ ID NO: 797944 - DNA, 20 bp, mouse
gagcctcctggaatgtctgc

SEQ ID NO: 797945 - DNA, 20 bp, mouse
ggagaccctccaagcccatc

SEQ ID NO: 797946 - DNA, 20 bp, mouse
gtggaagcgagagtgggcca

SEQ ID NO: 797947 - DNA, 20 bp, mouse
ggcagttcacggggtacagg

SEQ ID NO: 797948 - DNA, 20 bp, mouse
gcccgagctggaagcgagag

SEQ ID NO: 797949 - DNA, 20 bp, mouse
ggcgagaaggagtgaacgac

SEQ ID NO: 797950 - DNA, 20 bp, mouse
gggaggggctggcacggcgg

SEQ ID NO: 797951 - DNA, 20 bp, mouse
gactccttctcgcaccggag

SEQ ID NO: 797952 - DNA, 20 bp, mouse
gggcctggctctactgagaa

SEQ ID NO: 797953 - DNA, 20 bp, mouse
ggaagtggatcgcagttcac

SEQ ID NO: 797954 - DNA, 20 bp, mouse
gggagacttgagctagtcca

SEQ ID NO: 797955 - DNA, 20 bp, mouse
gagagtgggccagggcgctc

SEQ ID NO: 797956 - DNA, 20 bp, mouse
ggtcgcgttgggatatagac

SEQ ID NO: 797957 - DNA, 20 bp, mouse
gaggcaacggagggagtcag

SEQ ID NO: 797958 - DNA, 20 bp, mouse
gagactgcaggtttggtctg

SEQ ID NO: 797959 - DNA, 20 bp, mouse
gctctggaggggcaggtggt

SEQ ID NO: 797960 - DNA, 20 bp, mouse
gaaggggaagtgcagtcggg

SEQ ID NO: 797961 - DNA, 20 bp, mouse
ggggatatagactggaacag

SEQ ID NO: 797962 - DNA, 20 bp, mouse
gcagtccagcgtggcgggaa

SEQ ID NO: 797963 - DNA, 20 bp, mouse
gcgtggcgggaatggagaag

SEQ ID NO: 797964 - DNA, 20 bp, mouse
gtgggagagccagtccagcg

SEQ ID NO: 797965 - DNA, 20 bp, mouse
gcaggaggtgggggtcgcgt

SEQ ID NO: 797966 - DNA, 20 bp, mouse
gggcccccggccgagtcgga

SEQ ID NO: 797967 - DNA, 20 bp, mouse
gcacgcacgcggaccgtgaa

SEQ ID NO: 797968 - DNA, 20 bp, mouse
gggcgcgggcggtgaccgga

SEQ ID NO: 797969 - DNA, 20 bp, mouse
ggaggggcggcgggtcacgt

SEQ ID NO: 797970 - DNA, 20 bp, mouse
gggagccgtccgactcggcc

SEQ ID NO: 797971 - DNA, 20 bp, mouse
gcccgccctgggcgctccga

SEQ ID NO: 797972 - DNA, 20 bp, mouse
gccgctggagccgtccgact

SEQ ID NO: 797973 - DNA, 20 bp, mouse
ggagcgcccagggcgggaga

SEQ ID NO: 797974 - DNA, 20 bp, mouse
ggggacgcggcgtgagacgg

SEQ ID NO: 797975 - DNA, 20 bp, mouse
gcgtgcacgcgcacgtccgc

SEQ ID NO: 797976 - DNA, 20 bp, mouse
ggctgctggaaggatcagtc

SEQ ID NO: 797977 - DNA, 20 bp, mouse
gttcccgccgctggggtcag

SEQ ID NO: 797978 - DNA, 20 bp, mouse
gcccggccgcgcctcagccc

SEQ ID NO: 797979 - DNA, 20 bp, mouse
gccgctcacgccagcgtcgg

SEQ ID NO: 797980 - DNA, 20 bp, mouse
gggcgtgagcggctgctgga

SEQ ID NO: 797981 - DNA, 20 bp, mouse
gcttcccgccaaaacgcccg

SEQ ID NO: 797982 - DNA, 20 bp, mouse
gcaggcggaagtgcgcgcgt

SEQ ID NO: 797983 - DNA, 20 bp, mouse
gggaaggatcagtcgggact

SEQ ID NO: 797984 - DNA, 20 bp, mouse
gggagccaataaagctacac

SEQ ID NO: 797985 - DNA, 20 bp, mouse
gcgctccccgggctgaggcg

SEQ ID NO: 797986 - DNA, 20 bp, mouse
ggcccggccaggtgctacct

SEQ ID NO: 797987 - DNA, 20 bp, mouse
gtagcacctggccgggctga

SEQ ID NO: 797988 - DNA, 20 bp, mouse
gggtctggtccctatggcaa

SEQ ID NO: 797989 - DNA, 20 bp, mouse
gggactgtacactaccgcaa

SEQ ID NO: 797990 - DNA, 20 bp, mouse
ggagcccgccctcaacgcag

SEQ ID NO: 797991 - DNA, 20 bp, mouse
gcagcctctgcgttgagggc

SEQ ID NO: 797992 - DNA, 20 bp, mouse
gtgctggggtctggtcccta

SEQ ID NO: 797993 - DNA, 20 bp, mouse
gatgcaggattgagccgttg

SEQ ID NO: 797994 - DNA, 20 bp, mouse
gaaagtcatggccaacctac

SEQ ID NO: 797995 - DNA, 20 bp, mouse
gtccaagccaaggtagcacc

SEQ ID NO: 797996 - DNA, 20 bp, mouse
gaggatgcagcggttgtaaa

SEQ ID NO: 797997 - DNA, 20 bp, mouse
gcactgggagcgagcggctt

SEQ ID NO: 797998 - DNA, 20 bp, mouse
gtcccgctgcgggctccgag

SEQ ID NO: 797999 - DNA, 20 bp, mouse
ggcgggcagttgggtcgtgg

SEQ ID NO: 798000 - DNA, 20 bp, mouse
gtcagctgcccacttagttt

SEQ ID NO: 798001 - DNA, 20 bp, mouse
gccagtctccaaaactaagt

SEQ ID NO: 798002 - DNA, 20 bp, mouse
gcgcaccggcggttgggcgg

SEQ ID NO: 798003 - DNA, 20 bp, mouse
gcggagcccgcagcgggact

SEQ ID NO: 798004 - DNA, 20 bp, mouse
gcagttatgaacatgtggga

SEQ ID NO: 798005 - DNA, 20 bp, mouse
gtgggagcgagcggcttggg

SEQ ID NO: 798006 - DNA, 20 bp, mouse
ggagacgaactccctttccc

SEQ ID NO: 798007 - DNA, 20 bp, mouse
gaactccctttccccgggaa

SEQ ID NO: 798008 - DNA, 20 bp, mouse
gtcacaaagcggacctaaaa

SEQ ID NO: 798009 - DNA, 20 bp, mouse
gtctggagcgcgggcgtggc

SEQ ID NO: 798010 - DNA, 20 bp, mouse
gtggcggggtgacagcgagc

SEQ ID NO: 798011 - DNA, 20 bp, mouse
gaaagcctttcccggggaaa

SEQ ID NO: 798012 - DNA, 20 bp, mouse
ggcgaaacggtcacgtggtc

SEQ ID NO: 798013 - DNA, 20 bp, mouse
gcgtttgcgaaacggtcacg

SEQ ID NO: 798014 - DNA, 20 bp, mouse
gagctccgtcgcgaacggat

SEQ ID NO: 798015 - DNA, 20 bp, mouse
gcacctcacggggtagttga

SEQ ID NO: 798016 - DNA, 20 bp, mouse
gcccgcccgcaaagggaaga

SEQ ID NO: 798017 - DNA, 20 bp, mouse
gcgcgcggccggagctctag

SEQ ID NO: 798018 - DNA, 20 bp, mouse
gcccggcccccgggctccga

SEQ ID NO: 798019 - DNA, 20 bp, mouse
gagccagcgccggtgtgagg

SEQ ID NO: 798020 - DNA, 20 bp, mouse
gccgcgcgcctgcgcagtaa

SEQ ID NO: 798021 - DNA, 20 bp, mouse
gctcgcacccgctagagctc

SEQ ID NO: 798022 - DNA, 20 bp, mouse
ggaagagggtgtggctagcg

SEQ ID NO: 798023 - DNA, 20 bp, mouse
gggtcctgagctcctagcat

SEQ ID NO: 798024 - DNA, 20 bp, mouse
gcattggcagcatgttaagg

SEQ ID NO: 798025 - DNA, 20 bp, mouse
gataagccagcgccggtgtg

SEQ ID NO: 798026 - DNA, 20 bp, mouse
ggggcagtgcagttattctc

SEQ ID NO: 798027 - DNA, 20 bp, mouse
gaaagcccaagcccaaagca

SEQ ID NO: 798028 - DNA, 20 bp, mouse
ggaaaagatccagctggatc

SEQ ID NO: 798029 - DNA, 20 bp, mouse
gcaacgcagcagaagcaagg

SEQ ID NO: 798030 - DNA, 20 bp, mouse
gttaacggagtgaccaaagc

SEQ ID NO: 798031 - DNA, 20 bp, mouse
gctagctgattagcatagag

SEQ ID NO: 798032 - DNA, 20 bp, mouse
gttctcaggcacaagcgaaa

SEQ ID NO: 798033 - DNA, 20 bp, mouse
gcactgcccaagccctgctt

SEQ ID NO: 798034 - DNA, 20 bp, mouse
gtaaacagctccgaggctcc

SEQ ID NO: 798035 - DNA, 20 bp, mouse
gtaagacaaggcagcttgtg

SEQ ID NO: 798036 - DNA, 20 bp, mouse
gtctacaggagcacatcggt

SEQ ID NO: 798037 - DNA, 20 bp, mouse
gagcacatcggtcggagaac

SEQ ID NO: 798038 - DNA, 20 bp, mouse
gcgctgcggcggggtgaagc

SEQ ID NO: 798039 - DNA, 20 bp, mouse
ggggagcggtgacgtcagtg

SEQ ID NO: 798040 - DNA, 20 bp, mouse
gctgctcccactctccgctg

SEQ ID NO: 798041 - DNA, 20 bp, mouse
gggagctgagtgcgttttag

SEQ ID NO: 798042 - DNA, 20 bp, mouse
gagcacctgctatggagtga

SEQ ID NO: 798043 - DNA, 20 bp, mouse
ggggtctgggttttacaggg

SEQ ID NO: 798044 - DNA, 20 bp, mouse
gccccgccgcagcggagagt

SEQ ID NO: 798045 - DNA, 20 bp, mouse
gctgggttttacagggtgga

SEQ ID NO: 798046 - DNA, 20 bp, mouse
ggagccccaggccgcggaga

SEQ ID NO: 798047 - DNA, 20 bp, mouse
ggcctggggctcgccggcgc

SEQ ID NO: 798048 - DNA, 20 bp, mouse
gttcggccgcgggcctccgg

SEQ ID NO: 798049 - DNA, 20 bp, mouse
gcggcctcgtcgcgtctcga

SEQ ID NO: 798050 - DNA, 20 bp, mouse
ggcgcggacggccttctccg

SEQ ID NO: 798051 - DNA, 20 bp, mouse
ggaggcgggccgcggcgcga

SEQ ID NO: 798052 - DNA, 20 bp, mouse
gaggatcccgcagccaccgg

SEQ ID NO: 798053 - DNA, 20 bp, mouse
gtcccggcggctgaggggga

SEQ ID NO: 798054 - DNA, 20 bp, mouse
gggcccgtcgagacgcgacg

SEQ ID NO: 798055 - DNA, 20 bp, mouse
gacgcgacgaggccgccggt

SEQ ID NO: 798056 - DNA, 20 bp, mouse
gccggcttgcggggcctact

SEQ ID NO: 798057 - DNA, 20 bp, mouse
ggccgagagggcggagagga

SEQ ID NO: 798058 - DNA, 20 bp, mouse
gaaagagccagaagccgaga

SEQ ID NO: 798059 - DNA, 20 bp, mouse
gtccgagcgctctgcatcat

SEQ ID NO: 798060 - DNA, 20 bp, mouse
gcccgccatgccagcgccgg

SEQ ID NO: 798061 - DNA, 20 bp, mouse
gcatgccagcgccggaggac

SEQ ID NO: 798062 - DNA, 20 bp, mouse
ggaagggtgcggctacttcg

SEQ ID NO: 798063 - DNA, 20 bp, mouse
gcgtcccgccatgccagcgc

SEQ ID NO: 798064 - DNA, 20 bp, mouse
gaagtcctgtcctccggcgc

SEQ ID NO: 798065 - DNA, 20 bp, mouse
gttgcggggcctactgggaa

SEQ ID NO: 798066 - DNA, 20 bp, mouse
gaaggagcaagtgggcacga

SEQ ID NO: 798067 - DNA, 20 bp, mouse
gggggcggggctatccttgg

SEQ ID NO: 798068 - DNA, 20 bp, mouse
gttacaatgaaggagcaagt

SEQ ID NO: 798069 - DNA, 20 bp, mouse
gcggctctttggaaagaccc

SEQ ID NO: 798070 - DNA, 20 bp, mouse
gttaacctagacccacacct

SEQ ID NO: 798071 - DNA, 20 bp, mouse
gaagcagaccccagcggtcc

SEQ ID NO: 798072 - DNA, 20 bp, mouse
ggggcgtgaccagatcttaa

SEQ ID NO: 798073 - DNA, 20 bp, mouse
gtcggctcccggcctcccgt

SEQ ID NO: 798074 - DNA, 20 bp, mouse
gggttggtgatgctagtgat

SEQ ID NO: 798075 - DNA, 20 bp, mouse
gctcaagtgaccttcttaga

SEQ ID NO: 798076 - DNA, 20 bp, mouse
gtaagggagccgttcttcaa

SEQ ID NO: 798077 - DNA, 20 bp, mouse
ggcaaggccccagttcctgt

SEQ ID NO: 798078 - DNA, 20 bp, mouse
gagtgtgccaacaggaactg

SEQ ID NO: 798079 - DNA, 20 bp, mouse
ggtgtccggaatctatttaa

SEQ ID NO: 798080 - DNA, 20 bp, mouse
gtaggcattggggacctact

SEQ ID NO: 798081 - DNA, 20 bp, mouse
gagccgttcttcaaagggtg

SEQ ID NO: 798082 - DNA, 20 bp, mouse
ggccttaaccaccttctcaa

SEQ ID NO: 798083 - DNA, 20 bp, mouse
gagccacaaaccccgaggtg

SEQ ID NO: 798084 - DNA, 20 bp, mouse
gtcaactaacagctgtccca

SEQ ID NO: 798085 - DNA, 20 bp, mouse
ggggggcatagtgtgccaac

SEQ ID NO: 798086 - DNA, 20 bp, mouse
gcgggtaacggggagctcag

SEQ ID NO: 798087 - DNA, 20 bp, mouse
gggccccgcgaaggcgtcag

SEQ ID NO: 798088 - DNA, 20 bp, mouse
gggagccggcgaccgagagc

SEQ ID NO: 798089 - DNA, 20 bp, mouse
gcggggcgaggcccactgcg

SEQ ID NO: 798090 - DNA, 20 bp, mouse
gttacccgctggggtcgaaa

SEQ ID NO: 798091 - DNA, 20 bp, mouse
gcgccccggctctcggtcgc

SEQ ID NO: 798092 - DNA, 20 bp, mouse
gaaacggatgcgctccgctg

SEQ ID NO: 798093 - DNA, 20 bp, mouse
gggcgggccctggcggaggg

SEQ ID NO: 798094 - DNA, 20 bp, mouse
gtgggcctcgccccggctct

SEQ ID NO: 798095 - DNA, 20 bp, mouse
ggtcgtgctcgcctcgcagt

SEQ ID NO: 798096 - DNA, 20 bp, mouse
gcgcccctagctaacaggta

SEQ ID NO: 798097 - DNA, 20 bp, mouse
ggaggcacagggacgagctt

SEQ ID NO: 798098 - DNA, 20 bp, mouse
gccacgcgcccctagctaac

SEQ ID NO: 798099 - DNA, 20 bp, mouse
gagctaggggcgcgtggcag

SEQ ID NO: 798100 - DNA, 20 bp, mouse
gtcaggctccgcagtgaggg

SEQ ID NO: 798101 - DNA, 20 bp, mouse
gcctgccgctcccgcgcctg

SEQ ID NO: 798102 - DNA, 20 bp, mouse
gggctcaggctccgcagtga

SEQ ID NO: 798103 - DNA, 20 bp, mouse
gcaagtagagagttgtggag

SEQ ID NO: 798104 - DNA, 20 bp, mouse
gtggggcaagtagagagttg

SEQ ID NO: 798105 - DNA, 20 bp, mouse
gtttccctacctgttagcta

SEQ ID NO: 798106 - DNA, 20 bp, mouse
ggcccggccgccccgcgagt

SEQ ID NO: 798107 - DNA, 20 bp, mouse
gtcgcggggcggccgggcaa

SEQ ID NO: 798108 - DNA, 20 bp, mouse
ggcggggcgccaggtgcggg

SEQ ID NO: 798109 - DNA, 20 bp, mouse
ggccaccacgcccactcgcg

SEQ ID NO: 798110 - DNA, 20 bp, mouse
gagcagggtgagcccagaga

SEQ ID NO: 798111 - DNA, 20 bp, mouse
gcttcaaggacaaggttctt

SEQ ID NO: 798112 - DNA, 20 bp, mouse
gcctgaggcttcccgcgcgc

SEQ ID NO: 798113 - DNA, 20 bp, mouse
ggtgtcctgggccccttgcc

SEQ ID NO: 798114 - DNA, 20 bp, mouse
gagaggcagggtctccagtc

SEQ ID NO: 798115 - DNA, 20 bp, mouse
ggatctggtgagacacgcaa

SEQ ID NO: 798116 - DNA, 20 bp, mouse
gcggacacgagcatccctca

SEQ ID NO: 798117 - DNA, 20 bp, mouse
gcggccgctcgcacacctgg

SEQ ID NO: 798118 - DNA, 20 bp, mouse
gcagctccgaaaagccccga

SEQ ID NO: 798119 - DNA, 20 bp, mouse
gccgaaaagccccgagggac

SEQ ID NO: 798120 - DNA, 20 bp, mouse
gcgggcgcgcccccggccta

SEQ ID NO: 798121 - DNA, 20 bp, mouse
gtctcccgctgctgcgcggt

SEQ ID NO: 798122 - DNA, 20 bp, mouse
gtgcgggatctagcggacta

SEQ ID NO: 798123 - DNA, 20 bp, mouse
gctgtcagggtattgccccg

SEQ ID NO: 798124 - DNA, 20 bp, mouse
gggcgcccaccgcgcagcag

SEQ ID NO: 798125 - DNA, 20 bp, mouse
gtgtgcgcgctccgtaggcc

SEQ ID NO: 798126 - DNA, 20 bp, mouse
gccaccgagctgtaccgctc

SEQ ID NO: 798127 - DNA, 20 bp, mouse
ggcggggcgctcggcggaga

SEQ ID NO: 798128 - DNA, 20 bp, mouse
gagcgagcgagcgaacgtgc

SEQ ID NO: 798129 - DNA, 20 bp, mouse
gcgtcgggagggcgctcctc

SEQ ID NO: 798130 - DNA, 20 bp, mouse
ggggagggcgctcctcagga

SEQ ID NO: 798131 - DNA, 20 bp, mouse
ggaggcgccgagccgtcctg

SEQ ID NO: 798132 - DNA, 20 bp, mouse
gagcgagcgaacgtgcgggc

SEQ ID NO: 798133 - DNA, 20 bp, mouse
ggggctgtgcgtctacagac

SEQ ID NO: 798134 - DNA, 20 bp, mouse
ggctcggccgcgcgtcggga

SEQ ID NO: 798135 - DNA, 20 bp, mouse
ggaagcagggctcagatctc

SEQ ID NO: 798136 - DNA, 20 bp, mouse
gagagcgcgcagacgcagta

SEQ ID NO: 798137 - DNA, 20 bp, mouse
gggggcggagccagccgggt

SEQ ID NO: 798138 - DNA, 20 bp, mouse
ggcggacggtcgctaggcga

SEQ ID NO: 798139 - DNA, 20 bp, mouse
gtcgctaggcgacggcgcga

SEQ ID NO: 798140 - DNA, 20 bp, mouse
gcccgcaaacccccgagcgt

SEQ ID NO: 798141 - DNA, 20 bp, mouse
ggtcagacgcccacgctcgg

SEQ ID NO: 798142 - DNA, 20 bp, mouse
gcgggcgcgcgctccagcgc

SEQ ID NO: 798143 - DNA, 20 bp, mouse
gtgggtgttgccgggtgtcg

SEQ ID NO: 798144 - DNA, 20 bp, mouse
gtcaagccaaagctctccga

SEQ ID NO: 798145 - DNA, 20 bp, mouse
gcccgggcagcgctgcggct

SEQ ID NO: 798146 - DNA, 20 bp, mouse
gacagagggtgtggcaaaca

SEQ ID NO: 798147 - DNA, 20 bp, mouse
gcggctgccggcctcctatg

SEQ ID NO: 798148 - DNA, 20 bp, mouse
ggcaccgcgggcgacgtact

SEQ ID NO: 798149 - DNA, 20 bp, mouse
ggcggcgcgaatcttggaac

SEQ ID NO: 798150 - DNA, 20 bp, mouse
gctggctgcgacctcttcgt

SEQ ID NO: 798151 - DNA, 20 bp, mouse
ggtcacgccccctcccgatg

SEQ ID NO: 798152 - DNA, 20 bp, mouse
ggacacttgtccccgaactc

SEQ ID NO: 798153 - DNA, 20 bp, mouse
gaaaccgaagtcacctcggt

SEQ ID NO: 798154 - DNA, 20 bp, mouse
gacgccccctcccgatgcgg

SEQ ID NO: 798155 - DNA, 20 bp, mouse
gaaaagctggagcggagttc

SEQ ID NO: 798156 - DNA, 20 bp, mouse
gccggcgagcgtccgagcga

SEQ ID NO: 798157 - DNA, 20 bp, mouse
ggaaaagagccaagtgtcgt

SEQ ID NO: 798158 - DNA, 20 bp, mouse
ggaacccagggcggcctggg

SEQ ID NO: 798159 - DNA, 20 bp, mouse
gtcgtcgggtgggtggggat

SEQ ID NO: 798160 - DNA, 20 bp, mouse
gagcgtccgagcgacggttg

SEQ ID NO: 798161 - DNA, 20 bp, mouse
ggagccaagtgtcgtcgggt

SEQ ID NO: 798162 - DNA, 20 bp, mouse
gatgctgatgcccttcctat

SEQ ID NO: 798163 - DNA, 20 bp, mouse
gaagtgtcgtcgggtgggtg

SEQ ID NO: 798164 - DNA, 20 bp, mouse
ggagaggcggagggcccgac

SEQ ID NO: 798165 - DNA, 20 bp, mouse
gcccttcctataggaaccca

SEQ ID NO: 798166 - DNA, 20 bp, mouse
gaggactccaagccggtaga

SEQ ID NO: 798167 - DNA, 20 bp, mouse
gcctcgcgccaggcttagtt

SEQ ID NO: 798168 - DNA, 20 bp, mouse
gggcgcggaggactccaagc

SEQ ID NO: 798169 - DNA, 20 bp, mouse
ggaaaactctgggttaccgg

SEQ ID NO: 798170 - DNA, 20 bp, mouse
gtcggctccgggccatcagg

SEQ ID NO: 798171 - DNA, 20 bp, mouse
ggcagcgccctctaccggct

SEQ ID NO: 798172 - DNA, 20 bp, mouse
gaattggagctgtcagtcat

SEQ ID NO: 798173 - DNA, 20 bp, mouse
gagtcctccgcgccacagct

SEQ ID NO: 798174 - DNA, 20 bp, mouse
ggtggcgcgagcggcgcggt

SEQ ID NO: 798175 - DNA, 20 bp, mouse
gataccgagctgtggcgcgg

SEQ ID NO: 798176 - DNA, 20 bp, mouse
gtctgaggctgaagaacaag

SEQ ID NO: 798177 - DNA, 20 bp, mouse
gagggcagagcgtgtgaatc

SEQ ID NO: 798178 - DNA, 20 bp, mouse
gaaaaggaatctgaacgaca

SEQ ID NO: 798179 - DNA, 20 bp, mouse
gggagtgggacagagatcac

SEQ ID NO: 798180 - DNA, 20 bp, mouse
gctgaaactctaaccctcgg

SEQ ID NO: 798181 - DNA, 20 bp, mouse
gggtgacttgccgtcgtgag

SEQ ID NO: 798182 - DNA, 20 bp, mouse
gctatcagaagcctgaaggc

SEQ ID NO: 798183 - DNA, 20 bp, mouse
ggaatctgaacgacagggct

SEQ ID NO: 798184 - DNA, 20 bp, mouse
gcgttctatcagaagcctga

SEQ ID NO: 798185 - DNA, 20 bp, mouse
gacttgccgtcgtgagaggt

SEQ ID NO: 798186 - DNA, 20 bp, mouse
gaacccactgacgtagtctc

SEQ ID NO: 798187 - DNA, 20 bp, mouse
gggcacgagctttacggtag

SEQ ID NO: 798188 - DNA, 20 bp, mouse
gcgccccctcggcctgtccg

SEQ ID NO: 798189 - DNA, 20 bp, mouse
gccacccgggagggaaatcc

SEQ ID NO: 798190 - DNA, 20 bp, mouse
gggcctgtccggggagggga

SEQ ID NO: 798191 - DNA, 20 bp, mouse
ggggcagaaccaacagctga

SEQ ID NO: 798192 - DNA, 20 bp, mouse
gctacccgagactacgtcag

SEQ ID NO: 798193 - DNA, 20 bp, mouse
gacatctgggacggaggcgg

SEQ ID NO: 798194 - DNA, 20 bp, mouse
gcccctcggcctgtccgggg

SEQ ID NO: 798195 - DNA, 20 bp, mouse
gggaaggggcgggcagcgca

SEQ ID NO: 798196 - DNA, 20 bp, mouse
gtgcactgcggcgcccgcgt

SEQ ID NO: 798197 - DNA, 20 bp, mouse
gcccgcgtctaccctcacct

SEQ ID NO: 798198 - DNA, 20 bp, mouse
gcacctgccgcaggtgtcgt

SEQ ID NO: 798199 - DNA, 20 bp, mouse
gcttccctcccccgaggtga

SEQ ID NO: 798200 - DNA, 20 bp, mouse
gggagcggggcacctgccgc

SEQ ID NO: 798201 - DNA, 20 bp, mouse
gatgccacccggttgcgcgt

SEQ ID NO: 798202 - DNA, 20 bp, mouse
gggcgaccccacgacacctg

SEQ ID NO: 798203 - DNA, 20 bp, mouse
gcccgcccgcccgccaggag

SEQ ID NO: 798204 - DNA, 20 bp, mouse
gcctgcggggcggggaccga

SEQ ID NO: 798205 - DNA, 20 bp, mouse
gtctaccctcacctcggggg

SEQ ID NO: 798206 - DNA, 20 bp, mouse
gcccgccgctcacctccgga

SEQ ID NO: 798207 - DNA, 20 bp, mouse
gcgcggaaggggccctggag

SEQ ID NO: 798208 - DNA, 20 bp, mouse
gggtccgggaggaggttttt

SEQ ID NO: 798209 - DNA, 20 bp, mouse
ggagacactcccaccgcccg

SEQ ID NO: 798210 - DNA, 20 bp, mouse
gggccccttccgcgggcggt

SEQ ID NO: 798211 - DNA, 20 bp, mouse
gccactcctggctggagcaa

SEQ ID NO: 798212 - DNA, 20 bp, mouse
gggcgcgcgccaatgggcag

SEQ ID NO: 798213 - DNA, 20 bp, mouse
gcagagcactcgccgctcca

SEQ ID NO: 798214 - DNA, 20 bp, mouse
gggagcggagaaaactagtt

SEQ ID NO: 798215 - DNA, 20 bp, mouse
gactcccaccgcccgcggaa

SEQ ID NO: 798216 - DNA, 20 bp, mouse
gggccgtgacgtagagagat

SEQ ID NO: 798217 - DNA, 20 bp, mouse
gcaaccggaagctgggtatg

SEQ ID NO: 798218 - DNA, 20 bp, mouse
gagactatcgggtagagctg

SEQ ID NO: 798219 - DNA, 20 bp, mouse
gctacccgatagtctatttt

SEQ ID NO: 798220 - DNA, 20 bp, mouse
gagtactgccccgagatccg

SEQ ID NO: 798221 - DNA, 20 bp, mouse
gggaacctcaaccggaagct

SEQ ID NO: 798222 - DNA, 20 bp, mouse
gcagaaagacgcctgcgcgg

SEQ ID NO: 798223 - DNA, 20 bp, mouse
gtcgccaaaaatagactatc

SEQ ID NO: 798224 - DNA, 20 bp, mouse
ggagactccgcctcggttac

SEQ ID NO: 798225 - DNA, 20 bp, mouse
gggcttgcggagcggtgcgt

SEQ ID NO: 798226 - DNA, 20 bp, mouse
gggcctaagcagggtagggg

SEQ ID NO: 798227 - DNA, 20 bp, mouse
gcgcagaagggcaaaggcga

SEQ ID NO: 798228 - DNA, 20 bp, mouse
ggccgcgcgaggcttgaact

SEQ ID NO: 798229 - DNA, 20 bp, mouse
gagccaggagtcctctgctt

SEQ ID NO: 798230 - DNA, 20 bp, mouse
gctcctggccccggggaagg

SEQ ID NO: 798231 - DNA, 20 bp, mouse
gtaccaaagcagaggactcc

SEQ ID NO: 798232 - DNA, 20 bp, mouse
ggagagatctaccaaagcag

SEQ ID NO: 798233 - DNA, 20 bp, mouse
gcgcgaggaaaattaggact

SEQ ID NO: 798234 - DNA, 20 bp, mouse
ggcgggcctaagcagggtag

SEQ ID NO: 798235 - DNA, 20 bp, mouse
gggcacgcctacctgtgcac

SEQ ID NO: 798236 - DNA, 20 bp, mouse
gcgcacgcgcgcgcccctcc

SEQ ID NO: 798237 - DNA, 20 bp, mouse
gagggcgcggaggacggccg

SEQ ID NO: 798238 - DNA, 20 bp, mouse
gaggggcggccggttgggtg

SEQ ID NO: 798239 - DNA, 20 bp, mouse
ggacgcgcgctggaaaggca

SEQ ID NO: 798240 - DNA, 20 bp, mouse
gcggaagtgagcggtggccg

SEQ ID NO: 798241 - DNA, 20 bp, mouse
ggtgccggggcaggacgcgc

SEQ ID NO: 798242 - DNA, 20 bp, mouse
gtgccccggcacactgggcg

SEQ ID NO: 798243 - DNA, 20 bp, mouse
gctgcgccggaagtgagcgg

SEQ ID NO: 798244 - DNA, 20 bp, mouse
ggggccgcgcggcccaaggg

SEQ ID NO: 798245 - DNA, 20 bp, mouse
gtgagggccgcgcggcccaa

SEQ ID NO: 798246 - DNA, 20 bp, mouse
gagtgtcagaagtgtcaaag

SEQ ID NO: 798247 - DNA, 20 bp, mouse
gcaccaccggagaacctgtt

SEQ ID NO: 798248 - DNA, 20 bp, mouse
ggtggctgtcccagggatat

SEQ ID NO: 798249 - DNA, 20 bp, mouse
gcccactccaagctgaaagg

SEQ ID NO: 798250 - DNA, 20 bp, mouse
ggtcaaaggggacaccaaac

SEQ ID NO: 798251 - DNA, 20 bp, mouse
gctgaaaggtggctgtccca

SEQ ID NO: 798252 - DNA, 20 bp, mouse
gctaaggcttgcctgcatcc

SEQ ID NO: 798253 - DNA, 20 bp, mouse
gcaccaaacaggttctccgg

SEQ ID NO: 798254 - DNA, 20 bp, mouse
gtaacctgccaggggcacca

SEQ ID NO: 798255 - DNA, 20 bp, mouse
gaaagagcataacctgccag

SEQ ID NO: 798256 - DNA, 20 bp, mouse
gtggccggaccgtgggaatc

SEQ ID NO: 798257 - DNA, 20 bp, mouse
gccacgggccaatcactaac

SEQ ID NO: 798258 - DNA, 20 bp, mouse
ggggcggagggtatggagct

SEQ ID NO: 798259 - DNA, 20 bp, mouse
gcccgcccccggttagtgat

SEQ ID NO: 798260 - DNA, 20 bp, mouse
gttaagactcgcccttccct

SEQ ID NO: 798261 - DNA, 20 bp, mouse
gctagactggggggggcgga

SEQ ID NO: 798262 - DNA, 20 bp, mouse
gccccccagtctagggctcc

SEQ ID NO: 798263 - DNA, 20 bp, mouse
gcgggccaatcactaaccgg

SEQ ID NO: 798264 - DNA, 20 bp, mouse
gcggcggtgaacgaacctca

SEQ ID NO: 798265 - DNA, 20 bp, mouse
gcccttccctgggtctatta

SEQ ID NO: 798266 - DNA, 20 bp, mouse
gagtggggcagcctcagaga

SEQ ID NO: 798267 - DNA, 20 bp, mouse
gagggccagaaggctgcatg

SEQ ID NO: 798268 - DNA, 20 bp, mouse
ggagagatgcagggaagcga

SEQ ID NO: 798269 - DNA, 20 bp, mouse
gtggctgggtatggataaca

SEQ ID NO: 798270 - DNA, 20 bp, mouse
gtgcatgaggaccacgagtg

SEQ ID NO: 798271 - DNA, 20 bp, mouse
gagtggggcccgcagagaaa

SEQ ID NO: 798272 - DNA, 20 bp, mouse
ggaggctgggagccgaaact

SEQ ID NO: 798273 - DNA, 20 bp, mouse
ggataacagggtgcactggg

SEQ ID NO: 798274 - DNA, 20 bp, mouse
gtgggagccgaaactgggat

SEQ ID NO: 798275 - DNA, 20 bp, mouse
gcatctctctcgtagtagtg

SEQ ID NO: 798276 - DNA, 20 bp, mouse
gcggctggccgcggactcgc

SEQ ID NO: 798277 - DNA, 20 bp, mouse
gtccgtgtgacagaagtggt

SEQ ID NO: 798278 - DNA, 20 bp, mouse
ggaaggttagcagcccggga

SEQ ID NO: 798279 - DNA, 20 bp, mouse
gagggtctccctgccagggc

SEQ ID NO: 798280 - DNA, 20 bp, mouse
gggagttggtgatgtcagac

SEQ ID NO: 798281 - DNA, 20 bp, mouse
gccagggccggccgatgaaa

SEQ ID NO: 798282 - DNA, 20 bp, mouse
gagccgcgcggtgctcccca

SEQ ID NO: 798283 - DNA, 20 bp, mouse
ggaactctggtccccccctt

SEQ ID NO: 798284 - DNA, 20 bp, mouse
ggctcctgatgggcagttcg

SEQ ID NO: 798285 - DNA, 20 bp, mouse
gtcgcagagggaagcctctg

SEQ ID NO: 798286 - DNA, 20 bp, mouse
gtgcacgcacatatattcat

SEQ ID NO: 798287 - DNA, 20 bp, mouse
gcgtgcccaggtggggattg

SEQ ID NO: 798288 - DNA, 20 bp, mouse
gtgtaaaagcaaagcctaga

SEQ ID NO: 798289 - DNA, 20 bp, mouse
gtctgtgcaagcatttatct

SEQ ID NO: 798290 - DNA, 20 bp, mouse
gcatacgtctactagctgag

SEQ ID NO: 798291 - DNA, 20 bp, mouse
gcctggagagcgaaaggggc

SEQ ID NO: 798292 - DNA, 20 bp, mouse
gaacgcaggtcctacgggtc

SEQ ID NO: 798293 - DNA, 20 bp, mouse
gaagaatggccgtgtagatg

SEQ ID NO: 798294 - DNA, 20 bp, mouse
gtggggcctggagagcgaaa

SEQ ID NO: 798295 - DNA, 20 bp, mouse
gtgcacttaagcgcgtgccc

SEQ ID NO: 798296 - DNA, 20 bp, mouse
ggcagagacccaggcgtcct

SEQ ID NO: 798297 - DNA, 20 bp, mouse
gcagctctgcccggcctccc

SEQ ID NO: 798298 - DNA, 20 bp, mouse
gcggaagcctagcaaatggg

SEQ ID NO: 798299 - DNA, 20 bp, mouse
ggatgccaaccctttctctc

SEQ ID NO: 798300 - DNA, 20 bp, mouse
gtgccaagacgtggagtgat

SEQ ID NO: 798301 - DNA, 20 bp, mouse
ggctccctcctcggtgccct

SEQ ID NO: 798302 - DNA, 20 bp, mouse
gccacggaagcctagcaaat

SEQ ID NO: 798303 - DNA, 20 bp, mouse
gatcccccttccagccattt

SEQ ID NO: 798304 - DNA, 20 bp, mouse
gggggcggcccaggacgcct

SEQ ID NO: 798305 - DNA, 20 bp, mouse
gccgtggctccatccccggg

SEQ ID NO: 798306 - DNA, 20 bp, mouse
gtcccctctcaccgcgtcat

SEQ ID NO: 798307 - DNA, 20 bp, mouse
gtccccatgacgcggtgaga

SEQ ID NO: 798308 - DNA, 20 bp, mouse
gagaggggacatgggacagt

SEQ ID NO: 798309 - DNA, 20 bp, mouse
gaggaagggcggcgacccgg

SEQ ID NO: 798310 - DNA, 20 bp, mouse
ggacgcggtgagaggggaca

SEQ ID NO: 798311 - DNA, 20 bp, mouse
gcagtggggcgcctccttga

SEQ ID NO: 798312 - DNA, 20 bp, mouse
gtccaagcagaaggaccaga

SEQ ID NO: 798313 - DNA, 20 bp, mouse
gaagttcccagagttggagt

SEQ ID NO: 798314 - DNA, 20 bp, mouse
gtcggagtgtgccctcaagg

SEQ ID NO: 798315 - DNA, 20 bp, mouse
gaaggcgcctccgggagagc

SEQ ID NO: 798316 - DNA, 20 bp, mouse
ggagcaccaaatgagactgc

SEQ ID NO: 798317 - DNA, 20 bp, mouse
ggaaagactgggttgggact

SEQ ID NO: 798318 - DNA, 20 bp, mouse
gtttcagaagacgtaaacgt

SEQ ID NO: 798319 - DNA, 20 bp, mouse
gtgcattgagccaaaggagg

SEQ ID NO: 798320 - DNA, 20 bp, mouse
gactccggactctgggagaa

SEQ ID NO: 798321 - DNA, 20 bp, mouse
gggagaaacacccactgctg

SEQ ID NO: 798322 - DNA, 20 bp, mouse
gtcctcttgcattgagccaa

SEQ ID NO: 798323 - DNA, 20 bp, mouse
ggaggaaggtcagggaactt

SEQ ID NO: 798324 - DNA, 20 bp, mouse
ggggtcagtgggaaaaggcg

SEQ ID NO: 798325 - DNA, 20 bp, mouse
ggggaaaaggcggggctttg

SEQ ID NO: 798326 - DNA, 20 bp, mouse
gcaacctaccctctgcttgg

SEQ ID NO: 798327 - DNA, 20 bp, mouse
gagacactgcgagagaggcg

SEQ ID NO: 798328 - DNA, 20 bp, mouse
gatgcctccaagcagagggt

SEQ ID NO: 798329 - DNA, 20 bp, mouse
gccaggagacactgcgagag

SEQ ID NO: 798330 - DNA, 20 bp, mouse
gctgccccctaacgggatcc

SEQ ID NO: 798331 - DNA, 20 bp, mouse
gccctctgctgccccctaac

SEQ ID NO: 798332 - DNA, 20 bp, mouse
gggaggcatggcgcgggcat

SEQ ID NO: 798333 - DNA, 20 bp, mouse
gagcagagggtaggttgctt

SEQ ID NO: 798334 - DNA, 20 bp, mouse
ggtctcctggatcccgttag

SEQ ID NO: 798335 - DNA, 20 bp, mouse
gcgccatgcctccaagcaga

SEQ ID NO: 798336 - DNA, 20 bp, mouse
gaggaggtggccatagtccg

SEQ ID NO: 798337 - DNA, 20 bp, mouse
ggatgcccatcaaacctcgt

SEQ ID NO: 798338 - DNA, 20 bp, mouse
ggccacctcctccgtgtcta

SEQ ID NO: 798339 - DNA, 20 bp, mouse
gcacacggggccgcggacta

SEQ ID NO: 798340 - DNA, 20 bp, mouse
gcggaagcagaggcgacttc

SEQ ID NO: 798341 - DNA, 20 bp, mouse
gggcgctcgcctcagattcg

SEQ ID NO: 798342 - DNA, 20 bp, mouse
gttgcccaggtccgggttcg

SEQ ID NO: 798343 - DNA, 20 bp, mouse
gaggacgcagcacattctgg

SEQ ID NO: 798344 - DNA, 20 bp, mouse
gtatggagggggaagagtgg

SEQ ID NO: 798345 - DNA, 20 bp, mouse
gaagtccgacgaggtttgat

SEQ ID NO: 798346 - DNA, 20 bp, mouse
gagggcggggccgggaagaa

SEQ ID NO: 798347 - DNA, 20 bp, mouse
ggaaacccgggagagaaaga

SEQ ID NO: 798348 - DNA, 20 bp, mouse
gcgcccgccgcttcctgccc

SEQ ID NO: 798349 - DNA, 20 bp, mouse
ggaagggaagcccgctgcag

SEQ ID NO: 798350 - DNA, 20 bp, mouse
ggctctccggagcgaaaccc

SEQ ID NO: 798351 - DNA, 20 bp, mouse
gaagcccgctgcagcggctg

SEQ ID NO: 798352 - DNA, 20 bp, mouse
gactccagccggcggagatg

SEQ ID NO: 798353 - DNA, 20 bp, mouse
gctccgctgcgggctacctg

SEQ ID NO: 798354 - DNA, 20 bp, mouse
gccgccgcgcctcaacgccc

SEQ ID NO: 798355 - DNA, 20 bp, mouse
ggaacccgggcgttgaggcg

SEQ ID NO: 798356 - DNA, 20 bp, mouse
gtccctgggcaagtcgcgag

SEQ ID NO: 798357 - DNA, 20 bp, mouse
gtgcccagggaggcaaggcg

SEQ ID NO: 798358 - DNA, 20 bp, mouse
ggcaaggcgaggcggatgca

SEQ ID NO: 798359 - DNA, 20 bp, mouse
gtcagcccgaggccgaggcg

SEQ ID NO: 798360 - DNA, 20 bp, mouse
ggtagccccgcctcggcctc

SEQ ID NO: 798361 - DNA, 20 bp, mouse
gaggcgaggcggatgcaggg

SEQ ID NO: 798362 - DNA, 20 bp, mouse
gcgcctctcgcgacttgccc

SEQ ID NO: 798363 - DNA, 20 bp, mouse
gcagggcgggcacggcgcga

SEQ ID NO: 798364 - DNA, 20 bp, mouse
gcgcctcgccttgcctccct

SEQ ID NO: 798365 - DNA, 20 bp, mouse
ggacctagaggtccgttcgt

SEQ ID NO: 798366 - DNA, 20 bp, mouse
gcggaggcggactctaaggc

SEQ ID NO: 798367 - DNA, 20 bp, mouse
ggcggactctaaggcgggat

SEQ ID NO: 798368 - DNA, 20 bp, mouse
ggaggcggaggcggactcta

SEQ ID NO: 798369 - DNA, 20 bp, mouse
gagagagaccggaccagcga

SEQ ID NO: 798370 - DNA, 20 bp, mouse
gccagagccccgatcttcat

SEQ ID NO: 798371 - DNA, 20 bp, mouse
gccgcctcgcgcccttccat

SEQ ID NO: 798372 - DNA, 20 bp, mouse
gactctaaggcgggatcgga

SEQ ID NO: 798373 - DNA, 20 bp, mouse
gaccagcgagggctgtgaag

SEQ ID NO: 798374 - DNA, 20 bp, mouse
gccccgatcttcattggcta

SEQ ID NO: 798375 - DNA, 20 bp, mouse
ggtgaagagggaccgcttca

SEQ ID NO: 798376 - DNA, 20 bp, mouse
gtgccagcagctacacttcg

SEQ ID NO: 798377 - DNA, 20 bp, mouse
gagaatcgagagcaccagga

SEQ ID NO: 798378 - DNA, 20 bp, mouse
gagagagcccaggctcacgg

SEQ ID NO: 798379 - DNA, 20 bp, mouse
gaggccagagaggggagcgc

SEQ ID NO: 798380 - DNA, 20 bp, mouse
gcgtcctggatgcccagaat

SEQ ID NO: 798381 - DNA, 20 bp, mouse
gccctctcggggtaaggagg

SEQ ID NO: 798382 - DNA, 20 bp, mouse
gcaggctcacggagggacct

SEQ ID NO: 798383 - DNA, 20 bp, mouse
gggggcggggagacactgca

SEQ ID NO: 798384 - DNA, 20 bp, mouse
gtgcggcttgcgtccctcat

SEQ ID NO: 798385 - DNA, 20 bp, mouse
gccttccaggtggccaatga

SEQ ID NO: 798386 - DNA, 20 bp, mouse
ggcgctatgggtcaaggggt

SEQ ID NO: 798387 - DNA, 20 bp, mouse
ggaggcgcgagcagtcaagc

SEQ ID NO: 798388 - DNA, 20 bp, mouse
gagacacccgggttcttgga

SEQ ID NO: 798389 - DNA, 20 bp, mouse
gcactcgcatcagaccccca

SEQ ID NO: 798390 - DNA, 20 bp, mouse
gtaaacccggagtgtgccag

SEQ ID NO: 798391 - DNA, 20 bp, mouse
gtcaccggctgccactgcgg

SEQ ID NO: 798392 - DNA, 20 bp, mouse
gatagcgcctggggggtccc

SEQ ID NO: 798393 - DNA, 20 bp, mouse
gcggctgagtgcagtagcct

SEQ ID NO: 798394 - DNA, 20 bp, mouse
gccaggcgctatgggtcaag

SEQ ID NO: 798395 - DNA, 20 bp, mouse
gactcagccggggacccccc

SEQ ID NO: 798396 - DNA, 20 bp, mouse
ggtcggagcaggatagtctt

SEQ ID NO: 798397 - DNA, 20 bp, mouse
gcggcggcaggcggcatccc

SEQ ID NO: 798398 - DNA, 20 bp, mouse
gcgggcaccgaaatactcag

SEQ ID NO: 798399 - DNA, 20 bp, mouse
gcgaggatccccgcaccgag

SEQ ID NO: 798400 - DNA, 20 bp, mouse
gaccgagaggcggtcggagc

SEQ ID NO: 798401 - DNA, 20 bp, mouse
gggcggcatcccagggtgat

SEQ ID NO: 798402 - DNA, 20 bp, mouse
ggccgaagacagcaaaaatc

SEQ ID NO: 798403 - DNA, 20 bp, mouse
gggatccccgcaccgagagg

SEQ ID NO: 798404 - DNA, 20 bp, mouse
gatagtcttaggaaagtagg

SEQ ID NO: 798405 - DNA, 20 bp, mouse
gccccgcaccgagaggcggt

SEQ ID NO: 798406 - DNA, 20 bp, mouse
gaggctgggagggcatgatg

SEQ ID NO: 798407 - DNA, 20 bp, mouse
gtctgacgagaaggtctagg

SEQ ID NO: 798408 - DNA, 20 bp, mouse
gcagcctgactgtaaagggg

SEQ ID NO: 798409 - DNA, 20 bp, mouse
gcccccccccctttacagtc

SEQ ID NO: 798410 - DNA, 20 bp, mouse
gcctcccagcctgactgtaa

SEQ ID NO: 798411 - DNA, 20 bp, mouse
ggccccctaaagtctcctgg

SEQ ID NO: 798412 - DNA, 20 bp, mouse
gtctcctggtggccggagtg

SEQ ID NO: 798413 - DNA, 20 bp, mouse
ggcttctgacgagaaggtct

SEQ ID NO: 798414 - DNA, 20 bp, mouse
gaagctaggcacagtacaga

SEQ ID NO: 798415 - DNA, 20 bp, mouse
ggccaccaggagactttagg

SEQ ID NO: 798416 - DNA, 20 bp, mouse
ggggaagcgccggatcccac

SEQ ID NO: 798417 - DNA, 20 bp, mouse
gacctccgccttggagcctg

SEQ ID NO: 798418 - DNA, 20 bp, mouse
ggacctctgcggccaaaagt

SEQ ID NO: 798419 - DNA, 20 bp, mouse
gaggtctgaagaggagcctc

SEQ ID NO: 798420 - DNA, 20 bp, mouse
gccagaggtaagtgaatcaa

SEQ ID NO: 798421 - DNA, 20 bp, mouse
gagcgcacgtaggtctgaag

SEQ ID NO: 798422 - DNA, 20 bp, mouse
gaggagctgggcgcgtccgg

SEQ ID NO: 798423 - DNA, 20 bp, mouse
ggacctaaggggttggccct

SEQ ID NO: 798424 - DNA, 20 bp, mouse
gtgaatataagggcggtgtg

SEQ ID NO: 798425 - DNA, 20 bp, mouse
gcagacctacgtgcgctgaa

SEQ ID NO: 798426 - DNA, 20 bp, mouse
gcaccgggagagcacgaggg

SEQ ID NO: 798427 - DNA, 20 bp, mouse
gagccaccgggagagcacga

SEQ ID NO: 798428 - DNA, 20 bp, mouse
ggcacagtgcggagcgacgt

SEQ ID NO: 798429 - DNA, 20 bp, mouse
gcagggcccgaggtaggcgt

SEQ ID NO: 798430 - DNA, 20 bp, mouse
ggcggcggcgctgggcaggt

SEQ ID NO: 798431 - DNA, 20 bp, mouse
gcgcaacctacgcctacctc

SEQ ID NO: 798432 - DNA, 20 bp, mouse
gagcgaggagaagtttctta

SEQ ID NO: 798433 - DNA, 20 bp, mouse
gagcccgagcttgagccacc

SEQ ID NO: 798434 - DNA, 20 bp, mouse
gtaggagccgcggcaatctg

SEQ ID NO: 798435 - DNA, 20 bp, mouse
gtagcgcgcgccagggcccg

SEQ ID NO: 798436 - DNA, 20 bp, mouse
gcaggcagggtcagtatctg

SEQ ID NO: 798437 - DNA, 20 bp, mouse
gtagggtggagcttactcac

SEQ ID NO: 798438 - DNA, 20 bp, mouse
ggctcagggcagcagtcggg

SEQ ID NO: 798439 - DNA, 20 bp, mouse
ggggatgtccgggtgaggcg

SEQ ID NO: 798440 - DNA, 20 bp, mouse
gttggagtaaagacacaggc

SEQ ID NO: 798441 - DNA, 20 bp, mouse
ggaccctgcctgcctgaaca

SEQ ID NO: 798442 - DNA, 20 bp, mouse
gtgccgcgggcggggatgtc

SEQ ID NO: 798443 - DNA, 20 bp, mouse
ggcagctggaggcgagcgtc

SEQ ID NO: 798444 - DNA, 20 bp, mouse
gctgttgcagaagaaagtct

SEQ ID NO: 798445 - DNA, 20 bp, mouse
gagtaagctccaccctacct

SEQ ID NO: 798446 - DNA, 20 bp, mouse
ggcgttctggggatgataga

SEQ ID NO: 798447 - DNA, 20 bp, mouse
gagcagctgctgtcgtggaa

SEQ ID NO: 798448 - DNA, 20 bp, mouse
gtctgaactaagcgctgctt

SEQ ID NO: 798449 - DNA, 20 bp, mouse
gtagcgttcagtctccaagg

SEQ ID NO: 798450 - DNA, 20 bp, mouse
gaacgctacagagctaccgc

SEQ ID NO: 798451 - DNA, 20 bp, mouse
gctgtatccctggcgttctg

SEQ ID NO: 798452 - DNA, 20 bp, mouse
gtatcatccccagaacgcca

SEQ ID NO: 798453 - DNA, 20 bp, mouse
gcagtctccaaggaggagtc

SEQ ID NO: 798454 - DNA, 20 bp, mouse
ggcggtgggaggcacctgac

SEQ ID NO: 798455 - DNA, 20 bp, mouse
ggaagggctaatccgagtaa

SEQ ID NO: 798456 - DNA, 20 bp, mouse
gggcgctcggggacttgcca

SEQ ID NO: 798457 - DNA, 20 bp, mouse
gtcacgggagtccctacccg

SEQ ID NO: 798458 - DNA, 20 bp, mouse
ggtacccacccacgctgcag

SEQ ID NO: 798459 - DNA, 20 bp, mouse
gccagcctctgcagcgtggg

SEQ ID NO: 798460 - DNA, 20 bp, mouse
gtccccgagcgcccgctgca

SEQ ID NO: 798461 - DNA, 20 bp, mouse
ggggacttgccagggttccg

SEQ ID NO: 798462 - DNA, 20 bp, mouse
gcgctgcagggcggcgtggg

SEQ ID NO: 798463 - DNA, 20 bp, mouse
gagggactcccgtgacgctg

SEQ ID NO: 798464 - DNA, 20 bp, mouse
gaagccagcctctgcagcgt

SEQ ID NO: 798465 - DNA, 20 bp, mouse
gggccacgcccatcctgcgc

SEQ ID NO: 798466 - DNA, 20 bp, mouse
gacggcatgcggagtggaca

SEQ ID NO: 798467 - DNA, 20 bp, mouse
gcggccgcacagggaagcgc

SEQ ID NO: 798468 - DNA, 20 bp, mouse
gtggacaaggcgacggcatg

SEQ ID NO: 798469 - DNA, 20 bp, mouse
ggggaaacgaatcacattga

SEQ ID NO: 798470 - DNA, 20 bp, mouse
gcacgcgcggggctgacccg

SEQ ID NO: 798471 - DNA, 20 bp, mouse
ggggacttccctcaagcgag

SEQ ID NO: 798472 - DNA, 20 bp, mouse
gtccctgtgcggccgcgagg

SEQ ID NO: 798473 - DNA, 20 bp, mouse
gccacccgcgcttccctgtg

SEQ ID NO: 798474 - DNA, 20 bp, mouse
gtgcgctgcgcggactcggg

SEQ ID NO: 798475 - DNA, 20 bp, mouse
gtggggcgcggcagcgacgt

SEQ ID NO: 798476 - DNA, 20 bp, mouse
ggggagggcggtctgcgcga

SEQ ID NO: 798477 - DNA, 20 bp, mouse
gtctctccgcagagccgcgg

SEQ ID NO: 798478 - DNA, 20 bp, mouse
gccaaggtgcagcctgcgtg

SEQ ID NO: 798479 - DNA, 20 bp, mouse
ggctgaaacgggctcttcga

SEQ ID NO: 798480 - DNA, 20 bp, mouse
gcctcagctaactgagggga

SEQ ID NO: 798481 - DNA, 20 bp, mouse
gaacacccgaagtagagaag

SEQ ID NO: 798482 - DNA, 20 bp, mouse
ggggtcgtgcaacatcccca

SEQ ID NO: 798483 - DNA, 20 bp, mouse
gcctccctcagctaactgag

SEQ ID NO: 798484 - DNA, 20 bp, mouse
gcaagccaatggcaccccgg

SEQ ID NO: 798485 - DNA, 20 bp, mouse
ggcggctctgcggagagaag

SEQ ID NO: 798486 - DNA, 20 bp, mouse
gtgggctcccgcaatacttc

SEQ ID NO: 798487 - DNA, 20 bp, mouse
gtggtgcgggcgccctcgga

SEQ ID NO: 798488 - DNA, 20 bp, mouse
ggccggagagggcgcggtcg

SEQ ID NO: 798489 - DNA, 20 bp, mouse
ggtgacgagtggccctccga

SEQ ID NO: 798490 - DNA, 20 bp, mouse
gcagacctagggcgcctatc

SEQ ID NO: 798491 - DNA, 20 bp, mouse
gcggcgagcggggtgccccg

SEQ ID NO: 798492 - DNA, 20 bp, mouse
gacttcgggtggagtgacac

SEQ ID NO: 798493 - DNA, 20 bp, mouse
gggggaacaggaggcgtcgg

SEQ ID NO: 798494 - DNA, 20 bp, mouse
gcgctcgccgcccagaccta

SEQ ID NO: 798495 - DNA, 20 bp, mouse
gttgcccgaggacagtcctc

SEQ ID NO: 798496 - DNA, 20 bp, mouse
ggggcgctaccaagtaatgg

SEQ ID NO: 798497 - DNA, 20 bp, mouse
gcccctcggacctaactctt

SEQ ID NO: 798498 - DNA, 20 bp, mouse
gaatggcaggcggggatgaa

SEQ ID NO: 798499 - DNA, 20 bp, mouse
ggggatgaagggagacgcta

SEQ ID NO: 798500 - DNA, 20 bp, mouse
gtcaggctggaggaaacgtg

SEQ ID NO: 798501 - DNA, 20 bp, mouse
gtagggcggcgcaactcctc

SEQ ID NO: 798502 - DNA, 20 bp, mouse
gagcccaagagttaggtccg

SEQ ID NO: 798503 - DNA, 20 bp, mouse
gcaaggctacgagtccccta

SEQ ID NO: 798504 - DNA, 20 bp, mouse
ggctgggagagatgaatggc

SEQ ID NO: 798505 - DNA, 20 bp, mouse
ggactcgtagccttgggtgg

SEQ ID NO: 798506 - DNA, 20 bp, mouse
gaggggcaggaagcggactg

SEQ ID NO: 798507 - DNA, 20 bp, mouse
gaaactctctggggcggcag

SEQ ID NO: 798508 - DNA, 20 bp, mouse
gctctggggcggcaggggag

SEQ ID NO: 798509 - DNA, 20 bp, mouse
gcccgcggttaaactctctg

SEQ ID NO: 798510 - DNA, 20 bp, mouse
ggagcccgggggtgtcgcgg

SEQ ID NO: 798511 - DNA, 20 bp, mouse
gcccgggggtgtcgcggtgg

SEQ ID NO: 798512 - DNA, 20 bp, mouse
ggaggggttaatctgcttca

SEQ ID NO: 798513 - DNA, 20 bp, mouse
ggccccagagagtttaaccg

SEQ ID NO: 798514 - DNA, 20 bp, mouse
gcgggcagggtgaaccccgt

SEQ ID NO: 798515 - DNA, 20 bp, mouse
gcctccgtgcgacacccagg

SEQ ID NO: 798516 - DNA, 20 bp, mouse
ggagtcgcgggaggttagaa

SEQ ID NO: 798517 - DNA, 20 bp, mouse
gggcccacccgcggagtcgc

SEQ ID NO: 798518 - DNA, 20 bp, mouse
gctaacctcccgcgactccg

SEQ ID NO: 798519 - DNA, 20 bp, mouse
gtcggcgcgtaggaacgggg

SEQ ID NO: 798520 - DNA, 20 bp, mouse
gggagtgcagagtcaagctg

SEQ ID NO: 798521 - DNA, 20 bp, mouse
gcaactcgctagttgggaaa

SEQ ID NO: 798522 - DNA, 20 bp, mouse
gcgtaggaacggggcggagt

SEQ ID NO: 798523 - DNA, 20 bp, mouse
gtagcgagttgcaccatccc

SEQ ID NO: 798524 - DNA, 20 bp, mouse
gtaaccctgcgggggaaggg

SEQ ID NO: 798525 - DNA, 20 bp, mouse
ggggttaaacggtcctgccc

SEQ ID NO: 798526 - DNA, 20 bp, mouse
gggaggccggaaaactaagt

SEQ ID NO: 798527 - DNA, 20 bp, mouse
gtgagtaccgaggaaagagg

SEQ ID NO: 798528 - DNA, 20 bp, mouse
gctgtgagtaccgaggaaag

SEQ ID NO: 798529 - DNA, 20 bp, mouse
ggatttcaaaaggcagtcag

SEQ ID NO: 798530 - DNA, 20 bp, mouse
ggaaaaaaacagcgctccac

SEQ ID NO: 798531 - DNA, 20 bp, mouse
gggggtgcctgaataccagg

SEQ ID NO: 798532 - DNA, 20 bp, mouse
gacagcgctccactggaggc

SEQ ID NO: 798533 - DNA, 20 bp, mouse
ggctgctgctgtgagtaccg

SEQ ID NO: 798534 - DNA, 20 bp, mouse
gaaaaacagcgctccactgg

SEQ ID NO: 798535 - DNA, 20 bp, mouse
gttaccagtgcagacttgga

SEQ ID NO: 798536 - DNA, 20 bp, mouse
ggccctgcatgctaatcaag

SEQ ID NO: 798537 - DNA, 20 bp, mouse
gcaacccacggctcaggaga

SEQ ID NO: 798538 - DNA, 20 bp, mouse
gcaaaccttctcctgagccg

SEQ ID NO: 798539 - DNA, 20 bp, mouse
gcaggagaaggtttgccaaa

SEQ ID NO: 798540 - DNA, 20 bp, mouse
gtcgctcgctcggtgccagg

SEQ ID NO: 798541 - DNA, 20 bp, mouse
gctgataagtcacaccggga

SEQ ID NO: 798542 - DNA, 20 bp, mouse
gtgagagagcggtgtttatc

SEQ ID NO: 798543 - DNA, 20 bp, mouse
gccaccgtttgttttacttt

SEQ ID NO: 798544 - DNA, 20 bp, mouse
gctcacttaagttctctcta

SEQ ID NO: 798545 - DNA, 20 bp, mouse
gggaaggaaacagctgctac

SEQ ID NO: 798546 - DNA, 20 bp, mouse
gtgtgcgtgcgtgacagaga

SEQ ID NO: 798547 - DNA, 20 bp, mouse
gagcgaacccgctgaggggt

SEQ ID NO: 798548 - DNA, 20 bp, mouse
ggctcccctccccctcacgg

SEQ ID NO: 798549 - DNA, 20 bp, mouse
gcaggcagggatcccccgtg

SEQ ID NO: 798550 - DNA, 20 bp, mouse
ggtgctgcctacccctcagc

SEQ ID NO: 798551 - DNA, 20 bp, mouse
gcccacccacccctaggcca

SEQ ID NO: 798552 - DNA, 20 bp, mouse
ggaggctggggagagaccaa

SEQ ID NO: 798553 - DNA, 20 bp, mouse
gatagatagcgaacccgctg

SEQ ID NO: 798554 - DNA, 20 bp, mouse
ggcgtgcgtgacagagacgg

SEQ ID NO: 798555 - DNA, 20 bp, mouse
ggcagggatcccccgtgagg

SEQ ID NO: 798556 - DNA, 20 bp, mouse
ggggcccaccactcactcat

SEQ ID NO: 798557 - DNA, 20 bp, mouse
ggggcccagaatcaaggcgc

SEQ ID NO: 798558 - DNA, 20 bp, mouse
gcatctgagggagttgtagc

SEQ ID NO: 798559 - DNA, 20 bp, mouse
gtaggtggcccatgagtgag

SEQ ID NO: 798560 - DNA, 20 bp, mouse
ggtgaggagaccaggcctgg

SEQ ID NO: 798561 - DNA, 20 bp, mouse
gactcatgggccacctagaa

SEQ ID NO: 798562 - DNA, 20 bp, mouse
gaaacccggcaggaagagcg

SEQ ID NO: 798563 - DNA, 20 bp, mouse
gtgccctcccccgccatctg

SEQ ID NO: 798564 - DNA, 20 bp, mouse
gagtggtgggcccagaatca

SEQ ID NO: 798565 - DNA, 20 bp, mouse
gggctccaagagaggagatc

SEQ ID NO: 798566 - DNA, 20 bp, mouse
gaggtggcgcccagcggctt

SEQ ID NO: 798567 - DNA, 20 bp, mouse
gagcgagcggggcctcccgg

SEQ ID NO: 798568 - DNA, 20 bp, mouse
gcagcggtgttggaggaaca

SEQ ID NO: 798569 - DNA, 20 bp, mouse
gaggttgcagccagcggtgt

SEQ ID NO: 798570 - DNA, 20 bp, mouse
gcccggcgccggagcgagaa

SEQ ID NO: 798571 - DNA, 20 bp, mouse
gcgccggagcgagaagggga

SEQ ID NO: 798572 - DNA, 20 bp, mouse
gcggtgttggaggaacaggg

SEQ ID NO: 798573 - DNA, 20 bp, mouse
gggcccaaggtcattcaacc

SEQ ID NO: 798574 - DNA, 20 bp, mouse
gggcctgattctaagagcct

SEQ ID NO: 798575 - DNA, 20 bp, mouse
ggggacggagctgaaggtgg

SEQ ID NO: 798576 - DNA, 20 bp, mouse
gtcccaggggagagtcgcgg

SEQ ID NO: 798577 - DNA, 20 bp, mouse
gaggggacgagccctgccga

SEQ ID NO: 798578 - DNA, 20 bp, mouse
ggcagggtgcgaggctgtgt

SEQ ID NO: 798579 - DNA, 20 bp, mouse
ggcgccccagtgaatccgtc

SEQ ID NO: 798580 - DNA, 20 bp, mouse
gctcgagctaatttctccca

SEQ ID NO: 798581 - DNA, 20 bp, mouse
gtcaaaaggacagcgtgggg

SEQ ID NO: 798582 - DNA, 20 bp, mouse
ggacccccgcgactctcccc

SEQ ID NO: 798583 - DNA, 20 bp, mouse
gggagagtcgcgggggtcgg

SEQ ID NO: 798584 - DNA, 20 bp, mouse
ggggaagggagtcgcaatga

SEQ ID NO: 798585 - DNA, 20 bp, mouse
gtcgcaccctgccctcggca

SEQ ID NO: 798586 - DNA, 20 bp, mouse
gcagctgcgcgggttcctcc

SEQ ID NO: 798587 - DNA, 20 bp, mouse
gggaacccgcgcagctgggc

SEQ ID NO: 798588 - DNA, 20 bp, mouse
gcgcgggcgtgcgctcctca

SEQ ID NO: 798589 - DNA, 20 bp, mouse
gtgggcgggcagagcgcgtc

SEQ ID NO: 798590 - DNA, 20 bp, mouse
ggggagcagcgcccgagcag

SEQ ID NO: 798591 - DNA, 20 bp, mouse
ggaaacttttgctctttcgg

SEQ ID NO: 798592 - DNA, 20 bp, mouse
ggcaggggactgtcacccgc

SEQ ID NO: 798593 - DNA, 20 bp, mouse
gtcctcccggtgcagcccag

SEQ ID NO: 798594 - DNA, 20 bp, mouse
gggctggtgctccagactgg

SEQ ID NO: 798595 - DNA, 20 bp, mouse
gttgagcaaaggcctcccct

SEQ ID NO: 798596 - DNA, 20 bp, mouse
gcggggccccgtgagatccg

SEQ ID NO: 798597 - DNA, 20 bp, mouse
ggaccccgcaggcaccggtg

SEQ ID NO: 798598 - DNA, 20 bp, mouse
gggagccgagagcgagtgcg

SEQ ID NO: 798599 - DNA, 20 bp, mouse
gccggccgccctgttttcct

SEQ ID NO: 798600 - DNA, 20 bp, mouse
gccggtgcctgcggggtcac

SEQ ID NO: 798601 - DNA, 20 bp, mouse
gtaccaggctgcgcccccac

SEQ ID NO: 798602 - DNA, 20 bp, mouse
gcggccgcgtgctagcgcag

SEQ ID NO: 798603 - DNA, 20 bp, mouse
gactcgctctcggctcctgt

SEQ ID NO: 798604 - DNA, 20 bp, mouse
ggagcggggcgctcggggat

SEQ ID NO: 798605 - DNA, 20 bp, mouse
gtgagaccccgtgaccccgc

SEQ ID NO: 798606 - DNA, 20 bp, mouse
gccagagcaccctgcaacca

SEQ ID NO: 798607 - DNA, 20 bp, mouse
gtgtccgcccgctggaggag

SEQ ID NO: 798608 - DNA, 20 bp, mouse
gtagcatcgctgcagaactc

SEQ ID NO: 798609 - DNA, 20 bp, mouse
ggaggcaaggagtgcaaccc

SEQ ID NO: 798610 - DNA, 20 bp, mouse
gagagacccaccaggaggca

SEQ ID NO: 798611 - DNA, 20 bp, mouse
gttaaaaggcagttggagca

SEQ ID NO: 798612 - DNA, 20 bp, mouse
gtgcagggtgctctggctgg

SEQ ID NO: 798613 - DNA, 20 bp, mouse
gggagtgcaaccctggttgc

SEQ ID NO: 798614 - DNA, 20 bp, mouse
gtaaagtgctgagggtgagc

SEQ ID NO: 798615 - DNA, 20 bp, mouse
ggcactccttgcctcctggt

SEQ ID NO: 798616 - DNA, 20 bp, mouse
gccggcagagcgcaacacga

SEQ ID NO: 798617 - DNA, 20 bp, mouse
gactctgtaccagactgtgg

SEQ ID NO: 798618 - DNA, 20 bp, mouse
gcgctgcggtgcccacccga

SEQ ID NO: 798619 - DNA, 20 bp, mouse
gagtgaaaatcagtcctgga

SEQ ID NO: 798620 - DNA, 20 bp, mouse
gacgagggttggttgtcctt

SEQ ID NO: 798621 - DNA, 20 bp, mouse
gctaacagatctgttcagga

SEQ ID NO: 798622 - DNA, 20 bp, mouse
ggtaccagactgtgggggaa

SEQ ID NO: 798623 - DNA, 20 bp, mouse
ggtccttccagctaccttcc

SEQ ID NO: 798624 - DNA, 20 bp, mouse
ggtcctggaaggtagctgga

SEQ ID NO: 798625 - DNA, 20 bp, mouse
ggggtgggcaccgcagcggc

SEQ ID NO: 798626 - DNA, 20 bp, mouse
gccacgacgctacagctcga

SEQ ID NO: 798627 - DNA, 20 bp, mouse
ggggtgaagacgtcgagggg

SEQ ID NO: 798628 - DNA, 20 bp, mouse
ggagggggtgaagacgtcga

SEQ ID NO: 798629 - DNA, 20 bp, mouse
gactttagctctggtgtcga

SEQ ID NO: 798630 - DNA, 20 bp, mouse
gtgcaccgccgctgccctta

SEQ ID NO: 798631 - DNA, 20 bp, mouse
gttagctctggtgtcgaggg

SEQ ID NO: 798632 - DNA, 20 bp, mouse
gctgggaggcgggacctgag

SEQ ID NO: 798633 - DNA, 20 bp, mouse
gtgcacatgcgcacacgccc

SEQ ID NO: 798634 - DNA, 20 bp, mouse
ggcgccgcgcggcaaccgtt

SEQ ID NO: 798635 - DNA, 20 bp, mouse
gccggccctaagggcagcgg

SEQ ID NO: 798636 - DNA, 20 bp, mouse
gggacggaaagattgggaag

SEQ ID NO: 798637 - DNA, 20 bp, mouse
ggcccacaagtccacacggt

SEQ ID NO: 798638 - DNA, 20 bp, mouse
gaagactggacggaaagatt

SEQ ID NO: 798639 - DNA, 20 bp, mouse
ggcggggcacggcacagggg

SEQ ID NO: 798640 - DNA, 20 bp, mouse
gcagtcatccttggggtcgg

SEQ ID NO: 798641 - DNA, 20 bp, mouse
ggggcggcgggaaagagccg

SEQ ID NO: 798642 - DNA, 20 bp, mouse
gggttccagcgcgtcctcct

SEQ ID NO: 798643 - DNA, 20 bp, mouse
gcggcgggaaagagccgagg

SEQ ID NO: 798644 - DNA, 20 bp, mouse
gtgggaaggggctctttgaa

SEQ ID NO: 798645 - DNA, 20 bp, mouse
gcctaggcgagccgaccgtg

SEQ ID NO: 798646 - DNA, 20 bp, mouse
gccccctagaggggagggag

SEQ ID NO: 798647 - DNA, 20 bp, mouse
ggggtgggttggtcaaggat

SEQ ID NO: 798648 - DNA, 20 bp, mouse
ggctccgccccctagagggg

SEQ ID NO: 798649 - DNA, 20 bp, mouse
gagaactgcagggtggcggg

SEQ ID NO: 798650 - DNA, 20 bp, mouse
gaggaggcggagagcgtggg

SEQ ID NO: 798651 - DNA, 20 bp, mouse
ggaagctccgccccctagag

SEQ ID NO: 798652 - DNA, 20 bp, mouse
gggagagaactgcagggtgg

SEQ ID NO: 798653 - DNA, 20 bp, mouse
gctggcagcccgcgcgaggt

SEQ ID NO: 798654 - DNA, 20 bp, mouse
gtggagagggcaggcgcgat

SEQ ID NO: 798655 - DNA, 20 bp, mouse
gcggggcggaggggccaggt

SEQ ID NO: 798656 - DNA, 20 bp, mouse
gcgtgtgctgggtccttgac

SEQ ID NO: 798657 - DNA, 20 bp, mouse
gggcggggccttggtagcag

SEQ ID NO: 798658 - DNA, 20 bp, mouse
ggcagcggaggcccgtgggg

SEQ ID NO: 798659 - DNA, 20 bp, mouse
gccctccgtcctagcaccgg

SEQ ID NO: 798660 - DNA, 20 bp, mouse
gtgggggcggggtcttggct

SEQ ID NO: 798661 - DNA, 20 bp, mouse
ggcagcagcggaggcccgtg

SEQ ID NO: 798662 - DNA, 20 bp, mouse
gagagggcggctgatcctgc

SEQ ID NO: 798663 - DNA, 20 bp, mouse
gccacctgcgcgcgcggagc

SEQ ID NO: 798664 - DNA, 20 bp, mouse
gtggaaacggtctgggtcga

SEQ ID NO: 798665 - DNA, 20 bp, mouse
ggccgagcccgaaggagagt

SEQ ID NO: 798666 - DNA, 20 bp, mouse
gtggacacgccccttctctc

SEQ ID NO: 798667 - DNA, 20 bp, mouse
ggcggagaggggcgtgttcg

SEQ ID NO: 798668 - DNA, 20 bp, mouse
gaatgctcggggtctacttg

SEQ ID NO: 798669 - DNA, 20 bp, mouse
gcagtaccaagcaccctaga

SEQ ID NO: 798670 - DNA, 20 bp, mouse
ggcgtcctggggtgccctcg

SEQ ID NO: 798671 - DNA, 20 bp, mouse
gggccctcggtctacacagg

SEQ ID NO: 798672 - DNA, 20 bp, mouse
gggcgtgtccagggcggaga

SEQ ID NO: 798673 - DNA, 20 bp, mouse
gagaaggggcgtgtccaggg

SEQ ID NO: 798674 - DNA, 20 bp, mouse
gaacacgcccctctccgccc

SEQ ID NO: 798675 - DNA, 20 bp, mouse
gggaggaggtgtgtctaggg

SEQ ID NO: 798676 - DNA, 20 bp, mouse
ggagacgcccagaggggacg

SEQ ID NO: 798677 - DNA, 20 bp, mouse
ggggcagctcggagaatccg

SEQ ID NO: 798678 - DNA, 20 bp, mouse
ggattctccgagctgcccgt

SEQ ID NO: 798679 - DNA, 20 bp, mouse
gtagcccgccgctgtcagta

SEQ ID NO: 798680 - DNA, 20 bp, mouse
gcgagctgcccgtgggaagc

SEQ ID NO: 798681 - DNA, 20 bp, mouse
gtaatcccagtcttcgggga

SEQ ID NO: 798682 - DNA, 20 bp, mouse
gagacctctctgtgccccat

SEQ ID NO: 798683 - DNA, 20 bp, mouse
gctatgtagcagaggtgaga

SEQ ID NO: 798684 - DNA, 20 bp, mouse
gagggcaacacgcgtgactg

SEQ ID NO: 798685 - DNA, 20 bp, mouse
gcgagctcgcgaagcctctc

SEQ ID NO: 798686 - DNA, 20 bp, mouse
gccgaggcaggcagtcaggg

SEQ ID NO: 798687 - DNA, 20 bp, mouse
gctctgcagtagtggactga

SEQ ID NO: 798688 - DNA, 20 bp, mouse
gaccctgctctctgcagtag

SEQ ID NO: 798689 - DNA, 20 bp, mouse
gacaaggttgcccatcgcag

SEQ ID NO: 798690 - DNA, 20 bp, mouse
ggcagtagtggactgatggt

SEQ ID NO: 798691 - DNA, 20 bp, mouse
gtccactactgcagagagca

SEQ ID NO: 798692 - DNA, 20 bp, mouse
gtgcagcctgtcactgacaa

SEQ ID NO: 798693 - DNA, 20 bp, mouse
gtgctcacaccccctgcgat

SEQ ID NO: 798694 - DNA, 20 bp, mouse
gccaacatgcactgaggcac

SEQ ID NO: 798695 - DNA, 20 bp, mouse
ggagctgcctgcgggtgaca

SEQ ID NO: 798696 - DNA, 20 bp, mouse
gaagggtcgccaatgggagt

SEQ ID NO: 798697 - DNA, 20 bp, mouse
gcgccaatgggagtgggcat

SEQ ID NO: 798698 - DNA, 20 bp, mouse
ggccccatgcccactcccat

SEQ ID NO: 798699 - DNA, 20 bp, mouse
gaccgagtaacgagccaatg

SEQ ID NO: 798700 - DNA, 20 bp, mouse
gcccaacctcacggcctcat

SEQ ID NO: 798701 - DNA, 20 bp, mouse
gcccacacctggttgcctcc

SEQ ID NO: 798702 - DNA, 20 bp, mouse
gaggcaaccaggtgtgggcg

SEQ ID NO: 798703 - DNA, 20 bp, mouse
gtgaagaccgggagccaatg

SEQ ID NO: 798704 - DNA, 20 bp, mouse
gtgggagaagggtcgccaat

SEQ ID NO: 798705 - DNA, 20 bp, mouse
gcacacgcctccgagctaat

SEQ ID NO: 798706 - DNA, 20 bp, mouse
ggggaggccgggagagtagc

SEQ ID NO: 798707 - DNA, 20 bp, mouse
gtgcaccccaccagtcgggg

SEQ ID NO: 798708 - DNA, 20 bp, mouse
gtcccggcctccccgactgg

SEQ ID NO: 798709 - DNA, 20 bp, mouse
gaagctgccagctactctcc

SEQ ID NO: 798710 - DNA, 20 bp, mouse
gcccaccagtcggggaggcc

SEQ ID NO: 798711 - DNA, 20 bp, mouse
gaggctgcaccccaccagtc

SEQ ID NO: 798712 - DNA, 20 bp, mouse
gccaggttcagaggtgacgg

SEQ ID NO: 798713 - DNA, 20 bp, mouse
ggtgacggtggtggagagcc

SEQ ID NO: 798714 - DNA, 20 bp, mouse
gagccaggactgctgcgagc

SEQ ID NO: 798715 - DNA, 20 bp, mouse
gcttccaggttcagaggtga

SEQ ID NO: 798716 - DNA, 20 bp, mouse
gtaagacctgccaaccctac

SEQ ID NO: 798717 - DNA, 20 bp, mouse
gtatgtgtgtacaccttgtg

SEQ ID NO: 798718 - DNA, 20 bp, mouse
gtagctacaacacacaatag

SEQ ID NO: 798719 - DNA, 20 bp, mouse
gtgtggaaagcaggaaaggg

SEQ ID NO: 798720 - DNA, 20 bp, mouse
gggaaaccgtgaaggaccaa

SEQ ID NO: 798721 - DNA, 20 bp, mouse
gggctattaccatgcctgta

SEQ ID NO: 798722 - DNA, 20 bp, mouse
gagctcaaaagatagaggag

SEQ ID NO: 798723 - DNA, 20 bp, mouse
ggcaggaggccgcagggggg

SEQ ID NO: 798724 - DNA, 20 bp, mouse
gtggctggcaggaggccgca

SEQ ID NO: 798725 - DNA, 20 bp, mouse
gcatggtaatagccatggaa

SEQ ID NO: 798726 - DNA, 20 bp, mouse
ggaagggggcaacgctcgcg

SEQ ID NO: 798727 - DNA, 20 bp, mouse
gttcaatggcccagagtcag

SEQ ID NO: 798728 - DNA, 20 bp, mouse
gagggcggagcgacatagag

SEQ ID NO: 798729 - DNA, 20 bp, mouse
gtctgggccattgaataaaa

SEQ ID NO: 798730 - DNA, 20 bp, mouse
gctagccaatacgctgaaag

SEQ ID NO: 798731 - DNA, 20 bp, mouse
gggcccagagtcaggggaag

SEQ ID NO: 798732 - DNA, 20 bp, mouse
ggctccgcccttttattcaa

SEQ ID NO: 798733 - DNA, 20 bp, mouse
gaccgccttaagagttggtc

SEQ ID NO: 798734 - DNA, 20 bp, mouse
gaaagggcggagctgcaaca

SEQ ID NO: 798735 - DNA, 20 bp, mouse
gtgcacctgaccaactctta

SEQ ID NO: 798736 - DNA, 20 bp, mouse
gtaggacgcggtaacatggt

SEQ ID NO: 798737 - DNA, 20 bp, mouse
gggcgagctaggggtagtgt

SEQ ID NO: 798738 - DNA, 20 bp, mouse
ggccgagcgcggcgagctag

SEQ ID NO: 798739 - DNA, 20 bp, mouse
gctaggggtagtgttggtag

SEQ ID NO: 798740 - DNA, 20 bp, mouse
ggcctcgcctctcaaatccg

SEQ ID NO: 798741 - DNA, 20 bp, mouse
gcagtggcgcctgaggccct

SEQ ID NO: 798742 - DNA, 20 bp, mouse
gcgggccggacgcggagcaa

SEQ ID NO: 798743 - DNA, 20 bp, mouse
gtgaggccctcggatttgag

SEQ ID NO: 798744 - DNA, 20 bp, mouse
gtccgcccctcccgcgtcgg

SEQ ID NO: 798745 - DNA, 20 bp, mouse
gggctccgcccctcccgcgt

SEQ ID NO: 798746 - DNA, 20 bp, mouse
gcaggaccctaggctgagag

SEQ ID NO: 798747 - DNA, 20 bp, mouse
gaggctgagaggggaaagac

SEQ ID NO: 798748 - DNA, 20 bp, mouse
gcccagggaggttcggactg

SEQ ID NO: 798749 - DNA, 20 bp, mouse
ggggtgaagtgaaccctggg

SEQ ID NO: 798750 - DNA, 20 bp, mouse
gggaaagaccggccctctat

SEQ ID NO: 798751 - DNA, 20 bp, mouse
gtgaaatagatcagatgaag

SEQ ID NO: 798752 - DNA, 20 bp, mouse
ggcccgcagcgctctagtct

SEQ ID NO: 798753 - DNA, 20 bp, mouse
gaccccagtccgaacctccc

SEQ ID NO: 798754 - DNA, 20 bp, mouse
gaccggccctctataggggg

SEQ ID NO: 798755 - DNA, 20 bp, mouse
gggagatggtaggcaagaga

SEQ ID NO: 798756 - DNA, 20 bp, mouse
gccgcccacggggacgacgc

SEQ ID NO: 798757 - DNA, 20 bp, mouse
gcggcggcgggcaagggcga

SEQ ID NO: 798758 - DNA, 20 bp, mouse
gaggccgcggctcctcgcag

SEQ ID NO: 798759 - DNA, 20 bp, mouse
gtcggctggcgccgcccacg

SEQ ID NO: 798760 - DNA, 20 bp, mouse
gcgtcagtggggaaccgggg

SEQ ID NO: 798761 - DNA, 20 bp, mouse
gggcaggcgcggcttccccg

SEQ ID NO: 798762 - DNA, 20 bp, mouse
gcagcgggccggccccgcct

SEQ ID NO: 798763 - DNA, 20 bp, mouse
gggacgacgcgggcggagac

SEQ ID NO: 798764 - DNA, 20 bp, mouse
gagacaggcccgggcaggcg

SEQ ID NO: 798765 - DNA, 20 bp, mouse
ggggcgtcagtggggaaccg

SEQ ID NO: 798766 - DNA, 20 bp, mouse
gggtcggcgagcgtagtccc

SEQ ID NO: 798767 - DNA, 20 bp, mouse
gggcgagcgtagtccctggc

SEQ ID NO: 798768 - DNA, 20 bp, mouse
gcggacgggcgcggctcggt

SEQ ID NO: 798769 - DNA, 20 bp, mouse
ggagtggcccaggtgacagt

SEQ ID NO: 798770 - DNA, 20 bp, mouse
ggccccaacaggggaaccgg

SEQ ID NO: 798771 - DNA, 20 bp, mouse
ggcagccccaacaggggaac

SEQ ID NO: 798772 - DNA, 20 bp, mouse
gagcaccgaaataccttcca

SEQ ID NO: 798773 - DNA, 20 bp, mouse
gcggccagcccagcgacttc

SEQ ID NO: 798774 - DNA, 20 bp, mouse
gagaaggtcacgctcacctt

SEQ ID NO: 798775 - DNA, 20 bp, mouse
ggaaacagccagccggggga

SEQ ID NO: 798776 - DNA, 20 bp, mouse
gtcgcgcgccactgcatcta

SEQ ID NO: 798777 - DNA, 20 bp, mouse
gcgaggatccctagatgcag

SEQ ID NO: 798778 - DNA, 20 bp, mouse
ggtggcgcgcgaaggcgtct

SEQ ID NO: 798779 - DNA, 20 bp, mouse
gtacctcctcccagcagttt

SEQ ID NO: 798780 - DNA, 20 bp, mouse
gaagtcccaagtcttgtccc

SEQ ID NO: 798781 - DNA, 20 bp, mouse
gaaacaagaaggtaagagca

SEQ ID NO: 798782 - DNA, 20 bp, mouse
gagtttctgtgcaattcttg

SEQ ID NO: 798783 - DNA, 20 bp, mouse
gtcaggactcctaaaataag

SEQ ID NO: 798784 - DNA, 20 bp, mouse
gcagtggcccagcgcaagcg

SEQ ID NO: 798785 - DNA, 20 bp, mouse
gaggcacaaacactaatggt

SEQ ID NO: 798786 - DNA, 20 bp, mouse
gggggcgcgcgcgcaatccg

SEQ ID NO: 798787 - DNA, 20 bp, mouse
gcgcaatccgtggaagtctc

SEQ ID NO: 798788 - DNA, 20 bp, mouse
gaaagcgcgggtctgagggg

SEQ ID NO: 798789 - DNA, 20 bp, mouse
gcgtggaagtctccggactg

SEQ ID NO: 798790 - DNA, 20 bp, mouse
ggaagtctccggactgtggt

SEQ ID NO: 798791 - DNA, 20 bp, mouse
gtggctgcgcatgagcgtgt

SEQ ID NO: 798792 - DNA, 20 bp, mouse
ggggccgcaggaaacaatag

SEQ ID NO: 798793 - DNA, 20 bp, mouse
ggactctcgagcgtctccat

SEQ ID NO: 798794 - DNA, 20 bp, mouse
gcagacccgcgctttctcat

SEQ ID NO: 798795 - DNA, 20 bp, mouse
ggtctccataggccgcgagg

SEQ ID NO: 798796 - DNA, 20 bp, mouse
gcagccgccgggacaaccca

SEQ ID NO: 798797 - DNA, 20 bp, mouse
ggttccttgggttgtcccgg

SEQ ID NO: 798798 - DNA, 20 bp, mouse
gtacgtaaaacgaacaagga

SEQ ID NO: 798799 - DNA, 20 bp, mouse
ggtaaaacgaacaaggaagg

SEQ ID NO: 798800 - DNA, 20 bp, mouse
gaagagcctggcgcaagctc

SEQ ID NO: 798801 - DNA, 20 bp, mouse
gacaatgccgtgtgttcctt

SEQ ID NO: 798802 - DNA, 20 bp, mouse
gacaactataatattatcga

SEQ ID NO: 798803 - DNA, 20 bp, mouse
gcggcattgtgagtattagt

SEQ ID NO: 798804 - DNA, 20 bp, mouse
gtaagtgagcaagaaatttc

SEQ ID NO: 798805 - DNA, 20 bp, mouse
ggcaggaaagcgggaaaggt

SEQ ID NO: 798806 - DNA, 20 bp, mouse
gctaagggccggcaggagac

SEQ ID NO: 798807 - DNA, 20 bp, mouse
gtcccactcgctcatgctaa

SEQ ID NO: 798808 - DNA, 20 bp, mouse
gtgagcgagtgggacccagc

SEQ ID NO: 798809 - DNA, 20 bp, mouse
gcaaccggcacaatgtcacc

SEQ ID NO: 798810 - DNA, 20 bp, mouse
gcggcacaatgtcacccggc

SEQ ID NO: 798811 - DNA, 20 bp, mouse
gggcccttagcatgagcgag

SEQ ID NO: 798812 - DNA, 20 bp, mouse
gtaggcccggagtccacgag

SEQ ID NO: 798813 - DNA, 20 bp, mouse
gcaggcggtgcagtcagtag

SEQ ID NO: 798814 - DNA, 20 bp, mouse
gaatgaccccgcggggtcag

SEQ ID NO: 798815 - DNA, 20 bp, mouse
gtccccgcaaccttctcccg

SEQ ID NO: 798816 - DNA, 20 bp, mouse
gctgggagccaacggctcgg

SEQ ID NO: 798817 - DNA, 20 bp, mouse
gtggaccaatagcgtgcgac

SEQ ID NO: 798818 - DNA, 20 bp, mouse
ggcgcgaggcgtcactcccc

SEQ ID NO: 798819 - DNA, 20 bp, mouse
gggcctgggagccaacggct

SEQ ID NO: 798820 - DNA, 20 bp, mouse
ggggtctgacgcgctctccg

SEQ ID NO: 798821 - DNA, 20 bp, mouse
gcggtgtgcaggctgcgcgg

SEQ ID NO: 798822 - DNA, 20 bp, mouse
gaccaatagcgtgcgacggg

SEQ ID NO: 798823 - DNA, 20 bp, mouse
gagcgcaggcgcagccgccc

SEQ ID NO: 798824 - DNA, 20 bp, mouse
gtgggcttctcgagagtggg

SEQ ID NO: 798825 - DNA, 20 bp, mouse
gccctgggaaattggagagg

SEQ ID NO: 798826 - DNA, 20 bp, mouse
ggggccgcggccgagcgagt

SEQ ID NO: 798827 - DNA, 20 bp, mouse
gccgcggccgagcgagttgg

SEQ ID NO: 798828 - DNA, 20 bp, mouse
gtgaccgcgagcccttcctt

SEQ ID NO: 798829 - DNA, 20 bp, mouse
gtggcgggtgggaagtgctt

SEQ ID NO: 798830 - DNA, 20 bp, mouse
gaaggctgccggagtccgcc

SEQ ID NO: 798831 - DNA, 20 bp, mouse
ggccgagcgagttggcgggt

SEQ ID NO: 798832 - DNA, 20 bp, mouse
gaggggacgcggcgagaggt

SEQ ID NO: 798833 - DNA, 20 bp, mouse
gtcgcggtcaagttcccaac

SEQ ID NO: 798834 - DNA, 20 bp, mouse
ggcccggcggcccgggggaa

SEQ ID NO: 798835 - DNA, 20 bp, mouse
gccggcgtgacgtcacgaga

SEQ ID NO: 798836 - DNA, 20 bp, mouse
gtcaagctgaggcacccagg

SEQ ID NO: 798837 - DNA, 20 bp, mouse
gcacccaggcggctcggatt

SEQ ID NO: 798838 - DNA, 20 bp, mouse
gtgcggagatggtcaagctg

SEQ ID NO: 798839 - DNA, 20 bp, mouse
gctgaggcacccaggcggct

SEQ ID NO: 798840 - DNA, 20 bp, mouse
gacacaggatgctgcggaga

SEQ ID NO: 798841 - DNA, 20 bp, mouse
gggagagtggaagaaccggc

SEQ ID NO: 798842 - DNA, 20 bp, mouse
gtgactctggacaggagtac

SEQ ID NO: 798843 - DNA, 20 bp, mouse
gtggtcaagctgaggcaccc

SEQ ID NO: 798844 - DNA, 20 bp, mouse
gctggccatctctgggagag

SEQ ID NO: 798845 - DNA, 20 bp, mouse
ggctgtgtgggcctttatga

SEQ ID NO: 798846 - DNA, 20 bp, mouse
ggtatgagaacgctggaaaa

SEQ ID NO: 798847 - DNA, 20 bp, mouse
gatgtggagtatgagaacgc

SEQ ID NO: 798848 - DNA, 20 bp, mouse
gcactgttgccaggacataa

SEQ ID NO: 798849 - DNA, 20 bp, mouse
gcattttctggctaaagcac

SEQ ID NO: 798850 - DNA, 20 bp, mouse
gtgcaggcctacgcattttc

SEQ ID NO: 798851 - DNA, 20 bp, mouse
gtcattacgtagccccttac

SEQ ID NO: 798852 - DNA, 20 bp, mouse
gtctgggccggatgtagtct

SEQ ID NO: 798853 - DNA, 20 bp, mouse
gctttagccagaaaatgcgt

SEQ ID NO: 798854 - DNA, 20 bp, mouse
gagcctgcactgcggacttc

SEQ ID NO: 798855 - DNA, 20 bp, mouse
gctccacatcccttatgtcc

SEQ ID NO: 798856 - DNA, 20 bp, mouse
gacagcgcgagcagcgtccc

SEQ ID NO: 798857 - DNA, 20 bp, mouse
gactctgcagggtcaccaac

SEQ ID NO: 798858 - DNA, 20 bp, mouse
ggcagcgcctagctctggga

SEQ ID NO: 798859 - DNA, 20 bp, mouse
gggcctagagggcgaggtat

SEQ ID NO: 798860 - DNA, 20 bp, mouse
ggggagaggggggggatcat

SEQ ID NO: 798861 - DNA, 20 bp, mouse
gagagggcgaggtattggat

SEQ ID NO: 798862 - DNA, 20 bp, mouse
gaagtaccggggctacctat

SEQ ID NO: 798863 - DNA, 20 bp, mouse
gcctcacccgagactctgca

SEQ ID NO: 798864 - DNA, 20 bp, mouse
gagtgccaggagcagtctag

SEQ ID NO: 798865 - DNA, 20 bp, mouse
gtccaggcagcgcctagctc

SEQ ID NO: 798866 - DNA, 20 bp, mouse
gtgggcggggcgcaaactgt

SEQ ID NO: 798867 - DNA, 20 bp, mouse
gggcgtggctaacccggcat

SEQ ID NO: 798868 - DNA, 20 bp, mouse
ggggatgccactctctcgtc

SEQ ID NO: 798869 - DNA, 20 bp, mouse
ggcgcaaactgtgggcagtg

SEQ ID NO: 798870 - DNA, 20 bp, mouse
gctaacccggctggtgggcg

SEQ ID NO: 798871 - DNA, 20 bp, mouse
gcgcggagttatgactgctg

SEQ ID NO: 798872 - DNA, 20 bp, mouse
ggaagccccggggcgtgtgt

SEQ ID NO: 798873 - DNA, 20 bp, mouse
gcgtggctaacccggctggt

SEQ ID NO: 798874 - DNA, 20 bp, mouse
gcccggggcttcctgttgtc

SEQ ID NO: 798875 - DNA, 20 bp, mouse
gaactgtgggcagtgtggcc

SEQ ID NO: 798876 - DNA, 20 bp, mouse
gggccaaattgcaaggggct

SEQ ID NO: 798877 - DNA, 20 bp, mouse
ggaactgggccaaattgcaa

SEQ ID NO: 798878 - DNA, 20 bp, mouse
gcatccacaggcagcggaga

SEQ ID NO: 798879 - DNA, 20 bp, mouse
gcggcagctgcagggtcggt

SEQ ID NO: 798880 - DNA, 20 bp, mouse
gggaatcaggcgaaaagaga

SEQ ID NO: 798881 - DNA, 20 bp, mouse
ggacccagccccttgcaatt

SEQ ID NO: 798882 - DNA, 20 bp, mouse
gagagaaggcatttgtcctg

SEQ ID NO: 798883 - DNA, 20 bp, mouse
gcaagggagatggagtgaca

SEQ ID NO: 798884 - DNA, 20 bp, mouse
ggacgcggcagctgcagggt

SEQ ID NO: 798885 - DNA, 20 bp, mouse
gtcggtcggagctaccaaaa

SEQ ID NO: 798886 - DNA, 20 bp, mouse
gcatgtgctggcatattata

SEQ ID NO: 798887 - DNA, 20 bp, mouse
gtaagagtgggtctaatgaa

SEQ ID NO: 798888 - DNA, 20 bp, mouse
ggccctcattacattgcctc

SEQ ID NO: 798889 - DNA, 20 bp, mouse
gcgtgcgcacagtaaagcac

SEQ ID NO: 798890 - DNA, 20 bp, mouse
gcgaaaagctgcgtggtgac

SEQ ID NO: 798891 - DNA, 20 bp, mouse
gagctcccaactccagaagc

SEQ ID NO: 798892 - DNA, 20 bp, mouse
gggcaatgtaatgagggcat

SEQ ID NO: 798893 - DNA, 20 bp, mouse
ggccagaggcaatgtaatga

SEQ ID NO: 798894 - DNA, 20 bp, mouse
ggtaatgagggcataggact

SEQ ID NO: 798895 - DNA, 20 bp, mouse
gcaaactgccattctccagc

SEQ ID NO: 798896 - DNA, 20 bp, mouse
ggagccagccagaggaacga

SEQ ID NO: 798897 - DNA, 20 bp, mouse
gtaggctggtgagacttgta

SEQ ID NO: 798898 - DNA, 20 bp, mouse
gtggctcggctgaagcgaga

SEQ ID NO: 798899 - DNA, 20 bp, mouse
gttggagaacggggatgcgt

SEQ ID NO: 798900 - DNA, 20 bp, mouse
gaggcagcaggagcacgcgg

SEQ ID NO: 798901 - DNA, 20 bp, mouse
gcagccagaggaacgagggg

SEQ ID NO: 798902 - DNA, 20 bp, mouse
gcgcgcagctcggcgaggga

SEQ ID NO: 798903 - DNA, 20 bp, mouse
gcagcgaccaagtctttcta

SEQ ID NO: 798904 - DNA, 20 bp, mouse
ggcggtcgcgcggccaggga

SEQ ID NO: 798905 - DNA, 20 bp, mouse
gagaacggggatgcgtaggc

SEQ ID NO: 798906 - DNA, 20 bp, mouse
ggggccctgtgcttgtgagg

SEQ ID NO: 798907 - DNA, 20 bp, mouse
gagggatcaggactagccaa

SEQ ID NO: 798908 - DNA, 20 bp, mouse
gcgtccccgcgccgagaagc

SEQ ID NO: 798909 - DNA, 20 bp, mouse
gtgaaggttcccgggagctc

SEQ ID NO: 798910 - DNA, 20 bp, mouse
gtggaacgcccgcgtcgtta

SEQ ID NO: 798911 - DNA, 20 bp, mouse
ggggcggcgtccctggttac

SEQ ID NO: 798912 - DNA, 20 bp, mouse
gcaaatgcccgaaatctctc

SEQ ID NO: 798913 - DNA, 20 bp, mouse
gtgccccgcctcacaagcac

SEQ ID NO: 798914 - DNA, 20 bp, mouse
gggctagtcctgatccctct

SEQ ID NO: 798915 - DNA, 20 bp, mouse
gggagagggcgggacgtccg

SEQ ID NO: 798916 - DNA, 20 bp, mouse
ggcagcccgtctcccggaat

SEQ ID NO: 798917 - DNA, 20 bp, mouse
ggggacggacgtgagagagc

SEQ ID NO: 798918 - DNA, 20 bp, mouse
gagcggaggcagacgatgaa

SEQ ID NO: 798919 - DNA, 20 bp, mouse
ggcgggctccagaggagaaa

SEQ ID NO: 798920 - DNA, 20 bp, mouse
ggtcccggcagcctcagcac

SEQ ID NO: 798921 - DNA, 20 bp, mouse
ggccccgcagctgcccaccc

SEQ ID NO: 798922 - DNA, 20 bp, mouse
gtccgggagacgggctgctg

SEQ ID NO: 798923 - DNA, 20 bp, mouse
gtctaacggagatctagctc

SEQ ID NO: 798924 - DNA, 20 bp, mouse
gtctagctcgggccctgggt

SEQ ID NO: 798925 - DNA, 20 bp, mouse
gcacaccagggaacccgcgg

SEQ ID NO: 798926 - DNA, 20 bp, mouse
ggggaaatgtagtctcggcc

SEQ ID NO: 798927 - DNA, 20 bp, mouse
gtagtctcggccgggatctc

SEQ ID NO: 798928 - DNA, 20 bp, mouse
gacgagctgtgcatcattta

SEQ ID NO: 798929 - DNA, 20 bp, mouse
ggcacccgtaggtctgagca

SEQ ID NO: 798930 - DNA, 20 bp, mouse
gaggccgtgctcagacctac

SEQ ID NO: 798931 - DNA, 20 bp, mouse
ggacctacgggtgcccgcat

SEQ ID NO: 798932 - DNA, 20 bp, mouse
ggggtgcccgcatgggactg

SEQ ID NO: 798933 - DNA, 20 bp, mouse
gggcggcacagtagcaggac

SEQ ID NO: 798934 - DNA, 20 bp, mouse
gctccctaggcaagacccac

SEQ ID NO: 798935 - DNA, 20 bp, mouse
gggtctgagcacggcctgct

SEQ ID NO: 798936 - DNA, 20 bp, mouse
gtaaagagcgggcctcttag

SEQ ID NO: 798937 - DNA, 20 bp, mouse
gtaggggccaatctggacca

SEQ ID NO: 798938 - DNA, 20 bp, mouse
ggacgaaaacgtctacgcga

SEQ ID NO: 798939 - DNA, 20 bp, mouse
gcgaactcgtaaacaaactt

SEQ ID NO: 798940 - DNA, 20 bp, mouse
gggaaaacgggacgctgtag

SEQ ID NO: 798941 - DNA, 20 bp, mouse
gaatacaatgtgcgcagctg

SEQ ID NO: 798942 - DNA, 20 bp, mouse
ggacgctgtaggggccaatc

SEQ ID NO: 798943 - DNA, 20 bp, mouse
gcggcccgagatttgagcag

SEQ ID NO: 798944 - DNA, 20 bp, mouse
gcccggctgctcgcgttcgc

SEQ ID NO: 798945 - DNA, 20 bp, mouse
gcgtctacgcgaaggtgaga

SEQ ID NO: 798946 - DNA, 20 bp, mouse
gggcggggctgcgaggtggt

SEQ ID NO: 798947 - DNA, 20 bp, mouse
gaggtggtgggcgggtcccg

SEQ ID NO: 798948 - DNA, 20 bp, mouse
gttactgcgcggctccgcct

SEQ ID NO: 798949 - DNA, 20 bp, mouse
gtttctagtcagggagggcg

SEQ ID NO: 798950 - DNA, 20 bp, mouse
gcagtaaagcggagcgaggg

SEQ ID NO: 798951 - DNA, 20 bp, mouse
gccgcagccagggatggagg

SEQ ID NO: 798952 - DNA, 20 bp, mouse
gggggctgcgaggtggtggg

SEQ ID NO: 798953 - DNA, 20 bp, mouse
ggcgcagtaaagcggagcga

SEQ ID NO: 798954 - DNA, 20 bp, mouse
gggcgggtcccgcgggacgg

SEQ ID NO: 798955 - DNA, 20 bp, mouse
gagggcatcagtcgtccact

SEQ ID NO: 798956 - DNA, 20 bp, mouse
gcaggcgcgctgaggatttg

SEQ ID NO: 798957 - DNA, 20 bp, mouse
gcggaagttgcaggtatttg

SEQ ID NO: 798958 - DNA, 20 bp, mouse
ggctgccgacgtcacctgat

SEQ ID NO: 798959 - DNA, 20 bp, mouse
ggtcacctgatgggagacgc

SEQ ID NO: 798960 - DNA, 20 bp, mouse
gcgcgcctgcgtctcccatc

SEQ ID NO: 798961 - DNA, 20 bp, mouse
ggcggcgccccgcctactcc

SEQ ID NO: 798962 - DNA, 20 bp, mouse
ggtctcccatcaggtgacgt

SEQ ID NO: 798963 - DNA, 20 bp, mouse
gtcactgcagaactgtcttg

SEQ ID NO: 798964 - DNA, 20 bp, mouse
gcccgcctactccgggaacg

SEQ ID NO: 798965 - DNA, 20 bp, mouse
ggcaaaagctcggaagttgc

SEQ ID NO: 798966 - DNA, 20 bp, mouse
gtgggtccgggcttacagaa

SEQ ID NO: 798967 - DNA, 20 bp, mouse
ggagctgcttgcagtggtta

SEQ ID NO: 798968 - DNA, 20 bp, mouse
gccgggcttacagaatggat

SEQ ID NO: 798969 - DNA, 20 bp, mouse
ggcggattagaatttttcag

SEQ ID NO: 798970 - DNA, 20 bp, mouse
gtggttaggggactggagga

SEQ ID NO: 798971 - DNA, 20 bp, mouse
gaaaaattctaatccgcgga

SEQ ID NO: 798972 - DNA, 20 bp, mouse
gtccagagcgcccctgttgt

SEQ ID NO: 798973 - DNA, 20 bp, mouse
gtcagatccaacccacaaca

SEQ ID NO: 798974 - DNA, 20 bp, mouse
gacccacaacaggggcgctc

SEQ ID NO: 798975 - DNA, 20 bp, mouse
gggcctgcactggtcagtga

SEQ ID NO: 798976 - DNA, 20 bp, mouse
gccccagtggaagttttcag

SEQ ID NO: 798977 - DNA, 20 bp, mouse
gaaaaacagggcagttgcat

SEQ ID NO: 798978 - DNA, 20 bp, mouse
gcgttcagagcgccaagggg

SEQ ID NO: 798979 - DNA, 20 bp, mouse
gcgccaaggggtggctggtt

SEQ ID NO: 798980 - DNA, 20 bp, mouse
gtggcgggtgtgagtgagga

SEQ ID NO: 798981 - DNA, 20 bp, mouse
gcaactgccctgtttttctc

SEQ ID NO: 798982 - DNA, 20 bp, mouse
gtgattggcgggtgtgagtg

SEQ ID NO: 798983 - DNA, 20 bp, mouse
gcacccctgaaaacttccac

SEQ ID NO: 798984 - DNA, 20 bp, mouse
gcttcggttacagtgattgg

SEQ ID NO: 798985 - DNA, 20 bp, mouse
ggtgcgcagacgtactgctt

SEQ ID NO: 798986 - DNA, 20 bp, mouse
gaccaaccgccaccttcggg

SEQ ID NO: 798987 - DNA, 20 bp, mouse
ggctccaggccctctgggat

SEQ ID NO: 798988 - DNA, 20 bp, mouse
ggagccccttgttaacggag

SEQ ID NO: 798989 - DNA, 20 bp, mouse
gggatagcagccaatcaaac

SEQ ID NO: 798990 - DNA, 20 bp, mouse
gccaccccctccgttaacaa

SEQ ID NO: 798991 - DNA, 20 bp, mouse
ggctgccatcacaacaccca

SEQ ID NO: 798992 - DNA, 20 bp, mouse
ggctccggccgagtccgcag

SEQ ID NO: 798993 - DNA, 20 bp, mouse
ggcgaccaaccgccaccttc

SEQ ID NO: 798994 - DNA, 20 bp, mouse
gatgccgcctccaattggtt

SEQ ID NO: 798995 - DNA, 20 bp, mouse
gaaggggctccaggccctct

SEQ ID NO: 798996 - DNA, 20 bp, mouse
ggagccctggccagtctcag

SEQ ID NO: 798997 - DNA, 20 bp, mouse
ggacacagggaacagcgccg

SEQ ID NO: 798998 - DNA, 20 bp, mouse
gctaaggcggccactgagac

SEQ ID NO: 798999 - DNA, 20 bp, mouse
gcggccactgagactggcca

SEQ ID NO: 799000 - DNA, 20 bp, mouse
ggcaggtcggaccagtaagt

SEQ ID NO: 799001 - DNA, 20 bp, mouse
ggacactgcgggccctaagg

SEQ ID NO: 799002 - DNA, 20 bp, mouse
gagggcgtcagcgtgacccg

SEQ ID NO: 799003 - DNA, 20 bp, mouse
gcgctggggcggtgagttca

SEQ ID NO: 799004 - DNA, 20 bp, mouse
ggtcacgctgacgccctggg

SEQ ID NO: 799005 - DNA, 20 bp, mouse
gtgggcttgcaggacactgc

SEQ ID NO: 799006 - DNA, 20 bp, mouse
gcaagacaggccgcttcctc

SEQ ID NO: 799007 - DNA, 20 bp, mouse
gacccaggagccgggtgcct

SEQ ID NO: 799008 - DNA, 20 bp, mouse
gggccacggagctccgtgat

SEQ ID NO: 799009 - DNA, 20 bp, mouse
gacacgtgaccgcggtgggc

SEQ ID NO: 799010 - DNA, 20 bp, mouse
ggggccacgcccaccggagc

SEQ ID NO: 799011 - DNA, 20 bp, mouse
gcccgcaccacgtgacatct

SEQ ID NO: 799012 - DNA, 20 bp, mouse
gcggcctgccgagctcgaga

SEQ ID NO: 799013 - DNA, 20 bp, mouse
gcggccgcgacacgtgaccg

SEQ ID NO: 799014 - DNA, 20 bp, mouse
ggcgccaaagctcgcaagac

SEQ ID NO: 799015 - DNA, 20 bp, mouse
gcaagcggccacacctgctc

SEQ ID NO: 799016 - DNA, 20 bp, mouse
gaatacctggagcctagtag

SEQ ID NO: 799017 - DNA, 20 bp, mouse
gtggagcctagtaggggatt

SEQ ID NO: 799018 - DNA, 20 bp, mouse
gagatggcgccattggcaca

SEQ ID NO: 799019 - DNA, 20 bp, mouse
gcgcactgcaccctgctgac

SEQ ID NO: 799020 - DNA, 20 bp, mouse
gactgcaccctgctgacggg

SEQ ID NO: 799021 - DNA, 20 bp, mouse
ggaagcaaagctgcactctc

SEQ ID NO: 799022 - DNA, 20 bp, mouse
ggcgcggggtaagagagcgg

SEQ ID NO: 799023 - DNA, 20 bp, mouse
gtgcgcctgcgtgtgactcg

SEQ ID NO: 799024 - DNA, 20 bp, mouse
gaggagccgaatcccctact

SEQ ID NO: 799025 - DNA, 20 bp, mouse
gaggcgcagacgtggactcc

SEQ ID NO: 799026 - DNA, 20 bp, mouse
gctctcggagggacctcgta

SEQ ID NO: 799027 - DNA, 20 bp, mouse
gggggtcggctctcaaggag

SEQ ID NO: 799028 - DNA, 20 bp, mouse
gtcggctctcaaggagtggg

SEQ ID NO: 799029 - DNA, 20 bp, mouse
ggggacttctatgctcacaa

SEQ ID NO: 799030 - DNA, 20 bp, mouse
gaactctgctgaaccagtca

SEQ ID NO: 799031 - DNA, 20 bp, mouse
gcccggccgtagctggtgag

SEQ ID NO: 799032 - DNA, 20 bp, mouse
gacgtcacgggccagcgcgg

SEQ ID NO: 799033 - DNA, 20 bp, mouse
gtgcgggcgtcatgacgtca

SEQ ID NO: 799034 - DNA, 20 bp, mouse
gaacacacgcgggacagcgg

SEQ ID NO: 799035 - DNA, 20 bp, mouse
gggagggacctcgtagggct

SEQ ID NO: 799036 - DNA, 20 bp, mouse
ggggcctctaaatccccgca

SEQ ID NO: 799037 - DNA, 20 bp, mouse
gccaaccccctcgggatgac

SEQ ID NO: 799038 - DNA, 20 bp, mouse
ggctgatgtccaaccccctc

SEQ ID NO: 799039 - DNA, 20 bp, mouse
gccaaccccgccttgtgggt

SEQ ID NO: 799040 - DNA, 20 bp, mouse
gtcacgggagactctctccg

SEQ ID NO: 799041 - DNA, 20 bp, mouse
gcagaagcctgtcatcccga

SEQ ID NO: 799042 - DNA, 20 bp, mouse
gcccacttccggatggaacg

SEQ ID NO: 799043 - DNA, 20 bp, mouse
gaaatccccgcaaggaaggc

SEQ ID NO: 799044 - DNA, 20 bp, mouse
ggcctcctgccttccttgcg

SEQ ID NO: 799045 - DNA, 20 bp, mouse
gcttccttgcggggatttag

SEQ ID NO: 799046 - DNA, 20 bp, mouse
gcgtggggaggagacgagaa

SEQ ID NO: 799047 - DNA, 20 bp, mouse
ggggaggagacgagaagggt

SEQ ID NO: 799048 - DNA, 20 bp, mouse
gtgtccttctcggtggcgtg

SEQ ID NO: 799049 - DNA, 20 bp, mouse
gcaagctggagaggctgcgg

SEQ ID NO: 799050 - DNA, 20 bp, mouse
gcctggctggtcaccccgaa

SEQ ID NO: 799051 - DNA, 20 bp, mouse
ggcctctccagcttgagcgc

SEQ ID NO: 799052 - DNA, 20 bp, mouse
gcacctcccggcgctcaagc

SEQ ID NO: 799053 - DNA, 20 bp, mouse
gcccggcgctcaagctggag

SEQ ID NO: 799054 - DNA, 20 bp, mouse
gccagcgcgaagtgcgcccg

SEQ ID NO: 799055 - DNA, 20 bp, mouse
gcgccaccgagaaggacaag

SEQ ID NO: 799056 - DNA, 20 bp, mouse
gaaccggtgggattgtaacg

SEQ ID NO: 799057 - DNA, 20 bp, mouse
ggtggggcgtggcttcgagt

SEQ ID NO: 799058 - DNA, 20 bp, mouse
gaagatgcaaggacgtacac

SEQ ID NO: 799059 - DNA, 20 bp, mouse
gcaaaagcgccatgaacctc

SEQ ID NO: 799060 - DNA, 20 bp, mouse
gaaccgcgttacaatcccac

SEQ ID NO: 799061 - DNA, 20 bp, mouse
gtgcgcgcccagggcgacgt

SEQ ID NO: 799062 - DNA, 20 bp, mouse
gcccagggcgacgtggggcg

SEQ ID NO: 799063 - DNA, 20 bp, mouse
gtccttgcatcttaaggaac

SEQ ID NO: 799064 - DNA, 20 bp, mouse
ggtggcttcgagtcggggtg

SEQ ID NO: 799065 - DNA, 20 bp, mouse
gcgtcaaagccggaggttca

SEQ ID NO: 799066 - DNA, 20 bp, mouse
ggcgctgggtcgcctggctg

SEQ ID NO: 799067 - DNA, 20 bp, mouse
ggctggggcagagttggaaa

SEQ ID NO: 799068 - DNA, 20 bp, mouse
gacccctggcgattcccgca

SEQ ID NO: 799069 - DNA, 20 bp, mouse
gtccctgcgggaatcgccag

SEQ ID NO: 799070 - DNA, 20 bp, mouse
gagctcactctgggtccctg

SEQ ID NO: 799071 - DNA, 20 bp, mouse
ggggctctggcgctgttgct

SEQ ID NO: 799072 - DNA, 20 bp, mouse
gcagctgttcccaacagctg

SEQ ID NO: 799073 - DNA, 20 bp, mouse
gggtgctgtgggtaaccaag

SEQ ID NO: 799074 - DNA, 20 bp, mouse
gcagagttggaaacggctgg

SEQ ID NO: 799075 - DNA, 20 bp, mouse
gttggccgggacagcacctg

SEQ ID NO: 799076 - DNA, 20 bp, mouse
ggcgacggcggagactatct

SEQ ID NO: 799077 - DNA, 20 bp, mouse
gagagggatgaccatagagt

SEQ ID NO: 799078 - DNA, 20 bp, mouse
gaatgagtcagaggcgacgg

SEQ ID NO: 799079 - DNA, 20 bp, mouse
gcttaatgagtcagaggcga

SEQ ID NO: 799080 - DNA, 20 bp, mouse
ggcgccaggaggcgtggaaa

SEQ ID NO: 799081 - DNA, 20 bp, mouse
gttgaggtcaaggttccggc

SEQ ID NO: 799082 - DNA, 20 bp, mouse
gggctccaatcaaaaatggc

SEQ ID NO: 799083 - DNA, 20 bp, mouse
gctcgcgcggggcttgttac

SEQ ID NO: 799084 - DNA, 20 bp, mouse
gccaccctgccatttttgat

SEQ ID NO: 799085 - DNA, 20 bp, mouse
gctgactcattaagtacaga

SEQ ID NO: 799086 - DNA, 20 bp, mouse
ggaggattgaccaatcgcaa

SEQ ID NO: 799087 - DNA, 20 bp, mouse
gctgggaagagacgcaagtt

SEQ ID NO: 799088 - DNA, 20 bp, mouse
gcgaaggccgatggataaaa

SEQ ID NO: 799089 - DNA, 20 bp, mouse
gagggcaggtcgcacagtgc

SEQ ID NO: 799090 - DNA, 20 bp, mouse
gggagctctccataagaaga

SEQ ID NO: 799091 - DNA, 20 bp, mouse
gaggcctcaacccttgcgat

SEQ ID NO: 799092 - DNA, 20 bp, mouse
gtgaccaatcgcaagggttg

SEQ ID NO: 799093 - DNA, 20 bp, mouse
ggaggatgctgtgacaccga

SEQ ID NO: 799094 - DNA, 20 bp, mouse
ggcccgcggccactccatcc

SEQ ID NO: 799095 - DNA, 20 bp, mouse
ggatggataaaaggggaccg

SEQ ID NO: 799096 - DNA, 20 bp, mouse
gcggagggacctagcaaggt

SEQ ID NO: 799097 - DNA, 20 bp, mouse
gaagccgtacccagtgaggg

SEQ ID NO: 799098 - DNA, 20 bp, mouse
gcctccgccctcactgggta

SEQ ID NO: 799099 - DNA, 20 bp, mouse
gcgcaagccgtacccagtga

SEQ ID NO: 799100 - DNA, 20 bp, mouse
gagggcggagggacctagca

SEQ ID NO: 799101 - DNA, 20 bp, mouse
ggggccgactaaccaatagg

SEQ ID NO: 799102 - DNA, 20 bp, mouse
ggtggcggcatggtcaaaag

SEQ ID NO: 799103 - DNA, 20 bp, mouse
gcggaagtaaccaggaagag

SEQ ID NO: 799104 - DNA, 20 bp, mouse
gaggtccctccgccctcact

SEQ ID NO: 799105 - DNA, 20 bp, mouse
gcccaggtgggcgggaggta

SEQ ID NO: 799106 - DNA, 20 bp, mouse
gggcggagcttcttgaacga

SEQ ID NO: 799107 - DNA, 20 bp, mouse
gagactggaaggaatagttc

SEQ ID NO: 799108 - DNA, 20 bp, mouse
ggcaccgcccccgccactgg

SEQ ID NO: 799109 - DNA, 20 bp, mouse
gaaaagaaaaatgacgtcct

SEQ ID NO: 799110 - DNA, 20 bp, mouse
gtcaagtttcccccagtggc

SEQ ID NO: 799111 - DNA, 20 bp, mouse
gccctcatctgacatagagt

SEQ ID NO: 799112 - DNA, 20 bp, mouse
gttgctcaaaagagtccggg

SEQ ID NO: 799113 - DNA, 20 bp, mouse
gcagatgagggcaggcttag

SEQ ID NO: 799114 - DNA, 20 bp, mouse
gtccgggaggaaacgcagac

SEQ ID NO: 799115 - DNA, 20 bp, mouse
gaccccaaattcaccaaagc

SEQ ID NO: 799116 - DNA, 20 bp, mouse
ggaggctcttatctccgggg

SEQ ID NO: 799117 - DNA, 20 bp, mouse
ggggtggctgggtagaacac

SEQ ID NO: 799118 - DNA, 20 bp, mouse
gaggaaggagcttccgatgg

SEQ ID NO: 799119 - DNA, 20 bp, mouse
gtccggggcggctcactggg

SEQ ID NO: 799120 - DNA, 20 bp, mouse
gaactggagtgaaaggacag

SEQ ID NO: 799121 - DNA, 20 bp, mouse
gggtaagaagaggcgataac

SEQ ID NO: 799122 - DNA, 20 bp, mouse
gtatctccggggcggctcac

SEQ ID NO: 799123 - DNA, 20 bp, mouse
gcggagataagagcctccat

SEQ ID NO: 799124 - DNA, 20 bp, mouse
ggtgaggaaggagcttccga

SEQ ID NO: 799125 - DNA, 20 bp, mouse
gaaggagaggacattacatg

SEQ ID NO: 799126 - DNA, 20 bp, mouse
gccctggcgtgcgtgctcat

SEQ ID NO: 799127 - DNA, 20 bp, mouse
ggccgcttccgggaatcgag

SEQ ID NO: 799128 - DNA, 20 bp, mouse
ggggggttgggaagaggacg

SEQ ID NO: 799129 - DNA, 20 bp, mouse
gggaagtcctaactgacagt

SEQ ID NO: 799130 - DNA, 20 bp, mouse
ggccccctttccatctcaaa

SEQ ID NO: 799131 - DNA, 20 bp, mouse
gttgacaggaagaactctga

SEQ ID NO: 799132 - DNA, 20 bp, mouse
gaacactgaaaatgacgtca

SEQ ID NO: 799133 - DNA, 20 bp, mouse
gaatgacgtcagggaggaaa

SEQ ID NO: 799134 - DNA, 20 bp, mouse
ggggacgttgtgtgacgtct

SEQ ID NO: 799135 - DNA, 20 bp, mouse
gggaaagggggccagtctct

SEQ ID NO: 799136 - DNA, 20 bp, mouse
gcaaagttgaaacatcctac

SEQ ID NO: 799137 - DNA, 20 bp, mouse
gaggaaaacaaaatgtctat

SEQ ID NO: 799138 - DNA, 20 bp, mouse
gagacattttgttttcctgt

SEQ ID NO: 799139 - DNA, 20 bp, mouse
ggaggaggggcggtgcccgg

SEQ ID NO: 799140 - DNA, 20 bp, mouse
gggggggcgtaaggagggtg

SEQ ID NO: 799141 - DNA, 20 bp, mouse
gtacgcccccccctcagttt

SEQ ID NO: 799142 - DNA, 20 bp, mouse
gggcaggcctgctttataca

SEQ ID NO: 799143 - DNA, 20 bp, mouse
gcagccgtcctcagggagga

SEQ ID NO: 799144 - DNA, 20 bp, mouse
gcgtatcctaaactgagggg

SEQ ID NO: 799145 - DNA, 20 bp, mouse
ggcttcgtatcctaaactga

SEQ ID NO: 799146 - DNA, 20 bp, mouse
gaacgccagcgagtgcccgg

SEQ ID NO: 799147 - DNA, 20 bp, mouse
ggaaggccgaggcttcaggc

SEQ ID NO: 799148 - DNA, 20 bp, mouse
gggcggacgcctaaggtccc

SEQ ID NO: 799149 - DNA, 20 bp, mouse
ggcgcgtagggtcttaggaa

SEQ ID NO: 799150 - DNA, 20 bp, mouse
gcaaaagcgagctgggaagg

SEQ ID NO: 799151 - DNA, 20 bp, mouse
gtaccgcgcccccaagcttg

SEQ ID NO: 799152 - DNA, 20 bp, mouse
gactcggccgttagcgtctc

SEQ ID NO: 799153 - DNA, 20 bp, mouse
gtcgcgcgcctcaagcttgg

SEQ ID NO: 799154 - DNA, 20 bp, mouse
gcacagacacagtttcggcc

SEQ ID NO: 799155 - DNA, 20 bp, mouse
ggcgcggccggagacgctaa

SEQ ID NO: 799156 - DNA, 20 bp, mouse
gaggcctcgtgttagtacga

SEQ ID NO: 799157 - DNA, 20 bp, mouse
ggcgcagccacgggctgaat

SEQ ID NO: 799158 - DNA, 20 bp, mouse
ggcggctcctgcgcagccac

SEQ ID NO: 799159 - DNA, 20 bp, mouse
gggaagtagtcggaacccgg

SEQ ID NO: 799160 - DNA, 20 bp, mouse
ggccggaacccggaaccaga

SEQ ID NO: 799161 - DNA, 20 bp, mouse
gtccgactacttccgttcta

SEQ ID NO: 799162 - DNA, 20 bp, mouse
gaacggaagtagtcggaacc

SEQ ID NO: 799163 - DNA, 20 bp, mouse
gggtttccctgagacgcctg

SEQ ID NO: 799164 - DNA, 20 bp, mouse
gcaagtctcacgagtagctg

SEQ ID NO: 799165 - DNA, 20 bp, mouse
gtgtcttagcagtcggggaa

SEQ ID NO: 799166 - DNA, 20 bp, mouse
gaagcggcgcgggacagcgt

SEQ ID NO: 799167 - DNA, 20 bp, mouse
ggacgcgggtccggcgaatg

SEQ ID NO: 799168 - DNA, 20 bp, mouse
ggagacagacaagctgatac

SEQ ID NO: 799169 - DNA, 20 bp, mouse
ggataccggcgagcacctag

SEQ ID NO: 799170 - DNA, 20 bp, mouse
gagcgtggggaactcggatt

SEQ ID NO: 799171 - DNA, 20 bp, mouse
gtctcgcggggcgcacggtc

SEQ ID NO: 799172 - DNA, 20 bp, mouse
ggtcccgcgtgccaggacgc

SEQ ID NO: 799173 - DNA, 20 bp, mouse
ggcgtggccggctacaaagg

SEQ ID NO: 799174 - DNA, 20 bp, mouse
ggacccgcgtcctggcacgc

SEQ ID NO: 799175 - DNA, 20 bp, mouse
gcggcggcccccgcttccaa

SEQ ID NO: 799176 - DNA, 20 bp, mouse
gctgcacccaagtctcgcga

SEQ ID NO: 799177 - DNA, 20 bp, mouse
gctctcgcgagaaactgccc

SEQ ID NO: 799178 - DNA, 20 bp, mouse
gattgcgcgagattgggcca

SEQ ID NO: 799179 - DNA, 20 bp, mouse
gactgccccgggttccagac

SEQ ID NO: 799180 - DNA, 20 bp, mouse
gccacggtcgccgggagccg

SEQ ID NO: 799181 - DNA, 20 bp, mouse
gctcccggagccgcaagcac

SEQ ID NO: 799182 - DNA, 20 bp, mouse
gagaagcctttcggaattgg

SEQ ID NO: 799183 - DNA, 20 bp, mouse
gatcgcgagatctctcaccg

SEQ ID NO: 799184 - DNA, 20 bp, mouse
gagggcgggtgtccggggtg

SEQ ID NO: 799185 - DNA, 20 bp, mouse
gcgagacttgggtgcagctc

SEQ ID NO: 799186 - DNA, 20 bp, mouse
gaccaaccgccaccttcggg

SEQ ID NO: 799187 - DNA, 20 bp, mouse
ggctccaggccctctgggat

SEQ ID NO: 799188 - DNA, 20 bp, mouse
ggagccccttgttaacggag

SEQ ID NO: 799189 - DNA, 20 bp, mouse
gggatagcagccaatcaaac

SEQ ID NO: 799190 - DNA, 20 bp, mouse
gccaccccctccgttaacaa

SEQ ID NO: 799191 - DNA, 20 bp, mouse
ggctgccatcacaacaccca

SEQ ID NO: 799192 - DNA, 20 bp, mouse
ggctccggccgagtccgcag

SEQ ID NO: 799193 - DNA, 20 bp, mouse
ggcgaccaaccgccaccttc

SEQ ID NO: 799194 - DNA, 20 bp, mouse
gatgccgcctccaattggtt

SEQ ID NO: 799195 - DNA, 20 bp, mouse
gaaggggctccaggccctct

SEQ ID NO: 799196 - DNA, 20 bp, mouse
gaaagcgggtattgggtgat

SEQ ID NO: 799197 - DNA, 20 bp, mouse
ggaagccaaaggtgaatcct

SEQ ID NO: 799198 - DNA, 20 bp, mouse
gggaaagagaaagcgggtat

SEQ ID NO: 799199 - DNA, 20 bp, mouse
gactcaaaggtgatgaaggt

SEQ ID NO: 799200 - DNA, 20 bp, mouse
gaagtgtagtaatgtgatga

SEQ ID NO: 799201 - DNA, 20 bp, mouse
gtaaactaagggaacccaga

SEQ ID NO: 799202 - DNA, 20 bp, mouse
gaggttggagcgtggaactc

SEQ ID NO: 799203 - DNA, 20 bp, mouse
gatctgtgcggcagactcaa

SEQ ID NO: 799204 - DNA, 20 bp, mouse
gtacaatgtggttagaccag

SEQ ID NO: 799205 - DNA, 20 bp, mouse
gcggtgattaggaacaatat

SEQ ID NO: 799206 - DNA, 20 bp, mouse
ggaaagtcagggccccggaa

SEQ ID NO: 799207 - DNA, 20 bp, mouse
gcgccctcgtagagaaaggt

SEQ ID NO: 799208 - DNA, 20 bp, mouse
gaggaggcacggaagttcgg

SEQ ID NO: 799209 - DNA, 20 bp, mouse
ggccccgccctcgtagagaa

SEQ ID NO: 799210 - DNA, 20 bp, mouse
gcagacgcggctgtacggat

SEQ ID NO: 799211 - DNA, 20 bp, mouse
ggacgtatggactaccgcga

SEQ ID NO: 799212 - DNA, 20 bp, mouse
gggagccggccgatgacgta

SEQ ID NO: 799213 - DNA, 20 bp, mouse
gccggcttccacagcggggt

SEQ ID NO: 799214 - DNA, 20 bp, mouse
gcgcccacctttctctacga

SEQ ID NO: 799215 - DNA, 20 bp, mouse
gggaagccggaactttgagg

SEQ ID NO: 799216 - DNA, 20 bp, mouse
gcccctggggcatcttgcac

SEQ ID NO: 799217 - DNA, 20 bp, mouse
gagaatgcgctggagagacg

SEQ ID NO: 799218 - DNA, 20 bp, mouse
gcgcccaggctcatcaccgg

SEQ ID NO: 799219 - DNA, 20 bp, mouse
gctggcgggaaggaagtgtc

SEQ ID NO: 799220 - DNA, 20 bp, mouse
gggaaggaagtgtcggggat

SEQ ID NO: 799221 - DNA, 20 bp, mouse
ggtcacgggcgcagcaggtc

SEQ ID NO: 799222 - DNA, 20 bp, mouse
ggagagacggggcaaagcct

SEQ ID NO: 799223 - DNA, 20 bp, mouse
gcccggctgggtcggtccct

SEQ ID NO: 799224 - DNA, 20 bp, mouse
gtacctgtgcaagatgcccc

SEQ ID NO: 799225 - DNA, 20 bp, mouse
gtctctccaaactcattcct

SEQ ID NO: 799226 - DNA, 20 bp, mouse
gccacggggttccatgtcta

SEQ ID NO: 799227 - DNA, 20 bp, mouse
gcgcgggaaggagctgcacg

SEQ ID NO: 799228 - DNA, 20 bp, mouse
ggaaggagctgcacggggct

SEQ ID NO: 799229 - DNA, 20 bp, mouse
gagctgcacggggcttggat

SEQ ID NO: 799230 - DNA, 20 bp, mouse
gagacttaaaaggcgctaag

SEQ ID NO: 799231 - DNA, 20 bp, mouse
gctggtggggcttaaatgcg

SEQ ID NO: 799232 - DNA, 20 bp, mouse
gcagcaaagcgcaagccacg

SEQ ID NO: 799233 - DNA, 20 bp, mouse
gtcttctcgcgagacttaaa

SEQ ID NO: 799234 - DNA, 20 bp, mouse
gtattggctgtgtaacaggg

SEQ ID NO: 799235 - DNA, 20 bp, mouse
gaacagggtggctccatgat

SEQ ID NO: 799236 - DNA, 20 bp, mouse
ggggcgctgcagaatgttcc

SEQ ID NO: 799237 - DNA, 20 bp, mouse
ggcagcgccccctggtgcca

SEQ ID NO: 799238 - DNA, 20 bp, mouse
ggcgttggggtcttgcagta

SEQ ID NO: 799239 - DNA, 20 bp, mouse
ggaaggcttaagaatcaggc

SEQ ID NO: 799240 - DNA, 20 bp, mouse
gcgtcccgcagtgaggtctg

SEQ ID NO: 799241 - DNA, 20 bp, mouse
gagcccgcagacctcactgc

SEQ ID NO: 799242 - DNA, 20 bp, mouse
gaggcaggcttcactcaaaa

SEQ ID NO: 799243 - DNA, 20 bp, mouse
ggagtccaccgtggcaccag

SEQ ID NO: 799244 - DNA, 20 bp, mouse
gatctcaaatcttcagtccc

SEQ ID NO: 799245 - DNA, 20 bp, mouse
gttggggtcttgcagtaagg

SEQ ID NO: 799246 - DNA, 20 bp, mouse
gaatcagcggccgccggtgg

SEQ ID NO: 799247 - DNA, 20 bp, mouse
gcgggactgaggcttgaggc

SEQ ID NO: 799248 - DNA, 20 bp, mouse
ggccgctgattggtcgaggt

SEQ ID NO: 799249 - DNA, 20 bp, mouse
gagtctgggcgagtgaagtt

SEQ ID NO: 799250 - DNA, 20 bp, mouse
gccttaagggagatgtaggt

SEQ ID NO: 799251 - DNA, 20 bp, mouse
ggcacgctcgctggccaatc

SEQ ID NO: 799252 - DNA, 20 bp, mouse
ggcctcctcgcccccaccgg

SEQ ID NO: 799253 - DNA, 20 bp, mouse
gaccaatcagcggccgccgg

SEQ ID NO: 799254 - DNA, 20 bp, mouse
gtcgaccaatcagcggccgc

SEQ ID NO: 799255 - DNA, 20 bp, mouse
gccccacctcgaccaatcag

SEQ ID NO: 799256 - DNA, 20 bp, mouse
gaggggccatagctgtcctg

SEQ ID NO: 799257 - DNA, 20 bp, mouse
gaaggcgtggctcagaaagc

SEQ ID NO: 799258 - DNA, 20 bp, mouse
gccgagccaggagccacgta

SEQ ID NO: 799259 - DNA, 20 bp, mouse
ggtggctcctggctcggcat

SEQ ID NO: 799260 - DNA, 20 bp, mouse
gctggctcggcattggccaa

SEQ ID NO: 799261 - DNA, 20 bp, mouse
gacgccttcaaattcattcc

SEQ ID NO: 799262 - DNA, 20 bp, mouse
gtcccaaggctcaaagccat

SEQ ID NO: 799263 - DNA, 20 bp, mouse
gttcctggggttaggggcaa

SEQ ID NO: 799264 - DNA, 20 bp, mouse
ggcaatgcagtgtcttcttg

SEQ ID NO: 799265 - DNA, 20 bp, mouse
ggcagagtcacgctgttcct

SEQ ID NO: 799266 - DNA, 20 bp, mouse
ggccgggcgtgggaagaggg

SEQ ID NO: 799267 - DNA, 20 bp, mouse
ggggcctgatcgatgttctc

SEQ ID NO: 799268 - DNA, 20 bp, mouse
gccgccccctagagcttcgg

SEQ ID NO: 799269 - DNA, 20 bp, mouse
gggtgacagcggccgggcgt

SEQ ID NO: 799270 - DNA, 20 bp, mouse
ggtgccgccccctagagctt

SEQ ID NO: 799271 - DNA, 20 bp, mouse
gcccggccgctgtcaccctc

SEQ ID NO: 799272 - DNA, 20 bp, mouse
ggccacctccgaagctctag

SEQ ID NO: 799273 - DNA, 20 bp, mouse
gagcttcggaggtggcccga

SEQ ID NO: 799274 - DNA, 20 bp, mouse
gctcaggagatgatcgtcga

SEQ ID NO: 799275 - DNA, 20 bp, mouse
ggcggccgggcgtgggaaga

SEQ ID NO: 799276 - DNA, 20 bp, mouse
ggggcggggtcatgtggtga

SEQ ID NO: 799277 - DNA, 20 bp, mouse
gaagccgcgacccactccca

SEQ ID NO: 799278 - DNA, 20 bp, mouse
gggtcgccccgctcctgcga

SEQ ID NO: 799279 - DNA, 20 bp, mouse
gccactcccaaggcggtgat

SEQ ID NO: 799280 - DNA, 20 bp, mouse
gcctccccctcgcaggagcg

SEQ ID NO: 799281 - DNA, 20 bp, mouse
ggtattgggcgcactgtcga

SEQ ID NO: 799282 - DNA, 20 bp, mouse
gctgtccgccccccgtgcgg

SEQ ID NO: 799283 - DNA, 20 bp, mouse
gaaagcgcccggtcgcgccg

SEQ ID NO: 799284 - DNA, 20 bp, mouse
gtgacggcactgcggagcga

SEQ ID NO: 799285 - DNA, 20 bp, mouse
gagcggggcgaccaatcctg

SEQ ID NO: 799286 - DNA, 20 bp, mouse
gtaacgcagggtatagtgac

SEQ ID NO: 799287 - DNA, 20 bp, mouse
gagggtgccggtctgcgcga

SEQ ID NO: 799288 - DNA, 20 bp, mouse
gcgagggctgccgggaagtg

SEQ ID NO: 799289 - DNA, 20 bp, mouse
gccgggaagtgtggtcgccc

SEQ ID NO: 799290 - DNA, 20 bp, mouse
gtcgacgcgcgagggactgt

SEQ ID NO: 799291 - DNA, 20 bp, mouse
gggtctgcgcgagggctgcc

SEQ ID NO: 799292 - DNA, 20 bp, mouse
gcagaggcgtccaatcagcg

SEQ ID NO: 799293 - DNA, 20 bp, mouse
gcgcgcgagggactgtgggt

SEQ ID NO: 799294 - DNA, 20 bp, mouse
ggctggtaaagttcacatcc

SEQ ID NO: 799295 - DNA, 20 bp, mouse
ggtatagtgacaggctgcct

SEQ ID NO: 799296 - DNA, 20 bp, mouse
ggagctgctgcccaatggaa

SEQ ID NO: 799297 - DNA, 20 bp, mouse
gagtgtgcaaggggtccggg

SEQ ID NO: 799298 - DNA, 20 bp, mouse
gcctgccgggagttatggtt

SEQ ID NO: 799299 - DNA, 20 bp, mouse
ggcgcagcggctttgacggc

SEQ ID NO: 799300 - DNA, 20 bp, mouse
ggtgccttctaattgggcag

SEQ ID NO: 799301 - DNA, 20 bp, mouse
gacttcctcccggtgggctc

SEQ ID NO: 799302 - DNA, 20 bp, mouse
gagaagcgtgccttctaatt

SEQ ID NO: 799303 - DNA, 20 bp, mouse
gcagggcacggcgggagagg

SEQ ID NO: 799304 - DNA, 20 bp, mouse
gctgcgcgcagcggctttga

SEQ ID NO: 799305 - DNA, 20 bp, mouse
gcgccgtgccctgcgcgcag

SEQ ID NO: 799306 - DNA, 20 bp, mouse
ggcgtgaaaaatggctactg

SEQ ID NO: 799307 - DNA, 20 bp, mouse
ggtaacggttgcgtctgacg

SEQ ID NO: 799308 - DNA, 20 bp, mouse
gtgacctgcggcgccgccga

SEQ ID NO: 799309 - DNA, 20 bp, mouse
gggacagcgacaccgagttc

SEQ ID NO: 799310 - DNA, 20 bp, mouse
gtccgccgttgcgtgaaaaa

SEQ ID NO: 799311 - DNA, 20 bp, mouse
gaaggagcagccgccggaaa

SEQ ID NO: 799312 - DNA, 20 bp, mouse
ggatcaaactgggccctcgg

SEQ ID NO: 799313 - DNA, 20 bp, mouse
gacgagctacgcacgcgcgc

SEQ ID NO: 799314 - DNA, 20 bp, mouse
gggcgatcaagccaacagga

SEQ ID NO: 799315 - DNA, 20 bp, mouse
ggatcggtgggccatcctgt

SEQ ID NO: 799316 - DNA, 20 bp, mouse
gcagcactctgggaccccga

SEQ ID NO: 799317 - DNA, 20 bp, mouse
gtactcgcagagctccatcg

SEQ ID NO: 799318 - DNA, 20 bp, mouse
gtgtggaaggggaatatagt

SEQ ID NO: 799319 - DNA, 20 bp, mouse
gaagaaaaacgtcacgagtt

SEQ ID NO: 799320 - DNA, 20 bp, mouse
gtatgaggccgtaggctaca

SEQ ID NO: 799321 - DNA, 20 bp, mouse
gtagaaacgtccagcactct

SEQ ID NO: 799322 - DNA, 20 bp, mouse
ggaaaattcgccaatgtagg

SEQ ID NO: 799323 - DNA, 20 bp, mouse
ggtaacttcgagcccagcta

SEQ ID NO: 799324 - DNA, 20 bp, mouse
gcgccgagggcgggacttgg

SEQ ID NO: 799325 - DNA, 20 bp, mouse
gtctgcgagtatgaggccgt

SEQ ID NO: 799326 - DNA, 20 bp, mouse
gctcacctccagcgggtccc

SEQ ID NO: 799327 - DNA, 20 bp, mouse
gggtgcgcccgatagcgaga

SEQ ID NO: 799328 - DNA, 20 bp, mouse
gttgtgtccagggtgggaga

SEQ ID NO: 799329 - DNA, 20 bp, mouse
gcaccggtccgggaatttgg

SEQ ID NO: 799330 - DNA, 20 bp, mouse
gtgccaggcggcatctgggg

SEQ ID NO: 799331 - DNA, 20 bp, mouse
gcggcgatcgctttgtgtcc

SEQ ID NO: 799332 - DNA, 20 bp, mouse
gtaggagtgatcaatacaag

SEQ ID NO: 799333 - DNA, 20 bp, mouse
gcggtgccaggcggcatctg

SEQ ID NO: 799334 - DNA, 20 bp, mouse
gcttgggcgccgccgagccc

SEQ ID NO: 799335 - DNA, 20 bp, mouse
gcagcgggtcccgggctcgg

SEQ ID NO: 799336 - DNA, 20 bp, mouse
gccactgggtcctaatgccc

SEQ ID NO: 799337 - DNA, 20 bp, mouse
gctgcggggaagaatgagct

SEQ ID NO: 799338 - DNA, 20 bp, mouse
gcattaggacccagtggaag

SEQ ID NO: 799339 - DNA, 20 bp, mouse
gagaacgagccacttccact

SEQ ID NO: 799340 - DNA, 20 bp, mouse
gtgggaactgagcataggcc

SEQ ID NO: 799341 - DNA, 20 bp, mouse
gccgaccccagcacccaatg

SEQ ID NO: 799342 - DNA, 20 bp, mouse
gacttgttcatggagaaaca

SEQ ID NO: 799343 - DNA, 20 bp, mouse
gctcagttcccagatctaca

SEQ ID NO: 799344 - DNA, 20 bp, mouse
gagtggctcgttctgacttt

SEQ ID NO: 799345 - DNA, 20 bp, mouse
gacagaacatcccgggcatt

SEQ ID NO: 799346 - DNA, 20 bp, mouse
ggccgggcacgcagtccaga

SEQ ID NO: 799347 - DNA, 20 bp, mouse
gcagatagctagcagagggg

SEQ ID NO: 799348 - DNA, 20 bp, mouse
gccacccactggctggaagg

SEQ ID NO: 799349 - DNA, 20 bp, mouse
gtggggttcggttccacccg

SEQ ID NO: 799350 - DNA, 20 bp, mouse
gccctgcgaggggagcatga

SEQ ID NO: 799351 - DNA, 20 bp, mouse
gaactgagagagcctctcca

SEQ ID NO: 799352 - DNA, 20 bp, mouse
ggcgaggggagcatgaggga

SEQ ID NO: 799353 - DNA, 20 bp, mouse
gtctgcagccgagccgcggg

SEQ ID NO: 799354 - DNA, 20 bp, mouse
gtgaagaggagaagcagctt

SEQ ID NO: 799355 - DNA, 20 bp, mouse
gagcgtctgcagccgagccg

SEQ ID NO: 799356 - DNA, 20 bp, mouse
gagggcaaacggttaaaatc

SEQ ID NO: 799357 - DNA, 20 bp, mouse
gtggttcccagattcttcat

SEQ ID NO: 799358 - DNA, 20 bp, mouse
gagtgactagtgaatgacaa

SEQ ID NO: 799359 - DNA, 20 bp, mouse
gtgaagcacgaagggagggg

SEQ ID NO: 799360 - DNA, 20 bp, mouse
gaagctaaaaggcgccttgg

SEQ ID NO: 799361 - DNA, 20 bp, mouse
gggaacgaggctgaagaacc

SEQ ID NO: 799362 - DNA, 20 bp, mouse
gcgccttggaggagaatgga

SEQ ID NO: 799363 - DNA, 20 bp, mouse
gaacagccaatgaagaatct

SEQ ID NO: 799364 - DNA, 20 bp, mouse
gcctgtgtctcttaaagttc

SEQ ID NO: 799365 - DNA, 20 bp, mouse
ggcgaagctaaaaggcgcct

SEQ ID NO: 799366 - DNA, 20 bp, mouse
gcgcctgcgcagtaaggtga

SEQ ID NO: 799367 - DNA, 20 bp, mouse
gagggggcggggactgactt

SEQ ID NO: 799368 - DNA, 20 bp, mouse
gcatcgctctccatcaaaaa

SEQ ID NO: 799369 - DNA, 20 bp, mouse
gccgactggcagaggaacac

SEQ ID NO: 799370 - DNA, 20 bp, mouse
gcaggcattcgctcctgtgg

SEQ ID NO: 799371 - DNA, 20 bp, mouse
gccttactgcgcaggcgcca

SEQ ID NO: 799372 - DNA, 20 bp, mouse
gaggctaaggctcacaccat

SEQ ID NO: 799373 - DNA, 20 bp, mouse
gcccgtgctccaatctgagc

SEQ ID NO: 799374 - DNA, 20 bp, mouse
ggagcacggggcccgcgagg

SEQ ID NO: 799375 - DNA, 20 bp, mouse
gcaccttcaccttactgcgc

SEQ ID NO: 799376 - DNA, 20 bp, mouse
gcgcacgccgcgggtctctc

SEQ ID NO: 799377 - DNA, 20 bp, mouse
gtctctgcaaggcatgtctc

SEQ ID NO: 799378 - DNA, 20 bp, mouse
gaggcccgcagtgggagaga

SEQ ID NO: 799379 - DNA, 20 bp, mouse
gccacggcgcagcccggtac

SEQ ID NO: 799380 - DNA, 20 bp, mouse
gcgcgggtctctcgggctca

SEQ ID NO: 799381 - DNA, 20 bp, mouse
gcgtgcgctgggccggtacc

SEQ ID NO: 799382 - DNA, 20 bp, mouse
gagacgcccagcctcatcat

SEQ ID NO: 799383 - DNA, 20 bp, mouse
ggtgagagacgctctctgca

SEQ ID NO: 799384 - DNA, 20 bp, mouse
gggtgggcgcgtctattctg

SEQ ID NO: 799385 - DNA, 20 bp, mouse
gaccggcccagcgcacgccg

SEQ ID NO: 799386 - DNA, 20 bp, mouse
ggggcccacacgtgaagcca

SEQ ID NO: 799387 - DNA, 20 bp, mouse
gctccccgaccggtaggagg

SEQ ID NO: 799388 - DNA, 20 bp, mouse
gggaggcggaaactggtttg

SEQ ID NO: 799389 - DNA, 20 bp, mouse
gtcaagcgagtgtctcgggg

SEQ ID NO: 799390 - DNA, 20 bp, mouse
ggtctcggggaggcggaaac

SEQ ID NO: 799391 - DNA, 20 bp, mouse
gagggccagcagagtgagcc

SEQ ID NO: 799392 - DNA, 20 bp, mouse
ggggccccgtcccagaagcg

SEQ ID NO: 799393 - DNA, 20 bp, mouse
gagcgagtgtctcggggagg

SEQ ID NO: 799394 - DNA, 20 bp, mouse
gctggccctggcttcacgtg

SEQ ID NO: 799395 - DNA, 20 bp, mouse
ggagacactcgcttgaggtg

SEQ ID NO: 799396 - DNA, 20 bp, mouse
gcacgtacgcacagggttgc

SEQ ID NO: 799397 - DNA, 20 bp, mouse
ggactggctggttgaggggt

SEQ ID NO: 799398 - DNA, 20 bp, mouse
gaaaggaagtagggatgatg

SEQ ID NO: 799399 - DNA, 20 bp, mouse
gtgggcttcagagtcagaaa

SEQ ID NO: 799400 - DNA, 20 bp, mouse
gtgaatggagggagttgtta

SEQ ID NO: 799401 - DNA, 20 bp, mouse
ggctatctcgggtgtaatgg

SEQ ID NO: 799402 - DNA, 20 bp, mouse
ggatgtgcttgctatatccc

SEQ ID NO: 799403 - DNA, 20 bp, mouse
gggtgggcgtagtgtggtat

SEQ ID NO: 799404 - DNA, 20 bp, mouse
gcaagagactggctggttga

SEQ ID NO: 799405 - DNA, 20 bp, mouse
ggaggattgaaccaagagac

SEQ ID NO: 799406 - DNA, 20 bp, mouse
ggggcactagacaaagagac

SEQ ID NO: 799407 - DNA, 20 bp, mouse
gggagctcttggatctattt

SEQ ID NO: 799408 - DNA, 20 bp, mouse
ggcaaaccagctcagagtaa

SEQ ID NO: 799409 - DNA, 20 bp, mouse
gctaccacagaaagcctcct

SEQ ID NO: 799410 - DNA, 20 bp, mouse
gctaggagatctagaagagc

SEQ ID NO: 799411 - DNA, 20 bp, mouse
gcgcccccttccccacaaag

SEQ ID NO: 799412 - DNA, 20 bp, mouse
gtcggggtatcacctgtgga

SEQ ID NO: 799413 - DNA, 20 bp, mouse
gggagatggccaaagtggtc

SEQ ID NO: 799414 - DNA, 20 bp, mouse
ggaggctttctgtggtagtc

SEQ ID NO: 799415 - DNA, 20 bp, mouse
gggtgacccctttgtgggga

SEQ ID NO: 799416 - DNA, 20 bp, mouse
gccttggagcagctcatttt

SEQ ID NO: 799417 - DNA, 20 bp, mouse
ggcaaagttcaacaggtctg

SEQ ID NO: 799418 - DNA, 20 bp, mouse
gggacacgcagacctggcaa

SEQ ID NO: 799419 - DNA, 20 bp, mouse
gagtgtgtcatggagatcac

SEQ ID NO: 799420 - DNA, 20 bp, mouse
ggctccaaggcagtgtgtca

SEQ ID NO: 799421 - DNA, 20 bp, mouse
gtcacagggacacgcagacc

SEQ ID NO: 799422 - DNA, 20 bp, mouse
gtgataggcaagcctggctc

SEQ ID NO: 799423 - DNA, 20 bp, mouse
gttgaactttgcaaaggcaa

SEQ ID NO: 799424 - DNA, 20 bp, mouse
gacaaagtcctgccgttgcc

SEQ ID NO: 799425 - DNA, 20 bp, mouse
gtctgcaggacaccggagcc

SEQ ID NO: 799426 - DNA, 20 bp, mouse
gacagggcctcgcatgtgtc

SEQ ID NO: 799427 - DNA, 20 bp, mouse
ggagctggactctgaagaag

SEQ ID NO: 799428 - DNA, 20 bp, mouse
gaaggtctggggctcaatgt

SEQ ID NO: 799429 - DNA, 20 bp, mouse
gaggccagggtggtttgacc

SEQ ID NO: 799430 - DNA, 20 bp, mouse
gcagggtggtttgacccgga

SEQ ID NO: 799431 - DNA, 20 bp, mouse
gaatgtgggagttagatgtg

SEQ ID NO: 799432 - DNA, 20 bp, mouse
gtgcctaattccagagtcat

SEQ ID NO: 799433 - DNA, 20 bp, mouse
gggactctgaagaagaggcc

SEQ ID NO: 799434 - DNA, 20 bp, mouse
ggtcatgggtgagccacagt

SEQ ID NO: 799435 - DNA, 20 bp, mouse
gtgtccccatctgaaacggt

SEQ ID NO: 799436 - DNA, 20 bp, mouse
ggggacggcaaggctgacgg

SEQ ID NO: 799437 - DNA, 20 bp, mouse
gagctggcccggggacccag

SEQ ID NO: 799438 - DNA, 20 bp, mouse
ggggtccccgggccagctct

SEQ ID NO: 799439 - DNA, 20 bp, mouse
gaggggccccgcgtgcgttc

SEQ ID NO: 799440 - DNA, 20 bp, mouse
ggggccacttgggaaagcca

SEQ ID NO: 799441 - DNA, 20 bp, mouse
gcagcccagaggatccatcg

SEQ ID NO: 799442 - DNA, 20 bp, mouse
gccaccgagaccaccctgag

SEQ ID NO: 799443 - DNA, 20 bp, mouse
ggctccgctcagggtggtct

SEQ ID NO: 799444 - DNA, 20 bp, mouse
ggagcataggcgacgtggga

SEQ ID NO: 799445 - DNA, 20 bp, mouse
gagaccgcggggaggtgccg

SEQ ID NO: 799446 - DNA, 20 bp, mouse
ggatggagccaggagtacgt

SEQ ID NO: 799447 - DNA, 20 bp, mouse
gagccaggatggagcccaag

SEQ ID NO: 799448 - DNA, 20 bp, mouse
gcccaaggggactgcaggag

SEQ ID NO: 799449 - DNA, 20 bp, mouse
ggaggttgccaaggtagggt

SEQ ID NO: 799450 - DNA, 20 bp, mouse
gaaacagaggttgccaaggt

SEQ ID NO: 799451 - DNA, 20 bp, mouse
gctcctgccccaccctacct

SEQ ID NO: 799452 - DNA, 20 bp, mouse
gagccaggagtacgtgggaa

SEQ ID NO: 799453 - DNA, 20 bp, mouse
gtcccctcctgcagtcccct

SEQ ID NO: 799454 - DNA, 20 bp, mouse
gtaagaataagggatgacct

SEQ ID NO: 799455 - DNA, 20 bp, mouse
gctcgccccattgacaatat

SEQ ID NO: 799456 - DNA, 20 bp, mouse
gtccccatggactactcgga

SEQ ID NO: 799457 - DNA, 20 bp, mouse
gcggcctgcgcatgctccat

SEQ ID NO: 799458 - DNA, 20 bp, mouse
ggggagcgctccggttatcc

SEQ ID NO: 799459 - DNA, 20 bp, mouse
gtcagtatcaggtgccggag

SEQ ID NO: 799460 - DNA, 20 bp, mouse
gcctgcgcatgctccatcgg

SEQ ID NO: 799461 - DNA, 20 bp, mouse
gcatgctccatcggcggggt

SEQ ID NO: 799462 - DNA, 20 bp, mouse
gcgcgccgcccgcggactaa

SEQ ID NO: 799463 - DNA, 20 bp, mouse
gtctccacgtacgtccccga

SEQ ID NO: 799464 - DNA, 20 bp, mouse
ggaaaatgcgagcgtctcac

SEQ ID NO: 799465 - DNA, 20 bp, mouse
gaagcggggaaagacggcgc

SEQ ID NO: 799466 - DNA, 20 bp, mouse
gtcccgggaccttgaagata

SEQ ID NO: 799467 - DNA, 20 bp, mouse
gtctcgcctgctcttaggag

SEQ ID NO: 799468 - DNA, 20 bp, mouse
gaggcgagaaacagacaccg

SEQ ID NO: 799469 - DNA, 20 bp, mouse
gagacccagcaggcgccccc

SEQ ID NO: 799470 - DNA, 20 bp, mouse
gccgccagggggcgcctgct

SEQ ID NO: 799471 - DNA, 20 bp, mouse
gggtctgggttcttagtggt

SEQ ID NO: 799472 - DNA, 20 bp, mouse
gagtagaagccagacccagc

SEQ ID NO: 799473 - DNA, 20 bp, mouse
gggcctgtttgctctgggca

SEQ ID NO: 799474 - DNA, 20 bp, mouse
gaaggtcccgggactcccag

SEQ ID NO: 799475 - DNA, 20 bp, mouse
gacgccaaagagcagctctt

SEQ ID NO: 799476 - DNA, 20 bp, mouse
gaagccccccgcgagaggag

SEQ ID NO: 799477 - DNA, 20 bp, mouse
ggggcggagcggtcgaaccc

SEQ ID NO: 799478 - DNA, 20 bp, mouse
gagcccagagagacgcggat

SEQ ID NO: 799479 - DNA, 20 bp, mouse
ggtccggccgcgcacgtcca

SEQ ID NO: 799480 - DNA, 20 bp, mouse
gcggccgcgcacgtccaggg

SEQ ID NO: 799481 - DNA, 20 bp, mouse
ggtcccgatccgcgtctctc

SEQ ID NO: 799482 - DNA, 20 bp, mouse
ggggaccgcgggcggaaggt

SEQ ID NO: 799483 - DNA, 20 bp, mouse
gagcggtcgaacccagggct

SEQ ID NO: 799484 - DNA, 20 bp, mouse
ggcgcccctcctctcgcggg

SEQ ID NO: 799485 - DNA, 20 bp, mouse
gaccccgaaaggcttgtcct

SEQ ID NO: 799486 - DNA, 20 bp, mouse
ggccccgcgcgcggtctccg

SEQ ID NO: 799487 - DNA, 20 bp, mouse
gaatccccgcagcccagtgc

SEQ ID NO: 799488 - DNA, 20 bp, mouse
ggccggggcgagcccgcact

SEQ ID NO: 799489 - DNA, 20 bp, mouse
ggcccagtgcgggctcgccc

SEQ ID NO: 799490 - DNA, 20 bp, mouse
gcggcccgcgagtgcgctcg

SEQ ID NO: 799491 - DNA, 20 bp, mouse
gcaaggcaccgggaacccga

SEQ ID NO: 799492 - DNA, 20 bp, mouse
gagccgagtcggggagagaa

SEQ ID NO: 799493 - DNA, 20 bp, mouse
gccggaaccggcctcagctg

SEQ ID NO: 799494 - DNA, 20 bp, mouse
gaaaacgccggagccaagga

SEQ ID NO: 799495 - DNA, 20 bp, mouse
gtcccccggagaccgcgcgc

SEQ ID NO: 799496 - DNA, 20 bp, mouse
gtggcgcgagcgtggagaag

SEQ ID NO: 799497 - DNA, 20 bp, mouse
gcccttaaaggcgcaggcgg

SEQ ID NO: 799498 - DNA, 20 bp, mouse
gtccccatctctctcagctg

SEQ ID NO: 799499 - DNA, 20 bp, mouse
gacctcacggacgttcccac

SEQ ID NO: 799500 - DNA, 20 bp, mouse
ggaggaggctggagtgattg

SEQ ID NO: 799501 - DNA, 20 bp, mouse
gcgctcgcgccaatgagggg

SEQ ID NO: 799502 - DNA, 20 bp, mouse
gctgcggtcacgccccttaa

SEQ ID NO: 799503 - DNA, 20 bp, mouse
gtggaccagggcttaagtcc

SEQ ID NO: 799504 - DNA, 20 bp, mouse
ggagccaggcggtgtctctc

SEQ ID NO: 799505 - DNA, 20 bp, mouse
gtcacgccccttaaaggcgc

SEQ ID NO: 799506 - DNA, 20 bp, mouse
gacagcgctcgagacacggg

SEQ ID NO: 799507 - DNA, 20 bp, mouse
ggtggggcgtggtcgtctga

SEQ ID NO: 799508 - DNA, 20 bp, mouse
ggggcgtggctaacgaggtg

SEQ ID NO: 799509 - DNA, 20 bp, mouse
ggggcggggcgtggctaacg

SEQ ID NO: 799510 - DNA, 20 bp, mouse
gtggctaacgaggtggggcg

SEQ ID NO: 799511 - DNA, 20 bp, mouse
gcccaacgccctgtcgggag

SEQ ID NO: 799512 - DNA, 20 bp, mouse
gccggcccgccccgagactg

SEQ ID NO: 799513 - DNA, 20 bp, mouse
gaggcagcgcgagactccat

SEQ ID NO: 799514 - DNA, 20 bp, mouse
ggcgtcgcccgctcccgaca

SEQ ID NO: 799515 - DNA, 20 bp, mouse
gaaggcgaggctcctcctca

SEQ ID NO: 799516 - DNA, 20 bp, mouse
gtacgcaagcccgggagttg

SEQ ID NO: 799517 - DNA, 20 bp, mouse
ggggcagaagggaagcgtag

SEQ ID NO: 799518 - DNA, 20 bp, mouse
gtactgtgggagatgatgcg

SEQ ID NO: 799519 - DNA, 20 bp, mouse
gcatctcccacagtactctg

SEQ ID NO: 799520 - DNA, 20 bp, mouse
gcaccctcgtcacatgacaa

SEQ ID NO: 799521 - DNA, 20 bp, mouse
gcgaggactaggcaagacga

SEQ ID NO: 799522 - DNA, 20 bp, mouse
gccctccaggtccgcctccg

SEQ ID NO: 799523 - DNA, 20 bp, mouse
ggatgcgcagttctggtggc

SEQ ID NO: 799524 - DNA, 20 bp, mouse
gttctcgcgagagctaaatc

SEQ ID NO: 799525 - DNA, 20 bp, mouse
ggaagggaagcgtagtggcc

SEQ ID NO: 799526 - DNA, 20 bp, mouse
gtcaggtcccgcatgccctc

SEQ ID NO: 799527 - DNA, 20 bp, mouse
gcagaagcacgttgtctggg

SEQ ID NO: 799528 - DNA, 20 bp, mouse
gtgcttctggggctgaatgg

SEQ ID NO: 799529 - DNA, 20 bp, mouse
gagcagaggtaattagcata

SEQ ID NO: 799530 - DNA, 20 bp, mouse
ggagggtggaaaaggcgcta

SEQ ID NO: 799531 - DNA, 20 bp, mouse
ggggaactatgccgcaagag

SEQ ID NO: 799532 - DNA, 20 bp, mouse
gtctgtccccgtctgcccga

SEQ ID NO: 799533 - DNA, 20 bp, mouse
gctgtctaaacaggacgctc

SEQ ID NO: 799534 - DNA, 20 bp, mouse
gacagagtgtaaatttctac

SEQ ID NO: 799535 - DNA, 20 bp, mouse
ggggcgagccctgcttaaga

SEQ ID NO: 799536 - DNA, 20 bp, mouse
gtgttggggggaagcagctt

SEQ ID NO: 799537 - DNA, 20 bp, mouse
gaattcaggcagcgttcgtg

SEQ ID NO: 799538 - DNA, 20 bp, mouse
ggtggtgcccagaacatgtg

SEQ ID NO: 799539 - DNA, 20 bp, mouse
gaagcagcttcggcttgtgt

SEQ ID NO: 799540 - DNA, 20 bp, mouse
gtgcactgcctagagataaa

SEQ ID NO: 799541 - DNA, 20 bp, mouse
gcagtggttccactctgcga

SEQ ID NO: 799542 - DNA, 20 bp, mouse
gtggacacaggagccttcct

SEQ ID NO: 799543 - DNA, 20 bp, mouse
gtacgtgctaaatctgaact

SEQ ID NO: 799544 - DNA, 20 bp, mouse
ggtggggggtctgacagcag

SEQ ID NO: 799545 - DNA, 20 bp, mouse
gactcggactaaatcaattc

SEQ ID NO: 799546 - DNA, 20 bp, mouse
gggagtcgccgagtggtggg

SEQ ID NO: 799547 - DNA, 20 bp, mouse
gcgccggcgcacagacagga

SEQ ID NO: 799548 - DNA, 20 bp, mouse
gtaagagtgccggcccaggg

SEQ ID NO: 799549 - DNA, 20 bp, mouse
gccagccagccaagaggagc

SEQ ID NO: 799550 - DNA, 20 bp, mouse
gccagtgccagccagccaag

SEQ ID NO: 799551 - DNA, 20 bp, mouse
gcggctgccaggttcctaga

SEQ ID NO: 799552 - DNA, 20 bp, mouse
ggggcgaggtcgggcacatc

SEQ ID NO: 799553 - DNA, 20 bp, mouse
gcgcattcgcctgctcctct

SEQ ID NO: 799554 - DNA, 20 bp, mouse
ggggggcggcggataccaag

SEQ ID NO: 799555 - DNA, 20 bp, mouse
ggctgcgccggcgcacagac

SEQ ID NO: 799556 - DNA, 20 bp, mouse
gcggcggcgcagcggagtca

SEQ ID NO: 799557 - DNA, 20 bp, mouse
gcagcgcaggggcgccgtag

SEQ ID NO: 799558 - DNA, 20 bp, mouse
ggggaacctgagcagacaga

SEQ ID NO: 799559 - DNA, 20 bp, mouse
gcccgggccgccggtcacgt

SEQ ID NO: 799560 - DNA, 20 bp, mouse
ggggtcgcgtcacgtgacac

SEQ ID NO: 799561 - DNA, 20 bp, mouse
gaggcgaaggcgtcccagga

SEQ ID NO: 799562 - DNA, 20 bp, mouse
gtctgctcaggttcccgctc

SEQ ID NO: 799563 - DNA, 20 bp, mouse
ggacccgcccacgtgaccgg

SEQ ID NO: 799564 - DNA, 20 bp, mouse
ggggccgccggtcacgtggg

SEQ ID NO: 799565 - DNA, 20 bp, mouse
gcgccgtagtggctcccgcg

SEQ ID NO: 799566 - DNA, 20 bp, mouse
gatggaggctacgatgtttg

SEQ ID NO: 799567 - DNA, 20 bp, mouse
ggaggtggttactgggacta

SEQ ID NO: 799568 - DNA, 20 bp, mouse
gagagagttcaagggagcga

SEQ ID NO: 799569 - DNA, 20 bp, mouse
gggggcactaagctagaaag

SEQ ID NO: 799570 - DNA, 20 bp, mouse
gaaagtagagaggtggttac

SEQ ID NO: 799571 - DNA, 20 bp, mouse
gtagggagaagggagcctgt

SEQ ID NO: 799572 - DNA, 20 bp, mouse
gaggccagggtcgccgatcc

SEQ ID NO: 799573 - DNA, 20 bp, mouse
ggggtcacaggatccacaaa

SEQ ID NO: 799574 - DNA, 20 bp, mouse
ggcaaagatcaagcaagagg

SEQ ID NO: 799575 - DNA, 20 bp, mouse
gagaaagcggggtccagcac

SEQ ID NO: 799576 - DNA, 20 bp, mouse
gccaccgcgggaagtgcgag

SEQ ID NO: 799577 - DNA, 20 bp, mouse
gggcccctggcggccaccgc

SEQ ID NO: 799578 - DNA, 20 bp, mouse
gcagccgctcgcacttcccg

SEQ ID NO: 799579 - DNA, 20 bp, mouse
ggccgcgaccctggccagaa

SEQ ID NO: 799580 - DNA, 20 bp, mouse
gtaggaaaatctggtgcgtg

SEQ ID NO: 799581 - DNA, 20 bp, mouse
ggagtggacaaataaccaac

SEQ ID NO: 799582 - DNA, 20 bp, mouse
gtgtccactcatcccacttt

SEQ ID NO: 799583 - DNA, 20 bp, mouse
gagagccgggcggcccctgg

SEQ ID NO: 799584 - DNA, 20 bp, mouse
ggtctgcacggaacaaaaca

SEQ ID NO: 799585 - DNA, 20 bp, mouse
ggtacacagcattctgtact

SEQ ID NO: 799586 - DNA, 20 bp, mouse
gacgcccggcgccacgccgc

SEQ ID NO: 799587 - DNA, 20 bp, mouse
gcaggccgcgctgcgtgcaa

SEQ ID NO: 799588 - DNA, 20 bp, mouse
gggcgtgcggagcgcgcaag

SEQ ID NO: 799589 - DNA, 20 bp, mouse
gccacgccgcaggccccgct

SEQ ID NO: 799590 - DNA, 20 bp, mouse
ggggtcctccggccggtagg

SEQ ID NO: 799591 - DNA, 20 bp, mouse
ggcaagcggcggggcccagc

SEQ ID NO: 799592 - DNA, 20 bp, mouse
ggtgcggagcgcgcaagcgg

SEQ ID NO: 799593 - DNA, 20 bp, mouse
gcgtctagacaggtcacctg

SEQ ID NO: 799594 - DNA, 20 bp, mouse
gccgggacgcaggctcgggt

SEQ ID NO: 799595 - DNA, 20 bp, mouse
gagcctgcgtcccggacgcc

SEQ ID NO: 799596 - DNA, 20 bp, mouse
gcaaccgcgtccactgctgt

SEQ ID NO: 799597 - DNA, 20 bp, mouse
gctgaccggcacacatgcgc

SEQ ID NO: 799598 - DNA, 20 bp, mouse
gccactggggcgcgcctgac

SEQ ID NO: 799599 - DNA, 20 bp, mouse
gtaacccggcgcatgtgtgc

SEQ ID NO: 799600 - DNA, 20 bp, mouse
gagcggtgacgtcaccactg

SEQ ID NO: 799601 - DNA, 20 bp, mouse
ggatactcttgacgatccga

SEQ ID NO: 799602 - DNA, 20 bp, mouse
gacgatccgagggaaacggc

SEQ ID NO: 799603 - DNA, 20 bp, mouse
gtgcctggtggcaggtaacc

SEQ ID NO: 799604 - DNA, 20 bp, mouse
gagcctgggccaatcagtga

SEQ ID NO: 799605 - DNA, 20 bp, mouse
ggagacttcagcctactgcc

SEQ ID NO: 799606 - DNA, 20 bp, mouse
gcacgtgtcccgggcttcct

SEQ ID NO: 799607 - DNA, 20 bp, mouse
gtgtccgagtggctgaatcc

SEQ ID NO: 799608 - DNA, 20 bp, mouse
gcgtctcagagagaatgctt

SEQ ID NO: 799609 - DNA, 20 bp, mouse
gtctgctcccgcaggacttg

SEQ ID NO: 799610 - DNA, 20 bp, mouse
gcaaggggaggggcgcccgg

SEQ ID NO: 799611 - DNA, 20 bp, mouse
gcgacggcgtaggtgacgtc

SEQ ID NO: 799612 - DNA, 20 bp, mouse
ggcgcgcggcagtgacgcga

SEQ ID NO: 799613 - DNA, 20 bp, mouse
gaggcagctagccctgcggg

SEQ ID NO: 799614 - DNA, 20 bp, mouse
gctgccgcgcgccacgggtc

SEQ ID NO: 799615 - DNA, 20 bp, mouse
gggcagtgacgcgacggcgt

SEQ ID NO: 799616 - DNA, 20 bp, mouse
gagggctggcagcgatgccg

SEQ ID NO: 799617 - DNA, 20 bp, mouse
gtccccttcgcccgcaatca

SEQ ID NO: 799618 - DNA, 20 bp, mouse
ggctaatggtagtaagtctt

SEQ ID NO: 799619 - DNA, 20 bp, mouse
gtcgctgccagccctgattg

SEQ ID NO: 799620 - DNA, 20 bp, mouse
gcgcccgccagacgacgcag

SEQ ID NO: 799621 - DNA, 20 bp, mouse
ggggaggggccgctcctcac

SEQ ID NO: 799622 - DNA, 20 bp, mouse
gcggccaccagagtcaggaa

SEQ ID NO: 799623 - DNA, 20 bp, mouse
gggaccgctgcgtcgtctgg

SEQ ID NO: 799624 - DNA, 20 bp, mouse
gagccctgattgcgggcgaa

SEQ ID NO: 799625 - DNA, 20 bp, mouse
gagcagcggccaccagagtc

SEQ ID NO: 799626 - DNA, 20 bp, mouse
gggtctgcgctgtagctggg

SEQ ID NO: 799627 - DNA, 20 bp, mouse
gcaacacccagatccctcgt

SEQ ID NO: 799628 - DNA, 20 bp, mouse
gcagctacagcgcagaccaa

SEQ ID NO: 799629 - DNA, 20 bp, mouse
gaccaatggcgacgcagaga

SEQ ID NO: 799630 - DNA, 20 bp, mouse
gggccggtagtgaaagaggg

SEQ ID NO: 799631 - DNA, 20 bp, mouse
gtagtgctgcggggaaaccc

SEQ ID NO: 799632 - DNA, 20 bp, mouse
ggggccgccccagccagggg

SEQ ID NO: 799633 - DNA, 20 bp, mouse
ggggccccagcaacagcgcg

SEQ ID NO: 799634 - DNA, 20 bp, mouse
gcactaccattggcccacga

SEQ ID NO: 799635 - DNA, 20 bp, mouse
ggtagtgtgcctcggaggcc

SEQ ID NO: 799636 - DNA, 20 bp, mouse
ggcaacgagatagcggggag

SEQ ID NO: 799637 - DNA, 20 bp, mouse
ggccacgtcgccagccaggg

SEQ ID NO: 799638 - DNA, 20 bp, mouse
gcgcgcccctcgctggggag

SEQ ID NO: 799639 - DNA, 20 bp, mouse
gacgtcgccagccagggtgg

SEQ ID NO: 799640 - DNA, 20 bp, mouse
gccgggctccggtttcgctt

SEQ ID NO: 799641 - DNA, 20 bp, mouse
gaggggcgggtccagatgat

SEQ ID NO: 799642 - DNA, 20 bp, mouse
gctcacgcgcccattggcca

SEQ ID NO: 799643 - DNA, 20 bp, mouse
ggccaatgggcgcgtgagtg

SEQ ID NO: 799644 - DNA, 20 bp, mouse
gccctcgcaacgagatagcg

SEQ ID NO: 799645 - DNA, 20 bp, mouse
gaatgggcgcgtgagtgggg

SEQ ID NO: 799646 - DNA, 20 bp, mouse
gaaggtgaaggggcccgcag

SEQ ID NO: 799647 - DNA, 20 bp, mouse
ggtacggcggcaaaggtgaa

SEQ ID NO: 799648 - DNA, 20 bp, mouse
ggcaaagtgctgtggaattg

SEQ ID NO: 799649 - DNA, 20 bp, mouse
gcccgcggccatataaggca

SEQ ID NO: 799650 - DNA, 20 bp, mouse
ggtcccgtggccccagcagc

SEQ ID NO: 799651 - DNA, 20 bp, mouse
gctcaagggtacggcggcaa

SEQ ID NO: 799652 - DNA, 20 bp, mouse
gtggggccacgggacccctg

SEQ ID NO: 799653 - DNA, 20 bp, mouse
gatgcagcgccgcccctctg

SEQ ID NO: 799654 - DNA, 20 bp, mouse
ggagccagctgctggggcca

SEQ ID NO: 799655 - DNA, 20 bp, mouse
gctcgcctgcagattctagt

SEQ ID NO: 799656 - DNA, 20 bp, mouse
gtccagacccgaaggcgtgg

SEQ ID NO: 799657 - DNA, 20 bp, mouse
ggaaggcgtggtgggcgata

SEQ ID NO: 799658 - DNA, 20 bp, mouse
gcgggtaacagaggtgtggt

SEQ ID NO: 799659 - DNA, 20 bp, mouse
ggtggcaagggggtcgtcat

SEQ ID NO: 799660 - DNA, 20 bp, mouse
gaactcaggccgggtaacag

SEQ ID NO: 799661 - DNA, 20 bp, mouse
gctggccccaggggattaag

SEQ ID NO: 799662 - DNA, 20 bp, mouse
gtggaggtggtcgtgcaagt

SEQ ID NO: 799663 - DNA, 20 bp, mouse
gctgctctgagactcctctg

SEQ ID NO: 799664 - DNA, 20 bp, mouse
gcccaccacgccttcgggtc

SEQ ID NO: 799665 - DNA, 20 bp, mouse
gctggggccagagactctgg

SEQ ID NO: 799666 - DNA, 20 bp, mouse
gggctctcacgggatccggg

SEQ ID NO: 799667 - DNA, 20 bp, mouse
gcggcaagcaggggcatggt

SEQ ID NO: 799668 - DNA, 20 bp, mouse
ggggcgggatcacgggaagg

SEQ ID NO: 799669 - DNA, 20 bp, mouse
gcgcccctgcgagcttccat

SEQ ID NO: 799670 - DNA, 20 bp, mouse
gagagccaatggaagctcgc

SEQ ID NO: 799671 - DNA, 20 bp, mouse
gcgggcggcaagcaggggca

SEQ ID NO: 799672 - DNA, 20 bp, mouse
gagcttgcgagcgacgggtt

SEQ ID NO: 799673 - DNA, 20 bp, mouse
gcgggatcacgggaaggagg

SEQ ID NO: 799674 - DNA, 20 bp, mouse
ggggcggagcttgcgagcga

SEQ ID NO: 799675 - DNA, 20 bp, mouse
gcggatcccgtgagagccaa

SEQ ID NO: 799676 - DNA, 20 bp, mouse
gacaccaagggtgctccctg

SEQ ID NO: 799677 - DNA, 20 bp, mouse
gggccggggctagacctcca

SEQ ID NO: 799678 - DNA, 20 bp, mouse
gggtggggtcaggaccggaa

SEQ ID NO: 799679 - DNA, 20 bp, mouse
gtgaacatctggccctgggg

SEQ ID NO: 799680 - DNA, 20 bp, mouse
gcactggggtctacccaaaa

SEQ ID NO: 799681 - DNA, 20 bp, mouse
gacctccagggggtggggtc

SEQ ID NO: 799682 - DNA, 20 bp, mouse
ggaaccggtgtgcttgtggg

SEQ ID NO: 799683 - DNA, 20 bp, mouse
gcctccgccagctgaacatc

SEQ ID NO: 799684 - DNA, 20 bp, mouse
gggcgcacgtacccccccca

SEQ ID NO: 799685 - DNA, 20 bp, mouse
gccagctgaacatctggccc

SEQ ID NO: 799686 - DNA, 20 bp, mouse
ggcggggcggagagaccaga

SEQ ID NO: 799687 - DNA, 20 bp, mouse
gcgcggccggaacctcccta

SEQ ID NO: 799688 - DNA, 20 bp, mouse
ggccccggaggcggcatgga

SEQ ID NO: 799689 - DNA, 20 bp, mouse
gccctcgagcgcccgggaac

SEQ ID NO: 799690 - DNA, 20 bp, mouse
gggccggaacctccctaggg

SEQ ID NO: 799691 - DNA, 20 bp, mouse
ggaggagcgcgcggccacga

SEQ ID NO: 799692 - DNA, 20 bp, mouse
gcgagcgcccgggaaccggc

SEQ ID NO: 799693 - DNA, 20 bp, mouse
ggatgtggaggccccggagg

SEQ ID NO: 799694 - DNA, 20 bp, mouse
gcccgggaaccggccggctg

SEQ ID NO: 799695 - DNA, 20 bp, mouse
ggtggccgcgcgctcctcac

SEQ ID NO: 799696 - DNA, 20 bp, mouse
ggcgctgcccagcccatgtt

SEQ ID NO: 799697 - DNA, 20 bp, mouse
gaatggagtcgtggcggctc

SEQ ID NO: 799698 - DNA, 20 bp, mouse
ggggcagattaatggagtcg

SEQ ID NO: 799699 - DNA, 20 bp, mouse
gccgagggacgcaggaggag

SEQ ID NO: 799700 - DNA, 20 bp, mouse
gcagattaatggagtcgtgg

SEQ ID NO: 799701 - DNA, 20 bp, mouse
ggaaaaaagtgcaaagccca

SEQ ID NO: 799702 - DNA, 20 bp, mouse
gaaaagagggagagttgagg

SEQ ID NO: 799703 - DNA, 20 bp, mouse
gaatctgcccaaacatgggc

SEQ ID NO: 799704 - DNA, 20 bp, mouse
ggctaaaagagggagagttg

SEQ ID NO: 799705 - DNA, 20 bp, mouse
ggggctcttgagtcctgcct

SEQ ID NO: 799706 - DNA, 20 bp, mouse
gaagcagtgtggctcttcgg

SEQ ID NO: 799707 - DNA, 20 bp, mouse
gggtctgcccagtccttgga

SEQ ID NO: 799708 - DNA, 20 bp, mouse
gcagtgtaggttaagtggta

SEQ ID NO: 799709 - DNA, 20 bp, mouse
ggccgaggatgcttggttca

SEQ ID NO: 799710 - DNA, 20 bp, mouse
gccatctgaggggcacccat

SEQ ID NO: 799711 - DNA, 20 bp, mouse
gctgcactataaggtcccat

SEQ ID NO: 799712 - DNA, 20 bp, mouse
gcccaggtgctgatggatta

SEQ ID NO: 799713 - DNA, 20 bp, mouse
gtaggcccaaatgtgactgg

SEQ ID NO: 799714 - DNA, 20 bp, mouse
gaaaaactcccatgcagtgt

SEQ ID NO: 799715 - DNA, 20 bp, mouse
gcccttgaaccaagcatcct

SEQ ID NO: 799716 - DNA, 20 bp, mouse
gagagagtggtgttcccaga

SEQ ID NO: 799717 - DNA, 20 bp, mouse
gaaggtagagacaagttcat

SEQ ID NO: 799718 - DNA, 20 bp, mouse
gtgacccgacacagagagag

SEQ ID NO: 799719 - DNA, 20 bp, mouse
ggatggtactgagagagtaa

SEQ ID NO: 799720 - DNA, 20 bp, mouse
gaccaggcagctagaaacat

SEQ ID NO: 799721 - DNA, 20 bp, mouse
gaagcagtattagctggtga

SEQ ID NO: 799722 - DNA, 20 bp, mouse
gggcctgaagcagtattagc

SEQ ID NO: 799723 - DNA, 20 bp, mouse
gcaggccaagaggcttaggt

SEQ ID NO: 799724 - DNA, 20 bp, mouse
gagaaacatcggccaatagc

SEQ ID NO: 799725 - DNA, 20 bp, mouse
gttagtagcatcaaaccaga

SEQ ID NO: 799726 - DNA, 20 bp, mouse
gcctgggccttgacggatgt

SEQ ID NO: 799727 - DNA, 20 bp, mouse
gcatggccccatctgagcat

SEQ ID NO: 799728 - DNA, 20 bp, mouse
gtcatggcccacatccgtca

SEQ ID NO: 799729 - DNA, 20 bp, mouse
gatgtgggccatgagtcatt

SEQ ID NO: 799730 - DNA, 20 bp, mouse
ggaaactaatgccataagag

SEQ ID NO: 799731 - DNA, 20 bp, mouse
gcaaatgtagccttggactc

SEQ ID NO: 799732 - DNA, 20 bp, mouse
gacgatctcacacacttaag

SEQ ID NO: 799733 - DNA, 20 bp, mouse
gttaagtaggaggtgcccag

SEQ ID NO: 799734 - DNA, 20 bp, mouse
ggttctacctatgctcagat

SEQ ID NO: 799735 - DNA, 20 bp, mouse
ggtctaagcctaatgactca

SEQ ID NO: 799736 - DNA, 20 bp, mouse
ggcgaagagtggcacgacga

SEQ ID NO: 799737 - DNA, 20 bp, mouse
gggccgcggtcgtggaagag

SEQ ID NO: 799738 - DNA, 20 bp, mouse
gggagggccgagctgaggga

SEQ ID NO: 799739 - DNA, 20 bp, mouse
gggcggggagggccgagctg

SEQ ID NO: 799740 - DNA, 20 bp, mouse
gaagagtggcacgacgaggg

SEQ ID NO: 799741 - DNA, 20 bp, mouse
ggggaagagtgatgacccga

SEQ ID NO: 799742 - DNA, 20 bp, mouse
ggggcgggagccttcggccg

SEQ ID NO: 799743 - DNA, 20 bp, mouse
gatgacccgaaggtccgagg

SEQ ID NO: 799744 - DNA, 20 bp, mouse
gcggctcacgccccctgctg

SEQ ID NO: 799745 - DNA, 20 bp, mouse
ggggcgtgagccgcgaagag

SEQ ID NO: 799746 - DNA, 20 bp, mouse
ggtggagcaatggtcttcag

SEQ ID NO: 799747 - DNA, 20 bp, mouse
ggctggctcaacgatcccac

SEQ ID NO: 799748 - DNA, 20 bp, mouse
ggtccagggcctaggcctgt

SEQ ID NO: 799749 - DNA, 20 bp, mouse
gggcggttgcagttgaaccg

SEQ ID NO: 799750 - DNA, 20 bp, mouse
ggactctttggaagtctcgc

SEQ ID NO: 799751 - DNA, 20 bp, mouse
gtgaaccaaacactggactt

SEQ ID NO: 799752 - DNA, 20 bp, mouse
gtggccactaattgactctt

SEQ ID NO: 799753 - DNA, 20 bp, mouse
gccaggcggccgccaaatcc

SEQ ID NO: 799754 - DNA, 20 bp, mouse
gagggcaaaggtcatctctg

SEQ ID NO: 799755 - DNA, 20 bp, mouse
gagaggagtggtagaagggc

SEQ ID NO: 799756 - DNA, 20 bp, mouse
ggggagttgtagtcctagag

SEQ ID NO: 799757 - DNA, 20 bp, mouse
gggggcttaaggaaagatta

SEQ ID NO: 799758 - DNA, 20 bp, mouse
gttagggcttcaccttatat

SEQ ID NO: 799759 - DNA, 20 bp, mouse
gtgaaaatagcgtgttgagg

SEQ ID NO: 799760 - DNA, 20 bp, mouse
gagcaggcttcaaaaaagcc

SEQ ID NO: 799761 - DNA, 20 bp, mouse
ggtaagaaggatggctaagt

SEQ ID NO: 799762 - DNA, 20 bp, mouse
gtatattggcagtgagaatt

SEQ ID NO: 799763 - DNA, 20 bp, mouse
gaagacgttgtcactatgcc

SEQ ID NO: 799764 - DNA, 20 bp, mouse
ggttgtagtcctagaggggt

SEQ ID NO: 799765 - DNA, 20 bp, mouse
ggtcttataatcaacgtatt

SEQ ID NO: 799766 - DNA, 20 bp, mouse
gcaagggcgtcctgaagttc

SEQ ID NO: 799767 - DNA, 20 bp, mouse
ggaatgcggccgaggttgac

SEQ ID NO: 799768 - DNA, 20 bp, mouse
gtggagatggaatgcggccg

SEQ ID NO: 799769 - DNA, 20 bp, mouse
gtatggggagtgaccagatg

SEQ ID NO: 799770 - DNA, 20 bp, mouse
gcttcaggacgcccttggat

SEQ ID NO: 799771 - DNA, 20 bp, mouse
gtcacactcaaccaatccaa

SEQ ID NO: 799772 - DNA, 20 bp, mouse
gccaccagaacccggctatg

SEQ ID NO: 799773 - DNA, 20 bp, mouse
gagtttctggagatggaatg

SEQ ID NO: 799774 - DNA, 20 bp, mouse
gcagaagaatactatctggg

SEQ ID NO: 799775 - DNA, 20 bp, mouse
gccatggcgcacttaatgct

SEQ ID NO: 799776 - DNA, 20 bp, mouse
ggggcgccgcctgctgtcct

SEQ ID NO: 799777 - DNA, 20 bp, mouse
gactgcgcgcggggctttct

SEQ ID NO: 799778 - DNA, 20 bp, mouse
gctacacgcgaaggactctg

SEQ ID NO: 799779 - DNA, 20 bp, mouse
gcctagaaaaggtatattca

SEQ ID NO: 799780 - DNA, 20 bp, mouse
gacttgtagttttgctccta

SEQ ID NO: 799781 - DNA, 20 bp, mouse
ggctaagtcaagtcagcctt

SEQ ID NO: 799782 - DNA, 20 bp, mouse
gctgacttgacttagcgttc

SEQ ID NO: 799783 - DNA, 20 bp, mouse
gaagtggacagtgttagaat

SEQ ID NO: 799784 - DNA, 20 bp, mouse
gagaaaaggtatattcaggg

SEQ ID NO: 799785 - DNA, 20 bp, mouse
ggtacacatgaaagccccag

SEQ ID NO: 799786 - DNA, 20 bp, mouse
gcgtgactctggactttaac

SEQ ID NO: 799787 - DNA, 20 bp, mouse
gtgagtctgggactggattg

SEQ ID NO: 799788 - DNA, 20 bp, mouse
gcagaggcctgtacgtcagc

SEQ ID NO: 799789 - DNA, 20 bp, mouse
gctccaccctgctgacgtac

SEQ ID NO: 799790 - DNA, 20 bp, mouse
gccgtgttgttgaatatcag

SEQ ID NO: 799791 - DNA, 20 bp, mouse
ggcaagttatggaacataga

SEQ ID NO: 799792 - DNA, 20 bp, mouse
gtctggactttaacaggctt

SEQ ID NO: 799793 - DNA, 20 bp, mouse
gttttgctgcgccgtgactc

SEQ ID NO: 799794 - DNA, 20 bp, mouse
gtgtattctgacctgattcc

SEQ ID NO: 799795 - DNA, 20 bp, mouse
gaggtcaatttatcatgttt

SEQ ID NO: 799796 - DNA, 20 bp, mouse
gtgacatagggagagccagt

SEQ ID NO: 799797 - DNA, 20 bp, mouse
gtctggggccacaatctagg

SEQ ID NO: 799798 - DNA, 20 bp, mouse
gactgactgttgaataacat

SEQ ID NO: 799799 - DNA, 20 bp, mouse
ggagccatcccaaacatgga

SEQ ID NO: 799800 - DNA, 20 bp, mouse
gtgccattacatatgactca

SEQ ID NO: 799801 - DNA, 20 bp, mouse
gacatcaggactcccagagt

SEQ ID NO: 799802 - DNA, 20 bp, mouse
gaaaggtacactaggtgata

SEQ ID NO: 799803 - DNA, 20 bp, mouse
gaggactcccagagtaggta

SEQ ID NO: 799804 - DNA, 20 bp, mouse
gcgctctggggccacaatct

SEQ ID NO: 799805 - DNA, 20 bp, mouse
gcccagagtaggtatggaga

SEQ ID NO: 799806 - DNA, 20 bp, mouse
gtaggaggtgggaactaaga

SEQ ID NO: 799807 - DNA, 20 bp, mouse
gtaggagacaatggcataga

SEQ ID NO: 799808 - DNA, 20 bp, mouse
ggacaatggcatagatggtc

SEQ ID NO: 799809 - DNA, 20 bp, mouse
gtatgccattgtctcctagg

SEQ ID NO: 799810 - DNA, 20 bp, mouse
gaggctggagattaattctt

SEQ ID NO: 799811 - DNA, 20 bp, mouse
gggacactttagggctgaga

SEQ ID NO: 799812 - DNA, 20 bp, mouse
gaaaaaaagcgacagatcca

SEQ ID NO: 799813 - DNA, 20 bp, mouse
gtggcagctgcccctctctg

SEQ ID NO: 799814 - DNA, 20 bp, mouse
gtgaagttaggttttggcag

SEQ ID NO: 799815 - DNA, 20 bp, mouse
gccattgtctcctaggaggt

SEQ ID NO: 799816 - DNA, 20 bp, mouse
gggccccatggtccagtcca

SEQ ID NO: 799817 - DNA, 20 bp, mouse
gtcaggggggaatacatatt

SEQ ID NO: 799818 - DNA, 20 bp, mouse
gccaacctgcacttggactg

SEQ ID NO: 799819 - DNA, 20 bp, mouse
ggagccttggactggaccat

SEQ ID NO: 799820 - DNA, 20 bp, mouse
gcacaagatgagccttggac

SEQ ID NO: 799821 - DNA, 20 bp, mouse
gagagacacaagatgagcct

SEQ ID NO: 799822 - DNA, 20 bp, mouse
gcctctccacatcaactctg

SEQ ID NO: 799823 - DNA, 20 bp, mouse
gcctgggcagctactatatt

SEQ ID NO: 799824 - DNA, 20 bp, mouse
gccagtggaagcattttctc

SEQ ID NO: 799825 - DNA, 20 bp, mouse
gaacaagaaaggcctgttta

SEQ ID NO: 799826 - DNA, 20 bp, mouse
gcccagggaggacttggctg

SEQ ID NO: 799827 - DNA, 20 bp, mouse
ggggcatcctggctctgcaa

SEQ ID NO: 799828 - DNA, 20 bp, mouse
gggctctgcaagggatcagg

SEQ ID NO: 799829 - DNA, 20 bp, mouse
ggcaagggatcaggtggctg

SEQ ID NO: 799830 - DNA, 20 bp, mouse
ggtagactgttcacttctgc

SEQ ID NO: 799831 - DNA, 20 bp, mouse
gtgaagcagtaggcccagtg

SEQ ID NO: 799832 - DNA, 20 bp, mouse
gggcctgtacattccatctc

SEQ ID NO: 799833 - DNA, 20 bp, mouse
gagagatgagctgaagcagt

SEQ ID NO: 799834 - DNA, 20 bp, mouse
gttatgctcctaaacttggt

SEQ ID NO: 799835 - DNA, 20 bp, mouse
gaaacttggttggctctaag

SEQ ID NO: 799836 - DNA, 20 bp, mouse
ggtaacctatgcttggactc

SEQ ID NO: 799837 - DNA, 20 bp, mouse
gaagtctggaactggaccat

SEQ ID NO: 799838 - DNA, 20 bp, mouse
gtggactcaggacaacttac

SEQ ID NO: 799839 - DNA, 20 bp, mouse
gttggcagtgagatagggag

SEQ ID NO: 799840 - DNA, 20 bp, mouse
gttgtcctgagtccaagcat

SEQ ID NO: 799841 - DNA, 20 bp, mouse
gaagttgcaaagtctggaac

SEQ ID NO: 799842 - DNA, 20 bp, mouse
gaaaggaacactaggtggtg

SEQ ID NO: 799843 - DNA, 20 bp, mouse
ggactcccagagtagatatg

SEQ ID NO: 799844 - DNA, 20 bp, mouse
gaacactaggtggtggggct

SEQ ID NO: 799845 - DNA, 20 bp, mouse
ggaagggccagccccaaaca

SEQ ID NO: 799846 - DNA, 20 bp, mouse
gcctgggccttgacggatgt

SEQ ID NO: 799847 - DNA, 20 bp, mouse
gcatggccccatctgagcat

SEQ ID NO: 799848 - DNA, 20 bp, mouse
gatgtgggccatgagtcatt

SEQ ID NO: 799849 - DNA, 20 bp, mouse
gtcatggcccacatccgtca

SEQ ID NO: 799850 - DNA, 20 bp, mouse
gacgatctcacacacttaag

SEQ ID NO: 799851 - DNA, 20 bp, mouse
gttaagtaggaggtgcccag

SEQ ID NO: 799852 - DNA, 20 bp, mouse
ggaaactaatgccataagag

SEQ ID NO: 799853 - DNA, 20 bp, mouse
gcaaatgtagccttggactc

SEQ ID NO: 799854 - DNA, 20 bp, mouse
gagagaggtgttttttaagt

SEQ ID NO: 799855 - DNA, 20 bp, mouse
ggtctaagcctaatgactca

SEQ ID NO: 799856 - DNA, 20 bp, mouse
ggaggggaacagagtcacga

SEQ ID NO: 799857 - DNA, 20 bp, mouse
gctggtggggagttatttgg

SEQ ID NO: 799858 - DNA, 20 bp, mouse
gtgtagcactggagctaatg

SEQ ID NO: 799859 - DNA, 20 bp, mouse
gcgcgccgaaagctcgaacc

SEQ ID NO: 799860 - DNA, 20 bp, mouse
gcccctctggggagtaaagt

SEQ ID NO: 799861 - DNA, 20 bp, mouse
ggcgctgtagagcgcaaccg

SEQ ID NO: 799862 - DNA, 20 bp, mouse
gagctggttgcttgatccta

SEQ ID NO: 799863 - DNA, 20 bp, mouse
ggagaccgcaaggaacacgt

SEQ ID NO: 799864 - DNA, 20 bp, mouse
gcactggagctaatgtgggg

SEQ ID NO: 799865 - DNA, 20 bp, mouse
ggaaaggccccttttcctca

SEQ ID NO: 799866 - DNA, 20 bp, mouse
ggccccgggcggaatcgagt

SEQ ID NO: 799867 - DNA, 20 bp, mouse
ggggaacagctccacctcgg

SEQ ID NO: 799868 - DNA, 20 bp, mouse
gcagtggcggggcgaggccg

SEQ ID NO: 799869 - DNA, 20 bp, mouse
ggccgcccggcgcctcctcg

SEQ ID NO: 799870 - DNA, 20 bp, mouse
gtccccccaacccccggctg

SEQ ID NO: 799871 - DNA, 20 bp, mouse
ggtgccagggaactcacgga

SEQ ID NO: 799872 - DNA, 20 bp, mouse
gtcactgcgggcttcggact

SEQ ID NO: 799873 - DNA, 20 bp, mouse
gcggccgggagacacgctcg

SEQ ID NO: 799874 - DNA, 20 bp, mouse
ggctccgcttcgttcactgc

SEQ ID NO: 799875 - DNA, 20 bp, mouse
gaggcccactcgattccgcc

SEQ ID NO: 799876 - DNA, 20 bp, mouse
gatcaggtgcacactctcca

SEQ ID NO: 799877 - DNA, 20 bp, mouse
gtctccaagagcctatggcc

SEQ ID NO: 799878 - DNA, 20 bp, mouse
gttctggcgcggcttctcat

SEQ ID NO: 799879 - DNA, 20 bp, mouse
gggagccggggtcatgtgaa

SEQ ID NO: 799880 - DNA, 20 bp, mouse
gcgctcagaattctcgtgat

SEQ ID NO: 799881 - DNA, 20 bp, mouse
gcagaattctcgtgattggc

SEQ ID NO: 799882 - DNA, 20 bp, mouse
ggcttctcattggctgtcgg

SEQ ID NO: 799883 - DNA, 20 bp, mouse
gccaatggcctctcgttctc

SEQ ID NO: 799884 - DNA, 20 bp, mouse
gactattctccaagagccta

SEQ ID NO: 799885 - DNA, 20 bp, mouse
gagtaacaaggacttcgcca

SEQ ID NO: 799886 - DNA, 20 bp, mouse
gccgtgtcggggcacatagg

SEQ ID NO: 799887 - DNA, 20 bp, mouse
gcccgggagcccgagtccga

SEQ ID NO: 799888 - DNA, 20 bp, mouse
gggacagaggcattccacag

SEQ ID NO: 799889 - DNA, 20 bp, mouse
gtcttcaaacgggaagtcag

SEQ ID NO: 799890 - DNA, 20 bp, mouse
gcgcgctgccgccccccggg

SEQ ID NO: 799891 - DNA, 20 bp, mouse
gcgggctgcggtcttcaaac

SEQ ID NO: 799892 - DNA, 20 bp, mouse
gggcagcgcgccctggaccc

SEQ ID NO: 799893 - DNA, 20 bp, mouse
gaagtcaaagctgaactgta

SEQ ID NO: 799894 - DNA, 20 bp, mouse
gggggcggggcctggtgcca

SEQ ID NO: 799895 - DNA, 20 bp, mouse
gctggtgccaggggttgcta

SEQ ID NO: 799896 - DNA, 20 bp, mouse
gccgcaaggccgcgctccat

SEQ ID NO: 799897 - DNA, 20 bp, mouse
gcccgagccgccacgtcttc

SEQ ID NO: 799898 - DNA, 20 bp, mouse
ggggcccacgctgcgaagcc

SEQ ID NO: 799899 - DNA, 20 bp, mouse
gcgtcgccgaggctcttctc

SEQ ID NO: 799900 - DNA, 20 bp, mouse
gctggtccggagaagagcct

SEQ ID NO: 799901 - DNA, 20 bp, mouse
ggtggcggctcgggcccggg

SEQ ID NO: 799902 - DNA, 20 bp, mouse
gcacgctgcgaagcctggtc

SEQ ID NO: 799903 - DNA, 20 bp, mouse
gggagcgcggccttgcggcc

SEQ ID NO: 799904 - DNA, 20 bp, mouse
gtcattgcggggcggagcag

SEQ ID NO: 799905 - DNA, 20 bp, mouse
ggccaccatgatctccctca

SEQ ID NO: 799906 - DNA, 20 bp, mouse
ggaggcttgctgggcgagga

SEQ ID NO: 799907 - DNA, 20 bp, mouse
ggagctgggcgaggcttgct

SEQ ID NO: 799908 - DNA, 20 bp, mouse
gcggggaggcggatgagcgg

SEQ ID NO: 799909 - DNA, 20 bp, mouse
gcaagtgccctgaccactaa

SEQ ID NO: 799910 - DNA, 20 bp, mouse
gcaggccttggtagtcgggg

SEQ ID NO: 799911 - DNA, 20 bp, mouse
gtccgcctccccgactacca

SEQ ID NO: 799912 - DNA, 20 bp, mouse
ggggatgggccgcaagcgaa

SEQ ID NO: 799913 - DNA, 20 bp, mouse
ggctctgagccccccgggga

SEQ ID NO: 799914 - DNA, 20 bp, mouse
gcggccgctctcattggcta

SEQ ID NO: 799915 - DNA, 20 bp, mouse
gggttgcaggccttggtagt

SEQ ID NO: 799916 - DNA, 20 bp, mouse
gcgctgtgggagtaagatgg

SEQ ID NO: 799917 - DNA, 20 bp, mouse
gccacagcgcggtgtggctc

SEQ ID NO: 799918 - DNA, 20 bp, mouse
gccgcgctgtgggagtaaga

SEQ ID NO: 799919 - DNA, 20 bp, mouse
gaaactggagtcgacgctgt

SEQ ID NO: 799920 - DNA, 20 bp, mouse
gttactcccacagcgcggtg

SEQ ID NO: 799921 - DNA, 20 bp, mouse
ggaaaggggagggtctgtta

SEQ ID NO: 799922 - DNA, 20 bp, mouse
gaatcaaaagggctgtgtct

SEQ ID NO: 799923 - DNA, 20 bp, mouse
gccaacttcttccggatccc

SEQ ID NO: 799924 - DNA, 20 bp, mouse
ggactcataagccaatttag

SEQ ID NO: 799925 - DNA, 20 bp, mouse
gcgactggtgagacttgagc

SEQ ID NO: 799926 - DNA, 20 bp, mouse
ggctctggggctgggacgat

SEQ ID NO: 799927 - DNA, 20 bp, mouse
ggggctgggacgatcggagc

SEQ ID NO: 799928 - DNA, 20 bp, mouse
gcgggcccacggcgattggg

SEQ ID NO: 799929 - DNA, 20 bp, mouse
gtgggcccgcggagcccctg

SEQ ID NO: 799930 - DNA, 20 bp, mouse
gcgcgagcgcggggccggac

SEQ ID NO: 799931 - DNA, 20 bp, mouse
gccacacggtttcacaagga

SEQ ID NO: 799932 - DNA, 20 bp, mouse
ggagcaggggcgggtcgcgc

SEQ ID NO: 799933 - DNA, 20 bp, mouse
gattgggcggctagcggtga

SEQ ID NO: 799934 - DNA, 20 bp, mouse
gctagccgcccaatcgccgt

SEQ ID NO: 799935 - DNA, 20 bp, mouse
gtccgcgggcccacggcgat

SEQ ID NO: 799936 - DNA, 20 bp, mouse
ggggccgaagctgctgtcaa

SEQ ID NO: 799937 - DNA, 20 bp, mouse
gggaaccccgccaggactct

SEQ ID NO: 799938 - DNA, 20 bp, mouse
gaaaggggaggccgcggtgt

SEQ ID NO: 799939 - DNA, 20 bp, mouse
gggcggtggcgcctcttaaa

SEQ ID NO: 799940 - DNA, 20 bp, mouse
ggtggcgcctcttaaagggg

SEQ ID NO: 799941 - DNA, 20 bp, mouse
gagggtgaaggcgcatgccc

SEQ ID NO: 799942 - DNA, 20 bp, mouse
gcctgcccacatcaggttga

SEQ ID NO: 799943 - DNA, 20 bp, mouse
gcgcccacggaccgccgctg

SEQ ID NO: 799944 - DNA, 20 bp, mouse
gtcctggcggggttcccttt

SEQ ID NO: 799945 - DNA, 20 bp, mouse
gagctgggcacagagggtga

SEQ ID NO: 799946 - DNA, 20 bp, mouse
gaggtgaccgcgcagctcgg

SEQ ID NO: 799947 - DNA, 20 bp, mouse
gcctgcgctccgctgatagg

SEQ ID NO: 799948 - DNA, 20 bp, mouse
gtatcagcggagcgcagggg

SEQ ID NO: 799949 - DNA, 20 bp, mouse
gcttcccccgcccccggcct

SEQ ID NO: 799950 - DNA, 20 bp, mouse
ggcgggcggtgagagcgcgt

SEQ ID NO: 799951 - DNA, 20 bp, mouse
gtgggagccgaggccggggg

SEQ ID NO: 799952 - DNA, 20 bp, mouse
ggggtcacgtttggagtgat

SEQ ID NO: 799953 - DNA, 20 bp, mouse
gggccaagggagagcgtcgg

SEQ ID NO: 799954 - DNA, 20 bp, mouse
gcccccggcccggggaagcg

SEQ ID NO: 799955 - DNA, 20 bp, mouse
ggcgctccgctgataggcgg

SEQ ID NO: 799956 - DNA, 20 bp, mouse
ggatgctcggcgcacttcgg

SEQ ID NO: 799957 - DNA, 20 bp, mouse
ggaggggcgggacgaggtca

SEQ ID NO: 799958 - DNA, 20 bp, mouse
gacgaggtcagggagacaaa

SEQ ID NO: 799959 - DNA, 20 bp, mouse
gggtcgaatagtcttctgaa

SEQ ID NO: 799960 - DNA, 20 bp, mouse
ggctcggcgcacttcggagg

SEQ ID NO: 799961 - DNA, 20 bp, mouse
gacctcgtcccgcccctctg

SEQ ID NO: 799962 - DNA, 20 bp, mouse
gcgcaatggagccctcagag

SEQ ID NO: 799963 - DNA, 20 bp, mouse
ggttggcaggtggacagata

SEQ ID NO: 799964 - DNA, 20 bp, mouse
gatggagccctcagaggggc

SEQ ID NO: 799965 - DNA, 20 bp, mouse
ggctccaggcgcaggcgcaa

SEQ ID NO: 799966 - DNA, 20 bp, mouse
gtgagcgctcggctggggca

SEQ ID NO: 799967 - DNA, 20 bp, mouse
gcagctgccacgcccatacc

SEQ ID NO: 799968 - DNA, 20 bp, mouse
gggtgcacctagacagaaag

SEQ ID NO: 799969 - DNA, 20 bp, mouse
gagcgcagtgagccgggtat

SEQ ID NO: 799970 - DNA, 20 bp, mouse
ggtccgcgccaacagggcga

SEQ ID NO: 799971 - DNA, 20 bp, mouse
gggcggggtccgcgccaaca

SEQ ID NO: 799972 - DNA, 20 bp, mouse
ggggggcagcgcagtgagcc

SEQ ID NO: 799973 - DNA, 20 bp, mouse
gaaacctcgtgcacgagccg

SEQ ID NO: 799974 - DNA, 20 bp, mouse
gcaggtccagctgcttacag

SEQ ID NO: 799975 - DNA, 20 bp, mouse
gggaacccagctgaccgggg

SEQ ID NO: 799976 - DNA, 20 bp, mouse
gcggcagcgaggagtcccga

SEQ ID NO: 799977 - DNA, 20 bp, mouse
ggacggagagcgattgacgt

SEQ ID NO: 799978 - DNA, 20 bp, mouse
ggggagggcagggcggacaa

SEQ ID NO: 799979 - DNA, 20 bp, mouse
gtctggccaatgggagggca

SEQ ID NO: 799980 - DNA, 20 bp, mouse
gagggcagggcggacaaagg

SEQ ID NO: 799981 - DNA, 20 bp, mouse
gccccccggctctggccaat

SEQ ID NO: 799982 - DNA, 20 bp, mouse
ggggcggggccccagggtga

SEQ ID NO: 799983 - DNA, 20 bp, mouse
gtggccctctggccagggtg

SEQ ID NO: 799984 - DNA, 20 bp, mouse
gaagctgatcacgaaggagg

SEQ ID NO: 799985 - DNA, 20 bp, mouse
gccagagggccatgcggccg

SEQ ID NO: 799986 - DNA, 20 bp, mouse
gttcccacatgggttgtcca

SEQ ID NO: 799987 - DNA, 20 bp, mouse
ggtccctggacaacccatgt

SEQ ID NO: 799988 - DNA, 20 bp, mouse
gcgcacagatggccctgctc

SEQ ID NO: 799989 - DNA, 20 bp, mouse
gcacatctgtgactgttccc

SEQ ID NO: 799990 - DNA, 20 bp, mouse
gcccctttctgatacaccct

SEQ ID NO: 799991 - DNA, 20 bp, mouse
ggtccctgactcacaaaacc

SEQ ID NO: 799992 - DNA, 20 bp, mouse
gtgtccagggacgcgggaac

SEQ ID NO: 799993 - DNA, 20 bp, mouse
gagggccatctgtgcgggca

SEQ ID NO: 799994 - DNA, 20 bp, mouse
gcagccctgatgtatataaa

SEQ ID NO: 799995 - DNA, 20 bp, mouse
ggaagtactctgttcccaca

SEQ ID NO: 799996 - DNA, 20 bp, mouse
gacatcatgggaatgatcac

SEQ ID NO: 799997 - DNA, 20 bp, mouse
gggtgatgaactcttcagtt

SEQ ID NO: 799998 - DNA, 20 bp, mouse
ggatcgtgacaaatgatcaa

SEQ ID NO: 799999 - DNA, 20 bp, mouse
gatagtcaatgagtgaggaa

SEQ ID NO: 800000 - DNA, 20 bp, mouse
ggacaaatgatcaaagggag

SEQ ID NO: 800001 - DNA, 20 bp, mouse
ggaagggctctttttggtca

SEQ ID NO: 800002 - DNA, 20 bp, mouse
gtgcctttctcggacatcat

SEQ ID NO: 800003 - DNA, 20 bp, mouse
gcttccttttggcacagata

SEQ ID NO: 800004 - DNA, 20 bp, mouse
gaaacgagatgtgtgaccct

SEQ ID NO: 800005 - DNA, 20 bp, mouse
gtcaagatagtcaatgagtg

SEQ ID NO: 800006 - DNA, 20 bp, mouse
gacagaaactaacacacatt

SEQ ID NO: 800007 - DNA, 20 bp, mouse
ggcaaacatgttctgtgttc

SEQ ID NO: 800008 - DNA, 20 bp, mouse
gttcacaggcattatttctt

SEQ ID NO: 800009 - DNA, 20 bp, mouse
gctgggtgatagctagtgct

SEQ ID NO: 800010 - DNA, 20 bp, mouse
gacagaacatgtttgctaat

SEQ ID NO: 800011 - DNA, 20 bp, mouse
gcttgcacttggtgattcga

SEQ ID NO: 800012 - DNA, 20 bp, mouse
gacttcccagcaaaacttgc

SEQ ID NO: 800013 - DNA, 20 bp, mouse
gacttcagtggttcatctat

SEQ ID NO: 800014 - DNA, 20 bp, mouse
gagtgtcctgcaagttttgc

SEQ ID NO: 800015 - DNA, 20 bp, mouse
gggttcatctataggaaata

SEQ ID NO: 800016 - DNA, 20 bp, mouse
gaggtcggctaacgggaaag

SEQ ID NO: 800017 - DNA, 20 bp, mouse
ggtaaagcaggtcggctaac

SEQ ID NO: 800018 - DNA, 20 bp, mouse
gcttcccagaacagagtgtc

SEQ ID NO: 800019 - DNA, 20 bp, mouse
ggaacagagtgtctggaaga

SEQ ID NO: 800020 - DNA, 20 bp, mouse
ggctgcccaccatccttaac

SEQ ID NO: 800021 - DNA, 20 bp, mouse
gagccgacctgctttacctc

SEQ ID NO: 800022 - DNA, 20 bp, mouse
gggacatcgtagtaaataac

SEQ ID NO: 800023 - DNA, 20 bp, mouse
gcacctgaggtaaagcaggt

SEQ ID NO: 800024 - DNA, 20 bp, mouse
gtggaacattgatccagtta

SEQ ID NO: 800025 - DNA, 20 bp, mouse
gcaaacttcactcacacctg

SEQ ID NO: 800026 - DNA, 20 bp, mouse
gaggtcagagctagattaac

SEQ ID NO: 800027 - DNA, 20 bp, mouse
gctgacctcaggtgctgatt

SEQ ID NO: 800028 - DNA, 20 bp, mouse
gaagaatacaggactactca

SEQ ID NO: 800029 - DNA, 20 bp, mouse
ggggaaacttaagtaatcac

SEQ ID NO: 800030 - DNA, 20 bp, mouse
gctaccaggtgtcagattct

SEQ ID NO: 800031 - DNA, 20 bp, mouse
gtgctgattaggtttgaaaa

SEQ ID NO: 800032 - DNA, 20 bp, mouse
gtttcccagaatctgacacc

SEQ ID NO: 800033 - DNA, 20 bp, mouse
gaaactgcatattcggtagc

SEQ ID NO: 800034 - DNA, 20 bp, mouse
gagagctagattaacaggaa

SEQ ID NO: 800035 - DNA, 20 bp, mouse
gagtagtcctgtattcttat

SEQ ID NO: 800036 - DNA, 20 bp, mouse
gcagggaggtaggtggtgct

SEQ ID NO: 800037 - DNA, 20 bp, mouse
gagaaactcccgcttttgat

SEQ ID NO: 800038 - DNA, 20 bp, mouse
gggtgcttggcatggactct

SEQ ID NO: 800039 - DNA, 20 bp, mouse
gaggggtttcccatcaaaag

SEQ ID NO: 800040 - DNA, 20 bp, mouse
ggcagccctgctgaattgtc

SEQ ID NO: 800041 - DNA, 20 bp, mouse
gtttccggaacatagtatct

SEQ ID NO: 800042 - DNA, 20 bp, mouse
gtgtaacagtttatagtctt

SEQ ID NO: 800043 - DNA, 20 bp, mouse
gtgcaagtcagggaggtagg

SEQ ID NO: 800044 - DNA, 20 bp, mouse
gatgctcatgcaagtcaggg

SEQ ID NO: 800045 - DNA, 20 bp, mouse
gtcatgcaagtcagggaggt

SEQ ID NO: 800046 - DNA, 20 bp, mouse
gcagaaccaggctccattaa

SEQ ID NO: 800047 - DNA, 20 bp, mouse
gccagagagggaaggacgtt

SEQ ID NO: 800048 - DNA, 20 bp, mouse
gtgccgactacaggatactg

SEQ ID NO: 800049 - DNA, 20 bp, mouse
gggtgggaatgagcactttg

SEQ ID NO: 800050 - DNA, 20 bp, mouse
gaggataaagacaaccggaa

SEQ ID NO: 800051 - DNA, 20 bp, mouse
ggaagattttgtttgctcac

SEQ ID NO: 800052 - DNA, 20 bp, mouse
gatccacagtatcctgtagt

SEQ ID NO: 800053 - DNA, 20 bp, mouse
ggttccaaggaccttggtgc

SEQ ID NO: 800054 - DNA, 20 bp, mouse
gacgaagagataaaaacgag

SEQ ID NO: 800055 - DNA, 20 bp, mouse
gtttgtttgctcacagggag

SEQ ID NO: 800056 - DNA, 20 bp, mouse
gggaccgcccggcggaacgt

SEQ ID NO: 800057 - DNA, 20 bp, mouse
gccgcccggcggaacgtggg

SEQ ID NO: 800058 - DNA, 20 bp, mouse
gcgcgccgggagctccgtga

SEQ ID NO: 800059 - DNA, 20 bp, mouse
gccaccgcctacccggggcg

SEQ ID NO: 800060 - DNA, 20 bp, mouse
gcgggcgcgcgaccccgcgc

SEQ ID NO: 800061 - DNA, 20 bp, mouse
gccgccccctgcccctgccg

SEQ ID NO: 800062 - DNA, 20 bp, mouse
ggaccggagcgcgaagattc

SEQ ID NO: 800063 - DNA, 20 bp, mouse
gggcgcgagcgtgcaggctg

SEQ ID NO: 800064 - DNA, 20 bp, mouse
ggccccccgccccgggtagg

SEQ ID NO: 800065 - DNA, 20 bp, mouse
gctggaggaagtaagcgcac

SEQ ID NO: 800066 - DNA, 20 bp, mouse
ggggcgcggaaggtgtgcgg

SEQ ID NO: 800067 - DNA, 20 bp, mouse
ggcgctgcggagcttgtagt

SEQ ID NO: 800068 - DNA, 20 bp, mouse
gcgggactggagccgagcca

SEQ ID NO: 800069 - DNA, 20 bp, mouse
gcaggtgcgcgactcacgct

SEQ ID NO: 800070 - DNA, 20 bp, mouse
gcgccaccgccgcgcgtggg

SEQ ID NO: 800071 - DNA, 20 bp, mouse
ggcggggccgggaacgggac

SEQ ID NO: 800072 - DNA, 20 bp, mouse
ggactcacgctgggcgcgga

SEQ ID NO: 800073 - DNA, 20 bp, mouse
gtcggctccagtcccggcca

SEQ ID NO: 800074 - DNA, 20 bp, mouse
ggcgtcctcccgccgcgctg

SEQ ID NO: 800075 - DNA, 20 bp, mouse
gcctgcgcagggagaggccc

SEQ ID NO: 800076 - DNA, 20 bp, mouse
gacgtcacgtcaaagggaat

SEQ ID NO: 800077 - DNA, 20 bp, mouse
gggacccggacggacctcag

SEQ ID NO: 800078 - DNA, 20 bp, mouse
ggggcgcaagtggacccgga

SEQ ID NO: 800079 - DNA, 20 bp, mouse
ggcggggcggcggaattccc

SEQ ID NO: 800080 - DNA, 20 bp, mouse
ggggcggggcataactctga

SEQ ID NO: 800081 - DNA, 20 bp, mouse
ggggcgtagtggcaggtcta

SEQ ID NO: 800082 - DNA, 20 bp, mouse
gtacccaaggcccctagctc

SEQ ID NO: 800083 - DNA, 20 bp, mouse
gcccgcagtcacgtgagcag

SEQ ID NO: 800084 - DNA, 20 bp, mouse
gtcagggcgagcgcacacga

SEQ ID NO: 800085 - DNA, 20 bp, mouse
gggggcctgcagcgagatgg

SEQ ID NO: 800086 - DNA, 20 bp, mouse
gttagcccgcccagcagagg

SEQ ID NO: 800087 - DNA, 20 bp, mouse
ggcgacccaagggtttagag

SEQ ID NO: 800088 - DNA, 20 bp, mouse
gcgcggctgacgcgacccaa

SEQ ID NO: 800089 - DNA, 20 bp, mouse
gaggcgcggcctggactcgg

SEQ ID NO: 800090 - DNA, 20 bp, mouse
ggagaggcgcggcctggact

SEQ ID NO: 800091 - DNA, 20 bp, mouse
gcggggtggggccacggctt

SEQ ID NO: 800092 - DNA, 20 bp, mouse
gggcggggtcatgcgtgcgg

SEQ ID NO: 800093 - DNA, 20 bp, mouse
ggaggggaagcgggagtgac

SEQ ID NO: 800094 - DNA, 20 bp, mouse
gccagcagaggaggcggaga

SEQ ID NO: 800095 - DNA, 20 bp, mouse
gtgaccccgcccccgagtcc

SEQ ID NO: 800096 - DNA, 20 bp, mouse
ggaactgcacatcccctccg

SEQ ID NO: 800097 - DNA, 20 bp, mouse
ggagtctcggttctcgtcga

SEQ ID NO: 800098 - DNA, 20 bp, mouse
gggacctttgccagacgtga

SEQ ID NO: 800099 - DNA, 20 bp, mouse
gagggtggccagatcctccg

SEQ ID NO: 800100 - DNA, 20 bp, mouse
gtagccctcacgtctggcaa

SEQ ID NO: 800101 - DNA, 20 bp, mouse
gcgtcgagggtcgagaggtc

SEQ ID NO: 800102 - DNA, 20 bp, mouse
gaggggcggaactccagaaa

SEQ ID NO: 800103 - DNA, 20 bp, mouse
gtcagattgcccagacgagt

SEQ ID NO: 800104 - DNA, 20 bp, mouse
gcgctccgccccttggtcct

SEQ ID NO: 800105 - DNA, 20 bp, mouse
ggttctcgtcgagggtcgag

SEQ ID NO: 800106 - DNA, 20 bp, mouse
ggggaggcgcgcgtgtgctc

SEQ ID NO: 800107 - DNA, 20 bp, mouse
gcgctccgcccggaagggca

SEQ ID NO: 800108 - DNA, 20 bp, mouse
ggggacacgtgtggcggcgg

SEQ ID NO: 800109 - DNA, 20 bp, mouse
ggaggtgcgggcaagcccga

SEQ ID NO: 800110 - DNA, 20 bp, mouse
gggcgcccggggctttaaga

SEQ ID NO: 800111 - DNA, 20 bp, mouse
gagagcggccagagaccgac

SEQ ID NO: 800112 - DNA, 20 bp, mouse
gccccggcccgggtcttcag

SEQ ID NO: 800113 - DNA, 20 bp, mouse
ggccgctgcgcgaacgagag

SEQ ID NO: 800114 - DNA, 20 bp, mouse
ggcagccctgcccttccggg

SEQ ID NO: 800115 - DNA, 20 bp, mouse
gggcgcggctgggacacgtg

SEQ ID NO: 800116 - DNA, 20 bp, mouse
gagcccctgcagttcctagg

SEQ ID NO: 800117 - DNA, 20 bp, mouse
gcggagcagcgtggcctggc

SEQ ID NO: 800118 - DNA, 20 bp, mouse
gaactgcaggggctacgact

SEQ ID NO: 800119 - DNA, 20 bp, mouse
ggccagaagccgtgacgcga

SEQ ID NO: 800120 - DNA, 20 bp, mouse
ggagcccttggcccgcagag

SEQ ID NO: 800121 - DNA, 20 bp, mouse
gggctcaagaggtggcgatg

SEQ ID NO: 800122 - DNA, 20 bp, mouse
gctaaccccgagcccctctg

SEQ ID NO: 800123 - DNA, 20 bp, mouse
gcgggagaatcgtgagccct

SEQ ID NO: 800124 - DNA, 20 bp, mouse
ggccacctcttgagcctcct

SEQ ID NO: 800125 - DNA, 20 bp, mouse
ggagcctcctaggaactgca

SEQ ID NO: 800126 - DNA, 20 bp, mouse
gggaaagggagtttattctt

SEQ ID NO: 800127 - DNA, 20 bp, mouse
gccacccccacctcacgggg

SEQ ID NO: 800128 - DNA, 20 bp, mouse
gctgaaggcggaggtctaca

SEQ ID NO: 800129 - DNA, 20 bp, mouse
gacctcacggggaggactga

SEQ ID NO: 800130 - DNA, 20 bp, mouse
gtaggaatggggtgctggaa

SEQ ID NO: 800131 - DNA, 20 bp, mouse
gggggtggccgtgtaggaat

SEQ ID NO: 800132 - DNA, 20 bp, mouse
gcctccgcacgcagcccctc

SEQ ID NO: 800133 - DNA, 20 bp, mouse
gaaggcggaggtctacaggg

SEQ ID NO: 800134 - DNA, 20 bp, mouse
ggatgtgccccgtaagtggt

SEQ ID NO: 800135 - DNA, 20 bp, mouse
ggggcggggtggcgctggaa

SEQ ID NO: 800136 - DNA, 20 bp, mouse
gcagggagtatgctcccaga

SEQ ID NO: 800137 - DNA, 20 bp, mouse
ggggctggaaacaacagaca

SEQ ID NO: 800138 - DNA, 20 bp, mouse
ggaggggtggggaatatgat

SEQ ID NO: 800139 - DNA, 20 bp, mouse
ggtgctgctgagtgaggaac

SEQ ID NO: 800140 - DNA, 20 bp, mouse
ggggagcatactccctgcat

SEQ ID NO: 800141 - DNA, 20 bp, mouse
gctccccgctccagacacct

SEQ ID NO: 800142 - DNA, 20 bp, mouse
gagtgacacaaagaaaaagg

SEQ ID NO: 800143 - DNA, 20 bp, mouse
gaagaaaaggtttcagaggg

SEQ ID NO: 800144 - DNA, 20 bp, mouse
gaacagagcagtcaggggga

SEQ ID NO: 800145 - DNA, 20 bp, mouse
gccaccctaagctggacgat

SEQ ID NO: 800146 - DNA, 20 bp, mouse
gagcagccaggtaactctgg

SEQ ID NO: 800147 - DNA, 20 bp, mouse
ggggtccttggccagaaaac

SEQ ID NO: 800148 - DNA, 20 bp, mouse
gtatacacaccatgtatcac

SEQ ID NO: 800149 - DNA, 20 bp, mouse
gcatggtcccacaggccctg

SEQ ID NO: 800150 - DNA, 20 bp, mouse
gacatggtgtgtataaaaga

SEQ ID NO: 800151 - DNA, 20 bp, mouse
gactgggcgggcagacagca

SEQ ID NO: 800152 - DNA, 20 bp, mouse
gccttcttcatggcaatgac

SEQ ID NO: 800153 - DNA, 20 bp, mouse
gactcaccatgctggagtca

SEQ ID NO: 800154 - DNA, 20 bp, mouse
ggctttgatttattacccca

SEQ ID NO: 800155 - DNA, 20 bp, mouse
gttattaccccagggcctgt

SEQ ID NO: 800156 - DNA, 20 bp, mouse
ggatccccctggtgggaact

SEQ ID NO: 800157 - DNA, 20 bp, mouse
gcctagaagagcagaaggcg

SEQ ID NO: 800158 - DNA, 20 bp, mouse
gaagtctggccttatgagga

SEQ ID NO: 800159 - DNA, 20 bp, mouse
gccctggtgggaactgggtg

SEQ ID NO: 800160 - DNA, 20 bp, mouse
gtaggtaggagactgaatct

SEQ ID NO: 800161 - DNA, 20 bp, mouse
ggccgacaatatggggtcac

SEQ ID NO: 800162 - DNA, 20 bp, mouse
gccgaagggccccgagttgg

SEQ ID NO: 800163 - DNA, 20 bp, mouse
gtcagctgagtgatagtcac

SEQ ID NO: 800164 - DNA, 20 bp, mouse
gagctctagatccccctggt

SEQ ID NO: 800165 - DNA, 20 bp, mouse
gctctctggcccttcctcct

SEQ ID NO: 800166 - DNA, 20 bp, mouse
gagggccccgtttgtcaact

SEQ ID NO: 800167 - DNA, 20 bp, mouse
gtctactccaggttatgtac

SEQ ID NO: 800168 - DNA, 20 bp, mouse
gtagacaaacatgtgaggga

SEQ ID NO: 800169 - DNA, 20 bp, mouse
gccagcaacctgcctgggga

SEQ ID NO: 800170 - DNA, 20 bp, mouse
gaaaccagcacgtgaatgta

SEQ ID NO: 800171 - DNA, 20 bp, mouse
gagaacagatgcgtcaaaaa

SEQ ID NO: 800172 - DNA, 20 bp, mouse
ggtggtggctttaacagatg

SEQ ID NO: 800173 - DNA, 20 bp, mouse
ggacacaagcttagagacat

SEQ ID NO: 800174 - DNA, 20 bp, mouse
ggaggctagacaaacatgtg

SEQ ID NO: 800175 - DNA, 20 bp, mouse
gtcaaggaagctgtggcatt

SEQ ID NO: 800176 - DNA, 20 bp, mouse
ggcccccggctccatcgcca

SEQ ID NO: 800177 - DNA, 20 bp, mouse
gccgctccggcacaaggcca

SEQ ID NO: 800178 - DNA, 20 bp, mouse
ggcagccaccagctccggtt

SEQ ID NO: 800179 - DNA, 20 bp, mouse
ggggcacgcgggagaggtat

SEQ ID NO: 800180 - DNA, 20 bp, mouse
gtggccacaaggtggcccag

SEQ ID NO: 800181 - DNA, 20 bp, mouse
gaggccggcctggtgctcta

SEQ ID NO: 800182 - DNA, 20 bp, mouse
gtgactacaggagctgcgga

SEQ ID NO: 800183 - DNA, 20 bp, mouse
gagctgcggagggtcagtct

SEQ ID NO: 800184 - DNA, 20 bp, mouse
gctggtggctgccatggcga

SEQ ID NO: 800185 - DNA, 20 bp, mouse
gtcgacgccaggagaaccgt

SEQ ID NO: 800186 - DNA, 20 bp, mouse
ggggcgcggcgagtggccct

SEQ ID NO: 800187 - DNA, 20 bp, mouse
gcagacccggatgtgaggcc

SEQ ID NO: 800188 - DNA, 20 bp, mouse
gcgggaggagagagcgcgag

SEQ ID NO: 800189 - DNA, 20 bp, mouse
ggccgcgccccgccgtgccg

SEQ ID NO: 800190 - DNA, 20 bp, mouse
gcagcctggggtcctcgcgg

SEQ ID NO: 800191 - DNA, 20 bp, mouse
gtcctcccggcctcacatcc

SEQ ID NO: 800192 - DNA, 20 bp, mouse
ggccggggcgcagtcaatgg

SEQ ID NO: 800193 - DNA, 20 bp, mouse
gggctggctcggccgctccc

SEQ ID NO: 800194 - DNA, 20 bp, mouse
gtggccggagccccgcggca

SEQ ID NO: 800195 - DNA, 20 bp, mouse
gtgggcggaaggggaagccg

SEQ ID NO: 800196 - DNA, 20 bp, mouse
gtgcccctcaggaacacggt

SEQ ID NO: 800197 - DNA, 20 bp, mouse
gcaggtaaggaacgcaactc

SEQ ID NO: 800198 - DNA, 20 bp, mouse
gcccttgcagagcaggtgaa

SEQ ID NO: 800199 - DNA, 20 bp, mouse
gcggcacatggagacaggcg

SEQ ID NO: 800200 - DNA, 20 bp, mouse
gcagagcaggtgaaaggctt

SEQ ID NO: 800201 - DNA, 20 bp, mouse
gtccgccccttcgccaggta

SEQ ID NO: 800202 - DNA, 20 bp, mouse
gctagcccaccgtgttcctg

SEQ ID NO: 800203 - DNA, 20 bp, mouse
gcggggcgggctttcgggga

SEQ ID NO: 800204 - DNA, 20 bp, mouse
gaggggcccaggtgggattt

SEQ ID NO: 800205 - DNA, 20 bp, mouse
gtgttcctgaggggcatctt

SEQ ID NO: 800206 - DNA, 20 bp, mouse
ggaaacgtgccgtggtgcac

SEQ ID NO: 800207 - DNA, 20 bp, mouse
ggcaaccggaggccaatgga

SEQ ID NO: 800208 - DNA, 20 bp, mouse
gcccggcggaaggacggggt

SEQ ID NO: 800209 - DNA, 20 bp, mouse
ggcttcccggcggaaggacg

SEQ ID NO: 800210 - DNA, 20 bp, mouse
ggcgccggatccggagcctg

SEQ ID NO: 800211 - DNA, 20 bp, mouse
gacatccgaagcagcggcgc

SEQ ID NO: 800212 - DNA, 20 bp, mouse
gtcaatgcgcctgtgcacca

SEQ ID NO: 800213 - DNA, 20 bp, mouse
gcaggcgcattgacgtcctc

SEQ ID NO: 800214 - DNA, 20 bp, mouse
gtggcgggagcgcttcccgg

SEQ ID NO: 800215 - DNA, 20 bp, mouse
ggcagctggcgatccctacc

SEQ ID NO: 800216 - DNA, 20 bp, mouse
gagagacagaccaatggtga

SEQ ID NO: 800217 - DNA, 20 bp, mouse
gaggacgggccaataggagg

SEQ ID NO: 800218 - DNA, 20 bp, mouse
gccaataggaggcggaaggc

SEQ ID NO: 800219 - DNA, 20 bp, mouse
gcgcccggagcgtgcactaa

SEQ ID NO: 800220 - DNA, 20 bp, mouse
ggaggcggaaggcgggcctg

SEQ ID NO: 800221 - DNA, 20 bp, mouse
gcggccggaacctgggagat

SEQ ID NO: 800222 - DNA, 20 bp, mouse
gtagaggacgggccaatagg

SEQ ID NO: 800223 - DNA, 20 bp, mouse
gtcgtgacgtcagtagagga

SEQ ID NO: 800224 - DNA, 20 bp, mouse
gcagtagaggacgggccaat

SEQ ID NO: 800225 - DNA, 20 bp, mouse
gatggtcgatactgcgaggt

SEQ ID NO: 800226 - DNA, 20 bp, mouse
gataactgaacacattccca

SEQ ID NO: 800227 - DNA, 20 bp, mouse
gtggtggcggagcgcagcgg

SEQ ID NO: 800228 - DNA, 20 bp, mouse
gcgggtccaagactagtaaa

SEQ ID NO: 800229 - DNA, 20 bp, mouse
gaaatggctgggagaaaatc

SEQ ID NO: 800230 - DNA, 20 bp, mouse
gcctcactgcagcatcttgg

SEQ ID NO: 800231 - DNA, 20 bp, mouse
ggatcttgctaatacgccct

SEQ ID NO: 800232 - DNA, 20 bp, mouse
gtcgcagactggtccagcag

SEQ ID NO: 800233 - DNA, 20 bp, mouse
gtccaagactagtaaatggc

SEQ ID NO: 800234 - DNA, 20 bp, mouse
ggcacctcactgcagcatct

SEQ ID NO: 800235 - DNA, 20 bp, mouse
gtctctacgccttttttcaa

SEQ ID NO: 800236 - DNA, 20 bp, mouse
gtctccagaggattatgaat

SEQ ID NO: 800237 - DNA, 20 bp, mouse
gcaacagatagtctaaaaat

SEQ ID NO: 800238 - DNA, 20 bp, mouse
gagtcccattcataatcctc

SEQ ID NO: 800239 - DNA, 20 bp, mouse
gacttgaaaacgtttgcttt

SEQ ID NO: 800240 - DNA, 20 bp, mouse
ggttaaaaatacataaccat

SEQ ID NO: 800241 - DNA, 20 bp, mouse
ggttggctggaagcaactgg

SEQ ID NO: 800242 - DNA, 20 bp, mouse
gagatctggtggaaatcatc

SEQ ID NO: 800243 - DNA, 20 bp, mouse
gtttcttcttgattctccag

SEQ ID NO: 800244 - DNA, 20 bp, mouse
ggaacaaggacagccataaa

SEQ ID NO: 800245 - DNA, 20 bp, mouse
gattagatggtaggaatata

SEQ ID NO: 800246 - DNA, 20 bp, mouse
ggaaaagtgtgtagagggtg

SEQ ID NO: 800247 - DNA, 20 bp, mouse
gtatctggaaaagtgtgtag

SEQ ID NO: 800248 - DNA, 20 bp, mouse
gggggggcagaaattccaaa

SEQ ID NO: 800249 - DNA, 20 bp, mouse
gccaagttagccatcctctt

SEQ ID NO: 800250 - DNA, 20 bp, mouse
gagactgattgcatatgaga

SEQ ID NO: 800251 - DNA, 20 bp, mouse
gaaggcaataaccagtcatc

SEQ ID NO: 800252 - DNA, 20 bp, mouse
gggaaccaacttcatgtgtt

SEQ ID NO: 800253 - DNA, 20 bp, mouse
gccgccattctcaatctcca

SEQ ID NO: 800254 - DNA, 20 bp, mouse
gcttgggtaagcagctgcag

SEQ ID NO: 800255 - DNA, 20 bp, mouse
gggcagagcctgcttgtgat

SEQ ID NO: 800256 - DNA, 20 bp, mouse
gcacgcgcgcgggcggggaa

SEQ ID NO: 800257 - DNA, 20 bp, mouse
gcccgccttaggctcattaa

SEQ ID NO: 800258 - DNA, 20 bp, mouse
gaggggcggggcgcgctcgg

SEQ ID NO: 800259 - DNA, 20 bp, mouse
ggggcgcgcgcggacggcga

SEQ ID NO: 800260 - DNA, 20 bp, mouse
ggaggctcgaagtggactcc

SEQ ID NO: 800261 - DNA, 20 bp, mouse
ggcacgcccgggtaaggctg

SEQ ID NO: 800262 - DNA, 20 bp, mouse
gggcggggaagggggcgtgt

SEQ ID NO: 800263 - DNA, 20 bp, mouse
gggggaagggggcgtgtcgg

SEQ ID NO: 800264 - DNA, 20 bp, mouse
gtcggtcccgaggctcgaag

SEQ ID NO: 800265 - DNA, 20 bp, mouse
gcgggcgtgcacgagaattg

SEQ ID NO: 800266 - DNA, 20 bp, mouse
ggtactgtgtggggcaaggt

SEQ ID NO: 800267 - DNA, 20 bp, mouse
ggacccgcgctcatctagag

SEQ ID NO: 800268 - DNA, 20 bp, mouse
gggtcggagctgggtgcgtg

SEQ ID NO: 800269 - DNA, 20 bp, mouse
ggatgagcgcgggtcggagc

SEQ ID NO: 800270 - DNA, 20 bp, mouse
ggacgcacggggtgagaaag

SEQ ID NO: 800271 - DNA, 20 bp, mouse
gggtgagaaagtggctatgc

SEQ ID NO: 800272 - DNA, 20 bp, mouse
gagagggagtggcagcgaga

SEQ ID NO: 800273 - DNA, 20 bp, mouse
ggcgggtgctggtctactaa

SEQ ID NO: 800274 - DNA, 20 bp, mouse
gccaggtactgtgtggggca

SEQ ID NO: 800275 - DNA, 20 bp, mouse
gcggggagcggactggggca

SEQ ID NO: 800276 - DNA, 20 bp, mouse
gcagcccttcctacattaga

SEQ ID NO: 800277 - DNA, 20 bp, mouse
gagccaagacttcacctgta

SEQ ID NO: 800278 - DNA, 20 bp, mouse
gtggtggtgtggttcagcaa

SEQ ID NO: 800279 - DNA, 20 bp, mouse
gcaagagaggtgaactctag

SEQ ID NO: 800280 - DNA, 20 bp, mouse
gtggcggggatatacagtgt

SEQ ID NO: 800281 - DNA, 20 bp, mouse
ggaaacatacatgacagctg

SEQ ID NO: 800282 - DNA, 20 bp, mouse
gccaccccgcccccagagag

SEQ ID NO: 800283 - DNA, 20 bp, mouse
gaatccttctaatgtaggaa

SEQ ID NO: 800284 - DNA, 20 bp, mouse
ggtcttctcaggacgttgtc

SEQ ID NO: 800285 - DNA, 20 bp, mouse
gaggagggaaatccctcctc

SEQ ID NO: 800286 - DNA, 20 bp, mouse
gacacaacttggcagttcag

SEQ ID NO: 800287 - DNA, 20 bp, mouse
ggtgtggttcaagagacttg

SEQ ID NO: 800288 - DNA, 20 bp, mouse
gtaaacccacttcatctgtt

SEQ ID NO: 800289 - DNA, 20 bp, mouse
gaaccacacctcttctactt

SEQ ID NO: 800290 - DNA, 20 bp, mouse
ggtagccaagggacacaact

SEQ ID NO: 800291 - DNA, 20 bp, mouse
gagcaggatcagcttgaatg

SEQ ID NO: 800292 - DNA, 20 bp, mouse
ggtgtcccttggctacatga

SEQ ID NO: 800293 - DNA, 20 bp, mouse
gtcttgtgaattatgattct

SEQ ID NO: 800294 - DNA, 20 bp, mouse
ggctaaacagtacatgtggg

SEQ ID NO: 800295 - DNA, 20 bp, mouse
ggcagttcagcgggttagag

SEQ ID NO: 800296 - DNA, 20 bp, mouse
gctgtgggtcactgccaaga

SEQ ID NO: 800297 - DNA, 20 bp, mouse
gagtggaagaacatataagt

SEQ ID NO: 800298 - DNA, 20 bp, mouse
gagcaagaggatttccctat

SEQ ID NO: 800299 - DNA, 20 bp, mouse
gtggtgaaggatcaagcaag

SEQ ID NO: 800300 - DNA, 20 bp, mouse
gccacaaagcaattacctcc

SEQ ID NO: 800301 - DNA, 20 bp, mouse
gtcttctttgtcagcggaca

SEQ ID NO: 800302 - DNA, 20 bp, mouse
gtgataagcaacagctgcct

SEQ ID NO: 800303 - DNA, 20 bp, mouse
ggaggatttccctatgggac

SEQ ID NO: 800304 - DNA, 20 bp, mouse
ggacacactcaagtttattg

SEQ ID NO: 800305 - DNA, 20 bp, mouse
gagcaattacctcctggtga

SEQ ID NO: 800306 - DNA, 20 bp, mouse
gaaccagccgaactgccaag

SEQ ID NO: 800307 - DNA, 20 bp, mouse
gcaccacttggcagttcggc

SEQ ID NO: 800308 - DNA, 20 bp, mouse
ggcagttcggctggttagag

SEQ ID NO: 800309 - DNA, 20 bp, mouse
ggcattccaggcacctccaa

SEQ ID NO: 800310 - DNA, 20 bp, mouse
gtaaacattcttgacctatc

SEQ ID NO: 800311 - DNA, 20 bp, mouse
ggagtcaccacttggcagtt

SEQ ID NO: 800312 - DNA, 20 bp, mouse
ggccttgcagaaagctctat

SEQ ID NO: 800313 - DNA, 20 bp, mouse
gttgaccccttggaggtgcc

SEQ ID NO: 800314 - DNA, 20 bp, mouse
gaagggaactacaataattc

SEQ ID NO: 800315 - DNA, 20 bp, mouse
gggggtcaagagtcaccact

SEQ ID NO: 800316 - DNA, 20 bp, mouse
gtgagcaaggggtctggtga

SEQ ID NO: 800317 - DNA, 20 bp, mouse
ggacgcgtccggtgagcaag

SEQ ID NO: 800318 - DNA, 20 bp, mouse
gcgtccccagcgttccggta

SEQ ID NO: 800319 - DNA, 20 bp, mouse
gggaacgctggggacgcgtc

SEQ ID NO: 800320 - DNA, 20 bp, mouse
gtgcacggctgcgcgaaaag

SEQ ID NO: 800321 - DNA, 20 bp, mouse
gccagcgttccggtaagggg

SEQ ID NO: 800322 - DNA, 20 bp, mouse
gcgagacaggcgacactgca

SEQ ID NO: 800323 - DNA, 20 bp, mouse
gctctgcaaagatcatacgg

SEQ ID NO: 800324 - DNA, 20 bp, mouse
gtgcgcgaaaagggggatgt

SEQ ID NO: 800325 - DNA, 20 bp, mouse
gacccagacagaggctgtgt

SEQ ID NO: 800326 - DNA, 20 bp, mouse
gaggcagcgtggtgatgcgg

SEQ ID NO: 800327 - DNA, 20 bp, mouse
ggggaggcagcgtggtgatg

SEQ ID NO: 800328 - DNA, 20 bp, mouse
gtcggctgcacgtgaccgtg

SEQ ID NO: 800329 - DNA, 20 bp, mouse
ggcggggccggggtcgcctc

SEQ ID NO: 800330 - DNA, 20 bp, mouse
gggccgcggtgtggatggga

SEQ ID NO: 800331 - DNA, 20 bp, mouse
gtggctgggcggaggtggcg

SEQ ID NO: 800332 - DNA, 20 bp, mouse
ggcccggcccgaggcgaccc

SEQ ID NO: 800333 - DNA, 20 bp, mouse
gccccgccctcctctcgcgc

SEQ ID NO: 800334 - DNA, 20 bp, mouse
gaccacgctgcctcccgccg

SEQ ID NO: 800335 - DNA, 20 bp, mouse
gcggcggccaggacgctcac

SEQ ID NO: 800336 - DNA, 20 bp, mouse
ggggccccgccgcagtgacc

SEQ ID NO: 800337 - DNA, 20 bp, mouse
ggggtgggaggggacgagga

SEQ ID NO: 800338 - DNA, 20 bp, mouse
gcgcgcgagcggcgacgggg

SEQ ID NO: 800339 - DNA, 20 bp, mouse
gcgccgaggaatcgatgatt

SEQ ID NO: 800340 - DNA, 20 bp, mouse
gcggtcggcgaggggaactc

SEQ ID NO: 800341 - DNA, 20 bp, mouse
ggagcgccgatagcatggat

SEQ ID NO: 800342 - DNA, 20 bp, mouse
gcatgctatcggcgctcccc

SEQ ID NO: 800343 - DNA, 20 bp, mouse
ggaggggcgcagggttttgg

SEQ ID NO: 800344 - DNA, 20 bp, mouse
ggtgacatggcggtcggcga

SEQ ID NO: 800345 - DNA, 20 bp, mouse
gggccgaatcatcgattcct

SEQ ID NO: 800346 - DNA, 20 bp, mouse
gccggtgccggaaggttctc

SEQ ID NO: 800347 - DNA, 20 bp, mouse
gcccgcggaactgtagccgt

SEQ ID NO: 800348 - DNA, 20 bp, mouse
gtccctagcgacagcgtccc

SEQ ID NO: 800349 - DNA, 20 bp, mouse
gccccgggacgctgtcgcta

SEQ ID NO: 800350 - DNA, 20 bp, mouse
ggcgaaagtccggtgccgga

SEQ ID NO: 800351 - DNA, 20 bp, mouse
ggggagacgacattgtaagc

SEQ ID NO: 800352 - DNA, 20 bp, mouse
gaagaccctggctagagagt

SEQ ID NO: 800353 - DNA, 20 bp, mouse
gggacagcccaggcttctca

SEQ ID NO: 800354 - DNA, 20 bp, mouse
ggggctgtccagagtgcgcc

SEQ ID NO: 800355 - DNA, 20 bp, mouse
gacccgcgaaagtccggtgc

SEQ ID NO: 800356 - DNA, 20 bp, mouse
gctactctcggctgccgaaa

SEQ ID NO: 800357 - DNA, 20 bp, mouse
gcgccctccacagctactct

SEQ ID NO: 800358 - DNA, 20 bp, mouse
gcggcagccgagagtagctg

SEQ ID NO: 800359 - DNA, 20 bp, mouse
gtctcccggcacctccccgt

SEQ ID NO: 800360 - DNA, 20 bp, mouse
gcagccgagagtagctgtgg

SEQ ID NO: 800361 - DNA, 20 bp, mouse
gcgaaaacacgtggcggggg

SEQ ID NO: 800362 - DNA, 20 bp, mouse
gaacatccgaaaacacgtgg

SEQ ID NO: 800363 - DNA, 20 bp, mouse
gggctgccgaaagggctgat

SEQ ID NO: 800364 - DNA, 20 bp, mouse
ggggagaagactacaagccc

SEQ ID NO: 800365 - DNA, 20 bp, mouse
gcaaacccacggggaggtgc

SEQ ID NO: 800366 - DNA, 20 bp, mouse
gtccgcagtcggaaccacca

SEQ ID NO: 800367 - DNA, 20 bp, mouse
gtagcccgctagttagcact

SEQ ID NO: 800368 - DNA, 20 bp, mouse
ggcccccagtgctaactagc

SEQ ID NO: 800369 - DNA, 20 bp, mouse
gctcccttccgtcaaactct

SEQ ID NO: 800370 - DNA, 20 bp, mouse
gaccgcagcgctgctagcca

SEQ ID NO: 800371 - DNA, 20 bp, mouse
ggccctggctagcagcgctg

SEQ ID NO: 800372 - DNA, 20 bp, mouse
gactgcgcatgcgggaaccc

SEQ ID NO: 800373 - DNA, 20 bp, mouse
gctcggtgtggcactcacgg

SEQ ID NO: 800374 - DNA, 20 bp, mouse
gactcacgggggtacggaag

SEQ ID NO: 800375 - DNA, 20 bp, mouse
ggaagccttccccacgtctc

SEQ ID NO: 800376 - DNA, 20 bp, mouse
gcacagccctagcaaccgga

SEQ ID NO: 800377 - DNA, 20 bp, mouse
ggggttgctaccttgtagga

SEQ ID NO: 800378 - DNA, 20 bp, mouse
gtctaagccgggttcccagg

SEQ ID NO: 800379 - DNA, 20 bp, mouse
ggccgggagacgcccaattt

SEQ ID NO: 800380 - DNA, 20 bp, mouse
gtgcgcgtgcgatcgtggcc

SEQ ID NO: 800381 - DNA, 20 bp, mouse
gagcaaccctccggttgcta

SEQ ID NO: 800382 - DNA, 20 bp, mouse
ggcgagtgcgcgtgcgatcg

SEQ ID NO: 800383 - DNA, 20 bp, mouse
gcgcagctcccgcctcgggg

SEQ ID NO: 800384 - DNA, 20 bp, mouse
gcggagggttgctaccttgt

SEQ ID NO: 800385 - DNA, 20 bp, mouse
gcagcctcagatcccaaatt

SEQ ID NO: 800386 - DNA, 20 bp, mouse
gtagaggccgcagtgatctc

SEQ ID NO: 800387 - DNA, 20 bp, mouse
gcggaagtgcgttatagagg

SEQ ID NO: 800388 - DNA, 20 bp, mouse
gtcaggagctggcgtttgag

SEQ ID NO: 800389 - DNA, 20 bp, mouse
gagcaccgcgtagccatccc

SEQ ID NO: 800390 - DNA, 20 bp, mouse
gtacgcggtgctctctgcgc

SEQ ID NO: 800391 - DNA, 20 bp, mouse
gctgcggcctctagcggcca

SEQ ID NO: 800392 - DNA, 20 bp, mouse
gggagctggcgtttgagagg

SEQ ID NO: 800393 - DNA, 20 bp, mouse
ggcggccagggatggctacg

SEQ ID NO: 800394 - DNA, 20 bp, mouse
gaagcggaagtgcgttatag

SEQ ID NO: 800395 - DNA, 20 bp, mouse
gggcctctagcggccaggga

SEQ ID NO: 800396 - DNA, 20 bp, mouse
gcacccggcgacttccggat

SEQ ID NO: 800397 - DNA, 20 bp, mouse
gagactgggcaatctcaacc

SEQ ID NO: 800398 - DNA, 20 bp, mouse
gttacagggtgagaacaaag

SEQ ID NO: 800399 - DNA, 20 bp, mouse
ggggcaatctcaaccgggag

SEQ ID NO: 800400 - DNA, 20 bp, mouse
ggacttccggatagggagac

SEQ ID NO: 800401 - DNA, 20 bp, mouse
gcggtaaatccagcgactgt

SEQ ID NO: 800402 - DNA, 20 bp, mouse
ggcgactgttggtgcagtgg

SEQ ID NO: 800403 - DNA, 20 bp, mouse
gctccctatccggaagtcgc

SEQ ID NO: 800404 - DNA, 20 bp, mouse
gtcgtccaatctgagttctt

SEQ ID NO: 800405 - DNA, 20 bp, mouse
gtccggcacccggcgacttc

SEQ ID NO: 800406 - DNA, 20 bp, mouse
gacactgcagagcgcggtcg

SEQ ID NO: 800407 - DNA, 20 bp, mouse
gctacacaggatcacctccg

SEQ ID NO: 800408 - DNA, 20 bp, mouse
gcatctggggcgttccgcgg

SEQ ID NO: 800409 - DNA, 20 bp, mouse
gctggccgcggagtctacac

SEQ ID NO: 800410 - DNA, 20 bp, mouse
gtgtctgctgggccgaggtc

SEQ ID NO: 800411 - DNA, 20 bp, mouse
ggcgctctgcagtgtctgct

SEQ ID NO: 800412 - DNA, 20 bp, mouse
gctgcagagcgcggtcgggg

SEQ ID NO: 800413 - DNA, 20 bp, mouse
gcaaaaagggagcgcgtcac

SEQ ID NO: 800414 - DNA, 20 bp, mouse
gtcggggaggagccgaccta

SEQ ID NO: 800415 - DNA, 20 bp, mouse
gctgggccgaggtctggccg

SEQ ID NO: 800416 - DNA, 20 bp, mouse
gtcaccctggacctcgtgcg

SEQ ID NO: 800417 - DNA, 20 bp, mouse
gaggctgagacagccgactc

SEQ ID NO: 800418 - DNA, 20 bp, mouse
gccctggacctcgtgcgagg

SEQ ID NO: 800419 - DNA, 20 bp, mouse
gctgagacagccgactcagg

SEQ ID NO: 800420 - DNA, 20 bp, mouse
gcggaggcgaagcctcgcga

SEQ ID NO: 800421 - DNA, 20 bp, mouse
gcgctgcaggccggcgccta

SEQ ID NO: 800422 - DNA, 20 bp, mouse
gacaggatcgggccctggtg

SEQ ID NO: 800423 - DNA, 20 bp, mouse
ggctaggtaaccctaggcgc

SEQ ID NO: 800424 - DNA, 20 bp, mouse
ggcaaccagcaccttagcaa

SEQ ID NO: 800425 - DNA, 20 bp, mouse
gcccctgcactgacaggatc

SEQ ID NO: 800426 - DNA, 20 bp, mouse
gaggacagcagcctgatgga

SEQ ID NO: 800427 - DNA, 20 bp, mouse
gcgcgcaggcgcaggacgca

SEQ ID NO: 800428 - DNA, 20 bp, mouse
gtgcgggagctgggtgttga

SEQ ID NO: 800429 - DNA, 20 bp, mouse
ggagctgggtgttgagggcg

SEQ ID NO: 800430 - DNA, 20 bp, mouse
ggtcacgtgctaggaagtac

SEQ ID NO: 800431 - DNA, 20 bp, mouse
gtgcgcgacgcgagtttgtg

SEQ ID NO: 800432 - DNA, 20 bp, mouse
ggcgacgcgagtttgtgagg

SEQ ID NO: 800433 - DNA, 20 bp, mouse
gagcagcctgatggagggac

SEQ ID NO: 800434 - DNA, 20 bp, mouse
gcccctcccgtccctccatc

SEQ ID NO: 800435 - DNA, 20 bp, mouse
gacgcgagtttgtgaggagg

SEQ ID NO: 800436 - DNA, 20 bp, mouse
gcgacagagggcgctcgcgg

SEQ ID NO: 800437 - DNA, 20 bp, mouse
gcgcccccgccaccatagag

SEQ ID NO: 800438 - DNA, 20 bp, mouse
gagaggaatcgggcgcgcgg

SEQ ID NO: 800439 - DNA, 20 bp, mouse
ggcggggccgcaagccggga

SEQ ID NO: 800440 - DNA, 20 bp, mouse
gcctagccgggctccgacag

SEQ ID NO: 800441 - DNA, 20 bp, mouse
gcgcgcccgattcctctcta

SEQ ID NO: 800442 - DNA, 20 bp, mouse
ggctcaagatcaccacataa

SEQ ID NO: 800443 - DNA, 20 bp, mouse
gggggactccacacctagcc

SEQ ID NO: 800444 - DNA, 20 bp, mouse
ggccaccatagagaggaatc

SEQ ID NO: 800445 - DNA, 20 bp, mouse
ggggccgcaagccgggaggg

SEQ ID NO: 800446 - DNA, 20 bp, mouse
gagggcggggcctcagccgc

SEQ ID NO: 800447 - DNA, 20 bp, mouse
ggggccacagaggcgagggc

SEQ ID NO: 800448 - DNA, 20 bp, mouse
gacaattagaggctgggcta

SEQ ID NO: 800449 - DNA, 20 bp, mouse
gacggtccgcactacgatgt

SEQ ID NO: 800450 - DNA, 20 bp, mouse
ggcggggcctcagccgcagg

SEQ ID NO: 800451 - DNA, 20 bp, mouse
gctgaaaaggcgacaattag

SEQ ID NO: 800452 - DNA, 20 bp, mouse
gccaaactcagaagctgaaa

SEQ ID NO: 800453 - DNA, 20 bp, mouse
gctgggctatgggtgagggc

SEQ ID NO: 800454 - DNA, 20 bp, mouse
gcggggcgcggcttctgggc

SEQ ID NO: 800455 - DNA, 20 bp, mouse
gggctacggcgggagagcaa

SEQ ID NO: 800456 - DNA, 20 bp, mouse
gtggccgttcggtccggagc

SEQ ID NO: 800457 - DNA, 20 bp, mouse
gaggcccgctccggaccgaa

SEQ ID NO: 800458 - DNA, 20 bp, mouse
ggggctgcggctcaggtcgg

SEQ ID NO: 800459 - DNA, 20 bp, mouse
gccgcccaccaggcccgctc

SEQ ID NO: 800460 - DNA, 20 bp, mouse
gcgctcgccgcgtggccgtt

SEQ ID NO: 800461 - DNA, 20 bp, mouse
ggcgacgttcgcttccgggg

SEQ ID NO: 800462 - DNA, 20 bp, mouse
ggcgcccaggccagagccgc

SEQ ID NO: 800463 - DNA, 20 bp, mouse
ggccgcgtggccgttcggtc

SEQ ID NO: 800464 - DNA, 20 bp, mouse
gggtccggagcgggcctggt

SEQ ID NO: 800465 - DNA, 20 bp, mouse
gcccagctcggcctcgtcgt

SEQ ID NO: 800466 - DNA, 20 bp, mouse
ggacagaagggtagtgtagc

SEQ ID NO: 800467 - DNA, 20 bp, mouse
gcaaggtagtgttgacagaa

SEQ ID NO: 800468 - DNA, 20 bp, mouse
gaactctctttaggagtcat

SEQ ID NO: 800469 - DNA, 20 bp, mouse
gccagtcctacgtacagtaa

SEQ ID NO: 800470 - DNA, 20 bp, mouse
gacgtacagtaaaggatcat

SEQ ID NO: 800471 - DNA, 20 bp, mouse
gggactggtcattccttaca

SEQ ID NO: 800472 - DNA, 20 bp, mouse
gtcctgaagcactcacagta

SEQ ID NO: 800473 - DNA, 20 bp, mouse
gctctagattcatgtgcaca

SEQ ID NO: 800474 - DNA, 20 bp, mouse
ggcctcagaacagtggacaa

SEQ ID NO: 800475 - DNA, 20 bp, mouse
gatgggaacacagtgaaatg

SEQ ID NO: 800476 - DNA, 20 bp, mouse
gcatcagttagatggtgatt

SEQ ID NO: 800477 - DNA, 20 bp, mouse
ggacaggtggggagtaagac

SEQ ID NO: 800478 - DNA, 20 bp, mouse
gtacaaaaccgggggatgga

SEQ ID NO: 800479 - DNA, 20 bp, mouse
gtaaacctcttccatccatc

SEQ ID NO: 800480 - DNA, 20 bp, mouse
gggcaaaaatacaaaaccgg

SEQ ID NO: 800481 - DNA, 20 bp, mouse
gcaccagcaaaagattattg

SEQ ID NO: 800482 - DNA, 20 bp, mouse
gtggggaggctgatacaaga

SEQ ID NO: 800483 - DNA, 20 bp, mouse
gagcctgaactattcagcca

SEQ ID NO: 800484 - DNA, 20 bp, mouse
gtgttctctcatcagttaga

SEQ ID NO: 800485 - DNA, 20 bp, mouse
gatcaggtccctccatcccc

SEQ ID NO: 800486 - DNA, 20 bp, mouse
gggagcttatggctcattgt

SEQ ID NO: 800487 - DNA, 20 bp, mouse
gtttaagtcctacactcgga

SEQ ID NO: 800488 - DNA, 20 bp, mouse
gtgactttaagtcctacact

SEQ ID NO: 800489 - DNA, 20 bp, mouse
gcatgatctaattacttagt

SEQ ID NO: 800490 - DNA, 20 bp, mouse
ggcttatggctcattgtggg

SEQ ID NO: 800491 - DNA, 20 bp, mouse
gagtttttgactcacattgt

SEQ ID NO: 800492 - DNA, 20 bp, mouse
gtacatatttatcggtttag

SEQ ID NO: 800493 - DNA, 20 bp, mouse
ggggatattaggtaaacagg

SEQ ID NO: 800494 - DNA, 20 bp, mouse
gcttctctgtctggtaagaa

SEQ ID NO: 800495 - DNA, 20 bp, mouse
ggaagggatattaggtaaac

SEQ ID NO: 800496 - DNA, 20 bp, mouse
ggggtctttgacagcagggg

SEQ ID NO: 800497 - DNA, 20 bp, mouse
gcgactccaaacaacttttg

SEQ ID NO: 800498 - DNA, 20 bp, mouse
gcaacatggtctacagggat

SEQ ID NO: 800499 - DNA, 20 bp, mouse
ggaaaaatggcgtcacggac

SEQ ID NO: 800500 - DNA, 20 bp, mouse
ggcctagaactcgcagtctc

SEQ ID NO: 800501 - DNA, 20 bp, mouse
gtcgcagtctctggaacact

SEQ ID NO: 800502 - DNA, 20 bp, mouse
gagccccaactgatatcttt

SEQ ID NO: 800503 - DNA, 20 bp, mouse
ggcccgcgcccgcttcgtcg

SEQ ID NO: 800504 - DNA, 20 bp, mouse
ggcgggccccgtttcctcct

SEQ ID NO: 800505 - DNA, 20 bp, mouse
gaagccaaaagatatcagtt

SEQ ID NO: 800506 - DNA, 20 bp, mouse
gcggacgggtctctcgtgcg

SEQ ID NO: 800507 - DNA, 20 bp, mouse
gctctcgtgcggggctgcca

SEQ ID NO: 800508 - DNA, 20 bp, mouse
gctgtgctgcatcttcttgg

SEQ ID NO: 800509 - DNA, 20 bp, mouse
ggcgctggcgacgcacgggg

SEQ ID NO: 800510 - DNA, 20 bp, mouse
gcggcggcgcggggtggagt

SEQ ID NO: 800511 - DNA, 20 bp, mouse
gaaagagaggtggggttagg

SEQ ID NO: 800512 - DNA, 20 bp, mouse
gggcgacgcacggggcggac

SEQ ID NO: 800513 - DNA, 20 bp, mouse
ggcggcgctggcgacgcacg

SEQ ID NO: 800514 - DNA, 20 bp, mouse
ggaagaggaagtgtagcggg

SEQ ID NO: 800515 - DNA, 20 bp, mouse
gctctccgaaagtagtgctt

SEQ ID NO: 800516 - DNA, 20 bp, mouse
gaaaggaagtgagctttctg

SEQ ID NO: 800517 - DNA, 20 bp, mouse
gaacaatattaattccagaa

SEQ ID NO: 800518 - DNA, 20 bp, mouse
gctagaaagttctcagtcct

SEQ ID NO: 800519 - DNA, 20 bp, mouse
gagattgtttcttaacgtgt

SEQ ID NO: 800520 - DNA, 20 bp, mouse
gctttctgaggaaacaacag

SEQ ID NO: 800521 - DNA, 20 bp, mouse
gggaaagaagttttccacct

SEQ ID NO: 800522 - DNA, 20 bp, mouse
ggaaagttctcagtcctagg

SEQ ID NO: 800523 - DNA, 20 bp, mouse
gaaaaaaaaaacccgctgtg

SEQ ID NO: 800524 - DNA, 20 bp, mouse
gaaaacttctttccacacag

SEQ ID NO: 800525 - DNA, 20 bp, mouse
ggtgctttttttatacttgg

SEQ ID NO: 800526 - DNA, 20 bp, mouse
gactgccgaggaggccgccg

SEQ ID NO: 800527 - DNA, 20 bp, mouse
gcgggcttgcgcatgagcgg

SEQ ID NO: 800528 - DNA, 20 bp, mouse
gcgggcgcgccgaggcggtc

SEQ ID NO: 800529 - DNA, 20 bp, mouse
gtgcccagctaaaactgcgg

SEQ ID NO: 800530 - DNA, 20 bp, mouse
gccaaagggtggaaggggaa

SEQ ID NO: 800531 - DNA, 20 bp, mouse
gtctccgtacagcccggcgc

SEQ ID NO: 800532 - DNA, 20 bp, mouse
gcatgagcggcggaaggggc

SEQ ID NO: 800533 - DNA, 20 bp, mouse
gcgcctcggcgcgcccgggt

SEQ ID NO: 800534 - DNA, 20 bp, mouse
gccgccggggcagccaaccc

SEQ ID NO: 800535 - DNA, 20 bp, mouse
gtgccccgggtggacgctgg

SEQ ID NO: 800536 - DNA, 20 bp, mouse
gtcgcccagaaatgtatcaa

SEQ ID NO: 800537 - DNA, 20 bp, mouse
gccaaggcgcctcctgcaat

SEQ ID NO: 800538 - DNA, 20 bp, mouse
gcaaaggaaggggcgcgaga

SEQ ID NO: 800539 - DNA, 20 bp, mouse
ggggcgagaacctccggcca

SEQ ID NO: 800540 - DNA, 20 bp, mouse
gaggaaggggcgcgagatgg

SEQ ID NO: 800541 - DNA, 20 bp, mouse
gttcccgccgaacagttcaa

SEQ ID NO: 800542 - DNA, 20 bp, mouse
gagggcgccactatttcagc

SEQ ID NO: 800543 - DNA, 20 bp, mouse
ggaaatagtggcgccctcat

SEQ ID NO: 800544 - DNA, 20 bp, mouse
gtcgccgccagctgaaatag

SEQ ID NO: 800545 - DNA, 20 bp, mouse
gtcagcctttgatacatttc

SEQ ID NO: 800546 - DNA, 20 bp, mouse
ggagctcggtgaagtcgaga

SEQ ID NO: 800547 - DNA, 20 bp, mouse
ggggtactgaaaagcgtgga

SEQ ID NO: 800548 - DNA, 20 bp, mouse
gacgccagggcggacctcca

SEQ ID NO: 800549 - DNA, 20 bp, mouse
gggcgcttccagcatgctat

SEQ ID NO: 800550 - DNA, 20 bp, mouse
ggacgtccgaactgaggaat

SEQ ID NO: 800551 - DNA, 20 bp, mouse
gccacccccttgtaattctc

SEQ ID NO: 800552 - DNA, 20 bp, mouse
gctgccctggaggtccgccc

SEQ ID NO: 800553 - DNA, 20 bp, mouse
gcagccctgagaattacaag

SEQ ID NO: 800554 - DNA, 20 bp, mouse
gccctggcgtgtgacgtagt

SEQ ID NO: 800555 - DNA, 20 bp, mouse
gctgacggacgtccgaactg

SEQ ID NO: 800556 - DNA, 20 bp, mouse
gtcgcgctgccctcacgggg

SEQ ID NO: 800557 - DNA, 20 bp, mouse
ggcaacgccccgccccgtga

SEQ ID NO: 800558 - DNA, 20 bp, mouse
gcccgcctccaacggcctcg

SEQ ID NO: 800559 - DNA, 20 bp, mouse
ggggcactatgaaagccaat

SEQ ID NO: 800560 - DNA, 20 bp, mouse
gcggaggcgctcaccgtcta

SEQ ID NO: 800561 - DNA, 20 bp, mouse
ggctctaaggaggtgcgcga

SEQ ID NO: 800562 - DNA, 20 bp, mouse
ggcctcgcgctgccctcacg

SEQ ID NO: 800563 - DNA, 20 bp, mouse
gcctccaacggcctcgggga

SEQ ID NO: 800564 - DNA, 20 bp, mouse
gccaacggcctcggggaggg

SEQ ID NO: 800565 - DNA, 20 bp, mouse
gggtgaaggggcaggtcctt

SEQ ID NO: 800566 - DNA, 20 bp, mouse
gcgagtctgcctggaggaac

SEQ ID NO: 800567 - DNA, 20 bp, mouse
gtgacagctcggagcccggg

SEQ ID NO: 800568 - DNA, 20 bp, mouse
gccggggaaagctgagggtc

SEQ ID NO: 800569 - DNA, 20 bp, mouse
gagggcgggcccgagagcgc

SEQ ID NO: 800570 - DNA, 20 bp, mouse
gcggctgggcacagagctgg

SEQ ID NO: 800571 - DNA, 20 bp, mouse
gggcacagagctggcggcag

SEQ ID NO: 800572 - DNA, 20 bp, mouse
gccgagagcgccggaagaag

SEQ ID NO: 800573 - DNA, 20 bp, mouse
gaacgggacggaggacgccg

SEQ ID NO: 800574 - DNA, 20 bp, mouse
gtcgggggaaaaaccgacgt

SEQ ID NO: 800575 - DNA, 20 bp, mouse
gtcctccgtcccgttcctcc

SEQ ID NO: 800576 - DNA, 20 bp, mouse
gaagccgcctccgaaaaggg

SEQ ID NO: 800577 - DNA, 20 bp, mouse
gatagaagggggaagtcgga

SEQ ID NO: 800578 - DNA, 20 bp, mouse
gaaaacgggacgtgtctcga

SEQ ID NO: 800579 - DNA, 20 bp, mouse
ggcggtgcagccatgaaggg

SEQ ID NO: 800580 - DNA, 20 bp, mouse
ggcgggaggactgaagaggg

SEQ ID NO: 800581 - DNA, 20 bp, mouse
ggggcgcgggaggactgaag

SEQ ID NO: 800582 - DNA, 20 bp, mouse
gccggggagtagtgcagagg

SEQ ID NO: 800583 - DNA, 20 bp, mouse
gtctgagccccccttttcgg

SEQ ID NO: 800584 - DNA, 20 bp, mouse
gaatggccgctcgtcagatg

SEQ ID NO: 800585 - DNA, 20 bp, mouse
gagaaaagccgcctccgaaa

SEQ ID NO: 800586 - DNA, 20 bp, mouse
gaggtctgcgggcccggaaa

SEQ ID NO: 800587 - DNA, 20 bp, mouse
gcctggtaacagaatatgat

SEQ ID NO: 800588 - DNA, 20 bp, mouse
gcgtgtatccaggcagatcg

SEQ ID NO: 800589 - DNA, 20 bp, mouse
gcccgccggctgggcaccgt

SEQ ID NO: 800590 - DNA, 20 bp, mouse
gtacagggtaggaaagtgat

SEQ ID NO: 800591 - DNA, 20 bp, mouse
gatgattggtcgagagggga

SEQ ID NO: 800592 - DNA, 20 bp, mouse
gttcgtcttggaggcagcaa

SEQ ID NO: 800593 - DNA, 20 bp, mouse
gcagaagcagccaagcgccc

SEQ ID NO: 800594 - DNA, 20 bp, mouse
gagaatatgattggtcgaga

SEQ ID NO: 800595 - DNA, 20 bp, mouse
gccccacggtgcccagccgg

SEQ ID NO: 800596 - DNA, 20 bp, mouse
gtgaacaggtaccgcacaga

SEQ ID NO: 800597 - DNA, 20 bp, mouse
gcagaccgagcaagacactt

SEQ ID NO: 800598 - DNA, 20 bp, mouse
gaggtaccgcacagatggca

SEQ ID NO: 800599 - DNA, 20 bp, mouse
gcgcacagatggcagggtgg

SEQ ID NO: 800600 - DNA, 20 bp, mouse
ggtcccctctccaccatcgg

SEQ ID NO: 800601 - DNA, 20 bp, mouse
gtaccgcacagatggcaggg

SEQ ID NO: 800602 - DNA, 20 bp, mouse
gagagcccccgatggtggag

SEQ ID NO: 800603 - DNA, 20 bp, mouse
ggcaagagagaacaaacgaa

SEQ ID NO: 800604 - DNA, 20 bp, mouse
ggaacctgtggccgctgggc

SEQ ID NO: 800605 - DNA, 20 bp, mouse
gagcaagacacttgggaaaa

SEQ ID NO: 800606 - DNA, 20 bp, mouse
ggggcggagcggagcggcta

SEQ ID NO: 800607 - DNA, 20 bp, mouse
gtccctcggggcccccgccg

SEQ ID NO: 800608 - DNA, 20 bp, mouse
gggggccccgagggagcggt

SEQ ID NO: 800609 - DNA, 20 bp, mouse
ggggagcggtcgggtggctg

SEQ ID NO: 800610 - DNA, 20 bp, mouse
ggagcgggctcgcgtgacgg

SEQ ID NO: 800611 - DNA, 20 bp, mouse
gcggcggccgagggggttgg

SEQ ID NO: 800612 - DNA, 20 bp, mouse
gggctcgcgtgacggcggca

SEQ ID NO: 800613 - DNA, 20 bp, mouse
ggccacccgaccgctccctc

SEQ ID NO: 800614 - DNA, 20 bp, mouse
ggggcgtggacgcgcgtgtg

SEQ ID NO: 800615 - DNA, 20 bp, mouse
gagcggtcgggtggctgcgg

SEQ ID NO: 800616 - DNA, 20 bp, mouse
gcccaacgttggccagagag

SEQ ID NO: 800617 - DNA, 20 bp, mouse
ggggggatggggaacgacat

SEQ ID NO: 800618 - DNA, 20 bp, mouse
ggggctaacggatcaaacca

SEQ ID NO: 800619 - DNA, 20 bp, mouse
gggatggggaacgacatggg

SEQ ID NO: 800620 - DNA, 20 bp, mouse
ggggcggcagcatgggggat

SEQ ID NO: 800621 - DNA, 20 bp, mouse
ggcacccagaggtgcgggtt

SEQ ID NO: 800622 - DNA, 20 bp, mouse
gcggggggcgcgtgcagctg

SEQ ID NO: 800623 - DNA, 20 bp, mouse
gccgccaccaaaggtcggag

SEQ ID NO: 800624 - DNA, 20 bp, mouse
gtgatccgttagcccaacgt

SEQ ID NO: 800625 - DNA, 20 bp, mouse
ggaggtgcctctccgacctt

SEQ ID NO: 800626 - DNA, 20 bp, mouse
gcgattggggcagacaggag

SEQ ID NO: 800627 - DNA, 20 bp, mouse
ggcacgctatccttcctaaa

SEQ ID NO: 800628 - DNA, 20 bp, mouse
gcatgcgccactgtacccat

SEQ ID NO: 800629 - DNA, 20 bp, mouse
gaaaatcttcagcgagtcta

SEQ ID NO: 800630 - DNA, 20 bp, mouse
gtccgccctcccaccgtctg

SEQ ID NO: 800631 - DNA, 20 bp, mouse
gccacggggcggagacacat

SEQ ID NO: 800632 - DNA, 20 bp, mouse
gtccacagacggtgggaggg

SEQ ID NO: 800633 - DNA, 20 bp, mouse
gcaccgtctgtggatccgat

SEQ ID NO: 800634 - DNA, 20 bp, mouse
ggaccctagaggggttggag

SEQ ID NO: 800635 - DNA, 20 bp, mouse
gctagcgctttaagactgga

SEQ ID NO: 800636 - DNA, 20 bp, mouse
gtgcaggctgaccaagaacc

SEQ ID NO: 800637 - DNA, 20 bp, mouse
gtgggaacggcgagaggggc

SEQ ID NO: 800638 - DNA, 20 bp, mouse
ggcaagcgattcctaggtgc

SEQ ID NO: 800639 - DNA, 20 bp, mouse
gggtccgcgagcctctgctt

SEQ ID NO: 800640 - DNA, 20 bp, mouse
gcaagaacccggctgacagc

SEQ ID NO: 800641 - DNA, 20 bp, mouse
gccatccgcaagcgattcct

SEQ ID NO: 800642 - DNA, 20 bp, mouse
gaccacgaccggctgtcagc

SEQ ID NO: 800643 - DNA, 20 bp, mouse
gagaggctcgcggaccgcta

SEQ ID NO: 800644 - DNA, 20 bp, mouse
gagaaaccctgtctccttcc

SEQ ID NO: 800645 - DNA, 20 bp, mouse
gtgcttgggaacggcgagag

SEQ ID NO: 800646 - DNA, 20 bp, mouse
gtggctctggagcccactat

SEQ ID NO: 800647 - DNA, 20 bp, mouse
gttatgagttgtcacatata

SEQ ID NO: 800648 - DNA, 20 bp, mouse
gggaagctgtgctgtataac

SEQ ID NO: 800649 - DNA, 20 bp, mouse
gagcagcctctatgaatcat

SEQ ID NO: 800650 - DNA, 20 bp, mouse
gtgtataactgggtatgggt

SEQ ID NO: 800651 - DNA, 20 bp, mouse
gaggatagttgcttcagctt

SEQ ID NO: 800652 - DNA, 20 bp, mouse
gcatatatggctttgaaagt

SEQ ID NO: 800653 - DNA, 20 bp, mouse
gaacctaggtactggtaggc

SEQ ID NO: 800654 - DNA, 20 bp, mouse
gcttgtaattggccagaagg

SEQ ID NO: 800655 - DNA, 20 bp, mouse
gaatctgaacttcttgtaat

SEQ ID NO: 800656 - DNA, 20 bp, mouse
gaggagaggaacacgttcac

SEQ ID NO: 800657 - DNA, 20 bp, mouse
gaggcagctgcgcagcagga

SEQ ID NO: 800658 - DNA, 20 bp, mouse
gggcaggcccccgagtgtag

SEQ ID NO: 800659 - DNA, 20 bp, mouse
ggggaaccgagggagcccac

SEQ ID NO: 800660 - DNA, 20 bp, mouse
gcgcagccgcgggagccagt

SEQ ID NO: 800661 - DNA, 20 bp, mouse
gtccctagctgcagctaact

SEQ ID NO: 800662 - DNA, 20 bp, mouse
gacactcgggggcctgcccg

SEQ ID NO: 800663 - DNA, 20 bp, mouse
gtgcccactcgaggtcgtca

SEQ ID NO: 800664 - DNA, 20 bp, mouse
ggctgcagctaactcgggtc

SEQ ID NO: 800665 - DNA, 20 bp, mouse
gctgttgcaaggtactgcga

SEQ ID NO: 800666 - DNA, 20 bp, mouse
gcgtcactgcggttcttcag

SEQ ID NO: 800667 - DNA, 20 bp, mouse
gtagggcggtgccgggagta

SEQ ID NO: 800668 - DNA, 20 bp, mouse
gaaagcggcgggtaaatatt

SEQ ID NO: 800669 - DNA, 20 bp, mouse
gcccgcaaagacacttcctt

SEQ ID NO: 800670 - DNA, 20 bp, mouse
gcaccgccctagccacgcgc

SEQ ID NO: 800671 - DNA, 20 bp, mouse
gggcgggtaaatatttgggg

SEQ ID NO: 800672 - DNA, 20 bp, mouse
gccgcagtgacgggtgtcgc

SEQ ID NO: 800673 - DNA, 20 bp, mouse
gcctgccggtggctataaga

SEQ ID NO: 800674 - DNA, 20 bp, mouse
gttgggtcgggttgtcaggg

SEQ ID NO: 800675 - DNA, 20 bp, mouse
gagaggccagcgcgtggcta

SEQ ID NO: 800676 - DNA, 20 bp, mouse
gcggagacgcgattggtcgc

SEQ ID NO: 800677 - DNA, 20 bp, mouse
gcgggagcgcgcgtcggcag

SEQ ID NO: 800678 - DNA, 20 bp, mouse
ggacgccccagagcggaaga

SEQ ID NO: 800679 - DNA, 20 bp, mouse
gcgcgggcccgctgcaggaa

SEQ ID NO: 800680 - DNA, 20 bp, mouse
ggccgagcccgctagcgcgc

SEQ ID NO: 800681 - DNA, 20 bp, mouse
ggcgcgctcccgggggacgc

SEQ ID NO: 800682 - DNA, 20 bp, mouse
gcggcgggtcgacagaaagc

SEQ ID NO: 800683 - DNA, 20 bp, mouse
gttccgctctggggcgtcgc

SEQ ID NO: 800684 - DNA, 20 bp, mouse
ggggagcatcacgtgatgcc

SEQ ID NO: 800685 - DNA, 20 bp, mouse
ggcgtcggcaggggagcgcg

SEQ ID NO: 800686 - DNA, 20 bp, mouse
gcgacagcaggagccaaaaa

SEQ ID NO: 800687 - DNA, 20 bp, mouse
gagccagggagagcgactag

SEQ ID NO: 800688 - DNA, 20 bp, mouse
ggaagtgaggacaggagcca

SEQ ID NO: 800689 - DNA, 20 bp, mouse
gggggagtgctggacgccag

SEQ ID NO: 800690 - DNA, 20 bp, mouse
gcgagcgcgcgcggttccca

SEQ ID NO: 800691 - DNA, 20 bp, mouse
gagcccggcggggtgcagga

SEQ ID NO: 800692 - DNA, 20 bp, mouse
ggcttcagagccaccgagtg

SEQ ID NO: 800693 - DNA, 20 bp, mouse
gcccttgcagccccactcgg

SEQ ID NO: 800694 - DNA, 20 bp, mouse
ggagtgggcgggcataaggg

SEQ ID NO: 800695 - DNA, 20 bp, mouse
gacacggggacattcgtaaa

SEQ ID NO: 800696 - DNA, 20 bp, mouse
gtgggtgcggggatggggtc

SEQ ID NO: 800697 - DNA, 20 bp, mouse
ggtgcaggggacacgacaac

SEQ ID NO: 800698 - DNA, 20 bp, mouse
gcagccgagcgtccagtcgt

SEQ ID NO: 800699 - DNA, 20 bp, mouse
gacaacaggtctgtgtccct

SEQ ID NO: 800700 - DNA, 20 bp, mouse
gctagcctgggtgcggggat

SEQ ID NO: 800701 - DNA, 20 bp, mouse
gacagattgacccgcacttc

SEQ ID NO: 800702 - DNA, 20 bp, mouse
ggatcaatcccaggtgtcga

SEQ ID NO: 800703 - DNA, 20 bp, mouse
gtgcggggatggggtccggc

SEQ ID NO: 800704 - DNA, 20 bp, mouse
ggcatggcttccatcaccta

SEQ ID NO: 800705 - DNA, 20 bp, mouse
gcaggtctgtgtccctggga

SEQ ID NO: 800706 - DNA, 20 bp, mouse
gcggccgggcccgtagccaa

SEQ ID NO: 800707 - DNA, 20 bp, mouse
gggcctaaggcgctcaggac

SEQ ID NO: 800708 - DNA, 20 bp, mouse
gctggatgaaacccgagctc

SEQ ID NO: 800709 - DNA, 20 bp, mouse
ggggccgctgggacattggc

SEQ ID NO: 800710 - DNA, 20 bp, mouse
gatgaaacccgagctcggga

SEQ ID NO: 800711 - DNA, 20 bp, mouse
gctaaggcgctcaggacagg

SEQ ID NO: 800712 - DNA, 20 bp, mouse
gcgagtgcctggccggtcct

SEQ ID NO: 800713 - DNA, 20 bp, mouse
gttcatccaggcgggaggga

SEQ ID NO: 800714 - DNA, 20 bp, mouse
gttggcggggaaccgaatga

SEQ ID NO: 800715 - DNA, 20 bp, mouse
gtgaggagaggcggcccagg

SEQ ID NO: 800716 - DNA, 20 bp, mouse
gcactagcgcggatcagcaa

SEQ ID NO: 800717 - DNA, 20 bp, mouse
gtgggtgtgtgaggacgtag

SEQ ID NO: 800718 - DNA, 20 bp, mouse
gcctgcgggctcgcgatccc

SEQ ID NO: 800719 - DNA, 20 bp, mouse
gtagcgcggatcagcaaggg

SEQ ID NO: 800720 - DNA, 20 bp, mouse
gatcagcaagggtgggaccg

SEQ ID NO: 800721 - DNA, 20 bp, mouse
gcacttgctgctcgaaccct

SEQ ID NO: 800722 - DNA, 20 bp, mouse
ggcgggcggagcggagcaga

SEQ ID NO: 800723 - DNA, 20 bp, mouse
ggatgcgttagcggaaggga

SEQ ID NO: 800724 - DNA, 20 bp, mouse
gggctcagggttaagaaagt

SEQ ID NO: 800725 - DNA, 20 bp, mouse
gcaagggtgggaccgcggcg

SEQ ID NO: 800726 - DNA, 20 bp, mouse
gagggcggggctaaagtgcg

SEQ ID NO: 800727 - DNA, 20 bp, mouse
gaagctgccccacccgcggg

SEQ ID NO: 800728 - DNA, 20 bp, mouse
gggaggaggaggttgaccgg

SEQ ID NO: 800729 - DNA, 20 bp, mouse
ggaacttgagtgagacgcga

SEQ ID NO: 800730 - DNA, 20 bp, mouse
gaaaaccgtgatcgcggaaa

SEQ ID NO: 800731 - DNA, 20 bp, mouse
gcacccgcgggcggcggaca

SEQ ID NO: 800732 - DNA, 20 bp, mouse
gcacaaggaagccggcagga

SEQ ID NO: 800733 - DNA, 20 bp, mouse
gcgcagccaatggaaagtgg

SEQ ID NO: 800734 - DNA, 20 bp, mouse
gagtgagacgcgagggcggg

SEQ ID NO: 800735 - DNA, 20 bp, mouse
gaagaagctgccccacccgc

SEQ ID NO: 800736 - DNA, 20 bp, mouse
gaagcaagatacaactaagg

SEQ ID NO: 800737 - DNA, 20 bp, mouse
gaacctgcagacacccagag

SEQ ID NO: 800738 - DNA, 20 bp, mouse
ggagaggtggcagcatgaaa

SEQ ID NO: 800739 - DNA, 20 bp, mouse
gccagaggggccaccaatga

SEQ ID NO: 800740 - DNA, 20 bp, mouse
gcaatagcatcaatgaatga

SEQ ID NO: 800741 - DNA, 20 bp, mouse
ggtgccagctcttcatccca

SEQ ID NO: 800742 - DNA, 20 bp, mouse
gtcaatgaatgagggagagg

SEQ ID NO: 800743 - DNA, 20 bp, mouse
gatgagttggggttggagat

SEQ ID NO: 800744 - DNA, 20 bp, mouse
gtgggcagctccctcattgg

SEQ ID NO: 800745 - DNA, 20 bp, mouse
ggatgctattgatttccctg

SEQ ID NO: 800746 - DNA, 20 bp, mouse
gcggctccagggctgggtac

SEQ ID NO: 800747 - DNA, 20 bp, mouse
gcctgggcgggtcccagagg

SEQ ID NO: 800748 - DNA, 20 bp, mouse
ggggcggggccgaaggtcgc

SEQ ID NO: 800749 - DNA, 20 bp, mouse
gatcccccgcgcccacgctc

SEQ ID NO: 800750 - DNA, 20 bp, mouse
gaaagggatccggtggtccc

SEQ ID NO: 800751 - DNA, 20 bp, mouse
gcggccggaaagggatccgg

SEQ ID NO: 800752 - DNA, 20 bp, mouse
gcacctgagcgtgggcgcgg

SEQ ID NO: 800753 - DNA, 20 bp, mouse
gcgggtcaccttcccagcgg

SEQ ID NO: 800754 - DNA, 20 bp, mouse
ggctcctgggcgggtcccag

SEQ ID NO: 800755 - DNA, 20 bp, mouse
gcgagggccgaccagctcca

SEQ ID NO: 800756 - DNA, 20 bp, mouse
gtgaaagctgaattgggtaa

SEQ ID NO: 800757 - DNA, 20 bp, mouse
ggggttgcataactaaggga

SEQ ID NO: 800758 - DNA, 20 bp, mouse
ggtaagggttgcataactaa

SEQ ID NO: 800759 - DNA, 20 bp, mouse
ggcactatccatctactgaa

SEQ ID NO: 800760 - DNA, 20 bp, mouse
ggccaagaggaagacttaga

SEQ ID NO: 800761 - DNA, 20 bp, mouse
gagaccttaatcctgcctag

SEQ ID NO: 800762 - DNA, 20 bp, mouse
gaaagaatccattcagtaga

SEQ ID NO: 800763 - DNA, 20 bp, mouse
gtcattccagcccactaggc

SEQ ID NO: 800764 - DNA, 20 bp, mouse
gttgttcattccagcccact

SEQ ID NO: 800765 - DNA, 20 bp, mouse
gtctggctatccaattctcg

SEQ ID NO: 800766 - DNA, 20 bp, mouse
ggggccatacacatctctgg

SEQ ID NO: 800767 - DNA, 20 bp, mouse
gagtgtacagggatgtcttg

SEQ ID NO: 800768 - DNA, 20 bp, mouse
gtatcaagtgatgttaccac

SEQ ID NO: 800769 - DNA, 20 bp, mouse
gaccccaagcatcaaggtga

SEQ ID NO: 800770 - DNA, 20 bp, mouse
gcacgacacaccaagaaagg

SEQ ID NO: 800771 - DNA, 20 bp, mouse
gacggaagttcctcctttct

SEQ ID NO: 800772 - DNA, 20 bp, mouse
gtcaaggtgaagggagggat

SEQ ID NO: 800773 - DNA, 20 bp, mouse
gagggggccatacacatctc

SEQ ID NO: 800774 - DNA, 20 bp, mouse
gcaagcatcaaggtgaaggg

SEQ ID NO: 800775 - DNA, 20 bp, mouse
gtgctgctttatatagcgta

SEQ ID NO: 800776 - DNA, 20 bp, mouse
ggccctgcgcgggtaactga

SEQ ID NO: 800777 - DNA, 20 bp, mouse
gtctccaggccgcgagggga

SEQ ID NO: 800778 - DNA, 20 bp, mouse
gaggccgcgaggggagggac

SEQ ID NO: 800779 - DNA, 20 bp, mouse
gcacccgcgcccgtgggcac

SEQ ID NO: 800780 - DNA, 20 bp, mouse
ggagggaccgggatgtgcgc

SEQ ID NO: 800781 - DNA, 20 bp, mouse
ggccgcgcgcccacggaatc

SEQ ID NO: 800782 - DNA, 20 bp, mouse
gagtgggcgcccactcgcgg

SEQ ID NO: 800783 - DNA, 20 bp, mouse
gtggaggggcggcgtcgcgc

SEQ ID NO: 800784 - DNA, 20 bp, mouse
ggcgatctgggaggtgactc

SEQ ID NO: 800785 - DNA, 20 bp, mouse
gcgggagctgagggtcaccc

SEQ ID NO: 800786 - DNA, 20 bp, mouse
gccctcgcaagatgtgactt

SEQ ID NO: 800787 - DNA, 20 bp, mouse
gcaagtaagccaccagacta

SEQ ID NO: 800788 - DNA, 20 bp, mouse
ggagaacccgtgtatctcat

SEQ ID NO: 800789 - DNA, 20 bp, mouse
ggggcggggcgtttcctctc

SEQ ID NO: 800790 - DNA, 20 bp, mouse
gtcgagacccatgagataca

SEQ ID NO: 800791 - DNA, 20 bp, mouse
gtggtggcttacttgcctca

SEQ ID NO: 800792 - DNA, 20 bp, mouse
gagggcttggtctcagagat

SEQ ID NO: 800793 - DNA, 20 bp, mouse
ggaaacgccccgccccatgc

SEQ ID NO: 800794 - DNA, 20 bp, mouse
gtcacatcttgcgagggctc

SEQ ID NO: 800795 - DNA, 20 bp, mouse
gaagcagacgagccttagtc

SEQ ID NO: 800796 - DNA, 20 bp, mouse
gcccgcgggtcctgcttctg

SEQ ID NO: 800797 - DNA, 20 bp, mouse
ggggcgggacccgtgagggg

SEQ ID NO: 800798 - DNA, 20 bp, mouse
gaggggatagatcaggtcgt

SEQ ID NO: 800799 - DNA, 20 bp, mouse
gtgggggcgggacccgtgag

SEQ ID NO: 800800 - DNA, 20 bp, mouse
gcccccagaagcaggacccg

SEQ ID NO: 800801 - DNA, 20 bp, mouse
ggacccgtgaggggcgggtc

SEQ ID NO: 800802 - DNA, 20 bp, mouse
ggtcaggccgttgtgcgctt

SEQ ID NO: 800803 - DNA, 20 bp, mouse
ggggggtgtggctcctggaa

SEQ ID NO: 800804 - DNA, 20 bp, mouse
gcggcctgacccgcccctca

SEQ ID NO: 800805 - DNA, 20 bp, mouse
ggagtcggagctcctctctc

SEQ ID NO: 800806 - DNA, 20 bp, mouse
gaacatctgacatgtccaga

SEQ ID NO: 800807 - DNA, 20 bp, mouse
gaaggtaattatacagacag

SEQ ID NO: 800808 - DNA, 20 bp, mouse
ggctgctgcttccagccatc

SEQ ID NO: 800809 - DNA, 20 bp, mouse
gaacagcagaaagagctaca

SEQ ID NO: 800810 - DNA, 20 bp, mouse
gaacactattatcaagtcat

SEQ ID NO: 800811 - DNA, 20 bp, mouse
gaagagaggttttttgaata

SEQ ID NO: 800812 - DNA, 20 bp, mouse
gtctgtataattaccttcta

SEQ ID NO: 800813 - DNA, 20 bp, mouse
gagagcccttagtttgtttc

SEQ ID NO: 800814 - DNA, 20 bp, mouse
ggtagatcatgtctgaagtg

SEQ ID NO: 800815 - DNA, 20 bp, mouse
gaatgccttgctgataaaag

SEQ ID NO: 800816 - DNA, 20 bp, mouse
gtacctcgctgggcaaaagg

SEQ ID NO: 800817 - DNA, 20 bp, mouse
gctggctgttggtgcttgca

SEQ ID NO: 800818 - DNA, 20 bp, mouse
gggcaaaaggaggctcctgc

SEQ ID NO: 800819 - DNA, 20 bp, mouse
gtgtgcaaccgagggtgcgt

SEQ ID NO: 800820 - DNA, 20 bp, mouse
ggcaaccgagggtgcgttgg

SEQ ID NO: 800821 - DNA, 20 bp, mouse
gaacactccaggtacctcgc

SEQ ID NO: 800822 - DNA, 20 bp, mouse
gcataagcctgggacataga

SEQ ID NO: 800823 - DNA, 20 bp, mouse
gttgtggagcagacagtctg

SEQ ID NO: 800824 - DNA, 20 bp, mouse
gaacacatgccccatgtcca

SEQ ID NO: 800825 - DNA, 20 bp, mouse
gtgggcatgctgtgtcacga

SEQ ID NO: 800826 - DNA, 20 bp, mouse
ggcagcgaggggagtctgaa

SEQ ID NO: 800827 - DNA, 20 bp, mouse
gtgaaggggtggggcacgac

SEQ ID NO: 800828 - DNA, 20 bp, mouse
gcccccaaggtcggagactt

SEQ ID NO: 800829 - DNA, 20 bp, mouse
ggccccgtgcgcttgagatg

SEQ ID NO: 800830 - DNA, 20 bp, mouse
gggcctcatctcaagcgcac

SEQ ID NO: 800831 - DNA, 20 bp, mouse
ggggctgggcgttgggaggg

SEQ ID NO: 800832 - DNA, 20 bp, mouse
gcaccccaagtctccgacct

SEQ ID NO: 800833 - DNA, 20 bp, mouse
ggcacgactggtagccccca

SEQ ID NO: 800834 - DNA, 20 bp, mouse
gacaggagaggtttggtagg

SEQ ID NO: 800835 - DNA, 20 bp, mouse
gcgccgaccaataagagagt

SEQ ID NO: 800836 - DNA, 20 bp, mouse
gcgggcgggcacgccgggaa

SEQ ID NO: 800837 - DNA, 20 bp, mouse
gccccgcgcagccggaggtg

SEQ ID NO: 800838 - DNA, 20 bp, mouse
gacactgtgagctctgtcgc

SEQ ID NO: 800839 - DNA, 20 bp, mouse
gaggggctgcgcctgtctcc

SEQ ID NO: 800840 - DNA, 20 bp, mouse
gcggctctggcgacagcagt

SEQ ID NO: 800841 - DNA, 20 bp, mouse
ggctgtcgccagagccgcct

SEQ ID NO: 800842 - DNA, 20 bp, mouse
ggcccctcgccccgcgcagc

SEQ ID NO: 800843 - DNA, 20 bp, mouse
ggaggcgtcctcccctcccg

SEQ ID NO: 800844 - DNA, 20 bp, mouse
gcctcgccccgcgcagccgg

SEQ ID NO: 800845 - DNA, 20 bp, mouse
gcgttgagggtcggggtcag

SEQ ID NO: 800846 - DNA, 20 bp, mouse
gggagcttcagtaatgtgaa

SEQ ID NO: 800847 - DNA, 20 bp, mouse
gtggccttcaagataaaagc

SEQ ID NO: 800848 - DNA, 20 bp, mouse
gctttctctgcgggcttgaa

SEQ ID NO: 800849 - DNA, 20 bp, mouse
gtggtgctgtcatttaccaa

SEQ ID NO: 800850 - DNA, 20 bp, mouse
gcaagacattttatgtcctt

SEQ ID NO: 800851 - DNA, 20 bp, mouse
gaaaacaaatcggaatcttt

SEQ ID NO: 800852 - DNA, 20 bp, mouse
gtcttgtactgaattgttga

SEQ ID NO: 800853 - DNA, 20 bp, mouse
gaaagtgatctaaaacaaat

SEQ ID NO: 800854 - DNA, 20 bp, mouse
gataccagcttttatcttga

SEQ ID NO: 800855 - DNA, 20 bp, mouse
gacatttgcaaaaccgcttc

SEQ ID NO: 800856 - DNA, 20 bp, mouse
ggtggcatggtgaccctgag

SEQ ID NO: 800857 - DNA, 20 bp, mouse
ggggtgagtcgtacagagag

SEQ ID NO: 800858 - DNA, 20 bp, mouse
gccagccgcgggtggggcac

SEQ ID NO: 800859 - DNA, 20 bp, mouse
gggctcgccaggattagaag

SEQ ID NO: 800860 - DNA, 20 bp, mouse
ggacacgccagccgcgggtg

SEQ ID NO: 800861 - DNA, 20 bp, mouse
gtgcccgaaagggaggttca

SEQ ID NO: 800862 - DNA, 20 bp, mouse
gcggctggcgtgtcgtcccg

SEQ ID NO: 800863 - DNA, 20 bp, mouse
gccgcggggcggggcactgc

SEQ ID NO: 800864 - DNA, 20 bp, mouse
ggtgtcgtcccgcggtagcg

SEQ ID NO: 800865 - DNA, 20 bp, mouse
gtcccccacgcgcaaggggt

SEQ ID NO: 800866 - DNA, 20 bp, mouse
gagtcacggcagcccccgaa

SEQ ID NO: 800867 - DNA, 20 bp, mouse
gccgaagggcctggaagcga

SEQ ID NO: 800868 - DNA, 20 bp, mouse
gccccggcctgtggcagtca

SEQ ID NO: 800869 - DNA, 20 bp, mouse
gtcccggcctcaaacagctg

SEQ ID NO: 800870 - DNA, 20 bp, mouse
ggctgcagacggcacgaggg

SEQ ID NO: 800871 - DNA, 20 bp, mouse
gagcgcgccgcgggctttta

SEQ ID NO: 800872 - DNA, 20 bp, mouse
gtacccatggacaagagtgc

SEQ ID NO: 800873 - DNA, 20 bp, mouse
ggccccaagagagcgcggat

SEQ ID NO: 800874 - DNA, 20 bp, mouse
ggcggagtcgccccggcctg

SEQ ID NO: 800875 - DNA, 20 bp, mouse
ggggctgccgtgactgccac

SEQ ID NO: 800876 - DNA, 20 bp, mouse
ggtactccctagtcccaaat

SEQ ID NO: 800877 - DNA, 20 bp, mouse
gaaacgcaggaaagggcggg

SEQ ID NO: 800878 - DNA, 20 bp, mouse
gctggggcagggcaatcccc

SEQ ID NO: 800879 - DNA, 20 bp, mouse
gagacccagaaacgcaggaa

SEQ ID NO: 800880 - DNA, 20 bp, mouse
ggcgtgctgccgccagaagg

SEQ ID NO: 800881 - DNA, 20 bp, mouse
ggctgcgtgctgccgccaga

SEQ ID NO: 800882 - DNA, 20 bp, mouse
gagcttagacccagaaacgc

SEQ ID NO: 800883 - DNA, 20 bp, mouse
gggtggcagagagccagcgc

SEQ ID NO: 800884 - DNA, 20 bp, mouse
ggccagaaggaggcgagcca

SEQ ID NO: 800885 - DNA, 20 bp, mouse
ggcgctcgctcgctttcctg

SEQ ID NO: 800886 - DNA, 20 bp, mouse
gacaacttgtaacccaggga

SEQ ID NO: 800887 - DNA, 20 bp, mouse
gtatgcaaatacccgtccct

SEQ ID NO: 800888 - DNA, 20 bp, mouse
gcaaagaattgtgggttcct

SEQ ID NO: 800889 - DNA, 20 bp, mouse
gtttaagtcctgctagtctc

SEQ ID NO: 800890 - DNA, 20 bp, mouse
ggctgaaggtacatgacagc

SEQ ID NO: 800891 - DNA, 20 bp, mouse
gtgactgatcttcaagctga

SEQ ID NO: 800892 - DNA, 20 bp, mouse
ggataaaacctgagactagc

SEQ ID NO: 800893 - DNA, 20 bp, mouse
gaatgacaacttgtaaccca

SEQ ID NO: 800894 - DNA, 20 bp, mouse
gtcacaaaatcaaaaaatag

SEQ ID NO: 800895 - DNA, 20 bp, mouse
gaacgtgattattaagcaca

SEQ ID NO: 800896 - DNA, 20 bp, mouse
gtggggaagggctgttgcgg

SEQ ID NO: 800897 - DNA, 20 bp, mouse
gcacggctcctggtggggaa

SEQ ID NO: 800898 - DNA, 20 bp, mouse
gctctgcggtccttcgctgt

SEQ ID NO: 800899 - DNA, 20 bp, mouse
ggctacaggcgtctgaccta

SEQ ID NO: 800900 - DNA, 20 bp, mouse
ggcagatcctcccacagcga

SEQ ID NO: 800901 - DNA, 20 bp, mouse
gttagggtaactgtaatctg

SEQ ID NO: 800902 - DNA, 20 bp, mouse
gtgggccaggggtggcggct

SEQ ID NO: 800903 - DNA, 20 bp, mouse
gagatcgcacggctcctggt

SEQ ID NO: 800904 - DNA, 20 bp, mouse
gtaccctaaaatgtgtgttc

SEQ ID NO: 800905 - DNA, 20 bp, mouse
gtgcggtccttcgctgtggg

SEQ ID NO: 800906 - DNA, 20 bp, mouse
gaggctgcagggccatagtg

SEQ ID NO: 800907 - DNA, 20 bp, mouse
gctgacgcgggccagatccg

SEQ ID NO: 800908 - DNA, 20 bp, mouse
ggccagatccggggaggcgt

SEQ ID NO: 800909 - DNA, 20 bp, mouse
gggtgaggctgctgaagcta

SEQ ID NO: 800910 - DNA, 20 bp, mouse
gacgcgggccagatccgggg

SEQ ID NO: 800911 - DNA, 20 bp, mouse
gccgcccgcccgggagacgc

SEQ ID NO: 800912 - DNA, 20 bp, mouse
gaaccagcgcgggccaatca

SEQ ID NO: 800913 - DNA, 20 bp, mouse
gctccggagtgggcccatga

SEQ ID NO: 800914 - DNA, 20 bp, mouse
gacgcaggcgaggtgcagaa

SEQ ID NO: 800915 - DNA, 20 bp, mouse
gggcccgcgtcagccaagtc

SEQ ID NO: 800916 - DNA, 20 bp, mouse
ggggatgcaaatggacccag

SEQ ID NO: 800917 - DNA, 20 bp, mouse
gccagccctcagaaagggtg

SEQ ID NO: 800918 - DNA, 20 bp, mouse
ggcagcgcgccgcagcagag

SEQ ID NO: 800919 - DNA, 20 bp, mouse
gagaaacaactgacgcatca

SEQ ID NO: 800920 - DNA, 20 bp, mouse
gcgtgctgaaaaatattcat

SEQ ID NO: 800921 - DNA, 20 bp, mouse
ggagaagccattcgcaaagt

SEQ ID NO: 800922 - DNA, 20 bp, mouse
gtatatgcctactttgcgaa

SEQ ID NO: 800923 - DNA, 20 bp, mouse
gtgcagacctgtcatctgat

SEQ ID NO: 800924 - DNA, 20 bp, mouse
gcgaatggcttctctccgct

SEQ ID NO: 800925 - DNA, 20 bp, mouse
gagagctggtactaagatcg

SEQ ID NO: 800926 - DNA, 20 bp, mouse
gctgacttcaggcactgctg

SEQ ID NO: 800927 - DNA, 20 bp, mouse
gtgctggggcatgtttctgg

SEQ ID NO: 800928 - DNA, 20 bp, mouse
gcagcctgggcgaaaattgt

SEQ ID NO: 800929 - DNA, 20 bp, mouse
gagcagtttgccttcggtgg

SEQ ID NO: 800930 - DNA, 20 bp, mouse
gcactgctggggcatgtttc

SEQ ID NO: 800931 - DNA, 20 bp, mouse
ggactcccagcccccaccga

SEQ ID NO: 800932 - DNA, 20 bp, mouse
gaaagcccacatcgtcgttc

SEQ ID NO: 800933 - DNA, 20 bp, mouse
gctgggcgaaaattgtgggc

SEQ ID NO: 800934 - DNA, 20 bp, mouse
ggggagtctttcctgacttc

SEQ ID NO: 800935 - DNA, 20 bp, mouse
gggcagatctgaaatggctc

SEQ ID NO: 800936 - DNA, 20 bp, mouse
ggccgcccggggtacggatc

SEQ ID NO: 800937 - DNA, 20 bp, mouse
gccgccaggctcacctgtcc

SEQ ID NO: 800938 - DNA, 20 bp, mouse
gaggccctgtgcagcaagcg

SEQ ID NO: 800939 - DNA, 20 bp, mouse
ggacacctgagcacgttctt

SEQ ID NO: 800940 - DNA, 20 bp, mouse
gcagctacctagaaaactga

SEQ ID NO: 800941 - DNA, 20 bp, mouse
ggcgacctaagaacgtgctc

SEQ ID NO: 800942 - DNA, 20 bp, mouse
ggggtcccgctcatagcgcg

SEQ ID NO: 800943 - DNA, 20 bp, mouse
ggcctgatccgtaccccggg

SEQ ID NO: 800944 - DNA, 20 bp, mouse
ggcacctgggcgcccgcacc

SEQ ID NO: 800945 - DNA, 20 bp, mouse
gcgcccccgggcggagttct

SEQ ID NO: 800946 - DNA, 20 bp, mouse
gacagggcctgtgctcccga

SEQ ID NO: 800947 - DNA, 20 bp, mouse
gtcgccgccgccacacccct

SEQ ID NO: 800948 - DNA, 20 bp, mouse
gcgaaggtgccggctcggac

SEQ ID NO: 800949 - DNA, 20 bp, mouse
ggggaggccggggacaccca

SEQ ID NO: 800950 - DNA, 20 bp, mouse
gcagggacgcccgaaggtgc

SEQ ID NO: 800951 - DNA, 20 bp, mouse
gcaggcctgcggcggcgcgt

SEQ ID NO: 800952 - DNA, 20 bp, mouse
gaagccgagcccgtccgagc

SEQ ID NO: 800953 - DNA, 20 bp, mouse
ggaggaggcgacagtcacgt

SEQ ID NO: 800954 - DNA, 20 bp, mouse
gacgcccgaaggtgccggct

SEQ ID NO: 800955 - DNA, 20 bp, mouse
gtcgactggtcccagtcccc

SEQ ID NO: 800956 - DNA, 20 bp, mouse
gctggcgagccgtggaggga

SEQ ID NO: 800957 - DNA, 20 bp, mouse
gcagacgcacggagtcggtc

SEQ ID NO: 800958 - DNA, 20 bp, mouse
gaggtctggcgagccgtgga

SEQ ID NO: 800959 - DNA, 20 bp, mouse
gaaagcctgcgctgcaaggt

SEQ ID NO: 800960 - DNA, 20 bp, mouse
gactggcagacgcacggagt

SEQ ID NO: 800961 - DNA, 20 bp, mouse
ggccccccaccttgcagcgc

SEQ ID NO: 800962 - DNA, 20 bp, mouse
gcggctcgccagacctggaa

SEQ ID NO: 800963 - DNA, 20 bp, mouse
gtggataagtgcataaactg

SEQ ID NO: 800964 - DNA, 20 bp, mouse
gcgtggccccgcacattgat

SEQ ID NO: 800965 - DNA, 20 bp, mouse
gcctctcggcatggattgac

SEQ ID NO: 800966 - DNA, 20 bp, mouse
gcacaccaaggcaggagcgt

SEQ ID NO: 800967 - DNA, 20 bp, mouse
gcgggatggcaatgtctgtg

SEQ ID NO: 800968 - DNA, 20 bp, mouse
ggaggaccgcaggctccaac

SEQ ID NO: 800969 - DNA, 20 bp, mouse
ggatgcgcagccacgcagtt

SEQ ID NO: 800970 - DNA, 20 bp, mouse
gtgactgcggtcatcaacct

SEQ ID NO: 800971 - DNA, 20 bp, mouse
ggagggagcggggaggcaga

SEQ ID NO: 800972 - DNA, 20 bp, mouse
gctacctccggagcggctgg

SEQ ID NO: 800973 - DNA, 20 bp, mouse
gccaagcgctacctccggag

SEQ ID NO: 800974 - DNA, 20 bp, mouse
gaccgcaggctccaacggga

SEQ ID NO: 800975 - DNA, 20 bp, mouse
gcctgccttggtgtggtcag

SEQ ID NO: 800976 - DNA, 20 bp, mouse
gcagagcagctgctgtgggc

SEQ ID NO: 800977 - DNA, 20 bp, mouse
gaaggagctgcaggttagtg

SEQ ID NO: 800978 - DNA, 20 bp, mouse
gtctgcacgcccatcctcat

SEQ ID NO: 800979 - DNA, 20 bp, mouse
ggaggctgcactgaggagca

SEQ ID NO: 800980 - DNA, 20 bp, mouse
gctgccccccagccaagagt

SEQ ID NO: 800981 - DNA, 20 bp, mouse
gtggctgaaaatccagggaa

SEQ ID NO: 800982 - DNA, 20 bp, mouse
gaaggcgcaggatgcatgcc

SEQ ID NO: 800983 - DNA, 20 bp, mouse
ggtgtcctgccaatgaggat

SEQ ID NO: 800984 - DNA, 20 bp, mouse
gctgcagccaaaggagctgc

SEQ ID NO: 800985 - DNA, 20 bp, mouse
gaagacaggccccctcctcc

SEQ ID NO: 800986 - DNA, 20 bp, mouse
gtccacctggaccaaacctc

SEQ ID NO: 800987 - DNA, 20 bp, mouse
gggtgcgagggagagtcgag

SEQ ID NO: 800988 - DNA, 20 bp, mouse
ggggctcccacctgccacca

SEQ ID NO: 800989 - DNA, 20 bp, mouse
gcctacctgaggtttggtcc

SEQ ID NO: 800990 - DNA, 20 bp, mouse
gcaggtaggaaggccagatc

SEQ ID NO: 800991 - DNA, 20 bp, mouse
ggcgctgctcgctgattggt

SEQ ID NO: 800992 - DNA, 20 bp, mouse
gttaacaggctcacacacct

SEQ ID NO: 800993 - DNA, 20 bp, mouse
gggcggcgtccggctccacc

SEQ ID NO: 800994 - DNA, 20 bp, mouse
gtgcatgtcggcgggtgcga

SEQ ID NO: 800995 - DNA, 20 bp, mouse
ggggagagtcgaggggtgga

SEQ ID NO: 800996 - DNA, 20 bp, mouse
gcccccgggccaggggtagg

SEQ ID NO: 800997 - DNA, 20 bp, mouse
gtatcatggtagggagaaga

SEQ ID NO: 800998 - DNA, 20 bp, mouse
gagcccaggtagatcaagtg

SEQ ID NO: 800999 - DNA, 20 bp, mouse
gaccctgtaggcaacagagt

SEQ ID NO: 801000 - DNA, 20 bp, mouse
gcgcagcccatgctagtgaa

SEQ ID NO: 801001 - DNA, 20 bp, mouse
gttccagaattatcatggta

SEQ ID NO: 801002 - DNA, 20 bp, mouse
gagccccgggcctggactgg

SEQ ID NO: 801003 - DNA, 20 bp, mouse
gtagggtggctcggaagtct

SEQ ID NO: 801004 - DNA, 20 bp, mouse
gcaagctgggcccctgaaat

SEQ ID NO: 801005 - DNA, 20 bp, mouse
gcccatgctagtgaagggaa

SEQ ID NO: 801006 - DNA, 20 bp, mouse
ggaaggtcttagacagactt

SEQ ID NO: 801007 - DNA, 20 bp, mouse
gtatggactgagtataggat

SEQ ID NO: 801008 - DNA, 20 bp, mouse
gactgagtataggatgggtc

SEQ ID NO: 801009 - DNA, 20 bp, mouse
gcagacctaaatgtgaagga

SEQ ID NO: 801010 - DNA, 20 bp, mouse
gtgggtctggtttattcagg

SEQ ID NO: 801011 - DNA, 20 bp, mouse
gggtgcagacctaaatgtga

SEQ ID NO: 801012 - DNA, 20 bp, mouse
ggtctgtctaagaccttcta

SEQ ID NO: 801013 - DNA, 20 bp, mouse
gtctctcttaccccatctct

SEQ ID NO: 801014 - DNA, 20 bp, mouse
gcatactctctctttagcat

SEQ ID NO: 801015 - DNA, 20 bp, mouse
gaggagacatattttatgaa

SEQ ID NO: 801016 - DNA, 20 bp, mouse
gtcccatacaatgtagaatg

SEQ ID NO: 801017 - DNA, 20 bp, mouse
gtaccacattctacattgta

SEQ ID NO: 801018 - DNA, 20 bp, mouse
gcagaatctagcatttccat

SEQ ID NO: 801019 - DNA, 20 bp, mouse
gaagcactgaatattctact

SEQ ID NO: 801020 - DNA, 20 bp, mouse
gcacagagttcagagcatca

SEQ ID NO: 801021 - DNA, 20 bp, mouse
gcttctctctgtgtgaaatt

SEQ ID NO: 801022 - DNA, 20 bp, mouse
gagtgagtgatgaacagaat

SEQ ID NO: 801023 - DNA, 20 bp, mouse
gatagtgttgataagagcag

SEQ ID NO: 801024 - DNA, 20 bp, mouse
ggttaaaacgctccacccaa

SEQ ID NO: 801025 - DNA, 20 bp, mouse
gggttgtatgaaaacaaata

SEQ ID NO: 801026 - DNA, 20 bp, mouse
gttgttgctaagggttgaat

SEQ ID NO: 801027 - DNA, 20 bp, mouse
gtagctagaggaagccgaaa

SEQ ID NO: 801028 - DNA, 20 bp, mouse
ggaaaaggcagtacgaagca

SEQ ID NO: 801029 - DNA, 20 bp, mouse
gagcgctacgcattagctag

SEQ ID NO: 801030 - DNA, 20 bp, mouse
gccgacacccttgttgctaa

SEQ ID NO: 801031 - DNA, 20 bp, mouse
ggaagtggagcctgcggaat

SEQ ID NO: 801032 - DNA, 20 bp, mouse
ggtgtagtctaccaagtgga

SEQ ID NO: 801033 - DNA, 20 bp, mouse
gacagcgcatgagtcgccta

SEQ ID NO: 801034 - DNA, 20 bp, mouse
ggtgccggaagttgagtctc

SEQ ID NO: 801035 - DNA, 20 bp, mouse
gacgagcgcgggagtacgtg

SEQ ID NO: 801036 - DNA, 20 bp, mouse
gtaagagcggaggactccac

SEQ ID NO: 801037 - DNA, 20 bp, mouse
gcagcccgcacaacacccgt

SEQ ID NO: 801038 - DNA, 20 bp, mouse
gtgcgtgcaacgcgcgtgga

SEQ ID NO: 801039 - DNA, 20 bp, mouse
gacaactcccggcctccttt

SEQ ID NO: 801040 - DNA, 20 bp, mouse
gtcctttgggcgggtaagag

SEQ ID NO: 801041 - DNA, 20 bp, mouse
gtacccgcccaaaggaggcc

SEQ ID NO: 801042 - DNA, 20 bp, mouse
ggggggaaggcccaatcccg

SEQ ID NO: 801043 - DNA, 20 bp, mouse
gtttgggcgggtaagagcgg

SEQ ID NO: 801044 - DNA, 20 bp, mouse
gtggggcggtgcttgaggag

SEQ ID NO: 801045 - DNA, 20 bp, mouse
gcggaggactccacgggatt

SEQ ID NO: 801046 - DNA, 20 bp, mouse
gccagcgcgccagtgagcga

SEQ ID NO: 801047 - DNA, 20 bp, mouse
gcagcctccgtctccctcca

SEQ ID NO: 801048 - DNA, 20 bp, mouse
gctcgcgccaaggagctctc

SEQ ID NO: 801049 - DNA, 20 bp, mouse
ggttacgcccgctggctcta

SEQ ID NO: 801050 - DNA, 20 bp, mouse
gggcgcgaggcgcggtggct

SEQ ID NO: 801051 - DNA, 20 bp, mouse
ggaggcgcggtggctcggaa

SEQ ID NO: 801052 - DNA, 20 bp, mouse
gtccttggcgcgaggcgcgg

SEQ ID NO: 801053 - DNA, 20 bp, mouse
gtgggagaggatcgggtcaa

SEQ ID NO: 801054 - DNA, 20 bp, mouse
gaaggagctctcgggttcgt

SEQ ID NO: 801055 - DNA, 20 bp, mouse
gggtaagcggagtgggatcg

SEQ ID NO: 801056 - DNA, 20 bp, mouse
gcagccggaggtcttcccgg

SEQ ID NO: 801057 - DNA, 20 bp, mouse
gggggcggccgcctgactca

SEQ ID NO: 801058 - DNA, 20 bp, mouse
ggagcccgactcccagctac

SEQ ID NO: 801059 - DNA, 20 bp, mouse
gcaggggcagcacaagatga

SEQ ID NO: 801060 - DNA, 20 bp, mouse
ggacctccaaagcaagaggg

SEQ ID NO: 801061 - DNA, 20 bp, mouse
gttcccggaggaggcgcccg

SEQ ID NO: 801062 - DNA, 20 bp, mouse
gcaaagcaagagggtggcgt

SEQ ID NO: 801063 - DNA, 20 bp, mouse
ggacacctgtagctgggagt

SEQ ID NO: 801064 - DNA, 20 bp, mouse
gtgggaatgccacgggccga

SEQ ID NO: 801065 - DNA, 20 bp, mouse
gcgcactggcacatcactga

SEQ ID NO: 801066 - DNA, 20 bp, mouse
gcggcccgcggcttctgcct

SEQ ID NO: 801067 - DNA, 20 bp, mouse
gtgtgtgggcggtgcttcgg

SEQ ID NO: 801068 - DNA, 20 bp, mouse
gtgtgggcggggcctcattg

SEQ ID NO: 801069 - DNA, 20 bp, mouse
ggactccaggagcctcgact

SEQ ID NO: 801070 - DNA, 20 bp, mouse
gcagcaggagctacaagccc

SEQ ID NO: 801071 - DNA, 20 bp, mouse
gtagctgcagcgatcgatcg

SEQ ID NO: 801072 - DNA, 20 bp, mouse
gggggggcgtggtcggcccg

SEQ ID NO: 801073 - DNA, 20 bp, mouse
gaagcccaggcagaagccgc

SEQ ID NO: 801074 - DNA, 20 bp, mouse
ggtgcttcggggggcgtggt

SEQ ID NO: 801075 - DNA, 20 bp, mouse
gtcgaggctcctggagtcaa

SEQ ID NO: 801076 - DNA, 20 bp, mouse
ggggtcgagctgttcggtgg

SEQ ID NO: 801077 - DNA, 20 bp, mouse
gccaactcgacgcactgcct

SEQ ID NO: 801078 - DNA, 20 bp, mouse
gtctgggtcgagctgttcgg

SEQ ID NO: 801079 - DNA, 20 bp, mouse
gtggtgcaagagctggacgc

SEQ ID NO: 801080 - DNA, 20 bp, mouse
gtggacgcaggcagtggttc

SEQ ID NO: 801081 - DNA, 20 bp, mouse
gaggctgcctaagagggtat

SEQ ID NO: 801082 - DNA, 20 bp, mouse
ggaacctggggcttcgttgc

SEQ ID NO: 801083 - DNA, 20 bp, mouse
gaagagctggacgcaggcag

SEQ ID NO: 801084 - DNA, 20 bp, mouse
gctgccagctatggcctact

SEQ ID NO: 801085 - DNA, 20 bp, mouse
gtgctgcaggctgccagcta

SEQ ID NO: 801086 - DNA, 20 bp, mouse
gccctggcacagacccaagt

SEQ ID NO: 801087 - DNA, 20 bp, mouse
gcacagacccaagtaggagg

SEQ ID NO: 801088 - DNA, 20 bp, mouse
gacaggacggcaggacaagg

SEQ ID NO: 801089 - DNA, 20 bp, mouse
gcctgctaggcagtcttccc

SEQ ID NO: 801090 - DNA, 20 bp, mouse
gtcctggcctcctcctactt

SEQ ID NO: 801091 - DNA, 20 bp, mouse
ggccaggactcattcatcca

SEQ ID NO: 801092 - DNA, 20 bp, mouse
ggggaaaggtctgctctggt

SEQ ID NO: 801093 - DNA, 20 bp, mouse
gttcatccagggccaaccca

SEQ ID NO: 801094 - DNA, 20 bp, mouse
gacccaagtaggaggaggcc

SEQ ID NO: 801095 - DNA, 20 bp, mouse
gtagcaggctggcccggctt

SEQ ID NO: 801096 - DNA, 20 bp, mouse
ggcaacgcagtccccatctc

SEQ ID NO: 801097 - DNA, 20 bp, mouse
ggctcctcccgcccggagat

SEQ ID NO: 801098 - DNA, 20 bp, mouse
ggcagtccccatctccgggc

SEQ ID NO: 801099 - DNA, 20 bp, mouse
gcaccccggaggagtccgtg

SEQ ID NO: 801100 - DNA, 20 bp, mouse
gcgaacagagagaggtctta

SEQ ID NO: 801101 - DNA, 20 bp, mouse
gctgccagacaggagcggag

SEQ ID NO: 801102 - DNA, 20 bp, mouse
ggcagcagattgtgtgacgg

SEQ ID NO: 801103 - DNA, 20 bp, mouse
gaggtcttaagggtggctgg

SEQ ID NO: 801104 - DNA, 20 bp, mouse
gtgtgacggaggcagaagcg

SEQ ID NO: 801105 - DNA, 20 bp, mouse
ggaagcagcagattgtgtga

SEQ ID NO: 801106 - DNA, 20 bp, mouse
gtggcagctggggcacagtt

SEQ ID NO: 801107 - DNA, 20 bp, mouse
gccaacctcgagctgagggg

SEQ ID NO: 801108 - DNA, 20 bp, mouse
gggggaagctcacacatcac

SEQ ID NO: 801109 - DNA, 20 bp, mouse
gcctgccaacctcgagctga

SEQ ID NO: 801110 - DNA, 20 bp, mouse
ggtgaggccccgccccccgg

SEQ ID NO: 801111 - DNA, 20 bp, mouse
gaaacaggacctgacctgcg

SEQ ID NO: 801112 - DNA, 20 bp, mouse
ggtactcgcccctttaaacc

SEQ ID NO: 801113 - DNA, 20 bp, mouse
ggagcagcacggcctccggg

SEQ ID NO: 801114 - DNA, 20 bp, mouse
gtctcacaccaggtttaaag

SEQ ID NO: 801115 - DNA, 20 bp, mouse
gggtgcctcagcggggccat

SEQ ID NO: 801116 - DNA, 20 bp, mouse
gacgggacgcgcagaagttg

SEQ ID NO: 801117 - DNA, 20 bp, mouse
gggccccgcgggactctcgc

SEQ ID NO: 801118 - DNA, 20 bp, mouse
gcaaccggcgagagtcccgc

SEQ ID NO: 801119 - DNA, 20 bp, mouse
gcacccgaacagggcgggaa

SEQ ID NO: 801120 - DNA, 20 bp, mouse
ggcctcgggctctacccaac

SEQ ID NO: 801121 - DNA, 20 bp, mouse
gggaaaggccaggcatcgac

SEQ ID NO: 801122 - DNA, 20 bp, mouse
gcgagcccagtacccctaga

SEQ ID NO: 801123 - DNA, 20 bp, mouse
gtctcccagttcacccgaac

SEQ ID NO: 801124 - DNA, 20 bp, mouse
gaaaggaccgggacactggg

SEQ ID NO: 801125 - DNA, 20 bp, mouse
gggtgggtagctcaagtcgg

SEQ ID NO: 801126 - DNA, 20 bp, mouse
gtagctcggagggatgtcat

SEQ ID NO: 801127 - DNA, 20 bp, mouse
gaacaggaatccagccagga

SEQ ID NO: 801128 - DNA, 20 bp, mouse
gcctgttgggagcttctact

SEQ ID NO: 801129 - DNA, 20 bp, mouse
gcgggctggcctagctcgga

SEQ ID NO: 801130 - DNA, 20 bp, mouse
ggcccacttgaaggagcgat

SEQ ID NO: 801131 - DNA, 20 bp, mouse
gcggggctctgtgctcagtt

SEQ ID NO: 801132 - DNA, 20 bp, mouse
gtcccaacaggaatccagcc

SEQ ID NO: 801133 - DNA, 20 bp, mouse
ggccacaggaacaagtctaa

SEQ ID NO: 801134 - DNA, 20 bp, mouse
gcggacttataggaattctc

SEQ ID NO: 801135 - DNA, 20 bp, mouse
gcagcctgagataagacctt

SEQ ID NO: 801136 - DNA, 20 bp, mouse
ggaaactccgtcttctattg

SEQ ID NO: 801137 - DNA, 20 bp, mouse
gaacgcgcgggggagcgtcg

SEQ ID NO: 801138 - DNA, 20 bp, mouse
ggggccgcgcgcggtcacgt

SEQ ID NO: 801139 - DNA, 20 bp, mouse
gaaaaagcggcggaagtagg

SEQ ID NO: 801140 - DNA, 20 bp, mouse
gtcccagcccggaacgcgcg

SEQ ID NO: 801141 - DNA, 20 bp, mouse
gctgccgcgcgatgacgcaa

SEQ ID NO: 801142 - DNA, 20 bp, mouse
gaggcgtgaagcacggtgat

SEQ ID NO: 801143 - DNA, 20 bp, mouse
ggcggcggaagtaggtggga

SEQ ID NO: 801144 - DNA, 20 bp, mouse
ggcgggaggcggcgcagacg

SEQ ID NO: 801145 - DNA, 20 bp, mouse
ggtcacgtgggtgtgttgtt

SEQ ID NO: 801146 - DNA, 20 bp, mouse
gcggctgtacgcaagggagc

SEQ ID NO: 801147 - DNA, 20 bp, mouse
ggggaggggacaagacgagc

SEQ ID NO: 801148 - DNA, 20 bp, mouse
gggtctattagaatagagga

SEQ ID NO: 801149 - DNA, 20 bp, mouse
gacacagcggctgtacgcaa

SEQ ID NO: 801150 - DNA, 20 bp, mouse
gggcggagtcacccacagga

SEQ ID NO: 801151 - DNA, 20 bp, mouse
gacgcaagggagctgggcga

SEQ ID NO: 801152 - DNA, 20 bp, mouse
ggacgagcgggatacctagc

SEQ ID NO: 801153 - DNA, 20 bp, mouse
ggagtcacccacaggaggga

SEQ ID NO: 801154 - DNA, 20 bp, mouse
gagcgggatacctagccggg

SEQ ID NO: 801155 - DNA, 20 bp, mouse
gggcccgcccttccctcctg

SEQ ID NO: 801156 - DNA, 20 bp, mouse
ggcccggggcggggtgacgg

SEQ ID NO: 801157 - DNA, 20 bp, mouse
ggccccgcgtggagcagacg

SEQ ID NO: 801158 - DNA, 20 bp, mouse
ggcgctgcgggacccacccc

SEQ ID NO: 801159 - DNA, 20 bp, mouse
gcccgggcggcgggtcccgg

SEQ ID NO: 801160 - DNA, 20 bp, mouse
gtccagggagggctcggagt

SEQ ID NO: 801161 - DNA, 20 bp, mouse
gggccccggcggggctcgag

SEQ ID NO: 801162 - DNA, 20 bp, mouse
gccgccccgggctcccaccc

SEQ ID NO: 801163 - DNA, 20 bp, mouse
gcgggacccacccccggccc

SEQ ID NO: 801164 - DNA, 20 bp, mouse
ggccgggagggcgggtaagg

SEQ ID NO: 801165 - DNA, 20 bp, mouse
gaggccgcgtctgctccacg

SEQ ID NO: 801166 - DNA, 20 bp, mouse
ggggccaaggtgacatcggg

SEQ ID NO: 801167 - DNA, 20 bp, mouse
ggctgccaccggggcctaat

SEQ ID NO: 801168 - DNA, 20 bp, mouse
gaggccaccagactgacatg

SEQ ID NO: 801169 - DNA, 20 bp, mouse
gagatgggataggtgagttc

SEQ ID NO: 801170 - DNA, 20 bp, mouse
ggggcctaattggcttgcag

SEQ ID NO: 801171 - DNA, 20 bp, mouse
ggcccctctgcaagccaatt

SEQ ID NO: 801172 - DNA, 20 bp, mouse
gaatcccactgctgccaccg

SEQ ID NO: 801173 - DNA, 20 bp, mouse
gccaccagactgacatgggg

SEQ ID NO: 801174 - DNA, 20 bp, mouse
gtggggactggataagtcag

SEQ ID NO: 801175 - DNA, 20 bp, mouse
gccaaggtgacatcgggtgg

SEQ ID NO: 801176 - DNA, 20 bp, mouse
gccccaccctgcttgcttaa

SEQ ID NO: 801177 - DNA, 20 bp, mouse
gcagacgcgtggagcatgac

SEQ ID NO: 801178 - DNA, 20 bp, mouse
ggggcgctggccagtcatgg

SEQ ID NO: 801179 - DNA, 20 bp, mouse
ggttaagcgtctagctctca

SEQ ID NO: 801180 - DNA, 20 bp, mouse
gggggagcgcgagcgaacga

SEQ ID NO: 801181 - DNA, 20 bp, mouse
gagtgcgcacgcgtaataca

SEQ ID NO: 801182 - DNA, 20 bp, mouse
ggggcggggagcgacgtgcg

SEQ ID NO: 801183 - DNA, 20 bp, mouse
ggagcatgacgggaacaccg

SEQ ID NO: 801184 - DNA, 20 bp, mouse
gaacgagggcgggcggtggc

SEQ ID NO: 801185 - DNA, 20 bp, mouse
ggagcgcgagcgaacgaggg

SEQ ID NO: 801186 - DNA, 20 bp, mouse
gtctcccagccccgcggaca

SEQ ID NO: 801187 - DNA, 20 bp, mouse
ggtcgcccgctgcagtccga

SEQ ID NO: 801188 - DNA, 20 bp, mouse
gctgggagaggcgttgactg

SEQ ID NO: 801189 - DNA, 20 bp, mouse
gctcagagaggctgcgacga

SEQ ID NO: 801190 - DNA, 20 bp, mouse
gagggcagtcaatcaagcta

SEQ ID NO: 801191 - DNA, 20 bp, mouse
ggccacacaaccccacgggg

SEQ ID NO: 801192 - DNA, 20 bp, mouse
gcacccaatgggaagccata

SEQ ID NO: 801193 - DNA, 20 bp, mouse
ggagccctccgggtctgggt

SEQ ID NO: 801194 - DNA, 20 bp, mouse
gaggcagcctggagccctcc

SEQ ID NO: 801195 - DNA, 20 bp, mouse
gcacgatgtcgcactcagag

SEQ ID NO: 801196 - DNA, 20 bp, mouse
gggagcgagcaaagcggtgg

SEQ ID NO: 801197 - DNA, 20 bp, mouse
ggccaaggctgctcacgtca

SEQ ID NO: 801198 - DNA, 20 bp, mouse
ggccccgcctggccaggaaa

SEQ ID NO: 801199 - DNA, 20 bp, mouse
gaaggctgctcacgtcacgg

SEQ ID NO: 801200 - DNA, 20 bp, mouse
gcggaggggcctgggctcca

SEQ ID NO: 801201 - DNA, 20 bp, mouse
gagagagagagagcgatcgg

SEQ ID NO: 801202 - DNA, 20 bp, mouse
ggcctggtgtgtctgagctg

SEQ ID NO: 801203 - DNA, 20 bp, mouse
gcgggcggaaccctgcgccc

SEQ ID NO: 801204 - DNA, 20 bp, mouse
gtggcggcgacagcgacctg

SEQ ID NO: 801205 - DNA, 20 bp, mouse
gggaaccctgcgcccgggca

SEQ ID NO: 801206 - DNA, 20 bp, mouse
gcgtggctcccaggggaaaa

SEQ ID NO: 801207 - DNA, 20 bp, mouse
ggaggcgttcccgggatcgg

SEQ ID NO: 801208 - DNA, 20 bp, mouse
ggcccacagcggcgtgtggt

SEQ ID NO: 801209 - DNA, 20 bp, mouse
ggagacacgcccccgatccc

SEQ ID NO: 801210 - DNA, 20 bp, mouse
ggtcagctgctggccattcg

SEQ ID NO: 801211 - DNA, 20 bp, mouse
gtctcaggatagttttcccc

SEQ ID NO: 801212 - DNA, 20 bp, mouse
gatggggattggacacccag

SEQ ID NO: 801213 - DNA, 20 bp, mouse
gctggccattcgtggctccc

SEQ ID NO: 801214 - DNA, 20 bp, mouse
gggtggagagcggagcgatg

SEQ ID NO: 801215 - DNA, 20 bp, mouse
gagggaggaggtgcaaaacc

SEQ ID NO: 801216 - DNA, 20 bp, mouse
gtcctggctgggctctcttc

SEQ ID NO: 801217 - DNA, 20 bp, mouse
ggggtacgggaccgcggggt

SEQ ID NO: 801218 - DNA, 20 bp, mouse
gtgggctctcttctggtccc

SEQ ID NO: 801219 - DNA, 20 bp, mouse
gtttctgcgaaggctggggt

SEQ ID NO: 801220 - DNA, 20 bp, mouse
gctcttctggtccccggcgg

SEQ ID NO: 801221 - DNA, 20 bp, mouse
gccgaggccgcgggacacaa

SEQ ID NO: 801222 - DNA, 20 bp, mouse
gtgaaacctgagccgggagc

SEQ ID NO: 801223 - DNA, 20 bp, mouse
ggccgcgggacacaaaggag

SEQ ID NO: 801224 - DNA, 20 bp, mouse
gcccgcgcgccggactctcg

SEQ ID NO: 801225 - DNA, 20 bp, mouse
gaaacttgctgcaggcggat

SEQ ID NO: 801226 - DNA, 20 bp, mouse
gaggacccggcaaggggcgt

SEQ ID NO: 801227 - DNA, 20 bp, mouse
gcctcagccggggtgacctg

SEQ ID NO: 801228 - DNA, 20 bp, mouse
ggggcggccgcaggtcaccc

SEQ ID NO: 801229 - DNA, 20 bp, mouse
gcggctgaggacccggcaag

SEQ ID NO: 801230 - DNA, 20 bp, mouse
gaactgtgcccggagatgtc

SEQ ID NO: 801231 - DNA, 20 bp, mouse
gcccccacgggttggaagtg

SEQ ID NO: 801232 - DNA, 20 bp, mouse
gccggcaaggggcgtagggc

SEQ ID NO: 801233 - DNA, 20 bp, mouse
gtctggggcgggtccatcaa

SEQ ID NO: 801234 - DNA, 20 bp, mouse
ggtcaccccggctgaggacc

SEQ ID NO: 801235 - DNA, 20 bp, mouse
ggcagaggccgagttatccg

SEQ ID NO: 801236 - DNA, 20 bp, mouse
ggagaagcccgggacaagat

SEQ ID NO: 801237 - DNA, 20 bp, mouse
gcccaggagcgtccaccctt

SEQ ID NO: 801238 - DNA, 20 bp, mouse
gctactgcgtgcagtcgctg

SEQ ID NO: 801239 - DNA, 20 bp, mouse
gtagacaagtacttggagag

SEQ ID NO: 801240 - DNA, 20 bp, mouse
ggcccggcgggacaggaatg

SEQ ID NO: 801241 - DNA, 20 bp, mouse
gggggtgcggcgcccgccca

SEQ ID NO: 801242 - DNA, 20 bp, mouse
gcgcacccccatcttgtccc

SEQ ID NO: 801243 - DNA, 20 bp, mouse
gtgcggcgcccgcccaaggg

SEQ ID NO: 801244 - DNA, 20 bp, mouse
gcgccaggagaccggacccc

SEQ ID NO: 801245 - DNA, 20 bp, mouse
ggcagtcgctgaggccgcag

SEQ ID NO: 801246 - DNA, 20 bp, mouse
ggccgaggagaattaagaca

SEQ ID NO: 801247 - DNA, 20 bp, mouse
gggtccccggaccatagccg

SEQ ID NO: 801248 - DNA, 20 bp, mouse
gacagggtggtgaacctggg

SEQ ID NO: 801249 - DNA, 20 bp, mouse
gtaagacagggtggtgaacc

SEQ ID NO: 801250 - DNA, 20 bp, mouse
gactgcaagacaaatacccg

SEQ ID NO: 801251 - DNA, 20 bp, mouse
gaatctactaagcagggggt

SEQ ID NO: 801252 - DNA, 20 bp, mouse
gaaaggctgtctctgtgaag

SEQ ID NO: 801253 - DNA, 20 bp, mouse
gggggcggggttacagggca

SEQ ID NO: 801254 - DNA, 20 bp, mouse
gcccctgcttagtagattcg

SEQ ID NO: 801255 - DNA, 20 bp, mouse
ggacaaatacccggggtccc

SEQ ID NO: 801256 - DNA, 20 bp, mouse
ggggcggactaggaagtcgg

SEQ ID NO: 801257 - DNA, 20 bp, mouse
gccagactcaaggggtctca

SEQ ID NO: 801258 - DNA, 20 bp, mouse
gggtgtgcgggactgtgcgg

SEQ ID NO: 801259 - DNA, 20 bp, mouse
gcttgagaggccagactcaa

SEQ ID NO: 801260 - DNA, 20 bp, mouse
gaacccgaggctggagggtg

SEQ ID NO: 801261 - DNA, 20 bp, mouse
ggggctcacggggcgaagag

SEQ ID NO: 801262 - DNA, 20 bp, mouse
ggggagatgccaagtgaaag

SEQ ID NO: 801263 - DNA, 20 bp, mouse
gaaagcttgcagaaaacccg

SEQ ID NO: 801264 - DNA, 20 bp, mouse
gcagaaaacccgaggctgga

SEQ ID NO: 801265 - DNA, 20 bp, mouse
gaggggtctcagggctcacg

SEQ ID NO: 801266 - DNA, 20 bp, mouse
ggtgcagcaaaagccctatt

SEQ ID NO: 801267 - DNA, 20 bp, mouse
gaacaaacgcacatgcgcac

SEQ ID NO: 801268 - DNA, 20 bp, mouse
gtttccttccctcaacagga

SEQ ID NO: 801269 - DNA, 20 bp, mouse
gttgcttgggtaggtttcac

SEQ ID NO: 801270 - DNA, 20 bp, mouse
gagggcttttgctgcacggc

SEQ ID NO: 801271 - DNA, 20 bp, mouse
gagagagaaacgatccagaa

SEQ ID NO: 801272 - DNA, 20 bp, mouse
gaaactgggatgattctttc

SEQ ID NO: 801273 - DNA, 20 bp, mouse
gtctccattccctcctgttg

SEQ ID NO: 801274 - DNA, 20 bp, mouse
gtgccgaagtgagtttcctg

SEQ ID NO: 801275 - DNA, 20 bp, mouse
gcaggcccctaaacccacac

SEQ ID NO: 801276 - DNA, 20 bp, mouse
gagaatgcaggctgcggggg

SEQ ID NO: 801277 - DNA, 20 bp, mouse
gggtgggagaatgcaggctg

SEQ ID NO: 801278 - DNA, 20 bp, mouse
gcaaaatgatctacctgtgg

SEQ ID NO: 801279 - DNA, 20 bp, mouse
gcatctggattgaactggaa

SEQ ID NO: 801280 - DNA, 20 bp, mouse
gaagagtaggcccagctcac

SEQ ID NO: 801281 - DNA, 20 bp, mouse
gcggcctggtgaaacccaga

SEQ ID NO: 801282 - DNA, 20 bp, mouse
gtgtggccacacacactccc

SEQ ID NO: 801283 - DNA, 20 bp, mouse
gttgagaaaggcattaccaa

SEQ ID NO: 801284 - DNA, 20 bp, mouse
gagctgggcctactcttggg

SEQ ID NO: 801285 - DNA, 20 bp, mouse
gagcctggaaggaaccgaga

SEQ ID NO: 801286 - DNA, 20 bp, mouse
gggggaaggcggcaacaatg

SEQ ID NO: 801287 - DNA, 20 bp, mouse
gcggagaggggaaaacacta

SEQ ID NO: 801288 - DNA, 20 bp, mouse
gaggatcagtgggccgggga

SEQ ID NO: 801289 - DNA, 20 bp, mouse
gcggcccactgatcctaata

SEQ ID NO: 801290 - DNA, 20 bp, mouse
gccgagtgtcaggaaatcgt

SEQ ID NO: 801291 - DNA, 20 bp, mouse
gagctagcaggggataaagc

SEQ ID NO: 801292 - DNA, 20 bp, mouse
ggagctgagaggacctcata

SEQ ID NO: 801293 - DNA, 20 bp, mouse
gagctggaggaagcgagggg

SEQ ID NO: 801294 - DNA, 20 bp, mouse
ggaagaaaggatggaacccg

SEQ ID NO: 801295 - DNA, 20 bp, mouse
gtcctgctgcattccatatt

SEQ ID NO: 801296 - DNA, 20 bp, mouse
gcacccaagcttgactccct

SEQ ID NO: 801297 - DNA, 20 bp, mouse
gagggcggtccgggcggctc

SEQ ID NO: 801298 - DNA, 20 bp, mouse
gctcctgggccggtgaaggg

SEQ ID NO: 801299 - DNA, 20 bp, mouse
gctcccagggagtcaagctt

SEQ ID NO: 801300 - DNA, 20 bp, mouse
ggaggaggcgccctgtatcc

SEQ ID NO: 801301 - DNA, 20 bp, mouse
gtgggggagggcggtccggg

SEQ ID NO: 801302 - DNA, 20 bp, mouse
gctcccccaccccccttcac

SEQ ID NO: 801303 - DNA, 20 bp, mouse
ggagtcggcaactttgggga

SEQ ID NO: 801304 - DNA, 20 bp, mouse
gaaggcaggagccatctcgt

SEQ ID NO: 801305 - DNA, 20 bp, mouse
gccctgtatccgggaggatg

SEQ ID NO: 801306 - DNA, 20 bp, mouse
ggcggcggcgaggacgacgg

SEQ ID NO: 801307 - DNA, 20 bp, mouse
gcggtagcgcaaaaccccgg

SEQ ID NO: 801308 - DNA, 20 bp, mouse
gctcccaagcggagcggtag

SEQ ID NO: 801309 - DNA, 20 bp, mouse
gtcaagatacgagagcgttg

SEQ ID NO: 801310 - DNA, 20 bp, mouse
gtgtggcaggcaaacctccg

SEQ ID NO: 801311 - DNA, 20 bp, mouse
gacagtctgaacactgccag

SEQ ID NO: 801312 - DNA, 20 bp, mouse
gggcgagggacaagagcttt

SEQ ID NO: 801313 - DNA, 20 bp, mouse
ggcagtgttcagactgtggc

SEQ ID NO: 801314 - DNA, 20 bp, mouse
gcggcgaggacgacggcggg

SEQ ID NO: 801315 - DNA, 20 bp, mouse
gaggcggagctggcttgccc

SEQ ID NO: 801316 - DNA, 20 bp, mouse
ggggaggaaagggtgagctc

SEQ ID NO: 801317 - DNA, 20 bp, mouse
gcgggctcctcgggaggaaa

SEQ ID NO: 801318 - DNA, 20 bp, mouse
ggtactgaagacaggaagtg

SEQ ID NO: 801319 - DNA, 20 bp, mouse
gcaaacaactcagactcaac

SEQ ID NO: 801320 - DNA, 20 bp, mouse
gactcaacgggctcctcggg

SEQ ID NO: 801321 - DNA, 20 bp, mouse
gccagctagtggttgggcta

SEQ ID NO: 801322 - DNA, 20 bp, mouse
gagagtcaggaacactctac

SEQ ID NO: 801323 - DNA, 20 bp, mouse
ggctgtatgccgagccagga

SEQ ID NO: 801324 - DNA, 20 bp, mouse
ggggaccggaagcttgggtg

SEQ ID NO: 801325 - DNA, 20 bp, mouse
gtgagggcggtactgaagac

SEQ ID NO: 801326 - DNA, 20 bp, mouse
gccggcgcctcgaaacggtg

SEQ ID NO: 801327 - DNA, 20 bp, mouse
gccgcgctggtgaactacgc

SEQ ID NO: 801328 - DNA, 20 bp, mouse
ggggaaagaggcgggtccgg

SEQ ID NO: 801329 - DNA, 20 bp, mouse
gagaaagagccgggagggaa

SEQ ID NO: 801330 - DNA, 20 bp, mouse
gtgggaaggagccgggaaag

SEQ ID NO: 801331 - DNA, 20 bp, mouse
gacggtgcggctggactagc

SEQ ID NO: 801332 - DNA, 20 bp, mouse
gcagcgcggcgcgcagacgg

SEQ ID NO: 801333 - DNA, 20 bp, mouse
gctacgccggcgcctcgaaa

SEQ ID NO: 801334 - DNA, 20 bp, mouse
gggaagagaaagagccggga

SEQ ID NO: 801335 - DNA, 20 bp, mouse
ggctcggggtccgcgtgggt

SEQ ID NO: 801336 - DNA, 20 bp, mouse
gcccgctagaggctgacaga

SEQ ID NO: 801337 - DNA, 20 bp, mouse
gagggaggctccaggtcggt

SEQ ID NO: 801338 - DNA, 20 bp, mouse
ggcaccgccaagccagtact

SEQ ID NO: 801339 - DNA, 20 bp, mouse
gcggaccccgcccaccgacc

SEQ ID NO: 801340 - DNA, 20 bp, mouse
gggcggggtccggggcacta

SEQ ID NO: 801341 - DNA, 20 bp, mouse
gcaggctccacgaaggtaca

SEQ ID NO: 801342 - DNA, 20 bp, mouse
gagctgggcacgcccgctag

SEQ ID NO: 801343 - DNA, 20 bp, mouse
gctaaccccagcaccctaga

SEQ ID NO: 801344 - DNA, 20 bp, mouse
gagaaaggaatatgaaaacc

SEQ ID NO: 801345 - DNA, 20 bp, mouse
gttttctgggtgttctgcag

SEQ ID NO: 801346 - DNA, 20 bp, mouse
ggactaagacagtttattga

SEQ ID NO: 801347 - DNA, 20 bp, mouse
gaactatcagagatctgaca

SEQ ID NO: 801348 - DNA, 20 bp, mouse
gacaggacaggaattcacag

SEQ ID NO: 801349 - DNA, 20 bp, mouse
gtctctgatagttattgtac

SEQ ID NO: 801350 - DNA, 20 bp, mouse
ggacaaggataaattagaac

SEQ ID NO: 801351 - DNA, 20 bp, mouse
gtgttgctattcaccaccaa

SEQ ID NO: 801352 - DNA, 20 bp, mouse
gtgatagttattgtactggc

SEQ ID NO: 801353 - DNA, 20 bp, mouse
gctgtcctgtcttcctttgg

SEQ ID NO: 801354 - DNA, 20 bp, mouse
gttcacagagggcagcaact

SEQ ID NO: 801355 - DNA, 20 bp, mouse
ggtcattttaattgatacag

SEQ ID NO: 801356 - DNA, 20 bp, mouse
gcggggagacgcctgaattc

SEQ ID NO: 801357 - DNA, 20 bp, mouse
ggaggcacgtagttgccatt

SEQ ID NO: 801358 - DNA, 20 bp, mouse
gaagaggcgaatccatccca

SEQ ID NO: 801359 - DNA, 20 bp, mouse
gtctccccgcatcccaagag

SEQ ID NO: 801360 - DNA, 20 bp, mouse
gggtctgtgtgggcgtgaag

SEQ ID NO: 801361 - DNA, 20 bp, mouse
gttcctcagtggcctctctt

SEQ ID NO: 801362 - DNA, 20 bp, mouse
gaggcgaatccatcccacgg

SEQ ID NO: 801363 - DNA, 20 bp, mouse
gtatttggaggcggagaata

SEQ ID NO: 801364 - DNA, 20 bp, mouse
gggcaactacgtgcctccgt

SEQ ID NO: 801365 - DNA, 20 bp, mouse
gtaaacttaggcacggaagt

SEQ ID NO: 801366 - DNA, 20 bp, mouse
gtaagacaggatcttgacta

SEQ ID NO: 801367 - DNA, 20 bp, mouse
gtaaacgggcgtggcaaaaa

SEQ ID NO: 801368 - DNA, 20 bp, mouse
gtaggctgatttagatgtga

SEQ ID NO: 801369 - DNA, 20 bp, mouse
gtgagaagtgaagccctagt

SEQ ID NO: 801370 - DNA, 20 bp, mouse
gcctagttggatctcagtta

SEQ ID NO: 801371 - DNA, 20 bp, mouse
gtcagttaaggagtttccct

SEQ ID NO: 801372 - DNA, 20 bp, mouse
gaagatcctgtcttagaccc

SEQ ID NO: 801373 - DNA, 20 bp, mouse
gagagatgaagctttattta

SEQ ID NO: 801374 - DNA, 20 bp, mouse
gcatcctagaaagccaaatt

SEQ ID NO: 801375 - DNA, 20 bp, mouse
gtggcctaatttggctttct

SEQ ID NO: 801376 - DNA, 20 bp, mouse
gttcttggggaggtgtaata

SEQ ID NO: 801377 - DNA, 20 bp, mouse
gcaagaaggcacataatact

SEQ ID NO: 801378 - DNA, 20 bp, mouse
ggcctagtgaatctggtcaa

SEQ ID NO: 801379 - DNA, 20 bp, mouse
gcggcatggtgctggggtca

SEQ ID NO: 801380 - DNA, 20 bp, mouse
gcaagacggctgagaagcag

SEQ ID NO: 801381 - DNA, 20 bp, mouse
gtttcatagcagtttcatcc

SEQ ID NO: 801382 - DNA, 20 bp, mouse
gaatgacagggtgtcttttg

SEQ ID NO: 801383 - DNA, 20 bp, mouse
gtatagtcttggggagggcg

SEQ ID NO: 801384 - DNA, 20 bp, mouse
ggggctgctgctgtaagcct

SEQ ID NO: 801385 - DNA, 20 bp, mouse
gagaagcagcggcatggtgc

SEQ ID NO: 801386 - DNA, 20 bp, mouse
gcactagcacccatcttgag

SEQ ID NO: 801387 - DNA, 20 bp, mouse
ggctctgagcagccagtgga

SEQ ID NO: 801388 - DNA, 20 bp, mouse
gctgcggacagattgtgagg

SEQ ID NO: 801389 - DNA, 20 bp, mouse
ggacctgcggacagattgtg

SEQ ID NO: 801390 - DNA, 20 bp, mouse
gacccatcttgaggggagtg

SEQ ID NO: 801391 - DNA, 20 bp, mouse
gaccacactcccctcaagat

SEQ ID NO: 801392 - DNA, 20 bp, mouse
gttcagtgatggactgccag

SEQ ID NO: 801393 - DNA, 20 bp, mouse
gtcgtacaagtgacggggta

SEQ ID NO: 801394 - DNA, 20 bp, mouse
gactatctattgcaacaagt

SEQ ID NO: 801395 - DNA, 20 bp, mouse
gtttagtcgtacaagtgacg

SEQ ID NO: 801396 - DNA, 20 bp, mouse
ggggtgtggcagcagacgat

SEQ ID NO: 801397 - DNA, 20 bp, mouse
gaatattgaagatggggccc

SEQ ID NO: 801398 - DNA, 20 bp, mouse
gagtagctccggaggactta

SEQ ID NO: 801399 - DNA, 20 bp, mouse
gatgtatcgtgcttccaggt

SEQ ID NO: 801400 - DNA, 20 bp, mouse
gcacatttccgtaagtcctc

SEQ ID NO: 801401 - DNA, 20 bp, mouse
gacattgcatcactggtcaa

SEQ ID NO: 801402 - DNA, 20 bp, mouse
gcgtaatgtatcgtgcttcc

SEQ ID NO: 801403 - DNA, 20 bp, mouse
gtgtggcagcagacgattgg

SEQ ID NO: 801404 - DNA, 20 bp, mouse
gtttctccacattgcatcac

SEQ ID NO: 801405 - DNA, 20 bp, mouse
gagagatggcagttcactga

SEQ ID NO: 801406 - DNA, 20 bp, mouse
ggccccttctatacctgact

SEQ ID NO: 801407 - DNA, 20 bp, mouse
gacggcctttatgggagctt

SEQ ID NO: 801408 - DNA, 20 bp, mouse
gtctgcccaagctcccataa

SEQ ID NO: 801409 - DNA, 20 bp, mouse
ggctcccataaaggccgtcc

SEQ ID NO: 801410 - DNA, 20 bp, mouse
ggcttccaggacggccttta

SEQ ID NO: 801411 - DNA, 20 bp, mouse
ggtgtatcgtgcttccagga

SEQ ID NO: 801412 - DNA, 20 bp, mouse
gcgtagtgtatcgtgcttcc

SEQ ID NO: 801413 - DNA, 20 bp, mouse
gtggcttctctttccaagtc

SEQ ID NO: 801414 - DNA, 20 bp, mouse
ggtgggaaggttaaagaagc

SEQ ID NO: 801415 - DNA, 20 bp, mouse
gctgcaaaactcaggacagt

SEQ ID NO: 801416 - DNA, 20 bp, mouse
gaggacagtgggaaggttat

SEQ ID NO: 801417 - DNA, 20 bp, mouse
gggtctgccgccacacctcc

SEQ ID NO: 801418 - DNA, 20 bp, mouse
ggtgggaaggttatcggagc

SEQ ID NO: 801419 - DNA, 20 bp, mouse
gaatgtggagaaatagacca

SEQ ID NO: 801420 - DNA, 20 bp, mouse
ggtgtatcgtccttccaggt

SEQ ID NO: 801421 - DNA, 20 bp, mouse
gcgtagtgtatcgtccttcc

SEQ ID NO: 801422 - DNA, 20 bp, mouse
gccttccaggtcggccttta

SEQ ID NO: 801423 - DNA, 20 bp, mouse
gagtagctcgggaggccttg

SEQ ID NO: 801424 - DNA, 20 bp, mouse
ggatacctcagtagctcggg

SEQ ID NO: 801425 - DNA, 20 bp, mouse
gtattgaagatggggcccgg

SEQ ID NO: 801426 - DNA, 20 bp, mouse
gtgtcagggtacagctacta

SEQ ID NO: 801427 - DNA, 20 bp, mouse
gaaaaagagcacttgtgtca

SEQ ID NO: 801428 - DNA, 20 bp, mouse
ggagaagatctgtttcaagg

SEQ ID NO: 801429 - DNA, 20 bp, mouse
gaaagtcgctgtaatccaca

SEQ ID NO: 801430 - DNA, 20 bp, mouse
gatccacagggcttactgac

SEQ ID NO: 801431 - DNA, 20 bp, mouse
gacagtgacttgagcatggg

SEQ ID NO: 801432 - DNA, 20 bp, mouse
gtctacagtgacttgagcat

SEQ ID NO: 801433 - DNA, 20 bp, mouse
ggtacagctactatggatgt

SEQ ID NO: 801434 - DNA, 20 bp, mouse
ggagcatgggtggctgcctg

SEQ ID NO: 801435 - DNA, 20 bp, mouse
gaggtcctcttcctgcattc

SEQ ID NO: 801436 - DNA, 20 bp, mouse
ggaatactgtagattctttc

SEQ ID NO: 801437 - DNA, 20 bp, mouse
gaaagtccctgtaacccaca

SEQ ID NO: 801438 - DNA, 20 bp, mouse
gagtaagccctgtgggttac

SEQ ID NO: 801439 - DNA, 20 bp, mouse
gcacagtcagtaagccctgt

SEQ ID NO: 801440 - DNA, 20 bp, mouse
ggaagcacaaaacaaatata

SEQ ID NO: 801441 - DNA, 20 bp, mouse
gtgaggaagcgtggatccct

SEQ ID NO: 801442 - DNA, 20 bp, mouse
ggcaaaacatcgtctggcta

SEQ ID NO: 801443 - DNA, 20 bp, mouse
gtgaaacaagatctgtttcc

SEQ ID NO: 801444 - DNA, 20 bp, mouse
gttggcggcaaaacatcgtc

SEQ ID NO: 801445 - DNA, 20 bp, mouse
ggagagatgctgtgggaagc

SEQ ID NO: 801446 - DNA, 20 bp, mouse
gtgtgtggggatatttttta

SEQ ID NO: 801447 - DNA, 20 bp, mouse
gtggggatattttttaagga

SEQ ID NO: 801448 - DNA, 20 bp, mouse
gagtttggtgctgggatgtg

SEQ ID NO: 801449 - DNA, 20 bp, mouse
gctgcatctctacttcctcg

SEQ ID NO: 801450 - DNA, 20 bp, mouse
gagtaactctggagtccttg

SEQ ID NO: 801451 - DNA, 20 bp, mouse
gctaccagggaatcaatgcg

SEQ ID NO: 801452 - DNA, 20 bp, mouse
gtgccctggtgagaggagtt

SEQ ID NO: 801453 - DNA, 20 bp, mouse
gaattcaataaggtcagaga

SEQ ID NO: 801454 - DNA, 20 bp, mouse
gagtacttgggaaggattgg

SEQ ID NO: 801455 - DNA, 20 bp, mouse
gccagttggtagaagtactt

SEQ ID NO: 801456 - DNA, 20 bp, mouse
gaaagtccctgtaatccata

SEQ ID NO: 801457 - DNA, 20 bp, mouse
gagtaagccctatggattac

SEQ ID NO: 801458 - DNA, 20 bp, mouse
ggaatactgtagattctttc

SEQ ID NO: 801459 - DNA, 20 bp, mouse
ggaagcacaaaacaaatata

SEQ ID NO: 801460 - DNA, 20 bp, mouse
gtgaggaagcgtggatccct

SEQ ID NO: 801461 - DNA, 20 bp, mouse
gggaaaacatcgtctggcta

SEQ ID NO: 801462 - DNA, 20 bp, mouse
gtcacagtcagtaagcccta

SEQ ID NO: 801463 - DNA, 20 bp, mouse
gttggcgggaaaacatcgtc

SEQ ID NO: 801464 - DNA, 20 bp, mouse
gtgaaacaagatctgtttcc

SEQ ID NO: 801465 - DNA, 20 bp, mouse
ggagagatgctgtgggaagc

SEQ ID NO: 801466 - DNA, 20 bp, mouse
ggctcagaagaacaatgaga

SEQ ID NO: 801467 - DNA, 20 bp, mouse
gagagggctcaacttcacca

SEQ ID NO: 801468 - DNA, 20 bp, mouse
gggaagaggcttattcttag

SEQ ID NO: 801469 - DNA, 20 bp, mouse
ggaggcttattcttagtggt

SEQ ID NO: 801470 - DNA, 20 bp, mouse
gatccctgcaccgcaagccc

SEQ ID NO: 801471 - DNA, 20 bp, mouse
gtcaccagggcttgcggtgc

SEQ ID NO: 801472 - DNA, 20 bp, mouse
gtcaacttcaccagggcttg

SEQ ID NO: 801473 - DNA, 20 bp, mouse
gttcttagtggtgggctttc

SEQ ID NO: 801474 - DNA, 20 bp, mouse
gattgttcttctgagccagc

SEQ ID NO: 801475 - DNA, 20 bp, mouse
gagtacttgggaaggattgg

SEQ ID NO: 801476 - DNA, 20 bp, mouse
gggctcagaagaatgatcag

SEQ ID NO: 801477 - DNA, 20 bp, mouse
gtctacacaagctcctctaa

SEQ ID NO: 801478 - DNA, 20 bp, mouse
gcagagggctcaacttcaac

SEQ ID NO: 801479 - DNA, 20 bp, mouse
gatcattcttctgagccagc

SEQ ID NO: 801480 - DNA, 20 bp, mouse
gaaagtgaacttagaccctg

SEQ ID NO: 801481 - DNA, 20 bp, mouse
gaatccacaatcatgatagc

SEQ ID NO: 801482 - DNA, 20 bp, mouse
gccagttggtagaagtactt

SEQ ID NO: 801483 - DNA, 20 bp, mouse
gtagcaggaagcacggcagc

SEQ ID NO: 801484 - DNA, 20 bp, mouse
gggagcttgtgtagacttgc

SEQ ID NO: 801485 - DNA, 20 bp, mouse
gtgggaagaggcttattgtt

SEQ ID NO: 801486 - DNA, 20 bp, mouse
gtgtcagggtacagctacta

SEQ ID NO: 801487 - DNA, 20 bp, mouse
gaaaaagagcacttgtgtca

SEQ ID NO: 801488 - DNA, 20 bp, mouse
ggagaagatctgtttcaagg

SEQ ID NO: 801489 - DNA, 20 bp, mouse
gaaagtcgctgtaatccaca

SEQ ID NO: 801490 - DNA, 20 bp, mouse
gatccacagggcttactgac

SEQ ID NO: 801491 - DNA, 20 bp, mouse
gacagtgacttgagcatggg

SEQ ID NO: 801492 - DNA, 20 bp, mouse
gtctacagtgacttgagcat

SEQ ID NO: 801493 - DNA, 20 bp, mouse
ggtacagctactatggatgt

SEQ ID NO: 801494 - DNA, 20 bp, mouse
gaggtcctcttcctgcattc

SEQ ID NO: 801495 - DNA, 20 bp, mouse
ggagcatgggtggctgcctg

SEQ ID NO: 801496 - DNA, 20 bp, mouse
gtagtgaagtgtccaatcat

SEQ ID NO: 801497 - DNA, 20 bp, mouse
gctcaaaggaagagacctgg

SEQ ID NO: 801498 - DNA, 20 bp, mouse
gacactcaaaggaagagacc

SEQ ID NO: 801499 - DNA, 20 bp, mouse
gctcttctctatcaagtaac

SEQ ID NO: 801500 - DNA, 20 bp, mouse
gatagagaagagaaattaaa

SEQ ID NO: 801501 - DNA, 20 bp, mouse
gaagagaaattaaacggaga

SEQ ID NO: 801502 - DNA, 20 bp, mouse
gacggagaaggtgatccacc

SEQ ID NO: 801503 - DNA, 20 bp, mouse
ggccgctagtataaactact

SEQ ID NO: 801504 - DNA, 20 bp, mouse
gacacccccaactaaacaag

SEQ ID NO: 801505 - DNA, 20 bp, mouse
ggcctagtagtttatactag

SEQ ID NO: 801506 - DNA, 20 bp, mouse
gaaccgttcaggcttaacca

SEQ ID NO: 801507 - DNA, 20 bp, mouse
gagccctggttaagcctgaa

SEQ ID NO: 801508 - DNA, 20 bp, mouse
gtccgggcaaaccatgatgt

SEQ ID NO: 801509 - DNA, 20 bp, mouse
gcaggcttaaccagggctac

SEQ ID NO: 801510 - DNA, 20 bp, mouse
gtgggggacacctgtagccc

SEQ ID NO: 801511 - DNA, 20 bp, mouse
gggtgggattgagccctgtt

SEQ ID NO: 801512 - DNA, 20 bp, mouse
gatccacaagtttaatatca

SEQ ID NO: 801513 - DNA, 20 bp, mouse
gtaaacttgtggatgatggt

SEQ ID NO: 801514 - DNA, 20 bp, mouse
gatattaaacttgtggatga

SEQ ID NO: 801515 - DNA, 20 bp, mouse
ggagagactgtgtccccaac

SEQ ID NO: 801516 - DNA, 20 bp, mouse
gagcagcagtgggaccaggt

SEQ ID NO: 801517 - DNA, 20 bp, mouse
ggaggagcagcagtgggacc

SEQ ID NO: 801518 - DNA, 20 bp, mouse
gcacagttataaagagagtg

SEQ ID NO: 801519 - DNA, 20 bp, mouse
ggtgtggagtacacactgaa

SEQ ID NO: 801520 - DNA, 20 bp, mouse
gacactgaatggcttttcct

SEQ ID NO: 801521 - DNA, 20 bp, mouse
gaaactagttccaagcttgc

SEQ ID NO: 801522 - DNA, 20 bp, mouse
gaaagaggaggtctccctat

SEQ ID NO: 801523 - DNA, 20 bp, mouse
gagtgggaccaggtgggggc

SEQ ID NO: 801524 - DNA, 20 bp, mouse
ggcggcaggtcctgcaagct

SEQ ID NO: 801525 - DNA, 20 bp, mouse
gtctccctatgggaagaagg

SEQ ID NO: 801526 - DNA, 20 bp, mouse
ggagctcagggggtctgctg

SEQ ID NO: 801527 - DNA, 20 bp, mouse
gcaagaagggcacaacccgt

SEQ ID NO: 801528 - DNA, 20 bp, mouse
gaatgtgggggtgtaacatt

SEQ ID NO: 801529 - DNA, 20 bp, mouse
gggcacaacccgtgggaatg

SEQ ID NO: 801530 - DNA, 20 bp, mouse
gacaacccgtgggaatgtgg

SEQ ID NO: 801531 - DNA, 20 bp, mouse
gtgctctgctggtctacatc

SEQ ID NO: 801532 - DNA, 20 bp, mouse
gtgtagaccagcagagcagg

SEQ ID NO: 801533 - DNA, 20 bp, mouse
gttacacccccacattccca

SEQ ID NO: 801534 - DNA, 20 bp, mouse
gtcaggaaagacgatcacat

SEQ ID NO: 801535 - DNA, 20 bp, mouse
gagagcctggcaagcttcca

SEQ ID NO: 801536 - DNA, 20 bp, mouse
ggggacacctgtatcccttg

SEQ ID NO: 801537 - DNA, 20 bp, mouse
ggaataccggtgccccccaa

SEQ ID NO: 801538 - DNA, 20 bp, mouse
gttgaaccgttcaggaatac

SEQ ID NO: 801539 - DNA, 20 bp, mouse
gactgccccttctttggttg

SEQ ID NO: 801540 - DNA, 20 bp, mouse
gtgtatcccttggggggcac

SEQ ID NO: 801541 - DNA, 20 bp, mouse
gggtgggattgaaccatgtt

SEQ ID NO: 801542 - DNA, 20 bp, mouse
gatccacaagtttaatctca

SEQ ID NO: 801543 - DNA, 20 bp, mouse
ggggcaccggtattcctgaa

SEQ ID NO: 801544 - DNA, 20 bp, mouse
gtaaacttgtggatgatggt

SEQ ID NO: 801545 - DNA, 20 bp, mouse
gtctcatggagtgtttgtgt

SEQ ID NO: 801546 - DNA, 20 bp, mouse
gtgcgcatgcgtaccctgat

SEQ ID NO: 801547 - DNA, 20 bp, mouse
gtaggcgtgcggagaaagtt

SEQ ID NO: 801548 - DNA, 20 bp, mouse
gcagggccgctcgccgatca

SEQ ID NO: 801549 - DNA, 20 bp, mouse
ggaaaggcgggctccaggta

SEQ ID NO: 801550 - DNA, 20 bp, mouse
gagtagccctcacctctgat

SEQ ID NO: 801551 - DNA, 20 bp, mouse
gctggagggtcccgttgccg

SEQ ID NO: 801552 - DNA, 20 bp, mouse
gggcccgcgctctgccgcac

SEQ ID NO: 801553 - DNA, 20 bp, mouse
ggaaaagacaagcagaactg

SEQ ID NO: 801554 - DNA, 20 bp, mouse
ggaggtgagggctactccga

SEQ ID NO: 801555 - DNA, 20 bp, mouse
gatgcgcaacgctaggtgtt

SEQ ID NO: 801556 - DNA, 20 bp, mouse
ggggcgtggctccagagatc

SEQ ID NO: 801557 - DNA, 20 bp, mouse
ggggcggagctccagatatc

SEQ ID NO: 801558 - DNA, 20 bp, mouse
gggctccagagatcaggggt

SEQ ID NO: 801559 - DNA, 20 bp, mouse
gccctagagcgccagatatc

SEQ ID NO: 801560 - DNA, 20 bp, mouse
ggggcggaactgtagggctt

SEQ ID NO: 801561 - DNA, 20 bp, mouse
gcaggggtggggctcactct

SEQ ID NO: 801562 - DNA, 20 bp, mouse
gcaggaggactgcaaatgcg

SEQ ID NO: 801563 - DNA, 20 bp, mouse
gtgcggggggcggaactgta

SEQ ID NO: 801564 - DNA, 20 bp, mouse
gttgggattcgcctcttggg

SEQ ID NO: 801565 - DNA, 20 bp, mouse
gcaccatccagtcctaccgg

SEQ ID NO: 801566 - DNA, 20 bp, mouse
gggaaacaggaaatcgtgat

SEQ ID NO: 801567 - DNA, 20 bp, mouse
gaaggccgcgccttactcct

SEQ ID NO: 801568 - DNA, 20 bp, mouse
ggcgaggcttactgtacacc

SEQ ID NO: 801569 - DNA, 20 bp, mouse
gggaacgaggttagcccgcg

SEQ ID NO: 801570 - DNA, 20 bp, mouse
ggctctggtgagattaaaac

SEQ ID NO: 801571 - DNA, 20 bp, mouse
gaaatagcgcagtgcaagcc

SEQ ID NO: 801572 - DNA, 20 bp, mouse
gaacctcgttcccaggagta

SEQ ID NO: 801573 - DNA, 20 bp, mouse
gacaagggtcgacagattat

SEQ ID NO: 801574 - DNA, 20 bp, mouse
gacgccagcgccgctgtcat

SEQ ID NO: 801575 - DNA, 20 bp, mouse
gggtaactacgtagaggggc

SEQ ID NO: 801576 - DNA, 20 bp, mouse
gggtcccctcgggtctacag

SEQ ID NO: 801577 - DNA, 20 bp, mouse
ggagcacgaggaagcggctg

SEQ ID NO: 801578 - DNA, 20 bp, mouse
gaggcacggcgcgcagccat

SEQ ID NO: 801579 - DNA, 20 bp, mouse
gcgaggaagcggctgaggca

SEQ ID NO: 801580 - DNA, 20 bp, mouse
gccgaggccgtggatttctg

SEQ ID NO: 801581 - DNA, 20 bp, mouse
gtcacgggagcacgaggaag

SEQ ID NO: 801582 - DNA, 20 bp, mouse
gtcgcccgctgtagacccga

SEQ ID NO: 801583 - DNA, 20 bp, mouse
ggtagacccgaggggaccca

SEQ ID NO: 801584 - DNA, 20 bp, mouse
gagagccgagagtgggtccc

SEQ ID NO: 801585 - DNA, 20 bp, mouse
gccgttggggccaatgatgc

SEQ ID NO: 801586 - DNA, 20 bp, mouse
gggagatagaagcttgctgt

SEQ ID NO: 801587 - DNA, 20 bp, mouse
gcacggacggcggcgcgcga

SEQ ID NO: 801588 - DNA, 20 bp, mouse
ggagcactttggtagagtgg

SEQ ID NO: 801589 - DNA, 20 bp, mouse
ggaccggcgagctgcacgga

SEQ ID NO: 801590 - DNA, 20 bp, mouse
gcggcgagctgcacggacgg

SEQ ID NO: 801591 - DNA, 20 bp, mouse
gactctaccaaagtgctcca

SEQ ID NO: 801592 - DNA, 20 bp, mouse
gaatccggctcacactcgac

SEQ ID NO: 801593 - DNA, 20 bp, mouse
gtgcttggatgcccgggcct

SEQ ID NO: 801594 - DNA, 20 bp, mouse
gtcgccggtcgagtgtgagc

SEQ ID NO: 801595 - DNA, 20 bp, mouse
gagttccttcaaaggagaaa

SEQ ID NO: 801596 - DNA, 20 bp, mouse
gctagagaggagggctcaaa

SEQ ID NO: 801597 - DNA, 20 bp, mouse
gcgaacccaagggtgtgtac

SEQ ID NO: 801598 - DNA, 20 bp, mouse
gccccgcctgccaggaactc

SEQ ID NO: 801599 - DNA, 20 bp, mouse
gagcccggcgtccacgcgtg

SEQ ID NO: 801600 - DNA, 20 bp, mouse
ggggagagcagccgaaccca

SEQ ID NO: 801601 - DNA, 20 bp, mouse
ggggttgctccaccttaagt

SEQ ID NO: 801602 - DNA, 20 bp, mouse
gaggtggagcaacccggctg

SEQ ID NO: 801603 - DNA, 20 bp, mouse
ggacaagagcgtaaagagga

SEQ ID NO: 801604 - DNA, 20 bp, mouse
gtacaggcgcctccgactta

SEQ ID NO: 801605 - DNA, 20 bp, mouse
gcggggacaagagcgtaaag

SEQ ID NO: 801606 - DNA, 20 bp, mouse
gaagccccgggccttgtcag

SEQ ID NO: 801607 - DNA, 20 bp, mouse
gaaggcccggggcttggtgg

SEQ ID NO: 801608 - DNA, 20 bp, mouse
gcctcccctgacaaggcccg

SEQ ID NO: 801609 - DNA, 20 bp, mouse
gctggcagacctaggggagt

SEQ ID NO: 801610 - DNA, 20 bp, mouse
gtcgcggggtgaaagttgag

SEQ ID NO: 801611 - DNA, 20 bp, mouse
ggacaaggcccggggcttgg

SEQ ID NO: 801612 - DNA, 20 bp, mouse
gtccgggcgccggttgctgg

SEQ ID NO: 801613 - DNA, 20 bp, mouse
ggaagcccaactcttcccca

SEQ ID NO: 801614 - DNA, 20 bp, mouse
gcccaaggctggcagaccta

SEQ ID NO: 801615 - DNA, 20 bp, mouse
gcggtaggctcgcagatggg

SEQ ID NO: 801616 - DNA, 20 bp, mouse
gagtcccgggccacatcaat

SEQ ID NO: 801617 - DNA, 20 bp, mouse
ggggaggcgcagttcccacg

SEQ ID NO: 801618 - DNA, 20 bp, mouse
gcccaccgcccaatgcgggt

SEQ ID NO: 801619 - DNA, 20 bp, mouse
gtgtgccgacccgcattggg

SEQ ID NO: 801620 - DNA, 20 bp, mouse
ggggatgcgacccccggcgg

SEQ ID NO: 801621 - DNA, 20 bp, mouse
gcgcctgtgccgacccgcat

SEQ ID NO: 801622 - DNA, 20 bp, mouse
gggcacggaggctcgcccgc

SEQ ID NO: 801623 - DNA, 20 bp, mouse
gcgtcggggcgcaggcgtgg

SEQ ID NO: 801624 - DNA, 20 bp, mouse
gggcgagcctccgtgccgag

SEQ ID NO: 801625 - DNA, 20 bp, mouse
gtgcccgtgtccccccgccg

SEQ ID NO: 801626 - DNA, 20 bp, mouse
gcccgcccccggagcacctc

SEQ ID NO: 801627 - DNA, 20 bp, mouse
gtgagcaagtagctggagtc

SEQ ID NO: 801628 - DNA, 20 bp, mouse
ggcccccggagcacctcggg

SEQ ID NO: 801629 - DNA, 20 bp, mouse
gaccccccgaggtgctccgg

SEQ ID NO: 801630 - DNA, 20 bp, mouse
gccagcccggggctagagat

SEQ ID NO: 801631 - DNA, 20 bp, mouse
gggcgcgccgggctgctcga

SEQ ID NO: 801632 - DNA, 20 bp, mouse
gccaacgggcggtggcgcgc

SEQ ID NO: 801633 - DNA, 20 bp, mouse
ggcgccaccgcccgttggat

SEQ ID NO: 801634 - DNA, 20 bp, mouse
gaggcgatacacaccccccg

SEQ ID NO: 801635 - DNA, 20 bp, mouse
gtgtgtatcgcctccagccc

SEQ ID NO: 801636 - DNA, 20 bp, mouse
ggggcatggggcaggattgg

SEQ ID NO: 801637 - DNA, 20 bp, mouse
gagaggcatcagaggagttt

SEQ ID NO: 801638 - DNA, 20 bp, mouse
ggggcaccatatttctgaac

SEQ ID NO: 801639 - DNA, 20 bp, mouse
gtgtgtcttggcttgggcat

SEQ ID NO: 801640 - DNA, 20 bp, mouse
gaccttcagagaggcatcag

SEQ ID NO: 801641 - DNA, 20 bp, mouse
gccagcagagaccttcagag

SEQ ID NO: 801642 - DNA, 20 bp, mouse
gtcatgctgtgtcttggctt

SEQ ID NO: 801643 - DNA, 20 bp, mouse
ggctataagcctcttcctag

SEQ ID NO: 801644 - DNA, 20 bp, mouse
gggatctctctgtgatctga

SEQ ID NO: 801645 - DNA, 20 bp, mouse
gctaacccatatgggcctct

SEQ ID NO: 801646 - DNA, 20 bp, mouse
ggggtcaggcgctatgggga

SEQ ID NO: 801647 - DNA, 20 bp, mouse
gtggcagccaagtccagggg

SEQ ID NO: 801648 - DNA, 20 bp, mouse
gaaggtcactggatacaggt

SEQ ID NO: 801649 - DNA, 20 bp, mouse
gaacccgggaggaacaaata

SEQ ID NO: 801650 - DNA, 20 bp, mouse
gggcaggtatccaagagttg

SEQ ID NO: 801651 - DNA, 20 bp, mouse
gcgggctccacccctggact

SEQ ID NO: 801652 - DNA, 20 bp, mouse
ggggctccctgtgccctaca

SEQ ID NO: 801653 - DNA, 20 bp, mouse
gagcccgggtcaggcgctat

SEQ ID NO: 801654 - DNA, 20 bp, mouse
gtacaggtcggccaacttcc

SEQ ID NO: 801655 - DNA, 20 bp, mouse
ggactcagggagctgagttg

SEQ ID NO: 801656 - DNA, 20 bp, mouse
ggaacgctgcgaggcgacgt

SEQ ID NO: 801657 - DNA, 20 bp, mouse
gcgctccgcctccaaggcag

SEQ ID NO: 801658 - DNA, 20 bp, mouse
gagggagctcctaggtgcga

SEQ ID NO: 801659 - DNA, 20 bp, mouse
gcagccgcgctccgcctcca

SEQ ID NO: 801660 - DNA, 20 bp, mouse
gcaacagagtctgcctgcga

SEQ ID NO: 801661 - DNA, 20 bp, mouse
gtgtcaccgcgcacggccat

SEQ ID NO: 801662 - DNA, 20 bp, mouse
ggagcagggccggggtcttg

SEQ ID NO: 801663 - DNA, 20 bp, mouse
gagtctgcctgcgagggctg

SEQ ID NO: 801664 - DNA, 20 bp, mouse
gcgcaggcccgcagcgtctc

SEQ ID NO: 801665 - DNA, 20 bp, mouse
ggcggcccggagactcctcc

SEQ ID NO: 801666 - DNA, 20 bp, mouse
gcccaggttgccctgctcaa

SEQ ID NO: 801667 - DNA, 20 bp, mouse
ggaggcctggtagtctgcga

SEQ ID NO: 801668 - DNA, 20 bp, mouse
gctcacgcgtccgtcaccaa

SEQ ID NO: 801669 - DNA, 20 bp, mouse
gtcacggtgcaggggagtcg

SEQ ID NO: 801670 - DNA, 20 bp, mouse
ggaagctccgcccttggtga

SEQ ID NO: 801671 - DNA, 20 bp, mouse
gcggacttcccaagtggtca

SEQ ID NO: 801672 - DNA, 20 bp, mouse
gaagtccgcccccgtttcca

SEQ ID NO: 801673 - DNA, 20 bp, mouse
ggacggacgcgtgagaagcc

SEQ ID NO: 801674 - DNA, 20 bp, mouse
gggcatgggaggggaaatcc

SEQ ID NO: 801675 - DNA, 20 bp, mouse
gtcctccctcgcagactacc

SEQ ID NO: 801676 - DNA, 20 bp, mouse
ggagctggggcccttgatgc

SEQ ID NO: 801677 - DNA, 20 bp, mouse
gcctccctgcaaaaattaaa

SEQ ID NO: 801678 - DNA, 20 bp, mouse
gccctggcggcccatggctg

SEQ ID NO: 801679 - DNA, 20 bp, mouse
gcggtggtcaaaagcagggc

SEQ ID NO: 801680 - DNA, 20 bp, mouse
gctgaaggacacgggtgtgt

SEQ ID NO: 801681 - DNA, 20 bp, mouse
ggcacacacgcatcccaaga

SEQ ID NO: 801682 - DNA, 20 bp, mouse
ggaagcggtggtcaaaagca

SEQ ID NO: 801683 - DNA, 20 bp, mouse
gagtagccaaagcttggaaa

SEQ ID NO: 801684 - DNA, 20 bp, mouse
gcagatggaagcagacatca

SEQ ID NO: 801685 - DNA, 20 bp, mouse
ggagagacaccggcagggaa

SEQ ID NO: 801686 - DNA, 20 bp, mouse
gggtatccggggaagttcag

SEQ ID NO: 801687 - DNA, 20 bp, mouse
gtggggatctaattctggaa

SEQ ID NO: 801688 - DNA, 20 bp, mouse
gtcagaggctagtttgaaag

SEQ ID NO: 801689 - DNA, 20 bp, mouse
gaatatgcccggggtatccg

SEQ ID NO: 801690 - DNA, 20 bp, mouse
gagggagatcgcccccaagg

SEQ ID NO: 801691 - DNA, 20 bp, mouse
ggggaggcgacaggttataa

SEQ ID NO: 801692 - DNA, 20 bp, mouse
gcccacacatatctgcttta

SEQ ID NO: 801693 - DNA, 20 bp, mouse
gcacactgccagggcgaaag

SEQ ID NO: 801694 - DNA, 20 bp, mouse
ggccctaaagcagatatgtg

SEQ ID NO: 801695 - DNA, 20 bp, mouse
ggaacttccccggatacccc

SEQ ID NO: 801696 - DNA, 20 bp, mouse
gtacccagccagtggcccat

SEQ ID NO: 801697 - DNA, 20 bp, mouse
ggcaggctgcgcagctccgc

SEQ ID NO: 801698 - DNA, 20 bp, mouse
ggggcgaccccgggaaccga

SEQ ID NO: 801699 - DNA, 20 bp, mouse
gaaccgatgggccactggct

SEQ ID NO: 801700 - DNA, 20 bp, mouse
ggcgacgcccggggaggacc

SEQ ID NO: 801701 - DNA, 20 bp, mouse
gccaggctgggagttgtctt

SEQ ID NO: 801702 - DNA, 20 bp, mouse
gaccgcgcctacccagccag

SEQ ID NO: 801703 - DNA, 20 bp, mouse
gcagtggcccatcggttccc

SEQ ID NO: 801704 - DNA, 20 bp, mouse
gaagactcgcacttttctct

SEQ ID NO: 801705 - DNA, 20 bp, mouse
gcacgtcgcgacgcccgggg

SEQ ID NO: 801706 - DNA, 20 bp, mouse
gcgccccgcggctacccctc

SEQ ID NO: 801707 - DNA, 20 bp, mouse
gcacggccgcagcccaagga

SEQ ID NO: 801708 - DNA, 20 bp, mouse
gagcctggaaaacgggtagg

SEQ ID NO: 801709 - DNA, 20 bp, mouse
gagaccgccccgccgccgga

SEQ ID NO: 801710 - DNA, 20 bp, mouse
gcccgcggctacccctccgg

SEQ ID NO: 801711 - DNA, 20 bp, mouse
gcggtctcctcgcaggtgtc

SEQ ID NO: 801712 - DNA, 20 bp, mouse
gcggggcgcgcgctcgcgaa

SEQ ID NO: 801713 - DNA, 20 bp, mouse
gcggagcctggaaaacgggt

SEQ ID NO: 801714 - DNA, 20 bp, mouse
ggccccgcgcagcccctcct

SEQ ID NO: 801715 - DNA, 20 bp, mouse
ggggagggcgcacaacggca

SEQ ID NO: 801716 - DNA, 20 bp, mouse
ggagcggctccgggactgag

SEQ ID NO: 801717 - DNA, 20 bp, mouse
gtggctcggacccggggagt

SEQ ID NO: 801718 - DNA, 20 bp, mouse
gggtgggtggtgcccgtggg

SEQ ID NO: 801719 - DNA, 20 bp, mouse
gcacgcgtggctcggacccg

SEQ ID NO: 801720 - DNA, 20 bp, mouse
ggagagtttgggtgtcagtt

SEQ ID NO: 801721 - DNA, 20 bp, mouse
gcgtcggcgagcgtggggcg

SEQ ID NO: 801722 - DNA, 20 bp, mouse
gggaatggccagggcacgcg

SEQ ID NO: 801723 - DNA, 20 bp, mouse
ggtggtgcccgtgggcggag

SEQ ID NO: 801724 - DNA, 20 bp, mouse
gggctccgctgcctccagtt

SEQ ID NO: 801725 - DNA, 20 bp, mouse
gagtttgggtgtcagttagg

SEQ ID NO: 801726 - DNA, 20 bp, mouse
gggcggggacggctgagggt

SEQ ID NO: 801727 - DNA, 20 bp, mouse
gggagggcggtggagtaagg

SEQ ID NO: 801728 - DNA, 20 bp, mouse
gtggagtaaggtggcgggga

SEQ ID NO: 801729 - DNA, 20 bp, mouse
gccgacccctggggagtccc

SEQ ID NO: 801730 - DNA, 20 bp, mouse
gcccgcgagcccgacccctg

SEQ ID NO: 801731 - DNA, 20 bp, mouse
ggggccggggcgcgagtgtc

SEQ ID NO: 801732 - DNA, 20 bp, mouse
gcgctccgcgcactcggcgt

SEQ ID NO: 801733 - DNA, 20 bp, mouse
gcgcccggaggcggcgagag

SEQ ID NO: 801734 - DNA, 20 bp, mouse
gccccctcccccaggaaaga

SEQ ID NO: 801735 - DNA, 20 bp, mouse
ggggctgaggagtgcgctcg

SEQ ID NO: 801736 - DNA, 20 bp, mouse
gtggggcggggcccgaaggt

SEQ ID NO: 801737 - DNA, 20 bp, mouse
gagcatcttagggacttgag

SEQ ID NO: 801738 - DNA, 20 bp, mouse
gtctaagaatcaggggttgg

SEQ ID NO: 801739 - DNA, 20 bp, mouse
gaggaagcgggccctggcag

SEQ ID NO: 801740 - DNA, 20 bp, mouse
gaggtgtatccttgaggagt

SEQ ID NO: 801741 - DNA, 20 bp, mouse
gggctggtgggagggattag

SEQ ID NO: 801742 - DNA, 20 bp, mouse
gtatccttgaggagtaggcc

SEQ ID NO: 801743 - DNA, 20 bp, mouse
gtcttctaggtgtatccttg

SEQ ID NO: 801744 - DNA, 20 bp, mouse
gggaggtgcccccaaggaca

SEQ ID NO: 801745 - DNA, 20 bp, mouse
gcagaggccacgcccacctt

SEQ ID NO: 801746 - DNA, 20 bp, mouse
gtgtctgcgcccggctgctg

SEQ ID NO: 801747 - DNA, 20 bp, mouse
gccgccgctgccaaccgggc

SEQ ID NO: 801748 - DNA, 20 bp, mouse
gggcgcagacagccttgcgg

SEQ ID NO: 801749 - DNA, 20 bp, mouse
ggcctcacccagataccctg

SEQ ID NO: 801750 - DNA, 20 bp, mouse
ggggtcagagcgggcaccgg

SEQ ID NO: 801751 - DNA, 20 bp, mouse
gggcgcagcccgcaccctcg

SEQ ID NO: 801752 - DNA, 20 bp, mouse
gcggggcttgggagccgcga

SEQ ID NO: 801753 - DNA, 20 bp, mouse
ggctgccgccgctgccaacc

SEQ ID NO: 801754 - DNA, 20 bp, mouse
ggcacctgcccggttggcag

SEQ ID NO: 801755 - DNA, 20 bp, mouse
gtgggagcctcagggtatct

SEQ ID NO: 801756 - DNA, 20 bp, mouse
gcggggcctgatgatgacac

SEQ ID NO: 801757 - DNA, 20 bp, mouse
gtaactggcggggtgtgaca

SEQ ID NO: 801758 - DNA, 20 bp, mouse
ggctgcaggaggtgctgtgt

SEQ ID NO: 801759 - DNA, 20 bp, mouse
gatgatgacactggcatgga

SEQ ID NO: 801760 - DNA, 20 bp, mouse
gtcccccactgcctagtgtg

SEQ ID NO: 801761 - DNA, 20 bp, mouse
gggtggtcctcccttagccg

SEQ ID NO: 801762 - DNA, 20 bp, mouse
ggcctcctcacactaggcag

SEQ ID NO: 801763 - DNA, 20 bp, mouse
ggcacaggcgtgcacattcc

SEQ ID NO: 801764 - DNA, 20 bp, mouse
gggtcaccttaagaagtctg

SEQ ID NO: 801765 - DNA, 20 bp, mouse
gatcaggccccggctaaggg

SEQ ID NO: 801766 - DNA, 20 bp, mouse
gcgggaggagagctaactga

SEQ ID NO: 801767 - DNA, 20 bp, mouse
gaaagcttatagatttcata

SEQ ID NO: 801768 - DNA, 20 bp, mouse
ggcaggcaaggtcagcagaa

SEQ ID NO: 801769 - DNA, 20 bp, mouse
gtgccagcagctgacgtaga

SEQ ID NO: 801770 - DNA, 20 bp, mouse
gacttcagggagcataaaga

SEQ ID NO: 801771 - DNA, 20 bp, mouse
gcctaacagcaggatttcct

SEQ ID NO: 801772 - DNA, 20 bp, mouse
gcagtcccactggcttctaa

SEQ ID NO: 801773 - DNA, 20 bp, mouse
gatggcagatcgcagaagaa

SEQ ID NO: 801774 - DNA, 20 bp, mouse
gtacgtcagctgctggcaga

SEQ ID NO: 801775 - DNA, 20 bp, mouse
ggacctcactccctaacagc

SEQ ID NO: 801776 - DNA, 20 bp, mouse
gaagccgggccgcgccccta

SEQ ID NO: 801777 - DNA, 20 bp, mouse
ggggccgcgcccctagggcc

SEQ ID NO: 801778 - DNA, 20 bp, mouse
gccgccaggcccggccctag

SEQ ID NO: 801779 - DNA, 20 bp, mouse
ggcctgcgagcgaaactcac

SEQ ID NO: 801780 - DNA, 20 bp, mouse
ggggacctccttcatcccgg

SEQ ID NO: 801781 - DNA, 20 bp, mouse
gtcgaggacagcacggactg

SEQ ID NO: 801782 - DNA, 20 bp, mouse
gtccgtgctgtcctcgaccc

SEQ ID NO: 801783 - DNA, 20 bp, mouse
gccggatagcaaggcactca

SEQ ID NO: 801784 - DNA, 20 bp, mouse
ggcctggcggcgggcggtgc

SEQ ID NO: 801785 - DNA, 20 bp, mouse
gggcttccgcgcgccccagg

SEQ ID NO: 801786 - DNA, 20 bp, mouse
ggggcggaggatcccctccg

SEQ ID NO: 801787 - DNA, 20 bp, mouse
ggcccggcttgagagaagtt

SEQ ID NO: 801788 - DNA, 20 bp, mouse
gtgcgcgccctgagatccta

SEQ ID NO: 801789 - DNA, 20 bp, mouse
gtggggatcagcgccacgga

SEQ ID NO: 801790 - DNA, 20 bp, mouse
gccgccgcccccaaacctcg

SEQ ID NO: 801791 - DNA, 20 bp, mouse
gcggagcgcgggacggtccc

SEQ ID NO: 801792 - DNA, 20 bp, mouse
gccggctttccggggttctc

SEQ ID NO: 801793 - DNA, 20 bp, mouse
ggaggggatcctccgccctc

SEQ ID NO: 801794 - DNA, 20 bp, mouse
ggaagcggggacaccagatg

SEQ ID NO: 801795 - DNA, 20 bp, mouse
gccgcagccctaggatctca

SEQ ID NO: 801796 - DNA, 20 bp, mouse
gtcaccaggctaccctctcc

SEQ ID NO: 801797 - DNA, 20 bp, mouse
gtgggtacttaaggcatctg

SEQ ID NO: 801798 - DNA, 20 bp, mouse
gaagatcctggagccataga

SEQ ID NO: 801799 - DNA, 20 bp, mouse
gactgaccccggaaagacag

SEQ ID NO: 801800 - DNA, 20 bp, mouse
gaaagactccagaccatcta

SEQ ID NO: 801801 - DNA, 20 bp, mouse
ggcctggtgactttttaccc

SEQ ID NO: 801802 - DNA, 20 bp, mouse
gagtattaggggatccactt

SEQ ID NO: 801803 - DNA, 20 bp, mouse
gtacttaaggcatctgggga

SEQ ID NO: 801804 - DNA, 20 bp, mouse
gtccaggatcttaggagtaa

SEQ ID NO: 801805 - DNA, 20 bp, mouse
gccaagctatgcccctggag

SEQ ID NO: 801806 - DNA, 20 bp, mouse
gagcagcctgggaagcagta

SEQ ID NO: 801807 - DNA, 20 bp, mouse
ggaaccagagagtcggtgat

SEQ ID NO: 801808 - DNA, 20 bp, mouse
gctcaaccctgcgtcccaga

SEQ ID NO: 801809 - DNA, 20 bp, mouse
gtacacactgaattcaagga

SEQ ID NO: 801810 - DNA, 20 bp, mouse
gggcccacgtggtactaggt

SEQ ID NO: 801811 - DNA, 20 bp, mouse
ggggaagcagtagggctgcc

SEQ ID NO: 801812 - DNA, 20 bp, mouse
gcctctctaggccaagagaa

SEQ ID NO: 801813 - DNA, 20 bp, mouse
ggtgagccacaagtcgggag

SEQ ID NO: 801814 - DNA, 20 bp, mouse
gacttggaattccaccgttt

SEQ ID NO: 801815 - DNA, 20 bp, mouse
gggagctctctccacttctt

SEQ ID NO: 801816 - DNA, 20 bp, mouse
gccaatccgcgatgtgaagt

SEQ ID NO: 801817 - DNA, 20 bp, mouse
ggtcacgcgcatgctccctg

SEQ ID NO: 801818 - DNA, 20 bp, mouse
gccaaaccctagtgccctca

SEQ ID NO: 801819 - DNA, 20 bp, mouse
ggggagcatgcgcgtgacgg

SEQ ID NO: 801820 - DNA, 20 bp, mouse
ggcaaccgccaggcccaaga

SEQ ID NO: 801821 - DNA, 20 bp, mouse
gatggtggagcaagaacgaa

SEQ ID NO: 801822 - DNA, 20 bp, mouse
gaccggggtgtcaggataca

SEQ ID NO: 801823 - DNA, 20 bp, mouse
gtccagaggaagaaggtcag

SEQ ID NO: 801824 - DNA, 20 bp, mouse
gggtgcgttgtttgtagcgt

SEQ ID NO: 801825 - DNA, 20 bp, mouse
gtgggcctggcggttgccga

SEQ ID NO: 801826 - DNA, 20 bp, mouse
gtgccgagagacagcgcgtg

SEQ ID NO: 801827 - DNA, 20 bp, mouse
ggggacgctgatcccaggac

SEQ ID NO: 801828 - DNA, 20 bp, mouse
gggcctgggacgctgatccc

SEQ ID NO: 801829 - DNA, 20 bp, mouse
gtaatctcgcaggctttcgg

SEQ ID NO: 801830 - DNA, 20 bp, mouse
gagtgcttacgtcacgagag

SEQ ID NO: 801831 - DNA, 20 bp, mouse
gcgcacgcgccctgtattta

SEQ ID NO: 801832 - DNA, 20 bp, mouse
ggctgcactaaaagtgggcg

SEQ ID NO: 801833 - DNA, 20 bp, mouse
gtccggccttaattccaatc

SEQ ID NO: 801834 - DNA, 20 bp, mouse
ggtgcactgtaaagtcaggg

SEQ ID NO: 801835 - DNA, 20 bp, mouse
ggccagcaaaaccactgaaa

SEQ ID NO: 801836 - DNA, 20 bp, mouse
gggaaggcggtgcctgcaca

SEQ ID NO: 801837 - DNA, 20 bp, mouse
gaccggaagtacagccctcc

SEQ ID NO: 801838 - DNA, 20 bp, mouse
gacgagctcctggcaaggca

SEQ ID NO: 801839 - DNA, 20 bp, mouse
gggaagaaggaaccggaagg

SEQ ID NO: 801840 - DNA, 20 bp, mouse
gtggctgttcataacccagg

SEQ ID NO: 801841 - DNA, 20 bp, mouse
gctcctggcaaggcagggct

SEQ ID NO: 801842 - DNA, 20 bp, mouse
gcgaaacccggacggattgg

SEQ ID NO: 801843 - DNA, 20 bp, mouse
gctctgcgcttccgattcaa

SEQ ID NO: 801844 - DNA, 20 bp, mouse
ggaatcggaagcgcagagac

SEQ ID NO: 801845 - DNA, 20 bp, mouse
gatacagggcggaaaagaag

SEQ ID NO: 801846 - DNA, 20 bp, mouse
gagccccggggcgtgagcag

SEQ ID NO: 801847 - DNA, 20 bp, mouse
gggcccgcgggcggaaggaa

SEQ ID NO: 801848 - DNA, 20 bp, mouse
gcatcccggaggcccgcggg

SEQ ID NO: 801849 - DNA, 20 bp, mouse
ggccccggggctgtgtgcac

SEQ ID NO: 801850 - DNA, 20 bp, mouse
gcgcctctgctcacgccccg

SEQ ID NO: 801851 - DNA, 20 bp, mouse
ggatggtcgtgctgcgaacc

SEQ ID NO: 801852 - DNA, 20 bp, mouse
gtggcctttgcaagctttgt

SEQ ID NO: 801853 - DNA, 20 bp, mouse
ggaccatcccggaggcccgc

SEQ ID NO: 801854 - DNA, 20 bp, mouse
gtcgcccgtgcacacagccc

SEQ ID NO: 801855 - DNA, 20 bp, mouse
gcgtgagcagaggcggagac

SEQ ID NO: 801856 - DNA, 20 bp, mouse
gagagggaggagaccgcgga

SEQ ID NO: 801857 - DNA, 20 bp, mouse
ggtaggagcccgcccaggga

SEQ ID NO: 801858 - DNA, 20 bp, mouse
gcggcagagggaggagaccg

SEQ ID NO: 801859 - DNA, 20 bp, mouse
gggaggagcccgccgagtcc

SEQ ID NO: 801860 - DNA, 20 bp, mouse
ggggaggagctcacagagag

SEQ ID NO: 801861 - DNA, 20 bp, mouse
gagcccctgcctcctacccc

SEQ ID NO: 801862 - DNA, 20 bp, mouse
gcggcggagggagaagccag

SEQ ID NO: 801863 - DNA, 20 bp, mouse
ggggaggagaccgcggaggg

SEQ ID NO: 801864 - DNA, 20 bp, mouse
gctgaggagttggtgaaggt

SEQ ID NO: 801865 - DNA, 20 bp, mouse
gccctccgccggccctccct

SEQ ID NO: 801866 - DNA, 20 bp, mouse
ggtggggagtcaatcgttcc

SEQ ID NO: 801867 - DNA, 20 bp, mouse
gaagagagactggctatcgt

SEQ ID NO: 801868 - DNA, 20 bp, mouse
gtaaggggtccaagagagac

SEQ ID NO: 801869 - DNA, 20 bp, mouse
ggcactgggcgtgccacaaa

SEQ ID NO: 801870 - DNA, 20 bp, mouse
gtgcctgggcgcttctcggg

SEQ ID NO: 801871 - DNA, 20 bp, mouse
gggagtcaatcgttcctgga

SEQ ID NO: 801872 - DNA, 20 bp, mouse
gttctagtaagggttgtctt

SEQ ID NO: 801873 - DNA, 20 bp, mouse
gcagtgcctgggcgcttctc

SEQ ID NO: 801874 - DNA, 20 bp, mouse
gcccagggggcggagataga

SEQ ID NO: 801875 - DNA, 20 bp, mouse
gatggtgaggacaccttttg

SEQ ID NO: 801876 - DNA, 20 bp, mouse
ggggtgttgcggtcccacca

SEQ ID NO: 801877 - DNA, 20 bp, mouse
ggctcccttgagggcgtcgg

SEQ ID NO: 801878 - DNA, 20 bp, mouse
gctcctaggggcgtgcgctg

SEQ ID NO: 801879 - DNA, 20 bp, mouse
gccacccccgacgccctcaa

SEQ ID NO: 801880 - DNA, 20 bp, mouse
ggattccaccgatccctggt

SEQ ID NO: 801881 - DNA, 20 bp, mouse
gcccggcgctagactctcac

SEQ ID NO: 801882 - DNA, 20 bp, mouse
gagccacagcgcacgcccct

SEQ ID NO: 801883 - DNA, 20 bp, mouse
gcggtcccaccagggatcgg

SEQ ID NO: 801884 - DNA, 20 bp, mouse
gtcccagcctgcgaattcgc

SEQ ID NO: 801885 - DNA, 20 bp, mouse
gggcgggatggggctagcgt

SEQ ID NO: 801886 - DNA, 20 bp, mouse
gtcaggcaatgcaaggatgg

SEQ ID NO: 801887 - DNA, 20 bp, mouse
gtctcccagttgagtaaaca

SEQ ID NO: 801888 - DNA, 20 bp, mouse
gggatgctggtaaagatcta

SEQ ID NO: 801889 - DNA, 20 bp, mouse
gctacagctccaagtcagta

SEQ ID NO: 801890 - DNA, 20 bp, mouse
gtgctggtaaagatctaggg

SEQ ID NO: 801891 - DNA, 20 bp, mouse
gagcccctccttcccacctt

SEQ ID NO: 801892 - DNA, 20 bp, mouse
gcaaggcagggcttataaaa

SEQ ID NO: 801893 - DNA, 20 bp, mouse
gcagttgagtaaacagggtc

SEQ ID NO: 801894 - DNA, 20 bp, mouse
gcaggatcaggacccaaggt

SEQ ID NO: 801895 - DNA, 20 bp, mouse
gtattcaggcaatgcaagga

SEQ ID NO: 801896 - DNA, 20 bp, mouse
ggccccctgacacacggtct

SEQ ID NO: 801897 - DNA, 20 bp, mouse
gcatgtgaagaggttaggag

SEQ ID NO: 801898 - DNA, 20 bp, mouse
gaacctcttcacatggaaat

SEQ ID NO: 801899 - DNA, 20 bp, mouse
gctcccagaccgtgtgtcag

SEQ ID NO: 801900 - DNA, 20 bp, mouse
gagccaatttccatgtgaag

SEQ ID NO: 801901 - DNA, 20 bp, mouse
gctggtaattgcctgacact

SEQ ID NO: 801902 - DNA, 20 bp, mouse
gttaatagccccctgacaca

SEQ ID NO: 801903 - DNA, 20 bp, mouse
gcgctccagcagccggttcc

SEQ ID NO: 801904 - DNA, 20 bp, mouse
gtcccaaatggcccgggaac

SEQ ID NO: 801905 - DNA, 20 bp, mouse
gaatctgcctgttacttgaa

SEQ ID NO: 801906 - DNA, 20 bp, mouse
ggaagagagcagggtcggga

SEQ ID NO: 801907 - DNA, 20 bp, mouse
gagggcaagggacctcggga

SEQ ID NO: 801908 - DNA, 20 bp, mouse
gccgccacccgtcatctcgg

SEQ ID NO: 801909 - DNA, 20 bp, mouse
gggacctcgggaagggacgg

SEQ ID NO: 801910 - DNA, 20 bp, mouse
ggaggggtgtgtgtccagag

SEQ ID NO: 801911 - DNA, 20 bp, mouse
gaaggctcaaggaagagagc

SEQ ID NO: 801912 - DNA, 20 bp, mouse
ggggcctccgagatgacggg

SEQ ID NO: 801913 - DNA, 20 bp, mouse
gaaaccaggagggtcactgg

SEQ ID NO: 801914 - DNA, 20 bp, mouse
ggaaactgcgccccgtgggg

SEQ ID NO: 801915 - DNA, 20 bp, mouse
ggtggggcttcatgctttta

SEQ ID NO: 801916 - DNA, 20 bp, mouse
gtggtcacatacgaatctca

SEQ ID NO: 801917 - DNA, 20 bp, mouse
gagcgagttagagttaggcg

SEQ ID NO: 801918 - DNA, 20 bp, mouse
gtcctggaagatggcgccgg

SEQ ID NO: 801919 - DNA, 20 bp, mouse
gggaagatggcgccggtggg

SEQ ID NO: 801920 - DNA, 20 bp, mouse
gaggcttgcacttacaaaaa

SEQ ID NO: 801921 - DNA, 20 bp, mouse
ggcagagtatctgtcagctg

SEQ ID NO: 801922 - DNA, 20 bp, mouse
ggagtatctgtcagctgtgg

SEQ ID NO: 801923 - DNA, 20 bp, mouse
ggttagagttaggcgcgggg

SEQ ID NO: 801924 - DNA, 20 bp, mouse
gtacagaattacattagggt

SEQ ID NO: 801925 - DNA, 20 bp, mouse
gtaccgcgatcatctggttt

SEQ ID NO: 801926 - DNA, 20 bp, mouse
gtggagatgtgaaacagtga

SEQ ID NO: 801927 - DNA, 20 bp, mouse
gtgggggcatcacacagaag

SEQ ID NO: 801928 - DNA, 20 bp, mouse
gaatgaacaagcgagatcag

SEQ ID NO: 801929 - DNA, 20 bp, mouse
gagactgaggtgagatttaa

SEQ ID NO: 801930 - DNA, 20 bp, mouse
gagctgcagcagaagcgttt

SEQ ID NO: 801931 - DNA, 20 bp, mouse
gacagtgaaggatcagaggg

SEQ ID NO: 801932 - DNA, 20 bp, mouse
gttgacgtcattccagactg

SEQ ID NO: 801933 - DNA, 20 bp, mouse
ggaaacagtgaaggatcaga

SEQ ID NO: 801934 - DNA, 20 bp, mouse
gtgctggtcctctgctggag

SEQ ID NO: 801935 - DNA, 20 bp, mouse
ggtgggggccctaatataga

SEQ ID NO: 801936 - DNA, 20 bp, mouse
gtgactgaatgggaaacggt

SEQ ID NO: 801937 - DNA, 20 bp, mouse
gaagcaagtgaagcaccctg

SEQ ID NO: 801938 - DNA, 20 bp, mouse
gtgaagcaccctgagggaga

SEQ ID NO: 801939 - DNA, 20 bp, mouse
gggcctctcccctctccctc

SEQ ID NO: 801940 - DNA, 20 bp, mouse
gtcacaaagcagggctttga

SEQ ID NO: 801941 - DNA, 20 bp, mouse
gaggggagaggcccggcctg

SEQ ID NO: 801942 - DNA, 20 bp, mouse
gggcagagatcggagggtca

SEQ ID NO: 801943 - DNA, 20 bp, mouse
gagagatcggcagagatcgg

SEQ ID NO: 801944 - DNA, 20 bp, mouse
gaggacagaaagtcggacaa

SEQ ID NO: 801945 - DNA, 20 bp, mouse
gcatgtggaagccacttcac

SEQ ID NO: 801946 - DNA, 20 bp, mouse
gtgcgctcctcgactctgaa

SEQ ID NO: 801947 - DNA, 20 bp, mouse
gggggggtgcgtcactaaca

SEQ ID NO: 801948 - DNA, 20 bp, mouse
gctgctgggccgtgggaaga

SEQ ID NO: 801949 - DNA, 20 bp, mouse
gggaagatggcggacggaaa

SEQ ID NO: 801950 - DNA, 20 bp, mouse
gcagagtcgaggagcgcaaa

SEQ ID NO: 801951 - DNA, 20 bp, mouse
gggtcatcgccctgcatctc

SEQ ID NO: 801952 - DNA, 20 bp, mouse
ggaaaagcatccccggttgg

SEQ ID NO: 801953 - DNA, 20 bp, mouse
gggggccaggcggagtcacg

SEQ ID NO: 801954 - DNA, 20 bp, mouse
gtcactaggacgccgaatgt

SEQ ID NO: 801955 - DNA, 20 bp, mouse
gcaggcggagtcacgtggtt

SEQ ID NO: 801956 - DNA, 20 bp, mouse
ggtaacaatggggaagataa

SEQ ID NO: 801957 - DNA, 20 bp, mouse
gaggcctggtgggcagagga

SEQ ID NO: 801958 - DNA, 20 bp, mouse
gtacccgcccagacgggcgg

SEQ ID NO: 801959 - DNA, 20 bp, mouse
ggcccaccaggccttttcga

SEQ ID NO: 801960 - DNA, 20 bp, mouse
gcaaaatggcgaaggagggt

SEQ ID NO: 801961 - DNA, 20 bp, mouse
gtctgggcgggtagtctgtc

SEQ ID NO: 801962 - DNA, 20 bp, mouse
ggccctcgaaaaggcctggt

SEQ ID NO: 801963 - DNA, 20 bp, mouse
ggagggtggggcctgtcaca

SEQ ID NO: 801964 - DNA, 20 bp, mouse
gcccagacgggcggcgggtc

SEQ ID NO: 801965 - DNA, 20 bp, mouse
gtcagtgctaggtaacaatg

SEQ ID NO: 801966 - DNA, 20 bp, mouse
ggggatataaggttgtttgg

SEQ ID NO: 801967 - DNA, 20 bp, mouse
gatgaatgaaaggtgggtaa

SEQ ID NO: 801968 - DNA, 20 bp, mouse
gtggtgtgatgaatgaaagg

SEQ ID NO: 801969 - DNA, 20 bp, mouse
gcaagaagacaataccacgc

SEQ ID NO: 801970 - DNA, 20 bp, mouse
ggctgatgtgacttagtcca

SEQ ID NO: 801971 - DNA, 20 bp, mouse
gagaagacataacgggagga

SEQ ID NO: 801972 - DNA, 20 bp, mouse
gacaataccacgcaggctga

SEQ ID NO: 801973 - DNA, 20 bp, mouse
gtggtgctgagagctcccaa

SEQ ID NO: 801974 - DNA, 20 bp, mouse
gctctcagcaccagtgttga

SEQ ID NO: 801975 - DNA, 20 bp, mouse
gggtgggaagtgggtggagc

SEQ ID NO: 801976 - DNA, 20 bp, mouse
gcaaggagatggtaaaggtc

SEQ ID NO: 801977 - DNA, 20 bp, mouse
ggcaggaaacttgctcggtg

SEQ ID NO: 801978 - DNA, 20 bp, mouse
gggagccagcctgtataaat

SEQ ID NO: 801979 - DNA, 20 bp, mouse
gccagcgccgcccgctgacc

SEQ ID NO: 801980 - DNA, 20 bp, mouse
ggataacctttcacgcagac

SEQ ID NO: 801981 - DNA, 20 bp, mouse
gagattctgtctaagaagaa

SEQ ID NO: 801982 - DNA, 20 bp, mouse
ggtcaccctgtctgcgtgaa

SEQ ID NO: 801983 - DNA, 20 bp, mouse
gttatctcttagcaaggaga

SEQ ID NO: 801984 - DNA, 20 bp, mouse
gtgccatctctccagatcag

SEQ ID NO: 801985 - DNA, 20 bp, mouse
gcttagtagtagactgaagc

SEQ ID NO: 801986 - DNA, 20 bp, mouse
gcgcgtactcgggtactcat

SEQ ID NO: 801987 - DNA, 20 bp, mouse
gctccccgccccggcttcgt

SEQ ID NO: 801988 - DNA, 20 bp, mouse
ggagtacccgagtacgcgga

SEQ ID NO: 801989 - DNA, 20 bp, mouse
gtcagccaacgaagccgggg

SEQ ID NO: 801990 - DNA, 20 bp, mouse
gaactcagccaacgaagccg

SEQ ID NO: 801991 - DNA, 20 bp, mouse
gtcccgggcgcaaacaccag

SEQ ID NO: 801992 - DNA, 20 bp, mouse
gactcgggtactcatgggtg

SEQ ID NO: 801993 - DNA, 20 bp, mouse
gaggggacgccaccctccag

SEQ ID NO: 801994 - DNA, 20 bp, mouse
gtggctgagttcgccccggg

SEQ ID NO: 801995 - DNA, 20 bp, mouse
gtcccacaacctcccacccg

SEQ ID NO: 801996 - DNA, 20 bp, mouse
gaactccgggtgggagaaat

SEQ ID NO: 801997 - DNA, 20 bp, mouse
ggcggggcgaaagtcagctc

SEQ ID NO: 801998 - DNA, 20 bp, mouse
gaccggaaataactccgggt

SEQ ID NO: 801999 - DNA, 20 bp, mouse
ggtagcttttgtggtggttg

SEQ ID NO: 802000 - DNA, 20 bp, mouse
gcagagaccggaaataactc

SEQ ID NO: 802001 - DNA, 20 bp, mouse
gaagctgcgggccggcgtga

SEQ ID NO: 802002 - DNA, 20 bp, mouse
gcgggccggcgtgaaggagg

SEQ ID NO: 802003 - DNA, 20 bp, mouse
gcgcacaacaggctcaggcg

SEQ ID NO: 802004 - DNA, 20 bp, mouse
ggacctctggaactccgttc

SEQ ID NO: 802005 - DNA, 20 bp, mouse
gaaccgaggcccggaagctg

SEQ ID NO: 802006 - DNA, 20 bp, mouse
ggggccatccctgccaccga

SEQ ID NO: 802007 - DNA, 20 bp, mouse
gtggaggtgagctaagggcg

SEQ ID NO: 802008 - DNA, 20 bp, mouse
ggcaactgcccccctccacc

SEQ ID NO: 802009 - DNA, 20 bp, mouse
ggggggtggaggtgagctaa

SEQ ID NO: 802010 - DNA, 20 bp, mouse
ggggcctgcttctctcgacc

SEQ ID NO: 802011 - DNA, 20 bp, mouse
gagcgccccgcaggccgcct

SEQ ID NO: 802012 - DNA, 20 bp, mouse
gcggcctgcggggcgctctg

SEQ ID NO: 802013 - DNA, 20 bp, mouse
ggaagcaggcccggagcccg

SEQ ID NO: 802014 - DNA, 20 bp, mouse
gggggcagttgcctccgagg

SEQ ID NO: 802015 - DNA, 20 bp, mouse
ggcctccgaggcggcctgcg

SEQ ID NO: 802016 - DNA, 20 bp, mouse
gtagccccgcccacagaacc

SEQ ID NO: 802017 - DNA, 20 bp, mouse
gtctgtgggcggggctacat

SEQ ID NO: 802018 - DNA, 20 bp, mouse
gttaccggggccgcgaaggt

SEQ ID NO: 802019 - DNA, 20 bp, mouse
gccgggtaaagtccacccag

SEQ ID NO: 802020 - DNA, 20 bp, mouse
gggggccgcgaaggtgggtt

SEQ ID NO: 802021 - DNA, 20 bp, mouse
gggacgctgtgcggttaccg

SEQ ID NO: 802022 - DNA, 20 bp, mouse
gtcggcgaatggacgctgtg

SEQ ID NO: 802023 - DNA, 20 bp, mouse
gccgcccacagaacccgggt

SEQ ID NO: 802024 - DNA, 20 bp, mouse
gacagcccaacccaccttcg

SEQ ID NO: 802025 - DNA, 20 bp, mouse
gcgcgtggagatgacgcacg

SEQ ID NO: 802026 - DNA, 20 bp, mouse
gaggcaacggcggactcgcg

SEQ ID NO: 802027 - DNA, 20 bp, mouse
ggaagcctgggcagccaatg

SEQ ID NO: 802028 - DNA, 20 bp, mouse
gccggggcgccaacccgctc

SEQ ID NO: 802029 - DNA, 20 bp, mouse
gggcacgctcggggaaatgg

SEQ ID NO: 802030 - DNA, 20 bp, mouse
gcaaccgcaggggcacgctc

SEQ ID NO: 802031 - DNA, 20 bp, mouse
gttccgccggcgactccctt

SEQ ID NO: 802032 - DNA, 20 bp, mouse
gccagcccaaagggagtcgc

SEQ ID NO: 802033 - DNA, 20 bp, mouse
ggggaaatggcggcggtggg

SEQ ID NO: 802034 - DNA, 20 bp, mouse
gggttggcgccccgggatgg

SEQ ID NO: 802035 - DNA, 20 bp, mouse
gcaccccggacagccgacta

SEQ ID NO: 802036 - DNA, 20 bp, mouse
gccgaggcagccaatggatg

SEQ ID NO: 802037 - DNA, 20 bp, mouse
gcaactctgacggacggcgg

SEQ ID NO: 802038 - DNA, 20 bp, mouse
ggggcaggcgcgctcttgat

SEQ ID NO: 802039 - DNA, 20 bp, mouse
gctgtcccgcccccatccat

SEQ ID NO: 802040 - DNA, 20 bp, mouse
gtcagcttctggcggttacg

SEQ ID NO: 802041 - DNA, 20 bp, mouse
gaaactggaacggagacata

SEQ ID NO: 802042 - DNA, 20 bp, mouse
gtaacaaatgcagggagata

SEQ ID NO: 802043 - DNA, 20 bp, mouse
gacggcgggggtttggcgag

SEQ ID NO: 802044 - DNA, 20 bp, mouse
gctgacggacggcgggggtt

SEQ ID NO: 802045 - DNA, 20 bp, mouse
gtacggaatttcctctccta

SEQ ID NO: 802046 - DNA, 20 bp, mouse
ggtagcccgccgagcggaag

SEQ ID NO: 802047 - DNA, 20 bp, mouse
gagcggaagccctggaggac

SEQ ID NO: 802048 - DNA, 20 bp, mouse
gtaccgcctccggtcctcca

SEQ ID NO: 802049 - DNA, 20 bp, mouse
gacgcgagcggaagccctgg

SEQ ID NO: 802050 - DNA, 20 bp, mouse
ggctacgcgagcggaagccc

SEQ ID NO: 802051 - DNA, 20 bp, mouse
ggagcggtcacgtgttcgga

SEQ ID NO: 802052 - DNA, 20 bp, mouse
gtggccagggtcagaacatg

SEQ ID NO: 802053 - DNA, 20 bp, mouse
ggtcccagcttgccggcctg

SEQ ID NO: 802054 - DNA, 20 bp, mouse
gagttcgagtcccacctcgg

SEQ ID NO: 802055 - DNA, 20 bp, mouse
gggcgtcgcccggggttcaa

SEQ ID NO: 802056 - DNA, 20 bp, mouse
gaccacgcgggaggccgtga

SEQ ID NO: 802057 - DNA, 20 bp, mouse
gccctcgccgcgctccctca

SEQ ID NO: 802058 - DNA, 20 bp, mouse
gcgcgggcgttctgaaggtg

SEQ ID NO: 802059 - DNA, 20 bp, mouse
gacgcggccggtaaacaaga

SEQ ID NO: 802060 - DNA, 20 bp, mouse
ggggcgcgcgggcgttctga

SEQ ID NO: 802061 - DNA, 20 bp, mouse
ggactcggcgaggggtcagg

SEQ ID NO: 802062 - DNA, 20 bp, mouse
gagagggtggaaaccgtccc

SEQ ID NO: 802063 - DNA, 20 bp, mouse
ggggaagcagcgggcgagca

SEQ ID NO: 802064 - DNA, 20 bp, mouse
ggggaggccgtgagggagcg

SEQ ID NO: 802065 - DNA, 20 bp, mouse
ggcgcgggccgtaccaatcg

SEQ ID NO: 802066 - DNA, 20 bp, mouse
gcggaaacccaggtttgctc

SEQ ID NO: 802067 - DNA, 20 bp, mouse
ggcgtggtgtcgcggagcgt

SEQ ID NO: 802068 - DNA, 20 bp, mouse
gactcgtgacaacccgtcgg

SEQ ID NO: 802069 - DNA, 20 bp, mouse
gacgcctggcctctgcgatc

SEQ ID NO: 802070 - DNA, 20 bp, mouse
gaggcgtcccggcactgcgc

SEQ ID NO: 802071 - DNA, 20 bp, mouse
ggctccgcgacaccacgcat

SEQ ID NO: 802072 - DNA, 20 bp, mouse
gtcgcccatgcgtggtgtcg

SEQ ID NO: 802073 - DNA, 20 bp, mouse
ggaaactcgtgacaacccgt

SEQ ID NO: 802074 - DNA, 20 bp, mouse
gtcgcagaggccaggcgtcc

SEQ ID NO: 802075 - DNA, 20 bp, mouse
ggtgcgccagctaatacttc

SEQ ID NO: 802076 - DNA, 20 bp, mouse
ggggcagcagagctagccac

SEQ ID NO: 802077 - DNA, 20 bp, mouse
ggccccttgggaatcagcac

SEQ ID NO: 802078 - DNA, 20 bp, mouse
gtggaaaggaaatccccaga

SEQ ID NO: 802079 - DNA, 20 bp, mouse
gccttgggaatcagcacagg

SEQ ID NO: 802080 - DNA, 20 bp, mouse
gtcccagccgtgcttctctt

SEQ ID NO: 802081 - DNA, 20 bp, mouse
ggtatgtgccattgtccctg

SEQ ID NO: 802082 - DNA, 20 bp, mouse
ggaagcacggctgggagatc

SEQ ID NO: 802083 - DNA, 20 bp, mouse
gaaatccccagaaggctgcc

SEQ ID NO: 802084 - DNA, 20 bp, mouse
gtccctcttccatgattccc

SEQ ID NO: 802085 - DNA, 20 bp, mouse
gttggcttctaagaaaaaat

SEQ ID NO: 802086 - DNA, 20 bp, mouse
gacaggaagtatcctctacc

SEQ ID NO: 802087 - DNA, 20 bp, mouse
gtaaaccacaggtcagtggg

SEQ ID NO: 802088 - DNA, 20 bp, mouse
gggcatgggttcaggagatc

SEQ ID NO: 802089 - DNA, 20 bp, mouse
gaaacaagacaatcaggctt

SEQ ID NO: 802090 - DNA, 20 bp, mouse
gaggggagaggcatgggttc

SEQ ID NO: 802091 - DNA, 20 bp, mouse
gacaatcaggcttgggactc

SEQ ID NO: 802092 - DNA, 20 bp, mouse
gttccagaagtgatgggaaa

SEQ ID NO: 802093 - DNA, 20 bp, mouse
gctaccattccagaagtgat

SEQ ID NO: 802094 - DNA, 20 bp, mouse
gagccctttcccatcacttc

SEQ ID NO: 802095 - DNA, 20 bp, mouse
gtgagactgttctaaaccac

SEQ ID NO: 802096 - DNA, 20 bp, mouse
ggtaagagacagcaatagtg

SEQ ID NO: 802097 - DNA, 20 bp, mouse
gtgttgctcaggttgctcaa

SEQ ID NO: 802098 - DNA, 20 bp, mouse
ggagctaaatctaatgtgca

SEQ ID NO: 802099 - DNA, 20 bp, mouse
gttactgcccacacaggacc

SEQ ID NO: 802100 - DNA, 20 bp, mouse
gctctgggtgccatgtgaac

SEQ ID NO: 802101 - DNA, 20 bp, mouse
gaaagagtccagcttcttgc

SEQ ID NO: 802102 - DNA, 20 bp, mouse
gtcttcagattggtaaacta

SEQ ID NO: 802103 - DNA, 20 bp, mouse
gctgctattgggtctgacca

SEQ ID NO: 802104 - DNA, 20 bp, mouse
gcacattagatttagctcat

SEQ ID NO: 802105 - DNA, 20 bp, mouse
gaatgggtggcgaagaagcc

SEQ ID NO: 802106 - DNA, 20 bp, mouse
ggacagtcgaagtgagacat

SEQ ID NO: 802107 - DNA, 20 bp, mouse
gtcgaagtgagacattggta

SEQ ID NO: 802108 - DNA, 20 bp, mouse
ggttctcattagacactcat

SEQ ID NO: 802109 - DNA, 20 bp, mouse
gcttgagtgcacactgttgg

SEQ ID NO: 802110 - DNA, 20 bp, mouse
ggagtgcacactgttggagg

SEQ ID NO: 802111 - DNA, 20 bp, mouse
gcgttcacagacttgtgagg

SEQ ID NO: 802112 - DNA, 20 bp, mouse
gtagacactcatgggctctt

SEQ ID NO: 802113 - DNA, 20 bp, mouse
gtgaagaaaggtcatggtag

SEQ ID NO: 802114 - DNA, 20 bp, mouse
ggtgcttgagtgcacactgt

SEQ ID NO: 802115 - DNA, 20 bp, mouse
gctcaagcacactgttcctc

SEQ ID NO: 802116 - DNA, 20 bp, mouse
gagccctggggcttataagt

SEQ ID NO: 802117 - DNA, 20 bp, mouse
gacagtcaggggaagagagt

SEQ ID NO: 802118 - DNA, 20 bp, mouse
ggaggagcactgtgctatct

SEQ ID NO: 802119 - DNA, 20 bp, mouse
ggcactgtgctatctgggtt

SEQ ID NO: 802120 - DNA, 20 bp, mouse
gtgtgctatctgggttaggt

SEQ ID NO: 802121 - DNA, 20 bp, mouse
gggaggaaagagatactgtc

SEQ ID NO: 802122 - DNA, 20 bp, mouse
gtggatcaagacagtctggg

SEQ ID NO: 802123 - DNA, 20 bp, mouse
gggagtgtcctctggatttg

SEQ ID NO: 802124 - DNA, 20 bp, mouse
gccagagcaaacatcaaaga

SEQ ID NO: 802125 - DNA, 20 bp, mouse
gcagtgctcctcaaatccag

SEQ ID NO: 802126 - DNA, 20 bp, mouse
gaaccaaggccactaatcat

SEQ ID NO: 802127 - DNA, 20 bp, mouse
ggataaggaccatacacata

SEQ ID NO: 802128 - DNA, 20 bp, mouse
gtcaaatattaaccacctgg

SEQ ID NO: 802129 - DNA, 20 bp, mouse
gaccatacacataaggaaag

SEQ ID NO: 802130 - DNA, 20 bp, mouse
ggggtcaaatattaaccacc

SEQ ID NO: 802131 - DNA, 20 bp, mouse
gaatacacacagcacttcct

SEQ ID NO: 802132 - DNA, 20 bp, mouse
ggaagttggcctgaacgtca

SEQ ID NO: 802133 - DNA, 20 bp, mouse
gttcagtcctaccctgagca

SEQ ID NO: 802134 - DNA, 20 bp, mouse
gtgcccatgattagtggcct

SEQ ID NO: 802135 - DNA, 20 bp, mouse
gcactaatcatgggcaaaca

SEQ ID NO: 802136 - DNA, 20 bp, mouse
ggtgggcgttccagcctcgg

SEQ ID NO: 802137 - DNA, 20 bp, mouse
gcaggcagacccaatgggga

SEQ ID NO: 802138 - DNA, 20 bp, mouse
gtgggtttctgtacagaaat

SEQ ID NO: 802139 - DNA, 20 bp, mouse
gacttccaagcagacaaggt

SEQ ID NO: 802140 - DNA, 20 bp, mouse
gagggtcttcctgacagtca

SEQ ID NO: 802141 - DNA, 20 bp, mouse
gccacgcaaacagattgggg

SEQ ID NO: 802142 - DNA, 20 bp, mouse
gcaaggatgcccctccccat

SEQ ID NO: 802143 - DNA, 20 bp, mouse
gcctggaaggttctcccctg

SEQ ID NO: 802144 - DNA, 20 bp, mouse
ggaaacccaccttgtctgct

SEQ ID NO: 802145 - DNA, 20 bp, mouse
ggggcaccaagtggttccag

SEQ ID NO: 802146 - DNA, 20 bp, mouse
gacggaagctacagtgaaaa

SEQ ID NO: 802147 - DNA, 20 bp, mouse
gtgtacttctgcaaaatcta

SEQ ID NO: 802148 - DNA, 20 bp, mouse
gtaaagagctcactaggagg

SEQ ID NO: 802149 - DNA, 20 bp, mouse
gaaggtgcaaaggtggagtg

SEQ ID NO: 802150 - DNA, 20 bp, mouse
gggtcacagctgcctaggtg

SEQ ID NO: 802151 - DNA, 20 bp, mouse
gctcaaagctcagaggttta

SEQ ID NO: 802152 - DNA, 20 bp, mouse
gggtggagtgcggatacgga

SEQ ID NO: 802153 - DNA, 20 bp, mouse
gcgtggggaaggtgcaaagg

SEQ ID NO: 802154 - DNA, 20 bp, mouse
gagctgcctaggtggggcac

SEQ ID NO: 802155 - DNA, 20 bp, mouse
gtgttaaagagctcactagg

SEQ ID NO: 802156 - DNA, 20 bp, mouse
ggggccgtgggcatttgcgt

SEQ ID NO: 802157 - DNA, 20 bp, mouse
ggtcagccatgctcttcttg

SEQ ID NO: 802158 - DNA, 20 bp, mouse
gtctgctaggcttttcttca

SEQ ID NO: 802159 - DNA, 20 bp, mouse
ggagtaaattggcaatgtgg

SEQ ID NO: 802160 - DNA, 20 bp, mouse
gccacccacgcaaatgccca

SEQ ID NO: 802161 - DNA, 20 bp, mouse
gccttgatgaaagaaggtgg

SEQ ID NO: 802162 - DNA, 20 bp, mouse
gaaatgcccacggccctcac

SEQ ID NO: 802163 - DNA, 20 bp, mouse
gtatgggggcatgtgctcca

SEQ ID NO: 802164 - DNA, 20 bp, mouse
gggaaactcactcttctgat

SEQ ID NO: 802165 - DNA, 20 bp, mouse
ggtgggggaaggctgcacag

SEQ ID NO: 802166 - DNA, 20 bp, mouse
ggggccgaggattgtgtctt

SEQ ID NO: 802167 - DNA, 20 bp, mouse
gcagcacagcaaaactgatt

SEQ ID NO: 802168 - DNA, 20 bp, mouse
gagacgtcggtggagacgtt

SEQ ID NO: 802169 - DNA, 20 bp, mouse
gaaaccgaagacacaatcct

SEQ ID NO: 802170 - DNA, 20 bp, mouse
ggctgtgctgggattggact

SEQ ID NO: 802171 - DNA, 20 bp, mouse
gaggcgcccgtcgcggagag

SEQ ID NO: 802172 - DNA, 20 bp, mouse
ggaggatgatggccgaatga

SEQ ID NO: 802173 - DNA, 20 bp, mouse
ggccccgcccctctccgcga

SEQ ID NO: 802174 - DNA, 20 bp, mouse
gcggcgagccgacacacttc

SEQ ID NO: 802175 - DNA, 20 bp, mouse
gatgggatgtagttttacag

SEQ ID NO: 802176 - DNA, 20 bp, mouse
gacgccggagggcgcatcga

SEQ ID NO: 802177 - DNA, 20 bp, mouse
gccggagggcgcatcgaggg

SEQ ID NO: 802178 - DNA, 20 bp, mouse
gaggactatctccaagggcg

SEQ ID NO: 802179 - DNA, 20 bp, mouse
ggagcctggccctcagtgac

SEQ ID NO: 802180 - DNA, 20 bp, mouse
gcgtaaacgaccacgccgga

SEQ ID NO: 802181 - DNA, 20 bp, mouse
gctgggaattgtagtctttg

SEQ ID NO: 802182 - DNA, 20 bp, mouse
gcacgcgctgctgtcgccgc

SEQ ID NO: 802183 - DNA, 20 bp, mouse
gggctccagcagcaacgggg

SEQ ID NO: 802184 - DNA, 20 bp, mouse
gaatggaggtagtaggagac

SEQ ID NO: 802185 - DNA, 20 bp, mouse
gcgtgcgtaaacgaccacgc

SEQ ID NO: 802186 - DNA, 20 bp, mouse
gacccccccggcagccgcaa

SEQ ID NO: 802187 - DNA, 20 bp, mouse
ggccgcggtcggatccattg

SEQ ID NO: 802188 - DNA, 20 bp, mouse
gggtccacacgctttcacaa

SEQ ID NO: 802189 - DNA, 20 bp, mouse
gccacggggcgcgttggggt

SEQ ID NO: 802190 - DNA, 20 bp, mouse
gaggcctgcaccacactagt

SEQ ID NO: 802191 - DNA, 20 bp, mouse
ggaaaccaaggcccgagccc

SEQ ID NO: 802192 - DNA, 20 bp, mouse
gatccattgcggctgccggg

SEQ ID NO: 802193 - DNA, 20 bp, mouse
ggccgcaatggatccgaccg

SEQ ID NO: 802194 - DNA, 20 bp, mouse
ggcactgcctggtgtggttt

SEQ ID NO: 802195 - DNA, 20 bp, mouse
gtgggtggggtgtgcccttt

SEQ ID NO: 802196 - DNA, 20 bp, mouse
gtggcccacagccaatttga

SEQ ID NO: 802197 - DNA, 20 bp, mouse
gcgggcgggcccggaaatgg

SEQ ID NO: 802198 - DNA, 20 bp, mouse
gcgggccctgctgtcagtgg

SEQ ID NO: 802199 - DNA, 20 bp, mouse
gcgggcccggaaatggaggc

SEQ ID NO: 802200 - DNA, 20 bp, mouse
ggggcgagcagccttcaaat

SEQ ID NO: 802201 - DNA, 20 bp, mouse
gcagccttcaaattggctgt

SEQ ID NO: 802202 - DNA, 20 bp, mouse
gcccgcgcagatttcaaaaa

SEQ ID NO: 802203 - DNA, 20 bp, mouse
gccagggcggcatactttga

SEQ ID NO: 802204 - DNA, 20 bp, mouse
gacaccctccactgacagca

SEQ ID NO: 802205 - DNA, 20 bp, mouse
ggcgtgtatttcatacattg

SEQ ID NO: 802206 - DNA, 20 bp, mouse
gggaaacgtagtcttttctc

SEQ ID NO: 802207 - DNA, 20 bp, mouse
gaaaaatattagggctgggt

SEQ ID NO: 802208 - DNA, 20 bp, mouse
gctggcgggtgaggaacgca

SEQ ID NO: 802209 - DNA, 20 bp, mouse
gcacgtgcttaatatgtcca

SEQ ID NO: 802210 - DNA, 20 bp, mouse
gtagggctgggtgggcacgg

SEQ ID NO: 802211 - DNA, 20 bp, mouse
gaggcaaaagctggcgggtg

SEQ ID NO: 802212 - DNA, 20 bp, mouse
gctaggactaccatcctgta

SEQ ID NO: 802213 - DNA, 20 bp, mouse
gtgaggaacgcagggcctgt

SEQ ID NO: 802214 - DNA, 20 bp, mouse
gttagagtcaagtcaggggt

SEQ ID NO: 802215 - DNA, 20 bp, mouse
gtaaagacttgagcacagga

SEQ ID NO: 802216 - DNA, 20 bp, mouse
gcgggcgccgaccactctga

SEQ ID NO: 802217 - DNA, 20 bp, mouse
ggcgtggtgggccaagcttg

SEQ ID NO: 802218 - DNA, 20 bp, mouse
ggagtggcagaagtgttgag

SEQ ID NO: 802219 - DNA, 20 bp, mouse
gtaacgctgtgacgcgtggt

SEQ ID NO: 802220 - DNA, 20 bp, mouse
gttgagtggtgcagacgcta

SEQ ID NO: 802221 - DNA, 20 bp, mouse
gtaccccggcttggaatgga

SEQ ID NO: 802222 - DNA, 20 bp, mouse
ggcgacaagtgataacactc

SEQ ID NO: 802223 - DNA, 20 bp, mouse
gcggcgcagagcgacggggg

SEQ ID NO: 802224 - DNA, 20 bp, mouse
gaagtcttgcttgaaccgag

SEQ ID NO: 802225 - DNA, 20 bp, mouse
gtcatgtgatccaacaaagt

SEQ ID NO: 802226 - DNA, 20 bp, mouse
gcgggtgagcaagacggccc

SEQ ID NO: 802227 - DNA, 20 bp, mouse
gcaaacaaccccatggaaat

SEQ ID NO: 802228 - DNA, 20 bp, mouse
gtatgagggaacacacatac

SEQ ID NO: 802229 - DNA, 20 bp, mouse
gggctcaactctaaatatga

SEQ ID NO: 802230 - DNA, 20 bp, mouse
gaattgttgccgatttccat

SEQ ID NO: 802231 - DNA, 20 bp, mouse
gggggaacaagacacaaaca

SEQ ID NO: 802232 - DNA, 20 bp, mouse
gactagctggttcttgtaag

SEQ ID NO: 802233 - DNA, 20 bp, mouse
gagtagccatcccatgacct

SEQ ID NO: 802234 - DNA, 20 bp, mouse
gcacatacgggtgagcaaga

SEQ ID NO: 802235 - DNA, 20 bp, mouse
gactcagattagccagcaga

SEQ ID NO: 802236 - DNA, 20 bp, mouse
gagcaatcttcacctcctgg

SEQ ID NO: 802237 - DNA, 20 bp, mouse
gacggaagaacagaagtcat

SEQ ID NO: 802238 - DNA, 20 bp, mouse
gcatgggtgcagcgtcaatc

SEQ ID NO: 802239 - DNA, 20 bp, mouse
gcgacttgtgataacagaga

SEQ ID NO: 802240 - DNA, 20 bp, mouse
gagtcgcctgtgttcttgga

SEQ ID NO: 802241 - DNA, 20 bp, mouse
gcacaagtcgcctgtgttct

SEQ ID NO: 802242 - DNA, 20 bp, mouse
gtaggaaaagacttgctctc

SEQ ID NO: 802243 - DNA, 20 bp, mouse
gagattgctcaggctgtgcc

SEQ ID NO: 802244 - DNA, 20 bp, mouse
gagtaaattctaagacaaga

SEQ ID NO: 802245 - DNA, 20 bp, mouse
gctcagaggacagatatgat

SEQ ID NO: 802246 - DNA, 20 bp, mouse
ggggacttgctcccacgccc

SEQ ID NO: 802247 - DNA, 20 bp, mouse
gtgaggaggggacatgggtt

SEQ ID NO: 802248 - DNA, 20 bp, mouse
gtctaagtgctactgcacag

SEQ ID NO: 802249 - DNA, 20 bp, mouse
gaaatctagtaagtggtcta

SEQ ID NO: 802250 - DNA, 20 bp, mouse
gagggtgtgtgggatgtgag

SEQ ID NO: 802251 - DNA, 20 bp, mouse
gggatgtgaggggcgagaga

SEQ ID NO: 802252 - DNA, 20 bp, mouse
ggaggggtgtgaggttcctc

SEQ ID NO: 802253 - DNA, 20 bp, mouse
ggggagggactgcgtgagga

SEQ ID NO: 802254 - DNA, 20 bp, mouse
gctgcgtgaggaggggacat

SEQ ID NO: 802255 - DNA, 20 bp, mouse
gggagctgaaatctagtaag

SEQ ID NO: 802256 - DNA, 20 bp, mouse
gagcaagtccccttattggg

SEQ ID NO: 802257 - DNA, 20 bp, mouse
ggaggggtgtgaggttcctc

SEQ ID NO: 802258 - DNA, 20 bp, mouse
gcgtggggacttctgggcta

SEQ ID NO: 802259 - DNA, 20 bp, mouse
ggtggagtcgaggtgggtcg

SEQ ID NO: 802260 - DNA, 20 bp, mouse
ggggctagggcgcagtgtga

SEQ ID NO: 802261 - DNA, 20 bp, mouse
gagtccccaggctccagttc

SEQ ID NO: 802262 - DNA, 20 bp, mouse
ggtgccaggaactgaggcgt

SEQ ID NO: 802263 - DNA, 20 bp, mouse
gtccgcctccagacgcccta

SEQ ID NO: 802264 - DNA, 20 bp, mouse
ggacaagaggtgggtcagat

SEQ ID NO: 802265 - DNA, 20 bp, mouse
ggcgtcgggaggccaagcaa

SEQ ID NO: 802266 - DNA, 20 bp, mouse
gccctgctgcagccaatagt

SEQ ID NO: 802267 - DNA, 20 bp, mouse
gctgtccaggccaatcccta

SEQ ID NO: 802268 - DNA, 20 bp, mouse
gcgtgcagctttaacagaaa

SEQ ID NO: 802269 - DNA, 20 bp, mouse
gactcggagtctcctactat

SEQ ID NO: 802270 - DNA, 20 bp, mouse
ggggatcccaccttagggat

SEQ ID NO: 802271 - DNA, 20 bp, mouse
ggtgggaatccccttccaag

SEQ ID NO: 802272 - DNA, 20 bp, mouse
gcacaaagagctatagaatc

SEQ ID NO: 802273 - DNA, 20 bp, mouse
ggctgttaggaggtcaggag

SEQ ID NO: 802274 - DNA, 20 bp, mouse
gtccaggccaatccctaagg

SEQ ID NO: 802275 - DNA, 20 bp, mouse
gacagcaacacaaaaagcgt

SEQ ID NO: 802276 - DNA, 20 bp, mouse
gcacccgcacagccgagggg

SEQ ID NO: 802277 - DNA, 20 bp, mouse
gtgaccccaggagcgcctga

SEQ ID NO: 802278 - DNA, 20 bp, mouse
gcagccgaggggcggggttc

SEQ ID NO: 802279 - DNA, 20 bp, mouse
gaaaccctcaggcgctcctg

SEQ ID NO: 802280 - DNA, 20 bp, mouse
gcgaggggcggggttcggga

SEQ ID NO: 802281 - DNA, 20 bp, mouse
gtcccacccgcacagccgag

SEQ ID NO: 802282 - DNA, 20 bp, mouse
gtggaggctgggctgaccga

SEQ ID NO: 802283 - DNA, 20 bp, mouse
gcgaggaactcaaataaacg

SEQ ID NO: 802284 - DNA, 20 bp, mouse
gagcccgcgggccgcacctc

SEQ ID NO: 802285 - DNA, 20 bp, mouse
gcacacctgcgtgcacgcgt

SEQ ID NO: 802286 - DNA, 20 bp, mouse
ggtaagcagcgcgccctcta

SEQ ID NO: 802287 - DNA, 20 bp, mouse
gagcacggccgccccgttgg

SEQ ID NO: 802288 - DNA, 20 bp, mouse
gtctagggtggcgtgcagga

SEQ ID NO: 802289 - DNA, 20 bp, mouse
gcagatgggtaggttgttca

SEQ ID NO: 802290 - DNA, 20 bp, mouse
gagcagcgcgccctctaggg

SEQ ID NO: 802291 - DNA, 20 bp, mouse
ggccctctagggtggcgtgc

SEQ ID NO: 802292 - DNA, 20 bp, mouse
ggaaggctgggcgtataaag

SEQ ID NO: 802293 - DNA, 20 bp, mouse
gctcccaggctccataaaag

SEQ ID NO: 802294 - DNA, 20 bp, mouse
gaaaaggggaggaggcggat

SEQ ID NO: 802295 - DNA, 20 bp, mouse
gtctcattgagaaagcggag

SEQ ID NO: 802296 - DNA, 20 bp, mouse
gaaggaacccgctagggagg

SEQ ID NO: 802297 - DNA, 20 bp, mouse
gggaaaagaaacctcgaaca

SEQ ID NO: 802298 - DNA, 20 bp, mouse
gtgtcggagaccccggtccc

SEQ ID NO: 802299 - DNA, 20 bp, mouse
gaaaaagaaggaacccgcta

SEQ ID NO: 802300 - DNA, 20 bp, mouse
gtacctacatccgggtccta

SEQ ID NO: 802301 - DNA, 20 bp, mouse
ggcgaggaatatctgtgaat

SEQ ID NO: 802302 - DNA, 20 bp, mouse
gcacaagcggtccctcccct

SEQ ID NO: 802303 - DNA, 20 bp, mouse
gggccgagctgctccgggaa

SEQ ID NO: 802304 - DNA, 20 bp, mouse
gaaagagttcaggtcccgtt

SEQ ID NO: 802305 - DNA, 20 bp, mouse
gacccgctagggaggcggga

SEQ ID NO: 802306 - DNA, 20 bp, mouse
gtagaagccgcggggtgcaa

SEQ ID NO: 802307 - DNA, 20 bp, mouse
gtaaacatcagcgcatcaga

SEQ ID NO: 802308 - DNA, 20 bp, mouse
ggggtccaatgtccaatcct

SEQ ID NO: 802309 - DNA, 20 bp, mouse
gcaaaggtgcacagtgtcgc

SEQ ID NO: 802310 - DNA, 20 bp, mouse
gcggggcggggtctcggcag

SEQ ID NO: 802311 - DNA, 20 bp, mouse
ggggccaggactatttaata

SEQ ID NO: 802312 - DNA, 20 bp, mouse
ggagagcacagtaactcgga

SEQ ID NO: 802313 - DNA, 20 bp, mouse
gcagtcccaggattggacat

SEQ ID NO: 802314 - DNA, 20 bp, mouse
gactgacgtcggcatcgggg

SEQ ID NO: 802315 - DNA, 20 bp, mouse
gacaactgacgtcggcatcg

SEQ ID NO: 802316 - DNA, 20 bp, mouse
ggcgccggaggcagatggtc

SEQ ID NO: 802317 - DNA, 20 bp, mouse
gggcgcgcgcgtccgactcc

SEQ ID NO: 802318 - DNA, 20 bp, mouse
gagacagcgtgaacagtctg

SEQ ID NO: 802319 - DNA, 20 bp, mouse
ggctgcagccgggacataca

SEQ ID NO: 802320 - DNA, 20 bp, mouse
gacgcacggcggcatgacgt

SEQ ID NO: 802321 - DNA, 20 bp, mouse
gcggcgccccctgtatgtcc

SEQ ID NO: 802322 - DNA, 20 bp, mouse
gagtcggacgcgcgcgcccg

SEQ ID NO: 802323 - DNA, 20 bp, mouse
gactcctggactgcgtggct

SEQ ID NO: 802324 - DNA, 20 bp, mouse
gggggccggagcacgcacgg

SEQ ID NO: 802325 - DNA, 20 bp, mouse
ggcggtggccagaacgaggc

SEQ ID NO: 802326 - DNA, 20 bp, mouse
gtctgcgcatgtgcgggcca

SEQ ID NO: 802327 - DNA, 20 bp, mouse
gcagacatactgctgtgaga

SEQ ID NO: 802328 - DNA, 20 bp, mouse
ggggccgggcggctctcctc

SEQ ID NO: 802329 - DNA, 20 bp, mouse
gagcgcgcgtgggccgcgat

SEQ ID NO: 802330 - DNA, 20 bp, mouse
gcgcctaagccagtgcaaag

SEQ ID NO: 802331 - DNA, 20 bp, mouse
gaaggcacgccggccgttca

SEQ ID NO: 802332 - DNA, 20 bp, mouse
gggagggccggcccaggctg

SEQ ID NO: 802333 - DNA, 20 bp, mouse
gagcctggctcggctggacc

SEQ ID NO: 802334 - DNA, 20 bp, mouse
gcgggcggctctcctcagga

SEQ ID NO: 802335 - DNA, 20 bp, mouse
gtcgcgcagtcggggagggc

SEQ ID NO: 802336 - DNA, 20 bp, mouse
gggtaccagggcttcggagg

SEQ ID NO: 802337 - DNA, 20 bp, mouse
gctgaggcggtgaatctcca

SEQ ID NO: 802338 - DNA, 20 bp, mouse
gtgcatcccggcctccgcca

SEQ ID NO: 802339 - DNA, 20 bp, mouse
ggcgggtaccagggcttcgg

SEQ ID NO: 802340 - DNA, 20 bp, mouse
gaatctccatggagacgaaa

SEQ ID NO: 802341 - DNA, 20 bp, mouse
ggctgcgggtaccagggctt

SEQ ID NO: 802342 - DNA, 20 bp, mouse
gtccgccagggaatctgagc

SEQ ID NO: 802343 - DNA, 20 bp, mouse
gacccccaactgctcccgta

SEQ ID NO: 802344 - DNA, 20 bp, mouse
gtggatgcacctggcacagc

SEQ ID NO: 802345 - DNA, 20 bp, mouse
gagacagggctgcgggtacc

SEQ ID NO: 802346 - DNA, 20 bp, mouse
ggcggtgccccgtacggctc

SEQ ID NO: 802347 - DNA, 20 bp, mouse
ggtgccccgtacggctccgg

SEQ ID NO: 802348 - DNA, 20 bp, mouse
gtggcgtgcgagtaacggtg

SEQ ID NO: 802349 - DNA, 20 bp, mouse
gccgcgtgctgccggaagag

SEQ ID NO: 802350 - DNA, 20 bp, mouse
gaggaagcgacggtggctgt

SEQ ID NO: 802351 - DNA, 20 bp, mouse
gcctcctccggagccgtacg

SEQ ID NO: 802352 - DNA, 20 bp, mouse
gccggaggaggaagcgacgg

SEQ ID NO: 802353 - DNA, 20 bp, mouse
ggctccggaggaggaagcga

SEQ ID NO: 802354 - DNA, 20 bp, mouse
gggaggggcggtgccccgta

SEQ ID NO: 802355 - DNA, 20 bp, mouse
gcggcagcacgcgggagggg

SEQ ID NO: 802356 - DNA, 20 bp, mouse
ggcggagcccgagaccgtca

SEQ ID NO: 802357 - DNA, 20 bp, mouse
gcatgcgccgtgacggtctc

SEQ ID NO: 802358 - DNA, 20 bp, mouse
gagctgcgaggtgtcagccg

SEQ ID NO: 802359 - DNA, 20 bp, mouse
gtgttctgtaccaaatccca

SEQ ID NO: 802360 - DNA, 20 bp, mouse
gtgtacctttccatgggatt

SEQ ID NO: 802361 - DNA, 20 bp, mouse
ggcgccagctagcccgctaa

SEQ ID NO: 802362 - DNA, 20 bp, mouse
gaatcacagcaatacttgat

SEQ ID NO: 802363 - DNA, 20 bp, mouse
gagtcattaaacagaactct

SEQ ID NO: 802364 - DNA, 20 bp, mouse
gaatacttgattggagatct

SEQ ID NO: 802365 - DNA, 20 bp, mouse
gactccttgtacctttccat

SEQ ID NO: 802366 - DNA, 20 bp, mouse
gacgccatctacacacctgg

SEQ ID NO: 802367 - DNA, 20 bp, mouse
gcgcccaccaggtgtgtaga

SEQ ID NO: 802368 - DNA, 20 bp, mouse
gcacgcgctaggggctgaga

SEQ ID NO: 802369 - DNA, 20 bp, mouse
gcgtcctctaggctctcccc

SEQ ID NO: 802370 - DNA, 20 bp, mouse
ggagaggtgtgggctcagtg

SEQ ID NO: 802371 - DNA, 20 bp, mouse
gggtgtgtagatggcgtccc

SEQ ID NO: 802372 - DNA, 20 bp, mouse
gtcctgtgggtgagaggtgt

SEQ ID NO: 802373 - DNA, 20 bp, mouse
gtcacggtctgagttcctgt

SEQ ID NO: 802374 - DNA, 20 bp, mouse
gaaactggaaaggttcacgg

SEQ ID NO: 802375 - DNA, 20 bp, mouse
gcaagttggtgagctagcta

SEQ ID NO: 802376 - DNA, 20 bp, mouse
gaggagagaaagagcgtccc

SEQ ID NO: 802377 - DNA, 20 bp, mouse
gctcccggcaccaaaggcag

SEQ ID NO: 802378 - DNA, 20 bp, mouse
gatgggaagctcatgagctg

SEQ ID NO: 802379 - DNA, 20 bp, mouse
gcctccagcctcccaacgag

SEQ ID NO: 802380 - DNA, 20 bp, mouse
ggcccgcctcccggcaccaa

SEQ ID NO: 802381 - DNA, 20 bp, mouse
gcgcggaagggtcagagcac

SEQ ID NO: 802382 - DNA, 20 bp, mouse
ggaggctggaggaccggcca

SEQ ID NO: 802383 - DNA, 20 bp, mouse
gcgcccagaggaggcggcga

SEQ ID NO: 802384 - DNA, 20 bp, mouse
ggggctgtctgaggtgccgg

SEQ ID NO: 802385 - DNA, 20 bp, mouse
gcatccaggcggacgcggaa

SEQ ID NO: 802386 - DNA, 20 bp, mouse
gctgggcggagcagcaagac

SEQ ID NO: 802387 - DNA, 20 bp, mouse
gggcggagcagcaagaccgg

SEQ ID NO: 802388 - DNA, 20 bp, mouse
gtcgcgacactccctcgctt

SEQ ID NO: 802389 - DNA, 20 bp, mouse
gagaccggcggatgcctgtg

SEQ ID NO: 802390 - DNA, 20 bp, mouse
gtgctccttcggaattaaga

SEQ ID NO: 802391 - DNA, 20 bp, mouse
gttcagcaggagagcgttct

SEQ ID NO: 802392 - DNA, 20 bp, mouse
ggctacaagcgcttgagcgg

SEQ ID NO: 802393 - DNA, 20 bp, mouse
gctgctcgtgtcctaagcga

SEQ ID NO: 802394 - DNA, 20 bp, mouse
gcccaggccgcgcctccgat

SEQ ID NO: 802395 - DNA, 20 bp, mouse
ggtcacggaacggaattggc

SEQ ID NO: 802396 - DNA, 20 bp, mouse
ggacaggggagcttttttct

SEQ ID NO: 802397 - DNA, 20 bp, mouse
gagggcaggtgacgaaaagg

SEQ ID NO: 802398 - DNA, 20 bp, mouse
gcgggcggggagggctatgg

SEQ ID NO: 802399 - DNA, 20 bp, mouse
gccgggagggagcagtccta

SEQ ID NO: 802400 - DNA, 20 bp, mouse
ggagggagcagtcctaggga

SEQ ID NO: 802401 - DNA, 20 bp, mouse
gtacaagccagtttaccctc

SEQ ID NO: 802402 - DNA, 20 bp, mouse
gcggagggcaggtgacgaaa

SEQ ID NO: 802403 - DNA, 20 bp, mouse
gaaaagctcccctgtccaga

SEQ ID NO: 802404 - DNA, 20 bp, mouse
gcacgccgttctgcaggcta

SEQ ID NO: 802405 - DNA, 20 bp, mouse
gccgcctcctagccagacct

SEQ ID NO: 802406 - DNA, 20 bp, mouse
gacggctgggctaggaaagg

SEQ ID NO: 802407 - DNA, 20 bp, mouse
ggatgtgctgctaggggtgt

SEQ ID NO: 802408 - DNA, 20 bp, mouse
gtagaacatagtccctgcta

SEQ ID NO: 802409 - DNA, 20 bp, mouse
ggctacggctgggctaggaa

SEQ ID NO: 802410 - DNA, 20 bp, mouse
gcaaccctgcccattggatc

SEQ ID NO: 802411 - DNA, 20 bp, mouse
gcatatgcacagaccgcaac

SEQ ID NO: 802412 - DNA, 20 bp, mouse
ggagaggcagcattgggact

SEQ ID NO: 802413 - DNA, 20 bp, mouse
gcgacctcagggatagatgg

SEQ ID NO: 802414 - DNA, 20 bp, mouse
gctgtcagaagtggtctttc

SEQ ID NO: 802415 - DNA, 20 bp, mouse
gcgggcacgcggtttggccc

SEQ ID NO: 802416 - DNA, 20 bp, mouse
ggcgccgcggggcctctcgg

SEQ ID NO: 802417 - DNA, 20 bp, mouse
ggggcctctcggtggagcgc

SEQ ID NO: 802418 - DNA, 20 bp, mouse
ggcggaagagcgtttgtaag

SEQ ID NO: 802419 - DNA, 20 bp, mouse
ggaggctcgaggtccccgga

SEQ ID NO: 802420 - DNA, 20 bp, mouse
gagtgcggactccgagtgga

SEQ ID NO: 802421 - DNA, 20 bp, mouse
ggaagagcgtttgtaagcgg

SEQ ID NO: 802422 - DNA, 20 bp, mouse
gaggaaggaagtcccggccc

SEQ ID NO: 802423 - DNA, 20 bp, mouse
ggagacaggatgactctatc

SEQ ID NO: 802424 - DNA, 20 bp, mouse
gtctgagtgcggactccgag

SEQ ID NO: 802425 - DNA, 20 bp, mouse
gacgaggaatgcagagttcg

SEQ ID NO: 802426 - DNA, 20 bp, mouse
ggacctgggtccagtgtgtg

SEQ ID NO: 802427 - DNA, 20 bp, mouse
gggggctgactcgtggagaa

SEQ ID NO: 802428 - DNA, 20 bp, mouse
ggactccgcccacaccagat

SEQ ID NO: 802429 - DNA, 20 bp, mouse
gacctccgtcccggttacta

SEQ ID NO: 802430 - DNA, 20 bp, mouse
gtggggctcgcggagaaacg

SEQ ID NO: 802431 - DNA, 20 bp, mouse
ggctgactcgtggagaacgg

SEQ ID NO: 802432 - DNA, 20 bp, mouse
gcgccccacacactggaccc

SEQ ID NO: 802433 - DNA, 20 bp, mouse
ggagcggcggggctacgtgg

SEQ ID NO: 802434 - DNA, 20 bp, mouse
ggagcctgggggcgaagcgg

SEQ ID NO: 802435 - DNA, 20 bp, mouse
gaaacgcgggcaacgcgctg

SEQ ID NO: 802436 - DNA, 20 bp, mouse
gcgagcaagcggagaggaaa

SEQ ID NO: 802437 - DNA, 20 bp, mouse
gggagaggaaaaggacactg

SEQ ID NO: 802438 - DNA, 20 bp, mouse
gcgggatccgcctcttaaaa

SEQ ID NO: 802439 - DNA, 20 bp, mouse
gcaggatggggaaacgttac

SEQ ID NO: 802440 - DNA, 20 bp, mouse
gcgcctcttaaaagggtcac

SEQ ID NO: 802441 - DNA, 20 bp, mouse
gaatcctcggcccgagaaac

SEQ ID NO: 802442 - DNA, 20 bp, mouse
gacccggctgggggtagagg

SEQ ID NO: 802443 - DNA, 20 bp, mouse
gccgaggattcttcctaaaa

SEQ ID NO: 802444 - DNA, 20 bp, mouse
gcaagctttcagttcggagt

SEQ ID NO: 802445 - DNA, 20 bp, mouse
ggaactgaaagcttgtaaac

SEQ ID NO: 802446 - DNA, 20 bp, mouse
gaggctggggcagtccaggg

SEQ ID NO: 802447 - DNA, 20 bp, mouse
gagaggggcggggccgtgac

SEQ ID NO: 802448 - DNA, 20 bp, mouse
gagcctgcctctgctgggtt

SEQ ID NO: 802449 - DNA, 20 bp, mouse
gcgcgactccgcgagagggg

SEQ ID NO: 802450 - DNA, 20 bp, mouse
gcagagtgaggccctagcga

SEQ ID NO: 802451 - DNA, 20 bp, mouse
ggctgcgcgactccgcgaga

SEQ ID NO: 802452 - DNA, 20 bp, mouse
gcccgcctcccatgcctcat

SEQ ID NO: 802453 - DNA, 20 bp, mouse
gttaggaacggggaagatga

SEQ ID NO: 802454 - DNA, 20 bp, mouse
gatcaggctggggcagtcca

SEQ ID NO: 802455 - DNA, 20 bp, mouse
gatagggatgatgtatcacg

SEQ ID NO: 802456 - DNA, 20 bp, mouse
gcgcgcccgtggatctctca

SEQ ID NO: 802457 - DNA, 20 bp, mouse
ggcgcgggccgcggacgtga

SEQ ID NO: 802458 - DNA, 20 bp, mouse
gcccctgagaggactcggag

SEQ ID NO: 802459 - DNA, 20 bp, mouse
gacgtgagggcggcgaacgg

SEQ ID NO: 802460 - DNA, 20 bp, mouse
gcgcgcgcctcgaaacgagc

SEQ ID NO: 802461 - DNA, 20 bp, mouse
gcgtcaggccgtgtgctgtc

SEQ ID NO: 802462 - DNA, 20 bp, mouse
gggtccccactgctcgggga

SEQ ID NO: 802463 - DNA, 20 bp, mouse
ggcggcgaacggcggagccg

SEQ ID NO: 802464 - DNA, 20 bp, mouse
gcttcccctgagagatccac

SEQ ID NO: 802465 - DNA, 20 bp, mouse
gtctcaggggccctgtccgc

SEQ ID NO: 802466 - DNA, 20 bp, mouse
gctcatacccataaccacac

SEQ ID NO: 802467 - DNA, 20 bp, mouse
gcagcatgctctgagctaat

SEQ ID NO: 802468 - DNA, 20 bp, mouse
gaataaatgaatggaccgtg

SEQ ID NO: 802469 - DNA, 20 bp, mouse
gagccatataaaatggttat

SEQ ID NO: 802470 - DNA, 20 bp, mouse
gtacctataaccattttata

SEQ ID NO: 802471 - DNA, 20 bp, mouse
ggtcatggagccatataaaa

SEQ ID NO: 802472 - DNA, 20 bp, mouse
gaaaatgtaaaagttccaca

SEQ ID NO: 802473 - DNA, 20 bp, mouse
gatgtttccagtgtggttat

SEQ ID NO: 802474 - DNA, 20 bp, mouse
gatacaaagaatcataaatt

SEQ ID NO: 802475 - DNA, 20 bp, mouse
gtggatatatatttaccaat

SEQ ID NO: 802476 - DNA, 20 bp, mouse
gtaaaagcgccggacattgc

SEQ ID NO: 802477 - DNA, 20 bp, mouse
gacaaggcgaagtgttgccg

SEQ ID NO: 802478 - DNA, 20 bp, mouse
gcgggtcgagctgatgggag

SEQ ID NO: 802479 - DNA, 20 bp, mouse
gtggctacctgcctggattt

SEQ ID NO: 802480 - DNA, 20 bp, mouse
ggcaggtagccagcaatgtc

SEQ ID NO: 802481 - DNA, 20 bp, mouse
ggggagaattagcagctggg

SEQ ID NO: 802482 - DNA, 20 bp, mouse
gcggggcgagctgatggaca

SEQ ID NO: 802483 - DNA, 20 bp, mouse
ggggttgcgtgtttgtggct

SEQ ID NO: 802484 - DNA, 20 bp, mouse
gtgttgccggggaagttagt

SEQ ID NO: 802485 - DNA, 20 bp, mouse
gtccaggccaaaatccaggc

SEQ ID NO: 802486 - DNA, 20 bp, mouse
gaggtcccgcccattctccg

SEQ ID NO: 802487 - DNA, 20 bp, mouse
gttcacgctggtgtcccccg

SEQ ID NO: 802488 - DNA, 20 bp, mouse
ggtcccccgcggagaatggg

SEQ ID NO: 802489 - DNA, 20 bp, mouse
ggcaacccgggcaggtgcgg

SEQ ID NO: 802490 - DNA, 20 bp, mouse
ggctccatggcggctctggg

SEQ ID NO: 802491 - DNA, 20 bp, mouse
gtcccgcccattctccgcgg

SEQ ID NO: 802492 - DNA, 20 bp, mouse
gaggtagaagacgcagtcat

SEQ ID NO: 802493 - DNA, 20 bp, mouse
gacaaggcagcagcacgagc

SEQ ID NO: 802494 - DNA, 20 bp, mouse
gccggggctcagggcatctg

SEQ ID NO: 802495 - DNA, 20 bp, mouse
gggtgtcccccgcggagaat

SEQ ID NO: 802496 - DNA, 20 bp, mouse
gctgcctcagcaccccttaa

SEQ ID NO: 802497 - DNA, 20 bp, mouse
gtagccattaaggggtgctg

SEQ ID NO: 802498 - DNA, 20 bp, mouse
gggaggcggggtcaatagga

SEQ ID NO: 802499 - DNA, 20 bp, mouse
gtgtaatcctagccattaag

SEQ ID NO: 802500 - DNA, 20 bp, mouse
gagccggaggcggggtcaat

SEQ ID NO: 802501 - DNA, 20 bp, mouse
gtccctaaatctctcagtct

SEQ ID NO: 802502 - DNA, 20 bp, mouse
gagcgcgtcgcgccttcagc

SEQ ID NO: 802503 - DNA, 20 bp, mouse
gaatcaccaagctgtgctgg

SEQ ID NO: 802504 - DNA, 20 bp, mouse
gcccgcctccggctctcctg

SEQ ID NO: 802505 - DNA, 20 bp, mouse
gaggactttatgaagacgta

SEQ ID NO: 802506 - DNA, 20 bp, mouse
ggcaggcggggtcaagatgg

SEQ ID NO: 802507 - DNA, 20 bp, mouse
ggggaccatggcaacgctcg

SEQ ID NO: 802508 - DNA, 20 bp, mouse
gtgaccgcgggcgccgcctc

SEQ ID NO: 802509 - DNA, 20 bp, mouse
ggcaacggcagcaacggccg

SEQ ID NO: 802510 - DNA, 20 bp, mouse
gaggctaggcgagccgaagc

SEQ ID NO: 802511 - DNA, 20 bp, mouse
ggcccgctcgcgtccctcgg

SEQ ID NO: 802512 - DNA, 20 bp, mouse
gggcctcgcaacggcagcaa

SEQ ID NO: 802513 - DNA, 20 bp, mouse
gcgcctcgggggcctcgcaa

SEQ ID NO: 802514 - DNA, 20 bp, mouse
ggcggccctgcgtcacaatc

SEQ ID NO: 802515 - DNA, 20 bp, mouse
gccgccccctgctccaccga

SEQ ID NO: 802516 - DNA, 20 bp, mouse
gaggggccacggcctgtaga

SEQ ID NO: 802517 - DNA, 20 bp, mouse
gcaggagccagccgcgctga

SEQ ID NO: 802518 - DNA, 20 bp, mouse
gctcctgcagcgaggggcca

SEQ ID NO: 802519 - DNA, 20 bp, mouse
gcagccgccctcagcgcggc

SEQ ID NO: 802520 - DNA, 20 bp, mouse
ggtggaggctcctgcagcga

SEQ ID NO: 802521 - DNA, 20 bp, mouse
gtgaagcttgcacattctgt

SEQ ID NO: 802522 - DNA, 20 bp, mouse
ggagccagccgcgctgaggg

SEQ ID NO: 802523 - DNA, 20 bp, mouse
gcagagctgtcagctgagag

SEQ ID NO: 802524 - DNA, 20 bp, mouse
gacagctctggagacggaag

SEQ ID NO: 802525 - DNA, 20 bp, mouse
gtgaagtaacggtccaccta

SEQ ID NO: 802526 - DNA, 20 bp, mouse
ggctgctgacacacacctgt

SEQ ID NO: 802527 - DNA, 20 bp, mouse
gcacccccccctgttggctt

SEQ ID NO: 802528 - DNA, 20 bp, mouse
ggagctccacccccccctgt

SEQ ID NO: 802529 - DNA, 20 bp, mouse
gaaatgaagaggcaagtcac

SEQ ID NO: 802530 - DNA, 20 bp, mouse
gacctccaaagccaacaggg

SEQ ID NO: 802531 - DNA, 20 bp, mouse
gctcgcgcgttgcctggaga

SEQ ID NO: 802532 - DNA, 20 bp, mouse
gccccccctgttggctttgg

SEQ ID NO: 802533 - DNA, 20 bp, mouse
gtacgtcactgaggtgcgac

SEQ ID NO: 802534 - DNA, 20 bp, mouse
gggggtggagctccgtctcc

SEQ ID NO: 802535 - DNA, 20 bp, mouse
gagaggcaagtcacaggctt

SEQ ID NO: 802536 - DNA, 20 bp, mouse
gagggcccagatcagttggg

SEQ ID NO: 802537 - DNA, 20 bp, mouse
gaaaacaggggtccaacttc

SEQ ID NO: 802538 - DNA, 20 bp, mouse
ggggagggcccagatcagtt

SEQ ID NO: 802539 - DNA, 20 bp, mouse
gctccctttggcattgctgg

SEQ ID NO: 802540 - DNA, 20 bp, mouse
gagcccccagcaatgccaaa

SEQ ID NO: 802541 - DNA, 20 bp, mouse
gaccccgcgcgcagttctca

SEQ ID NO: 802542 - DNA, 20 bp, mouse
gaactgcgcgcggggtcgac

SEQ ID NO: 802543 - DNA, 20 bp, mouse
gcccaccccccaactgatct

SEQ ID NO: 802544 - DNA, 20 bp, mouse
gcagggcggggaggcataaa

SEQ ID NO: 802545 - DNA, 20 bp, mouse
gttccagcttctgactggta

SEQ ID NO: 802546 - DNA, 20 bp, mouse
gtgcgacccagatgggaagt

SEQ ID NO: 802547 - DNA, 20 bp, mouse
gagaaccagccagcagctcg

SEQ ID NO: 802548 - DNA, 20 bp, mouse
gaggtgagcaggcaagtcaa

SEQ ID NO: 802549 - DNA, 20 bp, mouse
ggctgcgcgccccgagctgc

SEQ ID NO: 802550 - DNA, 20 bp, mouse
ggcctgcatgggatcggaca

SEQ ID NO: 802551 - DNA, 20 bp, mouse
gctctgcgctctgcctgcat

SEQ ID NO: 802552 - DNA, 20 bp, mouse
gacccggcgcaggattcctg

SEQ ID NO: 802553 - DNA, 20 bp, mouse
gtgccccaggaatcctgcgc

SEQ ID NO: 802554 - DNA, 20 bp, mouse
ggtcgaagtgcgacccagat

SEQ ID NO: 802555 - DNA, 20 bp, mouse
gacgcccagacctacagctc

SEQ ID NO: 802556 - DNA, 20 bp, mouse
ggagcgaagacactcagtgg

SEQ ID NO: 802557 - DNA, 20 bp, mouse
gtgcccgcgtccggatttcc

SEQ ID NO: 802558 - DNA, 20 bp, mouse
gagtaagcaggcagcgcgag

SEQ ID NO: 802559 - DNA, 20 bp, mouse
gggtccaggaaatccggacg

SEQ ID NO: 802560 - DNA, 20 bp, mouse
gcgcgcgcgcacacctcccc

SEQ ID NO: 802561 - DNA, 20 bp, mouse
gctaaggagtgcgcctccgg

SEQ ID NO: 802562 - DNA, 20 bp, mouse
gcaggcagcgcgagtggtcc

SEQ ID NO: 802563 - DNA, 20 bp, mouse
gaactgggtctctcctgggt

SEQ ID NO: 802564 - DNA, 20 bp, mouse
gcagatgaaagattttaaac

SEQ ID NO: 802565 - DNA, 20 bp, mouse
gtactcgcggccctgacagg

SEQ ID NO: 802566 - DNA, 20 bp, mouse
gcgggcccactcaacggagg

SEQ ID NO: 802567 - DNA, 20 bp, mouse
gggtcccagcaggtgagtgt

SEQ ID NO: 802568 - DNA, 20 bp, mouse
gcgaaacgccggcttctctt

SEQ ID NO: 802569 - DNA, 20 bp, mouse
gggtccggcagactattcca

SEQ ID NO: 802570 - DNA, 20 bp, mouse
gcgcgattgtgagtgagcgt

SEQ ID NO: 802571 - DNA, 20 bp, mouse
gcactcaacggaggcggtgc

SEQ ID NO: 802572 - DNA, 20 bp, mouse
gtcacctgctgggaccacgt

SEQ ID NO: 802573 - DNA, 20 bp, mouse
gttgagtgggcccgaaacgc

SEQ ID NO: 802574 - DNA, 20 bp, mouse
gccacgtgggacaatgtgaa

SEQ ID NO: 802575 - DNA, 20 bp, mouse
ggtgtcgcctcacccttcct

SEQ ID NO: 802576 - DNA, 20 bp, mouse
gagcaaagcaggcggggttg

SEQ ID NO: 802577 - DNA, 20 bp, mouse
gtatctgagcaaagcaggcg

SEQ ID NO: 802578 - DNA, 20 bp, mouse
gccaaggctaggggattacg

SEQ ID NO: 802579 - DNA, 20 bp, mouse
gggaaggcatcaaagattaa

SEQ ID NO: 802580 - DNA, 20 bp, mouse
ggtgctccctgcctcgccaa

SEQ ID NO: 802581 - DNA, 20 bp, mouse
ggcagcagccccaaggctag

SEQ ID NO: 802582 - DNA, 20 bp, mouse
ggcacccgggcttctcttcc

SEQ ID NO: 802583 - DNA, 20 bp, mouse
gcttgcggcgagctggcttg

SEQ ID NO: 802584 - DNA, 20 bp, mouse
gtgatgccttcccactgcaa

SEQ ID NO: 802585 - DNA, 20 bp, mouse
ggctgctcgtgactgaagag

SEQ ID NO: 802586 - DNA, 20 bp, mouse
gagcagcccggtcgcagcaa

SEQ ID NO: 802587 - DNA, 20 bp, mouse
gtgcgccacgcagagggtga

SEQ ID NO: 802588 - DNA, 20 bp, mouse
gatcccgcgcgcggcggccc

SEQ ID NO: 802589 - DNA, 20 bp, mouse
ggcgcgcgggatcacggtga

SEQ ID NO: 802590 - DNA, 20 bp, mouse
gtggtggaggtccatctagg

SEQ ID NO: 802591 - DNA, 20 bp, mouse
gtggctggcggtccccacgc

SEQ ID NO: 802592 - DNA, 20 bp, mouse
gggtgagggaggaccggaac

SEQ ID NO: 802593 - DNA, 20 bp, mouse
gacaagatgcgccacgcaga

SEQ ID NO: 802594 - DNA, 20 bp, mouse
gaactggtggaggtccatct

SEQ ID NO: 802595 - DNA, 20 bp, mouse
gtggcctcctggttctgaac

SEQ ID NO: 802596 - DNA, 20 bp, mouse
gggtagttaagccaatccag

SEQ ID NO: 802597 - DNA, 20 bp, mouse
ggggtaaattgtgacatcag

SEQ ID NO: 802598 - DNA, 20 bp, mouse
gtgagatcctattggtcaaa

SEQ ID NO: 802599 - DNA, 20 bp, mouse
ggtccatggaggggtcaact

SEQ ID NO: 802600 - DNA, 20 bp, mouse
gtactaagcaataagtcaag

SEQ ID NO: 802601 - DNA, 20 bp, mouse
gtagtagccttttgaccaat

SEQ ID NO: 802602 - DNA, 20 bp, mouse
gtacccagttgacccctcca

SEQ ID NO: 802603 - DNA, 20 bp, mouse
gaaacttatgacttcctaat

SEQ ID NO: 802604 - DNA, 20 bp, mouse
gatgcatactgagatcctat

SEQ ID NO: 802605 - DNA, 20 bp, mouse
ggtaatctcatgttaataca

SEQ ID NO: 802606 - DNA, 20 bp, mouse
ggcgtggcgacggaaggggt

SEQ ID NO: 802607 - DNA, 20 bp, mouse
gggcgcacgcgcacctggag

SEQ ID NO: 802608 - DNA, 20 bp, mouse
gtgtgccgcagggctgtggg

SEQ ID NO: 802609 - DNA, 20 bp, mouse
gcgccagggtctgtgccgca

SEQ ID NO: 802610 - DNA, 20 bp, mouse
ggcacctggaggggcgtgac

SEQ ID NO: 802611 - DNA, 20 bp, mouse
gccggggcgtggcgacggaa

SEQ ID NO: 802612 - DNA, 20 bp, mouse
gctgccagagtccccaagtc

SEQ ID NO: 802613 - DNA, 20 bp, mouse
gcacaaacttccccagactt

SEQ ID NO: 802614 - DNA, 20 bp, mouse
gcacaaccgcagtcccacgc

SEQ ID NO: 802615 - DNA, 20 bp, mouse
gagagaccgccgagcgcggc

SEQ ID NO: 802616 - DNA, 20 bp, mouse
gacagagtgagcgttgcaag

SEQ ID NO: 802617 - DNA, 20 bp, mouse
gagcgttgcaaggggagccc

SEQ ID NO: 802618 - DNA, 20 bp, mouse
ggcagaggtcgctgacgccc

SEQ ID NO: 802619 - DNA, 20 bp, mouse
gacactcacttgccgaggga

SEQ ID NO: 802620 - DNA, 20 bp, mouse
gaccttcaggcctttgaatt

SEQ ID NO: 802621 - DNA, 20 bp, mouse
ggggggagagcgtgaggaga

SEQ ID NO: 802622 - DNA, 20 bp, mouse
gggggaggtacggggcagat

SEQ ID NO: 802623 - DNA, 20 bp, mouse
ggtatgatgtcaaagctcct

SEQ ID NO: 802624 - DNA, 20 bp, mouse
gcgggacactcacttgccga

SEQ ID NO: 802625 - DNA, 20 bp, mouse
gcccccagacctgaatattt

SEQ ID NO: 802626 - DNA, 20 bp, mouse
ggcctcaattcagtagtcta

SEQ ID NO: 802627 - DNA, 20 bp, mouse
ggaggccacccacctttgga

SEQ ID NO: 802628 - DNA, 20 bp, mouse
gagaacttggttcttgatga

SEQ ID NO: 802629 - DNA, 20 bp, mouse
gaattgaggccacccacctt

SEQ ID NO: 802630 - DNA, 20 bp, mouse
gccaccgcccagctagaact

SEQ ID NO: 802631 - DNA, 20 bp, mouse
gtagctgtcagccacaacca

SEQ ID NO: 802632 - DNA, 20 bp, mouse
gtagagaaccaagcttgtag

SEQ ID NO: 802633 - DNA, 20 bp, mouse
gagcggctcctccactgact

SEQ ID NO: 802634 - DNA, 20 bp, mouse
gacccttagcttccctccaa

SEQ ID NO: 802635 - DNA, 20 bp, mouse
gtctggagcagagctgtgat

SEQ ID NO: 802636 - DNA, 20 bp, mouse
gctggtctacggtgggtaga

SEQ ID NO: 802637 - DNA, 20 bp, mouse
gcacctggaccgagcacgga

SEQ ID NO: 802638 - DNA, 20 bp, mouse
ggtgctcgctggtctacggt

SEQ ID NO: 802639 - DNA, 20 bp, mouse
gccaggtgctcgctggtcta

SEQ ID NO: 802640 - DNA, 20 bp, mouse
gctggaccgagcacggaagg

SEQ ID NO: 802641 - DNA, 20 bp, mouse
gcacggaaggaggacctgaa

SEQ ID NO: 802642 - DNA, 20 bp, mouse
gcaacctcttggtgtgggtg

SEQ ID NO: 802643 - DNA, 20 bp, mouse
gcaccacaggctagaacgac

SEQ ID NO: 802644 - DNA, 20 bp, mouse
gtgccgggtggagtgcggga

SEQ ID NO: 802645 - DNA, 20 bp, mouse
gtctgtcggtcggtccccag

SEQ ID NO: 802646 - DNA, 20 bp, mouse
gcggcggcagcgacgggcaa

SEQ ID NO: 802647 - DNA, 20 bp, mouse
gtggggctcggcggcagcga

SEQ ID NO: 802648 - DNA, 20 bp, mouse
gtcagaccgcgtgatgtcag

SEQ ID NO: 802649 - DNA, 20 bp, mouse
gctcccccgtggcaccgggg

SEQ ID NO: 802650 - DNA, 20 bp, mouse
gagctcgaggcaggcctccc

SEQ ID NO: 802651 - DNA, 20 bp, mouse
ggtgcttcgcgcggaggttg

SEQ ID NO: 802652 - DNA, 20 bp, mouse
gcacccgagcggtgtcccgg

SEQ ID NO: 802653 - DNA, 20 bp, mouse
gaataggaaacgagctgcgg

SEQ ID NO: 802654 - DNA, 20 bp, mouse
gcggctcgctgtgggattca

SEQ ID NO: 802655 - DNA, 20 bp, mouse
gtcccggagctgctcggcca

SEQ ID NO: 802656 - DNA, 20 bp, mouse
ggcgccctgcacatacacgc

SEQ ID NO: 802657 - DNA, 20 bp, mouse
gccgcccgcgtgtatgtgca

SEQ ID NO: 802658 - DNA, 20 bp, mouse
gacgcggggcgcgtggaacc

SEQ ID NO: 802659 - DNA, 20 bp, mouse
gggaacctggcgcggtcctc

SEQ ID NO: 802660 - DNA, 20 bp, mouse
ggcggggcccgctgcggtgc

SEQ ID NO: 802661 - DNA, 20 bp, mouse
gtccccgagtgacctgtgtg

SEQ ID NO: 802662 - DNA, 20 bp, mouse
gcacggagcgtgcacacgac

SEQ ID NO: 802663 - DNA, 20 bp, mouse
ggtcccccgcggttccggcg

SEQ ID NO: 802664 - DNA, 20 bp, mouse
ggggcgcgtggaacctggcg

SEQ ID NO: 802665 - DNA, 20 bp, mouse
gagcgcatctccacatgtcc

SEQ ID NO: 802666 - DNA, 20 bp, mouse
gaaccgaaggggactgtccc

SEQ ID NO: 802667 - DNA, 20 bp, mouse
ggaggggtgggtcccgactg

SEQ ID NO: 802668 - DNA, 20 bp, mouse
gagccggcgcgctgagatgc

SEQ ID NO: 802669 - DNA, 20 bp, mouse
gggccccgcgtaatcctcac

SEQ ID NO: 802670 - DNA, 20 bp, mouse
gcaccggcctgacacatgga

SEQ ID NO: 802671 - DNA, 20 bp, mouse
gggagcctccgcccgtgccg

SEQ ID NO: 802672 - DNA, 20 bp, mouse
ggacgcaacccggggaggtg

SEQ ID NO: 802673 - DNA, 20 bp, mouse
gcgggactgctgtgagtcgg

SEQ ID NO: 802674 - DNA, 20 bp, mouse
ggggtctgccggcctggata

SEQ ID NO: 802675 - DNA, 20 bp, mouse
gcacgacagcgcccgctcgg

SEQ ID NO: 802676 - DNA, 20 bp, mouse
gccggaggggcgggaattta

SEQ ID NO: 802677 - DNA, 20 bp, mouse
gaggcctcatagcccgaact

SEQ ID NO: 802678 - DNA, 20 bp, mouse
ggcagccggggaataaggcg

SEQ ID NO: 802679 - DNA, 20 bp, mouse
ggggctaagatgcacgatga

SEQ ID NO: 802680 - DNA, 20 bp, mouse
gagggcagctccaggatctc

SEQ ID NO: 802681 - DNA, 20 bp, mouse
gttagccccgccttattccc

SEQ ID NO: 802682 - DNA, 20 bp, mouse
gtaccgtggcggccagacga

SEQ ID NO: 802683 - DNA, 20 bp, mouse
gcaaaggcagccggggaata

SEQ ID NO: 802684 - DNA, 20 bp, mouse
gtggcggccagacgaaggag

SEQ ID NO: 802685 - DNA, 20 bp, mouse
gcctccggaattggaatcgc

SEQ ID NO: 802686 - DNA, 20 bp, mouse
gcgactgagcggttccttgg

SEQ ID NO: 802687 - DNA, 20 bp, mouse
gtagccgagcgaccaaaagc

SEQ ID NO: 802688 - DNA, 20 bp, mouse
ggggaggagttgctactagc

SEQ ID NO: 802689 - DNA, 20 bp, mouse
gggagcccgggtacctgctc

SEQ ID NO: 802690 - DNA, 20 bp, mouse
gttggtcgctcggctactgt

SEQ ID NO: 802691 - DNA, 20 bp, mouse
gaagacgtgccgttttggcg

SEQ ID NO: 802692 - DNA, 20 bp, mouse
gggaacgcagacgcagctcc

SEQ ID NO: 802693 - DNA, 20 bp, mouse
gcctcccgcttttggtcgct

SEQ ID NO: 802694 - DNA, 20 bp, mouse
gcggggaattgtgacgtccg

SEQ ID NO: 802695 - DNA, 20 bp, mouse
gtctaaaccaagatccgaac

SEQ ID NO: 802696 - DNA, 20 bp, mouse
ggcggtgggagaggagtaga

SEQ ID NO: 802697 - DNA, 20 bp, mouse
gaagggaggggacttcataa

SEQ ID NO: 802698 - DNA, 20 bp, mouse
gccctaggagaaatatcccc

SEQ ID NO: 802699 - DNA, 20 bp, mouse
gcgggaacctagtccgcctg

SEQ ID NO: 802700 - DNA, 20 bp, mouse
gaagtcccctcccttggctg

SEQ ID NO: 802701 - DNA, 20 bp, mouse
gaagtacttcgacaagtttc

SEQ ID NO: 802702 - DNA, 20 bp, mouse
ggaggggctgaaatgagggc

SEQ ID NO: 802703 - DNA, 20 bp, mouse
gtaatcacaacaagctgcta

SEQ ID NO: 802704 - DNA, 20 bp, mouse
ggctgaaatgagggctggtc

SEQ ID NO: 802705 - DNA, 20 bp, mouse
gcaaacacagaagtaatctg

SEQ ID NO: 802706 - DNA, 20 bp, mouse
gccccaaccccaggttgctc

SEQ ID NO: 802707 - DNA, 20 bp, mouse
gcggcctcttctgagaacac

SEQ ID NO: 802708 - DNA, 20 bp, mouse
gcggtgctgggcttttatcc

SEQ ID NO: 802709 - DNA, 20 bp, mouse
gagccagagcaacctggggt

SEQ ID NO: 802710 - DNA, 20 bp, mouse
gaggcctgtgttctcagaag

SEQ ID NO: 802711 - DNA, 20 bp, mouse
gaatgcagccagagcaacct

SEQ ID NO: 802712 - DNA, 20 bp, mouse
gtctgagaacacaggcctcc

SEQ ID NO: 802713 - DNA, 20 bp, mouse
gacaggactccggcgaccat

SEQ ID NO: 802714 - DNA, 20 bp, mouse
ggtcgccggagtcctgtgat

SEQ ID NO: 802715 - DNA, 20 bp, mouse
gcgaccataggtagccaatc

SEQ ID NO: 802716 - DNA, 20 bp, mouse
gcgctcgcgcaagagggcgt

SEQ ID NO: 802717 - DNA, 20 bp, mouse
gagtgcgcggccccgagcga

SEQ ID NO: 802718 - DNA, 20 bp, mouse
ggcgcccgcgggccttggac

SEQ ID NO: 802719 - DNA, 20 bp, mouse
gggagcgcgcctctaggggc

SEQ ID NO: 802720 - DNA, 20 bp, mouse
gccccgagcgagggaaggag

SEQ ID NO: 802721 - DNA, 20 bp, mouse
gcgacctgccgtcacatccg

SEQ ID NO: 802722 - DNA, 20 bp, mouse
gcgagcgcgagcgtgcgcag

SEQ ID NO: 802723 - DNA, 20 bp, mouse
ggcgcggcgctcgcgcaaga

SEQ ID NO: 802724 - DNA, 20 bp, mouse
ggtgcgcgcaagggagtgcg

SEQ ID NO: 802725 - DNA, 20 bp, mouse
gtctgggagcgcgcctctag

SEQ ID NO: 802726 - DNA, 20 bp, mouse
gacccgagcaacagaagtct

SEQ ID NO: 802727 - DNA, 20 bp, mouse
gaggctctaggtgaagaccg

SEQ ID NO: 802728 - DNA, 20 bp, mouse
gcgggtaaggggttgagcgg

SEQ ID NO: 802729 - DNA, 20 bp, mouse
gtctcccacgagccgcgcgt

SEQ ID NO: 802730 - DNA, 20 bp, mouse
ggggagcgcaggcggatgtt

SEQ ID NO: 802731 - DNA, 20 bp, mouse
gaagtctgggcttgtctccc

SEQ ID NO: 802732 - DNA, 20 bp, mouse
ggtaaggggttgagcggagg

SEQ ID NO: 802733 - DNA, 20 bp, mouse
gccccgcggggccgaacgag

SEQ ID NO: 802734 - DNA, 20 bp, mouse
gccgcccacgcgcggctcgt

SEQ ID NO: 802735 - DNA, 20 bp, mouse
ggctcgggtaaggggttgag

SEQ ID NO: 802736 - DNA, 20 bp, mouse
gggcgagagccctcagatcc

SEQ ID NO: 802737 - DNA, 20 bp, mouse
gggagagccgaatccagcgc

SEQ ID NO: 802738 - DNA, 20 bp, mouse
ggcagccgcctctcgttggt

SEQ ID NO: 802739 - DNA, 20 bp, mouse
gcgatgcagccgcctctcgt

SEQ ID NO: 802740 - DNA, 20 bp, mouse
ggacacagtagagatacttc

SEQ ID NO: 802741 - DNA, 20 bp, mouse
gtatctctactgtgtctcct

SEQ ID NO: 802742 - DNA, 20 bp, mouse
gttatccaaccaacgagagg

SEQ ID NO: 802743 - DNA, 20 bp, mouse
gagtgactcgcacacagagg

SEQ ID NO: 802744 - DNA, 20 bp, mouse
gaccaaagactaaagccaat

SEQ ID NO: 802745 - DNA, 20 bp, mouse
gaccccaggagcactctgat

SEQ ID NO: 802746 - DNA, 20 bp, mouse
gaagaagggcgtgggtctca

SEQ ID NO: 802747 - DNA, 20 bp, mouse
ggcaagggactctgagactc

SEQ ID NO: 802748 - DNA, 20 bp, mouse
gagggcgtgggtctcagggc

SEQ ID NO: 802749 - DNA, 20 bp, mouse
gctgctgagaagaagggcgt

SEQ ID NO: 802750 - DNA, 20 bp, mouse
gcccctaaggcaccacggtc

SEQ ID NO: 802751 - DNA, 20 bp, mouse
gctggcggggtcccggaccg

SEQ ID NO: 802752 - DNA, 20 bp, mouse
gcaaccgccactgccggggc

SEQ ID NO: 802753 - DNA, 20 bp, mouse
gtacccaactgctgagaaga

SEQ ID NO: 802754 - DNA, 20 bp, mouse
gtctcagcagttgggtagtg

SEQ ID NO: 802755 - DNA, 20 bp, mouse
gccgagagcctgaaccccta

SEQ ID NO: 802756 - DNA, 20 bp, mouse
gtctgctgggttatctgctt

SEQ ID NO: 802757 - DNA, 20 bp, mouse
gaggtcagcccagggtaaaa

SEQ ID NO: 802758 - DNA, 20 bp, mouse
ggataagtgtgagtccagac

SEQ ID NO: 802759 - DNA, 20 bp, mouse
ggccctagcctttttaccct

SEQ ID NO: 802760 - DNA, 20 bp, mouse
gtaccctgggctgacctgtc

SEQ ID NO: 802761 - DNA, 20 bp, mouse
ggcccagggtaaaaaggcta

SEQ ID NO: 802762 - DNA, 20 bp, mouse
gtacctatcgggtcggtgtc

SEQ ID NO: 802763 - DNA, 20 bp, mouse
gctcagagtagccatgtatc

SEQ ID NO: 802764 - DNA, 20 bp, mouse
gctcacacttatcctggctt

SEQ ID NO: 802765 - DNA, 20 bp, mouse
gtatcctggctttggtaggt

SEQ ID NO: 802766 - DNA, 20 bp, mouse
gaggagggaaggcagctcgg

SEQ ID NO: 802767 - DNA, 20 bp, mouse
gccccgggacaggaagggga

SEQ ID NO: 802768 - DNA, 20 bp, mouse
gcggctggtaagttccgccc

SEQ ID NO: 802769 - DNA, 20 bp, mouse
gggaaggcagctcggtggat

SEQ ID NO: 802770 - DNA, 20 bp, mouse
gccagcgctaggaaacccta

SEQ ID NO: 802771 - DNA, 20 bp, mouse
gttccgccccgggacaggaa

SEQ ID NO: 802772 - DNA, 20 bp, mouse
gggcgtctggtctttccgta

SEQ ID NO: 802773 - DNA, 20 bp, mouse
gtcctagcgctggaagagga

SEQ ID NO: 802774 - DNA, 20 bp, mouse
ggtaagttccgccccgggac

SEQ ID NO: 802775 - DNA, 20 bp, mouse
gtccggcccaggcgcccggc

SEQ ID NO: 802776 - DNA, 20 bp, mouse
ggaatcaggactttcctgtt

SEQ ID NO: 802777 - DNA, 20 bp, mouse
gcaatcaaagccctggtgta

SEQ ID NO: 802778 - DNA, 20 bp, mouse
gtgtctacatgacaaccgac

SEQ ID NO: 802779 - DNA, 20 bp, mouse
gctgatagaagggccaaagt

SEQ ID NO: 802780 - DNA, 20 bp, mouse
gtgtcatgtagacactcacc

SEQ ID NO: 802781 - DNA, 20 bp, mouse
gtgtctctactactacgctc

SEQ ID NO: 802782 - DNA, 20 bp, mouse
gatagaagggccaaagtggg

SEQ ID NO: 802783 - DNA, 20 bp, mouse
ggttctgcggggtagaactt

SEQ ID NO: 802784 - DNA, 20 bp, mouse
gcatgagactccacccactt

SEQ ID NO: 802785 - DNA, 20 bp, mouse
gcaccaggcatggccccaac

SEQ ID NO: 802786 - DNA, 20 bp, mouse
ggctgctacgggaaccagtg

SEQ ID NO: 802787 - DNA, 20 bp, mouse
gactgacaccatcaggacaa

SEQ ID NO: 802788 - DNA, 20 bp, mouse
ggctgcaaggacctggatgg

SEQ ID NO: 802789 - DNA, 20 bp, mouse
gcaaaggtcgtgagctgcta

SEQ ID NO: 802790 - DNA, 20 bp, mouse
gcagctgctcaatcatgggc

SEQ ID NO: 802791 - DNA, 20 bp, mouse
gcgctctgacgtccaggtcc

SEQ ID NO: 802792 - DNA, 20 bp, mouse
gccacctcccaaattatctg

SEQ ID NO: 802793 - DNA, 20 bp, mouse
gccctgaagcaggataaaac

SEQ ID NO: 802794 - DNA, 20 bp, mouse
ggcaggatgagtaatcttat

SEQ ID NO: 802795 - DNA, 20 bp, mouse
gtcctgatggtgtcagtcgc

SEQ ID NO: 802796 - DNA, 20 bp, mouse
gcccgtctccgtgaggtgat

SEQ ID NO: 802797 - DNA, 20 bp, mouse
gaccagccgcggttatctct

SEQ ID NO: 802798 - DNA, 20 bp, mouse
gcagtgcgaggcgaacgtgc

SEQ ID NO: 802799 - DNA, 20 bp, mouse
gggggtcggggttacaagaa

SEQ ID NO: 802800 - DNA, 20 bp, mouse
gtctccgtgaggtgatagga

SEQ ID NO: 802801 - DNA, 20 bp, mouse
gtaagtcgccgcccgcggga

SEQ ID NO: 802802 - DNA, 20 bp, mouse
gaccgcggctggtcgacgtg

SEQ ID NO: 802803 - DNA, 20 bp, mouse
gggcgagagcgcgcagtgcg

SEQ ID NO: 802804 - DNA, 20 bp, mouse
gacctcacggagacggggtc

SEQ ID NO: 802805 - DNA, 20 bp, mouse
ggcggctggtcgacgtgggg

SEQ ID NO: 802806 - DNA, 20 bp, mouse
gcggccccgcgagaggagct

SEQ ID NO: 802807 - DNA, 20 bp, mouse
ggtggagcctgtgcaaaata

SEQ ID NO: 802808 - DNA, 20 bp, mouse
ggcgccgcgggcaactgcgc

SEQ ID NO: 802809 - DNA, 20 bp, mouse
gcttctgcggtcaggtggtc

SEQ ID NO: 802810 - DNA, 20 bp, mouse
gactcctggacaaggaacgg

SEQ ID NO: 802811 - DNA, 20 bp, mouse
gcacctgaccgcagaaggcg

SEQ ID NO: 802812 - DNA, 20 bp, mouse
gccccgcgagaggagctggg

SEQ ID NO: 802813 - DNA, 20 bp, mouse
gctgactcctggacaaggaa

SEQ ID NO: 802814 - DNA, 20 bp, mouse
gggcgaagccccgccttctg

SEQ ID NO: 802815 - DNA, 20 bp, mouse
gagccccgccttctgcggtc

SEQ ID NO: 802816 - DNA, 20 bp, mouse
gcggggaggcccctggcgta

SEQ ID NO: 802817 - DNA, 20 bp, mouse
gaggacgaggacgaagtcag

SEQ ID NO: 802818 - DNA, 20 bp, mouse
ggcccctggcgtaggggaag

SEQ ID NO: 802819 - DNA, 20 bp, mouse
gtcggccggagctgcgggga

SEQ ID NO: 802820 - DNA, 20 bp, mouse
ggagggaaggcgcaacctgt

SEQ ID NO: 802821 - DNA, 20 bp, mouse
gcaccgcgcggggaggcccc

SEQ ID NO: 802822 - DNA, 20 bp, mouse
ggaaggggcgtgcctagtgc

SEQ ID NO: 802823 - DNA, 20 bp, mouse
gaaaccctgaggatttactt

SEQ ID NO: 802824 - DNA, 20 bp, mouse
ggcaacctgtgggctcagac

SEQ ID NO: 802825 - DNA, 20 bp, mouse
gcgcccaagtcagcaggcgt

SEQ ID NO: 802826 - DNA, 20 bp, mouse
ggccgcctctgtgttgggat

SEQ ID NO: 802827 - DNA, 20 bp, mouse
gcggaagtgacgcgtgagga

SEQ ID NO: 802828 - DNA, 20 bp, mouse
gagagggcggaagtgacgtg

SEQ ID NO: 802829 - DNA, 20 bp, mouse
gtgaagagaccggtcacttt

SEQ ID NO: 802830 - DNA, 20 bp, mouse
gtgcgctgccgcctctgtgt

SEQ ID NO: 802831 - DNA, 20 bp, mouse
gcccgcccatcccaacacag

SEQ ID NO: 802832 - DNA, 20 bp, mouse
gcaggcggaagtgacgcgtg

SEQ ID NO: 802833 - DNA, 20 bp, mouse
gccgaggcacggcgaggaga

SEQ ID NO: 802834 - DNA, 20 bp, mouse
gagaccggtcactttgggac

SEQ ID NO: 802835 - DNA, 20 bp, mouse
gcaacgcgaagcattgtgta

SEQ ID NO: 802836 - DNA, 20 bp, mouse
gtcacccagaggacgtcgta

SEQ ID NO: 802837 - DNA, 20 bp, mouse
ggtagggcggagaattgcaa

SEQ ID NO: 802838 - DNA, 20 bp, mouse
gaggtgggagaagtgacgaa

SEQ ID NO: 802839 - DNA, 20 bp, mouse
gagacggtccaaaatctcta

SEQ ID NO: 802840 - DNA, 20 bp, mouse
gctcactcctggtcacccag

SEQ ID NO: 802841 - DNA, 20 bp, mouse
gctggcaacctgaccttcta

SEQ ID NO: 802842 - DNA, 20 bp, mouse
gccgccctacgacgtcctct

SEQ ID NO: 802843 - DNA, 20 bp, mouse
gaaaaacacggtgcatggtg

SEQ ID NO: 802844 - DNA, 20 bp, mouse
ggcggagaattgcaagggag

SEQ ID NO: 802845 - DNA, 20 bp, mouse
ggcgaggttcagtgtagtct

SEQ ID NO: 802846 - DNA, 20 bp, mouse
ggacccgcgcggggtccacg

SEQ ID NO: 802847 - DNA, 20 bp, mouse
gcagaccaggcgtagatcga

SEQ ID NO: 802848 - DNA, 20 bp, mouse
gtagctgggaggtcgacact

SEQ ID NO: 802849 - DNA, 20 bp, mouse
gccaggcgtagatcgagggg

SEQ ID NO: 802850 - DNA, 20 bp, mouse
gcccgcgcgggtccccagac

SEQ ID NO: 802851 - DNA, 20 bp, mouse
gcgggtccccagacaggggg

SEQ ID NO: 802852 - DNA, 20 bp, mouse
gcgccccgtggaccccgcgc

SEQ ID NO: 802853 - DNA, 20 bp, mouse
gtctacgcctggtctggcgt

SEQ ID NO: 802854 - DNA, 20 bp, mouse
gcagcgccaccccctgtctg

SEQ ID NO: 802855 - DNA, 20 bp, mouse
gtgggagccgacgccagacc

SEQ ID NO: 802856 - DNA, 20 bp, mouse
ggaagtgccagttatgtaca

SEQ ID NO: 802857 - DNA, 20 bp, mouse
gaaacggagacaagtaaatg

SEQ ID NO: 802858 - DNA, 20 bp, mouse
gttagctgttaaaactgaat

SEQ ID NO: 802859 - DNA, 20 bp, mouse
gaagcaggttggggcagcca

SEQ ID NO: 802860 - DNA, 20 bp, mouse
gtatactttgggatgagtga

SEQ ID NO: 802861 - DNA, 20 bp, mouse
gttaaaaaatagcttgccaa

SEQ ID NO: 802862 - DNA, 20 bp, mouse
gagacataagacctcagaca

SEQ ID NO: 802863 - DNA, 20 bp, mouse
gtgacctagtctggtcaata

SEQ ID NO: 802864 - DNA, 20 bp, mouse
gagcaaagtaatacaaatac

SEQ ID NO: 802865 - DNA, 20 bp, mouse
gacagagacaaccttgtctg

SEQ ID NO: 802866 - DNA, 20 bp, mouse
ggaagctcaaaagtagaggg

SEQ ID NO: 802867 - DNA, 20 bp, mouse
gtcaaggaaaacgaagtgat

SEQ ID NO: 802868 - DNA, 20 bp, mouse
ggggcttcggtggtgggcag

SEQ ID NO: 802869 - DNA, 20 bp, mouse
ggtggcagtcacgtgacatg

SEQ ID NO: 802870 - DNA, 20 bp, mouse
ggagcttccctgggcttcgg

SEQ ID NO: 802871 - DNA, 20 bp, mouse
gtccagctactcccccaagc

SEQ ID NO: 802872 - DNA, 20 bp, mouse
ggggaccctgatgtgacaag

SEQ ID NO: 802873 - DNA, 20 bp, mouse
gagggcaagtcagcagtaac

SEQ ID NO: 802874 - DNA, 20 bp, mouse
gcttccctgggcttcggtgg

SEQ ID NO: 802875 - DNA, 20 bp, mouse
gtcctgcttgggggagtagc

SEQ ID NO: 802876 - DNA, 20 bp, mouse
ggggctccgcttgggtctca

SEQ ID NO: 802877 - DNA, 20 bp, mouse
gtgtccctcgggctccgctt

SEQ ID NO: 802878 - DNA, 20 bp, mouse
gagacccaagcggagcccga

SEQ ID NO: 802879 - DNA, 20 bp, mouse
ggaagccgagagtttccgta

SEQ ID NO: 802880 - DNA, 20 bp, mouse
gggcaggcgcggacagcgac

SEQ ID NO: 802881 - DNA, 20 bp, mouse
ggcggacagcgaccggacaa

SEQ ID NO: 802882 - DNA, 20 bp, mouse
gcaccgacggcgccctctgg

SEQ ID NO: 802883 - DNA, 20 bp, mouse
gtctggcccgcgtgtccctc

SEQ ID NO: 802884 - DNA, 20 bp, mouse
gcgacggagaagagccgcga

SEQ ID NO: 802885 - DNA, 20 bp, mouse
gggtgagcggccgccaccga

SEQ ID NO: 802886 - DNA, 20 bp, mouse
gtgctccatcgcagctcctc

SEQ ID NO: 802887 - DNA, 20 bp, mouse
ggaggcctgaggagctgcga

SEQ ID NO: 802888 - DNA, 20 bp, mouse
gaggggcgagggaggtataa

SEQ ID NO: 802889 - DNA, 20 bp, mouse
gctgagaaacctaatgtagg

SEQ ID NO: 802890 - DNA, 20 bp, mouse
ggcggggctcggcaccggga

SEQ ID NO: 802891 - DNA, 20 bp, mouse
ggagggaggtataagggtct

SEQ ID NO: 802892 - DNA, 20 bp, mouse
ggggcggggccgcagccgga

SEQ ID NO: 802893 - DNA, 20 bp, mouse
gcagcgagagcgcctcctgg

SEQ ID NO: 802894 - DNA, 20 bp, mouse
gggtgcggttgtctcaggat

SEQ ID NO: 802895 - DNA, 20 bp, mouse
gaggccgcgccggacagggc

SEQ ID NO: 802896 - DNA, 20 bp, mouse
ggggacgcggacagtcgggg

SEQ ID NO: 802897 - DNA, 20 bp, mouse
gcgcaggcgcgaggtggacg

SEQ ID NO: 802898 - DNA, 20 bp, mouse
gggctaggcacccatctcta

SEQ ID NO: 802899 - DNA, 20 bp, mouse
gccccctcccgactaataac

SEQ ID NO: 802900 - DNA, 20 bp, mouse
gagagggacgcggacagtcg

SEQ ID NO: 802901 - DNA, 20 bp, mouse
gagtcaaggttctgcagtcg

SEQ ID NO: 802902 - DNA, 20 bp, mouse
gaggctggaagagatcgtca

SEQ ID NO: 802903 - DNA, 20 bp, mouse
gcgcggacagtcggggagga

SEQ ID NO: 802904 - DNA, 20 bp, mouse
gataacaggaagaaccatag

SEQ ID NO: 802905 - DNA, 20 bp, mouse
gggatagatacgtgattaat

SEQ ID NO: 802906 - DNA, 20 bp, mouse
gggccgagtgggaattctta

SEQ ID NO: 802907 - DNA, 20 bp, mouse
gtcgcacgcacacaggagtg

SEQ ID NO: 802908 - DNA, 20 bp, mouse
gcacacagtcgcacgcacac

SEQ ID NO: 802909 - DNA, 20 bp, mouse
ggaggtgtgtgccaaagggg

SEQ ID NO: 802910 - DNA, 20 bp, mouse
gcgtacacacatacgcgcgc

SEQ ID NO: 802911 - DNA, 20 bp, mouse
gtctggacggagaacacact

SEQ ID NO: 802912 - DNA, 20 bp, mouse
gctggaccctgggctctgga

SEQ ID NO: 802913 - DNA, 20 bp, mouse
ggtgtccctggaggagaagc

SEQ ID NO: 802914 - DNA, 20 bp, mouse
ggctcgagaagtagaggcga

SEQ ID NO: 802915 - DNA, 20 bp, mouse
ggcgcttaagcatttggctg

SEQ ID NO: 802916 - DNA, 20 bp, mouse
gaaggaagatggtttacgag

SEQ ID NO: 802917 - DNA, 20 bp, mouse
gtcaaacgggtctctgggtc

SEQ ID NO: 802918 - DNA, 20 bp, mouse
gaggggacggaagcgcgctt

SEQ ID NO: 802919 - DNA, 20 bp, mouse
gaggggaaatgccggggtga

SEQ ID NO: 802920 - DNA, 20 bp, mouse
gcggagacgcgccgtcaccc

SEQ ID NO: 802921 - DNA, 20 bp, mouse
gtaagataggggaaatgccg

SEQ ID NO: 802922 - DNA, 20 bp, mouse
gcgcttccgtcccctcgccc

SEQ ID NO: 802923 - DNA, 20 bp, mouse
ggcagggccacagcgagccg

SEQ ID NO: 802924 - DNA, 20 bp, mouse
gccctcgccccggctcgctg

SEQ ID NO: 802925 - DNA, 20 bp, mouse
gacatctcaaacgggtctct

SEQ ID NO: 802926 - DNA, 20 bp, mouse
gagagagacaccaatatggc

SEQ ID NO: 802927 - DNA, 20 bp, mouse
gaagggagatacgcagtcag

SEQ ID NO: 802928 - DNA, 20 bp, mouse
gaagatcccttttttggaag

SEQ ID NO: 802929 - DNA, 20 bp, mouse
gccaaacctcagaaaagtca

SEQ ID NO: 802930 - DNA, 20 bp, mouse
ggaccagctaggtttaaact

SEQ ID NO: 802931 - DNA, 20 bp, mouse
gctagagagagacaccaata

SEQ ID NO: 802932 - DNA, 20 bp, mouse
gaaggaaatgatgcatgaca

SEQ ID NO: 802933 - DNA, 20 bp, mouse
gctgccttctgagaacttgc

SEQ ID NO: 802934 - DNA, 20 bp, mouse
gcctggaggcctctacacaa

SEQ ID NO: 802935 - DNA, 20 bp, mouse
ggatcaccactaccttaact

SEQ ID NO: 802936 - DNA, 20 bp, mouse
ggagccctgggctgaatcag

SEQ ID NO: 802937 - DNA, 20 bp, mouse
gccagtgaggatgctagctg

SEQ ID NO: 802938 - DNA, 20 bp, mouse
gagaccctctgattcagccc

SEQ ID NO: 802939 - DNA, 20 bp, mouse
gactatagaagcagtaactc

SEQ ID NO: 802940 - DNA, 20 bp, mouse
gcaggtcgggaggacagcgc

SEQ ID NO: 802941 - DNA, 20 bp, mouse
gaataggtcagagcctaagt

SEQ ID NO: 802942 - DNA, 20 bp, mouse
ggagcctcctggcctcaaac

SEQ ID NO: 802943 - DNA, 20 bp, mouse
gttggtttggggactgtctt

SEQ ID NO: 802944 - DNA, 20 bp, mouse
gtctggtgctgcccaggggt

SEQ ID NO: 802945 - DNA, 20 bp, mouse
gcaaacttagtgtgggactt

SEQ ID NO: 802946 - DNA, 20 bp, mouse
gaagccgcgcgccctcagtg

SEQ ID NO: 802947 - DNA, 20 bp, mouse
ggggctactggctgctctag

SEQ ID NO: 802948 - DNA, 20 bp, mouse
gggcgcggcgtcccttccgc

SEQ ID NO: 802949 - DNA, 20 bp, mouse
gagagcagccagtagcccag

SEQ ID NO: 802950 - DNA, 20 bp, mouse
gccggcccaagagtcctcaa

SEQ ID NO: 802951 - DNA, 20 bp, mouse
gcaggtggaagatctaacta

SEQ ID NO: 802952 - DNA, 20 bp, mouse
gagtcccgcctcctcactga

SEQ ID NO: 802953 - DNA, 20 bp, mouse
ggggcgcgcggcttcattgt

SEQ ID NO: 802954 - DNA, 20 bp, mouse
ggtcccttccgctgggctac

SEQ ID NO: 802955 - DNA, 20 bp, mouse
gcctctcattcatgccgcgg

SEQ ID NO: 802956 - DNA, 20 bp, mouse
gtggctagcaggccccacaa

SEQ ID NO: 802957 - DNA, 20 bp, mouse
gagtaaaactggtaagagtg

SEQ ID NO: 802958 - DNA, 20 bp, mouse
gtaaaggacaaagctctcag

SEQ ID NO: 802959 - DNA, 20 bp, mouse
gtagaggcggaaaactaggg

SEQ ID NO: 802960 - DNA, 20 bp, mouse
gcgcccattggcactttgta

SEQ ID NO: 802961 - DNA, 20 bp, mouse
gtagactgggagcaagttag

SEQ ID NO: 802962 - DNA, 20 bp, mouse
ggaacctgggagagtataga

SEQ ID NO: 802963 - DNA, 20 bp, mouse
gactaacgagagcatcaatg

SEQ ID NO: 802964 - DNA, 20 bp, mouse
gacagatgcgaaccgcccat

SEQ ID NO: 802965 - DNA, 20 bp, mouse
gaggagcgtgtgagcatcgc

SEQ ID NO: 802966 - DNA, 20 bp, mouse
gttaaggggcggagcgggac

SEQ ID NO: 802967 - DNA, 20 bp, mouse
ggcctgtggccaatcagtga

SEQ ID NO: 802968 - DNA, 20 bp, mouse
gaaccattggtggttttgaa

SEQ ID NO: 802969 - DNA, 20 bp, mouse
gtcctctttgaagtggtgat

SEQ ID NO: 802970 - DNA, 20 bp, mouse
gaaagacagtttccaatgag

SEQ ID NO: 802971 - DNA, 20 bp, mouse
ggccaatcagtgaggggcaa

SEQ ID NO: 802972 - DNA, 20 bp, mouse
gaatgtcgacaaaccattgg

SEQ ID NO: 802973 - DNA, 20 bp, mouse
ggctctttaaggggcggagc

SEQ ID NO: 802974 - DNA, 20 bp, mouse
gtcctcccgctcgcggcgag

SEQ ID NO: 802975 - DNA, 20 bp, mouse
gaatgaatgagatgaggcgg

SEQ ID NO: 802976 - DNA, 20 bp, mouse
gaaggggcgggatagtttaa

SEQ ID NO: 802977 - DNA, 20 bp, mouse
gcgggccgcggcttcttcat

SEQ ID NO: 802978 - DNA, 20 bp, mouse
gggctcctcccataatgcta

SEQ ID NO: 802979 - DNA, 20 bp, mouse
ggtaaagctgagatcaggaa

SEQ ID NO: 802980 - DNA, 20 bp, mouse
gaacccctcgcatgggaggt

SEQ ID NO: 802981 - DNA, 20 bp, mouse
ggaggtgggtccctccggaa

SEQ ID NO: 802982 - DNA, 20 bp, mouse
gagcctgattcggaaggaaa

SEQ ID NO: 802983 - DNA, 20 bp, mouse
ggccgcggcttcttcattgg

SEQ ID NO: 802984 - DNA, 20 bp, mouse
gcggggaagtcccaccttat

SEQ ID NO: 802985 - DNA, 20 bp, mouse
gtgggtccctccggaagggg

SEQ ID NO: 802986 - DNA, 20 bp, mouse
gtccgcccgcgcttacatca

SEQ ID NO: 802987 - DNA, 20 bp, mouse
ggacgctgacgatacgcgag

SEQ ID NO: 802988 - DNA, 20 bp, mouse
gggagccatgatgtaagcgc

SEQ ID NO: 802989 - DNA, 20 bp, mouse
ggctgacgatacgcgagggg

SEQ ID NO: 802990 - DNA, 20 bp, mouse
ggggatgtctggccagactg

SEQ ID NO: 802991 - DNA, 20 bp, mouse
gggagccagccgctcgcagc

SEQ ID NO: 802992 - DNA, 20 bp, mouse
gagaaggggcgaacgtgaaa

SEQ ID NO: 802993 - DNA, 20 bp, mouse
gcacgccactccacgcgcct

SEQ ID NO: 802994 - DNA, 20 bp, mouse
ggacgtaaccgcaccagcgc

SEQ ID NO: 802995 - DNA, 20 bp, mouse
ggcgtcctaggcgcgtggag

SEQ ID NO: 802996 - DNA, 20 bp, mouse
ggccccccgaagacccgctt

SEQ ID NO: 802997 - DNA, 20 bp, mouse
gaaatggtgaagaaggggcg

SEQ ID NO: 802998 - DNA, 20 bp, mouse
gaatccgaagcgggtcttcg

SEQ ID NO: 802999 - DNA, 20 bp, mouse
ggcgcagtcttgcgagcgaa

SEQ ID NO: 803000 - DNA, 20 bp, mouse
gttgcgagcgaaggggagag

SEQ ID NO: 803001 - DNA, 20 bp, mouse
ggccccgggaagacgccgag

SEQ ID NO: 803002 - DNA, 20 bp, mouse
gcgccgctcggcgtcttccc

SEQ ID NO: 803003 - DNA, 20 bp, mouse
gggcggagggaaacggggcg

SEQ ID NO: 803004 - DNA, 20 bp, mouse
gggagcccaccaatccgaag

SEQ ID NO: 803005 - DNA, 20 bp, mouse
gtgagcgtccctacgtaagg

SEQ ID NO: 803006 - DNA, 20 bp, mouse
gaagcctcagctcactattg

SEQ ID NO: 803007 - DNA, 20 bp, mouse
gtcaccgtcgtcctgagggt

SEQ ID NO: 803008 - DNA, 20 bp, mouse
gtgctcgggcggcgaaggtg

SEQ ID NO: 803009 - DNA, 20 bp, mouse
gaagccgagcgagtgagctt

SEQ ID NO: 803010 - DNA, 20 bp, mouse
ggggcagcgtctcccaacgc

SEQ ID NO: 803011 - DNA, 20 bp, mouse
gtcactcgctcggcttgctc

SEQ ID NO: 803012 - DNA, 20 bp, mouse
gtcaccccaatagtgagctg

SEQ ID NO: 803013 - DNA, 20 bp, mouse
gagcttgggcggggctgcgc

SEQ ID NO: 803014 - DNA, 20 bp, mouse
gcccccgcgggtggaaacaa

SEQ ID NO: 803015 - DNA, 20 bp, mouse
gtcgggcggcgaaggtgggg

SEQ ID NO: 803016 - DNA, 20 bp, mouse
gcagccaagcgcaggatcgc

SEQ ID NO: 803017 - DNA, 20 bp, mouse
gcccccgcgggtggaaacaa

SEQ ID NO: 803018 - DNA, 20 bp, mouse
gacaaggggtgcagtggggt

SEQ ID NO: 803019 - DNA, 20 bp, mouse
gggtccgcgagcgctgacaa

SEQ ID NO: 803020 - DNA, 20 bp, mouse
ggggaagaggcggagctacc

SEQ ID NO: 803021 - DNA, 20 bp, mouse
gccgcgggtggaaacaaagg

SEQ ID NO: 803022 - DNA, 20 bp, mouse
gttgccggaactggcccgag

SEQ ID NO: 803023 - DNA, 20 bp, mouse
gaagccgagcgagtgagctt

SEQ ID NO: 803024 - DNA, 20 bp, mouse
gggcgtccggaactccgagg

SEQ ID NO: 803025 - DNA, 20 bp, mouse
ggggaggctgtcgagttctg

SEQ ID NO: 803026 - DNA, 20 bp, mouse
gaacctcagctctccttcat

SEQ ID NO: 803027 - DNA, 20 bp, mouse
gcatgctggccatactgaca

SEQ ID NO: 803028 - DNA, 20 bp, mouse
gtctgtcagcagacggggca

SEQ ID NO: 803029 - DNA, 20 bp, mouse
gatggagaacaagcctatga

SEQ ID NO: 803030 - DNA, 20 bp, mouse
gggagatatctgggaaaaag

SEQ ID NO: 803031 - DNA, 20 bp, mouse
gagaggtgctgaattggccc

SEQ ID NO: 803032 - DNA, 20 bp, mouse
gccaggtagaggtgctgaat

SEQ ID NO: 803033 - DNA, 20 bp, mouse
gtgttaggatggccaggtag

SEQ ID NO: 803034 - DNA, 20 bp, mouse
gcacgaacggtctctagcaa

SEQ ID NO: 803035 - DNA, 20 bp, mouse
gtaacaaggtgatttgtgaa

SEQ ID NO: 803036 - DNA, 20 bp, mouse
gttcagggactcactcacgg

SEQ ID NO: 803037 - DNA, 20 bp, mouse
gtgggcaaggtagcactgtt

SEQ ID NO: 803038 - DNA, 20 bp, mouse
ggcccgggagaggggtagat

SEQ ID NO: 803039 - DNA, 20 bp, mouse
gttctcccgcttccctagta

SEQ ID NO: 803040 - DNA, 20 bp, mouse
ggctgccccaaaccctacta

SEQ ID NO: 803041 - DNA, 20 bp, mouse
gaaccgaggcagcccgggag

SEQ ID NO: 803042 - DNA, 20 bp, mouse
gccagggcatgagtcatccc

SEQ ID NO: 803043 - DNA, 20 bp, mouse
ggaagcgggagaaccagatg

SEQ ID NO: 803044 - DNA, 20 bp, mouse
ggggagactcacgctcttca

SEQ ID NO: 803045 - DNA, 20 bp, mouse
gttgcccacagcgcatgccc

SEQ ID NO: 803046 - DNA, 20 bp, mouse
ggacaccgccaagttctcgt

SEQ ID NO: 803047 - DNA, 20 bp, mouse
gagcaggcggggggcgtgac

SEQ ID NO: 803048 - DNA, 20 bp, mouse
gcgactggcggcactctcgc

SEQ ID NO: 803049 - DNA, 20 bp, mouse
gaggcgggagaggccaataa

SEQ ID NO: 803050 - DNA, 20 bp, mouse
gggggggcgtgaccggaaga

SEQ ID NO: 803051 - DNA, 20 bp, mouse
ggaagctcccgcaagcaggc

SEQ ID NO: 803052 - DNA, 20 bp, mouse
gtcctcccacgagaacttgg

SEQ ID NO: 803053 - DNA, 20 bp, mouse
gaggccaataagggctgaga

SEQ ID NO: 803054 - DNA, 20 bp, mouse
ggcggcactctcgcgggaag

SEQ ID NO: 803055 - DNA, 20 bp, mouse
ggggctagatgcagccgtaa

SEQ ID NO: 803056 - DNA, 20 bp, mouse
gactgcggggtcagtaacta

SEQ ID NO: 803057 - DNA, 20 bp, mouse
gagtccgtcgcggggttgga

SEQ ID NO: 803058 - DNA, 20 bp, mouse
gtgggactaaaagactcgag

SEQ ID NO: 803059 - DNA, 20 bp, mouse
gcacccctccaaccccgcga

SEQ ID NO: 803060 - DNA, 20 bp, mouse
gcgtgtgcgcacatatgtac

SEQ ID NO: 803061 - DNA, 20 bp, mouse
ggtcaccggggagacaagtt

SEQ ID NO: 803062 - DNA, 20 bp, mouse
ggttgcactaggagatggag

SEQ ID NO: 803063 - DNA, 20 bp, mouse
gccgcagttgcactaggaga

SEQ ID NO: 803064 - DNA, 20 bp, mouse
ggccgccagacgcacagcgc

SEQ ID NO: 803065 - DNA, 20 bp, mouse
gcacatatgtacaggatgtt

SEQ ID NO: 803066 - DNA, 20 bp, mouse
ggggccggaagttcttagga

SEQ ID NO: 803067 - DNA, 20 bp, mouse
gagcggcctatgagaggcgg

SEQ ID NO: 803068 - DNA, 20 bp, mouse
ggcgagcggcctatgagagg

SEQ ID NO: 803069 - DNA, 20 bp, mouse
gctgcaaggcgggacaccca

SEQ ID NO: 803070 - DNA, 20 bp, mouse
ggggcagctggtctgcagcg

SEQ ID NO: 803071 - DNA, 20 bp, mouse
gaacttccggcccagagcgg

SEQ ID NO: 803072 - DNA, 20 bp, mouse
gacagtgtagccttttggga

SEQ ID NO: 803073 - DNA, 20 bp, mouse
gtgtagccttttgggaggga

SEQ ID NO: 803074 - DNA, 20 bp, mouse
gcctggatgctccttgcgag

SEQ ID NO: 803075 - DNA, 20 bp, mouse
ggggacacccagggtcgccc

SEQ ID NO: 803076 - DNA, 20 bp, mouse
gctgacggcggtatgaggaa

SEQ ID NO: 803077 - DNA, 20 bp, mouse
gtctcctgtggggaaaggta

SEQ ID NO: 803078 - DNA, 20 bp, mouse
gagcactagcacactgacgg

SEQ ID NO: 803079 - DNA, 20 bp, mouse
gagcgtgattgcagtcccag

SEQ ID NO: 803080 - DNA, 20 bp, mouse
gagtgagtgcgtgcaccaag

SEQ ID NO: 803081 - DNA, 20 bp, mouse
gttgggctgtcgctcactag

SEQ ID NO: 803082 - DNA, 20 bp, mouse
gtgcgtgcaccaagaggagg

SEQ ID NO: 803083 - DNA, 20 bp, mouse
ggcacactgacggcggtatg

SEQ ID NO: 803084 - DNA, 20 bp, mouse
ggtaagcactagcacactga

SEQ ID NO: 803085 - DNA, 20 bp, mouse
gctacctgctgacaaagtga

SEQ ID NO: 803086 - DNA, 20 bp, mouse
gcgtccctgcggtccccgga

SEQ ID NO: 803087 - DNA, 20 bp, mouse
gcggcccattgcacgctgtg

SEQ ID NO: 803088 - DNA, 20 bp, mouse
gcgggccgcaccatcgtggg

SEQ ID NO: 803089 - DNA, 20 bp, mouse
gccgcctcacagcgtgcaat

SEQ ID NO: 803090 - DNA, 20 bp, mouse
gctggggcgcgtcgtccctg

SEQ ID NO: 803091 - DNA, 20 bp, mouse
gacgacgcgccccagccgaa

SEQ ID NO: 803092 - DNA, 20 bp, mouse
gggtcgggccgcaccatcgt

SEQ ID NO: 803093 - DNA, 20 bp, mouse
gtgcacgctgtgaggcgggg

SEQ ID NO: 803094 - DNA, 20 bp, mouse
gtggacacgccccctcaaca

SEQ ID NO: 803095 - DNA, 20 bp, mouse
gcatccccagtgctcgctat

SEQ ID NO: 803096 - DNA, 20 bp, mouse
ggccgcccgcaggacgcgat

SEQ ID NO: 803097 - DNA, 20 bp, mouse
gagcgggtcgccatcttgaa

SEQ ID NO: 803098 - DNA, 20 bp, mouse
gagcccaggtacggggaccg

SEQ ID NO: 803099 - DNA, 20 bp, mouse
gcgggcggcacgtgactagc

SEQ ID NO: 803100 - DNA, 20 bp, mouse
gccgagtcgcaggtgatgag

SEQ ID NO: 803101 - DNA, 20 bp, mouse
gtgggctttgaagtatgagg

SEQ ID NO: 803102 - DNA, 20 bp, mouse
gtgccacggtccccgtacct

SEQ ID NO: 803103 - DNA, 20 bp, mouse
gtcggccaatcgcgtcctgc

SEQ ID NO: 803104 - DNA, 20 bp, mouse
gagcggtgcgagcccaggta

SEQ ID NO: 803105 - DNA, 20 bp, mouse
gacctgcgactcggccttgt

SEQ ID NO: 803106 - DNA, 20 bp, mouse
gacccttgcacgatgatgat

SEQ ID NO: 803107 - DNA, 20 bp, mouse
ggctcagaagggattggctc

SEQ ID NO: 803108 - DNA, 20 bp, mouse
gacgagagagagcgagtgaa

SEQ ID NO: 803109 - DNA, 20 bp, mouse
gaggccaacccagacgaagg

SEQ ID NO: 803110 - DNA, 20 bp, mouse
gcatcatcgtgcaagggtag

SEQ ID NO: 803111 - DNA, 20 bp, mouse
gagtaactatgcactgccga

SEQ ID NO: 803112 - DNA, 20 bp, mouse
gaaagagtgggggcggaaaa

SEQ ID NO: 803113 - DNA, 20 bp, mouse
gaaaaaaagaggcttatggt

SEQ ID NO: 803114 - DNA, 20 bp, mouse
gtatggtgggcgagttctgt

SEQ ID NO: 803115 - DNA, 20 bp, mouse
gtgttgtcactcagctaaag

SEQ ID NO: 803116 - DNA, 20 bp, mouse
ggcggcttcaggaccgaagg

SEQ ID NO: 803117 - DNA, 20 bp, mouse
ggcttcaggaccgaaggcgg

SEQ ID NO: 803118 - DNA, 20 bp, mouse
ggtggcggcttcaggaccga

SEQ ID NO: 803119 - DNA, 20 bp, mouse
gtcaaggcactcagagcccg

SEQ ID NO: 803120 - DNA, 20 bp, mouse
gctgtcgcgggctcgggtca

SEQ ID NO: 803121 - DNA, 20 bp, mouse
ggacctgcgcacagcagatg

SEQ ID NO: 803122 - DNA, 20 bp, mouse
gtcccagtgaactacactaa

SEQ ID NO: 803123 - DNA, 20 bp, mouse
gtcaaactgggtagttaacc

SEQ ID NO: 803124 - DNA, 20 bp, mouse
ggaggagctggcatttccaa

SEQ ID NO: 803125 - DNA, 20 bp, mouse
gcacagcagatgcggaactc

SEQ ID NO: 803126 - DNA, 20 bp, mouse
gcgcgccagtgacgtcacga

SEQ ID NO: 803127 - DNA, 20 bp, mouse
gggagccagacggcgatgat

SEQ ID NO: 803128 - DNA, 20 bp, mouse
gccagacggcgatgattgga

SEQ ID NO: 803129 - DNA, 20 bp, mouse
gccaaaggccagttgctgta

SEQ ID NO: 803130 - DNA, 20 bp, mouse
ggccactttagcaagcgctg

SEQ ID NO: 803131 - DNA, 20 bp, mouse
gcgcttgctaaagtggccaa

SEQ ID NO: 803132 - DNA, 20 bp, mouse
gagcctcccgcaggcacggg

SEQ ID NO: 803133 - DNA, 20 bp, mouse
gaatgctcgcttactgaccc

SEQ ID NO: 803134 - DNA, 20 bp, mouse
gcgtcacgaggggctgggca

SEQ ID NO: 803135 - DNA, 20 bp, mouse
gacgccacggagcctcccgc

SEQ ID NO: 803136 - DNA, 20 bp, mouse
gcgggcccgcgctctcaacg

SEQ ID NO: 803137 - DNA, 20 bp, mouse
gaggcgggcgggaagtgcgc

SEQ ID NO: 803138 - DNA, 20 bp, mouse
gcacccacacccacccgcta

SEQ ID NO: 803139 - DNA, 20 bp, mouse
gcaccctagcgggtgggtgt

SEQ ID NO: 803140 - DNA, 20 bp, mouse
gtctcaacgcggtcgatccc

SEQ ID NO: 803141 - DNA, 20 bp, mouse
ggttacgctcgtccttcttc

SEQ ID NO: 803142 - DNA, 20 bp, mouse
gaagcgtggagacgatgctc

SEQ ID NO: 803143 - DNA, 20 bp, mouse
ggagagcgcgggcccgcccc

SEQ ID NO: 803144 - DNA, 20 bp, mouse
gacgagcgtaacgtctgctg

SEQ ID NO: 803145 - DNA, 20 bp, mouse
gcgccttcccaggcctgggg

SEQ ID NO: 803146 - DNA, 20 bp, mouse
gccgcccttcccagcagaga

SEQ ID NO: 803147 - DNA, 20 bp, mouse
ggggctagggactcgggaca

SEQ ID NO: 803148 - DNA, 20 bp, mouse
ggactcgggacagggcctaa

SEQ ID NO: 803149 - DNA, 20 bp, mouse
ggggccacgccctcgcccag

SEQ ID NO: 803150 - DNA, 20 bp, mouse
gttcccttctctgctgggaa

SEQ ID NO: 803151 - DNA, 20 bp, mouse
gtatacgagtggcgtagtgg

SEQ ID NO: 803152 - DNA, 20 bp, mouse
gccccgccttcactgggagg

SEQ ID NO: 803153 - DNA, 20 bp, mouse
gtagccccgccttcactggg

SEQ ID NO: 803154 - DNA, 20 bp, mouse
gggcgggtctacgatgttca

SEQ ID NO: 803155 - DNA, 20 bp, mouse
gctcctcctcccagtgaagg

SEQ ID NO: 803156 - DNA, 20 bp, mouse
gtggctgaatgtgacggcag

SEQ ID NO: 803157 - DNA, 20 bp, mouse
ggaggctccggcagaaccaa

SEQ ID NO: 803158 - DNA, 20 bp, mouse
gggcgctaggaccctcgcac

SEQ ID NO: 803159 - DNA, 20 bp, mouse
gggcagaaccaatggcgagg

SEQ ID NO: 803160 - DNA, 20 bp, mouse
gcggagcctcggctctccat

SEQ ID NO: 803161 - DNA, 20 bp, mouse
gaaccaatggcgaggaggca

SEQ ID NO: 803162 - DNA, 20 bp, mouse
gttggcgtcactaggtgggg

SEQ ID NO: 803163 - DNA, 20 bp, mouse
ggcgttggcgtcactaggtg

SEQ ID NO: 803164 - DNA, 20 bp, mouse
ggtgcggcggatcacgtggc

SEQ ID NO: 803165 - DNA, 20 bp, mouse
ggtggccggcgcgttggctg

SEQ ID NO: 803166 - DNA, 20 bp, mouse
gggaagccccgcccaagtga

SEQ ID NO: 803167 - DNA, 20 bp, mouse
ggcgccctgagatacagggg

SEQ ID NO: 803168 - DNA, 20 bp, mouse
gaagctgctgagaactagat

SEQ ID NO: 803169 - DNA, 20 bp, mouse
gatacaggggcggggctgaa

SEQ ID NO: 803170 - DNA, 20 bp, mouse
gccggcgccctgagatacag

SEQ ID NO: 803171 - DNA, 20 bp, mouse
gctgctgagaactagatagg

SEQ ID NO: 803172 - DNA, 20 bp, mouse
gcaggggcggggcgtggcag

SEQ ID NO: 803173 - DNA, 20 bp, mouse
ggccccgcccctgtatctca

SEQ ID NO: 803174 - DNA, 20 bp, mouse
gagccccgcccaagtgaggg

SEQ ID NO: 803175 - DNA, 20 bp, mouse
gcacaaaggcaaaacagggg

SEQ ID NO: 803176 - DNA, 20 bp, mouse
gcaaaagcgggtctaggaat

SEQ ID NO: 803177 - DNA, 20 bp, mouse
gtgaagcggtggtgctctta

SEQ ID NO: 803178 - DNA, 20 bp, mouse
gagtccacccggctgtgaag

SEQ ID NO: 803179 - DNA, 20 bp, mouse
gcactaccctggagtccacc

SEQ ID NO: 803180 - DNA, 20 bp, mouse
gcacagccgggtggactcca

SEQ ID NO: 803181 - DNA, 20 bp, mouse
gctccagggtagtgctactc

SEQ ID NO: 803182 - DNA, 20 bp, mouse
gtacccgcctggtcactacc

SEQ ID NO: 803183 - DNA, 20 bp, mouse
gccaccgcttcacagccggg

SEQ ID NO: 803184 - DNA, 20 bp, mouse
gctactccggctggacttcc

SEQ ID NO: 803185 - DNA, 20 bp, mouse
gagccggagtagcactaccc

SEQ ID NO: 803186 - DNA, 20 bp, mouse
gcacagccagatttcttctg

SEQ ID NO: 803187 - DNA, 20 bp, mouse
gcttgaggatgactgaagtg

SEQ ID NO: 803188 - DNA, 20 bp, mouse
gtggttttataggcctcttc

SEQ ID NO: 803189 - DNA, 20 bp, mouse
gttagggcaaagttgatgcc

SEQ ID NO: 803190 - DNA, 20 bp, mouse
gaaagttgatgccagggcca

SEQ ID NO: 803191 - DNA, 20 bp, mouse
gtctgtcactaccatggccc

SEQ ID NO: 803192 - DNA, 20 bp, mouse
ggtagaatctgtcactacca

SEQ ID NO: 803193 - DNA, 20 bp, mouse
gaattacctgaaaaatgcta

SEQ ID NO: 803194 - DNA, 20 bp, mouse
gttattggatactattgtca

SEQ ID NO: 803195 - DNA, 20 bp, mouse
gaggttccatagcatttttc

SEQ ID NO: 803196 - DNA, 20 bp, mouse
gccgccgcgcggggaaccat

SEQ ID NO: 803197 - DNA, 20 bp, mouse
gtgcctctagccctgcgagc

SEQ ID NO: 803198 - DNA, 20 bp, mouse
ggggactcgtagttccaacg

SEQ ID NO: 803199 - DNA, 20 bp, mouse
ggggccgtgaggaactgcct

SEQ ID NO: 803200 - DNA, 20 bp, mouse
gcccgtgcggcgggaatccg

SEQ ID NO: 803201 - DNA, 20 bp, mouse
gactaggcctccaccaccca

SEQ ID NO: 803202 - DNA, 20 bp, mouse
ggggccacccggccgagcgg

SEQ ID NO: 803203 - DNA, 20 bp, mouse
ggccctgcgagcgggcacgg

SEQ ID NO: 803204 - DNA, 20 bp, mouse
gaggacccaggctacctctc

SEQ ID NO: 803205 - DNA, 20 bp, mouse
gcggaggacgagcaaacact

SEQ ID NO: 803206 - DNA, 20 bp, mouse
gcgtggcaacgcggagtcta

SEQ ID NO: 803207 - DNA, 20 bp, mouse
ggggcggccgggccgcacca

SEQ ID NO: 803208 - DNA, 20 bp, mouse
gaggggagggaagacgccgt

SEQ ID NO: 803209 - DNA, 20 bp, mouse
gggctagcgcgagaccccga

SEQ ID NO: 803210 - DNA, 20 bp, mouse
ggtcacccgacgatccttcc

SEQ ID NO: 803211 - DNA, 20 bp, mouse
gcgctagccccgctcggtcc

SEQ ID NO: 803212 - DNA, 20 bp, mouse
gtggaactcggttttcgtgt

SEQ ID NO: 803213 - DNA, 20 bp, mouse
gagcgcgagaccccgatggg

SEQ ID NO: 803214 - DNA, 20 bp, mouse
gagagctcgacgagtggcca

SEQ ID NO: 803215 - DNA, 20 bp, mouse
gcaaaccgggaaggatcgtc

SEQ ID NO: 803216 - DNA, 20 bp, mouse
gcgaactcccgcagtcaccg

SEQ ID NO: 803217 - DNA, 20 bp, mouse
gtcctcgcgagaatggcctc

SEQ ID NO: 803218 - DNA, 20 bp, mouse
gagaagagcgactctcccgg

SEQ ID NO: 803219 - DNA, 20 bp, mouse
gaagagaagagcgactctcc

SEQ ID NO: 803220 - DNA, 20 bp, mouse
gcccagggatcaagtactga

SEQ ID NO: 803221 - DNA, 20 bp, mouse
gtactgaaggaaccgtgcaa

SEQ ID NO: 803222 - DNA, 20 bp, mouse
ggagtcgctcttctcttttc

SEQ ID NO: 803223 - DNA, 20 bp, mouse
gtctcttttcgggactgttg

SEQ ID NO: 803224 - DNA, 20 bp, mouse
gaacttaaagcacgactcct

SEQ ID NO: 803225 - DNA, 20 bp, mouse
gagagcacgccgttatcagt

SEQ ID NO: 803226 - DNA, 20 bp, mouse
gaccctgagaccgaagtagg

SEQ ID NO: 803227 - DNA, 20 bp, mouse
ggaggggttgtgtgccacaa

SEQ ID NO: 803228 - DNA, 20 bp, mouse
ggctaccctgagaccgaagt

SEQ ID NO: 803229 - DNA, 20 bp, mouse
ggccgcccgaattcctcgga

SEQ ID NO: 803230 - DNA, 20 bp, mouse
ggggttgtgtgccacaaggg

SEQ ID NO: 803231 - DNA, 20 bp, mouse
gccacagcccctaaccccct

SEQ ID NO: 803232 - DNA, 20 bp, mouse
gccgaagtaggtggtgtggt

SEQ ID NO: 803233 - DNA, 20 bp, mouse
ggacagccccagggggttag

SEQ ID NO: 803234 - DNA, 20 bp, mouse
gagaagatggggaatcctca

SEQ ID NO: 803235 - DNA, 20 bp, mouse
gttgcagactgcttagaaga

SEQ ID NO: 803236 - DNA, 20 bp, mouse
gaacgcgaggcaggacgctg

SEQ ID NO: 803237 - DNA, 20 bp, mouse
gagcctgcgcgctgcaacta

SEQ ID NO: 803238 - DNA, 20 bp, mouse
ggccgtgcgccgccccgctc

SEQ ID NO: 803239 - DNA, 20 bp, mouse
ggtagccatcgggtgcaaag

SEQ ID NO: 803240 - DNA, 20 bp, mouse
gcacccgatggctactgccc

SEQ ID NO: 803241 - DNA, 20 bp, mouse
gtgggctcggcagccaccgg

SEQ ID NO: 803242 - DNA, 20 bp, mouse
gagcggcggagcagaacgcg

SEQ ID NO: 803243 - DNA, 20 bp, mouse
gactccgggaatgattcttg

SEQ ID NO: 803244 - DNA, 20 bp, mouse
gccggagtctgaggaccgac

SEQ ID NO: 803245 - DNA, 20 bp, mouse
gggcctgggcagtagccatc

SEQ ID NO: 803246 - DNA, 20 bp, mouse
ggacagcaactgtgtgtggg

SEQ ID NO: 803247 - DNA, 20 bp, mouse
gcggctgcatccgacctccg

SEQ ID NO: 803248 - DNA, 20 bp, mouse
gagccaatgcaagttagcgg

SEQ ID NO: 803249 - DNA, 20 bp, mouse
gtgtgtggatggagctactc

SEQ ID NO: 803250 - DNA, 20 bp, mouse
gggaagatgtaagtcggggt

SEQ ID NO: 803251 - DNA, 20 bp, mouse
ggtaagtcggggtaggaatc

SEQ ID NO: 803252 - DNA, 20 bp, mouse
gagagagtgtggttcaggtc

SEQ ID NO: 803253 - DNA, 20 bp, mouse
gcggagcgtcgtagcgccta

SEQ ID NO: 803254 - DNA, 20 bp, mouse
ggccttgggaagatgtaagt

SEQ ID NO: 803255 - DNA, 20 bp, mouse
gttagaccagtcggggaggg

SEQ ID NO: 803256 - DNA, 20 bp, mouse
gagcagcgccagtgagggcc

SEQ ID NO: 803257 - DNA, 20 bp, mouse
gcggctcgggaacctttaaa

SEQ ID NO: 803258 - DNA, 20 bp, mouse
ggggacgctcgatccctgcc

SEQ ID NO: 803259 - DNA, 20 bp, mouse
gtcgttgaaatctcacctga

SEQ ID NO: 803260 - DNA, 20 bp, mouse
gggtaaagaagaggttaaga

SEQ ID NO: 803261 - DNA, 20 bp, mouse
gagcgcccaactgcgccctc

SEQ ID NO: 803262 - DNA, 20 bp, mouse
gccctaaatcggtaaagaag

SEQ ID NO: 803263 - DNA, 20 bp, mouse
gttcccgagccgggctggag

SEQ ID NO: 803264 - DNA, 20 bp, mouse
ggttgggcgctccaggcatg

SEQ ID NO: 803265 - DNA, 20 bp, mouse
ggtctgagcagcgccagtga

SEQ ID NO: 803266 - DNA, 20 bp, mouse
gaggccgcggccacccggga

SEQ ID NO: 803267 - DNA, 20 bp, mouse
ggctccgcggaccccgggga

SEQ ID NO: 803268 - DNA, 20 bp, mouse
gccacgcgtgagcatcctca

SEQ ID NO: 803269 - DNA, 20 bp, mouse
gtcctcagggctcccaggtc

SEQ ID NO: 803270 - DNA, 20 bp, mouse
ggaggcagcactactcccgg

SEQ ID NO: 803271 - DNA, 20 bp, mouse
ggcggtgactgtcccgaaag

SEQ ID NO: 803272 - DNA, 20 bp, mouse
gggcgagcaccgccagatct

SEQ ID NO: 803273 - DNA, 20 bp, mouse
gcgggacagtgatcgggtgg

SEQ ID NO: 803274 - DNA, 20 bp, mouse
gcacgcgtggtccagcctcc

SEQ ID NO: 803275 - DNA, 20 bp, mouse
ggggacagtcaccgcttcag

SEQ ID NO: 803276 - DNA, 20 bp, mouse
gtggagagaagaaccagcga

SEQ ID NO: 803277 - DNA, 20 bp, mouse
gcaccaggatggccactaac

SEQ ID NO: 803278 - DNA, 20 bp, mouse
gaatcccctgggagctgggc

SEQ ID NO: 803279 - DNA, 20 bp, mouse
gaggctcagtccgcgtcttg

SEQ ID NO: 803280 - DNA, 20 bp, mouse
gttgcgcgcggccctgttag

SEQ ID NO: 803281 - DNA, 20 bp, mouse
gcggatcacgccgtaattaa

SEQ ID NO: 803282 - DNA, 20 bp, mouse
gcagagcaacatttgatgag

SEQ ID NO: 803283 - DNA, 20 bp, mouse
gggggactctaacttgcgcg

SEQ ID NO: 803284 - DNA, 20 bp, mouse
gatgagaggagtgtggggcg

SEQ ID NO: 803285 - DNA, 20 bp, mouse
gctaggatacctgggagtgg

SEQ ID NO: 803286 - DNA, 20 bp, mouse
ggtcccctcccagttctcta

SEQ ID NO: 803287 - DNA, 20 bp, mouse
gagcaggtagactgagtctt

SEQ ID NO: 803288 - DNA, 20 bp, mouse
gtacaattgggatcagtgtg

SEQ ID NO: 803289 - DNA, 20 bp, mouse
ggatgctaactgcaggctaa

SEQ ID NO: 803290 - DNA, 20 bp, mouse
gacacttcagctgtaatccc

SEQ ID NO: 803291 - DNA, 20 bp, mouse
gtctctaaggcatgagggcc

SEQ ID NO: 803292 - DNA, 20 bp, mouse
gagcctgcagttagcatccc

SEQ ID NO: 803293 - DNA, 20 bp, mouse
ggaaacggatgcttcctgcc

SEQ ID NO: 803294 - DNA, 20 bp, mouse
gtccccgggatgctaactgc

SEQ ID NO: 803295 - DNA, 20 bp, mouse
gtcttgggaggctagaaagt

SEQ ID NO: 803296 - DNA, 20 bp, mouse
gcatgcgcacagagcgccgg

SEQ ID NO: 803297 - DNA, 20 bp, mouse
gacgagctggaagacatagg

SEQ ID NO: 803298 - DNA, 20 bp, mouse
gcgcggcgcgggcgttcgga

SEQ ID NO: 803299 - DNA, 20 bp, mouse
gcatgcgcggcgcgggcgtt

SEQ ID NO: 803300 - DNA, 20 bp, mouse
gcgggtcgcgtcggggagga

SEQ ID NO: 803301 - DNA, 20 bp, mouse
gtggccgggtcgcgtcgggg

SEQ ID NO: 803302 - DNA, 20 bp, mouse
gaggcggggccgtacgtggg

SEQ ID NO: 803303 - DNA, 20 bp, mouse
gctgggaaaagggcgagtcg

SEQ ID NO: 803304 - DNA, 20 bp, mouse
gggggctggccgggtcgcgt

SEQ ID NO: 803305 - DNA, 20 bp, mouse
ggaggcgaatgcctgggggt

SEQ ID NO: 803306 - DNA, 20 bp, mouse
ggaaccggcccgacgaggca

SEQ ID NO: 803307 - DNA, 20 bp, mouse
ggccgcgcgcagccgaccgc

SEQ ID NO: 803308 - DNA, 20 bp, mouse
gggcgacgtgggacacacga

SEQ ID NO: 803309 - DNA, 20 bp, mouse
gcctcgtcgggccggttcgc

SEQ ID NO: 803310 - DNA, 20 bp, mouse
ggggcgtggccggaggccag

SEQ ID NO: 803311 - DNA, 20 bp, mouse
ggcggccggcggcgatatgc

SEQ ID NO: 803312 - DNA, 20 bp, mouse
gtagctgcgcgctgagtcag

SEQ ID NO: 803313 - DNA, 20 bp, mouse
gcccggtggcggggcgtggc

SEQ ID NO: 803314 - DNA, 20 bp, mouse
ggcgcggccgagtagggacg

SEQ ID NO: 803315 - DNA, 20 bp, mouse
ggacccggggcgcagcagtt

SEQ ID NO: 803316 - DNA, 20 bp, mouse
gggccccgccgaccaatcag

SEQ ID NO: 803317 - DNA, 20 bp, mouse
gggtgagtggctagacggat

SEQ ID NO: 803318 - DNA, 20 bp, mouse
ggggtccctgctgaaaaaca

SEQ ID NO: 803319 - DNA, 20 bp, mouse
gcggctacgcctcaagcgac

SEQ ID NO: 803320 - DNA, 20 bp, mouse
gcccgccgaccaatcagtgg

SEQ ID NO: 803321 - DNA, 20 bp, mouse
gtggctgtagcttctagtcc

SEQ ID NO: 803322 - DNA, 20 bp, mouse
ggggaaagaatcaggtgagt

SEQ ID NO: 803323 - DNA, 20 bp, mouse
gggcgggcggatagaaggcg

SEQ ID NO: 803324 - DNA, 20 bp, mouse
gagcccgcccagggttccac

SEQ ID NO: 803325 - DNA, 20 bp, mouse
ggccaccactgattggtcgg

SEQ ID NO: 803326 - DNA, 20 bp, mouse
gcagggcggggtcacgaaat

SEQ ID NO: 803327 - DNA, 20 bp, mouse
ggggcggggcctttcctaaa

SEQ ID NO: 803328 - DNA, 20 bp, mouse
gagcctgcagagggttatta

SEQ ID NO: 803329 - DNA, 20 bp, mouse
ggggcctttcctaaagggca

SEQ ID NO: 803330 - DNA, 20 bp, mouse
ggagccgtgccacccctcgg

SEQ ID NO: 803331 - DNA, 20 bp, mouse
gtcgggtcccggacagggaa

SEQ ID NO: 803332 - DNA, 20 bp, mouse
ggacccgaggctcaggccgg

SEQ ID NO: 803333 - DNA, 20 bp, mouse
gtagccttgccctttaggaa

SEQ ID NO: 803334 - DNA, 20 bp, mouse
ggcccagcctggcttcaaca

SEQ ID NO: 803335 - DNA, 20 bp, mouse
ggctaagaagcatcctgaat

SEQ ID NO: 803336 - DNA, 20 bp, mouse
gtggaggcgggcgtcgttgg

SEQ ID NO: 803337 - DNA, 20 bp, mouse
gaacgacgcccgcctccaag

SEQ ID NO: 803338 - DNA, 20 bp, mouse
ggcaggcgcagtccccgggt

SEQ ID NO: 803339 - DNA, 20 bp, mouse
gtgcaagcgccgcggatggt

SEQ ID NO: 803340 - DNA, 20 bp, mouse
ggaaagggaacgtaccgcgc

SEQ ID NO: 803341 - DNA, 20 bp, mouse
gccgcggatggtgggctctg

SEQ ID NO: 803342 - DNA, 20 bp, mouse
gcgtgggaacgaaaaggaaa

SEQ ID NO: 803343 - DNA, 20 bp, mouse
ggctgcgagccgcttggagg

SEQ ID NO: 803344 - DNA, 20 bp, mouse
ggaccttcccagggccaagg

SEQ ID NO: 803345 - DNA, 20 bp, mouse
ggggcaccgaggaccttccc

SEQ ID NO: 803346 - DNA, 20 bp, mouse
gccccagcacccagagttgg

SEQ ID NO: 803347 - DNA, 20 bp, mouse
ggggaggaagctaaaggcct

SEQ ID NO: 803348 - DNA, 20 bp, mouse
gcaggtgaggggaagccctg

SEQ ID NO: 803349 - DNA, 20 bp, mouse
gagcagaaatagcaggtgag

SEQ ID NO: 803350 - DNA, 20 bp, mouse
gtatctgaatgtggcagtaa

SEQ ID NO: 803351 - DNA, 20 bp, mouse
gccgcagcaagcaccacctg

SEQ ID NO: 803352 - DNA, 20 bp, mouse
gtagggcttcacatctgccc

SEQ ID NO: 803353 - DNA, 20 bp, mouse
gccctccaactctgggtgct

SEQ ID NO: 803354 - DNA, 20 bp, mouse
ggcctgcccaccagggagca

SEQ ID NO: 803355 - DNA, 20 bp, mouse
gttagctaggtgccttgccg

SEQ ID NO: 803356 - DNA, 20 bp, mouse
gatgaggtcacaccactcaa

SEQ ID NO: 803357 - DNA, 20 bp, mouse
gggaagaccatccactcctt

SEQ ID NO: 803358 - DNA, 20 bp, mouse
gggatagtacaacagtccga

SEQ ID NO: 803359 - DNA, 20 bp, mouse
ggtacaacagtccgaaggag

SEQ ID NO: 803360 - DNA, 20 bp, mouse
gaggtctgaaggtttcactt

SEQ ID NO: 803361 - DNA, 20 bp, mouse
ggcacttagcgagtatgggt

SEQ ID NO: 803362 - DNA, 20 bp, mouse
gaagcactttacaggatgtt

SEQ ID NO: 803363 - DNA, 20 bp, mouse
gaaaccttcagaccttccag

SEQ ID NO: 803364 - DNA, 20 bp, mouse
ggctaagtgctaaagaatat

SEQ ID NO: 803365 - DNA, 20 bp, mouse
ggaatggaaaagcactttac

SEQ ID NO: 803366 - DNA, 20 bp, mouse
gcaaacaaggggcggacgtc

SEQ ID NO: 803367 - DNA, 20 bp, mouse
gaccctggtcgagacctctt

SEQ ID NO: 803368 - DNA, 20 bp, mouse
gccgctctgtggtcactcgt

SEQ ID NO: 803369 - DNA, 20 bp, mouse
gcacagcctcagcaaacaag

SEQ ID NO: 803370 - DNA, 20 bp, mouse
gagcctcagcaaacaagggg

SEQ ID NO: 803371 - DNA, 20 bp, mouse
gcggatagagcacgcgattg

SEQ ID NO: 803372 - DNA, 20 bp, mouse
ggtcgagacctcttggggtt

SEQ ID NO: 803373 - DNA, 20 bp, mouse
ggtccgccccttgtttgctg

SEQ ID NO: 803374 - DNA, 20 bp, mouse
gccccaagaggtctcgacca

SEQ ID NO: 803375 - DNA, 20 bp, mouse
gagcgcaacctccgcgtttt

SEQ ID NO: 803376 - DNA, 20 bp, mouse
gggggcggaggggggatgat

SEQ ID NO: 803377 - DNA, 20 bp, mouse
gtgggcgagaagagagatcg

SEQ ID NO: 803378 - DNA, 20 bp, mouse
gggctggtccccagcgagtg

SEQ ID NO: 803379 - DNA, 20 bp, mouse
gcccgcctctgccattggtc

SEQ ID NO: 803380 - DNA, 20 bp, mouse
gccccaccccccactcgctg

SEQ ID NO: 803381 - DNA, 20 bp, mouse
ggatgggttaacaggaggtg

SEQ ID NO: 803382 - DNA, 20 bp, mouse
gcctggactcgcaccttcca

SEQ ID NO: 803383 - DNA, 20 bp, mouse
ggtagagggcgctgggaccc

SEQ ID NO: 803384 - DNA, 20 bp, mouse
gaggtagcagtagagggcgc

SEQ ID NO: 803385 - DNA, 20 bp, mouse
gttggtggaaagtgacaagt

SEQ ID NO: 803386 - DNA, 20 bp, mouse
gctctgccggagtgactcaa

SEQ ID NO: 803387 - DNA, 20 bp, mouse
ggggcagcgacccgagtgag

SEQ ID NO: 803388 - DNA, 20 bp, mouse
ggggtccgcccctgcgtcca

SEQ ID NO: 803389 - DNA, 20 bp, mouse
gcaggcggctccctggacgc

SEQ ID NO: 803390 - DNA, 20 bp, mouse
gcctctctgcccatcggggc

SEQ ID NO: 803391 - DNA, 20 bp, mouse
gcgagtgagcgggaaggagc

SEQ ID NO: 803392 - DNA, 20 bp, mouse
ggcgacccgagtgagcggga

SEQ ID NO: 803393 - DNA, 20 bp, mouse
gcggccgccgggaagagcac

SEQ ID NO: 803394 - DNA, 20 bp, mouse
gcctcgtggggcttcatcaa

SEQ ID NO: 803395 - DNA, 20 bp, mouse
ggccgggaagagcacagggg

SEQ ID NO: 803396 - DNA, 20 bp, mouse
ggggcagcactgtgtcgggg

SEQ ID NO: 803397 - DNA, 20 bp, mouse
gtgtcggggtgggccgttcc

SEQ ID NO: 803398 - DNA, 20 bp, mouse
gcctccgcttcctcccgggg

SEQ ID NO: 803399 - DNA, 20 bp, mouse
gataagaggctccatgtgac

SEQ ID NO: 803400 - DNA, 20 bp, mouse
ggcgggcaggtgaccgggaa

SEQ ID NO: 803401 - DNA, 20 bp, mouse
gcgcggtgtaaacagagcgg

SEQ ID NO: 803402 - DNA, 20 bp, mouse
ggtggcgagggactttggtg

SEQ ID NO: 803403 - DNA, 20 bp, mouse
gccgggccgccacaggtgat

SEQ ID NO: 803404 - DNA, 20 bp, mouse
gagccatcccgagccataag

SEQ ID NO: 803405 - DNA, 20 bp, mouse
ggggcccctgggagcgcagg

SEQ ID NO: 803406 - DNA, 20 bp, mouse
ggcagcgcgtggagagtctg

SEQ ID NO: 803407 - DNA, 20 bp, mouse
gaggggacgctcttggggac

SEQ ID NO: 803408 - DNA, 20 bp, mouse
ggcgcgtggagagtctgggg

SEQ ID NO: 803409 - DNA, 20 bp, mouse
gcgggggaggggacgctctt

SEQ ID NO: 803410 - DNA, 20 bp, mouse
gctagggactctggcgtccc

SEQ ID NO: 803411 - DNA, 20 bp, mouse
ggcgggacgctgattggcca

SEQ ID NO: 803412 - DNA, 20 bp, mouse
gtctggcgtcccaggatgtg

SEQ ID NO: 803413 - DNA, 20 bp, mouse
gaagctgcacagaactagag

SEQ ID NO: 803414 - DNA, 20 bp, mouse
gacatctgcctcactctcca

SEQ ID NO: 803415 - DNA, 20 bp, mouse
gagaagaggcttatacgcga

SEQ ID NO: 803416 - DNA, 20 bp, mouse
gagagcagtggaccagtgtc

SEQ ID NO: 803417 - DNA, 20 bp, mouse
gccgtcagcaggcaggggaa

SEQ ID NO: 803418 - DNA, 20 bp, mouse
gctggcccgtcagcaggcag

SEQ ID NO: 803419 - DNA, 20 bp, mouse
gtggcagagtgtcctggcac

SEQ ID NO: 803420 - DNA, 20 bp, mouse
gagtggctggcagagtgtcc

SEQ ID NO: 803421 - DNA, 20 bp, mouse
gtgaggaaaaacaggtgaaa

SEQ ID NO: 803422 - DNA, 20 bp, mouse
gtcctcaagactccagacac

SEQ ID NO: 803423 - DNA, 20 bp, mouse
gccacatgataaccccctac

SEQ ID NO: 803424 - DNA, 20 bp, mouse
gcaaaaactcagcatacagt

SEQ ID NO: 803425 - DNA, 20 bp, mouse
gtggagtcttgaggaaaaac

SEQ ID NO: 803426 - DNA, 20 bp, mouse
ggggcggggcagccaatcac

SEQ ID NO: 803427 - DNA, 20 bp, mouse
gggtctggggcagggtgtga

SEQ ID NO: 803428 - DNA, 20 bp, mouse
gttccaacgccccctgtgat

SEQ ID NO: 803429 - DNA, 20 bp, mouse
gcaccccacgtggccaatct

SEQ ID NO: 803430 - DNA, 20 bp, mouse
gcgtggccaatctgggtctg

SEQ ID NO: 803431 - DNA, 20 bp, mouse
gtccccagctagaactcccc

SEQ ID NO: 803432 - DNA, 20 bp, mouse
gccaatctgggtctggggca

SEQ ID NO: 803433 - DNA, 20 bp, mouse
gcatacccaatgcacctctg

SEQ ID NO: 803434 - DNA, 20 bp, mouse
gaggggtagggatgttccaa

SEQ ID NO: 803435 - DNA, 20 bp, mouse
gggagcttcgtggagctcat

SEQ ID NO: 803436 - DNA, 20 bp, mouse
gcaacctcaaagaagtgcgg

SEQ ID NO: 803437 - DNA, 20 bp, mouse
gcagccaccgcacttctttg

SEQ ID NO: 803438 - DNA, 20 bp, mouse
ggacctaagtgtcctgtgtc

SEQ ID NO: 803439 - DNA, 20 bp, mouse
gtggatctaacttttagcca

SEQ ID NO: 803440 - DNA, 20 bp, mouse
gagggaatgtcttttgttat

SEQ ID NO: 803441 - DNA, 20 bp, mouse
gtagccttgctgcgatgttc

SEQ ID NO: 803442 - DNA, 20 bp, mouse
gatgagctagagaagaaaat

SEQ ID NO: 803443 - DNA, 20 bp, mouse
gctgcaggattcagtcactc

SEQ ID NO: 803444 - DNA, 20 bp, mouse
gagtcaacctcaaagaagtg

SEQ ID NO: 803445 - DNA, 20 bp, mouse
gagcccagaacatcgcagca

SEQ ID NO: 803446 - DNA, 20 bp, mouse
gcagggctgtggcacccttg

SEQ ID NO: 803447 - DNA, 20 bp, mouse
gcagaagtagctcacctcaa

SEQ ID NO: 803448 - DNA, 20 bp, mouse
gtcttaatagagagacttca

SEQ ID NO: 803449 - DNA, 20 bp, mouse
gcaaaagagacaatctaata

SEQ ID NO: 803450 - DNA, 20 bp, mouse
gtcacgtaaacaaatgtctt

SEQ ID NO: 803451 - DNA, 20 bp, mouse
ggaggtgggtaggggagcgt

SEQ ID NO: 803452 - DNA, 20 bp, mouse
gagtgggaggaggtgggtag

SEQ ID NO: 803453 - DNA, 20 bp, mouse
gtagagagacttcagggctg

SEQ ID NO: 803454 - DNA, 20 bp, mouse
gactgaggtaattagaagag

SEQ ID NO: 803455 - DNA, 20 bp, mouse
gaactggaaaaaaataactg

SEQ ID NO: 803456 - DNA, 20 bp, mouse
gtggccctcggcctgagagg

SEQ ID NO: 803457 - DNA, 20 bp, mouse
ggctagggctggagtcaaat

SEQ ID NO: 803458 - DNA, 20 bp, mouse
ggaaccccactaatcctctt

SEQ ID NO: 803459 - DNA, 20 bp, mouse
gacaagttggaggactaaga

SEQ ID NO: 803460 - DNA, 20 bp, mouse
ggcctgagaggaggtttgtg

SEQ ID NO: 803461 - DNA, 20 bp, mouse
gcagagctgtggccactgct

SEQ ID NO: 803462 - DNA, 20 bp, mouse
gtcctcacaaacctcctctc

SEQ ID NO: 803463 - DNA, 20 bp, mouse
gcaaacctcctctcaggccg

SEQ ID NO: 803464 - DNA, 20 bp, mouse
gctggtgatgcacaagttgg

SEQ ID NO: 803465 - DNA, 20 bp, mouse
ggctctggtgatgcacaagt

SEQ ID NO: 803466 - DNA, 20 bp, mouse
gtcactagaggggagaagct

SEQ ID NO: 803467 - DNA, 20 bp, mouse
ggccagccccccgctgacgt

SEQ ID NO: 803468 - DNA, 20 bp, mouse
gccccccgctgacgtaggat

SEQ ID NO: 803469 - DNA, 20 bp, mouse
gtgagcaccgggtcaggaaa

SEQ ID NO: 803470 - DNA, 20 bp, mouse
ggctctgctcctatgagctc

SEQ ID NO: 803471 - DNA, 20 bp, mouse
ggtggagtaggaccgacctg

SEQ ID NO: 803472 - DNA, 20 bp, mouse
ggggcctggcgggagtgctg

SEQ ID NO: 803473 - DNA, 20 bp, mouse
gttcaccaatcctacgtcag

SEQ ID NO: 803474 - DNA, 20 bp, mouse
gtcggtgagagcacctgagc

SEQ ID NO: 803475 - DNA, 20 bp, mouse
ggcggcggggctgctcccct

SEQ ID NO: 803476 - DNA, 20 bp, mouse
gtgggtgggcaaggtgtcaa

SEQ ID NO: 803477 - DNA, 20 bp, mouse
ggggccggtgggacgttggt

SEQ ID NO: 803478 - DNA, 20 bp, mouse
gctagtaaagtcagagacct

SEQ ID NO: 803479 - DNA, 20 bp, mouse
gagcaacgagtcgcagaagt

SEQ ID NO: 803480 - DNA, 20 bp, mouse
ggaaccttagctgagagggg

SEQ ID NO: 803481 - DNA, 20 bp, mouse
ggcacgggccggtgggacgt

SEQ ID NO: 803482 - DNA, 20 bp, mouse
gggcggggcccgagggcttc

SEQ ID NO: 803483 - DNA, 20 bp, mouse
gggtgctccaagtcgcctgc

SEQ ID NO: 803484 - DNA, 20 bp, mouse
ggtgccgcagaacgccgaca

SEQ ID NO: 803485 - DNA, 20 bp, mouse
gtggggagatcctgttacaa

SEQ ID NO: 803486 - DNA, 20 bp, mouse
gacgccgatagccaccgcat

SEQ ID NO: 803487 - DNA, 20 bp, mouse
gtaggcctcgaacccggcct

SEQ ID NO: 803488 - DNA, 20 bp, mouse
gcgccactaggcctcgaacc

SEQ ID NO: 803489 - DNA, 20 bp, mouse
gagagcacgtgactcttccg

SEQ ID NO: 803490 - DNA, 20 bp, mouse
ggcgggatggcgggacgtga

SEQ ID NO: 803491 - DNA, 20 bp, mouse
gtgccgcgcggtagccaatg

SEQ ID NO: 803492 - DNA, 20 bp, mouse
gcacgtgactcttccgaggc

SEQ ID NO: 803493 - DNA, 20 bp, mouse
gcgcaccgcgctcacgctgg

SEQ ID NO: 803494 - DNA, 20 bp, mouse
ggaccccggcagagaagctc

SEQ ID NO: 803495 - DNA, 20 bp, mouse
gtcttccgaggccgggttcg

SEQ ID NO: 803496 - DNA, 20 bp, mouse
ggagcggcggaagtgatgta

SEQ ID NO: 803497 - DNA, 20 bp, mouse
ggggactcatgagttctgat

SEQ ID NO: 803498 - DNA, 20 bp, mouse
gaaaacacccggccccaaga

SEQ ID NO: 803499 - DNA, 20 bp, mouse
gccagtgcaaagtagccaga

SEQ ID NO: 803500 - DNA, 20 bp, mouse
ggagagcggcccaagacgct

SEQ ID NO: 803501 - DNA, 20 bp, mouse
gacccggccccaagaaggaa

SEQ ID NO: 803502 - DNA, 20 bp, mouse
gcgtcttgggccgctctctc

SEQ ID NO: 803503 - DNA, 20 bp, mouse
gtgtgtgtgaagaatgcttg

SEQ ID NO: 803504 - DNA, 20 bp, mouse
ggagaactgcgaccaggatg

SEQ ID NO: 803505 - DNA, 20 bp, mouse
gcgtggggagagtcacgcga

SEQ ID NO: 803506 - DNA, 20 bp, mouse
gtaagctgaaggaccgtggt

SEQ ID NO: 803507 - DNA, 20 bp, mouse
gtgggacccgggatctggag

SEQ ID NO: 803508 - DNA, 20 bp, mouse
ggcgggacttagaggggcgg

SEQ ID NO: 803509 - DNA, 20 bp, mouse
gtggttcgctcgcaccgggc

SEQ ID NO: 803510 - DNA, 20 bp, mouse
ggcggcgttccggaagtcac

SEQ ID NO: 803511 - DNA, 20 bp, mouse
gagtggaggcgggacttaga

SEQ ID NO: 803512 - DNA, 20 bp, mouse
gagtcactggggccgaaacc

SEQ ID NO: 803513 - DNA, 20 bp, mouse
gcggaggggctcaaggcttc

SEQ ID NO: 803514 - DNA, 20 bp, mouse
gtcaaggcttccggaagtac

SEQ ID NO: 803515 - DNA, 20 bp, mouse
gggcagtctaccagtacttc

SEQ ID NO: 803516 - DNA, 20 bp, mouse
gcggggcggagtggagtgta

SEQ ID NO: 803517 - DNA, 20 bp, mouse
ggctgtgcgtagccaatccg

SEQ ID NO: 803518 - DNA, 20 bp, mouse
gccctcacagtgacagattt

SEQ ID NO: 803519 - DNA, 20 bp, mouse
gacagatttaggggaatccg

SEQ ID NO: 803520 - DNA, 20 bp, mouse
ggagccgcaagaacacgacg

SEQ ID NO: 803521 - DNA, 20 bp, mouse
gcagtgagggggtagcgtta

SEQ ID NO: 803522 - DNA, 20 bp, mouse
gaatcgctagaggatagaca

SEQ ID NO: 803523 - DNA, 20 bp, mouse
gacaccacccgggctgaggg

SEQ ID NO: 803524 - DNA, 20 bp, mouse
gtgagaagtaaacaccaccc

SEQ ID NO: 803525 - DNA, 20 bp, mouse
gggagtgtaaggatcgcttt

SEQ ID NO: 803526 - DNA, 20 bp, mouse
gccgtgctgtggaaagacct

SEQ ID NO: 803527 - DNA, 20 bp, mouse
gcacactggggagatcgcat

SEQ ID NO: 803528 - DNA, 20 bp, mouse
gggctcgcccgggagctcga

SEQ ID NO: 803529 - DNA, 20 bp, mouse
ggggagtggagcgggaatac

SEQ ID NO: 803530 - DNA, 20 bp, mouse
gtgagtgcggggagtggagc

SEQ ID NO: 803531 - DNA, 20 bp, mouse
gagccccgcctgccgcgctg

SEQ ID NO: 803532 - DNA, 20 bp, mouse
gagccacagcgcggcaggcg

SEQ ID NO: 803533 - DNA, 20 bp, mouse
gcctcaagcggcgaagcctg

SEQ ID NO: 803534 - DNA, 20 bp, mouse
gggaagccgaactctagagg

SEQ ID NO: 803535 - DNA, 20 bp, mouse
gcgcggcaggcggggctgct

SEQ ID NO: 803536 - DNA, 20 bp, mouse
gaggcaggcgcgtggatcgg

SEQ ID NO: 803537 - DNA, 20 bp, mouse
gtaggtagacatgctgggtc

SEQ ID NO: 803538 - DNA, 20 bp, mouse
gggcgcgtggatcggcgggt

SEQ ID NO: 803539 - DNA, 20 bp, mouse
gaagaggcaggcgcgtggat

SEQ ID NO: 803540 - DNA, 20 bp, mouse
gcggcctgcgctacctgaag

SEQ ID NO: 803541 - DNA, 20 bp, mouse
ggtgcggcgcaggtcctgtt

SEQ ID NO: 803542 - DNA, 20 bp, mouse
ggcgctacctgaagtggaga

SEQ ID NO: 803543 - DNA, 20 bp, mouse
gggcgggtaggtagacatgc

SEQ ID NO: 803544 - DNA, 20 bp, mouse
gatgctgggtcgggcggatc

SEQ ID NO: 803545 - DNA, 20 bp, mouse
gctgcaggagcagggagaaa

SEQ ID NO: 803546 - DNA, 20 bp, mouse
gcgagcgtgcgcagaaggtt

SEQ ID NO: 803547 - DNA, 20 bp, mouse
ggaggtcaatacgtcaagat

SEQ ID NO: 803548 - DNA, 20 bp, mouse
gcaagatgggtgcactttgg

SEQ ID NO: 803549 - DNA, 20 bp, mouse
gctctcagaaacacaatcga

SEQ ID NO: 803550 - DNA, 20 bp, mouse
gctcacgcttagtctagaag

SEQ ID NO: 803551 - DNA, 20 bp, mouse
gccgctcgagcgtgcgcaga

SEQ ID NO: 803552 - DNA, 20 bp, mouse
ggctacaaacatctcgttag

SEQ ID NO: 803553 - DNA, 20 bp, mouse
gaaaaggctttatgctttgg

SEQ ID NO: 803554 - DNA, 20 bp, mouse
gagcaagagcagccgagcgc

SEQ ID NO: 803555 - DNA, 20 bp, mouse
ggctgctcttgctttgctgg

SEQ ID NO: 803556 - DNA, 20 bp, mouse
ggcggcgcgcccaatcggga

SEQ ID NO: 803557 - DNA, 20 bp, mouse
gtcagctggctggctagggg

SEQ ID NO: 803558 - DNA, 20 bp, mouse
gggaagtcccgcctcctcct

SEQ ID NO: 803559 - DNA, 20 bp, mouse
gccagtgcggcgcgcccaat

SEQ ID NO: 803560 - DNA, 20 bp, mouse
gggcgtcagctggctggcta

SEQ ID NO: 803561 - DNA, 20 bp, mouse
gccggaagagagtgcgaggt

SEQ ID NO: 803562 - DNA, 20 bp, mouse
ggggtcaggaggagtggctg

SEQ ID NO: 803563 - DNA, 20 bp, mouse
gaagagagtgcgaggtggga

SEQ ID NO: 803564 - DNA, 20 bp, mouse
gaagcagctgccctgcggcg

SEQ ID NO: 803565 - DNA, 20 bp, mouse
gccaagactccgtcccgatt

SEQ ID NO: 803566 - DNA, 20 bp, mouse
gcagacttggatcctttcaa

SEQ ID NO: 803567 - DNA, 20 bp, mouse
ggccgcaggctcctccaata

SEQ ID NO: 803568 - DNA, 20 bp, mouse
gactgcatggcaggcccaca

SEQ ID NO: 803569 - DNA, 20 bp, mouse
gtggatcctttcaagggaga

SEQ ID NO: 803570 - DNA, 20 bp, mouse
gcagctcaggactgcatggc

SEQ ID NO: 803571 - DNA, 20 bp, mouse
gcatcagctgaggggtggag

SEQ ID NO: 803572 - DNA, 20 bp, mouse
gagagggttcccagagccgc

SEQ ID NO: 803573 - DNA, 20 bp, mouse
gctactccctctcccttgaa

SEQ ID NO: 803574 - DNA, 20 bp, mouse
ggataacagcaaagaaatgg

SEQ ID NO: 803575 - DNA, 20 bp, mouse
gcaagaaagtatgatgactg

SEQ ID NO: 803576 - DNA, 20 bp, mouse
gaagtgccaaggctggacgc

SEQ ID NO: 803577 - DNA, 20 bp, mouse
gcaaggctggacgctggtgg

SEQ ID NO: 803578 - DNA, 20 bp, mouse
gttccggggccgccaagttc

SEQ ID NO: 803579 - DNA, 20 bp, mouse
gaagtaaaaccgtatgaccc

SEQ ID NO: 803580 - DNA, 20 bp, mouse
gcgctagttccggaacttgg

SEQ ID NO: 803581 - DNA, 20 bp, mouse
ggctatgtaagaaagtgcca

SEQ ID NO: 803582 - DNA, 20 bp, mouse
gggtgtctgtggtgtttgag

SEQ ID NO: 803583 - DNA, 20 bp, mouse
ggaactagcgctttgcttta

SEQ ID NO: 803584 - DNA, 20 bp, mouse
gctgagaccagtgagaacgt

SEQ ID NO: 803585 - DNA, 20 bp, mouse
gttccggaacttggcggccc

SEQ ID NO: 803586 - DNA, 20 bp, mouse
gacttagtcgaggatttggg

SEQ ID NO: 803587 - DNA, 20 bp, mouse
gaaagtaaacgacttagtcg

SEQ ID NO: 803588 - DNA, 20 bp, mouse
gagaatgctagaaaggttgg

SEQ ID NO: 803589 - DNA, 20 bp, mouse
ggaagccagcacagccgtga

SEQ ID NO: 803590 - DNA, 20 bp, mouse
gcatggcgttccgtctccct

SEQ ID NO: 803591 - DNA, 20 bp, mouse
gcaactgctctcccagttaa

SEQ ID NO: 803592 - DNA, 20 bp, mouse
ggctggcggccattttggga

SEQ ID NO: 803593 - DNA, 20 bp, mouse
gacagcccggctgtccgcgc

SEQ ID NO: 803594 - DNA, 20 bp, mouse
ggccgccagcgcggacagcc

SEQ ID NO: 803595 - DNA, 20 bp, mouse
gaacgacttagtcgaggatt

SEQ ID NO: 803596 - DNA, 20 bp, mouse
gacgctaggggcaacggagg

SEQ ID NO: 803597 - DNA, 20 bp, mouse
gtccaatcgcgaccgctaga

SEQ ID NO: 803598 - DNA, 20 bp, mouse
gggcggaagctgtgtcagtg

SEQ ID NO: 803599 - DNA, 20 bp, mouse
gtagcggtcgcgattggaag

SEQ ID NO: 803600 - DNA, 20 bp, mouse
ggcagatgccatggtcgcgg

SEQ ID NO: 803601 - DNA, 20 bp, mouse
ggaggcggagccttgcgggg

SEQ ID NO: 803602 - DNA, 20 bp, mouse
gacccccatcgcgaccctct

SEQ ID NO: 803603 - DNA, 20 bp, mouse
ggcgaaaggcttttggaagg

SEQ ID NO: 803604 - DNA, 20 bp, mouse
gagcgcagatgccatggtcg

SEQ ID NO: 803605 - DNA, 20 bp, mouse
gtcccctctaggtccctgca

SEQ ID NO: 803606 - DNA, 20 bp, mouse
gcgttagtggagaaagtcct

SEQ ID NO: 803607 - DNA, 20 bp, mouse
gaacctgagaaatacatgat

SEQ ID NO: 803608 - DNA, 20 bp, mouse
gcaagttcagcacgcgatga

SEQ ID NO: 803609 - DNA, 20 bp, mouse
gtggattagtgtctcctcta

SEQ ID NO: 803610 - DNA, 20 bp, mouse
gttctcaggttcagcgttag

SEQ ID NO: 803611 - DNA, 20 bp, mouse
gctcctctaaggaggacaag

SEQ ID NO: 803612 - DNA, 20 bp, mouse
ggaaatacatgattggctga

SEQ ID NO: 803613 - DNA, 20 bp, mouse
gttgttaaaggaccaggtgt

SEQ ID NO: 803614 - DNA, 20 bp, mouse
gcaaagagttaacagctaaa

SEQ ID NO: 803615 - DNA, 20 bp, mouse
gagccaatcatgtatttctc

SEQ ID NO: 803616 - DNA, 20 bp, mouse
gagactcccgagtactcctt

SEQ ID NO: 803617 - DNA, 20 bp, mouse
ggactggagaaattcagctc

SEQ ID NO: 803618 - DNA, 20 bp, mouse
gcggagcccaaggagtactc

SEQ ID NO: 803619 - DNA, 20 bp, mouse
ggagtctcgcgcagcattct

SEQ ID NO: 803620 - DNA, 20 bp, mouse
gacacaggaggcggggtcca

SEQ ID NO: 803621 - DNA, 20 bp, mouse
gacccgcagacccgctggga

SEQ ID NO: 803622 - DNA, 20 bp, mouse
gaagcgcgtccagaccgcgg

SEQ ID NO: 803623 - DNA, 20 bp, mouse
gcgggaagctaaggtatgtg

SEQ ID NO: 803624 - DNA, 20 bp, mouse
ggggaaatgtagttctccgt

SEQ ID NO: 803625 - DNA, 20 bp, mouse
ggaacgagagcgggaagcta

SEQ ID NO: 803626 - DNA, 20 bp, mouse
ggcagaacaggggaagttat

SEQ ID NO: 803627 - DNA, 20 bp, mouse
gaggccagagtagaggaacc

SEQ ID NO: 803628 - DNA, 20 bp, mouse
gaagggagaggccagagtag

SEQ ID NO: 803629 - DNA, 20 bp, mouse
gggacgcaagcggaggggaa

SEQ ID NO: 803630 - DNA, 20 bp, mouse
gaggggcagccgcttcccgg

SEQ ID NO: 803631 - DNA, 20 bp, mouse
gcagtctgacaaaatcgtcc

SEQ ID NO: 803632 - DNA, 20 bp, mouse
ggacagcaccaggacgcaag

SEQ ID NO: 803633 - DNA, 20 bp, mouse
ggccccagaacgatccggat

SEQ ID NO: 803634 - DNA, 20 bp, mouse
gtattggatccctgcagcag

SEQ ID NO: 803635 - DNA, 20 bp, mouse
gaagggcggccactaacccc

SEQ ID NO: 803636 - DNA, 20 bp, mouse
gctgttgcatggagccgagg

SEQ ID NO: 803637 - DNA, 20 bp, mouse
gcccaccacgggcatcttca

SEQ ID NO: 803638 - DNA, 20 bp, mouse
gtaccagaataggacttgga

SEQ ID NO: 803639 - DNA, 20 bp, mouse
gaccctgaagatgcccgtgg

SEQ ID NO: 803640 - DNA, 20 bp, mouse
gcgggcaggcagcacctata

SEQ ID NO: 803641 - DNA, 20 bp, mouse
gctgcagagaggtagacagc

SEQ ID NO: 803642 - DNA, 20 bp, mouse
gacagctggcccctgatagc

SEQ ID NO: 803643 - DNA, 20 bp, mouse
gagcaggctaggtcagctga

SEQ ID NO: 803644 - DNA, 20 bp, mouse
gcagctgagggttgccttgg

SEQ ID NO: 803645 - DNA, 20 bp, mouse
gtgacctagcctgctatcag

SEQ ID NO: 803646 - DNA, 20 bp, mouse
gcaccccagcactattgtac

SEQ ID NO: 803647 - DNA, 20 bp, mouse
gcccagttggagccaaaccc

SEQ ID NO: 803648 - DNA, 20 bp, mouse
ggcccggcttccctgcacta

SEQ ID NO: 803649 - DNA, 20 bp, mouse
gcactagggagagagaatcc

SEQ ID NO: 803650 - DNA, 20 bp, mouse
gactgaaaacacatccgcga

SEQ ID NO: 803651 - DNA, 20 bp, mouse
gctgctgccactgtgggact

SEQ ID NO: 803652 - DNA, 20 bp, mouse
ggagggcctcccttgtatgg

SEQ ID NO: 803653 - DNA, 20 bp, mouse
ggggatgtaagcttctgcct

SEQ ID NO: 803654 - DNA, 20 bp, mouse
gtctccagtacaatagtgct

SEQ ID NO: 803655 - DNA, 20 bp, mouse
ggggacctgccagcactgaa

SEQ ID NO: 803656 - DNA, 20 bp, mouse
gcaagcgagcgggtttccgg

SEQ ID NO: 803657 - DNA, 20 bp, mouse
ggccaggacccgcccgtaga

SEQ ID NO: 803658 - DNA, 20 bp, mouse
gggcccttcagcaccctcta

SEQ ID NO: 803659 - DNA, 20 bp, mouse
ggcaggttgcgcaagcgagc

SEQ ID NO: 803660 - DNA, 20 bp, mouse
gggaacaactggggcctctc

SEQ ID NO: 803661 - DNA, 20 bp, mouse
gcggagaggctggagcgagg

SEQ ID NO: 803662 - DNA, 20 bp, mouse
gggtcctggccccactgccc

SEQ ID NO: 803663 - DNA, 20 bp, mouse
ggcccgtagagggtgctgaa

SEQ ID NO: 803664 - DNA, 20 bp, mouse
gccggcccgcccgggcagtg

SEQ ID NO: 803665 - DNA, 20 bp, mouse
gcgggtttccggaggagttg

SEQ ID NO: 803666 - DNA, 20 bp, mouse
gggtgactggataccggaat

SEQ ID NO: 803667 - DNA, 20 bp, mouse
gccccctggctgtaactcta

SEQ ID NO: 803668 - DNA, 20 bp, mouse
ggaactgcatgctggcgaat

SEQ ID NO: 803669 - DNA, 20 bp, mouse
gggaatagggaactgcatgc

SEQ ID NO: 803670 - DNA, 20 bp, mouse
gtctgcgcatgtgtaccagg

SEQ ID NO: 803671 - DNA, 20 bp, mouse
gaacgaagcacagagcttat

SEQ ID NO: 803672 - DNA, 20 bp, mouse
gcacagagcttattggtgac

SEQ ID NO: 803673 - DNA, 20 bp, mouse
gtgctctgcgcatgtgtacc

SEQ ID NO: 803674 - DNA, 20 bp, mouse
gaaccatagagttacagcca

SEQ ID NO: 803675 - DNA, 20 bp, mouse
gtgggcggagagccattgac

SEQ ID NO: 803676 - DNA, 20 bp, mouse
gggtacagctctattgaaag

SEQ ID NO: 803677 - DNA, 20 bp, mouse
gagcatggaagcaggcatat

SEQ ID NO: 803678 - DNA, 20 bp, mouse
gagctaatgccctgatctac

SEQ ID NO: 803679 - DNA, 20 bp, mouse
gtgaactctttgtccctgat

SEQ ID NO: 803680 - DNA, 20 bp, mouse
gaatgccctgatctacaggt

SEQ ID NO: 803681 - DNA, 20 bp, mouse
gaggcatatgggcatgttgc

SEQ ID NO: 803682 - DNA, 20 bp, mouse
ggctcagtgagggctggatc

SEQ ID NO: 803683 - DNA, 20 bp, mouse
gctaacacaaacacagtata

SEQ ID NO: 803684 - DNA, 20 bp, mouse
gaaatccaacctgtagatca

SEQ ID NO: 803685 - DNA, 20 bp, mouse
gactctttgtccctgattgg

SEQ ID NO: 803686 - DNA, 20 bp, mouse
gacggagaccggttctgccg

SEQ ID NO: 803687 - DNA, 20 bp, mouse
gccggggactggaagtcatg

SEQ ID NO: 803688 - DNA, 20 bp, mouse
gtgaagccgggccctgggat

SEQ ID NO: 803689 - DNA, 20 bp, mouse
ggctcctagagcggttctca

SEQ ID NO: 803690 - DNA, 20 bp, mouse
gtcagcccttgtcccaatgc

SEQ ID NO: 803691 - DNA, 20 bp, mouse
gctgcctgctgctcctagag

SEQ ID NO: 803692 - DNA, 20 bp, mouse
gcaggcagaagatagaaagc

SEQ ID NO: 803693 - DNA, 20 bp, mouse
gagggctgaagccgggccct

SEQ ID NO: 803694 - DNA, 20 bp, mouse
ggcaccgtgagaaccgctct

SEQ ID NO: 803695 - DNA, 20 bp, mouse
ggcacaatgcacggctagag

SEQ ID NO: 803696 - DNA, 20 bp, mouse
gctgtccatgagactaagta

SEQ ID NO: 803697 - DNA, 20 bp, mouse
gcagatgctccgcacatcct

SEQ ID NO: 803698 - DNA, 20 bp, mouse
ggctccgcacatcctggggg

SEQ ID NO: 803699 - DNA, 20 bp, mouse
ggacccccccaggatgtgtg

SEQ ID NO: 803700 - DNA, 20 bp, mouse
gtacatgaggaattcatagc

SEQ ID NO: 803701 - DNA, 20 bp, mouse
gtgtgactgcagaccccccc

SEQ ID NO: 803702 - DNA, 20 bp, mouse
ggctccgcagagaactgtta

SEQ ID NO: 803703 - DNA, 20 bp, mouse
gatcatgccccacacatcct

SEQ ID NO: 803704 - DNA, 20 bp, mouse
gtctgctgtccatgagacta

SEQ ID NO: 803705 - DNA, 20 bp, mouse
gtgtgtatcccaggttgttc

SEQ ID NO: 803706 - DNA, 20 bp, mouse
gcaccactgcccaccgaatt

SEQ ID NO: 803707 - DNA, 20 bp, mouse
gtgaccttaagctttgtagt

SEQ ID NO: 803708 - DNA, 20 bp, mouse
gttccaaattcggtgggcag

SEQ ID NO: 803709 - DNA, 20 bp, mouse
gtcaaagttccaaattcggt

SEQ ID NO: 803710 - DNA, 20 bp, mouse
gacgcctgcgcaggcctcag

SEQ ID NO: 803711 - DNA, 20 bp, mouse
gctcagtggtaaatactgaa

SEQ ID NO: 803712 - DNA, 20 bp, mouse
ggagtgacccggagattgag

SEQ ID NO: 803713 - DNA, 20 bp, mouse
gaaggtcaaagttccaaatt

SEQ ID NO: 803714 - DNA, 20 bp, mouse
gatactgaaaggtttctttc

SEQ ID NO: 803715 - DNA, 20 bp, mouse
gaagcctactacaaagctta

SEQ ID NO: 803716 - DNA, 20 bp, mouse
gtgggcaaaagactaggtcg

SEQ ID NO: 803717 - DNA, 20 bp, mouse
ggcggtgagtaggcgagagt

SEQ ID NO: 803718 - DNA, 20 bp, mouse
ggtggcgctgccacctctag

SEQ ID NO: 803719 - DNA, 20 bp, mouse
gcccagggcggctgtctcgc

SEQ ID NO: 803720 - DNA, 20 bp, mouse
gcatcctaagaatggggctc

SEQ ID NO: 803721 - DNA, 20 bp, mouse
ggaggacagtccactagagg

SEQ ID NO: 803722 - DNA, 20 bp, mouse
gttcgaggacagtccactag

SEQ ID NO: 803723 - DNA, 20 bp, mouse
gcgtctccatccgcagtcgg

SEQ ID NO: 803724 - DNA, 20 bp, mouse
gcttctaggcagacaaacga

SEQ ID NO: 803725 - DNA, 20 bp, mouse
gttaatgccaacagcctcgc

SEQ ID NO: 803726 - DNA, 20 bp, mouse
gtgagctcgggattcggaag

SEQ ID NO: 803727 - DNA, 20 bp, mouse
ggggcaggcgtctgcggcag

SEQ ID NO: 803728 - DNA, 20 bp, mouse
gggaacgtggaccaggaacc

SEQ ID NO: 803729 - DNA, 20 bp, mouse
ggccctgggctgggtcccag

SEQ ID NO: 803730 - DNA, 20 bp, mouse
ggtgtcgcccagagactggg

SEQ ID NO: 803731 - DNA, 20 bp, mouse
gactgcagagcttggtctgt

SEQ ID NO: 803732 - DNA, 20 bp, mouse
gagggtgtcgcccagagact

SEQ ID NO: 803733 - DNA, 20 bp, mouse
ggtgcagatcccttagggga

SEQ ID NO: 803734 - DNA, 20 bp, mouse
ggcccctgggacccagccca

SEQ ID NO: 803735 - DNA, 20 bp, mouse
ggctggccccacccagtctc

SEQ ID NO: 803736 - DNA, 20 bp, mouse
gccgacggctagaaaggcga

SEQ ID NO: 803737 - DNA, 20 bp, mouse
gttcgcagtgtgggtatctc

SEQ ID NO: 803738 - DNA, 20 bp, mouse
gggtgcgtgcttcagttctg

SEQ ID NO: 803739 - DNA, 20 bp, mouse
ggggggggaagtctggaatg

SEQ ID NO: 803740 - DNA, 20 bp, mouse
ggtggacggggaaaaaacac

SEQ ID NO: 803741 - DNA, 20 bp, mouse
gatacccacactgcgaagtt

SEQ ID NO: 803742 - DNA, 20 bp, mouse
gaaaggcgatggtccgccgg

SEQ ID NO: 803743 - DNA, 20 bp, mouse
gaaaaacactggatctagga

SEQ ID NO: 803744 - DNA, 20 bp, mouse
ggcgagaataaccaacccga

SEQ ID NO: 803745 - DNA, 20 bp, mouse
ggagggagaaagagttttag

SEQ ID NO: 803746 - DNA, 20 bp, mouse
ggagactgacatatgtgcct

SEQ ID NO: 803747 - DNA, 20 bp, mouse
gagggtgagcagacacccag

SEQ ID NO: 803748 - DNA, 20 bp, mouse
gagagggtagggacacccct

SEQ ID NO: 803749 - DNA, 20 bp, mouse
gtcaacaaaacttgagcctt

SEQ ID NO: 803750 - DNA, 20 bp, mouse
ggactctgtgaggaaagaac

SEQ ID NO: 803751 - DNA, 20 bp, mouse
gtgtgctggaccgaggccct

SEQ ID NO: 803752 - DNA, 20 bp, mouse
ggtgaggaaagaactgggat

SEQ ID NO: 803753 - DNA, 20 bp, mouse
gatgaagtctcagccagttt

SEQ ID NO: 803754 - DNA, 20 bp, mouse
gcttgggtgctctcagacaa

SEQ ID NO: 803755 - DNA, 20 bp, mouse
ggactctcatggaagagaca

SEQ ID NO: 803756 - DNA, 20 bp, mouse
gcacatggcagacaccggaa

SEQ ID NO: 803757 - DNA, 20 bp, mouse
ggcggggcgggatgtcacgt

SEQ ID NO: 803758 - DNA, 20 bp, mouse
gcggccatgactgtgcgggg

SEQ ID NO: 803759 - DNA, 20 bp, mouse
gagtgcgcgtctatcgaggc

SEQ ID NO: 803760 - DNA, 20 bp, mouse
gccttcaaatatggcggctg

SEQ ID NO: 803761 - DNA, 20 bp, mouse
ggcggaggaagtgacgcaga

SEQ ID NO: 803762 - DNA, 20 bp, mouse
gggccgccaagagccaactc

SEQ ID NO: 803763 - DNA, 20 bp, mouse
gcggcttggccggcattgta

SEQ ID NO: 803764 - DNA, 20 bp, mouse
gtgtcacgtgggtttcggag

SEQ ID NO: 803765 - DNA, 20 bp, mouse
gtactcccatcaagtgatgg

SEQ ID NO: 803766 - DNA, 20 bp, mouse
gcggccgcagacctcagctt

SEQ ID NO: 803767 - DNA, 20 bp, mouse
gggccctgaaaggatagcga

SEQ ID NO: 803768 - DNA, 20 bp, mouse
ggggcccaagctgaggtctg

SEQ ID NO: 803769 - DNA, 20 bp, mouse
gatagcgaagggatgcgaca

SEQ ID NO: 803770 - DNA, 20 bp, mouse
gcctcagcttgggccctgaa

SEQ ID NO: 803771 - DNA, 20 bp, mouse
gccgggctcgaactcacccc

SEQ ID NO: 803772 - DNA, 20 bp, mouse
gctagtggtaacaagtggcg

SEQ ID NO: 803773 - DNA, 20 bp, mouse
gggaggcaaagtctatttaa

SEQ ID NO: 803774 - DNA, 20 bp, mouse
gaccataaggaatgtcatag

SEQ ID NO: 803775 - DNA, 20 bp, mouse
ggccacctagtggtaacaag

SEQ ID NO: 803776 - DNA, 20 bp, mouse
gtgcgtgcgcgcacgagcat

SEQ ID NO: 803777 - DNA, 20 bp, mouse
gaaaggcaatgggacgtcga

SEQ ID NO: 803778 - DNA, 20 bp, mouse
gaatccactgagtgagttca

SEQ ID NO: 803779 - DNA, 20 bp, mouse
gcactcagtggattatgaat

SEQ ID NO: 803780 - DNA, 20 bp, mouse
ggcagtgctcacttctaaga

SEQ ID NO: 803781 - DNA, 20 bp, mouse
gggttagtagaccactaaaa

SEQ ID NO: 803782 - DNA, 20 bp, mouse
gtcccccaaataaatgctgg

SEQ ID NO: 803783 - DNA, 20 bp, mouse
gctttcccccaaataaatgc

SEQ ID NO: 803784 - DNA, 20 bp, mouse
gagcttcaaaccatttcatt

SEQ ID NO: 803785 - DNA, 20 bp, mouse
gctcaaagcatccattttag

SEQ ID NO: 803786 - DNA, 20 bp, mouse
gtgggcacgctggacgtcgg

SEQ ID NO: 803787 - DNA, 20 bp, mouse
ggtccagcgtgcccaccgat

SEQ ID NO: 803788 - DNA, 20 bp, mouse
ggtgcccaccgattggtcga

SEQ ID NO: 803789 - DNA, 20 bp, mouse
gtccccgtcgaccaatcggt

SEQ ID NO: 803790 - DNA, 20 bp, mouse
gaccggaagaagagtgactg

SEQ ID NO: 803791 - DNA, 20 bp, mouse
gtggcggttccggctctcta

SEQ ID NO: 803792 - DNA, 20 bp, mouse
gcggtgggcacgctggacgt

SEQ ID NO: 803793 - DNA, 20 bp, mouse
gggttatgacatggcggttc

SEQ ID NO: 803794 - DNA, 20 bp, mouse
gagctcactgcacgtgtctg

SEQ ID NO: 803795 - DNA, 20 bp, mouse
gaagacacagccgagggtgc

SEQ ID NO: 803796 - DNA, 20 bp, mouse
gtcccgacatccaacctggt

SEQ ID NO: 803797 - DNA, 20 bp, mouse
gcggtccgaaggcgtccctc

SEQ ID NO: 803798 - DNA, 20 bp, mouse
gggagagcatccggaagcgg

SEQ ID NO: 803799 - DNA, 20 bp, mouse
gtgggacagcccgccgcttc

SEQ ID NO: 803800 - DNA, 20 bp, mouse
gggccggaggaagcaggtcg

SEQ ID NO: 803801 - DNA, 20 bp, mouse
gggcacctcggaaaattcag

SEQ ID NO: 803802 - DNA, 20 bp, mouse
gcaaggctgcggaaagtgag

SEQ ID NO: 803803 - DNA, 20 bp, mouse
gccaccggaaggagggtcgc

SEQ ID NO: 803804 - DNA, 20 bp, mouse
gggagcactgctgagagctt

SEQ ID NO: 803805 - DNA, 20 bp, mouse
ggtagtcccgacatccaacc

SEQ ID NO: 803806 - DNA, 20 bp, mouse
gggaacgagatctgaggagt

SEQ ID NO: 803807 - DNA, 20 bp, mouse
gaggagtgggcgggccgcga

SEQ ID NO: 803808 - DNA, 20 bp, mouse
ggtgggcgggccgcgaagga

SEQ ID NO: 803809 - DNA, 20 bp, mouse
gtaggtgccaggcacacccg

SEQ ID NO: 803810 - DNA, 20 bp, mouse
ggcccaaggaacgagatctg

SEQ ID NO: 803811 - DNA, 20 bp, mouse
gggtgtgcctggcacctatc

SEQ ID NO: 803812 - DNA, 20 bp, mouse
gaaagacagtcatgaagcgt

SEQ ID NO: 803813 - DNA, 20 bp, mouse
gtgcctggcacctatcgggt

SEQ ID NO: 803814 - DNA, 20 bp, mouse
gtcctcagatctcgttcctt

SEQ ID NO: 803815 - DNA, 20 bp, mouse
gacgagatctgaggagtggg

SEQ ID NO: 803816 - DNA, 20 bp, mouse
ggggaggaccgagtaaaccg

SEQ ID NO: 803817 - DNA, 20 bp, mouse
ggggtcccagccctttcctc

SEQ ID NO: 803818 - DNA, 20 bp, mouse
gcggagctctaccacaattt

SEQ ID NO: 803819 - DNA, 20 bp, mouse
gcacaatttgggtttctcga

SEQ ID NO: 803820 - DNA, 20 bp, mouse
ggggctgtgtgtcggaggtg

SEQ ID NO: 803821 - DNA, 20 bp, mouse
gggctcgcggaggacccggt

SEQ ID NO: 803822 - DNA, 20 bp, mouse
gtgggtttctcgatggtatg

SEQ ID NO: 803823 - DNA, 20 bp, mouse
ggacccggtgggctgtgtgt

SEQ ID NO: 803824 - DNA, 20 bp, mouse
gcctgctctaacactctcca

SEQ ID NO: 803825 - DNA, 20 bp, mouse
gcacgccgaccgcttctcgg

SEQ ID NO: 803826 - DNA, 20 bp, mouse
gcacgacgatggggcgtccc

SEQ ID NO: 803827 - DNA, 20 bp, mouse
ggatccctcgcgcacgacga

SEQ ID NO: 803828 - DNA, 20 bp, mouse
ggtcgtgcgcgagggatcct

SEQ ID NO: 803829 - DNA, 20 bp, mouse
ggcccgtcgcgctgctctct

SEQ ID NO: 803830 - DNA, 20 bp, mouse
gtcccgggagaaacttgcaa

SEQ ID NO: 803831 - DNA, 20 bp, mouse
gtggatgatgggtcatagat

SEQ ID NO: 803832 - DNA, 20 bp, mouse
ggccccatcgtcgtgcgcga

SEQ ID NO: 803833 - DNA, 20 bp, mouse
gttcccagagagcagcgcga

SEQ ID NO: 803834 - DNA, 20 bp, mouse
gtagtctccgtgaagagagg

SEQ ID NO: 803835 - DNA, 20 bp, mouse
gtggaagcaccgcatcagga

SEQ ID NO: 803836 - DNA, 20 bp, mouse
gagggctagcggtctgtgaa

SEQ ID NO: 803837 - DNA, 20 bp, mouse
gaggcggcgtgaggagggtt

SEQ ID NO: 803838 - DNA, 20 bp, mouse
gcgcgcaggcggcgtgagga

SEQ ID NO: 803839 - DNA, 20 bp, mouse
gcgcatgtgcgccgcggagt

SEQ ID NO: 803840 - DNA, 20 bp, mouse
gcagagatagggatctgcgg

SEQ ID NO: 803841 - DNA, 20 bp, mouse
gacggcctggtcttcgcgga

SEQ ID NO: 803842 - DNA, 20 bp, mouse
gcgcgcgagctactactctc

SEQ ID NO: 803843 - DNA, 20 bp, mouse
gaaagcggggtagtgtccgc

SEQ ID NO: 803844 - DNA, 20 bp, mouse
gaagtcacgctaagtcgcgc

SEQ ID NO: 803845 - DNA, 20 bp, mouse
gctgggagaaaaggagcgaa

SEQ ID NO: 803846 - DNA, 20 bp, mouse
gcccgcgagggccccattcc

SEQ ID NO: 803847 - DNA, 20 bp, mouse
ggggcccggcgtttctcttc

SEQ ID NO: 803848 - DNA, 20 bp, mouse
gaacgccgggcccgcgaggc

SEQ ID NO: 803849 - DNA, 20 bp, mouse
gacggcgtctccaggttatc

SEQ ID NO: 803850 - DNA, 20 bp, mouse
gtccggctccacgcccgcga

SEQ ID NO: 803851 - DNA, 20 bp, mouse
gctgctagacatcccggaat

SEQ ID NO: 803852 - DNA, 20 bp, mouse
ggccggggagcgtgtcctca

SEQ ID NO: 803853 - DNA, 20 bp, mouse
ggagaaacgccgggcccgcg

SEQ ID NO: 803854 - DNA, 20 bp, mouse
ggctccccggcgcagattaa

SEQ ID NO: 803855 - DNA, 20 bp, mouse
gccaggttatcgggacgatg

SEQ ID NO: 803856 - DNA, 20 bp, mouse
gatcccggtaacacatactt

SEQ ID NO: 803857 - DNA, 20 bp, mouse
gttcctaagtatgtgttacc

SEQ ID NO: 803858 - DNA, 20 bp, mouse
gaacaacctcttgccaccac

SEQ ID NO: 803859 - DNA, 20 bp, mouse
gtaagtaaatgactgacgaa

SEQ ID NO: 803860 - DNA, 20 bp, mouse
gtaaaacattttcaagtcta

SEQ ID NO: 803861 - DNA, 20 bp, mouse
gtaaatgactgacgaatgga

SEQ ID NO: 803862 - DNA, 20 bp, mouse
gcatcaattattgttttgtt

SEQ ID NO: 803863 - DNA, 20 bp, mouse
gtgtctttcacatctcaatt

SEQ ID NO: 803864 - DNA, 20 bp, mouse
gtaggaaaggaaaccagtgg

SEQ ID NO: 803865 - DNA, 20 bp, mouse
gacttaggaaaggaaaccag

SEQ ID NO: 803866 - DNA, 20 bp, mouse
gctgtggtttaattaggggt

SEQ ID NO: 803867 - DNA, 20 bp, mouse
gggtttaattaggggtagga

SEQ ID NO: 803868 - DNA, 20 bp, mouse
gtatatacagactgccaatt

SEQ ID NO: 803869 - DNA, 20 bp, mouse
gtaaagctcaattccaaatg

SEQ ID NO: 803870 - DNA, 20 bp, mouse
gcaggaagcccttgtgtgtt

SEQ ID NO: 803871 - DNA, 20 bp, mouse
gatgttctcccaaacacaca

SEQ ID NO: 803872 - DNA, 20 bp, mouse
gatccctgtggtttaattag

SEQ ID NO: 803873 - DNA, 20 bp, mouse
gtgggagctcccagggttct

SEQ ID NO: 803874 - DNA, 20 bp, mouse
gccaacctggcagtatacat

SEQ ID NO: 803875 - DNA, 20 bp, mouse
gtgctggcaggacctcttag

SEQ ID NO: 803876 - DNA, 20 bp, mouse
gaagggcgatcgagaagcaa

SEQ ID NO: 803877 - DNA, 20 bp, mouse
gcgaagtcggctgtcgggaa

SEQ ID NO: 803878 - DNA, 20 bp, mouse
gtcccactgcgaatgactca

SEQ ID NO: 803879 - DNA, 20 bp, mouse
gctccctgagtcattcgcag

SEQ ID NO: 803880 - DNA, 20 bp, mouse
gtggccgatcgttacttagg

SEQ ID NO: 803881 - DNA, 20 bp, mouse
gccagggcgaagtcggctgt

SEQ ID NO: 803882 - DNA, 20 bp, mouse
ggcgaatgactcagggagac

SEQ ID NO: 803883 - DNA, 20 bp, mouse
gccctgggaaaagcaatagc

SEQ ID NO: 803884 - DNA, 20 bp, mouse
ggcttttcccagggcgaagt

SEQ ID NO: 803885 - DNA, 20 bp, mouse
gtaagagcccgcagcgcaca

SEQ ID NO: 803886 - DNA, 20 bp, mouse
ggaaacggaggcgtggcgtt

SEQ ID NO: 803887 - DNA, 20 bp, mouse
gtcccactcgaagacgcagg

SEQ ID NO: 803888 - DNA, 20 bp, mouse
ggaggcgtggcgttgggggg

SEQ ID NO: 803889 - DNA, 20 bp, mouse
gtccgcctgcgtcttcgagt

SEQ ID NO: 803890 - DNA, 20 bp, mouse
ggccagagcagagaatcagt

SEQ ID NO: 803891 - DNA, 20 bp, mouse
ggcgtcttcgagtgggaagc

SEQ ID NO: 803892 - DNA, 20 bp, mouse
ggcagagaatcagtcggctc

SEQ ID NO: 803893 - DNA, 20 bp, mouse
gaggcggaaaccaaacgcca

SEQ ID NO: 803894 - DNA, 20 bp, mouse
gccagagtggagtaagttca

SEQ ID NO: 803895 - DNA, 20 bp, mouse
ggcagtcacctaggaaacgg

SEQ ID NO: 803896 - DNA, 20 bp, mouse
gtgtaggggcgagtaatttt

SEQ ID NO: 803897 - DNA, 20 bp, mouse
gccgcgggaccgttctgcgt

SEQ ID NO: 803898 - DNA, 20 bp, mouse
gccaacgcctcggaagtaat

SEQ ID NO: 803899 - DNA, 20 bp, mouse
gctgcgcttaagatgtgtag

SEQ ID NO: 803900 - DNA, 20 bp, mouse
gtggacgaggtccggtcacg

SEQ ID NO: 803901 - DNA, 20 bp, mouse
gaggcgggctggacgaggtc

SEQ ID NO: 803902 - DNA, 20 bp, mouse
gctgtggccaagcccctctc

SEQ ID NO: 803903 - DNA, 20 bp, mouse
gagcccctctctggataaca

SEQ ID NO: 803904 - DNA, 20 bp, mouse
gtaaaaggcctgggcctccg

SEQ ID NO: 803905 - DNA, 20 bp, mouse
gcccacgatgccgagattat

SEQ ID NO: 803906 - DNA, 20 bp, mouse
gccctttgaaagggcttctt

SEQ ID NO: 803907 - DNA, 20 bp, mouse
gtgcttggtctcccactcta

SEQ ID NO: 803908 - DNA, 20 bp, mouse
gcgccacctttccctttgaa

SEQ ID NO: 803909 - DNA, 20 bp, mouse
gaatgtggcgttttttggtt

SEQ ID NO: 803910 - DNA, 20 bp, mouse
gctgtaatatgaggcttctt

SEQ ID NO: 803911 - DNA, 20 bp, mouse
ggggaaaggtggcgcatgct

SEQ ID NO: 803912 - DNA, 20 bp, mouse
gcccactctagggaattaaa

SEQ ID NO: 803913 - DNA, 20 bp, mouse
gttggatgaactgtaatatg

SEQ ID NO: 803914 - DNA, 20 bp, mouse
gctgggggaattgtaggttt

SEQ ID NO: 803915 - DNA, 20 bp, mouse
ggagtcttcatgtgattgtc

SEQ ID NO: 803916 - DNA, 20 bp, mouse
gttacactttgcacaaactt

SEQ ID NO: 803917 - DNA, 20 bp, mouse
gaaattaataagatgatttg

SEQ ID NO: 803918 - DNA, 20 bp, mouse
gtctatatataaaaatgtaa

SEQ ID NO: 803919 - DNA, 20 bp, mouse
gctgatgttcagatatatta

SEQ ID NO: 803920 - DNA, 20 bp, mouse
ggtaaatattggataattct

SEQ ID NO: 803921 - DNA, 20 bp, mouse
gctcaaacaccaaaaacaac

SEQ ID NO: 803922 - DNA, 20 bp, mouse
gatcttggtttttccattta

SEQ ID NO: 803923 - DNA, 20 bp, mouse
gggaaaactccaatacaagg

SEQ ID NO: 803924 - DNA, 20 bp, mouse
ggatggaaaactccaataca

SEQ ID NO: 803925 - DNA, 20 bp, mouse
gtgatgcttcctgttgtttt

SEQ ID NO: 803926 - DNA, 20 bp, mouse
gaaagtgagctcttggaagt

SEQ ID NO: 803927 - DNA, 20 bp, mouse
gaaaaagttctacatgaccc

SEQ ID NO: 803928 - DNA, 20 bp, mouse
gtagtgaagaaggttcggga

SEQ ID NO: 803929 - DNA, 20 bp, mouse
gcttcactagcaaactcttt

SEQ ID NO: 803930 - DNA, 20 bp, mouse
gtctacatgaccctggctct

SEQ ID NO: 803931 - DNA, 20 bp, mouse
gacaaagcctatgaaagctg

SEQ ID NO: 803932 - DNA, 20 bp, mouse
gtgatatactcctagagcca

SEQ ID NO: 803933 - DNA, 20 bp, mouse
ggctgcggaaagtgagctct

SEQ ID NO: 803934 - DNA, 20 bp, mouse
ggtgcatccaggcatggata

SEQ ID NO: 803935 - DNA, 20 bp, mouse
gctcacagacctgtgcatcc

SEQ ID NO: 803936 - DNA, 20 bp, mouse
gctctctcgggcagatacgg

SEQ ID NO: 803937 - DNA, 20 bp, mouse
gcggtgtgacgtcaacactg

SEQ ID NO: 803938 - DNA, 20 bp, mouse
gcggaggacatgttggaaga

SEQ ID NO: 803939 - DNA, 20 bp, mouse
ggtggctttacagagagcgt

SEQ ID NO: 803940 - DNA, 20 bp, mouse
gaacactgcggaggacatgt

SEQ ID NO: 803941 - DNA, 20 bp, mouse
gctacggctctgcgctccca

SEQ ID NO: 803942 - DNA, 20 bp, mouse
gagagggaacgcgctctctc

SEQ ID NO: 803943 - DNA, 20 bp, mouse
gccgtagcgcgctccaatcg

SEQ ID NO: 803944 - DNA, 20 bp, mouse
ggcggggccgccaccccgat

SEQ ID NO: 803945 - DNA, 20 bp, mouse
ggcgctctctcgggcagata

SEQ ID NO: 803946 - DNA, 20 bp, mouse
gtacagcattggcggggagt

SEQ ID NO: 803947 - DNA, 20 bp, mouse
ggggcgccggggtcaaggaa

SEQ ID NO: 803948 - DNA, 20 bp, mouse
gtaaggtccaagttggttct

SEQ ID NO: 803949 - DNA, 20 bp, mouse
gcccaagccaagaaccaact

SEQ ID NO: 803950 - DNA, 20 bp, mouse
gtctctgggcgccggggtca

SEQ ID NO: 803951 - DNA, 20 bp, mouse
gggtttgaggtgttcgttta

SEQ ID NO: 803952 - DNA, 20 bp, mouse
gggagaaccttatagggcag

SEQ ID NO: 803953 - DNA, 20 bp, mouse
gtcttcctacagcattggcg

SEQ ID NO: 803954 - DNA, 20 bp, mouse
gaggaaacagactgggcgct

SEQ ID NO: 803955 - DNA, 20 bp, mouse
gctggtctgggcttcgtaag

SEQ ID NO: 803956 - DNA, 20 bp, mouse
gacatctagcggctcggagg

SEQ ID NO: 803957 - DNA, 20 bp, mouse
gcgaaaggggagaggaggtt

SEQ ID NO: 803958 - DNA, 20 bp, mouse
gcctcggaggtgtgcgtggt

SEQ ID NO: 803959 - DNA, 20 bp, mouse
gggagtttagcgacatctag

SEQ ID NO: 803960 - DNA, 20 bp, mouse
ggctcggagggggactgcga

SEQ ID NO: 803961 - DNA, 20 bp, mouse
gacctccgagggatgacgtc

SEQ ID NO: 803962 - DNA, 20 bp, mouse
gcgagagtctcggagcgaaa

SEQ ID NO: 803963 - DNA, 20 bp, mouse
gccggagcccaggaatgaaa

SEQ ID NO: 803964 - DNA, 20 bp, mouse
gtcctgacgtcatccctcgg

SEQ ID NO: 803965 - DNA, 20 bp, mouse
gtggtaggcttagtcctctg

SEQ ID NO: 803966 - DNA, 20 bp, mouse
gggaaggagctcgtcaggga

SEQ ID NO: 803967 - DNA, 20 bp, mouse
gggttggtggtcaaagttgt

SEQ ID NO: 803968 - DNA, 20 bp, mouse
gtggcggaaggagctcgtca

SEQ ID NO: 803969 - DNA, 20 bp, mouse
gcccagccatgccccacggt

SEQ ID NO: 803970 - DNA, 20 bp, mouse
gtaggggactacagcaatga

SEQ ID NO: 803971 - DNA, 20 bp, mouse
ggagctcgtcagggagggtc

SEQ ID NO: 803972 - DNA, 20 bp, mouse
gtggtggtcaaagttgttgg

SEQ ID NO: 803973 - DNA, 20 bp, mouse
ggaacagagcgttccggttc

SEQ ID NO: 803974 - DNA, 20 bp, mouse
gtccggttccggcgtgtgga

SEQ ID NO: 803975 - DNA, 20 bp, mouse
gggtcaaagttgttggcgga

SEQ ID NO: 803976 - DNA, 20 bp, mouse
gacaaggagaaggggatcac

SEQ ID NO: 803977 - DNA, 20 bp, mouse
ggttgtgagctgccagttaa

SEQ ID NO: 803978 - DNA, 20 bp, mouse
gttgctcttgattgacaagg

SEQ ID NO: 803979 - DNA, 20 bp, mouse
gaggggagaggtgttagaaa

SEQ ID NO: 803980 - DNA, 20 bp, mouse
gagatcctgtgggaggtggt

SEQ ID NO: 803981 - DNA, 20 bp, mouse
ggtaggaggtatggcagcag

SEQ ID NO: 803982 - DNA, 20 bp, mouse
gtactcacaatcctcctaag

SEQ ID NO: 803983 - DNA, 20 bp, mouse
gagccagatcctgtgggagg

SEQ ID NO: 803984 - DNA, 20 bp, mouse
gccacatagccagatcctgt

SEQ ID NO: 803985 - DNA, 20 bp, mouse
gaattcccagcacccttaac

SEQ ID NO: 803986 - DNA, 20 bp, mouse
gcccgcccatccacacggaa

SEQ ID NO: 803987 - DNA, 20 bp, mouse
gccgcagcggcgctcgacta

SEQ ID NO: 803988 - DNA, 20 bp, mouse
gcatccacacggaaaggaag

SEQ ID NO: 803989 - DNA, 20 bp, mouse
ggatgggcggggtgaaccgg

SEQ ID NO: 803990 - DNA, 20 bp, mouse
gggaagggctcctgacgtca

SEQ ID NO: 803991 - DNA, 20 bp, mouse
gcgctgcggccggtcatcgt

SEQ ID NO: 803992 - DNA, 20 bp, mouse
ggactagggaggagctaccg

SEQ ID NO: 803993 - DNA, 20 bp, mouse
gcgccgggagccgtgacgtc

SEQ ID NO: 803994 - DNA, 20 bp, mouse
gcagcggcgctcgactaggg

SEQ ID NO: 803995 - DNA, 20 bp, mouse
gccgaagccggcctcctggc

SEQ ID NO: 803996 - DNA, 20 bp, mouse
gccaccccggcgcctcatca

SEQ ID NO: 803997 - DNA, 20 bp, mouse
gagtcaaaaagactcggagg

SEQ ID NO: 803998 - DNA, 20 bp, mouse
gaagctgggtagccgagttc

SEQ ID NO: 803999 - DNA, 20 bp, mouse
ggactcggaggcggaaccca

SEQ ID NO: 804000 - DNA, 20 bp, mouse
gacggaaagagagacacgag

SEQ ID NO: 804001 - DNA, 20 bp, mouse
ggggtggggtaggaagtttt

SEQ ID NO: 804002 - DNA, 20 bp, mouse
gagggcagcgaatggtgctt

SEQ ID NO: 804003 - DNA, 20 bp, mouse
gcccgtggcgcgcctgaact

SEQ ID NO: 804004 - DNA, 20 bp, mouse
gagtgcagactgaacagatc

SEQ ID NO: 804005 - DNA, 20 bp, mouse
gaggtcccggcgagttctcg

SEQ ID NO: 804006 - DNA, 20 bp, mouse
gagggattggtatcttgcgg

SEQ ID NO: 804007 - DNA, 20 bp, mouse
gggaggcaggagagattttt

SEQ ID NO: 804008 - DNA, 20 bp, mouse
gtgtgacttgatagctaagg

SEQ ID NO: 804009 - DNA, 20 bp, mouse
gacaggcttaatgagggctg

SEQ ID NO: 804010 - DNA, 20 bp, mouse
gttagctatcaagtcacatc

SEQ ID NO: 804011 - DNA, 20 bp, mouse
gaaaaaaagctgaggttacc

SEQ ID NO: 804012 - DNA, 20 bp, mouse
gaggagggattggtatcttg

SEQ ID NO: 804013 - DNA, 20 bp, mouse
gagaaccgtcaggtggaggc

SEQ ID NO: 804014 - DNA, 20 bp, mouse
gacagagacaggcttaatga

SEQ ID NO: 804015 - DNA, 20 bp, mouse
gctagaaataaagtcctctg

SEQ ID NO: 804016 - DNA, 20 bp, mouse
gacaccgccggaaagtccaa

SEQ ID NO: 804017 - DNA, 20 bp, mouse
gaaggggaggggttagagcc

SEQ ID NO: 804018 - DNA, 20 bp, mouse
gaagagttgaagcctagaaa

SEQ ID NO: 804019 - DNA, 20 bp, mouse
gacgctaagagggcgtggcc

SEQ ID NO: 804020 - DNA, 20 bp, mouse
gcatccctcaaaggccccct

SEQ ID NO: 804021 - DNA, 20 bp, mouse
ggctcaaaaaatagcgggga

SEQ ID NO: 804022 - DNA, 20 bp, mouse
gccaagagcaaagtaggcac

SEQ ID NO: 804023 - DNA, 20 bp, mouse
ggcggagaaaaaaggttcca

SEQ ID NO: 804024 - DNA, 20 bp, mouse
ggtgtggaatgcactggaga

SEQ ID NO: 804025 - DNA, 20 bp, mouse
ggaaatctgtgacgctaaga

SEQ ID NO: 804026 - DNA, 20 bp, mouse
gagggtctacggagaatgat

SEQ ID NO: 804027 - DNA, 20 bp, mouse
gaaacgcctcgtcgacgctg

SEQ ID NO: 804028 - DNA, 20 bp, mouse
gccactaggattgacaaata

SEQ ID NO: 804029 - DNA, 20 bp, mouse
gaaaacaacggcgttgaagc

SEQ ID NO: 804030 - DNA, 20 bp, mouse
gtctagaacggaatcacaca

SEQ ID NO: 804031 - DNA, 20 bp, mouse
gtgcgaacgtgttgacgcat

SEQ ID NO: 804032 - DNA, 20 bp, mouse
ggcataggcgtcgggtcgaa

SEQ ID NO: 804033 - DNA, 20 bp, mouse
gcgtgttgacgcataggcgt

SEQ ID NO: 804034 - DNA, 20 bp, mouse
gtcaacacgttcgcacgctc

SEQ ID NO: 804035 - DNA, 20 bp, mouse
gcgttcgcacgctcaggggg

SEQ ID NO: 804036 - DNA, 20 bp, mouse
gcggagagccggagctcgat

SEQ ID NO: 804037 - DNA, 20 bp, mouse
gggggaccgggttacaacgc

SEQ ID NO: 804038 - DNA, 20 bp, mouse
gaacaaacgcccagaaccga

SEQ ID NO: 804039 - DNA, 20 bp, mouse
gcagcgacctggcctctcct

SEQ ID NO: 804040 - DNA, 20 bp, mouse
gcggcggcccggggtccttc

SEQ ID NO: 804041 - DNA, 20 bp, mouse
ggggctccggccttcggttc

SEQ ID NO: 804042 - DNA, 20 bp, mouse
ggcgtctgggctccggcctt

SEQ ID NO: 804043 - DNA, 20 bp, mouse
gaacgcccagaaccgaaggc

SEQ ID NO: 804044 - DNA, 20 bp, mouse
gggagctgacgacgaggccc

SEQ ID NO: 804045 - DNA, 20 bp, mouse
ggcacgcccaagacaacgtc

SEQ ID NO: 804046 - DNA, 20 bp, mouse
gtaaatacagcgcgcgtcag

SEQ ID NO: 804047 - DNA, 20 bp, mouse
ggcggcatggggcggaccca

SEQ ID NO: 804048 - DNA, 20 bp, mouse
gtcggaacgcccggccggga

SEQ ID NO: 804049 - DNA, 20 bp, mouse
gcggacccagggcgggccca

SEQ ID NO: 804050 - DNA, 20 bp, mouse
gcccgcacctccactgctca

SEQ ID NO: 804051 - DNA, 20 bp, mouse
ggcatggggcggacccaggg

SEQ ID NO: 804052 - DNA, 20 bp, mouse
ggaagttaggagttaggctg

SEQ ID NO: 804053 - DNA, 20 bp, mouse
gggaggaagaggtgtggcga

SEQ ID NO: 804054 - DNA, 20 bp, mouse
gatacagcgcgcgtcagggg

SEQ ID NO: 804055 - DNA, 20 bp, mouse
gggggcggagcgagcggcat

SEQ ID NO: 804056 - DNA, 20 bp, mouse
gacagaacactagtccacta

SEQ ID NO: 804057 - DNA, 20 bp, mouse
gtatgatgggacggagtctt

SEQ ID NO: 804058 - DNA, 20 bp, mouse
gctacctcccagcctcaagg

SEQ ID NO: 804059 - DNA, 20 bp, mouse
gatactgaaaaaaaccctag

SEQ ID NO: 804060 - DNA, 20 bp, mouse
gagggtgcctccttgaggct

SEQ ID NO: 804061 - DNA, 20 bp, mouse
gttaaattgttggttcccga

SEQ ID NO: 804062 - DNA, 20 bp, mouse
gttaggtcctggcagagaaa

SEQ ID NO: 804063 - DNA, 20 bp, mouse
ggagctaagacctgctaggt

SEQ ID NO: 804064 - DNA, 20 bp, mouse
ggggaagcacttccggctct

SEQ ID NO: 804065 - DNA, 20 bp, mouse
gctcttcgaagatccttagg

SEQ ID NO: 804066 - DNA, 20 bp, mouse
gagcgcgccgccatgttgta

SEQ ID NO: 804067 - DNA, 20 bp, mouse
gaacgcggcgccatccacac

SEQ ID NO: 804068 - DNA, 20 bp, mouse
ggagcggcggatgtgtagtg

SEQ ID NO: 804069 - DNA, 20 bp, mouse
gcacgtgagaagttaggtgt

SEQ ID NO: 804070 - DNA, 20 bp, mouse
gccgccatgttgtacggaag

SEQ ID NO: 804071 - DNA, 20 bp, mouse
gcaaaagcgagtgacagagg

SEQ ID NO: 804072 - DNA, 20 bp, mouse
gatggcgccgcgttgagcgg

SEQ ID NO: 804073 - DNA, 20 bp, mouse
gtggatggcgccgcgttgag

SEQ ID NO: 804074 - DNA, 20 bp, mouse
gcgcggggaacctgtgtgga

SEQ ID NO: 804075 - DNA, 20 bp, mouse
ggtagtgcggcttccgtagg

SEQ ID NO: 804076 - DNA, 20 bp, mouse
gtctctaagcgacccagctg

SEQ ID NO: 804077 - DNA, 20 bp, mouse
ggctggaggcagcgcagaga

SEQ ID NO: 804078 - DNA, 20 bp, mouse
gctagccgcgggtggtgtca

SEQ ID NO: 804079 - DNA, 20 bp, mouse
gagccagcgagcatggaggt

SEQ ID NO: 804080 - DNA, 20 bp, mouse
ggcgatgagcaacaccgggc

SEQ ID NO: 804081 - DNA, 20 bp, mouse
gtctcgcgatgagcaacacc

SEQ ID NO: 804082 - DNA, 20 bp, mouse
gcggaagtcctgccttccta

SEQ ID NO: 804083 - DNA, 20 bp, mouse
gagtcctgccttcctaaggt

SEQ ID NO: 804084 - DNA, 20 bp, mouse
gttagagaccagccaacctt

SEQ ID NO: 804085 - DNA, 20 bp, mouse
gcgcaccctgacaccacccg

SEQ ID NO: 804086 - DNA, 20 bp, mouse
gaggcgggaaccaaactaat

SEQ ID NO: 804087 - DNA, 20 bp, mouse
ggccgcttacaaagacgaaa

SEQ ID NO: 804088 - DNA, 20 bp, mouse
gttggcgcctgtggaggtga

SEQ ID NO: 804089 - DNA, 20 bp, mouse
ggagcctggcaaaatactca

SEQ ID NO: 804090 - DNA, 20 bp, mouse
gtccagctgggctggtagag

SEQ ID NO: 804091 - DNA, 20 bp, mouse
gacaaagacgaaagggcagg

SEQ ID NO: 804092 - DNA, 20 bp, mouse
gcggctcgggaggagagaat

SEQ ID NO: 804093 - DNA, 20 bp, mouse
gcgaccgccagaggtttctg

SEQ ID NO: 804094 - DNA, 20 bp, mouse
ggactcggaatcgtgggcaa

SEQ ID NO: 804095 - DNA, 20 bp, mouse
gttcccgcctccagctgggc

SEQ ID NO: 804096 - DNA, 20 bp, mouse
gtcccaagccgaggtctcac

SEQ ID NO: 804097 - DNA, 20 bp, mouse
gcatcccttaggttaggagt

SEQ ID NO: 804098 - DNA, 20 bp, mouse
gtacggcacccgtgagacct

SEQ ID NO: 804099 - DNA, 20 bp, mouse
gtagagagacaggcgcgctg

SEQ ID NO: 804100 - DNA, 20 bp, mouse
ggcgcgctgcgggcgacctc

SEQ ID NO: 804101 - DNA, 20 bp, mouse
gctggtggccggaggttcta

SEQ ID NO: 804102 - DNA, 20 bp, mouse
gcacccgtgagacctcggct

SEQ ID NO: 804103 - DNA, 20 bp, mouse
gcctgtctctctagccggaa

SEQ ID NO: 804104 - DNA, 20 bp, mouse
ggcgggcgacctctggtggc

SEQ ID NO: 804105 - DNA, 20 bp, mouse
gcgctgcgggcgacctctgg

SEQ ID NO: 804106 - DNA, 20 bp, mouse
ggtcctgggaaataaggtgg

SEQ ID NO: 804107 - DNA, 20 bp, mouse
gactgtcctgggaaataagg

SEQ ID NO: 804108 - DNA, 20 bp, mouse
gcataatccaaagtggagat

SEQ ID NO: 804109 - DNA, 20 bp, mouse
gcatgtgtatacctgattat

SEQ ID NO: 804110 - DNA, 20 bp, mouse
gggccagtgagcttgttcca

SEQ ID NO: 804111 - DNA, 20 bp, mouse
gacaagaccttgtcccactc

SEQ ID NO: 804112 - DNA, 20 bp, mouse
gaccttgtcccactcagggt

SEQ ID NO: 804113 - DNA, 20 bp, mouse
gggaataccactaaagctct

SEQ ID NO: 804114 - DNA, 20 bp, mouse
gaaagtggagatgggatcct

SEQ ID NO: 804115 - DNA, 20 bp, mouse
gtgccgccaccttatttccc

SEQ ID NO: 804116 - DNA, 20 bp, mouse
ggaggcttgccaaggtaagc

SEQ ID NO: 804117 - DNA, 20 bp, mouse
ggctgaaaagaggcacccga

SEQ ID NO: 804118 - DNA, 20 bp, mouse
gtgggccagaggctgaaaag

SEQ ID NO: 804119 - DNA, 20 bp, mouse
gatgcagaggggagatgtcc

SEQ ID NO: 804120 - DNA, 20 bp, mouse
gcctctgcataacttctctt

SEQ ID NO: 804121 - DNA, 20 bp, mouse
gttagaaggcagtgcctgtg

SEQ ID NO: 804122 - DNA, 20 bp, mouse
gccagtgcagagtttttgtg

SEQ ID NO: 804123 - DNA, 20 bp, mouse
ggagctcacgagcacttaga

SEQ ID NO: 804124 - DNA, 20 bp, mouse
gggctggtctacattaatgt

SEQ ID NO: 804125 - DNA, 20 bp, mouse
ggaaggcagtgcctgtgagg

SEQ ID NO: 804126 - DNA, 20 bp, mouse
ggcaacgtcctccgccaaca

SEQ ID NO: 804127 - DNA, 20 bp, mouse
ggatggctgcagaccctagg

SEQ ID NO: 804128 - DNA, 20 bp, mouse
gtgagccgaggctccgccta

SEQ ID NO: 804129 - DNA, 20 bp, mouse
gtccacttgatcctagtccc

SEQ ID NO: 804130 - DNA, 20 bp, mouse
ggaccatagagctgtctgta

SEQ ID NO: 804131 - DNA, 20 bp, mouse
gaacacgggcaattagagtc

SEQ ID NO: 804132 - DNA, 20 bp, mouse
gttggagcagacccgggact

SEQ ID NO: 804133 - DNA, 20 bp, mouse
gataaagcagttactggcgc

SEQ ID NO: 804134 - DNA, 20 bp, mouse
gcagacgcgagtttgagccg

SEQ ID NO: 804135 - DNA, 20 bp, mouse
gctatggtcgccgtttccca

SEQ ID NO: 804136 - DNA, 20 bp, mouse
gccggagcggggcgaggctg

SEQ ID NO: 804137 - DNA, 20 bp, mouse
gggcgctcgcaggccagtcg

SEQ ID NO: 804138 - DNA, 20 bp, mouse
gcagtcgcggcttgtcagag

SEQ ID NO: 804139 - DNA, 20 bp, mouse
gtgcgagcgcccgggccctc

SEQ ID NO: 804140 - DNA, 20 bp, mouse
gaccgcggcggggcttcttc

SEQ ID NO: 804141 - DNA, 20 bp, mouse
gggtgtgggccggagggccc

SEQ ID NO: 804142 - DNA, 20 bp, mouse
ggcccgggatgagttagcga

SEQ ID NO: 804143 - DNA, 20 bp, mouse
ggccccgccgctacgagccg

SEQ ID NO: 804144 - DNA, 20 bp, mouse
gggtaaaggaatcacggtgt

SEQ ID NO: 804145 - DNA, 20 bp, mouse
ggggctgcaggccaaggcga

SEQ ID NO: 804146 - DNA, 20 bp, mouse
ggggctgcaacaccggtagg

SEQ ID NO: 804147 - DNA, 20 bp, mouse
gctcccgggcgagagagcca

SEQ ID NO: 804148 - DNA, 20 bp, mouse
gagagagccagggagccgat

SEQ ID NO: 804149 - DNA, 20 bp, mouse
gcccgcctcctggttggaga

SEQ ID NO: 804150 - DNA, 20 bp, mouse
gtccgcacccgaggcctgat

SEQ ID NO: 804151 - DNA, 20 bp, mouse
gtgcggaggtgtagtctccc

SEQ ID NO: 804152 - DNA, 20 bp, mouse
gctccctggctctctcgccc

SEQ ID NO: 804153 - DNA, 20 bp, mouse
gaccggtgttgcagcccaat

SEQ ID NO: 804154 - DNA, 20 bp, mouse
gcaggggcgccgccacgcac

SEQ ID NO: 804155 - DNA, 20 bp, mouse
gaggaggcgggccgctgggg

SEQ ID NO: 804156 - DNA, 20 bp, mouse
gcgaagagacgggttttagg

SEQ ID NO: 804157 - DNA, 20 bp, mouse
gcccaggccgagttacagtt

SEQ ID NO: 804158 - DNA, 20 bp, mouse
gtcccagccgaactgtaact

SEQ ID NO: 804159 - DNA, 20 bp, mouse
gtcgcgaagagacgggtttt

SEQ ID NO: 804160 - DNA, 20 bp, mouse
gcggcctgggagcggatcct

SEQ ID NO: 804161 - DNA, 20 bp, mouse
gacgcctaggatccgctccc

SEQ ID NO: 804162 - DNA, 20 bp, mouse
ggttctgctcgcgaagagac

SEQ ID NO: 804163 - DNA, 20 bp, mouse
ggcatctatgcatttctcag

SEQ ID NO: 804164 - DNA, 20 bp, mouse
gctgtaactcggcctgggag

SEQ ID NO: 804165 - DNA, 20 bp, mouse
gtaagagttacgaaatgggc

SEQ ID NO: 804166 - DNA, 20 bp, mouse
gataggggaaaggataagaa

SEQ ID NO: 804167 - DNA, 20 bp, mouse
ggtgctgggcaggtggggaa

SEQ ID NO: 804168 - DNA, 20 bp, mouse
gcaacagaggaaactgagta

SEQ ID NO: 804169 - DNA, 20 bp, mouse
gtggggaagggcgttcaatc

SEQ ID NO: 804170 - DNA, 20 bp, mouse
gactaatctgaaccagaaga

SEQ ID NO: 804171 - DNA, 20 bp, mouse
gagggaggtgagggtgatgc

SEQ ID NO: 804172 - DNA, 20 bp, mouse
gttcttatagcaatggcgtt

SEQ ID NO: 804173 - DNA, 20 bp, mouse
gcctgcgccctccccggctg

SEQ ID NO: 804174 - DNA, 20 bp, mouse
gggcgatccgcagccgggga

SEQ ID NO: 804175 - DNA, 20 bp, mouse
ggatgagaaccgaagagaac

SEQ ID NO: 804176 - DNA, 20 bp, mouse
ggggccgtgggaacccaaac

SEQ ID NO: 804177 - DNA, 20 bp, mouse
gggaacaggcatggacgcgg

SEQ ID NO: 804178 - DNA, 20 bp, mouse
gtagaggcggagcttagggg

SEQ ID NO: 804179 - DNA, 20 bp, mouse
gaccatggccaccaaggctg

SEQ ID NO: 804180 - DNA, 20 bp, mouse
gtctcaaaggccacctacca

SEQ ID NO: 804181 - DNA, 20 bp, mouse
gggtgatcatcattgtgctg

SEQ ID NO: 804182 - DNA, 20 bp, mouse
ggtaggcgggaccaactctg

SEQ ID NO: 804183 - DNA, 20 bp, mouse
gccacccctgcgctcccatg

SEQ ID NO: 804184 - DNA, 20 bp, mouse
gtgcgctcccatggggccgt

SEQ ID NO: 804185 - DNA, 20 bp, mouse
ggcgggaccaactctgagga

SEQ ID NO: 804186 - DNA, 20 bp, mouse
gccgggtacggcaaattctg

SEQ ID NO: 804187 - DNA, 20 bp, mouse
gaaattctggggctgagtct

SEQ ID NO: 804188 - DNA, 20 bp, mouse
gtgcgcttgctagtcttccg

SEQ ID NO: 804189 - DNA, 20 bp, mouse
gcagttctaacagacatccc

SEQ ID NO: 804190 - DNA, 20 bp, mouse
gcggaaaggcctgggagcta

SEQ ID NO: 804191 - DNA, 20 bp, mouse
gttcacctctcaagtataac

SEQ ID NO: 804192 - DNA, 20 bp, mouse
gagctcctggacttaattac

SEQ ID NO: 804193 - DNA, 20 bp, mouse
gtctgaatctcaagctccta

SEQ ID NO: 804194 - DNA, 20 bp, mouse
gttgccgtacccggaagcgc

SEQ ID NO: 804195 - DNA, 20 bp, mouse
gcgctagcttccagcgcttc

SEQ ID NO: 804196 - DNA, 20 bp, mouse
gtgtgtgggaacactctccc

SEQ ID NO: 804197 - DNA, 20 bp, mouse
gcaggaccatggtgagtgtg

SEQ ID NO: 804198 - DNA, 20 bp, mouse
gccacagtggtccttatctt

SEQ ID NO: 804199 - DNA, 20 bp, mouse
gacctgggaagggcattaga

SEQ ID NO: 804200 - DNA, 20 bp, mouse
gggtaccagcggaaaaacct

SEQ ID NO: 804201 - DNA, 20 bp, mouse
gcctgccaggtgctaaatct

SEQ ID NO: 804202 - DNA, 20 bp, mouse
gacacagttccccaggacca

SEQ ID NO: 804203 - DNA, 20 bp, mouse
gggtaagaacacctggcacc

SEQ ID NO: 804204 - DNA, 20 bp, mouse
gagtcatcacacagttcccc

SEQ ID NO: 804205 - DNA, 20 bp, mouse
gaggtgctaaatctgggatc

SEQ ID NO: 804206 - DNA, 20 bp, mouse
gtggtcgcgaatgaaccgcg

SEQ ID NO: 804207 - DNA, 20 bp, mouse
ggcctctgacgtcattgtct

SEQ ID NO: 804208 - DNA, 20 bp, mouse
ggcccagacaatgacgtcag

SEQ ID NO: 804209 - DNA, 20 bp, mouse
gaaacaccaccggcagggga

SEQ ID NO: 804210 - DNA, 20 bp, mouse
gttaaagcgtgaagtagttc

SEQ ID NO: 804211 - DNA, 20 bp, mouse
gcccaaccacaactcactgc

SEQ ID NO: 804212 - DNA, 20 bp, mouse
gaatccgcatcgaccctcct

SEQ ID NO: 804213 - DNA, 20 bp, mouse
gcgtctccggcagtgagttg

SEQ ID NO: 804214 - DNA, 20 bp, mouse
gtccggcagtgagttgtggt

SEQ ID NO: 804215 - DNA, 20 bp, mouse
ggtggcaaacaccaccggca

SEQ ID NO: 804216 - DNA, 20 bp, mouse
gtcgagcagccccgccctaa

SEQ ID NO: 804217 - DNA, 20 bp, mouse
gaactcccatgaagcaacga

SEQ ID NO: 804218 - DNA, 20 bp, mouse
gggactgagaaaaaataggc

SEQ ID NO: 804219 - DNA, 20 bp, mouse
gtgctcgagacagcgacttc

SEQ ID NO: 804220 - DNA, 20 bp, mouse
gccagcacctgtttccagta

SEQ ID NO: 804221 - DNA, 20 bp, mouse
gtaaaatagacggaaaggtg

SEQ ID NO: 804222 - DNA, 20 bp, mouse
gtaagggacgacacacgggc

SEQ ID NO: 804223 - DNA, 20 bp, mouse
gtgtgtcgtcccttagggcg

SEQ ID NO: 804224 - DNA, 20 bp, mouse
gtatgggactgagaaaaaat

SEQ ID NO: 804225 - DNA, 20 bp, mouse
gttctccctcgttgcttcat

SEQ ID NO: 804226 - DNA, 20 bp, mouse
gctccatgctcgttgagagg

SEQ ID NO: 804227 - DNA, 20 bp, mouse
ggaggatgggcgatgagaaa

SEQ ID NO: 804228 - DNA, 20 bp, mouse
gtcggctcgtgcgacccggg

SEQ ID NO: 804229 - DNA, 20 bp, mouse
gctcaacgagcatggaggat

SEQ ID NO: 804230 - DNA, 20 bp, mouse
gcgatgagaaagggaaatag

SEQ ID NO: 804231 - DNA, 20 bp, mouse
gtcctcctgcccggtagtgg

SEQ ID NO: 804232 - DNA, 20 bp, mouse
gttcctcctctcaacgagca

SEQ ID NO: 804233 - DNA, 20 bp, mouse
ggggcaccccggtgcacgca

SEQ ID NO: 804234 - DNA, 20 bp, mouse
ggggcatccgcgagaggagg

SEQ ID NO: 804235 - DNA, 20 bp, mouse
gcaagcgacgtgagaaagag

SEQ ID NO: 804236 - DNA, 20 bp, mouse
ggccccacccccaccctaat

SEQ ID NO: 804237 - DNA, 20 bp, mouse
gcagctgcccttacctatta

SEQ ID NO: 804238 - DNA, 20 bp, mouse
gcccccaccctaataggtaa

SEQ ID NO: 804239 - DNA, 20 bp, mouse
gtgcccttacctattagggt

SEQ ID NO: 804240 - DNA, 20 bp, mouse
gttcctgtatggggcatcat

SEQ ID NO: 804241 - DNA, 20 bp, mouse
gctccgtggcaatgcaccta

SEQ ID NO: 804242 - DNA, 20 bp, mouse
ggcctggggggacgttccct

SEQ ID NO: 804243 - DNA, 20 bp, mouse
gttccctaggtgcattgcca

SEQ ID NO: 804244 - DNA, 20 bp, mouse
gagccttgcgactcatgtgg

SEQ ID NO: 804245 - DNA, 20 bp, mouse
gacctagggaacgtcccccc

SEQ ID NO: 804246 - DNA, 20 bp, mouse
gtccgcagagcctgacccta

SEQ ID NO: 804247 - DNA, 20 bp, mouse
gcataacccgcggggctgga

SEQ ID NO: 804248 - DNA, 20 bp, mouse
ggaacagcttggcttagtca

SEQ ID NO: 804249 - DNA, 20 bp, mouse
gaggacagctataaggcgtg

SEQ ID NO: 804250 - DNA, 20 bp, mouse
ggggacacctcgtcagctct

SEQ ID NO: 804251 - DNA, 20 bp, mouse
gcagccctgctcccccacct

SEQ ID NO: 804252 - DNA, 20 bp, mouse
gcgtcgctgcataacccgcg

SEQ ID NO: 804253 - DNA, 20 bp, mouse
gcgaaggctgcccagagtgt

SEQ ID NO: 804254 - DNA, 20 bp, mouse
gtggcgcaaaatgaacagct

SEQ ID NO: 804255 - DNA, 20 bp, mouse
gaccctagggtcaggctctg

SEQ ID NO: 804256 - DNA, 20 bp, mouse
ggggaggcgccaggagtgaa

SEQ ID NO: 804257 - DNA, 20 bp, mouse
gtcggactctgacagagggg

SEQ ID NO: 804258 - DNA, 20 bp, mouse
ggcccgacacgcccccgctc

SEQ ID NO: 804259 - DNA, 20 bp, mouse
gagcctgcggtccggtgcca

SEQ ID NO: 804260 - DNA, 20 bp, mouse
gcgcggctgcgcgttcgtcc

SEQ ID NO: 804261 - DNA, 20 bp, mouse
ggaccgcaggctccgagagg

SEQ ID NO: 804262 - DNA, 20 bp, mouse
gggcccgaaccgagtactga

SEQ ID NO: 804263 - DNA, 20 bp, mouse
ggctgcgcgttcgtccaggc

SEQ ID NO: 804264 - DNA, 20 bp, mouse
gcctctgtcagagtccgaag

SEQ ID NO: 804265 - DNA, 20 bp, mouse
gcagcaggcccttacggcga

SEQ ID NO: 804266 - DNA, 20 bp, mouse
gtatgaggagtgggcaaatt

SEQ ID NO: 804267 - DNA, 20 bp, mouse
gggaataaagtgtggtgtct

SEQ ID NO: 804268 - DNA, 20 bp, mouse
gcatacatttggtgggtgta

SEQ ID NO: 804269 - DNA, 20 bp, mouse
gatatacattgttggtggat

SEQ ID NO: 804270 - DNA, 20 bp, mouse
gtagcactaaaaagagaaat

SEQ ID NO: 804271 - DNA, 20 bp, mouse
gtcattctaggtcaagtcca

SEQ ID NO: 804272 - DNA, 20 bp, mouse
gaaggaaaaacattcattct

SEQ ID NO: 804273 - DNA, 20 bp, mouse
gagtccaaggatgaagccac

SEQ ID NO: 804274 - DNA, 20 bp, mouse
gttactgttctatgaggagt

SEQ ID NO: 804275 - DNA, 20 bp, mouse
gacacctgtggcttcatcct

SEQ ID NO: 804276 - DNA, 20 bp, mouse
ggagctgcacacagtggctt

SEQ ID NO: 804277 - DNA, 20 bp, mouse
ggcacacagtggcttggggg

SEQ ID NO: 804278 - DNA, 20 bp, mouse
gtaagaggaccaaggttaag

SEQ ID NO: 804279 - DNA, 20 bp, mouse
ggaggaccaaggttaagagg

SEQ ID NO: 804280 - DNA, 20 bp, mouse
gacagaaatcagtgggtaag

SEQ ID NO: 804281 - DNA, 20 bp, mouse
ggactgctggataatctgtt

SEQ ID NO: 804282 - DNA, 20 bp, mouse
gggcgttccatgagtcttga

SEQ ID NO: 804283 - DNA, 20 bp, mouse
gaacagtttttattagtgtg

SEQ ID NO: 804284 - DNA, 20 bp, mouse
gactcatggaacgccagcag

SEQ ID NO: 804285 - DNA, 20 bp, mouse
gtaatctgttgggttgcatg

SEQ ID NO: 804286 - DNA, 20 bp, mouse
ggcactgctagattgtttga

SEQ ID NO: 804287 - DNA, 20 bp, mouse
gtctgaaatgaacattggat

SEQ ID NO: 804288 - DNA, 20 bp, mouse
gaattcagttgcccatcctc

SEQ ID NO: 804289 - DNA, 20 bp, mouse
gtttgatggccttctacaga

SEQ ID NO: 804290 - DNA, 20 bp, mouse
gtttttcagattctattata

SEQ ID NO: 804291 - DNA, 20 bp, mouse
gctctgtattttcctaataa

SEQ ID NO: 804292 - DNA, 20 bp, mouse
gatatatttactgaatagta

SEQ ID NO: 804293 - DNA, 20 bp, mouse
gtagagcaaccttctgtaga

SEQ ID NO: 804294 - DNA, 20 bp, mouse
gaatgttcatttcagaatta

SEQ ID NO: 804295 - DNA, 20 bp, mouse
gatagtaaggaagacatgct

SEQ ID NO: 804296 - DNA, 20 bp, mouse
gccccaccccgcatggtcta

SEQ ID NO: 804297 - DNA, 20 bp, mouse
gggtgggggaggccccgagc

SEQ ID NO: 804298 - DNA, 20 bp, mouse
gggggtggggaggcgaccat

SEQ ID NO: 804299 - DNA, 20 bp, mouse
gtccttagaccatgcggggt

SEQ ID NO: 804300 - DNA, 20 bp, mouse
gtgaatgtgttgacctgctc

SEQ ID NO: 804301 - DNA, 20 bp, mouse
gcgcttccaggggagaggtc

SEQ ID NO: 804302 - DNA, 20 bp, mouse
gagcagcgcttccaggggag

SEQ ID NO: 804303 - DNA, 20 bp, mouse
gccctggaagcgctgctgga

SEQ ID NO: 804304 - DNA, 20 bp, mouse
gacaaccataagcttcgctt

SEQ ID NO: 804305 - DNA, 20 bp, mouse
ggccaacacatcgtgcctaa

SEQ ID NO: 804306 - DNA, 20 bp, mouse
gaaactggagggttttttgc

SEQ ID NO: 804307 - DNA, 20 bp, mouse
ggactctagagaccttagaa

SEQ ID NO: 804308 - DNA, 20 bp, mouse
gcgctcccgcaggaggactc

SEQ ID NO: 804309 - DNA, 20 bp, mouse
gaatatctacgggttcccag

SEQ ID NO: 804310 - DNA, 20 bp, mouse
gggaagctgcagatgcattg

SEQ ID NO: 804311 - DNA, 20 bp, mouse
gtagagaccttagaagggat

SEQ ID NO: 804312 - DNA, 20 bp, mouse
ggtagtgaagtggtgtagtg

SEQ ID NO: 804313 - DNA, 20 bp, mouse
ggcagcttccgctacggcac

SEQ ID NO: 804314 - DNA, 20 bp, mouse
gacattcgctaaggaatctc

SEQ ID NO: 804315 - DNA, 20 bp, mouse
gtggccgccttgcttaggtg

SEQ ID NO: 804316 - DNA, 20 bp, mouse
ggagtcttacggaggaaggg

SEQ ID NO: 804317 - DNA, 20 bp, mouse
gaggcattgcgctggggaag

SEQ ID NO: 804318 - DNA, 20 bp, mouse
gccccagcgcaatgcctgtc

SEQ ID NO: 804319 - DNA, 20 bp, mouse
ggggtcttgtagtcacatgc

SEQ ID NO: 804320 - DNA, 20 bp, mouse
gtcagagtctgcctctcccc

SEQ ID NO: 804321 - DNA, 20 bp, mouse
gaggtggaaggatttgtcca

SEQ ID NO: 804322 - DNA, 20 bp, mouse
gggccccgccccggaagata

SEQ ID NO: 804323 - DNA, 20 bp, mouse
gcaagagtcttacggaggaa

SEQ ID NO: 804324 - DNA, 20 bp, mouse
gcgactcaagagtcttacgg

SEQ ID NO: 804325 - DNA, 20 bp, mouse
gtgctgaaacttgtcgtcct

SEQ ID NO: 804326 - DNA, 20 bp, mouse
gaggagtgtcaagggatcga

SEQ ID NO: 804327 - DNA, 20 bp, mouse
gggaacagcacccccggcac

SEQ ID NO: 804328 - DNA, 20 bp, mouse
ggactcaagcgacgagttgt

SEQ ID NO: 804329 - DNA, 20 bp, mouse
gtggggtcccgggtgagcgg

SEQ ID NO: 804330 - DNA, 20 bp, mouse
gctagtcgagtcgcgccggt

SEQ ID NO: 804331 - DNA, 20 bp, mouse
ggcgacacgcagggccctga

SEQ ID NO: 804332 - DNA, 20 bp, mouse
gagctcgcagcctggggtcc

SEQ ID NO: 804333 - DNA, 20 bp, mouse
ggggtcgtgacgcgacacgc

SEQ ID NO: 804334 - DNA, 20 bp, mouse
gatcgagggaacagcacccc

SEQ ID NO: 804335 - DNA, 20 bp, mouse
gagagccatccccctctttt

SEQ ID NO: 804336 - DNA, 20 bp, mouse
ggaagtctctagggaagaaa

SEQ ID NO: 804337 - DNA, 20 bp, mouse
gtgagtggagacaatatggg

SEQ ID NO: 804338 - DNA, 20 bp, mouse
ggagacttcaacttaaagct

SEQ ID NO: 804339 - DNA, 20 bp, mouse
ggctgtccatcctcagtata

SEQ ID NO: 804340 - DNA, 20 bp, mouse
gttctgagtggagacaatat

SEQ ID NO: 804341 - DNA, 20 bp, mouse
gaagtaccttatactgagga

SEQ ID NO: 804342 - DNA, 20 bp, mouse
gttgcttctgcatgcctacc

SEQ ID NO: 804343 - DNA, 20 bp, mouse
gttctctgtacttgtaatga

SEQ ID NO: 804344 - DNA, 20 bp, mouse
gagcaaagtaccttatactg

SEQ ID NO: 804345 - DNA, 20 bp, mouse
gttcagagtgtgtgaattaa

SEQ ID NO: 804346 - DNA, 20 bp, mouse
ggaagtaatacagttgactg

SEQ ID NO: 804347 - DNA, 20 bp, mouse
ggtaatacagttgactgggg

SEQ ID NO: 804348 - DNA, 20 bp, mouse
gatgcctagtcttatcacgt

SEQ ID NO: 804349 - DNA, 20 bp, mouse
gttacccacgtgataagact

SEQ ID NO: 804350 - DNA, 20 bp, mouse
gcagacccagccttactgat

SEQ ID NO: 804351 - DNA, 20 bp, mouse
gtacagttgactggggagga

SEQ ID NO: 804352 - DNA, 20 bp, mouse
gagagccaatcagtaaggct

SEQ ID NO: 804353 - DNA, 20 bp, mouse
gagagcagctttattctcag

SEQ ID NO: 804354 - DNA, 20 bp, mouse
gcaataagagccaatcagta

SEQ ID NO: 804355 - DNA, 20 bp, mouse
gggctgggtctgtgtctcag

SEQ ID NO: 804356 - DNA, 20 bp, mouse
ggctgccactccagcaagtc

SEQ ID NO: 804357 - DNA, 20 bp, mouse
gactcggtgacgctgcaggg

SEQ ID NO: 804358 - DNA, 20 bp, mouse
ggagactagagcatcagcta

SEQ ID NO: 804359 - DNA, 20 bp, mouse
ggcggctccgacccagcaga

SEQ ID NO: 804360 - DNA, 20 bp, mouse
gaataaacatgcgcgtctat

SEQ ID NO: 804361 - DNA, 20 bp, mouse
gctgctgccctctgctgggt

SEQ ID NO: 804362 - DNA, 20 bp, mouse
gtctgaaagcgcgcctcctg

SEQ ID NO: 804363 - DNA, 20 bp, mouse
gaaagacagcacccggccgc

SEQ ID NO: 804364 - DNA, 20 bp, mouse
gcatggacgacgtcgtcttc

SEQ ID NO: 804365 - DNA, 20 bp, mouse
gcgacgtcgtccatgcctat

SEQ ID NO: 804366 - DNA, 20 bp, mouse
gtaaagggagagagctatcg

SEQ ID NO: 804367 - DNA, 20 bp, mouse
ggcacgcccggggtgagggt

SEQ ID NO: 804368 - DNA, 20 bp, mouse
gccccaaaggccaatcgcac

SEQ ID NO: 804369 - DNA, 20 bp, mouse
gcgtctgcagaacgcagttc

SEQ ID NO: 804370 - DNA, 20 bp, mouse
gacgtgatccgcaaggcttg

SEQ ID NO: 804371 - DNA, 20 bp, mouse
ggggcagggccaaaaccgag

SEQ ID NO: 804372 - DNA, 20 bp, mouse
gctcaacagtagagattaac

SEQ ID NO: 804373 - DNA, 20 bp, mouse
ggtagagattaacaggctaa

SEQ ID NO: 804374 - DNA, 20 bp, mouse
gcagggccaaaaccgagagg

SEQ ID NO: 804375 - DNA, 20 bp, mouse
gagtaactgtgtctgtgatg

SEQ ID NO: 804376 - DNA, 20 bp, mouse
ggggacgcgaggcgttaaag

SEQ ID NO: 804377 - DNA, 20 bp, mouse
ggccaggggcctctgcaaca

SEQ ID NO: 804378 - DNA, 20 bp, mouse
gcccgtgcccgcatggattt

SEQ ID NO: 804379 - DNA, 20 bp, mouse
gggactgcggggttggatga

SEQ ID NO: 804380 - DNA, 20 bp, mouse
gtgggccgcgaacagtggtg

SEQ ID NO: 804381 - DNA, 20 bp, mouse
gacgaaaagggtgcaccgga

SEQ ID NO: 804382 - DNA, 20 bp, mouse
gaacagtggtggggactgcg

SEQ ID NO: 804383 - DNA, 20 bp, mouse
gccgcctgggccgcgaacag

SEQ ID NO: 804384 - DNA, 20 bp, mouse
gcaggctactcactcggctg

SEQ ID NO: 804385 - DNA, 20 bp, mouse
gaagacgctgacgcagtggg

SEQ ID NO: 804386 - DNA, 20 bp, mouse
gaggaaatcaggggtgaata

SEQ ID NO: 804387 - DNA, 20 bp, mouse
gagggcaaccgggcgatcgt

SEQ ID NO: 804388 - DNA, 20 bp, mouse
gaaagtgcaggcgtacttct

SEQ ID NO: 804389 - DNA, 20 bp, mouse
gtggctgggcccggtcagaa

SEQ ID NO: 804390 - DNA, 20 bp, mouse
gcaggatataaggaaatcag

SEQ ID NO: 804391 - DNA, 20 bp, mouse
gaggactagctgtctggtga

SEQ ID NO: 804392 - DNA, 20 bp, mouse
gcagaaaggaccccgtctcc

SEQ ID NO: 804393 - DNA, 20 bp, mouse
gccacggcgcaaccgctgat

SEQ ID NO: 804394 - DNA, 20 bp, mouse
gcggttgcgccgtggcgggg

SEQ ID NO: 804395 - DNA, 20 bp, mouse
gaccgggcccagccatcttg

SEQ ID NO: 804396 - DNA, 20 bp, mouse
ggtgtggggcagttgagtcg

SEQ ID NO: 804397 - DNA, 20 bp, mouse
gactcaactgccccacactg

SEQ ID NO: 804398 - DNA, 20 bp, mouse
gcggcccaatcgggtcccgg

SEQ ID NO: 804399 - DNA, 20 bp, mouse
gcaagcaggacccgtgagtg

SEQ ID NO: 804400 - DNA, 20 bp, mouse
gcggcaaaggtcagtcgcgg

SEQ ID NO: 804401 - DNA, 20 bp, mouse
ggggcacggccctgccaagc

SEQ ID NO: 804402 - DNA, 20 bp, mouse
gtgcccggcagccgcagtgt

SEQ ID NO: 804403 - DNA, 20 bp, mouse
gccgccaccgggacccgatt

SEQ ID NO: 804404 - DNA, 20 bp, mouse
ggagcagggcggttgagagg

SEQ ID NO: 804405 - DNA, 20 bp, mouse
gtccggccagtcactgtcac

SEQ ID NO: 804406 - DNA, 20 bp, mouse
gtccgagggtggacgctaga

SEQ ID NO: 804407 - DNA, 20 bp, mouse
gagtgcgtaaccctcagcgg

SEQ ID NO: 804408 - DNA, 20 bp, mouse
gtgtctgacgacagttccga

SEQ ID NO: 804409 - DNA, 20 bp, mouse
ggccctctagcgtccaccct

SEQ ID NO: 804410 - DNA, 20 bp, mouse
gtaaccctcagcgggggctg

SEQ ID NO: 804411 - DNA, 20 bp, mouse
ggcgggggctgaggacgaac

SEQ ID NO: 804412 - DNA, 20 bp, mouse
gctgacgacagttccgaggg

SEQ ID NO: 804413 - DNA, 20 bp, mouse
gcgtcctcagcccccgctga

SEQ ID NO: 804414 - DNA, 20 bp, mouse
gacgtcctgttatgcgtctg

SEQ ID NO: 804415 - DNA, 20 bp, mouse
gtggcgtcaccgcgccgcgt

SEQ ID NO: 804416 - DNA, 20 bp, mouse
ggggaactgtagtgcgggag

SEQ ID NO: 804417 - DNA, 20 bp, mouse
gcgtgagggataccaaacta

SEQ ID NO: 804418 - DNA, 20 bp, mouse
gttggtatccctcacgtatt

SEQ ID NO: 804419 - DNA, 20 bp, mouse
gaactgtagtgcgggagggg

SEQ ID NO: 804420 - DNA, 20 bp, mouse
gtgtgcaggcagccctagtt

SEQ ID NO: 804421 - DNA, 20 bp, mouse
gtctgacagaagctggtgcg

SEQ ID NO: 804422 - DNA, 20 bp, mouse
ggcactgcgcacgtctgggg

SEQ ID NO: 804423 - DNA, 20 bp, mouse
gacgtctacctaatacgtga

SEQ ID NO: 804424 - DNA, 20 bp, mouse
ggaagacctgtggggtcctc

SEQ ID NO: 804425 - DNA, 20 bp, mouse
gagaagctggtgcggggctg

SEQ ID NO: 804426 - DNA, 20 bp, mouse
gtcacctcccaaatcacccg

SEQ ID NO: 804427 - DNA, 20 bp, mouse
gcgaaggggcgggtcctatc

SEQ ID NO: 804428 - DNA, 20 bp, mouse
ggctggggtcacagagccac

SEQ ID NO: 804429 - DNA, 20 bp, mouse
gacagagccacgggtgattt

SEQ ID NO: 804430 - DNA, 20 bp, mouse
gaagtcacgcagagttgggg

SEQ ID NO: 804431 - DNA, 20 bp, mouse
gcccaaaggctggagggact

SEQ ID NO: 804432 - DNA, 20 bp, mouse
ggagccacgggtgatttggg

SEQ ID NO: 804433 - DNA, 20 bp, mouse
gcttgcgctggaaccccgca

SEQ ID NO: 804434 - DNA, 20 bp, mouse
ggtagcgaagccccaaaagg

SEQ ID NO: 804435 - DNA, 20 bp, mouse
ggctggatcccaaaggctgg

SEQ ID NO: 804436 - DNA, 20 bp, mouse
gcggggtcgtccagtgtccc

SEQ ID NO: 804437 - DNA, 20 bp, mouse
gacctgcagagggcccaccc

SEQ ID NO: 804438 - DNA, 20 bp, mouse
gggcccacccgggaaaggaa

SEQ ID NO: 804439 - DNA, 20 bp, mouse
gggaaaggaacggctatcgg

SEQ ID NO: 804440 - DNA, 20 bp, mouse
ggcaccccgctacctgcaga

SEQ ID NO: 804441 - DNA, 20 bp, mouse
gcagagggcccacccgggaa

SEQ ID NO: 804442 - DNA, 20 bp, mouse
gggccagatgccaccatcac

SEQ ID NO: 804443 - DNA, 20 bp, mouse
gcggggcctgagagaaaccc

SEQ ID NO: 804444 - DNA, 20 bp, mouse
ggggccgcgcacgcaggggg

SEQ ID NO: 804445 - DNA, 20 bp, mouse
gtgcaggtagcggggtgctc

SEQ ID NO: 804446 - DNA, 20 bp, mouse
gtggctggattctagggaat

SEQ ID NO: 804447 - DNA, 20 bp, mouse
gtaactttggctggattcta

SEQ ID NO: 804448 - DNA, 20 bp, mouse
gtgcctgagggacaacacgg

SEQ ID NO: 804449 - DNA, 20 bp, mouse
gcagccaaagttagtgtgtt

SEQ ID NO: 804450 - DNA, 20 bp, mouse
gtgacatcggtatgctctat

SEQ ID NO: 804451 - DNA, 20 bp, mouse
gaaactcccagcatgcctga

SEQ ID NO: 804452 - DNA, 20 bp, mouse
ggctccccagagctttaaac

SEQ ID NO: 804453 - DNA, 20 bp, mouse
gagccgccgtgttgtccctc

SEQ ID NO: 804454 - DNA, 20 bp, mouse
gttgctgtatggtaggagca

SEQ ID NO: 804455 - DNA, 20 bp, mouse
gtatgaataagtaaggctat

SEQ ID NO: 804456 - DNA, 20 bp, mouse
ggggacgcgtgcaggggaat

SEQ ID NO: 804457 - DNA, 20 bp, mouse
gggggaatgggtggctataa

SEQ ID NO: 804458 - DNA, 20 bp, mouse
gaacagctcggttctgtgag

SEQ ID NO: 804459 - DNA, 20 bp, mouse
gacgcgtgcaggggaatggg

SEQ ID NO: 804460 - DNA, 20 bp, mouse
ggtcgtccaaaatgacgatg

SEQ ID NO: 804461 - DNA, 20 bp, mouse
gatgacgatgcggaacagct

SEQ ID NO: 804462 - DNA, 20 bp, mouse
gtctcccagggacgcgtgca

SEQ ID NO: 804463 - DNA, 20 bp, mouse
gtttggacgaccagtcagaa

SEQ ID NO: 804464 - DNA, 20 bp, mouse
gagtgcaggcgcacgtggag

SEQ ID NO: 804465 - DNA, 20 bp, mouse
gccagcctctcccttctgac

SEQ ID NO: 804466 - DNA, 20 bp, mouse
gttctcaagaacctggcatg

SEQ ID NO: 804467 - DNA, 20 bp, mouse
gtcagaaaggggcgaatggt

SEQ ID NO: 804468 - DNA, 20 bp, mouse
ggtagtcagaaaggggcgaa

SEQ ID NO: 804469 - DNA, 20 bp, mouse
gtatatgcactgttcctcca

SEQ ID NO: 804470 - DNA, 20 bp, mouse
gagggttagggcgtggtgga

SEQ ID NO: 804471 - DNA, 20 bp, mouse
ggggaggggtgtagtcagaa

SEQ ID NO: 804472 - DNA, 20 bp, mouse
gctgaaggttctcaagaacc

SEQ ID NO: 804473 - DNA, 20 bp, mouse
gcctgtctgtcagttcctgc

SEQ ID NO: 804474 - DNA, 20 bp, mouse
gaggggcgaatggtggggtg

SEQ ID NO: 804475 - DNA, 20 bp, mouse
gcgggaggcgggccaagagg

SEQ ID NO: 804476 - DNA, 20 bp, mouse
gcccagggagagcagcgcga

SEQ ID NO: 804477 - DNA, 20 bp, mouse
gagcgggaggggaaaccgag

SEQ ID NO: 804478 - DNA, 20 bp, mouse
gcagcaagatggcgcccggc

SEQ ID NO: 804479 - DNA, 20 bp, mouse
ggagagcagcgcgaggggca

SEQ ID NO: 804480 - DNA, 20 bp, mouse
gcgaccggcctcggactcgg

SEQ ID NO: 804481 - DNA, 20 bp, mouse
gcggcagtgacgtcacacgc

SEQ ID NO: 804482 - DNA, 20 bp, mouse
ggtacaaatgcggagaaagg

SEQ ID NO: 804483 - DNA, 20 bp, mouse
gtgggggcttggcacacccg

SEQ ID NO: 804484 - DNA, 20 bp, mouse
gaccaccacccccgagtccg

SEQ ID NO: 804485 - DNA, 20 bp, mouse
ggaaaggagccgccgcctgg

SEQ ID NO: 804486 - DNA, 20 bp, mouse
ggggaaaaagggttccggtg

SEQ ID NO: 804487 - DNA, 20 bp, mouse
gcctaaggatcgttttcctc

SEQ ID NO: 804488 - DNA, 20 bp, mouse
gacagctcggggtaccaggt

SEQ ID NO: 804489 - DNA, 20 bp, mouse
gccggcgcagtgagcctcac

SEQ ID NO: 804490 - DNA, 20 bp, mouse
gggcggcggggtgagaggtc

SEQ ID NO: 804491 - DNA, 20 bp, mouse
ggccacagccgggcgccgag

SEQ ID NO: 804492 - DNA, 20 bp, mouse
ggaaaacgatccttaggagg

SEQ ID NO: 804493 - DNA, 20 bp, mouse
gtgcaggaggcgggagagtg

SEQ ID NO: 804494 - DNA, 20 bp, mouse
gccgcctagggtgcaggagg

SEQ ID NO: 804495 - DNA, 20 bp, mouse
ggcctctcggcgcccggctg

SEQ ID NO: 804496 - DNA, 20 bp, mouse
ggcccctcctcgcagcgtgt

SEQ ID NO: 804497 - DNA, 20 bp, mouse
ggggagtcgggagacgacta

SEQ ID NO: 804498 - DNA, 20 bp, mouse
gaggactgtcagtatggctc

SEQ ID NO: 804499 - DNA, 20 bp, mouse
gccgcggaggactgtcagta

SEQ ID NO: 804500 - DNA, 20 bp, mouse
gacgctgcgaggaggggccg

SEQ ID NO: 804501 - DNA, 20 bp, mouse
gagtcgggagacgactacgg

SEQ ID NO: 804502 - DNA, 20 bp, mouse
gggctcctctggcggcagga

SEQ ID NO: 804503 - DNA, 20 bp, mouse
gtagctgctgggcgcgctgg

SEQ ID NO: 804504 - DNA, 20 bp, mouse
gtggggacgctgcacgcgct

SEQ ID NO: 804505 - DNA, 20 bp, mouse
ggaggagacagaacctgcga

SEQ ID NO: 804506 - DNA, 20 bp, mouse
gcccgctcggcttagagggg

SEQ ID NO: 804507 - DNA, 20 bp, mouse
gttagaggggcggctaagat

SEQ ID NO: 804508 - DNA, 20 bp, mouse
ggcgcccgctcggcttagag

SEQ ID NO: 804509 - DNA, 20 bp, mouse
gaagccgagcgggcgcagca

SEQ ID NO: 804510 - DNA, 20 bp, mouse
gttaagagagggtgtgatcc

SEQ ID NO: 804511 - DNA, 20 bp, mouse
gctgctcagaggtgataggg

SEQ ID NO: 804512 - DNA, 20 bp, mouse
gcaaggctctatcaccagca

SEQ ID NO: 804513 - DNA, 20 bp, mouse
gtagcccttggaaatgcaga

SEQ ID NO: 804514 - DNA, 20 bp, mouse
ggccgctgttcgcttggagc

SEQ ID NO: 804515 - DNA, 20 bp, mouse
ggggagctcttggaacttgg

SEQ ID NO: 804516 - DNA, 20 bp, mouse
gacgcgagtgggttggggaa

SEQ ID NO: 804517 - DNA, 20 bp, mouse
gcgcagacagcacgctggga

SEQ ID NO: 804518 - DNA, 20 bp, mouse
gcacccagagccacacccgt

SEQ ID NO: 804519 - DNA, 20 bp, mouse
gtgcgcaaagcccgctggac

SEQ ID NO: 804520 - DNA, 20 bp, mouse
ggggcgacgcgagtgggttg

SEQ ID NO: 804521 - DNA, 20 bp, mouse
gcagcttgggcgacgcgagt

SEQ ID NO: 804522 - DNA, 20 bp, mouse
gtcgcgtcgcccaagctgcg

SEQ ID NO: 804523 - DNA, 20 bp, mouse
gcgcccccatccacagttct

SEQ ID NO: 804524 - DNA, 20 bp, mouse
gcactctgaccctgtccagc

SEQ ID NO: 804525 - DNA, 20 bp, mouse
ggggccgaaagctgccccaa

SEQ ID NO: 804526 - DNA, 20 bp, mouse
gagggggcgggaagcgtagc

SEQ ID NO: 804527 - DNA, 20 bp, mouse
gcccaccgggcaatgcggac

SEQ ID NO: 804528 - DNA, 20 bp, mouse
gagctccggacacaactcac

SEQ ID NO: 804529 - DNA, 20 bp, mouse
ggctagcaatctccaggtgg

SEQ ID NO: 804530 - DNA, 20 bp, mouse
ggtgccctcggcagtgcctg

SEQ ID NO: 804531 - DNA, 20 bp, mouse
gccgcattgcccggtgggga

SEQ ID NO: 804532 - DNA, 20 bp, mouse
gggcgggaagcgtagcggga

SEQ ID NO: 804533 - DNA, 20 bp, mouse
gcctccgcctccatccccac

SEQ ID NO: 804534 - DNA, 20 bp, mouse
gctagcccgtgagttgtgtc

SEQ ID NO: 804535 - DNA, 20 bp, mouse
ggcagcgcgcgggtcctgca

SEQ ID NO: 804536 - DNA, 20 bp, mouse
gttatgaggttcaagtcagc

SEQ ID NO: 804537 - DNA, 20 bp, mouse
gctgcaataaatccaggaat

SEQ ID NO: 804538 - DNA, 20 bp, mouse
gctagaccctgtcgcaaaac

SEQ ID NO: 804539 - DNA, 20 bp, mouse
ggattaatgtcactcttatg

SEQ ID NO: 804540 - DNA, 20 bp, mouse
gtctcaactgcaataaatcc

SEQ ID NO: 804541 - DNA, 20 bp, mouse
gttgagaggcatgggcagaa

SEQ ID NO: 804542 - DNA, 20 bp, mouse
ggagcaataaattgttacta

SEQ ID NO: 804543 - DNA, 20 bp, mouse
gacaatttattgctctcttg

SEQ ID NO: 804544 - DNA, 20 bp, mouse
gctttttcctgttttgcgac

SEQ ID NO: 804545 - DNA, 20 bp, mouse
gtattgcagttgagaggcat

SEQ ID NO: 804546 - DNA, 20 bp, mouse
gaaggcgtgccgtacgggtt

SEQ ID NO: 804547 - DNA, 20 bp, mouse
gcggagaaggcgtgccgtac

SEQ ID NO: 804548 - DNA, 20 bp, mouse
gcatgacgggggaggactaa

SEQ ID NO: 804549 - DNA, 20 bp, mouse
gctgcacggccgcttctctc

SEQ ID NO: 804550 - DNA, 20 bp, mouse
gaaacgtgcatcatgtggta

SEQ ID NO: 804551 - DNA, 20 bp, mouse
ggcagagcgggtctcaagaa

SEQ ID NO: 804552 - DNA, 20 bp, mouse
ggcggcgtacggacagtccc

SEQ ID NO: 804553 - DNA, 20 bp, mouse
gacgggggaggactaagggg

SEQ ID NO: 804554 - DNA, 20 bp, mouse
ggcgaggcttagggcggaga

SEQ ID NO: 804555 - DNA, 20 bp, mouse
gtacgccgccatgacggggg

SEQ ID NO: 804556 - DNA, 20 bp, mouse
gggctcctctcgtgttccgt

SEQ ID NO: 804557 - DNA, 20 bp, mouse
ggtccacgccccctgggcaa

SEQ ID NO: 804558 - DNA, 20 bp, mouse
ggtcccacgatccgctccta

SEQ ID NO: 804559 - DNA, 20 bp, mouse
gttccgtaggagcggatcgt

SEQ ID NO: 804560 - DNA, 20 bp, mouse
gtggacacactcagcctaat

SEQ ID NO: 804561 - DNA, 20 bp, mouse
ggcggatcgtgggacctctg

SEQ ID NO: 804562 - DNA, 20 bp, mouse
gagcgtccgtggtaagaacg

SEQ ID NO: 804563 - DNA, 20 bp, mouse
ggaagaaaacggcagtagtt

SEQ ID NO: 804564 - DNA, 20 bp, mouse
gcatgcgcacagaagtcgag

SEQ ID NO: 804565 - DNA, 20 bp, mouse
gcgggcagcctttgcccagg

SEQ ID NO: 804566 - DNA, 20 bp, mouse
ggtaccctcaaactgtgagt

SEQ ID NO: 804567 - DNA, 20 bp, mouse
gctggcttatagaaggaatg

SEQ ID NO: 804568 - DNA, 20 bp, mouse
gggacataccagagaaccca

SEQ ID NO: 804569 - DNA, 20 bp, mouse
gggccattctgataggaatc

SEQ ID NO: 804570 - DNA, 20 bp, mouse
ggtggaggagtttgaaacac

SEQ ID NO: 804571 - DNA, 20 bp, mouse
ggcttatagaaggaatgtgg

SEQ ID NO: 804572 - DNA, 20 bp, mouse
gtttgtaactggcttataga

SEQ ID NO: 804573 - DNA, 20 bp, mouse
ggagcaacagccccatttct

SEQ ID NO: 804574 - DNA, 20 bp, mouse
gacttgactatgaggttcac

SEQ ID NO: 804575 - DNA, 20 bp, mouse
gatgaagaacttgcaagcca

SEQ ID NO: 804576 - DNA, 20 bp, mouse
gcggcgaggcggtaagtgta

SEQ ID NO: 804577 - DNA, 20 bp, mouse
gaggcggtaagtgtatggct

SEQ ID NO: 804578 - DNA, 20 bp, mouse
gcccgcgcgagagcaaacgt

SEQ ID NO: 804579 - DNA, 20 bp, mouse
gtcgcatctgaggggaccta

SEQ ID NO: 804580 - DNA, 20 bp, mouse
gagaaggcatggcggcgagg

SEQ ID NO: 804581 - DNA, 20 bp, mouse
gggagactacgcgtcccaga

SEQ ID NO: 804582 - DNA, 20 bp, mouse
gagtcctgggctgaaggatt

SEQ ID NO: 804583 - DNA, 20 bp, mouse
gccccgaactcgtgcggtgt

SEQ ID NO: 804584 - DNA, 20 bp, mouse
gtcttcggaagtcgcatctg

SEQ ID NO: 804585 - DNA, 20 bp, mouse
gagtggcgtcacttcctgtg

SEQ ID NO: 804586 - DNA, 20 bp, mouse
gccgctccgagagttctcat

SEQ ID NO: 804587 - DNA, 20 bp, mouse
gaaaccgccggtacggaagt

SEQ ID NO: 804588 - DNA, 20 bp, mouse
gtctcggagcggacacgagt

SEQ ID NO: 804589 - DNA, 20 bp, mouse
gcacgagtgggagaacaggc

SEQ ID NO: 804590 - DNA, 20 bp, mouse
gtcacagcaacacgtagcac

SEQ ID NO: 804591 - DNA, 20 bp, mouse
gcagcagcacccgcgacctg

SEQ ID NO: 804592 - DNA, 20 bp, mouse
ggaggagcgcagtcgcctcc

SEQ ID NO: 804593 - DNA, 20 bp, mouse
ggaagctaaaaccgccggta

SEQ ID NO: 804594 - DNA, 20 bp, mouse
gtagcaccggcttcttttat

SEQ ID NO: 804595 - DNA, 20 bp, mouse
gtgcgctcctcgtggtacgg

SEQ ID NO: 804596 - DNA, 20 bp, mouse
gcaaaagcgccgctaccctc

SEQ ID NO: 804597 - DNA, 20 bp, mouse
gggagccacgcccctccgga

SEQ ID NO: 804598 - DNA, 20 bp, mouse
ggcgccgctaccctccggag

SEQ ID NO: 804599 - DNA, 20 bp, mouse
gaaagggagccacgcccctc

SEQ ID NO: 804600 - DNA, 20 bp, mouse
gacgcccctccggagggtag

SEQ ID NO: 804601 - DNA, 20 bp, mouse
gtgctctggcctccggacag

SEQ ID NO: 804602 - DNA, 20 bp, mouse
gagcggaagctgttgagcgg

SEQ ID NO: 804603 - DNA, 20 bp, mouse
gattgccccccgctgtccgg

SEQ ID NO: 804604 - DNA, 20 bp, mouse
gggtagcggcgcttttgctc

SEQ ID NO: 804605 - DNA, 20 bp, mouse
gctcaacagcttccgctctg

SEQ ID NO: 804606 - DNA, 20 bp, mouse
ggggcagatgaaactagaaa

SEQ ID NO: 804607 - DNA, 20 bp, mouse
ggggcggggcctcctctggg

SEQ ID NO: 804608 - DNA, 20 bp, mouse
gctagtcgctctgaaactcg

SEQ ID NO: 804609 - DNA, 20 bp, mouse
gaggacaaccaatgcgaggg

SEQ ID NO: 804610 - DNA, 20 bp, mouse
gtaaacgcaagaacccgcag

SEQ ID NO: 804611 - DNA, 20 bp, mouse
ggttaatgccaaaaccctag

SEQ ID NO: 804612 - DNA, 20 bp, mouse
ggccaaaaccctagaggctg

SEQ ID NO: 804613 - DNA, 20 bp, mouse
gggaggccccgccctcgcat

SEQ ID NO: 804614 - DNA, 20 bp, mouse
gtataggacaaccaatgcga

SEQ ID NO: 804615 - DNA, 20 bp, mouse
gtcactaggtagcttcggct

SEQ ID NO: 804616 - DNA, 20 bp, mouse
ggggacgtgtgaattgcggc

SEQ ID NO: 804617 - DNA, 20 bp, mouse
gagaggggacgtgtgaattg

SEQ ID NO: 804618 - DNA, 20 bp, mouse
gacgccttcaggcaagggag

SEQ ID NO: 804619 - DNA, 20 bp, mouse
ggtgcgggacccggagggtg

SEQ ID NO: 804620 - DNA, 20 bp, mouse
gtgacgtcgaagcctgagag

SEQ ID NO: 804621 - DNA, 20 bp, mouse
gtcgcgacgggggatcgtaa

SEQ ID NO: 804622 - DNA, 20 bp, mouse
ggcggaaaagcaatggaaaa

SEQ ID NO: 804623 - DNA, 20 bp, mouse
gcgggaacgccttcaggcaa

SEQ ID NO: 804624 - DNA, 20 bp, mouse
gggggactccgtccagaact

SEQ ID NO: 804625 - DNA, 20 bp, mouse
ggggagggggcggtgtcgga

SEQ ID NO: 804626 - DNA, 20 bp, mouse
gcccctagcggagtggagtg

SEQ ID NO: 804627 - DNA, 20 bp, mouse
gcgtgcgcacgccggcagct

SEQ ID NO: 804628 - DNA, 20 bp, mouse
gcggacgcccaagagaagca

SEQ ID NO: 804629 - DNA, 20 bp, mouse
gctgactagaggcgcgggta

SEQ ID NO: 804630 - DNA, 20 bp, mouse
ggcgggtagggtggaaatcg

SEQ ID NO: 804631 - DNA, 20 bp, mouse
gaatctctgactagaggcgc

SEQ ID NO: 804632 - DNA, 20 bp, mouse
gagtgaggctgcctggctgt

SEQ ID NO: 804633 - DNA, 20 bp, mouse
gagtctgcgcgtgcgcacgc

SEQ ID NO: 804634 - DNA, 20 bp, mouse
gacagcggcccctagcggag

SEQ ID NO: 804635 - DNA, 20 bp, mouse
gagagaagcacggaactatt

SEQ ID NO: 804636 - DNA, 20 bp, mouse
gggctccagcctctccggtt

SEQ ID NO: 804637 - DNA, 20 bp, mouse
ggaaccggaagttatagctc

SEQ ID NO: 804638 - DNA, 20 bp, mouse
gacgacagagaaggccgaac

SEQ ID NO: 804639 - DNA, 20 bp, mouse
gctccgcgcccacacaagaa

SEQ ID NO: 804640 - DNA, 20 bp, mouse
gaacggtacgacgacagaga

SEQ ID NO: 804641 - DNA, 20 bp, mouse
gcgatcggctccagcctctc

SEQ ID NO: 804642 - DNA, 20 bp, mouse
gggaccggagctataacttc

SEQ ID NO: 804643 - DNA, 20 bp, mouse
gtctccccgtctccccctaa

SEQ ID NO: 804644 - DNA, 20 bp, mouse
ggatcaaagcctaaccggag

SEQ ID NO: 804645 - DNA, 20 bp, mouse
gtcgtcgtaccgttcttgtg

SEQ ID NO: 804646 - DNA, 20 bp, mouse
gcagcaagtaaagtgggtaa

SEQ ID NO: 804647 - DNA, 20 bp, mouse
gctcctgtggaagagctctt

SEQ ID NO: 804648 - DNA, 20 bp, mouse
gtccttacataccatgacac

SEQ ID NO: 804649 - DNA, 20 bp, mouse
gttgggccagcaagtaaagt

SEQ ID NO: 804650 - DNA, 20 bp, mouse
gggctcggatgccctcttta

SEQ ID NO: 804651 - DNA, 20 bp, mouse
gatggtatgtaaggatatga

SEQ ID NO: 804652 - DNA, 20 bp, mouse
gatccaaagagctcttccac

SEQ ID NO: 804653 - DNA, 20 bp, mouse
gaactgaagtcccataggct

SEQ ID NO: 804654 - DNA, 20 bp, mouse
gagagggcatccgagcctat

SEQ ID NO: 804655 - DNA, 20 bp, mouse
gcaaatgcagtttgagttta

SEQ ID NO: 804656 - DNA, 20 bp, mouse
gccaagagaagggactcggg

SEQ ID NO: 804657 - DNA, 20 bp, mouse
gggcgggtctgtaagaggaa

SEQ ID NO: 804658 - DNA, 20 bp, mouse
gggactcgggaggaggataa

SEQ ID NO: 804659 - DNA, 20 bp, mouse
gaagccaagagaagggactc

SEQ ID NO: 804660 - DNA, 20 bp, mouse
gggtggagaagccaagagaa

SEQ ID NO: 804661 - DNA, 20 bp, mouse
gctcgctccggtcacgccca

SEQ ID NO: 804662 - DNA, 20 bp, mouse
gccggtcacgcccaaggaaa

SEQ ID NO: 804663 - DNA, 20 bp, mouse
gaggaggcggaaacttttga

SEQ ID NO: 804664 - DNA, 20 bp, mouse
ggggagcggggaggagatta

SEQ ID NO: 804665 - DNA, 20 bp, mouse
gcgagagcggctaaaccaga

SEQ ID NO: 804666 - DNA, 20 bp, mouse
gccggaggagcggggagcta

SEQ ID NO: 804667 - DNA, 20 bp, mouse
gaagtgctgccttagaacgc

SEQ ID NO: 804668 - DNA, 20 bp, mouse
gtctgcccgcccacacagcc

SEQ ID NO: 804669 - DNA, 20 bp, mouse
gtctgtccaggggccaagtg

SEQ ID NO: 804670 - DNA, 20 bp, mouse
ggtgatccaggctgtgtggg

SEQ ID NO: 804671 - DNA, 20 bp, mouse
ggcagcacttccgctcgctg

SEQ ID NO: 804672 - DNA, 20 bp, mouse
gcctcggcagaaactggagc

SEQ ID NO: 804673 - DNA, 20 bp, mouse
gccttagaacgcaggctcaa

SEQ ID NO: 804674 - DNA, 20 bp, mouse
gctatagccccggaggagcg

SEQ ID NO: 804675 - DNA, 20 bp, mouse
gtggacagaattgaccagta

SEQ ID NO: 804676 - DNA, 20 bp, mouse
gtcggcgagggaaagtccgc

SEQ ID NO: 804677 - DNA, 20 bp, mouse
gtagggcgcggcttcggcga

SEQ ID NO: 804678 - DNA, 20 bp, mouse
gggcgcagacagatcacggc

SEQ ID NO: 804679 - DNA, 20 bp, mouse
gagcacccgcaggctgtggt

SEQ ID NO: 804680 - DNA, 20 bp, mouse
gcgggtaagtcgctcctcac

SEQ ID NO: 804681 - DNA, 20 bp, mouse
gcaggaacccgtggcgacgt

SEQ ID NO: 804682 - DNA, 20 bp, mouse
gcggggcagcagagtcgctc

SEQ ID NO: 804683 - DNA, 20 bp, mouse
gaagcgggacggcccagcgc

SEQ ID NO: 804684 - DNA, 20 bp, mouse
gaagcctggagaagcccgtg

SEQ ID NO: 804685 - DNA, 20 bp, mouse
gctggtgtagggcgcggctt

SEQ ID NO: 804686 - DNA, 20 bp, mouse
ggggtctgcacccacttcaa

SEQ ID NO: 804687 - DNA, 20 bp, mouse
gtcagagctggtgaagagac

SEQ ID NO: 804688 - DNA, 20 bp, mouse
gactgtcatccattctcaag

SEQ ID NO: 804689 - DNA, 20 bp, mouse
gtctgcacccacttcaaggg

SEQ ID NO: 804690 - DNA, 20 bp, mouse
gccactgagaccaagagttc

SEQ ID NO: 804691 - DNA, 20 bp, mouse
ggctcaccatgatctgtatc

SEQ ID NO: 804692 - DNA, 20 bp, mouse
ggctgtccagatacagatca

SEQ ID NO: 804693 - DNA, 20 bp, mouse
gcacttcaagggtggatctg

SEQ ID NO: 804694 - DNA, 20 bp, mouse
gaacacaggaacttgcagtc

SEQ ID NO: 804695 - DNA, 20 bp, mouse
gaacttgcagtcaggagggc

SEQ ID NO: 804696 - DNA, 20 bp, mouse
gcagagctactgtctgagaa

SEQ ID NO: 804697 - DNA, 20 bp, mouse
gcccaggatctggcagaaac

SEQ ID NO: 804698 - DNA, 20 bp, mouse
ggcaacgataaaatgatgaa

SEQ ID NO: 804699 - DNA, 20 bp, mouse
gttgtaaaaactgacttcag

SEQ ID NO: 804700 - DNA, 20 bp, mouse
ggcctgtttctgccagatcc

SEQ ID NO: 804701 - DNA, 20 bp, mouse
gcactagatactgctgccat

SEQ ID NO: 804702 - DNA, 20 bp, mouse
gagttgtcctttgcaatcat

SEQ ID NO: 804703 - DNA, 20 bp, mouse
gactaaactcaccactagag

SEQ ID NO: 804704 - DNA, 20 bp, mouse
ggtcctttgcaatcatgggg

SEQ ID NO: 804705 - DNA, 20 bp, mouse
ggtcagtttttacaatccag

SEQ ID NO: 804706 - DNA, 20 bp, mouse
ggaccctgtaccactcctta

SEQ ID NO: 804707 - DNA, 20 bp, mouse
gcaccctaaggagtggtaca

SEQ ID NO: 804708 - DNA, 20 bp, mouse
ggaagccacagcccacccta

SEQ ID NO: 804709 - DNA, 20 bp, mouse
gcactccttagggtgggctg

SEQ ID NO: 804710 - DNA, 20 bp, mouse
gtttcaataggtggcttcta

SEQ ID NO: 804711 - DNA, 20 bp, mouse
gaagccacctattgaaaatg

SEQ ID NO: 804712 - DNA, 20 bp, mouse
gcgatggccacattttcaat

SEQ ID NO: 804713 - DNA, 20 bp, mouse
gtggttagcactaactgggg

SEQ ID NO: 804714 - DNA, 20 bp, mouse
gtggccacattttcaatagg

SEQ ID NO: 804715 - DNA, 20 bp, mouse
gtctggcttgaatttgaaag

SEQ ID NO: 804716 - DNA, 20 bp, mouse
ggcgccctctggcctctcgg

SEQ ID NO: 804717 - DNA, 20 bp, mouse
gactccgccgagaggccaga

SEQ ID NO: 804718 - DNA, 20 bp, mouse
gcgcgcgccctctggcctct

SEQ ID NO: 804719 - DNA, 20 bp, mouse
gagtccctgtcctgactcgg

SEQ ID NO: 804720 - DNA, 20 bp, mouse
gaggacagacgaagctggag

SEQ ID NO: 804721 - DNA, 20 bp, mouse
ggcaccgccggggctcagaa

SEQ ID NO: 804722 - DNA, 20 bp, mouse
gcgccggggctcagaaagga

SEQ ID NO: 804723 - DNA, 20 bp, mouse
ggacgccccccacctcacca

SEQ ID NO: 804724 - DNA, 20 bp, mouse
gcccgcgaagaggtcgccgt

SEQ ID NO: 804725 - DNA, 20 bp, mouse
gtgtcctccgagtcaggaca

SEQ ID NO: 804726 - DNA, 20 bp, mouse
ggaagaaggcatgtcttggc

SEQ ID NO: 804727 - DNA, 20 bp, mouse
ggggctggactccgcaatgg

SEQ ID NO: 804728 - DNA, 20 bp, mouse
gtgaggaagaaggcatgtct

SEQ ID NO: 804729 - DNA, 20 bp, mouse
gtctccagcggaggacggag

SEQ ID NO: 804730 - DNA, 20 bp, mouse
gctggactccgcaatggagg

SEQ ID NO: 804731 - DNA, 20 bp, mouse
gttggctggaggcggagaca

SEQ ID NO: 804732 - DNA, 20 bp, mouse
ggaggggctggactccgcaa

SEQ ID NO: 804733 - DNA, 20 bp, mouse
ggacaagctagcctcgaggg

SEQ ID NO: 804734 - DNA, 20 bp, mouse
gctctggcggcgcctcaggt

SEQ ID NO: 804735 - DNA, 20 bp, mouse
gcctgggaggggaacgagcg

SEQ ID NO: 804736 - DNA, 20 bp, mouse
gcctgtaccggggagtgtgt

SEQ ID NO: 804737 - DNA, 20 bp, mouse
gtccaagcggcgcctgtacc

SEQ ID NO: 804738 - DNA, 20 bp, mouse
ggggcggtgctaattcggaa

SEQ ID NO: 804739 - DNA, 20 bp, mouse
gcccccacacctcaggccca

SEQ ID NO: 804740 - DNA, 20 bp, mouse
ggggtggggctggacggagt

SEQ ID NO: 804741 - DNA, 20 bp, mouse
gctgtgtctcacaaaagtgg

SEQ ID NO: 804742 - DNA, 20 bp, mouse
gtggggctggacggagtagg

SEQ ID NO: 804743 - DNA, 20 bp, mouse
ggggctgggcggtgctaatt

SEQ ID NO: 804744 - DNA, 20 bp, mouse
gggaagccccgcccagccga

SEQ ID NO: 804745 - DNA, 20 bp, mouse
gccgcacggggccttcggct

SEQ ID NO: 804746 - DNA, 20 bp, mouse
gaatgcaggacggaaaagaa

SEQ ID NO: 804747 - DNA, 20 bp, mouse
ggcgtggctaagggctagcg

SEQ ID NO: 804748 - DNA, 20 bp, mouse
gaggaaggaccccagcgcgg

SEQ ID NO: 804749 - DNA, 20 bp, mouse
gcaaaagggtcgtgaccctt

SEQ ID NO: 804750 - DNA, 20 bp, mouse
gggctctggctggcctgaat

SEQ ID NO: 804751 - DNA, 20 bp, mouse
gggtcacgacccttttgcaa

SEQ ID NO: 804752 - DNA, 20 bp, mouse
gggggcgtggctaaggcctt

SEQ ID NO: 804753 - DNA, 20 bp, mouse
ggcttcaagtactttcggtc

SEQ ID NO: 804754 - DNA, 20 bp, mouse
gttgggcaacccttgcaaaa

SEQ ID NO: 804755 - DNA, 20 bp, mouse
gatctacagcgatagtttca

SEQ ID NO: 804756 - DNA, 20 bp, mouse
gaggctatgacaccagttcc

SEQ ID NO: 804757 - DNA, 20 bp, mouse
ggggctggcgctgcggaagt

SEQ ID NO: 804758 - DNA, 20 bp, mouse
gcggggtgggccgggctcga

SEQ ID NO: 804759 - DNA, 20 bp, mouse
gcatcactgtgctacggata

SEQ ID NO: 804760 - DNA, 20 bp, mouse
gtgcgcgtgcgctttaggag

SEQ ID NO: 804761 - DNA, 20 bp, mouse
ggacgtgaatggcaagtaca

SEQ ID NO: 804762 - DNA, 20 bp, mouse
gaggggggagggccgcagga

SEQ ID NO: 804763 - DNA, 20 bp, mouse
gagctattcgccacgggctg

SEQ ID NO: 804764 - DNA, 20 bp, mouse
gtgtacgtggtgaacaaagc

SEQ ID NO: 804765 - DNA, 20 bp, mouse
gagcgcgacggcatccgggg

SEQ ID NO: 804766 - DNA, 20 bp, mouse
ggacgcacactccctagtgt

SEQ ID NO: 804767 - DNA, 20 bp, mouse
gtcgagcataatagctgcta

SEQ ID NO: 804768 - DNA, 20 bp, mouse
ggaactatttaaccttccgg

SEQ ID NO: 804769 - DNA, 20 bp, mouse
gagggagtaaatagaattac

SEQ ID NO: 804770 - DNA, 20 bp, mouse
gggagtgtgcgtccgaattc

SEQ ID NO: 804771 - DNA, 20 bp, mouse
gtcacaaccctacatttcac

SEQ ID NO: 804772 - DNA, 20 bp, mouse
gtacaaggctctataacatc

SEQ ID NO: 804773 - DNA, 20 bp, mouse
ggagtttcctgtgaaatgta

SEQ ID NO: 804774 - DNA, 20 bp, mouse
gctatgacgaaaaatatcag

SEQ ID NO: 804775 - DNA, 20 bp, mouse
gttctggataacttccgctc

SEQ ID NO: 804776 - DNA, 20 bp, mouse
gtagcttgggttatgaaaag

SEQ ID NO: 804777 - DNA, 20 bp, mouse
ggacgtagaaaaaatagaat

SEQ ID NO: 804778 - DNA, 20 bp, mouse
gcacaagtatagagcaagca

SEQ ID NO: 804779 - DNA, 20 bp, mouse
gcaaatgttcagctatagct

SEQ ID NO: 804780 - DNA, 20 bp, mouse
gtacagtctcatcccattgc

SEQ ID NO: 804781 - DNA, 20 bp, mouse
gttataaattaccctgcaat

SEQ ID NO: 804782 - DNA, 20 bp, mouse
gtaaaaatatgctattaggt

SEQ ID NO: 804783 - DNA, 20 bp, mouse
gatttataaactgaagaagt

SEQ ID NO: 804784 - DNA, 20 bp, mouse
ggaggctggaaagtctgaga

SEQ ID NO: 804785 - DNA, 20 bp, mouse
gaactgaagaagttggtctt

SEQ ID NO: 804786 - DNA, 20 bp, mouse
ggctacgcgcccgcgacgcg

SEQ ID NO: 804787 - DNA, 20 bp, mouse
gtaaaggctcctcgcgtcgc

SEQ ID NO: 804788 - DNA, 20 bp, mouse
gttgacagctggagtgtgat

SEQ ID NO: 804789 - DNA, 20 bp, mouse
gagtgtgatgggaacatcac

SEQ ID NO: 804790 - DNA, 20 bp, mouse
ggaagctaactctctcacca

SEQ ID NO: 804791 - DNA, 20 bp, mouse
gcgtcgcgggcgcgtagcca

SEQ ID NO: 804792 - DNA, 20 bp, mouse
gctactctgttcgaatgcaa

SEQ ID NO: 804793 - DNA, 20 bp, mouse
ggctgctgtggcgagaaaaa

SEQ ID NO: 804794 - DNA, 20 bp, mouse
ggttgactgccatttgtaga

SEQ ID NO: 804795 - DNA, 20 bp, mouse
gcgaagatggcgaagcaaca

SEQ ID NO: 804796 - DNA, 20 bp, mouse
ggcgcgctgcagcggaatcg

SEQ ID NO: 804797 - DNA, 20 bp, mouse
gcagcgcgcaggcacgtgtg

SEQ ID NO: 804798 - DNA, 20 bp, mouse
gccccggagggaaggcttaa

SEQ ID NO: 804799 - DNA, 20 bp, mouse
gcacgtgtgtggccgcctaa

SEQ ID NO: 804800 - DNA, 20 bp, mouse
gtgtgtggccgcctaagggg

SEQ ID NO: 804801 - DNA, 20 bp, mouse
gaagtgtggaaatgcatcct

SEQ ID NO: 804802 - DNA, 20 bp, mouse
ggagtcaggtgaggactcag

SEQ ID NO: 804803 - DNA, 20 bp, mouse
ggccgaaggacccgcccctt

SEQ ID NO: 804804 - DNA, 20 bp, mouse
gccgagcgaacgagcaaatc

SEQ ID NO: 804805 - DNA, 20 bp, mouse
gcagccgatgcgattaagag

SEQ ID NO: 804806 - DNA, 20 bp, mouse
ggaagcccggcctgggtgca

SEQ ID NO: 804807 - DNA, 20 bp, mouse
gcacccaggccgggcttcgg

SEQ ID NO: 804808 - DNA, 20 bp, mouse
gcctgggtgcagggcggagt

SEQ ID NO: 804809 - DNA, 20 bp, mouse
gggctcccgtctcagtggta

SEQ ID NO: 804810 - DNA, 20 bp, mouse
ggcccggcctgggtgcaggg

SEQ ID NO: 804811 - DNA, 20 bp, mouse
gggagccgtaccactgagac

SEQ ID NO: 804812 - DNA, 20 bp, mouse
ggccgggccaagtccaatga

SEQ ID NO: 804813 - DNA, 20 bp, mouse
gccaatgagggacatttaaa

SEQ ID NO: 804814 - DNA, 20 bp, mouse
gccgggcattaggcattaga

SEQ ID NO: 804815 - DNA, 20 bp, mouse
gtgccccgcacaatgaacag

SEQ ID NO: 804816 - DNA, 20 bp, mouse
ggcggtacccaggaatcctc

SEQ ID NO: 804817 - DNA, 20 bp, mouse
gtggtgacgactctgtcccg

SEQ ID NO: 804818 - DNA, 20 bp, mouse
ggagaccgcacgcggtaccc

SEQ ID NO: 804819 - DNA, 20 bp, mouse
gtctcgcgagagcgaaagtg

SEQ ID NO: 804820 - DNA, 20 bp, mouse
gagaggagtcacgtgagcag

SEQ ID NO: 804821 - DNA, 20 bp, mouse
gtactggagtcacaaattca

SEQ ID NO: 804822 - DNA, 20 bp, mouse
gaggggatgccttttatagt

SEQ ID NO: 804823 - DNA, 20 bp, mouse
gactctgtcccgaggattcc

SEQ ID NO: 804824 - DNA, 20 bp, mouse
gtccgggccgggaaggattt

SEQ ID NO: 804825 - DNA, 20 bp, mouse
ggctctcgcgagaccgcacg

SEQ ID NO: 804826 - DNA, 20 bp, mouse
gcggcgagcgctgagagcga

SEQ ID NO: 804827 - DNA, 20 bp, mouse
ggtacgccgtgcgacaacat

SEQ ID NO: 804828 - DNA, 20 bp, mouse
gacgtcttagcgttgtattc

SEQ ID NO: 804829 - DNA, 20 bp, mouse
gaaatgtcactcagagcacg

SEQ ID NO: 804830 - DNA, 20 bp, mouse
ggcggaccaatgttgtcgca

SEQ ID NO: 804831 - DNA, 20 bp, mouse
ggcgagaccccgtctctttt

SEQ ID NO: 804832 - DNA, 20 bp, mouse
gaagtgtccaaaaagagacg

SEQ ID NO: 804833 - DNA, 20 bp, mouse
gggcacagtgagtgacgtca

SEQ ID NO: 804834 - DNA, 20 bp, mouse
gtgagtgacatttctaaggc

SEQ ID NO: 804835 - DNA, 20 bp, mouse
ggacatttctaaggctggct

SEQ ID NO: 804836 - DNA, 20 bp, mouse
ggcgtctaaaacggcgtagg

SEQ ID NO: 804837 - DNA, 20 bp, mouse
gtagcaacctgtaatgtagg

SEQ ID NO: 804838 - DNA, 20 bp, mouse
gcgacccttgcaagtgttca

SEQ ID NO: 804839 - DNA, 20 bp, mouse
gggaagtagacatctagttc

SEQ ID NO: 804840 - DNA, 20 bp, mouse
gttcccatgaacacttgcaa

SEQ ID NO: 804841 - DNA, 20 bp, mouse
gtttgcgtctaaaacggcgt

SEQ ID NO: 804842 - DNA, 20 bp, mouse
gaaactcataaaggccaagc

SEQ ID NO: 804843 - DNA, 20 bp, mouse
gacctagcaacctgtaatgt

SEQ ID NO: 804844 - DNA, 20 bp, mouse
gccagcactaacgaagtaga

SEQ ID NO: 804845 - DNA, 20 bp, mouse
ggtacagagcactttcagac

SEQ ID NO: 804846 - DNA, 20 bp, mouse
gggctggctaggctgtgcat

SEQ ID NO: 804847 - DNA, 20 bp, mouse
gcgacagcgccctcgtgtgt

SEQ ID NO: 804848 - DNA, 20 bp, mouse
ggcacagcctagccagcccg

SEQ ID NO: 804849 - DNA, 20 bp, mouse
ggcgacctcccgacacacga

SEQ ID NO: 804850 - DNA, 20 bp, mouse
ggggcgctgtcgcagcacgg

SEQ ID NO: 804851 - DNA, 20 bp, mouse
gcggaagggcgaaagagcaa

SEQ ID NO: 804852 - DNA, 20 bp, mouse
gtgtcgggaggtcgcgcagc

SEQ ID NO: 804853 - DNA, 20 bp, mouse
gagagcaagggtcacgtaga

SEQ ID NO: 804854 - DNA, 20 bp, mouse
gcgagggcgctgtcgcagca

SEQ ID NO: 804855 - DNA, 20 bp, mouse
gttacacccgagggaactga

SEQ ID NO: 804856 - DNA, 20 bp, mouse
gggggcagggaaccttacta

SEQ ID NO: 804857 - DNA, 20 bp, mouse
gaatcatagggaaataactc

SEQ ID NO: 804858 - DNA, 20 bp, mouse
gaaggatcagacaggtgtca

SEQ ID NO: 804859 - DNA, 20 bp, mouse
gtactgggtaaggaatgaat

SEQ ID NO: 804860 - DNA, 20 bp, mouse
gtcacaatatagcaatcata

SEQ ID NO: 804861 - DNA, 20 bp, mouse
gatcctggaaaggatcagac

SEQ ID NO: 804862 - DNA, 20 bp, mouse
gtacaatgcttatcctggaa

SEQ ID NO: 804863 - DNA, 20 bp, mouse
gggtcaggacttgagcagga

SEQ ID NO: 804864 - DNA, 20 bp, mouse
gaccatatgtagatgattaa

SEQ ID NO: 804865 - DNA, 20 bp, mouse
gcagtgatgcctactgggta

SEQ ID NO: 804866 - DNA, 20 bp, mouse
gaatccaaggaggggcacca

SEQ ID NO: 804867 - DNA, 20 bp, mouse
gtaggagacaaatccaagga

SEQ ID NO: 804868 - DNA, 20 bp, mouse
gagaggtgtggtgacaccca

SEQ ID NO: 804869 - DNA, 20 bp, mouse
gcacccatggtgcccctcct

SEQ ID NO: 804870 - DNA, 20 bp, mouse
ggacttagaagacaatactt

SEQ ID NO: 804871 - DNA, 20 bp, mouse
gtggatgtaaaaaaggtaat

SEQ ID NO: 804872 - DNA, 20 bp, mouse
ggaagagtggaatcctgttc

SEQ ID NO: 804873 - DNA, 20 bp, mouse
ggcattagactaatatcttt

SEQ ID NO: 804874 - DNA, 20 bp, mouse
gcaatatacttttagaggtg

SEQ ID NO: 804875 - DNA, 20 bp, mouse
ggtttgaagtgatgaatgaa

SEQ ID NO: 804876 - DNA, 20 bp, mouse
ggtcccaggctgggaaactg

SEQ ID NO: 804877 - DNA, 20 bp, mouse
gcgcccgctgggaaagtctg

SEQ ID NO: 804878 - DNA, 20 bp, mouse
gtgcgcgcgcgctggagcct

SEQ ID NO: 804879 - DNA, 20 bp, mouse
ggggaaagtctgaggctggg

SEQ ID NO: 804880 - DNA, 20 bp, mouse
gcaaggagagttctgttaga

SEQ ID NO: 804881 - DNA, 20 bp, mouse
gtatctggtgcgattggtct

SEQ ID NO: 804882 - DNA, 20 bp, mouse
gctcggcacaaagaagagaa

SEQ ID NO: 804883 - DNA, 20 bp, mouse
gagcctcagtttcccagcct

SEQ ID NO: 804884 - DNA, 20 bp, mouse
ggctgggaaagtctgaggct

SEQ ID NO: 804885 - DNA, 20 bp, mouse
gtagcatggggctggctgat

SEQ ID NO: 804886 - DNA, 20 bp, mouse
gggagcgggctctgagttaa

SEQ ID NO: 804887 - DNA, 20 bp, mouse
gtactggaaaggacccggat

SEQ ID NO: 804888 - DNA, 20 bp, mouse
ggaggagctacctgccttca

SEQ ID NO: 804889 - DNA, 20 bp, mouse
ggaaaggacccggatgggtg

SEQ ID NO: 804890 - DNA, 20 bp, mouse
gactctggatgaaaaacatg

SEQ ID NO: 804891 - DNA, 20 bp, mouse
gtgtgcgcgtgcgcatgagt

SEQ ID NO: 804892 - DNA, 20 bp, mouse
gcctagcgccatctgttgga

SEQ ID NO: 804893 - DNA, 20 bp, mouse
gccgcctactggaaaggacc

SEQ ID NO: 804894 - DNA, 20 bp, mouse
gcagactgcactttccctga

SEQ ID NO: 804895 - DNA, 20 bp, mouse
gccatctgttggagggaggc

SEQ ID NO: 804896 - DNA, 20 bp, mouse
gcgccacgcccgtcttctgg

SEQ ID NO: 804897 - DNA, 20 bp, mouse
gagcctagctagtacttcag

SEQ ID NO: 804898 - DNA, 20 bp, mouse
gaatcaagcgctaggatgag

SEQ ID NO: 804899 - DNA, 20 bp, mouse
ggtccgccagaagacgggcg

SEQ ID NO: 804900 - DNA, 20 bp, mouse
gtcagaggtccgccagaaga

SEQ ID NO: 804901 - DNA, 20 bp, mouse
gcaccaaccaatcaagcgct

SEQ ID NO: 804902 - DNA, 20 bp, mouse
gcgcacatgcgcagaaactt

SEQ ID NO: 804903 - DNA, 20 bp, mouse
ggacggtggattcttagcta

SEQ ID NO: 804904 - DNA, 20 bp, mouse
gcatgctttacccggctcaa

SEQ ID NO: 804905 - DNA, 20 bp, mouse
gacccaggaaccatggacgg

SEQ ID NO: 804906 - DNA, 20 bp, mouse
gcccgtcaccaggaaggtcc

SEQ ID NO: 804907 - DNA, 20 bp, mouse
gaacgacagaccccgtcacc

SEQ ID NO: 804908 - DNA, 20 bp, mouse
ggggttagccgcttccagac

SEQ ID NO: 804909 - DNA, 20 bp, mouse
gttagaggggcgttacttcc

SEQ ID NO: 804910 - DNA, 20 bp, mouse
gccgacttccgcttaaccca

SEQ ID NO: 804911 - DNA, 20 bp, mouse
gacagccagggcgacaattc

SEQ ID NO: 804912 - DNA, 20 bp, mouse
gttagcttcctggaccttcc

SEQ ID NO: 804913 - DNA, 20 bp, mouse
gacagaccccgtcaccagga

SEQ ID NO: 804914 - DNA, 20 bp, mouse
gggcggaagtgactttagag

SEQ ID NO: 804915 - DNA, 20 bp, mouse
gagggtcgcaaacggagatt

SEQ ID NO: 804916 - DNA, 20 bp, mouse
gaacccgcggagcctccggt

SEQ ID NO: 804917 - DNA, 20 bp, mouse
gctgactcccggcgcgttgg

SEQ ID NO: 804918 - DNA, 20 bp, mouse
ggggctggggtctctcgtga

SEQ ID NO: 804919 - DNA, 20 bp, mouse
gggggtctctcgtgaaggca

SEQ ID NO: 804920 - DNA, 20 bp, mouse
gacccccgcccccaacgcgc

SEQ ID NO: 804921 - DNA, 20 bp, mouse
gggtgggcagggccgacagt

SEQ ID NO: 804922 - DNA, 20 bp, mouse
ggggaatgccgcgccgtggg

SEQ ID NO: 804923 - DNA, 20 bp, mouse
gctgcccaccggaggctccg

SEQ ID NO: 804924 - DNA, 20 bp, mouse
gccgcgggttccgttttccc

SEQ ID NO: 804925 - DNA, 20 bp, mouse
gggactgggcggggctactc

SEQ ID NO: 804926 - DNA, 20 bp, mouse
ggggcctgaggtctgccctc

SEQ ID NO: 804927 - DNA, 20 bp, mouse
gcagcagctgggttgatatg

SEQ ID NO: 804928 - DNA, 20 bp, mouse
ggggcagacctcaggccccg

SEQ ID NO: 804929 - DNA, 20 bp, mouse
ggctggagccgggaaaccac

SEQ ID NO: 804930 - DNA, 20 bp, mouse
gagggtggatggctggagcc

SEQ ID NO: 804931 - DNA, 20 bp, mouse
gcaagacagccaatcagacg

SEQ ID NO: 804932 - DNA, 20 bp, mouse
gaccacaggccccgtctgat

SEQ ID NO: 804933 - DNA, 20 bp, mouse
ggtgcagggtgaaggcgtgg

SEQ ID NO: 804934 - DNA, 20 bp, mouse
ggggccagaggcggatgtgc

SEQ ID NO: 804935 - DNA, 20 bp, mouse
gggggcgttctctttgtagg

SEQ ID NO: 804936 - DNA, 20 bp, mouse
gacaacgcccctgggcagga

SEQ ID NO: 804937 - DNA, 20 bp, mouse
gggagagtacggtggtgggc

SEQ ID NO: 804938 - DNA, 20 bp, mouse
gcaggatggctggtgataat

SEQ ID NO: 804939 - DNA, 20 bp, mouse
gggaaaagagctctggctgc

SEQ ID NO: 804940 - DNA, 20 bp, mouse
gaattggagagtacggtggt

SEQ ID NO: 804941 - DNA, 20 bp, mouse
gcgggcactgattggtgggt

SEQ ID NO: 804942 - DNA, 20 bp, mouse
ggctgcgggcactgattggt

SEQ ID NO: 804943 - DNA, 20 bp, mouse
gttcacggggacaacgcccc

SEQ ID NO: 804944 - DNA, 20 bp, mouse
gaggcaacggcgctgattgg

SEQ ID NO: 804945 - DNA, 20 bp, mouse
ggtaggttttccgactaaag

SEQ ID NO: 804946 - DNA, 20 bp, mouse
ggatcccagcagaacagcga

SEQ ID NO: 804947 - DNA, 20 bp, mouse
gaccgcgcgcacccaggggc

SEQ ID NO: 804948 - DNA, 20 bp, mouse
gcggccgtcgctgttctgct

SEQ ID NO: 804949 - DNA, 20 bp, mouse
gtctctagagcgaggctggg

SEQ ID NO: 804950 - DNA, 20 bp, mouse
gcccacttccgctcacaaca

SEQ ID NO: 804951 - DNA, 20 bp, mouse
gccaccaccgcgcgcaccca

SEQ ID NO: 804952 - DNA, 20 bp, mouse
gttagacgccatgttgtgag

SEQ ID NO: 804953 - DNA, 20 bp, mouse
gaggggtaggaggtggaaaa

SEQ ID NO: 804954 - DNA, 20 bp, mouse
gcgccgagcggccagccagg

SEQ ID NO: 804955 - DNA, 20 bp, mouse
gtacctgtctctctagagcg

SEQ ID NO: 804956 - DNA, 20 bp, mouse
gggtgggaagcatcagacgg

SEQ ID NO: 804957 - DNA, 20 bp, mouse
gtcaggcggctggaacgtga

SEQ ID NO: 804958 - DNA, 20 bp, mouse
gggctggaacgtgacggagc

SEQ ID NO: 804959 - DNA, 20 bp, mouse
gtgactcaggccgcacgggg

SEQ ID NO: 804960 - DNA, 20 bp, mouse
gggccctgcacggctctcac

SEQ ID NO: 804961 - DNA, 20 bp, mouse
gtgaggagggctgcccaccc

SEQ ID NO: 804962 - DNA, 20 bp, mouse
gccgtgcggcctgagtcagg

SEQ ID NO: 804963 - DNA, 20 bp, mouse
gacggctctcactggtcccg

SEQ ID NO: 804964 - DNA, 20 bp, mouse
gggaagcatcagacggtggc

SEQ ID NO: 804965 - DNA, 20 bp, mouse
ggtcacccaaaggccctgca

SEQ ID NO: 804966 - DNA, 20 bp, mouse
gagcgcccgttcccattggg

SEQ ID NO: 804967 - DNA, 20 bp, mouse
gagtaggtggggcattccgt

SEQ ID NO: 804968 - DNA, 20 bp, mouse
gctagccgcccaatgggaac

SEQ ID NO: 804969 - DNA, 20 bp, mouse
ggggcggctcctgaaacgtc

SEQ ID NO: 804970 - DNA, 20 bp, mouse
gaaggggtgtgaccattctg

SEQ ID NO: 804971 - DNA, 20 bp, mouse
gtggctcagggctgtctcct

SEQ ID NO: 804972 - DNA, 20 bp, mouse
gtgccagcgcccgttcccat

SEQ ID NO: 804973 - DNA, 20 bp, mouse
ggggtgtgaccattctgggg

SEQ ID NO: 804974 - DNA, 20 bp, mouse
gctccgattggcaagaccca

SEQ ID NO: 804975 - DNA, 20 bp, mouse
ggcgctgcgcccaatagcgc

SEQ ID NO: 804976 - DNA, 20 bp, mouse
gcgccgaacaggtaacgcgg

SEQ ID NO: 804977 - DNA, 20 bp, mouse
gggcgtcacccgcacgtcaa

SEQ ID NO: 804978 - DNA, 20 bp, mouse
gcgaacaggtaacgcggcgg

SEQ ID NO: 804979 - DNA, 20 bp, mouse
gcgccccgccaggatccgcg

SEQ ID NO: 804980 - DNA, 20 bp, mouse
gaggcgccgaacaggtaacg

SEQ ID NO: 804981 - DNA, 20 bp, mouse
gcctccctgcgccgccaata

SEQ ID NO: 804982 - DNA, 20 bp, mouse
ggcggcggccgccatattgg

SEQ ID NO: 804983 - DNA, 20 bp, mouse
gccagccccgagtggaaagg

SEQ ID NO: 804984 - DNA, 20 bp, mouse
gggggttccaggcgccgaac

SEQ ID NO: 804985 - DNA, 20 bp, mouse
ggtggaaaggggggctgcgt

SEQ ID NO: 804986 - DNA, 20 bp, mouse
gagctcccggggccaggtac

SEQ ID NO: 804987 - DNA, 20 bp, mouse
gaacttgaggagccagtctg

SEQ ID NO: 804988 - DNA, 20 bp, mouse
gacaccgtccgaagccaagc

SEQ ID NO: 804989 - DNA, 20 bp, mouse
gcccggggccaggtactggc

SEQ ID NO: 804990 - DNA, 20 bp, mouse
gggtacgcatgctccgtgtc

SEQ ID NO: 804991 - DNA, 20 bp, mouse
gcgcgcaagctgtactttcc

SEQ ID NO: 804992 - DNA, 20 bp, mouse
gggctcctcaagttcagctc

SEQ ID NO: 804993 - DNA, 20 bp, mouse
ggagcatgcgcgtagtgaga

SEQ ID NO: 804994 - DNA, 20 bp, mouse
gttcccggcttggcttcgga

SEQ ID NO: 804995 - DNA, 20 bp, mouse
ggccttcctaaatagaagaa

SEQ ID NO: 804996 - DNA, 20 bp, mouse
gggcccaggagaaaccgaca

SEQ ID NO: 804997 - DNA, 20 bp, mouse
gataaggcttgcaggatggg

SEQ ID NO: 804998 - DNA, 20 bp, mouse
gcagctcacagcactaagaa

SEQ ID NO: 804999 - DNA, 20 bp, mouse
ggagaaaccgacaaggaaga

SEQ ID NO: 805000 - DNA, 20 bp, mouse
ggatgggaggtccagatgtc

SEQ ID NO: 805001 - DNA, 20 bp, mouse
gtggaactacgactcccgag

SEQ ID NO: 805002 - DNA, 20 bp, mouse
gaaagcctattctattcata

SEQ ID NO: 805003 - DNA, 20 bp, mouse
gcgcggctcggggcgagagc

SEQ ID NO: 805004 - DNA, 20 bp, mouse
gttccttgtcggtttctcct

SEQ ID NO: 805005 - DNA, 20 bp, mouse
gtcccgagaggctttccgac

SEQ ID NO: 805006 - DNA, 20 bp, mouse
gtaggcgctagtaaccacag

SEQ ID NO: 805007 - DNA, 20 bp, mouse
ggctcagtcgccatggatac

SEQ ID NO: 805008 - DNA, 20 bp, mouse
gcggacgatacagctcggag

SEQ ID NO: 805009 - DNA, 20 bp, mouse
gcagtcgccatggataccgg

SEQ ID NO: 805010 - DNA, 20 bp, mouse
ggcgtccctactaagtctcc

SEQ ID NO: 805011 - DNA, 20 bp, mouse
ggcgcctagctcagtcgcca

SEQ ID NO: 805012 - DNA, 20 bp, mouse
gcgagctgtatcgtccgctg

SEQ ID NO: 805013 - DNA, 20 bp, mouse
ggaaaggagatgcttggctc

SEQ ID NO: 805014 - DNA, 20 bp, mouse
ggcaccgcacagagtaagta

SEQ ID NO: 805015 - DNA, 20 bp, mouse
ggacttagtagggacgcctc

SEQ ID NO: 805016 - DNA, 20 bp, mouse
ggcaaactctagggctttaa

SEQ ID NO: 805017 - DNA, 20 bp, mouse
gaggccaggaactcaggagt

SEQ ID NO: 805018 - DNA, 20 bp, mouse
gcgaggagaacgatgattgg

SEQ ID NO: 805019 - DNA, 20 bp, mouse
gcccccaggcacctgcggaa

SEQ ID NO: 805020 - DNA, 20 bp, mouse
gtgggtgactgagtgtagca

SEQ ID NO: 805021 - DNA, 20 bp, mouse
gtttgcaaggccaggaactc

SEQ ID NO: 805022 - DNA, 20 bp, mouse
gtaagggctgtcagaagccg

SEQ ID NO: 805023 - DNA, 20 bp, mouse
ggggtgtgtactctgcccta

SEQ ID NO: 805024 - DNA, 20 bp, mouse
gaaaaggtctattgtcaccc

SEQ ID NO: 805025 - DNA, 20 bp, mouse
gagctctaccctaagcccta

SEQ ID NO: 805026 - DNA, 20 bp, mouse
gctgcccaggtctccaacta

SEQ ID NO: 805027 - DNA, 20 bp, mouse
gtccctactgggaactaatg

SEQ ID NO: 805028 - DNA, 20 bp, mouse
gaggtctccaactaggggag

SEQ ID NO: 805029 - DNA, 20 bp, mouse
gtactgggaactaatgcggg

SEQ ID NO: 805030 - DNA, 20 bp, mouse
gagcggagaattttcaccaa

SEQ ID NO: 805031 - DNA, 20 bp, mouse
gtgaaacgtcccatcttcgt

SEQ ID NO: 805032 - DNA, 20 bp, mouse
ggacctgggcagagtggtgg

SEQ ID NO: 805033 - DNA, 20 bp, mouse
gaggtggggacagcggaagt

SEQ ID NO: 805034 - DNA, 20 bp, mouse
gtaccgggaacaagcgaaac

SEQ ID NO: 805035 - DNA, 20 bp, mouse
gcccggtagtcgtcagcgtt

SEQ ID NO: 805036 - DNA, 20 bp, mouse
gccagaccgcccaaggtcaa

SEQ ID NO: 805037 - DNA, 20 bp, mouse
gcctcaaatcccttgacctt

SEQ ID NO: 805038 - DNA, 20 bp, mouse
gagcctgggacgctggcaca

SEQ ID NO: 805039 - DNA, 20 bp, mouse
gccgccctccagaccgccca

SEQ ID NO: 805040 - DNA, 20 bp, mouse
gcaaatcccttgaccttggg

SEQ ID NO: 805041 - DNA, 20 bp, mouse
gggaagagacgtaaagaagg

SEQ ID NO: 805042 - DNA, 20 bp, mouse
gtcccctgtgccagcgtccc

SEQ ID NO: 805043 - DNA, 20 bp, mouse
gctggggccgcggcgagcct

SEQ ID NO: 805044 - DNA, 20 bp, mouse
gccaacgctctgttcacagg

SEQ ID NO: 805045 - DNA, 20 bp, mouse
gggtcaagggatttgaggcg

SEQ ID NO: 805046 - DNA, 20 bp, mouse
gaacgaggctgccccttcca

SEQ ID NO: 805047 - DNA, 20 bp, mouse
gaggtggttaggcgattaaa

SEQ ID NO: 805048 - DNA, 20 bp, mouse
ggggcagcctcgttaattct

SEQ ID NO: 805049 - DNA, 20 bp, mouse
gaatcgcctaaccacctcac

SEQ ID NO: 805050 - DNA, 20 bp, mouse
gaatgctttagccctggaag

SEQ ID NO: 805051 - DNA, 20 bp, mouse
gacgagcaggccggctagag

SEQ ID NO: 805052 - DNA, 20 bp, mouse
gggccgacttgccagtgagg

SEQ ID NO: 805053 - DNA, 20 bp, mouse
ggaaagccatagagacgagc

SEQ ID NO: 805054 - DNA, 20 bp, mouse
gggctagagcggcgcttcgc

SEQ ID NO: 805055 - DNA, 20 bp, mouse
ggccggcctgctcgtctcta

SEQ ID NO: 805056 - DNA, 20 bp, mouse
gccggaagtagctggggcga

SEQ ID NO: 805057 - DNA, 20 bp, mouse
gcccaggccggaagtagctg

SEQ ID NO: 805058 - DNA, 20 bp, mouse
gcagtcgctgcacagacccc

SEQ ID NO: 805059 - DNA, 20 bp, mouse
ggggcccgctgtagcgcgcg

SEQ ID NO: 805060 - DNA, 20 bp, mouse
ggaagtagctggggcgaggg

SEQ ID NO: 805061 - DNA, 20 bp, mouse
gcgcggagcggaagttaaag

SEQ ID NO: 805062 - DNA, 20 bp, mouse
gaaagtggcccgcgcctgcg

SEQ ID NO: 805063 - DNA, 20 bp, mouse
gggtccgctgagtgacgaat

SEQ ID NO: 805064 - DNA, 20 bp, mouse
ggctccgcgcgcgctacagc

SEQ ID NO: 805065 - DNA, 20 bp, mouse
gcccgggtagcgcgaaagga

SEQ ID NO: 805066 - DNA, 20 bp, mouse
gataataaaaatatcttaat

SEQ ID NO: 805067 - DNA, 20 bp, mouse
ggagaaagtcccatttatca

SEQ ID NO: 805068 - DNA, 20 bp, mouse
gcaaggacaagatattctac

SEQ ID NO: 805069 - DNA, 20 bp, mouse
gaggagaagaaaatactact

SEQ ID NO: 805070 - DNA, 20 bp, mouse
gttcaagatgtggtttaaat

SEQ ID NO: 805071 - DNA, 20 bp, mouse
gtttaaattggaaatgagta

SEQ ID NO: 805072 - DNA, 20 bp, mouse
gatagaattgttttacagtt

SEQ ID NO: 805073 - DNA, 20 bp, mouse
gtatcttgtccttgataaat

SEQ ID NO: 805074 - DNA, 20 bp, mouse
gtctttaactcatcacatta

SEQ ID NO: 805075 - DNA, 20 bp, mouse
gtgataatgtgttcaagatg

SEQ ID NO: 805076 - DNA, 20 bp, mouse
gaaagcaaacggtttccaga

SEQ ID NO: 805077 - DNA, 20 bp, mouse
ggacaggaagacagaggtac

SEQ ID NO: 805078 - DNA, 20 bp, mouse
gaggtcaagctggattgaac

SEQ ID NO: 805079 - DNA, 20 bp, mouse
gaaacggtttccagagggag

SEQ ID NO: 805080 - DNA, 20 bp, mouse
ggtagggcctgaatcattct

SEQ ID NO: 805081 - DNA, 20 bp, mouse
ggggaagtaaataaagcaaa

SEQ ID NO: 805082 - DNA, 20 bp, mouse
gcaacagaatgggtgtctcc

SEQ ID NO: 805083 - DNA, 20 bp, mouse
gccagagggagaggtcaagc

SEQ ID NO: 805084 - DNA, 20 bp, mouse
gtacttgtcaaggtggatgc

SEQ ID NO: 805085 - DNA, 20 bp, mouse
ggcatactacaatgacaaac

SEQ ID NO: 805086 - DNA, 20 bp, mouse
ggtaacctcggtaacggcgt

SEQ ID NO: 805087 - DNA, 20 bp, mouse
gcaccgctctacccctgcta

SEQ ID NO: 805088 - DNA, 20 bp, mouse
gtactagtggagatcaacta

SEQ ID NO: 805089 - DNA, 20 bp, mouse
gagaaaagacgtggtaacct

SEQ ID NO: 805090 - DNA, 20 bp, mouse
gtaacggcgtgggggaaggg

SEQ ID NO: 805091 - DNA, 20 bp, mouse
ggacgtggtaacctcggtaa

SEQ ID NO: 805092 - DNA, 20 bp, mouse
gcaactaaggagaaaagacg

SEQ ID NO: 805093 - DNA, 20 bp, mouse
ggagaacgctcgaagaggtt

SEQ ID NO: 805094 - DNA, 20 bp, mouse
gcgccctagcaggggtagag

SEQ ID NO: 805095 - DNA, 20 bp, mouse
ggcggtgagaacgctcgaag

SEQ ID NO: 805096 - DNA, 20 bp, mouse
ggggaggcggggaaataggt

SEQ ID NO: 805097 - DNA, 20 bp, mouse
ggcggcgcgggaagttctga

SEQ ID NO: 805098 - DNA, 20 bp, mouse
gagctccgcccactgaagaa

SEQ ID NO: 805099 - DNA, 20 bp, mouse
gagcgcgtgcgcagactatt

SEQ ID NO: 805100 - DNA, 20 bp, mouse
gtgcgcagactattcgggta

SEQ ID NO: 805101 - DNA, 20 bp, mouse
ggggccttaccattcttcag

SEQ ID NO: 805102 - DNA, 20 bp, mouse
gcaacagccgacgttcccag

SEQ ID NO: 805103 - DNA, 20 bp, mouse
gaacgtcggctgttgattgg

SEQ ID NO: 805104 - DNA, 20 bp, mouse
gcgcccactgaagaatggta

SEQ ID NO: 805105 - DNA, 20 bp, mouse
gcgccattggccagcgggga

SEQ ID NO: 805106 - DNA, 20 bp, mouse
gcccttatgcccaaggtcac

SEQ ID NO: 805107 - DNA, 20 bp, mouse
gaagatcccagtacagaggc

SEQ ID NO: 805108 - DNA, 20 bp, mouse
gcaggaagatcccagtacag

SEQ ID NO: 805109 - DNA, 20 bp, mouse
gactcccgaagatttccttt

SEQ ID NO: 805110 - DNA, 20 bp, mouse
gagaggcgggtttgcaagaa

SEQ ID NO: 805111 - DNA, 20 bp, mouse
gtcatgtggcggggtgtccc

SEQ ID NO: 805112 - DNA, 20 bp, mouse
ggcaaacccgcctctgtact

SEQ ID NO: 805113 - DNA, 20 bp, mouse
gcacaaggtaacaaccaatc

SEQ ID NO: 805114 - DNA, 20 bp, mouse
gtagccgtgctgtcatgtgg

SEQ ID NO: 805115 - DNA, 20 bp, mouse
gagataagcgctattttcct

SEQ ID NO: 805116 - DNA, 20 bp, mouse
gggagaagaaaggtgaagac

SEQ ID NO: 805117 - DNA, 20 bp, mouse
ggggtcttgcgcacggcaga

SEQ ID NO: 805118 - DNA, 20 bp, mouse
gtaaaaccgagggagaagaa

SEQ ID NO: 805119 - DNA, 20 bp, mouse
gcgcacggaggatgtacggg

SEQ ID NO: 805120 - DNA, 20 bp, mouse
gctcagacgagcgagaatcc

SEQ ID NO: 805121 - DNA, 20 bp, mouse
gggaggatgtacgggaggtg

SEQ ID NO: 805122 - DNA, 20 bp, mouse
ggcgcacggcagagggatgc

SEQ ID NO: 805123 - DNA, 20 bp, mouse
gacataacgcaaaactctca

SEQ ID NO: 805124 - DNA, 20 bp, mouse
gggagctggggtcttgcgca

SEQ ID NO: 805125 - DNA, 20 bp, mouse
gagagactagatcaaggaga

SEQ ID NO: 805126 - DNA, 20 bp, mouse
gcagacgcggtgagtgtgtg

SEQ ID NO: 805127 - DNA, 20 bp, mouse
gccggtagctgcagctggag

SEQ ID NO: 805128 - DNA, 20 bp, mouse
gcagctggagcggtggcgtt

SEQ ID NO: 805129 - DNA, 20 bp, mouse
ggggcggtgcgcgctcagtg

SEQ ID NO: 805130 - DNA, 20 bp, mouse
gtgggccctgctgatcacgt

SEQ ID NO: 805131 - DNA, 20 bp, mouse
ggggaagccaggcgagggct

SEQ ID NO: 805132 - DNA, 20 bp, mouse
gcgggccatgcgaaaaccgt

SEQ ID NO: 805133 - DNA, 20 bp, mouse
ggtagcctacgggtcacgtg

SEQ ID NO: 805134 - DNA, 20 bp, mouse
gaccgccccacgtgacccgt

SEQ ID NO: 805135 - DNA, 20 bp, mouse
ggaggacctggttgctaaga

SEQ ID NO: 805136 - DNA, 20 bp, mouse
gcgatgctgtggggatacga

SEQ ID NO: 805137 - DNA, 20 bp, mouse
gcggttgcgcgtgaggaaaa

SEQ ID NO: 805138 - DNA, 20 bp, mouse
gttaggggctgggcatggtg

SEQ ID NO: 805139 - DNA, 20 bp, mouse
gtacgcgcacgcgcctggac

SEQ ID NO: 805140 - DNA, 20 bp, mouse
gcgaaaggctcggaaggaag

SEQ ID NO: 805141 - DNA, 20 bp, mouse
gtgcgcgtgaggaaaatggt

SEQ ID NO: 805142 - DNA, 20 bp, mouse
gtgggtgggcggagggtcag

SEQ ID NO: 805143 - DNA, 20 bp, mouse
gggcagagcgaatgcttgag

SEQ ID NO: 805144 - DNA, 20 bp, mouse
gaaaggccagcaggcttgga

SEQ ID NO: 805145 - DNA, 20 bp, mouse
gcgtgaggaaaatggtagga

SEQ ID NO: 805146 - DNA, 20 bp, mouse
gtcctcccgggctgctgcaa

SEQ ID NO: 805147 - DNA, 20 bp, mouse
gggggcaggtagctggaagg

SEQ ID NO: 805148 - DNA, 20 bp, mouse
gaccgcaaacccgccagggg

SEQ ID NO: 805149 - DNA, 20 bp, mouse
gcaggggcggggcaggtagc

SEQ ID NO: 805150 - DNA, 20 bp, mouse
gaatcccccacctcccttct

SEQ ID NO: 805151 - DNA, 20 bp, mouse
ggacgcatccactcgccctc

SEQ ID NO: 805152 - DNA, 20 bp, mouse
gtaggaccgcaaacccgcca

SEQ ID NO: 805153 - DNA, 20 bp, mouse
ggcagcagcccgggaggaca

SEQ ID NO: 805154 - DNA, 20 bp, mouse
gtgcggtcctagaagggagg

SEQ ID NO: 805155 - DNA, 20 bp, mouse
gcgggtttgcggtcctagaa

SEQ ID NO: 805156 - DNA, 20 bp, mouse
gaaagggcgagcccacgctg

SEQ ID NO: 805157 - DNA, 20 bp, mouse
ggggtcgagtgaacctggga

SEQ ID NO: 805158 - DNA, 20 bp, mouse
gggcgacatcgcgagaacgt

SEQ ID NO: 805159 - DNA, 20 bp, mouse
gcagaacaaaaccccagcgt

SEQ ID NO: 805160 - DNA, 20 bp, mouse
gcatctcgcgagaactccga

SEQ ID NO: 805161 - DNA, 20 bp, mouse
ggctgtgcgctagattgcaa

SEQ ID NO: 805162 - DNA, 20 bp, mouse
gagaaggggtcgagtgaacc

SEQ ID NO: 805163 - DNA, 20 bp, mouse
gcacagcgagttaaaatgaa

SEQ ID NO: 805164 - DNA, 20 bp, mouse
gaccccttctgcaaagaccc

SEQ ID NO: 805165 - DNA, 20 bp, mouse
ggcctgccgccacccacttc

SEQ ID NO: 805166 - DNA, 20 bp, mouse
gtgcccgcaggccgccctaa

SEQ ID NO: 805167 - DNA, 20 bp, mouse
gggcgcggaaatgagagccc

SEQ ID NO: 805168 - DNA, 20 bp, mouse
ggagagcccgggccacgtga

SEQ ID NO: 805169 - DNA, 20 bp, mouse
gtccgcgccattggccctta

SEQ ID NO: 805170 - DNA, 20 bp, mouse
gacccgccatcacgtggccc

SEQ ID NO: 805171 - DNA, 20 bp, mouse
ggccctaagggccaatggcg

SEQ ID NO: 805172 - DNA, 20 bp, mouse
gaggccgccctaagggccaa

SEQ ID NO: 805173 - DNA, 20 bp, mouse
gggcccccccaaaagggtag

SEQ ID NO: 805174 - DNA, 20 bp, mouse
gagtgccacccgccatcacg

SEQ ID NO: 805175 - DNA, 20 bp, mouse
gactctgagcagcgagtggg

SEQ ID NO: 805176 - DNA, 20 bp, mouse
gcataagcccagctccgatt

SEQ ID NO: 805177 - DNA, 20 bp, mouse
ggaaggccgaggtgcgttgc

SEQ ID NO: 805178 - DNA, 20 bp, mouse
gccaagcttcggtttattat

SEQ ID NO: 805179 - DNA, 20 bp, mouse
gctgccactctgggacaaca

SEQ ID NO: 805180 - DNA, 20 bp, mouse
gactagcagcggcagaaggg

SEQ ID NO: 805181 - DNA, 20 bp, mouse
gagcccagcgcgcgcatgga

SEQ ID NO: 805182 - DNA, 20 bp, mouse
gttaccctgttgtcccagag

SEQ ID NO: 805183 - DNA, 20 bp, mouse
gctgactagcagcggcagaa

SEQ ID NO: 805184 - DNA, 20 bp, mouse
ggcctggccgcgcctctcgt

SEQ ID NO: 805185 - DNA, 20 bp, mouse
gctgctagtcaggtgattcc

SEQ ID NO: 805186 - DNA, 20 bp, mouse
gggacacccgaattctctct

SEQ ID NO: 805187 - DNA, 20 bp, mouse
gtgtgtggccgagcaagcgg

SEQ ID NO: 805188 - DNA, 20 bp, mouse
gtctagggggagaacgtgtg

SEQ ID NO: 805189 - DNA, 20 bp, mouse
ggagcagaagtccccgaggg

SEQ ID NO: 805190 - DNA, 20 bp, mouse
gcacccgaattctctctagg

SEQ ID NO: 805191 - DNA, 20 bp, mouse
gggcggtggccagtgcgctc

SEQ ID NO: 805192 - DNA, 20 bp, mouse
gccaccgggcgcgcgctcgc

SEQ ID NO: 805193 - DNA, 20 bp, mouse
gctccccctagagagaattc

SEQ ID NO: 805194 - DNA, 20 bp, mouse
gagcgagcagaagtccccga

SEQ ID NO: 805195 - DNA, 20 bp, mouse
gaggctgcccctcaactgtg

SEQ ID NO: 805196 - DNA, 20 bp, mouse
gggaggagctagactaataa

SEQ ID NO: 805197 - DNA, 20 bp, mouse
gaaaacggggaattccaaga

SEQ ID NO: 805198 - DNA, 20 bp, mouse
gcctcccaaaggcggactgc

SEQ ID NO: 805199 - DNA, 20 bp, mouse
gactgcaggaggagagctcg

SEQ ID NO: 805200 - DNA, 20 bp, mouse
gggaaacaaggttgcaaaaa

SEQ ID NO: 805201 - DNA, 20 bp, mouse
gagctagactaataagggta

SEQ ID NO: 805202 - DNA, 20 bp, mouse
ggatgcttctggaggaggcg

SEQ ID NO: 805203 - DNA, 20 bp, mouse
gtgggcgaaaaagttttctt

SEQ ID NO: 805204 - DNA, 20 bp, mouse
gagagctcgtggctgtgctt

SEQ ID NO: 805205 - DNA, 20 bp, mouse
gcggggaattccaagagggg

SEQ ID NO: 805206 - DNA, 20 bp, mouse
gaagaaaccgggaagatgga

SEQ ID NO: 805207 - DNA, 20 bp, mouse
gaaaccgggaagatggacgg

SEQ ID NO: 805208 - DNA, 20 bp, mouse
gtcagagcaccgggaggaga

SEQ ID NO: 805209 - DNA, 20 bp, mouse
gacagtgattgcataaatca

SEQ ID NO: 805210 - DNA, 20 bp, mouse
gctgccctcagagcaccggg

SEQ ID NO: 805211 - DNA, 20 bp, mouse
gtaggccgcgcccgcccagg

SEQ ID NO: 805212 - DNA, 20 bp, mouse
gtcaccgccgtccatcttcc

SEQ ID NO: 805213 - DNA, 20 bp, mouse
gcccagacggccatttgtag

SEQ ID NO: 805214 - DNA, 20 bp, mouse
gcgctccagagtctccgcct

SEQ ID NO: 805215 - DNA, 20 bp, mouse
gggagactctggagcgccct

SEQ ID NO: 805216 - DNA, 20 bp, mouse
gaccgcggcgcggccgtccg

SEQ ID NO: 805217 - DNA, 20 bp, mouse
gggtctgattggtcagaggc

SEQ ID NO: 805218 - DNA, 20 bp, mouse
gaccgcggacggccgcgccg

SEQ ID NO: 805219 - DNA, 20 bp, mouse
gcggccgtccgcggtctgat

SEQ ID NO: 805220 - DNA, 20 bp, mouse
gtggcggctagtgaaccaat

SEQ ID NO: 805221 - DNA, 20 bp, mouse
gccgcggtctgattggtcag

SEQ ID NO: 805222 - DNA, 20 bp, mouse
gactccccgcccacctaggg

SEQ ID NO: 805223 - DNA, 20 bp, mouse
gagagagaggaggagctgcg

SEQ ID NO: 805224 - DNA, 20 bp, mouse
ggcgccgcggtggcgaccat

SEQ ID NO: 805225 - DNA, 20 bp, mouse
ggtctcagccaatgagagag

SEQ ID NO: 805226 - DNA, 20 bp, mouse
gagggcgtggggcaaacttg

SEQ ID NO: 805227 - DNA, 20 bp, mouse
gggccccgggcgcctaggga

SEQ ID NO: 805228 - DNA, 20 bp, mouse
gactatcccgggatgagtgg

SEQ ID NO: 805229 - DNA, 20 bp, mouse
gcccggcagccggaggggaa

SEQ ID NO: 805230 - DNA, 20 bp, mouse
gcaaacttggggctgctgta

SEQ ID NO: 805231 - DNA, 20 bp, mouse
gcagccgcggctgaacgagc

SEQ ID NO: 805232 - DNA, 20 bp, mouse
gtgcctagctaaaactgggg

SEQ ID NO: 805233 - DNA, 20 bp, mouse
gccgcagttgccactatccc

SEQ ID NO: 805234 - DNA, 20 bp, mouse
gctagctaaaactggggcgg

SEQ ID NO: 805235 - DNA, 20 bp, mouse
gcgcgcagcccgaggggaga

SEQ ID NO: 805236 - DNA, 20 bp, mouse
gctaaagtgcttaagatgtg

SEQ ID NO: 805237 - DNA, 20 bp, mouse
gtgtccattaatacataatt

SEQ ID NO: 805238 - DNA, 20 bp, mouse
ggaccgatcaccattgctga

SEQ ID NO: 805239 - DNA, 20 bp, mouse
gtctgtagctattcaggtga

SEQ ID NO: 805240 - DNA, 20 bp, mouse
gaacggaacagctcatttca

SEQ ID NO: 805241 - DNA, 20 bp, mouse
ggcttaagatgtgaggcggt

SEQ ID NO: 805242 - DNA, 20 bp, mouse
gtcttaagcactttaggtcc

SEQ ID NO: 805243 - DNA, 20 bp, mouse
gagtctagcaaaaaaaccac

SEQ ID NO: 805244 - DNA, 20 bp, mouse
gcagggactgcttttggagt

SEQ ID NO: 805245 - DNA, 20 bp, mouse
gagactaggatgtgtttact

SEQ ID NO: 805246 - DNA, 20 bp, mouse
ggaaaggagcgcagtctccc

SEQ ID NO: 805247 - DNA, 20 bp, mouse
gtcaacgccgggagttgaat

SEQ ID NO: 805248 - DNA, 20 bp, mouse
ggctttgcccacactcaata

SEQ ID NO: 805249 - DNA, 20 bp, mouse
ggacgtgcagagcaacgcga

SEQ ID NO: 805250 - DNA, 20 bp, mouse
gtgggtgaaagcggacctgg

SEQ ID NO: 805251 - DNA, 20 bp, mouse
ggcgttgctctgcacgtcac

SEQ ID NO: 805252 - DNA, 20 bp, mouse
gtggccgccatattgagtgt

SEQ ID NO: 805253 - DNA, 20 bp, mouse
gagacagcacacgagtccct

SEQ ID NO: 805254 - DNA, 20 bp, mouse
gttgagtgtgggcaaagccc

SEQ ID NO: 805255 - DNA, 20 bp, mouse
gacgccgggagttgaatggg

SEQ ID NO: 805256 - DNA, 20 bp, mouse
ggggcggcgagcggggtcag

SEQ ID NO: 805257 - DNA, 20 bp, mouse
gcctgcgcgctcaatcccca

SEQ ID NO: 805258 - DNA, 20 bp, mouse
ggtggcgagcggggtgcgga

SEQ ID NO: 805259 - DNA, 20 bp, mouse
gccgctgaagcgactcaccc

SEQ ID NO: 805260 - DNA, 20 bp, mouse
gcgggtgcgcgggcgctcgc

SEQ ID NO: 805261 - DNA, 20 bp, mouse
gggggtcagcggcgtccaat

SEQ ID NO: 805262 - DNA, 20 bp, mouse
gtgggacatgaagacagtca

SEQ ID NO: 805263 - DNA, 20 bp, mouse
gcccccgcacccctctactt

SEQ ID NO: 805264 - DNA, 20 bp, mouse
gccgctgaggttggtgccaa

SEQ ID NO: 805265 - DNA, 20 bp, mouse
gcggagagcatggcgaacga

SEQ ID NO: 805266 - DNA, 20 bp, mouse
gcagccgaggaagcagagtt

SEQ ID NO: 805267 - DNA, 20 bp, mouse
gccgccgaactctgcttcct

SEQ ID NO: 805268 - DNA, 20 bp, mouse
gaagcagagttcggcggcga

SEQ ID NO: 805269 - DNA, 20 bp, mouse
gagcaggaggaggttcgcac

SEQ ID NO: 805270 - DNA, 20 bp, mouse
gagggtccccactccggcga

SEQ ID NO: 805271 - DNA, 20 bp, mouse
gtaggcggatctctaggcag

SEQ ID NO: 805272 - DNA, 20 bp, mouse
gctgctcagtgaagagaagc

SEQ ID NO: 805273 - DNA, 20 bp, mouse
gcgcccaggcacgctactct

SEQ ID NO: 805274 - DNA, 20 bp, mouse
gaagagaagcgggccagccg

SEQ ID NO: 805275 - DNA, 20 bp, mouse
gacgcagccgtcgccggagt

SEQ ID NO: 805276 - DNA, 20 bp, mouse
gcccacgtgagcagagcgta

SEQ ID NO: 805277 - DNA, 20 bp, mouse
gtcgcagcaagaaggcgggt

SEQ ID NO: 805278 - DNA, 20 bp, mouse
gagcttggcggggcaatcgg

SEQ ID NO: 805279 - DNA, 20 bp, mouse
gtcaaagcgggtttccttct

SEQ ID NO: 805280 - DNA, 20 bp, mouse
gctgaagctttcctagaaat

SEQ ID NO: 805281 - DNA, 20 bp, mouse
gcgtaaggatcgcagcaaga

SEQ ID NO: 805282 - DNA, 20 bp, mouse
ggtggaggcgggaggataaa

SEQ ID NO: 805283 - DNA, 20 bp, mouse
gaaaaagaagcttgtcttag

SEQ ID NO: 805284 - DNA, 20 bp, mouse
gcgtgaccttggcgctcagg

SEQ ID NO: 805285 - DNA, 20 bp, mouse
gagaaacacagccatccctg

SEQ ID NO: 805286 - DNA, 20 bp, mouse
gggaaccgtggtcccacttc

SEQ ID NO: 805287 - DNA, 20 bp, mouse
gcctcccggaagtgggacca

SEQ ID NO: 805288 - DNA, 20 bp, mouse
gactcggagtgcgtgagcag

SEQ ID NO: 805289 - DNA, 20 bp, mouse
ggaagcggaacagagtgcgc

SEQ ID NO: 805290 - DNA, 20 bp, mouse
gagtgcgtgagcagcgggaa

SEQ ID NO: 805291 - DNA, 20 bp, mouse
gtggaggtacaactcgaagg

SEQ ID NO: 805292 - DNA, 20 bp, mouse
gtgagcagcgggaacggcgg

SEQ ID NO: 805293 - DNA, 20 bp, mouse
gggtacaactcgaaggtggt

SEQ ID NO: 805294 - DNA, 20 bp, mouse
gtgcgcagccgcaggggact

SEQ ID NO: 805295 - DNA, 20 bp, mouse
gcccgcagcgcccccacctc

SEQ ID NO: 805296 - DNA, 20 bp, mouse
ggtacgctaccgcctctcag

SEQ ID NO: 805297 - DNA, 20 bp, mouse
gggcgcaactgcaccctgca

SEQ ID NO: 805298 - DNA, 20 bp, mouse
gcctctcggccactgagagg

SEQ ID NO: 805299 - DNA, 20 bp, mouse
ggctgcgccagctggatctc

SEQ ID NO: 805300 - DNA, 20 bp, mouse
gatggtctggtgtaagccta

SEQ ID NO: 805301 - DNA, 20 bp, mouse
gaaagtggatgctctacaag

SEQ ID NO: 805302 - DNA, 20 bp, mouse
gcgcctggcgggcaatgaac

SEQ ID NO: 805303 - DNA, 20 bp, mouse
ggcgcctctcggccactgag

SEQ ID NO: 805304 - DNA, 20 bp, mouse
gcaaacgtcctggacgatgc

SEQ ID NO: 805305 - DNA, 20 bp, mouse
ggggcaatgaacaggtgacg

SEQ ID NO: 805306 - DNA, 20 bp, mouse
gcggctgaggacacacacgt

SEQ ID NO: 805307 - DNA, 20 bp, mouse
ggatgcaccgccaagattcg

SEQ ID NO: 805308 - DNA, 20 bp, mouse
gccaagattcgtggccgtga

SEQ ID NO: 805309 - DNA, 20 bp, mouse
gggaagtgacatcagaggaa

SEQ ID NO: 805310 - DNA, 20 bp, mouse
gccaatcaacatccgttctg

SEQ ID NO: 805311 - DNA, 20 bp, mouse
gggtgtttcggatgctgtgt

SEQ ID NO: 805312 - DNA, 20 bp, mouse
gttaagatcgcaaagcaaat

SEQ ID NO: 805313 - DNA, 20 bp, mouse
ggcgatcttaacgctgggga

SEQ ID NO: 805314 - DNA, 20 bp, mouse
gaaggaaaaccttgtaaaac

SEQ ID NO: 805315 - DNA, 20 bp, mouse
ggctttgcgatcttaacgct

SEQ ID NO: 805316 - DNA, 20 bp, mouse
ggaacccagcttctggggga

SEQ ID NO: 805317 - DNA, 20 bp, mouse
gtgggagcctcgggtaggga

SEQ ID NO: 805318 - DNA, 20 bp, mouse
gcaccccggccccttctggg

SEQ ID NO: 805319 - DNA, 20 bp, mouse
gactcggaacccagcttctg

SEQ ID NO: 805320 - DNA, 20 bp, mouse
gacgacctaccggttttctc

SEQ ID NO: 805321 - DNA, 20 bp, mouse
ggaatcgagactctccgaga

SEQ ID NO: 805322 - DNA, 20 bp, mouse
gtctgccggagaaaaccggt

SEQ ID NO: 805323 - DNA, 20 bp, mouse
gaggctgcccgggtaagggg

SEQ ID NO: 805324 - DNA, 20 bp, mouse
gcgactctgccggagaaaac

SEQ ID NO: 805325 - DNA, 20 bp, mouse
gagcagcagccgcccagaag

SEQ ID NO: 805326 - DNA, 20 bp, mouse
gtgacagggcggttagttgg

SEQ ID NO: 805327 - DNA, 20 bp, mouse
gtcctccagcagaacgccta

SEQ ID NO: 805328 - DNA, 20 bp, mouse
gaagcccgccgagtgaatgg

SEQ ID NO: 805329 - DNA, 20 bp, mouse
gtgtcctgggacaagtgcaa

SEQ ID NO: 805330 - DNA, 20 bp, mouse
gaggttcagggcgattgaca

SEQ ID NO: 805331 - DNA, 20 bp, mouse
ggccaacctcccaatgtcct

SEQ ID NO: 805332 - DNA, 20 bp, mouse
ggggaagcccgccgagtgaa

SEQ ID NO: 805333 - DNA, 20 bp, mouse
ggcatcaggggcacttacag

SEQ ID NO: 805334 - DNA, 20 bp, mouse
gacggcgtctacccgcacag

SEQ ID NO: 805335 - DNA, 20 bp, mouse
gtgagagtggcccaggttca

SEQ ID NO: 805336 - DNA, 20 bp, mouse
ggactacgatagaggggtgg

SEQ ID NO: 805337 - DNA, 20 bp, mouse
gcctgaagccagaaccgcaa

SEQ ID NO: 805338 - DNA, 20 bp, mouse
gggcaaaggggccacccttg

SEQ ID NO: 805339 - DNA, 20 bp, mouse
ggaacttcacgtctgcggag

SEQ ID NO: 805340 - DNA, 20 bp, mouse
gccgtagaacttcacgtctg

SEQ ID NO: 805341 - DNA, 20 bp, mouse
gttctggcgactacgataga

SEQ ID NO: 805342 - DNA, 20 bp, mouse
gggcgactacgatagagggg

SEQ ID NO: 805343 - DNA, 20 bp, mouse
gtccggaaagggtgggacgt

SEQ ID NO: 805344 - DNA, 20 bp, mouse
gaagttctacggctgcgggg

SEQ ID NO: 805345 - DNA, 20 bp, mouse
gtggctcaggcttccggaaa

SEQ ID NO: 805346 - DNA, 20 bp, mouse
gtagccttccctgtcctatt

SEQ ID NO: 805347 - DNA, 20 bp, mouse
gtagggccgggcaagatccc

SEQ ID NO: 805348 - DNA, 20 bp, mouse
gcaccacgtgtcctggaact

SEQ ID NO: 805349 - DNA, 20 bp, mouse
gggcgggcctagggctgaga

SEQ ID NO: 805350 - DNA, 20 bp, mouse
gtctacttcccaataggaca

SEQ ID NO: 805351 - DNA, 20 bp, mouse
gaacccagttccaggacacg

SEQ ID NO: 805352 - DNA, 20 bp, mouse
gacagggaaggctaaatctt

SEQ ID NO: 805353 - DNA, 20 bp, mouse
gtccaggacacgtggtgcac

SEQ ID NO: 805354 - DNA, 20 bp, mouse
gcgtcgtcgtggaaacgcag

SEQ ID NO: 805355 - DNA, 20 bp, mouse
ggggcaagatcccgggaggc

SEQ ID NO: 805356 - DNA, 20 bp, mouse
gtgcaagacagcgtggggta

SEQ ID NO: 805357 - DNA, 20 bp, mouse
ggaggcagtaggaggtcgga

SEQ ID NO: 805358 - DNA, 20 bp, mouse
gggcgagctagagaggcagt

SEQ ID NO: 805359 - DNA, 20 bp, mouse
ggcgcctgcggcccgagtcc

SEQ ID NO: 805360 - DNA, 20 bp, mouse
gtgcctctctagctcgccag

SEQ ID NO: 805361 - DNA, 20 bp, mouse
gggcccgccccggccagctc

SEQ ID NO: 805362 - DNA, 20 bp, mouse
gagccgctggcgagctagag

SEQ ID NO: 805363 - DNA, 20 bp, mouse
gcgccagcggctacgctcta

SEQ ID NO: 805364 - DNA, 20 bp, mouse
gcagtaggaggtcggaaggg

SEQ ID NO: 805365 - DNA, 20 bp, mouse
gggtccttgcccggcggccc

SEQ ID NO: 805366 - DNA, 20 bp, mouse
gaaggcgtgtccagctgcgt

SEQ ID NO: 805367 - DNA, 20 bp, mouse
gaacgcctgactagcaggga

SEQ ID NO: 805368 - DNA, 20 bp, mouse
ggcgccgtgggaacctatca

SEQ ID NO: 805369 - DNA, 20 bp, mouse
gcgtggcaggatcttctcaa

SEQ ID NO: 805370 - DNA, 20 bp, mouse
gaggggccagtcagtccgag

SEQ ID NO: 805371 - DNA, 20 bp, mouse
gcaagggcccaatggagctg

SEQ ID NO: 805372 - DNA, 20 bp, mouse
gcggtccaatagacgtttgg

SEQ ID NO: 805373 - DNA, 20 bp, mouse
ggagacttgcttcctactcc

SEQ ID NO: 805374 - DNA, 20 bp, mouse
gaggtggagccagaggtgcg

SEQ ID NO: 805375 - DNA, 20 bp, mouse
gcaagagctcctataggctc

SEQ ID NO: 805376 - DNA, 20 bp, mouse
gtaggcggggaggtaaagac

SEQ ID NO: 805377 - DNA, 20 bp, mouse
ggggaggtaaagaccggcag

SEQ ID NO: 805378 - DNA, 20 bp, mouse
ggcggcattggacagcagat

SEQ ID NO: 805379 - DNA, 20 bp, mouse
gcgccagtcgggccaacatc

SEQ ID NO: 805380 - DNA, 20 bp, mouse
gaggtagtgcagtaggacgc

SEQ ID NO: 805381 - DNA, 20 bp, mouse
gggacagcagatgggcttag

SEQ ID NO: 805382 - DNA, 20 bp, mouse
ggggaaacgtagtcccaacc

SEQ ID NO: 805383 - DNA, 20 bp, mouse
gttggcccgactggcgctga

SEQ ID NO: 805384 - DNA, 20 bp, mouse
gcgggacttggattcgtcac

SEQ ID NO: 805385 - DNA, 20 bp, mouse
gggctcacagctaggcgggg

SEQ ID NO: 805386 - DNA, 20 bp, mouse
gtaactgtaaggcgagtaat

SEQ ID NO: 805387 - DNA, 20 bp, mouse
gatgtggcttaattggatgg

SEQ ID NO: 805388 - DNA, 20 bp, mouse
gtgcctcaacaagcagtctg

SEQ ID NO: 805389 - DNA, 20 bp, mouse
gtcaacatgacaagttcttc

SEQ ID NO: 805390 - DNA, 20 bp, mouse
gactccctaggaaatgatgt

SEQ ID NO: 805391 - DNA, 20 bp, mouse
gaaagtagagttggaagatg

SEQ ID NO: 805392 - DNA, 20 bp, mouse
ggttgaggcaggggactatg

SEQ ID NO: 805393 - DNA, 20 bp, mouse
gggggactatgtggcttaat

SEQ ID NO: 805394 - DNA, 20 bp, mouse
gaggtattgttgacataggt

SEQ ID NO: 805395 - DNA, 20 bp, mouse
gtaggttggtttagcaaggg

SEQ ID NO: 805396 - DNA, 20 bp, mouse
ggccctggcggaagtcagag

SEQ ID NO: 805397 - DNA, 20 bp, mouse
gcccagcaggggtgtacccg

SEQ ID NO: 805398 - DNA, 20 bp, mouse
gcgcaaggcggcagaaagga

SEQ ID NO: 805399 - DNA, 20 bp, mouse
gtgccggtccggaccccgga

SEQ ID NO: 805400 - DNA, 20 bp, mouse
gaggtggcgccgcagacacg

SEQ ID NO: 805401 - DNA, 20 bp, mouse
gtgtgtccttgagaacgaat

SEQ ID NO: 805402 - DNA, 20 bp, mouse
ggcggggcattctgcgtcct

SEQ ID NO: 805403 - DNA, 20 bp, mouse
gcggaccccggagggaacca

SEQ ID NO: 805404 - DNA, 20 bp, mouse
gtccttggcaaaagatagac

SEQ ID NO: 805405 - DNA, 20 bp, mouse
gttccctccggggtccggac

SEQ ID NO: 805406 - DNA, 20 bp, mouse
gccaaggaaaggcagtgagt

SEQ ID NO: 805407 - DNA, 20 bp, mouse
ggcgtcctaaggttcagtct

SEQ ID NO: 805408 - DNA, 20 bp, mouse
gagttggcctgcgcgtccta

SEQ ID NO: 805409 - DNA, 20 bp, mouse
gactgaaccttaggacgcgc

SEQ ID NO: 805410 - DNA, 20 bp, mouse
gagagccaagactgaacctt

SEQ ID NO: 805411 - DNA, 20 bp, mouse
gacagtgatcaaatgcttgg

SEQ ID NO: 805412 - DNA, 20 bp, mouse
gtgatcactgtgtcacaagg

SEQ ID NO: 805413 - DNA, 20 bp, mouse
ggatgtttacaggggttata

SEQ ID NO: 805414 - DNA, 20 bp, mouse
gctctgtttaactgagtcaa

SEQ ID NO: 805415 - DNA, 20 bp, mouse
gatcaggacagatgtttaca

SEQ ID NO: 805416 - DNA, 20 bp, mouse
gagaacgaccgatcagtgga

SEQ ID NO: 805417 - DNA, 20 bp, mouse
gacgaccgatcagtggaggg

SEQ ID NO: 805418 - DNA, 20 bp, mouse
ggaggtctgcggagaggtgt

SEQ ID NO: 805419 - DNA, 20 bp, mouse
ggctcggttggcgaggtctg

SEQ ID NO: 805420 - DNA, 20 bp, mouse
ggggagggggaagaacgcga

SEQ ID NO: 805421 - DNA, 20 bp, mouse
ggacctgaacatgccggaaa

SEQ ID NO: 805422 - DNA, 20 bp, mouse
ggcaaggccttgcgcgtcca

SEQ ID NO: 805423 - DNA, 20 bp, mouse
gaatagaagctcggttggcg

SEQ ID NO: 805424 - DNA, 20 bp, mouse
gtacgagaacgaccgatcag

SEQ ID NO: 805425 - DNA, 20 bp, mouse
gtccactcagagagcaaagt

SEQ ID NO: 805426 - DNA, 20 bp, mouse
ggacagaagccgtcggggtg

SEQ ID NO: 805427 - DNA, 20 bp, mouse
gatggagagctcgctgagaa

SEQ ID NO: 805428 - DNA, 20 bp, mouse
gcccccgctccggggagcgg

SEQ ID NO: 805429 - DNA, 20 bp, mouse
gtccaggccgagctcccatt

SEQ ID NO: 805430 - DNA, 20 bp, mouse
gctcggtgaccccaccccga

SEQ ID NO: 805431 - DNA, 20 bp, mouse
ggagagctcgctgagaaggg

SEQ ID NO: 805432 - DNA, 20 bp, mouse
gacgcggacagaagccgtcg

SEQ ID NO: 805433 - DNA, 20 bp, mouse
gcaccgagcggaccttcatt

SEQ ID NO: 805434 - DNA, 20 bp, mouse
gggggctcccgagcgacggt

SEQ ID NO: 805435 - DNA, 20 bp, mouse
ggatctcccgaccgtcgctc

SEQ ID NO: 805436 - DNA, 20 bp, mouse
gtgtccagcatctgacccaa

SEQ ID NO: 805437 - DNA, 20 bp, mouse
gtgggtggcctacgatgcag

SEQ ID NO: 805438 - DNA, 20 bp, mouse
gctgaaagctgagggagcat

SEQ ID NO: 805439 - DNA, 20 bp, mouse
gaggcggctacattctgaaa

SEQ ID NO: 805440 - DNA, 20 bp, mouse
ggtagcaaagcatcctagac

SEQ ID NO: 805441 - DNA, 20 bp, mouse
gatcgtaggccacccagtct

SEQ ID NO: 805442 - DNA, 20 bp, mouse
gaaactaacctctgcatcgt

SEQ ID NO: 805443 - DNA, 20 bp, mouse
ggtgtctgttttggtttctc

SEQ ID NO: 805444 - DNA, 20 bp, mouse
gaatggtgtcttactcattc

SEQ ID NO: 805445 - DNA, 20 bp, mouse
gtatgacatcagttccgagg

SEQ ID NO: 805446 - DNA, 20 bp, mouse
gcgtgcacttcacaatggat

SEQ ID NO: 805447 - DNA, 20 bp, mouse
gaagctgagaggcgcctgcc

SEQ ID NO: 805448 - DNA, 20 bp, mouse
gagcactggggttacagcat

SEQ ID NO: 805449 - DNA, 20 bp, mouse
gtctcactgcacagcagagc

SEQ ID NO: 805450 - DNA, 20 bp, mouse
gattagcgtgcacttcacaa

SEQ ID NO: 805451 - DNA, 20 bp, mouse
gcagaaataaagtgactgct

SEQ ID NO: 805452 - DNA, 20 bp, mouse
gtacagagtgagaacctatt

SEQ ID NO: 805453 - DNA, 20 bp, mouse
gcttaggaggctgacgcaca

SEQ ID NO: 805454 - DNA, 20 bp, mouse
gaaggattgctgataattaa

SEQ ID NO: 805455 - DNA, 20 bp, mouse
gtggctttactatagtgagt

SEQ ID NO: 805456 - DNA, 20 bp, mouse
ggaagagggcggaaagtgaa

SEQ ID NO: 805457 - DNA, 20 bp, mouse
gaagcggggcggagaggttg

SEQ ID NO: 805458 - DNA, 20 bp, mouse
gggagccttgaagtcgtaga

SEQ ID NO: 805459 - DNA, 20 bp, mouse
gggcagtagcgaccccgaag

SEQ ID NO: 805460 - DNA, 20 bp, mouse
gcctggtggctgaaccgctg

SEQ ID NO: 805461 - DNA, 20 bp, mouse
gctactgcctcgtgtgacag

SEQ ID NO: 805462 - DNA, 20 bp, mouse
gcgatcccacaataccacgc

SEQ ID NO: 805463 - DNA, 20 bp, mouse
gcgggccggcgtggtattgt

SEQ ID NO: 805464 - DNA, 20 bp, mouse
gccggctgaaggcgaattcc

SEQ ID NO: 805465 - DNA, 20 bp, mouse
gtcgagaactgagttagatc

SEQ ID NO: 805466 - DNA, 20 bp, mouse
gaggcggggctcctgaattc

SEQ ID NO: 805467 - DNA, 20 bp, mouse
gggagatgatcatgtttgat

SEQ ID NO: 805468 - DNA, 20 bp, mouse
ggtagaaaaggaaacttaag

SEQ ID NO: 805469 - DNA, 20 bp, mouse
gcggggctcctgaattccgg

SEQ ID NO: 805470 - DNA, 20 bp, mouse
gtgatgaagcctcctttctg

SEQ ID NO: 805471 - DNA, 20 bp, mouse
gggtctttgtaggttttgca

SEQ ID NO: 805472 - DNA, 20 bp, mouse
gggaaaatatgagctcacat

SEQ ID NO: 805473 - DNA, 20 bp, mouse
gaattccggcgggtctttgt

SEQ ID NO: 805474 - DNA, 20 bp, mouse
gatcatctcccccagaaagg

SEQ ID NO: 805475 - DNA, 20 bp, mouse
gagcagagcctgcttccgtc

SEQ ID NO: 805476 - DNA, 20 bp, mouse
ggatgggaacacacagttga

SEQ ID NO: 805477 - DNA, 20 bp, mouse
ggtgggtgaagtctactgtt

SEQ ID NO: 805478 - DNA, 20 bp, mouse
gaagctgtgggtaatgagat

SEQ ID NO: 805479 - DNA, 20 bp, mouse
gcacagcttttctgcagata

SEQ ID NO: 805480 - DNA, 20 bp, mouse
gtggacttgggatacaaagc

SEQ ID NO: 805481 - DNA, 20 bp, mouse
gtactcgtgcgtctttctta

SEQ ID NO: 805482 - DNA, 20 bp, mouse
gtacagacctgaactcagaa

SEQ ID NO: 805483 - DNA, 20 bp, mouse
gagcatagtcaggaacgcca

SEQ ID NO: 805484 - DNA, 20 bp, mouse
gttactacttcctggccggg

SEQ ID NO: 805485 - DNA, 20 bp, mouse
gcgtgcgtctttcttaaggt

SEQ ID NO: 805486 - DNA, 20 bp, mouse
gctgccgctagaataactct

SEQ ID NO: 805487 - DNA, 20 bp, mouse
gaggagcgacagggtttttc

SEQ ID NO: 805488 - DNA, 20 bp, mouse
ggaggcgcgaaattagatgt

SEQ ID NO: 805489 - DNA, 20 bp, mouse
gcagccttagaaagagtcgg

SEQ ID NO: 805490 - DNA, 20 bp, mouse
gcagcccggaggcccggaac

SEQ ID NO: 805491 - DNA, 20 bp, mouse
gatgttgggcccgccctctt

SEQ ID NO: 805492 - DNA, 20 bp, mouse
gacagcacgggattgaagag

SEQ ID NO: 805493 - DNA, 20 bp, mouse
ggtgcccagagttattctag

SEQ ID NO: 805494 - DNA, 20 bp, mouse
gtagaaagagtcggaggcaa

SEQ ID NO: 805495 - DNA, 20 bp, mouse
ggcagtcagtaacactgcga

SEQ ID NO: 805496 - DNA, 20 bp, mouse
ggcgtcccgcgcagacgcag

SEQ ID NO: 805497 - DNA, 20 bp, mouse
gagaggctatagactgcatc

SEQ ID NO: 805498 - DNA, 20 bp, mouse
gatagcctctgcgtctgcgc

SEQ ID NO: 805499 - DNA, 20 bp, mouse
gcgggcacgctcccccacac

SEQ ID NO: 805500 - DNA, 20 bp, mouse
gaagcaccgcaatagcgcta

SEQ ID NO: 805501 - DNA, 20 bp, mouse
gccctgacccgacccggaaa

SEQ ID NO: 805502 - DNA, 20 bp, mouse
gtgcgcacacgcgggtcagg

SEQ ID NO: 805503 - DNA, 20 bp, mouse
gggcgctttggaatttttcc

SEQ ID NO: 805504 - DNA, 20 bp, mouse
gatctgggagtttgactttt

SEQ ID NO: 805505 - DNA, 20 bp, mouse
gccaaagtctgctttactcc

SEQ ID NO: 805506 - DNA, 20 bp, mouse
gatggctaccacctactaag

SEQ ID NO: 805507 - DNA, 20 bp, mouse
gtctgctgcttcctctaaga

SEQ ID NO: 805508 - DNA, 20 bp, mouse
gtatgagtctcagcttgggg

SEQ ID NO: 805509 - DNA, 20 bp, mouse
gctggctagcccacctagtg

SEQ ID NO: 805510 - DNA, 20 bp, mouse
gtaggtggtagccatcttag

SEQ ID NO: 805511 - DNA, 20 bp, mouse
gtgcttatgagtctcagctt

SEQ ID NO: 805512 - DNA, 20 bp, mouse
gaggatcttgttgctgtgtc

SEQ ID NO: 805513 - DNA, 20 bp, mouse
ggggtctgctcaaggctcgg

SEQ ID NO: 805514 - DNA, 20 bp, mouse
gtccgggatgggtaagacag

SEQ ID NO: 805515 - DNA, 20 bp, mouse
gaaagctgtgttgtatggga

SEQ ID NO: 805516 - DNA, 20 bp, mouse
gaatcgccgcccaggacgag

SEQ ID NO: 805517 - DNA, 20 bp, mouse
gctaacatgggcagtgtcac

SEQ ID NO: 805518 - DNA, 20 bp, mouse
gagacctggcctcctaacat

SEQ ID NO: 805519 - DNA, 20 bp, mouse
gttaggaggccaggtctgcg

SEQ ID NO: 805520 - DNA, 20 bp, mouse
gagtgtcctagcaactggaa

SEQ ID NO: 805521 - DNA, 20 bp, mouse
gcccaccccctcgtcctggg

SEQ ID NO: 805522 - DNA, 20 bp, mouse
gctgaaagagtggcggaaaa

SEQ ID NO: 805523 - DNA, 20 bp, mouse
gacggctgcaaaagaagcgt

SEQ ID NO: 805524 - DNA, 20 bp, mouse
gggctctccgcctgaaagag

SEQ ID NO: 805525 - DNA, 20 bp, mouse
gtctccgcctgaaagagtgg

SEQ ID NO: 805526 - DNA, 20 bp, mouse
gccattactcgggcttcagt

SEQ ID NO: 805527 - DNA, 20 bp, mouse
ggtcgtacatgccattactc

SEQ ID NO: 805528 - DNA, 20 bp, mouse
gataatgttctaatgtccca

SEQ ID NO: 805529 - DNA, 20 bp, mouse
gagtctgccaaagaaatcat

SEQ ID NO: 805530 - DNA, 20 bp, mouse
gtctgggtatgtgtataccc

SEQ ID NO: 805531 - DNA, 20 bp, mouse
gaattagccaatgatttctt

SEQ ID NO: 805532 - DNA, 20 bp, mouse
gaaaacgatctgtgcaacat

SEQ ID NO: 805533 - DNA, 20 bp, mouse
gggaactcataaaattacgt

SEQ ID NO: 805534 - DNA, 20 bp, mouse
gacccagtctttattttttc

SEQ ID NO: 805535 - DNA, 20 bp, mouse
gccaggatacagattatgaa

SEQ ID NO: 805536 - DNA, 20 bp, mouse
gaccaagagcaacgcgtttt

SEQ ID NO: 805537 - DNA, 20 bp, mouse
ggttgctcttggtcgcctgc

SEQ ID NO: 805538 - DNA, 20 bp, mouse
gtcctaaaacgcgttgctct

SEQ ID NO: 805539 - DNA, 20 bp, mouse
gagaagagcgattaaagcca

SEQ ID NO: 805540 - DNA, 20 bp, mouse
ggagcgattaaagccaaggt

SEQ ID NO: 805541 - DNA, 20 bp, mouse
gggtgactgtctgctttaaa

SEQ ID NO: 805542 - DNA, 20 bp, mouse
gaagtatactaaaaagtgtg

SEQ ID NO: 805543 - DNA, 20 bp, mouse
gttttagtatacttatagaa

SEQ ID NO: 805544 - DNA, 20 bp, mouse
gttacgcgctggggcacagg

SEQ ID NO: 805545 - DNA, 20 bp, mouse
ggcatcccttgtgattatgt

SEQ ID NO: 805546 - DNA, 20 bp, mouse
gcccaagagcgaagcgtttt

SEQ ID NO: 805547 - DNA, 20 bp, mouse
gttcgctcttgggcgcctgc

SEQ ID NO: 805548 - DNA, 20 bp, mouse
gtcctaaaacgcttcgctct

SEQ ID NO: 805549 - DNA, 20 bp, mouse
gagaagagcgcttaaagcct

SEQ ID NO: 805550 - DNA, 20 bp, mouse
ggagcgcttaaagcctaggc

SEQ ID NO: 805551 - DNA, 20 bp, mouse
ggtaggttgttgatcaagca

SEQ ID NO: 805552 - DNA, 20 bp, mouse
gaagtatactaaaaagtgtg

SEQ ID NO: 805553 - DNA, 20 bp, mouse
gttttagtatacttatagaa

SEQ ID NO: 805554 - DNA, 20 bp, mouse
ggccgccaccaacatctggg

SEQ ID NO: 805555 - DNA, 20 bp, mouse
gggccagctgggtttcccga

SEQ ID NO: 805556 - DNA, 20 bp, mouse
gcgaaaggtagggttcggat

SEQ ID NO: 805557 - DNA, 20 bp, mouse
gacctgcaagatgagagcaa

SEQ ID NO: 805558 - DNA, 20 bp, mouse
gtgcaagatgagagcaaagg

SEQ ID NO: 805559 - DNA, 20 bp, mouse
gtggaactgtgatccggtgt

SEQ ID NO: 805560 - DNA, 20 bp, mouse
gtgccagcctggggttgcta

SEQ ID NO: 805561 - DNA, 20 bp, mouse
gacaaacaaaacgaaaggta

SEQ ID NO: 805562 - DNA, 20 bp, mouse
gctccatagcaaccccaggc

SEQ ID NO: 805563 - DNA, 20 bp, mouse
gcaaaggtggaactgtgatc

SEQ ID NO: 805564 - DNA, 20 bp, mouse
gtatataaagtgtggctcag

SEQ ID NO: 805565 - DNA, 20 bp, mouse
gttgctaggattttagggag

SEQ ID NO: 805566 - DNA, 20 bp, mouse
gacagctgcgggagtttggg

SEQ ID NO: 805567 - DNA, 20 bp, mouse
ggcgccctcagggtgagaaa

SEQ ID NO: 805568 - DNA, 20 bp, mouse
gctgacagctgcgggagttt

SEQ ID NO: 805569 - DNA, 20 bp, mouse
gctaacacaggcacatcctc

SEQ ID NO: 805570 - DNA, 20 bp, mouse
gcgcaggcgcagtctaacac

SEQ ID NO: 805571 - DNA, 20 bp, mouse
ggcagtcgggtcgagctcca

SEQ ID NO: 805572 - DNA, 20 bp, mouse
gcagggaacccgagagcaag

SEQ ID NO: 805573 - DNA, 20 bp, mouse
gtgctgctgcctcctggtgg

SEQ ID NO: 805574 - DNA, 20 bp, mouse
gcctgggaatgggtctgagt

SEQ ID NO: 805575 - DNA, 20 bp, mouse
gaggggcccctgcctaaggt

SEQ ID NO: 805576 - DNA, 20 bp, mouse
gaatgtggagtgcacatata

SEQ ID NO: 805577 - DNA, 20 bp, mouse
gagtccgtggcccccggaaa

SEQ ID NO: 805578 - DNA, 20 bp, mouse
gccaaacccgccctttccgg

SEQ ID NO: 805579 - DNA, 20 bp, mouse
ggccaagaagtgatattccc

SEQ ID NO: 805580 - DNA, 20 bp, mouse
gaaaaatggagtacgtaatg

SEQ ID NO: 805581 - DNA, 20 bp, mouse
gtggccttgtggctttgtat

SEQ ID NO: 805582 - DNA, 20 bp, mouse
gcgtggcccccggaaagggc

SEQ ID NO: 805583 - DNA, 20 bp, mouse
gtaaagggtgacagtttccc

SEQ ID NO: 805584 - DNA, 20 bp, mouse
gcatatagggaagccgcgct

SEQ ID NO: 805585 - DNA, 20 bp, mouse
gaatacagctagtggccttg

SEQ ID NO: 805586 - DNA, 20 bp, mouse
gcgggtgcgggtcggagaaa

SEQ ID NO: 805587 - DNA, 20 bp, mouse
gaacccaagaaaagcgggtg

SEQ ID NO: 805588 - DNA, 20 bp, mouse
gcgtccctagtcctggtgtg

SEQ ID NO: 805589 - DNA, 20 bp, mouse
gctcccgcacaccaggacta

SEQ ID NO: 805590 - DNA, 20 bp, mouse
gacccgcacccgcttttctt

SEQ ID NO: 805591 - DNA, 20 bp, mouse
gccccggctcgcacgaggga

SEQ ID NO: 805592 - DNA, 20 bp, mouse
gggacccaggatgcttgcta

SEQ ID NO: 805593 - DNA, 20 bp, mouse
ggacggcgcgtccctagtcc

SEQ ID NO: 805594 - DNA, 20 bp, mouse
ggctcctaacccaagaaaag

SEQ ID NO: 805595 - DNA, 20 bp, mouse
gaaaaaacggactggagcgc

SEQ ID NO: 805596 - DNA, 20 bp, mouse
gaggtcctaaagagtactga

SEQ ID NO: 805597 - DNA, 20 bp, mouse
ggttcccgagaggacacctt

SEQ ID NO: 805598 - DNA, 20 bp, mouse
gctaaactgaagagcaccta

SEQ ID NO: 805599 - DNA, 20 bp, mouse
gacacccaaggtgtcctctc

SEQ ID NO: 805600 - DNA, 20 bp, mouse
gaggccatatcgctcaccct

SEQ ID NO: 805601 - DNA, 20 bp, mouse
gaaacgctcgggtttccctg

SEQ ID NO: 805602 - DNA, 20 bp, mouse
ggcacctagggtgagcgata

SEQ ID NO: 805603 - DNA, 20 bp, mouse
gaggctgcctcagagttcct

SEQ ID NO: 805604 - DNA, 20 bp, mouse
gaaaggctaattggtgaggt

SEQ ID NO: 805605 - DNA, 20 bp, mouse
gcactcaggaggaaagtaga

SEQ ID NO: 805606 - DNA, 20 bp, mouse
gcacagacccgggacccctt

SEQ ID NO: 805607 - DNA, 20 bp, mouse
gacggggaggagcaacaacc

SEQ ID NO: 805608 - DNA, 20 bp, mouse
ggatgctccgccacagaccc

SEQ ID NO: 805609 - DNA, 20 bp, mouse
gggcggggggagctcgggga

SEQ ID NO: 805610 - DNA, 20 bp, mouse
gcgggctaggagcaccccat

SEQ ID NO: 805611 - DNA, 20 bp, mouse
gtgggcgcactggggtttgg

SEQ ID NO: 805612 - DNA, 20 bp, mouse
gaagtacaggcgttgcgatt

SEQ ID NO: 805613 - DNA, 20 bp, mouse
gcggcaaggtgggcgcactg

SEQ ID NO: 805614 - DNA, 20 bp, mouse
ggggagggacaatttgaacc

SEQ ID NO: 805615 - DNA, 20 bp, mouse
gggacgggaagaggcgccta

SEQ ID NO: 805616 - DNA, 20 bp, mouse
gccggcctgtgcacgtgcga

SEQ ID NO: 805617 - DNA, 20 bp, mouse
gtgcacgtgcgaggggcgtg

SEQ ID NO: 805618 - DNA, 20 bp, mouse
ggggcggcgcttaaccctcg

SEQ ID NO: 805619 - DNA, 20 bp, mouse
ggcagagggagggtctgtcc

SEQ ID NO: 805620 - DNA, 20 bp, mouse
ggaacccaagctagccaggt

SEQ ID NO: 805621 - DNA, 20 bp, mouse
gacaagccaggacggtcctg

SEQ ID NO: 805622 - DNA, 20 bp, mouse
gactgcctcacctccaacac

SEQ ID NO: 805623 - DNA, 20 bp, mouse
ggccgcactgcacactcacc

SEQ ID NO: 805624 - DNA, 20 bp, mouse
gaaccctcggggggcccttg

SEQ ID NO: 805625 - DNA, 20 bp, mouse
ggacactgggtcaaagagta

SEQ ID NO: 805626 - DNA, 20 bp, mouse
gaggaaggggcgtttcctag

SEQ ID NO: 805627 - DNA, 20 bp, mouse
gtccacgaggcgctcgggga

SEQ ID NO: 805628 - DNA, 20 bp, mouse
gcttcggcaaggggattagc

SEQ ID NO: 805629 - DNA, 20 bp, mouse
ggagggagagagctgttgat

SEQ ID NO: 805630 - DNA, 20 bp, mouse
gggattagctggttcattcc

SEQ ID NO: 805631 - DNA, 20 bp, mouse
gagggcttgccactgaggaa

SEQ ID NO: 805632 - DNA, 20 bp, mouse
gggcccgggcggtgtgaagc

SEQ ID NO: 805633 - DNA, 20 bp, mouse
gcgtatggagcgatctgatt

SEQ ID NO: 805634 - DNA, 20 bp, mouse
gggaaacgccccttcctcag

SEQ ID NO: 805635 - DNA, 20 bp, mouse
ggaagccccgaagggtcaaa

SEQ ID NO: 805636 - DNA, 20 bp, mouse
gctgtcgagtgcgtcgatgc

SEQ ID NO: 805637 - DNA, 20 bp, mouse
gtctccaaaagcaataaagg

SEQ ID NO: 805638 - DNA, 20 bp, mouse
gagcaataaaggtggtacta

SEQ ID NO: 805639 - DNA, 20 bp, mouse
gacgataacggcgaatacta

SEQ ID NO: 805640 - DNA, 20 bp, mouse
ggtaccacctttattgcttt

SEQ ID NO: 805641 - DNA, 20 bp, mouse
gcatccgcgtagagcaaaat

SEQ ID NO: 805642 - DNA, 20 bp, mouse
gaggaagaaatctgcccgat

SEQ ID NO: 805643 - DNA, 20 bp, mouse
gaaatctgcccgataggaga

SEQ ID NO: 805644 - DNA, 20 bp, mouse
gggttagttcctgttgagcg

SEQ ID NO: 805645 - DNA, 20 bp, mouse
ggctgcctggtgctggaacc

SEQ ID NO: 805646 - DNA, 20 bp, mouse
ggaagcctacgaagtgggtg

SEQ ID NO: 805647 - DNA, 20 bp, mouse
gggcgtgaagcctacgaagt

SEQ ID NO: 805648 - DNA, 20 bp, mouse
gttggccccacccacttcgt

SEQ ID NO: 805649 - DNA, 20 bp, mouse
gaccgagcatccattctggg

SEQ ID NO: 805650 - DNA, 20 bp, mouse
ggattggttagtctctcgaa

SEQ ID NO: 805651 - DNA, 20 bp, mouse
gaaggtaaaatgagtagggg

SEQ ID NO: 805652 - DNA, 20 bp, mouse
ggggaattcaatttagttta

SEQ ID NO: 805653 - DNA, 20 bp, mouse
gagaatggatgctcggtatc

SEQ ID NO: 805654 - DNA, 20 bp, mouse
gccaaggatacctcccagaa

SEQ ID NO: 805655 - DNA, 20 bp, mouse
gtgctgggagaaaaagtggg

SEQ ID NO: 805656 - DNA, 20 bp, mouse
gagactaaaacgtgtacgat

SEQ ID NO: 805657 - DNA, 20 bp, mouse
ggaagcaggggattctaagc

SEQ ID NO: 805658 - DNA, 20 bp, mouse
ggggaagtgtcaggccggga

SEQ ID NO: 805659 - DNA, 20 bp, mouse
gctgaaggacaaagttctgt

SEQ ID NO: 805660 - DNA, 20 bp, mouse
gggcgttcctcagcgtaggg

SEQ ID NO: 805661 - DNA, 20 bp, mouse
gcgcaggcgcacacaaaatc

SEQ ID NO: 805662 - DNA, 20 bp, mouse
gctctgcccactgaagaaag

SEQ ID NO: 805663 - DNA, 20 bp, mouse
gcctgcgcgatcgctgggac

SEQ ID NO: 805664 - DNA, 20 bp, mouse
gaagaaagtggaccccgagg

SEQ ID NO: 805665 - DNA, 20 bp, mouse
gcagacctggtggaggtatg

SEQ ID NO: 805666 - DNA, 20 bp, mouse
gccctaaaacaggtgtactt

SEQ ID NO: 805667 - DNA, 20 bp, mouse
gaaacaggtgtacttgggac

SEQ ID NO: 805668 - DNA, 20 bp, mouse
gctgtgtctcttctgtgttg

SEQ ID NO: 805669 - DNA, 20 bp, mouse
gttgtggagaggacgtttct

SEQ ID NO: 805670 - DNA, 20 bp, mouse
gacctgttttagggttgtgg

SEQ ID NO: 805671 - DNA, 20 bp, mouse
gtgttttagggttgtggagg

SEQ ID NO: 805672 - DNA, 20 bp, mouse
gatactctgtactgcgttct

SEQ ID NO: 805673 - DNA, 20 bp, mouse
gatgctaaacttgagattta

SEQ ID NO: 805674 - DNA, 20 bp, mouse
gggtgatgcacttgtataca

SEQ ID NO: 805675 - DNA, 20 bp, mouse
gtcacagaattaacacaaga

SEQ ID NO: 805676 - DNA, 20 bp, mouse
ggaggggatgcaagacttga

SEQ ID NO: 805677 - DNA, 20 bp, mouse
ggagatctaagggtgccctg

SEQ ID NO: 805678 - DNA, 20 bp, mouse
gttgaggggctctgccctgt

SEQ ID NO: 805679 - DNA, 20 bp, mouse
gtagctggtagctggggagg

SEQ ID NO: 805680 - DNA, 20 bp, mouse
gaggggctctgccctgtggg

SEQ ID NO: 805681 - DNA, 20 bp, mouse
gctccttaatcctgatcatg

SEQ ID NO: 805682 - DNA, 20 bp, mouse
gagcgattagctggtagctg

SEQ ID NO: 805683 - DNA, 20 bp, mouse
gtggggggatagtctttcca

SEQ ID NO: 805684 - DNA, 20 bp, mouse
gtcagcagagtgattactgg

SEQ ID NO: 805685 - DNA, 20 bp, mouse
gggaaattgtctccacccca

SEQ ID NO: 805686 - DNA, 20 bp, mouse
ggaactgggctggccacaag

SEQ ID NO: 805687 - DNA, 20 bp, mouse
gctccacccagcgctcagag

SEQ ID NO: 805688 - DNA, 20 bp, mouse
gactgtgtacccaaactagc

SEQ ID NO: 805689 - DNA, 20 bp, mouse
ggcagtgcttacacatgatt

SEQ ID NO: 805690 - DNA, 20 bp, mouse
gggcctctctgagcgctggg

SEQ ID NO: 805691 - DNA, 20 bp, mouse
gaactagcagggaactgggc

SEQ ID NO: 805692 - DNA, 20 bp, mouse
ggcgcggcctctctgagcgc

SEQ ID NO: 805693 - DNA, 20 bp, mouse
gggcccggaagcgcactatc

SEQ ID NO: 805694 - DNA, 20 bp, mouse
gcccaaactagcagggaact

SEQ ID NO: 805695 - DNA, 20 bp, mouse
ggaagaatgtacctgttggg

SEQ ID NO: 805696 - DNA, 20 bp, mouse
ggcgtggagcgggtggactg

SEQ ID NO: 805697 - DNA, 20 bp, mouse
gaggcggcgctgcgtggagc

SEQ ID NO: 805698 - DNA, 20 bp, mouse
ggaccagctccgctccagga

SEQ ID NO: 805699 - DNA, 20 bp, mouse
ggcgcctgcgccctgagagg

SEQ ID NO: 805700 - DNA, 20 bp, mouse
gccacgcagcgccgcctctc

SEQ ID NO: 805701 - DNA, 20 bp, mouse
ggtcgcgcctgcgccctgag

SEQ ID NO: 805702 - DNA, 20 bp, mouse
ggggaagatggcaagcgccg

SEQ ID NO: 805703 - DNA, 20 bp, mouse
gcggcgctgcgtggagcggg

SEQ ID NO: 805704 - DNA, 20 bp, mouse
gttccctcctggagcggagc

SEQ ID NO: 805705 - DNA, 20 bp, mouse
ggccatcttccctcctggag

SEQ ID NO: 805706 - DNA, 20 bp, mouse
gcgcaggcgcaaaaagacta

SEQ ID NO: 805707 - DNA, 20 bp, mouse
gctctggggagccaaggcgc

SEQ ID NO: 805708 - DNA, 20 bp, mouse
ggggagccaaaggagatgtt

SEQ ID NO: 805709 - DNA, 20 bp, mouse
ggcttctcggtcaatactct

SEQ ID NO: 805710 - DNA, 20 bp, mouse
gtcagccagtatgtactggg

SEQ ID NO: 805711 - DNA, 20 bp, mouse
ggatcagcttgcagaaatat

SEQ ID NO: 805712 - DNA, 20 bp, mouse
gagtaactttatacagttca

SEQ ID NO: 805713 - DNA, 20 bp, mouse
gccctgaccgggcagttctg

SEQ ID NO: 805714 - DNA, 20 bp, mouse
ggggtcaggtctacgtgact

SEQ ID NO: 805715 - DNA, 20 bp, mouse
gcaggaaatctgtaccacta

SEQ ID NO: 805716 - DNA, 20 bp, mouse
gccctggcgtccagaggcga

SEQ ID NO: 805717 - DNA, 20 bp, mouse
gcgggtgcaaagtagcggac

SEQ ID NO: 805718 - DNA, 20 bp, mouse
ggcaaagtagcggaccggaa

SEQ ID NO: 805719 - DNA, 20 bp, mouse
gccgctgattggaacttcgc

SEQ ID NO: 805720 - DNA, 20 bp, mouse
gcggaccggaagggaggaaa

SEQ ID NO: 805721 - DNA, 20 bp, mouse
gccgcccgggtgcaaagtag

SEQ ID NO: 805722 - DNA, 20 bp, mouse
gaaagtggggatgagtgtcc

SEQ ID NO: 805723 - DNA, 20 bp, mouse
ggaagtgtagcatttaggcg

SEQ ID NO: 805724 - DNA, 20 bp, mouse
gcagcaggttccctcgcctc

SEQ ID NO: 805725 - DNA, 20 bp, mouse
ggggcttcgtgcagtggacc

SEQ ID NO: 805726 - DNA, 20 bp, mouse
gcagctagatcagggagcgt

SEQ ID NO: 805727 - DNA, 20 bp, mouse
ggcccctcgcgctgcgtcgg

SEQ ID NO: 805728 - DNA, 20 bp, mouse
gcttccggacagctagatca

SEQ ID NO: 805729 - DNA, 20 bp, mouse
ggccacgcgcccgagggttc

SEQ ID NO: 805730 - DNA, 20 bp, mouse
gagatcagggagcgttggtc

SEQ ID NO: 805731 - DNA, 20 bp, mouse
gtctgcagtgttggagttgt

SEQ ID NO: 805732 - DNA, 20 bp, mouse
ggggcggagccacgcgcccg

SEQ ID NO: 805733 - DNA, 20 bp, mouse
ggtccctgaggccgcattcc

SEQ ID NO: 805734 - DNA, 20 bp, mouse
gcctcgcgctgcgtcggagg

SEQ ID NO: 805735 - DNA, 20 bp, mouse
gagagtggaccctggtccgg

SEQ ID NO: 805736 - DNA, 20 bp, mouse
gcggaagtggacgcactcca

SEQ ID NO: 805737 - DNA, 20 bp, mouse
gtgaaaccacgcccaactcc

SEQ ID NO: 805738 - DNA, 20 bp, mouse
ggggtcgccgcgcgaggcct

SEQ ID NO: 805739 - DNA, 20 bp, mouse
gcagtagtgctgtaagtcta

SEQ ID NO: 805740 - DNA, 20 bp, mouse
ggacgggagaacatttgtcg

SEQ ID NO: 805741 - DNA, 20 bp, mouse
gaaccagcgcgccgcgaaag

SEQ ID NO: 805742 - DNA, 20 bp, mouse
ggaccgcccacgaccggaag

SEQ ID NO: 805743 - DNA, 20 bp, mouse
gcgacgtgctggagcatcct

SEQ ID NO: 805744 - DNA, 20 bp, mouse
gggagcgccggaagtaggta

SEQ ID NO: 805745 - DNA, 20 bp, mouse
gaaaatcttgtccgggagtt

SEQ ID NO: 805746 - DNA, 20 bp, mouse
gcgaaaggatggaagctctc

SEQ ID NO: 805747 - DNA, 20 bp, mouse
gtaaagtcccggcccgtact

SEQ ID NO: 805748 - DNA, 20 bp, mouse
gtacgggccgggactttagc

SEQ ID NO: 805749 - DNA, 20 bp, mouse
ggcactgctggagtgcttta

SEQ ID NO: 805750 - DNA, 20 bp, mouse
gtggcttggcacccgagtac

SEQ ID NO: 805751 - DNA, 20 bp, mouse
gccagcccaggtgtcgtctc

SEQ ID NO: 805752 - DNA, 20 bp, mouse
gcatgcaggggagtctgaat

SEQ ID NO: 805753 - DNA, 20 bp, mouse
ggctgcagaggaggggattt

SEQ ID NO: 805754 - DNA, 20 bp, mouse
gagctcaccagcacttgggg

SEQ ID NO: 805755 - DNA, 20 bp, mouse
gtccacccccgctaaagtcc

SEQ ID NO: 805756 - DNA, 20 bp, mouse
gtccctcactggcccgggaa

SEQ ID NO: 805757 - DNA, 20 bp, mouse
gcatgtgggaagatgacctt

SEQ ID NO: 805758 - DNA, 20 bp, mouse
gaacccttcccgggccagtg

SEQ ID NO: 805759 - DNA, 20 bp, mouse
ggggacctccttgagcatgt

SEQ ID NO: 805760 - DNA, 20 bp, mouse
gggctcagaacgtgctgaca

SEQ ID NO: 805761 - DNA, 20 bp, mouse
gaccacgcttaacccttccc

SEQ ID NO: 805762 - DNA, 20 bp, mouse
gggctaagtcagaaatgaga

SEQ ID NO: 805763 - DNA, 20 bp, mouse
ggcccgggaagggttaagcg

SEQ ID NO: 805764 - DNA, 20 bp, mouse
gagggatacagactttaaac

SEQ ID NO: 805765 - DNA, 20 bp, mouse
gccctcccgcctgggattcc

SEQ ID NO: 805766 - DNA, 20 bp, mouse
ggggcggggcctcaactggt

SEQ ID NO: 805767 - DNA, 20 bp, mouse
ggggcctcaactggtgggcg

SEQ ID NO: 805768 - DNA, 20 bp, mouse
ggcggggcctgaacccgcct

SEQ ID NO: 805769 - DNA, 20 bp, mouse
gccaccccgcccaccagttg

SEQ ID NO: 805770 - DNA, 20 bp, mouse
gacgaagagcaagtccgggt

SEQ ID NO: 805771 - DNA, 20 bp, mouse
gtaagccctgcggtagcaga

SEQ ID NO: 805772 - DNA, 20 bp, mouse
gtaccgcagggcttaagcga

SEQ ID NO: 805773 - DNA, 20 bp, mouse
ggaacccgcctgggttttgt

SEQ ID NO: 805774 - DNA, 20 bp, mouse
gagagcaagtccgggtgggt

SEQ ID NO: 805775 - DNA, 20 bp, mouse
gcgggcgggatgcaagaaga

SEQ ID NO: 805776 - DNA, 20 bp, mouse
gggacagtgaagccacgtag

SEQ ID NO: 805777 - DNA, 20 bp, mouse
ggaatgttcagcatgggctg

SEQ ID NO: 805778 - DNA, 20 bp, mouse
gatgaggcccctaagagctc

SEQ ID NO: 805779 - DNA, 20 bp, mouse
gaccccaggtatagcaaaga

SEQ ID NO: 805780 - DNA, 20 bp, mouse
gagagttgaatgttcagcat

SEQ ID NO: 805781 - DNA, 20 bp, mouse
gctatgaagggttcagtggg

SEQ ID NO: 805782 - DNA, 20 bp, mouse
gtgccctcaactcctctacg

SEQ ID NO: 805783 - DNA, 20 bp, mouse
gcatctatgaagggttcagt

SEQ ID NO: 805784 - DNA, 20 bp, mouse
gagccacgtagaggagttga

SEQ ID NO: 805785 - DNA, 20 bp, mouse
gagggaaaggtattcgctga

SEQ ID NO: 805786 - DNA, 20 bp, mouse
gcgcgcacaggctaggtatg

SEQ ID NO: 805787 - DNA, 20 bp, mouse
gcgcgtggagatggcagcta

SEQ ID NO: 805788 - DNA, 20 bp, mouse
gcggctgctctatgcgaccg

SEQ ID NO: 805789 - DNA, 20 bp, mouse
gaccgcggcgggcgcgggct

SEQ ID NO: 805790 - DNA, 20 bp, mouse
ggcgcgggctgggcagcctt

SEQ ID NO: 805791 - DNA, 20 bp, mouse
gctgctctatgcgaccgcgg

SEQ ID NO: 805792 - DNA, 20 bp, mouse
ggccccgggcgcgcgcgcaa

SEQ ID NO: 805793 - DNA, 20 bp, mouse
ggcccagcccgcgcccgccg

SEQ ID NO: 805794 - DNA, 20 bp, mouse
gcagaggcgagctaacagtg

SEQ ID NO: 805795 - DNA, 20 bp, mouse
gcgaggcgcgcgcacaggct

SEQ ID NO: 805796 - DNA, 20 bp, mouse
gcaggctttcaaaacgaagg

SEQ ID NO: 805797 - DNA, 20 bp, mouse
ggtgaggtgctggaactcgc

SEQ ID NO: 805798 - DNA, 20 bp, mouse
ggcccaggctttcaaaacga

SEQ ID NO: 805799 - DNA, 20 bp, mouse
ggggacttagtaaacagaca

SEQ ID NO: 805800 - DNA, 20 bp, mouse
ggctttcaaaacgaaggcgg

SEQ ID NO: 805801 - DNA, 20 bp, mouse
gaggtcttgctgtgaggtgc

SEQ ID NO: 805802 - DNA, 20 bp, mouse
gttgcggttcctggaggccc

SEQ ID NO: 805803 - DNA, 20 bp, mouse
gcattggttgggttgcaaag

SEQ ID NO: 805804 - DNA, 20 bp, mouse
gtggggacaattcccaattt

SEQ ID NO: 805805 - DNA, 20 bp, mouse
gggaattgtccccacctctc

SEQ ID NO: 805806 - DNA, 20 bp, mouse
ggggcctagaattgaaggcg

SEQ ID NO: 805807 - DNA, 20 bp, mouse
gagagcggggcctttaggaa

SEQ ID NO: 805808 - DNA, 20 bp, mouse
ggggcggggcctagaattga

SEQ ID NO: 805809 - DNA, 20 bp, mouse
gtgccccaacacccttacat

SEQ ID NO: 805810 - DNA, 20 bp, mouse
gagcaagcactgcagcgcgg

SEQ ID NO: 805811 - DNA, 20 bp, mouse
gttagagatggcactgagag

SEQ ID NO: 805812 - DNA, 20 bp, mouse
ggagggacctccgttttaat

SEQ ID NO: 805813 - DNA, 20 bp, mouse
gtggagatggcgtggaaaaa

SEQ ID NO: 805814 - DNA, 20 bp, mouse
gacgcctcccattaaaacgg

SEQ ID NO: 805815 - DNA, 20 bp, mouse
gagccccgccccattcctaa

SEQ ID NO: 805816 - DNA, 20 bp, mouse
gggggaaagcctgacgtaag

SEQ ID NO: 805817 - DNA, 20 bp, mouse
ggggtggggcaggcctctcg

SEQ ID NO: 805818 - DNA, 20 bp, mouse
gtcactgcgtcctttcctgc

SEQ ID NO: 805819 - DNA, 20 bp, mouse
gcaggcctctcgggggtgag

SEQ ID NO: 805820 - DNA, 20 bp, mouse
gtgtccctctgcgctcccgc

SEQ ID NO: 805821 - DNA, 20 bp, mouse
gaggaaaggacgcagtgact

SEQ ID NO: 805822 - DNA, 20 bp, mouse
gtagccacgccccttacgtc

SEQ ID NO: 805823 - DNA, 20 bp, mouse
gaggggctgcagtggcgggc

SEQ ID NO: 805824 - DNA, 20 bp, mouse
gcacggttaatctgtagcag

SEQ ID NO: 805825 - DNA, 20 bp, mouse
gaagcctgacgtaaggggcg

SEQ ID NO: 805826 - DNA, 20 bp, mouse
gggctgcgggatagagaaga

SEQ ID NO: 805827 - DNA, 20 bp, mouse
ggatagagaagatggatcac

SEQ ID NO: 805828 - DNA, 20 bp, mouse
gccccaactacactaggtgg

SEQ ID NO: 805829 - DNA, 20 bp, mouse
ggggttgtccaatagaaata

SEQ ID NO: 805830 - DNA, 20 bp, mouse
gcacccccacctagtgtagt

SEQ ID NO: 805831 - DNA, 20 bp, mouse
gaggggagggctggctggcg

SEQ ID NO: 805832 - DNA, 20 bp, mouse
ggaacgccaccaaggaagta

SEQ ID NO: 805833 - DNA, 20 bp, mouse
gctagtgtagttggggaatg

SEQ ID NO: 805834 - DNA, 20 bp, mouse
gggagggcggggtttggagc

SEQ ID NO: 805835 - DNA, 20 bp, mouse
gcgccctccgaacgccacca

SEQ ID NO: 805836 - DNA, 20 bp, mouse
gtctgccaccggcgttacat

SEQ ID NO: 805837 - DNA, 20 bp, mouse
ggcaccgggtcccggaacag

SEQ ID NO: 805838 - DNA, 20 bp, mouse
gcgggtcccggaacagagga

SEQ ID NO: 805839 - DNA, 20 bp, mouse
gtgcgcccatgtaacgccgg

SEQ ID NO: 805840 - DNA, 20 bp, mouse
gtgctaccggctgactccga

SEQ ID NO: 805841 - DNA, 20 bp, mouse
gtacatgggcgcagacatct

SEQ ID NO: 805842 - DNA, 20 bp, mouse
gggagtcagccggtagcacc

SEQ ID NO: 805843 - DNA, 20 bp, mouse
gttccgggacccggtgctac

SEQ ID NO: 805844 - DNA, 20 bp, mouse
gtgagtggacatggccagga

SEQ ID NO: 805845 - DNA, 20 bp, mouse
gcaggaatgtaggcggtcgg

SEQ ID NO: 805846 - DNA, 20 bp, mouse
gtggggcggaccggtgggta

SEQ ID NO: 805847 - DNA, 20 bp, mouse
gccgcgctggggcggaccgg

SEQ ID NO: 805848 - DNA, 20 bp, mouse
gccggtgggtacggggtgta

SEQ ID NO: 805849 - DNA, 20 bp, mouse
ggcgccgcgctggggcggac

SEQ ID NO: 805850 - DNA, 20 bp, mouse
gccgggcggggcgctcacct

SEQ ID NO: 805851 - DNA, 20 bp, mouse
gtcacctgggcgcgccgcgc

SEQ ID NO: 805852 - DNA, 20 bp, mouse
gctcgagggcgtggcggcac

SEQ ID NO: 805853 - DNA, 20 bp, mouse
ggcacaggctgagtcccgaa

SEQ ID NO: 805854 - DNA, 20 bp, mouse
gggagcgcggtgcaagtggc

SEQ ID NO: 805855 - DNA, 20 bp, mouse
ggcgtggcccgtgcaccggg

SEQ ID NO: 805856 - DNA, 20 bp, mouse
gggagggagctgaagagcga

SEQ ID NO: 805857 - DNA, 20 bp, mouse
gggaggcgctccgtgagcgg

SEQ ID NO: 805858 - DNA, 20 bp, mouse
ggggagctgaagagcgaggg

SEQ ID NO: 805859 - DNA, 20 bp, mouse
gacagtggccggacgacccg

SEQ ID NO: 805860 - DNA, 20 bp, mouse
gtacctgccccagtcatccg

SEQ ID NO: 805861 - DNA, 20 bp, mouse
ggggccgaggatcatccccg

SEQ ID NO: 805862 - DNA, 20 bp, mouse
gtgcccccggggatgatcct

SEQ ID NO: 805863 - DNA, 20 bp, mouse
gggcggggaagaggggacat

SEQ ID NO: 805864 - DNA, 20 bp, mouse
ggagcgccgtcctattccca

SEQ ID NO: 805865 - DNA, 20 bp, mouse
gcgctgccctgggaatagga

SEQ ID NO: 805866 - DNA, 20 bp, mouse
gcggggccgcgctgctgaag

SEQ ID NO: 805867 - DNA, 20 bp, mouse
ggggcacgacgggatggaaa

SEQ ID NO: 805868 - DNA, 20 bp, mouse
gcaaccttgggagatcggga

SEQ ID NO: 805869 - DNA, 20 bp, mouse
gcgccccggctgctcgccga

SEQ ID NO: 805870 - DNA, 20 bp, mouse
gggagactgagtggtctaga

SEQ ID NO: 805871 - DNA, 20 bp, mouse
gcagccttcccgatctccca

SEQ ID NO: 805872 - DNA, 20 bp, mouse
gtgctcgccgagggagagtg

SEQ ID NO: 805873 - DNA, 20 bp, mouse
ggagggggccggagactgag

SEQ ID NO: 805874 - DNA, 20 bp, mouse
gagggaggagccagcgagtg

SEQ ID NO: 805875 - DNA, 20 bp, mouse
gtaaggacccggggagtccc

SEQ ID NO: 805876 - DNA, 20 bp, mouse
gtgccaggagacacaacctg

SEQ ID NO: 805877 - DNA, 20 bp, mouse
gtacagaagcaaggtttagg

SEQ ID NO: 805878 - DNA, 20 bp, mouse
gcttctgtagactgcaatca

SEQ ID NO: 805879 - DNA, 20 bp, mouse
ggggagccaaggagaaataa

SEQ ID NO: 805880 - DNA, 20 bp, mouse
gttaccttgctgtaccctgg

SEQ ID NO: 805881 - DNA, 20 bp, mouse
gctccccaggttgtgtctcc

SEQ ID NO: 805882 - DNA, 20 bp, mouse
gtcaggcccccaaactatct

SEQ ID NO: 805883 - DNA, 20 bp, mouse
gtagactgcaatcagggctc

SEQ ID NO: 805884 - DNA, 20 bp, mouse
ggtctacagaagcaaggttt

SEQ ID NO: 805885 - DNA, 20 bp, mouse
gatgcctccagggtacagca

SEQ ID NO: 805886 - DNA, 20 bp, mouse
ggggaggaggcaagcctcca

SEQ ID NO: 805887 - DNA, 20 bp, mouse
ggtcctgagccagattgcag

SEQ ID NO: 805888 - DNA, 20 bp, mouse
gaggaccctggaactctccc

SEQ ID NO: 805889 - DNA, 20 bp, mouse
ggtaccaggagccagggata

SEQ ID NO: 805890 - DNA, 20 bp, mouse
gggaacctccgtcagcccat

SEQ ID NO: 805891 - DNA, 20 bp, mouse
ggcctccagggagagttcca

SEQ ID NO: 805892 - DNA, 20 bp, mouse
gccaacccatgggctgacgg

SEQ ID NO: 805893 - DNA, 20 bp, mouse
gagaagcagaatggagatat

SEQ ID NO: 805894 - DNA, 20 bp, mouse
gctgaattgtaatgctgact

SEQ ID NO: 805895 - DNA, 20 bp, mouse
gccaggagccagggataggg

SEQ ID NO: 805896 - DNA, 20 bp, mouse
ggcagagtctctgaaagggc

SEQ ID NO: 805897 - DNA, 20 bp, mouse
gccagagtgtgggactccca

SEQ ID NO: 805898 - DNA, 20 bp, mouse
ggacctccggggtcaggctg

SEQ ID NO: 805899 - DNA, 20 bp, mouse
gccttctgtcccagggacaa

SEQ ID NO: 805900 - DNA, 20 bp, mouse
gagttctggagtccaaagca

SEQ ID NO: 805901 - DNA, 20 bp, mouse
gggtctcaatacactagtga

SEQ ID NO: 805902 - DNA, 20 bp, mouse
gaaccacagcctgaccccgg

SEQ ID NO: 805903 - DNA, 20 bp, mouse
gagcagggatgagcggcctc

SEQ ID NO: 805904 - DNA, 20 bp, mouse
gttcttgtggaggaaggcaa

SEQ ID NO: 805905 - DNA, 20 bp, mouse
gagtatctcaggaggatggt

SEQ ID NO: 805906 - DNA, 20 bp, mouse
gccgctgccactgtgttaaa

SEQ ID NO: 805907 - DNA, 20 bp, mouse
ggggccaccagcatctactg

SEQ ID NO: 805908 - DNA, 20 bp, mouse
gaaggtgcacagaaacctta

SEQ ID NO: 805909 - DNA, 20 bp, mouse
gagtgtggggattgaaataa

SEQ ID NO: 805910 - DNA, 20 bp, mouse
gtaaacaacgcaccagtgtg

SEQ ID NO: 805911 - DNA, 20 bp, mouse
gcgcctgccccagtagatgc

SEQ ID NO: 805912 - DNA, 20 bp, mouse
gtgctgaaactgcggagttc

SEQ ID NO: 805913 - DNA, 20 bp, mouse
gaagggccgtgctgaaactg

SEQ ID NO: 805914 - DNA, 20 bp, mouse
gcattctagcggctcctgtg

SEQ ID NO: 805915 - DNA, 20 bp, mouse
ggcagtgcggatttttttca

SEQ ID NO: 805916 - DNA, 20 bp, mouse
gcagacgcgggctgtgaagc

SEQ ID NO: 805917 - DNA, 20 bp, mouse
gaggacctggcaacagccca

SEQ ID NO: 805918 - DNA, 20 bp, mouse
gaggatggagattgaggtta

SEQ ID NO: 805919 - DNA, 20 bp, mouse
gcaactcccgacatgcactt

SEQ ID NO: 805920 - DNA, 20 bp, mouse
gacagcccgcgtctgaaagc

SEQ ID NO: 805921 - DNA, 20 bp, mouse
ggagatgtcgtaagcttgtg

SEQ ID NO: 805922 - DNA, 20 bp, mouse
gtcagtaccaaggagcgaag

SEQ ID NO: 805923 - DNA, 20 bp, mouse
gttccgcccaagtgcatgtc

SEQ ID NO: 805924 - DNA, 20 bp, mouse
gagttcctgctttcagacgc

SEQ ID NO: 805925 - DNA, 20 bp, mouse
gaggagcgaaggggcgtgta

SEQ ID NO: 805926 - DNA, 20 bp, mouse
gataaggcgcattcccgggg

SEQ ID NO: 805927 - DNA, 20 bp, mouse
ggccttgctcgctctcacct

SEQ ID NO: 805928 - DNA, 20 bp, mouse
gagtaacttccaagtgctcc

SEQ ID NO: 805929 - DNA, 20 bp, mouse
gagagcgagcaaggccgcag

SEQ ID NO: 805930 - DNA, 20 bp, mouse
gtaaaataaggcgcattccc

SEQ ID NO: 805931 - DNA, 20 bp, mouse
gagcacttggaagttacttt

SEQ ID NO: 805932 - DNA, 20 bp, mouse
gtaggcaggcaatatcgctg

SEQ ID NO: 805933 - DNA, 20 bp, mouse
gctgggaatcacctacggtt

SEQ ID NO: 805934 - DNA, 20 bp, mouse
gcgcagcggcttaaggtcgt

SEQ ID NO: 805935 - DNA, 20 bp, mouse
gacaagggagacattaaaac

SEQ ID NO: 805936 - DNA, 20 bp, mouse
gggaggaaggtggccatctt

SEQ ID NO: 805937 - DNA, 20 bp, mouse
gctcagagccacacccacgg

SEQ ID NO: 805938 - DNA, 20 bp, mouse
ggagccacacccacggagga

SEQ ID NO: 805939 - DNA, 20 bp, mouse
gccccgggaaagatccgact

SEQ ID NO: 805940 - DNA, 20 bp, mouse
gccacacccacggaggaagg

SEQ ID NO: 805941 - DNA, 20 bp, mouse
ggatggccaccttcctccgt

SEQ ID NO: 805942 - DNA, 20 bp, mouse
gcgtccaatagaaatagtca

SEQ ID NO: 805943 - DNA, 20 bp, mouse
ggacctagtcggatctttcc

SEQ ID NO: 805944 - DNA, 20 bp, mouse
gtctgaaacgctgtaagccc

SEQ ID NO: 805945 - DNA, 20 bp, mouse
gaggaaggacactttcctgc

SEQ ID NO: 805946 - DNA, 20 bp, mouse
gacctggggcacagcgccaa

SEQ ID NO: 805947 - DNA, 20 bp, mouse
gccaagggaggatgtagatg

SEQ ID NO: 805948 - DNA, 20 bp, mouse
gtcagagaaagaggcgtgac

SEQ ID NO: 805949 - DNA, 20 bp, mouse
gtgggggtgggggtgatcgg

SEQ ID NO: 805950 - DNA, 20 bp, mouse
gtggggcacagcgccaaggg

SEQ ID NO: 805951 - DNA, 20 bp, mouse
gtgtcagggttggtcaaatg

SEQ ID NO: 805952 - DNA, 20 bp, mouse
gggcctcaagctacctgtca

SEQ ID NO: 805953 - DNA, 20 bp, mouse
gccacagcgcccctggcggc

SEQ ID NO: 805954 - DNA, 20 bp, mouse
ggcaaggatgaaaccttgac

SEQ ID NO: 805955 - DNA, 20 bp, mouse
gtggcggcgggaggacgcca

SEQ ID NO: 805956 - DNA, 20 bp, mouse
gcaccgggcaagcaattccc

SEQ ID NO: 805957 - DNA, 20 bp, mouse
ggtctgaaagtgggttgtgc

SEQ ID NO: 805958 - DNA, 20 bp, mouse
gactagcacagtctgaaagt

SEQ ID NO: 805959 - DNA, 20 bp, mouse
gagagtgtagagaattgatg

SEQ ID NO: 805960 - DNA, 20 bp, mouse
gtgatgcaggaggagcaatt

SEQ ID NO: 805961 - DNA, 20 bp, mouse
gagcagggtgttgaccaaaa

SEQ ID NO: 805962 - DNA, 20 bp, mouse
gagcatctataaagcatcct

SEQ ID NO: 805963 - DNA, 20 bp, mouse
gatcctgggaattgcttgcc

SEQ ID NO: 805964 - DNA, 20 bp, mouse
ggcagctggtcacatgagcc

SEQ ID NO: 805965 - DNA, 20 bp, mouse
gaaaaaagcattccgtgtca

SEQ ID NO: 805966 - DNA, 20 bp, mouse
ggcggctcggcgcccctagg

SEQ ID NO: 805967 - DNA, 20 bp, mouse
ggagcccagcggaaggtgcg

SEQ ID NO: 805968 - DNA, 20 bp, mouse
gccccgtgatccggagggat

SEQ ID NO: 805969 - DNA, 20 bp, mouse
gtctgggccccgtgatccgg

SEQ ID NO: 805970 - DNA, 20 bp, mouse
gcctccgcgcaccttccgct

SEQ ID NO: 805971 - DNA, 20 bp, mouse
gcgctccggagcccagcgga

SEQ ID NO: 805972 - DNA, 20 bp, mouse
ggggtccagccgggtagcag

SEQ ID NO: 805973 - DNA, 20 bp, mouse
gtccggagcgccgatccctc

SEQ ID NO: 805974 - DNA, 20 bp, mouse
gctacccggctggaccctgc

SEQ ID NO: 805975 - DNA, 20 bp, mouse
gtcggcgctccggagcccag

SEQ ID NO: 805976 - DNA, 20 bp, mouse
gtggtggcaaaacacaacac

SEQ ID NO: 805977 - DNA, 20 bp, mouse
gaggagcaggtgcccgggaa

SEQ ID NO: 805978 - DNA, 20 bp, mouse
ggagaaagatcagggcactg

SEQ ID NO: 805979 - DNA, 20 bp, mouse
gaaagacaggagcaggtgcc

SEQ ID NO: 805980 - DNA, 20 bp, mouse
gggctgacagaagcgctagt

SEQ ID NO: 805981 - DNA, 20 bp, mouse
gtgccagtagatggcggaaa

SEQ ID NO: 805982 - DNA, 20 bp, mouse
gcaaaacacaacaccggcag

SEQ ID NO: 805983 - DNA, 20 bp, mouse
ggagggagaaagacacttgg

SEQ ID NO: 805984 - DNA, 20 bp, mouse
gggttggtccagcccccttc

SEQ ID NO: 805985 - DNA, 20 bp, mouse
gctggcatgaggccagttgg

SEQ ID NO: 805986 - DNA, 20 bp, mouse
ggggcgggccctcccgagat

SEQ ID NO: 805987 - DNA, 20 bp, mouse
gcgggccctcccgagattgg

SEQ ID NO: 805988 - DNA, 20 bp, mouse
gcactcctccaatctcggga

SEQ ID NO: 805989 - DNA, 20 bp, mouse
gacccgcccaccactcgtcc

SEQ ID NO: 805990 - DNA, 20 bp, mouse
ggtaggaggaagggttgcga

SEQ ID NO: 805991 - DNA, 20 bp, mouse
gtactctctatccagggaaa

SEQ ID NO: 805992 - DNA, 20 bp, mouse
gggaagcctggacgagtggt

SEQ ID NO: 805993 - DNA, 20 bp, mouse
gtcgggagggcccgccccct

SEQ ID NO: 805994 - DNA, 20 bp, mouse
gctgccatggcaacgggctc

SEQ ID NO: 805995 - DNA, 20 bp, mouse
gaacgctcccggtgtccttc

SEQ ID NO: 805996 - DNA, 20 bp, mouse
gaaagggcgcagagttttgg

SEQ ID NO: 805997 - DNA, 20 bp, mouse
gaccccctccgctctctcaa

SEQ ID NO: 805998 - DNA, 20 bp, mouse
ggggtcccccggagaaacaa

SEQ ID NO: 805999 - DNA, 20 bp, mouse
gaggcccttgagagagcgga

SEQ ID NO: 806000 - DNA, 20 bp, mouse
gaccgaggcccttgagagag

SEQ ID NO: 806001 - DNA, 20 bp, mouse
gcgcaaagggcgcagagttt

SEQ ID NO: 806002 - DNA, 20 bp, mouse
gggcgcagagttttggggga

SEQ ID NO: 806003 - DNA, 20 bp, mouse
gctcctcggccggtgacgtc

SEQ ID NO: 806004 - DNA, 20 bp, mouse
ggcccgggaccaatccgcaa

SEQ ID NO: 806005 - DNA, 20 bp, mouse
ggggccgggctgacaagcct

SEQ ID NO: 806006 - DNA, 20 bp, mouse
gctgctggaagaatgacgtg

SEQ ID NO: 806007 - DNA, 20 bp, mouse
gggcgggctccgagtctcca

SEQ ID NO: 806008 - DNA, 20 bp, mouse
ggctcgcccgggcgctggtg

SEQ ID NO: 806009 - DNA, 20 bp, mouse
gagtgagacaggcgtgggga

SEQ ID NO: 806010 - DNA, 20 bp, mouse
gggaagaatgacgtgcggtt

SEQ ID NO: 806011 - DNA, 20 bp, mouse
gggctgagtgagacaggcgt

SEQ ID NO: 806012 - DNA, 20 bp, mouse
ggaggggggcttcacctcag

SEQ ID NO: 806013 - DNA, 20 bp, mouse
gcgcccccacctctcgtcat

SEQ ID NO: 806014 - DNA, 20 bp, mouse
gagagccaatgacgagaggt

SEQ ID NO: 806015 - DNA, 20 bp, mouse
gggcgctggtgcggcgtccc

SEQ ID NO: 806016 - DNA, 20 bp, mouse
gcgggagctggggacggtag

SEQ ID NO: 806017 - DNA, 20 bp, mouse
gtgcccggcccgggactcgg

SEQ ID NO: 806018 - DNA, 20 bp, mouse
gcgggccaattccaggagcg

SEQ ID NO: 806019 - DNA, 20 bp, mouse
ggggcgcgcgggccaattcc

SEQ ID NO: 806020 - DNA, 20 bp, mouse
gctgccaccgagtcccgggc

SEQ ID NO: 806021 - DNA, 20 bp, mouse
ggcagcgtacagtagcgcgc

SEQ ID NO: 806022 - DNA, 20 bp, mouse
ggccgcgcccaggctgatac

SEQ ID NO: 806023 - DNA, 20 bp, mouse
ggcccaggctgataccggaa

SEQ ID NO: 806024 - DNA, 20 bp, mouse
gcgcccggcaaacccaccca

SEQ ID NO: 806025 - DNA, 20 bp, mouse
ggctgccgcgctcctggaat

SEQ ID NO: 806026 - DNA, 20 bp, mouse
gccgccgcctccctcccgag

SEQ ID NO: 806027 - DNA, 20 bp, mouse
gcggcgctcctgctccccgg

SEQ ID NO: 806028 - DNA, 20 bp, mouse
gtggccgcgaccaggtgcgg

SEQ ID NO: 806029 - DNA, 20 bp, mouse
gcacagcgcccgcaccaggt

SEQ ID NO: 806030 - DNA, 20 bp, mouse
ggcgccgcggccgctcggga

SEQ ID NO: 806031 - DNA, 20 bp, mouse
gcctcgctcgctctcgagga

SEQ ID NO: 806032 - DNA, 20 bp, mouse
ggtggctgacaaatgtgatg

SEQ ID NO: 806033 - DNA, 20 bp, mouse
gaggggattgccactgtcac

SEQ ID NO: 806034 - DNA, 20 bp, mouse
ggccgcggcgcccccgggtg

SEQ ID NO: 806035 - DNA, 20 bp, mouse
gcgcccacagcgcccgcacc

SEQ ID NO: 806036 - DNA, 20 bp, mouse
ggcgaggaggaggaaatcga

SEQ ID NO: 806037 - DNA, 20 bp, mouse
gtgccgggcggagtctgctg

SEQ ID NO: 806038 - DNA, 20 bp, mouse
ggcccccagcagactccgcc

SEQ ID NO: 806039 - DNA, 20 bp, mouse
gctgtccggtctccagtcgc

SEQ ID NO: 806040 - DNA, 20 bp, mouse
gcggacagagtcggggtagc

SEQ ID NO: 806041 - DNA, 20 bp, mouse
ggacgggggcggaaagagga

SEQ ID NO: 806042 - DNA, 20 bp, mouse
gcagagtcggggtagcgggt

SEQ ID NO: 806043 - DNA, 20 bp, mouse
gtggagaccggacagagtcg

SEQ ID NO: 806044 - DNA, 20 bp, mouse
gaggtgagaaatcaagttcg

SEQ ID NO: 806045 - DNA, 20 bp, mouse
ggagaggcgcggatctccac

SEQ ID NO: 806046 - DNA, 20 bp, mouse
gagggggaagccacagtggt

SEQ ID NO: 806047 - DNA, 20 bp, mouse
ggtgggactgcctaccactg

SEQ ID NO: 806048 - DNA, 20 bp, mouse
gcacagtactcaaagtaaag

SEQ ID NO: 806049 - DNA, 20 bp, mouse
ggctagaacacaaatgctga

SEQ ID NO: 806050 - DNA, 20 bp, mouse
gcttaaccttacaggagtgt

SEQ ID NO: 806051 - DNA, 20 bp, mouse
gtcctgtaaggttaagcctc

SEQ ID NO: 806052 - DNA, 20 bp, mouse
gccctctgacaaaaggcttg

SEQ ID NO: 806053 - DNA, 20 bp, mouse
gtttttgcaagcactattac

SEQ ID NO: 806054 - DNA, 20 bp, mouse
gaatagtgcttgcaaaaaat

SEQ ID NO: 806055 - DNA, 20 bp, mouse
ggcttgtggtaaggccttcc

SEQ ID NO: 806056 - DNA, 20 bp, mouse
gcgggtgtctagaccctctg

SEQ ID NO: 806057 - DNA, 20 bp, mouse
ggcccgcgcgagccaagcag

SEQ ID NO: 806058 - DNA, 20 bp, mouse
gaggctgcgactcgagggag

SEQ ID NO: 806059 - DNA, 20 bp, mouse
gcagccaggctgcgactcga

SEQ ID NO: 806060 - DNA, 20 bp, mouse
ggtgtctagaccctctgggg

SEQ ID NO: 806061 - DNA, 20 bp, mouse
gggccaggctccgccccaga

SEQ ID NO: 806062 - DNA, 20 bp, mouse
gcgcgagccaagcaggggcc

SEQ ID NO: 806063 - DNA, 20 bp, mouse
gcggtccccggagtcaggag

SEQ ID NO: 806064 - DNA, 20 bp, mouse
gcgagccaccgggtcctcca

SEQ ID NO: 806065 - DNA, 20 bp, mouse
gttcgccgtggaggacccgg

SEQ ID NO: 806066 - DNA, 20 bp, mouse
gacaacgtcaagtgttgcgt

SEQ ID NO: 806067 - DNA, 20 bp, mouse
gagagggcagcttggaatcc

SEQ ID NO: 806068 - DNA, 20 bp, mouse
gttatccagaatgcaggggt

SEQ ID NO: 806069 - DNA, 20 bp, mouse
gcagcagggaacagagcgga

SEQ ID NO: 806070 - DNA, 20 bp, mouse
gcatgggcgtggcatagctc

SEQ ID NO: 806071 - DNA, 20 bp, mouse
ggcaccggcaaaacccactg

SEQ ID NO: 806072 - DNA, 20 bp, mouse
gatctacaaagcagacgctt

SEQ ID NO: 806073 - DNA, 20 bp, mouse
gatgccacgcccatgcgtga

SEQ ID NO: 806074 - DNA, 20 bp, mouse
ggccgcaccccttcacgcat

SEQ ID NO: 806075 - DNA, 20 bp, mouse
ggcccatgcgtgaaggggtg

SEQ ID NO: 806076 - DNA, 20 bp, mouse
gggaccgacctggaactgag

SEQ ID NO: 806077 - DNA, 20 bp, mouse
gtgctactaaggggagggat

SEQ ID NO: 806078 - DNA, 20 bp, mouse
gccttcggcctgttagtctg

SEQ ID NO: 806079 - DNA, 20 bp, mouse
gcggcctgttagtctggggg

SEQ ID NO: 806080 - DNA, 20 bp, mouse
ggcccctcccccagactaac

SEQ ID NO: 806081 - DNA, 20 bp, mouse
ggacgttgctactaagggga

SEQ ID NO: 806082 - DNA, 20 bp, mouse
gcaggccgaagggaccgacc

SEQ ID NO: 806083 - DNA, 20 bp, mouse
gagttccaggtcggtccctt

SEQ ID NO: 806084 - DNA, 20 bp, mouse
ggccgagcctagcttctcct

SEQ ID NO: 806085 - DNA, 20 bp, mouse
ggaactgagtggctgcactg

SEQ ID NO: 806086 - DNA, 20 bp, mouse
ggagccgggtgcgcagacca

SEQ ID NO: 806087 - DNA, 20 bp, mouse
gctcccctggtctgcgcacc

SEQ ID NO: 806088 - DNA, 20 bp, mouse
gctcctccagctcaagcgca

SEQ ID NO: 806089 - DNA, 20 bp, mouse
ggcccctccgcgaggcgcgt

SEQ ID NO: 806090 - DNA, 20 bp, mouse
gtgcggtgctgggtaaatga

SEQ ID NO: 806091 - DNA, 20 bp, mouse
gcctgctccggaggctcccc

SEQ ID NO: 806092 - DNA, 20 bp, mouse
gtcgcggaggggccgcgcga

SEQ ID NO: 806093 - DNA, 20 bp, mouse
gggaaggtgggcgcgcccgc

SEQ ID NO: 806094 - DNA, 20 bp, mouse
ggcgcccaccttcccggctg

SEQ ID NO: 806095 - DNA, 20 bp, mouse
gcgcagaccaggggagcctc

SEQ ID NO: 806096 - DNA, 20 bp, mouse
ggcaggaaatgtttgccctg

SEQ ID NO: 806097 - DNA, 20 bp, mouse
ggacacagacggaagttact

SEQ ID NO: 806098 - DNA, 20 bp, mouse
gtaacttccgtctgtgtcac

SEQ ID NO: 806099 - DNA, 20 bp, mouse
gggagcagtggggcattctc

SEQ ID NO: 806100 - DNA, 20 bp, mouse
gtctcagtcaaatgtggcca

SEQ ID NO: 806101 - DNA, 20 bp, mouse
gagaaggcttcgctttctat

SEQ ID NO: 806102 - DNA, 20 bp, mouse
gcctatcaatatgtcattgg

SEQ ID NO: 806103 - DNA, 20 bp, mouse
gtcacaggataagttccccc

SEQ ID NO: 806104 - DNA, 20 bp, mouse
gcaggagagcggcctagtaa

SEQ ID NO: 806105 - DNA, 20 bp, mouse
gctaaaagctacgctggtca

SEQ ID NO: 806106 - DNA, 20 bp, mouse
gaggaggagcaagagacgtc

SEQ ID NO: 806107 - DNA, 20 bp, mouse
gccagcccgcgaggctaaat

SEQ ID NO: 806108 - DNA, 20 bp, mouse
gggacttagcagttgcaggg

SEQ ID NO: 806109 - DNA, 20 bp, mouse
gccccagagcgctccgactc

SEQ ID NO: 806110 - DNA, 20 bp, mouse
ggaggaggctaggtaagagg

SEQ ID NO: 806111 - DNA, 20 bp, mouse
gcgaggacacagagagactg

SEQ ID NO: 806112 - DNA, 20 bp, mouse
gcgtgctagaccagcagggt

SEQ ID NO: 806113 - DNA, 20 bp, mouse
gtgagctgagacactgaatc

SEQ ID NO: 806114 - DNA, 20 bp, mouse
gagggatcgtggaggacgtg

SEQ ID NO: 806115 - DNA, 20 bp, mouse
gggctcctggggagctgcgg

SEQ ID NO: 806116 - DNA, 20 bp, mouse
gcagacaggcagcgaatcgg

SEQ ID NO: 806117 - DNA, 20 bp, mouse
gacggctcgggattggctgg

SEQ ID NO: 806118 - DNA, 20 bp, mouse
gtgcctgtctgcgacggctc

SEQ ID NO: 806119 - DNA, 20 bp, mouse
ggcggggcgcggaggtccaa

SEQ ID NO: 806120 - DNA, 20 bp, mouse
gggccgcccgatccccgcgt

SEQ ID NO: 806121 - DNA, 20 bp, mouse
gaatcggcggccggcattcc

SEQ ID NO: 806122 - DNA, 20 bp, mouse
gcgcacgcgcagagtcggag

SEQ ID NO: 806123 - DNA, 20 bp, mouse
ggcccgcccggcgttcggga

SEQ ID NO: 806124 - DNA, 20 bp, mouse
gtccttcccgaacgccgggc

SEQ ID NO: 806125 - DNA, 20 bp, mouse
ggcgcagagtcggagtggaa

SEQ ID NO: 806126 - DNA, 20 bp, mouse
gaggtctgagagagttggtt

SEQ ID NO: 806127 - DNA, 20 bp, mouse
gccgccccgaccaatcgcgg

SEQ ID NO: 806128 - DNA, 20 bp, mouse
ggcggggcttggtggtgcag

SEQ ID NO: 806129 - DNA, 20 bp, mouse
gggcccttccgggctgtgat

SEQ ID NO: 806130 - DNA, 20 bp, mouse
ggggctgtgattggtgtggg

SEQ ID NO: 806131 - DNA, 20 bp, mouse
gtcgggccggaagcaaagct

SEQ ID NO: 806132 - DNA, 20 bp, mouse
gacaccaatcacagcccgga

SEQ ID NO: 806133 - DNA, 20 bp, mouse
gaacccgccgcgattggtcg

SEQ ID NO: 806134 - DNA, 20 bp, mouse
ggaggctggggcatgactgc

SEQ ID NO: 806135 - DNA, 20 bp, mouse
ggccgcgcgcagcgttggat

SEQ ID NO: 806136 - DNA, 20 bp, mouse
gtgtggcggtgatacaggac

SEQ ID NO: 806137 - DNA, 20 bp, mouse
ggaagacaatgagtccggga

SEQ ID NO: 806138 - DNA, 20 bp, mouse
gaccagaaagcaaccggcgg

SEQ ID NO: 806139 - DNA, 20 bp, mouse
gcacgtctggagcagcgaag

SEQ ID NO: 806140 - DNA, 20 bp, mouse
gggggctgtggcggtgatac

SEQ ID NO: 806141 - DNA, 20 bp, mouse
gttcctggggaccggggctg

SEQ ID NO: 806142 - DNA, 20 bp, mouse
gcggactcattgtcttcctg

SEQ ID NO: 806143 - DNA, 20 bp, mouse
gtcattgtcttcctggggac

SEQ ID NO: 806144 - DNA, 20 bp, mouse
gcggcccgcaaagcgctcgc

SEQ ID NO: 806145 - DNA, 20 bp, mouse
gcgcgtgaggacgcaagtcc

SEQ ID NO: 806146 - DNA, 20 bp, mouse
gtagcctggtgaagcacggt

SEQ ID NO: 806147 - DNA, 20 bp, mouse
ggcgccccccagtgaccgta

SEQ ID NO: 806148 - DNA, 20 bp, mouse
ggggagatgggcgtgtttat

SEQ ID NO: 806149 - DNA, 20 bp, mouse
ggcgccatccgcagccgacc

SEQ ID NO: 806150 - DNA, 20 bp, mouse
gctcccctacggtcactggg

SEQ ID NO: 806151 - DNA, 20 bp, mouse
gacagaggccaaaactcaga

SEQ ID NO: 806152 - DNA, 20 bp, mouse
gcccggcctcacagccaggt

SEQ ID NO: 806153 - DNA, 20 bp, mouse
gctcacagccaggtcggctg

SEQ ID NO: 806154 - DNA, 20 bp, mouse
gcagcctggttgttcttgta

SEQ ID NO: 806155 - DNA, 20 bp, mouse
gccggagcaaagctccccta

SEQ ID NO: 806156 - DNA, 20 bp, mouse
ggcaggggcgtctaggaatg

SEQ ID NO: 806157 - DNA, 20 bp, mouse
gtccccgcctccgctggcac

SEQ ID NO: 806158 - DNA, 20 bp, mouse
gggtccagggcgtgcggcca

SEQ ID NO: 806159 - DNA, 20 bp, mouse
ggagccaggcaggggcgtct

SEQ ID NO: 806160 - DNA, 20 bp, mouse
gccgcagaccgggcgacaga

SEQ ID NO: 806161 - DNA, 20 bp, mouse
gaggaaacccgttctattcc

SEQ ID NO: 806162 - DNA, 20 bp, mouse
gcaggccaggctatcccggc

SEQ ID NO: 806163 - DNA, 20 bp, mouse
ggccagcggaggcggggaaa

SEQ ID NO: 806164 - DNA, 20 bp, mouse
gtggggctgttgcttgtcgg

SEQ ID NO: 806165 - DNA, 20 bp, mouse
ggtcgcccggtctgcggctg

SEQ ID NO: 806166 - DNA, 20 bp, mouse
gaaagtttctgagagcacat

SEQ ID NO: 806167 - DNA, 20 bp, mouse
gccacaaaagcattcataga

SEQ ID NO: 806168 - DNA, 20 bp, mouse
ggtggcacagctataaagga

SEQ ID NO: 806169 - DNA, 20 bp, mouse
gagctataaaggagggatta

SEQ ID NO: 806170 - DNA, 20 bp, mouse
gcaagttctttctaacatcg

SEQ ID NO: 806171 - DNA, 20 bp, mouse
ggtaaaatgttaccatgctt

SEQ ID NO: 806172 - DNA, 20 bp, mouse
ggattaaggtgtgattgcag

SEQ ID NO: 806173 - DNA, 20 bp, mouse
gaagccttcacatacatata

SEQ ID NO: 806174 - DNA, 20 bp, mouse
ggtggcattttaaatctgtt

SEQ ID NO: 806175 - DNA, 20 bp, mouse
gttttgtggcacagctataa

SEQ ID NO: 806176 - DNA, 20 bp, mouse
gactccccagtgacaagcgt

SEQ ID NO: 806177 - DNA, 20 bp, mouse
gggacaccgacgcttgtcac

SEQ ID NO: 806178 - DNA, 20 bp, mouse
gtcacggtgtaagaagggta

SEQ ID NO: 806179 - DNA, 20 bp, mouse
gattcatcacggtgtaagaa

SEQ ID NO: 806180 - DNA, 20 bp, mouse
gaatgggtgcaagtcactcc

SEQ ID NO: 806181 - DNA, 20 bp, mouse
ggtgtcccttcgtgccaagg

SEQ ID NO: 806182 - DNA, 20 bp, mouse
gtgaaacctccttggcacga

SEQ ID NO: 806183 - DNA, 20 bp, mouse
ggaggtgagcgttacaagtg

SEQ ID NO: 806184 - DNA, 20 bp, mouse
gacacacacggaggactgtg

SEQ ID NO: 806185 - DNA, 20 bp, mouse
gcatctaccgtggaccaact

SEQ ID NO: 806186 - DNA, 20 bp, mouse
ggggcttcagtttgagtact

SEQ ID NO: 806187 - DNA, 20 bp, mouse
gaagtgttcagctaattaga

SEQ ID NO: 806188 - DNA, 20 bp, mouse
gttaagaactgaagctacag

SEQ ID NO: 806189 - DNA, 20 bp, mouse
gggtgttactattgtgtaag

SEQ ID NO: 806190 - DNA, 20 bp, mouse
gtacagggggccgtggggag

SEQ ID NO: 806191 - DNA, 20 bp, mouse
gaaactattgtgttaaggtg

SEQ ID NO: 806192 - DNA, 20 bp, mouse
gcagctaattagaggggaga

SEQ ID NO: 806193 - DNA, 20 bp, mouse
gcacttacctggtgtcagat

SEQ ID NO: 806194 - DNA, 20 bp, mouse
gaagacttgtaatcagtcaa

SEQ ID NO: 806195 - DNA, 20 bp, mouse
gctaagggttgatgtttgcc

SEQ ID NO: 806196 - DNA, 20 bp, mouse
gccaccacggttgtccaact

SEQ ID NO: 806197 - DNA, 20 bp, mouse
gaacatgcatgtaataggga

SEQ ID NO: 806198 - DNA, 20 bp, mouse
gagagagaaaaagcgtcttc

SEQ ID NO: 806199 - DNA, 20 bp, mouse
gaggaaaggcacagcaactg

SEQ ID NO: 806200 - DNA, 20 bp, mouse
gtcaaagggcagcttgtgag

SEQ ID NO: 806201 - DNA, 20 bp, mouse
gttggacaaccgtggtgggt

SEQ ID NO: 806202 - DNA, 20 bp, mouse
gtgtcaacatgcatgtaata

SEQ ID NO: 806203 - DNA, 20 bp, mouse
gagagagctctctgcactcc

SEQ ID NO: 806204 - DNA, 20 bp, mouse
gcttcccagttggacaaccg

SEQ ID NO: 806205 - DNA, 20 bp, mouse
ggggggcaggccagagatcg

SEQ ID NO: 806206 - DNA, 20 bp, mouse
ggcggggcgcgcaccggttg

SEQ ID NO: 806207 - DNA, 20 bp, mouse
ggggcggcggcgtgggagga

SEQ ID NO: 806208 - DNA, 20 bp, mouse
gccgagtccgcgcccgtcgc

SEQ ID NO: 806209 - DNA, 20 bp, mouse
gcccgcgacccgctccggcc

SEQ ID NO: 806210 - DNA, 20 bp, mouse
ggttcccaggagccgtgggg

SEQ ID NO: 806211 - DNA, 20 bp, mouse
ggcgcgcccgcgacccgctc

SEQ ID NO: 806212 - DNA, 20 bp, mouse
gcccccgccccgctgcaggc

SEQ ID NO: 806213 - DNA, 20 bp, mouse
gagccgtggggcggcggcgt

SEQ ID NO: 806214 - DNA, 20 bp, mouse
gggaaactgaggccggtgaa

SEQ ID NO: 806215 - DNA, 20 bp, mouse
ggcggcggggggcccgcgac

SEQ ID NO: 806216 - DNA, 20 bp, mouse
gtcggggcgcaggcaagaaa

SEQ ID NO: 806217 - DNA, 20 bp, mouse
gggcgccgccatgttggtaa

SEQ ID NO: 806218 - DNA, 20 bp, mouse
gggcccgggcgtcatgtctt

SEQ ID NO: 806219 - DNA, 20 bp, mouse
gagcagcagggacctctcac

SEQ ID NO: 806220 - DNA, 20 bp, mouse
gcaacatggcggcgccccga

SEQ ID NO: 806221 - DNA, 20 bp, mouse
ggccatgttggtaaaggtat

SEQ ID NO: 806222 - DNA, 20 bp, mouse
ggcgaaggggcgggagctca

SEQ ID NO: 806223 - DNA, 20 bp, mouse
gtccacctcggcgaaggggc

SEQ ID NO: 806224 - DNA, 20 bp, mouse
ggcggcgcggccacggcgtc

SEQ ID NO: 806225 - DNA, 20 bp, mouse
ggagctggggggttatccga

SEQ ID NO: 806226 - DNA, 20 bp, mouse
ggcatacggcccaggaatag

SEQ ID NO: 806227 - DNA, 20 bp, mouse
ggctccgacacacacggctg

SEQ ID NO: 806228 - DNA, 20 bp, mouse
gcagagggatcggggttgaa

SEQ ID NO: 806229 - DNA, 20 bp, mouse
gtgtcggagccgctattcct

SEQ ID NO: 806230 - DNA, 20 bp, mouse
ggctgtggagatgaacttag

SEQ ID NO: 806231 - DNA, 20 bp, mouse
gtatgcctgtacagagggat

SEQ ID NO: 806232 - DNA, 20 bp, mouse
ggggccgtatgcctgtacag

SEQ ID NO: 806233 - DNA, 20 bp, mouse
gccaactgggctgtgtgcaa

SEQ ID NO: 806234 - DNA, 20 bp, mouse
gaaccccgatccctctgtac

SEQ ID NO: 806235 - DNA, 20 bp, mouse
ggggagagtgacaggtcctg

SEQ ID NO: 806236 - DNA, 20 bp, mouse
gtgggtcaggagaaaaggag

SEQ ID NO: 806237 - DNA, 20 bp, mouse
gagtccccagaggttcctac

SEQ ID NO: 806238 - DNA, 20 bp, mouse
ggatgtgtgactgccctagt

SEQ ID NO: 806239 - DNA, 20 bp, mouse
gccacccggtaggaacctct

SEQ ID NO: 806240 - DNA, 20 bp, mouse
gaaactagcaacaggatctc

SEQ ID NO: 806241 - DNA, 20 bp, mouse
gagggcagtcacacatcgat

SEQ ID NO: 806242 - DNA, 20 bp, mouse
gaggaacctctggggactag

SEQ ID NO: 806243 - DNA, 20 bp, mouse
gtgggtgcgagtcaaggaaa

SEQ ID NO: 806244 - DNA, 20 bp, mouse
ggggcccaatccaaatctaa

SEQ ID NO: 806245 - DNA, 20 bp, mouse
ggctccccgctagtccccag

SEQ ID NO: 806246 - DNA, 20 bp, mouse
gggcccccgtggctctgtgg

SEQ ID NO: 806247 - DNA, 20 bp, mouse
gctcgcacgctcagacgcgc

SEQ ID NO: 806248 - DNA, 20 bp, mouse
ggcggccggcgtgcgtgccc

SEQ ID NO: 806249 - DNA, 20 bp, mouse
gtccgccgagtgactgacga

SEQ ID NO: 806250 - DNA, 20 bp, mouse
ggggagccgccacagagcca

SEQ ID NO: 806251 - DNA, 20 bp, mouse
gcggccacgtgctccccgcc

SEQ ID NO: 806252 - DNA, 20 bp, mouse
ggcgccgggcaaccaataag

SEQ ID NO: 806253 - DNA, 20 bp, mouse
gagccgccacagagccacgg

SEQ ID NO: 806254 - DNA, 20 bp, mouse
ggggcgcgcgtgcctgccgg

SEQ ID NO: 806255 - DNA, 20 bp, mouse
gcccctcgtcagtcactcgg

SEQ ID NO: 806256 - DNA, 20 bp, mouse
gggagagcgtctcagacctg

SEQ ID NO: 806257 - DNA, 20 bp, mouse
gcggcccccaccccgacctc

SEQ ID NO: 806258 - DNA, 20 bp, mouse
gtcagacctgaggtcggggt

SEQ ID NO: 806259 - DNA, 20 bp, mouse
gccgccgcccgggaacggga

SEQ ID NO: 806260 - DNA, 20 bp, mouse
gagcgtctcagacctgaggt

SEQ ID NO: 806261 - DNA, 20 bp, mouse
gggggtgggggccgcgcgta

SEQ ID NO: 806262 - DNA, 20 bp, mouse
gccccagaaccaggcgctct

SEQ ID NO: 806263 - DNA, 20 bp, mouse
gtgaaacgcgcgaggaataa

SEQ ID NO: 806264 - DNA, 20 bp, mouse
gacctctgatggtgggataa

SEQ ID NO: 806265 - DNA, 20 bp, mouse
gttctggggcgcgcgtgcac

SEQ ID NO: 806266 - DNA, 20 bp, mouse
gtgggcggggttctgaacag

SEQ ID NO: 806267 - DNA, 20 bp, mouse
ggaagccagaggcacccgcg

SEQ ID NO: 806268 - DNA, 20 bp, mouse
gtggcggggaacctgagggc

SEQ ID NO: 806269 - DNA, 20 bp, mouse
ggcaggaagcatgccctgtg

SEQ ID NO: 806270 - DNA, 20 bp, mouse
ggccccaccgcacacccatt

SEQ ID NO: 806271 - DNA, 20 bp, mouse
gctggcatgcaagtgatcta

SEQ ID NO: 806272 - DNA, 20 bp, mouse
gtgtcccatgcttgcccaat

SEQ ID NO: 806273 - DNA, 20 bp, mouse
gtgtctagaaagtagctgag

SEQ ID NO: 806274 - DNA, 20 bp, mouse
ggcccaatgggtgtgcggtg

SEQ ID NO: 806275 - DNA, 20 bp, mouse
gtgcgggacacaatgagaga

SEQ ID NO: 806276 - DNA, 20 bp, mouse
gcctccggccgccagcgccg

SEQ ID NO: 806277 - DNA, 20 bp, mouse
gtccccaagcagccagtaag

SEQ ID NO: 806278 - DNA, 20 bp, mouse
gaatccgcagcccgctcctc

SEQ ID NO: 806279 - DNA, 20 bp, mouse
gggctgcttggggaatcaac

SEQ ID NO: 806280 - DNA, 20 bp, mouse
gcggcactgtgccccggcgc

SEQ ID NO: 806281 - DNA, 20 bp, mouse
gcgctggcggccggaggagc

SEQ ID NO: 806282 - DNA, 20 bp, mouse
gcaggaagggcacaggtgca

SEQ ID NO: 806283 - DNA, 20 bp, mouse
gggggcacagtgccgcttac

SEQ ID NO: 806284 - DNA, 20 bp, mouse
gtcccccggtgcacagaatg

SEQ ID NO: 806285 - DNA, 20 bp, mouse
gggtggcaagtactgtagca

SEQ ID NO: 806286 - DNA, 20 bp, mouse
ggctgccgcgcacttggctg

SEQ ID NO: 806287 - DNA, 20 bp, mouse
gcgggctgctcgcctggcat

SEQ ID NO: 806288 - DNA, 20 bp, mouse
gcccgaccatatagggagct

SEQ ID NO: 806289 - DNA, 20 bp, mouse
ggcgctgtccgcggagtccg

SEQ ID NO: 806290 - DNA, 20 bp, mouse
gcgccgcgctgcgctgtccg

SEQ ID NO: 806291 - DNA, 20 bp, mouse
gccgcacggcaccgcacatt

SEQ ID NO: 806292 - DNA, 20 bp, mouse
ggattagctcggcgctgctg

SEQ ID NO: 806293 - DNA, 20 bp, mouse
gcggtgcgggggaggttcca

SEQ ID NO: 806294 - DNA, 20 bp, mouse
gctcgccccagccaagtgcg

SEQ ID NO: 806295 - DNA, 20 bp, mouse
ggctctgccccacacccgcc

SEQ ID NO: 806296 - DNA, 20 bp, mouse
gtggaagggaaggaggtcga

SEQ ID NO: 806297 - DNA, 20 bp, mouse
ggagcctagcgggaagtagg

SEQ ID NO: 806298 - DNA, 20 bp, mouse
gcctgagcctagcgggaagt

SEQ ID NO: 806299 - DNA, 20 bp, mouse
gtagcgggaagtaggtggaa

SEQ ID NO: 806300 - DNA, 20 bp, mouse
ggaggcgccctctgtctccc

SEQ ID NO: 806301 - DNA, 20 bp, mouse
gagacagaagcccctgtcgg

SEQ ID NO: 806302 - DNA, 20 bp, mouse
ggtagccctcataattggga

SEQ ID NO: 806303 - DNA, 20 bp, mouse
gcaagaacggaaagaaacac

SEQ ID NO: 806304 - DNA, 20 bp, mouse
gggtcgagggaagggtgcta

SEQ ID NO: 806305 - DNA, 20 bp, mouse
gggtgctgggtgctgcggtg

SEQ ID NO: 806306 - DNA, 20 bp, mouse
gtacgcgaggcgggtacaga

SEQ ID NO: 806307 - DNA, 20 bp, mouse
gagagagcgctggtggggcg

SEQ ID NO: 806308 - DNA, 20 bp, mouse
gtctgttggcagagtgggaa

SEQ ID NO: 806309 - DNA, 20 bp, mouse
gaggcgggtacagagggcgg

SEQ ID NO: 806310 - DNA, 20 bp, mouse
ggggccgtgcccttcctctc

SEQ ID NO: 806311 - DNA, 20 bp, mouse
gacgggcaaagttagtctgt

SEQ ID NO: 806312 - DNA, 20 bp, mouse
ggggcagatgcctgccctcc

SEQ ID NO: 806313 - DNA, 20 bp, mouse
gctccaggctcctcccgctc

SEQ ID NO: 806314 - DNA, 20 bp, mouse
gtacaatagggctgtccctg

SEQ ID NO: 806315 - DNA, 20 bp, mouse
gcgcagggacgtttacaata

SEQ ID NO: 806316 - DNA, 20 bp, mouse
ggagtctagagcaccgacat

SEQ ID NO: 806317 - DNA, 20 bp, mouse
gtgagtcgtgctcatcaagt

SEQ ID NO: 806318 - DNA, 20 bp, mouse
gccgacatggggacaggccg

SEQ ID NO: 806319 - DNA, 20 bp, mouse
ggtagtccctgtgactcaac

SEQ ID NO: 806320 - DNA, 20 bp, mouse
gagagcaccgacatggggac

SEQ ID NO: 806321 - DNA, 20 bp, mouse
gcaccatctggcctacctaa

SEQ ID NO: 806322 - DNA, 20 bp, mouse
ggtgcatagaaaaagagcta

SEQ ID NO: 806323 - DNA, 20 bp, mouse
gactcaggctgtgcccgccc

SEQ ID NO: 806324 - DNA, 20 bp, mouse
gaagtaggtccctaggagct

SEQ ID NO: 806325 - DNA, 20 bp, mouse
gagagacctgttgagtcaca

SEQ ID NO: 806326 - DNA, 20 bp, mouse
ggtagccctcataattggga

SEQ ID NO: 806327 - DNA, 20 bp, mouse
gggacacagcctgatcagga

SEQ ID NO: 806328 - DNA, 20 bp, mouse
gccaagtagccctcataatt

SEQ ID NO: 806329 - DNA, 20 bp, mouse
gtcatccctcccaattatga

SEQ ID NO: 806330 - DNA, 20 bp, mouse
ggcgtggcgctgtgttggga

SEQ ID NO: 806331 - DNA, 20 bp, mouse
gcctgatcaggaaggaccac

SEQ ID NO: 806332 - DNA, 20 bp, mouse
gaggctgtgtcccagtcgcg

SEQ ID NO: 806333 - DNA, 20 bp, mouse
gtggaagggaaggaggtcga

SEQ ID NO: 806334 - DNA, 20 bp, mouse
ggggatggctagtgacagca

SEQ ID NO: 806335 - DNA, 20 bp, mouse
gcagtcgcgtggcgctgtgt

SEQ ID NO: 806336 - DNA, 20 bp, mouse
gagggtggggctcataaagc

SEQ ID NO: 806337 - DNA, 20 bp, mouse
ggaggctgcaatagctgggg

SEQ ID NO: 806338 - DNA, 20 bp, mouse
gtcctcctcatgataggggt

SEQ ID NO: 806339 - DNA, 20 bp, mouse
gcaggaggctgcaatagctg

SEQ ID NO: 806340 - DNA, 20 bp, mouse
gcatgaggaggaagccgtgg

SEQ ID NO: 806341 - DNA, 20 bp, mouse
gacggcttcctcctcatgat

SEQ ID NO: 806342 - DNA, 20 bp, mouse
gagaagcaagggctgatcaa

SEQ ID NO: 806343 - DNA, 20 bp, mouse
gagtccccacccctatcatg

SEQ ID NO: 806344 - DNA, 20 bp, mouse
gccaaagcacagagatccat

SEQ ID NO: 806345 - DNA, 20 bp, mouse
ggctgggtacgggatgcccc

SEQ ID NO: 806346 - DNA, 20 bp, mouse
ggggttgggcccttgttaaa

SEQ ID NO: 806347 - DNA, 20 bp, mouse
gcagccaggcaaggccggga

SEQ ID NO: 806348 - DNA, 20 bp, mouse
gagggagtgggacagattct

SEQ ID NO: 806349 - DNA, 20 bp, mouse
gtaacaagggcccaacccca

SEQ ID NO: 806350 - DNA, 20 bp, mouse
gcctctaccctcaccctaga

SEQ ID NO: 806351 - DNA, 20 bp, mouse
gaccactccctctagggtga

SEQ ID NO: 806352 - DNA, 20 bp, mouse
gagagcctgtgggtttagga

SEQ ID NO: 806353 - DNA, 20 bp, mouse
gcccaccctcctaaacccac

SEQ ID NO: 806354 - DNA, 20 bp, mouse
gacagattctgggagtgcag

SEQ ID NO: 806355 - DNA, 20 bp, mouse
ggaactcttgacttggccct

SEQ ID NO: 806356 - DNA, 20 bp, mouse
gttggaggggctctgtgcat

SEQ ID NO: 806357 - DNA, 20 bp, mouse
gccctcacccagctggtccc

SEQ ID NO: 806358 - DNA, 20 bp, mouse
gcacccagctggtcccagga

SEQ ID NO: 806359 - DNA, 20 bp, mouse
gggagtccagaaaaggtgta

SEQ ID NO: 806360 - DNA, 20 bp, mouse
ggaggggctctgtgcatggg

SEQ ID NO: 806361 - DNA, 20 bp, mouse
gagaagacgcaataaaggca

SEQ ID NO: 806362 - DNA, 20 bp, mouse
gggcaaggctagaaagcatg

SEQ ID NO: 806363 - DNA, 20 bp, mouse
gaacaggatatgaagggagc

SEQ ID NO: 806364 - DNA, 20 bp, mouse
gaatcagatggtgtgtgcac

SEQ ID NO: 806365 - DNA, 20 bp, mouse
gagttcattgttgtgcttga

SEQ ID NO: 806366 - DNA, 20 bp, mouse
gtatggctgtctaaggacga

SEQ ID NO: 806367 - DNA, 20 bp, mouse
ggtctggttacagtgtaaag

SEQ ID NO: 806368 - DNA, 20 bp, mouse
gttccagcctgagtgtccaa

SEQ ID NO: 806369 - DNA, 20 bp, mouse
gctgcaagtatggctgtcta

SEQ ID NO: 806370 - DNA, 20 bp, mouse
ggtgacttgtcattcctgga

SEQ ID NO: 806371 - DNA, 20 bp, mouse
ggcattctgccctgcaagta

SEQ ID NO: 806372 - DNA, 20 bp, mouse
ggggacgctcgtagagtgac

SEQ ID NO: 806373 - DNA, 20 bp, mouse
gcacaggaaagtttaacgtc

SEQ ID NO: 806374 - DNA, 20 bp, mouse
gcctgaagacctatctctga

SEQ ID NO: 806375 - DNA, 20 bp, mouse
gagagcacagatgtgtccat

SEQ ID NO: 806376 - DNA, 20 bp, mouse
gcagaggggggaatgagtag

SEQ ID NO: 806377 - DNA, 20 bp, mouse
gaacgctgaggctgccctca

SEQ ID NO: 806378 - DNA, 20 bp, mouse
gcctgtaatagaggctactg

SEQ ID NO: 806379 - DNA, 20 bp, mouse
gggcggtgggcctgtaatag

SEQ ID NO: 806380 - DNA, 20 bp, mouse
ggctcccttcatctctcgag

SEQ ID NO: 806381 - DNA, 20 bp, mouse
ggatgtgtgcgttgctaggt

SEQ ID NO: 806382 - DNA, 20 bp, mouse
ggcgttgctaggtgggcggt

SEQ ID NO: 806383 - DNA, 20 bp, mouse
gatggaggcaggggaccctg

SEQ ID NO: 806384 - DNA, 20 bp, mouse
gcccaagtaggtcaacgctg

SEQ ID NO: 806385 - DNA, 20 bp, mouse
gcggtgcctgagactctgac

SEQ ID NO: 806386 - DNA, 20 bp, mouse
gcacggcagagacttggatg

SEQ ID NO: 806387 - DNA, 20 bp, mouse
ggaagcctggttcccagact

SEQ ID NO: 806388 - DNA, 20 bp, mouse
gcccagactgggctggtcga

SEQ ID NO: 806389 - DNA, 20 bp, mouse
ggcaacctggacatgaggtg

SEQ ID NO: 806390 - DNA, 20 bp, mouse
gggcagagacttggatgggg

SEQ ID NO: 806391 - DNA, 20 bp, mouse
ggtagtgagtgagctccagt

SEQ ID NO: 806392 - DNA, 20 bp, mouse
gaacgggcaacctggacatg

SEQ ID NO: 806393 - DNA, 20 bp, mouse
ggggaccttgggaccacccc

SEQ ID NO: 806394 - DNA, 20 bp, mouse
ggacatgaggtgtgggccac

SEQ ID NO: 806395 - DNA, 20 bp, mouse
gaaggagatggagatgttat

SEQ ID NO: 806396 - DNA, 20 bp, mouse
ggtacccaggagatcaggat

SEQ ID NO: 806397 - DNA, 20 bp, mouse
gcaccatctggtgaagtaat

SEQ ID NO: 806398 - DNA, 20 bp, mouse
gccccagtacccaggagatc

SEQ ID NO: 806399 - DNA, 20 bp, mouse
gggcttccagacaaggttgg

SEQ ID NO: 806400 - DNA, 20 bp, mouse
gactggggacgagggaataa

SEQ ID NO: 806401 - DNA, 20 bp, mouse
gtcctgggtactggggacga

SEQ ID NO: 806402 - DNA, 20 bp, mouse
gaaaggacccctcttgggat

SEQ ID NO: 806403 - DNA, 20 bp, mouse
ggagggcttccagacaaggt

SEQ ID NO: 806404 - DNA, 20 bp, mouse
gccagatggtgaggcttcat

SEQ ID NO: 806405 - DNA, 20 bp, mouse
gagcagaaaggacccctctt

SEQ ID NO: 806406 - DNA, 20 bp, mouse
gcatccgtgaggtccgccca

SEQ ID NO: 806407 - DNA, 20 bp, mouse
gctggacagtccaggcaaca

SEQ ID NO: 806408 - DNA, 20 bp, mouse
gagtccaggcaacaggggcg

SEQ ID NO: 806409 - DNA, 20 bp, mouse
gtggcaaggtccccaagtga

SEQ ID NO: 806410 - DNA, 20 bp, mouse
gaagggccgcagcattagtc

SEQ ID NO: 806411 - DNA, 20 bp, mouse
gggcacgtgactcgaaactc

SEQ ID NO: 806412 - DNA, 20 bp, mouse
ggtctcctttgggcccgtta

SEQ ID NO: 806413 - DNA, 20 bp, mouse
ggactgtccaggattaggag

SEQ ID NO: 806414 - DNA, 20 bp, mouse
ggggcgtgccagcactccct

SEQ ID NO: 806415 - DNA, 20 bp, mouse
gttcgagtcacgtgccagaa

SEQ ID NO: 806416 - DNA, 20 bp, mouse
gtccctggggctaggaggtg

SEQ ID NO: 806417 - DNA, 20 bp, mouse
gaggatggggttgaagaaca

SEQ ID NO: 806418 - DNA, 20 bp, mouse
gcccgtggaaagccactcac

SEQ ID NO: 806419 - DNA, 20 bp, mouse
gaggttcactaattgaggga

SEQ ID NO: 806420 - DNA, 20 bp, mouse
gaattgagggagggtgtcca

SEQ ID NO: 806421 - DNA, 20 bp, mouse
ggaggtgggtccctaaagcc

SEQ ID NO: 806422 - DNA, 20 bp, mouse
ggagctctgattggaggcag

SEQ ID NO: 806423 - DNA, 20 bp, mouse
gtcagaggttcactaattga

SEQ ID NO: 806424 - DNA, 20 bp, mouse
gcaggaatgcagttaaggtt

SEQ ID NO: 806425 - DNA, 20 bp, mouse
gtccaaggaagctgttttta

SEQ ID NO: 806426 - DNA, 20 bp, mouse
gtctgaggaagtgggagtgt

SEQ ID NO: 806427 - DNA, 20 bp, mouse
ggtacccagcaggaagaatc

SEQ ID NO: 806428 - DNA, 20 bp, mouse
gccagacaggagtacccagc

SEQ ID NO: 806429 - DNA, 20 bp, mouse
gggctgtggcaactctggaa

SEQ ID NO: 806430 - DNA, 20 bp, mouse
gacagaggctgtggcaactc

SEQ ID NO: 806431 - DNA, 20 bp, mouse
gaatggatccaattaggaga

SEQ ID NO: 806432 - DNA, 20 bp, mouse
gcagcaggaagaatcaggat

SEQ ID NO: 806433 - DNA, 20 bp, mouse
gtgcccacagcctcgggcta

SEQ ID NO: 806434 - DNA, 20 bp, mouse
ggtactcagtgattgccaca

SEQ ID NO: 806435 - DNA, 20 bp, mouse
gtatgcttctgtatgagtgt

SEQ ID NO: 806436 - DNA, 20 bp, mouse
gtctgacagtcagggagctg

SEQ ID NO: 806437 - DNA, 20 bp, mouse
gcctgggcttggagcttgtt

SEQ ID NO: 806438 - DNA, 20 bp, mouse
gggcttggagcttgtttggg

SEQ ID NO: 806439 - DNA, 20 bp, mouse
ggaaaggtatcaaagatggc

SEQ ID NO: 806440 - DNA, 20 bp, mouse
gggtggcaggcgaatcattg

SEQ ID NO: 806441 - DNA, 20 bp, mouse
gtagatacatggttatctcg

SEQ ID NO: 806442 - DNA, 20 bp, mouse
ggctgtcttgcttaagattt

SEQ ID NO: 806443 - DNA, 20 bp, mouse
gagcttgtttggggggaaac

SEQ ID NO: 806444 - DNA, 20 bp, mouse
gcctctgtatattacaagtc

SEQ ID NO: 806445 - DNA, 20 bp, mouse
gcttaagatttgggcgggga

SEQ ID NO: 806446 - DNA, 20 bp, mouse
ggggccctgtatgcaggcct

SEQ ID NO: 806447 - DNA, 20 bp, mouse
gcccagggtaccactcaatg

SEQ ID NO: 806448 - DNA, 20 bp, mouse
gccaatgggggccaaggata

SEQ ID NO: 806449 - DNA, 20 bp, mouse
gaagaggagagagacaacgt

SEQ ID NO: 806450 - DNA, 20 bp, mouse
ggctgcccagtggatcccca

SEQ ID NO: 806451 - DNA, 20 bp, mouse
gagggaggagttagacaccc

SEQ ID NO: 806452 - DNA, 20 bp, mouse
gtcaatggggccctgtatgc

SEQ ID NO: 806453 - DNA, 20 bp, mouse
ggacacccaggcctgcatac

SEQ ID NO: 806454 - DNA, 20 bp, mouse
ggcaggctgaggctgccaat

SEQ ID NO: 806455 - DNA, 20 bp, mouse
gtggtaccctggggatccac

SEQ ID NO: 806456 - DNA, 20 bp, mouse
gtggagggaaaatattctaa

SEQ ID NO: 806457 - DNA, 20 bp, mouse
ggcagtggaattgcagattt

SEQ ID NO: 806458 - DNA, 20 bp, mouse
gccactgcatttcgaaatgt

SEQ ID NO: 806459 - DNA, 20 bp, mouse
gtacttcaacaattgcttaa

SEQ ID NO: 806460 - DNA, 20 bp, mouse
ggtcaaaattctatactgga

SEQ ID NO: 806461 - DNA, 20 bp, mouse
ggagtcccaagggtaaaatc

SEQ ID NO: 806462 - DNA, 20 bp, mouse
gacagacggacaatactata

SEQ ID NO: 806463 - DNA, 20 bp, mouse
gaaaatccagattttaccct

SEQ ID NO: 806464 - DNA, 20 bp, mouse
gcaaggtcaaaattctatac

SEQ ID NO: 806465 - DNA, 20 bp, mouse
ggaaatgtgggctgtgcgca

SEQ ID NO: 806466 - DNA, 20 bp, mouse
gccctgagagggtgcgtcat

SEQ ID NO: 806467 - DNA, 20 bp, mouse
ggggatgctcggggagagga

SEQ ID NO: 806468 - DNA, 20 bp, mouse
ggcagcggggccaacaccag

SEQ ID NO: 806469 - DNA, 20 bp, mouse
gagggcaagcaagcagtgat

SEQ ID NO: 806470 - DNA, 20 bp, mouse
gaaaccgccccgcccctgag

SEQ ID NO: 806471 - DNA, 20 bp, mouse
ggcccatgacgcaccctctc

SEQ ID NO: 806472 - DNA, 20 bp, mouse
gcctgactcggggatgctcg

SEQ ID NO: 806473 - DNA, 20 bp, mouse
gcaagcaagcagtgattggc

SEQ ID NO: 806474 - DNA, 20 bp, mouse
gaaaaccaaaacagtgtagg

SEQ ID NO: 806475 - DNA, 20 bp, mouse
gacgacggcgaacgaggaaa

SEQ ID NO: 806476 - DNA, 20 bp, mouse
gcccgagggccatggaggaa

SEQ ID NO: 806477 - DNA, 20 bp, mouse
ggctgccccgagggccatgg

SEQ ID NO: 806478 - DNA, 20 bp, mouse
gaggaagttgatgaccagaa

SEQ ID NO: 806479 - DNA, 20 bp, mouse
ggctgtacccatattcccac

SEQ ID NO: 806480 - DNA, 20 bp, mouse
ggccatggaggaaggggagt

SEQ ID NO: 806481 - DNA, 20 bp, mouse
ggaaacactagaagctgctt

SEQ ID NO: 806482 - DNA, 20 bp, mouse
ggcattgctgaggagtgtct

SEQ ID NO: 806483 - DNA, 20 bp, mouse
ggtgtgcgctgctgccccga

SEQ ID NO: 806484 - DNA, 20 bp, mouse
gtgacagtgagaactccatt

SEQ ID NO: 806485 - DNA, 20 bp, mouse
gaatccatgtagctgagagt

SEQ ID NO: 806486 - DNA, 20 bp, mouse
gaggagccacccagcctcgg

SEQ ID NO: 806487 - DNA, 20 bp, mouse
ggccccctgccgctggcaga

SEQ ID NO: 806488 - DNA, 20 bp, mouse
ggaggctgggtggctcctct

SEQ ID NO: 806489 - DNA, 20 bp, mouse
gggctcctctaggaagggac

SEQ ID NO: 806490 - DNA, 20 bp, mouse
ggtctctgagcgccccgccg

SEQ ID NO: 806491 - DNA, 20 bp, mouse
gcgccctctgccagcggcag

SEQ ID NO: 806492 - DNA, 20 bp, mouse
gagggggcccctcagggtct

SEQ ID NO: 806493 - DNA, 20 bp, mouse
gtgagcgccccgccgaggct

SEQ ID NO: 806494 - DNA, 20 bp, mouse
gagcggcagggggcccctca

SEQ ID NO: 806495 - DNA, 20 bp, mouse
gctgggtggctcctctagga

SEQ ID NO: 806496 - DNA, 20 bp, mouse
ggtggcccgccagttagcca

SEQ ID NO: 806497 - DNA, 20 bp, mouse
gcgcgcacgggggaagagca

SEQ ID NO: 806498 - DNA, 20 bp, mouse
gcggccgtgacatcatgcca

SEQ ID NO: 806499 - DNA, 20 bp, mouse
gcggcagttctcacgagtgg

SEQ ID NO: 806500 - DNA, 20 bp, mouse
ggcaagtcgccgccggaaag

SEQ ID NO: 806501 - DNA, 20 bp, mouse
gttagccagggcgcgcacgg

SEQ ID NO: 806502 - DNA, 20 bp, mouse
gccacggcagttctcacgag

SEQ ID NO: 806503 - DNA, 20 bp, mouse
ggcgcgccctggctaactgg

SEQ ID NO: 806504 - DNA, 20 bp, mouse
gctgccgtggcatgatgtca

SEQ ID NO: 806505 - DNA, 20 bp, mouse
gcccgcctctctcttgtcct

SEQ ID NO: 806506 - DNA, 20 bp, mouse
ggtagcccgaggcggggacg

SEQ ID NO: 806507 - DNA, 20 bp, mouse
ggggaaccagggcgtatctg

SEQ ID NO: 806508 - DNA, 20 bp, mouse
gtgggcggggacgtagcccg

SEQ ID NO: 806509 - DNA, 20 bp, mouse
gccaagcttcagagcttcgc

SEQ ID NO: 806510 - DNA, 20 bp, mouse
gtacgtccccgcccagtctc

SEQ ID NO: 806511 - DNA, 20 bp, mouse
gctggtccccagatacgccc

SEQ ID NO: 806512 - DNA, 20 bp, mouse
gcggggacgtagcccgaggc

SEQ ID NO: 806513 - DNA, 20 bp, mouse
gcgggtgcagaactgggctt

SEQ ID NO: 806514 - DNA, 20 bp, mouse
ggagaagtaatccagagact

SEQ ID NO: 806515 - DNA, 20 bp, mouse
gaaccttggagtcagagtat

SEQ ID NO: 806516 - DNA, 20 bp, mouse
gaaggtgccccagagtgggt

SEQ ID NO: 806517 - DNA, 20 bp, mouse
ggggcatcctgagcaactgt

SEQ ID NO: 806518 - DNA, 20 bp, mouse
ggggaggcaagcactagatg

SEQ ID NO: 806519 - DNA, 20 bp, mouse
ggtcacacccacagttgctc

SEQ ID NO: 806520 - DNA, 20 bp, mouse
ggggaaatttggtcctgggt

SEQ ID NO: 806521 - DNA, 20 bp, mouse
gactgagagaggcctccgca

SEQ ID NO: 806522 - DNA, 20 bp, mouse
ggcaactgtgggtgtgactc

SEQ ID NO: 806523 - DNA, 20 bp, mouse
gggaacagttgggcacaagg

SEQ ID NO: 806524 - DNA, 20 bp, mouse
gctagatggggagtcactac

SEQ ID NO: 806525 - DNA, 20 bp, mouse
gcagtgactccaccctgcgg

SEQ ID NO: 806526 - DNA, 20 bp, mouse
ggcaccggagagcgcctcag

SEQ ID NO: 806527 - DNA, 20 bp, mouse
gtgggagggcccagaatcgc

SEQ ID NO: 806528 - DNA, 20 bp, mouse
ggtccccgggagggacccga

SEQ ID NO: 806529 - DNA, 20 bp, mouse
ggtgccgcggcgggtggcac

SEQ ID NO: 806530 - DNA, 20 bp, mouse
gggcccgcgacgccaagtgt

SEQ ID NO: 806531 - DNA, 20 bp, mouse
gggcacaggctggcaacccc

SEQ ID NO: 806532 - DNA, 20 bp, mouse
ggcgctctccggtgccgcgg

SEQ ID NO: 806533 - DNA, 20 bp, mouse
gcaccccgagtgtccccggg

SEQ ID NO: 806534 - DNA, 20 bp, mouse
gtccctcccggggacactcg

SEQ ID NO: 806535 - DNA, 20 bp, mouse
gctcccaccccgagtgtccc

SEQ ID NO: 806536 - DNA, 20 bp, mouse
ggaaaagtgactggcggagg

SEQ ID NO: 806537 - DNA, 20 bp, mouse
gaactttgaaaagtgactgg

SEQ ID NO: 806538 - DNA, 20 bp, mouse
gtttgaaaagtgactggcgg

SEQ ID NO: 806539 - DNA, 20 bp, mouse
gcataactttgaaaagtgac

SEQ ID NO: 806540 - DNA, 20 bp, mouse
gtggagagacgatggctcaa

SEQ ID NO: 806541 - DNA, 20 bp, mouse
gcaaaagtgggagtcctcag

SEQ ID NO: 806542 - DNA, 20 bp, mouse
gctatgagccacctgacatg

SEQ ID NO: 806543 - DNA, 20 bp, mouse
gggagtcctcaggggagagt

SEQ ID NO: 806544 - DNA, 20 bp, mouse
gatcgtctctccagcaccat

SEQ ID NO: 806545 - DNA, 20 bp, mouse
gtgtatacaagtgcccatgg

SEQ ID NO: 806546 - DNA, 20 bp, mouse
gagcctggggtcaatactga

SEQ ID NO: 806547 - DNA, 20 bp, mouse
gttccctcagtattgacccc

SEQ ID NO: 806548 - DNA, 20 bp, mouse
gccccccagtctctgattaa

SEQ ID NO: 806549 - DNA, 20 bp, mouse
gtaacaagcaggtggggtag

SEQ ID NO: 806550 - DNA, 20 bp, mouse
gttgtctggagttttcccaa

SEQ ID NO: 806551 - DNA, 20 bp, mouse
gtctggggcatagtagcctg

SEQ ID NO: 806552 - DNA, 20 bp, mouse
gaagaagtagagttccctgt

SEQ ID NO: 806553 - DNA, 20 bp, mouse
gtgaaagaaggtaaaatggg

SEQ ID NO: 806554 - DNA, 20 bp, mouse
gacagactgtctggtggatc

SEQ ID NO: 806555 - DNA, 20 bp, mouse
gtcacattaacaagcaggtg

SEQ ID NO: 806556 - DNA, 20 bp, mouse
gagcctggggtcaacagtga

SEQ ID NO: 806557 - DNA, 20 bp, mouse
gggaaggcagtgtgtgtcct

SEQ ID NO: 806558 - DNA, 20 bp, mouse
gtcccctcactgttgacccc

SEQ ID NO: 806559 - DNA, 20 bp, mouse
gctgtgcggtggcaatcttc

SEQ ID NO: 806560 - DNA, 20 bp, mouse
gttgtctggagtattaccaa

SEQ ID NO: 806561 - DNA, 20 bp, mouse
ggagacaattttctgtgcgg

SEQ ID NO: 806562 - DNA, 20 bp, mouse
gtctggggtgtagtagcctg

SEQ ID NO: 806563 - DNA, 20 bp, mouse
ggtgaggggcaaggacagcc

SEQ ID NO: 806564 - DNA, 20 bp, mouse
gggagcccctatcccctccc

SEQ ID NO: 806565 - DNA, 20 bp, mouse
gaaaactcaggtcccttgaa

SEQ ID NO: 806566 - DNA, 20 bp, mouse
gggaaagaagatgtacatga

SEQ ID NO: 806567 - DNA, 20 bp, mouse
gtgcctagatggcgcaatct

SEQ ID NO: 806568 - DNA, 20 bp, mouse
gtggagccttagggaacagg

SEQ ID NO: 806569 - DNA, 20 bp, mouse
gaagtcttcgccatcctggt

SEQ ID NO: 806570 - DNA, 20 bp, mouse
gtgaatgtgtgataaatcat

SEQ ID NO: 806571 - DNA, 20 bp, mouse
gtccccagattgcgccatct

SEQ ID NO: 806572 - DNA, 20 bp, mouse
gtcctaactggccacatttc

SEQ ID NO: 806573 - DNA, 20 bp, mouse
ggacttcagaaagtcctaac

SEQ ID NO: 806574 - DNA, 20 bp, mouse
gccctttcaaagctcagttc

SEQ ID NO: 806575 - DNA, 20 bp, mouse
gtatactgtcactccactaa

SEQ ID NO: 806576 - DNA, 20 bp, mouse
gtagccagcaccaggaagaa

SEQ ID NO: 806577 - DNA, 20 bp, mouse
gagcaagagggactctgcca

SEQ ID NO: 806578 - DNA, 20 bp, mouse
ggtgctggctactgaagtta

SEQ ID NO: 806579 - DNA, 20 bp, mouse
gctagctttccctttcttcc

SEQ ID NO: 806580 - DNA, 20 bp, mouse
gagcttgtggtgtattactc

SEQ ID NO: 806581 - DNA, 20 bp, mouse
gtcactactcggcaagcact

SEQ ID NO: 806582 - DNA, 20 bp, mouse
gaaacattttagctaatctg

SEQ ID NO: 806583 - DNA, 20 bp, mouse
gagttacaggctggggctac

SEQ ID NO: 806584 - DNA, 20 bp, mouse
gggactctgccaaggcttgt

SEQ ID NO: 806585 - DNA, 20 bp, mouse
gagagggtggacaaaaacca

SEQ ID NO: 806586 - DNA, 20 bp, mouse
gggtggagaagaagacccca

SEQ ID NO: 806587 - DNA, 20 bp, mouse
gacggcagggggcgctgtgt

SEQ ID NO: 806588 - DNA, 20 bp, mouse
gggaacctgtaggatccatg

SEQ ID NO: 806589 - DNA, 20 bp, mouse
gaagaccccatggatcctac

SEQ ID NO: 806590 - DNA, 20 bp, mouse
ggtcaggctcccgcgaggtc

SEQ ID NO: 806591 - DNA, 20 bp, mouse
gtgtgctcactcctagctct

SEQ ID NO: 806592 - DNA, 20 bp, mouse
gtggaagtggaggcataaga

SEQ ID NO: 806593 - DNA, 20 bp, mouse
ggctcactcctagctctggg

SEQ ID NO: 806594 - DNA, 20 bp, mouse
gacaggttcccggacctcgc

SEQ ID NO: 806595 - DNA, 20 bp, mouse
gctgccgtcaggctcccgcg

SEQ ID NO: 806596 - DNA, 20 bp, mouse
ggatctctactgagtcagcc

SEQ ID NO: 806597 - DNA, 20 bp, mouse
gtgacttccagaccatgcaa

SEQ ID NO: 806598 - DNA, 20 bp, mouse
gaggggcaagggactagagc

SEQ ID NO: 806599 - DNA, 20 bp, mouse
gagttaaaacaaaacgcata

SEQ ID NO: 806600 - DNA, 20 bp, mouse
ggcgcctttaatccgggaat

SEQ ID NO: 806601 - DNA, 20 bp, mouse
gttaactgtgtacctttgca

SEQ ID NO: 806602 - DNA, 20 bp, mouse
gctgttgggtggagcctacc

SEQ ID NO: 806603 - DNA, 20 bp, mouse
gctttaatccgggaattgga

SEQ ID NO: 806604 - DNA, 20 bp, mouse
gatagacacgtacgtaaagc

SEQ ID NO: 806605 - DNA, 20 bp, mouse
gtgtgtacctttgcatggtc

SEQ ID NO: 806606 - DNA, 20 bp, mouse
ggggcgagcacgggagccgg

SEQ ID NO: 806607 - DNA, 20 bp, mouse
ggcgttacaccaatccccag

SEQ ID NO: 806608 - DNA, 20 bp, mouse
ggcgacgtcacggcgttctt

SEQ ID NO: 806609 - DNA, 20 bp, mouse
gcctcccgggtccgcctctc

SEQ ID NO: 806610 - DNA, 20 bp, mouse
gacgcctccgatgcgcggat

SEQ ID NO: 806611 - DNA, 20 bp, mouse
ggctccaatccgcgcatcgg

SEQ ID NO: 806612 - DNA, 20 bp, mouse
ggcagagaaaggcggagtcc

SEQ ID NO: 806613 - DNA, 20 bp, mouse
gcccgtgctcgcccgagagg

SEQ ID NO: 806614 - DNA, 20 bp, mouse
ggaccaccgcgcctggggag

SEQ ID NO: 806615 - DNA, 20 bp, mouse
ggaggcacgcctccgatgcg

SEQ ID NO: 806616 - DNA, 20 bp, mouse
gaaggcgtggctacgcggaa

SEQ ID NO: 806617 - DNA, 20 bp, mouse
ggctccgcccctctcgtgga

SEQ ID NO: 806618 - DNA, 20 bp, mouse
gaaggcgtggcctaagaagg

SEQ ID NO: 806619 - DNA, 20 bp, mouse
gaacggggcggggtcgaggc

SEQ ID NO: 806620 - DNA, 20 bp, mouse
ggggctgcaaagggccatgt

SEQ ID NO: 806621 - DNA, 20 bp, mouse
gcccctctcgtggatggcaa

SEQ ID NO: 806622 - DNA, 20 bp, mouse
gacggacccgcccccttctt

SEQ ID NO: 806623 - DNA, 20 bp, mouse
ggctcctccaagaacagtag

SEQ ID NO: 806624 - DNA, 20 bp, mouse
gcgcgcgctcggggctgcaa

SEQ ID NO: 806625 - DNA, 20 bp, mouse
gcgaagggcgctcctgggag

SEQ ID NO: 806626 - DNA, 20 bp, mouse
gtcgctgccccatcacgtga

SEQ ID NO: 806627 - DNA, 20 bp, mouse
gtggagacgccaatcaatcc

SEQ ID NO: 806628 - DNA, 20 bp, mouse
gcaggcgcggctctctgcgc

SEQ ID NO: 806629 - DNA, 20 bp, mouse
gaccgggattccagcatcga

SEQ ID NO: 806630 - DNA, 20 bp, mouse
gacgccaatcaatcccggag

SEQ ID NO: 806631 - DNA, 20 bp, mouse
ggcgtctccatcacgtgatg

SEQ ID NO: 806632 - DNA, 20 bp, mouse
gcaagcgcgtccccggtgca

SEQ ID NO: 806633 - DNA, 20 bp, mouse
gcacgcggtcatttatgaag

SEQ ID NO: 806634 - DNA, 20 bp, mouse
gtcctcctggacagaaaaag

SEQ ID NO: 806635 - DNA, 20 bp, mouse
ggtggataccgaagactcca

SEQ ID NO: 806636 - DNA, 20 bp, mouse
gtgcgcctgcgcatcactgt

SEQ ID NO: 806637 - DNA, 20 bp, mouse
gagcgctggccgtagagcgg

SEQ ID NO: 806638 - DNA, 20 bp, mouse
gcgcgtgcgcattaaaaaga

SEQ ID NO: 806639 - DNA, 20 bp, mouse
gtgcgcacgccaccgctcta

SEQ ID NO: 806640 - DNA, 20 bp, mouse
gtaaaggcgtctgagagcgt

SEQ ID NO: 806641 - DNA, 20 bp, mouse
gacgctgcgagaggcaaacg

SEQ ID NO: 806642 - DNA, 20 bp, mouse
gccaagcgcagtgtgcgcgg

SEQ ID NO: 806643 - DNA, 20 bp, mouse
ggcggcggcagagacgacgt

SEQ ID NO: 806644 - DNA, 20 bp, mouse
gcgctccgacagtgatgcgc

SEQ ID NO: 806645 - DNA, 20 bp, mouse
gtcgaggtgcgcctccgggg

SEQ ID NO: 806646 - DNA, 20 bp, mouse
gcgcgtgcgcattaaaaaga

SEQ ID NO: 806647 - DNA, 20 bp, mouse
gtgcgcctgcgcatcactgt

SEQ ID NO: 806648 - DNA, 20 bp, mouse
gagcgctggccgtagagcgg

SEQ ID NO: 806649 - DNA, 20 bp, mouse
gtaaaaagagggtggcgacg

SEQ ID NO: 806650 - DNA, 20 bp, mouse
gagggtggcgacggggccgg

SEQ ID NO: 806651 - DNA, 20 bp, mouse
gacgctgcgagaggcaaacg

SEQ ID NO: 806652 - DNA, 20 bp, mouse
ggggagggggggcttacgac

SEQ ID NO: 806653 - DNA, 20 bp, mouse
gtgcgcacgccaccgctcta

SEQ ID NO: 806654 - DNA, 20 bp, mouse
ggtcagtgagcgtagcgagg

SEQ ID NO: 806655 - DNA, 20 bp, mouse
gtaaaggcgtctgagagcgt

SEQ ID NO: 806656 - DNA, 20 bp, mouse
gaatgctagaactgctgaag

SEQ ID NO: 806657 - DNA, 20 bp, mouse
ggctgattggattatcgaga

SEQ ID NO: 806658 - DNA, 20 bp, mouse
gaggcccctggctgccccgg

SEQ ID NO: 806659 - DNA, 20 bp, mouse
gtgggaccctctgagaagat

SEQ ID NO: 806660 - DNA, 20 bp, mouse
gccctgtggggttatctgat

SEQ ID NO: 806661 - DNA, 20 bp, mouse
gggagctccaatcttctcag

SEQ ID NO: 806662 - DNA, 20 bp, mouse
gtccccccccggggcagcca

SEQ ID NO: 806663 - DNA, 20 bp, mouse
gtggatggctcgtgcatctt

SEQ ID NO: 806664 - DNA, 20 bp, mouse
gcccggggggggaatttgta

SEQ ID NO: 806665 - DNA, 20 bp, mouse
gacactgagacctaacagct

SEQ ID NO: 806666 - DNA, 20 bp, mouse
gtcgcgatcaggagaggaga

SEQ ID NO: 806667 - DNA, 20 bp, mouse
gcagtcggctcgcgcgaagt

SEQ ID NO: 806668 - DNA, 20 bp, mouse
gagaccagggagacgcgcga

SEQ ID NO: 806669 - DNA, 20 bp, mouse
gcaaaggcgctccagaattg

SEQ ID NO: 806670 - DNA, 20 bp, mouse
gcataaggacgccccaattc

SEQ ID NO: 806671 - DNA, 20 bp, mouse
gtgtcacgatccagactcaa

SEQ ID NO: 806672 - DNA, 20 bp, mouse
gtctggagcgcctttgagtc

SEQ ID NO: 806673 - DNA, 20 bp, mouse
ggggaaaaagaaccgtggaa

SEQ ID NO: 806674 - DNA, 20 bp, mouse
gagggagacgcgcgaggggt

SEQ ID NO: 806675 - DNA, 20 bp, mouse
gctctcctgatcgcgagata

SEQ ID NO: 806676 - DNA, 20 bp, mouse
gcacccagcgacccagactg

SEQ ID NO: 806677 - DNA, 20 bp, mouse
ggagcgcgaaagctggtagt

SEQ ID NO: 806678 - DNA, 20 bp, mouse
gaaagctggtagtggggaga

SEQ ID NO: 806679 - DNA, 20 bp, mouse
gaggataaagacatctgggg

SEQ ID NO: 806680 - DNA, 20 bp, mouse
gggggagctggcagaggata

SEQ ID NO: 806681 - DNA, 20 bp, mouse
gggcgagagcggagagtgcg

SEQ ID NO: 806682 - DNA, 20 bp, mouse
ggcagaggatagggcacagt

SEQ ID NO: 806683 - DNA, 20 bp, mouse
gtctgggtcaggtgtcagtg

SEQ ID NO: 806684 - DNA, 20 bp, mouse
gcagggagggagacgaaagc

SEQ ID NO: 806685 - DNA, 20 bp, mouse
gagtctaggaagctttactc

SEQ ID NO: 806686 - DNA, 20 bp, mouse
gcggagccgcacctgagcga

SEQ ID NO: 806687 - DNA, 20 bp, mouse
gccccaggaccacaagcggt

SEQ ID NO: 806688 - DNA, 20 bp, mouse
gcggctcgcccagcccgctc

SEQ ID NO: 806689 - DNA, 20 bp, mouse
gcggcccggccgaccgcttg

SEQ ID NO: 806690 - DNA, 20 bp, mouse
ggtgcggcgcccgagcagcc

SEQ ID NO: 806691 - DNA, 20 bp, mouse
gcgagacaaaggcgccgggc

SEQ ID NO: 806692 - DNA, 20 bp, mouse
gaggaccccgcgaagtggac

SEQ ID NO: 806693 - DNA, 20 bp, mouse
gccgcgaagtggacaggagc

SEQ ID NO: 806694 - DNA, 20 bp, mouse
gggtcctccggcaacccgcc

SEQ ID NO: 806695 - DNA, 20 bp, mouse
gagcagcccgggcgagacaa

SEQ ID NO: 806696 - DNA, 20 bp, mouse
gagccctcattgatcaggga

SEQ ID NO: 806697 - DNA, 20 bp, mouse
gaattcggatagtggccgca

SEQ ID NO: 806698 - DNA, 20 bp, mouse
gtccaagtcgatccacgcct

SEQ ID NO: 806699 - DNA, 20 bp, mouse
ggacaaaggcgtgttcatct

SEQ ID NO: 806700 - DNA, 20 bp, mouse
ggcctcggccaatctgagcc

SEQ ID NO: 806701 - DNA, 20 bp, mouse
gaataagccctcattgatca

SEQ ID NO: 806702 - DNA, 20 bp, mouse
gcgtggatcgacttggaggt

SEQ ID NO: 806703 - DNA, 20 bp, mouse
gcacgcctttgtcacatgta

SEQ ID NO: 806704 - DNA, 20 bp, mouse
ggccgaggcgtggatcgact

SEQ ID NO: 806705 - DNA, 20 bp, mouse
gcgaattctgagacggaaaa

SEQ ID NO: 806706 - DNA, 20 bp, mouse
gcgcgcgcgcccagcagaag

SEQ ID NO: 806707 - DNA, 20 bp, mouse
gcaacagccccgcttctgct

SEQ ID NO: 806708 - DNA, 20 bp, mouse
gctagagcgacgggtacacg

SEQ ID NO: 806709 - DNA, 20 bp, mouse
gccggagtgagctagagcga

SEQ ID NO: 806710 - DNA, 20 bp, mouse
gcgcgcgggagttgtaaggg

SEQ ID NO: 806711 - DNA, 20 bp, mouse
gaggggggccggagtgtccc

SEQ ID NO: 806712 - DNA, 20 bp, mouse
gccccacgcgcccgctttta

SEQ ID NO: 806713 - DNA, 20 bp, mouse
gaaagcgcgcgggagttgta

SEQ ID NO: 806714 - DNA, 20 bp, mouse
gcgcacgcgcgccctgcgcc

SEQ ID NO: 806715 - DNA, 20 bp, mouse
gcgggctccaccttaaaagc

SEQ ID NO: 806716 - DNA, 20 bp, mouse
gctccagcgggttgcaagag

SEQ ID NO: 806717 - DNA, 20 bp, mouse
gcgtccttgcgcacctgggt

SEQ ID NO: 806718 - DNA, 20 bp, mouse
gggtccacggagtcctaccc

SEQ ID NO: 806719 - DNA, 20 bp, mouse
gaactgcaaaggccctccag

SEQ ID NO: 806720 - DNA, 20 bp, mouse
gcgcggggctgcgtatgctt

SEQ ID NO: 806721 - DNA, 20 bp, mouse
ggagctcggaggtgtatcgg

SEQ ID NO: 806722 - DNA, 20 bp, mouse
gcccaccaccaccagaccga

SEQ ID NO: 806723 - DNA, 20 bp, mouse
gggtcccctcggtctggtgg

SEQ ID NO: 806724 - DNA, 20 bp, mouse
gcgggagctcggaggtgtat

SEQ ID NO: 806725 - DNA, 20 bp, mouse
gttggcaggcgaggtcccct

SEQ ID NO: 806726 - DNA, 20 bp, mouse
gtccccgaggggcccagatg

SEQ ID NO: 806727 - DNA, 20 bp, mouse
ggaggtgagcggtctctcta

SEQ ID NO: 806728 - DNA, 20 bp, mouse
gtctctctgacacccgacac

SEQ ID NO: 806729 - DNA, 20 bp, mouse
gccctctgggcctgtggtgc

SEQ ID NO: 806730 - DNA, 20 bp, mouse
gaggcaggcgctgtctgcag

SEQ ID NO: 806731 - DNA, 20 bp, mouse
gcctcagcagacatccccga

SEQ ID NO: 806732 - DNA, 20 bp, mouse
gtataccccacctgccctct

SEQ ID NO: 806733 - DNA, 20 bp, mouse
gagcccggctccagtcaccc

SEQ ID NO: 806734 - DNA, 20 bp, mouse
ggccgcatctgggcccctcg

SEQ ID NO: 806735 - DNA, 20 bp, mouse
gtggggtataagtactttat

SEQ ID NO: 806736 - DNA, 20 bp, mouse
gcaaatgggaggcttcgagg

SEQ ID NO: 806737 - DNA, 20 bp, mouse
gaagggaaccccgagagtga

SEQ ID NO: 806738 - DNA, 20 bp, mouse
gttgggagattgtgcaagaa

SEQ ID NO: 806739 - DNA, 20 bp, mouse
ggctccgcgcgaggcggcat

SEQ ID NO: 806740 - DNA, 20 bp, mouse
gcggggcaggaggagtacct

SEQ ID NO: 806741 - DNA, 20 bp, mouse
gtagatatacgctcctactg

SEQ ID NO: 806742 - DNA, 20 bp, mouse
gcgagctgcacgggacaaat

SEQ ID NO: 806743 - DNA, 20 bp, mouse
ggggaggcttcgagggggtt

SEQ ID NO: 806744 - DNA, 20 bp, mouse
gtggcgaaatcgagctgcac

SEQ ID NO: 806745 - DNA, 20 bp, mouse
gccgaggtccgtagaagagc

SEQ ID NO: 806746 - DNA, 20 bp, mouse
gagaagggaggggctcctcc

SEQ ID NO: 806747 - DNA, 20 bp, mouse
gaagccgggcggaggcagag

SEQ ID NO: 806748 - DNA, 20 bp, mouse
gcagaggctctaagagggaa

SEQ ID NO: 806749 - DNA, 20 bp, mouse
gtgaatccgctgggattctg

SEQ ID NO: 806750 - DNA, 20 bp, mouse
ggtcctcctcagaatcccag

SEQ ID NO: 806751 - DNA, 20 bp, mouse
gcttccagggagcagaaggg

SEQ ID NO: 806752 - DNA, 20 bp, mouse
gagaccctccggcgccacgg

SEQ ID NO: 806753 - DNA, 20 bp, mouse
ggggttaccaacattttctg

SEQ ID NO: 806754 - DNA, 20 bp, mouse
gggaaaggactgaatccgct

SEQ ID NO: 806755 - DNA, 20 bp, mouse
gggcaaactctgtacagcgg

SEQ ID NO: 806756 - DNA, 20 bp, mouse
gagtctgcgcgcgaatggca

SEQ ID NO: 806757 - DNA, 20 bp, mouse
gaatggcagggaagcgacca

SEQ ID NO: 806758 - DNA, 20 bp, mouse
ggaaagccccgtgcgtccta

SEQ ID NO: 806759 - DNA, 20 bp, mouse
gcgcgggagtctcagcgcta

SEQ ID NO: 806760 - DNA, 20 bp, mouse
gggtgcccgcggccggcccc

SEQ ID NO: 806761 - DNA, 20 bp, mouse
gcgggcgagcggccagcctg

SEQ ID NO: 806762 - DNA, 20 bp, mouse
gcggaagcagctaggaccga

SEQ ID NO: 806763 - DNA, 20 bp, mouse
gtagggagtctgcgcgcgaa

SEQ ID NO: 806764 - DNA, 20 bp, mouse
ggggatcccggggccggccg

SEQ ID NO: 806765 - DNA, 20 bp, mouse
gtaaggcgggaccgcctccc

SEQ ID NO: 806766 - DNA, 20 bp, mouse
gagccacgggccggaaggag

SEQ ID NO: 806767 - DNA, 20 bp, mouse
gctggcctgacacgtgagag

SEQ ID NO: 806768 - DNA, 20 bp, mouse
ggccggaaggagcggctggg

SEQ ID NO: 806769 - DNA, 20 bp, mouse
ggggcggcagagggtagcgc

SEQ ID NO: 806770 - DNA, 20 bp, mouse
gcccgcccctctcacgtgtc

SEQ ID NO: 806771 - DNA, 20 bp, mouse
gcgggctgcagatgtcggac

SEQ ID NO: 806772 - DNA, 20 bp, mouse
gcggagccgaagcgagccac

SEQ ID NO: 806773 - DNA, 20 bp, mouse
gggagcggctgggcggcaga

SEQ ID NO: 806774 - DNA, 20 bp, mouse
ggcctgacacgtgagagggg

SEQ ID NO: 806775 - DNA, 20 bp, mouse
ggcggcagaggagagccgag

SEQ ID NO: 806776 - DNA, 20 bp, mouse
ggggtcatctctctcttagt

SEQ ID NO: 806777 - DNA, 20 bp, mouse
gccactgtcctcacagctct

SEQ ID NO: 806778 - DNA, 20 bp, mouse
gtgagagacgtaagtaaacc

SEQ ID NO: 806779 - DNA, 20 bp, mouse
gaagtggttgacatttacag

SEQ ID NO: 806780 - DNA, 20 bp, mouse
gcagcaaactcttttctcag

SEQ ID NO: 806781 - DNA, 20 bp, mouse
gttgacatttacagaggggt

SEQ ID NO: 806782 - DNA, 20 bp, mouse
gagaaaggtgtgaaatcatc

SEQ ID NO: 806783 - DNA, 20 bp, mouse
gggagtaacattggaacgac

SEQ ID NO: 806784 - DNA, 20 bp, mouse
gcatttacagaggggtgggc

SEQ ID NO: 806785 - DNA, 20 bp, mouse
gcattggaacgacaggagaa

SEQ ID NO: 806786 - DNA, 20 bp, mouse
gtaagcccgggccatagagg

SEQ ID NO: 806787 - DNA, 20 bp, mouse
gcggcacgcgggggagtcgg

SEQ ID NO: 806788 - DNA, 20 bp, mouse
gcacgcgggggagtcggggg

SEQ ID NO: 806789 - DNA, 20 bp, mouse
gggtccgggtgaattcctct

SEQ ID NO: 806790 - DNA, 20 bp, mouse
gggggggagaggaacccggg

SEQ ID NO: 806791 - DNA, 20 bp, mouse
gcggcggcacgcgggggagt

SEQ ID NO: 806792 - DNA, 20 bp, mouse
gcccgggccatagaggagga

SEQ ID NO: 806793 - DNA, 20 bp, mouse
gggagcggaagagcgcagat

SEQ ID NO: 806794 - DNA, 20 bp, mouse
gtcctaagcccgggccatag

SEQ ID NO: 806795 - DNA, 20 bp, mouse
gccacccgcgtgttctacaa

SEQ ID NO: 806796 - DNA, 20 bp, mouse
gggcccaatcggagaccgct

SEQ ID NO: 806797 - DNA, 20 bp, mouse
ggagctgaccgggtgatggg

SEQ ID NO: 806798 - DNA, 20 bp, mouse
ggcaccaatcagtggtttta

SEQ ID NO: 806799 - DNA, 20 bp, mouse
gcacctagcggtctccgatt

SEQ ID NO: 806800 - DNA, 20 bp, mouse
gtcgcgtggcagagtcccac

SEQ ID NO: 806801 - DNA, 20 bp, mouse
gatgggcggggcctactcgg

SEQ ID NO: 806802 - DNA, 20 bp, mouse
gggcggggcctactcggagg

SEQ ID NO: 806803 - DNA, 20 bp, mouse
gtgccatggggactagtggg

SEQ ID NO: 806804 - DNA, 20 bp, mouse
gcggaggcggggcagcgagc

SEQ ID NO: 806805 - DNA, 20 bp, mouse
gggctcccaaaaaagtaaag

SEQ ID NO: 806806 - DNA, 20 bp, mouse
ggtgacccgcgcgggtgcga

SEQ ID NO: 806807 - DNA, 20 bp, mouse
gcccagctggggaacctcct

SEQ ID NO: 806808 - DNA, 20 bp, mouse
ggctccggcgggcagaccgg

SEQ ID NO: 806809 - DNA, 20 bp, mouse
ggtggccgcgcatccagggg

SEQ ID NO: 806810 - DNA, 20 bp, mouse
gtcgcgctgcgccgcccagg

SEQ ID NO: 806811 - DNA, 20 bp, mouse
gggagccgcctccacggcgt

SEQ ID NO: 806812 - DNA, 20 bp, mouse
gcccgccggagccgcctcca

SEQ ID NO: 806813 - DNA, 20 bp, mouse
gacccggttgcagacgtcca

SEQ ID NO: 806814 - DNA, 20 bp, mouse
gagcgcgacggtgacccgcg

SEQ ID NO: 806815 - DNA, 20 bp, mouse
gcacacccctcgcacccgcg

SEQ ID NO: 806816 - DNA, 20 bp, mouse
gcccaaggaaagtgcagtag

SEQ ID NO: 806817 - DNA, 20 bp, mouse
ggccccacaaagcatcttaa

SEQ ID NO: 806818 - DNA, 20 bp, mouse
gaaaggctaaactctgagac

SEQ ID NO: 806819 - DNA, 20 bp, mouse
gtgagaatgggcactctata

SEQ ID NO: 806820 - DNA, 20 bp, mouse
gtatctgtggaggatgtccg

SEQ ID NO: 806821 - DNA, 20 bp, mouse
gctaaaagatgttaagccca

SEQ ID NO: 806822 - DNA, 20 bp, mouse
gtaaggaaggattatgctaa

SEQ ID NO: 806823 - DNA, 20 bp, mouse
gtagcctttaagatgctttg

SEQ ID NO: 806824 - DNA, 20 bp, mouse
ggtggaggatgtccgagggc

SEQ ID NO: 806825 - DNA, 20 bp, mouse
ggcatcttaaaggctaagga

SEQ ID NO: 806826 - DNA, 20 bp, mouse
gaagaggaggggaaacccaa

SEQ ID NO: 806827 - DNA, 20 bp, mouse
gcccaagcataattcatcaa

SEQ ID NO: 806828 - DNA, 20 bp, mouse
gtcccgaagcagttccggtt

SEQ ID NO: 806829 - DNA, 20 bp, mouse
gggcttgtgggttgttgact

SEQ ID NO: 806830 - DNA, 20 bp, mouse
ggcgggtccaaaaccggaag

SEQ ID NO: 806831 - DNA, 20 bp, mouse
gaagataggagaaggcttgt

SEQ ID NO: 806832 - DNA, 20 bp, mouse
gcagcagcggccagccgaac

SEQ ID NO: 806833 - DNA, 20 bp, mouse
gtccaaaaccggaagaggag

SEQ ID NO: 806834 - DNA, 20 bp, mouse
gaggataatagcctcttcct

SEQ ID NO: 806835 - DNA, 20 bp, mouse
ggagggggcgggtccaaaac

SEQ ID NO: 806836 - DNA, 20 bp, mouse
gaaccagcaggtggcatagt

SEQ ID NO: 806837 - DNA, 20 bp, mouse
gcacaggcagaaaagattaa

SEQ ID NO: 806838 - DNA, 20 bp, mouse
gggtactaaacaactggcgg

SEQ ID NO: 806839 - DNA, 20 bp, mouse
gagagcaagctgcacagtcg

SEQ ID NO: 806840 - DNA, 20 bp, mouse
gtaaacaactggcgggggtg

SEQ ID NO: 806841 - DNA, 20 bp, mouse
ggtgggtactaaacaactgg

SEQ ID NO: 806842 - DNA, 20 bp, mouse
gtctttttgtagagtttttt

SEQ ID NO: 806843 - DNA, 20 bp, mouse
gtggaggaactgtggggact

SEQ ID NO: 806844 - DNA, 20 bp, mouse
gaggaactgtggggactggg

SEQ ID NO: 806845 - DNA, 20 bp, mouse
gactggggggaatgggatga

SEQ ID NO: 806846 - DNA, 20 bp, mouse
gctcccagggctgatgtccg

SEQ ID NO: 806847 - DNA, 20 bp, mouse
gcggggaggccacgctccca

SEQ ID NO: 806848 - DNA, 20 bp, mouse
gtccccggggcgctcgcgcc

SEQ ID NO: 806849 - DNA, 20 bp, mouse
gaaacacaagggcggagttg

SEQ ID NO: 806850 - DNA, 20 bp, mouse
gttggggtgtggtgtcagtg

SEQ ID NO: 806851 - DNA, 20 bp, mouse
ggggccgggcgcgagcgccc

SEQ ID NO: 806852 - DNA, 20 bp, mouse
gcgccccggacatcagccct

SEQ ID NO: 806853 - DNA, 20 bp, mouse
ggagttgagggcgatcgcgt

SEQ ID NO: 806854 - DNA, 20 bp, mouse
gtgcgcttgcgcaatgggcc

SEQ ID NO: 806855 - DNA, 20 bp, mouse
gaggcattgcgcttgcgcaa

SEQ ID NO: 806856 - DNA, 20 bp, mouse
gtggtcccgtgaaaaggcaa

SEQ ID NO: 806857 - DNA, 20 bp, mouse
gaacgctccacgcttgcact

SEQ ID NO: 806858 - DNA, 20 bp, mouse
gagcggagggtcttgagtca

SEQ ID NO: 806859 - DNA, 20 bp, mouse
gtgagctcctcgttgtatgg

SEQ ID NO: 806860 - DNA, 20 bp, mouse
gggtaagcccccatacaacg

SEQ ID NO: 806861 - DNA, 20 bp, mouse
gaggaagcccagtgcaagcg

SEQ ID NO: 806862 - DNA, 20 bp, mouse
gcccagaaagctgcggttat

SEQ ID NO: 806863 - DNA, 20 bp, mouse
gcagagctggtcccgtgaaa

SEQ ID NO: 806864 - DNA, 20 bp, mouse
gccgacgggtccagtaaaaa

SEQ ID NO: 806865 - DNA, 20 bp, mouse
ggggtccagtaaaaagggtc

SEQ ID NO: 806866 - DNA, 20 bp, mouse
gttaccaaataattacggta

SEQ ID NO: 806867 - DNA, 20 bp, mouse
gtcagtgtctgcttggttga

SEQ ID NO: 806868 - DNA, 20 bp, mouse
gcaaataattacggtaagga

SEQ ID NO: 806869 - DNA, 20 bp, mouse
ggtaattactaagggtgtaa

SEQ ID NO: 806870 - DNA, 20 bp, mouse
gtaactctgtactgtattct

SEQ ID NO: 806871 - DNA, 20 bp, mouse
gtggctacggtaattactaa

SEQ ID NO: 806872 - DNA, 20 bp, mouse
gcacacctttgacatggcta

SEQ ID NO: 806873 - DNA, 20 bp, mouse
gttagctcacacctttgaca

SEQ ID NO: 806874 - DNA, 20 bp, mouse
gtatcagatgctgggtatca

SEQ ID NO: 806875 - DNA, 20 bp, mouse
ggaagtcacatcctgaccag

SEQ ID NO: 806876 - DNA, 20 bp, mouse
gaacctgtgaagaatattct

SEQ ID NO: 806877 - DNA, 20 bp, mouse
gtaagctttaattctggtat

SEQ ID NO: 806878 - DNA, 20 bp, mouse
gcgcatgtaatgaacaactt

SEQ ID NO: 806879 - DNA, 20 bp, mouse
gaaagtcctgagcaatgatg

SEQ ID NO: 806880 - DNA, 20 bp, mouse
ggcttactcttttttgattc

SEQ ID NO: 806881 - DNA, 20 bp, mouse
ggcaatgatgaggttcaaat

SEQ ID NO: 806882 - DNA, 20 bp, mouse
gtaccaagaatattcttcac

SEQ ID NO: 806883 - DNA, 20 bp, mouse
gagaagatccagtagtaacc

SEQ ID NO: 806884 - DNA, 20 bp, mouse
ggaaaaatctagcttgttga

SEQ ID NO: 806885 - DNA, 20 bp, mouse
ggagagcatgctggaaagat

SEQ ID NO: 806886 - DNA, 20 bp, mouse
ggaattgtgagcaatggtgt

SEQ ID NO: 806887 - DNA, 20 bp, mouse
gtgtgtggaagagacataaa

SEQ ID NO: 806888 - DNA, 20 bp, mouse
gacagggaggtttagcacat

SEQ ID NO: 806889 - DNA, 20 bp, mouse
gtacctaatatgtgtctgtg

SEQ ID NO: 806890 - DNA, 20 bp, mouse
ggcatcttttagagactttg

SEQ ID NO: 806891 - DNA, 20 bp, mouse
gaatggtgaattgtgagcaa

SEQ ID NO: 806892 - DNA, 20 bp, mouse
gattacttacatagtagaaa

SEQ ID NO: 806893 - DNA, 20 bp, mouse
gaacatgactgtcttttttc

SEQ ID NO: 806894 - DNA, 20 bp, mouse
gcattatgcccttgtagtca

SEQ ID NO: 806895 - DNA, 20 bp, mouse
gtagctactgtaatatctga

SEQ ID NO: 806896 - DNA, 20 bp, mouse
gtgggtaaagtggtagaaat

SEQ ID NO: 806897 - DNA, 20 bp, mouse
gtggagggaaggatcatcca

SEQ ID NO: 806898 - DNA, 20 bp, mouse
gggaatggaaaacttgatga

SEQ ID NO: 806899 - DNA, 20 bp, mouse
gtggttccaaaagacatatg

SEQ ID NO: 806900 - DNA, 20 bp, mouse
gatgggagaaatgggtaaag

SEQ ID NO: 806901 - DNA, 20 bp, mouse
gatgtagaatgtgatgggaa

SEQ ID NO: 806902 - DNA, 20 bp, mouse
gcaacaaattatacagtata

SEQ ID NO: 806903 - DNA, 20 bp, mouse
ggtagttactaatagaatgg

SEQ ID NO: 806904 - DNA, 20 bp, mouse
gtaatcttaaaggcaagtgg

SEQ ID NO: 806905 - DNA, 20 bp, mouse
gaatgtagttactaatagaa

SEQ ID NO: 806906 - DNA, 20 bp, mouse
ggggcctgggcgactggacg

SEQ ID NO: 806907 - DNA, 20 bp, mouse
gcccaggccccgccctctta

SEQ ID NO: 806908 - DNA, 20 bp, mouse
gagggcggggcctgggcgac

SEQ ID NO: 806909 - DNA, 20 bp, mouse
gaggatacggcgggctctcg

SEQ ID NO: 806910 - DNA, 20 bp, mouse
gccgcctcttggagccgaag

SEQ ID NO: 806911 - DNA, 20 bp, mouse
ggtccccagccctaagaggg

SEQ ID NO: 806912 - DNA, 20 bp, mouse
gagcccgcgtccagtcgccc

SEQ ID NO: 806913 - DNA, 20 bp, mouse
ggacgcgtaaggagtaaagg

SEQ ID NO: 806914 - DNA, 20 bp, mouse
gaggcctcttcggctccaag

SEQ ID NO: 806915 - DNA, 20 bp, mouse
ggccccgccctcttagggct

SEQ ID NO: 806916 - DNA, 20 bp, mouse
gtacgtgttgccttggggag

SEQ ID NO: 806917 - DNA, 20 bp, mouse
gttgccttggggagaggggt

SEQ ID NO: 806918 - DNA, 20 bp, mouse
gcgcatgcgcagtgctctac

SEQ ID NO: 806919 - DNA, 20 bp, mouse
gcgcgcgtacgtgttgcctt

SEQ ID NO: 806920 - DNA, 20 bp, mouse
ggcggggcatcgcatggcgc

SEQ ID NO: 806921 - DNA, 20 bp, mouse
gtcaagagaggcaaatccag

SEQ ID NO: 806922 - DNA, 20 bp, mouse
gcactctgaagaccaggtga

SEQ ID NO: 806923 - DNA, 20 bp, mouse
gggcaaggcggggcatcgca

SEQ ID NO: 806924 - DNA, 20 bp, mouse
ggggtaaagctgtctgttta

SEQ ID NO: 806925 - DNA, 20 bp, mouse
gtatcatcactatgactacc

SEQ ID NO: 806926 - DNA, 20 bp, mouse
ggctcccaccaggttctcaa

SEQ ID NO: 806927 - DNA, 20 bp, mouse
gagcccaaaggcctgtaggt

SEQ ID NO: 806928 - DNA, 20 bp, mouse
gacactgggactcacagtag

SEQ ID NO: 806929 - DNA, 20 bp, mouse
gaggcacggggcacttgtgc

SEQ ID NO: 806930 - DNA, 20 bp, mouse
gagctcgcgcattcatggac

SEQ ID NO: 806931 - DNA, 20 bp, mouse
gtcgggtacagcccccatct

SEQ ID NO: 806932 - DNA, 20 bp, mouse
gaaggacagcagcgatgtga

SEQ ID NO: 806933 - DNA, 20 bp, mouse
ggactcacagtagaggactc

SEQ ID NO: 806934 - DNA, 20 bp, mouse
ggagcccttgagaacctggt

SEQ ID NO: 806935 - DNA, 20 bp, mouse
gaggaaggggcccctggaag

SEQ ID NO: 806936 - DNA, 20 bp, mouse
gctccctcgcgcaggttctg

SEQ ID NO: 806937 - DNA, 20 bp, mouse
gacctgccgcgcggccccac

SEQ ID NO: 806938 - DNA, 20 bp, mouse
gtcgccacgcgacgcatgct

SEQ ID NO: 806939 - DNA, 20 bp, mouse
gccgcgcggccccacgggaa

SEQ ID NO: 806940 - DNA, 20 bp, mouse
gaaaaccagcccttgctcgc

SEQ ID NO: 806941 - DNA, 20 bp, mouse
gaaccccagaacctgcgcga

SEQ ID NO: 806942 - DNA, 20 bp, mouse
gtgctcgcaggagagaatag

SEQ ID NO: 806943 - DNA, 20 bp, mouse
gacgctctagaagtcagctg

SEQ ID NO: 806944 - DNA, 20 bp, mouse
gcatcccagcatgcgtcgcg

SEQ ID NO: 806945 - DNA, 20 bp, mouse
gccgcgcggcaggtgtgggg

SEQ ID NO: 806946 - DNA, 20 bp, mouse
gaatcaaaagggctgtgtct

SEQ ID NO: 806947 - DNA, 20 bp, mouse
gggacggaagtaaggtcttg

SEQ ID NO: 806948 - DNA, 20 bp, mouse
gggcgagagctgttgacttg

SEQ ID NO: 806949 - DNA, 20 bp, mouse
gacttcgctgacttctcggg

SEQ ID NO: 806950 - DNA, 20 bp, mouse
gtctacttcgctgacttctc

SEQ ID NO: 806951 - DNA, 20 bp, mouse
gtcagcacgggacggaagta

SEQ ID NO: 806952 - DNA, 20 bp, mouse
gggtcggcgtccttgatgaa

SEQ ID NO: 806953 - DNA, 20 bp, mouse
gaaacgtcatcagcacggga

SEQ ID NO: 806954 - DNA, 20 bp, mouse
gggcttctgagttcgagtta

SEQ ID NO: 806955 - DNA, 20 bp, mouse
gagccaaccgaaaagagcct

SEQ ID NO: 806956 - DNA, 20 bp, mouse
gccgcgagggatgctgaacg

SEQ ID NO: 806957 - DNA, 20 bp, mouse
gcgccgctggcagttcccat

SEQ ID NO: 806958 - DNA, 20 bp, mouse
ggtagcctggcaccggagac

SEQ ID NO: 806959 - DNA, 20 bp, mouse
gagggatgctgaacggggtc

SEQ ID NO: 806960 - DNA, 20 bp, mouse
gcaagagggaagagttaccc

SEQ ID NO: 806961 - DNA, 20 bp, mouse
gcaccggagaccggcagcga

SEQ ID NO: 806962 - DNA, 20 bp, mouse
ggctgccggtctccggtgcc

SEQ ID NO: 806963 - DNA, 20 bp, mouse
gggcagcgatggcgcccaat

SEQ ID NO: 806964 - DNA, 20 bp, mouse
gacgcggggcctccacctca

SEQ ID NO: 806965 - DNA, 20 bp, mouse
gcgccatcgctgccggtctc

SEQ ID NO: 806966 - DNA, 20 bp, mouse
gctgtccttgggactcaatg

SEQ ID NO: 806967 - DNA, 20 bp, mouse
gaggcaggatgggtagaaga

SEQ ID NO: 806968 - DNA, 20 bp, mouse
gctgaaagacaaggcaggat

SEQ ID NO: 806969 - DNA, 20 bp, mouse
gagaattatcctggcctcac

SEQ ID NO: 806970 - DNA, 20 bp, mouse
gacaccctcttctagtctca

SEQ ID NO: 806971 - DNA, 20 bp, mouse
gccttgtctttcagcctgtg

SEQ ID NO: 806972 - DNA, 20 bp, mouse
gtaaataaatgcaggtacga

SEQ ID NO: 806973 - DNA, 20 bp, mouse
gaaagtaggaagggcggagc

SEQ ID NO: 806974 - DNA, 20 bp, mouse
gttgtcctcattgagtccca

SEQ ID NO: 806975 - DNA, 20 bp, mouse
gtagataattacatttagtc

SEQ ID NO: 806976 - DNA, 20 bp, mouse
gcccaagggccggatggtgt

SEQ ID NO: 806977 - DNA, 20 bp, mouse
ggggagacttaacgagaaac

SEQ ID NO: 806978 - DNA, 20 bp, mouse
gggcgggcgcccacaccatc

SEQ ID NO: 806979 - DNA, 20 bp, mouse
gaagtctcccaagggccgga

SEQ ID NO: 806980 - DNA, 20 bp, mouse
gttctcgttaagtctcccaa

SEQ ID NO: 806981 - DNA, 20 bp, mouse
gggatggtggacgtggagac

SEQ ID NO: 806982 - DNA, 20 bp, mouse
gaaactggcccatctgttcc

SEQ ID NO: 806983 - DNA, 20 bp, mouse
ggcaggagggatggtggacg

SEQ ID NO: 806984 - DNA, 20 bp, mouse
ggaaatcaaactgggactgg

SEQ ID NO: 806985 - DNA, 20 bp, mouse
ggagccaatcccggaacaga

SEQ ID NO: 806986 - DNA, 20 bp, mouse
gtgaggctccgcccgctctg

SEQ ID NO: 806987 - DNA, 20 bp, mouse
gtgcccggaagtctcaggga

SEQ ID NO: 806988 - DNA, 20 bp, mouse
gctaacagccactctggccg

SEQ ID NO: 806989 - DNA, 20 bp, mouse
gagagcctccacagagcggg

SEQ ID NO: 806990 - DNA, 20 bp, mouse
gggctccgcccgctctgtgg

SEQ ID NO: 806991 - DNA, 20 bp, mouse
gtaaggagtgacgtacgctc

SEQ ID NO: 806992 - DNA, 20 bp, mouse
gtcgacgcgtcacgccgtcc

SEQ ID NO: 806993 - DNA, 20 bp, mouse
gtctgtggaggctctcaagc

SEQ ID NO: 806994 - DNA, 20 bp, mouse
ggcgcgccggacatcagaag

SEQ ID NO: 806995 - DNA, 20 bp, mouse
gcgcctctccgcggccagag

SEQ ID NO: 806996 - DNA, 20 bp, mouse
gtggtccggagcacagggat

SEQ ID NO: 806997 - DNA, 20 bp, mouse
gtggcgagaccgcaaggagg

SEQ ID NO: 806998 - DNA, 20 bp, mouse
gtgaagtggtccggagcaca

SEQ ID NO: 806999 - DNA, 20 bp, mouse
gaggcacccgccgacccgga

SEQ ID NO: 807000 - DNA, 20 bp, mouse
gtcttggggttggagtgaag

SEQ ID NO: 807001 - DNA, 20 bp, mouse
gaaaatctcacatgcctctt

SEQ ID NO: 807002 - DNA, 20 bp, mouse
gctcacatgcctcttggggt

SEQ ID NO: 807003 - DNA, 20 bp, mouse
gcgcaaggaggcggaactga

SEQ ID NO: 807004 - DNA, 20 bp, mouse
gtggtggcgagaccgcaagg

SEQ ID NO: 807005 - DNA, 20 bp, mouse
gcaaccccctattactgaga

SEQ ID NO: 807006 - DNA, 20 bp, mouse
gccagcagcaagggagtggg

SEQ ID NO: 807007 - DNA, 20 bp, mouse
gtccccgacagccccttcat

SEQ ID NO: 807008 - DNA, 20 bp, mouse
ggggggggtcccttatgaga

SEQ ID NO: 807009 - DNA, 20 bp, mouse
ggccatggataactgtggga

SEQ ID NO: 807010 - DNA, 20 bp, mouse
gctagtgctgccttaaaaaa

SEQ ID NO: 807011 - DNA, 20 bp, mouse
gggacggccatggataactg

SEQ ID NO: 807012 - DNA, 20 bp, mouse
gggaccagcagcaagggagt

SEQ ID NO: 807013 - DNA, 20 bp, mouse
gtagtccggaccagcagcaa

SEQ ID NO: 807014 - DNA, 20 bp, mouse
gggagtagatgggacggcca

SEQ ID NO: 807015 - DNA, 20 bp, mouse
ggacacagggccctttttta

SEQ ID NO: 807016 - DNA, 20 bp, mouse
gcaggcgcaagccctacccc

SEQ ID NO: 807017 - DNA, 20 bp, mouse
gcaccaccaaggggagactg

SEQ ID NO: 807018 - DNA, 20 bp, mouse
gctccccagtctccccttgg

SEQ ID NO: 807019 - DNA, 20 bp, mouse
ggcatcttgcacaccaccaa

SEQ ID NO: 807020 - DNA, 20 bp, mouse
ggtgcaagatgctgtagaaa

SEQ ID NO: 807021 - DNA, 20 bp, mouse
gtaaccatccggaggggacg

SEQ ID NO: 807022 - DNA, 20 bp, mouse
gcgctcggctccccaaaatg

SEQ ID NO: 807023 - DNA, 20 bp, mouse
gtatccacgtcccctccgga

SEQ ID NO: 807024 - DNA, 20 bp, mouse
gagcccgtgaaacctagagg

SEQ ID NO: 807025 - DNA, 20 bp, mouse
gcagacgcgtgaagcctaag

SEQ ID NO: 807026 - DNA, 20 bp, mouse
gtctgcgctctccctattgg

SEQ ID NO: 807027 - DNA, 20 bp, mouse
gctctaaaaaggtggatcca

SEQ ID NO: 807028 - DNA, 20 bp, mouse
ggtggatccaggggagggcg

SEQ ID NO: 807029 - DNA, 20 bp, mouse
gccgcgctgtccccaatcat

SEQ ID NO: 807030 - DNA, 20 bp, mouse
gggctcttcccattagtcag

SEQ ID NO: 807031 - DNA, 20 bp, mouse
gaatagggagagcgcagaca

SEQ ID NO: 807032 - DNA, 20 bp, mouse
gccagcttcaggagcccgtc

SEQ ID NO: 807033 - DNA, 20 bp, mouse
gactctgggaggagcatggg

SEQ ID NO: 807034 - DNA, 20 bp, mouse
gcgccgccgccgctgactaa

SEQ ID NO: 807035 - DNA, 20 bp, mouse
gaaaaaggtggatccagggg

SEQ ID NO: 807036 - DNA, 20 bp, mouse
ggaagccgcagtgttaggca

SEQ ID NO: 807037 - DNA, 20 bp, mouse
gggagtggtgagaagtgaaa

SEQ ID NO: 807038 - DNA, 20 bp, mouse
gcagagaaacaacccgcata

SEQ ID NO: 807039 - DNA, 20 bp, mouse
ggctcgagaatcttgagggt

SEQ ID NO: 807040 - DNA, 20 bp, mouse
gggcacccggcagcccggga

SEQ ID NO: 807041 - DNA, 20 bp, mouse
gaatcttgagggtaggtaac

SEQ ID NO: 807042 - DNA, 20 bp, mouse
gtgctctgtaatcaagatag

SEQ ID NO: 807043 - DNA, 20 bp, mouse
ggtgagaagtgaaaagggcg

SEQ ID NO: 807044 - DNA, 20 bp, mouse
gcagggctcgagaatcttga

SEQ ID NO: 807045 - DNA, 20 bp, mouse
gaggcattcacgatttcagt

SEQ ID NO: 807046 - DNA, 20 bp, mouse
gacgggacaaggatgacgat

SEQ ID NO: 807047 - DNA, 20 bp, mouse
gtcactgaagggacgggaca

SEQ ID NO: 807048 - DNA, 20 bp, mouse
gccggaaggggctggaggta

SEQ ID NO: 807049 - DNA, 20 bp, mouse
gctaaggaggaaccccggaa

SEQ ID NO: 807050 - DNA, 20 bp, mouse
gcccacctcaccaacctagc

SEQ ID NO: 807051 - DNA, 20 bp, mouse
ggaaccccggaaggggctgg

SEQ ID NO: 807052 - DNA, 20 bp, mouse
gaagatctagccaatcacta

SEQ ID NO: 807053 - DNA, 20 bp, mouse
gcgaccccgctaggttggtg

SEQ ID NO: 807054 - DNA, 20 bp, mouse
ggaggaaccccggaaggggc

SEQ ID NO: 807055 - DNA, 20 bp, mouse
gcttgcccggatactggaag

SEQ ID NO: 807056 - DNA, 20 bp, mouse
gcacgggagggactgattga

SEQ ID NO: 807057 - DNA, 20 bp, mouse
gcctgcctgggaacctccaa

SEQ ID NO: 807058 - DNA, 20 bp, mouse
gtggacggcgcagtctctac

SEQ ID NO: 807059 - DNA, 20 bp, mouse
gggtcccgcctgccagctac

SEQ ID NO: 807060 - DNA, 20 bp, mouse
gcctccaaaggctcacggga

SEQ ID NO: 807061 - DNA, 20 bp, mouse
ggtgcgcagagaccagtagc

SEQ ID NO: 807062 - DNA, 20 bp, mouse
ggaagcgatcagagtggaag

SEQ ID NO: 807063 - DNA, 20 bp, mouse
gcctctcgcgccatctaaga

SEQ ID NO: 807064 - DNA, 20 bp, mouse
gggaacctccaaaggctcac

SEQ ID NO: 807065 - DNA, 20 bp, mouse
ggggactgattgagggtgcg

SEQ ID NO: 807066 - DNA, 20 bp, mouse
gctcagggagcaggaagctg

SEQ ID NO: 807067 - DNA, 20 bp, mouse
gacgccaccgtcagaagaaa

SEQ ID NO: 807068 - DNA, 20 bp, mouse
gcgctaaaggatagcatcag

SEQ ID NO: 807069 - DNA, 20 bp, mouse
gatcggatgcaccatctcat

SEQ ID NO: 807070 - DNA, 20 bp, mouse
gcacgagcataacctgcgtc

SEQ ID NO: 807071 - DNA, 20 bp, mouse
gtaaaggatagcatcagcgg

SEQ ID NO: 807072 - DNA, 20 bp, mouse
gtacaaccgtggacagctgt

SEQ ID NO: 807073 - DNA, 20 bp, mouse
gccggtgcgtggttgtttcc

SEQ ID NO: 807074 - DNA, 20 bp, mouse
gggcgcctcgaccttaacta

SEQ ID NO: 807075 - DNA, 20 bp, mouse
gctgcgtccggctacaaccg

SEQ ID NO: 807076 - DNA, 20 bp, mouse
ggcaggacgcagcacccgtg

SEQ ID NO: 807077 - DNA, 20 bp, mouse
ggctgcggcggggagttcac

SEQ ID NO: 807078 - DNA, 20 bp, mouse
ggacaagagccacaccgcac

SEQ ID NO: 807079 - DNA, 20 bp, mouse
gcgggtgctgcgtcctgctt

SEQ ID NO: 807080 - DNA, 20 bp, mouse
gggagcagagtccacaacac

SEQ ID NO: 807081 - DNA, 20 bp, mouse
gacgcagcacccgtgcggtg

SEQ ID NO: 807082 - DNA, 20 bp, mouse
gcggggagttcacgggacca

SEQ ID NO: 807083 - DNA, 20 bp, mouse
gcaggggacagtgacgcctg

SEQ ID NO: 807084 - DNA, 20 bp, mouse
ggacccgggctaattagtcc

SEQ ID NO: 807085 - DNA, 20 bp, mouse
gcagtgacgcctgtggaccc

SEQ ID NO: 807086 - DNA, 20 bp, mouse
gaccggagacaacaggattg

SEQ ID NO: 807087 - DNA, 20 bp, mouse
gtggcccctgccggcctcta

SEQ ID NO: 807088 - DNA, 20 bp, mouse
ggtggatgaccggagacaac

SEQ ID NO: 807089 - DNA, 20 bp, mouse
ggctgtaagagcaggtcacg

SEQ ID NO: 807090 - DNA, 20 bp, mouse
gtctctgactgttcaactca

SEQ ID NO: 807091 - DNA, 20 bp, mouse
gcgtgatcgcagtaatgact

SEQ ID NO: 807092 - DNA, 20 bp, mouse
gtgtaaaggtgaccactcta

SEQ ID NO: 807093 - DNA, 20 bp, mouse
ggccacaggagtgacagtaa

SEQ ID NO: 807094 - DNA, 20 bp, mouse
gaagagcaggtcacgtggca

SEQ ID NO: 807095 - DNA, 20 bp, mouse
ggggatgatggctggggcgt

SEQ ID NO: 807096 - DNA, 20 bp, mouse
gaggcggccacgtttgttaa

SEQ ID NO: 807097 - DNA, 20 bp, mouse
gaaccggaaaaaggtgacgg

SEQ ID NO: 807098 - DNA, 20 bp, mouse
gcgatgggaaatccgatcga

SEQ ID NO: 807099 - DNA, 20 bp, mouse
gccgcggggaaaaggttctg

SEQ ID NO: 807100 - DNA, 20 bp, mouse
gcctgaggggggtgggtcca

SEQ ID NO: 807101 - DNA, 20 bp, mouse
gtaagggaagtgggaccaaa

SEQ ID NO: 807102 - DNA, 20 bp, mouse
gaaacgtggccgcctgaggg

SEQ ID NO: 807103 - DNA, 20 bp, mouse
gaaaggggactgacaacttt

SEQ ID NO: 807104 - DNA, 20 bp, mouse
ggacccgcgactcccaggaa

SEQ ID NO: 807105 - DNA, 20 bp, mouse
gaacaaacgtggccgcctga

SEQ ID NO: 807106 - DNA, 20 bp, mouse
gcccggaagagggcagtgtc

SEQ ID NO: 807107 - DNA, 20 bp, mouse
gaaacccggagggcggggta

SEQ ID NO: 807108 - DNA, 20 bp, mouse
gcggagggcggggtagggcg

SEQ ID NO: 807109 - DNA, 20 bp, mouse
gggcgccgctagaggacatg

SEQ ID NO: 807110 - DNA, 20 bp, mouse
ggacacccatggcgcaaacc

SEQ ID NO: 807111 - DNA, 20 bp, mouse
gggcgcaaacccggagggcg

SEQ ID NO: 807112 - DNA, 20 bp, mouse
gcccatggcgcaaacccgga

SEQ ID NO: 807113 - DNA, 20 bp, mouse
gtcacgagagagcccggaag

SEQ ID NO: 807114 - DNA, 20 bp, mouse
gggagagatcgcgaccagta

SEQ ID NO: 807115 - DNA, 20 bp, mouse
ggcgccttgcggatccttgc

SEQ ID NO: 807116 - DNA, 20 bp, mouse
gcggcgcagagtccagtcac

SEQ ID NO: 807117 - DNA, 20 bp, mouse
gctgcagggaggcccggagg

SEQ ID NO: 807118 - DNA, 20 bp, mouse
gggatgccccagtgattaga

SEQ ID NO: 807119 - DNA, 20 bp, mouse
ggaggcgggaccagggggtg

SEQ ID NO: 807120 - DNA, 20 bp, mouse
gctgccagaggcatagcaca

SEQ ID NO: 807121 - DNA, 20 bp, mouse
gcgcctcgctgtccagtgac

SEQ ID NO: 807122 - DNA, 20 bp, mouse
gacaggaagcttaagtagtc

SEQ ID NO: 807123 - DNA, 20 bp, mouse
ggcgaggcgaggcgggacca

SEQ ID NO: 807124 - DNA, 20 bp, mouse
gaagctgattggctgcaggg

SEQ ID NO: 807125 - DNA, 20 bp, mouse
gggaaccggtcgggggtctt

SEQ ID NO: 807126 - DNA, 20 bp, mouse
ggcgccgcgctctacactgc

SEQ ID NO: 807127 - DNA, 20 bp, mouse
ggcccccggccagcgtcggg

SEQ ID NO: 807128 - DNA, 20 bp, mouse
gctacactgcgggctccgag

SEQ ID NO: 807129 - DNA, 20 bp, mouse
gcgaagtgggcgtttaaagg

SEQ ID NO: 807130 - DNA, 20 bp, mouse
ggagcccgcagtgtagagcg

SEQ ID NO: 807131 - DNA, 20 bp, mouse
gtaaacgcccacttcggatg

SEQ ID NO: 807132 - DNA, 20 bp, mouse
gagcgtcggggggctctcgt

SEQ ID NO: 807133 - DNA, 20 bp, mouse
gagcgcggcgcgggcgatcg

SEQ ID NO: 807134 - DNA, 20 bp, mouse
ggccccccgacgctggccgg

SEQ ID NO: 807135 - DNA, 20 bp, mouse
gcgcctctcgcccgcgtggg

SEQ ID NO: 807136 - DNA, 20 bp, mouse
gggcggaggcggtgggtggt

SEQ ID NO: 807137 - DNA, 20 bp, mouse
gaagtggccttccccaaacg

SEQ ID NO: 807138 - DNA, 20 bp, mouse
gggtcggctccgagcagatg

SEQ ID NO: 807139 - DNA, 20 bp, mouse
gtcccggccgcgtttgggga

SEQ ID NO: 807140 - DNA, 20 bp, mouse
gagcgagctccccatctgct

SEQ ID NO: 807141 - DNA, 20 bp, mouse
ggggtccggcactggagaaa

SEQ ID NO: 807142 - DNA, 20 bp, mouse
gtgctcggagccgaccggcc

SEQ ID NO: 807143 - DNA, 20 bp, mouse
ggcggccgcacgggatttga

SEQ ID NO: 807144 - DNA, 20 bp, mouse
gggctcccgaagaccctcag

SEQ ID NO: 807145 - DNA, 20 bp, mouse
gcgcttcgggccgggccggt

SEQ ID NO: 807146 - DNA, 20 bp, mouse
ggaggcgcggccagagtcgc

SEQ ID NO: 807147 - DNA, 20 bp, mouse
gacaccttcgggtagaagac

SEQ ID NO: 807148 - DNA, 20 bp, mouse
ggaaccggtcttctacccga

SEQ ID NO: 807149 - DNA, 20 bp, mouse
ggggacgttgccaccaagag

SEQ ID NO: 807150 - DNA, 20 bp, mouse
gactctggccgcgcctcctc

SEQ ID NO: 807151 - DNA, 20 bp, mouse
gaaaggaggactcctccaaa

SEQ ID NO: 807152 - DNA, 20 bp, mouse
gcaccagagcgagcggggga

SEQ ID NO: 807153 - DNA, 20 bp, mouse
gaccaagagcggggaaggtg

SEQ ID NO: 807154 - DNA, 20 bp, mouse
gctggcagaggcagccgcga

SEQ ID NO: 807155 - DNA, 20 bp, mouse
gcgctctggtgcccctttgg

SEQ ID NO: 807156 - DNA, 20 bp, mouse
gaatggaaatggagtagaac

SEQ ID NO: 807157 - DNA, 20 bp, mouse
ggagttctgcaacaatgctg

SEQ ID NO: 807158 - DNA, 20 bp, mouse
gccctgcccctacctcacat

SEQ ID NO: 807159 - DNA, 20 bp, mouse
gtaaaggctaaggggatcct

SEQ ID NO: 807160 - DNA, 20 bp, mouse
gtgtgaacattgctgaacct

SEQ ID NO: 807161 - DNA, 20 bp, mouse
gtctttgcctatgtgaggta

SEQ ID NO: 807162 - DNA, 20 bp, mouse
gcacataggcaaagagaatc

SEQ ID NO: 807163 - DNA, 20 bp, mouse
gagtcatcagacatggactc

SEQ ID NO: 807164 - DNA, 20 bp, mouse
gggtcataatggaggaaatg

SEQ ID NO: 807165 - DNA, 20 bp, mouse
ggaaaactaggtccatacct

SEQ ID NO: 807166 - DNA, 20 bp, mouse
ggcggtcccagcacacccga

SEQ ID NO: 807167 - DNA, 20 bp, mouse
gcccccgccgggcgcggacg

SEQ ID NO: 807168 - DNA, 20 bp, mouse
gaccatcgcggccctcagtg

SEQ ID NO: 807169 - DNA, 20 bp, mouse
gtggggagctggagtccggg

SEQ ID NO: 807170 - DNA, 20 bp, mouse
ggcggctaacgggccgggtg

SEQ ID NO: 807171 - DNA, 20 bp, mouse
gcggtccggagcccgctggg

SEQ ID NO: 807172 - DNA, 20 bp, mouse
gagggcggtaggcaagtcca

SEQ ID NO: 807173 - DNA, 20 bp, mouse
gcgctggggagctggagtcc

SEQ ID NO: 807174 - DNA, 20 bp, mouse
ggggcgggcggctaacgggc

SEQ ID NO: 807175 - DNA, 20 bp, mouse
ggggtgtgctgggaccgcga

SEQ ID NO: 807176 - DNA, 20 bp, mouse
gcaagagccggaacatctga

SEQ ID NO: 807177 - DNA, 20 bp, mouse
gtcccgagacgctttttctg

SEQ ID NO: 807178 - DNA, 20 bp, mouse
ggaccgctccaggtacagga

SEQ ID NO: 807179 - DNA, 20 bp, mouse
gaaaaagcgtctcgggacgc

SEQ ID NO: 807180 - DNA, 20 bp, mouse
ggaccctcctgtacctggag

SEQ ID NO: 807181 - DNA, 20 bp, mouse
gggaggagacctgtgatctc

SEQ ID NO: 807182 - DNA, 20 bp, mouse
gcccgggtcggaattttcca

SEQ ID NO: 807183 - DNA, 20 bp, mouse
ggcggtcctcggttctcgag

SEQ ID NO: 807184 - DNA, 20 bp, mouse
gctggtgaccctcctgtacc

SEQ ID NO: 807185 - DNA, 20 bp, mouse
gtcagggaagaacgcatgcg

SEQ ID NO: 807186 - DNA, 20 bp, mouse
gcctctagttccaccctcaa

SEQ ID NO: 807187 - DNA, 20 bp, mouse
gaacgacccgccttcctttg

SEQ ID NO: 807188 - DNA, 20 bp, mouse
gcagttacgcctacctatta

SEQ ID NO: 807189 - DNA, 20 bp, mouse
gcgtgcggtagcttcttccc

SEQ ID NO: 807190 - DNA, 20 bp, mouse
gctgtgatgacgtcatttac

SEQ ID NO: 807191 - DNA, 20 bp, mouse
ggtaaaaagtcacggcgcgc

SEQ ID NO: 807192 - DNA, 20 bp, mouse
gctactgcacatgcgtcaag

SEQ ID NO: 807193 - DNA, 20 bp, mouse
gttccaccctcaaaggaagg

SEQ ID NO: 807194 - DNA, 20 bp, mouse
gttactcacccataataggt

SEQ ID NO: 807195 - DNA, 20 bp, mouse
ggggtggaaacatgatattt

SEQ ID NO: 807196 - DNA, 20 bp, mouse
ggtaagcttcacccgcccaa

SEQ ID NO: 807197 - DNA, 20 bp, mouse
ggggccactccgcatggggc

SEQ ID NO: 807198 - DNA, 20 bp, mouse
gttagggcatacttccccgt

SEQ ID NO: 807199 - DNA, 20 bp, mouse
ggggaggggcagaactgcgc

SEQ ID NO: 807200 - DNA, 20 bp, mouse
ggggcgggtgaagcttacgg

SEQ ID NO: 807201 - DNA, 20 bp, mouse
gcggggcgggtcagctaccc

SEQ ID NO: 807202 - DNA, 20 bp, mouse
gaggaccggctcaacccttt

SEQ ID NO: 807203 - DNA, 20 bp, mouse
gggacccgccccatgcggag

SEQ ID NO: 807204 - DNA, 20 bp, mouse
gtgggagagcctaactccga

SEQ ID NO: 807205 - DNA, 20 bp, mouse
gcggggcttcagttccgacg

SEQ ID NO: 807206 - DNA, 20 bp, mouse
gtctaagcgcccggcctcgg

SEQ ID NO: 807207 - DNA, 20 bp, mouse
gcggcctccgggcgccgcgt

SEQ ID NO: 807208 - DNA, 20 bp, mouse
ggacacgcggctcgcgaggt

SEQ ID NO: 807209 - DNA, 20 bp, mouse
gcggaggccgctcggacacg

SEQ ID NO: 807210 - DNA, 20 bp, mouse
gtggcctcgcgccgccaccg

SEQ ID NO: 807211 - DNA, 20 bp, mouse
gaagcgcccggcctcggtgg

SEQ ID NO: 807212 - DNA, 20 bp, mouse
gctcgcgccgccaccgaggc

SEQ ID NO: 807213 - DNA, 20 bp, mouse
gcggcgtccgcgaacccacg

SEQ ID NO: 807214 - DNA, 20 bp, mouse
ggcctctaagcgcccggcct

SEQ ID NO: 807215 - DNA, 20 bp, mouse
gtcccccgccccacccgaaa

SEQ ID NO: 807216 - DNA, 20 bp, mouse
gccctcccgccaggcgccac

SEQ ID NO: 807217 - DNA, 20 bp, mouse
gcatcgtgcggctcccgcgg

SEQ ID NO: 807218 - DNA, 20 bp, mouse
gaccccgcgtggccggaaag

SEQ ID NO: 807219 - DNA, 20 bp, mouse
gaagcgggcggggcatcgtg

SEQ ID NO: 807220 - DNA, 20 bp, mouse
ggggcatcgtgcggctcccg

SEQ ID NO: 807221 - DNA, 20 bp, mouse
gcacccggcgcggcggacaa

SEQ ID NO: 807222 - DNA, 20 bp, mouse
ggccagaacgaggttagaga

SEQ ID NO: 807223 - DNA, 20 bp, mouse
gcgtggccggaaagcgggcg

SEQ ID NO: 807224 - DNA, 20 bp, mouse
gtggacctccccaccgccgc

SEQ ID NO: 807225 - DNA, 20 bp, mouse
gcaggcccgtggcgcctggc

SEQ ID NO: 807226 - DNA, 20 bp, mouse
gtcgctctgcccccaatggg

SEQ ID NO: 807227 - DNA, 20 bp, mouse
gcccttctgccccccattgg

SEQ ID NO: 807228 - DNA, 20 bp, mouse
gggaggggatcttggatata

SEQ ID NO: 807229 - DNA, 20 bp, mouse
gaagtcccgccctcactctg

SEQ ID NO: 807230 - DNA, 20 bp, mouse
ggatgtcgctctgcccccaa

SEQ ID NO: 807231 - DNA, 20 bp, mouse
gcctgaacccttgggtccaa

SEQ ID NO: 807232 - DNA, 20 bp, mouse
ggaacccttgggtccaaggg

SEQ ID NO: 807233 - DNA, 20 bp, mouse
gttagcgccttgcacttcgg

SEQ ID NO: 807234 - DNA, 20 bp, mouse
ggtgtgttgaatcctagtac

SEQ ID NO: 807235 - DNA, 20 bp, mouse
gtctcctcccttggacccaa

SEQ ID NO: 807236 - DNA, 20 bp, mouse
gcgcatgcgcgcacgttcac

SEQ ID NO: 807237 - DNA, 20 bp, mouse
gacctcaaccggtggggcgg

SEQ ID NO: 807238 - DNA, 20 bp, mouse
ggtaccggagatgggatcca

SEQ ID NO: 807239 - DNA, 20 bp, mouse
gggtcaagatggggaggtgt

SEQ ID NO: 807240 - DNA, 20 bp, mouse
gtgggtgccgaaggcagaga

SEQ ID NO: 807241 - DNA, 20 bp, mouse
ggggggcggtcaagatgggg

SEQ ID NO: 807242 - DNA, 20 bp, mouse
ggaggggggcggtcaagatg

SEQ ID NO: 807243 - DNA, 20 bp, mouse
ggaggcggggcggagacggg

SEQ ID NO: 807244 - DNA, 20 bp, mouse
ggggtgggcgaagggcgagg

SEQ ID NO: 807245 - DNA, 20 bp, mouse
gaggtctcggcgagcgaccg

SEQ ID NO: 807246 - DNA, 20 bp, mouse
ggcccagcaaggtcaggcag

SEQ ID NO: 807247 - DNA, 20 bp, mouse
gagggtgtgagaggttggtg

SEQ ID NO: 807248 - DNA, 20 bp, mouse
ggatagttctaagggagcgg

SEQ ID NO: 807249 - DNA, 20 bp, mouse
ggtcccctgcctgaccttgc

SEQ ID NO: 807250 - DNA, 20 bp, mouse
gcgaaggggcgcggccttag

SEQ ID NO: 807251 - DNA, 20 bp, mouse
gtgatgttgcaagtgtgcca

SEQ ID NO: 807252 - DNA, 20 bp, mouse
gtctacagcccagcaaggtc

SEQ ID NO: 807253 - DNA, 20 bp, mouse
gcttaggggcggggcctctt

SEQ ID NO: 807254 - DNA, 20 bp, mouse
ggcatgtgcaaagccctgaa

SEQ ID NO: 807255 - DNA, 20 bp, mouse
gcgcacttccgcttctgcga

SEQ ID NO: 807256 - DNA, 20 bp, mouse
gagcgcagagaattactgta

SEQ ID NO: 807257 - DNA, 20 bp, mouse
gggggcggatcagcccagaa

SEQ ID NO: 807258 - DNA, 20 bp, mouse
gaacaacggcgcaccctgct

SEQ ID NO: 807259 - DNA, 20 bp, mouse
gccagaagggctgtcaacaa

SEQ ID NO: 807260 - DNA, 20 bp, mouse
gttgcatgagggttagtcac

SEQ ID NO: 807261 - DNA, 20 bp, mouse
gatgcctgcctggtaagtca

SEQ ID NO: 807262 - DNA, 20 bp, mouse
gaaacccagcccagccttag

SEQ ID NO: 807263 - DNA, 20 bp, mouse
gggtaagtcagggcagttac

SEQ ID NO: 807264 - DNA, 20 bp, mouse
gtccgacttcccctaaggct

SEQ ID NO: 807265 - DNA, 20 bp, mouse
gactaaccctcatgcaaatg

SEQ ID NO: 807266 - DNA, 20 bp, mouse
gaggacagaaaagggagaat

SEQ ID NO: 807267 - DNA, 20 bp, mouse
gaaccagtctggtgcagtca

SEQ ID NO: 807268 - DNA, 20 bp, mouse
gaaggagcccagaaccagtc

SEQ ID NO: 807269 - DNA, 20 bp, mouse
gcagtctggtgcagtcaggg

SEQ ID NO: 807270 - DNA, 20 bp, mouse
ggtcaggaaggtcacagtgt

SEQ ID NO: 807271 - DNA, 20 bp, mouse
ggcaaggttgggcaaagtta

SEQ ID NO: 807272 - DNA, 20 bp, mouse
gtgtgggtgaagccttctgt

SEQ ID NO: 807273 - DNA, 20 bp, mouse
gcaggagccgatgggtaaag

SEQ ID NO: 807274 - DNA, 20 bp, mouse
gaatccaggtagatgatctt

SEQ ID NO: 807275 - DNA, 20 bp, mouse
gaaggacggatggagggctt

SEQ ID NO: 807276 - DNA, 20 bp, mouse
ggcacaggatggttttagtg

SEQ ID NO: 807277 - DNA, 20 bp, mouse
ggggtggcatcagggtataa

SEQ ID NO: 807278 - DNA, 20 bp, mouse
gacccagtcatagccatcgt

SEQ ID NO: 807279 - DNA, 20 bp, mouse
gaaaggctttcctgcaatgt

SEQ ID NO: 807280 - DNA, 20 bp, mouse
gttgaatctcagtggggcac

SEQ ID NO: 807281 - DNA, 20 bp, mouse
gtgtggggttttttgttcaa

SEQ ID NO: 807282 - DNA, 20 bp, mouse
gtcccacgatggctatgact

SEQ ID NO: 807283 - DNA, 20 bp, mouse
ggagtacagagctcccacga

SEQ ID NO: 807284 - DNA, 20 bp, mouse
gatcctgttgaatctcagtg

SEQ ID NO: 807285 - DNA, 20 bp, mouse
gttgcaggaaagcctttcag

SEQ ID NO: 807286 - DNA, 20 bp, mouse
ggcagggcagaaccctactg

SEQ ID NO: 807287 - DNA, 20 bp, mouse
ggggcagaaccctactgggg

SEQ ID NO: 807288 - DNA, 20 bp, mouse
gagaaccctactggggtgga

SEQ ID NO: 807289 - DNA, 20 bp, mouse
gaggactgacagggtggtta

SEQ ID NO: 807290 - DNA, 20 bp, mouse
gctgacttcggttcagtcaa

SEQ ID NO: 807291 - DNA, 20 bp, mouse
gggattgagcaattaagagg

SEQ ID NO: 807292 - DNA, 20 bp, mouse
gttgggattgagcaattaag

SEQ ID NO: 807293 - DNA, 20 bp, mouse
gtgactcaatccctcctgtg

SEQ ID NO: 807294 - DNA, 20 bp, mouse
gggaggtgaaggataaatag

SEQ ID NO: 807295 - DNA, 20 bp, mouse
ggattgagtcatgaggggtg

SEQ ID NO: 807296 - DNA, 20 bp, mouse
gaggagaagcgcgtcccacc

SEQ ID NO: 807297 - DNA, 20 bp, mouse
ggggtcgcccgggtgcacag

SEQ ID NO: 807298 - DNA, 20 bp, mouse
gtgggacgcgcttctcctcc

SEQ ID NO: 807299 - DNA, 20 bp, mouse
gagagcacctggggtggtcg

SEQ ID NO: 807300 - DNA, 20 bp, mouse
gtggctgtgcgcccgctcgg

SEQ ID NO: 807301 - DNA, 20 bp, mouse
ggccgaggggcggtgcggaa

SEQ ID NO: 807302 - DNA, 20 bp, mouse
ggtggtcgggggtcggctgg

SEQ ID NO: 807303 - DNA, 20 bp, mouse
gggggagagtggccggtagc

SEQ ID NO: 807304 - DNA, 20 bp, mouse
gcgcccgctcggcgggctct

SEQ ID NO: 807305 - DNA, 20 bp, mouse
gtgctctcacagcccgctac

SEQ ID NO: 807306 - DNA, 20 bp, mouse
gccctagcggcgccagtcat

SEQ ID NO: 807307 - DNA, 20 bp, mouse
gcatccgcgcagccaatgac

SEQ ID NO: 807308 - DNA, 20 bp, mouse
ggcgctgccgcgcggacgac

SEQ ID NO: 807309 - DNA, 20 bp, mouse
gcgagcgcgtgacggcgtga

SEQ ID NO: 807310 - DNA, 20 bp, mouse
ggcgccgcgcgagcgcgtga

SEQ ID NO: 807311 - DNA, 20 bp, mouse
gcgtgacggcgtgacggggc

SEQ ID NO: 807312 - DNA, 20 bp, mouse
ggacgactggctggccgcgc

SEQ ID NO: 807313 - DNA, 20 bp, mouse
gctccagctgcgctgccgcg

SEQ ID NO: 807314 - DNA, 20 bp, mouse
gccggctcgcctgtcgtaat

SEQ ID NO: 807315 - DNA, 20 bp, mouse
gggggcggaccaattacgac

SEQ ID NO: 807316 - DNA, 20 bp, mouse
gcgggggtgcggggaggcgt

SEQ ID NO: 807317 - DNA, 20 bp, mouse
gggagcgcgggacgcctacg

SEQ ID NO: 807318 - DNA, 20 bp, mouse
gcggatcgcgcgacctggac

SEQ ID NO: 807319 - DNA, 20 bp, mouse
gagtgctggacctggttcgg

SEQ ID NO: 807320 - DNA, 20 bp, mouse
gcggggaggcgtggggagcg

SEQ ID NO: 807321 - DNA, 20 bp, mouse
gcaataagctgatgtgacgg

SEQ ID NO: 807322 - DNA, 20 bp, mouse
gacctggaccggcgcggtcg

SEQ ID NO: 807323 - DNA, 20 bp, mouse
gcagagtgctggacctggtt

SEQ ID NO: 807324 - DNA, 20 bp, mouse
ggatagtcccggcagagtgc

SEQ ID NO: 807325 - DNA, 20 bp, mouse
gtggccggctgcctgcacat

SEQ ID NO: 807326 - DNA, 20 bp, mouse
gggacagtgtacggggtgag

SEQ ID NO: 807327 - DNA, 20 bp, mouse
gacccagctgggtttccgaa

SEQ ID NO: 807328 - DNA, 20 bp, mouse
gtgaagactccgtcacgcgg

SEQ ID NO: 807329 - DNA, 20 bp, mouse
gaaatcaatgcgtcacatgg

SEQ ID NO: 807330 - DNA, 20 bp, mouse
gcacgcgggggacagtgtac

SEQ ID NO: 807331 - DNA, 20 bp, mouse
ggaaaggccggcagcaccgg

SEQ ID NO: 807332 - DNA, 20 bp, mouse
gtccgaaaggccggcagcac

SEQ ID NO: 807333 - DNA, 20 bp, mouse
ggagtgcgcgcgctggatgc

SEQ ID NO: 807334 - DNA, 20 bp, mouse
gtcaatgcgtcacatggagg

SEQ ID NO: 807335 - DNA, 20 bp, mouse
ggcgtgacggagtcttcaca

SEQ ID NO: 807336 - DNA, 20 bp, mouse
gcccgcgagcaggtagcgtg

SEQ ID NO: 807337 - DNA, 20 bp, mouse
ggcgccccctggaggtccgg

SEQ ID NO: 807338 - DNA, 20 bp, mouse
gcagccgcgccgccacaggt

SEQ ID NO: 807339 - DNA, 20 bp, mouse
gcgggcgccccctggaggtc

SEQ ID NO: 807340 - DNA, 20 bp, mouse
ggtactcccccggacctcca

SEQ ID NO: 807341 - DNA, 20 bp, mouse
gtacggcagcgcccgcgagc

SEQ ID NO: 807342 - DNA, 20 bp, mouse
gagggagccgccagacacgg

SEQ ID NO: 807343 - DNA, 20 bp, mouse
ggggcgcccgcgagccgcga

SEQ ID NO: 807344 - DNA, 20 bp, mouse
gacgccgcccggctggagag

SEQ ID NO: 807345 - DNA, 20 bp, mouse
ggggcgctgccgtactcccc

SEQ ID NO: 807346 - DNA, 20 bp, mouse
ggggctcaggatccggacga

SEQ ID NO: 807347 - DNA, 20 bp, mouse
ggggcggagccaagcacgag

SEQ ID NO: 807348 - DNA, 20 bp, mouse
ggagccaagcacgagcgggg

SEQ ID NO: 807349 - DNA, 20 bp, mouse
gttgtcgcgcgctttcccgc

SEQ ID NO: 807350 - DNA, 20 bp, mouse
gttcccgccggttgcggctg

SEQ ID NO: 807351 - DNA, 20 bp, mouse
gccgcccctccgcgccccac

SEQ ID NO: 807352 - DNA, 20 bp, mouse
gtcccggggtgcattgtgtc

SEQ ID NO: 807353 - DNA, 20 bp, mouse
gacgcgcggtcacacgctag

SEQ ID NO: 807354 - DNA, 20 bp, mouse
gtagcggctcggcgccggtg

SEQ ID NO: 807355 - DNA, 20 bp, mouse
gtgggccagtgcgtgaggga

SEQ ID NO: 807356 - DNA, 20 bp, mouse
gagagcgtctggagtcgctg

SEQ ID NO: 807357 - DNA, 20 bp, mouse
ggcggctgcggcatccaata

SEQ ID NO: 807358 - DNA, 20 bp, mouse
gtggacggaggggcttcggg

SEQ ID NO: 807359 - DNA, 20 bp, mouse
gtgacacaggagcccgtggg

SEQ ID NO: 807360 - DNA, 20 bp, mouse
gaggtgacacaggagcccgt

SEQ ID NO: 807361 - DNA, 20 bp, mouse
gccgggatgaggacagccaa

SEQ ID NO: 807362 - DNA, 20 bp, mouse
gcggctggacggaggggctt

SEQ ID NO: 807363 - DNA, 20 bp, mouse
ggcgctgcggctggacggag

SEQ ID NO: 807364 - DNA, 20 bp, mouse
ggtgccatcccacccggaag

SEQ ID NO: 807365 - DNA, 20 bp, mouse
ggaggaagcgctgaccgcgg

SEQ ID NO: 807366 - DNA, 20 bp, mouse
gaagcggcggaggctggagt

SEQ ID NO: 807367 - DNA, 20 bp, mouse
gtgggccacgcgggacatga

SEQ ID NO: 807368 - DNA, 20 bp, mouse
gggcctaagcacccaatcag

SEQ ID NO: 807369 - DNA, 20 bp, mouse
gcgggaagctgaagcggcgg

SEQ ID NO: 807370 - DNA, 20 bp, mouse
gcgtggcccaccccgaggtt

SEQ ID NO: 807371 - DNA, 20 bp, mouse
ggctctgctagcagtcttta

SEQ ID NO: 807372 - DNA, 20 bp, mouse
gtaagcacccaatcagcggt

SEQ ID NO: 807373 - DNA, 20 bp, mouse
gagactgcaggtggcggcag

SEQ ID NO: 807374 - DNA, 20 bp, mouse
gctcaaccaaacctcggggt

SEQ ID NO: 807375 - DNA, 20 bp, mouse
gtcccctcctcgcctctcct

SEQ ID NO: 807376 - DNA, 20 bp, mouse
ggccgtggacccacctagtg

SEQ ID NO: 807377 - DNA, 20 bp, mouse
gtaggtgggtccacggcccg

SEQ ID NO: 807378 - DNA, 20 bp, mouse
gtccccaagccgcactaggt

SEQ ID NO: 807379 - DNA, 20 bp, mouse
ggggctctgcctccgaccga

SEQ ID NO: 807380 - DNA, 20 bp, mouse
gcccgcctggatctgcgctc

SEQ ID NO: 807381 - DNA, 20 bp, mouse
ggacccacctagtgcggctt

SEQ ID NO: 807382 - DNA, 20 bp, mouse
gaggtcccacgtggcaggtg

SEQ ID NO: 807383 - DNA, 20 bp, mouse
ggcgctcgcccttcggtcgg

SEQ ID NO: 807384 - DNA, 20 bp, mouse
gggtgcgcgcaggtcccacg

SEQ ID NO: 807385 - DNA, 20 bp, mouse
gctagtgcggcttggggaag

SEQ ID NO: 807386 - DNA, 20 bp, mouse
gaggctgggcaggggcggaa

SEQ ID NO: 807387 - DNA, 20 bp, mouse
gcaggcgtagcgccctctgt

SEQ ID NO: 807388 - DNA, 20 bp, mouse
gactaagtggatagaaggtt

SEQ ID NO: 807389 - DNA, 20 bp, mouse
gcggacctttgtgacgtcca

SEQ ID NO: 807390 - DNA, 20 bp, mouse
gagaagagattctgcaccgg

SEQ ID NO: 807391 - DNA, 20 bp, mouse
gtctgcaccggaggactaag

SEQ ID NO: 807392 - DNA, 20 bp, mouse
ggtcccggaccaaaaggaca

SEQ ID NO: 807393 - DNA, 20 bp, mouse
gagggccacgcccccacaga

SEQ ID NO: 807394 - DNA, 20 bp, mouse
gagaacggctgccttgctcc

SEQ ID NO: 807395 - DNA, 20 bp, mouse
ggtggccctggacgtcacaa

SEQ ID NO: 807396 - DNA, 20 bp, mouse
gcctgcgcctcagttggggg

SEQ ID NO: 807397 - DNA, 20 bp, mouse
gtgcgcctgcgcctcagttg

SEQ ID NO: 807398 - DNA, 20 bp, mouse
ggggctgcggagactggctt

SEQ ID NO: 807399 - DNA, 20 bp, mouse
gggcttagggatatcacgtg

SEQ ID NO: 807400 - DNA, 20 bp, mouse
gcggcccaaagaactccctc

SEQ ID NO: 807401 - DNA, 20 bp, mouse
ggactctgggctgcggagac

SEQ ID NO: 807402 - DNA, 20 bp, mouse
gtgccccggcagtacggcgg

SEQ ID NO: 807403 - DNA, 20 bp, mouse
gagtggaccaagcacaccgg

SEQ ID NO: 807404 - DNA, 20 bp, mouse
gaagattcccgcagcagcag

SEQ ID NO: 807405 - DNA, 20 bp, mouse
gccctgccccggcagtacgg

SEQ ID NO: 807406 - DNA, 20 bp, mouse
gcgccatggggcaccggaga

SEQ ID NO: 807407 - DNA, 20 bp, mouse
gaggtgagcagccgccgtag

SEQ ID NO: 807408 - DNA, 20 bp, mouse
ggtctcaaagtgtcacaaag

SEQ ID NO: 807409 - DNA, 20 bp, mouse
gtgccaccgcggggcaccac

SEQ ID NO: 807410 - DNA, 20 bp, mouse
ggaggcagaaggagactcta

SEQ ID NO: 807411 - DNA, 20 bp, mouse
gggcgaaagccgaaccccta

SEQ ID NO: 807412 - DNA, 20 bp, mouse
gggactttacagaagtatga

SEQ ID NO: 807413 - DNA, 20 bp, mouse
gcacgggagcgtagttccat

SEQ ID NO: 807414 - DNA, 20 bp, mouse
gtcagcagagagaagacttg

SEQ ID NO: 807415 - DNA, 20 bp, mouse
ggaaagccgaacccctacgg

SEQ ID NO: 807416 - DNA, 20 bp, mouse
gctcgcgagaagcaaggcac

SEQ ID NO: 807417 - DNA, 20 bp, mouse
gctagcacctggacgaggaa

SEQ ID NO: 807418 - DNA, 20 bp, mouse
gggaagagacagcttgatga

SEQ ID NO: 807419 - DNA, 20 bp, mouse
ggactcccacactgctcgta

SEQ ID NO: 807420 - DNA, 20 bp, mouse
gcctcgtccaggtgctaggt

SEQ ID NO: 807421 - DNA, 20 bp, mouse
ggggacctgtgggatgtacc

SEQ ID NO: 807422 - DNA, 20 bp, mouse
gggacagctcctgcaaggtg

SEQ ID NO: 807423 - DNA, 20 bp, mouse
gagagtggttgcagcaggca

SEQ ID NO: 807424 - DNA, 20 bp, mouse
gcggcgcctccgcaccttgc

SEQ ID NO: 807425 - DNA, 20 bp, mouse
gggagcgcgcgggcccgcct

SEQ ID NO: 807426 - DNA, 20 bp, mouse
gttgtccgccggctccaatg

SEQ ID NO: 807427 - DNA, 20 bp, mouse
gccagggcggtccttcggtt

SEQ ID NO: 807428 - DNA, 20 bp, mouse
gttggagccggcggacaagt

SEQ ID NO: 807429 - DNA, 20 bp, mouse
gggcactgcaaggtccccat

SEQ ID NO: 807430 - DNA, 20 bp, mouse
gtcgaaatctgagtcgggat

SEQ ID NO: 807431 - DNA, 20 bp, mouse
gggatcggattccagatcag

SEQ ID NO: 807432 - DNA, 20 bp, mouse
ggcctcgattaaggagataa

SEQ ID NO: 807433 - DNA, 20 bp, mouse
ggaggaagacaaggagagtc

SEQ ID NO: 807434 - DNA, 20 bp, mouse
gtaggggattgtcggagctt

SEQ ID NO: 807435 - DNA, 20 bp, mouse
gtgacagtcctgggtaaagg

SEQ ID NO: 807436 - DNA, 20 bp, mouse
ggtgtggcaggggaccacca

SEQ ID NO: 807437 - DNA, 20 bp, mouse
ggctcgggttcgccccctgg

SEQ ID NO: 807438 - DNA, 20 bp, mouse
gctggcactgccaacggctc

SEQ ID NO: 807439 - DNA, 20 bp, mouse
gagaagcggggctgggtgta

SEQ ID NO: 807440 - DNA, 20 bp, mouse
gggcgtgcgcatgcgtagtc

SEQ ID NO: 807441 - DNA, 20 bp, mouse
gccgccgggagcacgtgtgg

SEQ ID NO: 807442 - DNA, 20 bp, mouse
gacgccgccgggagcacgtg

SEQ ID NO: 807443 - DNA, 20 bp, mouse
gcgtagtctggcactgccaa

SEQ ID NO: 807444 - DNA, 20 bp, mouse
gcctgtggcctggaaaaagg

SEQ ID NO: 807445 - DNA, 20 bp, mouse
gcaactgcgagaggaagtac

SEQ ID NO: 807446 - DNA, 20 bp, mouse
gtgaagaaaaagacgttcgt

SEQ ID NO: 807447 - DNA, 20 bp, mouse
gcgccccgcccggtcctccg

SEQ ID NO: 807448 - DNA, 20 bp, mouse
gcgtcctgggccattcgcgc

SEQ ID NO: 807449 - DNA, 20 bp, mouse
gactccccctaggccgtcct

SEQ ID NO: 807450 - DNA, 20 bp, mouse
gtggcccaggacggcctagg

SEQ ID NO: 807451 - DNA, 20 bp, mouse
ggaatggcccaggacggcct

SEQ ID NO: 807452 - DNA, 20 bp, mouse
gcttgcgcgctcaagtagaa

SEQ ID NO: 807453 - DNA, 20 bp, mouse
gaagcccagccactccccct

SEQ ID NO: 807454 - DNA, 20 bp, mouse
gaccgggcggggcggatgga

SEQ ID NO: 807455 - DNA, 20 bp, mouse
gaagacgttcgtcggtacag

SEQ ID NO: 807456 - DNA, 20 bp, mouse
ggcacccagccccacgcatc

SEQ ID NO: 807457 - DNA, 20 bp, mouse
gtggggctgggtgcgcgaga

SEQ ID NO: 807458 - DNA, 20 bp, mouse
ggtaaccacgctttcccccg

SEQ ID NO: 807459 - DNA, 20 bp, mouse
ggcccaagcggtgacgacga

SEQ ID NO: 807460 - DNA, 20 bp, mouse
ggggaggagcaagaattctt

SEQ ID NO: 807461 - DNA, 20 bp, mouse
ggaaagcgtggttacagttg

SEQ ID NO: 807462 - DNA, 20 bp, mouse
gtatacaggactgaaatcca

SEQ ID NO: 807463 - DNA, 20 bp, mouse
gcacgctttcccccggggtg

SEQ ID NO: 807464 - DNA, 20 bp, mouse
gagacgaccaggttaagagg

SEQ ID NO: 807465 - DNA, 20 bp, mouse
ggtgcagaggtgtacggatg

SEQ ID NO: 807466 - DNA, 20 bp, mouse
ggcagagagttgtaagtctg

SEQ ID NO: 807467 - DNA, 20 bp, mouse
gcactgagtcccaaagccaa

SEQ ID NO: 807468 - DNA, 20 bp, mouse
gagaaaatggcggctagacc

SEQ ID NO: 807469 - DNA, 20 bp, mouse
gtgcacagcattccagccct

SEQ ID NO: 807470 - DNA, 20 bp, mouse
gagtctgaggatggccacaa

SEQ ID NO: 807471 - DNA, 20 bp, mouse
gaggcacgagagaacgggcc

SEQ ID NO: 807472 - DNA, 20 bp, mouse
ggggcctgggagaagccctc

SEQ ID NO: 807473 - DNA, 20 bp, mouse
ggcaacttctagagggagtt

SEQ ID NO: 807474 - DNA, 20 bp, mouse
gtgggagtggatgtaacttc

SEQ ID NO: 807475 - DNA, 20 bp, mouse
gctggtttgtgacacaccca

SEQ ID NO: 807476 - DNA, 20 bp, mouse
gaaagcccagcagctcggag

SEQ ID NO: 807477 - DNA, 20 bp, mouse
ggggcggtgctctgatggtg

SEQ ID NO: 807478 - DNA, 20 bp, mouse
gtgctctgatggtgaggcgt

SEQ ID NO: 807479 - DNA, 20 bp, mouse
gcgtgggcgtggcttccttt

SEQ ID NO: 807480 - DNA, 20 bp, mouse
gtcggaggggcggcgcccaa

SEQ ID NO: 807481 - DNA, 20 bp, mouse
gcgggattccggcgaggggt

SEQ ID NO: 807482 - DNA, 20 bp, mouse
gaatcccgcgccgaactcgg

SEQ ID NO: 807483 - DNA, 20 bp, mouse
ggcccagcagctcggagggg

SEQ ID NO: 807484 - DNA, 20 bp, mouse
gcggcgcgggattccggcga

SEQ ID NO: 807485 - DNA, 20 bp, mouse
ggaagaggtcgcaggggcgg

SEQ ID NO: 807486 - DNA, 20 bp, mouse
gcaaccccgccgaatcgcag

SEQ ID NO: 807487 - DNA, 20 bp, mouse
gcaggcggcgcggtcatcca

SEQ ID NO: 807488 - DNA, 20 bp, mouse
gcggcagagcgaatggggaa

SEQ ID NO: 807489 - DNA, 20 bp, mouse
gcggcccctgcgattcggcg

SEQ ID NO: 807490 - DNA, 20 bp, mouse
gaatcgcaggggccgctgca

SEQ ID NO: 807491 - DNA, 20 bp, mouse
ggatgaccgcgccgcctgca

SEQ ID NO: 807492 - DNA, 20 bp, mouse
ggggagatcctctggagtaa

SEQ ID NO: 807493 - DNA, 20 bp, mouse
gagcgcgcagagcggtgacg

SEQ ID NO: 807494 - DNA, 20 bp, mouse
gtctgctgagggcccacggt

SEQ ID NO: 807495 - DNA, 20 bp, mouse
ggctcgccagcaagccgcgg

SEQ ID NO: 807496 - DNA, 20 bp, mouse
gacgaggcacctccccgaga

SEQ ID NO: 807497 - DNA, 20 bp, mouse
ggaagccaggatagaggggc

SEQ ID NO: 807498 - DNA, 20 bp, mouse
ggctgcctgccctctcgggg

SEQ ID NO: 807499 - DNA, 20 bp, mouse
gttagcacatagaaacgaaa

SEQ ID NO: 807500 - DNA, 20 bp, mouse
gataggcaaaggaatagggt

SEQ ID NO: 807501 - DNA, 20 bp, mouse
gcctcccaaggcttttcctg

SEQ ID NO: 807502 - DNA, 20 bp, mouse
gaaagggaaaatagggctga

SEQ ID NO: 807503 - DNA, 20 bp, mouse
gtccctgaaacactagagat

SEQ ID NO: 807504 - DNA, 20 bp, mouse
gggcacctccccgagagggc

SEQ ID NO: 807505 - DNA, 20 bp, mouse
ggtgaaaactgagtggattt

SEQ ID NO: 807506 - DNA, 20 bp, mouse
gtggccatgcacgaactcgg

SEQ ID NO: 807507 - DNA, 20 bp, mouse
ggaggcgcgaccggagggtg

SEQ ID NO: 807508 - DNA, 20 bp, mouse
gttcgtgcatggccaggtgg

SEQ ID NO: 807509 - DNA, 20 bp, mouse
gcgggggccgagcaaagaag

SEQ ID NO: 807510 - DNA, 20 bp, mouse
gcggaccaggactccttcac

SEQ ID NO: 807511 - DNA, 20 bp, mouse
ggagctgcgggatcctgtga

SEQ ID NO: 807512 - DNA, 20 bp, mouse
gtcacccccgagttcgtgca

SEQ ID NO: 807513 - DNA, 20 bp, mouse
gggctccagggcttctgaca

SEQ ID NO: 807514 - DNA, 20 bp, mouse
ggggcggaggcgcgaccgga

SEQ ID NO: 807515 - DNA, 20 bp, mouse
gtcttcccgcagtgcttcgc

SEQ ID NO: 807516 - DNA, 20 bp, mouse
gcagcagcttggtcgcgagg

SEQ ID NO: 807517 - DNA, 20 bp, mouse
gcggcaccggccggtggccc

SEQ ID NO: 807518 - DNA, 20 bp, mouse
gcagcccgagccggatgtgg

SEQ ID NO: 807519 - DNA, 20 bp, mouse
gggctgcacgtccgcttcgg

SEQ ID NO: 807520 - DNA, 20 bp, mouse
gctcccttcggcccacgcgc

SEQ ID NO: 807521 - DNA, 20 bp, mouse
gcggccggtggcccgggatg

SEQ ID NO: 807522 - DNA, 20 bp, mouse
ggtgcagcccgagccggatg

SEQ ID NO: 807523 - DNA, 20 bp, mouse
gggagcttggaagtcggtgg

SEQ ID NO: 807524 - DNA, 20 bp, mouse
ggcgcagcagcttggtcgcg

SEQ ID NO: 807525 - DNA, 20 bp, mouse
gcgggtggccagattgatgc

SEQ ID NO: 807526 - DNA, 20 bp, mouse
gaagccaggcgtggaggtga

SEQ ID NO: 807527 - DNA, 20 bp, mouse
ggatgctgaaggcatcaaca

SEQ ID NO: 807528 - DNA, 20 bp, mouse
gagagggcgggaccaagaac

SEQ ID NO: 807529 - DNA, 20 bp, mouse
gacaagacgggcttcacagg

SEQ ID NO: 807530 - DNA, 20 bp, mouse
ggcgcctccaaggtctactc

SEQ ID NO: 807531 - DNA, 20 bp, mouse
gtgctggcagccgataaaag

SEQ ID NO: 807532 - DNA, 20 bp, mouse
ggtgaagcccgtcttgtcat

SEQ ID NO: 807533 - DNA, 20 bp, mouse
ggtctactctggaatctact

SEQ ID NO: 807534 - DNA, 20 bp, mouse
gctgctccaaccccctgcct

SEQ ID NO: 807535 - DNA, 20 bp, mouse
ggcgcagagatagctagcca

SEQ ID NO: 807536 - DNA, 20 bp, mouse
gcgcccccgtggcagggtgg

SEQ ID NO: 807537 - DNA, 20 bp, mouse
ggcccccctccgcttggcta

SEQ ID NO: 807538 - DNA, 20 bp, mouse
ggtaaactctggctagtcat

SEQ ID NO: 807539 - DNA, 20 bp, mouse
ggggctgggtggaggaccag

SEQ ID NO: 807540 - DNA, 20 bp, mouse
gctgaagcgcccccgtggca

SEQ ID NO: 807541 - DNA, 20 bp, mouse
gctgggtggaggaccagcgg

SEQ ID NO: 807542 - DNA, 20 bp, mouse
ggggggatgggtgagaagcc

SEQ ID NO: 807543 - DNA, 20 bp, mouse
gctaccggggcaggaagacg

SEQ ID NO: 807544 - DNA, 20 bp, mouse
gtggaggaccagcgggggat

SEQ ID NO: 807545 - DNA, 20 bp, mouse
gggcgcttcagcgctttctc

SEQ ID NO: 807546 - DNA, 20 bp, mouse
ggagactaagccagagtgat

SEQ ID NO: 807547 - DNA, 20 bp, mouse
ggttcagtcaagtgtaggag

SEQ ID NO: 807548 - DNA, 20 bp, mouse
gcctggggccactgagataa

SEQ ID NO: 807549 - DNA, 20 bp, mouse
gtatgggacaaggtgtgcaa

SEQ ID NO: 807550 - DNA, 20 bp, mouse
ggggacaaggtgtgcaaagg

SEQ ID NO: 807551 - DNA, 20 bp, mouse
gctacacttgactgaaccca

SEQ ID NO: 807552 - DNA, 20 bp, mouse
gtatctgccagtatgggaca

SEQ ID NO: 807553 - DNA, 20 bp, mouse
gctggctgacatggagtgac

SEQ ID NO: 807554 - DNA, 20 bp, mouse
gctgaggcatcccatcactc

SEQ ID NO: 807555 - DNA, 20 bp, mouse
gtgaacccagggctgggcct

SEQ ID NO: 807556 - DNA, 20 bp, mouse
gaagactgaaggcgagagag

SEQ ID NO: 807557 - DNA, 20 bp, mouse
gtcacctaaggcaaggctat

SEQ ID NO: 807558 - DNA, 20 bp, mouse
gccttgccttaggtgaatgt

SEQ ID NO: 807559 - DNA, 20 bp, mouse
gcaaagcccacattcaccta

SEQ ID NO: 807560 - DNA, 20 bp, mouse
gcatcccatagccttgcctt

SEQ ID NO: 807561 - DNA, 20 bp, mouse
gcagaaatctgctatctcgc

SEQ ID NO: 807562 - DNA, 20 bp, mouse
gtccaggcacaggatttaaa

SEQ ID NO: 807563 - DNA, 20 bp, mouse
gccgaggaggttggcacaga

SEQ ID NO: 807564 - DNA, 20 bp, mouse
gactccatctgtctaggaat

SEQ ID NO: 807565 - DNA, 20 bp, mouse
gtctctgccagcatcatgac

SEQ ID NO: 807566 - DNA, 20 bp, mouse
ggaggcaggccgtgtgaaag

SEQ ID NO: 807567 - DNA, 20 bp, mouse
gcacaggacggctgtctctg

SEQ ID NO: 807568 - DNA, 20 bp, mouse
gcaccccaagtagtagatgg

SEQ ID NO: 807569 - DNA, 20 bp, mouse
gaggagcagactgcccagtt

SEQ ID NO: 807570 - DNA, 20 bp, mouse
gaacactgagtcacgcaggg

SEQ ID NO: 807571 - DNA, 20 bp, mouse
gggaggtgggaagtgcaccc

SEQ ID NO: 807572 - DNA, 20 bp, mouse
gtaaaaggctcatttacaag

SEQ ID NO: 807573 - DNA, 20 bp, mouse
gcatttacaagtggttgact

SEQ ID NO: 807574 - DNA, 20 bp, mouse
gactgagtcacgcagggagg

SEQ ID NO: 807575 - DNA, 20 bp, mouse
gggtgacaccctctttcaca

SEQ ID NO: 807576 - DNA, 20 bp, mouse
gtgtctgtgaggaaaggcga

SEQ ID NO: 807577 - DNA, 20 bp, mouse
gaaaccgcttctcagggcat

SEQ ID NO: 807578 - DNA, 20 bp, mouse
gtaagagtagcgacctcggg

SEQ ID NO: 807579 - DNA, 20 bp, mouse
gaatcggggcgaacctcccg

SEQ ID NO: 807580 - DNA, 20 bp, mouse
gacgcccatgccctgagaag

SEQ ID NO: 807581 - DNA, 20 bp, mouse
gggaagggacactactgtta

SEQ ID NO: 807582 - DNA, 20 bp, mouse
gtctcagggcatgggcgtgg

SEQ ID NO: 807583 - DNA, 20 bp, mouse
gaaggcgagggctgggaccg

SEQ ID NO: 807584 - DNA, 20 bp, mouse
ggtagggccacgtcatcttc

SEQ ID NO: 807585 - DNA, 20 bp, mouse
ggggctgggaccggggaggc

SEQ ID NO: 807586 - DNA, 20 bp, mouse
gcgcgcggtgatgacgtctt

SEQ ID NO: 807587 - DNA, 20 bp, mouse
gggaacggaatgtgcttaca

SEQ ID NO: 807588 - DNA, 20 bp, mouse
gaggcgcgcgggctggcgga

SEQ ID NO: 807589 - DNA, 20 bp, mouse
ggatgagagctgacaaggga

SEQ ID NO: 807590 - DNA, 20 bp, mouse
gaacgccgagcgtcagagac

SEQ ID NO: 807591 - DNA, 20 bp, mouse
gaaggaacgtctgcacttga

SEQ ID NO: 807592 - DNA, 20 bp, mouse
ggaacgtctgcacttgaagg

SEQ ID NO: 807593 - DNA, 20 bp, mouse
gctgctgcctccagcttttc

SEQ ID NO: 807594 - DNA, 20 bp, mouse
gaaggtgatgagagctgaca

SEQ ID NO: 807595 - DNA, 20 bp, mouse
gtgggcctgtctctgacgct

SEQ ID NO: 807596 - DNA, 20 bp, mouse
gagcctcagagataaaagaa

SEQ ID NO: 807597 - DNA, 20 bp, mouse
gaaaaagctcgcctgcgctg

SEQ ID NO: 807598 - DNA, 20 bp, mouse
gcccccttcttttatctctg

SEQ ID NO: 807599 - DNA, 20 bp, mouse
gcattccacgctgacgtcac

SEQ ID NO: 807600 - DNA, 20 bp, mouse
gcagcctcaaaccccagcgc

SEQ ID NO: 807601 - DNA, 20 bp, mouse
gaatgcggagtcaggcgccc

SEQ ID NO: 807602 - DNA, 20 bp, mouse
gtcgcctgcgctggggtttg

SEQ ID NO: 807603 - DNA, 20 bp, mouse
gcagcgtggaatgcggagtc

SEQ ID NO: 807604 - DNA, 20 bp, mouse
gccaggctctctataagccg

SEQ ID NO: 807605 - DNA, 20 bp, mouse
gtgagccggtgacgtcagcg

SEQ ID NO: 807606 - DNA, 20 bp, mouse
gcaatcccgcgggaacggag

SEQ ID NO: 807607 - DNA, 20 bp, mouse
gtgcaggattgctggacgat

SEQ ID NO: 807608 - DNA, 20 bp, mouse
gcatggttgctgtacctcaa

SEQ ID NO: 807609 - DNA, 20 bp, mouse
ggtctccttgacaagttcac

SEQ ID NO: 807610 - DNA, 20 bp, mouse
gagcgctactccaatcccgc

SEQ ID NO: 807611 - DNA, 20 bp, mouse
gtcccgcgggaacggagcgg

SEQ ID NO: 807612 - DNA, 20 bp, mouse
ggtccagcaatcctgcaatc

SEQ ID NO: 807613 - DNA, 20 bp, mouse
gtactccaatcccgcgggaa

SEQ ID NO: 807614 - DNA, 20 bp, mouse
gacaagttcacgggtagaga

SEQ ID NO: 807615 - DNA, 20 bp, mouse
gcatacccaagactgcggca

SEQ ID NO: 807616 - DNA, 20 bp, mouse
gtgtctcttggctgtttcta

SEQ ID NO: 807617 - DNA, 20 bp, mouse
gttgcaggcgcctgcgtctc

SEQ ID NO: 807618 - DNA, 20 bp, mouse
gtcccctggggccttaaggg

SEQ ID NO: 807619 - DNA, 20 bp, mouse
ggaggtaaatgacgttcata

SEQ ID NO: 807620 - DNA, 20 bp, mouse
gaagcagtctctgtgtctct

SEQ ID NO: 807621 - DNA, 20 bp, mouse
gataggggtcgatggagaaa

SEQ ID NO: 807622 - DNA, 20 bp, mouse
gacacagagactgcttcagt

SEQ ID NO: 807623 - DNA, 20 bp, mouse
gggtggaccgaggtttcgga

SEQ ID NO: 807624 - DNA, 20 bp, mouse
ggggtcccctggggccttaa

SEQ ID NO: 807625 - DNA, 20 bp, mouse
gaacgtgcaggacactttcg

SEQ ID NO: 807626 - DNA, 20 bp, mouse
ggcagcccacaagaggtaga

SEQ ID NO: 807627 - DNA, 20 bp, mouse
gggacccaagtcagaggtcg

SEQ ID NO: 807628 - DNA, 20 bp, mouse
gttgtggagtattcaggcag

SEQ ID NO: 807629 - DNA, 20 bp, mouse
gtgagtgagctcagtttcaa

SEQ ID NO: 807630 - DNA, 20 bp, mouse
gagtggaggacccaagtcag

SEQ ID NO: 807631 - DNA, 20 bp, mouse
gactgccctctacctcttgt

SEQ ID NO: 807632 - DNA, 20 bp, mouse
gggccacttgtggagtattc

SEQ ID NO: 807633 - DNA, 20 bp, mouse
gtcacacaataggccacttg

SEQ ID NO: 807634 - DNA, 20 bp, mouse
gactgagcactccaggttcc

SEQ ID NO: 807635 - DNA, 20 bp, mouse
gtacttggtcatcttctccg

SEQ ID NO: 807636 - DNA, 20 bp, mouse
ggaggacataggcctcattt

SEQ ID NO: 807637 - DNA, 20 bp, mouse
ggacataggcctcattttgg

SEQ ID NO: 807638 - DNA, 20 bp, mouse
gcaatcagacctccaaaatg

SEQ ID NO: 807639 - DNA, 20 bp, mouse
gaacaaaaaggtaaaattga

SEQ ID NO: 807640 - DNA, 20 bp, mouse
gaattttacctttttgtttt

SEQ ID NO: 807641 - DNA, 20 bp, mouse
gatgcttattctgattttgt

SEQ ID NO: 807642 - DNA, 20 bp, mouse
gcaaagggaaagtaagagga

SEQ ID NO: 807643 - DNA, 20 bp, mouse
gccaagatgtgtaacaggag

SEQ ID NO: 807644 - DNA, 20 bp, mouse
gctgccctgctcagtgggaa

SEQ ID NO: 807645 - DNA, 20 bp, mouse
gatgtgtaacaggagaggca

SEQ ID NO: 807646 - DNA, 20 bp, mouse
gtatcttaagattactaaga

SEQ ID NO: 807647 - DNA, 20 bp, mouse
ggaaaagggaaagtatgagt

SEQ ID NO: 807648 - DNA, 20 bp, mouse
gaaggcacgaagcatatgga

SEQ ID NO: 807649 - DNA, 20 bp, mouse
gtggccagtggtcttaattt

SEQ ID NO: 807650 - DNA, 20 bp, mouse
gctgtttggctcagtgggaa

SEQ ID NO: 807651 - DNA, 20 bp, mouse
gcaatcagacctctagaatg

SEQ ID NO: 807652 - DNA, 20 bp, mouse
ggaaggatgcctacaaaatc

SEQ ID NO: 807653 - DNA, 20 bp, mouse
gaacaagaaagtcaaattga

SEQ ID NO: 807654 - DNA, 20 bp, mouse
gaagccaaaattaagaccac

SEQ ID NO: 807655 - DNA, 20 bp, mouse
gaatttgactttcttgttgt

SEQ ID NO: 807656 - DNA, 20 bp, mouse
gcaaaggaatagtaagacta

SEQ ID NO: 807657 - DNA, 20 bp, mouse
gtcaaaatgtgtcctggtag

SEQ ID NO: 807658 - DNA, 20 bp, mouse
ggaatagtaagactagggaa

SEQ ID NO: 807659 - DNA, 20 bp, mouse
gtaggggcaagtcaaagaca

SEQ ID NO: 807660 - DNA, 20 bp, mouse
gcccatgtgccctgtcacac

SEQ ID NO: 807661 - DNA, 20 bp, mouse
gtccagtgtgacagggcaca

SEQ ID NO: 807662 - DNA, 20 bp, mouse
gggatctctaagcaaggtcc

SEQ ID NO: 807663 - DNA, 20 bp, mouse
ggcctctccaggcccctacc

SEQ ID NO: 807664 - DNA, 20 bp, mouse
gccaacagctgtagaaactt

SEQ ID NO: 807665 - DNA, 20 bp, mouse
gtcccagaataatgtaggcc

SEQ ID NO: 807666 - DNA, 20 bp, mouse
gacatgtcatgtgaagtcaa

SEQ ID NO: 807667 - DNA, 20 bp, mouse
ggcccgtgtgcttgtgtcat

SEQ ID NO: 807668 - DNA, 20 bp, mouse
gtcctgggaggcatcgggtg

SEQ ID NO: 807669 - DNA, 20 bp, mouse
gaacacagacctcactctgg

SEQ ID NO: 807670 - DNA, 20 bp, mouse
gagaacaaagagaggtcagg

SEQ ID NO: 807671 - DNA, 20 bp, mouse
gatcgggtggggttcaaata

SEQ ID NO: 807672 - DNA, 20 bp, mouse
gacccatgacacaagcacac

SEQ ID NO: 807673 - DNA, 20 bp, mouse
gtaataagatcacaactaat

SEQ ID NO: 807674 - DNA, 20 bp, mouse
gacacagtctcccatgtgca

SEQ ID NO: 807675 - DNA, 20 bp, mouse
ggatcacaactaatgggacc

SEQ ID NO: 807676 - DNA, 20 bp, mouse
ggatcaatgctaatgggacc

SEQ ID NO: 807677 - DNA, 20 bp, mouse
gatggcagacctcagaccgc

SEQ ID NO: 807678 - DNA, 20 bp, mouse
gcctttttgctgttgtacag

SEQ ID NO: 807679 - DNA, 20 bp, mouse
gaatgggaccaggcagagcc

SEQ ID NO: 807680 - DNA, 20 bp, mouse
gcaaatgaccaccagaagtg

SEQ ID NO: 807681 - DNA, 20 bp, mouse
gaggcacaaagacctctgtg

SEQ ID NO: 807682 - DNA, 20 bp, mouse
gtcaacaacctggctctgcc

SEQ ID NO: 807683 - DNA, 20 bp, mouse
gagggaagacaggaagcaaa

SEQ ID NO: 807684 - DNA, 20 bp, mouse
ggactggttcaagggaagac

SEQ ID NO: 807685 - DNA, 20 bp, mouse
gcagcattcacatgggagag

SEQ ID NO: 807686 - DNA, 20 bp, mouse
gaacaaaaaggtaaaattga

SEQ ID NO: 807687 - DNA, 20 bp, mouse
gtatatttttttctgagata

SEQ ID NO: 807688 - DNA, 20 bp, mouse
gaattttacctttttgtttt

SEQ ID NO: 807689 - DNA, 20 bp, mouse
gccaagatgtgtaaaaggag

SEQ ID NO: 807690 - DNA, 20 bp, mouse
ggcaggggtcacatcgccag

SEQ ID NO: 807691 - DNA, 20 bp, mouse
gaagttccaagatgtgtaaa

SEQ ID NO: 807692 - DNA, 20 bp, mouse
gcgatcagacctccagaatg

SEQ ID NO: 807693 - DNA, 20 bp, mouse
gatgcttattctgattttgt

SEQ ID NO: 807694 - DNA, 20 bp, mouse
gcaaagggaaagtaagagga

SEQ ID NO: 807695 - DNA, 20 bp, mouse
gctgccctgctcagtgggaa

SEQ ID NO: 807696 - DNA, 20 bp, mouse
gggacacaccctcactctgg

SEQ ID NO: 807697 - DNA, 20 bp, mouse
gggaaaagatgactaggcag

SEQ ID NO: 807698 - DNA, 20 bp, mouse
gttaaggtttccagtgagag

SEQ ID NO: 807699 - DNA, 20 bp, mouse
gccgtgtctgagtctctcca

SEQ ID NO: 807700 - DNA, 20 bp, mouse
ggatgactaggcagaggatc

SEQ ID NO: 807701 - DNA, 20 bp, mouse
gcaagatcttgtcaataacc

SEQ ID NO: 807702 - DNA, 20 bp, mouse
ggtcaatggaaaagatgact

SEQ ID NO: 807703 - DNA, 20 bp, mouse
gggctcttaagtaaacatta

SEQ ID NO: 807704 - DNA, 20 bp, mouse
ggaacgttgtctacaatagc

SEQ ID NO: 807705 - DNA, 20 bp, mouse
gtagagattagttcaaggga

SEQ ID NO: 807706 - DNA, 20 bp, mouse
ggggctgtgtgtttgtgtca

SEQ ID NO: 807707 - DNA, 20 bp, mouse
gtggccagtagtctgaggtc

SEQ ID NO: 807708 - DNA, 20 bp, mouse
gtgaggtccccactgtgaca

SEQ ID NO: 807709 - DNA, 20 bp, mouse
gtacaacagcaggagaagtt

SEQ ID NO: 807710 - DNA, 20 bp, mouse
gtatcctgggaatggcctgg

SEQ ID NO: 807711 - DNA, 20 bp, mouse
gaatcagaccatcagtagtg

SEQ ID NO: 807712 - DNA, 20 bp, mouse
gacatggacctcactactga

SEQ ID NO: 807713 - DNA, 20 bp, mouse
ggactagggaaaaggtcaaa

SEQ ID NO: 807714 - DNA, 20 bp, mouse
gaagccagacctcagactac

SEQ ID NO: 807715 - DNA, 20 bp, mouse
gaagtttgggttgacgagac

SEQ ID NO: 807716 - DNA, 20 bp, mouse
gaacaaaaaggtaaaattga

SEQ ID NO: 807717 - DNA, 20 bp, mouse
gtatatttttttctgagata

SEQ ID NO: 807718 - DNA, 20 bp, mouse
gaattttacctttttgtttt

SEQ ID NO: 807719 - DNA, 20 bp, mouse
gaagccaaaatacagacaac

SEQ ID NO: 807720 - DNA, 20 bp, mouse
gcgatcagacctccagaatg

SEQ ID NO: 807721 - DNA, 20 bp, mouse
gatgcttattctgattttgt

SEQ ID NO: 807722 - DNA, 20 bp, mouse
gcaaagggaaagtaagagga

SEQ ID NO: 807723 - DNA, 20 bp, mouse
gccaagatgtgtaacaggag

SEQ ID NO: 807724 - DNA, 20 bp, mouse
gctgccctgctcagtgggaa

SEQ ID NO: 807725 - DNA, 20 bp, mouse
gcctcccttcccactgagca

SEQ ID NO: 807726 - DNA, 20 bp, mouse
ggcaaacatgtcggggtaag

SEQ ID NO: 807727 - DNA, 20 bp, mouse
gaacttgagtggatcataag

SEQ ID NO: 807728 - DNA, 20 bp, mouse
ggcagttggcaaacatgtcg

SEQ ID NO: 807729 - DNA, 20 bp, mouse
gtaacagggaggagtgccaa

SEQ ID NO: 807730 - DNA, 20 bp, mouse
gaggacctggcaggacaact

SEQ ID NO: 807731 - DNA, 20 bp, mouse
gtgtcctgccaggtcctgag

SEQ ID NO: 807732 - DNA, 20 bp, mouse
ggggtaagtggaatacatcc

SEQ ID NO: 807733 - DNA, 20 bp, mouse
ggggtgggggcctcccagag

SEQ ID NO: 807734 - DNA, 20 bp, mouse
gccagaagctgtcagagcac

SEQ ID NO: 807735 - DNA, 20 bp, mouse
gaaggtggcaccttgcccgg

SEQ ID NO: 807736 - DNA, 20 bp, mouse
ggacttgcgttcttgtttat

SEQ ID NO: 807737 - DNA, 20 bp, mouse
gttattggatgagactaagg

SEQ ID NO: 807738 - DNA, 20 bp, mouse
gtttagtatggcactgtacc

SEQ ID NO: 807739 - DNA, 20 bp, mouse
gtcggtgttcaaattaaatt

SEQ ID NO: 807740 - DNA, 20 bp, mouse
gagtttcctgatttctgtct

SEQ ID NO: 807741 - DNA, 20 bp, mouse
gttcatcctcttatgtgtcc

SEQ ID NO: 807742 - DNA, 20 bp, mouse
gaataaatagaggaacactg

SEQ ID NO: 807743 - DNA, 20 bp, mouse
gtgtttattggatgagacta

SEQ ID NO: 807744 - DNA, 20 bp, mouse
gctgttgatttcagtggttg

SEQ ID NO: 807745 - DNA, 20 bp, mouse
gctgtaccaggacacataag

SEQ ID NO: 807746 - DNA, 20 bp, mouse
gttgttcttcataataggag

SEQ ID NO: 807747 - DNA, 20 bp, mouse
gactacatgaatgagcaatg

SEQ ID NO: 807748 - DNA, 20 bp, mouse
gcacaggtgacaagtaaatc

SEQ ID NO: 807749 - DNA, 20 bp, mouse
gggctagagcctagcaactg

SEQ ID NO: 807750 - DNA, 20 bp, mouse
gtgctgaacaaaatgaactg

SEQ ID NO: 807751 - DNA, 20 bp, mouse
gactcctgaaggcatatttg

SEQ ID NO: 807752 - DNA, 20 bp, mouse
ggttgtttgttcttcataat

SEQ ID NO: 807753 - DNA, 20 bp, mouse
gcatccgcaaatatgccttc

SEQ ID NO: 807754 - DNA, 20 bp, mouse
gtggagtgaagcacaatttg

SEQ ID NO: 807755 - DNA, 20 bp, mouse
gaaagcatcatcagctacca

SEQ ID NO: 807756 - DNA, 20 bp, mouse
gacaaaaggaatgagcaact

SEQ ID NO: 807757 - DNA, 20 bp, mouse
ggggagtgaagcacaatttg

SEQ ID NO: 807758 - DNA, 20 bp, mouse
gacaaggtgaacatgacaaa

SEQ ID NO: 807759 - DNA, 20 bp, mouse
gtggaggcatgtttgcagaa

SEQ ID NO: 807760 - DNA, 20 bp, mouse
gggatagagcctagcacctg

SEQ ID NO: 807761 - DNA, 20 bp, mouse
ggcagtgtgaatatccttgg

SEQ ID NO: 807762 - DNA, 20 bp, mouse
gacaagtaaaacaggaccat

SEQ ID NO: 807763 - DNA, 20 bp, mouse
ggcatgtttgcagaagggtg

SEQ ID NO: 807764 - DNA, 20 bp, mouse
gttctgaacaaaatgaccta

SEQ ID NO: 807765 - DNA, 20 bp, mouse
ggtcattttgttcagaactt

SEQ ID NO: 807766 - DNA, 20 bp, mouse
gacaaaaggaatgagcaact

SEQ ID NO: 807767 - DNA, 20 bp, mouse
ggggagtgaagcacaatttg

SEQ ID NO: 807768 - DNA, 20 bp, mouse
gtggaggcatgtttgcagaa

SEQ ID NO: 807769 - DNA, 20 bp, mouse
gggatagagcctagcacctg

SEQ ID NO: 807770 - DNA, 20 bp, mouse
ggcagtgtgaatatccttgg

SEQ ID NO: 807771 - DNA, 20 bp, mouse
gacaagtaaaacaggaccat

SEQ ID NO: 807772 - DNA, 20 bp, mouse
ggcatgtttgcagaagggtg

SEQ ID NO: 807773 - DNA, 20 bp, mouse
gttctgaacaaaatgaccta

SEQ ID NO: 807774 - DNA, 20 bp, mouse
ggtcattttgttcagaactt

SEQ ID NO: 807775 - DNA, 20 bp, mouse
gtgaaaggctgaggacaagg

SEQ ID NO: 807776 - DNA, 20 bp, mouse
ggttgttggatcttcagagt

SEQ ID NO: 807777 - DNA, 20 bp, mouse
gactacatgaatgagcaatg

SEQ ID NO: 807778 - DNA, 20 bp, mouse
gtgaaggcatatttgcagat

SEQ ID NO: 807779 - DNA, 20 bp, mouse
gggctagagcctagcaactg

SEQ ID NO: 807780 - DNA, 20 bp, mouse
gtgctgaacaaaatgaactg

SEQ ID NO: 807781 - DNA, 20 bp, mouse
gtcaggctgtctcaggttgt

SEQ ID NO: 807782 - DNA, 20 bp, mouse
gtggagtgaagcacaatttg

SEQ ID NO: 807783 - DNA, 20 bp, mouse
gaaagcatcatcagctacca

SEQ ID NO: 807784 - DNA, 20 bp, mouse
gagtgtcacagagaggtgga

SEQ ID NO: 807785 - DNA, 20 bp, mouse
ggcatatttgcagatgggtg

SEQ ID NO: 807786 - DNA, 20 bp, mouse
ggagaacatcaggacatctc

SEQ ID NO: 807787 - DNA, 20 bp, mouse
gctccctccccagttcaagg

SEQ ID NO: 807788 - DNA, 20 bp, mouse
ggggtgattggagcaaaaag

SEQ ID NO: 807789 - DNA, 20 bp, mouse
gttcccccttgaactgggga

SEQ ID NO: 807790 - DNA, 20 bp, mouse
gcccaagcttctaagacctt

SEQ ID NO: 807791 - DNA, 20 bp, mouse
gtacccttcccccttgaact

SEQ ID NO: 807792 - DNA, 20 bp, mouse
ggcagtgagtggtagaataa

SEQ ID NO: 807793 - DNA, 20 bp, mouse
gagctctaactcttttggca

SEQ ID NO: 807794 - DNA, 20 bp, mouse
gcccacatggccaaagagtg

SEQ ID NO: 807795 - DNA, 20 bp, mouse
gtatcctcaggggatgatga

SEQ ID NO: 807796 - DNA, 20 bp, mouse
gaaagagctctggactaccc

SEQ ID NO: 807797 - DNA, 20 bp, mouse
gacaacatgaatgagcaatg

SEQ ID NO: 807798 - DNA, 20 bp, mouse
gccacactgccaaagagctc

SEQ ID NO: 807799 - DNA, 20 bp, mouse
gtttgttcttcagattggga

SEQ ID NO: 807800 - DNA, 20 bp, mouse
gctctctgtgacagtcagcc

SEQ ID NO: 807801 - DNA, 20 bp, mouse
gagaacaaacaccctgagac

SEQ ID NO: 807802 - DNA, 20 bp, mouse
ggcagtgtggacatccttgg

SEQ ID NO: 807803 - DNA, 20 bp, mouse
gatgacgtcagcctgtctca

SEQ ID NO: 807804 - DNA, 20 bp, mouse
gactcctgaaggtatgtttg

SEQ ID NO: 807805 - DNA, 20 bp, mouse
gcatccgcaaacataccttc

SEQ ID NO: 807806 - DNA, 20 bp, mouse
gtagccgtgtgggtattctt

SEQ ID NO: 807807 - DNA, 20 bp, mouse
gtggaggcaggattggtggt

SEQ ID NO: 807808 - DNA, 20 bp, mouse
gcaagagctcgacatacctt

SEQ ID NO: 807809 - DNA, 20 bp, mouse
ggcctctatgcaactgggaa

SEQ ID NO: 807810 - DNA, 20 bp, mouse
gatgtcgagctcttggaggc

SEQ ID NO: 807811 - DNA, 20 bp, mouse
gtattcttggggactgatga

SEQ ID NO: 807812 - DNA, 20 bp, mouse
gtcccttcccagttgcatag

SEQ ID NO: 807813 - DNA, 20 bp, mouse
gaggtcagctctaatccttt

SEQ ID NO: 807814 - DNA, 20 bp, mouse
gtctcagctgcttggtcaat

SEQ ID NO: 807815 - DNA, 20 bp, mouse
gctgagacatttggattgga

SEQ ID NO: 807816 - DNA, 20 bp, mouse
gctgctcaggccttgacctc

SEQ ID NO: 807817 - DNA, 20 bp, mouse
ggacaccttcccttgcatac

SEQ ID NO: 807818 - DNA, 20 bp, mouse
gtcctcctgtatgcaaggga

SEQ ID NO: 807819 - DNA, 20 bp, mouse
gcccacgtggccaaatatct

SEQ ID NO: 807820 - DNA, 20 bp, mouse
gttgcatacaggaggaagat

SEQ ID NO: 807821 - DNA, 20 bp, mouse
gaccttcccttgcatacagg

SEQ ID NO: 807822 - DNA, 20 bp, mouse
ggaaggtgtccacaggtgct

SEQ ID NO: 807823 - DNA, 20 bp, mouse
gttcctgtccaaacttggaa

SEQ ID NO: 807824 - DNA, 20 bp, mouse
gctaggtctccatgactctc

SEQ ID NO: 807825 - DNA, 20 bp, mouse
gagcagacgtgtgtatttct

SEQ ID NO: 807826 - DNA, 20 bp, mouse
ggttagctttaacccctctt

SEQ ID NO: 807827 - DNA, 20 bp, mouse
gagaggtgaggagtatgaca

SEQ ID NO: 807828 - DNA, 20 bp, mouse
gggatccctgaggacaggaa

SEQ ID NO: 807829 - DNA, 20 bp, mouse
ggatgccttaacttgcagga

SEQ ID NO: 807830 - DNA, 20 bp, mouse
ggaaggtacaggggtcaagg

SEQ ID NO: 807831 - DNA, 20 bp, mouse
gtgtagatgccttaacttgc

SEQ ID NO: 807832 - DNA, 20 bp, mouse
gttcctgtccaaactcagag

SEQ ID NO: 807833 - DNA, 20 bp, mouse
gctgctcagatcttgacctc

SEQ ID NO: 807834 - DNA, 20 bp, mouse
gtcttgctcaaagctcctgg

SEQ ID NO: 807835 - DNA, 20 bp, mouse
gagccaacaacccaaagcaa

SEQ ID NO: 807836 - DNA, 20 bp, mouse
gctccctcccctgttcaagt

SEQ ID NO: 807837 - DNA, 20 bp, mouse
gaagttggacagttagagca

SEQ ID NO: 807838 - DNA, 20 bp, mouse
gttcccttcccacttgaaca

SEQ ID NO: 807839 - DNA, 20 bp, mouse
gtcccctgttcaagtgggaa

SEQ ID NO: 807840 - DNA, 20 bp, mouse
ggcaaagaatctagcatctg

SEQ ID NO: 807841 - DNA, 20 bp, mouse
gaaaaagttggggactaaca

SEQ ID NO: 807842 - DNA, 20 bp, mouse
gggacagttagagcaaggag

SEQ ID NO: 807843 - DNA, 20 bp, mouse
gcaagagctcaaataccttt

SEQ ID NO: 807844 - DNA, 20 bp, mouse
gatggctgaaaatcacagag

SEQ ID NO: 807845 - DNA, 20 bp, mouse
gcccacatggccaaaaagtt

SEQ ID NO: 807846 - DNA, 20 bp, mouse
gacaacatgaatgagcaatg

SEQ ID NO: 807847 - DNA, 20 bp, mouse
gagaacaaacaccctgagac

SEQ ID NO: 807848 - DNA, 20 bp, mouse
ggcagtgtggacatccttgg

SEQ ID NO: 807849 - DNA, 20 bp, mouse
ggatgaagtcagcctgtctc

SEQ ID NO: 807850 - DNA, 20 bp, mouse
gcatctgcaaacataccttc

SEQ ID NO: 807851 - DNA, 20 bp, mouse
gggctgacttcatcagtttc

SEQ ID NO: 807852 - DNA, 20 bp, mouse
ggacaagtaaaacaggacac

SEQ ID NO: 807853 - DNA, 20 bp, mouse
gtggagtgaagcacaatttg

SEQ ID NO: 807854 - DNA, 20 bp, mouse
gtgctaggcactggaccaaa

SEQ ID NO: 807855 - DNA, 20 bp, mouse
ggtatgtttgcagatgggtg

SEQ ID NO: 807856 - DNA, 20 bp, mouse
gatggtcagtggaccctggg

SEQ ID NO: 807857 - DNA, 20 bp, mouse
gaggcctagcacttgagttc

SEQ ID NO: 807858 - DNA, 20 bp, mouse
gaaatcctcaggactgaggt

SEQ ID NO: 807859 - DNA, 20 bp, mouse
gtgggccctatgaagacaaa

SEQ ID NO: 807860 - DNA, 20 bp, mouse
gagtggaacctcaccctcct

SEQ ID NO: 807861 - DNA, 20 bp, mouse
gtgaagacaaagggcatccg

SEQ ID NO: 807862 - DNA, 20 bp, mouse
gaacctacataatcgcccgt

SEQ ID NO: 807863 - DNA, 20 bp, mouse
gcaggggcccatggctcggt

SEQ ID NO: 807864 - DNA, 20 bp, mouse
gggtacaggtcaggggccca

SEQ ID NO: 807865 - DNA, 20 bp, mouse
gaacttcctcttatggtcag

SEQ ID NO: 807866 - DNA, 20 bp, mouse
gggggtaagtcaacaggcag

SEQ ID NO: 807867 - DNA, 20 bp, mouse
gtgtcatcatttctatgcta

SEQ ID NO: 807868 - DNA, 20 bp, mouse
ggatgtgaaggctttctgtt

SEQ ID NO: 807869 - DNA, 20 bp, mouse
gcccttcagaatgtttagtt

SEQ ID NO: 807870 - DNA, 20 bp, mouse
gcatttctatgctagggctt

SEQ ID NO: 807871 - DNA, 20 bp, mouse
gcagcaaagaagagcatgca

SEQ ID NO: 807872 - DNA, 20 bp, mouse
ggctttctgttgggtttgag

SEQ ID NO: 807873 - DNA, 20 bp, mouse
gtttgctggggtaagtcaac

SEQ ID NO: 807874 - DNA, 20 bp, mouse
ggcatagaaatgatgacaga

SEQ ID NO: 807875 - DNA, 20 bp, mouse
gctgctttagtgttcttcca

SEQ ID NO: 807876 - DNA, 20 bp, mouse
gcacgcccggcagatctcag

SEQ ID NO: 807877 - DNA, 20 bp, mouse
gatggggtgaggagggtgat

SEQ ID NO: 807878 - DNA, 20 bp, mouse
gcggggcaggaggacgcctg

SEQ ID NO: 807879 - DNA, 20 bp, mouse
gacaaacaacttaaacggaa

SEQ ID NO: 807880 - DNA, 20 bp, mouse
gaacgggctgtctatgttta

SEQ ID NO: 807881 - DNA, 20 bp, mouse
gtgtcagtgctggcacctta

SEQ ID NO: 807882 - DNA, 20 bp, mouse
gctcctgcctgttagctgta

SEQ ID NO: 807883 - DNA, 20 bp, mouse
gctgttagctgtagggggaa

SEQ ID NO: 807884 - DNA, 20 bp, mouse
ggacacatactgtggtgcgg

SEQ ID NO: 807885 - DNA, 20 bp, mouse
gaaggcagtgagccgtgaac

SEQ ID NO: 807886 - DNA, 20 bp, mouse
gtagactgagaagtgcatga

SEQ ID NO: 807887 - DNA, 20 bp, mouse
gtcgaagccagcgttcatat

SEQ ID NO: 807888 - DNA, 20 bp, mouse
gcccccacccatatgaacgc

SEQ ID NO: 807889 - DNA, 20 bp, mouse
ggagggagaagtggagagta

SEQ ID NO: 807890 - DNA, 20 bp, mouse
gacctcatctaggaagacat

SEQ ID NO: 807891 - DNA, 20 bp, mouse
gcagagttggagagctcatg

SEQ ID NO: 807892 - DNA, 20 bp, mouse
ggtggagagtatggtcagtt

SEQ ID NO: 807893 - DNA, 20 bp, mouse
gagccagcgttcatatgggt

SEQ ID NO: 807894 - DNA, 20 bp, mouse
gcagacatgggagaatccta

SEQ ID NO: 807895 - DNA, 20 bp, mouse
gcccagccgggctttgacaa

SEQ ID NO: 807896 - DNA, 20 bp, mouse
gcaaagaaaaggatctgtct

SEQ ID NO: 807897 - DNA, 20 bp, mouse
gtagagaaaaaggccagcga

SEQ ID NO: 807898 - DNA, 20 bp, mouse
gaccaaccaagcaacactag

SEQ ID NO: 807899 - DNA, 20 bp, mouse
gaaggatgctgccgcagatt

SEQ ID NO: 807900 - DNA, 20 bp, mouse
gaccttctggtgctttatga

SEQ ID NO: 807901 - DNA, 20 bp, mouse
gtgaaggcagttaaccgatg

SEQ ID NO: 807902 - DNA, 20 bp, mouse
gtactagaatgtttccacat

SEQ ID NO: 807903 - DNA, 20 bp, mouse
gagccgagctgggaccggcc

SEQ ID NO: 807904 - DNA, 20 bp, mouse
ggtactcattatagagaaaa

SEQ ID NO: 807905 - DNA, 20 bp, mouse
gccccaggccggtcccagct

SEQ ID NO: 807906 - DNA, 20 bp, mouse
gctagtgcctgcagcctcca

SEQ ID NO: 807907 - DNA, 20 bp, mouse
gcctctgctggagccacgaa

SEQ ID NO: 807908 - DNA, 20 bp, mouse
gcagcctccaagggtgagtg

SEQ ID NO: 807909 - DNA, 20 bp, mouse
gtaccctcactcacccttgg

SEQ ID NO: 807910 - DNA, 20 bp, mouse
gctggtcgtggtgtggaagg

SEQ ID NO: 807911 - DNA, 20 bp, mouse
gtggagccacgaagggcagt

SEQ ID NO: 807912 - DNA, 20 bp, mouse
gttaagggagacttcccctg

SEQ ID NO: 807913 - DNA, 20 bp, mouse
gagttagcttcactagaatg

SEQ ID NO: 807914 - DNA, 20 bp, mouse
gagtgagggggttgccccag

SEQ ID NO: 807915 - DNA, 20 bp, mouse
gagcagaggcccatgaaggc

SEQ ID NO: 807916 - DNA, 20 bp, mouse
gccctggcgcctgggaactg

SEQ ID NO: 807917 - DNA, 20 bp, mouse
gagccacgcccgaacccggg

SEQ ID NO: 807918 - DNA, 20 bp, mouse
gaactcgggcgggtccacac

SEQ ID NO: 807919 - DNA, 20 bp, mouse
gcaggagtgggaggctgtta

SEQ ID NO: 807920 - DNA, 20 bp, mouse
gaccagcagggaaggaactg

SEQ ID NO: 807921 - DNA, 20 bp, mouse
ggcgcctgggaactgtggta

SEQ ID NO: 807922 - DNA, 20 bp, mouse
gtcctcaccctggcatcaga

SEQ ID NO: 807923 - DNA, 20 bp, mouse
gtgtggccaccaggagtggg

SEQ ID NO: 807924 - DNA, 20 bp, mouse
ggggtgaacaccagcaggga

SEQ ID NO: 807925 - DNA, 20 bp, mouse
gggggtgacagggaccagtg

SEQ ID NO: 807926 - DNA, 20 bp, mouse
ggtccctgaggccgcgttgg

SEQ ID NO: 807927 - DNA, 20 bp, mouse
gcgcagcgagtgtctgtctg

SEQ ID NO: 807928 - DNA, 20 bp, mouse
gagcccccaacgcggcctca

SEQ ID NO: 807929 - DNA, 20 bp, mouse
gcacctgcctgcgcctgaga

SEQ ID NO: 807930 - DNA, 20 bp, mouse
gcggctgaggggcgacgcca

SEQ ID NO: 807931 - DNA, 20 bp, mouse
ggacactcgctgcgccactg

SEQ ID NO: 807932 - DNA, 20 bp, mouse
gcgggtccctgaggccgcgt

SEQ ID NO: 807933 - DNA, 20 bp, mouse
ggcaccgctttcaaagtcgc

SEQ ID NO: 807934 - DNA, 20 bp, mouse
gtgggcggcagcgtccccgc

SEQ ID NO: 807935 - DNA, 20 bp, mouse
gtggctatctgtcaggcggt

SEQ ID NO: 807936 - DNA, 20 bp, mouse
gcagcgcggtggccctacta

SEQ ID NO: 807937 - DNA, 20 bp, mouse
gcgccccgaagtctctgaat

SEQ ID NO: 807938 - DNA, 20 bp, mouse
ggtcctatctaaccggtcat

SEQ ID NO: 807939 - DNA, 20 bp, mouse
gtgaccaatcaaccagtcag

SEQ ID NO: 807940 - DNA, 20 bp, mouse
ggcaaagcgcgcgccgctca

SEQ ID NO: 807941 - DNA, 20 bp, mouse
gggtcccggagtatccgcat

SEQ ID NO: 807942 - DNA, 20 bp, mouse
gggcggaggcagggcccgtg

SEQ ID NO: 807943 - DNA, 20 bp, mouse
gccgctcatggcgagtcatc

SEQ ID NO: 807944 - DNA, 20 bp, mouse
gcagagacttcggggcgctc

SEQ ID NO: 807945 - DNA, 20 bp, mouse
gtctgggagcccacctccct

SEQ ID NO: 807946 - DNA, 20 bp, mouse
gcgagagaacccaacggccg

SEQ ID NO: 807947 - DNA, 20 bp, mouse
gcgcgcgcgagagaacccaa

SEQ ID NO: 807948 - DNA, 20 bp, mouse
gtcgcggcaggagtctctgg

SEQ ID NO: 807949 - DNA, 20 bp, mouse
ggcgcgcggggcggcgggaa

SEQ ID NO: 807950 - DNA, 20 bp, mouse
ggagacgcgagcaatccagt

SEQ ID NO: 807951 - DNA, 20 bp, mouse
gagagactcctgccgcgagg

SEQ ID NO: 807952 - DNA, 20 bp, mouse
gggcgcgcgccgcggccgtt

SEQ ID NO: 807953 - DNA, 20 bp, mouse
gcaggagtctctggcgggcg

SEQ ID NO: 807954 - DNA, 20 bp, mouse
gtactacggggcaaaagtga

SEQ ID NO: 807955 - DNA, 20 bp, mouse
gcgggaggaaaactactatg

SEQ ID NO: 807956 - DNA, 20 bp, mouse
gcacccgcggcagcagtctt

SEQ ID NO: 807957 - DNA, 20 bp, mouse
gcccccttgggaagtggaga

SEQ ID NO: 807958 - DNA, 20 bp, mouse
gagtggccatcgtggagaag

SEQ ID NO: 807959 - DNA, 20 bp, mouse
gctcgggcggagaagacccg

SEQ ID NO: 807960 - DNA, 20 bp, mouse
ggctagaccccaggggtctt

SEQ ID NO: 807961 - DNA, 20 bp, mouse
ggcgggtggagcttgagccc

SEQ ID NO: 807962 - DNA, 20 bp, mouse
gcgcggcttctcaaaaatgg

SEQ ID NO: 807963 - DNA, 20 bp, mouse
gtataagggaaaactgccaa

SEQ ID NO: 807964 - DNA, 20 bp, mouse
gggtggccctggtccccctt

SEQ ID NO: 807965 - DNA, 20 bp, mouse
gtaagtacccaagacccctg

SEQ ID NO: 807966 - DNA, 20 bp, mouse
gggcaggcgtagcacacggg

SEQ ID NO: 807967 - DNA, 20 bp, mouse
gagctggtctgtctgtacag

SEQ ID NO: 807968 - DNA, 20 bp, mouse
gtgaggcaggcgtagcacac

SEQ ID NO: 807969 - DNA, 20 bp, mouse
gtctaatgagatgtttgcag

SEQ ID NO: 807970 - DNA, 20 bp, mouse
gcggaaaaccagccaaccgc

SEQ ID NO: 807971 - DNA, 20 bp, mouse
gcagaagtatcattacctgg

SEQ ID NO: 807972 - DNA, 20 bp, mouse
gctgctggcgactagctgtg

SEQ ID NO: 807973 - DNA, 20 bp, mouse
gcagcagtgagggccacacc

SEQ ID NO: 807974 - DNA, 20 bp, mouse
ggcttcaaccacatcatgtc

SEQ ID NO: 807975 - DNA, 20 bp, mouse
gagactgttacgatctgaca

SEQ ID NO: 807976 - DNA, 20 bp, mouse
gtgcccgtccttagcaggat

SEQ ID NO: 807977 - DNA, 20 bp, mouse
gagcccatcctgctaaggac

SEQ ID NO: 807978 - DNA, 20 bp, mouse
gcgggacctgctgaaaccta

SEQ ID NO: 807979 - DNA, 20 bp, mouse
gcaggctgcccgtccttagc

SEQ ID NO: 807980 - DNA, 20 bp, mouse
gtgccacgcaggggcagcgg

SEQ ID NO: 807981 - DNA, 20 bp, mouse
gggcagcctgagccaggctt

SEQ ID NO: 807982 - DNA, 20 bp, mouse
gggaactcgtgacgggaaat

SEQ ID NO: 807983 - DNA, 20 bp, mouse
gtctggaagggagcattcaa

SEQ ID NO: 807984 - DNA, 20 bp, mouse
ggtgctgctctgccacgcag

SEQ ID NO: 807985 - DNA, 20 bp, mouse
gagcagggtggaactcgtga

SEQ ID NO: 807986 - DNA, 20 bp, mouse
gctctgggagggcagcaagc

SEQ ID NO: 807987 - DNA, 20 bp, mouse
gaccagagaagtgactgaga

SEQ ID NO: 807988 - DNA, 20 bp, mouse
ggcctcatccaagagtgtga

SEQ ID NO: 807989 - DNA, 20 bp, mouse
ggctcacatggaagagactg

SEQ ID NO: 807990 - DNA, 20 bp, mouse
gagtcacttctctggttaca

SEQ ID NO: 807991 - DNA, 20 bp, mouse
gggcatgctgtcccttgcga

SEQ ID NO: 807992 - DNA, 20 bp, mouse
gagggacagcatgccatgtg

SEQ ID NO: 807993 - DNA, 20 bp, mouse
gacactcttggatgaggcta

SEQ ID NO: 807994 - DNA, 20 bp, mouse
gtggcagtgggctagagctc

SEQ ID NO: 807995 - DNA, 20 bp, mouse
gcatgtggggctcaacaacc

SEQ ID NO: 807996 - DNA, 20 bp, mouse
gtagtggctacatcgtaaat

SEQ ID NO: 807997 - DNA, 20 bp, mouse
gaatgaaaaaaaggcatctg

SEQ ID NO: 807998 - DNA, 20 bp, mouse
gccatgataggcagagcaaa

SEQ ID NO: 807999 - DNA, 20 bp, mouse
gtagtgagtggctctgaagg

SEQ ID NO: 808000 - DNA, 20 bp, mouse
gtaataaaaccaaaataaag

SEQ ID NO: 808001 - DNA, 20 bp, mouse
gtaaataggttctcacagcc

SEQ ID NO: 808002 - DNA, 20 bp, mouse
gaagtcaatagttccatgat

SEQ ID NO: 808003 - DNA, 20 bp, mouse
gtagatggcactgtaacgtt

SEQ ID NO: 808004 - DNA, 20 bp, mouse
gtttctcaaccgcttccttc

SEQ ID NO: 808005 - DNA, 20 bp, mouse
gagattaaaacaatcagaac

SEQ ID NO: 808006 - DNA, 20 bp, mouse
gcgggcaccggcctctccgg

SEQ ID NO: 808007 - DNA, 20 bp, mouse
gtcccgggccgctgcggcaa

SEQ ID NO: 808008 - DNA, 20 bp, mouse
gccggcttcaccagactctc

SEQ ID NO: 808009 - DNA, 20 bp, mouse
ggggcgggatgaatcaccgc

SEQ ID NO: 808010 - DNA, 20 bp, mouse
ggcccgggcaccggcctctc

SEQ ID NO: 808011 - DNA, 20 bp, mouse
gagccacgaagccaccggag

SEQ ID NO: 808012 - DNA, 20 bp, mouse
gggcctctccggtggcttcg

SEQ ID NO: 808013 - DNA, 20 bp, mouse
gccgacacccccagagagtc

SEQ ID NO: 808014 - DNA, 20 bp, mouse
gccgggaggcgcccgggcac

SEQ ID NO: 808015 - DNA, 20 bp, mouse
gcggccgcgccctccccccg

SEQ ID NO: 808016 - DNA, 20 bp, mouse
ggaggccttgcttcagacta

SEQ ID NO: 808017 - DNA, 20 bp, mouse
gaaggcctcattgggagggt

SEQ ID NO: 808018 - DNA, 20 bp, mouse
ggaagcaaggcctcattggg

SEQ ID NO: 808019 - DNA, 20 bp, mouse
gtctgaagcaaggcctcatt

SEQ ID NO: 808020 - DNA, 20 bp, mouse
gttgaatgttgctttgccaa

SEQ ID NO: 808021 - DNA, 20 bp, mouse
ggaaacatctcgaaccatat

SEQ ID NO: 808022 - DNA, 20 bp, mouse
gattacagcgattccacttg

SEQ ID NO: 808023 - DNA, 20 bp, mouse
gcatgctgttttctgacagt

SEQ ID NO: 808024 - DNA, 20 bp, mouse
gtgctcctaccctcccaatg

SEQ ID NO: 808025 - DNA, 20 bp, mouse
gagcgattccacttgtggcc

SEQ ID NO: 808026 - DNA, 20 bp, mouse
gctccacccaggaatgctca

SEQ ID NO: 808027 - DNA, 20 bp, mouse
gcctcctccgggctccaccc

SEQ ID NO: 808028 - DNA, 20 bp, mouse
gtcggtgctcgggtccctgg

SEQ ID NO: 808029 - DNA, 20 bp, mouse
gggcagccctgagcattcct

SEQ ID NO: 808030 - DNA, 20 bp, mouse
gagccctgagcattcctggg

SEQ ID NO: 808031 - DNA, 20 bp, mouse
gcggcttacagaccctcctc

SEQ ID NO: 808032 - DNA, 20 bp, mouse
ggaatgctcagggctgccgc

SEQ ID NO: 808033 - DNA, 20 bp, mouse
ggagggtctgtaagccgcca

SEQ ID NO: 808034 - DNA, 20 bp, mouse
gaaaacactgagtacgcagc

SEQ ID NO: 808035 - DNA, 20 bp, mouse
gacactgagtacgcagccgg

SEQ ID NO: 808036 - DNA, 20 bp, mouse
gtggctgctaaaaagagagg

SEQ ID NO: 808037 - DNA, 20 bp, mouse
gcaagacccttgcaagagag

SEQ ID NO: 808038 - DNA, 20 bp, mouse
ggacccttgcaagagagggg

SEQ ID NO: 808039 - DNA, 20 bp, mouse
gtggcaacttaatttcttcc

SEQ ID NO: 808040 - DNA, 20 bp, mouse
gtcttgcaagggtcttgctt

SEQ ID NO: 808041 - DNA, 20 bp, mouse
gggggtggtgtataagggaa

SEQ ID NO: 808042 - DNA, 20 bp, mouse
ggccacaagcactttcccca

SEQ ID NO: 808043 - DNA, 20 bp, mouse
gttggagcctaggctagctt

SEQ ID NO: 808044 - DNA, 20 bp, mouse
gaatatggccgacttgtatg

SEQ ID NO: 808045 - DNA, 20 bp, mouse
gtggatttcagaaagcaggt

SEQ ID NO: 808046 - DNA, 20 bp, mouse
gctcctgccttccgaagaga

SEQ ID NO: 808047 - DNA, 20 bp, mouse
gcagagagatgatggaggcg

SEQ ID NO: 808048 - DNA, 20 bp, mouse
gttaactgtgcacactcgtg

SEQ ID NO: 808049 - DNA, 20 bp, mouse
gcatctctctgctgtcaccg

SEQ ID NO: 808050 - DNA, 20 bp, mouse
ggcgtgtgtctgccagtaga

SEQ ID NO: 808051 - DNA, 20 bp, mouse
gtattctccatctcttcgga

SEQ ID NO: 808052 - DNA, 20 bp, mouse
gaaacattatgaatcatgta

SEQ ID NO: 808053 - DNA, 20 bp, mouse
gattcataatgtttccatac

SEQ ID NO: 808054 - DNA, 20 bp, mouse
gatacataaagaggcgtgaa

SEQ ID NO: 808055 - DNA, 20 bp, mouse
gctccatctcttcggaaggc

SEQ ID NO: 808056 - DNA, 20 bp, mouse
gggctggcgcgttgagaaga

SEQ ID NO: 808057 - DNA, 20 bp, mouse
gaccgcggtggcttcttgtc

SEQ ID NO: 808058 - DNA, 20 bp, mouse
ggaggggcacgtgggtttag

SEQ ID NO: 808059 - DNA, 20 bp, mouse
gcaacgcgccagccctggga

SEQ ID NO: 808060 - DNA, 20 bp, mouse
gaacccacgtgcccctccca

SEQ ID NO: 808061 - DNA, 20 bp, mouse
gaagaagccaccgcggtcgg

SEQ ID NO: 808062 - DNA, 20 bp, mouse
gagccctgggaggggcacgt

SEQ ID NO: 808063 - DNA, 20 bp, mouse
ggggtccatagcgaccaaag

SEQ ID NO: 808064 - DNA, 20 bp, mouse
gctagcaacacattcagcta

SEQ ID NO: 808065 - DNA, 20 bp, mouse
ggtggggaatatgtgtccaa

SEQ ID NO: 808066 - DNA, 20 bp, mouse
gtctctctctgtgtccctat

SEQ ID NO: 808067 - DNA, 20 bp, mouse
gctgtcctgaactgtctcct

SEQ ID NO: 808068 - DNA, 20 bp, mouse
gaaagagcccgggtctgcac

SEQ ID NO: 808069 - DNA, 20 bp, mouse
ggcttgaaggtcatgtggat

SEQ ID NO: 808070 - DNA, 20 bp, mouse
gctccagatggacaagggtg

SEQ ID NO: 808071 - DNA, 20 bp, mouse
gcatgtggattgggtgatac

SEQ ID NO: 808072 - DNA, 20 bp, mouse
gtctcctgggttcagatgcc

SEQ ID NO: 808073 - DNA, 20 bp, mouse
ggagacagttcaggacagtg

SEQ ID NO: 808074 - DNA, 20 bp, mouse
gaccctcacccttgtccatc

SEQ ID NO: 808075 - DNA, 20 bp, mouse
gtctccagccttaggaactt

SEQ ID NO: 808076 - DNA, 20 bp, mouse
ggggcactgtgcgaaaccga

SEQ ID NO: 808077 - DNA, 20 bp, mouse
gcattcccgtcccgctggag

SEQ ID NO: 808078 - DNA, 20 bp, mouse
gcagcgggacgggaatgctg

SEQ ID NO: 808079 - DNA, 20 bp, mouse
ggggatgatgcgggcgtctg

SEQ ID NO: 808080 - DNA, 20 bp, mouse
gaggagccggagctgaaggg

SEQ ID NO: 808081 - DNA, 20 bp, mouse
gcggccgtagggtccagcct

SEQ ID NO: 808082 - DNA, 20 bp, mouse
gggaggggcggcgtccccgt

SEQ ID NO: 808083 - DNA, 20 bp, mouse
gaggaggagccggagctgaa

SEQ ID NO: 808084 - DNA, 20 bp, mouse
gagaacacgagtaagggcag

SEQ ID NO: 808085 - DNA, 20 bp, mouse
gtcttcctctccagcgggac

SEQ ID NO: 808086 - DNA, 20 bp, mouse
gcgcccggggtcagagtggt

SEQ ID NO: 808087 - DNA, 20 bp, mouse
gccccgggcgcgtcgctctg

SEQ ID NO: 808088 - DNA, 20 bp, mouse
gggcgcgcccggggtcagag

SEQ ID NO: 808089 - DNA, 20 bp, mouse
gcgggcgcgtcgctctgggg

SEQ ID NO: 808090 - DNA, 20 bp, mouse
ggcgcccggggctccgcacg

SEQ ID NO: 808091 - DNA, 20 bp, mouse
gggagagccaccctgcccgg

SEQ ID NO: 808092 - DNA, 20 bp, mouse
gtgcgccccgccgggcaggg

SEQ ID NO: 808093 - DNA, 20 bp, mouse
gcacccacgcagacctggac

SEQ ID NO: 808094 - DNA, 20 bp, mouse
gtgggtggctctctgtagcg

SEQ ID NO: 808095 - DNA, 20 bp, mouse
gtagcgaggcgtccgcaggt

SEQ ID NO: 808096 - DNA, 20 bp, mouse
ggaagctagataagcgtggg

SEQ ID NO: 808097 - DNA, 20 bp, mouse
gggaaggatccagtcggtca

SEQ ID NO: 808098 - DNA, 20 bp, mouse
gctagaagctagataagcgt

SEQ ID NO: 808099 - DNA, 20 bp, mouse
gccactgagtgtgtagaaaa

SEQ ID NO: 808100 - DNA, 20 bp, mouse
ggggcagccagaccagtgta

SEQ ID NO: 808101 - DNA, 20 bp, mouse
ggggagggaagtatattaag

SEQ ID NO: 808102 - DNA, 20 bp, mouse
ggcaataacagcttcagcag

SEQ ID NO: 808103 - DNA, 20 bp, mouse
gctaatcccccttgaccgac

SEQ ID NO: 808104 - DNA, 20 bp, mouse
gtggatccttcccagggagc

SEQ ID NO: 808105 - DNA, 20 bp, mouse
gagctgggcaaagacatgaa

SEQ ID NO: 808106 - DNA, 20 bp, mouse
ggcgcccggcagggtaggtg

SEQ ID NO: 808107 - DNA, 20 bp, mouse
gcgggcgcgcccggcagggt

SEQ ID NO: 808108 - DNA, 20 bp, mouse
gcccggcagggtaggtgcgg

SEQ ID NO: 808109 - DNA, 20 bp, mouse
gctccggcgcgcatccagtc

SEQ ID NO: 808110 - DNA, 20 bp, mouse
gcgggcccggggacgctccc

SEQ ID NO: 808111 - DNA, 20 bp, mouse
gccccctgccggtcgggctc

SEQ ID NO: 808112 - DNA, 20 bp, mouse
gaaagctagtgttacgacag

SEQ ID NO: 808113 - DNA, 20 bp, mouse
gagctgggagcgaagaaggc

SEQ ID NO: 808114 - DNA, 20 bp, mouse
ggggacgctcccaggcgctc

SEQ ID NO: 808115 - DNA, 20 bp, mouse
ggggacgcaggccggggagc

SEQ ID NO: 808116 - DNA, 20 bp, mouse
gcagcccggtagacggtgca

SEQ ID NO: 808117 - DNA, 20 bp, mouse
gattgggcgtggtgatgcta

SEQ ID NO: 808118 - DNA, 20 bp, mouse
gcacccgcggccacctctct

SEQ ID NO: 808119 - DNA, 20 bp, mouse
ggggcggagacctggcgatt

SEQ ID NO: 808120 - DNA, 20 bp, mouse
gccgccctgcaccgtctacc

SEQ ID NO: 808121 - DNA, 20 bp, mouse
gagctcagggagcatcgagg

SEQ ID NO: 808122 - DNA, 20 bp, mouse
gatactccgtgctagaagaa

SEQ ID NO: 808123 - DNA, 20 bp, mouse
gcgagtgtgcgccagtgtgg

SEQ ID NO: 808124 - DNA, 20 bp, mouse
ggctgggaggagggagctag

SEQ ID NO: 808125 - DNA, 20 bp, mouse
gcttctagcacggagtatag

SEQ ID NO: 808126 - DNA, 20 bp, mouse
gaagcgtggaacatcatccc

SEQ ID NO: 808127 - DNA, 20 bp, mouse
gggttcgcgcgacgcaagcg

SEQ ID NO: 808128 - DNA, 20 bp, mouse
gttgttgaatctgtacttcc

SEQ ID NO: 808129 - DNA, 20 bp, mouse
gaagaaaccggaagcagaga

SEQ ID NO: 808130 - DNA, 20 bp, mouse
gctatcgccttctctgcttc

SEQ ID NO: 808131 - DNA, 20 bp, mouse
ggcgctggaggcgggtcttc

SEQ ID NO: 808132 - DNA, 20 bp, mouse
ggattcaacaagaaagaaac

SEQ ID NO: 808133 - DNA, 20 bp, mouse
gcgcctccagcgccctgagg

SEQ ID NO: 808134 - DNA, 20 bp, mouse
ggaggcgtcagggatctcag

SEQ ID NO: 808135 - DNA, 20 bp, mouse
gtggagccggaatttcaggg

SEQ ID NO: 808136 - DNA, 20 bp, mouse
ggcagagggaggatcggagg

SEQ ID NO: 808137 - DNA, 20 bp, mouse
gcgtcggccacgggcaagga

SEQ ID NO: 808138 - DNA, 20 bp, mouse
gcggaggaggagtctggtct

SEQ ID NO: 808139 - DNA, 20 bp, mouse
gtgactgaaaaagagactag

SEQ ID NO: 808140 - DNA, 20 bp, mouse
ggagactaggggcagaagac

SEQ ID NO: 808141 - DNA, 20 bp, mouse
gctggtctgggagctctcca

SEQ ID NO: 808142 - DNA, 20 bp, mouse
gaaggaggatcgccgagagt

SEQ ID NO: 808143 - DNA, 20 bp, mouse
gcgcccgtcggccacgggca

SEQ ID NO: 808144 - DNA, 20 bp, mouse
ggtctgggagctctccaggg

SEQ ID NO: 808145 - DNA, 20 bp, mouse
gggactgtgcaaagagctga

SEQ ID NO: 808146 - DNA, 20 bp, mouse
ggggcggggacctaccggga

SEQ ID NO: 808147 - DNA, 20 bp, mouse
gtgtggggaggcaacgacag

SEQ ID NO: 808148 - DNA, 20 bp, mouse
gtctatacagggttgtgggg

SEQ ID NO: 808149 - DNA, 20 bp, mouse
gtatagagactgggactggg

SEQ ID NO: 808150 - DNA, 20 bp, mouse
gcggagggcggggacctacc

SEQ ID NO: 808151 - DNA, 20 bp, mouse
ggtggtgtgaggatacacgg

SEQ ID NO: 808152 - DNA, 20 bp, mouse
gggaggtgagaagtggcctg

SEQ ID NO: 808153 - DNA, 20 bp, mouse
gcctccgcctacagcgtccc

SEQ ID NO: 808154 - DNA, 20 bp, mouse
gagccctgactaacccagga

SEQ ID NO: 808155 - DNA, 20 bp, mouse
gctgtatagagactgggact

SEQ ID NO: 808156 - DNA, 20 bp, mouse
gccaggagcgccagtgggtc

SEQ ID NO: 808157 - DNA, 20 bp, mouse
gcaagcttgctgcctcccag

SEQ ID NO: 808158 - DNA, 20 bp, mouse
gcagctccgcgcctcaaccc

SEQ ID NO: 808159 - DNA, 20 bp, mouse
gccgggctaagacaagtcgg

SEQ ID NO: 808160 - DNA, 20 bp, mouse
gcgcagcccgggttgaggcg

SEQ ID NO: 808161 - DNA, 20 bp, mouse
gaaaacacctgggcaggtgt

SEQ ID NO: 808162 - DNA, 20 bp, mouse
ggggaggcagcaagcttgca

SEQ ID NO: 808163 - DNA, 20 bp, mouse
gacttgtcttagcccggaga

SEQ ID NO: 808164 - DNA, 20 bp, mouse
ggactctacaaagtactctg

SEQ ID NO: 808165 - DNA, 20 bp, mouse
ggctgcgctgcttctcgtgg

SEQ ID NO: 808166 - DNA, 20 bp, mouse
gatagcggtaggtggttctc

SEQ ID NO: 808167 - DNA, 20 bp, mouse
gaacccggctagaagaccca

SEQ ID NO: 808168 - DNA, 20 bp, mouse
gtgtggaggagtcccgggtc

SEQ ID NO: 808169 - DNA, 20 bp, mouse
gggaggagtcccgggtccgg

SEQ ID NO: 808170 - DNA, 20 bp, mouse
gtggccctgggtcttctagc

SEQ ID NO: 808171 - DNA, 20 bp, mouse
gtccggcggctgatagcggt

SEQ ID NO: 808172 - DNA, 20 bp, mouse
gggactcctccacaaccaga

SEQ ID NO: 808173 - DNA, 20 bp, mouse
gcgggtccggcggctgatag

SEQ ID NO: 808174 - DNA, 20 bp, mouse
gtcgctcctcccagctgcaa

SEQ ID NO: 808175 - DNA, 20 bp, mouse
gttagaccgggcagtaggaa

SEQ ID NO: 808176 - DNA, 20 bp, mouse
gtggccgcggcgttggatga

SEQ ID NO: 808177 - DNA, 20 bp, mouse
gaacgccgcggccactcggg

SEQ ID NO: 808178 - DNA, 20 bp, mouse
gcagctgccggcgttgcgtg

SEQ ID NO: 808179 - DNA, 20 bp, mouse
gcgaaagcatcagctggaag

SEQ ID NO: 808180 - DNA, 20 bp, mouse
ggagccgtcatccaacgccg

SEQ ID NO: 808181 - DNA, 20 bp, mouse
ggaccaggaaagatcgggag

SEQ ID NO: 808182 - DNA, 20 bp, mouse
gtagctaaagcattgtgctc

SEQ ID NO: 808183 - DNA, 20 bp, mouse
gcggcccagagggttatcca

SEQ ID NO: 808184 - DNA, 20 bp, mouse
gcaagaggagctgctcgcac

SEQ ID NO: 808185 - DNA, 20 bp, mouse
gcgggagccccacgcaacgc

SEQ ID NO: 808186 - DNA, 20 bp, mouse
gttagggcaaaggtggaccc

SEQ ID NO: 808187 - DNA, 20 bp, mouse
gacgaccaatcaggattttt

SEQ ID NO: 808188 - DNA, 20 bp, mouse
gcacgctccgtgggcgggaa

SEQ ID NO: 808189 - DNA, 20 bp, mouse
ggctccgtgggcgggaaggg

SEQ ID NO: 808190 - DNA, 20 bp, mouse
gtcgctcggcgcacgctccg

SEQ ID NO: 808191 - DNA, 20 bp, mouse
gcacctttgccctaacaaaa

SEQ ID NO: 808192 - DNA, 20 bp, mouse
gtggggtggaaagtcactct

SEQ ID NO: 808193 - DNA, 20 bp, mouse
gctctgccacaggcctgtcg

SEQ ID NO: 808194 - DNA, 20 bp, mouse
gggctgctggacgcctcgac

SEQ ID NO: 808195 - DNA, 20 bp, mouse
gcgtcaatgcccttttgtta

SEQ ID NO: 808196 - DNA, 20 bp, mouse
gggcagctgccactcctcaa

SEQ ID NO: 808197 - DNA, 20 bp, mouse
gccacagtgtggttcctgtg

SEQ ID NO: 808198 - DNA, 20 bp, mouse
gttaacttgggtctggtttc

SEQ ID NO: 808199 - DNA, 20 bp, mouse
ggggcaggcgccagtcctca

SEQ ID NO: 808200 - DNA, 20 bp, mouse
gaccgtagcctggcagacaa

SEQ ID NO: 808201 - DNA, 20 bp, mouse
gtaactctttaacttgggtc

SEQ ID NO: 808202 - DNA, 20 bp, mouse
gcagcaagggcgagcacaag

SEQ ID NO: 808203 - DNA, 20 bp, mouse
gtgtgctcgcccttgaggag

SEQ ID NO: 808204 - DNA, 20 bp, mouse
ggggcactgctaccgtagcc

SEQ ID NO: 808205 - DNA, 20 bp, mouse
gctctgtaactctttaactt

SEQ ID NO: 808206 - DNA, 20 bp, mouse
gggcggggccgcagcgtcag

SEQ ID NO: 808207 - DNA, 20 bp, mouse
ggaaccgaccggaggaggca

SEQ ID NO: 808208 - DNA, 20 bp, mouse
gagagagggaaggcctaaaa

SEQ ID NO: 808209 - DNA, 20 bp, mouse
gtacgggaaccgaccggagg

SEQ ID NO: 808210 - DNA, 20 bp, mouse
gggaaactcagaatcctgtg

SEQ ID NO: 808211 - DNA, 20 bp, mouse
gggccccgcccctgacgctg

SEQ ID NO: 808212 - DNA, 20 bp, mouse
gaggggcggggccgagttac

SEQ ID NO: 808213 - DNA, 20 bp, mouse
gctagagccaagtcctttat

SEQ ID NO: 808214 - DNA, 20 bp, mouse
gcgcctggggttgggataat

SEQ ID NO: 808215 - DNA, 20 bp, mouse
gggccgcagcgtcaggggcg

SEQ ID NO: 808216 - DNA, 20 bp, mouse
gacagggccgaaggagatca

SEQ ID NO: 808217 - DNA, 20 bp, mouse
gaatcctaaaatatgacgta

SEQ ID NO: 808218 - DNA, 20 bp, mouse
gtccccgcaggtttcggaac

SEQ ID NO: 808219 - DNA, 20 bp, mouse
ggatagagctgtccattctg

SEQ ID NO: 808220 - DNA, 20 bp, mouse
gcctaaaatatgacgtaggg

SEQ ID NO: 808221 - DNA, 20 bp, mouse
gtccaaatcaggctccccgc

SEQ ID NO: 808222 - DNA, 20 bp, mouse
gactggcgccacagggccga

SEQ ID NO: 808223 - DNA, 20 bp, mouse
gccagtagttctagttagtc

SEQ ID NO: 808224 - DNA, 20 bp, mouse
gtagaactactggcgccaca

SEQ ID NO: 808225 - DNA, 20 bp, mouse
gcaggttccctgatctcctt

SEQ ID NO: 808226 - DNA, 20 bp, mouse
ggagggaggtgctacaaagg

SEQ ID NO: 808227 - DNA, 20 bp, mouse
gtcctacaaagggctctcga

SEQ ID NO: 808228 - DNA, 20 bp, mouse
gctcgagggaggtgctacaa

SEQ ID NO: 808229 - DNA, 20 bp, mouse
gcacccaggacctcctacaa

SEQ ID NO: 808230 - DNA, 20 bp, mouse
gtgaccttggttactaagta

SEQ ID NO: 808231 - DNA, 20 bp, mouse
gtacaaagggctctcgaggg

SEQ ID NO: 808232 - DNA, 20 bp, mouse
gtcaggggcggagcctaagt

SEQ ID NO: 808233 - DNA, 20 bp, mouse
gcaaacacgggccgggctga

SEQ ID NO: 808234 - DNA, 20 bp, mouse
gggtcctgggtgggtccgac

SEQ ID NO: 808235 - DNA, 20 bp, mouse
gggtgggtccgaccggcaga

SEQ ID NO: 808236 - DNA, 20 bp, mouse
gaaggggagtggaaggagac

SEQ ID NO: 808237 - DNA, 20 bp, mouse
gtgctccagccagaaaggag

SEQ ID NO: 808238 - DNA, 20 bp, mouse
gtgagaaggaggttcaagaa

SEQ ID NO: 808239 - DNA, 20 bp, mouse
gctgaacagtgtagttacag

SEQ ID NO: 808240 - DNA, 20 bp, mouse
gccaccccaccccccgaatg

SEQ ID NO: 808241 - DNA, 20 bp, mouse
gtggctggtacctcattcgg

SEQ ID NO: 808242 - DNA, 20 bp, mouse
ggaggtaggagacccttagc

SEQ ID NO: 808243 - DNA, 20 bp, mouse
ggtgtggagaggcctcatca

SEQ ID NO: 808244 - DNA, 20 bp, mouse
ggtacctcattcggggggtg

SEQ ID NO: 808245 - DNA, 20 bp, mouse
gctcatcatgggcctgctaa

SEQ ID NO: 808246 - DNA, 20 bp, mouse
ggccccgcgcgagaccgcta

SEQ ID NO: 808247 - DNA, 20 bp, mouse
ggtctcgcgcggggcatgtc

SEQ ID NO: 808248 - DNA, 20 bp, mouse
ggacccgtagcggtctcgcg

SEQ ID NO: 808249 - DNA, 20 bp, mouse
gcgagaccgctacgggtcgt

SEQ ID NO: 808250 - DNA, 20 bp, mouse
gcgcccacaaaatgctctct

SEQ ID NO: 808251 - DNA, 20 bp, mouse
gcgtctccgacgacccgtag

SEQ ID NO: 808252 - DNA, 20 bp, mouse
ggaccaagagagcattttgt

SEQ ID NO: 808253 - DNA, 20 bp, mouse
gcggggcatgtcgggatttc

SEQ ID NO: 808254 - DNA, 20 bp, mouse
gtgaacaggagggaccgggg

SEQ ID NO: 808255 - DNA, 20 bp, mouse
gctgctgtgcaggggtgaac

SEQ ID NO: 808256 - DNA, 20 bp, mouse
gagcccgccccgcctgggag

SEQ ID NO: 808257 - DNA, 20 bp, mouse
gcgccccgcctgggagggga

SEQ ID NO: 808258 - DNA, 20 bp, mouse
gctcagagcccgccccgcct

SEQ ID NO: 808259 - DNA, 20 bp, mouse
gggcgggactcaacagaaag

SEQ ID NO: 808260 - DNA, 20 bp, mouse
ggcaccgggaggcggagggt

SEQ ID NO: 808261 - DNA, 20 bp, mouse
ggcccccaagaacagcagag

SEQ ID NO: 808262 - DNA, 20 bp, mouse
ggggaagagagtagcagcag

SEQ ID NO: 808263 - DNA, 20 bp, mouse
ggtcctggggcccagagcac

SEQ ID NO: 808264 - DNA, 20 bp, mouse
gtggggcccagagcaccggg

SEQ ID NO: 808265 - DNA, 20 bp, mouse
gtctgcagggaattctcgcc

SEQ ID NO: 808266 - DNA, 20 bp, mouse
gtgggcatgcgcaggagcgt

SEQ ID NO: 808267 - DNA, 20 bp, mouse
gaagcccgggactcttaagc

SEQ ID NO: 808268 - DNA, 20 bp, mouse
gtggaagacggtgacattgc

SEQ ID NO: 808269 - DNA, 20 bp, mouse
gtagctagcgcgcaccctcg

SEQ ID NO: 808270 - DNA, 20 bp, mouse
gcagagagggtgagagaccg

SEQ ID NO: 808271 - DNA, 20 bp, mouse
gggaagaggcgcgtgaatgt

SEQ ID NO: 808272 - DNA, 20 bp, mouse
gtggacccaggttctctggt

SEQ ID NO: 808273 - DNA, 20 bp, mouse
gggcgcccggaaccgagcct

SEQ ID NO: 808274 - DNA, 20 bp, mouse
gggggtcttggatgcagaga

SEQ ID NO: 808275 - DNA, 20 bp, mouse
gatgtcaccgtcttccacga

SEQ ID NO: 808276 - DNA, 20 bp, mouse
gcaaacttgcctagcagttc

SEQ ID NO: 808277 - DNA, 20 bp, mouse
ggagtaaaggcatccggaga

SEQ ID NO: 808278 - DNA, 20 bp, mouse
ggacgactccagccgtgagg

SEQ ID NO: 808279 - DNA, 20 bp, mouse
gactgacaggcgggacttgg

SEQ ID NO: 808280 - DNA, 20 bp, mouse
gtagcaatctctgccctctc

SEQ ID NO: 808281 - DNA, 20 bp, mouse
gaggaggatacgaccctccc

SEQ ID NO: 808282 - DNA, 20 bp, mouse
gactgccggaagagagcaag

SEQ ID NO: 808283 - DNA, 20 bp, mouse
gcggaagagagcaagagggg

SEQ ID NO: 808284 - DNA, 20 bp, mouse
ggtcccgcctgtcagtcagt

SEQ ID NO: 808285 - DNA, 20 bp, mouse
ggacccagagcagagttcac

SEQ ID NO: 808286 - DNA, 20 bp, mouse
gtctcctgggaggggtcctg

SEQ ID NO: 808287 - DNA, 20 bp, mouse
gcatccccaggacccctccc

SEQ ID NO: 808288 - DNA, 20 bp, mouse
gccgctctcggacagctctg

SEQ ID NO: 808289 - DNA, 20 bp, mouse
ggctcggcggtaggcagaag

SEQ ID NO: 808290 - DNA, 20 bp, mouse
ggggaaaaggccggcggaaa

SEQ ID NO: 808291 - DNA, 20 bp, mouse
gaaagccaagcgctggggga

SEQ ID NO: 808292 - DNA, 20 bp, mouse
gagaggctgcgctcggcggt

SEQ ID NO: 808293 - DNA, 20 bp, mouse
ggggagaggcgggagaccaa

SEQ ID NO: 808294 - DNA, 20 bp, mouse
gagaggcttgcgggctcaga

SEQ ID NO: 808295 - DNA, 20 bp, mouse
gggtcgggccagggtctcct

SEQ ID NO: 808296 - DNA, 20 bp, mouse
gtgcccccaccgccggttca

SEQ ID NO: 808297 - DNA, 20 bp, mouse
gtcccctgaaccggcggtgg

SEQ ID NO: 808298 - DNA, 20 bp, mouse
gcggttcaggggaacgtgtg

SEQ ID NO: 808299 - DNA, 20 bp, mouse
gtgtgcggagcgattgtcct

SEQ ID NO: 808300 - DNA, 20 bp, mouse
gagaaagtggcaaaacactc

SEQ ID NO: 808301 - DNA, 20 bp, mouse
gcgttcccctgaaccggcgg

SEQ ID NO: 808302 - DNA, 20 bp, mouse
gaatccatcaaatgtccccc

SEQ ID NO: 808303 - DNA, 20 bp, mouse
gctctccacacacaccctga

SEQ ID NO: 808304 - DNA, 20 bp, mouse
gctgagggggatgcgaagaa

SEQ ID NO: 808305 - DNA, 20 bp, mouse
gcctgcgtcccatataaagc

SEQ ID NO: 808306 - DNA, 20 bp, mouse
gcgcccctcaactgccttgg

SEQ ID NO: 808307 - DNA, 20 bp, mouse
gccccccccaaggcagttga

SEQ ID NO: 808308 - DNA, 20 bp, mouse
gttgaggggcgccaacacgg

SEQ ID NO: 808309 - DNA, 20 bp, mouse
ggggcgccaacacggcggta

SEQ ID NO: 808310 - DNA, 20 bp, mouse
gaggggtggcagttcaggac

SEQ ID NO: 808311 - DNA, 20 bp, mouse
gccaacacggcggtagggac

SEQ ID NO: 808312 - DNA, 20 bp, mouse
gggtcccggcagctataaag

SEQ ID NO: 808313 - DNA, 20 bp, mouse
gcagttgaggggcgccaaca

SEQ ID NO: 808314 - DNA, 20 bp, mouse
gtggccggacgacagctggg

SEQ ID NO: 808315 - DNA, 20 bp, mouse
gcgcccacccagctgtcgtc

SEQ ID NO: 808316 - DNA, 20 bp, mouse
ggcctctatgcgggtgtcta

SEQ ID NO: 808317 - DNA, 20 bp, mouse
gaccctagacacccgcatag

SEQ ID NO: 808318 - DNA, 20 bp, mouse
gttggggggcggcacagagc

SEQ ID NO: 808319 - DNA, 20 bp, mouse
gctccagagaaagtactttc

SEQ ID NO: 808320 - DNA, 20 bp, mouse
gggttgcagctgcctctatg

SEQ ID NO: 808321 - DNA, 20 bp, mouse
gtgagaccatgtctcaatcg

SEQ ID NO: 808322 - DNA, 20 bp, mouse
ggagaaagtactttctggat

SEQ ID NO: 808323 - DNA, 20 bp, mouse
gagtactttctggattggaa

SEQ ID NO: 808324 - DNA, 20 bp, mouse
gcccagggttaggaaaattg

SEQ ID NO: 808325 - DNA, 20 bp, mouse
gctcgcgactccaccctgca

SEQ ID NO: 808326 - DNA, 20 bp, mouse
gagagctggggtcgcggtac

SEQ ID NO: 808327 - DNA, 20 bp, mouse
gccacccgacgcccactgga

SEQ ID NO: 808328 - DNA, 20 bp, mouse
ggggcccgcctcctctcccg

SEQ ID NO: 808329 - DNA, 20 bp, mouse
ggcgagctccgctaccgctc

SEQ ID NO: 808330 - DNA, 20 bp, mouse
gaggccgtccagtgggcgtc

SEQ ID NO: 808331 - DNA, 20 bp, mouse
gcggtacagggtgtcacccg

SEQ ID NO: 808332 - DNA, 20 bp, mouse
gaccgcgaccccagctctct

SEQ ID NO: 808333 - DNA, 20 bp, mouse
ggtgggagccgagagagctg

SEQ ID NO: 808334 - DNA, 20 bp, mouse
gcccggggccggcggcaggt

SEQ ID NO: 808335 - DNA, 20 bp, mouse
gcggctcccagccacatagc

SEQ ID NO: 808336 - DNA, 20 bp, mouse
gaggaccgggtcaagttgga

SEQ ID NO: 808337 - DNA, 20 bp, mouse
ggctctgctgacagcggctc

SEQ ID NO: 808338 - DNA, 20 bp, mouse
gtggaaggaccgggtcaagt

SEQ ID NO: 808339 - DNA, 20 bp, mouse
gacagcggctcgggccacgg

SEQ ID NO: 808340 - DNA, 20 bp, mouse
gtactctccgagacactctc

SEQ ID NO: 808341 - DNA, 20 bp, mouse
gggcctggggtcccattgta

SEQ ID NO: 808342 - DNA, 20 bp, mouse
gaggggccagacgggcgggg

SEQ ID NO: 808343 - DNA, 20 bp, mouse
gccaagactccgcgagcgag

SEQ ID NO: 808344 - DNA, 20 bp, mouse
gctgacagcggctcgggcca

SEQ ID NO: 808345 - DNA, 20 bp, mouse
gctccgccccgggccgggga

SEQ ID NO: 808346 - DNA, 20 bp, mouse
ggggagcggccgccacgccg

SEQ ID NO: 808347 - DNA, 20 bp, mouse
gccgggagacgagaaagcaa

SEQ ID NO: 808348 - DNA, 20 bp, mouse
gcaggagggccgaacggcga

SEQ ID NO: 808349 - DNA, 20 bp, mouse
gggcccggtctccatggaga

SEQ ID NO: 808350 - DNA, 20 bp, mouse
ggcagaccgcgcacaatcaa

SEQ ID NO: 808351 - DNA, 20 bp, mouse
gcccggggaagccgtctcca

SEQ ID NO: 808352 - DNA, 20 bp, mouse
gtcccccgctagctccccac

SEQ ID NO: 808353 - DNA, 20 bp, mouse
gggcccggcagcctggggag

SEQ ID NO: 808354 - DNA, 20 bp, mouse
gaagaaaacgaaaaggagca

SEQ ID NO: 808355 - DNA, 20 bp, mouse
gccaaacagcaccggggctc

SEQ ID NO: 808356 - DNA, 20 bp, mouse
gcaaccagaaagatgctcgg

SEQ ID NO: 808357 - DNA, 20 bp, mouse
gggcctgtggggacctaaag

SEQ ID NO: 808358 - DNA, 20 bp, mouse
gcgggcacatgtgttcggac

SEQ ID NO: 808359 - DNA, 20 bp, mouse
gaggccagaaagggaggcgg

SEQ ID NO: 808360 - DNA, 20 bp, mouse
gtggcctccgcctccctttc

SEQ ID NO: 808361 - DNA, 20 bp, mouse
gtctggttggagcgtttctg

SEQ ID NO: 808362 - DNA, 20 bp, mouse
gggatgggcaccattgtctt

SEQ ID NO: 808363 - DNA, 20 bp, mouse
gtcctccaggccagaaaggg

SEQ ID NO: 808364 - DNA, 20 bp, mouse
ggaggagctgactgctataa

SEQ ID NO: 808365 - DNA, 20 bp, mouse
gctcgggggccctctaggca

SEQ ID NO: 808366 - DNA, 20 bp, mouse
ggggcggagcgtgaccggaa

SEQ ID NO: 808367 - DNA, 20 bp, mouse
ggggagtgaggctggactga

SEQ ID NO: 808368 - DNA, 20 bp, mouse
ggactgaaggcagacctccc

SEQ ID NO: 808369 - DNA, 20 bp, mouse
gtcacgctccgccctgccca

SEQ ID NO: 808370 - DNA, 20 bp, mouse
gggaagtgagcgtgacaata

SEQ ID NO: 808371 - DNA, 20 bp, mouse
ggggcctatctaaacctggg

SEQ ID NO: 808372 - DNA, 20 bp, mouse
gaaggcagacctccctgggc

SEQ ID NO: 808373 - DNA, 20 bp, mouse
gttggggcggagctttaggg

SEQ ID NO: 808374 - DNA, 20 bp, mouse
gggcgagggcggagccagtc

SEQ ID NO: 808375 - DNA, 20 bp, mouse
gtagtggcaggcagtatgat

SEQ ID NO: 808376 - DNA, 20 bp, mouse
gcgggcaagaccagctttcc

SEQ ID NO: 808377 - DNA, 20 bp, mouse
gcaggagcgggcaggtcttt

SEQ ID NO: 808378 - DNA, 20 bp, mouse
gcccgaggcggagtgaggcg

SEQ ID NO: 808379 - DNA, 20 bp, mouse
gaccagctttccggggcccc

SEQ ID NO: 808380 - DNA, 20 bp, mouse
ggctaggaagcccgagtttc

SEQ ID NO: 808381 - DNA, 20 bp, mouse
gtggcctgggaaacagaaaa

SEQ ID NO: 808382 - DNA, 20 bp, mouse
gcgggcggttcggaagggta

SEQ ID NO: 808383 - DNA, 20 bp, mouse
gccctccccgaggcggagtg

SEQ ID NO: 808384 - DNA, 20 bp, mouse
ggactagtgatcagagtcac

SEQ ID NO: 808385 - DNA, 20 bp, mouse
gtggctggacactgcagctc

SEQ ID NO: 808386 - DNA, 20 bp, mouse
ggggaacaggcgtgcggcgc

SEQ ID NO: 808387 - DNA, 20 bp, mouse
gtcccggcagccggctctgg

SEQ ID NO: 808388 - DNA, 20 bp, mouse
gagagccggctgccgggaac

SEQ ID NO: 808389 - DNA, 20 bp, mouse
gcgcgggcccgggtaggtgt

SEQ ID NO: 808390 - DNA, 20 bp, mouse
gcgccctcgcagcacctgtg

SEQ ID NO: 808391 - DNA, 20 bp, mouse
gcgggtaggtgtgggcgcca

SEQ ID NO: 808392 - DNA, 20 bp, mouse
gggccgcacaggtgctgcga

SEQ ID NO: 808393 - DNA, 20 bp, mouse
gcgtgcggcgcaggctcccc

SEQ ID NO: 808394 - DNA, 20 bp, mouse
gtctggcttcagacaagtaa

SEQ ID NO: 808395 - DNA, 20 bp, mouse
ggcttccctgccgccagagc

SEQ ID NO: 808396 - DNA, 20 bp, mouse
ggcacgctatcggtccctgc

SEQ ID NO: 808397 - DNA, 20 bp, mouse
gactggttgtcaccaaactc

SEQ ID NO: 808398 - DNA, 20 bp, mouse
gaccagtagcggttgtccac

SEQ ID NO: 808399 - DNA, 20 bp, mouse
gcgcttgcccgaccgagcta

SEQ ID NO: 808400 - DNA, 20 bp, mouse
gaactgggaggaattggcgg

SEQ ID NO: 808401 - DNA, 20 bp, mouse
gcctacaaagagttgcagca

SEQ ID NO: 808402 - DNA, 20 bp, mouse
gcagagaagaggcggcggga

SEQ ID NO: 808403 - DNA, 20 bp, mouse
gcgagctacggaacgctcag

SEQ ID NO: 808404 - DNA, 20 bp, mouse
gggaaaagaatgttgagata

SEQ ID NO: 808405 - DNA, 20 bp, mouse
ggccggtggacaaccgctac

SEQ ID NO: 808406 - DNA, 20 bp, mouse
ggggcccgaggggtggagat

SEQ ID NO: 808407 - DNA, 20 bp, mouse
gaaggggcggggcaacccag

SEQ ID NO: 808408 - DNA, 20 bp, mouse
gggtgggcttcgatcctagg

SEQ ID NO: 808409 - DNA, 20 bp, mouse
ggatcctaggaggcgtggaa

SEQ ID NO: 808410 - DNA, 20 bp, mouse
gggtgtggctggatccctgg

SEQ ID NO: 808411 - DNA, 20 bp, mouse
gtggggtgggcttcgatcct

SEQ ID NO: 808412 - DNA, 20 bp, mouse
gttggagcgccccacccccc

SEQ ID NO: 808413 - DNA, 20 bp, mouse
gactcaccagtgctcagggg

SEQ ID NO: 808414 - DNA, 20 bp, mouse
gacccccttccacgcctcct

SEQ ID NO: 808415 - DNA, 20 bp, mouse
gccggcactcaccagtgctc

SEQ ID NO: 808416 - DNA, 20 bp, mouse
ggggtgtggggtgagatcga

SEQ ID NO: 808417 - DNA, 20 bp, mouse
gagggccaggctaagaaggg

SEQ ID NO: 808418 - DNA, 20 bp, mouse
gaaggtaggggcggttgaag

SEQ ID NO: 808419 - DNA, 20 bp, mouse
gaccagggagaggacacgga

SEQ ID NO: 808420 - DNA, 20 bp, mouse
ggtaggggcggttgaagcgg

SEQ ID NO: 808421 - DNA, 20 bp, mouse
gcttgagggccaggctaaga

SEQ ID NO: 808422 - DNA, 20 bp, mouse
gaggcggcgcgtagaaggag

SEQ ID NO: 808423 - DNA, 20 bp, mouse
gctacgcgccgcctcctcct

SEQ ID NO: 808424 - DNA, 20 bp, mouse
gcttccctcccttcttagcc

SEQ ID NO: 808425 - DNA, 20 bp, mouse
gtggggtgagatcgaggggg

SEQ ID NO: 808426 - DNA, 20 bp, mouse
gggaagagcaggttctcccg

SEQ ID NO: 808427 - DNA, 20 bp, mouse
gtcgcggatccacagtaggg

SEQ ID NO: 808428 - DNA, 20 bp, mouse
gcctgcgcggggggaaactg

SEQ ID NO: 808429 - DNA, 20 bp, mouse
gagaagctcaggaggaccag

SEQ ID NO: 808430 - DNA, 20 bp, mouse
gccccccccccctgcgcggg

SEQ ID NO: 808431 - DNA, 20 bp, mouse
ggacgtctgcccccctactg

SEQ ID NO: 808432 - DNA, 20 bp, mouse
gtcctctgacaccaccctac

SEQ ID NO: 808433 - DNA, 20 bp, mouse
gggcggggccgcggcgacac

SEQ ID NO: 808434 - DNA, 20 bp, mouse
gcgcaggcggggcgagcagg

SEQ ID NO: 808435 - DNA, 20 bp, mouse
gttctcccgcggctcgcaca

SEQ ID NO: 808436 - DNA, 20 bp, mouse
ggagccggcaggcacgctgt

SEQ ID NO: 808437 - DNA, 20 bp, mouse
gaacggggtaggattgacta

SEQ ID NO: 808438 - DNA, 20 bp, mouse
ggggctgctgcctataagaa

SEQ ID NO: 808439 - DNA, 20 bp, mouse
ggggtgggacccaacccgcc

SEQ ID NO: 808440 - DNA, 20 bp, mouse
ggaaactgaggcccataaac

SEQ ID NO: 808441 - DNA, 20 bp, mouse
gctcctggagctacagattg

SEQ ID NO: 808442 - DNA, 20 bp, mouse
gcacgctgtgggcgggtccc

SEQ ID NO: 808443 - DNA, 20 bp, mouse
gggcctgcggggtgctgcgc

SEQ ID NO: 808444 - DNA, 20 bp, mouse
ggcagtctgcctaaaatccg

SEQ ID NO: 808445 - DNA, 20 bp, mouse
gctacagattgaggtcagtt

SEQ ID NO: 808446 - DNA, 20 bp, mouse
ggggaacaaagggtagtaaa

SEQ ID NO: 808447 - DNA, 20 bp, mouse
ggggtagtaaaaggcggcgg

SEQ ID NO: 808448 - DNA, 20 bp, mouse
gcctgcgcggcggaaggcgg

SEQ ID NO: 808449 - DNA, 20 bp, mouse
ggctgccagggaaccgaggc

SEQ ID NO: 808450 - DNA, 20 bp, mouse
ggaggctggagccgggagtt

SEQ ID NO: 808451 - DNA, 20 bp, mouse
ggccaatgagcattcgttct

SEQ ID NO: 808452 - DNA, 20 bp, mouse
gagttgggaggatttcgtag

SEQ ID NO: 808453 - DNA, 20 bp, mouse
gggctgctgactgttactct

SEQ ID NO: 808454 - DNA, 20 bp, mouse
ggctggagccgggagttggg

SEQ ID NO: 808455 - DNA, 20 bp, mouse
ggggctgtgccgcgttgtca

SEQ ID NO: 808456 - DNA, 20 bp, mouse
gtagagatgggtgcgaacta

SEQ ID NO: 808457 - DNA, 20 bp, mouse
gagagcagtcacccacgagt

SEQ ID NO: 808458 - DNA, 20 bp, mouse
gagtcacccacgagtgggtg

SEQ ID NO: 808459 - DNA, 20 bp, mouse
ggaggaagtcagcacgactg

SEQ ID NO: 808460 - DNA, 20 bp, mouse
ggaagtcagcacgactgtgg

SEQ ID NO: 808461 - DNA, 20 bp, mouse
ggcgtagatgctgtagagat

SEQ ID NO: 808462 - DNA, 20 bp, mouse
gactcaccgtggactaggat

SEQ ID NO: 808463 - DNA, 20 bp, mouse
ggagtcagctgaacaagggg

SEQ ID NO: 808464 - DNA, 20 bp, mouse
gggtgcgaactagggctact

SEQ ID NO: 808465 - DNA, 20 bp, mouse
ggcggcctcaccctgccaat

SEQ ID NO: 808466 - DNA, 20 bp, mouse
gcggctgcttcggggatctg

SEQ ID NO: 808467 - DNA, 20 bp, mouse
gcctgtctcggtgcgaggaa

SEQ ID NO: 808468 - DNA, 20 bp, mouse
gatggcgacggcagtgtggg

SEQ ID NO: 808469 - DNA, 20 bp, mouse
gcggctgcgcggctgcttcg

SEQ ID NO: 808470 - DNA, 20 bp, mouse
gggcctctggatcagagcac

SEQ ID NO: 808471 - DNA, 20 bp, mouse
gctcgcaccgagacaggcct

SEQ ID NO: 808472 - DNA, 20 bp, mouse
ggtgcgaggaagggaggact

SEQ ID NO: 808473 - DNA, 20 bp, mouse
gactcgggggagttggtacc

SEQ ID NO: 808474 - DNA, 20 bp, mouse
gcgcggcggcgcgatggcga

SEQ ID NO: 808475 - DNA, 20 bp, mouse
gcgcctgtgctctgatccag

SEQ ID NO: 808476 - DNA, 20 bp, mouse
gtccgagcgcatagccctct

SEQ ID NO: 808477 - DNA, 20 bp, mouse
gaaggctcataggactctcg

SEQ ID NO: 808478 - DNA, 20 bp, mouse
gggccgctaaactgtcggag

SEQ ID NO: 808479 - DNA, 20 bp, mouse
gcctcaggccgctaaactgt

SEQ ID NO: 808480 - DNA, 20 bp, mouse
gcaagcgatgcaaaagggaa

SEQ ID NO: 808481 - DNA, 20 bp, mouse
gaccccggaccgagctccta

SEQ ID NO: 808482 - DNA, 20 bp, mouse
gctgttgccaagagacgggt

SEQ ID NO: 808483 - DNA, 20 bp, mouse
gctgggaagcgtagtatagc

SEQ ID NO: 808484 - DNA, 20 bp, mouse
gtgaggctgttgccaagaga

SEQ ID NO: 808485 - DNA, 20 bp, mouse
gcgccactccgacagtttag

SEQ ID NO: 808486 - DNA, 20 bp, mouse
gggcccggcgtcacgcgagc

SEQ ID NO: 808487 - DNA, 20 bp, mouse
ggacaggaaaggcctgcctg

SEQ ID NO: 808488 - DNA, 20 bp, mouse
gttgctaggggcggttgcta

SEQ ID NO: 808489 - DNA, 20 bp, mouse
gttgctagggcggggctcaa

SEQ ID NO: 808490 - DNA, 20 bp, mouse
gtgaccgccttccggaaagg

SEQ ID NO: 808491 - DNA, 20 bp, mouse
ggtcacgcgagctggcgtgg

SEQ ID NO: 808492 - DNA, 20 bp, mouse
ggggccacgtgaccgccttc

SEQ ID NO: 808493 - DNA, 20 bp, mouse
gcctgaggccgataagaccg

SEQ ID NO: 808494 - DNA, 20 bp, mouse
gctggagctaggcgttgcta

SEQ ID NO: 808495 - DNA, 20 bp, mouse
gttccagcgccccgcctccc

SEQ ID NO: 808496 - DNA, 20 bp, mouse
gtgtactgggtgctctgtgg

SEQ ID NO: 808497 - DNA, 20 bp, mouse
gcggctgcggagggcccttg

SEQ ID NO: 808498 - DNA, 20 bp, mouse
gtaacgtagtacgtcacctc

SEQ ID NO: 808499 - DNA, 20 bp, mouse
gaaagccctagacgccggag

SEQ ID NO: 808500 - DNA, 20 bp, mouse
ggaaccaaagccctagacgc

SEQ ID NO: 808501 - DNA, 20 bp, mouse
gacctccggctctctgtcac

SEQ ID NO: 808502 - DNA, 20 bp, mouse
ggagcacccagtacaaagtg

SEQ ID NO: 808503 - DNA, 20 bp, mouse
gccggaggggaaaagacagc

SEQ ID NO: 808504 - DNA, 20 bp, mouse
gctggggcctggtcccgtaa

SEQ ID NO: 808505 - DNA, 20 bp, mouse
gtagtccggacccaccgcaa

SEQ ID NO: 808506 - DNA, 20 bp, mouse
gtggctgcggcgagcgtccc

SEQ ID NO: 808507 - DNA, 20 bp, mouse
gccacccccagcttccaagg

SEQ ID NO: 808508 - DNA, 20 bp, mouse
ggaaaggggttggagacacc

SEQ ID NO: 808509 - DNA, 20 bp, mouse
ggcggcgagcgtccccggag

SEQ ID NO: 808510 - DNA, 20 bp, mouse
ggacacgagactaaagttta

SEQ ID NO: 808511 - DNA, 20 bp, mouse
gggacccgccaataaagcag

SEQ ID NO: 808512 - DNA, 20 bp, mouse
gacacccgaggatctctaac

SEQ ID NO: 808513 - DNA, 20 bp, mouse
gtatcccggggtctgagtgg

SEQ ID NO: 808514 - DNA, 20 bp, mouse
ggcagccactgctttattgg

SEQ ID NO: 808515 - DNA, 20 bp, mouse
gggaccagttaaaatcctcc

SEQ ID NO: 808516 - DNA, 20 bp, mouse
gccgccctggatatcagctc

SEQ ID NO: 808517 - DNA, 20 bp, mouse
gagggcggctttgaaggata

SEQ ID NO: 808518 - DNA, 20 bp, mouse
gtccccggagctgatatcca

SEQ ID NO: 808519 - DNA, 20 bp, mouse
gcctctgcgaagcaaccaat

SEQ ID NO: 808520 - DNA, 20 bp, mouse
ggcgaagcaaccaataggaa

SEQ ID NO: 808521 - DNA, 20 bp, mouse
ggagtcgaaacccccagcca

SEQ ID NO: 808522 - DNA, 20 bp, mouse
gttaggcctggtaacgtggg

SEQ ID NO: 808523 - DNA, 20 bp, mouse
gcggttaggcctggtaacgt

SEQ ID NO: 808524 - DNA, 20 bp, mouse
gaagccgccatctttcttat

SEQ ID NO: 808525 - DNA, 20 bp, mouse
gaaggggcgaataagacaac

SEQ ID NO: 808526 - DNA, 20 bp, mouse
gtggcaacacgtctgaggta

SEQ ID NO: 808527 - DNA, 20 bp, mouse
gggcggtggcaacacgtctg

SEQ ID NO: 808528 - DNA, 20 bp, mouse
ggggtggcagcaacgctgat

SEQ ID NO: 808529 - DNA, 20 bp, mouse
gcgcctgcgccctgtaaacg

SEQ ID NO: 808530 - DNA, 20 bp, mouse
gcgccctgtaaacgcggcgg

SEQ ID NO: 808531 - DNA, 20 bp, mouse
gcaggaggggcgtgttgcgc

SEQ ID NO: 808532 - DNA, 20 bp, mouse
gcactcacgcgagccaggag

SEQ ID NO: 808533 - DNA, 20 bp, mouse
gttgccaaaacagagagggt

SEQ ID NO: 808534 - DNA, 20 bp, mouse
gctgcgccctgtaaacgcgg

SEQ ID NO: 808535 - DNA, 20 bp, mouse
gttggcacctcacttacccc

SEQ ID NO: 808536 - DNA, 20 bp, mouse
gtggaagtgggcggagtctc

SEQ ID NO: 808537 - DNA, 20 bp, mouse
ggaacccggggctcaccaga

SEQ ID NO: 808538 - DNA, 20 bp, mouse
gcggcgctgccgcatctgat

SEQ ID NO: 808539 - DNA, 20 bp, mouse
gccaagatgtactgcagtac

SEQ ID NO: 808540 - DNA, 20 bp, mouse
gggctggctctggaagtggg

SEQ ID NO: 808541 - DNA, 20 bp, mouse
gggcctaagcggttagactc

SEQ ID NO: 808542 - DNA, 20 bp, mouse
gtgctgagaagctaacgggc

SEQ ID NO: 808543 - DNA, 20 bp, mouse
ggccagggctgtctgcgaga

SEQ ID NO: 808544 - DNA, 20 bp, mouse
gagagcgaagggatcgaacc

SEQ ID NO: 808545 - DNA, 20 bp, mouse
gggcagcgccggtgagcagg

SEQ ID NO: 808546 - DNA, 20 bp, mouse
ggccgcggagagtcccgact

SEQ ID NO: 808547 - DNA, 20 bp, mouse
ggccgcgcgcccccgttacc

SEQ ID NO: 808548 - DNA, 20 bp, mouse
gtggcggcggcggaagacag

SEQ ID NO: 808549 - DNA, 20 bp, mouse
ggccggcggggccggaagga

SEQ ID NO: 808550 - DNA, 20 bp, mouse
gccggcgccgcggaagggag

SEQ ID NO: 808551 - DNA, 20 bp, mouse
gtgacgccgccggtgggggg

SEQ ID NO: 808552 - DNA, 20 bp, mouse
gaggtcctggagctgtggga

SEQ ID NO: 808553 - DNA, 20 bp, mouse
ggaagggagggggtcggttg

SEQ ID NO: 808554 - DNA, 20 bp, mouse
gcgggacctggggcggagag

SEQ ID NO: 808555 - DNA, 20 bp, mouse
ggttaccgggaatatggcgg

SEQ ID NO: 808556 - DNA, 20 bp, mouse
gtgtgcagcagcggcccgta

SEQ ID NO: 808557 - DNA, 20 bp, mouse
gggaacataggaagcccagt

SEQ ID NO: 808558 - DNA, 20 bp, mouse
gtaggcggctagcggtcctc

SEQ ID NO: 808559 - DNA, 20 bp, mouse
ggagggaagggtagcgtgga

SEQ ID NO: 808560 - DNA, 20 bp, mouse
gttcccaccgcggtgttcga

SEQ ID NO: 808561 - DNA, 20 bp, mouse
ggtgacctctggagtctgag

SEQ ID NO: 808562 - DNA, 20 bp, mouse
gcgtagggcgcatgcccact

SEQ ID NO: 808563 - DNA, 20 bp, mouse
gtgggcttcctatgttccta

SEQ ID NO: 808564 - DNA, 20 bp, mouse
gatcccgtcgaacaccgcgg

SEQ ID NO: 808565 - DNA, 20 bp, mouse
gggctcggagaaaccggaag

SEQ ID NO: 808566 - DNA, 20 bp, mouse
gcaccaagcccggaacacaa

SEQ ID NO: 808567 - DNA, 20 bp, mouse
gctagaaactggcgcgtgag

SEQ ID NO: 808568 - DNA, 20 bp, mouse
gcaagcccggaacacaaagg

SEQ ID NO: 808569 - DNA, 20 bp, mouse
gccgccggctccgcccccaa

SEQ ID NO: 808570 - DNA, 20 bp, mouse
gtgccaggcagccacttctc

SEQ ID NO: 808571 - DNA, 20 bp, mouse
ggggcaggtaaacgcactaa

SEQ ID NO: 808572 - DNA, 20 bp, mouse
gaataaataagccggagaag

SEQ ID NO: 808573 - DNA, 20 bp, mouse
gaaaggcagggccacacggg

SEQ ID NO: 808574 - DNA, 20 bp, mouse
gcggctccgcccccaaaggc

SEQ ID NO: 808575 - DNA, 20 bp, mouse
gttccagcctaaaaattctg

SEQ ID NO: 808576 - DNA, 20 bp, mouse
gagggtgaggcgcagatccc

SEQ ID NO: 808577 - DNA, 20 bp, mouse
gggagtcaggcgcttcgctg

SEQ ID NO: 808578 - DNA, 20 bp, mouse
gcccgcgtaaaagaacggtg

SEQ ID NO: 808579 - DNA, 20 bp, mouse
gtgcgccttctgctgttcgg

SEQ ID NO: 808580 - DNA, 20 bp, mouse
ggcgcagcccggatcgagtg

SEQ ID NO: 808581 - DNA, 20 bp, mouse
gaagcgcctgactccgacaa

SEQ ID NO: 808582 - DNA, 20 bp, mouse
gacagcggccccactcgatc

SEQ ID NO: 808583 - DNA, 20 bp, mouse
gcgggaggcaagcgctgcgt

SEQ ID NO: 808584 - DNA, 20 bp, mouse
ggaggcaagcgctgcgtggg

SEQ ID NO: 808585 - DNA, 20 bp, mouse
gaagcgctgcgtgggaggaa

SEQ ID NO: 808586 - DNA, 20 bp, mouse
gcccgccgcgggtccctagg

SEQ ID NO: 808587 - DNA, 20 bp, mouse
gcccgccacccgcatctgat

SEQ ID NO: 808588 - DNA, 20 bp, mouse
gcgggcgcgggaagtcgctc

SEQ ID NO: 808589 - DNA, 20 bp, mouse
gtccccggcgggcttgtctg

SEQ ID NO: 808590 - DNA, 20 bp, mouse
gcgggcacgaaattgcaagc

SEQ ID NO: 808591 - DNA, 20 bp, mouse
gcacgaaattgcaagcgggc

SEQ ID NO: 808592 - DNA, 20 bp, mouse
gcgcgcgccggctctcgcct

SEQ ID NO: 808593 - DNA, 20 bp, mouse
gtgcgccccctagggacccg

SEQ ID NO: 808594 - DNA, 20 bp, mouse
gaaaacaagcgagcgccgtg

SEQ ID NO: 808595 - DNA, 20 bp, mouse
gtgcggccgggctgtgaatg

SEQ ID NO: 808596 - DNA, 20 bp, mouse
gtgggctgaagctagaagac

SEQ ID NO: 808597 - DNA, 20 bp, mouse
gcctccgccgcgctcgtctc

SEQ ID NO: 808598 - DNA, 20 bp, mouse
gtcggcgcaggcagactctc

SEQ ID NO: 808599 - DNA, 20 bp, mouse
gtctagggaggagtgagggt

SEQ ID NO: 808600 - DNA, 20 bp, mouse
gcgcggacgcctggcgtctc

SEQ ID NO: 808601 - DNA, 20 bp, mouse
gcacacggattgggtttctg

SEQ ID NO: 808602 - DNA, 20 bp, mouse
gaggcagctgctgccgaggt

SEQ ID NO: 808603 - DNA, 20 bp, mouse
gggggccgagcgctaccccg

SEQ ID NO: 808604 - DNA, 20 bp, mouse
ggaggcggagacgcggagag

SEQ ID NO: 808605 - DNA, 20 bp, mouse
gtcggtgcggggctcgccct

SEQ ID NO: 808606 - DNA, 20 bp, mouse
gaaaagaactcgggcttgtg

SEQ ID NO: 808607 - DNA, 20 bp, mouse
ggggaggcgccgagttgaaa

SEQ ID NO: 808608 - DNA, 20 bp, mouse
gtccacccagtggaaggcaa

SEQ ID NO: 808609 - DNA, 20 bp, mouse
gacctgctccacccagtgga

SEQ ID NO: 808610 - DNA, 20 bp, mouse
gaggttacaggacccactca

SEQ ID NO: 808611 - DNA, 20 bp, mouse
ggagctccccagcctctgat

SEQ ID NO: 808612 - DNA, 20 bp, mouse
gctcgggcttgtgcggagtg

SEQ ID NO: 808613 - DNA, 20 bp, mouse
gaccgagtgccctttagggg

SEQ ID NO: 808614 - DNA, 20 bp, mouse
ggccactgcagaaaagaact

SEQ ID NO: 808615 - DNA, 20 bp, mouse
gactagatttagccaatcag

SEQ ID NO: 808616 - DNA, 20 bp, mouse
gtaaagggatgggcagttct

SEQ ID NO: 808617 - DNA, 20 bp, mouse
gcacgaggcccctccccgga

SEQ ID NO: 808618 - DNA, 20 bp, mouse
gtggctcaggcaggtagcca

SEQ ID NO: 808619 - DNA, 20 bp, mouse
gatgagctgctgatatctgg

SEQ ID NO: 808620 - DNA, 20 bp, mouse
ggggcatgagaaaattttaa

SEQ ID NO: 808621 - DNA, 20 bp, mouse
ggactgtgatccctccgggg

SEQ ID NO: 808622 - DNA, 20 bp, mouse
gaacaatcctacatccagcc

SEQ ID NO: 808623 - DNA, 20 bp, mouse
ggaagtctcaagtgtctgaa

SEQ ID NO: 808624 - DNA, 20 bp, mouse
ggactctgcccttttcaaac

SEQ ID NO: 808625 - DNA, 20 bp, mouse
gtgggccccaagcgaaagac

SEQ ID NO: 808626 - DNA, 20 bp, mouse
ggactcatgtgtgttgtcta

SEQ ID NO: 808627 - DNA, 20 bp, mouse
ggccaacaggtggtagatgt

SEQ ID NO: 808628 - DNA, 20 bp, mouse
ggcaggcaaaggccaacagg

SEQ ID NO: 808629 - DNA, 20 bp, mouse
gcatgtgtgttgtctagggt

SEQ ID NO: 808630 - DNA, 20 bp, mouse
gtgtgttgtctagggttggg

SEQ ID NO: 808631 - DNA, 20 bp, mouse
gtcccacatctaccacctgt

SEQ ID NO: 808632 - DNA, 20 bp, mouse
gatcaggtgaaaatatatag

SEQ ID NO: 808633 - DNA, 20 bp, mouse
gagctgttcttggaactaat

SEQ ID NO: 808634 - DNA, 20 bp, mouse
ggtctccgtaactgtcactc

SEQ ID NO: 808635 - DNA, 20 bp, mouse
gaaaagtaattatatgaatc

SEQ ID NO: 808636 - DNA, 20 bp, mouse
ggtggatgacgcaaaagaga

SEQ ID NO: 808637 - DNA, 20 bp, mouse
gcggtctagagttgttcttt

SEQ ID NO: 808638 - DNA, 20 bp, mouse
gcaagagtgcgcacatgaac

SEQ ID NO: 808639 - DNA, 20 bp, mouse
gggagttatagtaatagcga

SEQ ID NO: 808640 - DNA, 20 bp, mouse
gactccttccgggtcggggg

SEQ ID NO: 808641 - DNA, 20 bp, mouse
gaccctcgagtcctgacaga

SEQ ID NO: 808642 - DNA, 20 bp, mouse
gactataactccttccgggt

SEQ ID NO: 808643 - DNA, 20 bp, mouse
gttcctggagggccctgaaa

SEQ ID NO: 808644 - DNA, 20 bp, mouse
gtacaactgggcattagact

SEQ ID NO: 808645 - DNA, 20 bp, mouse
gtccttctgtcaggactcga

SEQ ID NO: 808646 - DNA, 20 bp, mouse
gcccacccatccaaggaaac

SEQ ID NO: 808647 - DNA, 20 bp, mouse
gggtatgcgggttaagtata

SEQ ID NO: 808648 - DNA, 20 bp, mouse
gaccgcttccgggtctctct

SEQ ID NO: 808649 - DNA, 20 bp, mouse
gagtttcagaatcttttgag

SEQ ID NO: 808650 - DNA, 20 bp, mouse
gtgcagaactgatcgaagaa

SEQ ID NO: 808651 - DNA, 20 bp, mouse
gtcagccggtttccttggat

SEQ ID NO: 808652 - DNA, 20 bp, mouse
gtggctcctaaaaccgcttc

SEQ ID NO: 808653 - DNA, 20 bp, mouse
gtgtaggtaaataggtatgc

SEQ ID NO: 808654 - DNA, 20 bp, mouse
gatagagatgagggaacctc

SEQ ID NO: 808655 - DNA, 20 bp, mouse
gtcctagagagacccggaag

SEQ ID NO: 808656 - DNA, 20 bp, mouse
gtggggatattcatagtcat

SEQ ID NO: 808657 - DNA, 20 bp, mouse
gttctgggaaggggcacggg

SEQ ID NO: 808658 - DNA, 20 bp, mouse
gtctgacaaagccactgccc

SEQ ID NO: 808659 - DNA, 20 bp, mouse
gaggagagggatccaaaaat

SEQ ID NO: 808660 - DNA, 20 bp, mouse
gcctctcctgaaaggtctag

SEQ ID NO: 808661 - DNA, 20 bp, mouse
gcagaaggtaaaactgggat

SEQ ID NO: 808662 - DNA, 20 bp, mouse
gtgtcagagtgacacactgc

SEQ ID NO: 808663 - DNA, 20 bp, mouse
gtatccctaacagccctggc

SEQ ID NO: 808664 - DNA, 20 bp, mouse
gagcttaaatgcacggaaga

SEQ ID NO: 808665 - DNA, 20 bp, mouse
gagctggtattcattcctac

SEQ ID NO: 808666 - DNA, 20 bp, mouse
ggcacaggacccagtatagt

SEQ ID NO: 808667 - DNA, 20 bp, mouse
gctgtgcaaacagaaggcat

SEQ ID NO: 808668 - DNA, 20 bp, mouse
ggggacagccacgggagcta

SEQ ID NO: 808669 - DNA, 20 bp, mouse
ggggagctatggcaaactga

SEQ ID NO: 808670 - DNA, 20 bp, mouse
gcccaggctgtgcaaacaga

SEQ ID NO: 808671 - DNA, 20 bp, mouse
gttggcagatcataagaatc

SEQ ID NO: 808672 - DNA, 20 bp, mouse
gttgcttagtaactggccca

SEQ ID NO: 808673 - DNA, 20 bp, mouse
gatgatctgccaactatact

SEQ ID NO: 808674 - DNA, 20 bp, mouse
gctgtggcttgggacagcca

SEQ ID NO: 808675 - DNA, 20 bp, mouse
gctggaaagtttttctactt

SEQ ID NO: 808676 - DNA, 20 bp, mouse
ggctgggcggccacggagga

SEQ ID NO: 808677 - DNA, 20 bp, mouse
gagcccttgcctggacccgg

SEQ ID NO: 808678 - DNA, 20 bp, mouse
ggacccccgggtccaggcaa

SEQ ID NO: 808679 - DNA, 20 bp, mouse
gcggggctgggcggccacgg

SEQ ID NO: 808680 - DNA, 20 bp, mouse
gcgccccctggtccaggccg

SEQ ID NO: 808681 - DNA, 20 bp, mouse
gcagccccggcctggaccag

SEQ ID NO: 808682 - DNA, 20 bp, mouse
gaagagcccttgcctggacc

SEQ ID NO: 808683 - DNA, 20 bp, mouse
ggcggagcttgcttggggtg

SEQ ID NO: 808684 - DNA, 20 bp, mouse
gaaaaggggtggggagtatt

SEQ ID NO: 808685 - DNA, 20 bp, mouse
gagggggtggcggtaagcaa

SEQ ID NO: 808686 - DNA, 20 bp, mouse
gcatggctcatgaacgacct

SEQ ID NO: 808687 - DNA, 20 bp, mouse
ggaccaagatgaacccgtgg

SEQ ID NO: 808688 - DNA, 20 bp, mouse
gctgcgtaaggaagacagag

SEQ ID NO: 808689 - DNA, 20 bp, mouse
ggcaggggctggcaagcaag

SEQ ID NO: 808690 - DNA, 20 bp, mouse
gacaccccagatctgacttt

SEQ ID NO: 808691 - DNA, 20 bp, mouse
gtggactccttcaataacat

SEQ ID NO: 808692 - DNA, 20 bp, mouse
gtgggctcatctggcaagtg

SEQ ID NO: 808693 - DNA, 20 bp, mouse
gggtgtgcctatgttattga

SEQ ID NO: 808694 - DNA, 20 bp, mouse
gatgagccatgagctgcgta

SEQ ID NO: 808695 - DNA, 20 bp, mouse
gaaaaaacatacattagcag

SEQ ID NO: 808696 - DNA, 20 bp, mouse
ggctgcaaccctcactggat

SEQ ID NO: 808697 - DNA, 20 bp, mouse
ggacctcccagaacactcct

SEQ ID NO: 808698 - DNA, 20 bp, mouse
gcaaccctcactggataggt

SEQ ID NO: 808699 - DNA, 20 bp, mouse
gccaccgtgcgtcattccca

SEQ ID NO: 808700 - DNA, 20 bp, mouse
ggattgccaggtcctgacct

SEQ ID NO: 808701 - DNA, 20 bp, mouse
gtgaccccacaatggatgtg

SEQ ID NO: 808702 - DNA, 20 bp, mouse
gatgacgcacggtgggagtc

SEQ ID NO: 808703 - DNA, 20 bp, mouse
gcactcctgggttttcctgg

SEQ ID NO: 808704 - DNA, 20 bp, mouse
gcagccagcaagccaaggtc

SEQ ID NO: 808705 - DNA, 20 bp, mouse
gagtgccaccaggaaaaccc

SEQ ID NO: 808706 - DNA, 20 bp, mouse
gaggaaacatggcaggactg

SEQ ID NO: 808707 - DNA, 20 bp, mouse
gtcaagagaggttgagaagt

SEQ ID NO: 808708 - DNA, 20 bp, mouse
gcggagccacccactctgag

SEQ ID NO: 808709 - DNA, 20 bp, mouse
gttaagccgctcagagtggg

SEQ ID NO: 808710 - DNA, 20 bp, mouse
gtgtcagaggctgaggtttg

SEQ ID NO: 808711 - DNA, 20 bp, mouse
gccgctctctgagatcggat

SEQ ID NO: 808712 - DNA, 20 bp, mouse
ggatctgagttcaaccagat

SEQ ID NO: 808713 - DNA, 20 bp, mouse
gttcttggtgcacaccaatc

SEQ ID NO: 808714 - DNA, 20 bp, mouse
ggggtggctccgcctctgga

SEQ ID NO: 808715 - DNA, 20 bp, mouse
gcgatctcagagagcggggc

SEQ ID NO: 808716 - DNA, 20 bp, mouse
ggggcccatcgtggtctcca

SEQ ID NO: 808717 - DNA, 20 bp, mouse
ggggcactgaagcttctgat

SEQ ID NO: 808718 - DNA, 20 bp, mouse
gagaaagtggccagtgtact

SEQ ID NO: 808719 - DNA, 20 bp, mouse
gctgccctggagaccacgat

SEQ ID NO: 808720 - DNA, 20 bp, mouse
gacacacaccccatccgtgt

SEQ ID NO: 808721 - DNA, 20 bp, mouse
gaataaaggctcatgtcttg

SEQ ID NO: 808722 - DNA, 20 bp, mouse
gacgttgcctacgttgggac

SEQ ID NO: 808723 - DNA, 20 bp, mouse
gagcgcggaggtgcctgccg

SEQ ID NO: 808724 - DNA, 20 bp, mouse
ggactctcccaacacggatg

SEQ ID NO: 808725 - DNA, 20 bp, mouse
ggcagcggccgggcccatcg

SEQ ID NO: 808726 - DNA, 20 bp, mouse
gtgctgctggggcacgggtg

SEQ ID NO: 808727 - DNA, 20 bp, mouse
gtcttcgggagccgccgcgc

SEQ ID NO: 808728 - DNA, 20 bp, mouse
gaacctagggtcactgtctt

SEQ ID NO: 808729 - DNA, 20 bp, mouse
gtctcggccggagaaggcta

SEQ ID NO: 808730 - DNA, 20 bp, mouse
gccgtgccccagcagcacgc

SEQ ID NO: 808731 - DNA, 20 bp, mouse
ggccttctccggccgagaac

SEQ ID NO: 808732 - DNA, 20 bp, mouse
gggccctgggctgttctagg

SEQ ID NO: 808733 - DNA, 20 bp, mouse
gggcctggccttgtcaaaaa

SEQ ID NO: 808734 - DNA, 20 bp, mouse
gcccgccttccgcacgctgt

SEQ ID NO: 808735 - DNA, 20 bp, mouse
gcggaagtgcaggcatcagg

SEQ ID NO: 808736 - DNA, 20 bp, mouse
gcccgctcgccacgcttccc

SEQ ID NO: 808737 - DNA, 20 bp, mouse
ggggaattgtagtctcgtga

SEQ ID NO: 808738 - DNA, 20 bp, mouse
gtcgcctcccccataggacc

SEQ ID NO: 808739 - DNA, 20 bp, mouse
gccaccagcccgcatcctgg

SEQ ID NO: 808740 - DNA, 20 bp, mouse
gcctagctgcagtcatccaa

SEQ ID NO: 808741 - DNA, 20 bp, mouse
gtgagggtcgcctcccccat

SEQ ID NO: 808742 - DNA, 20 bp, mouse
gtctccaggtcctatggggg

SEQ ID NO: 808743 - DNA, 20 bp, mouse
gcggggcggggcctaaagat

SEQ ID NO: 808744 - DNA, 20 bp, mouse
gcctgggtcttcactggccg

SEQ ID NO: 808745 - DNA, 20 bp, mouse
gcgggcggagtgtgaggaat

SEQ ID NO: 808746 - DNA, 20 bp, mouse
gctgtggcgaccctaatcca

SEQ ID NO: 808747 - DNA, 20 bp, mouse
ggcagaactgcaggagggcg

SEQ ID NO: 808748 - DNA, 20 bp, mouse
ggccgaggatccagaagacg

SEQ ID NO: 808749 - DNA, 20 bp, mouse
gaagataaaggcagaactgc

SEQ ID NO: 808750 - DNA, 20 bp, mouse
gacacactcgactcacacaa

SEQ ID NO: 808751 - DNA, 20 bp, mouse
gataaaggcagaactgcagg

SEQ ID NO: 808752 - DNA, 20 bp, mouse
gtgcgggttccgggtcccac

SEQ ID NO: 808753 - DNA, 20 bp, mouse
ggacccggaacccgcagaaa

SEQ ID NO: 808754 - DNA, 20 bp, mouse
gagccggcaggctgtcaccc

SEQ ID NO: 808755 - DNA, 20 bp, mouse
gagtcgagtgtgttgctgac

SEQ ID NO: 808756 - DNA, 20 bp, mouse
ggagcaggaggcggttgcta

SEQ ID NO: 808757 - DNA, 20 bp, mouse
gagggctcgagtggttgtta

SEQ ID NO: 808758 - DNA, 20 bp, mouse
gcggccgccgggctggctaa

SEQ ID NO: 808759 - DNA, 20 bp, mouse
ggctaagggccgtactgcgc

SEQ ID NO: 808760 - DNA, 20 bp, mouse
gcgtgcgcacaccaggccga

SEQ ID NO: 808761 - DNA, 20 bp, mouse
gggaggggccagcccggaag

SEQ ID NO: 808762 - DNA, 20 bp, mouse
gaggaggcggttgctaggga

SEQ ID NO: 808763 - DNA, 20 bp, mouse
gcggcccttagccagcccgg

SEQ ID NO: 808764 - DNA, 20 bp, mouse
ggatctgcgcgtgcgtagga

SEQ ID NO: 808765 - DNA, 20 bp, mouse
gaggcgcgcgtgcgcacacc

SEQ ID NO: 808766 - DNA, 20 bp, mouse
gcagacccaagtagctcctc

SEQ ID NO: 808767 - DNA, 20 bp, mouse
ggcgagacgcgcagaggccc

SEQ ID NO: 808768 - DNA, 20 bp, mouse
gtacacctgaggagctactt

SEQ ID NO: 808769 - DNA, 20 bp, mouse
ggatcctcatcctaaccaag

SEQ ID NO: 808770 - DNA, 20 bp, mouse
gctctggtgcccactgaaaa

SEQ ID NO: 808771 - DNA, 20 bp, mouse
gttccagcttcctcttggtt

SEQ ID NO: 808772 - DNA, 20 bp, mouse
gcccctcgggctcctttaag

SEQ ID NO: 808773 - DNA, 20 bp, mouse
gtgaacaccacagttcctac

SEQ ID NO: 808774 - DNA, 20 bp, mouse
gggagtaaagtcccagtctt

SEQ ID NO: 808775 - DNA, 20 bp, mouse
gggcggggcgagacgcgcag

SEQ ID NO: 808776 - DNA, 20 bp, mouse
gtgggtctggcagacaggtg

SEQ ID NO: 808777 - DNA, 20 bp, mouse
gggggctagagagctctgag

SEQ ID NO: 808778 - DNA, 20 bp, mouse
ggctctgagaggggctccca

SEQ ID NO: 808779 - DNA, 20 bp, mouse
gcatctggcagaggccctct

SEQ ID NO: 808780 - DNA, 20 bp, mouse
ggaggaaatggcaggcccag

SEQ ID NO: 808781 - DNA, 20 bp, mouse
gaggcgcctgagccacaccc

SEQ ID NO: 808782 - DNA, 20 bp, mouse
gtaaagagttgtcccagggg

SEQ ID NO: 808783 - DNA, 20 bp, mouse
gttaagtgagggcccgtgtt

SEQ ID NO: 808784 - DNA, 20 bp, mouse
gtttggctctgggacaggtc

SEQ ID NO: 808785 - DNA, 20 bp, mouse
ggcagctgcaaaggaggcac

SEQ ID NO: 808786 - DNA, 20 bp, mouse
gctaccttaaggggacagag

SEQ ID NO: 808787 - DNA, 20 bp, mouse
ggtcatcaagcctaccttaa

SEQ ID NO: 808788 - DNA, 20 bp, mouse
gaggtaggcttgatgacctg

SEQ ID NO: 808789 - DNA, 20 bp, mouse
gtaggctgacctctctgggt

SEQ ID NO: 808790 - DNA, 20 bp, mouse
gcaagggaggcccgccccaa

SEQ ID NO: 808791 - DNA, 20 bp, mouse
gtggcccaggggtgagcctc

SEQ ID NO: 808792 - DNA, 20 bp, mouse
ggaggtgaccagatctcaag

SEQ ID NO: 808793 - DNA, 20 bp, mouse
gctcccccgaccttgaacac

SEQ ID NO: 808794 - DNA, 20 bp, mouse
gagcctgtgttcaaggtcgg

SEQ ID NO: 808795 - DNA, 20 bp, mouse
ggggagcactgggtagggcg

SEQ ID NO: 808796 - DNA, 20 bp, mouse
gaggggcaggcttaagacgc

SEQ ID NO: 808797 - DNA, 20 bp, mouse
gttaagacgcggggcgagtc

SEQ ID NO: 808798 - DNA, 20 bp, mouse
gggcaggtgcaaatgaacgg

SEQ ID NO: 808799 - DNA, 20 bp, mouse
gtgaacagggtcaacacggg

SEQ ID NO: 808800 - DNA, 20 bp, mouse
gggtacagagactgggttgg

SEQ ID NO: 808801 - DNA, 20 bp, mouse
gctgaaggcgtgaccaagag

SEQ ID NO: 808802 - DNA, 20 bp, mouse
gtgctcatgggtacagagac

SEQ ID NO: 808803 - DNA, 20 bp, mouse
gggagcaaaggtagggctga

SEQ ID NO: 808804 - DNA, 20 bp, mouse
ggggtcgcgtcctcagggct

SEQ ID NO: 808805 - DNA, 20 bp, mouse
ggggaacaagataatcttgt

SEQ ID NO: 808806 - DNA, 20 bp, mouse
ggacgcgccgaagacgtgta

SEQ ID NO: 808807 - DNA, 20 bp, mouse
gcaaaactggacgggagagg

SEQ ID NO: 808808 - DNA, 20 bp, mouse
gaagcagtgcaaaactggac

SEQ ID NO: 808809 - DNA, 20 bp, mouse
gtcaaaagggacactacgaa

SEQ ID NO: 808810 - DNA, 20 bp, mouse
gaatgggcggggcagctcct

SEQ ID NO: 808811 - DNA, 20 bp, mouse
gcgaagacgtgtacggagcg

SEQ ID NO: 808812 - DNA, 20 bp, mouse
ggtacggagcgcggccaaga

SEQ ID NO: 808813 - DNA, 20 bp, mouse
gactacgaaaggctcttaag

SEQ ID NO: 808814 - DNA, 20 bp, mouse
gagatgaggcggcaaaagac

SEQ ID NO: 808815 - DNA, 20 bp, mouse
gaacgaaaggcggagtcaaa

SEQ ID NO: 808816 - DNA, 20 bp, mouse
ggggacagtcccactaaaag

SEQ ID NO: 808817 - DNA, 20 bp, mouse
ggaagcggaaaggttctgtg

SEQ ID NO: 808818 - DNA, 20 bp, mouse
ggtcttcaggacttttgatc

SEQ ID NO: 808819 - DNA, 20 bp, mouse
gaactgttgctgaagcggaa

SEQ ID NO: 808820 - DNA, 20 bp, mouse
gctactaaattattccgtgg

SEQ ID NO: 808821 - DNA, 20 bp, mouse
gatgatctgatcaccatttt

SEQ ID NO: 808822 - DNA, 20 bp, mouse
gcccacctcaaaactgtatc

SEQ ID NO: 808823 - DNA, 20 bp, mouse
ggaagtagtgccccttttag

SEQ ID NO: 808824 - DNA, 20 bp, mouse
gttcagcaacagttccccca

SEQ ID NO: 808825 - DNA, 20 bp, mouse
gtgtgatgattagtgtcttc

SEQ ID NO: 808826 - DNA, 20 bp, mouse
gggacggaagagggacgcta

SEQ ID NO: 808827 - DNA, 20 bp, mouse
gaaaagcaccagcccctacc

SEQ ID NO: 808828 - DNA, 20 bp, mouse
gacggaagagggacggaaga

SEQ ID NO: 808829 - DNA, 20 bp, mouse
gtgcaactgcccggcctcca

SEQ ID NO: 808830 - DNA, 20 bp, mouse
gcaaacagcaaagacggaag

SEQ ID NO: 808831 - DNA, 20 bp, mouse
gagcaaagacggaagaggga

SEQ ID NO: 808832 - DNA, 20 bp, mouse
gccacggagctgattcatta

SEQ ID NO: 808833 - DNA, 20 bp, mouse
gcgtctttgctgtttgtagg

SEQ ID NO: 808834 - DNA, 20 bp, mouse
gaatcagctccgtggaggcc

SEQ ID NO: 808835 - DNA, 20 bp, mouse
ggctggctcagtctgtgacc

SEQ ID NO: 808836 - DNA, 20 bp, mouse
gaaaacctgccaatctccgc

SEQ ID NO: 808837 - DNA, 20 bp, mouse
gatagggcgggcctcggaaa

SEQ ID NO: 808838 - DNA, 20 bp, mouse
ggggatgcccgcgtccaacg

SEQ ID NO: 808839 - DNA, 20 bp, mouse
ggccggaggaggcggggata

SEQ ID NO: 808840 - DNA, 20 bp, mouse
gcgggcctatcggacgccgt

SEQ ID NO: 808841 - DNA, 20 bp, mouse
gtgcccgcgtccaacgtggc

SEQ ID NO: 808842 - DNA, 20 bp, mouse
ggcgccggcggagctcgcac

SEQ ID NO: 808843 - DNA, 20 bp, mouse
gaatctccgccggaggaggc

SEQ ID NO: 808844 - DNA, 20 bp, mouse
gtgccaatctccgccggagg

SEQ ID NO: 808845 - DNA, 20 bp, mouse
gccgccggcgccagccacgt

SEQ ID NO: 808846 - DNA, 20 bp, mouse
ggtgggcgggacttggtcgg

SEQ ID NO: 808847 - DNA, 20 bp, mouse
ggtggcgctcaagcttagta

SEQ ID NO: 808848 - DNA, 20 bp, mouse
gcgggtgctgagttgaactc

SEQ ID NO: 808849 - DNA, 20 bp, mouse
gaagcttagtagggcttgaa

SEQ ID NO: 808850 - DNA, 20 bp, mouse
gcacaaatgtgggcgggact

SEQ ID NO: 808851 - DNA, 20 bp, mouse
gttggtcggaggaatgactg

SEQ ID NO: 808852 - DNA, 20 bp, mouse
gttgcagagacaccacttag

SEQ ID NO: 808853 - DNA, 20 bp, mouse
gactgcggaactaaagttcc

SEQ ID NO: 808854 - DNA, 20 bp, mouse
gtcccggtggttgtggttct

SEQ ID NO: 808855 - DNA, 20 bp, mouse
gcaccgagaaccacaaccac

SEQ ID NO: 808856 - DNA, 20 bp, mouse
ggggacctgcggaagagacg

SEQ ID NO: 808857 - DNA, 20 bp, mouse
gccaggcatcgtggggacgt

SEQ ID NO: 808858 - DNA, 20 bp, mouse
gggcaagaggcccgagatag

SEQ ID NO: 808859 - DNA, 20 bp, mouse
gcacctcgagcggtgagaag

SEQ ID NO: 808860 - DNA, 20 bp, mouse
ggggctgaggggagcaaacc

SEQ ID NO: 808861 - DNA, 20 bp, mouse
gcgaggtgagactcgcacgt

SEQ ID NO: 808862 - DNA, 20 bp, mouse
ggaattgagtgaatctacca

SEQ ID NO: 808863 - DNA, 20 bp, mouse
gtgactggagtgacactccc

SEQ ID NO: 808864 - DNA, 20 bp, mouse
ggctccaggccaggcatcgt

SEQ ID NO: 808865 - DNA, 20 bp, mouse
gcctgggcgtgggttcttgc

SEQ ID NO: 808866 - DNA, 20 bp, mouse
ggggaggggcgaccagcgaa

SEQ ID NO: 808867 - DNA, 20 bp, mouse
gggggcgcgcaggaggtaat

SEQ ID NO: 808868 - DNA, 20 bp, mouse
ggaaggggcgggaacagtcc

SEQ ID NO: 808869 - DNA, 20 bp, mouse
gtgcgcgccccgcctcttcc

SEQ ID NO: 808870 - DNA, 20 bp, mouse
gggaacagtcccggaagagg

SEQ ID NO: 808871 - DNA, 20 bp, mouse
gcggagggcggggacaattc

SEQ ID NO: 808872 - DNA, 20 bp, mouse
ggtggggcgagcgtgaaaga

SEQ ID NO: 808873 - DNA, 20 bp, mouse
gtaatgggcgcgttgagtgg

SEQ ID NO: 808874 - DNA, 20 bp, mouse
gggcggggacaattcaggaa

SEQ ID NO: 808875 - DNA, 20 bp, mouse
ggacaattcaggaaggggcg

SEQ ID NO: 808876 - DNA, 20 bp, mouse
gctaccgggaagcgagaaga

SEQ ID NO: 808877 - DNA, 20 bp, mouse
gcaatcagagagcgcttctc

SEQ ID NO: 808878 - DNA, 20 bp, mouse
ggcgccgcgaaatgacgttt

SEQ ID NO: 808879 - DNA, 20 bp, mouse
gaggcgccgaggttctgtga

SEQ ID NO: 808880 - DNA, 20 bp, mouse
gtttgaatagggcaaggctg

SEQ ID NO: 808881 - DNA, 20 bp, mouse
gctgcgggaaggggctagga

SEQ ID NO: 808882 - DNA, 20 bp, mouse
ggtgtcagggcggtcccctg

SEQ ID NO: 808883 - DNA, 20 bp, mouse
ggcgcctccatctttgaata

SEQ ID NO: 808884 - DNA, 20 bp, mouse
ggccttgccctattcaaaga

SEQ ID NO: 808885 - DNA, 20 bp, mouse
gtggacttggcggtggaagc

SEQ ID NO: 808886 - DNA, 20 bp, mouse
gaccgaggctgtcacgtgat

SEQ ID NO: 808887 - DNA, 20 bp, mouse
gacccagtctcgcgagaccg

SEQ ID NO: 808888 - DNA, 20 bp, mouse
gacgccgcccaaaatcaata

SEQ ID NO: 808889 - DNA, 20 bp, mouse
gtgccacaggccagcgactc

SEQ ID NO: 808890 - DNA, 20 bp, mouse
gtccggaagaaaaccgatcc

SEQ ID NO: 808891 - DNA, 20 bp, mouse
gcgcaagtgcggaagtgcgg

SEQ ID NO: 808892 - DNA, 20 bp, mouse
gaaaccgatcccggagtcgc

SEQ ID NO: 808893 - DNA, 20 bp, mouse
gccgcccaaaatcaataagg

SEQ ID NO: 808894 - DNA, 20 bp, mouse
gaaaatcaataaggtggaat

SEQ ID NO: 808895 - DNA, 20 bp, mouse
gatactccatgagaaactca

SEQ ID NO: 808896 - DNA, 20 bp, mouse
ggccctcggggcagctcccc

SEQ ID NO: 808897 - DNA, 20 bp, mouse
gagtccgtgcacggtcctcc

SEQ ID NO: 808898 - DNA, 20 bp, mouse
gtccccggggagctgccccg

SEQ ID NO: 808899 - DNA, 20 bp, mouse
gcggccgtgctctctgtccc

SEQ ID NO: 808900 - DNA, 20 bp, mouse
gggactgtcaggtgccctcg

SEQ ID NO: 808901 - DNA, 20 bp, mouse
gtccccggggacagagagca

SEQ ID NO: 808902 - DNA, 20 bp, mouse
gtcaccttgctgacagtccc

SEQ ID NO: 808903 - DNA, 20 bp, mouse
gcgggagtccgtgacgtggc

SEQ ID NO: 808904 - DNA, 20 bp, mouse
gtggcaggcgagtccgtgca

SEQ ID NO: 808905 - DNA, 20 bp, mouse
gcacctgacagtcccgtgtc

SEQ ID NO: 808906 - DNA, 20 bp, mouse
ggcgccgccgccgaagggaa

SEQ ID NO: 808907 - DNA, 20 bp, mouse
gtggtggcgcggccgagcgt

SEQ ID NO: 808908 - DNA, 20 bp, mouse
gcacgcgtgcggtggtggcg

SEQ ID NO: 808909 - DNA, 20 bp, mouse
gtcaccgacgaccgcggccc

SEQ ID NO: 808910 - DNA, 20 bp, mouse
ggtcgtcggtgagagtgact

SEQ ID NO: 808911 - DNA, 20 bp, mouse
gtcactctcaccgacgaccg

SEQ ID NO: 808912 - DNA, 20 bp, mouse
gcggccgagcgtgggtgccc

SEQ ID NO: 808913 - DNA, 20 bp, mouse
gccccgcacaggccagactg

SEQ ID NO: 808914 - DNA, 20 bp, mouse
gtggcccgcgcctttccctt

SEQ ID NO: 808915 - DNA, 20 bp, mouse
gcggcccgggcacccacgct

SEQ ID NO: 808916 - DNA, 20 bp, mouse
gagttccgccccatgctcta

SEQ ID NO: 808917 - DNA, 20 bp, mouse
gggaaccggaagttgagcct

SEQ ID NO: 808918 - DNA, 20 bp, mouse
gtcggccttaggcacgcttc

SEQ ID NO: 808919 - DNA, 20 bp, mouse
gagcgtgcctaaggccgacg

SEQ ID NO: 808920 - DNA, 20 bp, mouse
ggcatggggcggaacttccg

SEQ ID NO: 808921 - DNA, 20 bp, mouse
gtacagactgcgtccatgac

SEQ ID NO: 808922 - DNA, 20 bp, mouse
ggatgttgcgcatgcgtatg

SEQ ID NO: 808923 - DNA, 20 bp, mouse
gctagccctagagcatgggg

SEQ ID NO: 808924 - DNA, 20 bp, mouse
gctaaggccgacgtggcaga

SEQ ID NO: 808925 - DNA, 20 bp, mouse
gaggcacgcttccggaaacc

SEQ ID NO: 808926 - DNA, 20 bp, mouse
gagccggtggcaggggactt

SEQ ID NO: 808927 - DNA, 20 bp, mouse
gaggaggcggggcctcgcga

SEQ ID NO: 808928 - DNA, 20 bp, mouse
gcccctgccaccggctccgg

SEQ ID NO: 808929 - DNA, 20 bp, mouse
gcacccaagtcccctgccac

SEQ ID NO: 808930 - DNA, 20 bp, mouse
gatcctccggagccggtggc

SEQ ID NO: 808931 - DNA, 20 bp, mouse
gcgtgtcggggagtgctcag

SEQ ID NO: 808932 - DNA, 20 bp, mouse
gaagaggcgcgagaccgcag

SEQ ID NO: 808933 - DNA, 20 bp, mouse
gtcgcgaaggaaaagcttag

SEQ ID NO: 808934 - DNA, 20 bp, mouse
ggcgctctgggttcaacagg

SEQ ID NO: 808935 - DNA, 20 bp, mouse
gaggaactggcctgtgtcaa

SEQ ID NO: 808936 - DNA, 20 bp, mouse
gaagtgctgtcccgcggggt

SEQ ID NO: 808937 - DNA, 20 bp, mouse
gcccggaagtgctgtcccgc

SEQ ID NO: 808938 - DNA, 20 bp, mouse
gccgctgctcccggaagtgc

SEQ ID NO: 808939 - DNA, 20 bp, mouse
ggcaactcgccacgcccacc

SEQ ID NO: 808940 - DNA, 20 bp, mouse
gaagtgccggctggccgggt

SEQ ID NO: 808941 - DNA, 20 bp, mouse
gaagtgccggcccgcaggcg

SEQ ID NO: 808942 - DNA, 20 bp, mouse
gcgggagcagccactccggt

SEQ ID NO: 808943 - DNA, 20 bp, mouse
gtgctcccggaagtgccggc

SEQ ID NO: 808944 - DNA, 20 bp, mouse
gcgagctgggcgtctccgtc

SEQ ID NO: 808945 - DNA, 20 bp, mouse
gccagactagcctaccggag

SEQ ID NO: 808946 - DNA, 20 bp, mouse
gggcctgcctcacttgccct

SEQ ID NO: 808947 - DNA, 20 bp, mouse
ggcgcggtgcgcccttggtt

SEQ ID NO: 808948 - DNA, 20 bp, mouse
gctagaactgtgcaatccca

SEQ ID NO: 808949 - DNA, 20 bp, mouse
gccgcagcgcggtgcgccct

SEQ ID NO: 808950 - DNA, 20 bp, mouse
gaagtgaggcaggccctgct

SEQ ID NO: 808951 - DNA, 20 bp, mouse
gagaatagactagcatgtac

SEQ ID NO: 808952 - DNA, 20 bp, mouse
ggatcacactgagagctcat

SEQ ID NO: 808953 - DNA, 20 bp, mouse
ggactagcatgtactggtgt

SEQ ID NO: 808954 - DNA, 20 bp, mouse
gagcgcagaggtttcccagc

SEQ ID NO: 808955 - DNA, 20 bp, mouse
gaccgagagcgatagcgcag

SEQ ID NO: 808956 - DNA, 20 bp, mouse
gctgtcgggaagacgactgt

SEQ ID NO: 808957 - DNA, 20 bp, mouse
gaagcgtccactagtaacaa

SEQ ID NO: 808958 - DNA, 20 bp, mouse
ggcgccaagaccacaactcc

SEQ ID NO: 808959 - DNA, 20 bp, mouse
gtgtcgggccacaccggaac

SEQ ID NO: 808960 - DNA, 20 bp, mouse
gcacacgcccagttccggtg

SEQ ID NO: 808961 - DNA, 20 bp, mouse
gcacccaggagggtattgta

SEQ ID NO: 808962 - DNA, 20 bp, mouse
ggtactgagggccaccgaca

SEQ ID NO: 808963 - DNA, 20 bp, mouse
gggtcgcgacatgctatcac

SEQ ID NO: 808964 - DNA, 20 bp, mouse
gacaactcccggcatgcagc

SEQ ID NO: 808965 - DNA, 20 bp, mouse
gcagactctcccggaagtga

SEQ ID NO: 808966 - DNA, 20 bp, mouse
gggactggatggcaagaggc

SEQ ID NO: 808967 - DNA, 20 bp, mouse
gggtgaccatagcaacgcgg

SEQ ID NO: 808968 - DNA, 20 bp, mouse
gcggggcggcctgccgtggt

SEQ ID NO: 808969 - DNA, 20 bp, mouse
gggcgggactggatggcaag

SEQ ID NO: 808970 - DNA, 20 bp, mouse
ggtcaccgttggcgcggcgg

SEQ ID NO: 808971 - DNA, 20 bp, mouse
gaaaaggaaaacccttgtcc

SEQ ID NO: 808972 - DNA, 20 bp, mouse
gtggggcggaaagaaaagtc

SEQ ID NO: 808973 - DNA, 20 bp, mouse
gaagaaccgcccaccacggc

SEQ ID NO: 808974 - DNA, 20 bp, mouse
ggcgttgctatggtcaccgt

SEQ ID NO: 808975 - DNA, 20 bp, mouse
gtggacgtccgccaacggcc

SEQ ID NO: 808976 - DNA, 20 bp, mouse
gaacgcaggcgtagttgcgc

SEQ ID NO: 808977 - DNA, 20 bp, mouse
ggggctgtaaacccgggaac

SEQ ID NO: 808978 - DNA, 20 bp, mouse
gcacacggcccagttgttgt

SEQ ID NO: 808979 - DNA, 20 bp, mouse
gtccgcctatacccatgtct

SEQ ID NO: 808980 - DNA, 20 bp, mouse
gcctgactcaatttctcatg

SEQ ID NO: 808981 - DNA, 20 bp, mouse
gcgcagactcttggatgact

SEQ ID NO: 808982 - DNA, 20 bp, mouse
gttacataaaagaagcgaaa

SEQ ID NO: 808983 - DNA, 20 bp, mouse
gcgcgcggagagcgcaagcg

SEQ ID NO: 808984 - DNA, 20 bp, mouse
gactacgcctgcgttagttt

SEQ ID NO: 808985 - DNA, 20 bp, mouse
gcacaagcttatcgctgatg

SEQ ID NO: 808986 - DNA, 20 bp, mouse
gagaggctgcgcccgagacc

SEQ ID NO: 808987 - DNA, 20 bp, mouse
gagaccgggaggcgaacaat

SEQ ID NO: 808988 - DNA, 20 bp, mouse
gtacgttgaggctgctggag

SEQ ID NO: 808989 - DNA, 20 bp, mouse
gaggccgacctgagcgattc

SEQ ID NO: 808990 - DNA, 20 bp, mouse
gggagagacccgaatcgctc

SEQ ID NO: 808991 - DNA, 20 bp, mouse
gggcgggcggtgtgggatct

SEQ ID NO: 808992 - DNA, 20 bp, mouse
gctgaacgggcgggcggtgt

SEQ ID NO: 808993 - DNA, 20 bp, mouse
gtgaagagccaattgaaagg

SEQ ID NO: 808994 - DNA, 20 bp, mouse
gctcccggcttcccgagcag

SEQ ID NO: 808995 - DNA, 20 bp, mouse
gagacccgaatcgctcaggt

SEQ ID NO: 808996 - DNA, 20 bp, mouse
gtgactcgggcgttcagtca

SEQ ID NO: 808997 - DNA, 20 bp, mouse
gggaggctggcaagtcgcgt

SEQ ID NO: 808998 - DNA, 20 bp, mouse
ggccacgtgagtcagagcgc

SEQ ID NO: 808999 - DNA, 20 bp, mouse
gacgtgagtcagagcgctgg

SEQ ID NO: 809000 - DNA, 20 bp, mouse
ggtgcggtggcggacgacgc

SEQ ID NO: 809001 - DNA, 20 bp, mouse
gaacgcccgagtcacctggc

SEQ ID NO: 809002 - DNA, 20 bp, mouse
gtcgtccgccaccgcacgga

SEQ ID NO: 809003 - DNA, 20 bp, mouse
gcccgcggcgggttacataa

SEQ ID NO: 809004 - DNA, 20 bp, mouse
ggacggcgggaagaccacgg

SEQ ID NO: 809005 - DNA, 20 bp, mouse
gcccgccgtccgtgcggtgg

SEQ ID NO: 809006 - DNA, 20 bp, mouse
gcgggcttatggaaaacaga

SEQ ID NO: 809007 - DNA, 20 bp, mouse
gcggccccgcccctgagcca

SEQ ID NO: 809008 - DNA, 20 bp, mouse
gtcctccacacgctcactga

SEQ ID NO: 809009 - DNA, 20 bp, mouse
gaaacagagggcgtggtccg

SEQ ID NO: 809010 - DNA, 20 bp, mouse
gggggagggaacagccgcgt

SEQ ID NO: 809011 - DNA, 20 bp, mouse
gggcgtggtccgtggctcag

SEQ ID NO: 809012 - DNA, 20 bp, mouse
ggtggtccgtggctcagggg

SEQ ID NO: 809013 - DNA, 20 bp, mouse
gtggaggagacggccgggga

SEQ ID NO: 809014 - DNA, 20 bp, mouse
gtcccccaagcagtgagcag

SEQ ID NO: 809015 - DNA, 20 bp, mouse
gggacccgggggcgggctta

SEQ ID NO: 809016 - DNA, 20 bp, mouse
gtggggcagcgacagctcta

SEQ ID NO: 809017 - DNA, 20 bp, mouse
gctagggggtggcttgtggt

SEQ ID NO: 809018 - DNA, 20 bp, mouse
gagccgcacgtggaagactg

SEQ ID NO: 809019 - DNA, 20 bp, mouse
gtggtgggccaggaagggcg

SEQ ID NO: 809020 - DNA, 20 bp, mouse
gcagcgacagctctaggggg

SEQ ID NO: 809021 - DNA, 20 bp, mouse
gacgccgagcacttccggca

SEQ ID NO: 809022 - DNA, 20 bp, mouse
gcgcactgatgcagtgcagg

SEQ ID NO: 809023 - DNA, 20 bp, mouse
ggggtggcttgtggtgggcc

SEQ ID NO: 809024 - DNA, 20 bp, mouse
ggggcctccggagccgcacg

SEQ ID NO: 809025 - DNA, 20 bp, mouse
gcgacggaggccttccctgc

SEQ ID NO: 809026 - DNA, 20 bp, mouse
gaagccgagcgggaccgaaa

SEQ ID NO: 809027 - DNA, 20 bp, mouse
gaggaaatggagatacgcag

SEQ ID NO: 809028 - DNA, 20 bp, mouse
gaacctgcctaggtgggagt

SEQ ID NO: 809029 - DNA, 20 bp, mouse
gcagcccaacctgcctaggt

SEQ ID NO: 809030 - DNA, 20 bp, mouse
ggatggccgaggagcgacgg

SEQ ID NO: 809031 - DNA, 20 bp, mouse
ggccccggggagggatcatc

SEQ ID NO: 809032 - DNA, 20 bp, mouse
gtgggaggagtaacccaacc

SEQ ID NO: 809033 - DNA, 20 bp, mouse
gggggatggccgaggagcga

SEQ ID NO: 809034 - DNA, 20 bp, mouse
gagatacgcaggggcgggga

SEQ ID NO: 809035 - DNA, 20 bp, mouse
gaatggagatacgcaggggc

SEQ ID NO: 809036 - DNA, 20 bp, mouse
gaagcctggaccctcctcca

SEQ ID NO: 809037 - DNA, 20 bp, mouse
gtggagggaggggctagatg

SEQ ID NO: 809038 - DNA, 20 bp, mouse
gtgcgtctcaggaaccctgg

SEQ ID NO: 809039 - DNA, 20 bp, mouse
gtccttgccagacactctgt

SEQ ID NO: 809040 - DNA, 20 bp, mouse
gggagctgatgtttgattca

SEQ ID NO: 809041 - DNA, 20 bp, mouse
ggggaaactgaaagcctgga

SEQ ID NO: 809042 - DNA, 20 bp, mouse
ggtgccttagggttgagcta

SEQ ID NO: 809043 - DNA, 20 bp, mouse
ggcttcattagttgcgtctc

SEQ ID NO: 809044 - DNA, 20 bp, mouse
gagagtgtctggcaaggaac

SEQ ID NO: 809045 - DNA, 20 bp, mouse
gagaatcactaagaaactca

SEQ ID NO: 809046 - DNA, 20 bp, mouse
gcacccgttctcatacccaa

SEQ ID NO: 809047 - DNA, 20 bp, mouse
gctgacctgagggcgtgtca

SEQ ID NO: 809048 - DNA, 20 bp, mouse
gtcctccctgacacgccctc

SEQ ID NO: 809049 - DNA, 20 bp, mouse
ggcggtcagtgtttgattca

SEQ ID NO: 809050 - DNA, 20 bp, mouse
gcaagggactgcattaatcc

SEQ ID NO: 809051 - DNA, 20 bp, mouse
gccaggaagaaaacaaactt

SEQ ID NO: 809052 - DNA, 20 bp, mouse
gtgagctcatcctgacctga

SEQ ID NO: 809053 - DNA, 20 bp, mouse
ggggaaagagtgtcatttgc

SEQ ID NO: 809054 - DNA, 20 bp, mouse
gtatgagaacgggtggtact

SEQ ID NO: 809055 - DNA, 20 bp, mouse
gaccggaggtaggggtcctt

SEQ ID NO: 809056 - DNA, 20 bp, mouse
gccggcgcgccacgccccga

SEQ ID NO: 809057 - DNA, 20 bp, mouse
gcgcgcagggcgtgtccctc

SEQ ID NO: 809058 - DNA, 20 bp, mouse
ggggacacgccctgcgcggg

SEQ ID NO: 809059 - DNA, 20 bp, mouse
ggacgcgggcgggcaggcga

SEQ ID NO: 809060 - DNA, 20 bp, mouse
ggggcccgcctccgagaggg

SEQ ID NO: 809061 - DNA, 20 bp, mouse
gttcggaggcgcacaccccc

SEQ ID NO: 809062 - DNA, 20 bp, mouse
gtgcccgcccgcgtcggccc

SEQ ID NO: 809063 - DNA, 20 bp, mouse
gcaccttccggggtcagcct

SEQ ID NO: 809064 - DNA, 20 bp, mouse
gtgcagcagcagacgaagct

SEQ ID NO: 809065 - DNA, 20 bp, mouse
gcgcaggctccgcccgcgca

SEQ ID NO: 809066 - DNA, 20 bp, mouse
gtgaatcagcggctcgaagg

SEQ ID NO: 809067 - DNA, 20 bp, mouse
gggcgtgactatgtgtgggg

SEQ ID NO: 809068 - DNA, 20 bp, mouse
gggccattggccaaggagga

SEQ ID NO: 809069 - DNA, 20 bp, mouse
gagggggcgtgactatgtgt

SEQ ID NO: 809070 - DNA, 20 bp, mouse
gggccgagaaaaatctagtg

SEQ ID NO: 809071 - DNA, 20 bp, mouse
ggtggggcgatcacggccat

SEQ ID NO: 809072 - DNA, 20 bp, mouse
ggacaactgtacacaatgat

SEQ ID NO: 809073 - DNA, 20 bp, mouse
ggcctgggaaggggcgaaga

SEQ ID NO: 809074 - DNA, 20 bp, mouse
ggtgaggccgtggtccaacc

SEQ ID NO: 809075 - DNA, 20 bp, mouse
gcgatcacggccattggcca

SEQ ID NO: 809076 - DNA, 20 bp, mouse
ggaagagcaggctatgagaa

SEQ ID NO: 809077 - DNA, 20 bp, mouse
ggtctctagaggtaacacaa

SEQ ID NO: 809078 - DNA, 20 bp, mouse
gaagaatggcagactaaata

SEQ ID NO: 809079 - DNA, 20 bp, mouse
gcaaccacttcctcactctt

SEQ ID NO: 809080 - DNA, 20 bp, mouse
gttcaactgttcaggatcat

SEQ ID NO: 809081 - DNA, 20 bp, mouse
gtagaggtgacttcctaata

SEQ ID NO: 809082 - DNA, 20 bp, mouse
gttcttgtggttggagacga

SEQ ID NO: 809083 - DNA, 20 bp, mouse
gtcctcactcttgggccaat

SEQ ID NO: 809084 - DNA, 20 bp, mouse
ggcccattggcccaagagtg

SEQ ID NO: 809085 - DNA, 20 bp, mouse
gggtgacttcctaatacgga

SEQ ID NO: 809086 - DNA, 20 bp, mouse
gcaggaggggtggacgtcgt

SEQ ID NO: 809087 - DNA, 20 bp, mouse
gaggagccggcgctcggttg

SEQ ID NO: 809088 - DNA, 20 bp, mouse
gtgggcgcctacggccagga

SEQ ID NO: 809089 - DNA, 20 bp, mouse
gggttcggagggaacgacca

SEQ ID NO: 809090 - DNA, 20 bp, mouse
gtgggcacccgctagagatg

SEQ ID NO: 809091 - DNA, 20 bp, mouse
gaggggacgggactgcgagc

SEQ ID NO: 809092 - DNA, 20 bp, mouse
gcacacaggtggggacctcg

SEQ ID NO: 809093 - DNA, 20 bp, mouse
ggtggacgtcgtgggttcgg

SEQ ID NO: 809094 - DNA, 20 bp, mouse
ggcgaacagcggccggggtg

SEQ ID NO: 809095 - DNA, 20 bp, mouse
gggctgggcagggaggccga

SEQ ID NO: 809096 - DNA, 20 bp, mouse
gctgcaccccagtgcctgtt

SEQ ID NO: 809097 - DNA, 20 bp, mouse
gaatcgagagtgacagatca

SEQ ID NO: 809098 - DNA, 20 bp, mouse
gataatgtcctatgactcac

SEQ ID NO: 809099 - DNA, 20 bp, mouse
gtgcatccaaaaagttttct

SEQ ID NO: 809100 - DNA, 20 bp, mouse
ggatacgtacatcagtgcca

SEQ ID NO: 809101 - DNA, 20 bp, mouse
gcagtgactgagcagaacct

SEQ ID NO: 809102 - DNA, 20 bp, mouse
gtgtatgcagttttatcaaa

SEQ ID NO: 809103 - DNA, 20 bp, mouse
ggccatcctaacaggcactg

SEQ ID NO: 809104 - DNA, 20 bp, mouse
gggacattattatcaaaatc

SEQ ID NO: 809105 - DNA, 20 bp, mouse
gaccccagtgcctgttagga

SEQ ID NO: 809106 - DNA, 20 bp, mouse
gctgcacaggcaaggggcaa

SEQ ID NO: 809107 - DNA, 20 bp, mouse
gacaaacttgatacagaccc

SEQ ID NO: 809108 - DNA, 20 bp, mouse
ggtgcggactgcacaggcaa

SEQ ID NO: 809109 - DNA, 20 bp, mouse
ggagccatttttggatgcct

SEQ ID NO: 809110 - DNA, 20 bp, mouse
gaatttatgcaaccaattgg

SEQ ID NO: 809111 - DNA, 20 bp, mouse
ggggaatttatgcaaccaat

SEQ ID NO: 809112 - DNA, 20 bp, mouse
gggtgatcagaactgtttct

SEQ ID NO: 809113 - DNA, 20 bp, mouse
gcaggtccctgaaatgtcca

SEQ ID NO: 809114 - DNA, 20 bp, mouse
gagacccaggcatccaaaaa

SEQ ID NO: 809115 - DNA, 20 bp, mouse
gcaggcaaggggcaaaggga

SEQ ID NO: 809116 - DNA, 20 bp, mouse
ggagccattagtgggtactt

SEQ ID NO: 809117 - DNA, 20 bp, mouse
gagaccaaagtacccactaa

SEQ ID NO: 809118 - DNA, 20 bp, mouse
gtgcagactgcacaggtaag

SEQ ID NO: 809119 - DNA, 20 bp, mouse
gcaaacaggtcctcaaccgt

SEQ ID NO: 809120 - DNA, 20 bp, mouse
gaaaacatctgagccattag

SEQ ID NO: 809121 - DNA, 20 bp, mouse
gggacatttcagggtaccca

SEQ ID NO: 809122 - DNA, 20 bp, mouse
gggaatttatgcatctaatt

SEQ ID NO: 809123 - DNA, 20 bp, mouse
gacaggtaaggggcaaaagg

SEQ ID NO: 809124 - DNA, 20 bp, mouse
gttcagggtacccacggttg

SEQ ID NO: 809125 - DNA, 20 bp, mouse
gacacaaacataaaggcaca

SEQ ID NO: 809126 - DNA, 20 bp, mouse
ggggtccgaggtggctcgaa

SEQ ID NO: 809127 - DNA, 20 bp, mouse
ggtggctcgaagggcttgga

SEQ ID NO: 809128 - DNA, 20 bp, mouse
gcaaaccggaaccaagtgag

SEQ ID NO: 809129 - DNA, 20 bp, mouse
gactgcctgagtcaggagac

SEQ ID NO: 809130 - DNA, 20 bp, mouse
gcaagcccttcgagccacct

SEQ ID NO: 809131 - DNA, 20 bp, mouse
gaggccacagcactgccgac

SEQ ID NO: 809132 - DNA, 20 bp, mouse
ggcagggttcgggtccgagg

SEQ ID NO: 809133 - DNA, 20 bp, mouse
gcaaaagacagcaacacatc

SEQ ID NO: 809134 - DNA, 20 bp, mouse
gggcagacacgcgcagggtt

SEQ ID NO: 809135 - DNA, 20 bp, mouse
ggctcgaagggcttggaggg

SEQ ID NO: 809136 - DNA, 20 bp, mouse
gtgagcccagattaggaaag

SEQ ID NO: 809137 - DNA, 20 bp, mouse
gtggggatatcctgagcagg

SEQ ID NO: 809138 - DNA, 20 bp, mouse
gggtccactactgtgttctt

SEQ ID NO: 809139 - DNA, 20 bp, mouse
ggggcggaggatgtgaggct

SEQ ID NO: 809140 - DNA, 20 bp, mouse
gaactcccgaccatggggta

SEQ ID NO: 809141 - DNA, 20 bp, mouse
gaggatatccccagtttgga

SEQ ID NO: 809142 - DNA, 20 bp, mouse
gcccacccctttcctaatct

SEQ ID NO: 809143 - DNA, 20 bp, mouse
ggaggcataggtaaccagaa

SEQ ID NO: 809144 - DNA, 20 bp, mouse
ggaaaggactaagaggatgt

SEQ ID NO: 809145 - DNA, 20 bp, mouse
ggagcagggggcatagcttc

SEQ ID NO: 809146 - DNA, 20 bp, mouse
ggggaggcaaccacccgatt

SEQ ID NO: 809147 - DNA, 20 bp, mouse
gagtagctgagacagggatg

SEQ ID NO: 809148 - DNA, 20 bp, mouse
ggcaaccacccgatttgggt

SEQ ID NO: 809149 - DNA, 20 bp, mouse
gggagcgtttcacacttagt

SEQ ID NO: 809150 - DNA, 20 bp, mouse
ggggctgtttctagctctgg

SEQ ID NO: 809151 - DNA, 20 bp, mouse
gacatcccacccaaatcggg

SEQ ID NO: 809152 - DNA, 20 bp, mouse
gctgggaacatgaagtctgg

SEQ ID NO: 809153 - DNA, 20 bp, mouse
gaagtgtgaaacgctcccgc

SEQ ID NO: 809154 - DNA, 20 bp, mouse
gctgtctcctggcatcctgc

SEQ ID NO: 809155 - DNA, 20 bp, mouse
ggggtcagagagttaagata

SEQ ID NO: 809156 - DNA, 20 bp, mouse
gacggctcgtagcctggaag

SEQ ID NO: 809157 - DNA, 20 bp, mouse
ggggtgggagcttcggacct

SEQ ID NO: 809158 - DNA, 20 bp, mouse
gctactccaagtgtgcctac

SEQ ID NO: 809159 - DNA, 20 bp, mouse
gttaggtccaccctctgcga

SEQ ID NO: 809160 - DNA, 20 bp, mouse
gaggctacgagccgtcgcag

SEQ ID NO: 809161 - DNA, 20 bp, mouse
ggggagcttcggacctcggc

SEQ ID NO: 809162 - DNA, 20 bp, mouse
gctggcatatgtcacctggg

SEQ ID NO: 809163 - DNA, 20 bp, mouse
ggaagccaaggccattccct

SEQ ID NO: 809164 - DNA, 20 bp, mouse
gtacgagccgtcgcagaggg

SEQ ID NO: 809165 - DNA, 20 bp, mouse
gcagtctggcatatgtcacc

SEQ ID NO: 809166 - DNA, 20 bp, mouse
gaggaaggagctgttgccag

SEQ ID NO: 809167 - DNA, 20 bp, mouse
gaaggagctgttgccagggg

SEQ ID NO: 809168 - DNA, 20 bp, mouse
ggtctccagccggtctcttg

SEQ ID NO: 809169 - DNA, 20 bp, mouse
gacggcctttcccctaaagt

SEQ ID NO: 809170 - DNA, 20 bp, mouse
ggctgcctcccgttgatgtc

SEQ ID NO: 809171 - DNA, 20 bp, mouse
ggaactcctgtcataatcaa

SEQ ID NO: 809172 - DNA, 20 bp, mouse
gcaggccaactttaggggaa

SEQ ID NO: 809173 - DNA, 20 bp, mouse
gaccctaggcaggtagaaaa

SEQ ID NO: 809174 - DNA, 20 bp, mouse
ggatcaggacccatgcaccc

SEQ ID NO: 809175 - DNA, 20 bp, mouse
ggtagaaaagggaaaatcca

SEQ ID NO: 809176 - DNA, 20 bp, mouse
gaacccccaacggcagggtg

SEQ ID NO: 809177 - DNA, 20 bp, mouse
ggaggcaaaggccagacaga

SEQ ID NO: 809178 - DNA, 20 bp, mouse
ggaaagttcaaggaaggtat

SEQ ID NO: 809179 - DNA, 20 bp, mouse
gaagggagggagggtctcaa

SEQ ID NO: 809180 - DNA, 20 bp, mouse
gagaatgaggttactcaggc

SEQ ID NO: 809181 - DNA, 20 bp, mouse
gcagtgtgatggcggtttgt

SEQ ID NO: 809182 - DNA, 20 bp, mouse
gtctcaatggagatggagaa

SEQ ID NO: 809183 - DNA, 20 bp, mouse
gagcgagaatgaggttactc

SEQ ID NO: 809184 - DNA, 20 bp, mouse
ggggagggtctcaatggaga

SEQ ID NO: 809185 - DNA, 20 bp, mouse
gaatcttgaaagttcaagga

SEQ ID NO: 809186 - DNA, 20 bp, mouse
gtggggagctaccaccgcaa

SEQ ID NO: 809187 - DNA, 20 bp, mouse
gcaggggcggggcatgccgg

SEQ ID NO: 809188 - DNA, 20 bp, mouse
gcgggggcgggttggaagga

SEQ ID NO: 809189 - DNA, 20 bp, mouse
gtaccaccgcaaaggatgat

SEQ ID NO: 809190 - DNA, 20 bp, mouse
ggacgcagaaacctgggaga

SEQ ID NO: 809191 - DNA, 20 bp, mouse
gtacagggagaaaaccatta

SEQ ID NO: 809192 - DNA, 20 bp, mouse
gtaaaccgacgcagaaacct

SEQ ID NO: 809193 - DNA, 20 bp, mouse
gggctggctcacgtaactga

SEQ ID NO: 809194 - DNA, 20 bp, mouse
ggctgtgtcggctttagaac

SEQ ID NO: 809195 - DNA, 20 bp, mouse
gctggctgatccagactaca

SEQ ID NO: 809196 - DNA, 20 bp, mouse
gacagggtaccagggagaaa

SEQ ID NO: 809197 - DNA, 20 bp, mouse
ggcctgcgcccgttctggga

SEQ ID NO: 809198 - DNA, 20 bp, mouse
ggctccgccaaggtcggcga

SEQ ID NO: 809199 - DNA, 20 bp, mouse
gcagagcctgcgcccgttct

SEQ ID NO: 809200 - DNA, 20 bp, mouse
gtgtgtgcatacatcctgac

SEQ ID NO: 809201 - DNA, 20 bp, mouse
gtggctgcgcatgcgcattc

SEQ ID NO: 809202 - DNA, 20 bp, mouse
gcgcagtggggagcagttcg

SEQ ID NO: 809203 - DNA, 20 bp, mouse
gctgccaagagcaacaatta

SEQ ID NO: 809204 - DNA, 20 bp, mouse
gtacatcctgacagggtacc

SEQ ID NO: 809205 - DNA, 20 bp, mouse
gcaaggtcggcgagggaagc

SEQ ID NO: 809206 - DNA, 20 bp, mouse
gtcagcggagcggagataaa

SEQ ID NO: 809207 - DNA, 20 bp, mouse
ggaggcgggaataatctctg

SEQ ID NO: 809208 - DNA, 20 bp, mouse
gccgctccgctgatagccgg

SEQ ID NO: 809209 - DNA, 20 bp, mouse
ggtcagccaccggctatcag

SEQ ID NO: 809210 - DNA, 20 bp, mouse
ggggtggctgaacccaaggg

SEQ ID NO: 809211 - DNA, 20 bp, mouse
gccgaggaagcagaatgaaa

SEQ ID NO: 809212 - DNA, 20 bp, mouse
gcctcggagccgaatgaagc

SEQ ID NO: 809213 - DNA, 20 bp, mouse
gcaggattagagtcagccac

SEQ ID NO: 809214 - DNA, 20 bp, mouse
gcctccagcgtgcctgggag

SEQ ID NO: 809215 - DNA, 20 bp, mouse
gagccgaatgaagcagggag

SEQ ID NO: 809216 - DNA, 20 bp, mouse
gggagtgtggaactgtgatg

SEQ ID NO: 809217 - DNA, 20 bp, mouse
gagggagggcgggaacgcag

SEQ ID NO: 809218 - DNA, 20 bp, mouse
gaggtcagcccctctgggat

SEQ ID NO: 809219 - DNA, 20 bp, mouse
gcctcgtgcacattcctccc

SEQ ID NO: 809220 - DNA, 20 bp, mouse
gggggactccccatcccaga

SEQ ID NO: 809221 - DNA, 20 bp, mouse
gaggctgaggtcagcccctc

SEQ ID NO: 809222 - DNA, 20 bp, mouse
ggatgtggctggttgagggg

SEQ ID NO: 809223 - DNA, 20 bp, mouse
gtgtggaactgtgatgtggc

SEQ ID NO: 809224 - DNA, 20 bp, mouse
ggaggaatgtgcacgaggga

SEQ ID NO: 809225 - DNA, 20 bp, mouse
ggagtgggatggggaagccg

SEQ ID NO: 809226 - DNA, 20 bp, mouse
gtggcccgccgcatctgcac

SEQ ID NO: 809227 - DNA, 20 bp, mouse
ggcggcccgtgcagatgcgg

SEQ ID NO: 809228 - DNA, 20 bp, mouse
ggagcctgagggcggagcac

SEQ ID NO: 809229 - DNA, 20 bp, mouse
ggcggcggcccgtgcagatg

SEQ ID NO: 809230 - DNA, 20 bp, mouse
gcagatgcggcgggccacgc

SEQ ID NO: 809231 - DNA, 20 bp, mouse
ggaggcgcgcatagcaaaac

SEQ ID NO: 809232 - DNA, 20 bp, mouse
gcggccaggcgctccctggg

SEQ ID NO: 809233 - DNA, 20 bp, mouse
gcccgcggccaggcgctccc

SEQ ID NO: 809234 - DNA, 20 bp, mouse
gcacaggctggcctgggcgc

SEQ ID NO: 809235 - DNA, 20 bp, mouse
gccggctgggcggtgcgccc

SEQ ID NO: 809236 - DNA, 20 bp, mouse
gcacgctccaagcaggaggg

SEQ ID NO: 809237 - DNA, 20 bp, mouse
gcagcgagcgtggtgaggaa

SEQ ID NO: 809238 - DNA, 20 bp, mouse
ggcccagacgaagacgtcac

SEQ ID NO: 809239 - DNA, 20 bp, mouse
gggcctaagcgccaactggt

SEQ ID NO: 809240 - DNA, 20 bp, mouse
gtaggccagcgagcgtggtg

SEQ ID NO: 809241 - DNA, 20 bp, mouse
gaggcacgctccaagcagga

SEQ ID NO: 809242 - DNA, 20 bp, mouse
gggacagcgcggccgagaca

SEQ ID NO: 809243 - DNA, 20 bp, mouse
gtgaagggagaggtaatccc

SEQ ID NO: 809244 - DNA, 20 bp, mouse
ggaaagaaggagtctctccc

SEQ ID NO: 809245 - DNA, 20 bp, mouse
gtaaaagccgccctcctgct

SEQ ID NO: 809246 - DNA, 20 bp, mouse
ggtgcctcgccgcatctccc

SEQ ID NO: 809247 - DNA, 20 bp, mouse
ggagatgcggcgaggcacgt

SEQ ID NO: 809248 - DNA, 20 bp, mouse
gggtcagagccggggagatg

SEQ ID NO: 809249 - DNA, 20 bp, mouse
gtgacccgcccgccaggcaa

SEQ ID NO: 809250 - DNA, 20 bp, mouse
gggtcctcaccctgtcgggg

SEQ ID NO: 809251 - DNA, 20 bp, mouse
gagacaggtcctcaccctgt

SEQ ID NO: 809252 - DNA, 20 bp, mouse
gtggcgggcgggtcagagcc

SEQ ID NO: 809253 - DNA, 20 bp, mouse
gaggacctgtctcccttgcc

SEQ ID NO: 809254 - DNA, 20 bp, mouse
gttacaggaaagttcaggca

SEQ ID NO: 809255 - DNA, 20 bp, mouse
gtgagcccgcgcgcgtttct

SEQ ID NO: 809256 - DNA, 20 bp, mouse
gctccggggcgggaccctcc

SEQ ID NO: 809257 - DNA, 20 bp, mouse
gggcagggctcagggttccc

SEQ ID NO: 809258 - DNA, 20 bp, mouse
gagggtcccgccccggaggt

SEQ ID NO: 809259 - DNA, 20 bp, mouse
gagccctgcccgcggacagg

SEQ ID NO: 809260 - DNA, 20 bp, mouse
gcccccgctccacctgtccg

SEQ ID NO: 809261 - DNA, 20 bp, mouse
gagaccgagcggggctgcgc

SEQ ID NO: 809262 - DNA, 20 bp, mouse
gcggtgggcaacccgcgcca

SEQ ID NO: 809263 - DNA, 20 bp, mouse
gcgagcgcagcgtagagcca

SEQ ID NO: 809264 - DNA, 20 bp, mouse
gggccgggagggtcccgccc

SEQ ID NO: 809265 - DNA, 20 bp, mouse
gttgcctggctgtctgacta

SEQ ID NO: 809266 - DNA, 20 bp, mouse
ggggtcagagtctcccaagg

SEQ ID NO: 809267 - DNA, 20 bp, mouse
ggaaactgcaggtagatggc

SEQ ID NO: 809268 - DNA, 20 bp, mouse
gaactggcctgctccccctt

SEQ ID NO: 809269 - DNA, 20 bp, mouse
gtagctgcacgggcattgag

SEQ ID NO: 809270 - DNA, 20 bp, mouse
gaggtggccggagaaactgc

SEQ ID NO: 809271 - DNA, 20 bp, mouse
gaagggataacctgagagag

SEQ ID NO: 809272 - DNA, 20 bp, mouse
gcaatgcccgtgcagctaac

SEQ ID NO: 809273 - DNA, 20 bp, mouse
ggggcattgagcgggccggc

SEQ ID NO: 809274 - DNA, 20 bp, mouse
gggagccactgccttataag

SEQ ID NO: 809275 - DNA, 20 bp, mouse
gataacctgagagagaggtc

SEQ ID NO: 809276 - DNA, 20 bp, mouse
ggggctggttagactggaag

SEQ ID NO: 809277 - DNA, 20 bp, mouse
gtggtgtgcgggagaaacaa

SEQ ID NO: 809278 - DNA, 20 bp, mouse
gcaagaggagtctgcagctt

SEQ ID NO: 809279 - DNA, 20 bp, mouse
gaacaagggcatcactgaac

SEQ ID NO: 809280 - DNA, 20 bp, mouse
gttagactggaagtggtgtg

SEQ ID NO: 809281 - DNA, 20 bp, mouse
ggtcgggaggtctcagtatg

SEQ ID NO: 809282 - DNA, 20 bp, mouse
gagggcatcactgaactggc

SEQ ID NO: 809283 - DNA, 20 bp, mouse
gaggtctcagtatgtggcag

SEQ ID NO: 809284 - DNA, 20 bp, mouse
gcggggagactggtggagtg

SEQ ID NO: 809285 - DNA, 20 bp, mouse
gcagcttgggctggttagac

SEQ ID NO: 809286 - DNA, 20 bp, mouse
ggaccgcggagcagtggcag

SEQ ID NO: 809287 - DNA, 20 bp, mouse
gggactgtatgtgatacagt

SEQ ID NO: 809288 - DNA, 20 bp, mouse
gggaggccctggcccgacgt

SEQ ID NO: 809289 - DNA, 20 bp, mouse
gtgctccgcggtcccctagc

SEQ ID NO: 809290 - DNA, 20 bp, mouse
gctccgctgccactgctccg

SEQ ID NO: 809291 - DNA, 20 bp, mouse
ggaatccggctaggggaccg

SEQ ID NO: 809292 - DNA, 20 bp, mouse
gtgtccaaaggcgccttcct

SEQ ID NO: 809293 - DNA, 20 bp, mouse
ggagccgaggaaggcgcctt

SEQ ID NO: 809294 - DNA, 20 bp, mouse
gggtgcagcacagtggactt

SEQ ID NO: 809295 - DNA, 20 bp, mouse
gaatacgatgctacccacgt

SEQ ID NO: 809296 - DNA, 20 bp, mouse
ggcagggaaggtggtcacgt

SEQ ID NO: 809297 - DNA, 20 bp, mouse
ggcgcggagcaggaagtcga

SEQ ID NO: 809298 - DNA, 20 bp, mouse
ggagcaggaagtcgacgggt

SEQ ID NO: 809299 - DNA, 20 bp, mouse
gccgcgctctcgccgcaggg

SEQ ID NO: 809300 - DNA, 20 bp, mouse
gacgtgggccgccgcaccgt

SEQ ID NO: 809301 - DNA, 20 bp, mouse
ggggctttcacccgcagcac

SEQ ID NO: 809302 - DNA, 20 bp, mouse
gccgacttggggcactgggg

SEQ ID NO: 809303 - DNA, 20 bp, mouse
gttcccgggagccggaagga

SEQ ID NO: 809304 - DNA, 20 bp, mouse
gcctgggcgctgaagtacga

SEQ ID NO: 809305 - DNA, 20 bp, mouse
gggtaggcgggcctcctagc

SEQ ID NO: 809306 - DNA, 20 bp, mouse
ggagctgcaagagtcgtaaa

SEQ ID NO: 809307 - DNA, 20 bp, mouse
gtcgacggaaagttaggggc

SEQ ID NO: 809308 - DNA, 20 bp, mouse
gacccgctgccttgcttacc

SEQ ID NO: 809309 - DNA, 20 bp, mouse
gtctgcgccacagcggccgg

SEQ ID NO: 809310 - DNA, 20 bp, mouse
gtgccgggtaagcaaggcag

SEQ ID NO: 809311 - DNA, 20 bp, mouse
gacagcgctaggggcagtgg

SEQ ID NO: 809312 - DNA, 20 bp, mouse
ggggacgcgaaggcccgccc

SEQ ID NO: 809313 - DNA, 20 bp, mouse
gcgggatgggctctctggaa

SEQ ID NO: 809314 - DNA, 20 bp, mouse
gcctgacgtcaaggggttgg

SEQ ID NO: 809315 - DNA, 20 bp, mouse
gcccgcctccggagcagaac

SEQ ID NO: 809316 - DNA, 20 bp, mouse
gctggggtaggtgaagacag

SEQ ID NO: 809317 - DNA, 20 bp, mouse
gggagcaggagaaaaagact

SEQ ID NO: 809318 - DNA, 20 bp, mouse
ggtaggtgaagacaggggcg

SEQ ID NO: 809319 - DNA, 20 bp, mouse
gggcggggcgcgggagggca

SEQ ID NO: 809320 - DNA, 20 bp, mouse
gaggtggtggaaggtaaatg

SEQ ID NO: 809321 - DNA, 20 bp, mouse
gaagggagggaagagacggg

SEQ ID NO: 809322 - DNA, 20 bp, mouse
ggagggagttggatgaaaag

SEQ ID NO: 809323 - DNA, 20 bp, mouse
gacacgggggaagaggacga

SEQ ID NO: 809324 - DNA, 20 bp, mouse
gccccatggtccagacccca

SEQ ID NO: 809325 - DNA, 20 bp, mouse
gggtggaaggtaaatgggga

SEQ ID NO: 809326 - DNA, 20 bp, mouse
gcctctccaagccacctctc

SEQ ID NO: 809327 - DNA, 20 bp, mouse
gcaagcgcaccagctgaccc

SEQ ID NO: 809328 - DNA, 20 bp, mouse
gtggttatttgtggtgtctg

SEQ ID NO: 809329 - DNA, 20 bp, mouse
ggtgctgggcagccagcaaa

SEQ ID NO: 809330 - DNA, 20 bp, mouse
gaggggaagcctgggtcagc

SEQ ID NO: 809331 - DNA, 20 bp, mouse
ggccagcaaaggggaagcct

SEQ ID NO: 809332 - DNA, 20 bp, mouse
ggactctgctctctgcgatg

SEQ ID NO: 809333 - DNA, 20 bp, mouse
gggggcagtatgcttagaca

SEQ ID NO: 809334 - DNA, 20 bp, mouse
gacccaggcttcccctttgc

SEQ ID NO: 809335 - DNA, 20 bp, mouse
ggatcttgagctatagacag

SEQ ID NO: 809336 - DNA, 20 bp, mouse
gctccgcctacacctgggta

SEQ ID NO: 809337 - DNA, 20 bp, mouse
ggcggagctaggacaggtgt

SEQ ID NO: 809338 - DNA, 20 bp, mouse
gcccaggtgtaggcggagct

SEQ ID NO: 809339 - DNA, 20 bp, mouse
gggccctacccaggtgtagg

SEQ ID NO: 809340 - DNA, 20 bp, mouse
ggaaggatggaaacgttcct

SEQ ID NO: 809341 - DNA, 20 bp, mouse
ggctaggacaggtgtaggtg

SEQ ID NO: 809342 - DNA, 20 bp, mouse
ggtgtaggcggagctaggac

SEQ ID NO: 809343 - DNA, 20 bp, mouse
gaatgaaaattgagtggagg

SEQ ID NO: 809344 - DNA, 20 bp, mouse
gatggctcagtgagtataag

SEQ ID NO: 809345 - DNA, 20 bp, mouse
ggcaactgctacaaattcac

SEQ ID NO: 809346 - DNA, 20 bp, mouse
gaggggacgccaggagccgt

SEQ ID NO: 809347 - DNA, 20 bp, mouse
gaccgcgtgcgccctaaaac

SEQ ID NO: 809348 - DNA, 20 bp, mouse
gtggtgggggtcgcaaagga

SEQ ID NO: 809349 - DNA, 20 bp, mouse
gcgagcatctcccacaaatc

SEQ ID NO: 809350 - DNA, 20 bp, mouse
gaggaccaaagcagatccgt

SEQ ID NO: 809351 - DNA, 20 bp, mouse
ggggagatgctcgaggccca

SEQ ID NO: 809352 - DNA, 20 bp, mouse
gctggcgtcccctttcttcc

SEQ ID NO: 809353 - DNA, 20 bp, mouse
gcgggtctattgtgcgtggt

SEQ ID NO: 809354 - DNA, 20 bp, mouse
gtgcgtggtgggggtcgcaa

SEQ ID NO: 809355 - DNA, 20 bp, mouse
gaaatcgggtctattgtgcg

SEQ ID NO: 809356 - DNA, 20 bp, mouse
gggcacaaatagaactcctg

SEQ ID NO: 809357 - DNA, 20 bp, mouse
ggccccctggggagtgtttg

SEQ ID NO: 809358 - DNA, 20 bp, mouse
gggcctgggaaggtcagggg

SEQ ID NO: 809359 - DNA, 20 bp, mouse
gcacgcgggaggggcggagt

SEQ ID NO: 809360 - DNA, 20 bp, mouse
gtgagcgggcccagagctcg

SEQ ID NO: 809361 - DNA, 20 bp, mouse
gggacccccaaacactcccc

SEQ ID NO: 809362 - DNA, 20 bp, mouse
gcgggaagaggcggggctag

SEQ ID NO: 809363 - DNA, 20 bp, mouse
gggtgtgtagagagccccct

SEQ ID NO: 809364 - DNA, 20 bp, mouse
gagctcggggcggggagcac

SEQ ID NO: 809365 - DNA, 20 bp, mouse
gcccccaaacactccccagg

SEQ ID NO: 809366 - DNA, 20 bp, mouse
gaggggccggagttctgcta

SEQ ID NO: 809367 - DNA, 20 bp, mouse
gtcgccccctagcagaactc

SEQ ID NO: 809368 - DNA, 20 bp, mouse
ggcttgcgagctatggggat

SEQ ID NO: 809369 - DNA, 20 bp, mouse
gggcgcttcacccgccagcc

SEQ ID NO: 809370 - DNA, 20 bp, mouse
gctcccgctctcctccgggc

SEQ ID NO: 809371 - DNA, 20 bp, mouse
gcgccagcccggaggagagc

SEQ ID NO: 809372 - DNA, 20 bp, mouse
ggagagcgggagagcgcgag

SEQ ID NO: 809373 - DNA, 20 bp, mouse
gccccatagctcgcaagcta

SEQ ID NO: 809374 - DNA, 20 bp, mouse
gtctgctagggggcgaaatc

SEQ ID NO: 809375 - DNA, 20 bp, mouse
gttggggtcggtttgagatg

SEQ ID NO: 809376 - DNA, 20 bp, mouse
gccgacccgaaggagagctg

SEQ ID NO: 809377 - DNA, 20 bp, mouse
gggcgtctcctccgacccga

SEQ ID NO: 809378 - DNA, 20 bp, mouse
ggcggagccaagtcccggac

SEQ ID NO: 809379 - DNA, 20 bp, mouse
gagctgtggtgtgtgcgcga

SEQ ID NO: 809380 - DNA, 20 bp, mouse
gcgcacccgggaggtcccag

SEQ ID NO: 809381 - DNA, 20 bp, mouse
ggtggtgtgtgcgcgaggga

SEQ ID NO: 809382 - DNA, 20 bp, mouse
gggaggggaattgaagtgat

SEQ ID NO: 809383 - DNA, 20 bp, mouse
ggtgagcgagccaaaggaaa

SEQ ID NO: 809384 - DNA, 20 bp, mouse
ggcccccgctgggacctccc

SEQ ID NO: 809385 - DNA, 20 bp, mouse
gcggaggagacgccagccca

SEQ ID NO: 809386 - DNA, 20 bp, mouse
gaaactgaggccaaggatgg

SEQ ID NO: 809387 - DNA, 20 bp, mouse
gcccagctcagtgcgggagt

SEQ ID NO: 809388 - DNA, 20 bp, mouse
ggagcggagcacggacggga

SEQ ID NO: 809389 - DNA, 20 bp, mouse
gggggcgcctccaccatcct

SEQ ID NO: 809390 - DNA, 20 bp, mouse
gaacccggagcagaccacca

SEQ ID NO: 809391 - DNA, 20 bp, mouse
gagctcagtgcgggagtcgg

SEQ ID NO: 809392 - DNA, 20 bp, mouse
gccaccccagtagagagaag

SEQ ID NO: 809393 - DNA, 20 bp, mouse
gggcatctccagtataccgt

SEQ ID NO: 809394 - DNA, 20 bp, mouse
gccaaggagcggagcacgga

SEQ ID NO: 809395 - DNA, 20 bp, mouse
gtccatgaggttcctgtgtg

SEQ ID NO: 809396 - DNA, 20 bp, mouse
gtcctggaatctggtgtcat

SEQ ID NO: 809397 - DNA, 20 bp, mouse
ggggactgtagcatggggtt

SEQ ID NO: 809398 - DNA, 20 bp, mouse
gaggtcagcctcctggaatc

SEQ ID NO: 809399 - DNA, 20 bp, mouse
ggcccccagcccatcacggg

SEQ ID NO: 809400 - DNA, 20 bp, mouse
gggtgtcatggggcgggtac

SEQ ID NO: 809401 - DNA, 20 bp, mouse
gctgtagcatggggttagga

SEQ ID NO: 809402 - DNA, 20 bp, mouse
gccccatgacaccagattcc

SEQ ID NO: 809403 - DNA, 20 bp, mouse
gtaggatggccgcagtgcag

SEQ ID NO: 809404 - DNA, 20 bp, mouse
gatggactgggaccgtggac

SEQ ID NO: 809405 - DNA, 20 bp, mouse
ggggtacagggggacagcac

SEQ ID NO: 809406 - DNA, 20 bp, mouse
gcacccagagctaaacggag

SEQ ID NO: 809407 - DNA, 20 bp, mouse
ggggcggcgggcccgagagg

SEQ ID NO: 809408 - DNA, 20 bp, mouse
ggggtcgcctaagtcgttga

SEQ ID NO: 809409 - DNA, 20 bp, mouse
gccgccgcttagtattccat

SEQ ID NO: 809410 - DNA, 20 bp, mouse
gtctcgggcccgccgcccaa

SEQ ID NO: 809411 - DNA, 20 bp, mouse
gcgcccaatggaatactaag

SEQ ID NO: 809412 - DNA, 20 bp, mouse
gagaagtgtcacaatcagga

SEQ ID NO: 809413 - DNA, 20 bp, mouse
gaccagagtcaggcacgaga

SEQ ID NO: 809414 - DNA, 20 bp, mouse
gaggaggggcgccgagcgca

SEQ ID NO: 809415 - DNA, 20 bp, mouse
gcacgagatggaaagaccca

SEQ ID NO: 809416 - DNA, 20 bp, mouse
gccaactggcccaaactggt

SEQ ID NO: 809417 - DNA, 20 bp, mouse
gagtgacagacagtgacagc

SEQ ID NO: 809418 - DNA, 20 bp, mouse
gaggagtctgcctgcaacaa

SEQ ID NO: 809419 - DNA, 20 bp, mouse
ggcagccatggtcctgtcta

SEQ ID NO: 809420 - DNA, 20 bp, mouse
gcagaagaccctatggggtg

SEQ ID NO: 809421 - DNA, 20 bp, mouse
gtgcctgctggtgtgacccc

SEQ ID NO: 809422 - DNA, 20 bp, mouse
gggcagcacaccaaccagtt

SEQ ID NO: 809423 - DNA, 20 bp, mouse
gctctccaactggcccaaac

SEQ ID NO: 809424 - DNA, 20 bp, mouse
gtaggtctgggacactcagt

SEQ ID NO: 809425 - DNA, 20 bp, mouse
gccagacctaggcaggagag

SEQ ID NO: 809426 - DNA, 20 bp, mouse
gggcaccgctggagaccgtg

SEQ ID NO: 809427 - DNA, 20 bp, mouse
ggacgctctgggtgcgtgat

SEQ ID NO: 809428 - DNA, 20 bp, mouse
ggtgcccgaggcgccagggg

SEQ ID NO: 809429 - DNA, 20 bp, mouse
gcgaggcgccaggggaggtc

SEQ ID NO: 809430 - DNA, 20 bp, mouse
gctctgaggcgcacccctaa

SEQ ID NO: 809431 - DNA, 20 bp, mouse
ggctggagaccgtgtggctt

SEQ ID NO: 809432 - DNA, 20 bp, mouse
gtaggcgcacccctcctctg

SEQ ID NO: 809433 - DNA, 20 bp, mouse
ggcagctcggccctcctcct

SEQ ID NO: 809434 - DNA, 20 bp, mouse
gcggacgcgtgtgtttgcgt

SEQ ID NO: 809435 - DNA, 20 bp, mouse
gtggtcagccagacctcccc

SEQ ID NO: 809436 - DNA, 20 bp, mouse
gcgcacgcgggcaactccac

SEQ ID NO: 809437 - DNA, 20 bp, mouse
ggggaggtctaagatgtgtg

SEQ ID NO: 809438 - DNA, 20 bp, mouse
gccccagccagcagccttct

SEQ ID NO: 809439 - DNA, 20 bp, mouse
gttcctctgtggaggagaga

SEQ ID NO: 809440 - DNA, 20 bp, mouse
gagcaatcgtggggcgttgt

SEQ ID NO: 809441 - DNA, 20 bp, mouse
gttacgaagagcagacaaag

SEQ ID NO: 809442 - DNA, 20 bp, mouse
gctcaggcagagcaatcgtg

SEQ ID NO: 809443 - DNA, 20 bp, mouse
gagaacctagcgccaggagg

SEQ ID NO: 809444 - DNA, 20 bp, mouse
gaagctagaaaaggctgcga

SEQ ID NO: 809445 - DNA, 20 bp, mouse
ggcggtcaccgcacaagcaa

SEQ ID NO: 809446 - DNA, 20 bp, mouse
ggcgaggcccgagacgtgga

SEQ ID NO: 809447 - DNA, 20 bp, mouse
gacagcgggtcaaggagccg

SEQ ID NO: 809448 - DNA, 20 bp, mouse
ggggcctcgccacctcgcgc

SEQ ID NO: 809449 - DNA, 20 bp, mouse
gcccagtctgacagggtgac

SEQ ID NO: 809450 - DNA, 20 bp, mouse
gaacgctccctccacgtctc

SEQ ID NO: 809451 - DNA, 20 bp, mouse
gaggtcaaagagcgagctac

SEQ ID NO: 809452 - DNA, 20 bp, mouse
gaacggaaccagatgacagc

SEQ ID NO: 809453 - DNA, 20 bp, mouse
ggcaaagcccgggaacctcc

SEQ ID NO: 809454 - DNA, 20 bp, mouse
ggagcgagctacaggctcgc

SEQ ID NO: 809455 - DNA, 20 bp, mouse
gcgcccgccaaacggtcttc

SEQ ID NO: 809456 - DNA, 20 bp, mouse
gcggaagaaggtgacgtcaa

SEQ ID NO: 809457 - DNA, 20 bp, mouse
gccagtcaggagtcgatctc

SEQ ID NO: 809458 - DNA, 20 bp, mouse
gtagcaacaggaagcgggac

SEQ ID NO: 809459 - DNA, 20 bp, mouse
gcggaggccgctttcccgtt

SEQ ID NO: 809460 - DNA, 20 bp, mouse
gaggccgctttcccgttggg

SEQ ID NO: 809461 - DNA, 20 bp, mouse
gggagagcgggctcttgcgc

SEQ ID NO: 809462 - DNA, 20 bp, mouse
ggcgcatgctcagactccgg

SEQ ID NO: 809463 - DNA, 20 bp, mouse
gcaagcaacccgacagtgga

SEQ ID NO: 809464 - DNA, 20 bp, mouse
gccgcgcctgatcctggcta

SEQ ID NO: 809465 - DNA, 20 bp, mouse
gggtctgactggcagaccga

SEQ ID NO: 809466 - DNA, 20 bp, mouse
gaagccaggcgactgtgcgc

SEQ ID NO: 809467 - DNA, 20 bp, mouse
ggccgcgtgtggcagtccca

SEQ ID NO: 809468 - DNA, 20 bp, mouse
gtccgcgtagagctcgaggg

SEQ ID NO: 809469 - DNA, 20 bp, mouse
gcccgccctcgagctctacg

SEQ ID NO: 809470 - DNA, 20 bp, mouse
gcggctccgcgtagagctcg

SEQ ID NO: 809471 - DNA, 20 bp, mouse
gggcctagacgcgctgaggt

SEQ ID NO: 809472 - DNA, 20 bp, mouse
ggagcctgcgcacagtcgcc

SEQ ID NO: 809473 - DNA, 20 bp, mouse
gtagacgcgctgaggtaggc

SEQ ID NO: 809474 - DNA, 20 bp, mouse
ggaggctaggcgcgacacgc

SEQ ID NO: 809475 - DNA, 20 bp, mouse
gcgagggcgggaccgtccgg

SEQ ID NO: 809476 - DNA, 20 bp, mouse
gatctgcaagggcaggtatg

SEQ ID NO: 809477 - DNA, 20 bp, mouse
ggtccagagcaggaatgtga

SEQ ID NO: 809478 - DNA, 20 bp, mouse
gggcccaggcgccacaaagc

SEQ ID NO: 809479 - DNA, 20 bp, mouse
gtaaagtcctggatctgcaa

SEQ ID NO: 809480 - DNA, 20 bp, mouse
gcttgaggacagctgatgac

SEQ ID NO: 809481 - DNA, 20 bp, mouse
gacagctgatgaccggaagt

SEQ ID NO: 809482 - DNA, 20 bp, mouse
gcaggaatgtgagggctcag

SEQ ID NO: 809483 - DNA, 20 bp, mouse
gtgtgcgaagagcgtgacta

SEQ ID NO: 809484 - DNA, 20 bp, mouse
gtcttcgcacaaggcgtggg

SEQ ID NO: 809485 - DNA, 20 bp, mouse
gtctggcggaagggcaagga

SEQ ID NO: 809486 - DNA, 20 bp, mouse
ggggcgagcagggacccgaa

SEQ ID NO: 809487 - DNA, 20 bp, mouse
ggggttcggccgagcccgga

SEQ ID NO: 809488 - DNA, 20 bp, mouse
gtcggccgaacccgagccgg

SEQ ID NO: 809489 - DNA, 20 bp, mouse
gggacgacagcccccggctc

SEQ ID NO: 809490 - DNA, 20 bp, mouse
gccggcaggacgacagcccc

SEQ ID NO: 809491 - DNA, 20 bp, mouse
gttcggccgagcccggaggg

SEQ ID NO: 809492 - DNA, 20 bp, mouse
gtccctgctcgcccccctcc

SEQ ID NO: 809493 - DNA, 20 bp, mouse
gcgggcccggaggccggtgg

SEQ ID NO: 809494 - DNA, 20 bp, mouse
gaaggccaccccaggccggc

SEQ ID NO: 809495 - DNA, 20 bp, mouse
ggagagaggctctggggcgg

SEQ ID NO: 809496 - DNA, 20 bp, mouse
gtaccccacgagggtcccta

SEQ ID NO: 809497 - DNA, 20 bp, mouse
gtaaccaacgacagaacgat

SEQ ID NO: 809498 - DNA, 20 bp, mouse
ggacccctcgggctggggaa

SEQ ID NO: 809499 - DNA, 20 bp, mouse
ggcccaggaagcgctacctc

SEQ ID NO: 809500 - DNA, 20 bp, mouse
ggaagcgctacctctggcag

SEQ ID NO: 809501 - DNA, 20 bp, mouse
ggacagaacgataggctcgc

SEQ ID NO: 809502 - DNA, 20 bp, mouse
ggggaggggcaagggacttc

SEQ ID NO: 809503 - DNA, 20 bp, mouse
ggggcaagggacttccggtc

SEQ ID NO: 809504 - DNA, 20 bp, mouse
gaaggggacttaccccacga

SEQ ID NO: 809505 - DNA, 20 bp, mouse
ggagcctatcgttctgtcgt

SEQ ID NO: 809506 - DNA, 20 bp, mouse
ggggaggcggggccattcgg

SEQ ID NO: 809507 - DNA, 20 bp, mouse
gccctgccgtaaagtgaaga

SEQ ID NO: 809508 - DNA, 20 bp, mouse
gggccgggcggggctgtccg

SEQ ID NO: 809509 - DNA, 20 bp, mouse
gccagcagcgtcacgtgcgg

SEQ ID NO: 809510 - DNA, 20 bp, mouse
ggcacgtgacgctgctggag

SEQ ID NO: 809511 - DNA, 20 bp, mouse
gagtcctggcaggacgggga

SEQ ID NO: 809512 - DNA, 20 bp, mouse
ggcttggcagcagggggcgt

SEQ ID NO: 809513 - DNA, 20 bp, mouse
ggcagcgtcacgtgcggagg

SEQ ID NO: 809514 - DNA, 20 bp, mouse
gggcggggccattcggaggg

SEQ ID NO: 809515 - DNA, 20 bp, mouse
ggggccgcgtgagcggggtc

SEQ ID NO: 809516 - DNA, 20 bp, mouse
ggaaccgaaagggcgagaag

SEQ ID NO: 809517 - DNA, 20 bp, mouse
ggccgcgagcgaccgaggga

SEQ ID NO: 809518 - DNA, 20 bp, mouse
gcgctcctccggtggcgatg

SEQ ID NO: 809519 - DNA, 20 bp, mouse
ggcgagaagcggcctctctt

SEQ ID NO: 809520 - DNA, 20 bp, mouse
gcgtgcgcgtggtggccgag

SEQ ID NO: 809521 - DNA, 20 bp, mouse
gcggccgcgcgctcctccgg

SEQ ID NO: 809522 - DNA, 20 bp, mouse
gcaccactgtaccggaggat

SEQ ID NO: 809523 - DNA, 20 bp, mouse
gaggccgcttctcgcccttt

SEQ ID NO: 809524 - DNA, 20 bp, mouse
gcgcggccgcgagcgaccga

SEQ ID NO: 809525 - DNA, 20 bp, mouse
gccaatgaacaccactgtac

SEQ ID NO: 809526 - DNA, 20 bp, mouse
ggccgcgtggagctcggcct

SEQ ID NO: 809527 - DNA, 20 bp, mouse
gggcccgccgccttaaaggg

SEQ ID NO: 809528 - DNA, 20 bp, mouse
gagcgcggcggcccggttcc

SEQ ID NO: 809529 - DNA, 20 bp, mouse
gcaccggcccgccgccttaa

SEQ ID NO: 809530 - DNA, 20 bp, mouse
gccgccgccttaaagggagg

SEQ ID NO: 809531 - DNA, 20 bp, mouse
gccggtggccggagcgcctc

SEQ ID NO: 809532 - DNA, 20 bp, mouse
gggcgcggccctccgggaac

SEQ ID NO: 809533 - DNA, 20 bp, mouse
ggcggcggcccggttcccgg

SEQ ID NO: 809534 - DNA, 20 bp, mouse
gggaccctcacgcgcccggc

SEQ ID NO: 809535 - DNA, 20 bp, mouse
gggagggccgcgcccagcct

SEQ ID NO: 809536 - DNA, 20 bp, mouse
ggaaagctgagacagatcga

SEQ ID NO: 809537 - DNA, 20 bp, mouse
gcacgtgaaccccttgtaac

SEQ ID NO: 809538 - DNA, 20 bp, mouse
ggaggggacaagacacgcac

SEQ ID NO: 809539 - DNA, 20 bp, mouse
gcgttccaggccggttacaa

SEQ ID NO: 809540 - DNA, 20 bp, mouse
ggaaccccttgtaaccggcc

SEQ ID NO: 809541 - DNA, 20 bp, mouse
ggaccggttgtgcaagcaga

SEQ ID NO: 809542 - DNA, 20 bp, mouse
ggaagcccgcctctcggtac

SEQ ID NO: 809543 - DNA, 20 bp, mouse
gggttcacgtgatgatctcg

SEQ ID NO: 809544 - DNA, 20 bp, mouse
gaccaggttcccagggcgga

SEQ ID NO: 809545 - DNA, 20 bp, mouse
gtcggtacgggaatcgtcat

SEQ ID NO: 809546 - DNA, 20 bp, mouse
gaggtagagggcctatggac

SEQ ID NO: 809547 - DNA, 20 bp, mouse
gggaaagagggaggtcccga

SEQ ID NO: 809548 - DNA, 20 bp, mouse
gcactgccggggaaagaggg

SEQ ID NO: 809549 - DNA, 20 bp, mouse
ggggagggagggcgtcagca

SEQ ID NO: 809550 - DNA, 20 bp, mouse
gagggagggcgtcagcaggg

SEQ ID NO: 809551 - DNA, 20 bp, mouse
gtgccggcccatcactgccg

SEQ ID NO: 809552 - DNA, 20 bp, mouse
gttggaagcggcgaggtaga

SEQ ID NO: 809553 - DNA, 20 bp, mouse
gcggcgaggtagagggccta

SEQ ID NO: 809554 - DNA, 20 bp, mouse
gtgtgtgtgcgcagggatga

SEQ ID NO: 809555 - DNA, 20 bp, mouse
gtgagggtgattatacttgg

SEQ ID NO: 809556 - DNA, 20 bp, mouse
ggtgatcggaaactgttcag

SEQ ID NO: 809557 - DNA, 20 bp, mouse
gctgaggcagtacttactga

SEQ ID NO: 809558 - DNA, 20 bp, mouse
ggggagggagcaccgaactt

SEQ ID NO: 809559 - DNA, 20 bp, mouse
gagtacttactgagggaaga

SEQ ID NO: 809560 - DNA, 20 bp, mouse
gttgcaaggtcgcagcggga

SEQ ID NO: 809561 - DNA, 20 bp, mouse
gtggtacagtccagggtgga

SEQ ID NO: 809562 - DNA, 20 bp, mouse
gtgtaccattcttagattat

SEQ ID NO: 809563 - DNA, 20 bp, mouse
gttagcccttccttccaccc

SEQ ID NO: 809564 - DNA, 20 bp, mouse
ggagggcgaggtaaacaaca

SEQ ID NO: 809565 - DNA, 20 bp, mouse
ggactgcacctcagagggcg

SEQ ID NO: 809566 - DNA, 20 bp, mouse
gcatgcgcggaagtcgaagg

SEQ ID NO: 809567 - DNA, 20 bp, mouse
gaagaaaggggagttggatt

SEQ ID NO: 809568 - DNA, 20 bp, mouse
gcccaacaccacaagcactt

SEQ ID NO: 809569 - DNA, 20 bp, mouse
ggcgcatgcgcggaagtcga

SEQ ID NO: 809570 - DNA, 20 bp, mouse
gaagtcgaaggcggcgtctt

SEQ ID NO: 809571 - DNA, 20 bp, mouse
gctgcccggacggtacgggg

SEQ ID NO: 809572 - DNA, 20 bp, mouse
ggggcagcgcgttgcatcct

SEQ ID NO: 809573 - DNA, 20 bp, mouse
gaacactagtacttcaagag

SEQ ID NO: 809574 - DNA, 20 bp, mouse
gtggaatctgacacagtctg

SEQ ID NO: 809575 - DNA, 20 bp, mouse
gggccagaagaaaggggagt

SEQ ID NO: 809576 - DNA, 20 bp, mouse
ggacagagggagctgagttt

SEQ ID NO: 809577 - DNA, 20 bp, mouse
gaagctgtatataaggtggc

SEQ ID NO: 809578 - DNA, 20 bp, mouse
gggcgggaagagatgcatcg

SEQ ID NO: 809579 - DNA, 20 bp, mouse
ggaacggtgtcaaacaaagg

SEQ ID NO: 809580 - DNA, 20 bp, mouse
gggtggggcaggaagttgaa

SEQ ID NO: 809581 - DNA, 20 bp, mouse
gggggctgaagctgtatata

SEQ ID NO: 809582 - DNA, 20 bp, mouse
gtcggggcttatcaattcag

SEQ ID NO: 809583 - DNA, 20 bp, mouse
gattgcctggcatagacaga

SEQ ID NO: 809584 - DNA, 20 bp, mouse
gcggtgtcaaacaaaggggg

SEQ ID NO: 809585 - DNA, 20 bp, mouse
gcatcatcatggtgagaggt

SEQ ID NO: 809586 - DNA, 20 bp, mouse
gtactcctggggtaccgtgg

SEQ ID NO: 809587 - DNA, 20 bp, mouse
gggccacaagaggggtcctt

SEQ ID NO: 809588 - DNA, 20 bp, mouse
gagcccaaggacccctcttg

SEQ ID NO: 809589 - DNA, 20 bp, mouse
gaggggaagacgctactcct

SEQ ID NO: 809590 - DNA, 20 bp, mouse
ggacccctcttgtggcctct

SEQ ID NO: 809591 - DNA, 20 bp, mouse
gggaggtgggctctagtctt

SEQ ID NO: 809592 - DNA, 20 bp, mouse
ggggtcttgtgaagtggtga

SEQ ID NO: 809593 - DNA, 20 bp, mouse
gggatggaacccgaccagtg

SEQ ID NO: 809594 - DNA, 20 bp, mouse
gaattcatacgtgaagttgg

SEQ ID NO: 809595 - DNA, 20 bp, mouse
gtaccgtggagggtaaggcc

SEQ ID NO: 809596 - DNA, 20 bp, mouse
gaacgcgccagggactacca

SEQ ID NO: 809597 - DNA, 20 bp, mouse
gaggacccggagagcggctt

SEQ ID NO: 809598 - DNA, 20 bp, mouse
ggacgaaaagccaagtgtgt

SEQ ID NO: 809599 - DNA, 20 bp, mouse
gtgggcggggcctcgggccg

SEQ ID NO: 809600 - DNA, 20 bp, mouse
gtccgctcgggactcaatct

SEQ ID NO: 809601 - DNA, 20 bp, mouse
gcgcccggtggggcacaccc

SEQ ID NO: 809602 - DNA, 20 bp, mouse
gtctcccgggtgtgccccac

SEQ ID NO: 809603 - DNA, 20 bp, mouse
gaggccgccccgcccattaa

SEQ ID NO: 809604 - DNA, 20 bp, mouse
gtcctccaggcgtccggcca

SEQ ID NO: 809605 - DNA, 20 bp, mouse
ggcgccccgcagccgttaat

SEQ ID NO: 809606 - DNA, 20 bp, mouse
gcggcgcgggcgagcagatg

SEQ ID NO: 809607 - DNA, 20 bp, mouse
ggcgttcgtctgctcggctg

SEQ ID NO: 809608 - DNA, 20 bp, mouse
gtctctgcacccccgtcccg

SEQ ID NO: 809609 - DNA, 20 bp, mouse
gccgagcagacgaacgcagc

SEQ ID NO: 809610 - DNA, 20 bp, mouse
gacggaagaaagccacagga

SEQ ID NO: 809611 - DNA, 20 bp, mouse
ggagcagggcgcagccgcga

SEQ ID NO: 809612 - DNA, 20 bp, mouse
gctcccccgcgcctccctcg

SEQ ID NO: 809613 - DNA, 20 bp, mouse
gtgcgcggagccggcacctg

SEQ ID NO: 809614 - DNA, 20 bp, mouse
gggagtgtcgggcagtgtcc

SEQ ID NO: 809615 - DNA, 20 bp, mouse
ggcagctaatggtcgagtcc

SEQ ID NO: 809616 - DNA, 20 bp, mouse
gccagagagacagggatctc

SEQ ID NO: 809617 - DNA, 20 bp, mouse
gtattggggtcaagggctta

SEQ ID NO: 809618 - DNA, 20 bp, mouse
gtcttgaagagggagttgac

SEQ ID NO: 809619 - DNA, 20 bp, mouse
gtgccaggtattggggtcaa

SEQ ID NO: 809620 - DNA, 20 bp, mouse
gagcccttgaccccaatacc

SEQ ID NO: 809621 - DNA, 20 bp, mouse
gggaggaggctgggattctg

SEQ ID NO: 809622 - DNA, 20 bp, mouse
gtagaagctggcactgctat

SEQ ID NO: 809623 - DNA, 20 bp, mouse
gcaacttggagtcttgaaga

SEQ ID NO: 809624 - DNA, 20 bp, mouse
gaagctaaggctcatggact

SEQ ID NO: 809625 - DNA, 20 bp, mouse
gaggctcatggactgggaag

SEQ ID NO: 809626 - DNA, 20 bp, mouse
gggtggggccatctgtaggc

SEQ ID NO: 809627 - DNA, 20 bp, mouse
ggcttcacattagcttagtt

SEQ ID NO: 809628 - DNA, 20 bp, mouse
gtcttatgaccaaaaagcaa

SEQ ID NO: 809629 - DNA, 20 bp, mouse
gaactcaaactgatggtgct

SEQ ID NO: 809630 - DNA, 20 bp, mouse
gaagtaaaccctttgctttt

SEQ ID NO: 809631 - DNA, 20 bp, mouse
gtagcttagttagggacaga

SEQ ID NO: 809632 - DNA, 20 bp, mouse
ggtttattatcaaggtagtc

SEQ ID NO: 809633 - DNA, 20 bp, mouse
gaacagtgatatggaactgg

SEQ ID NO: 809634 - DNA, 20 bp, mouse
gataaacagtgatatggaac

SEQ ID NO: 809635 - DNA, 20 bp, mouse
gtctgggaagtgtttcttca

SEQ ID NO: 809636 - DNA, 20 bp, mouse
gctgccgtccgcctctgcgc

SEQ ID NO: 809637 - DNA, 20 bp, mouse
gtggccaaccgccgtgggag

SEQ ID NO: 809638 - DNA, 20 bp, mouse
ggctctgcatgcaaccgcgg

SEQ ID NO: 809639 - DNA, 20 bp, mouse
gcccttgccaactccttcct

SEQ ID NO: 809640 - DNA, 20 bp, mouse
gtaggcggtgataacgggta

SEQ ID NO: 809641 - DNA, 20 bp, mouse
gtgcatgcagagcgcaagcg

SEQ ID NO: 809642 - DNA, 20 bp, mouse
gcggaggaggggactactcg

SEQ ID NO: 809643 - DNA, 20 bp, mouse
gtctatatggccaaccgccg

SEQ ID NO: 809644 - DNA, 20 bp, mouse
gtgagtgcggagcagtgaag

SEQ ID NO: 809645 - DNA, 20 bp, mouse
gtgcggagcagtgaagggga

SEQ ID NO: 809646 - DNA, 20 bp, mouse
ggggctagggataggctcta

SEQ ID NO: 809647 - DNA, 20 bp, mouse
gctggtaaggggctagggat

SEQ ID NO: 809648 - DNA, 20 bp, mouse
gagctcccgcgccagcacga

SEQ ID NO: 809649 - DNA, 20 bp, mouse
gcacgcacgcgcacggtcgc

SEQ ID NO: 809650 - DNA, 20 bp, mouse
ggatcgccgcggttctgccc

SEQ ID NO: 809651 - DNA, 20 bp, mouse
gtggacctggtaaggggcta

SEQ ID NO: 809652 - DNA, 20 bp, mouse
gggcgcgggagctgcgggaa

SEQ ID NO: 809653 - DNA, 20 bp, mouse
ggaacccagttctcttgatt

SEQ ID NO: 809654 - DNA, 20 bp, mouse
gggagctggggatgctcggc

SEQ ID NO: 809655 - DNA, 20 bp, mouse
ggggatacaggcaccttacc

SEQ ID NO: 809656 - DNA, 20 bp, mouse
gctcacgcaggcaccggttg

SEQ ID NO: 809657 - DNA, 20 bp, mouse
gcggtgcagccctgggcttc

SEQ ID NO: 809658 - DNA, 20 bp, mouse
gcaagagtgcggtccgctgg

SEQ ID NO: 809659 - DNA, 20 bp, mouse
ggcaccggttgtggctgcag

SEQ ID NO: 809660 - DNA, 20 bp, mouse
ggagaagctcacgcaggcac

SEQ ID NO: 809661 - DNA, 20 bp, mouse
gcttcaggagaagctcacgc

SEQ ID NO: 809662 - DNA, 20 bp, mouse
gctcataggaggtgtagtgt

SEQ ID NO: 809663 - DNA, 20 bp, mouse
gccaggcagtgttgcaccgt

SEQ ID NO: 809664 - DNA, 20 bp, mouse
ggttgtggctgcagaggtac

SEQ ID NO: 809665 - DNA, 20 bp, mouse
ggtccgctggtggcagggtg

SEQ ID NO: 809666 - DNA, 20 bp, mouse
ggcgtgggacagccaatcag

SEQ ID NO: 809667 - DNA, 20 bp, mouse
gggctcccaccctccaagga

SEQ ID NO: 809668 - DNA, 20 bp, mouse
ggtgctgtgcccaccggggt

SEQ ID NO: 809669 - DNA, 20 bp, mouse
gtgcctgcttcctaccccgg

SEQ ID NO: 809670 - DNA, 20 bp, mouse
gcctgggctcccaccctcca

SEQ ID NO: 809671 - DNA, 20 bp, mouse
gggaagcaggcaggcggcgt

SEQ ID NO: 809672 - DNA, 20 bp, mouse
gctggcttcagtgtccttag

SEQ ID NO: 809673 - DNA, 20 bp, mouse
gagctccctcctcctctgat

SEQ ID NO: 809674 - DNA, 20 bp, mouse
gtgggccgagagtcacctta

SEQ ID NO: 809675 - DNA, 20 bp, mouse
gccaacaaagtctgcagcac

SEQ ID NO: 809676 - DNA, 20 bp, mouse
ggcgcggccgggagaaccaa

SEQ ID NO: 809677 - DNA, 20 bp, mouse
gcgacccggagaggccggtg

SEQ ID NO: 809678 - DNA, 20 bp, mouse
gcctgggctagatgacagga

SEQ ID NO: 809679 - DNA, 20 bp, mouse
gtagcccggctgcactcgcg

SEQ ID NO: 809680 - DNA, 20 bp, mouse
gccgggagaaccaaaggcct

SEQ ID NO: 809681 - DNA, 20 bp, mouse
gtgcagccgggctattccca

SEQ ID NO: 809682 - DNA, 20 bp, mouse
ggcctggggggaaccacagc

SEQ ID NO: 809683 - DNA, 20 bp, mouse
gggactgaggcgtcccgctg

SEQ ID NO: 809684 - DNA, 20 bp, mouse
gtaggcctgggctagatgac

SEQ ID NO: 809685 - DNA, 20 bp, mouse
gcgaagccgtgggaatagcc

SEQ ID NO: 809686 - DNA, 20 bp, mouse
ggccgcgctgccttccccta

SEQ ID NO: 809687 - DNA, 20 bp, mouse
gggaactgggctcgccctag

SEQ ID NO: 809688 - DNA, 20 bp, mouse
ggtaccacggagcccagtag

SEQ ID NO: 809689 - DNA, 20 bp, mouse
gagcccagtagcggcaggga

SEQ ID NO: 809690 - DNA, 20 bp, mouse
gctcagagtaggtgtgggga

SEQ ID NO: 809691 - DNA, 20 bp, mouse
gaccccctcagagtaggtgt

SEQ ID NO: 809692 - DNA, 20 bp, mouse
gcgggcgcgaccaagtctgg

SEQ ID NO: 809693 - DNA, 20 bp, mouse
gggaggacgtggtcaccgag

SEQ ID NO: 809694 - DNA, 20 bp, mouse
gtcacccaccccctcagagt

SEQ ID NO: 809695 - DNA, 20 bp, mouse
gcgagtctcggcctctgtga

SEQ ID NO: 809696 - DNA, 20 bp, mouse
gacgccgggcggctacgctg

SEQ ID NO: 809697 - DNA, 20 bp, mouse
ggctcggcccggaagcctca

SEQ ID NO: 809698 - DNA, 20 bp, mouse
gaggaggcgcagcaaatcgg

SEQ ID NO: 809699 - DNA, 20 bp, mouse
ggggcgggcgagagccagtg

SEQ ID NO: 809700 - DNA, 20 bp, mouse
gaggcgcagcaaatcggcgg

SEQ ID NO: 809701 - DNA, 20 bp, mouse
gagcgggcggactgccccac

SEQ ID NO: 809702 - DNA, 20 bp, mouse
gcgcgagaacgcatccgcct

SEQ ID NO: 809703 - DNA, 20 bp, mouse
gcgctgccgtgtgcgtaagt

SEQ ID NO: 809704 - DNA, 20 bp, mouse
gaaagtcctggggactcggt

SEQ ID NO: 809705 - DNA, 20 bp, mouse
gtaagtggggcagcgacgcc

SEQ ID NO: 809706 - DNA, 20 bp, mouse
gaagccgcggagacccccgt

SEQ ID NO: 809707 - DNA, 20 bp, mouse
gcagcacagcgcactccccg

SEQ ID NO: 809708 - DNA, 20 bp, mouse
gtggcaggaggtactagctg

SEQ ID NO: 809709 - DNA, 20 bp, mouse
gcccgcggctgggaccgacg

SEQ ID NO: 809710 - DNA, 20 bp, mouse
ggcccggactgccacgtctg

SEQ ID NO: 809711 - DNA, 20 bp, mouse
gtcccccagacgtggcagtc

SEQ ID NO: 809712 - DNA, 20 bp, mouse
gagtacctcctgccaagccg

SEQ ID NO: 809713 - DNA, 20 bp, mouse
gaggcctgctgagtgtccct

SEQ ID NO: 809714 - DNA, 20 bp, mouse
gggaccgacgggggtctccg

SEQ ID NO: 809715 - DNA, 20 bp, mouse
gggcccgggtcccccagacg

SEQ ID NO: 809716 - DNA, 20 bp, mouse
ggcagggcgaggggacgagg

SEQ ID NO: 809717 - DNA, 20 bp, mouse
ggctacgaggggcagggcga

SEQ ID NO: 809718 - DNA, 20 bp, mouse
gtgctggggaattgctacga

SEQ ID NO: 809719 - DNA, 20 bp, mouse
gcagcagcagggcaagtctg

SEQ ID NO: 809720 - DNA, 20 bp, mouse
gaggagcctcccagagtgtg

SEQ ID NO: 809721 - DNA, 20 bp, mouse
gcaggacggcctgcggaggg

SEQ ID NO: 809722 - DNA, 20 bp, mouse
ggggcctaccaaaacactga

SEQ ID NO: 809723 - DNA, 20 bp, mouse
ggctcaggacggcctgcgga

SEQ ID NO: 809724 - DNA, 20 bp, mouse
ggggcaagtctgcggataag

SEQ ID NO: 809725 - DNA, 20 bp, mouse
gctgcccagaagcctatggg

SEQ ID NO: 809726 - DNA, 20 bp, mouse
ggcgcccgcctgtcaaaact

SEQ ID NO: 809727 - DNA, 20 bp, mouse
gcccctccgcggccagatgt

SEQ ID NO: 809728 - DNA, 20 bp, mouse
gagccagtgccgagtcgcgg

SEQ ID NO: 809729 - DNA, 20 bp, mouse
gagtcccaggcacacgacct

SEQ ID NO: 809730 - DNA, 20 bp, mouse
gggcctccgcgactcggcac

SEQ ID NO: 809731 - DNA, 20 bp, mouse
gtggccgcggaggggcgtga

SEQ ID NO: 809732 - DNA, 20 bp, mouse
ggagtcgcggaggccggctg

SEQ ID NO: 809733 - DNA, 20 bp, mouse
gaaccagagctgcttctaca

SEQ ID NO: 809734 - DNA, 20 bp, mouse
gcccgcctcccggctggatc

SEQ ID NO: 809735 - DNA, 20 bp, mouse
gggcccgggtgcttggggag

SEQ ID NO: 809736 - DNA, 20 bp, mouse
ggtggctcgaggcagagaat

SEQ ID NO: 809737 - DNA, 20 bp, mouse
ggtcccagagacgctgtcta

SEQ ID NO: 809738 - DNA, 20 bp, mouse
gacggcggggtctgtggcca

SEQ ID NO: 809739 - DNA, 20 bp, mouse
gcagagcaaaccaagtgcgg

SEQ ID NO: 809740 - DNA, 20 bp, mouse
gggcagggaaatcgacgcat

SEQ ID NO: 809741 - DNA, 20 bp, mouse
ggggacggcgaggggctctc

SEQ ID NO: 809742 - DNA, 20 bp, mouse
gcctgaggactgaaccatta

SEQ ID NO: 809743 - DNA, 20 bp, mouse
gcggagcacggcggggtctg

SEQ ID NO: 809744 - DNA, 20 bp, mouse
gcagagctacgggaggaccg

SEQ ID NO: 809745 - DNA, 20 bp, mouse
gcgaggggctctcaggttac

SEQ ID NO: 809746 - DNA, 20 bp, mouse
gcctctgcgcgcctagaaaa

SEQ ID NO: 809747 - DNA, 20 bp, mouse
gggcccgcccacaggaccga

SEQ ID NO: 809748 - DNA, 20 bp, mouse
gtgcgcgcctagaaaaaggt

SEQ ID NO: 809749 - DNA, 20 bp, mouse
ggcgcgatgacgtacggcgc

SEQ ID NO: 809750 - DNA, 20 bp, mouse
gggcgacgccgggccagctc

SEQ ID NO: 809751 - DNA, 20 bp, mouse
gctgcctcggagataaggcg

SEQ ID NO: 809752 - DNA, 20 bp, mouse
gtcgcaggcgcgatgacgta

SEQ ID NO: 809753 - DNA, 20 bp, mouse
gcggcgcaggcgcagtgagt

SEQ ID NO: 809754 - DNA, 20 bp, mouse
gagagtcgccccacctacta

SEQ ID NO: 809755 - DNA, 20 bp, mouse
ggcgcctgcgacaccctagt

SEQ ID NO: 809756 - DNA, 20 bp, mouse
gcctgagaggcgggatctca

SEQ ID NO: 809757 - DNA, 20 bp, mouse
ggaaggtggggaagcgagta

SEQ ID NO: 809758 - DNA, 20 bp, mouse
gtggggaagcgagtacgggg

SEQ ID NO: 809759 - DNA, 20 bp, mouse
gttgctgcgcagtgcacgct

SEQ ID NO: 809760 - DNA, 20 bp, mouse
gagcgtgctcgctgaaggtg

SEQ ID NO: 809761 - DNA, 20 bp, mouse
gacgctgggagttgaagttc

SEQ ID NO: 809762 - DNA, 20 bp, mouse
gacaactgattagcccggga

SEQ ID NO: 809763 - DNA, 20 bp, mouse
gttcgcgcgcgcctgagagg

SEQ ID NO: 809764 - DNA, 20 bp, mouse
gtgtgcagcgtgctcgctga

SEQ ID NO: 809765 - DNA, 20 bp, mouse
gtgcgccgcacggcaccatg

SEQ ID NO: 809766 - DNA, 20 bp, mouse
gagggtaaggctgctaagta

SEQ ID NO: 809767 - DNA, 20 bp, mouse
gaaagcccaccttcagggta

SEQ ID NO: 809768 - DNA, 20 bp, mouse
ggtaaggctgctaagtaagg

SEQ ID NO: 809769 - DNA, 20 bp, mouse
gcgcggacgcctcgctgaca

SEQ ID NO: 809770 - DNA, 20 bp, mouse
ggaagaaaggtgcaatgagc

SEQ ID NO: 809771 - DNA, 20 bp, mouse
gaaggaggcgagtgcgcgcg

SEQ ID NO: 809772 - DNA, 20 bp, mouse
gtcgctgacaagggacgcgc

SEQ ID NO: 809773 - DNA, 20 bp, mouse
gcgaggcgtcgccacatcga

SEQ ID NO: 809774 - DNA, 20 bp, mouse
gtgacaagggacgcgcgggg

SEQ ID NO: 809775 - DNA, 20 bp, mouse
ggccacgccgcggctgttgt

SEQ ID NO: 809776 - DNA, 20 bp, mouse
ggccacgcgccagtcccgga

SEQ ID NO: 809777 - DNA, 20 bp, mouse
gtcgccccgaaggaacgcgg

SEQ ID NO: 809778 - DNA, 20 bp, mouse
gagtcccggagggcgaagag

SEQ ID NO: 809779 - DNA, 20 bp, mouse
gggagcgctggcacggggcg

SEQ ID NO: 809780 - DNA, 20 bp, mouse
ggacccggcctagtttctac

SEQ ID NO: 809781 - DNA, 20 bp, mouse
gggcgaagagcggagctcgg

SEQ ID NO: 809782 - DNA, 20 bp, mouse
gcctcccccgcgttccttcg

SEQ ID NO: 809783 - DNA, 20 bp, mouse
gcggggccgggcacgtgact

SEQ ID NO: 809784 - DNA, 20 bp, mouse
gaggccgggtcacgtggccg

SEQ ID NO: 809785 - DNA, 20 bp, mouse
gcacgtggccggggggtgga

SEQ ID NO: 809786 - DNA, 20 bp, mouse
gtcagccggcgcttccggga

SEQ ID NO: 809787 - DNA, 20 bp, mouse
gtcagccctcccggaagcgc

SEQ ID NO: 809788 - DNA, 20 bp, mouse
gtggaggcggggtaaaatta

SEQ ID NO: 809789 - DNA, 20 bp, mouse
gcacctccgggtgtgttccc

SEQ ID NO: 809790 - DNA, 20 bp, mouse
ggcggcagagacagtctcgg

SEQ ID NO: 809791 - DNA, 20 bp, mouse
gtacgagtgtgggtgtagta

SEQ ID NO: 809792 - DNA, 20 bp, mouse
ggggctagggcagagacgaa

SEQ ID NO: 809793 - DNA, 20 bp, mouse
gtggctccgcccccgggcta

SEQ ID NO: 809794 - DNA, 20 bp, mouse
gtaaaattagggattaggag

SEQ ID NO: 809795 - DNA, 20 bp, mouse
ggtgcctgctgacagtgctt

SEQ ID NO: 809796 - DNA, 20 bp, mouse
gcggccggcccgggactttc

SEQ ID NO: 809797 - DNA, 20 bp, mouse
gaggaaggcggggcctcggt

SEQ ID NO: 809798 - DNA, 20 bp, mouse
gtagcagagaagtaagtctc

SEQ ID NO: 809799 - DNA, 20 bp, mouse
gccggcccgggactttcagg

SEQ ID NO: 809800 - DNA, 20 bp, mouse
gtgggcggtgtcgcttgaag

SEQ ID NO: 809801 - DNA, 20 bp, mouse
ggaagccggtggggacggga

SEQ ID NO: 809802 - DNA, 20 bp, mouse
gagatcctcctgaaagtccc

SEQ ID NO: 809803 - DNA, 20 bp, mouse
gggcgctaaaactggggcta

SEQ ID NO: 809804 - DNA, 20 bp, mouse
gagacggaagccggtgggga

SEQ ID NO: 809805 - DNA, 20 bp, mouse
gggggctggcgctaaaactg

SEQ ID NO: 809806 - DNA, 20 bp, mouse
gcgcaatgcgccgagaggaa

SEQ ID NO: 809807 - DNA, 20 bp, mouse
gaagaccacgcccttcctct

SEQ ID NO: 809808 - DNA, 20 bp, mouse
gcaccgggtccaggtctgag

SEQ ID NO: 809809 - DNA, 20 bp, mouse
gtgacgcacgcgaagctgag

SEQ ID NO: 809810 - DNA, 20 bp, mouse
gtgcgccgagaggaagggcg

SEQ ID NO: 809811 - DNA, 20 bp, mouse
gactaaaaaggggactttag

SEQ ID NO: 809812 - DNA, 20 bp, mouse
gactgtctggcaggcacttc

SEQ ID NO: 809813 - DNA, 20 bp, mouse
gttccgctcagacctggacc

SEQ ID NO: 809814 - DNA, 20 bp, mouse
gacgcccggcagcagtcacc

SEQ ID NO: 809815 - DNA, 20 bp, mouse
ggcgtgcgcaatgcgccgag

SEQ ID NO: 809816 - DNA, 20 bp, mouse
ggggaaagtccagcaacgac

SEQ ID NO: 809817 - DNA, 20 bp, mouse
gggcctcctaggactcacct

SEQ ID NO: 809818 - DNA, 20 bp, mouse
gggaaagtgacgagcggctt

SEQ ID NO: 809819 - DNA, 20 bp, mouse
gcctagctcagagttgagtt

SEQ ID NO: 809820 - DNA, 20 bp, mouse
ggtcccaggtgagtcctagg

SEQ ID NO: 809821 - DNA, 20 bp, mouse
gactcacctgggacaggtac

SEQ ID NO: 809822 - DNA, 20 bp, mouse
ggcgacgctcggggcctcct

SEQ ID NO: 809823 - DNA, 20 bp, mouse
gtggcgccagtacctgtccc

SEQ ID NO: 809824 - DNA, 20 bp, mouse
gaaacctcggcccaatctat

SEQ ID NO: 809825 - DNA, 20 bp, mouse
gcgccagacatttcctaaag

SEQ ID NO: 809826 - DNA, 20 bp, mouse
ggggtggcagaggacgtaga

SEQ ID NO: 809827 - DNA, 20 bp, mouse
ggagcctaagactgctgggg

SEQ ID NO: 809828 - DNA, 20 bp, mouse
ggtggtcagaggcaacataa

SEQ ID NO: 809829 - DNA, 20 bp, mouse
ggcggagcctaagactgctg

SEQ ID NO: 809830 - DNA, 20 bp, mouse
ggggtggccccgcccacgga

SEQ ID NO: 809831 - DNA, 20 bp, mouse
gagaggacgtagagggttcg

SEQ ID NO: 809832 - DNA, 20 bp, mouse
gacaactccgggctcgcttg

SEQ ID NO: 809833 - DNA, 20 bp, mouse
gaggataagtgcagttcgta

SEQ ID NO: 809834 - DNA, 20 bp, mouse
ggaagggcgggccctgtttc

SEQ ID NO: 809835 - DNA, 20 bp, mouse
gctgccaccccagcagtctt

SEQ ID NO: 809836 - DNA, 20 bp, mouse
gtggctgggagcttgtatga

SEQ ID NO: 809837 - DNA, 20 bp, mouse
ggcggcctcccgagaagcca

SEQ ID NO: 809838 - DNA, 20 bp, mouse
ggctcactggggctccggga

SEQ ID NO: 809839 - DNA, 20 bp, mouse
gcggcgcggtgagatcgaaa

SEQ ID NO: 809840 - DNA, 20 bp, mouse
gagatcgaaatggcgaccga

SEQ ID NO: 809841 - DNA, 20 bp, mouse
gcgagaccagcggcccggag

SEQ ID NO: 809842 - DNA, 20 bp, mouse
gaccgagggagacgtggagt

SEQ ID NO: 809843 - DNA, 20 bp, mouse
ggagcgggttactgactatg

SEQ ID NO: 809844 - DNA, 20 bp, mouse
ggaagcggcagcctatgcgg

SEQ ID NO: 809845 - DNA, 20 bp, mouse
gtggtgctgctgacctagag

SEQ ID NO: 809846 - DNA, 20 bp, mouse
gtccggcggaagtgccagag

SEQ ID NO: 809847 - DNA, 20 bp, mouse
ggtgctgcccggaaaggggc

SEQ ID NO: 809848 - DNA, 20 bp, mouse
gtccgccggagttagaccaa

SEQ ID NO: 809849 - DNA, 20 bp, mouse
ggggcggggcctaggatatg

SEQ ID NO: 809850 - DNA, 20 bp, mouse
gggagcgccgcgaaacccgg

SEQ ID NO: 809851 - DNA, 20 bp, mouse
gccactgtgctgcccggaaa

SEQ ID NO: 809852 - DNA, 20 bp, mouse
gcgccgggccgctcaagggg

SEQ ID NO: 809853 - DNA, 20 bp, mouse
gcatccgccgggccgctcaa

SEQ ID NO: 809854 - DNA, 20 bp, mouse
gctaagaccgccccgagtgt

SEQ ID NO: 809855 - DNA, 20 bp, mouse
gcggggcctaggatatgggg

SEQ ID NO: 809856 - DNA, 20 bp, mouse
gcgcgctcgggaaccagacg

SEQ ID NO: 809857 - DNA, 20 bp, mouse
gtggggtgagagttcaagaa

SEQ ID NO: 809858 - DNA, 20 bp, mouse
gcgcttggggagacgtgtag

SEQ ID NO: 809859 - DNA, 20 bp, mouse
gggcgctcgccctccctctc

SEQ ID NO: 809860 - DNA, 20 bp, mouse
gctcggggccaatccacgtc

SEQ ID NO: 809861 - DNA, 20 bp, mouse
gtcgggaaccagacgtggat

SEQ ID NO: 809862 - DNA, 20 bp, mouse
gactccgcccgctccggaga

SEQ ID NO: 809863 - DNA, 20 bp, mouse
gggaactcacctgtcaacag

SEQ ID NO: 809864 - DNA, 20 bp, mouse
gaccccgccccgcggaagtg

SEQ ID NO: 809865 - DNA, 20 bp, mouse
gaaagagaaacccacgcgct

SEQ ID NO: 809866 - DNA, 20 bp, mouse
gcgccgcgcgccaagcccaa

SEQ ID NO: 809867 - DNA, 20 bp, mouse
gcccgggccacggtgccctt

SEQ ID NO: 809868 - DNA, 20 bp, mouse
ggaggcgggaagcgagaggc

SEQ ID NO: 809869 - DNA, 20 bp, mouse
gaccgtggcccggggtgtcc

SEQ ID NO: 809870 - DNA, 20 bp, mouse
ggcaggaggcgggaagcgag

SEQ ID NO: 809871 - DNA, 20 bp, mouse
ggctgcggggcatagggttc

SEQ ID NO: 809872 - DNA, 20 bp, mouse
gtgcccttgggcttggcgcg

SEQ ID NO: 809873 - DNA, 20 bp, mouse
gatggcgaggaagtcggaga

SEQ ID NO: 809874 - DNA, 20 bp, mouse
gcggccaccgaggcaggagg

SEQ ID NO: 809875 - DNA, 20 bp, mouse
ggtcctgagatcgaacgctg

SEQ ID NO: 809876 - DNA, 20 bp, mouse
gtggggccataggacgagcc

SEQ ID NO: 809877 - DNA, 20 bp, mouse
ggtgaattctggtcatagtt

SEQ ID NO: 809878 - DNA, 20 bp, mouse
gacaagagtctcaccctcat

SEQ ID NO: 809879 - DNA, 20 bp, mouse
gctagaaagaaggttatcat

SEQ ID NO: 809880 - DNA, 20 bp, mouse
ggggaaccataaagggattt

SEQ ID NO: 809881 - DNA, 20 bp, mouse
gtccccagaggcccacactt

SEQ ID NO: 809882 - DNA, 20 bp, mouse
ggttcccagaagcagccatg

SEQ ID NO: 809883 - DNA, 20 bp, mouse
gtccaaagtgtgggcctctg

SEQ ID NO: 809884 - DNA, 20 bp, mouse
gttcatccccaccccaatga

SEQ ID NO: 809885 - DNA, 20 bp, mouse
gattccccaggctcgtccta

SEQ ID NO: 809886 - DNA, 20 bp, mouse
ggaggacaaaggtgactgag

SEQ ID NO: 809887 - DNA, 20 bp, mouse
gttaagggatgagagcgttc

SEQ ID NO: 809888 - DNA, 20 bp, mouse
ggagattgggagagtcaaca

SEQ ID NO: 809889 - DNA, 20 bp, mouse
gacgctctcatcccttaaaa

SEQ ID NO: 809890 - DNA, 20 bp, mouse
ggatgagagcgttcgggtag

SEQ ID NO: 809891 - DNA, 20 bp, mouse
ggaggatccttcaggggaag

SEQ ID NO: 809892 - DNA, 20 bp, mouse
ggatgaggaggatccttcag

SEQ ID NO: 809893 - DNA, 20 bp, mouse
ggtggttaggctccagaggt

SEQ ID NO: 809894 - DNA, 20 bp, mouse
ggcgggagctacctcaacgc

SEQ ID NO: 809895 - DNA, 20 bp, mouse
gaagttgcaaaaggtatgag

SEQ ID NO: 809896 - DNA, 20 bp, mouse
ggcacagtggccagggggac

SEQ ID NO: 809897 - DNA, 20 bp, mouse
ggccagggggacaggctagg

SEQ ID NO: 809898 - DNA, 20 bp, mouse
ggccccctagcctgtccccc

SEQ ID NO: 809899 - DNA, 20 bp, mouse
gctgacaggctggtgcacag

SEQ ID NO: 809900 - DNA, 20 bp, mouse
gggctggtgcacagtggcca

SEQ ID NO: 809901 - DNA, 20 bp, mouse
gctgacaggaaattcctgac

SEQ ID NO: 809902 - DNA, 20 bp, mouse
gagaatggactctgactgac

SEQ ID NO: 809903 - DNA, 20 bp, mouse
ggtggccagggggacaggct

SEQ ID NO: 809904 - DNA, 20 bp, mouse
gcaggaaattcctgacaggc

SEQ ID NO: 809905 - DNA, 20 bp, mouse
gattcatatctacacttgca

SEQ ID NO: 809906 - DNA, 20 bp, mouse
gggctggtgcacagtggcca

SEQ ID NO: 809907 - DNA, 20 bp, mouse
gctgacaggctggtgcacag

SEQ ID NO: 809908 - DNA, 20 bp, mouse
gctgacaggaaattcctgac

SEQ ID NO: 809909 - DNA, 20 bp, mouse
gagaatggactctgactgac

SEQ ID NO: 809910 - DNA, 20 bp, mouse
gcaggaaattcctgacaggc

SEQ ID NO: 809911 - DNA, 20 bp, mouse
gaggggctaagtccatcgag

SEQ ID NO: 809912 - DNA, 20 bp, mouse
gaattcatatctacactcgc

SEQ ID NO: 809913 - DNA, 20 bp, mouse
gcctagaggccctgtgactc

SEQ ID NO: 809914 - DNA, 20 bp, mouse
gctctctgcgcctaaaccaa

SEQ ID NO: 809915 - DNA, 20 bp, mouse
gtacctcagtgcccactcga

SEQ ID NO: 809916 - DNA, 20 bp, mouse
gaggggctaagttcatcgat

SEQ ID NO: 809917 - DNA, 20 bp, mouse
gcaggtgtccaaggtgcgtc

SEQ ID NO: 809918 - DNA, 20 bp, mouse
gcactctcctgggcaattct

SEQ ID NO: 809919 - DNA, 20 bp, mouse
ggtgtctccattcatcaagt

SEQ ID NO: 809920 - DNA, 20 bp, mouse
gtgcacagtggccaggggac

SEQ ID NO: 809921 - DNA, 20 bp, mouse
gggctggtgcacagtggcca

SEQ ID NO: 809922 - DNA, 20 bp, mouse
gctgacaggctggtgcacag

SEQ ID NO: 809923 - DNA, 20 bp, mouse
gctgacaggaaattcctgac

SEQ ID NO: 809924 - DNA, 20 bp, mouse
gtatgtgcccacttgatgaa

SEQ ID NO: 809925 - DNA, 20 bp, mouse
gagaatggactctgactgac

SEQ ID NO: 809926 - DNA, 20 bp, mouse
ggggagagagtccatccatt

SEQ ID NO: 809927 - DNA, 20 bp, mouse
gggacatcggatgttgtgtt

SEQ ID NO: 809928 - DNA, 20 bp, mouse
gtgttcggttgtgtttatga

SEQ ID NO: 809929 - DNA, 20 bp, mouse
gtgcacagtggccaggggac

SEQ ID NO: 809930 - DNA, 20 bp, mouse
gggctggtgcacagtggcca

SEQ ID NO: 809931 - DNA, 20 bp, mouse
gctgacaggctggtgcacag

SEQ ID NO: 809932 - DNA, 20 bp, mouse
gctgacaggaaattcctgac

SEQ ID NO: 809933 - DNA, 20 bp, mouse
gagaatggactctgactgac

SEQ ID NO: 809934 - DNA, 20 bp, mouse
gcaggaaattcctgacaggc

SEQ ID NO: 809935 - DNA, 20 bp, mouse
gtacctcagtgcccaatgga

SEQ ID NO: 809936 - DNA, 20 bp, mouse
gtggggctgaagcatcaaga

SEQ ID NO: 809937 - DNA, 20 bp, mouse
gccactgttgctcttagaga

SEQ ID NO: 809938 - DNA, 20 bp, mouse
gacccctgccccaacctcgg

SEQ ID NO: 809939 - DNA, 20 bp, mouse
gacgcagtatgacccagcat

SEQ ID NO: 809940 - DNA, 20 bp, mouse
gctaagagcaacagtggccc

SEQ ID NO: 809941 - DNA, 20 bp, mouse
gagcccccgaggttggggca

SEQ ID NO: 809942 - DNA, 20 bp, mouse
gtcagctgggcacaaaagag

SEQ ID NO: 809943 - DNA, 20 bp, mouse
gctggaaagatgttgggcca

SEQ ID NO: 809944 - DNA, 20 bp, mouse
gtgggccaaggctctatgcc

SEQ ID NO: 809945 - DNA, 20 bp, mouse
gtatgtgcacgatgtgtgaa

SEQ ID NO: 809946 - DNA, 20 bp, mouse
gtgggagtgggactgatatc

SEQ ID NO: 809947 - DNA, 20 bp, mouse
gtataggcatagcagagcgt

SEQ ID NO: 809948 - DNA, 20 bp, mouse
gggtagaggggcatgggact

SEQ ID NO: 809949 - DNA, 20 bp, mouse
gcgcgtgcacaagacttccc

SEQ ID NO: 809950 - DNA, 20 bp, mouse
gactttgggtagaggggcat

SEQ ID NO: 809951 - DNA, 20 bp, mouse
ggtaggctgcaatagccaca

SEQ ID NO: 809952 - DNA, 20 bp, mouse
gcacgctggaggagagcttt

SEQ ID NO: 809953 - DNA, 20 bp, mouse
gggcacaccatcttctagtc

SEQ ID NO: 809954 - DNA, 20 bp, mouse
gtgtaatcctgactagaaga

SEQ ID NO: 809955 - DNA, 20 bp, mouse
gcgtctcccttcaaaaaggt

SEQ ID NO: 809956 - DNA, 20 bp, mouse
ggcaagggataagaggggag

SEQ ID NO: 809957 - DNA, 20 bp, mouse
gttacatgtgtgtacagcct

SEQ ID NO: 809958 - DNA, 20 bp, mouse
gggaaagcaagggataagag

SEQ ID NO: 809959 - DNA, 20 bp, mouse
ggaagaagggaggatagttg

SEQ ID NO: 809960 - DNA, 20 bp, mouse
ggggggagagcggaaagcaa

SEQ ID NO: 809961 - DNA, 20 bp, mouse
gcacttgggagaccaagaca

SEQ ID NO: 809962 - DNA, 20 bp, mouse
gagaagaactgtaacagcca

SEQ ID NO: 809963 - DNA, 20 bp, mouse
ggacactggtctccatgtct

SEQ ID NO: 809964 - DNA, 20 bp, mouse
gacagtattgtctctgacac

SEQ ID NO: 809965 - DNA, 20 bp, mouse
ggctgttacagttcttctgc

SEQ ID NO: 809966 - DNA, 20 bp, mouse
gtgtgttctgtgctcggatt

SEQ ID NO: 809967 - DNA, 20 bp, mouse
gaatagctgtgttctgtgct

SEQ ID NO: 809968 - DNA, 20 bp, mouse
gacattggatgtcctcattg

SEQ ID NO: 809969 - DNA, 20 bp, mouse
gtctgtgctcggattgggaa

SEQ ID NO: 809970 - DNA, 20 bp, mouse
gagagtcttctacacaacat

SEQ ID NO: 809971 - DNA, 20 bp, mouse
gcctgttcttggtgacaagt

SEQ ID NO: 809972 - DNA, 20 bp, mouse
ggaagtgacttgggaagccc

SEQ ID NO: 809973 - DNA, 20 bp, mouse
gcatgatccttgattcttta

SEQ ID NO: 809974 - DNA, 20 bp, mouse
gtggaccaggtgagcagtca

SEQ ID NO: 809975 - DNA, 20 bp, mouse
gttgcagaaccagctcctgg

SEQ ID NO: 809976 - DNA, 20 bp, mouse
gtctgtgctcagactggaaa

SEQ ID NO: 809977 - DNA, 20 bp, mouse
gccatccctagtgacaagta

SEQ ID NO: 809978 - DNA, 20 bp, mouse
gtctaccctacttgtcacta

SEQ ID NO: 809979 - DNA, 20 bp, mouse
gttgtcactagggatggctg

SEQ ID NO: 809980 - DNA, 20 bp, mouse
gggagggaggagaccttggt

SEQ ID NO: 809981 - DNA, 20 bp, mouse
gaggtgggaattttcccatc

SEQ ID NO: 809982 - DNA, 20 bp, mouse
gctggggacaacaacatgcc

SEQ ID NO: 809983 - DNA, 20 bp, mouse
gaaatggttcaaagttaatg

SEQ ID NO: 809984 - DNA, 20 bp, mouse
gttcaaagttaatgtggaaa

SEQ ID NO: 809985 - DNA, 20 bp, mouse
gagcctgtttatccccacca

SEQ ID NO: 809986 - DNA, 20 bp, mouse
gaacatggtagagggtgtcc

SEQ ID NO: 809987 - DNA, 20 bp, mouse
gagttaggggattgcccagc

SEQ ID NO: 809988 - DNA, 20 bp, mouse
gaggactggtcccacatctt

SEQ ID NO: 809989 - DNA, 20 bp, mouse
gaaaaagcagaaaccacacc

SEQ ID NO: 809990 - DNA, 20 bp, mouse
gtaaagctaacacttatcct

SEQ ID NO: 809991 - DNA, 20 bp, mouse
gggtcccacatcttaggaaa

SEQ ID NO: 809992 - DNA, 20 bp, mouse
gtaactgttataaataaaca

SEQ ID NO: 809993 - DNA, 20 bp, mouse
ggttagctttaactctcctg

SEQ ID NO: 809994 - DNA, 20 bp, mouse
gtgggaaatgggtgatttct

SEQ ID NO: 809995 - DNA, 20 bp, mouse
gatgtgggaccagtccttgg

SEQ ID NO: 809996 - DNA, 20 bp, mouse
gaacatggtagagggtgtcc

SEQ ID NO: 809997 - DNA, 20 bp, mouse
gagttaggggattgcccagc

SEQ ID NO: 809998 - DNA, 20 bp, mouse
gaggactggtcccacatctt

SEQ ID NO: 809999 - DNA, 20 bp, mouse
gaaaaagcagaaaccacacc

SEQ ID NO: 810000 - DNA, 20 bp, mouse
gtaaagctaacacttatcct

SEQ ID NO: 810001 - DNA, 20 bp, mouse
gggtcccacatcttaggaaa

SEQ ID NO: 810002 - DNA, 20 bp, mouse
gtaactgttataaataaaca

SEQ ID NO: 810003 - DNA, 20 bp, mouse
ggttagctttaactctcctg

SEQ ID NO: 810004 - DNA, 20 bp, mouse
gtgggaaatgggtgatttct

SEQ ID NO: 810005 - DNA, 20 bp, mouse
gatgtgggaccagtccttgg

SEQ ID NO: 810006 - DNA, 20 bp, mouse
gtgggaggagtccttggtgg

SEQ ID NO: 810007 - DNA, 20 bp, mouse
gaccaatgggtgaactagtg

SEQ ID NO: 810008 - DNA, 20 bp, mouse
gaggactcctcccacttctt

SEQ ID NO: 810009 - DNA, 20 bp, mouse
gtctgggaacaagcacttac

SEQ ID NO: 810010 - DNA, 20 bp, mouse
gtgctagcatggacacagaa

SEQ ID NO: 810011 - DNA, 20 bp, mouse
ggtctcctttgaacagttat

SEQ ID NO: 810012 - DNA, 20 bp, mouse
gcatgcctataactgttcaa

SEQ ID NO: 810013 - DNA, 20 bp, mouse
gaagtgggaggagtccttgg

SEQ ID NO: 810014 - DNA, 20 bp, mouse
ggttctaaatacaaaccaat

SEQ ID NO: 810015 - DNA, 20 bp, mouse
gtgcagagccattccctgct

SEQ ID NO: 810016 - DNA, 20 bp, mouse
gttggcataaggctattagg

SEQ ID NO: 810017 - DNA, 20 bp, mouse
gagtaagctgtggagatatc

SEQ ID NO: 810018 - DNA, 20 bp, mouse
gtagagattggtgataggaa

SEQ ID NO: 810019 - DNA, 20 bp, mouse
ggatactctcaggggtgaca

SEQ ID NO: 810020 - DNA, 20 bp, mouse
ggccttatgccaatccagaa

SEQ ID NO: 810021 - DNA, 20 bp, mouse
gcagagtatggactagagat

SEQ ID NO: 810022 - DNA, 20 bp, mouse
gcgtttgtgcccatctctgt

SEQ ID NO: 810023 - DNA, 20 bp, mouse
gccacagtactacattgctc

SEQ ID NO: 810024 - DNA, 20 bp, mouse
gcataaggctattaggaggc

SEQ ID NO: 810025 - DNA, 20 bp, mouse
gtgtaatctcatctccattc

SEQ ID NO: 810026 - DNA, 20 bp, mouse
ggatctctaccctactgtac

SEQ ID NO: 810027 - DNA, 20 bp, mouse
gggcttgtacagagaagagt

SEQ ID NO: 810028 - DNA, 20 bp, mouse
gcttctctgtacaagcccat

SEQ ID NO: 810029 - DNA, 20 bp, mouse
gactacaaatccatattacc

SEQ ID NO: 810030 - DNA, 20 bp, mouse
gaagaagattcctggtaata

SEQ ID NO: 810031 - DNA, 20 bp, mouse
gaaatgtttcaaagacaatg

SEQ ID NO: 810032 - DNA, 20 bp, mouse
gaagcaagttggcaagaaaa

SEQ ID NO: 810033 - DNA, 20 bp, mouse
ggggtagagatcatgcattc

SEQ ID NO: 810034 - DNA, 20 bp, mouse
gttcaaagacaatgtggaaa

SEQ ID NO: 810035 - DNA, 20 bp, mouse
gttagagttggatctccttg

SEQ ID NO: 810036 - DNA, 20 bp, mouse
gccctccctggcaaaaagta

SEQ ID NO: 810037 - DNA, 20 bp, mouse
gcttcaatgatgtagaaaag

SEQ ID NO: 810038 - DNA, 20 bp, mouse
gaccctactttttgccaggg

SEQ ID NO: 810039 - DNA, 20 bp, mouse
gctctaccctactttttgcc

SEQ ID NO: 810040 - DNA, 20 bp, mouse
gtagtattatctgtggttat

SEQ ID NO: 810041 - DNA, 20 bp, mouse
gcttttctacacaagcccat

SEQ ID NO: 810042 - DNA, 20 bp, mouse
gcaagaattacaactctctg

SEQ ID NO: 810043 - DNA, 20 bp, mouse
gattttttttattaggttct

SEQ ID NO: 810044 - DNA, 20 bp, mouse
gatcaagctgcagccctccc

SEQ ID NO: 810045 - DNA, 20 bp, mouse
gggcttgtgtagaaaagaga

SEQ ID NO: 810046 - DNA, 20 bp, mouse
gcaggaaggagttctgatag

SEQ ID NO: 810047 - DNA, 20 bp, mouse
gcttgtgtagaacagaggtg

SEQ ID NO: 810048 - DNA, 20 bp, mouse
gcttcagagtcgatgtggaa

SEQ ID NO: 810049 - DNA, 20 bp, mouse
ggggagaagtcagaagcaaa

SEQ ID NO: 810050 - DNA, 20 bp, mouse
gaggtggggcttttcccatc

SEQ ID NO: 810051 - DNA, 20 bp, mouse
gaaatgcttcagagtcgatg

SEQ ID NO: 810052 - DNA, 20 bp, mouse
ggcccttgatgggaataaat

SEQ ID NO: 810053 - DNA, 20 bp, mouse
ggccctccttgtctcctgga

SEQ ID NO: 810054 - DNA, 20 bp, mouse
ggcactggggacaacatgcc

SEQ ID NO: 810055 - DNA, 20 bp, mouse
gctgcagctaacatttgttt

SEQ ID NO: 810056 - DNA, 20 bp, mouse
gaggctccagcctcgggctc

SEQ ID NO: 810057 - DNA, 20 bp, mouse
gtggagccttgaacttgtta

SEQ ID NO: 810058 - DNA, 20 bp, mouse
gactggtgtcatcaattcca

SEQ ID NO: 810059 - DNA, 20 bp, mouse
gcaatgccagccagagcccg

SEQ ID NO: 810060 - DNA, 20 bp, mouse
gagaaaccttaacaagttca

SEQ ID NO: 810061 - DNA, 20 bp, mouse
gcactccagctctgcttcat

SEQ ID NO: 810062 - DNA, 20 bp, mouse
gctctgcttcattgggagct

SEQ ID NO: 810063 - DNA, 20 bp, mouse
gtcgtagggtccccgataaa

SEQ ID NO: 810064 - DNA, 20 bp, mouse
gtccagcctcgggctctggc

SEQ ID NO: 810065 - DNA, 20 bp, mouse
ggctagagaagatacagtta

SEQ ID NO: 810066 - DNA, 20 bp, mouse
gcccccaagcatcaaccaat

SEQ ID NO: 810067 - DNA, 20 bp, mouse
gtgtggctagagttgcgtca

SEQ ID NO: 810068 - DNA, 20 bp, mouse
ggaagaatcaggcaagggta

SEQ ID NO: 810069 - DNA, 20 bp, mouse
gcatctggcaggggactcat

SEQ ID NO: 810070 - DNA, 20 bp, mouse
gtggttaatggttagaggag

SEQ ID NO: 810071 - DNA, 20 bp, mouse
gggtgccttggcaccaggag

SEQ ID NO: 810072 - DNA, 20 bp, mouse
gagagttgcgtcagggttca

SEQ ID NO: 810073 - DNA, 20 bp, mouse
ggtgtcattgataagcgcca

SEQ ID NO: 810074 - DNA, 20 bp, mouse
gcttcccattggttgatgct

SEQ ID NO: 810075 - DNA, 20 bp, mouse
ggtcccctgccagatggcac

SEQ ID NO: 810076 - DNA, 20 bp, mouse
gtaaccatgccatgaactct

SEQ ID NO: 810077 - DNA, 20 bp, mouse
gagttcttcctgtcagtgtt

SEQ ID NO: 810078 - DNA, 20 bp, mouse
gaatgtcatcccagagttca

SEQ ID NO: 810079 - DNA, 20 bp, mouse
gaagaccaagtggaaaaaaa

SEQ ID NO: 810080 - DNA, 20 bp, mouse
gtacacctccccctaaccca

SEQ ID NO: 810081 - DNA, 20 bp, mouse
gttagcctctgtcactttct

SEQ ID NO: 810082 - DNA, 20 bp, mouse
ggctctagttttgcaataga

SEQ ID NO: 810083 - DNA, 20 bp, mouse
ggcatggttaatttgtaacc

SEQ ID NO: 810084 - DNA, 20 bp, mouse
gaggatggtttgtgtatatg

SEQ ID NO: 810085 - DNA, 20 bp, mouse
gaggctttttagtgctcaaa

SEQ ID NO: 810086 - DNA, 20 bp, mouse
gtgggcggggtgagatctgt

SEQ ID NO: 810087 - DNA, 20 bp, mouse
ggaccccattaaggggagga

SEQ ID NO: 810088 - DNA, 20 bp, mouse
gtcaggaggcactggaagat

SEQ ID NO: 810089 - DNA, 20 bp, mouse
gttgtagcatcaggaggcac

SEQ ID NO: 810090 - DNA, 20 bp, mouse
gggtgagatctgtcggagag

SEQ ID NO: 810091 - DNA, 20 bp, mouse
gcagagcaaggatggtcctg

SEQ ID NO: 810092 - DNA, 20 bp, mouse
gggaaaagttgattccagtt

SEQ ID NO: 810093 - DNA, 20 bp, mouse
gtctcatcgggaagccgact

SEQ ID NO: 810094 - DNA, 20 bp, mouse
gtcataatgaagctgtgggc

SEQ ID NO: 810095 - DNA, 20 bp, mouse
gacaggaccccattaagggg

SEQ ID NO: 810096 - DNA, 20 bp, mouse
gcattatatgagctcagtca

SEQ ID NO: 810097 - DNA, 20 bp, mouse
ggacaaggatagaactagga

SEQ ID NO: 810098 - DNA, 20 bp, mouse
ggagtgttgtcccatgtgta

SEQ ID NO: 810099 - DNA, 20 bp, mouse
gtgacttaaaagctctttaa

SEQ ID NO: 810100 - DNA, 20 bp, mouse
ggaactaggaaggccacatt

SEQ ID NO: 810101 - DNA, 20 bp, mouse
gttgaaaaattgactttaag

SEQ ID NO: 810102 - DNA, 20 bp, mouse
ggtggctcacagctttattg

SEQ ID NO: 810103 - DNA, 20 bp, mouse
gcaacactcatgtatcgtaa

SEQ ID NO: 810104 - DNA, 20 bp, mouse
gacacataaatagttaaacc

SEQ ID NO: 810105 - DNA, 20 bp, mouse
gcctgaggtttgtggtgaca

SEQ ID NO: 810106 - DNA, 20 bp, mouse
gaggaagtacagctccaaga

SEQ ID NO: 810107 - DNA, 20 bp, mouse
gtgacatgggctctatcaat

SEQ ID NO: 810108 - DNA, 20 bp, mouse
gggtcctttgttcataaagc

SEQ ID NO: 810109 - DNA, 20 bp, mouse
gacttccttgggtggaagtt

SEQ ID NO: 810110 - DNA, 20 bp, mouse
gagggaggagcaaaaagtaa

SEQ ID NO: 810111 - DNA, 20 bp, mouse
gaacccctggaaagttgaca

SEQ ID NO: 810112 - DNA, 20 bp, mouse
gctttctgaaggccatatag

SEQ ID NO: 810113 - DNA, 20 bp, mouse
gcatgcagttagaaagattc

SEQ ID NO: 810114 - DNA, 20 bp, mouse
gcaaacctaacttccaccca

SEQ ID NO: 810115 - DNA, 20 bp, mouse
gctgaatcataacaacacag

SEQ ID NO: 810116 - DNA, 20 bp, mouse
gtcgagaaagccatagatta

SEQ ID NO: 810117 - DNA, 20 bp, mouse
gggggcatgtaaaatgctta

SEQ ID NO: 810118 - DNA, 20 bp, mouse
gggctctagcccctaatcta

SEQ ID NO: 810119 - DNA, 20 bp, mouse
gaacaaagagcggaaattcc

SEQ ID NO: 810120 - DNA, 20 bp, mouse
gcacaggttgtggatttatt

SEQ ID NO: 810121 - DNA, 20 bp, mouse
gcgtctgtgccaagatcatt

SEQ ID NO: 810122 - DNA, 20 bp, mouse
ggggcaacagaagtattgag

SEQ ID NO: 810123 - DNA, 20 bp, mouse
ggagcggaaattccaggctc

SEQ ID NO: 810124 - DNA, 20 bp, mouse
gtctgtgatcatgactgagt

SEQ ID NO: 810125 - DNA, 20 bp, mouse
ggatgtagcattatgcttaa

SEQ ID NO: 810126 - DNA, 20 bp, mouse
gaactgtaatgactagggag

SEQ ID NO: 810127 - DNA, 20 bp, mouse
gctaataaaaatagcaggca

SEQ ID NO: 810128 - DNA, 20 bp, mouse
ggtacttcaagtacactgga

SEQ ID NO: 810129 - DNA, 20 bp, mouse
ggaattatagcccatgaggc

SEQ ID NO: 810130 - DNA, 20 bp, mouse
gtttccagtgaaacagcctc

SEQ ID NO: 810131 - DNA, 20 bp, mouse
gggttgctctcctgcctcat

SEQ ID NO: 810132 - DNA, 20 bp, mouse
gagagtgtgttgtatttcta

SEQ ID NO: 810133 - DNA, 20 bp, mouse
gagataaactgtaatgacta

SEQ ID NO: 810134 - DNA, 20 bp, mouse
gagtatgaagggcctctttt

SEQ ID NO: 810135 - DNA, 20 bp, mouse
ggggtaaaactttaatggtc

SEQ ID NO: 810136 - DNA, 20 bp, mouse
gataaaaaggcctgcaactg

SEQ ID NO: 810137 - DNA, 20 bp, mouse
ggggtggaggcgccttttct

SEQ ID NO: 810138 - DNA, 20 bp, mouse
gtttaaaacccgaccttgga

SEQ ID NO: 810139 - DNA, 20 bp, mouse
gaggcgcctccacccagctt

SEQ ID NO: 810140 - DNA, 20 bp, mouse
ggtggggaattgtgggttga

SEQ ID NO: 810141 - DNA, 20 bp, mouse
gtctgtgcggtatgtaggta

SEQ ID NO: 810142 - DNA, 20 bp, mouse
gaggtgccaaggctagctca

SEQ ID NO: 810143 - DNA, 20 bp, mouse
ggattgtggccactctcaag

SEQ ID NO: 810144 - DNA, 20 bp, mouse
gagtaaagtccccttgagag

SEQ ID NO: 810145 - DNA, 20 bp, mouse
gcctttatagcatgcagaag

SEQ ID NO: 810146 - DNA, 20 bp, mouse
gagagcatagcctggaatgg

SEQ ID NO: 810147 - DNA, 20 bp, mouse
gcataggtgtagctagaaac

SEQ ID NO: 810148 - DNA, 20 bp, mouse
gggagaagtagagcatagcc

SEQ ID NO: 810149 - DNA, 20 bp, mouse
gtgtgtgcatgggggtgtag

SEQ ID NO: 810150 - DNA, 20 bp, mouse
ggaagattgcaagcgcccac

SEQ ID NO: 810151 - DNA, 20 bp, mouse
gcaaaaaggaatcatttgat

SEQ ID NO: 810152 - DNA, 20 bp, mouse
ggggtgtagaggcacctttg

SEQ ID NO: 810153 - DNA, 20 bp, mouse
gggcttttcacagctcagga

SEQ ID NO: 810154 - DNA, 20 bp, mouse
gcatttttgcagtctttcag

SEQ ID NO: 810155 - DNA, 20 bp, mouse
gtgcacacaccttacaaaaa

SEQ ID NO: 810156 - DNA, 20 bp, mouse
gagattgcaggtactcccaa

SEQ ID NO: 810157 - DNA, 20 bp, mouse
gaggaaagtaattgcccctt

SEQ ID NO: 810158 - DNA, 20 bp, mouse
gaggcgtagagaaaaaagcc

SEQ ID NO: 810159 - DNA, 20 bp, mouse
gggtggagaggccttttctc

SEQ ID NO: 810160 - DNA, 20 bp, mouse
gtgaggaaaaataagttact

SEQ ID NO: 810161 - DNA, 20 bp, mouse
gcctgcaagctcagttttaa

SEQ ID NO: 810162 - DNA, 20 bp, mouse
gagttgagaatggtgacttg

SEQ ID NO: 810163 - DNA, 20 bp, mouse
ggataaatgtcctctattcc

SEQ ID NO: 810164 - DNA, 20 bp, mouse
gtcagctgcaaatggccaag

SEQ ID NO: 810165 - DNA, 20 bp, mouse
gccccttctgcgtactataa

SEQ ID NO: 810166 - DNA, 20 bp, mouse
gacagatggtggctgtccaa

SEQ ID NO: 810167 - DNA, 20 bp, mouse
ggaaaaaagagctgtgtggg

SEQ ID NO: 810168 - DNA, 20 bp, mouse
ggatggtggctgtccaaagg

SEQ ID NO: 810169 - DNA, 20 bp, mouse
gtaaagactcccacagatgg

SEQ ID NO: 810170 - DNA, 20 bp, mouse
ggtgtggacaaggtaatgac

SEQ ID NO: 810171 - DNA, 20 bp, mouse
gagctggcactgtgtggaca

SEQ ID NO: 810172 - DNA, 20 bp, mouse
gttctgagcggctgacacac

SEQ ID NO: 810173 - DNA, 20 bp, mouse
ggattccctgtagatccaaa

SEQ ID NO: 810174 - DNA, 20 bp, mouse
ggtgggagtctttacaataa

SEQ ID NO: 810175 - DNA, 20 bp, mouse
gtcttccctttggatctaca

SEQ ID NO: 810176 - DNA, 20 bp, mouse
ggagttgtcagaagtgtaaa

SEQ ID NO: 810177 - DNA, 20 bp, mouse
gtatcttaggtgttcattaa

SEQ ID NO: 810178 - DNA, 20 bp, mouse
gcactttaaaataaggtaat

SEQ ID NO: 810179 - DNA, 20 bp, mouse
gcacatttgtgagaaaaggc

SEQ ID NO: 810180 - DNA, 20 bp, mouse
ggaagacttttttctagcct

SEQ ID NO: 810181 - DNA, 20 bp, mouse
gctagccttggtgataactt

SEQ ID NO: 810182 - DNA, 20 bp, mouse
gcaactaaataaccttcatt

SEQ ID NO: 810183 - DNA, 20 bp, mouse
gaagaaaaagtacctaatga

SEQ ID NO: 810184 - DNA, 20 bp, mouse
gcaaaaggaagtacagtggt

SEQ ID NO: 810185 - DNA, 20 bp, mouse
ggtggcaaaaggaagtacag

SEQ ID NO: 810186 - DNA, 20 bp, mouse
gcaaagggaagtacagtgat

SEQ ID NO: 810187 - DNA, 20 bp, mouse
gcaaagtgatcaccaaggct

SEQ ID NO: 810188 - DNA, 20 bp, mouse
gaagaataaagacctaattt

SEQ ID NO: 810189 - DNA, 20 bp, mouse
gctgtacttccctttgccac

SEQ ID NO: 810190 - DNA, 20 bp, mouse
ggaagactttttcctagcct

SEQ ID NO: 810191 - DNA, 20 bp, mouse
gtttcttgtgatcatttgct

SEQ ID NO: 810192 - DNA, 20 bp, mouse
ggatgagtctgcagctgaca

SEQ ID NO: 810193 - DNA, 20 bp, mouse
ggcaacagtggtaaaaggag

SEQ ID NO: 810194 - DNA, 20 bp, mouse
gcaactaaataacctaaatt

SEQ ID NO: 810195 - DNA, 20 bp, mouse
gatgaggcaacagtggtaaa

SEQ ID NO: 810196 - DNA, 20 bp, mouse
gtggaagacttttctagcct

SEQ ID NO: 810197 - DNA, 20 bp, mouse
gatgagtctgcagctcacaa

SEQ ID NO: 810198 - DNA, 20 bp, mouse
gttaaaataaggtaattttt

SEQ ID NO: 810199 - DNA, 20 bp, mouse
gctgtactaccttttgccac

SEQ ID NO: 810200 - DNA, 20 bp, mouse
gatggtcacaagaaacaaat

SEQ ID NO: 810201 - DNA, 20 bp, mouse
gtttagttgtttggtatcat

SEQ ID NO: 810202 - DNA, 20 bp, mouse
gcaaaaggtagtacagtggt

SEQ ID NO: 810203 - DNA, 20 bp, mouse
gactcatctgaaatgtacat

SEQ ID NO: 810204 - DNA, 20 bp, mouse
gctagccttggtgatcactt

SEQ ID NO: 810205 - DNA, 20 bp, mouse
gtagtccaaagtgatcacca

SEQ ID NO: 810206 - DNA, 20 bp, mouse
gtggaagacttttctagcct

SEQ ID NO: 810207 - DNA, 20 bp, mouse
gatgagtctgcagctcacaa

SEQ ID NO: 810208 - DNA, 20 bp, mouse
gttaaaataaggtaattttt

SEQ ID NO: 810209 - DNA, 20 bp, mouse
gctgtactaccttttgccac

SEQ ID NO: 810210 - DNA, 20 bp, mouse
gatggtcacaagaaacaaat

SEQ ID NO: 810211 - DNA, 20 bp, mouse
gtttagttgtttggtatcat

SEQ ID NO: 810212 - DNA, 20 bp, mouse
gcaaaaggtagtacagtggt

SEQ ID NO: 810213 - DNA, 20 bp, mouse
gactcatctgaaatgtacat

SEQ ID NO: 810214 - DNA, 20 bp, mouse
gctagccttggtgatcactt

SEQ ID NO: 810215 - DNA, 20 bp, mouse
gtagtccaaagtgatcacca

SEQ ID NO: 810216 - DNA, 20 bp, mouse
gaagatattaacattgcaga

SEQ ID NO: 810217 - DNA, 20 bp, mouse
gtctttaagactttgcaagc

SEQ ID NO: 810218 - DNA, 20 bp, mouse
gcttgctagtttgggtggaa

SEQ ID NO: 810219 - DNA, 20 bp, mouse
gtgttaatatcttaagtaga

SEQ ID NO: 810220 - DNA, 20 bp, mouse
gtatatgtgacatttttgcc

SEQ ID NO: 810221 - DNA, 20 bp, mouse
ggtgaggaatgaaagacaaa

SEQ ID NO: 810222 - DNA, 20 bp, mouse
gtagatatttagctgtctga

SEQ ID NO: 810223 - DNA, 20 bp, mouse
gaattaaaggaaaagttgaa

SEQ ID NO: 810224 - DNA, 20 bp, mouse
gaactgaaaataatgttctt

SEQ ID NO: 810225 - DNA, 20 bp, mouse
ggagcaagaaaaatgcatcc

SEQ ID NO: 810226 - DNA, 20 bp, mouse
gcagacagcagcagcaagtt

SEQ ID NO: 810227 - DNA, 20 bp, mouse
gcagagccagagggataaat

SEQ ID NO: 810228 - DNA, 20 bp, mouse
gtatccctctggctctgcct

SEQ ID NO: 810229 - DNA, 20 bp, mouse
gggcaggaaggttctgttgg

SEQ ID NO: 810230 - DNA, 20 bp, mouse
gatgtcttccaatcttgcac

SEQ ID NO: 810231 - DNA, 20 bp, mouse
gaggctggaagacctgggtg

SEQ ID NO: 810232 - DNA, 20 bp, mouse
gtgagcttactcatgactct

SEQ ID NO: 810233 - DNA, 20 bp, mouse
gctgccttggcaggtagggt

SEQ ID NO: 810234 - DNA, 20 bp, mouse
ggcctgcgacaagcacgggc

SEQ ID NO: 810235 - DNA, 20 bp, mouse
gtgggtggtgcaggcagcgc

SEQ ID NO: 810236 - DNA, 20 bp, mouse
ggccgctcccgagtaggaaa

SEQ ID NO: 810237 - DNA, 20 bp, mouse
gaaaaggaagagagtaagta

SEQ ID NO: 810238 - DNA, 20 bp, mouse
gagaggataggctagattgt

SEQ ID NO: 810239 - DNA, 20 bp, mouse
gtgcccaatctgaggcaaag

SEQ ID NO: 810240 - DNA, 20 bp, mouse
gggtgcggccgctcccgagt

SEQ ID NO: 810241 - DNA, 20 bp, mouse
gttctggcatcgctaagtgg

SEQ ID NO: 810242 - DNA, 20 bp, mouse
gggccactttgcctcagatt

SEQ ID NO: 810243 - DNA, 20 bp, mouse
ggaagagagtaagtaaggcc

SEQ ID NO: 810244 - DNA, 20 bp, mouse
ggggtccgcaggcactcacc

SEQ ID NO: 810245 - DNA, 20 bp, mouse
gctaagtgctggcacacttc

SEQ ID NO: 810246 - DNA, 20 bp, mouse
gtcccaggggaggtgtcaga

SEQ ID NO: 810247 - DNA, 20 bp, mouse
gcaaacaaacagtgctagcg

SEQ ID NO: 810248 - DNA, 20 bp, mouse
gtagaagggtgtccactagg

SEQ ID NO: 810249 - DNA, 20 bp, mouse
gtcagcagctagctgcagac

SEQ ID NO: 810250 - DNA, 20 bp, mouse
ggtgggctgtccgggtgaaa

SEQ ID NO: 810251 - DNA, 20 bp, mouse
gtgaacccgactgcaggcaa

SEQ ID NO: 810252 - DNA, 20 bp, mouse
gttggatgaagcaattagaa

SEQ ID NO: 810253 - DNA, 20 bp, mouse
ggtggggaggtcccagagtc

SEQ ID NO: 810254 - DNA, 20 bp, mouse
gcccagagtcaggaagtccc

SEQ ID NO: 810255 - DNA, 20 bp, mouse
gagctgctgaacccgactgc

SEQ ID NO: 810256 - DNA, 20 bp, mouse
ggctctgatgcaaggggcgt

SEQ ID NO: 810257 - DNA, 20 bp, mouse
gcacatgtggatccggatct

SEQ ID NO: 810258 - DNA, 20 bp, mouse
gcagctggtggccacgcctt

SEQ ID NO: 810259 - DNA, 20 bp, mouse
ggtcctggatctccaagtct

SEQ ID NO: 810260 - DNA, 20 bp, mouse
gaagcagtcacatgtggatc

SEQ ID NO: 810261 - DNA, 20 bp, mouse
gagacctgcgatcaggggta

SEQ ID NO: 810262 - DNA, 20 bp, mouse
ggtcagttcagcacccactg

SEQ ID NO: 810263 - DNA, 20 bp, mouse
gaacaaatcaactcctcagt

SEQ ID NO: 810264 - DNA, 20 bp, mouse
ggcaggagcgggtgtggcgt

SEQ ID NO: 810265 - DNA, 20 bp, mouse
gggggtcggtgtcccagatc

SEQ ID NO: 810266 - DNA, 20 bp, mouse
gtggcccacagccaaaggat

SEQ ID NO: 810267 - DNA, 20 bp, mouse
gaaaggatggggtgcattgt

SEQ ID NO: 810268 - DNA, 20 bp, mouse
gtggtgtggcccacagccaa

SEQ ID NO: 810269 - DNA, 20 bp, mouse
gcaaaggattagctgcctaa

SEQ ID NO: 810270 - DNA, 20 bp, mouse
gtgggctctggtgttaggaa

SEQ ID NO: 810271 - DNA, 20 bp, mouse
gtgaagcccagggcaggtac

SEQ ID NO: 810272 - DNA, 20 bp, mouse
gaacccaggctgaactccct

SEQ ID NO: 810273 - DNA, 20 bp, mouse
gctggtgttaggaaaggcaa

SEQ ID NO: 810274 - DNA, 20 bp, mouse
gccaggctgaactccctggg

SEQ ID NO: 810275 - DNA, 20 bp, mouse
gcctctgtaggaaaccaccc

SEQ ID NO: 810276 - DNA, 20 bp, mouse
ggccctattgccacttggga

SEQ ID NO: 810277 - DNA, 20 bp, mouse
gtgcacttctggtgttgata

SEQ ID NO: 810278 - DNA, 20 bp, mouse
ggcctcctggccatcccaag

SEQ ID NO: 810279 - DNA, 20 bp, mouse
ggccatcccaagtggcaata

SEQ ID NO: 810280 - DNA, 20 bp, mouse
gcagagaggtgggtgtagtc

SEQ ID NO: 810281 - DNA, 20 bp, mouse
ggccacttgggatggccagg

SEQ ID NO: 810282 - DNA, 20 bp, mouse
gcagctgccctattgccact

SEQ ID NO: 810283 - DNA, 20 bp, mouse
gcagctgacttttctggtcc

SEQ ID NO: 810284 - DNA, 20 bp, mouse
gtctaggttaggaaattcag

SEQ ID NO: 810285 - DNA, 20 bp, mouse
gaagtgcaccagcacttaat

SEQ ID NO: 810286 - DNA, 20 bp, mouse
gaaaatgagcccttgaaggg

SEQ ID NO: 810287 - DNA, 20 bp, mouse
gcagagtaaccccccttcaa

SEQ ID NO: 810288 - DNA, 20 bp, mouse
gaatctgtacctgaggatga

SEQ ID NO: 810289 - DNA, 20 bp, mouse
gtagaaaatgagcccttgaa

SEQ ID NO: 810290 - DNA, 20 bp, mouse
gttgtctgctaaaattgaaa

SEQ ID NO: 810291 - DNA, 20 bp, mouse
gtctacagaattgggaacca

SEQ ID NO: 810292 - DNA, 20 bp, mouse
gtaaatgacatgaaacttag

SEQ ID NO: 810293 - DNA, 20 bp, mouse
gaaaggaattctagaataca

SEQ ID NO: 810294 - DNA, 20 bp, mouse
gaccagggaatctgtacctg

SEQ ID NO: 810295 - DNA, 20 bp, mouse
gatttcaattcaaagttgtc

SEQ ID NO: 810296 - DNA, 20 bp, mouse
gggctaaggtcccaagggtg

SEQ ID NO: 810297 - DNA, 20 bp, mouse
gtggacagggcactacggac

SEQ ID NO: 810298 - DNA, 20 bp, mouse
gcttcccaggctgcactaag

SEQ ID NO: 810299 - DNA, 20 bp, mouse
gcccacaggaagtttatttc

SEQ ID NO: 810300 - DNA, 20 bp, mouse
ggcctgaaataaacttcctg

SEQ ID NO: 810301 - DNA, 20 bp, mouse
gtatcctcttagtgcagcct

SEQ ID NO: 810302 - DNA, 20 bp, mouse
ggataatcatgttcatggac

SEQ ID NO: 810303 - DNA, 20 bp, mouse
gaagaggataatcatgttca

SEQ ID NO: 810304 - DNA, 20 bp, mouse
gcaagtacaaatggcttaga

SEQ ID NO: 810305 - DNA, 20 bp, mouse
gccttgggaccttagccaat

SEQ ID NO: 810306 - DNA, 20 bp, mouse
gcctggccaggcagcttctt

SEQ ID NO: 810307 - DNA, 20 bp, mouse
gcaggcgccttgccccgatc

SEQ ID NO: 810308 - DNA, 20 bp, mouse
ggcgccttgccccgatcagg

SEQ ID NO: 810309 - DNA, 20 bp, mouse
gaggaatcgcaactgctctc

SEQ ID NO: 810310 - DNA, 20 bp, mouse
gaggatgcatgccaaaagct

SEQ ID NO: 810311 - DNA, 20 bp, mouse
gtcggggcaaggcgcctgtc

SEQ ID NO: 810312 - DNA, 20 bp, mouse
gatgttctgagtcacccgac

SEQ ID NO: 810313 - DNA, 20 bp, mouse
ggcaagagccggttggcagt

SEQ ID NO: 810314 - DNA, 20 bp, mouse
gctcctcccagatcccactg

SEQ ID NO: 810315 - DNA, 20 bp, mouse
gtgccccgatcaggaggatc

SEQ ID NO: 810316 - DNA, 20 bp, mouse
gggcaagtggtagatgtgaa

SEQ ID NO: 810317 - DNA, 20 bp, mouse
gtggcgaccacagcaggaag

SEQ ID NO: 810318 - DNA, 20 bp, mouse
ggggcctgcggggtggcaag

SEQ ID NO: 810319 - DNA, 20 bp, mouse
ggcaccaagggagaatgtca

SEQ ID NO: 810320 - DNA, 20 bp, mouse
gaaactctgggcctgcgggg

SEQ ID NO: 810321 - DNA, 20 bp, mouse
gctaccacttgccaccccgc

SEQ ID NO: 810322 - DNA, 20 bp, mouse
gtgggggttgggaaaaaact

SEQ ID NO: 810323 - DNA, 20 bp, mouse
gtttgccaggagaggaggct

SEQ ID NO: 810324 - DNA, 20 bp, mouse
gtgaccggggcacaggcgac

SEQ ID NO: 810325 - DNA, 20 bp, mouse
gaatccctgacattctccct

SEQ ID NO: 810326 - DNA, 20 bp, mouse
ggggtgggcccttagaggaa

SEQ ID NO: 810327 - DNA, 20 bp, mouse
gaaactgggtgggcccttag

SEQ ID NO: 810328 - DNA, 20 bp, mouse
gtgcaagaagaggactggtg

SEQ ID NO: 810329 - DNA, 20 bp, mouse
gaggcagcctatctctctgt

SEQ ID NO: 810330 - DNA, 20 bp, mouse
gggttggggaaaaaaaaact

SEQ ID NO: 810331 - DNA, 20 bp, mouse
gtagaggaagggaaaatagc

SEQ ID NO: 810332 - DNA, 20 bp, mouse
gctggatagcattcttggtt

SEQ ID NO: 810333 - DNA, 20 bp, mouse
ggtggccagaggcactaaac

SEQ ID NO: 810334 - DNA, 20 bp, mouse
gcattgctggatagcattct

SEQ ID NO: 810335 - DNA, 20 bp, mouse
gtctctctgtaggtggccag

SEQ ID NO: 810336 - DNA, 20 bp, mouse
gacaaggtagagttagatgg

SEQ ID NO: 810337 - DNA, 20 bp, mouse
gctggctttcagggaaccaa

SEQ ID NO: 810338 - DNA, 20 bp, mouse
gctctgagagaaagtaaaac

SEQ ID NO: 810339 - DNA, 20 bp, mouse
gtgtggagctggatgaggtc

SEQ ID NO: 810340 - DNA, 20 bp, mouse
ggctcagtgcccgaggcaag

SEQ ID NO: 810341 - DNA, 20 bp, mouse
gcctgaaagccagagattca

SEQ ID NO: 810342 - DNA, 20 bp, mouse
gcagtgcccgaggcaagagg

SEQ ID NO: 810343 - DNA, 20 bp, mouse
gtagaaccactattctccct

SEQ ID NO: 810344 - DNA, 20 bp, mouse
gttgctctgcagtaaatgaa

SEQ ID NO: 810345 - DNA, 20 bp, mouse
gggccaagtgtagacctgac

SEQ ID NO: 810346 - DNA, 20 bp, mouse
gccaagctgtgcattcaatc

SEQ ID NO: 810347 - DNA, 20 bp, mouse
ggcccagactgtgactgctc

SEQ ID NO: 810348 - DNA, 20 bp, mouse
gtaaccctgaaagtatgttc

SEQ ID NO: 810349 - DNA, 20 bp, mouse
gcttgagcacgcctcacctc

SEQ ID NO: 810350 - DNA, 20 bp, mouse
gtgcattcaatccggaggtg

SEQ ID NO: 810351 - DNA, 20 bp, mouse
gagcagcacggcagagtaga

SEQ ID NO: 810352 - DNA, 20 bp, mouse
ggtgactcagaactgcatta

SEQ ID NO: 810353 - DNA, 20 bp, mouse
gctgagatactgaatgagac

SEQ ID NO: 810354 - DNA, 20 bp, mouse
ggagagatccgaagttccct

SEQ ID NO: 810355 - DNA, 20 bp, mouse
ggaatgaaggggtggaagct

SEQ ID NO: 810356 - DNA, 20 bp, mouse
gtgcaggctagtggtagagg

SEQ ID NO: 810357 - DNA, 20 bp, mouse
gggaataaatacttcagccc

SEQ ID NO: 810358 - DNA, 20 bp, mouse
ggtgggaaacgtcatgctca

SEQ ID NO: 810359 - DNA, 20 bp, mouse
gtagggatgactgggggttg

SEQ ID NO: 810360 - DNA, 20 bp, mouse
gtctgtcgaacaaggaatca

SEQ ID NO: 810361 - DNA, 20 bp, mouse
gatgatgtcagaacacctgt

SEQ ID NO: 810362 - DNA, 20 bp, mouse
gcttggttctctgtcgaaca

SEQ ID NO: 810363 - DNA, 20 bp, mouse
gataaatacttcagccctgg

SEQ ID NO: 810364 - DNA, 20 bp, mouse
gtattagtcttacctcctcc

SEQ ID NO: 810365 - DNA, 20 bp, mouse
gttgtgacagtgtttgctcc

SEQ ID NO: 810366 - DNA, 20 bp, mouse
gtgaaggaggtaagactagt

SEQ ID NO: 810367 - DNA, 20 bp, mouse
ggcagtctataatcagcaat

SEQ ID NO: 810368 - DNA, 20 bp, mouse
gacatatgatgcagaattct

SEQ ID NO: 810369 - DNA, 20 bp, mouse
gccatccatgaaagacattc

SEQ ID NO: 810370 - DNA, 20 bp, mouse
ggagacgtcatgcttagggc

SEQ ID NO: 810371 - DNA, 20 bp, mouse
gaacacctgaatgtctttca

SEQ ID NO: 810372 - DNA, 20 bp, mouse
gcactgaggcagattaatac

SEQ ID NO: 810373 - DNA, 20 bp, mouse
ggttcacatgacagaacaca

SEQ ID NO: 810374 - DNA, 20 bp, mouse
gatacagtatattctctcca

SEQ ID NO: 810375 - DNA, 20 bp, mouse
gagtaggatccttggttctc

SEQ ID NO: 810376 - DNA, 20 bp, mouse
gaacaattggaaaattcgtg

SEQ ID NO: 810377 - DNA, 20 bp, mouse
ggcagtctataaccaacaat

SEQ ID NO: 810378 - DNA, 20 bp, mouse
gacatatgatgcagaattct

SEQ ID NO: 810379 - DNA, 20 bp, mouse
gctgtgggtccatccatgaa

SEQ ID NO: 810380 - DNA, 20 bp, mouse
ggaaaggcattcaggtgtta

SEQ ID NO: 810381 - DNA, 20 bp, mouse
ggagacgtcatgcttagggc

SEQ ID NO: 810382 - DNA, 20 bp, mouse
gcctgaatgcctttcatgga

SEQ ID NO: 810383 - DNA, 20 bp, mouse
gcactgaggcagattaatac

SEQ ID NO: 810384 - DNA, 20 bp, mouse
gatacagtatattctctcca

SEQ ID NO: 810385 - DNA, 20 bp, mouse
gagtagaatccttggttctc

SEQ ID NO: 810386 - DNA, 20 bp, mouse
gcctgattgccttacatgga

SEQ ID NO: 810387 - DNA, 20 bp, mouse
gatgacgtcctcaccatgca

SEQ ID NO: 810388 - DNA, 20 bp, mouse
ggcagtctataaccagtgat

SEQ ID NO: 810389 - DNA, 20 bp, mouse
ggtgttataatgtttgctcc

SEQ ID NO: 810390 - DNA, 20 bp, mouse
gcactgaggtagattagtac

SEQ ID NO: 810391 - DNA, 20 bp, mouse
ggtactgtatattctatcca

SEQ ID NO: 810392 - DNA, 20 bp, mouse
gaaaagaattttccaatcac

SEQ ID NO: 810393 - DNA, 20 bp, mouse
gaacacctgattgccttaca

SEQ ID NO: 810394 - DNA, 20 bp, mouse
gaaaacaattaaaaaatggg

SEQ ID NO: 810395 - DNA, 20 bp, mouse
ggtacttgcatgtgtcaatg

SEQ ID NO: 810396 - DNA, 20 bp, mouse
gttcactggggcccttggta

SEQ ID NO: 810397 - DNA, 20 bp, mouse
gcatgcctctcccatgtgca

SEQ ID NO: 810398 - DNA, 20 bp, mouse
gaggtaggatcagatggcaa

SEQ ID NO: 810399 - DNA, 20 bp, mouse
gacagactgcaccttaccaa

SEQ ID NO: 810400 - DNA, 20 bp, mouse
gccagtgaacaccatgcaca

SEQ ID NO: 810401 - DNA, 20 bp, mouse
gcaaggataaaagaggaggt

SEQ ID NO: 810402 - DNA, 20 bp, mouse
gcttacgcaagtgtgctctt

SEQ ID NO: 810403 - DNA, 20 bp, mouse
gcagtctgtttcagcgggtc

SEQ ID NO: 810404 - DNA, 20 bp, mouse
gtgtttcagcgggtctgggg

SEQ ID NO: 810405 - DNA, 20 bp, mouse
gtggtgttcactggggccct

SEQ ID NO: 810406 - DNA, 20 bp, mouse
gcagacgtgctgacacagat

SEQ ID NO: 810407 - DNA, 20 bp, mouse
gtgggtctccgtctgtgtga

SEQ ID NO: 810408 - DNA, 20 bp, mouse
gcgagatgtgctgaacaaga

SEQ ID NO: 810409 - DNA, 20 bp, mouse
ggccacacagaactgtagtt

SEQ ID NO: 810410 - DNA, 20 bp, mouse
gggacactgaacagtgcctc

SEQ ID NO: 810411 - DNA, 20 bp, mouse
gagctcactttgatcactta

SEQ ID NO: 810412 - DNA, 20 bp, mouse
gacacagacggagacccagc

SEQ ID NO: 810413 - DNA, 20 bp, mouse
ggagccatgtcttcccctgc

SEQ ID NO: 810414 - DNA, 20 bp, mouse
gaaggctgctacacaataga

SEQ ID NO: 810415 - DNA, 20 bp, mouse
gctgaagttatgcatacctg

SEQ ID NO: 810416 - DNA, 20 bp, mouse
gtacgtgtgaaagggcatgg

SEQ ID NO: 810417 - DNA, 20 bp, mouse
gcgtgtgtgtacgtgtgaaa

SEQ ID NO: 810418 - DNA, 20 bp, mouse
gtaggcccagggtgcacaag

SEQ ID NO: 810419 - DNA, 20 bp, mouse
gacgtgtcccagcaagtcac

SEQ ID NO: 810420 - DNA, 20 bp, mouse
gaccgaccagccaaaggcac

SEQ ID NO: 810421 - DNA, 20 bp, mouse
gcagcaagtcactgggaggg

SEQ ID NO: 810422 - DNA, 20 bp, mouse
gtgcagcagaccaaggctcg

SEQ ID NO: 810423 - DNA, 20 bp, mouse
ggcaccctgggcctacatcc

SEQ ID NO: 810424 - DNA, 20 bp, mouse
gggctcttgtggtacttcca

SEQ ID NO: 810425 - DNA, 20 bp, mouse
gtagacgaccgaccagccaa

SEQ ID NO: 810426 - DNA, 20 bp, mouse
gggcgtcctaaagtcccctg

SEQ ID NO: 810427 - DNA, 20 bp, mouse
gagatgccgccctctcgcgg

SEQ ID NO: 810428 - DNA, 20 bp, mouse
gctgcggtgcagagacgttg

SEQ ID NO: 810429 - DNA, 20 bp, mouse
ggggcggcatctggcgaccg

SEQ ID NO: 810430 - DNA, 20 bp, mouse
ggagctgcacgtggatcgtc

SEQ ID NO: 810431 - DNA, 20 bp, mouse
ggcgaccgcgggtcgggcag

SEQ ID NO: 810432 - DNA, 20 bp, mouse
ggcatctggcgaccgcgggt

SEQ ID NO: 810433 - DNA, 20 bp, mouse
ggtctggccggagctttctg

SEQ ID NO: 810434 - DNA, 20 bp, mouse
gacgacgcgtcttgcgtctc

SEQ ID NO: 810435 - DNA, 20 bp, mouse
gtgccacacaaaggcggcgg

SEQ ID NO: 810436 - DNA, 20 bp, mouse
gggagtggtagagacatcgc

SEQ ID NO: 810437 - DNA, 20 bp, mouse
gatgcccatcaagccttcta

SEQ ID NO: 810438 - DNA, 20 bp, mouse
gacagctgagatgcttctcc

SEQ ID NO: 810439 - DNA, 20 bp, mouse
gtgagagcagagtatgcctc

SEQ ID NO: 810440 - DNA, 20 bp, mouse
gaagccttagaaggcttgat

SEQ ID NO: 810441 - DNA, 20 bp, mouse
gaaggcttgatgggcatggc

SEQ ID NO: 810442 - DNA, 20 bp, mouse
gggagcctggacgttctgca

SEQ ID NO: 810443 - DNA, 20 bp, mouse
gcaattaccagcttcctccc

SEQ ID NO: 810444 - DNA, 20 bp, mouse
gcgtccaggctccaggaatt

SEQ ID NO: 810445 - DNA, 20 bp, mouse
ggagagaggcactaggtacc

SEQ ID NO: 810446 - DNA, 20 bp, mouse
gtggctccaagaccacacgt

SEQ ID NO: 810447 - DNA, 20 bp, mouse
gagatccaagggagatgtgg

SEQ ID NO: 810448 - DNA, 20 bp, mouse
gtggtcttggagccacatgg

SEQ ID NO: 810449 - DNA, 20 bp, mouse
ggctaacttcaggggcactt

SEQ ID NO: 810450 - DNA, 20 bp, mouse
ggaagagagataaagatcca

SEQ ID NO: 810451 - DNA, 20 bp, mouse
ggaacccagcatctccatac

SEQ ID NO: 810452 - DNA, 20 bp, mouse
gttggagccacatggcggaa

SEQ ID NO: 810453 - DNA, 20 bp, mouse
gccagccggtatggagatgc

SEQ ID NO: 810454 - DNA, 20 bp, mouse
gtctcccaccacatctccct

SEQ ID NO: 810455 - DNA, 20 bp, mouse
gtaaagatccaagggagatg

SEQ ID NO: 810456 - DNA, 20 bp, mouse
ggggtagccttgatgggaaa

SEQ ID NO: 810457 - DNA, 20 bp, mouse
gctgaacacaagctgaacgg

SEQ ID NO: 810458 - DNA, 20 bp, mouse
gcaggctcaggcagggttct

SEQ ID NO: 810459 - DNA, 20 bp, mouse
gcaggagcagataagtgagg

SEQ ID NO: 810460 - DNA, 20 bp, mouse
ggccctgctggctgcactgg

SEQ ID NO: 810461 - DNA, 20 bp, mouse
ggcctggagaaggggtttac

SEQ ID NO: 810462 - DNA, 20 bp, mouse
ggggttctgggtagccttga

SEQ ID NO: 810463 - DNA, 20 bp, mouse
gctgtgtaagggcgcagagt

SEQ ID NO: 810464 - DNA, 20 bp, mouse
gtcccccagtgcagccagca

SEQ ID NO: 810465 - DNA, 20 bp, mouse
gccggttaaacattgatatg

SEQ ID NO: 810466 - DNA, 20 bp, mouse
gagaaggttgccccagaggg

SEQ ID NO: 810467 - DNA, 20 bp, mouse
gcggtgccgggaaagcgaag

SEQ ID NO: 810468 - DNA, 20 bp, mouse
ggggaaagcgaagcggtttg

SEQ ID NO: 810469 - DNA, 20 bp, mouse
gacacaccctggaagggtcg

SEQ ID NO: 810470 - DNA, 20 bp, mouse
gtcgaggcctggaatggaat

SEQ ID NO: 810471 - DNA, 20 bp, mouse
gccaggcctcgacccttcca

SEQ ID NO: 810472 - DNA, 20 bp, mouse
ggaacagatgggccgagacc

SEQ ID NO: 810473 - DNA, 20 bp, mouse
ggggacgagtctcgaactgt

SEQ ID NO: 810474 - DNA, 20 bp, mouse
ggcagggagattgaacagat

SEQ ID NO: 810475 - DNA, 20 bp, mouse
ggaatggggtaggatgtgac

SEQ ID NO: 810476 - DNA, 20 bp, mouse
gggagagagcccgcaggcac

SEQ ID NO: 810477 - DNA, 20 bp, mouse
ggagtcccctctacctagta

SEQ ID NO: 810478 - DNA, 20 bp, mouse
ggggagccagggtggtttgg

SEQ ID NO: 810479 - DNA, 20 bp, mouse
ggacctcccccaaaccaccc

SEQ ID NO: 810480 - DNA, 20 bp, mouse
gccctcgccctactaggtag

SEQ ID NO: 810481 - DNA, 20 bp, mouse
gagggcgccgtggctcggag

SEQ ID NO: 810482 - DNA, 20 bp, mouse
gggcgggagccagggtggtt

SEQ ID NO: 810483 - DNA, 20 bp, mouse
gcccgcaccagctagacctt

SEQ ID NO: 810484 - DNA, 20 bp, mouse
gagactcgagagtgaactga

SEQ ID NO: 810485 - DNA, 20 bp, mouse
gcggaatcccaagaatgccc

SEQ ID NO: 810486 - DNA, 20 bp, mouse
gggccaggtgcgatgccaga

SEQ ID NO: 810487 - DNA, 20 bp, mouse
ggggagaaagtccgaaatga

SEQ ID NO: 810488 - DNA, 20 bp, mouse
gggtactgttgcttcggagt

SEQ ID NO: 810489 - DNA, 20 bp, mouse
ggcgcagcctaggcgcagag

SEQ ID NO: 810490 - DNA, 20 bp, mouse
gaaggctctaggggctagac

SEQ ID NO: 810491 - DNA, 20 bp, mouse
ggtccagtgaacacgggagt

SEQ ID NO: 810492 - DNA, 20 bp, mouse
gtaggctgcgcagatggcag

SEQ ID NO: 810493 - DNA, 20 bp, mouse
gaggcgcagagcggtacccg

SEQ ID NO: 810494 - DNA, 20 bp, mouse
gggcggggaggaaggctcta

SEQ ID NO: 810495 - DNA, 20 bp, mouse
gtagcaagcgacaggaggct

SEQ ID NO: 810496 - DNA, 20 bp, mouse
ggcacagtgcacacctgcta

SEQ ID NO: 810497 - DNA, 20 bp, mouse
gtgaagcagcttattggtga

SEQ ID NO: 810498 - DNA, 20 bp, mouse
gtgcacacctgctatggttg

SEQ ID NO: 810499 - DNA, 20 bp, mouse
gtaatgtgctggattctaat

SEQ ID NO: 810500 - DNA, 20 bp, mouse
gcactttgaagcatttatga

SEQ ID NO: 810501 - DNA, 20 bp, mouse
gatgcttcaaagtgcttagg

SEQ ID NO: 810502 - DNA, 20 bp, mouse
gtatcattaacttgatcaca

SEQ ID NO: 810503 - DNA, 20 bp, mouse
ggtataaatgactggaaata

SEQ ID NO: 810504 - DNA, 20 bp, mouse
gtaagctgcttcatataaga

SEQ ID NO: 810505 - DNA, 20 bp, mouse
gcgtttaagataaatatagt

SEQ ID NO: 810506 - DNA, 20 bp, mouse
gcggggccgttccagaagga

SEQ ID NO: 810507 - DNA, 20 bp, mouse
gtgagcggggccgttccaga

SEQ ID NO: 810508 - DNA, 20 bp, mouse
ggtccctaaagcgcatgccc

SEQ ID NO: 810509 - DNA, 20 bp, mouse
ggtggggcgatgacaggtag

SEQ ID NO: 810510 - DNA, 20 bp, mouse
gcgcgagtgggcgggaacta

SEQ ID NO: 810511 - DNA, 20 bp, mouse
gctcagggatcggctctcgt

SEQ ID NO: 810512 - DNA, 20 bp, mouse
ggaactgcgcctaccgtccc

SEQ ID NO: 810513 - DNA, 20 bp, mouse
gacaacctcccccctccttc

SEQ ID NO: 810514 - DNA, 20 bp, mouse
gctcctgggcatgcgcttta

SEQ ID NO: 810515 - DNA, 20 bp, mouse
gctagggatagtcgagtgtc

SEQ ID NO: 810516 - DNA, 20 bp, mouse
gtggacctgaaggcacgggt

SEQ ID NO: 810517 - DNA, 20 bp, mouse
ggggccctgcgaagctgagg

SEQ ID NO: 810518 - DNA, 20 bp, mouse
ggggacctatagtaggaggt

SEQ ID NO: 810519 - DNA, 20 bp, mouse
ggggcgggacctatagtagg

SEQ ID NO: 810520 - DNA, 20 bp, mouse
gggcgggccctgcgaagctg

SEQ ID NO: 810521 - DNA, 20 bp, mouse
gggtgggcgggacctatagt

SEQ ID NO: 810522 - DNA, 20 bp, mouse
gagggtgaactctcaggaag

SEQ ID NO: 810523 - DNA, 20 bp, mouse
gggtccggaccggctggagg

SEQ ID NO: 810524 - DNA, 20 bp, mouse
ggccccgcctccagccggtc

SEQ ID NO: 810525 - DNA, 20 bp, mouse
gcccgcccacccgtgccttc

SEQ ID NO: 810526 - DNA, 20 bp, mouse
ggggcgtgatcatagaccaa

SEQ ID NO: 810527 - DNA, 20 bp, mouse
gtgactccgcgggtctcccg

SEQ ID NO: 810528 - DNA, 20 bp, mouse
gcgcacttctagaacgagga

SEQ ID NO: 810529 - DNA, 20 bp, mouse
ggcgcagcgaggctgcccag

SEQ ID NO: 810530 - DNA, 20 bp, mouse
gcggcgaggcgggcggggta

SEQ ID NO: 810531 - DNA, 20 bp, mouse
gggcagtgaggctcgctagg

SEQ ID NO: 810532 - DNA, 20 bp, mouse
ggcagggcgtaccgccgtga

SEQ ID NO: 810533 - DNA, 20 bp, mouse
gtggcccaatgagtcttcta

SEQ ID NO: 810534 - DNA, 20 bp, mouse
gccgcccagctggaccggga

SEQ ID NO: 810535 - DNA, 20 bp, mouse
gtgggtggacgttgagcagg

SEQ ID NO: 810536 - DNA, 20 bp, mouse
gggacggggcctagcatccg

SEQ ID NO: 810537 - DNA, 20 bp, mouse
gactgggccgggtccggttt

SEQ ID NO: 810538 - DNA, 20 bp, mouse
gttaggttggctactggtca

SEQ ID NO: 810539 - DNA, 20 bp, mouse
gcagtggggtctggtataag

SEQ ID NO: 810540 - DNA, 20 bp, mouse
gctaggccccgtccatcact

SEQ ID NO: 810541 - DNA, 20 bp, mouse
gcggagcggagtctccacgg

SEQ ID NO: 810542 - DNA, 20 bp, mouse
ggcccgccgcggggcgccat

SEQ ID NO: 810543 - DNA, 20 bp, mouse
gcattggctaagaggagcca

SEQ ID NO: 810544 - DNA, 20 bp, mouse
gccactcggctcctccccgg

SEQ ID NO: 810545 - DNA, 20 bp, mouse
gacgccccccggagttccga

SEQ ID NO: 810546 - DNA, 20 bp, mouse
gtccgccctcggggccgcgc

SEQ ID NO: 810547 - DNA, 20 bp, mouse
gtgcagcccctgcctcccgc

SEQ ID NO: 810548 - DNA, 20 bp, mouse
ggcgcgtggggtccgggctg

SEQ ID NO: 810549 - DNA, 20 bp, mouse
gatagacaagacgtctgggc

SEQ ID NO: 810550 - DNA, 20 bp, mouse
gggcgcggcgccccgcgatc

SEQ ID NO: 810551 - DNA, 20 bp, mouse
gagcgggcgggggagcgcaa

SEQ ID NO: 810552 - DNA, 20 bp, mouse
gggaagaaagtctttagtaa

SEQ ID NO: 810553 - DNA, 20 bp, mouse
ggctctgctggatgcccccg

SEQ ID NO: 810554 - DNA, 20 bp, mouse
gccgcgatctggcagagcgg

SEQ ID NO: 810555 - DNA, 20 bp, mouse
gccgcggggaaatggcaaac

SEQ ID NO: 810556 - DNA, 20 bp, mouse
ggcgcggggagccccatctg

SEQ ID NO: 810557 - DNA, 20 bp, mouse
gcagcacggcgttctaacga

SEQ ID NO: 810558 - DNA, 20 bp, mouse
ggaggagcttacaccctggt

SEQ ID NO: 810559 - DNA, 20 bp, mouse
gacaccctggttggaggacg

SEQ ID NO: 810560 - DNA, 20 bp, mouse
gcacggcgttctaacgaggg

SEQ ID NO: 810561 - DNA, 20 bp, mouse
gcacctgccttccccagatg

SEQ ID NO: 810562 - DNA, 20 bp, mouse
ggcagctcgcccttttggag

SEQ ID NO: 810563 - DNA, 20 bp, mouse
gcctcctcgtcctccaacca

SEQ ID NO: 810564 - DNA, 20 bp, mouse
ggagggaggagcttacaccc

SEQ ID NO: 810565 - DNA, 20 bp, mouse
ggactcgtaaagacataaga

SEQ ID NO: 810566 - DNA, 20 bp, mouse
ggagcatcggcgtaccccgg

SEQ ID NO: 810567 - DNA, 20 bp, mouse
gcgggtgctggcggggtagg

SEQ ID NO: 810568 - DNA, 20 bp, mouse
gtcgccgctgacactgtgat

SEQ ID NO: 810569 - DNA, 20 bp, mouse
gcgaggctccggtgctccgg

SEQ ID NO: 810570 - DNA, 20 bp, mouse
ggccctgccgcggcgctagg

SEQ ID NO: 810571 - DNA, 20 bp, mouse
gtgtcagcggcgactaaggg

SEQ ID NO: 810572 - DNA, 20 bp, mouse
gtaccccgggggacaagaac

SEQ ID NO: 810573 - DNA, 20 bp, mouse
gggagactggtgtcggagga

SEQ ID NO: 810574 - DNA, 20 bp, mouse
ggggcggagactggtgtcgg

SEQ ID NO: 810575 - DNA, 20 bp, mouse
gacagtgtcagcggcgacta

SEQ ID NO: 810576 - DNA, 20 bp, mouse
ggacaagcgcctgggaactc

SEQ ID NO: 810577 - DNA, 20 bp, mouse
gctcccccagggaccgcagc

SEQ ID NO: 810578 - DNA, 20 bp, mouse
gcggagccgacacctccctc

SEQ ID NO: 810579 - DNA, 20 bp, mouse
ggcagccctaatgactcctt

SEQ ID NO: 810580 - DNA, 20 bp, mouse
gagcccgctgcggtccctgg

SEQ ID NO: 810581 - DNA, 20 bp, mouse
gtagggctgcgtgatgaaac

SEQ ID NO: 810582 - DNA, 20 bp, mouse
gtcgatgctgattggacgga

SEQ ID NO: 810583 - DNA, 20 bp, mouse
gaaggcgttagtcaggtctc

SEQ ID NO: 810584 - DNA, 20 bp, mouse
gcttgtcgatgctgattgga

SEQ ID NO: 810585 - DNA, 20 bp, mouse
gtgatgaaacgggacttcac

SEQ ID NO: 810586 - DNA, 20 bp, mouse
gccactacctaactaaccca

SEQ ID NO: 810587 - DNA, 20 bp, mouse
gtgcacccgcatccaatgag

SEQ ID NO: 810588 - DNA, 20 bp, mouse
gcgagagcaacacgaatctc

SEQ ID NO: 810589 - DNA, 20 bp, mouse
gggaagctagagctcgctag

SEQ ID NO: 810590 - DNA, 20 bp, mouse
gggctccggccaatcgcggg

SEQ ID NO: 810591 - DNA, 20 bp, mouse
ggaactctagcgccaccctc

SEQ ID NO: 810592 - DNA, 20 bp, mouse
gccaatgagaaatggaggtg

SEQ ID NO: 810593 - DNA, 20 bp, mouse
gcccgccaaccagacggcac

SEQ ID NO: 810594 - DNA, 20 bp, mouse
ggaggcgtggcttgtcctga

SEQ ID NO: 810595 - DNA, 20 bp, mouse
gcaagttaagtttatctccg

SEQ ID NO: 810596 - DNA, 20 bp, mouse
gtctacggggtggggaccac

SEQ ID NO: 810597 - DNA, 20 bp, mouse
gaccccgcccggcgcggaag

SEQ ID NO: 810598 - DNA, 20 bp, mouse
gaggtcgcgcggacagggcc

SEQ ID NO: 810599 - DNA, 20 bp, mouse
gcccacgcggtcaagctcta

SEQ ID NO: 810600 - DNA, 20 bp, mouse
ggcggtcaagctctacgggg

SEQ ID NO: 810601 - DNA, 20 bp, mouse
gcctgtggtaccatgcacac

SEQ ID NO: 810602 - DNA, 20 bp, mouse
ggcccggccctccgtgcgtc

SEQ ID NO: 810603 - DNA, 20 bp, mouse
gacgcgaggtcgcgcggaca

SEQ ID NO: 810604 - DNA, 20 bp, mouse
gtgggtggtggaagctaccc

SEQ ID NO: 810605 - DNA, 20 bp, mouse
gccccagcctgacgcacgga

SEQ ID NO: 810606 - DNA, 20 bp, mouse
gtcccgggtcggctggagaa

SEQ ID NO: 810607 - DNA, 20 bp, mouse
gacactggggcctggacgag

SEQ ID NO: 810608 - DNA, 20 bp, mouse
gcggcggcggtggggacact

SEQ ID NO: 810609 - DNA, 20 bp, mouse
gcgcggcgcgcaaatgtccc

SEQ ID NO: 810610 - DNA, 20 bp, mouse
gccgccgccgccacccgcca

SEQ ID NO: 810611 - DNA, 20 bp, mouse
gcggtggggacactggggcc

SEQ ID NO: 810612 - DNA, 20 bp, mouse
gggccgcggccgcggggcag

SEQ ID NO: 810613 - DNA, 20 bp, mouse
gggggaggggagcaccgcgc

SEQ ID NO: 810614 - DNA, 20 bp, mouse
ggccgcggccaatcgctgta

SEQ ID NO: 810615 - DNA, 20 bp, mouse
ggcgcgcaaatgtcccgggt

SEQ ID NO: 810616 - DNA, 20 bp, mouse
gcacaggcgcgcggcgagcc

SEQ ID NO: 810617 - DNA, 20 bp, mouse
ggagcccggctaattttagc

SEQ ID NO: 810618 - DNA, 20 bp, mouse
ggcattgagcggagagatgg

SEQ ID NO: 810619 - DNA, 20 bp, mouse
gttacggagagagatatcaa

SEQ ID NO: 810620 - DNA, 20 bp, mouse
ggggcgggccgccctcgctc

SEQ ID NO: 810621 - DNA, 20 bp, mouse
ggctggaggcggcgcgccga

SEQ ID NO: 810622 - DNA, 20 bp, mouse
ggggcgcggccatagagcag

SEQ ID NO: 810623 - DNA, 20 bp, mouse
gagggggaaaatggcgtctc

SEQ ID NO: 810624 - DNA, 20 bp, mouse
gaccgcgggcggaccagcgg

SEQ ID NO: 810625 - DNA, 20 bp, mouse
gggaagcgcggggctggccg

SEQ ID NO: 810626 - DNA, 20 bp, mouse
ggcgacgagcccctgaggga

SEQ ID NO: 810627 - DNA, 20 bp, mouse
ggggaatgcggcccatcttc

SEQ ID NO: 810628 - DNA, 20 bp, mouse
gtggtgcggtccactctccg

SEQ ID NO: 810629 - DNA, 20 bp, mouse
gggccggagcagctggatca

SEQ ID NO: 810630 - DNA, 20 bp, mouse
gccggcgccctgcgaggctc

SEQ ID NO: 810631 - DNA, 20 bp, mouse
gacgagcccctgagggaagg

SEQ ID NO: 810632 - DNA, 20 bp, mouse
ggctccgcccccttccctca

SEQ ID NO: 810633 - DNA, 20 bp, mouse
gcggagcagctggatcaggg

SEQ ID NO: 810634 - DNA, 20 bp, mouse
ggcggggcgaatgagtggac

SEQ ID NO: 810635 - DNA, 20 bp, mouse
gggcgggcggggcgaatgag

SEQ ID NO: 810636 - DNA, 20 bp, mouse
gtccccaggcactctcccgg

SEQ ID NO: 810637 - DNA, 20 bp, mouse
gccgccgccgggagagtgcc

SEQ ID NO: 810638 - DNA, 20 bp, mouse
ggtgtgggagcgcgcgagtg

SEQ ID NO: 810639 - DNA, 20 bp, mouse
gagtgcctggggaagcggcg

SEQ ID NO: 810640 - DNA, 20 bp, mouse
gaggccttccccccggggaa

SEQ ID NO: 810641 - DNA, 20 bp, mouse
ggaggggtggggggccgctg

SEQ ID NO: 810642 - DNA, 20 bp, mouse
ggctgcgccgccaaagcccc

SEQ ID NO: 810643 - DNA, 20 bp, mouse
gaggtggggggcttggctga

SEQ ID NO: 810644 - DNA, 20 bp, mouse
gctggggcccggggctttgg

SEQ ID NO: 810645 - DNA, 20 bp, mouse
gggaagggtagccccagccg

SEQ ID NO: 810646 - DNA, 20 bp, mouse
gcggccgagagccagttgaa

SEQ ID NO: 810647 - DNA, 20 bp, mouse
gccaccgaccctggcagggg

SEQ ID NO: 810648 - DNA, 20 bp, mouse
gcgggcgggcggttgctgga

SEQ ID NO: 810649 - DNA, 20 bp, mouse
gggcggggtgcgcgtcgctt

SEQ ID NO: 810650 - DNA, 20 bp, mouse
gaagtcccggggccgagtgt

SEQ ID NO: 810651 - DNA, 20 bp, mouse
gtgtgtgagggtgagagcgg

SEQ ID NO: 810652 - DNA, 20 bp, mouse
gttaaggggctgggcctgca

SEQ ID NO: 810653 - DNA, 20 bp, mouse
ggcgggcggttgctggaggg

SEQ ID NO: 810654 - DNA, 20 bp, mouse
gcttcgggagtgagtgtgtg

SEQ ID NO: 810655 - DNA, 20 bp, mouse
gaccccgcccctgccagggt

SEQ ID NO: 810656 - DNA, 20 bp, mouse
gtggacatcagcaaccgggg

SEQ ID NO: 810657 - DNA, 20 bp, mouse
gctggcgggcggatgggcgg

SEQ ID NO: 810658 - DNA, 20 bp, mouse
gggccgccgccgccgttcat

SEQ ID NO: 810659 - DNA, 20 bp, mouse
gtggctggcgggcggatggg

SEQ ID NO: 810660 - DNA, 20 bp, mouse
gggctgatcagcaccctggc

SEQ ID NO: 810661 - DNA, 20 bp, mouse
gcacctaacacgcctcggcg

SEQ ID NO: 810662 - DNA, 20 bp, mouse
gtaggcggcggggctgtctc

SEQ ID NO: 810663 - DNA, 20 bp, mouse
gggtgcgggccaatgaacgg

SEQ ID NO: 810664 - DNA, 20 bp, mouse
gagccgcgccgaggcgtgtt

SEQ ID NO: 810665 - DNA, 20 bp, mouse
ggggccgaagttccgttaac

SEQ ID NO: 810666 - DNA, 20 bp, mouse
gaggaagaaaggacacggtg

SEQ ID NO: 810667 - DNA, 20 bp, mouse
ggggatcaggtaagccagtc

SEQ ID NO: 810668 - DNA, 20 bp, mouse
gccaccagctacggagaaag

SEQ ID NO: 810669 - DNA, 20 bp, mouse
ggcagggcaaggtggggatc

SEQ ID NO: 810670 - DNA, 20 bp, mouse
gcctgccccctccaccagac

SEQ ID NO: 810671 - DNA, 20 bp, mouse
gcagaccgctccaccagcta

SEQ ID NO: 810672 - DNA, 20 bp, mouse
gaagaggaaaggcgggggac

SEQ ID NO: 810673 - DNA, 20 bp, mouse
gacgcgcatgcgcaactccc

SEQ ID NO: 810674 - DNA, 20 bp, mouse
gtggataagaggaaaggcgg

SEQ ID NO: 810675 - DNA, 20 bp, mouse
ggtgaggaaagacttcccgt

SEQ ID NO: 810676 - DNA, 20 bp, mouse
ggcaccggccaataagtgtg

SEQ ID NO: 810677 - DNA, 20 bp, mouse
gccaataagtgtggggcggt

SEQ ID NO: 810678 - DNA, 20 bp, mouse
gccggtgcgccgccaatcag

SEQ ID NO: 810679 - DNA, 20 bp, mouse
gcctcggctaggtaggggat

SEQ ID NO: 810680 - DNA, 20 bp, mouse
gccggccaataagtgtgggg

SEQ ID NO: 810681 - DNA, 20 bp, mouse
gtaggggatcgggactctgg

SEQ ID NO: 810682 - DNA, 20 bp, mouse
gggcactgggaatccccgtg

SEQ ID NO: 810683 - DNA, 20 bp, mouse
gagagagcctcggctaggta

SEQ ID NO: 810684 - DNA, 20 bp, mouse
gtcctcagagagcctcggct

SEQ ID NO: 810685 - DNA, 20 bp, mouse
gaggtaggggatcgggactc

SEQ ID NO: 810686 - DNA, 20 bp, mouse
gcgggacacggccagaacta

SEQ ID NO: 810687 - DNA, 20 bp, mouse
gtcccggagagcggcgtgca

SEQ ID NO: 810688 - DNA, 20 bp, mouse
gcacgccgctctccgggaca

SEQ ID NO: 810689 - DNA, 20 bp, mouse
gctggccgtgtcccggagag

SEQ ID NO: 810690 - DNA, 20 bp, mouse
gcctcactgcgcttccgggg

SEQ ID NO: 810691 - DNA, 20 bp, mouse
gtccctgcacgccgctctcc

SEQ ID NO: 810692 - DNA, 20 bp, mouse
gacggccagaactagggtgg

SEQ ID NO: 810693 - DNA, 20 bp, mouse
gtgccgtagtgaccgactga

SEQ ID NO: 810694 - DNA, 20 bp, mouse
gaaccatcagtcggtcacta

SEQ ID NO: 810695 - DNA, 20 bp, mouse
gggtcctcactgcgcttccg

SEQ ID NO: 810696 - DNA, 20 bp, mouse
gaacgagggagggagcgcac

SEQ ID NO: 810697 - DNA, 20 bp, mouse
gcggcgccgggtgatgtcag

SEQ ID NO: 810698 - DNA, 20 bp, mouse
gggctggcggaggaattgaa

SEQ ID NO: 810699 - DNA, 20 bp, mouse
gggagggagcgcaccggcgc

SEQ ID NO: 810700 - DNA, 20 bp, mouse
gaccccagagcctccgggac

SEQ ID NO: 810701 - DNA, 20 bp, mouse
ggggaactgtcaatcaacga

SEQ ID NO: 810702 - DNA, 20 bp, mouse
ggcctcgagggtacccgcct

SEQ ID NO: 810703 - DNA, 20 bp, mouse
gggcgctagcgaacagccgg

SEQ ID NO: 810704 - DNA, 20 bp, mouse
gagaggaggagcagtcgggg

SEQ ID NO: 810705 - DNA, 20 bp, mouse
gctagcgccgggggcctcga

SEQ ID NO: 810706 - DNA, 20 bp, mouse
gcacacgcggccccggtacg

SEQ ID NO: 810707 - DNA, 20 bp, mouse
gagaagctggggagtctcta

SEQ ID NO: 810708 - DNA, 20 bp, mouse
ggggccgcgtgtgcatgcgt

SEQ ID NO: 810709 - DNA, 20 bp, mouse
ggggcatcccagtagaagct

SEQ ID NO: 810710 - DNA, 20 bp, mouse
ggcttcccgaagccccgtac

SEQ ID NO: 810711 - DNA, 20 bp, mouse
gtctctagggccacacaacc

SEQ ID NO: 810712 - DNA, 20 bp, mouse
gtactgggatgcccaccggg

SEQ ID NO: 810713 - DNA, 20 bp, mouse
ggcccaccgggcggacgcct

SEQ ID NO: 810714 - DNA, 20 bp, mouse
gcggccccggtacggggctt

SEQ ID NO: 810715 - DNA, 20 bp, mouse
gctgccaggcgcctgcgggg

SEQ ID NO: 810716 - DNA, 20 bp, mouse
gcggggagaagggcggacac

SEQ ID NO: 810717 - DNA, 20 bp, mouse
gggctgctcgctgtgattgg

SEQ ID NO: 810718 - DNA, 20 bp, mouse
gcggccgcccgctctttcgc

SEQ ID NO: 810719 - DNA, 20 bp, mouse
gcttctccccgcctctctgc

SEQ ID NO: 810720 - DNA, 20 bp, mouse
gggaggacccggtatagagg

SEQ ID NO: 810721 - DNA, 20 bp, mouse
gctccccgcctctctgcagg

SEQ ID NO: 810722 - DNA, 20 bp, mouse
gagggtggacgtcaaggtga

SEQ ID NO: 810723 - DNA, 20 bp, mouse
ggtggagcttctgccagggg

SEQ ID NO: 810724 - DNA, 20 bp, mouse
gtatagaggtggatctcatc

SEQ ID NO: 810725 - DNA, 20 bp, mouse
gcgagcagcccgcgaaagag

SEQ ID NO: 810726 - DNA, 20 bp, mouse
gagtatgcatgtgtgaagta

SEQ ID NO: 810727 - DNA, 20 bp, mouse
ggctgcggtacaggggttat

SEQ ID NO: 810728 - DNA, 20 bp, mouse
gggggcggggagcaaaccga

SEQ ID NO: 810729 - DNA, 20 bp, mouse
gctctccgacggtagcccga

SEQ ID NO: 810730 - DNA, 20 bp, mouse
gcaggggttatgggaattta

SEQ ID NO: 810731 - DNA, 20 bp, mouse
gggacaaagcaggtattttc

SEQ ID NO: 810732 - DNA, 20 bp, mouse
gaactatattggccacctgt

SEQ ID NO: 810733 - DNA, 20 bp, mouse
gtagggcatttccagataag

SEQ ID NO: 810734 - DNA, 20 bp, mouse
gatggaagctcttcccctac

SEQ ID NO: 810735 - DNA, 20 bp, mouse
gcgacggtccggaagcaata

SEQ ID NO: 810736 - DNA, 20 bp, mouse
gtctgcccgcggtaggtgtg

SEQ ID NO: 810737 - DNA, 20 bp, mouse
ggccaagtgaggcacttcgc

SEQ ID NO: 810738 - DNA, 20 bp, mouse
ggcagccacacacctaccgc

SEQ ID NO: 810739 - DNA, 20 bp, mouse
gacagggaggagactccggg

SEQ ID NO: 810740 - DNA, 20 bp, mouse
gtgtctcgcgcggactgcta

SEQ ID NO: 810741 - DNA, 20 bp, mouse
gtggctgccgagaacccgat

SEQ ID NO: 810742 - DNA, 20 bp, mouse
gctacggccaatcgggttct

SEQ ID NO: 810743 - DNA, 20 bp, mouse
gaggcacttcgctggagtgg

SEQ ID NO: 810744 - DNA, 20 bp, mouse
gcggactgctacggccaatc

SEQ ID NO: 810745 - DNA, 20 bp, mouse
ggcgcggcctcctgattggt

SEQ ID NO: 810746 - DNA, 20 bp, mouse
gatacctccctcagcgtcgt

SEQ ID NO: 810747 - DNA, 20 bp, mouse
ggggacaaggtgagcttaca

SEQ ID NO: 810748 - DNA, 20 bp, mouse
gtagaacccgcggagaagtt

SEQ ID NO: 810749 - DNA, 20 bp, mouse
gaccccaacgacgctgaggg

SEQ ID NO: 810750 - DNA, 20 bp, mouse
gacaactcccatgaggaagt

SEQ ID NO: 810751 - DNA, 20 bp, mouse
gcgttggggtgcttttcctc

SEQ ID NO: 810752 - DNA, 20 bp, mouse
gagcaccccaacgacgctga

SEQ ID NO: 810753 - DNA, 20 bp, mouse
gcgcggagaagttgggtgac

SEQ ID NO: 810754 - DNA, 20 bp, mouse
gctgcggccctacttcctca

SEQ ID NO: 810755 - DNA, 20 bp, mouse
gttaaaacagtgggatccag

SEQ ID NO: 810756 - DNA, 20 bp, mouse
gcaagggcgccccaagtcga

SEQ ID NO: 810757 - DNA, 20 bp, mouse
gtgcagcagcggggaacaac

SEQ ID NO: 810758 - DNA, 20 bp, mouse
gcggaagtgacgccactcag

SEQ ID NO: 810759 - DNA, 20 bp, mouse
gccgaagagggtcggggaag

SEQ ID NO: 810760 - DNA, 20 bp, mouse
ggtcacttccggaacgaggg

SEQ ID NO: 810761 - DNA, 20 bp, mouse
ggggagcggaagagcccaaa

SEQ ID NO: 810762 - DNA, 20 bp, mouse
gaacaagccggctctggcgg

SEQ ID NO: 810763 - DNA, 20 bp, mouse
gaaccggcctgaccgctgag

SEQ ID NO: 810764 - DNA, 20 bp, mouse
ggaccatgggggcggacggg

SEQ ID NO: 810765 - DNA, 20 bp, mouse
ggggtccgctctcgcggcag

SEQ ID NO: 810766 - DNA, 20 bp, mouse
ggggcagctcgggaaggcgg

SEQ ID NO: 810767 - DNA, 20 bp, mouse
gtagctgtcaggtaccaagg

SEQ ID NO: 810768 - DNA, 20 bp, mouse
gaaggactgccctgctaatg

SEQ ID NO: 810769 - DNA, 20 bp, mouse
ggggcgtgggcagctcggga

SEQ ID NO: 810770 - DNA, 20 bp, mouse
ggacccagcggcaagagaac

SEQ ID NO: 810771 - DNA, 20 bp, mouse
gaacaggctttcgagccctg

SEQ ID NO: 810772 - DNA, 20 bp, mouse
gtaagctacaaacccgggag

SEQ ID NO: 810773 - DNA, 20 bp, mouse
gcaagcttgccaccctctcc

SEQ ID NO: 810774 - DNA, 20 bp, mouse
gagccccgcgcggcgatccc

SEQ ID NO: 810775 - DNA, 20 bp, mouse
gaccgtaaagtctcaagcaa

SEQ ID NO: 810776 - DNA, 20 bp, mouse
gctgggacggtcagacgagg

SEQ ID NO: 810777 - DNA, 20 bp, mouse
gcggccgagggccgttccgg

SEQ ID NO: 810778 - DNA, 20 bp, mouse
gggccaggctgcccccggaa

SEQ ID NO: 810779 - DNA, 20 bp, mouse
gatatcgcccggtcccgggt

SEQ ID NO: 810780 - DNA, 20 bp, mouse
gagcgcgaggaggcggccga

SEQ ID NO: 810781 - DNA, 20 bp, mouse
gctggtgcccgagcgagaga

SEQ ID NO: 810782 - DNA, 20 bp, mouse
gcgcgggcgacggacgagtg

SEQ ID NO: 810783 - DNA, 20 bp, mouse
gtatagtggggatacaggtc

SEQ ID NO: 810784 - DNA, 20 bp, mouse
ggtgtccttgcgaacccagt

SEQ ID NO: 810785 - DNA, 20 bp, mouse
gtgggttcgcaaggacacat

SEQ ID NO: 810786 - DNA, 20 bp, mouse
gaaggcccgcggggaggtcc

SEQ ID NO: 810787 - DNA, 20 bp, mouse
gcacttcccgaggcccctag

SEQ ID NO: 810788 - DNA, 20 bp, mouse
gagggaacctaattactact

SEQ ID NO: 810789 - DNA, 20 bp, mouse
gcctggggacgggtgaaagg

SEQ ID NO: 810790 - DNA, 20 bp, mouse
ggcctcgggaagtgcagtcc

SEQ ID NO: 810791 - DNA, 20 bp, mouse
gccacctgagcttccataaa

SEQ ID NO: 810792 - DNA, 20 bp, mouse
ggacagaggacatactggac

SEQ ID NO: 810793 - DNA, 20 bp, mouse
gttctggaatggcgccggga

SEQ ID NO: 810794 - DNA, 20 bp, mouse
gtctggtcccagtagtaatt

SEQ ID NO: 810795 - DNA, 20 bp, mouse
ggaaggagggatgccgagcc

SEQ ID NO: 810796 - DNA, 20 bp, mouse
gtgactgtgtaggcctctga

SEQ ID NO: 810797 - DNA, 20 bp, mouse
gggaatgtgggccccactgg

SEQ ID NO: 810798 - DNA, 20 bp, mouse
ggtgccctgctgcacaagac

SEQ ID NO: 810799 - DNA, 20 bp, mouse
gtgggccccactggggggag

SEQ ID NO: 810800 - DNA, 20 bp, mouse
ggcactgccacattttaact

SEQ ID NO: 810801 - DNA, 20 bp, mouse
gcctggtgacagcctgcacc

SEQ ID NO: 810802 - DNA, 20 bp, mouse
gtaactcggcaacattaggc

SEQ ID NO: 810803 - DNA, 20 bp, mouse
gacaggtggcacagatggga

SEQ ID NO: 810804 - DNA, 20 bp, mouse
gtgcaaatgtgtcccctcag

SEQ ID NO: 810805 - DNA, 20 bp, mouse
gaacacatcctcagaccact

SEQ ID NO: 810806 - DNA, 20 bp, mouse
gaggcccggcgacgaaatgg

SEQ ID NO: 810807 - DNA, 20 bp, mouse
ggccagagtggcaggggaat

SEQ ID NO: 810808 - DNA, 20 bp, mouse
gcccggcgacgaaatggcgg

SEQ ID NO: 810809 - DNA, 20 bp, mouse
gccgaggcgcttacctccat

SEQ ID NO: 810810 - DNA, 20 bp, mouse
ggtcgccgggcctaacggtt

SEQ ID NO: 810811 - DNA, 20 bp, mouse
ggttaggcccggcgacgaaa

SEQ ID NO: 810812 - DNA, 20 bp, mouse
gcactggctcttttcaatat

SEQ ID NO: 810813 - DNA, 20 bp, mouse
gaggggccgcggcctggatt

SEQ ID NO: 810814 - DNA, 20 bp, mouse
gcgtcgtagtgccacacgat

SEQ ID NO: 810815 - DNA, 20 bp, mouse
gggcagcggcctccgattgg

SEQ ID NO: 810816 - DNA, 20 bp, mouse
gcctcagctctgtgtctgtc

SEQ ID NO: 810817 - DNA, 20 bp, mouse
gacttcctccagagcgtctg

SEQ ID NO: 810818 - DNA, 20 bp, mouse
ggagggaagttcagagtcag

SEQ ID NO: 810819 - DNA, 20 bp, mouse
gtacgccgttgccaaggcag

SEQ ID NO: 810820 - DNA, 20 bp, mouse
gcggggctggaagtgcgaaa

SEQ ID NO: 810821 - DNA, 20 bp, mouse
ggggctaaaggtgtagtaag

SEQ ID NO: 810822 - DNA, 20 bp, mouse
gaggaaagaaacaggggcga

SEQ ID NO: 810823 - DNA, 20 bp, mouse
ggaagtgcgaaacggcgaga

SEQ ID NO: 810824 - DNA, 20 bp, mouse
gctcccgcggcttctctctc

SEQ ID NO: 810825 - DNA, 20 bp, mouse
gctcggagcctcagacgctc

SEQ ID NO: 810826 - DNA, 20 bp, mouse
ggggagagaaaggagcgtcg

SEQ ID NO: 810827 - DNA, 20 bp, mouse
gagggcggagcgaaactgtg

SEQ ID NO: 810828 - DNA, 20 bp, mouse
ggacttccgtcttcggtagg

SEQ ID NO: 810829 - DNA, 20 bp, mouse
gggcgccgctagacttaggg

SEQ ID NO: 810830 - DNA, 20 bp, mouse
ggccggcgccgctagactta

SEQ ID NO: 810831 - DNA, 20 bp, mouse
gttcggtaggcgggagagaa

SEQ ID NO: 810832 - DNA, 20 bp, mouse
gcggttgaacagagtcagac

SEQ ID NO: 810833 - DNA, 20 bp, mouse
gctctcccgcctaccgaaga

SEQ ID NO: 810834 - DNA, 20 bp, mouse
gtgacaagaggaaagcgtta

SEQ ID NO: 810835 - DNA, 20 bp, mouse
gggaaagcgttagggttcac

SEQ ID NO: 810836 - DNA, 20 bp, mouse
gggaagcgtagccacggtcg

SEQ ID NO: 810837 - DNA, 20 bp, mouse
gtgtcccggaagtgtcttgg

SEQ ID NO: 810838 - DNA, 20 bp, mouse
gaagcctgcaagaatcctgt

SEQ ID NO: 810839 - DNA, 20 bp, mouse
gctgcctccgcgttgaaagc

SEQ ID NO: 810840 - DNA, 20 bp, mouse
ggcaagaatcctgtaggctg

SEQ ID NO: 810841 - DNA, 20 bp, mouse
gtggctacgcttccccctgc

SEQ ID NO: 810842 - DNA, 20 bp, mouse
gcgggtgctatccgcgaccg

SEQ ID NO: 810843 - DNA, 20 bp, mouse
gccggcagggacacactagc

SEQ ID NO: 810844 - DNA, 20 bp, mouse
gtacgcttccccctgctggc

SEQ ID NO: 810845 - DNA, 20 bp, mouse
gcacccgcttgctctcttcg

SEQ ID NO: 810846 - DNA, 20 bp, mouse
gagactgcgaggggcattat

SEQ ID NO: 810847 - DNA, 20 bp, mouse
gagcctgtccggccagtggt

SEQ ID NO: 810848 - DNA, 20 bp, mouse
gccgcggggaagactaaacg

SEQ ID NO: 810849 - DNA, 20 bp, mouse
gcgaggggcattatgggagt

SEQ ID NO: 810850 - DNA, 20 bp, mouse
gtacccaccactggccggac

SEQ ID NO: 810851 - DNA, 20 bp, mouse
ggcccctcgcagtctcatat

SEQ ID NO: 810852 - DNA, 20 bp, mouse
gaggatggctacttcccaag

SEQ ID NO: 810853 - DNA, 20 bp, mouse
gcaagcactcggaagagaag

SEQ ID NO: 810854 - DNA, 20 bp, mouse
gggaagactaaacgcggaag

SEQ ID NO: 810855 - DNA, 20 bp, mouse
gggtgcgcacgctcagagag

SEQ ID NO: 810856 - DNA, 20 bp, mouse
gaaggctctgcaacctccgt

SEQ ID NO: 810857 - DNA, 20 bp, mouse
gcgagcgttcgtcctctaga

SEQ ID NO: 810858 - DNA, 20 bp, mouse
gggcggcgattcctattccc

SEQ ID NO: 810859 - DNA, 20 bp, mouse
gtattccccggtaagggaaa

SEQ ID NO: 810860 - DNA, 20 bp, mouse
ggaacgctcgctatgacatc

SEQ ID NO: 810861 - DNA, 20 bp, mouse
gaagaagaatgcatctgctc

SEQ ID NO: 810862 - DNA, 20 bp, mouse
ggctctgcaacctccgttgg

SEQ ID NO: 810863 - DNA, 20 bp, mouse
ggattcctattccccggtaa

SEQ ID NO: 810864 - DNA, 20 bp, mouse
gcacacgccctttcccttac

SEQ ID NO: 810865 - DNA, 20 bp, mouse
gcaggtctctcatcattgaa

SEQ ID NO: 810866 - DNA, 20 bp, mouse
gagctcctccgccaccggag

SEQ ID NO: 810867 - DNA, 20 bp, mouse
gcgcccaccgggagccaaga

SEQ ID NO: 810868 - DNA, 20 bp, mouse
gactctgtggcgaggaggtg

SEQ ID NO: 810869 - DNA, 20 bp, mouse
gtgcgaggtcccctctgcgt

SEQ ID NO: 810870 - DNA, 20 bp, mouse
gcggtggcagagggcatcac

SEQ ID NO: 810871 - DNA, 20 bp, mouse
ggctcccggtgggcgcttcc

SEQ ID NO: 810872 - DNA, 20 bp, mouse
ggtcaccgcgccaacgcaga

SEQ ID NO: 810873 - DNA, 20 bp, mouse
gcgttggcgcggtgaccttt

SEQ ID NO: 810874 - DNA, 20 bp, mouse
gcaagcccggaagcgcccac

SEQ ID NO: 810875 - DNA, 20 bp, mouse
gacttccaatggttttgatc

SEQ ID NO: 810876 - DNA, 20 bp, mouse
ggctgctgctgtagtcgggg

SEQ ID NO: 810877 - DNA, 20 bp, mouse
ggggtcggagtcttgtcttt

SEQ ID NO: 810878 - DNA, 20 bp, mouse
gagggctgctgctgtagtcg

SEQ ID NO: 810879 - DNA, 20 bp, mouse
gagcgatcgcggccatctta

SEQ ID NO: 810880 - DNA, 20 bp, mouse
ggatgcttccagactgttag

SEQ ID NO: 810881 - DNA, 20 bp, mouse
gcggaagggaaaggcgctct

SEQ ID NO: 810882 - DNA, 20 bp, mouse
gtcgcggccatcttaggggt

SEQ ID NO: 810883 - DNA, 20 bp, mouse
gaagactccgacccctaaga

SEQ ID NO: 810884 - DNA, 20 bp, mouse
ggaggagccggaagcgatcg

SEQ ID NO: 810885 - DNA, 20 bp, mouse
gtagttaactgtgtcgagac

SEQ ID NO: 810886 - DNA, 20 bp, mouse
gcggaagtgccgtctgtcgc

SEQ ID NO: 810887 - DNA, 20 bp, mouse
gggctctgggctactaagaa

SEQ ID NO: 810888 - DNA, 20 bp, mouse
gggtccgcttagtggctctc

SEQ ID NO: 810889 - DNA, 20 bp, mouse
ggcctctgagagttatccca

SEQ ID NO: 810890 - DNA, 20 bp, mouse
ggaagtaggcgggctccgtg

SEQ ID NO: 810891 - DNA, 20 bp, mouse
gatgcaacactcttcgaagt

SEQ ID NO: 810892 - DNA, 20 bp, mouse
ggccgtgggataactctcag

SEQ ID NO: 810893 - DNA, 20 bp, mouse
gtcacccgagagccactaag

SEQ ID NO: 810894 - DNA, 20 bp, mouse
gcaacactcttcgaagtagg

SEQ ID NO: 810895 - DNA, 20 bp, mouse
gtagtctgagcgttgcattc

SEQ ID NO: 810896 - DNA, 20 bp, mouse
gcagaagcgcagaaacttca

SEQ ID NO: 810897 - DNA, 20 bp, mouse
gttagtgcgctctgtcttcc

SEQ ID NO: 810898 - DNA, 20 bp, mouse
gttcagggcaagaaaaccgt

SEQ ID NO: 810899 - DNA, 20 bp, mouse
gaacagtgaaaactagtggg

SEQ ID NO: 810900 - DNA, 20 bp, mouse
gtacaactcctgcatgggac

SEQ ID NO: 810901 - DNA, 20 bp, mouse
gggctcctcccccgtctcca

SEQ ID NO: 810902 - DNA, 20 bp, mouse
gaagacagagcgcactaagc

SEQ ID NO: 810903 - DNA, 20 bp, mouse
ggcatgggaccggtgtgaga

SEQ ID NO: 810904 - DNA, 20 bp, mouse
gggcgcagggccggaaactc

SEQ ID NO: 810905 - DNA, 20 bp, mouse
ggaggagccgccgtcggcgc

SEQ ID NO: 810906 - DNA, 20 bp, mouse
gagggaggaccgcggagctg

SEQ ID NO: 810907 - DNA, 20 bp, mouse
ggccacgcgcgcgaagcgag

SEQ ID NO: 810908 - DNA, 20 bp, mouse
gcggcgccatggacggagaa

SEQ ID NO: 810909 - DNA, 20 bp, mouse
gtccagctccgcgagccggt

SEQ ID NO: 810910 - DNA, 20 bp, mouse
gttgccgggagggaggaccg

SEQ ID NO: 810911 - DNA, 20 bp, mouse
gtccgcgagccggtgggctt

SEQ ID NO: 810912 - DNA, 20 bp, mouse
gccggagcgcgggtgcaggg

SEQ ID NO: 810913 - DNA, 20 bp, mouse
gacgacgcgtccgcgggccc

SEQ ID NO: 810914 - DNA, 20 bp, mouse
gagcgaggggcgcgggttgc

SEQ ID NO: 810915 - DNA, 20 bp, mouse
ggggacgcgagcaaagcggc

SEQ ID NO: 810916 - DNA, 20 bp, mouse
gccaacgcaaccacaacctg

SEQ ID NO: 810917 - DNA, 20 bp, mouse
gcaaccacaacctgaggctt

SEQ ID NO: 810918 - DNA, 20 bp, mouse
gaagctgggagctaggtggg

SEQ ID NO: 810919 - DNA, 20 bp, mouse
ggggaagctgggagctaggt

SEQ ID NO: 810920 - DNA, 20 bp, mouse
gctgcccggaagtcctggta

SEQ ID NO: 810921 - DNA, 20 bp, mouse
gtgtgagttgagagctattc

SEQ ID NO: 810922 - DNA, 20 bp, mouse
gaacctgcgcttccgtccag

SEQ ID NO: 810923 - DNA, 20 bp, mouse
gatagctctcaactcacact

SEQ ID NO: 810924 - DNA, 20 bp, mouse
ggctttgcgcttggttattg

SEQ ID NO: 810925 - DNA, 20 bp, mouse
gcttccctaccaggacttcc

SEQ ID NO: 810926 - DNA, 20 bp, mouse
gcacttgtggagggagttga

SEQ ID NO: 810927 - DNA, 20 bp, mouse
gtcaccttgtgggcgggaga

SEQ ID NO: 810928 - DNA, 20 bp, mouse
gggggagagtgtcaccttgt

SEQ ID NO: 810929 - DNA, 20 bp, mouse
gtctacctatgcctgggcgg

SEQ ID NO: 810930 - DNA, 20 bp, mouse
gccacgaagagcaggctaat

SEQ ID NO: 810931 - DNA, 20 bp, mouse
ggagagtgtcaccttgtggg

SEQ ID NO: 810932 - DNA, 20 bp, mouse
gagggaagggaaccgcccca

SEQ ID NO: 810933 - DNA, 20 bp, mouse
gggagtctaccacgaagagc

SEQ ID NO: 810934 - DNA, 20 bp, mouse
gacctcgccacgaggacccc

SEQ ID NO: 810935 - DNA, 20 bp, mouse
gggcgaggtccgtgctcact

SEQ ID NO: 810936 - DNA, 20 bp, mouse
gaaaagggctgggacgggag

SEQ ID NO: 810937 - DNA, 20 bp, mouse
gaccacgcccaactcttctc

SEQ ID NO: 810938 - DNA, 20 bp, mouse
gaaagggtgtggcgaagact

SEQ ID NO: 810939 - DNA, 20 bp, mouse
ggaaaggtgcctttgcaggt

SEQ ID NO: 810940 - DNA, 20 bp, mouse
gtgaactgcagggggcagtc

SEQ ID NO: 810941 - DNA, 20 bp, mouse
gttaaaggtagagccggaaa

SEQ ID NO: 810942 - DNA, 20 bp, mouse
gagccagccctgaactgcag

SEQ ID NO: 810943 - DNA, 20 bp, mouse
gggtagagccggaaagggtg

SEQ ID NO: 810944 - DNA, 20 bp, mouse
gcagctcggtggctgaagcc

SEQ ID NO: 810945 - DNA, 20 bp, mouse
ggggtgtggcgaagactagg

SEQ ID NO: 810946 - DNA, 20 bp, mouse
gtagtgagaggcgggaggta

SEQ ID NO: 810947 - DNA, 20 bp, mouse
gctccctagtgagaggcggg

SEQ ID NO: 810948 - DNA, 20 bp, mouse
gtgtccgagctgtcaatcta

SEQ ID NO: 810949 - DNA, 20 bp, mouse
gcaattggctccctagtgag

SEQ ID NO: 810950 - DNA, 20 bp, mouse
gaaacctaagtttttccaat

SEQ ID NO: 810951 - DNA, 20 bp, mouse
ggcgctatcaggagctgata

SEQ ID NO: 810952 - DNA, 20 bp, mouse
gttggctccctagtgagagg

SEQ ID NO: 810953 - DNA, 20 bp, mouse
gcgagctgtcaatctaggga

SEQ ID NO: 810954 - DNA, 20 bp, mouse
gatagcggactactcataag

SEQ ID NO: 810955 - DNA, 20 bp, mouse
ggagcccaaaatttgggagg

SEQ ID NO: 810956 - DNA, 20 bp, mouse
gggcgggcgcggctcgtgat

SEQ ID NO: 810957 - DNA, 20 bp, mouse
gacgcgcagtcggagctgta

SEQ ID NO: 810958 - DNA, 20 bp, mouse
gcccccggggcgaggtcagt

SEQ ID NO: 810959 - DNA, 20 bp, mouse
gcggagaagagacgtacgat

SEQ ID NO: 810960 - DNA, 20 bp, mouse
ggcgggcctgggccacgggg

SEQ ID NO: 810961 - DNA, 20 bp, mouse
gggcgcggctcgtgattggc

SEQ ID NO: 810962 - DNA, 20 bp, mouse
ggccgcgggcctgggccacg

SEQ ID NO: 810963 - DNA, 20 bp, mouse
gagccgtggggtggcgtcca

SEQ ID NO: 810964 - DNA, 20 bp, mouse
gcccgggggcggagcctcac

SEQ ID NO: 810965 - DNA, 20 bp, mouse
gcctgggccacggggcggag

SEQ ID NO: 810966 - DNA, 20 bp, mouse
gccgcgccggccagaaggat

SEQ ID NO: 810967 - DNA, 20 bp, mouse
gctgcgcgcggggagatcca

SEQ ID NO: 810968 - DNA, 20 bp, mouse
gactgacgcggtgtggagag

SEQ ID NO: 810969 - DNA, 20 bp, mouse
ggtagttagaagtgcggggt

SEQ ID NO: 810970 - DNA, 20 bp, mouse
gaatcgccgcgccggccaga

SEQ ID NO: 810971 - DNA, 20 bp, mouse
gcggcgattggttaactgcg

SEQ ID NO: 810972 - DNA, 20 bp, mouse
gactgcgcggctgactgacg

SEQ ID NO: 810973 - DNA, 20 bp, mouse
ggggtgggtggagtcggagt

SEQ ID NO: 810974 - DNA, 20 bp, mouse
gccggcagcgcggagctgat

SEQ ID NO: 810975 - DNA, 20 bp, mouse
gactaagcaagtactttcga

SEQ ID NO: 810976 - DNA, 20 bp, mouse
gactccctcgctctgctcgt

SEQ ID NO: 810977 - DNA, 20 bp, mouse
gcctgtcccagggagagcga

SEQ ID NO: 810978 - DNA, 20 bp, mouse
gcgctcgctggcaggaaatt

SEQ ID NO: 810979 - DNA, 20 bp, mouse
gcgcgcaggggctgctgcct

SEQ ID NO: 810980 - DNA, 20 bp, mouse
gggccggtcactactttctg

SEQ ID NO: 810981 - DNA, 20 bp, mouse
gagcccgcgcgcagctccgg

SEQ ID NO: 810982 - DNA, 20 bp, mouse
gaagccgggcgccgggaggt

SEQ ID NO: 810983 - DNA, 20 bp, mouse
ggcccccacgagcagagcga

SEQ ID NO: 810984 - DNA, 20 bp, mouse
ggggctgcgcccccaccccg

SEQ ID NO: 810985 - DNA, 20 bp, mouse
gagccccagaaagtagtgac

SEQ ID NO: 810986 - DNA, 20 bp, mouse
gtgcgcccaggggtgatcga

SEQ ID NO: 810987 - DNA, 20 bp, mouse
gtcggccgctccacagccaa

SEQ ID NO: 810988 - DNA, 20 bp, mouse
gatggcccttggctgtggag

SEQ ID NO: 810989 - DNA, 20 bp, mouse
gagaagcgatgacatcatct

SEQ ID NO: 810990 - DNA, 20 bp, mouse
ggcagcggcgagagcaaagc

SEQ ID NO: 810991 - DNA, 20 bp, mouse
gcagacgcgtcccctgacgt

SEQ ID NO: 810992 - DNA, 20 bp, mouse
gaaaaaaaggatggactttg

SEQ ID NO: 810993 - DNA, 20 bp, mouse
gcacctctctcgccccctat

SEQ ID NO: 810994 - DNA, 20 bp, mouse
ggccagtgccggtgcgccca

SEQ ID NO: 810995 - DNA, 20 bp, mouse
gcccgcagctcggagcgcag

SEQ ID NO: 810996 - DNA, 20 bp, mouse
ggccgggcgggaaagactca

SEQ ID NO: 810997 - DNA, 20 bp, mouse
ggggcagcagaatagttgac

SEQ ID NO: 810998 - DNA, 20 bp, mouse
ggggaccagcggctgcagat

SEQ ID NO: 810999 - DNA, 20 bp, mouse
ggacccgagggacccgagcc

SEQ ID NO: 811000 - DNA, 20 bp, mouse
gcacccccgccccgggttgg

SEQ ID NO: 811001 - DNA, 20 bp, mouse
gcagaatagttgacgggtca

SEQ ID NO: 811002 - DNA, 20 bp, mouse
gccgcccggctcgggtccct

SEQ ID NO: 811003 - DNA, 20 bp, mouse
gcaggtccgccaacccgggg

SEQ ID NO: 811004 - DNA, 20 bp, mouse
gagcggctgcagattggcta

SEQ ID NO: 811005 - DNA, 20 bp, mouse
gtcagggtcgcgaggcgagg

SEQ ID NO: 811006 - DNA, 20 bp, mouse
ggcgcccggtggttctcacc

SEQ ID NO: 811007 - DNA, 20 bp, mouse
gacgggcttcacacacaaga

SEQ ID NO: 811008 - DNA, 20 bp, mouse
gagagggtccaactcgaggt

SEQ ID NO: 811009 - DNA, 20 bp, mouse
gcacaagagggtccaactcg

SEQ ID NO: 811010 - DNA, 20 bp, mouse
gtccgcgccatttttgttga

SEQ ID NO: 811011 - DNA, 20 bp, mouse
gaatgtgtcgggtatgacac

SEQ ID NO: 811012 - DNA, 20 bp, mouse
ggtccaactcgaggtgggtt

SEQ ID NO: 811013 - DNA, 20 bp, mouse
gaccatgtgatcttaccgac

SEQ ID NO: 811014 - DNA, 20 bp, mouse
gggtttgccctcaacaaaaa

SEQ ID NO: 811015 - DNA, 20 bp, mouse
gtggcgcggactcgtcccgt

SEQ ID NO: 811016 - DNA, 20 bp, mouse
ggccaggtgtggagacaagt

SEQ ID NO: 811017 - DNA, 20 bp, mouse
gctaggaggcctccaaaaaa

SEQ ID NO: 811018 - DNA, 20 bp, mouse
ggccatagcgagccacaaaa

SEQ ID NO: 811019 - DNA, 20 bp, mouse
gtaccatcgcaagatcaagt

SEQ ID NO: 811020 - DNA, 20 bp, mouse
gcgcgctttcgtcacatcct

SEQ ID NO: 811021 - DNA, 20 bp, mouse
ggacagtagaagttggcgcg

SEQ ID NO: 811022 - DNA, 20 bp, mouse
gcgccaacttctactgtcgt

SEQ ID NO: 811023 - DNA, 20 bp, mouse
gctccaacgacagtagaagt

SEQ ID NO: 811024 - DNA, 20 bp, mouse
gaggagacgcaacttccggt

SEQ ID NO: 811025 - DNA, 20 bp, mouse
gaatctaccactctcacctc

SEQ ID NO: 811026 - DNA, 20 bp, mouse
gcgcccacgggtgcccgcag

SEQ ID NO: 811027 - DNA, 20 bp, mouse
gtaactgtgtccctccctac

SEQ ID NO: 811028 - DNA, 20 bp, mouse
gggctggctgaacgatcttg

SEQ ID NO: 811029 - DNA, 20 bp, mouse
gcccgcagggggctggtgag

SEQ ID NO: 811030 - DNA, 20 bp, mouse
gtgtgtccctccctactggc

SEQ ID NO: 811031 - DNA, 20 bp, mouse
gtctccaacccaaaacaatc

SEQ ID NO: 811032 - DNA, 20 bp, mouse
gtgtccaggcactgagtgac

SEQ ID NO: 811033 - DNA, 20 bp, mouse
gtccagttgcatgactgtcc

SEQ ID NO: 811034 - DNA, 20 bp, mouse
gaggaggtgcgcatgcttga

SEQ ID NO: 811035 - DNA, 20 bp, mouse
gacagttagagctgtctgtc

SEQ ID NO: 811036 - DNA, 20 bp, mouse
gggcggggccgagagagtcg

SEQ ID NO: 811037 - DNA, 20 bp, mouse
gagctccttggggtcacccg

SEQ ID NO: 811038 - DNA, 20 bp, mouse
gccccctgaacgagctcctt

SEQ ID NO: 811039 - DNA, 20 bp, mouse
gcaccccgaagagtggtagg

SEQ ID NO: 811040 - DNA, 20 bp, mouse
ggagagagtcggggtgaagt

SEQ ID NO: 811041 - DNA, 20 bp, mouse
gaccccaaggagctcgttca

SEQ ID NO: 811042 - DNA, 20 bp, mouse
ggcgcaccccgaagagtggt

SEQ ID NO: 811043 - DNA, 20 bp, mouse
gcgggcgcgcagccagcttc

SEQ ID NO: 811044 - DNA, 20 bp, mouse
ggaacgaatccgtgaagccc

SEQ ID NO: 811045 - DNA, 20 bp, mouse
gggctggcgcggggcatgcc

SEQ ID NO: 811046 - DNA, 20 bp, mouse
ggctgagtgtgagacaaaaa

SEQ ID NO: 811047 - DNA, 20 bp, mouse
gaaagcgatccaagactgtt

SEQ ID NO: 811048 - DNA, 20 bp, mouse
gagagatagcctagagtgga

SEQ ID NO: 811049 - DNA, 20 bp, mouse
gggaagacgggaagagccgg

SEQ ID NO: 811050 - DNA, 20 bp, mouse
gtcacggagcattgcaggcg

SEQ ID NO: 811051 - DNA, 20 bp, mouse
ggtagttctttgtgctgggt

SEQ ID NO: 811052 - DNA, 20 bp, mouse
ggcattgcaggcgaggaagc

SEQ ID NO: 811053 - DNA, 20 bp, mouse
gcgggaagagccggaggatc

SEQ ID NO: 811054 - DNA, 20 bp, mouse
ggtagcttctgatattacgg

SEQ ID NO: 811055 - DNA, 20 bp, mouse
ggatctctcccatccactct

SEQ ID NO: 811056 - DNA, 20 bp, mouse
gcaggaacaaagtggggcgg

SEQ ID NO: 811057 - DNA, 20 bp, mouse
ggtctgaagcacactggggg

SEQ ID NO: 811058 - DNA, 20 bp, mouse
gaatgtgggccccaaggaag

SEQ ID NO: 811059 - DNA, 20 bp, mouse
gtggccctctccagggtcat

SEQ ID NO: 811060 - DNA, 20 bp, mouse
ggggccactcactaaatcct

SEQ ID NO: 811061 - DNA, 20 bp, mouse
ggtggggcccagatacctgc

SEQ ID NO: 811062 - DNA, 20 bp, mouse
gaaatcctgggcaatttgga

SEQ ID NO: 811063 - DNA, 20 bp, mouse
gtggaggtctgaagcacact

SEQ ID NO: 811064 - DNA, 20 bp, mouse
gttagtgagtggccctctcc

SEQ ID NO: 811065 - DNA, 20 bp, mouse
gacttcctatgaccctggag

SEQ ID NO: 811066 - DNA, 20 bp, mouse
gggcaaactcccaagtgtgt

SEQ ID NO: 811067 - DNA, 20 bp, mouse
gcacttagaacccttgaggg

SEQ ID NO: 811068 - DNA, 20 bp, mouse
gagagcacttagaacccttg

SEQ ID NO: 811069 - DNA, 20 bp, mouse
gagagcccctatcacaaagg

SEQ ID NO: 811070 - DNA, 20 bp, mouse
gtcacaaaggagggccggac

SEQ ID NO: 811071 - DNA, 20 bp, mouse
gtggttctgtgccaccctca

SEQ ID NO: 811072 - DNA, 20 bp, mouse
gggtggcacagaaccacaga

SEQ ID NO: 811073 - DNA, 20 bp, mouse
gcggccctcctttgtgatag

SEQ ID NO: 811074 - DNA, 20 bp, mouse
ggataggggctctgagggtg

SEQ ID NO: 811075 - DNA, 20 bp, mouse
gctcagagcccctatcacaa

SEQ ID NO: 811076 - DNA, 20 bp, mouse
gcctgctgagaagacctgga

SEQ ID NO: 811077 - DNA, 20 bp, mouse
gacatcggccagcacacggg

SEQ ID NO: 811078 - DNA, 20 bp, mouse
gcagcacacgggaggtggac

SEQ ID NO: 811079 - DNA, 20 bp, mouse
gtgtgcaagggatgctgagt

SEQ ID NO: 811080 - DNA, 20 bp, mouse
gtggagggctctcaagacac

SEQ ID NO: 811081 - DNA, 20 bp, mouse
ggggcgttgcataagagtag

SEQ ID NO: 811082 - DNA, 20 bp, mouse
ggaacaaagtcaggctgagg

SEQ ID NO: 811083 - DNA, 20 bp, mouse
ggggttcgggaagggggtaa

SEQ ID NO: 811084 - DNA, 20 bp, mouse
gaggctgagggggttcggga

SEQ ID NO: 811085 - DNA, 20 bp, mouse
gaaggactaggaaccgacat

SEQ ID NO: 811086 - DNA, 20 bp, mouse
gcagagcccaggccccgata

SEQ ID NO: 811087 - DNA, 20 bp, mouse
gctaggccaagggcccttgg

SEQ ID NO: 811088 - DNA, 20 bp, mouse
gcacctgctcctctcaccgt

SEQ ID NO: 811089 - DNA, 20 bp, mouse
gagctgccttatcggggcct

SEQ ID NO: 811090 - DNA, 20 bp, mouse
gtgtctgccagccaagtcct

SEQ ID NO: 811091 - DNA, 20 bp, mouse
gcccaggtttgctcttgttg

SEQ ID NO: 811092 - DNA, 20 bp, mouse
ggacttggctggcagacagg

SEQ ID NO: 811093 - DNA, 20 bp, mouse
gaaagtggcgcttgttgatg

SEQ ID NO: 811094 - DNA, 20 bp, mouse
gtcttgcagctgccttatcg

SEQ ID NO: 811095 - DNA, 20 bp, mouse
ggcctcaagataacctcccc

SEQ ID NO: 811096 - DNA, 20 bp, mouse
gagcaggtgcacatagtgtc

SEQ ID NO: 811097 - DNA, 20 bp, mouse
gcctgaccatgcatagctaa

SEQ ID NO: 811098 - DNA, 20 bp, mouse
gctgggtagctccacttaca

SEQ ID NO: 811099 - DNA, 20 bp, mouse
gcatgcatagctaagggagc

SEQ ID NO: 811100 - DNA, 20 bp, mouse
gacaaaggcagcaacctgtg

SEQ ID NO: 811101 - DNA, 20 bp, mouse
gtaagagtaggtgagtcaac

SEQ ID NO: 811102 - DNA, 20 bp, mouse
gggctactgtgcaaaatgat

SEQ ID NO: 811103 - DNA, 20 bp, mouse
ggtgtaggtggagtaagagt

SEQ ID NO: 811104 - DNA, 20 bp, mouse
gtcttactccacctacactc

SEQ ID NO: 811105 - DNA, 20 bp, mouse
gatagtgtcaggtatattga

SEQ ID NO: 811106 - DNA, 20 bp, mouse
gtggccagaagcagaagcgc

SEQ ID NO: 811107 - DNA, 20 bp, mouse
gaatggaggaacaatgatga

SEQ ID NO: 811108 - DNA, 20 bp, mouse
gagcagaagcgcgggcacat

SEQ ID NO: 811109 - DNA, 20 bp, mouse
gctgcggctaagatgaactt

SEQ ID NO: 811110 - DNA, 20 bp, mouse
ggacgcgcggccccgcccag

SEQ ID NO: 811111 - DNA, 20 bp, mouse
gtctgcctcggtgtcattca

SEQ ID NO: 811112 - DNA, 20 bp, mouse
gaaagccatgaatgacaccg

SEQ ID NO: 811113 - DNA, 20 bp, mouse
gaggcaggaacctctgggcg

SEQ ID NO: 811114 - DNA, 20 bp, mouse
gcgtcgtggccgcgctcctg

SEQ ID NO: 811115 - DNA, 20 bp, mouse
gaaaacagtggcattgaccc

SEQ ID NO: 811116 - DNA, 20 bp, mouse
gtgcgcaggcggtctcggga

SEQ ID NO: 811117 - DNA, 20 bp, mouse
gcgcccgcccattgcgcagg

SEQ ID NO: 811118 - DNA, 20 bp, mouse
gtgcgtgcgagggacgtcag

SEQ ID NO: 811119 - DNA, 20 bp, mouse
gtccctcgcacgcacagcgg

SEQ ID NO: 811120 - DNA, 20 bp, mouse
gaggaacggagcagcgggat

SEQ ID NO: 811121 - DNA, 20 bp, mouse
gagaccgcctgcgcaatggg

SEQ ID NO: 811122 - DNA, 20 bp, mouse
gaagtgggggcgtagggcga

SEQ ID NO: 811123 - DNA, 20 bp, mouse
ggggctggtgagcgacccag

SEQ ID NO: 811124 - DNA, 20 bp, mouse
gttaccaggggtaactgctg

SEQ ID NO: 811125 - DNA, 20 bp, mouse
gacgtccctcgcacgcacag

SEQ ID NO: 811126 - DNA, 20 bp, mouse
ggagcagcagggaagggcgg

SEQ ID NO: 811127 - DNA, 20 bp, mouse
ggggtcgggtttggtctcaa

SEQ ID NO: 811128 - DNA, 20 bp, mouse
gccaaacccgacccagtcct

SEQ ID NO: 811129 - DNA, 20 bp, mouse
ggaggccagaattgcttccc

SEQ ID NO: 811130 - DNA, 20 bp, mouse
gctggcctccttcccaacca

SEQ ID NO: 811131 - DNA, 20 bp, mouse
ggcctccagaggcaagctaa

SEQ ID NO: 811132 - DNA, 20 bp, mouse
gggaactctgccaagagggg

SEQ ID NO: 811133 - DNA, 20 bp, mouse
ggcaagcgaaggaggcaagt

SEQ ID NO: 811134 - DNA, 20 bp, mouse
gacgcgtgacgtctcggtga

SEQ ID NO: 811135 - DNA, 20 bp, mouse
gtggtctgggagaatcactc

SEQ ID NO: 811136 - DNA, 20 bp, mouse
gcctctgtacccggaccctt

SEQ ID NO: 811137 - DNA, 20 bp, mouse
gtagaagaatccgaagggtc

SEQ ID NO: 811138 - DNA, 20 bp, mouse
gttccagtctccacttgggg

SEQ ID NO: 811139 - DNA, 20 bp, mouse
ggagcgttcgggttctgggg

SEQ ID NO: 811140 - DNA, 20 bp, mouse
gacagggtctccgccccaag

SEQ ID NO: 811141 - DNA, 20 bp, mouse
gagaacttggcctatagcag

SEQ ID NO: 811142 - DNA, 20 bp, mouse
gtggggcgggacacgctgat

SEQ ID NO: 811143 - DNA, 20 bp, mouse
gctgataagcgcaggcgtga

SEQ ID NO: 811144 - DNA, 20 bp, mouse
gccgaacgctcccctgctat

SEQ ID NO: 811145 - DNA, 20 bp, mouse
gcacttccagtctccacttg

SEQ ID NO: 811146 - DNA, 20 bp, mouse
gtgcaactctctgcagtctg

SEQ ID NO: 811147 - DNA, 20 bp, mouse
gcatgtgcggatatacgtgt

SEQ ID NO: 811148 - DNA, 20 bp, mouse
ggggagaggcaactgtggcg

SEQ ID NO: 811149 - DNA, 20 bp, mouse
gggtccgagcggctctgaag

SEQ ID NO: 811150 - DNA, 20 bp, mouse
gcaaacgcctgctgctttag

SEQ ID NO: 811151 - DNA, 20 bp, mouse
gactaagaccaggtctgcgt

SEQ ID NO: 811152 - DNA, 20 bp, mouse
gtctgcagtctgaggttgtc

SEQ ID NO: 811153 - DNA, 20 bp, mouse
gtggaaagggggcgcatctg

SEQ ID NO: 811154 - DNA, 20 bp, mouse
gaggcagagtggggttaatt

SEQ ID NO: 811155 - DNA, 20 bp, mouse
ggctcacggccaatcgggag

SEQ ID NO: 811156 - DNA, 20 bp, mouse
gccagagtgagcactgactc

SEQ ID NO: 811157 - DNA, 20 bp, mouse
gtgtccctggtgaccacaat

SEQ ID NO: 811158 - DNA, 20 bp, mouse
ggtgagcactgactctgggg

SEQ ID NO: 811159 - DNA, 20 bp, mouse
gaggtgtggcagaccagctg

SEQ ID NO: 811160 - DNA, 20 bp, mouse
gctagaggatgccatgcgtg

SEQ ID NO: 811161 - DNA, 20 bp, mouse
gtggacactgtcctcacgca

SEQ ID NO: 811162 - DNA, 20 bp, mouse
gggcatcctctagttgtccc

SEQ ID NO: 811163 - DNA, 20 bp, mouse
gaaaacccattgtggtcacc

SEQ ID NO: 811164 - DNA, 20 bp, mouse
gtggggacactgcgttcagg

SEQ ID NO: 811165 - DNA, 20 bp, mouse
ggaccacaatgggttttatc

SEQ ID NO: 811166 - DNA, 20 bp, mouse
gcagccaagagtgtgatcta

SEQ ID NO: 811167 - DNA, 20 bp, mouse
gaaaggccggcctccctcaa

SEQ ID NO: 811168 - DNA, 20 bp, mouse
ggaggctcaggggcagggta

SEQ ID NO: 811169 - DNA, 20 bp, mouse
gcacactcttggctgtgtta

SEQ ID NO: 811170 - DNA, 20 bp, mouse
gtgtcacacgggaggctcag

SEQ ID NO: 811171 - DNA, 20 bp, mouse
gatctctgactctcctgaat

SEQ ID NO: 811172 - DNA, 20 bp, mouse
gcacgggaggctcaggggca

SEQ ID NO: 811173 - DNA, 20 bp, mouse
gacaaaaggtccacaaaggc

SEQ ID NO: 811174 - DNA, 20 bp, mouse
gcccaagagcactcccattc

SEQ ID NO: 811175 - DNA, 20 bp, mouse
gaatagcaggaaggcaacag

SEQ ID NO: 811176 - DNA, 20 bp, mouse
ggcaacccgcgggcgactta

SEQ ID NO: 811177 - DNA, 20 bp, mouse
gagtgggcaagattctgtgt

SEQ ID NO: 811178 - DNA, 20 bp, mouse
gtgggtgtggcaaggatctc

SEQ ID NO: 811179 - DNA, 20 bp, mouse
ggggttgcatgggtgtggca

SEQ ID NO: 811180 - DNA, 20 bp, mouse
gacgaccgtaagtcgcccgc

SEQ ID NO: 811181 - DNA, 20 bp, mouse
ggggcgacttacggtcgtga

SEQ ID NO: 811182 - DNA, 20 bp, mouse
gggggcatcctcaagttctt

SEQ ID NO: 811183 - DNA, 20 bp, mouse
gagtcgcccgcgggttgcat

SEQ ID NO: 811184 - DNA, 20 bp, mouse
ggtggggctcacaccctcga

SEQ ID NO: 811185 - DNA, 20 bp, mouse
ggagtggcgagggcgtgaca

SEQ ID NO: 811186 - DNA, 20 bp, mouse
gggagtcagcttgacaaaac

SEQ ID NO: 811187 - DNA, 20 bp, mouse
gcggctggaaaatctgactg

SEQ ID NO: 811188 - DNA, 20 bp, mouse
gcaaaaccggatcgaagtag

SEQ ID NO: 811189 - DNA, 20 bp, mouse
gaagcaggcagtgagagagc

SEQ ID NO: 811190 - DNA, 20 bp, mouse
gaggcagggcctgctcacgg

SEQ ID NO: 811191 - DNA, 20 bp, mouse
ggaaagctgagaggctctga

SEQ ID NO: 811192 - DNA, 20 bp, mouse
gatcgaagtagaggcagagt

SEQ ID NO: 811193 - DNA, 20 bp, mouse
gcgctcttgcaaggaaagct

SEQ ID NO: 811194 - DNA, 20 bp, mouse
gcaagctgactcccagctac

SEQ ID NO: 811195 - DNA, 20 bp, mouse
ggctgtctccagatatcaat

SEQ ID NO: 811196 - DNA, 20 bp, mouse
gggggcggaggggggcgcgt

SEQ ID NO: 811197 - DNA, 20 bp, mouse
gcgtgcttcgcgagcagcgg

SEQ ID NO: 811198 - DNA, 20 bp, mouse
gggcagcatgggctcaggaa

SEQ ID NO: 811199 - DNA, 20 bp, mouse
gaacgcgtgtatcgggagtc

SEQ ID NO: 811200 - DNA, 20 bp, mouse
ggctctccccaggtcgtagt

SEQ ID NO: 811201 - DNA, 20 bp, mouse
gcccatgctgcccctagcgg

SEQ ID NO: 811202 - DNA, 20 bp, mouse
gggagagcagccaaccgaga

SEQ ID NO: 811203 - DNA, 20 bp, mouse
gcggaggggggcgcgtgggc

SEQ ID NO: 811204 - DNA, 20 bp, mouse
gaggatgaggggtcccgcga

SEQ ID NO: 811205 - DNA, 20 bp, mouse
gggggtgcgcgatgctgaac

SEQ ID NO: 811206 - DNA, 20 bp, mouse
gggggcggaaacctgagcca

SEQ ID NO: 811207 - DNA, 20 bp, mouse
ggagagtgcccggctggaat

SEQ ID NO: 811208 - DNA, 20 bp, mouse
ggctcagactctcctaaaac

SEQ ID NO: 811209 - DNA, 20 bp, mouse
gaagacggccggagcttctc

SEQ ID NO: 811210 - DNA, 20 bp, mouse
gggtgctggctttgccccaa

SEQ ID NO: 811211 - DNA, 20 bp, mouse
gagggctcaccaaagacggc

SEQ ID NO: 811212 - DNA, 20 bp, mouse
gtggcacacccgagagtgcc

SEQ ID NO: 811213 - DNA, 20 bp, mouse
ggccggagcttctcaggaag

SEQ ID NO: 811214 - DNA, 20 bp, mouse
gtgcctctgggtaaggaaag

SEQ ID NO: 811215 - DNA, 20 bp, mouse
ggccacttcctgagaagctc

SEQ ID NO: 811216 - DNA, 20 bp, mouse
gctagtagattccggacaga

SEQ ID NO: 811217 - DNA, 20 bp, mouse
gttaaagactgccctctgtc

SEQ ID NO: 811218 - DNA, 20 bp, mouse
gcctgtcacctagtagattc

SEQ ID NO: 811219 - DNA, 20 bp, mouse
gtaaacagcccagatctaat

SEQ ID NO: 811220 - DNA, 20 bp, mouse
gcgactgtatttgtctggag

SEQ ID NO: 811221 - DNA, 20 bp, mouse
gcttagtgctggctgtggaa

SEQ ID NO: 811222 - DNA, 20 bp, mouse
gagagaaatccccttagtgc

SEQ ID NO: 811223 - DNA, 20 bp, mouse
gtcttgctcagataagcaca

SEQ ID NO: 811224 - DNA, 20 bp, mouse
gcttcagtggctttttattg

SEQ ID NO: 811225 - DNA, 20 bp, mouse
gccagacaaatacagtcgct

SEQ ID NO: 811226 - DNA, 20 bp, mouse
ggggaagtgcgtcaccaggt

SEQ ID NO: 811227 - DNA, 20 bp, mouse
gggttccgtgcgctctccgg

SEQ ID NO: 811228 - DNA, 20 bp, mouse
gtgcgtcaccaggtggggaa

SEQ ID NO: 811229 - DNA, 20 bp, mouse
gtctcctgacacaatacccc

SEQ ID NO: 811230 - DNA, 20 bp, mouse
gggcgccccagagccgcaat

SEQ ID NO: 811231 - DNA, 20 bp, mouse
gggtccagagctgaagggat

SEQ ID NO: 811232 - DNA, 20 bp, mouse
gggtagcgagcaatggggac

SEQ ID NO: 811233 - DNA, 20 bp, mouse
gttgcaaggaccacgaggag

SEQ ID NO: 811234 - DNA, 20 bp, mouse
ggacgcggtccagagctgaa

SEQ ID NO: 811235 - DNA, 20 bp, mouse
gggtccttgcaagcctattg

SEQ ID NO: 811236 - DNA, 20 bp, mouse
gacaaggtctggtggagctg

SEQ ID NO: 811237 - DNA, 20 bp, mouse
gttcaaagggagggactccc

SEQ ID NO: 811238 - DNA, 20 bp, mouse
gctagaatggggaaaggttc

SEQ ID NO: 811239 - DNA, 20 bp, mouse
gaacttgctagaatggggaa

SEQ ID NO: 811240 - DNA, 20 bp, mouse
gtggttaaacccaggatcac

SEQ ID NO: 811241 - DNA, 20 bp, mouse
gagaggaaggcaatcggtcc

SEQ ID NO: 811242 - DNA, 20 bp, mouse
gaggtcagaaactaacaata

SEQ ID NO: 811243 - DNA, 20 bp, mouse
gtagggagcagatgatgaaa

SEQ ID NO: 811244 - DNA, 20 bp, mouse
ggttcaggcacaaggtctgg

SEQ ID NO: 811245 - DNA, 20 bp, mouse
gttggcaacttgctagaatg

SEQ ID NO: 811246 - DNA, 20 bp, mouse
ggaagcctcggtcctgccca

SEQ ID NO: 811247 - DNA, 20 bp, mouse
ggactgagttgcgagaagat

SEQ ID NO: 811248 - DNA, 20 bp, mouse
gagggggtcaggaatgtgta

SEQ ID NO: 811249 - DNA, 20 bp, mouse
gtggctcactcaggacacgg

SEQ ID NO: 811250 - DNA, 20 bp, mouse
gctgcccagggcggctcgcc

SEQ ID NO: 811251 - DNA, 20 bp, mouse
gcgaggaggggagaggtcgg

SEQ ID NO: 811252 - DNA, 20 bp, mouse
ggcgggcggagcctggagat

SEQ ID NO: 811253 - DNA, 20 bp, mouse
ggggacgggacaccgaggag

SEQ ID NO: 811254 - DNA, 20 bp, mouse
ggcaggaccgaggcttccgc

SEQ ID NO: 811255 - DNA, 20 bp, mouse
gcaccccgtccctaagagcc

SEQ ID NO: 811256 - DNA, 20 bp, mouse
gccccagggcacagctgtcc

SEQ ID NO: 811257 - DNA, 20 bp, mouse
gacagtgtccgaagagactt

SEQ ID NO: 811258 - DNA, 20 bp, mouse
gaccatggttgctgcaccac

SEQ ID NO: 811259 - DNA, 20 bp, mouse
gaggctcaggaattcacgtg

SEQ ID NO: 811260 - DNA, 20 bp, mouse
gcagttaatgagtaaccgga

SEQ ID NO: 811261 - DNA, 20 bp, mouse
gaaccggaaggtcctgaagc

SEQ ID NO: 811262 - DNA, 20 bp, mouse
gcggttactcattaactgct

SEQ ID NO: 811263 - DNA, 20 bp, mouse
gcacgtgaggctctgggagc

SEQ ID NO: 811264 - DNA, 20 bp, mouse
gcagatggtggcatctagga

SEQ ID NO: 811265 - DNA, 20 bp, mouse
ggctcgcagctggcaggact

SEQ ID NO: 811266 - DNA, 20 bp, mouse
gcacgcggggtgcaaagttc

SEQ ID NO: 811267 - DNA, 20 bp, mouse
ggcggggtgcaaagttcagg

SEQ ID NO: 811268 - DNA, 20 bp, mouse
gccgccgcccggcgcttcgc

SEQ ID NO: 811269 - DNA, 20 bp, mouse
gcgggctcccgagtgggcca

SEQ ID NO: 811270 - DNA, 20 bp, mouse
gcccgcgctcgcccgtcacg

SEQ ID NO: 811271 - DNA, 20 bp, mouse
ggcgagcgcgggtagccgag

SEQ ID NO: 811272 - DNA, 20 bp, mouse
gccgggacccgcgcggatgg

SEQ ID NO: 811273 - DNA, 20 bp, mouse
gggcggcgcgaggggacggc

SEQ ID NO: 811274 - DNA, 20 bp, mouse
ggcggtcccgccatccgcgc

SEQ ID NO: 811275 - DNA, 20 bp, mouse
gcctccctgacgcgtcacgg

SEQ ID NO: 811276 - DNA, 20 bp, mouse
gcctccctggatgcggtctg

SEQ ID NO: 811277 - DNA, 20 bp, mouse
ggggaggcggccacggatgt

SEQ ID NO: 811278 - DNA, 20 bp, mouse
gggcgtcccgcccacatccg

SEQ ID NO: 811279 - DNA, 20 bp, mouse
gccctcaggcaggcgcccta

SEQ ID NO: 811280 - DNA, 20 bp, mouse
ggtcacctggcgcctgacaa

SEQ ID NO: 811281 - DNA, 20 bp, mouse
gcgccctaggggcaggtggg

SEQ ID NO: 811282 - DNA, 20 bp, mouse
gccaggttcaacccccactc

SEQ ID NO: 811283 - DNA, 20 bp, mouse
gtggagaagcccgctgagat

SEQ ID NO: 811284 - DNA, 20 bp, mouse
ggaaacctttgtcaggcgcc

SEQ ID NO: 811285 - DNA, 20 bp, mouse
ggaagcccgctgagatcggg

SEQ ID NO: 811286 - DNA, 20 bp, mouse
gtggccgtggggtgtgctgg

SEQ ID NO: 811287 - DNA, 20 bp, mouse
gaacacccggaggaacggac

SEQ ID NO: 811288 - DNA, 20 bp, mouse
gggacccagctgagtcccgc

SEQ ID NO: 811289 - DNA, 20 bp, mouse
gccacccccagcacacccca

SEQ ID NO: 811290 - DNA, 20 bp, mouse
gggaccgcggacgctcgacc

SEQ ID NO: 811291 - DNA, 20 bp, mouse
ggtccctggtcgagcgtccg

SEQ ID NO: 811292 - DNA, 20 bp, mouse
gggccgccgggaacacccgg

SEQ ID NO: 811293 - DNA, 20 bp, mouse
gtgtcctgcgggactcagct

SEQ ID NO: 811294 - DNA, 20 bp, mouse
ggccgagcatgcccagtccg

SEQ ID NO: 811295 - DNA, 20 bp, mouse
gctcgggctggctcctaata

SEQ ID NO: 811296 - DNA, 20 bp, mouse
gaaaagcttagactggggtg

SEQ ID NO: 811297 - DNA, 20 bp, mouse
ggtgaaggcgcttattggtt

SEQ ID NO: 811298 - DNA, 20 bp, mouse
gggtacaaattcccgaggtg

SEQ ID NO: 811299 - DNA, 20 bp, mouse
gtcccgaggtgaggctgtac

SEQ ID NO: 811300 - DNA, 20 bp, mouse
gacagctaatgaagtgagtc

SEQ ID NO: 811301 - DNA, 20 bp, mouse
gtcaggctgcacagggtttt

SEQ ID NO: 811302 - DNA, 20 bp, mouse
gttcttaaaagcttagactg

SEQ ID NO: 811303 - DNA, 20 bp, mouse
gtcctgaagccaggattagt

SEQ ID NO: 811304 - DNA, 20 bp, mouse
gccaagctctgcccagtcta

SEQ ID NO: 811305 - DNA, 20 bp, mouse
gccgccttaaccaacagtga

SEQ ID NO: 811306 - DNA, 20 bp, mouse
ggtgcagagggtgaaccctt

SEQ ID NO: 811307 - DNA, 20 bp, mouse
gctacctcaggggactacta

SEQ ID NO: 811308 - DNA, 20 bp, mouse
gcagagggtgaacccttggg

SEQ ID NO: 811309 - DNA, 20 bp, mouse
gcccccaagaggaagatctt

SEQ ID NO: 811310 - DNA, 20 bp, mouse
ggtagtcccctgaggtagat

SEQ ID NO: 811311 - DNA, 20 bp, mouse
gcggcacctatctacctcag

SEQ ID NO: 811312 - DNA, 20 bp, mouse
gacccactgcttgtcattag

SEQ ID NO: 811313 - DNA, 20 bp, mouse
gtctcaggcggtgataggaa

SEQ ID NO: 811314 - DNA, 20 bp, mouse
ggaacactgagtctggaggt

SEQ ID NO: 811315 - DNA, 20 bp, mouse
gtgaaataatgatcgtgcag

SEQ ID NO: 811316 - DNA, 20 bp, mouse
gcgcacgcgcagctgtggct

SEQ ID NO: 811317 - DNA, 20 bp, mouse
ggggccgggcgctgcgtcta

SEQ ID NO: 811318 - DNA, 20 bp, mouse
ggcgctgcgtctacggagaa

SEQ ID NO: 811319 - DNA, 20 bp, mouse
gtcaacaccccaggtctaac

SEQ ID NO: 811320 - DNA, 20 bp, mouse
gtcaaagtcgctagatctct

SEQ ID NO: 811321 - DNA, 20 bp, mouse
gtcgctagatctctaggctg

SEQ ID NO: 811322 - DNA, 20 bp, mouse
gcccggggaatggcatcacg

SEQ ID NO: 811323 - DNA, 20 bp, mouse
ggggccggagtgtcacgtga

SEQ ID NO: 811324 - DNA, 20 bp, mouse
gtctctaggctgtgggaagg

SEQ ID NO: 811325 - DNA, 20 bp, mouse
gagatctctaggctgtggga

SEQ ID NO: 811326 - DNA, 20 bp, mouse
ggggcgggacgtactggaga

SEQ ID NO: 811327 - DNA, 20 bp, mouse
ggtactggagagggtcgagt

SEQ ID NO: 811328 - DNA, 20 bp, mouse
ggccacccggaagtggaaga

SEQ ID NO: 811329 - DNA, 20 bp, mouse
gggctgcagcgagcgtgaaa

SEQ ID NO: 811330 - DNA, 20 bp, mouse
gatgcgctgccacccggaag

SEQ ID NO: 811331 - DNA, 20 bp, mouse
gtgggcgtggctgggtgagc

SEQ ID NO: 811332 - DNA, 20 bp, mouse
gagggtcgagtgggcgtggc

SEQ ID NO: 811333 - DNA, 20 bp, mouse
gaagtggaagacggaagggg

SEQ ID NO: 811334 - DNA, 20 bp, mouse
gcgtggctgggtgagccggg

SEQ ID NO: 811335 - DNA, 20 bp, mouse
gacgctcgctgcagcccgcc

SEQ ID NO: 811336 - DNA, 20 bp, mouse
ggcgcgcccgacagcggcaa

SEQ ID NO: 811337 - DNA, 20 bp, mouse
gacgtgcgcgcgcccgacag

SEQ ID NO: 811338 - DNA, 20 bp, mouse
ggaactcaggcgagagtttg

SEQ ID NO: 811339 - DNA, 20 bp, mouse
gcccgcctactgctgggtcc

SEQ ID NO: 811340 - DNA, 20 bp, mouse
ggggctaagtaatggcgcca

SEQ ID NO: 811341 - DNA, 20 bp, mouse
gtactgctgggtccgggctg

SEQ ID NO: 811342 - DNA, 20 bp, mouse
ggggtccgggctgtggtgtc

SEQ ID NO: 811343 - DNA, 20 bp, mouse
ggccgagcccagcgcggcgt

SEQ ID NO: 811344 - DNA, 20 bp, mouse
gcgcacgcccacacggctct

SEQ ID NO: 811345 - DNA, 20 bp, mouse
gcctcccggaaatggccttg

SEQ ID NO: 811346 - DNA, 20 bp, mouse
ggaacagtgcgggtctaggc

SEQ ID NO: 811347 - DNA, 20 bp, mouse
gaaagccgcgggcagctcct

SEQ ID NO: 811348 - DNA, 20 bp, mouse
ggctgtgcgaagaacagtgc

SEQ ID NO: 811349 - DNA, 20 bp, mouse
gcgaagaacagtgcgggtct

SEQ ID NO: 811350 - DNA, 20 bp, mouse
gggcgtgagtcggacgattc

SEQ ID NO: 811351 - DNA, 20 bp, mouse
gtcacgccccaattgattcc

SEQ ID NO: 811352 - DNA, 20 bp, mouse
ggtctcggatggttgatgtc

SEQ ID NO: 811353 - DNA, 20 bp, mouse
ggggcttcggcgacagctcc

SEQ ID NO: 811354 - DNA, 20 bp, mouse
ggtgacccaggagctgcccg

SEQ ID NO: 811355 - DNA, 20 bp, mouse
gtcccctggcgcgctcacgg

SEQ ID NO: 811356 - DNA, 20 bp, mouse
gtctccagcaggcaggtaag

SEQ ID NO: 811357 - DNA, 20 bp, mouse
gccgcccggttggctaggaa

SEQ ID NO: 811358 - DNA, 20 bp, mouse
ggctcccagcgcaggacggg

SEQ ID NO: 811359 - DNA, 20 bp, mouse
gcctacacgcgggcaagccc

SEQ ID NO: 811360 - DNA, 20 bp, mouse
ggacggtgacgtgtgcaagg

SEQ ID NO: 811361 - DNA, 20 bp, mouse
gtggaaggatgcgcgggagt

SEQ ID NO: 811362 - DNA, 20 bp, mouse
gggtgacgtgtgcaaggtgg

SEQ ID NO: 811363 - DNA, 20 bp, mouse
gagcacttggaaggatgcgc

SEQ ID NO: 811364 - DNA, 20 bp, mouse
gtggggccgcccggttggct

SEQ ID NO: 811365 - DNA, 20 bp, mouse
gagggcgcacgctgaggaca

SEQ ID NO: 811366 - DNA, 20 bp, mouse
gagggagtgtgtggcggtgt

SEQ ID NO: 811367 - DNA, 20 bp, mouse
ggactcagctaccgccactt

SEQ ID NO: 811368 - DNA, 20 bp, mouse
gagggagggttcccggagta

SEQ ID NO: 811369 - DNA, 20 bp, mouse
ggggccagcgctgagtcctc

SEQ ID NO: 811370 - DNA, 20 bp, mouse
gaaggcggcccggactctaa

SEQ ID NO: 811371 - DNA, 20 bp, mouse
gagcgtccggtgggtgaatc

SEQ ID NO: 811372 - DNA, 20 bp, mouse
gctgagtctcagcgtccggt

SEQ ID NO: 811373 - DNA, 20 bp, mouse
gtcacccgaggactcagcgc

SEQ ID NO: 811374 - DNA, 20 bp, mouse
gctgccgtgcacgtgaccgt

SEQ ID NO: 811375 - DNA, 20 bp, mouse
gactctaatggtttgcggta

SEQ ID NO: 811376 - DNA, 20 bp, mouse
gtgtcgctaacgcctggagg

SEQ ID NO: 811377 - DNA, 20 bp, mouse
gtacgcgtggatggacacac

SEQ ID NO: 811378 - DNA, 20 bp, mouse
gtccccactgaggagtcgat

SEQ ID NO: 811379 - DNA, 20 bp, mouse
gcaccctaggcaacttggca

SEQ ID NO: 811380 - DNA, 20 bp, mouse
ggagcacggttccgcatctt

SEQ ID NO: 811381 - DNA, 20 bp, mouse
gctgctgtatgctgtccagg

SEQ ID NO: 811382 - DNA, 20 bp, mouse
ggaggcaggggactcaacct

SEQ ID NO: 811383 - DNA, 20 bp, mouse
gcctagggtgacctaagatg

SEQ ID NO: 811384 - DNA, 20 bp, mouse
gggccttgccaagttgccta

SEQ ID NO: 811385 - DNA, 20 bp, mouse
gacacacgggatgtggagca

SEQ ID NO: 811386 - DNA, 20 bp, mouse
gcgggttcgcgccctcgggg

SEQ ID NO: 811387 - DNA, 20 bp, mouse
gtgcgcggcgcaggccggag

SEQ ID NO: 811388 - DNA, 20 bp, mouse
gggggggtcaagggcgggtg

SEQ ID NO: 811389 - DNA, 20 bp, mouse
gaacccgcattgtgagcgct

SEQ ID NO: 811390 - DNA, 20 bp, mouse
gaagtcgggagcggtcacgg

SEQ ID NO: 811391 - DNA, 20 bp, mouse
ggccgcagggacggttgtca

SEQ ID NO: 811392 - DNA, 20 bp, mouse
ggggccgggcgcgcgccgca

SEQ ID NO: 811393 - DNA, 20 bp, mouse
gggacggttgtcatggcgac

SEQ ID NO: 811394 - DNA, 20 bp, mouse
gggtgtgtgcgccgcaactg

SEQ ID NO: 811395 - DNA, 20 bp, mouse
ggccatgacaaccgtccctg

SEQ ID NO: 811396 - DNA, 20 bp, mouse
ggggaagactggcccatccc

SEQ ID NO: 811397 - DNA, 20 bp, mouse
gctaagaaggaagcggtgtg

SEQ ID NO: 811398 - DNA, 20 bp, mouse
gctggggtacctacctctaa

SEQ ID NO: 811399 - DNA, 20 bp, mouse
gctaaaggacgcctggaacc

SEQ ID NO: 811400 - DNA, 20 bp, mouse
gtgtttgggagcagtcagga

SEQ ID NO: 811401 - DNA, 20 bp, mouse
gctgggggctgtagtttcgc

SEQ ID NO: 811402 - DNA, 20 bp, mouse
gcacgcgcgggccgcagagc

SEQ ID NO: 811403 - DNA, 20 bp, mouse
gcaagcaactcgtggttgtt

SEQ ID NO: 811404 - DNA, 20 bp, mouse
gggaaagcagtaattgattg

SEQ ID NO: 811405 - DNA, 20 bp, mouse
gctgtgatgcaagcaactcg

SEQ ID NO: 811406 - DNA, 20 bp, mouse
gctaaagcacggtggggcgg

SEQ ID NO: 811407 - DNA, 20 bp, mouse
ggggcggcggcggacccctg

SEQ ID NO: 811408 - DNA, 20 bp, mouse
gaagtgacgtcacgcgaaga

SEQ ID NO: 811409 - DNA, 20 bp, mouse
ggaagaggggggtcacaagc

SEQ ID NO: 811410 - DNA, 20 bp, mouse
gtgacgtcacgcgaagaggg

SEQ ID NO: 811411 - DNA, 20 bp, mouse
gggcaccaaggcagaccacg

SEQ ID NO: 811412 - DNA, 20 bp, mouse
gggtcacaagctggttgtta

SEQ ID NO: 811413 - DNA, 20 bp, mouse
gcaaggcagaccacgtggta

SEQ ID NO: 811414 - DNA, 20 bp, mouse
gggtctgccttggtgcctca

SEQ ID NO: 811415 - DNA, 20 bp, mouse
gtgactgtcagactaacttc

SEQ ID NO: 811416 - DNA, 20 bp, mouse
gtgggcctgcagcacgtggg

SEQ ID NO: 811417 - DNA, 20 bp, mouse
gaggggcggggccacggcgt

SEQ ID NO: 811418 - DNA, 20 bp, mouse
ggggcggggcgatggactcg

SEQ ID NO: 811419 - DNA, 20 bp, mouse
gggggccacggcgtaggcgt

SEQ ID NO: 811420 - DNA, 20 bp, mouse
gcagctggcgcgtggtcctc

SEQ ID NO: 811421 - DNA, 20 bp, mouse
gagaccagatctcgagactg

SEQ ID NO: 811422 - DNA, 20 bp, mouse
gcggcctcagtctcgagatc

SEQ ID NO: 811423 - DNA, 20 bp, mouse
gcggggcgatggactcgggg

SEQ ID NO: 811424 - DNA, 20 bp, mouse
ggcagcacgtgggagggcgc

SEQ ID NO: 811425 - DNA, 20 bp, mouse
gcaggcccacgcctacgccg

SEQ ID NO: 811426 - DNA, 20 bp, mouse
gtcggcgccgagaacgatgg

SEQ ID NO: 811427 - DNA, 20 bp, mouse
ggagaagagcagtaagaagg

SEQ ID NO: 811428 - DNA, 20 bp, mouse
gtacctaaaaggaaccactg

SEQ ID NO: 811429 - DNA, 20 bp, mouse
ggcgcctggccctgcatcga

SEQ ID NO: 811430 - DNA, 20 bp, mouse
gatggcggaagtgaatacga

SEQ ID NO: 811431 - DNA, 20 bp, mouse
ggaaccactgaggcagctgt

SEQ ID NO: 811432 - DNA, 20 bp, mouse
gaggtctcactaagctcccg

SEQ ID NO: 811433 - DNA, 20 bp, mouse
gtctgcgcaggcgctgggac

SEQ ID NO: 811434 - DNA, 20 bp, mouse
gtctcggcgccgaggttttc

SEQ ID NO: 811435 - DNA, 20 bp, mouse
gtgcctcagtggttcctttt

SEQ ID NO: 811436 - DNA, 20 bp, mouse
gtgggcggggggtgcggcaa

SEQ ID NO: 811437 - DNA, 20 bp, mouse
gcggttagccggcgccactg

SEQ ID NO: 811438 - DNA, 20 bp, mouse
gcggggggtgcggcaaagga

SEQ ID NO: 811439 - DNA, 20 bp, mouse
gaaaggaggggcctgaagcg

SEQ ID NO: 811440 - DNA, 20 bp, mouse
gtccggagccccagtggcgc

SEQ ID NO: 811441 - DNA, 20 bp, mouse
gttggggcggggctagtggt

SEQ ID NO: 811442 - DNA, 20 bp, mouse
ggacttgggagcgtggctag

SEQ ID NO: 811443 - DNA, 20 bp, mouse
gcggagagagagccggggtt

SEQ ID NO: 811444 - DNA, 20 bp, mouse
gggaagacagagcggttagc

SEQ ID NO: 811445 - DNA, 20 bp, mouse
gggtggtggcccccaagggc

SEQ ID NO: 811446 - DNA, 20 bp, mouse
gagggggcgcgacgcaactt

SEQ ID NO: 811447 - DNA, 20 bp, mouse
gcaaggcggggcccctagaa

SEQ ID NO: 811448 - DNA, 20 bp, mouse
gcagagagcgcgccttatgg

SEQ ID NO: 811449 - DNA, 20 bp, mouse
ggacaagctccgcccccata

SEQ ID NO: 811450 - DNA, 20 bp, mouse
ggtgactggccagcgcgaga

SEQ ID NO: 811451 - DNA, 20 bp, mouse
gccgcccgctgcccggtggg

SEQ ID NO: 811452 - DNA, 20 bp, mouse
ggccccggggccgcctgcgg

SEQ ID NO: 811453 - DNA, 20 bp, mouse
gctacctcccaccgggcagc

SEQ ID NO: 811454 - DNA, 20 bp, mouse
ggcgtcgcgccccctaaaga

SEQ ID NO: 811455 - DNA, 20 bp, mouse
gggcaagctcagataaggtt

SEQ ID NO: 811456 - DNA, 20 bp, mouse
gacagcttcaaacttgtcat

SEQ ID NO: 811457 - DNA, 20 bp, mouse
ggggacgtgttcatcatgag

SEQ ID NO: 811458 - DNA, 20 bp, mouse
gtaagacaagtcattgtcaa

SEQ ID NO: 811459 - DNA, 20 bp, mouse
gccaacaaaggtttgtggtg

SEQ ID NO: 811460 - DNA, 20 bp, mouse
gtgagaagaggttttaaggc

SEQ ID NO: 811461 - DNA, 20 bp, mouse
ggcttccacagcatcaccaa

SEQ ID NO: 811462 - DNA, 20 bp, mouse
gcaagctctgtttgcgttgc

SEQ ID NO: 811463 - DNA, 20 bp, mouse
gagacaacatcctgttgtta

SEQ ID NO: 811464 - DNA, 20 bp, mouse
gacagcagaacatggctgca

SEQ ID NO: 811465 - DNA, 20 bp, mouse
gatcatctattctccaacaa

SEQ ID NO: 811466 - DNA, 20 bp, mouse
ggatacttcagcctaggggt

SEQ ID NO: 811467 - DNA, 20 bp, mouse
gcaaatatgactcacacaag

SEQ ID NO: 811468 - DNA, 20 bp, mouse
gaccacgatacttcagccta

SEQ ID NO: 811469 - DNA, 20 bp, mouse
gacttcagcctaggggtggg

SEQ ID NO: 811470 - DNA, 20 bp, mouse
gactaaaatcaagctcccta

SEQ ID NO: 811471 - DNA, 20 bp, mouse
gattctgtaacctgtcccta

SEQ ID NO: 811472 - DNA, 20 bp, mouse
gaatcaagctccctagggac

SEQ ID NO: 811473 - DNA, 20 bp, mouse
gcaaatgaggttgctctgta

SEQ ID NO: 811474 - DNA, 20 bp, mouse
gatttgagccacccacccct

SEQ ID NO: 811475 - DNA, 20 bp, mouse
gaggttctcccctaagtaca

SEQ ID NO: 811476 - DNA, 20 bp, mouse
gagcacactagtagccagaa

SEQ ID NO: 811477 - DNA, 20 bp, mouse
ggctactagtgtgcttccta

SEQ ID NO: 811478 - DNA, 20 bp, mouse
gactaaagtcaagcttccta

SEQ ID NO: 811479 - DNA, 20 bp, mouse
gcctctaggctgaagtgtca

SEQ ID NO: 811480 - DNA, 20 bp, mouse
gattcgaaccacctacctct

SEQ ID NO: 811481 - DNA, 20 bp, mouse
gacttcagcctagaggtagg

SEQ ID NO: 811482 - DNA, 20 bp, mouse
gcaaatgaggctgctctgtg

SEQ ID NO: 811483 - DNA, 20 bp, mouse
gtatgctgtaacctggccct

SEQ ID NO: 811484 - DNA, 20 bp, mouse
gtacgagatatgctgtaacc

SEQ ID NO: 811485 - DNA, 20 bp, mouse
gtgtacttagggaaggacat

SEQ ID NO: 811486 - DNA, 20 bp, mouse
gaggcacttggggtagtggt

SEQ ID NO: 811487 - DNA, 20 bp, mouse
gtaaaccagcactggggcca

SEQ ID NO: 811488 - DNA, 20 bp, mouse
ggccccagtgctggtttaag

SEQ ID NO: 811489 - DNA, 20 bp, mouse
gaagatacatgaggtgagtg

SEQ ID NO: 811490 - DNA, 20 bp, mouse
gccctgctattcaagcattt

SEQ ID NO: 811491 - DNA, 20 bp, mouse
ggctgcaacaggaaggatgt

SEQ ID NO: 811492 - DNA, 20 bp, mouse
gtctctggaagccaggcact

SEQ ID NO: 811493 - DNA, 20 bp, mouse
gagacctgggttagagagga

SEQ ID NO: 811494 - DNA, 20 bp, mouse
gtcgaaaaggacccacgtca

SEQ ID NO: 811495 - DNA, 20 bp, mouse
gtgtgtaacaaggaaactaa

SEQ ID NO: 811496 - DNA, 20 bp, mouse
gccagagaggagcaagtttg

SEQ ID NO: 811497 - DNA, 20 bp, mouse
ggagctgtgtgctcggaaag

SEQ ID NO: 811498 - DNA, 20 bp, mouse
gtccctgtcagtcacaatct

SEQ ID NO: 811499 - DNA, 20 bp, mouse
gagtgggaggagccaagcta

SEQ ID NO: 811500 - DNA, 20 bp, mouse
gcgagcgggaggcgtgtcta

SEQ ID NO: 811501 - DNA, 20 bp, mouse
gtgtctagggcgtggtcctc

SEQ ID NO: 811502 - DNA, 20 bp, mouse
gccaatcagtgtctctaagt

SEQ ID NO: 811503 - DNA, 20 bp, mouse
gtgtcagtcacaatctgggc

SEQ ID NO: 811504 - DNA, 20 bp, mouse
gcgggtgaaatctctgacca

SEQ ID NO: 811505 - DNA, 20 bp, mouse
gagagtaggaccctaggggc

SEQ ID NO: 811506 - DNA, 20 bp, mouse
gcccccgccccctgtggaga

SEQ ID NO: 811507 - DNA, 20 bp, mouse
gccagccagcagcaggggca

SEQ ID NO: 811508 - DNA, 20 bp, mouse
gccctgtggagacggtggga

SEQ ID NO: 811509 - DNA, 20 bp, mouse
gccgccccctgtggagacgg

SEQ ID NO: 811510 - DNA, 20 bp, mouse
ggggcacaccgcaaaccctt

SEQ ID NO: 811511 - DNA, 20 bp, mouse
gcaaacccttgggacctaga

SEQ ID NO: 811512 - DNA, 20 bp, mouse
gcagtggcccccagcctagt

SEQ ID NO: 811513 - DNA, 20 bp, mouse
ggtggagacggtgggagggt

SEQ ID NO: 811514 - DNA, 20 bp, mouse
ggacctgccaacagctgtca

SEQ ID NO: 811515 - DNA, 20 bp, mouse
gcaggccttctaggtcccaa

SEQ ID NO: 811516 - DNA, 20 bp, mouse
gcacccgggtggggccttga

SEQ ID NO: 811517 - DNA, 20 bp, mouse
ggggtgctggaggcgctcca

SEQ ID NO: 811518 - DNA, 20 bp, mouse
gctccctcaaggccccaccc

SEQ ID NO: 811519 - DNA, 20 bp, mouse
gagcgcctccagcacccggg

SEQ ID NO: 811520 - DNA, 20 bp, mouse
ggaggcaggcaaggcccatt

SEQ ID NO: 811521 - DNA, 20 bp, mouse
gcagcgctctagattaacca

SEQ ID NO: 811522 - DNA, 20 bp, mouse
gtagagcgctgtctacagtc

SEQ ID NO: 811523 - DNA, 20 bp, mouse
gcaagcttgcctactggccc

SEQ ID NO: 811524 - DNA, 20 bp, mouse
gtggacgctgagtgtccttc

SEQ ID NO: 811525 - DNA, 20 bp, mouse
gtaggcaagcttggctgcct

SEQ ID NO: 811526 - DNA, 20 bp, mouse
gccctcccctgcagataaga

SEQ ID NO: 811527 - DNA, 20 bp, mouse
gctgcagataagagggggtg

SEQ ID NO: 811528 - DNA, 20 bp, mouse
gccaagcagcaagaaccaag

SEQ ID NO: 811529 - DNA, 20 bp, mouse
gttgcataggcctctgacat

SEQ ID NO: 811530 - DNA, 20 bp, mouse
gggtgaagcagatacagttg

SEQ ID NO: 811531 - DNA, 20 bp, mouse
gtcttttgagccaatgtcag

SEQ ID NO: 811532 - DNA, 20 bp, mouse
ggtgtcgagtgatctgttag

SEQ ID NO: 811533 - DNA, 20 bp, mouse
ggacccaaatccacctgggt

SEQ ID NO: 811534 - DNA, 20 bp, mouse
ggcagagagctgtctagtcc

SEQ ID NO: 811535 - DNA, 20 bp, mouse
gactcgacacctcccgaccc

SEQ ID NO: 811536 - DNA, 20 bp, mouse
gccaacccaggtcgcagcgt

SEQ ID NO: 811537 - DNA, 20 bp, mouse
gaccctcgcagcctctgatt

SEQ ID NO: 811538 - DNA, 20 bp, mouse
gcccaaggggtcggatccca

SEQ ID NO: 811539 - DNA, 20 bp, mouse
gagtctggacagcttcgtgg

SEQ ID NO: 811540 - DNA, 20 bp, mouse
gcagaggctgcgagggtacc

SEQ ID NO: 811541 - DNA, 20 bp, mouse
gcggccaggtgatgcccaag

SEQ ID NO: 811542 - DNA, 20 bp, mouse
gagcgaccgtgcagacctag

SEQ ID NO: 811543 - DNA, 20 bp, mouse
gcaggtgatgcccaaggggt

SEQ ID NO: 811544 - DNA, 20 bp, mouse
gggagcggagcggctccgat

SEQ ID NO: 811545 - DNA, 20 bp, mouse
gcagacctagctactccact

SEQ ID NO: 811546 - DNA, 20 bp, mouse
gaagtggtagaaggagtaaa

SEQ ID NO: 811547 - DNA, 20 bp, mouse
gccaaaatggactttatcca

SEQ ID NO: 811548 - DNA, 20 bp, mouse
gacctaagccggaccaggtg

SEQ ID NO: 811549 - DNA, 20 bp, mouse
gcagagagccacacctggtc

SEQ ID NO: 811550 - DNA, 20 bp, mouse
gagaagacctaagccggacc

SEQ ID NO: 811551 - DNA, 20 bp, mouse
ggtagaaggagtaaagggtt

SEQ ID NO: 811552 - DNA, 20 bp, mouse
gccgctctcctctatagctg

SEQ ID NO: 811553 - DNA, 20 bp, mouse
gcggggccctgggagtgccc

SEQ ID NO: 811554 - DNA, 20 bp, mouse
gggtgggagaccacaggcag

SEQ ID NO: 811555 - DNA, 20 bp, mouse
ggataaagtccattttgggt

SEQ ID NO: 811556 - DNA, 20 bp, mouse
ggtgccacgggcattgagaa

SEQ ID NO: 811557 - DNA, 20 bp, mouse
gccactgaggcaaagactgg

SEQ ID NO: 811558 - DNA, 20 bp, mouse
gcacaggagagccatctaat

SEQ ID NO: 811559 - DNA, 20 bp, mouse
gggaggctatcgtagcagcc

SEQ ID NO: 811560 - DNA, 20 bp, mouse
gctatcgtagcagcctggta

SEQ ID NO: 811561 - DNA, 20 bp, mouse
ggaggcaaagactggaggtt

SEQ ID NO: 811562 - DNA, 20 bp, mouse
gggctgctagagtcactagc

SEQ ID NO: 811563 - DNA, 20 bp, mouse
gatcctgcctgatccttacc

SEQ ID NO: 811564 - DNA, 20 bp, mouse
gttgagaagggtgtgagcac

SEQ ID NO: 811565 - DNA, 20 bp, mouse
gacacaggagtcctattaga

SEQ ID NO: 811566 - DNA, 20 bp, mouse
gaggctaaagagcaacgggg

SEQ ID NO: 811567 - DNA, 20 bp, mouse
ggggagcaggtgccaggtca

SEQ ID NO: 811568 - DNA, 20 bp, mouse
ggggatgtcaggaaaacgat

SEQ ID NO: 811569 - DNA, 20 bp, mouse
ggccctaggcacctctccat

SEQ ID NO: 811570 - DNA, 20 bp, mouse
ggcctcttggttggagggga

SEQ ID NO: 811571 - DNA, 20 bp, mouse
gctgacatcccaaacggagg

SEQ ID NO: 811572 - DNA, 20 bp, mouse
ggataagggaaagggtccag

SEQ ID NO: 811573 - DNA, 20 bp, mouse
gctagcaggggtgtgttagg

SEQ ID NO: 811574 - DNA, 20 bp, mouse
gacccatggagaggtgccta

SEQ ID NO: 811575 - DNA, 20 bp, mouse
gaagaggctaaagagcaacg

SEQ ID NO: 811576 - DNA, 20 bp, mouse
gcccaaaccccggaaggctc

SEQ ID NO: 811577 - DNA, 20 bp, mouse
gagagccccgcctccaccag

SEQ ID NO: 811578 - DNA, 20 bp, mouse
gaatgagcctgagccttccg

SEQ ID NO: 811579 - DNA, 20 bp, mouse
gctctccgggaagggggcaa

SEQ ID NO: 811580 - DNA, 20 bp, mouse
gtgaaagcagccgctggtgg

SEQ ID NO: 811581 - DNA, 20 bp, mouse
gcaatcccagccccaaaccc

SEQ ID NO: 811582 - DNA, 20 bp, mouse
gaagcagccgctggtggagg

SEQ ID NO: 811583 - DNA, 20 bp, mouse
gtgaaaagctgcacgaggag

SEQ ID NO: 811584 - DNA, 20 bp, mouse
gtattccctctccgggaagg

SEQ ID NO: 811585 - DNA, 20 bp, mouse
gcattgaaagcagccgctgg

SEQ ID NO: 811586 - DNA, 20 bp, mouse
ggaagcaggcgccggacaga

SEQ ID NO: 811587 - DNA, 20 bp, mouse
gtgtccggcgcctgcttcac

SEQ ID NO: 811588 - DNA, 20 bp, mouse
ggcactgcgctccttctgtc

SEQ ID NO: 811589 - DNA, 20 bp, mouse
gacacgcaggtggtttagga

SEQ ID NO: 811590 - DNA, 20 bp, mouse
gggaagcgggacaagctaat

SEQ ID NO: 811591 - DNA, 20 bp, mouse
gttaggaaggacccggaagc

SEQ ID NO: 811592 - DNA, 20 bp, mouse
ggcgcagtgcctggtcactc

SEQ ID NO: 811593 - DNA, 20 bp, mouse
ggcaaacaagacaaagggtt

SEQ ID NO: 811594 - DNA, 20 bp, mouse
gaggtggtttaggaaggacc

SEQ ID NO: 811595 - DNA, 20 bp, mouse
gttgctgtgttcttgtaaac

SEQ ID NO: 811596 - DNA, 20 bp, mouse
ggggagccaagtagctgcag

SEQ ID NO: 811597 - DNA, 20 bp, mouse
gcaagtagctgcagaggaca

SEQ ID NO: 811598 - DNA, 20 bp, mouse
gtgcgcaggcgggtaaggcg

SEQ ID NO: 811599 - DNA, 20 bp, mouse
gatgaccccgccctgctccg

SEQ ID NO: 811600 - DNA, 20 bp, mouse
gttagccggtccccagcatg

SEQ ID NO: 811601 - DNA, 20 bp, mouse
ggagcagggcggggtcatgc

SEQ ID NO: 811602 - DNA, 20 bp, mouse
gcccgcgagtcactgctctc

SEQ ID NO: 811603 - DNA, 20 bp, mouse
gctgctccgtggcctggagc

SEQ ID NO: 811604 - DNA, 20 bp, mouse
gccgccgccgcgcttgggag

SEQ ID NO: 811605 - DNA, 20 bp, mouse
ggggtggtggctgtaagcga

SEQ ID NO: 811606 - DNA, 20 bp, mouse
gccgcctgccgagtgtccgt

SEQ ID NO: 811607 - DNA, 20 bp, mouse
gcaggcgggtcggacaaccc

SEQ ID NO: 811608 - DNA, 20 bp, mouse
gtccgggcctcaacgacccc

SEQ ID NO: 811609 - DNA, 20 bp, mouse
ggacaacccgggggtcgttg

SEQ ID NO: 811610 - DNA, 20 bp, mouse
gggggcggagtcgtgagcgg

SEQ ID NO: 811611 - DNA, 20 bp, mouse
gaagagcccgcactcaactg

SEQ ID NO: 811612 - DNA, 20 bp, mouse
gagactccaaacttggagaa

SEQ ID NO: 811613 - DNA, 20 bp, mouse
gggacactcggcaggcgggt

SEQ ID NO: 811614 - DNA, 20 bp, mouse
gcccgccgcggtgacaggac

SEQ ID NO: 811615 - DNA, 20 bp, mouse
gtggagaaaggagtgacctg

SEQ ID NO: 811616 - DNA, 20 bp, mouse
ggggcggagtggcagtgcga

SEQ ID NO: 811617 - DNA, 20 bp, mouse
gagggtggggatcagaacct

SEQ ID NO: 811618 - DNA, 20 bp, mouse
gggtggagaaggcgggccag

SEQ ID NO: 811619 - DNA, 20 bp, mouse
gcggagtggcagtgcgaggg

SEQ ID NO: 811620 - DNA, 20 bp, mouse
gtggaggcggggcctgcatc

SEQ ID NO: 811621 - DNA, 20 bp, mouse
ggtggggatcagaacctggg

SEQ ID NO: 811622 - DNA, 20 bp, mouse
ggcaggccccgcctccaatc

SEQ ID NO: 811623 - DNA, 20 bp, mouse
gggaggcggggccagattgg

SEQ ID NO: 811624 - DNA, 20 bp, mouse
gctgggaggcggggccagat

SEQ ID NO: 811625 - DNA, 20 bp, mouse
ggatcagaacctgggaggcg

SEQ ID NO: 811626 - DNA, 20 bp, mouse
ggggtggagaaactgacgta

SEQ ID NO: 811627 - DNA, 20 bp, mouse
gtctccacccactgcactga

SEQ ID NO: 811628 - DNA, 20 bp, mouse
ggggtactagcgtaggaagt

SEQ ID NO: 811629 - DNA, 20 bp, mouse
gccactgcactgagggtggt

SEQ ID NO: 811630 - DNA, 20 bp, mouse
ggaagccaccaatgcgaatg

SEQ ID NO: 811631 - DNA, 20 bp, mouse
gctcgcgggcggtagtgtaa

SEQ ID NO: 811632 - DNA, 20 bp, mouse
gccgtcccgagggagaccca

SEQ ID NO: 811633 - DNA, 20 bp, mouse
gggtggtgggctgcaataag

SEQ ID NO: 811634 - DNA, 20 bp, mouse
ggctgcaataagtggaaact

SEQ ID NO: 811635 - DNA, 20 bp, mouse
gtctggatggctcttaattc

SEQ ID NO: 811636 - DNA, 20 bp, mouse
ggaagaggcgggtcaagctc

SEQ ID NO: 811637 - DNA, 20 bp, mouse
gcaagctcaggctggggcgt

SEQ ID NO: 811638 - DNA, 20 bp, mouse
gaggctggggcgtagggacc

SEQ ID NO: 811639 - DNA, 20 bp, mouse
ggggcggaatcgcactctca

SEQ ID NO: 811640 - DNA, 20 bp, mouse
gcaaacagcgggctccagga

SEQ ID NO: 811641 - DNA, 20 bp, mouse
gcaagcagagaccgcgggag

SEQ ID NO: 811642 - DNA, 20 bp, mouse
ggaggggcggggccaaagct

SEQ ID NO: 811643 - DNA, 20 bp, mouse
ggcgggtcaagctcaggctg

SEQ ID NO: 811644 - DNA, 20 bp, mouse
ggggtgtgctcaaatgagcg

SEQ ID NO: 811645 - DNA, 20 bp, mouse
ggggccggggcgcaaacagc

SEQ ID NO: 811646 - DNA, 20 bp, mouse
gacggcggcctgggcaaagt

SEQ ID NO: 811647 - DNA, 20 bp, mouse
ggtgacacaggctatcacgg

SEQ ID NO: 811648 - DNA, 20 bp, mouse
gacagagtgtcgggtgacac

SEQ ID NO: 811649 - DNA, 20 bp, mouse
gcggccatggccactaggag

SEQ ID NO: 811650 - DNA, 20 bp, mouse
ggcacctctcctagtggcca

SEQ ID NO: 811651 - DNA, 20 bp, mouse
gggctcaccagcccgagcgt

SEQ ID NO: 811652 - DNA, 20 bp, mouse
gtgcactggagtcccggcca

SEQ ID NO: 811653 - DNA, 20 bp, mouse
gggcctgggcaaagtgggtg

SEQ ID NO: 811654 - DNA, 20 bp, mouse
ggccgggactccagtgcact

SEQ ID NO: 811655 - DNA, 20 bp, mouse
gtaggagaggtgccgcccag

SEQ ID NO: 811656 - DNA, 20 bp, mouse
gtcggcgtgctaaacgttca

SEQ ID NO: 811657 - DNA, 20 bp, mouse
ggagctaggaaaggcgacgt

SEQ ID NO: 811658 - DNA, 20 bp, mouse
gcaaaaacgccctggcagag

SEQ ID NO: 811659 - DNA, 20 bp, mouse
gcggtcttgttgcggaggga

SEQ ID NO: 811660 - DNA, 20 bp, mouse
gctagcaatagtgtcgtacg

SEQ ID NO: 811661 - DNA, 20 bp, mouse
ggttcagggtccgtacaaga

SEQ ID NO: 811662 - DNA, 20 bp, mouse
ggccgagcgtgagcttacat

SEQ ID NO: 811663 - DNA, 20 bp, mouse
gagagtagcgccatcttgta

SEQ ID NO: 811664 - DNA, 20 bp, mouse
gcccgatgtaagctcacgct

SEQ ID NO: 811665 - DNA, 20 bp, mouse
gactctaggtcgagacaggt

SEQ ID NO: 811666 - DNA, 20 bp, mouse
gctgcgggtgacggctggag

SEQ ID NO: 811667 - DNA, 20 bp, mouse
gtgaggctgcgggtgacggc

SEQ ID NO: 811668 - DNA, 20 bp, mouse
gctatgggtgactgttctgt

SEQ ID NO: 811669 - DNA, 20 bp, mouse
gcccactgtgggttaaacag

SEQ ID NO: 811670 - DNA, 20 bp, mouse
gatgagacatcacacaaacc

SEQ ID NO: 811671 - DNA, 20 bp, mouse
gccacagtgggcattagcgt

SEQ ID NO: 811672 - DNA, 20 bp, mouse
gcgtcacccgcagcctcagc

SEQ ID NO: 811673 - DNA, 20 bp, mouse
gaggcgcctgtagtgctgac

SEQ ID NO: 811674 - DNA, 20 bp, mouse
gtgtgagacggatgagagac

SEQ ID NO: 811675 - DNA, 20 bp, mouse
gttgctcctgtcagcactac

SEQ ID NO: 811676 - DNA, 20 bp, mouse
gaggcggagactcgagtcat

SEQ ID NO: 811677 - DNA, 20 bp, mouse
gtgagtcgaagcttcagggg

SEQ ID NO: 811678 - DNA, 20 bp, mouse
ggagctagtatctctatctg

SEQ ID NO: 811679 - DNA, 20 bp, mouse
gttcagggggggttgaagtt

SEQ ID NO: 811680 - DNA, 20 bp, mouse
gggcaagagtctgaaggtta

SEQ ID NO: 811681 - DNA, 20 bp, mouse
gagggctggcaagagtctga

SEQ ID NO: 811682 - DNA, 20 bp, mouse
ggaagcttcgactcacttgg

SEQ ID NO: 811683 - DNA, 20 bp, mouse
ggggccccaattcttgaagg

SEQ ID NO: 811684 - DNA, 20 bp, mouse
ggtggaagaggtacatacca

SEQ ID NO: 811685 - DNA, 20 bp, mouse
gaggtcaggatccaggtagt

SEQ ID NO: 811686 - DNA, 20 bp, mouse
gcagatgccgttgtagggtg

SEQ ID NO: 811687 - DNA, 20 bp, mouse
gaggcgccccctcatctcgt

SEQ ID NO: 811688 - DNA, 20 bp, mouse
gcgcgcgcagatgccgttgt

SEQ ID NO: 811689 - DNA, 20 bp, mouse
ggggcgtcaccggaagtgtg

SEQ ID NO: 811690 - DNA, 20 bp, mouse
gacagaaagagcattgccgg

SEQ ID NO: 811691 - DNA, 20 bp, mouse
ggcgcgcacgcgcagagagg

SEQ ID NO: 811692 - DNA, 20 bp, mouse
gccacaccaacgagatgagg

SEQ ID NO: 811693 - DNA, 20 bp, mouse
ggtggggtgaggcgatatgg

SEQ ID NO: 811694 - DNA, 20 bp, mouse
gcggaggaaagaagtcggtt

SEQ ID NO: 811695 - DNA, 20 bp, mouse
ggcgcggccgggatattaca

SEQ ID NO: 811696 - DNA, 20 bp, mouse
ggaacccccgcactgtgcgg

SEQ ID NO: 811697 - DNA, 20 bp, mouse
gtcgcccccgcacagtgcgg

SEQ ID NO: 811698 - DNA, 20 bp, mouse
gccgcccagggcgcaagccg

SEQ ID NO: 811699 - DNA, 20 bp, mouse
gcctccacggtccgaagcct

SEQ ID NO: 811700 - DNA, 20 bp, mouse
gtcctcgcgctcacctgcct

SEQ ID NO: 811701 - DNA, 20 bp, mouse
gggcggtgatccctttgcca

SEQ ID NO: 811702 - DNA, 20 bp, mouse
gcggcctcttaaaggggacg

SEQ ID NO: 811703 - DNA, 20 bp, mouse
gccagggcgcaagccgaggc

SEQ ID NO: 811704 - DNA, 20 bp, mouse
ggaggaacccccgcactgtg

SEQ ID NO: 811705 - DNA, 20 bp, mouse
gttaagggatattaaaatcg

SEQ ID NO: 811706 - DNA, 20 bp, mouse
gaagaagaggaccagtggaa

SEQ ID NO: 811707 - DNA, 20 bp, mouse
gctggccgtgggatgtccct

SEQ ID NO: 811708 - DNA, 20 bp, mouse
gctgccgaggctcgaccaat

SEQ ID NO: 811709 - DNA, 20 bp, mouse
gccacggccagcccttccac

SEQ ID NO: 811710 - DNA, 20 bp, mouse
ggggataaggagagcctctc

SEQ ID NO: 811711 - DNA, 20 bp, mouse
ggtgggatgtccctgggata

SEQ ID NO: 811712 - DNA, 20 bp, mouse
gagcctctcaggacttcttt

SEQ ID NO: 811713 - DNA, 20 bp, mouse
gagaggaccagtggaagggc

SEQ ID NO: 811714 - DNA, 20 bp, mouse
gcagcccattggtcgagcct

SEQ ID NO: 811715 - DNA, 20 bp, mouse
gagggagccccaaaccgctc

SEQ ID NO: 811716 - DNA, 20 bp, mouse
gggcgactgtgcaaccgcgg

SEQ ID NO: 811717 - DNA, 20 bp, mouse
ggacaggcccagcgtgtgag

SEQ ID NO: 811718 - DNA, 20 bp, mouse
gacggcggggcggacgtggt

SEQ ID NO: 811719 - DNA, 20 bp, mouse
ggcccagcgtgtgagcggag

SEQ ID NO: 811720 - DNA, 20 bp, mouse
gtggcctcaccgatggcgtg

SEQ ID NO: 811721 - DNA, 20 bp, mouse
gggaccgaggtcgcgtccgg

SEQ ID NO: 811722 - DNA, 20 bp, mouse
ggccccccaccccacgccat

SEQ ID NO: 811723 - DNA, 20 bp, mouse
ggaaaacagccggccgggag

SEQ ID NO: 811724 - DNA, 20 bp, mouse
gcccggcgactgtgcaaccg

SEQ ID NO: 811725 - DNA, 20 bp, mouse
gctcaccgatggcgtggggt

SEQ ID NO: 811726 - DNA, 20 bp, mouse
gctctgcgcgcgcgcgtccg

SEQ ID NO: 811727 - DNA, 20 bp, mouse
gcggccgcgggccccaccag

SEQ ID NO: 811728 - DNA, 20 bp, mouse
gagagcgaacagcccgctgg

SEQ ID NO: 811729 - DNA, 20 bp, mouse
ggtggggcccgcggccggca

SEQ ID NO: 811730 - DNA, 20 bp, mouse
gctccagggtgcacggaaac

SEQ ID NO: 811731 - DNA, 20 bp, mouse
ggggtgcggcggggtgcgtg

SEQ ID NO: 811732 - DNA, 20 bp, mouse
gccccgccccgcgctcggct

SEQ ID NO: 811733 - DNA, 20 bp, mouse
gagcccgctggtggggcccg

SEQ ID NO: 811734 - DNA, 20 bp, mouse
gcgcaggcagcaggtgggcg

SEQ ID NO: 811735 - DNA, 20 bp, mouse
gcaggtgggcggggtgcggc

SEQ ID NO: 811736 - DNA, 20 bp, mouse
ggggaggggaagccggtggc

SEQ ID NO: 811737 - DNA, 20 bp, mouse
ggaaggcagaaccccgagaa

SEQ ID NO: 811738 - DNA, 20 bp, mouse
gtgggggcgtcggagttgtg

SEQ ID NO: 811739 - DNA, 20 bp, mouse
gccggtggcaggtgaagagc

SEQ ID NO: 811740 - DNA, 20 bp, mouse
gccgccgcggcgaagctcag

SEQ ID NO: 811741 - DNA, 20 bp, mouse
ggacacctgctgttattaac

SEQ ID NO: 811742 - DNA, 20 bp, mouse
gagactggaggagatttagg

SEQ ID NO: 811743 - DNA, 20 bp, mouse
gtgtccccccccgcagggaa

SEQ ID NO: 811744 - DNA, 20 bp, mouse
gcggccgcccccctcacctc

SEQ ID NO: 811745 - DNA, 20 bp, mouse
gccgcgagactcctcgagac

SEQ ID NO: 811746 - DNA, 20 bp, mouse
ggccgcgctcgggctcctgg

SEQ ID NO: 811747 - DNA, 20 bp, mouse
gcgtcccaggctgctcccgt

SEQ ID NO: 811748 - DNA, 20 bp, mouse
ggaactggcggcgcagagga

SEQ ID NO: 811749 - DNA, 20 bp, mouse
ggagcccgagcgcggcccag

SEQ ID NO: 811750 - DNA, 20 bp, mouse
gagccctgcgaggcctggaa

SEQ ID NO: 811751 - DNA, 20 bp, mouse
gcctcctgcgcccacagcgc

SEQ ID NO: 811752 - DNA, 20 bp, mouse
ggcccccaggagcccgagcg

SEQ ID NO: 811753 - DNA, 20 bp, mouse
ggggctcggacggacggcga

SEQ ID NO: 811754 - DNA, 20 bp, mouse
gagcccttccaggcctcgca

SEQ ID NO: 811755 - DNA, 20 bp, mouse
gaggggccggcggcgcccct

SEQ ID NO: 811756 - DNA, 20 bp, mouse
ggcctggcgactctaaaccc

SEQ ID NO: 811757 - DNA, 20 bp, mouse
gcagtcccccacggggtcag

SEQ ID NO: 811758 - DNA, 20 bp, mouse
gccgccgggcgcggggacaa

SEQ ID NO: 811759 - DNA, 20 bp, mouse
gcgcggggacaaaggcccgc

SEQ ID NO: 811760 - DNA, 20 bp, mouse
gggaggttgcccatccccct

SEQ ID NO: 811761 - DNA, 20 bp, mouse
ggcggagcgcgccgtcccgc

SEQ ID NO: 811762 - DNA, 20 bp, mouse
gcctgagcccttaacgggaa

SEQ ID NO: 811763 - DNA, 20 bp, mouse
gagagctcgagcaagatgct

SEQ ID NO: 811764 - DNA, 20 bp, mouse
gacctccctgagcccttaac

SEQ ID NO: 811765 - DNA, 20 bp, mouse
gtcgccaggcccgggcgcgg

SEQ ID NO: 811766 - DNA, 20 bp, mouse
gcgggcgcccggggaccgga

SEQ ID NO: 811767 - DNA, 20 bp, mouse
ggcgctgtggtgcgtccctc

SEQ ID NO: 811768 - DNA, 20 bp, mouse
gcgaagctgccgcccgctgg

SEQ ID NO: 811769 - DNA, 20 bp, mouse
gtgctcggggtgcacgtcct

SEQ ID NO: 811770 - DNA, 20 bp, mouse
gcccacccgcccagcaagga

SEQ ID NO: 811771 - DNA, 20 bp, mouse
gagcgcgcagcgggcgcccg

SEQ ID NO: 811772 - DNA, 20 bp, mouse
ggacgcacttagcgggagga

SEQ ID NO: 811773 - DNA, 20 bp, mouse
gggggaacgcgacgccgcca

SEQ ID NO: 811774 - DNA, 20 bp, mouse
gcggggacgcacttagcggg

SEQ ID NO: 811775 - DNA, 20 bp, mouse
gtcctcggggcgtgaaggcg

SEQ ID NO: 811776 - DNA, 20 bp, mouse
gccagtcttaactcagacta

SEQ ID NO: 811777 - DNA, 20 bp, mouse
gaagactcagcttgctgcaa

SEQ ID NO: 811778 - DNA, 20 bp, mouse
gtaggtgggacacacctctc

SEQ ID NO: 811779 - DNA, 20 bp, mouse
ggtctactagaagggctgga

SEQ ID NO: 811780 - DNA, 20 bp, mouse
ggctagggccctccactcag

SEQ ID NO: 811781 - DNA, 20 bp, mouse
gcttgctgcaagggatcaga

SEQ ID NO: 811782 - DNA, 20 bp, mouse
gaaaacaaactgatctgggg

SEQ ID NO: 811783 - DNA, 20 bp, mouse
gagttacttgtctactagaa

SEQ ID NO: 811784 - DNA, 20 bp, mouse
gttaactcagactaaggctc

SEQ ID NO: 811785 - DNA, 20 bp, mouse
gagcacaagcagacaagctt

SEQ ID NO: 811786 - DNA, 20 bp, mouse
ggcgacccagggacgagatc

SEQ ID NO: 811787 - DNA, 20 bp, mouse
gcacatggtcccgcgaccca

SEQ ID NO: 811788 - DNA, 20 bp, mouse
ggccccggaggtggcctaaa

SEQ ID NO: 811789 - DNA, 20 bp, mouse
gctgcgcaggggaagttctc

SEQ ID NO: 811790 - DNA, 20 bp, mouse
ggcagcccgagggcgcatgg

SEQ ID NO: 811791 - DNA, 20 bp, mouse
gggcgcctccatgcgccctc

SEQ ID NO: 811792 - DNA, 20 bp, mouse
gcggtgctctggcagcccga

SEQ ID NO: 811793 - DNA, 20 bp, mouse
ggcagaggtcacagtcactg

SEQ ID NO: 811794 - DNA, 20 bp, mouse
gcccagcagcggggagtgca

SEQ ID NO: 811795 - DNA, 20 bp, mouse
gggtcgcgggaccatgtgcg

SEQ ID NO: 811796 - DNA, 20 bp, mouse
ggctgcggcaaggactccag

SEQ ID NO: 811797 - DNA, 20 bp, mouse
gctaggggcctggagaccca

SEQ ID NO: 811798 - DNA, 20 bp, mouse
gtcagcaccaagggtgtccc

SEQ ID NO: 811799 - DNA, 20 bp, mouse
gagagcacggggctggcagt

SEQ ID NO: 811800 - DNA, 20 bp, mouse
gtccccaatctcagcaccaa

SEQ ID NO: 811801 - DNA, 20 bp, mouse
gtaaaggccggggacaccct

SEQ ID NO: 811802 - DNA, 20 bp, mouse
gacacccttggtgctgagat

SEQ ID NO: 811803 - DNA, 20 bp, mouse
gcaggcccctaggctcaggg

SEQ ID NO: 811804 - DNA, 20 bp, mouse
gtaggctcagggaggaagtg

SEQ ID NO: 811805 - DNA, 20 bp, mouse
gtctccaggcccctaggctc

SEQ ID NO: 811806 - DNA, 20 bp, mouse
gcctccctggcacacgagga

SEQ ID NO: 811807 - DNA, 20 bp, mouse
gtgacagtgcgaggactatc

SEQ ID NO: 811808 - DNA, 20 bp, mouse
gactgcaggccggatatcaa

SEQ ID NO: 811809 - DNA, 20 bp, mouse
ggccaaggcctgacagtgcg

SEQ ID NO: 811810 - DNA, 20 bp, mouse
gtgcgggccaagtccatcta

SEQ ID NO: 811811 - DNA, 20 bp, mouse
gccctgggagcgccagtcag

SEQ ID NO: 811812 - DNA, 20 bp, mouse
gtcctcgcactgtcaggcct

SEQ ID NO: 811813 - DNA, 20 bp, mouse
gacaagaaccggcctgtgtc

SEQ ID NO: 811814 - DNA, 20 bp, mouse
ggagggacaccaccgatggg

SEQ ID NO: 811815 - DNA, 20 bp, mouse
gaaccttgggagcctcccat

SEQ ID NO: 811816 - DNA, 20 bp, mouse
ggggccagaagtcgcctaga

SEQ ID NO: 811817 - DNA, 20 bp, mouse
gaggcgcatgcgcactgcca

SEQ ID NO: 811818 - DNA, 20 bp, mouse
ggccgcgtacgaacgtgggg

SEQ ID NO: 811819 - DNA, 20 bp, mouse
gtgcccaggtcgcacgtcta

SEQ ID NO: 811820 - DNA, 20 bp, mouse
gtctggccgcgtacgaacgt

SEQ ID NO: 811821 - DNA, 20 bp, mouse
ggcgtacgaacgtggggcgg

SEQ ID NO: 811822 - DNA, 20 bp, mouse
gctaacagggagagcacttc

SEQ ID NO: 811823 - DNA, 20 bp, mouse
gtccgcccagcgctcttgtt

SEQ ID NO: 811824 - DNA, 20 bp, mouse
gtcgcacgtctaaggagtga

SEQ ID NO: 811825 - DNA, 20 bp, mouse
gagcaagtgagaggggtcta

SEQ ID NO: 811826 - DNA, 20 bp, mouse
ggagccgcgcgtgtgttggg

SEQ ID NO: 811827 - DNA, 20 bp, mouse
gaggggcgatatctctctgc

SEQ ID NO: 811828 - DNA, 20 bp, mouse
gcgtgtgttggggggagaat

SEQ ID NO: 811829 - DNA, 20 bp, mouse
gctctctgcgggctcccgga

SEQ ID NO: 811830 - DNA, 20 bp, mouse
ggtggagccgcgcgtgtgtt

SEQ ID NO: 811831 - DNA, 20 bp, mouse
gggtacatgggggtgagcag

SEQ ID NO: 811832 - DNA, 20 bp, mouse
ggatcccactaggggtacat

SEQ ID NO: 811833 - DNA, 20 bp, mouse
ggaagagcaggatcccacta

SEQ ID NO: 811834 - DNA, 20 bp, mouse
gtgcgggctcccggagggag

SEQ ID NO: 811835 - DNA, 20 bp, mouse
ggggagaatgggcgaggttt

SEQ ID NO: 811836 - DNA, 20 bp, mouse
gggccagtggggacacctgt

SEQ ID NO: 811837 - DNA, 20 bp, mouse
ggcacaacaagcatgtgtgt

SEQ ID NO: 811838 - DNA, 20 bp, mouse
gcacccacaggtgtccccac

SEQ ID NO: 811839 - DNA, 20 bp, mouse
gtgtccccactggccacctg

SEQ ID NO: 811840 - DNA, 20 bp, mouse
gaatttgtgtctggtatccg

SEQ ID NO: 811841 - DNA, 20 bp, mouse
gttccctccctgaggaaaca

SEQ ID NO: 811842 - DNA, 20 bp, mouse
gtaaataggagccaggccac

SEQ ID NO: 811843 - DNA, 20 bp, mouse
gctgtcaggtgggactgcaa

SEQ ID NO: 811844 - DNA, 20 bp, mouse
gcaaagaccaggacacccac

SEQ ID NO: 811845 - DNA, 20 bp, mouse
gactaagaaaatcaaagctg

SEQ ID NO: 811846 - DNA, 20 bp, mouse
gtcggggcggcgtgggcgtg

SEQ ID NO: 811847 - DNA, 20 bp, mouse
gggcggggatgggaagcccg

SEQ ID NO: 811848 - DNA, 20 bp, mouse
ggggatgggaagcccggggc

SEQ ID NO: 811849 - DNA, 20 bp, mouse
gaagcccggggccgggaaac

SEQ ID NO: 811850 - DNA, 20 bp, mouse
gggaaactggggtcccccgc

SEQ ID NO: 811851 - DNA, 20 bp, mouse
gcgcggggtcggggcggcgt

SEQ ID NO: 811852 - DNA, 20 bp, mouse
gtcggggcaagaggacccac

SEQ ID NO: 811853 - DNA, 20 bp, mouse
ggggcccgcgccgaagaggg

SEQ ID NO: 811854 - DNA, 20 bp, mouse
gcgtgggcgtgtggtgcaga

SEQ ID NO: 811855 - DNA, 20 bp, mouse
gcgtgtggtgcagagggcgg

SEQ ID NO: 811856 - DNA, 20 bp, mouse
gggaaggtgaagccgagtgg

SEQ ID NO: 811857 - DNA, 20 bp, mouse
ggcgccgccctccagtcctg

SEQ ID NO: 811858 - DNA, 20 bp, mouse
gaggtgaagccgagtggcgg

SEQ ID NO: 811859 - DNA, 20 bp, mouse
gagaccacgagaaaccttat

SEQ ID NO: 811860 - DNA, 20 bp, mouse
gcaacaccaagaggggaggc

SEQ ID NO: 811861 - DNA, 20 bp, mouse
gtcgcggctgcagcccgtat

SEQ ID NO: 811862 - DNA, 20 bp, mouse
gccggcagggcctggagtaa

SEQ ID NO: 811863 - DNA, 20 bp, mouse
gtggaccattcagaggagtg

SEQ ID NO: 811864 - DNA, 20 bp, mouse
ggtggaccactctaggaaga

SEQ ID NO: 811865 - DNA, 20 bp, mouse
gctcccctcttggtgttgat

SEQ ID NO: 811866 - DNA, 20 bp, mouse
gcccaggcggccgcaggagg

SEQ ID NO: 811867 - DNA, 20 bp, mouse
gggctcgtgcagtcgtgagg

SEQ ID NO: 811868 - DNA, 20 bp, mouse
gaggggcgtggcattggcgg

SEQ ID NO: 811869 - DNA, 20 bp, mouse
gcgcctgggcgccagctccg

SEQ ID NO: 811870 - DNA, 20 bp, mouse
gctagggcgcccgcgtcctg

SEQ ID NO: 811871 - DNA, 20 bp, mouse
gccgccgcgtgtgtgacact

SEQ ID NO: 811872 - DNA, 20 bp, mouse
ggacgcgggcgccctagggc

SEQ ID NO: 811873 - DNA, 20 bp, mouse
gagccgcagtccctgctgga

SEQ ID NO: 811874 - DNA, 20 bp, mouse
ggctccggggtcctgcccta

SEQ ID NO: 811875 - DNA, 20 bp, mouse
gcctaggaggggcgtggcat

SEQ ID NO: 811876 - DNA, 20 bp, mouse
gctgcaggggatactagtgg

SEQ ID NO: 811877 - DNA, 20 bp, mouse
gtggctgcaggggatactag

SEQ ID NO: 811878 - DNA, 20 bp, mouse
gcagaggggccgcacggtca

SEQ ID NO: 811879 - DNA, 20 bp, mouse
gctgaaggcaaatgaggtga

SEQ ID NO: 811880 - DNA, 20 bp, mouse
ggcccctctgaaggcaaatg

SEQ ID NO: 811881 - DNA, 20 bp, mouse
ggacactgaccctgaccgtg

SEQ ID NO: 811882 - DNA, 20 bp, mouse
gacaggatgctagttaaaca

SEQ ID NO: 811883 - DNA, 20 bp, mouse
gggcgcacatgggtggtgga

SEQ ID NO: 811884 - DNA, 20 bp, mouse
gcctgtcaaggctaatgctg

SEQ ID NO: 811885 - DNA, 20 bp, mouse
gggtcagtcagcaagatatc

SEQ ID NO: 811886 - DNA, 20 bp, mouse
gctgactcacaggctcagag

SEQ ID NO: 811887 - DNA, 20 bp, mouse
gccagacagttgtttgtatt

SEQ ID NO: 811888 - DNA, 20 bp, mouse
gcaggacagtgctgactcac

SEQ ID NO: 811889 - DNA, 20 bp, mouse
gtgggcaagccaaagagagc

SEQ ID NO: 811890 - DNA, 20 bp, mouse
gccccagaggcggggaacta

SEQ ID NO: 811891 - DNA, 20 bp, mouse
ggggaggagccagtaagctc

SEQ ID NO: 811892 - DNA, 20 bp, mouse
ggtggggatgggagtggtct

SEQ ID NO: 811893 - DNA, 20 bp, mouse
ggcccggcgcgaaaaaaaga

SEQ ID NO: 811894 - DNA, 20 bp, mouse
gtacaaacaactgtctggga

SEQ ID NO: 811895 - DNA, 20 bp, mouse
gacagttgtttgtattgggc

SEQ ID NO: 811896 - DNA, 20 bp, mouse
gaaagcagacgggtaaagga

SEQ ID NO: 811897 - DNA, 20 bp, mouse
gaaaggagggacagcgaggt

SEQ ID NO: 811898 - DNA, 20 bp, mouse
gagcctgctggcgcagccat

SEQ ID NO: 811899 - DNA, 20 bp, mouse
gggtctctgcggccgaaggc

SEQ ID NO: 811900 - DNA, 20 bp, mouse
gaaagcgaggccaaagaggg

SEQ ID NO: 811901 - DNA, 20 bp, mouse
ggtcaaactaggattctcat

SEQ ID NO: 811902 - DNA, 20 bp, mouse
ggggtaaaggagggacagcg

SEQ ID NO: 811903 - DNA, 20 bp, mouse
gccaatcgaggacttcaaaa

SEQ ID NO: 811904 - DNA, 20 bp, mouse
gttggaaagcagacgggtaa

SEQ ID NO: 811905 - DNA, 20 bp, mouse
gtaaatggagtgctgtgctc

SEQ ID NO: 811906 - DNA, 20 bp, mouse
ggcctgccggggctccccga

SEQ ID NO: 811907 - DNA, 20 bp, mouse
gagaacagggtcggggtccc

SEQ ID NO: 811908 - DNA, 20 bp, mouse
ggacaggggtcgcatacacg

SEQ ID NO: 811909 - DNA, 20 bp, mouse
ggcaggctgcgctaggtcgg

SEQ ID NO: 811910 - DNA, 20 bp, mouse
gaggcggcgctgccagaaca

SEQ ID NO: 811911 - DNA, 20 bp, mouse
ggcgctgccagaacagggtc

SEQ ID NO: 811912 - DNA, 20 bp, mouse
gttgctggaacagtggtgaa

SEQ ID NO: 811913 - DNA, 20 bp, mouse
gtccctcggggagccccggc

SEQ ID NO: 811914 - DNA, 20 bp, mouse
gcagtcaggctcagaccgat

SEQ ID NO: 811915 - DNA, 20 bp, mouse
gccggcaggctgcgctaggt

SEQ ID NO: 811916 - DNA, 20 bp, mouse
gcgcgggccctggagaccga

SEQ ID NO: 811917 - DNA, 20 bp, mouse
gaggagacccttctcaacaa

SEQ ID NO: 811918 - DNA, 20 bp, mouse
gccctggagaccgagggttg

SEQ ID NO: 811919 - DNA, 20 bp, mouse
ggtgaaaagggctcggtcgt

SEQ ID NO: 811920 - DNA, 20 bp, mouse
gggcctcggctgtccctctc

SEQ ID NO: 811921 - DNA, 20 bp, mouse
gcggctgtccctctccggaa

SEQ ID NO: 811922 - DNA, 20 bp, mouse
gttgcggctgatggagcgag

SEQ ID NO: 811923 - DNA, 20 bp, mouse
gcttgcaaaagtcatagttg

SEQ ID NO: 811924 - DNA, 20 bp, mouse
ggacgaggagcccgagtccc

SEQ ID NO: 811925 - DNA, 20 bp, mouse
gagcagcagccacgcagcgc

SEQ ID NO: 811926 - DNA, 20 bp, mouse
ggggaagggcgccctgagaa

SEQ ID NO: 811927 - DNA, 20 bp, mouse
ggtcaaaggcccttctgtat

SEQ ID NO: 811928 - DNA, 20 bp, mouse
gaaccccagcccatacagaa

SEQ ID NO: 811929 - DNA, 20 bp, mouse
gcagaccagcgcccgtcgct

SEQ ID NO: 811930 - DNA, 20 bp, mouse
gcgcccgtcgctaggactcc

SEQ ID NO: 811931 - DNA, 20 bp, mouse
gtatgacggctgccctctct

SEQ ID NO: 811932 - DNA, 20 bp, mouse
gaaccaagatcctccgagag

SEQ ID NO: 811933 - DNA, 20 bp, mouse
gccgccccgtgggagctgga

SEQ ID NO: 811934 - DNA, 20 bp, mouse
gagtcacgggaacaaataaa

SEQ ID NO: 811935 - DNA, 20 bp, mouse
ggccctctctcggaggatct

SEQ ID NO: 811936 - DNA, 20 bp, mouse
gagtccgccaatcccacagg

SEQ ID NO: 811937 - DNA, 20 bp, mouse
gaacagtccgccaatcccac

SEQ ID NO: 811938 - DNA, 20 bp, mouse
ggcgccacctgtgggattgg

SEQ ID NO: 811939 - DNA, 20 bp, mouse
gagcgtcagtactcgactag

SEQ ID NO: 811940 - DNA, 20 bp, mouse
gaacatagagtcaatcaaga

SEQ ID NO: 811941 - DNA, 20 bp, mouse
gaatcttaaaggtgttgcca

SEQ ID NO: 811942 - DNA, 20 bp, mouse
gaaggctctggaaatcttaa

SEQ ID NO: 811943 - DNA, 20 bp, mouse
gtcaacttccttttgttact

SEQ ID NO: 811944 - DNA, 20 bp, mouse
gatcccacaggtggcgctga

SEQ ID NO: 811945 - DNA, 20 bp, mouse
ggagccttggccatggtcag

SEQ ID NO: 811946 - DNA, 20 bp, mouse
gcagaggcggggataggggc

SEQ ID NO: 811947 - DNA, 20 bp, mouse
ggaccccgcccattgatcct

SEQ ID NO: 811948 - DNA, 20 bp, mouse
gtgcgcagaggcggggatag

SEQ ID NO: 811949 - DNA, 20 bp, mouse
ggcagaacctaggagctcgt

SEQ ID NO: 811950 - DNA, 20 bp, mouse
gaggctgcgtggtcccacga

SEQ ID NO: 811951 - DNA, 20 bp, mouse
ggatccttggaatcgcctaa

SEQ ID NO: 811952 - DNA, 20 bp, mouse
ggtgggagcacgctgcgcag

SEQ ID NO: 811953 - DNA, 20 bp, mouse
gaggcgattccaaggatcaa

SEQ ID NO: 811954 - DNA, 20 bp, mouse
gagcacgctgcgcagaggcg

SEQ ID NO: 811955 - DNA, 20 bp, mouse
ggacttaagggtggatgggt

SEQ ID NO: 811956 - DNA, 20 bp, mouse
gaggtgggctcagacctcaa

SEQ ID NO: 811957 - DNA, 20 bp, mouse
ggctgcgggtccgcgagcgg

SEQ ID NO: 811958 - DNA, 20 bp, mouse
ggggtccgcgagcggaggga

SEQ ID NO: 811959 - DNA, 20 bp, mouse
gtgcccgcctgtctctcctt

SEQ ID NO: 811960 - DNA, 20 bp, mouse
gagtctccccaactggtaat

SEQ ID NO: 811961 - DNA, 20 bp, mouse
gacagcaagagttactgcta

SEQ ID NO: 811962 - DNA, 20 bp, mouse
gtcgaaccccaaggagagac

SEQ ID NO: 811963 - DNA, 20 bp, mouse
ggcagctgcgggtccgcgag

SEQ ID NO: 811964 - DNA, 20 bp, mouse
gcggacggacgcagcggtga

SEQ ID NO: 811965 - DNA, 20 bp, mouse
gggctgcagatggagctagg

SEQ ID NO: 811966 - DNA, 20 bp, mouse
gccgcggtggacgcacagga

SEQ ID NO: 811967 - DNA, 20 bp, mouse
gggcgggcgccggggcactg

SEQ ID NO: 811968 - DNA, 20 bp, mouse
gcagccctgcccaccctaac

SEQ ID NO: 811969 - DNA, 20 bp, mouse
ggccgccatcgtcccagtta

SEQ ID NO: 811970 - DNA, 20 bp, mouse
gccccggcgccggcgaggga

SEQ ID NO: 811971 - DNA, 20 bp, mouse
ggtcccagttagggtgggca

SEQ ID NO: 811972 - DNA, 20 bp, mouse
gcgccccgcggtggacgcac

SEQ ID NO: 811973 - DNA, 20 bp, mouse
ggggacgtgtgcggggatcg

SEQ ID NO: 811974 - DNA, 20 bp, mouse
gcccaccctaactgggacga

SEQ ID NO: 811975 - DNA, 20 bp, mouse
ggcccggcagccccaagcgg

SEQ ID NO: 811976 - DNA, 20 bp, mouse
ggggacccgaggactctgag

SEQ ID NO: 811977 - DNA, 20 bp, mouse
ggactctgagaggagtagat

SEQ ID NO: 811978 - DNA, 20 bp, mouse
gcgggaagcaactgcgccga

SEQ ID NO: 811979 - DNA, 20 bp, mouse
ggagcacgggtaacgacatg

SEQ ID NO: 811980 - DNA, 20 bp, mouse
ggccccgggccggagcccgt

SEQ ID NO: 811981 - DNA, 20 bp, mouse
gaggagcccgctgcctaacg

SEQ ID NO: 811982 - DNA, 20 bp, mouse
gggactagagagcgccccac

SEQ ID NO: 811983 - DNA, 20 bp, mouse
gcccgcggcgggatccccca

SEQ ID NO: 811984 - DNA, 20 bp, mouse
gcatgtggaggactcaccct

SEQ ID NO: 811985 - DNA, 20 bp, mouse
gtcgtcgtcagtgacacgag

SEQ ID NO: 811986 - DNA, 20 bp, mouse
gaggaatgctgggacagcga

SEQ ID NO: 811987 - DNA, 20 bp, mouse
gtacaaccgcaggacgctct

SEQ ID NO: 811988 - DNA, 20 bp, mouse
gagcgtcctgcggttgtagt

SEQ ID NO: 811989 - DNA, 20 bp, mouse
ggggcagcgcgaggaatgct

SEQ ID NO: 811990 - DNA, 20 bp, mouse
ggtcctcccagagcgtcctg

SEQ ID NO: 811991 - DNA, 20 bp, mouse
gacagggaacccgggaccaa

SEQ ID NO: 811992 - DNA, 20 bp, mouse
gcgcaaccatagagacgaga

SEQ ID NO: 811993 - DNA, 20 bp, mouse
gtaacagcatgctcaaggct

SEQ ID NO: 811994 - DNA, 20 bp, mouse
gtggttgcgccggcgttgtc

SEQ ID NO: 811995 - DNA, 20 bp, mouse
ggaggacctactacaaccgc

SEQ ID NO: 811996 - DNA, 20 bp, mouse
gtggcaggggcgcatctgat

SEQ ID NO: 811997 - DNA, 20 bp, mouse
gaagccacagcagccagagg

SEQ ID NO: 811998 - DNA, 20 bp, mouse
gagggaggaggcctgtttat

SEQ ID NO: 811999 - DNA, 20 bp, mouse
gtactaaggtaaaggtgggt

SEQ ID NO: 812000 - DNA, 20 bp, mouse
gactacatttctcccccctc

SEQ ID NO: 812001 - DNA, 20 bp, mouse
gtgtacaggacagacgtcac

SEQ ID NO: 812002 - DNA, 20 bp, mouse
gttgccctcaaacaattgag

SEQ ID NO: 812003 - DNA, 20 bp, mouse
ggcagccctgagcacaaagc

SEQ ID NO: 812004 - DNA, 20 bp, mouse
gtacactcacatctggggat

SEQ ID NO: 812005 - DNA, 20 bp, mouse
gtggctttattttcacctga

SEQ ID NO: 812006 - DNA, 20 bp, mouse
gagtggccaggcagcggtgc

SEQ ID NO: 812007 - DNA, 20 bp, mouse
gttaactggcttccaaggcg

SEQ ID NO: 812008 - DNA, 20 bp, mouse
gaagggctacgagtgtcccc

SEQ ID NO: 812009 - DNA, 20 bp, mouse
gggcggagggaaagccctct

SEQ ID NO: 812010 - DNA, 20 bp, mouse
gttggaagccagttaaaaca

SEQ ID NO: 812011 - DNA, 20 bp, mouse
gagggctttccctccgccag

SEQ ID NO: 812012 - DNA, 20 bp, mouse
gtacgagtgtcccctggcgg

SEQ ID NO: 812013 - DNA, 20 bp, mouse
gaggcaccacagctcagata

SEQ ID NO: 812014 - DNA, 20 bp, mouse
gggtgaacagaacagacaag

SEQ ID NO: 812015 - DNA, 20 bp, mouse
gaccacaccaaattagggag

SEQ ID NO: 812016 - DNA, 20 bp, mouse
gaaggcccggggtagcgccg

SEQ ID NO: 812017 - DNA, 20 bp, mouse
ggagacgcgcgtgaacctgc

SEQ ID NO: 812018 - DNA, 20 bp, mouse
gtgcaggtctcggggaccaa

SEQ ID NO: 812019 - DNA, 20 bp, mouse
ggctcggcctggtcccctcg

SEQ ID NO: 812020 - DNA, 20 bp, mouse
gcccctcggggtcaccgcca

SEQ ID NO: 812021 - DNA, 20 bp, mouse
gctcgcgcggcgaccccgga

SEQ ID NO: 812022 - DNA, 20 bp, mouse
ggcgctaccccgggccttgg

SEQ ID NO: 812023 - DNA, 20 bp, mouse
gtggcagctggagaatccga

SEQ ID NO: 812024 - DNA, 20 bp, mouse
ggggtcaccgccaaggcccg

SEQ ID NO: 812025 - DNA, 20 bp, mouse
gcagtcgcggccaagtgcag

SEQ ID NO: 812026 - DNA, 20 bp, mouse
ggggctgtgtcttggggtga

SEQ ID NO: 812027 - DNA, 20 bp, mouse
ggaggctgggtgggcgtcgc

SEQ ID NO: 812028 - DNA, 20 bp, mouse
gagagcagggctgtgtcttg

SEQ ID NO: 812029 - DNA, 20 bp, mouse
gccagcccgcggccaggctc

SEQ ID NO: 812030 - DNA, 20 bp, mouse
ggctcctctcccgccttctt

SEQ ID NO: 812031 - DNA, 20 bp, mouse
gctgttggctgtgcccttaa

SEQ ID NO: 812032 - DNA, 20 bp, mouse
ggccctggcagggttactgc

SEQ ID NO: 812033 - DNA, 20 bp, mouse
gtagtcccgccccaagaagg

SEQ ID NO: 812034 - DNA, 20 bp, mouse
ggcctgcagtaaccctgcca

SEQ ID NO: 812035 - DNA, 20 bp, mouse
ggtgggcagacccctgggcg

SEQ ID NO: 812036 - DNA, 20 bp, mouse
ggaccacaacaggatgaggg

SEQ ID NO: 812037 - DNA, 20 bp, mouse
ggcaacgtagccctcactct

SEQ ID NO: 812038 - DNA, 20 bp, mouse
gaaaagaaatgcgggggtgt

SEQ ID NO: 812039 - DNA, 20 bp, mouse
gtatggcaagatgctttctg

SEQ ID NO: 812040 - DNA, 20 bp, mouse
gctctgaccacaacaggatg

SEQ ID NO: 812041 - DNA, 20 bp, mouse
gcccctgcctctacttcctc

SEQ ID NO: 812042 - DNA, 20 bp, mouse
ggatctcaaactttgagatc

SEQ ID NO: 812043 - DNA, 20 bp, mouse
gttccaccctcatcctgttg

SEQ ID NO: 812044 - DNA, 20 bp, mouse
gacagacagtagtcaggacg

SEQ ID NO: 812045 - DNA, 20 bp, mouse
gactactgtctgttttgttc

SEQ ID NO: 812046 - DNA, 20 bp, mouse
gggtgctggagggactccca

SEQ ID NO: 812047 - DNA, 20 bp, mouse
gaaagtatgcagtgagcaga

SEQ ID NO: 812048 - DNA, 20 bp, mouse
gaaaatcgcagcttccctga

SEQ ID NO: 812049 - DNA, 20 bp, mouse
gcgcaccagctgtacactgc

SEQ ID NO: 812050 - DNA, 20 bp, mouse
gttcgtggaccggtgctgga

SEQ ID NO: 812051 - DNA, 20 bp, mouse
gtaactgctcaccctggctc

SEQ ID NO: 812052 - DNA, 20 bp, mouse
gagggtgagcagttacctgg

SEQ ID NO: 812053 - DNA, 20 bp, mouse
gctaagtcagctgcaagggg

SEQ ID NO: 812054 - DNA, 20 bp, mouse
gcccatggccaggctgggag

SEQ ID NO: 812055 - DNA, 20 bp, mouse
ggatcccgctgcttgaagca

SEQ ID NO: 812056 - DNA, 20 bp, mouse
gcgcccaggcgtggaaacgt

SEQ ID NO: 812057 - DNA, 20 bp, mouse
gagcgtgtgcgataggagag

SEQ ID NO: 812058 - DNA, 20 bp, mouse
gcgcggcgctcccgcgtgtg

SEQ ID NO: 812059 - DNA, 20 bp, mouse
gccaggcgtggaaacgtggg

SEQ ID NO: 812060 - DNA, 20 bp, mouse
gcacgcctgggcgcccggtt

SEQ ID NO: 812061 - DNA, 20 bp, mouse
ggtcccccaaccgggcgccc

SEQ ID NO: 812062 - DNA, 20 bp, mouse
gggcgtggaaacgtgggcgg

SEQ ID NO: 812063 - DNA, 20 bp, mouse
gctccggggtgaaggtagtg

SEQ ID NO: 812064 - DNA, 20 bp, mouse
gaaacgtgggcggcggcgag

SEQ ID NO: 812065 - DNA, 20 bp, mouse
ggaaccgcctgcactagtgc

SEQ ID NO: 812066 - DNA, 20 bp, mouse
gtcacgaagcgggaaaagga

SEQ ID NO: 812067 - DNA, 20 bp, mouse
gcggcgcgagacacaggcga

SEQ ID NO: 812068 - DNA, 20 bp, mouse
gcacaactgggaccctgtct

SEQ ID NO: 812069 - DNA, 20 bp, mouse
gtctgtgggaggaagaaagt

SEQ ID NO: 812070 - DNA, 20 bp, mouse
gagaaagtggggtctcctcc

SEQ ID NO: 812071 - DNA, 20 bp, mouse
ggggtctcctccaggtgggg

SEQ ID NO: 812072 - DNA, 20 bp, mouse
gggcatcacgggggctacaa

SEQ ID NO: 812073 - DNA, 20 bp, mouse
gccaagccggcgcgagacac

SEQ ID NO: 812074 - DNA, 20 bp, mouse
gccgggaccagctgcccaat

SEQ ID NO: 812075 - DNA, 20 bp, mouse
ggggaacaaatgtcacaact

SEQ ID NO: 812076 - DNA, 20 bp, mouse
gcgtaaagaggtgactcggg

SEQ ID NO: 812077 - DNA, 20 bp, mouse
ggcgggcgggggcgaatagg

SEQ ID NO: 812078 - DNA, 20 bp, mouse
gcgggcgggcgggggcgaat

SEQ ID NO: 812079 - DNA, 20 bp, mouse
gaggtgactcgggcgggcgg

SEQ ID NO: 812080 - DNA, 20 bp, mouse
gccctagggggggaaatcga

SEQ ID NO: 812081 - DNA, 20 bp, mouse
ggggacctctggcaccctct

SEQ ID NO: 812082 - DNA, 20 bp, mouse
ggctagctcgaaaggggcgg

SEQ ID NO: 812083 - DNA, 20 bp, mouse
gcctgcgcacgcacccctag

SEQ ID NO: 812084 - DNA, 20 bp, mouse
ggcgcgtaaagaggtgactc

SEQ ID NO: 812085 - DNA, 20 bp, mouse
gggaggagggcggatagagg

SEQ ID NO: 812086 - DNA, 20 bp, mouse
ggtctctgactctttaaaga

SEQ ID NO: 812087 - DNA, 20 bp, mouse
gaatacctaagccttggtat

SEQ ID NO: 812088 - DNA, 20 bp, mouse
gtgtggggacgaggtcgaga

SEQ ID NO: 812089 - DNA, 20 bp, mouse
gccggctcgcacccacttcc

SEQ ID NO: 812090 - DNA, 20 bp, mouse
ggagctctctgtccaatcgc

SEQ ID NO: 812091 - DNA, 20 bp, mouse
gagctcgctcaacgcaatta

SEQ ID NO: 812092 - DNA, 20 bp, mouse
gcgtctccaagcagccacgg

SEQ ID NO: 812093 - DNA, 20 bp, mouse
gcggtctttcctggtttcga

SEQ ID NO: 812094 - DNA, 20 bp, mouse
gaaagagggccggtctttcc

SEQ ID NO: 812095 - DNA, 20 bp, mouse
gtttcgacggggcgcacttg

SEQ ID NO: 812096 - DNA, 20 bp, mouse
gctacagcggcccaatcagt

SEQ ID NO: 812097 - DNA, 20 bp, mouse
ggcgggaccaggctgcgctg

SEQ ID NO: 812098 - DNA, 20 bp, mouse
gtgcgctggggagagtttag

SEQ ID NO: 812099 - DNA, 20 bp, mouse
gaatcgcgcgtgggcagctg

SEQ ID NO: 812100 - DNA, 20 bp, mouse
gggagagtttagtggagctc

SEQ ID NO: 812101 - DNA, 20 bp, mouse
gaaagagctctgaactggag

SEQ ID NO: 812102 - DNA, 20 bp, mouse
ggggcagtattgctgattgt

SEQ ID NO: 812103 - DNA, 20 bp, mouse
ggattgggccgctgtagggg

SEQ ID NO: 812104 - DNA, 20 bp, mouse
gctggatgctcccactgatt

SEQ ID NO: 812105 - DNA, 20 bp, mouse
ggctgggggcgggctctacc

SEQ ID NO: 812106 - DNA, 20 bp, mouse
gataccgggacttgtataga

SEQ ID NO: 812107 - DNA, 20 bp, mouse
gagagcttcaagaaaggaca

SEQ ID NO: 812108 - DNA, 20 bp, mouse
gaggcaaagctctccatacc

SEQ ID NO: 812109 - DNA, 20 bp, mouse
gcctgcgcatgcgcagtact

SEQ ID NO: 812110 - DNA, 20 bp, mouse
gctctgaagagcttcaagaa

SEQ ID NO: 812111 - DNA, 20 bp, mouse
gaaaccaaaaagcgcttgcc

SEQ ID NO: 812112 - DNA, 20 bp, mouse
gaagcgcttgcctggaaaac

SEQ ID NO: 812113 - DNA, 20 bp, mouse
gtatctagcatatggttctc

SEQ ID NO: 812114 - DNA, 20 bp, mouse
gaccaagcatatctagcata

SEQ ID NO: 812115 - DNA, 20 bp, mouse
gcagctacatgtgaagttag

SEQ ID NO: 812116 - DNA, 20 bp, mouse
gagaccgcgcactgccgcgg

SEQ ID NO: 812117 - DNA, 20 bp, mouse
gcgagcctgggcattcgcta

SEQ ID NO: 812118 - DNA, 20 bp, mouse
gaatgcccaggctcgctcaa

SEQ ID NO: 812119 - DNA, 20 bp, mouse
gtgccgcggaggaaaggaaa

SEQ ID NO: 812120 - DNA, 20 bp, mouse
gctagccagcggcgcccagt

SEQ ID NO: 812121 - DNA, 20 bp, mouse
ggcgcactgccgcggaggaa

SEQ ID NO: 812122 - DNA, 20 bp, mouse
ggggagaccgcgcactgccg

SEQ ID NO: 812123 - DNA, 20 bp, mouse
gtgggtgactgcttttgctc

SEQ ID NO: 812124 - DNA, 20 bp, mouse
ggggcattcgctagggagga

SEQ ID NO: 812125 - DNA, 20 bp, mouse
gccaaggtttccctctgatt

SEQ ID NO: 812126 - DNA, 20 bp, mouse
gagcgccactacctggggtg

SEQ ID NO: 812127 - DNA, 20 bp, mouse
gggggccgccagagggaaat

SEQ ID NO: 812128 - DNA, 20 bp, mouse
gggaactgatgcttccctgc

SEQ ID NO: 812129 - DNA, 20 bp, mouse
gagaggaggcaggtcctcag

SEQ ID NO: 812130 - DNA, 20 bp, mouse
gggttcactaggagttgcga

SEQ ID NO: 812131 - DNA, 20 bp, mouse
ggcaggagcgccactacctg

SEQ ID NO: 812132 - DNA, 20 bp, mouse
gtgcgcggggccaaagagcc

SEQ ID NO: 812133 - DNA, 20 bp, mouse
ggctcctgctacccgcgaag

SEQ ID NO: 812134 - DNA, 20 bp, mouse
gagcccggttgcgtcgagcc

SEQ ID NO: 812135 - DNA, 20 bp, mouse
gtgaacacgcgcactccggc

SEQ ID NO: 812136 - DNA, 20 bp, mouse
gggtcccagggtcttcacca

SEQ ID NO: 812137 - DNA, 20 bp, mouse
ggtggagagacgacagaagg

SEQ ID NO: 812138 - DNA, 20 bp, mouse
gtggaagggcggaagagcat

SEQ ID NO: 812139 - DNA, 20 bp, mouse
ggacaggggctcggatgtga

SEQ ID NO: 812140 - DNA, 20 bp, mouse
gcacagcggcctccggtgat

SEQ ID NO: 812141 - DNA, 20 bp, mouse
gagcggcctccggtgatagg

SEQ ID NO: 812142 - DNA, 20 bp, mouse
gggcgggatctattggtcag

SEQ ID NO: 812143 - DNA, 20 bp, mouse
gtcactctggagggcagtaa

SEQ ID NO: 812144 - DNA, 20 bp, mouse
gaggttccgggacagtgcct

SEQ ID NO: 812145 - DNA, 20 bp, mouse
gtaacgcttggtaggggtga

SEQ ID NO: 812146 - DNA, 20 bp, mouse
gcgaacgcgcaggaccagtc

SEQ ID NO: 812147 - DNA, 20 bp, mouse
gtgggcggggcccgaaagaa

SEQ ID NO: 812148 - DNA, 20 bp, mouse
gcggggcccgaaagaagggg

SEQ ID NO: 812149 - DNA, 20 bp, mouse
gagggacgggacatgcgcag

SEQ ID NO: 812150 - DNA, 20 bp, mouse
gtgtcccgtccctgaggtcc

SEQ ID NO: 812151 - DNA, 20 bp, mouse
gccaacaccggaaagagggg

SEQ ID NO: 812152 - DNA, 20 bp, mouse
gttagcaaatgcaggatggg

SEQ ID NO: 812153 - DNA, 20 bp, mouse
gaggggcggagcgtcccgac

SEQ ID NO: 812154 - DNA, 20 bp, mouse
gctgaggtcccggtagaaga

SEQ ID NO: 812155 - DNA, 20 bp, mouse
gctaccgggacctcagggac

SEQ ID NO: 812156 - DNA, 20 bp, mouse
gaagcgctgtggtacggcgt

SEQ ID NO: 812157 - DNA, 20 bp, mouse
gcgaaagcgtcccgtctcca

SEQ ID NO: 812158 - DNA, 20 bp, mouse
ggggacgtttacggactaac

SEQ ID NO: 812159 - DNA, 20 bp, mouse
ggcggaagtgagtgcgtgtg

SEQ ID NO: 812160 - DNA, 20 bp, mouse
gcgccctgcgccagtctcct

SEQ ID NO: 812161 - DNA, 20 bp, mouse
gccacagcgcttccggacgg

SEQ ID NO: 812162 - DNA, 20 bp, mouse
ggtccggaagcgctgtggta

SEQ ID NO: 812163 - DNA, 20 bp, mouse
gactctaaccgggacgttta

SEQ ID NO: 812164 - DNA, 20 bp, mouse
gacaccgctactataaaagg

SEQ ID NO: 812165 - DNA, 20 bp, mouse
gagccacagcgacgtcccta

SEQ ID NO: 812166 - DNA, 20 bp, mouse
gtgtacgtggccctagtccc

SEQ ID NO: 812167 - DNA, 20 bp, mouse
gggtccagggccggggacta

SEQ ID NO: 812168 - DNA, 20 bp, mouse
gctccggctcgagttctctg

SEQ ID NO: 812169 - DNA, 20 bp, mouse
ggaggggccggagtctggag

SEQ ID NO: 812170 - DNA, 20 bp, mouse
ggggccggagtctggagtgg

SEQ ID NO: 812171 - DNA, 20 bp, mouse
gtggccctagtccccggccc

SEQ ID NO: 812172 - DNA, 20 bp, mouse
gggtccataagtcttgcctg

SEQ ID NO: 812173 - DNA, 20 bp, mouse
ggatccgcaggcaagactta

SEQ ID NO: 812174 - DNA, 20 bp, mouse
gggagtctggagtggcggca

SEQ ID NO: 812175 - DNA, 20 bp, mouse
gtctccggccgcagcagggg

SEQ ID NO: 812176 - DNA, 20 bp, mouse
ggggaggggccggctcccgg

SEQ ID NO: 812177 - DNA, 20 bp, mouse
gtgtgcgcgcccccgggagc

SEQ ID NO: 812178 - DNA, 20 bp, mouse
gactgcgctagaggtccaaa

SEQ ID NO: 812179 - DNA, 20 bp, mouse
gtcccgggggcgcgcacacg

SEQ ID NO: 812180 - DNA, 20 bp, mouse
gtacgcgggccggaccagga

SEQ ID NO: 812181 - DNA, 20 bp, mouse
ggcgccgatgggctcgggga

SEQ ID NO: 812182 - DNA, 20 bp, mouse
ggcgcgctcctcttcagcat

SEQ ID NO: 812183 - DNA, 20 bp, mouse
gcgcactagagaaacccctt

SEQ ID NO: 812184 - DNA, 20 bp, mouse
gagagggaggggccggctcc

SEQ ID NO: 812185 - DNA, 20 bp, mouse
gcaaccctccccgagcccat

SEQ ID NO: 812186 - DNA, 20 bp, mouse
ggacaggatcgaaaattccg

SEQ ID NO: 812187 - DNA, 20 bp, mouse
gagggcggacgctattgtca

SEQ ID NO: 812188 - DNA, 20 bp, mouse
gtaaagaaagcgggcgctag

SEQ ID NO: 812189 - DNA, 20 bp, mouse
gggggcgcgggcggcttgga

SEQ ID NO: 812190 - DNA, 20 bp, mouse
gtacacccgctggaattcag

SEQ ID NO: 812191 - DNA, 20 bp, mouse
gtcactcgctcaggaagaaa

SEQ ID NO: 812192 - DNA, 20 bp, mouse
gctgtccccggggggcggaa

SEQ ID NO: 812193 - DNA, 20 bp, mouse
gcgcccgctttctttaaatg

SEQ ID NO: 812194 - DNA, 20 bp, mouse
ggccgcctgaagcgagagtg

SEQ ID NO: 812195 - DNA, 20 bp, mouse
gtaaatgcggcttctgcgga

SEQ ID NO: 812196 - DNA, 20 bp, mouse
gcggcgcaggaggacgatgg

SEQ ID NO: 812197 - DNA, 20 bp, mouse
ggcagcttgtgagctctagg

SEQ ID NO: 812198 - DNA, 20 bp, mouse
ggcgcggcgcaggaggacga

SEQ ID NO: 812199 - DNA, 20 bp, mouse
gagtctccagccgggagagt

SEQ ID NO: 812200 - DNA, 20 bp, mouse
gcccgctccgcctactctcc

SEQ ID NO: 812201 - DNA, 20 bp, mouse
gctccagccgggagagtagg

SEQ ID NO: 812202 - DNA, 20 bp, mouse
gtgcctgagagtctccagcc

SEQ ID NO: 812203 - DNA, 20 bp, mouse
ggtaaagaggaggaccaaag

SEQ ID NO: 812204 - DNA, 20 bp, mouse
ggcactgcgacctcgcctat

SEQ ID NO: 812205 - DNA, 20 bp, mouse
ggcggagggatggtgcttaa

SEQ ID NO: 812206 - DNA, 20 bp, mouse
ggtactgaaggcttgagggt

SEQ ID NO: 812207 - DNA, 20 bp, mouse
ggggaagcaggtcaaaccgt

SEQ ID NO: 812208 - DNA, 20 bp, mouse
gccgataggtagaccctccc

SEQ ID NO: 812209 - DNA, 20 bp, mouse
gggggaggacaggctgtcga

SEQ ID NO: 812210 - DNA, 20 bp, mouse
gcttgagggtggggcccgat

SEQ ID NO: 812211 - DNA, 20 bp, mouse
gcggagagactacggcacga

SEQ ID NO: 812212 - DNA, 20 bp, mouse
gccacattggagagggagtg

SEQ ID NO: 812213 - DNA, 20 bp, mouse
gttaactacggaggccggga

SEQ ID NO: 812214 - DNA, 20 bp, mouse
gtggagatgcggagagacta

SEQ ID NO: 812215 - DNA, 20 bp, mouse
gtggtcttgcgtagtgggcg

SEQ ID NO: 812216 - DNA, 20 bp, mouse
gcgggagcgcgcaccgaacc

SEQ ID NO: 812217 - DNA, 20 bp, mouse
gtctgcgcgtgcgtggccgt

SEQ ID NO: 812218 - DNA, 20 bp, mouse
gcacgcgcagaagcggctgg

SEQ ID NO: 812219 - DNA, 20 bp, mouse
gacagcgcagccgcctcgtg

SEQ ID NO: 812220 - DNA, 20 bp, mouse
gagcgcgcaccgaacccggc

SEQ ID NO: 812221 - DNA, 20 bp, mouse
gcgccaaccgccaccgagtg

SEQ ID NO: 812222 - DNA, 20 bp, mouse
gccgcctcgtggggatgctc

SEQ ID NO: 812223 - DNA, 20 bp, mouse
gcgcaccgaacccggctggg

SEQ ID NO: 812224 - DNA, 20 bp, mouse
gggccacgcacgcgcagaag

SEQ ID NO: 812225 - DNA, 20 bp, mouse
gtgtctcgggccgttactgt

SEQ ID NO: 812226 - DNA, 20 bp, mouse
gtggtctaagcgacggatgg

SEQ ID NO: 812227 - DNA, 20 bp, mouse
gaggctgcggcgtgaggtaa

SEQ ID NO: 812228 - DNA, 20 bp, mouse
gtctaagcgacggatggagg

SEQ ID NO: 812229 - DNA, 20 bp, mouse
gagaaagtctaacgaaagag

SEQ ID NO: 812230 - DNA, 20 bp, mouse
gcccttgcgcctaagaccac

SEQ ID NO: 812231 - DNA, 20 bp, mouse
gccaaggtgaaggccacggt

SEQ ID NO: 812232 - DNA, 20 bp, mouse
gggtgattagggaacctctg

SEQ ID NO: 812233 - DNA, 20 bp, mouse
gactcgatctggcgagagag

SEQ ID NO: 812234 - DNA, 20 bp, mouse
gagaccacgccttttcctcc

SEQ ID NO: 812235 - DNA, 20 bp, mouse
gtggtacagcccggaggaaa

SEQ ID NO: 812236 - DNA, 20 bp, mouse
ggggaagggtcgggagactc

SEQ ID NO: 812237 - DNA, 20 bp, mouse
gcggcgatcgactcattcaa

SEQ ID NO: 812238 - DNA, 20 bp, mouse
gcgacccggcactcagggac

SEQ ID NO: 812239 - DNA, 20 bp, mouse
ggcaactgctggcccggcgt

SEQ ID NO: 812240 - DNA, 20 bp, mouse
gcccagcgaggaaaccgctc

SEQ ID NO: 812241 - DNA, 20 bp, mouse
gaggtcccctgggaagggtc

SEQ ID NO: 812242 - DNA, 20 bp, mouse
gcccccgcgtgtcaagctac

SEQ ID NO: 812243 - DNA, 20 bp, mouse
gtgacgctaagacacgtgtg

SEQ ID NO: 812244 - DNA, 20 bp, mouse
gagtcggtgcgggtcggcgt

SEQ ID NO: 812245 - DNA, 20 bp, mouse
gggcccggcgtgggcgtgga

SEQ ID NO: 812246 - DNA, 20 bp, mouse
gtaggggaggtatttgttat

SEQ ID NO: 812247 - DNA, 20 bp, mouse
gaatgcagtgtgctgatcta

SEQ ID NO: 812248 - DNA, 20 bp, mouse
gcatcagggagtttcagtag

SEQ ID NO: 812249 - DNA, 20 bp, mouse
gttgttcagggcactaagaa

SEQ ID NO: 812250 - DNA, 20 bp, mouse
gctccctgatgaattgagcc

SEQ ID NO: 812251 - DNA, 20 bp, mouse
gtacataatgctggggagat

SEQ ID NO: 812252 - DNA, 20 bp, mouse
ggacagaaatgttatccttg

SEQ ID NO: 812253 - DNA, 20 bp, mouse
ggccaaccatacataatgct

SEQ ID NO: 812254 - DNA, 20 bp, mouse
gcgccaggctcaattcatca

SEQ ID NO: 812255 - DNA, 20 bp, mouse
ggacgaccccatctgcctgt

SEQ ID NO: 812256 - DNA, 20 bp, mouse
gtaagccaggtgtctgagaa

SEQ ID NO: 812257 - DNA, 20 bp, mouse
gaagggcttctgctcgagca

SEQ ID NO: 812258 - DNA, 20 bp, mouse
gtctctgaggggtttgtcgt

SEQ ID NO: 812259 - DNA, 20 bp, mouse
gaggtcacgcgtgtggagta

SEQ ID NO: 812260 - DNA, 20 bp, mouse
gcttccagcaagactctcgc

SEQ ID NO: 812261 - DNA, 20 bp, mouse
gtgccacctggggtctccga

SEQ ID NO: 812262 - DNA, 20 bp, mouse
gtagcggctacctctctgag

SEQ ID NO: 812263 - DNA, 20 bp, mouse
gggaagacttaaaaagtcga

SEQ ID NO: 812264 - DNA, 20 bp, mouse
gtaccaattcgattttacag

SEQ ID NO: 812265 - DNA, 20 bp, mouse
gtggtggtttgaggttgaga

SEQ ID NO: 812266 - DNA, 20 bp, mouse
gacggctgcgtgggaagtag

SEQ ID NO: 812267 - DNA, 20 bp, mouse
ggagacggctcacataactc

SEQ ID NO: 812268 - DNA, 20 bp, mouse
ggacgctcacaggacagcga

SEQ ID NO: 812269 - DNA, 20 bp, mouse
gacgaaggatcactaagtat

SEQ ID NO: 812270 - DNA, 20 bp, mouse
gctcacaggacagcgaagga

SEQ ID NO: 812271 - DNA, 20 bp, mouse
gggaactggtcgtgtaagtt

SEQ ID NO: 812272 - DNA, 20 bp, mouse
ggcccgcccgcttacgtcat

SEQ ID NO: 812273 - DNA, 20 bp, mouse
ggaggcggcgacggctgcgt

SEQ ID NO: 812274 - DNA, 20 bp, mouse
gaaaccgacgcggatttaaa

SEQ ID NO: 812275 - DNA, 20 bp, mouse
gacccagcagtagaggtggg

SEQ ID NO: 812276 - DNA, 20 bp, mouse
gcacggggtcagttatgagt

SEQ ID NO: 812277 - DNA, 20 bp, mouse
gcaaaccctgcccctaagcc

SEQ ID NO: 812278 - DNA, 20 bp, mouse
gctagccctgcctgcggggc

SEQ ID NO: 812279 - DNA, 20 bp, mouse
gagtgtaggaagttccgtcc

SEQ ID NO: 812280 - DNA, 20 bp, mouse
gccgggatcttcaaacttcc

SEQ ID NO: 812281 - DNA, 20 bp, mouse
gggccctttgcgggttgcgc

SEQ ID NO: 812282 - DNA, 20 bp, mouse
gacttcccggcttaggggca

SEQ ID NO: 812283 - DNA, 20 bp, mouse
gcggggcaccttatggaaga

SEQ ID NO: 812284 - DNA, 20 bp, mouse
gttcaaacttcccggcttag

SEQ ID NO: 812285 - DNA, 20 bp, mouse
gtgcgctggttgggctcctt

SEQ ID NO: 812286 - DNA, 20 bp, mouse
gtcggactgagcacacgctg

SEQ ID NO: 812287 - DNA, 20 bp, mouse
gatgccctggagtaagtgac

SEQ ID NO: 812288 - DNA, 20 bp, mouse
gccagggagcagacaagatt

SEQ ID NO: 812289 - DNA, 20 bp, mouse
gtccttaaggggtggagcca

SEQ ID NO: 812290 - DNA, 20 bp, mouse
gtactcaaaccaacagaacc

SEQ ID NO: 812291 - DNA, 20 bp, mouse
gagaccctgtcacttactcc

SEQ ID NO: 812292 - DNA, 20 bp, mouse
gcacaaggactcagcccaga

SEQ ID NO: 812293 - DNA, 20 bp, mouse
gcaccgtaagcaccggaaat

SEQ ID NO: 812294 - DNA, 20 bp, mouse
gcaggaaggaacaccacagg

SEQ ID NO: 812295 - DNA, 20 bp, mouse
gctggggctctgcactgctg

SEQ ID NO: 812296 - DNA, 20 bp, mouse
gctctggggtgagtctccca

SEQ ID NO: 812297 - DNA, 20 bp, mouse
ggaagagtggtggagcagag

SEQ ID NO: 812298 - DNA, 20 bp, mouse
ggtctcccagggaagagtgg

SEQ ID NO: 812299 - DNA, 20 bp, mouse
gggaaatagaaagtggagtt

SEQ ID NO: 812300 - DNA, 20 bp, mouse
gcccgtgcgccttagtcatg

SEQ ID NO: 812301 - DNA, 20 bp, mouse
gagacaaacgggaagctctg

SEQ ID NO: 812302 - DNA, 20 bp, mouse
gctgctccaccactcttccc

SEQ ID NO: 812303 - DNA, 20 bp, mouse
gctagaattgctaaaaatgt

SEQ ID NO: 812304 - DNA, 20 bp, mouse
gtcctgccaactcacaccgc

SEQ ID NO: 812305 - DNA, 20 bp, mouse
gtagtcatgtgggagacaaa

SEQ ID NO: 812306 - DNA, 20 bp, mouse
gaaagaggttaatgcacaga

SEQ ID NO: 812307 - DNA, 20 bp, mouse
gatctgctacatatggggta

SEQ ID NO: 812308 - DNA, 20 bp, mouse
ggggagggttccagttgttg

SEQ ID NO: 812309 - DNA, 20 bp, mouse
gtggaagtgtttactttcca

SEQ ID NO: 812310 - DNA, 20 bp, mouse
gagtgctgataacctgtggg

SEQ ID NO: 812311 - DNA, 20 bp, mouse
gacagttcaggagtggaggg

SEQ ID NO: 812312 - DNA, 20 bp, mouse
ggatagtgctgataacctgt

SEQ ID NO: 812313 - DNA, 20 bp, mouse
ggcggaggatagtggtggta

SEQ ID NO: 812314 - DNA, 20 bp, mouse
gggaggcccagttatgaaaa

SEQ ID NO: 812315 - DNA, 20 bp, mouse
gtctgtgtgagtgggtacag

SEQ ID NO: 812316 - DNA, 20 bp, mouse
gaggtggtcaggccctgaac

SEQ ID NO: 812317 - DNA, 20 bp, mouse
ggtaagtagctgatactcaa

SEQ ID NO: 812318 - DNA, 20 bp, mouse
ggccctgaactggtgaatgt

SEQ ID NO: 812319 - DNA, 20 bp, mouse
gaaggggaactgggaggtac

SEQ ID NO: 812320 - DNA, 20 bp, mouse
gaggccaaggttagtagaga

SEQ ID NO: 812321 - DNA, 20 bp, mouse
gtggtctcaggagtaggtct

SEQ ID NO: 812322 - DNA, 20 bp, mouse
gcccctgaggctgatgatat

SEQ ID NO: 812323 - DNA, 20 bp, mouse
ggaggaagagcttcagaccc

SEQ ID NO: 812324 - DNA, 20 bp, mouse
gctactcctgagaccaaaga

SEQ ID NO: 812325 - DNA, 20 bp, mouse
gtggctgtgagatactcgag

SEQ ID NO: 812326 - DNA, 20 bp, mouse
gccctcccagccactagaga

SEQ ID NO: 812327 - DNA, 20 bp, mouse
ggcaggagagcgagacctcc

SEQ ID NO: 812328 - DNA, 20 bp, mouse
gaaacatggagtaggcaggt

SEQ ID NO: 812329 - DNA, 20 bp, mouse
gccagccactagagagggct

SEQ ID NO: 812330 - DNA, 20 bp, mouse
gggcctggggaccttgctgt

SEQ ID NO: 812331 - DNA, 20 bp, mouse
ggctccataaaacatggagt

SEQ ID NO: 812332 - DNA, 20 bp, mouse
gtgtgggtgaatataggttg

SEQ ID NO: 812333 - DNA, 20 bp, mouse
gcacccacagcaaggtcccc

SEQ ID NO: 812334 - DNA, 20 bp, mouse
ggctcacaagggaggatgaa

SEQ ID NO: 812335 - DNA, 20 bp, mouse
gctgcctactccatgtttta

SEQ ID NO: 812336 - DNA, 20 bp, mouse
gggtgtggttcagagaataa

SEQ ID NO: 812337 - DNA, 20 bp, mouse
gcagtcagacattaaagaga

SEQ ID NO: 812338 - DNA, 20 bp, mouse
gcattaaagagatggggcag

SEQ ID NO: 812339 - DNA, 20 bp, mouse
ggttcagagaataaaggctg

SEQ ID NO: 812340 - DNA, 20 bp, mouse
gacaaccaattcaggtagag

SEQ ID NO: 812341 - DNA, 20 bp, mouse
gaagaggaactagggacagc

SEQ ID NO: 812342 - DNA, 20 bp, mouse
gcaggaggatctctagagca

SEQ ID NO: 812343 - DNA, 20 bp, mouse
gtctttaatgtctgactgct

SEQ ID NO: 812344 - DNA, 20 bp, mouse
gagacttcagctcacagaag

SEQ ID NO: 812345 - DNA, 20 bp, mouse
gccagccactctacctgaat

SEQ ID NO: 812346 - DNA, 20 bp, mouse
gttctagaggggagagcgta

SEQ ID NO: 812347 - DNA, 20 bp, mouse
ggggagagcgtagggtttag

SEQ ID NO: 812348 - DNA, 20 bp, mouse
gtcctggctgccaccctgtt

SEQ ID NO: 812349 - DNA, 20 bp, mouse
gaccctgttgggttcaatct

SEQ ID NO: 812350 - DNA, 20 bp, mouse
gggggccaatcggaacgtcc

SEQ ID NO: 812351 - DNA, 20 bp, mouse
ggcgagccgtaccacggtgg

SEQ ID NO: 812352 - DNA, 20 bp, mouse
gcgcccccgccaccgtggta

SEQ ID NO: 812353 - DNA, 20 bp, mouse
gcaggtgggccaatccattc

SEQ ID NO: 812354 - DNA, 20 bp, mouse
ggtggcttggtctgcaagag

SEQ ID NO: 812355 - DNA, 20 bp, mouse
gggggagacccagaatggat

SEQ ID NO: 812356 - DNA, 20 bp, mouse
gcggcccggtgcctgccgag

SEQ ID NO: 812357 - DNA, 20 bp, mouse
gaccgcgggcggtgacgtca

SEQ ID NO: 812358 - DNA, 20 bp, mouse
ggcggcggggcgctgacatg

SEQ ID NO: 812359 - DNA, 20 bp, mouse
gagggggagcggagatcggg

SEQ ID NO: 812360 - DNA, 20 bp, mouse
gaccgggccgcgcgtcgctc

SEQ ID NO: 812361 - DNA, 20 bp, mouse
ggggcgccagcagtctcggg

SEQ ID NO: 812362 - DNA, 20 bp, mouse
ggcgaggcggggcttgtgcg

SEQ ID NO: 812363 - DNA, 20 bp, mouse
gccgagggggagcggagatc

SEQ ID NO: 812364 - DNA, 20 bp, mouse
gggcgccccctgccgggcat

SEQ ID NO: 812365 - DNA, 20 bp, mouse
gttgacgccagagcgacgcg

SEQ ID NO: 812366 - DNA, 20 bp, mouse
ggcagccgcgccgacgtcgg

SEQ ID NO: 812367 - DNA, 20 bp, mouse
gcgcaagagcgagccctggt

SEQ ID NO: 812368 - DNA, 20 bp, mouse
ggccgcgccgacgtcggggg

SEQ ID NO: 812369 - DNA, 20 bp, mouse
ggggcctccaccggtcacca

SEQ ID NO: 812370 - DNA, 20 bp, mouse
ggaggggcggtgcgcgggtc

SEQ ID NO: 812371 - DNA, 20 bp, mouse
gaggcgaccctccaggagac

SEQ ID NO: 812372 - DNA, 20 bp, mouse
gtgccccggccccctgacgt

SEQ ID NO: 812373 - DNA, 20 bp, mouse
gaaggctgaggagggcgtcg

SEQ ID NO: 812374 - DNA, 20 bp, mouse
gcggacggcgaccccgcccc

SEQ ID NO: 812375 - DNA, 20 bp, mouse
gaccgcagccgcgccgacgt

SEQ ID NO: 812376 - DNA, 20 bp, mouse
gagctcgcccggtgaggtca

SEQ ID NO: 812377 - DNA, 20 bp, mouse
ggagccggcgcctcaggaac

SEQ ID NO: 812378 - DNA, 20 bp, mouse
gcgggaaggtcgagctcgcc

SEQ ID NO: 812379 - DNA, 20 bp, mouse
gcgggggggccgaaagaggg

SEQ ID NO: 812380 - DNA, 20 bp, mouse
gatggcaaccgtgacctcac

SEQ ID NO: 812381 - DNA, 20 bp, mouse
gaggtcgagctcgcccggtg

SEQ ID NO: 812382 - DNA, 20 bp, mouse
gcgagctcgaccttcccgcg

SEQ ID NO: 812383 - DNA, 20 bp, mouse
gggcaaccgcgcgtcacgtg

SEQ ID NO: 812384 - DNA, 20 bp, mouse
ggctccctagtgcccccctc

SEQ ID NO: 812385 - DNA, 20 bp, mouse
ggaggtagggatatgagatg

SEQ ID NO: 812386 - DNA, 20 bp, mouse
gagggtggagcagcagaggt

SEQ ID NO: 812387 - DNA, 20 bp, mouse
gctgctgctccaccctagaa

SEQ ID NO: 812388 - DNA, 20 bp, mouse
gcggctgcgcgagcacgatg

SEQ ID NO: 812389 - DNA, 20 bp, mouse
gcgggcccggcgcgcctcct

SEQ ID NO: 812390 - DNA, 20 bp, mouse
gcaagagtccacctctgcgc

SEQ ID NO: 812391 - DNA, 20 bp, mouse
gcacagccttagcctttcta

SEQ ID NO: 812392 - DNA, 20 bp, mouse
gtaaacatgggcaggtgctg

SEQ ID NO: 812393 - DNA, 20 bp, mouse
gctgcgcgagcacgatgcgg

SEQ ID NO: 812394 - DNA, 20 bp, mouse
gcgccaagacgctgctggag

SEQ ID NO: 812395 - DNA, 20 bp, mouse
gcagctcatagtggccgagg

SEQ ID NO: 812396 - DNA, 20 bp, mouse
gggggctaacaatgccgcgt

SEQ ID NO: 812397 - DNA, 20 bp, mouse
gttagcagctgaggaaggcg

SEQ ID NO: 812398 - DNA, 20 bp, mouse
gttgcggaggaagacgctag

SEQ ID NO: 812399 - DNA, 20 bp, mouse
ggaggaagacgctaggggcg

SEQ ID NO: 812400 - DNA, 20 bp, mouse
ggttctggcaagttatcatt

SEQ ID NO: 812401 - DNA, 20 bp, mouse
gcgcgtggggtgagagttgc

SEQ ID NO: 812402 - DNA, 20 bp, mouse
gagaaactgaagttctaggt

SEQ ID NO: 812403 - DNA, 20 bp, mouse
gtctaaaaatagctacccgt

SEQ ID NO: 812404 - DNA, 20 bp, mouse
ggccacgcgccttcagcctt

SEQ ID NO: 812405 - DNA, 20 bp, mouse
ggtggggtgagagttgctgg

SEQ ID NO: 812406 - DNA, 20 bp, mouse
gccaaggaataagacatctg

SEQ ID NO: 812407 - DNA, 20 bp, mouse
gaactcctctggttctgagc

SEQ ID NO: 812408 - DNA, 20 bp, mouse
ggcagtggaggaattctgca

SEQ ID NO: 812409 - DNA, 20 bp, mouse
gcagccaaccgggccccaaa

SEQ ID NO: 812410 - DNA, 20 bp, mouse
gtgtaggaaacaggaatcgc

SEQ ID NO: 812411 - DNA, 20 bp, mouse
gaggccctttggggcccggt

SEQ ID NO: 812412 - DNA, 20 bp, mouse
gggccgggatgtagcaccga

SEQ ID NO: 812413 - DNA, 20 bp, mouse
ggagctggtttgtaggaaac

SEQ ID NO: 812414 - DNA, 20 bp, mouse
ggggagaggcagccggagtc

SEQ ID NO: 812415 - DNA, 20 bp, mouse
gggcaggtcggtcccgggac

SEQ ID NO: 812416 - DNA, 20 bp, mouse
gagcgcgccggtctctcgtg

SEQ ID NO: 812417 - DNA, 20 bp, mouse
gtcgtggggacagtccctgg

SEQ ID NO: 812418 - DNA, 20 bp, mouse
gcctccgcgtcgccacctcc

SEQ ID NO: 812419 - DNA, 20 bp, mouse
ggccgcggcccgtgagtcgc

SEQ ID NO: 812420 - DNA, 20 bp, mouse
ggtcgcgcctacccgctccg

SEQ ID NO: 812421 - DNA, 20 bp, mouse
ggaggcgcgccggcgactca

SEQ ID NO: 812422 - DNA, 20 bp, mouse
gccggcgcgctcccggggta

SEQ ID NO: 812423 - DNA, 20 bp, mouse
gcccggggtaaggtaagccg

SEQ ID NO: 812424 - DNA, 20 bp, mouse
gtcgcctccgacccccgccg

SEQ ID NO: 812425 - DNA, 20 bp, mouse
ggactgtccccacgagagac

SEQ ID NO: 812426 - DNA, 20 bp, mouse
gtcggagccccgcctatctc

SEQ ID NO: 812427 - DNA, 20 bp, mouse
ggcagccgcgcgcccgggtc

SEQ ID NO: 812428 - DNA, 20 bp, mouse
gcggctgcccccgagatagg

SEQ ID NO: 812429 - DNA, 20 bp, mouse
gggctgggccgcatggtcgg

SEQ ID NO: 812430 - DNA, 20 bp, mouse
gaaagggagggatagaaccg

SEQ ID NO: 812431 - DNA, 20 bp, mouse
gaggggctgggccgcatggt

SEQ ID NO: 812432 - DNA, 20 bp, mouse
gcactgtgatcggttgagag

SEQ ID NO: 812433 - DNA, 20 bp, mouse
ggcggggctccgagcgggac

SEQ ID NO: 812434 - DNA, 20 bp, mouse
gcgccccgcctccagaggac

SEQ ID NO: 812435 - DNA, 20 bp, mouse
ggcccctggctgcaggtgtg

SEQ ID NO: 812436 - DNA, 20 bp, mouse
gaataggcggggttgagtta

SEQ ID NO: 812437 - DNA, 20 bp, mouse
gggactctccccgccaatag

SEQ ID NO: 812438 - DNA, 20 bp, mouse
gccctcttccctcgctggga

SEQ ID NO: 812439 - DNA, 20 bp, mouse
gggctggggcggtatgggga

SEQ ID NO: 812440 - DNA, 20 bp, mouse
gtctccacgcccctattggc

SEQ ID NO: 812441 - DNA, 20 bp, mouse
gtcggcaatcagtctccaat

SEQ ID NO: 812442 - DNA, 20 bp, mouse
gagagcccggaggagggatt

SEQ ID NO: 812443 - DNA, 20 bp, mouse
gcctccgccggtccctgcat

SEQ ID NO: 812444 - DNA, 20 bp, mouse
gtctccaatgagatgtgaag

SEQ ID NO: 812445 - DNA, 20 bp, mouse
gaggcgggagccgatttgtt

SEQ ID NO: 812446 - DNA, 20 bp, mouse
ggcaaggggcgatcaatgaa

SEQ ID NO: 812447 - DNA, 20 bp, mouse
gtggaggcgactcttactcg

SEQ ID NO: 812448 - DNA, 20 bp, mouse
ggcgatcaatgaaggggaag

SEQ ID NO: 812449 - DNA, 20 bp, mouse
ggatgtaagagcctctgctt

SEQ ID NO: 812450 - DNA, 20 bp, mouse
gagagaggaggcggacccat

SEQ ID NO: 812451 - DNA, 20 bp, mouse
gtccagacccagctccaaat

SEQ ID NO: 812452 - DNA, 20 bp, mouse
gaaagccaatagatactggg

SEQ ID NO: 812453 - DNA, 20 bp, mouse
ggtaagagcctctgctttgg

SEQ ID NO: 812454 - DNA, 20 bp, mouse
gcggaactccaaatcccaaa

SEQ ID NO: 812455 - DNA, 20 bp, mouse
gctcgaaaaactccaagtgg

SEQ ID NO: 812456 - DNA, 20 bp, mouse
ggactcgtggcgtcaaatag

SEQ ID NO: 812457 - DNA, 20 bp, mouse
gagggccttgctggacgggg

SEQ ID NO: 812458 - DNA, 20 bp, mouse
gcagtaccggggagtctgag

SEQ ID NO: 812459 - DNA, 20 bp, mouse
ggcgggccccgcctcctagg

SEQ ID NO: 812460 - DNA, 20 bp, mouse
ggcccgcgcaagcgcgacca

SEQ ID NO: 812461 - DNA, 20 bp, mouse
gggtctcctctcagactccc

SEQ ID NO: 812462 - DNA, 20 bp, mouse
gctcaacttatgtgccctgg

SEQ ID NO: 812463 - DNA, 20 bp, mouse
gggccccgcctcctaggggg

SEQ ID NO: 812464 - DNA, 20 bp, mouse
gcataagggccttgctggac

SEQ ID NO: 812465 - DNA, 20 bp, mouse
gagaggtctaacctaaactg

SEQ ID NO: 812466 - DNA, 20 bp, mouse
ggggctgcctaggttcctgt

SEQ ID NO: 812467 - DNA, 20 bp, mouse
gactacccgggagctgtcta

SEQ ID NO: 812468 - DNA, 20 bp, mouse
gctaaggcgggaagcacagt

SEQ ID NO: 812469 - DNA, 20 bp, mouse
gacccgggagctgtctaagg

SEQ ID NO: 812470 - DNA, 20 bp, mouse
gggctgggacagagaacttc

SEQ ID NO: 812471 - DNA, 20 bp, mouse
gctcggtgaagtcactgact

SEQ ID NO: 812472 - DNA, 20 bp, mouse
ggagaacttcaggctgtccg

SEQ ID NO: 812473 - DNA, 20 bp, mouse
gtggcctctagcgctccaat

SEQ ID NO: 812474 - DNA, 20 bp, mouse
ggaggcggtacgtagtggag

SEQ ID NO: 812475 - DNA, 20 bp, mouse
gaggctgtccggggctgcct

SEQ ID NO: 812476 - DNA, 20 bp, mouse
ggaagcaagcagcattaatt

SEQ ID NO: 812477 - DNA, 20 bp, mouse
gatcatctgtgtcaactgta

SEQ ID NO: 812478 - DNA, 20 bp, mouse
gcacgcgcgcacgtgtgggg

SEQ ID NO: 812479 - DNA, 20 bp, mouse
ggcattaattgggttagaag

SEQ ID NO: 812480 - DNA, 20 bp, mouse
gaccaagtcccaggataggc

SEQ ID NO: 812481 - DNA, 20 bp, mouse
ggacaagggacttatctttg

SEQ ID NO: 812482 - DNA, 20 bp, mouse
gttaattgggttagaagtgg

SEQ ID NO: 812483 - DNA, 20 bp, mouse
gggaagctggagtccctgct

SEQ ID NO: 812484 - DNA, 20 bp, mouse
gggaacagactgagtctccg

SEQ ID NO: 812485 - DNA, 20 bp, mouse
gagacattctcctctgactc

SEQ ID NO: 812486 - DNA, 20 bp, mouse
ggctctgtgacagtgtaaag

SEQ ID NO: 812487 - DNA, 20 bp, mouse
gttggtatcagcagaggcaa

SEQ ID NO: 812488 - DNA, 20 bp, mouse
gacatgattcaggtcagtac

SEQ ID NO: 812489 - DNA, 20 bp, mouse
gcacgacgagtgtgctccag

SEQ ID NO: 812490 - DNA, 20 bp, mouse
gtaggtggatacttatggga

SEQ ID NO: 812491 - DNA, 20 bp, mouse
gtgagaaatcgcctgtagac

SEQ ID NO: 812492 - DNA, 20 bp, mouse
gagaggcttggtatcagcag

SEQ ID NO: 812493 - DNA, 20 bp, mouse
gagaaacgttagcaggatgc

SEQ ID NO: 812494 - DNA, 20 bp, mouse
gcaggtcagtaccggtctac

SEQ ID NO: 812495 - DNA, 20 bp, mouse
gaaagagtgctgccgaagcc

SEQ ID NO: 812496 - DNA, 20 bp, mouse
gccccgaggggtgtgaggca

SEQ ID NO: 812497 - DNA, 20 bp, mouse
gcggggctgcggaagtcctc

SEQ ID NO: 812498 - DNA, 20 bp, mouse
gcgcccctccccaggctcgc

SEQ ID NO: 812499 - DNA, 20 bp, mouse
gagggaggcgtgtcttgtgt

SEQ ID NO: 812500 - DNA, 20 bp, mouse
gggggtctgccgggagtcgt

SEQ ID NO: 812501 - DNA, 20 bp, mouse
gcgcgaagcggcttggaagt

SEQ ID NO: 812502 - DNA, 20 bp, mouse
gttcccagaaggcggtgcgg

SEQ ID NO: 812503 - DNA, 20 bp, mouse
ggtggcgtgcctacgactcc

SEQ ID NO: 812504 - DNA, 20 bp, mouse
gggaatcgtagtctactggt

SEQ ID NO: 812505 - DNA, 20 bp, mouse
ggggtgaggagctcccgggc

SEQ ID NO: 812506 - DNA, 20 bp, mouse
gccacccggaggccgacctt

SEQ ID NO: 812507 - DNA, 20 bp, mouse
gaggagcagcaaaaatgctg

SEQ ID NO: 812508 - DNA, 20 bp, mouse
gccgccgagcggggagactc

SEQ ID NO: 812509 - DNA, 20 bp, mouse
gcgggtgggcgtgagtccta

SEQ ID NO: 812510 - DNA, 20 bp, mouse
gggccagctaggaaagattt

SEQ ID NO: 812511 - DNA, 20 bp, mouse
gaagcagggcctctcgggga

SEQ ID NO: 812512 - DNA, 20 bp, mouse
gcggcgcgggcgaacgacta

SEQ ID NO: 812513 - DNA, 20 bp, mouse
gggaaaggggagcggacccg

SEQ ID NO: 812514 - DNA, 20 bp, mouse
gtggcccggcgtcacgctcc

SEQ ID NO: 812515 - DNA, 20 bp, mouse
gcacacaagcagggcctctc

SEQ ID NO: 812516 - DNA, 20 bp, mouse
gactgctttattccagcttt

SEQ ID NO: 812517 - DNA, 20 bp, mouse
gatcagtaaaagatatacaa

SEQ ID NO: 812518 - DNA, 20 bp, mouse
ggccaacttctcacaaaaga

SEQ ID NO: 812519 - DNA, 20 bp, mouse
gtgtaagatcagcccaaagc

SEQ ID NO: 812520 - DNA, 20 bp, mouse
gttcaatgttatgtgaaaaa

SEQ ID NO: 812521 - DNA, 20 bp, mouse
gtttacaatttgtttttaga

SEQ ID NO: 812522 - DNA, 20 bp, mouse
gtccttcttttgtgagaagt

SEQ ID NO: 812523 - DNA, 20 bp, mouse
gttgcattcagcttcaggga

SEQ ID NO: 812524 - DNA, 20 bp, mouse
ggggaaacattcttttgtac

SEQ ID NO: 812525 - DNA, 20 bp, mouse
gtgtctcaagtgtcttgtct

SEQ ID NO: 812526 - DNA, 20 bp, mouse
gacacataaagttctaagtt

SEQ ID NO: 812527 - DNA, 20 bp, mouse
gtatcttagcccatctgtaa

SEQ ID NO: 812528 - DNA, 20 bp, mouse
gttctcactgatgtctcttg

SEQ ID NO: 812529 - DNA, 20 bp, mouse
gatctaggatcttacgtgtt

SEQ ID NO: 812530 - DNA, 20 bp, mouse
gatttaccatttgttttcag

SEQ ID NO: 812531 - DNA, 20 bp, mouse
gtaatttactgtgcttgtgt

SEQ ID NO: 812532 - DNA, 20 bp, mouse
ggccaacttctcacagaaga

SEQ ID NO: 812533 - DNA, 20 bp, mouse
gcaatgctggaataaaccag

SEQ ID NO: 812534 - DNA, 20 bp, mouse
ggagtccctctgaaaacaaa

SEQ ID NO: 812535 - DNA, 20 bp, mouse
gatcattcccagagaaccac

SEQ ID NO: 812536 - DNA, 20 bp, mouse
gcaacaacatctagtatctt

SEQ ID NO: 812537 - DNA, 20 bp, mouse
ggccaacttctcacagaaga

SEQ ID NO: 812538 - DNA, 20 bp, mouse
gatcagtaaaggacatccaa

SEQ ID NO: 812539 - DNA, 20 bp, mouse
gcaatgctggaataaaccag

SEQ ID NO: 812540 - DNA, 20 bp, mouse
gttctctgggaatgatccct

SEQ ID NO: 812541 - DNA, 20 bp, mouse
gatcattcccagagaaccac

SEQ ID NO: 812542 - DNA, 20 bp, mouse
gtccttcttctgtgagaagt

SEQ ID NO: 812543 - DNA, 20 bp, mouse
gttgcatacagcttcaggga

SEQ ID NO: 812544 - DNA, 20 bp, mouse
ggagtccctctaaaaacaaa

SEQ ID NO: 812545 - DNA, 20 bp, mouse
gcagtgttgcatacagcttc

SEQ ID NO: 812546 - DNA, 20 bp, mouse
gagcgagcgagcgaacgggt

SEQ ID NO: 812547 - DNA, 20 bp, mouse
ggcggctcggctcccctcag

SEQ ID NO: 812548 - DNA, 20 bp, mouse
gagcgagcgaacgggtcggg

SEQ ID NO: 812549 - DNA, 20 bp, mouse
ggggccggaccacaacacgc

SEQ ID NO: 812550 - DNA, 20 bp, mouse
ggagccgagccgccctgggt

SEQ ID NO: 812551 - DNA, 20 bp, mouse
ggaggcgccagaggccgctg

SEQ ID NO: 812552 - DNA, 20 bp, mouse
gaggcccaggtgggaagtgg

SEQ ID NO: 812553 - DNA, 20 bp, mouse
gcgcccccgcggctcggctg

SEQ ID NO: 812554 - DNA, 20 bp, mouse
gaggggagccgagccgccct

SEQ ID NO: 812555 - DNA, 20 bp, mouse
gtgcacgcgtgaggcccagg

SEQ ID NO: 812556 - DNA, 20 bp, mouse
gtggctgtggtgcagtacag

SEQ ID NO: 812557 - DNA, 20 bp, mouse
gcggcggccatattgataaa

SEQ ID NO: 812558 - DNA, 20 bp, mouse
gacagccaatcagaaaaatg

SEQ ID NO: 812559 - DNA, 20 bp, mouse
gctgtggtgcagtacagggg

SEQ ID NO: 812560 - DNA, 20 bp, mouse
gaatggtgcgacagcggcct

SEQ ID NO: 812561 - DNA, 20 bp, mouse
gtgttggggaattcccgata

SEQ ID NO: 812562 - DNA, 20 bp, mouse
gtggtcgcctgcctgtcgct

SEQ ID NO: 812563 - DNA, 20 bp, mouse
gcacagggggccacccgagg

SEQ ID NO: 812564 - DNA, 20 bp, mouse
ggacaggcaggcgaccacag

SEQ ID NO: 812565 - DNA, 20 bp, mouse
gccaaaaagcctggcgccgg

SEQ ID NO: 812566 - DNA, 20 bp, mouse
gtactcaaggaggtcgagag

SEQ ID NO: 812567 - DNA, 20 bp, mouse
gcgataacccgaagtgtgga

SEQ ID NO: 812568 - DNA, 20 bp, mouse
gtaagagtgccgagagggcg

SEQ ID NO: 812569 - DNA, 20 bp, mouse
ggggagtaagagtgccgaga

SEQ ID NO: 812570 - DNA, 20 bp, mouse
gaggctacgtgaccagtcag

SEQ ID NO: 812571 - DNA, 20 bp, mouse
gggactctgacttattggtt

SEQ ID NO: 812572 - DNA, 20 bp, mouse
ggggacagctagccactgac

SEQ ID NO: 812573 - DNA, 20 bp, mouse
ggggctctgatcagtccgga

SEQ ID NO: 812574 - DNA, 20 bp, mouse
gaaacccgggagaagtttag

SEQ ID NO: 812575 - DNA, 20 bp, mouse
gagggcggggcttggctcac

SEQ ID NO: 812576 - DNA, 20 bp, mouse
ggaggagcgcccaagaatct

SEQ ID NO: 812577 - DNA, 20 bp, mouse
gctcccacgccaagattctt

SEQ ID NO: 812578 - DNA, 20 bp, mouse
gcgcccaagaatcttggcgt

SEQ ID NO: 812579 - DNA, 20 bp, mouse
ggacagcgggcaatccgtag

SEQ ID NO: 812580 - DNA, 20 bp, mouse
gattcttgggcgctcctcta

SEQ ID NO: 812581 - DNA, 20 bp, mouse
gcaggcgtcagcagcatatc

SEQ ID NO: 812582 - DNA, 20 bp, mouse
gtccgcgaagccgatctagt

SEQ ID NO: 812583 - DNA, 20 bp, mouse
gaaaaggcaatcattgcccc

SEQ ID NO: 812584 - DNA, 20 bp, mouse
gtccaaatccgtgatcctcc

SEQ ID NO: 812585 - DNA, 20 bp, mouse
gtccgcctaagcctattgag

SEQ ID NO: 812586 - DNA, 20 bp, mouse
ggggaccacgagtcagtgga

SEQ ID NO: 812587 - DNA, 20 bp, mouse
gaggccacagagcaggcggt

SEQ ID NO: 812588 - DNA, 20 bp, mouse
gcccctgaaaatctgtggcc

SEQ ID NO: 812589 - DNA, 20 bp, mouse
gtggcctggcgagtcggttc

SEQ ID NO: 812590 - DNA, 20 bp, mouse
ggcaggggccgctgcagcca

SEQ ID NO: 812591 - DNA, 20 bp, mouse
ggcctccttgagcacactgg

SEQ ID NO: 812592 - DNA, 20 bp, mouse
gtgggcagtggaatgagcct

SEQ ID NO: 812593 - DNA, 20 bp, mouse
gtggtgggaccacgagtcag

SEQ ID NO: 812594 - DNA, 20 bp, mouse
gcgccaggccacagattttc

SEQ ID NO: 812595 - DNA, 20 bp, mouse
ggcgctccgggtctccggca

SEQ ID NO: 812596 - DNA, 20 bp, mouse
gtccctagatacgtgcctga

SEQ ID NO: 812597 - DNA, 20 bp, mouse
gtggtcgcggatcccaggac

SEQ ID NO: 812598 - DNA, 20 bp, mouse
gaggccactcacaggagtcg

SEQ ID NO: 812599 - DNA, 20 bp, mouse
gaagtgatgaggccactcac

SEQ ID NO: 812600 - DNA, 20 bp, mouse
ggccggaagtggtgaaggga

SEQ ID NO: 812601 - DNA, 20 bp, mouse
gcaagcttagtcttcagtgc

SEQ ID NO: 812602 - DNA, 20 bp, mouse
gtagatacgtgcctgagggt

SEQ ID NO: 812603 - DNA, 20 bp, mouse
gtaagtcagagaggtagtct

SEQ ID NO: 812604 - DNA, 20 bp, mouse
gggctctggtcgcggatccc

SEQ ID NO: 812605 - DNA, 20 bp, mouse
gaagtggtgaagggacggtc

SEQ ID NO: 812606 - DNA, 20 bp, mouse
gggagcgcaaagctgctgag

SEQ ID NO: 812607 - DNA, 20 bp, mouse
gaagccggaagcgcagtcaa

SEQ ID NO: 812608 - DNA, 20 bp, mouse
gcatgcgtctctgtagctgc

SEQ ID NO: 812609 - DNA, 20 bp, mouse
ggcgagcgcgggcacggcag

SEQ ID NO: 812610 - DNA, 20 bp, mouse
ggagcgatggcagccggtgg

SEQ ID NO: 812611 - DNA, 20 bp, mouse
ggggatctggctgcaaggtg

SEQ ID NO: 812612 - DNA, 20 bp, mouse
gcggccctttccacctcttc

SEQ ID NO: 812613 - DNA, 20 bp, mouse
ggagcggctcagaccgccac

SEQ ID NO: 812614 - DNA, 20 bp, mouse
gcgagccggaagaggtggaa

SEQ ID NO: 812615 - DNA, 20 bp, mouse
gagcgcagtcaaaggagcga

SEQ ID NO: 812616 - DNA, 20 bp, mouse
gtctgccatctagaagtgaa

SEQ ID NO: 812617 - DNA, 20 bp, mouse
gaagaatattaaacattgat

SEQ ID NO: 812618 - DNA, 20 bp, mouse
gatagcctttcacttctaga

SEQ ID NO: 812619 - DNA, 20 bp, mouse
ggactctcaggttacttcta

SEQ ID NO: 812620 - DNA, 20 bp, mouse
gacacagttattaattaact

SEQ ID NO: 812621 - DNA, 20 bp, mouse
gcataatccacgttgaaaat

SEQ ID NO: 812622 - DNA, 20 bp, mouse
gtaaactattttcagggcaa

SEQ ID NO: 812623 - DNA, 20 bp, mouse
gtgagtttatttgagaaagt

SEQ ID NO: 812624 - DNA, 20 bp, mouse
gagagaatgcaaagaatcac

SEQ ID NO: 812625 - DNA, 20 bp, mouse
ggaaagaataaacacttaac

SEQ ID NO: 812626 - DNA, 20 bp, mouse
gtctctgagtccccttgagc

SEQ ID NO: 812627 - DNA, 20 bp, mouse
gaaggggactcagagacacg

SEQ ID NO: 812628 - DNA, 20 bp, mouse
gggtctactccctgctcaag

SEQ ID NO: 812629 - DNA, 20 bp, mouse
ggtgctcttcagagtctccg

SEQ ID NO: 812630 - DNA, 20 bp, mouse
ggctcacattgccatgaagg

SEQ ID NO: 812631 - DNA, 20 bp, mouse
gcaactatttccaccggtag

SEQ ID NO: 812632 - DNA, 20 bp, mouse
gggtgaaattccgtggctaa

SEQ ID NO: 812633 - DNA, 20 bp, mouse
gcaggtgcaggcacagggcg

SEQ ID NO: 812634 - DNA, 20 bp, mouse
ggagaaaaggtgaaattccg

SEQ ID NO: 812635 - DNA, 20 bp, mouse
gtgagcataaacctccttca

SEQ ID NO: 812636 - DNA, 20 bp, mouse
ggcaaggcgtggcacgggat

SEQ ID NO: 812637 - DNA, 20 bp, mouse
gataggccggagtgacgtcg

SEQ ID NO: 812638 - DNA, 20 bp, mouse
ggggccccgctgcgcgggat

SEQ ID NO: 812639 - DNA, 20 bp, mouse
gcgcccaataggccggagaa

SEQ ID NO: 812640 - DNA, 20 bp, mouse
ggcagttaacggcgagggat

SEQ ID NO: 812641 - DNA, 20 bp, mouse
ggcgctggcgcggcgaggtg

SEQ ID NO: 812642 - DNA, 20 bp, mouse
gcttacgcagttaacggcga

SEQ ID NO: 812643 - DNA, 20 bp, mouse
gtctgcgcaaggcgtggcac

SEQ ID NO: 812644 - DNA, 20 bp, mouse
ggcgggacttacgcagttaa

SEQ ID NO: 812645 - DNA, 20 bp, mouse
gcggaggcccgagccgacga

SEQ ID NO: 812646 - DNA, 20 bp, mouse
gccaccctgccgccccgcgt

SEQ ID NO: 812647 - DNA, 20 bp, mouse
gctgccgccccgcgtgggga

SEQ ID NO: 812648 - DNA, 20 bp, mouse
ggcctaggataagaagtggt

SEQ ID NO: 812649 - DNA, 20 bp, mouse
ggagaaggacccggagaggt

SEQ ID NO: 812650 - DNA, 20 bp, mouse
gtgggaagtgaggtggggtc

SEQ ID NO: 812651 - DNA, 20 bp, mouse
ggggaactggggtgctgaaa

SEQ ID NO: 812652 - DNA, 20 bp, mouse
gaagctaccgagtgctgcct

SEQ ID NO: 812653 - DNA, 20 bp, mouse
gcccggagaggtgggaagtg

SEQ ID NO: 812654 - DNA, 20 bp, mouse
ggcgtccccgacacgctgat

SEQ ID NO: 812655 - DNA, 20 bp, mouse
ggcttcgcaaggtcctgact

SEQ ID NO: 812656 - DNA, 20 bp, mouse
gagccggggcgatctgtcag

SEQ ID NO: 812657 - DNA, 20 bp, mouse
gggcccgcgccctgattggt

SEQ ID NO: 812658 - DNA, 20 bp, mouse
ggtgactgacagcgtctcca

SEQ ID NO: 812659 - DNA, 20 bp, mouse
ggacgcccaaagagcagagg

SEQ ID NO: 812660 - DNA, 20 bp, mouse
gaaaagaggaggaccgaagt

SEQ ID NO: 812661 - DNA, 20 bp, mouse
gccgagacggcggtgattga

SEQ ID NO: 812662 - DNA, 20 bp, mouse
gtcagcggagctggccgagg

SEQ ID NO: 812663 - DNA, 20 bp, mouse
gaggaggaccgaagtgggga

SEQ ID NO: 812664 - DNA, 20 bp, mouse
ggtctggcgcgggcaggccc

SEQ ID NO: 812665 - DNA, 20 bp, mouse
gggtcgggttatctgacccg

SEQ ID NO: 812666 - DNA, 20 bp, mouse
gggtctgtggcgtgtcgttg

SEQ ID NO: 812667 - DNA, 20 bp, mouse
gaatactgagaacgtaagga

SEQ ID NO: 812668 - DNA, 20 bp, mouse
gttaccacttagccggaggg

SEQ ID NO: 812669 - DNA, 20 bp, mouse
gttctcagtattgattggca

SEQ ID NO: 812670 - DNA, 20 bp, mouse
gagaaagaggagagatgacg

SEQ ID NO: 812671 - DNA, 20 bp, mouse
gggctgacagtgattggcag

SEQ ID NO: 812672 - DNA, 20 bp, mouse
ggacggttttaccacttagc

SEQ ID NO: 812673 - DNA, 20 bp, mouse
gtgtcgttgtggcgttgcca

SEQ ID NO: 812674 - DNA, 20 bp, mouse
gccccccccctccggctaag

SEQ ID NO: 812675 - DNA, 20 bp, mouse
gaatcaatactgagaacgta

SEQ ID NO: 812676 - DNA, 20 bp, mouse
ggggaggcgggtgatcgaca

SEQ ID NO: 812677 - DNA, 20 bp, mouse
ggtaaaggtgcctgggggtc

SEQ ID NO: 812678 - DNA, 20 bp, mouse
gccggcaggtaaaggtgcct

SEQ ID NO: 812679 - DNA, 20 bp, mouse
gaaggggtggagtgggaggc

SEQ ID NO: 812680 - DNA, 20 bp, mouse
gtgatcgacagggatagaaa

SEQ ID NO: 812681 - DNA, 20 bp, mouse
gtggctatttcgcattcagt

SEQ ID NO: 812682 - DNA, 20 bp, mouse
gaatgggcagttatttagtg

SEQ ID NO: 812683 - DNA, 20 bp, mouse
gaaagaatgtcggtgttttc

SEQ ID NO: 812684 - DNA, 20 bp, mouse
gtgaatgcgaaatagccaat

SEQ ID NO: 812685 - DNA, 20 bp, mouse
gtgcgaaatagccaatgggg

SEQ ID NO: 812686 - DNA, 20 bp, mouse
gtagacccagctctgcactc

SEQ ID NO: 812687 - DNA, 20 bp, mouse
gaagcgcggccagagacgga

SEQ ID NO: 812688 - DNA, 20 bp, mouse
gaagactgcaaggggaccgg

SEQ ID NO: 812689 - DNA, 20 bp, mouse
ggggccgtccggagggttaa

SEQ ID NO: 812690 - DNA, 20 bp, mouse
gcacggcgcggagatgggaa

SEQ ID NO: 812691 - DNA, 20 bp, mouse
gcagagctgggtctagtctt

SEQ ID NO: 812692 - DNA, 20 bp, mouse
ggaatcctgacagcccggga

SEQ ID NO: 812693 - DNA, 20 bp, mouse
ggctgggtctagtctttggg

SEQ ID NO: 812694 - DNA, 20 bp, mouse
gccaaaagcgcggccagaga

SEQ ID NO: 812695 - DNA, 20 bp, mouse
gaactgaggccctgagtcag

SEQ ID NO: 812696 - DNA, 20 bp, mouse
gggcgctgtcgattctgggg

SEQ ID NO: 812697 - DNA, 20 bp, mouse
gagtctccccggcaaaccgt

SEQ ID NO: 812698 - DNA, 20 bp, mouse
gaccgtgccgctactggggt

SEQ ID NO: 812699 - DNA, 20 bp, mouse
gctggacagggggagcccgg

SEQ ID NO: 812700 - DNA, 20 bp, mouse
gcgtgggcgctgtcgattct

SEQ ID NO: 812701 - DNA, 20 bp, mouse
gggtgggaaaacaagaggga

SEQ ID NO: 812702 - DNA, 20 bp, mouse
gcagcctagtgactgacagg

SEQ ID NO: 812703 - DNA, 20 bp, mouse
gccgcagcgtctcaccctcc

SEQ ID NO: 812704 - DNA, 20 bp, mouse
gacagcgcccacggtttgcc

SEQ ID NO: 812705 - DNA, 20 bp, mouse
gcaagagggaggggctggac

SEQ ID NO: 812706 - DNA, 20 bp, mouse
ggggtcgtgggcggggtcgt

SEQ ID NO: 812707 - DNA, 20 bp, mouse
gggctcgcttctaacataga

SEQ ID NO: 812708 - DNA, 20 bp, mouse
gtgaactctggcctctagct

SEQ ID NO: 812709 - DNA, 20 bp, mouse
gggagccctggcgctttcag

SEQ ID NO: 812710 - DNA, 20 bp, mouse
gtcacccactgaaagcgcca

SEQ ID NO: 812711 - DNA, 20 bp, mouse
gaacatagaaggctaattat

SEQ ID NO: 812712 - DNA, 20 bp, mouse
gcaacagcgcagactccgct

SEQ ID NO: 812713 - DNA, 20 bp, mouse
ggctagggaaagaatttccg

SEQ ID NO: 812714 - DNA, 20 bp, mouse
gaggctaattattggagccc

SEQ ID NO: 812715 - DNA, 20 bp, mouse
gttcagtgggtgaatttagt

SEQ ID NO: 812716 - DNA, 20 bp, mouse
gcggggaagccggagagaaa

SEQ ID NO: 812717 - DNA, 20 bp, mouse
gataacgaggggcgttaccc

SEQ ID NO: 812718 - DNA, 20 bp, mouse
gttacccaggcgccaatggg

SEQ ID NO: 812719 - DNA, 20 bp, mouse
gacgtcgcctaggcccgcag

SEQ ID NO: 812720 - DNA, 20 bp, mouse
gcaaaacgccgcagggggat

SEQ ID NO: 812721 - DNA, 20 bp, mouse
gtctacgattggtcgctcgt

SEQ ID NO: 812722 - DNA, 20 bp, mouse
gtagcactgaggccctccat

SEQ ID NO: 812723 - DNA, 20 bp, mouse
gcgcccgcccattggcgcct

SEQ ID NO: 812724 - DNA, 20 bp, mouse
gcgtagacgtggtctctaca

SEQ ID NO: 812725 - DNA, 20 bp, mouse
gaaagtgcgttttataacga

SEQ ID NO: 812726 - DNA, 20 bp, mouse
ggccgaggggagcgtgtccc

SEQ ID NO: 812727 - DNA, 20 bp, mouse
gagcacgctcggcctctcgc

SEQ ID NO: 812728 - DNA, 20 bp, mouse
ggcgccgccgcatcggtcgg

SEQ ID NO: 812729 - DNA, 20 bp, mouse
ggctcccggccactcacttc

SEQ ID NO: 812730 - DNA, 20 bp, mouse
gaggggagcgtgtcccgggc

SEQ ID NO: 812731 - DNA, 20 bp, mouse
ggcctctcgccggaagtgag

SEQ ID NO: 812732 - DNA, 20 bp, mouse
gtgctcgcttcccgggtccg

SEQ ID NO: 812733 - DNA, 20 bp, mouse
gaagcagcgcgccgccgcat

SEQ ID NO: 812734 - DNA, 20 bp, mouse
gggtacgcgaggtgggtttt

SEQ ID NO: 812735 - DNA, 20 bp, mouse
ggctgcttccggtctctctg

SEQ ID NO: 812736 - DNA, 20 bp, mouse
gaggtggcacgcaaagtcaa

SEQ ID NO: 812737 - DNA, 20 bp, mouse
gaccccgggcgcaggtgcac

SEQ ID NO: 812738 - DNA, 20 bp, mouse
gcacctgcgcccggggtccc

SEQ ID NO: 812739 - DNA, 20 bp, mouse
gcggtcgcgcgctcaggaag

SEQ ID NO: 812740 - DNA, 20 bp, mouse
gttttggtgaggggctcaaa

SEQ ID NO: 812741 - DNA, 20 bp, mouse
gactttgcgtgccacctcag

SEQ ID NO: 812742 - DNA, 20 bp, mouse
gaggtgcactggtgccactg

SEQ ID NO: 812743 - DNA, 20 bp, mouse
gtaggcaattttttggtgag

SEQ ID NO: 812744 - DNA, 20 bp, mouse
gaactgaggcactatatctt

SEQ ID NO: 812745 - DNA, 20 bp, mouse
gaagcggcgcgcgcagccgg

SEQ ID NO: 812746 - DNA, 20 bp, mouse
gaggcgaggcctccgaagga

SEQ ID NO: 812747 - DNA, 20 bp, mouse
gggaaggccacgcccatacg

SEQ ID NO: 812748 - DNA, 20 bp, mouse
gcaagcgcagtcaggtttta

SEQ ID NO: 812749 - DNA, 20 bp, mouse
gcccatacgcggaagcgagc

SEQ ID NO: 812750 - DNA, 20 bp, mouse
gggccttcccggctgtgtgt

SEQ ID NO: 812751 - DNA, 20 bp, mouse
gtacccggaggcgctttctt

SEQ ID NO: 812752 - DNA, 20 bp, mouse
gtgtgtgggcgtggtctacc

SEQ ID NO: 812753 - DNA, 20 bp, mouse
gccgaaggaagggagcgaat

SEQ ID NO: 812754 - DNA, 20 bp, mouse
ggggctatgggtgaaggggc

SEQ ID NO: 812755 - DNA, 20 bp, mouse
gagccccgcccaattctccc

SEQ ID NO: 812756 - DNA, 20 bp, mouse
gagcgccactgagcccggga

SEQ ID NO: 812757 - DNA, 20 bp, mouse
ggggccgagcactgccgaga

SEQ ID NO: 812758 - DNA, 20 bp, mouse
ggccgagccggtaccgagta

SEQ ID NO: 812759 - DNA, 20 bp, mouse
ggggccgagcgagaccgagt

SEQ ID NO: 812760 - DNA, 20 bp, mouse
gctggcccgcactccggctg

SEQ ID NO: 812761 - DNA, 20 bp, mouse
gaggggccgagctccggtac

SEQ ID NO: 812762 - DNA, 20 bp, mouse
gctccccctcccgggctcag

SEQ ID NO: 812763 - DNA, 20 bp, mouse
gtccgcctcagccggagtgc

SEQ ID NO: 812764 - DNA, 20 bp, mouse
gcgcgcggctcccgggacgg

SEQ ID NO: 812765 - DNA, 20 bp, mouse
gccgagcggagtcgagctgt

SEQ ID NO: 812766 - DNA, 20 bp, mouse
gaggggaggtggcagtataa

SEQ ID NO: 812767 - DNA, 20 bp, mouse
gcggctgtattatttacttt

SEQ ID NO: 812768 - DNA, 20 bp, mouse
gtaagggtatgctaattagt

SEQ ID NO: 812769 - DNA, 20 bp, mouse
ggaaacgataatagctgtat

SEQ ID NO: 812770 - DNA, 20 bp, mouse
gaattagtaggagattttgg

SEQ ID NO: 812771 - DNA, 20 bp, mouse
gagtctcctccactcccaga

SEQ ID NO: 812772 - DNA, 20 bp, mouse
gaatctttccattaaactat

SEQ ID NO: 812773 - DNA, 20 bp, mouse
gaggcagtatttctttaaag

SEQ ID NO: 812774 - DNA, 20 bp, mouse
gagcctggtatttcccttct

SEQ ID NO: 812775 - DNA, 20 bp, mouse
gacagctattatcgtttcaa

SEQ ID NO: 812776 - DNA, 20 bp, mouse
ggccgcccgggggacagcga

SEQ ID NO: 812777 - DNA, 20 bp, mouse
gcaggcgcgcgccccggtcg

SEQ ID NO: 812778 - DNA, 20 bp, mouse
gccgcgccagccagcccctc

SEQ ID NO: 812779 - DNA, 20 bp, mouse
ggcgggccgggtgacgtcag

SEQ ID NO: 812780 - DNA, 20 bp, mouse
ggccctcgctgtcccccggg

SEQ ID NO: 812781 - DNA, 20 bp, mouse
gagacggcgcgcgcgcccga

SEQ ID NO: 812782 - DNA, 20 bp, mouse
gcgcgcgccccggtcggggc

SEQ ID NO: 812783 - DNA, 20 bp, mouse
ggcccgccgggagccacaat

SEQ ID NO: 812784 - DNA, 20 bp, mouse
ggcccggcgcgccgtctggg

SEQ ID NO: 812785 - DNA, 20 bp, mouse
gcgcgccgtctggcctattg

SEQ ID NO: 812786 - DNA, 20 bp, mouse
gcaagaacagagttgaataa

SEQ ID NO: 812787 - DNA, 20 bp, mouse
ggactccttgcagcaatcat

SEQ ID NO: 812788 - DNA, 20 bp, mouse
ggttcattggaaatttccct

SEQ ID NO: 812789 - DNA, 20 bp, mouse
gaacatgactctcttgactg

SEQ ID NO: 812790 - DNA, 20 bp, mouse
gcatcaggtataaacttccc

SEQ ID NO: 812791 - DNA, 20 bp, mouse
ggttgaggtaatcagttcat

SEQ ID NO: 812792 - DNA, 20 bp, mouse
gtgtgattatcctagagcca

SEQ ID NO: 812793 - DNA, 20 bp, mouse
gagagcccatgattgctgca

SEQ ID NO: 812794 - DNA, 20 bp, mouse
ggactgcaaaaaagaaagtt

SEQ ID NO: 812795 - DNA, 20 bp, mouse
gtcaactctgttcttgcact

SEQ ID NO: 812796 - DNA, 20 bp, mouse
ggcagcttgttcctgaataa

SEQ ID NO: 812797 - DNA, 20 bp, mouse
ggtaaatctgagccacgcca

SEQ ID NO: 812798 - DNA, 20 bp, mouse
gaccacaaaaagatcatatg

SEQ ID NO: 812799 - DNA, 20 bp, mouse
ggtgctaacttgccttggcg

SEQ ID NO: 812800 - DNA, 20 bp, mouse
gaaattggttttgtgcagag

SEQ ID NO: 812801 - DNA, 20 bp, mouse
gaactaaaactgactattta

SEQ ID NO: 812802 - DNA, 20 bp, mouse
gcttaggagaactacctatt

SEQ ID NO: 812803 - DNA, 20 bp, mouse
ggcctcatatgatctttttg

SEQ ID NO: 812804 - DNA, 20 bp, mouse
ggccatatatccaatgaact

SEQ ID NO: 812805 - DNA, 20 bp, mouse
gtcctagttcattggatata

SEQ ID NO: 812806 - DNA, 20 bp, mouse
gacttgccttggtgtgactc

SEQ ID NO: 812807 - DNA, 20 bp, mouse
gttactaatttgagctatgc

SEQ ID NO: 812808 - DNA, 20 bp, mouse
ggtaaacctgagtcacacca

SEQ ID NO: 812809 - DNA, 20 bp, mouse
gttatgcaatgttaagtgag

SEQ ID NO: 812810 - DNA, 20 bp, mouse
gcacatgagaactacctcct

SEQ ID NO: 812811 - DNA, 20 bp, mouse
gaaatgctttctgtttctgg

SEQ ID NO: 812812 - DNA, 20 bp, mouse
gctaatcaacatgttagctg

SEQ ID NO: 812813 - DNA, 20 bp, mouse
gaatttgtcaacttcctagg

SEQ ID NO: 812814 - DNA, 20 bp, mouse
gataaatttgtcaacttcct

SEQ ID NO: 812815 - DNA, 20 bp, mouse
gatatgacattttttgtggt

SEQ ID NO: 812816 - DNA, 20 bp, mouse
gcctggaagagagacctgta

SEQ ID NO: 812817 - DNA, 20 bp, mouse
gagccctgtaggaagttccc

SEQ ID NO: 812818 - DNA, 20 bp, mouse
gcttccagggaacttcctac

SEQ ID NO: 812819 - DNA, 20 bp, mouse
gtagcaagactttcctccac

SEQ ID NO: 812820 - DNA, 20 bp, mouse
gcactgagttccaaataaaa

SEQ ID NO: 812821 - DNA, 20 bp, mouse
gagactttcaggttaggagt

SEQ ID NO: 812822 - DNA, 20 bp, mouse
gttgatataaccagccctgt

SEQ ID NO: 812823 - DNA, 20 bp, mouse
gttgactgggagtaaagttg

SEQ ID NO: 812824 - DNA, 20 bp, mouse
gaagatcacagcagtttccc

SEQ ID NO: 812825 - DNA, 20 bp, mouse
ggtggccagactttcaggtt

SEQ ID NO: 812826 - DNA, 20 bp, mouse
gcaggcttgcagaatcatag

SEQ ID NO: 812827 - DNA, 20 bp, mouse
gataccagatgcagtcacta

SEQ ID NO: 812828 - DNA, 20 bp, mouse
gtcacaggaaatttcaaata

SEQ ID NO: 812829 - DNA, 20 bp, mouse
gaagcaaagatttcatatgt

SEQ ID NO: 812830 - DNA, 20 bp, mouse
gtacaagtgtgggtcagatt

SEQ ID NO: 812831 - DNA, 20 bp, mouse
gtatggcttcaagaaaactg

SEQ ID NO: 812832 - DNA, 20 bp, mouse
gggcaagacttgacttatcc

SEQ ID NO: 812833 - DNA, 20 bp, mouse
gtcagagttatatggaaatc

SEQ ID NO: 812834 - DNA, 20 bp, mouse
gttaccttagtgactgcatc

SEQ ID NO: 812835 - DNA, 20 bp, mouse
gtgtgggtcagatttgggtt

SEQ ID NO: 812836 - DNA, 20 bp, mouse
gtgttccaacatgatacgtt

SEQ ID NO: 812837 - DNA, 20 bp, mouse
gtggtcgttttaatagtcta

SEQ ID NO: 812838 - DNA, 20 bp, mouse
gtgcctatattaacagtaat

SEQ ID NO: 812839 - DNA, 20 bp, mouse
gcagcattagcatgtgtgta

SEQ ID NO: 812840 - DNA, 20 bp, mouse
gtcagtcatgtagtgggatc

SEQ ID NO: 812841 - DNA, 20 bp, mouse
gtgagccaaacgtatcatgt

SEQ ID NO: 812842 - DNA, 20 bp, mouse
gaacctattactgttaatat

SEQ ID NO: 812843 - DNA, 20 bp, mouse
gctatattcagtcatgtagt

SEQ ID NO: 812844 - DNA, 20 bp, mouse
ggctaatgctgaaaatacca

SEQ ID NO: 812845 - DNA, 20 bp, mouse
gctggaagctcttgggaaag

SEQ ID NO: 812846 - DNA, 20 bp, mouse
gcagcccagtcctaagattc

SEQ ID NO: 812847 - DNA, 20 bp, mouse
gcaagcctgaatcttaggac

SEQ ID NO: 812848 - DNA, 20 bp, mouse
gctgggcatgttaacccaca

SEQ ID NO: 812849 - DNA, 20 bp, mouse
gtcaagagttgcctcaccta

SEQ ID NO: 812850 - DNA, 20 bp, mouse
gttcacctaccctgaatatc

SEQ ID NO: 812851 - DNA, 20 bp, mouse
gcctcagtatacggcaagta

SEQ ID NO: 812852 - DNA, 20 bp, mouse
gtcattctgtcctcagtata

SEQ ID NO: 812853 - DNA, 20 bp, mouse
gtcttatcacgatctgactc

SEQ ID NO: 812854 - DNA, 20 bp, mouse
ggaaagagcaccctaaaact

SEQ ID NO: 812855 - DNA, 20 bp, mouse
gttggtaacaagtcttcaca

SEQ ID NO: 812856 - DNA, 20 bp, mouse
gcagccctgtcgtaattttc

SEQ ID NO: 812857 - DNA, 20 bp, mouse
gtaagcctgaaaattacgac

SEQ ID NO: 812858 - DNA, 20 bp, mouse
gcagagtcagatagagatcg

SEQ ID NO: 812859 - DNA, 20 bp, mouse
gtcaggagttgcctcaccca

SEQ ID NO: 812860 - DNA, 20 bp, mouse
gtcattctgtactcagtgta

SEQ ID NO: 812861 - DNA, 20 bp, mouse
gtactcagtgtatggcaggt

SEQ ID NO: 812862 - DNA, 20 bp, mouse
gatctcctaccctgaaaatc

SEQ ID NO: 812863 - DNA, 20 bp, mouse
gtctgtactcagtgtatggc

SEQ ID NO: 812864 - DNA, 20 bp, mouse
ggaaagagcaccctaaaacc

SEQ ID NO: 812865 - DNA, 20 bp, mouse
gacttgttaccctggtttta

SEQ ID NO: 812866 - DNA, 20 bp, mouse
gaagcaagtcatgatgaaac

SEQ ID NO: 812867 - DNA, 20 bp, mouse
gtaagaagtatcaaagtagt

SEQ ID NO: 812868 - DNA, 20 bp, mouse
gaaataggactggtaataac

SEQ ID NO: 812869 - DNA, 20 bp, mouse
gaaggcctataataaatagt

SEQ ID NO: 812870 - DNA, 20 bp, mouse
ggcaatattcagtttaatga

SEQ ID NO: 812871 - DNA, 20 bp, mouse
gtgatatctgagacaaggaa

SEQ ID NO: 812872 - DNA, 20 bp, mouse
gaaagtttgcctgtccagtg

SEQ ID NO: 812873 - DNA, 20 bp, mouse
gtagttttctaaaattctca

SEQ ID NO: 812874 - DNA, 20 bp, mouse
gaattctcaaggaaaattta

SEQ ID NO: 812875 - DNA, 20 bp, mouse
ggaaggttataaaataggac

SEQ ID NO: 812876 - DNA, 20 bp, mouse
gagaaagctcctagtctttt

SEQ ID NO: 812877 - DNA, 20 bp, mouse
gatagagttgaagggatata

SEQ ID NO: 812878 - DNA, 20 bp, mouse
gtttgcagaagttcagggag

SEQ ID NO: 812879 - DNA, 20 bp, mouse
gtaatgaagtgtatggaata

SEQ ID NO: 812880 - DNA, 20 bp, mouse
gtctgttcaccgaaaagact

SEQ ID NO: 812881 - DNA, 20 bp, mouse
ggaaaaaagtatagagttga

SEQ ID NO: 812882 - DNA, 20 bp, mouse
gcaagaagtatcaaagtatt

SEQ ID NO: 812883 - DNA, 20 bp, mouse
gaagcaagtcatgttggaac

SEQ ID NO: 812884 - DNA, 20 bp, mouse
ggaagtgtatggaataggga

SEQ ID NO: 812885 - DNA, 20 bp, mouse
gccagacaagcaagtcatgt

SEQ ID NO: 812886 - DNA, 20 bp, mouse
gcctgagccatgccaaggaa

SEQ ID NO: 812887 - DNA, 20 bp, mouse
gcagctctgtttctgaataa

SEQ ID NO: 812888 - DNA, 20 bp, mouse
ggtgctgcctttccttggca

SEQ ID NO: 812889 - DNA, 20 bp, mouse
gtacatgagaccaatgtact

SEQ ID NO: 812890 - DNA, 20 bp, mouse
gagttacttaacaaagtgag

SEQ ID NO: 812891 - DNA, 20 bp, mouse
gctcaaatgtataaaaagta

SEQ ID NO: 812892 - DNA, 20 bp, mouse
gcaaatatggcaaatattga

SEQ ID NO: 812893 - DNA, 20 bp, mouse
gctttatgaaaatcagtcta

SEQ ID NO: 812894 - DNA, 20 bp, mouse
gtttgttaagtaactattga

SEQ ID NO: 812895 - DNA, 20 bp, mouse
gaaatttgtgcctagtacat

SEQ ID NO: 812896 - DNA, 20 bp, mouse
ggcgccgccccctcaggtga

SEQ ID NO: 812897 - DNA, 20 bp, mouse
gctcgcggcgatgacgtaaa

SEQ ID NO: 812898 - DNA, 20 bp, mouse
gggacacgcggtaaccaagg

SEQ ID NO: 812899 - DNA, 20 bp, mouse
ggcgggacacgcggtaacca

SEQ ID NO: 812900 - DNA, 20 bp, mouse
gcgcccgggcccgcggtctc

SEQ ID NO: 812901 - DNA, 20 bp, mouse
gccgggagcgtgggcgagag

SEQ ID NO: 812902 - DNA, 20 bp, mouse
gcggcggcgccggagaccgc

SEQ ID NO: 812903 - DNA, 20 bp, mouse
gccttgcccggctccgagtc

SEQ ID NO: 812904 - DNA, 20 bp, mouse
gcggcgatgacgtaaagggg

SEQ ID NO: 812905 - DNA, 20 bp, mouse
gctcgcccacgctcccggcg

SEQ ID NO: 812906 - DNA, 20 bp, mouse
gaggcggagtctgaggacac

SEQ ID NO: 812907 - DNA, 20 bp, mouse
gcgcggagcccggatggagg

SEQ ID NO: 812908 - DNA, 20 bp, mouse
gggcaggacccagactagaa

SEQ ID NO: 812909 - DNA, 20 bp, mouse
gcatccgggctccgcggctg

SEQ ID NO: 812910 - DNA, 20 bp, mouse
gggaggctgggtggaggcgt

SEQ ID NO: 812911 - DNA, 20 bp, mouse
gtgaactgccggactcgcag

SEQ ID NO: 812912 - DNA, 20 bp, mouse
gctgccggactcgcagtggt

SEQ ID NO: 812913 - DNA, 20 bp, mouse
gtacggtcgcggggcctctt

SEQ ID NO: 812914 - DNA, 20 bp, mouse
ggctggggctccggctcaat

SEQ ID NO: 812915 - DNA, 20 bp, mouse
gtcactgtagggtacggtcg

SEQ ID NO: 812916 - DNA, 20 bp, mouse
gagggacagcgaggggtggt

SEQ ID NO: 812917 - DNA, 20 bp, mouse
gagggcgcgagggacagcga

SEQ ID NO: 812918 - DNA, 20 bp, mouse
gaggccctggggctgcggag

SEQ ID NO: 812919 - DNA, 20 bp, mouse
gcgagccagagaggccgagt

SEQ ID NO: 812920 - DNA, 20 bp, mouse
gggccctgcgcgagccagag

SEQ ID NO: 812921 - DNA, 20 bp, mouse
gctggggcgcacaggccctg

SEQ ID NO: 812922 - DNA, 20 bp, mouse
ggtaagcggccgcccacctg

SEQ ID NO: 812923 - DNA, 20 bp, mouse
gggcccgcggctcgcacctg

SEQ ID NO: 812924 - DNA, 20 bp, mouse
gcctgtgcgccccaggtaag

SEQ ID NO: 812925 - DNA, 20 bp, mouse
ggtgggcggccgcttacctg

SEQ ID NO: 812926 - DNA, 20 bp, mouse
gtaaagggctggcatgttac

SEQ ID NO: 812927 - DNA, 20 bp, mouse
gcacctagccaactgcaact

SEQ ID NO: 812928 - DNA, 20 bp, mouse
gctcgccaatgattcagcgt

SEQ ID NO: 812929 - DNA, 20 bp, mouse
gggctggcatgttacaggga

SEQ ID NO: 812930 - DNA, 20 bp, mouse
gcattggcgagaatcctagg

SEQ ID NO: 812931 - DNA, 20 bp, mouse
gcgttcgtgcctgctggaaa

SEQ ID NO: 812932 - DNA, 20 bp, mouse
ggggacgccacccagcgggc

SEQ ID NO: 812933 - DNA, 20 bp, mouse
gactgggcagctcctcaacc

SEQ ID NO: 812934 - DNA, 20 bp, mouse
gggaacaaaacgcagcaata

SEQ ID NO: 812935 - DNA, 20 bp, mouse
gcctgacactccacattaaa

SEQ ID NO: 812936 - DNA, 20 bp, mouse
gccgcagaggtctcctggag

SEQ ID NO: 812937 - DNA, 20 bp, mouse
gcagaccctgagcgccgcag

SEQ ID NO: 812938 - DNA, 20 bp, mouse
gacggcagtcgaaacacagg

SEQ ID NO: 812939 - DNA, 20 bp, mouse
gcatgcctgaaagacccttc

SEQ ID NO: 812940 - DNA, 20 bp, mouse
gagccggacacgttcctcga

SEQ ID NO: 812941 - DNA, 20 bp, mouse
gtcgacccgaagggtctttc

SEQ ID NO: 812942 - DNA, 20 bp, mouse
ggccggctgtgtgacgtcac

SEQ ID NO: 812943 - DNA, 20 bp, mouse
ggagacctctgcggcgctca

SEQ ID NO: 812944 - DNA, 20 bp, mouse
gaggcatgggctgtcttaaa

SEQ ID NO: 812945 - DNA, 20 bp, mouse
gtcaaagcggactccggcac

SEQ ID NO: 812946 - DNA, 20 bp, mouse
gactccctgcggcgccgggc

SEQ ID NO: 812947 - DNA, 20 bp, mouse
gcggcgccgggcgggattga

SEQ ID NO: 812948 - DNA, 20 bp, mouse
gcggcgccgcagggagttgt

SEQ ID NO: 812949 - DNA, 20 bp, mouse
gcgccgggcgggattgaagg

SEQ ID NO: 812950 - DNA, 20 bp, mouse
ggcaacggggcgtcagaagg

SEQ ID NO: 812951 - DNA, 20 bp, mouse
gcgggcgggattgaaggagg

SEQ ID NO: 812952 - DNA, 20 bp, mouse
ggccgccaggcccatctccg

SEQ ID NO: 812953 - DNA, 20 bp, mouse
ggcagggagttgtgggtatc

SEQ ID NO: 812954 - DNA, 20 bp, mouse
gaatcccgcccggcgccgca

SEQ ID NO: 812955 - DNA, 20 bp, mouse
gccctggcggacatagactt

SEQ ID NO: 812956 - DNA, 20 bp, mouse
gtctctctacaaggacgatg

SEQ ID NO: 812957 - DNA, 20 bp, mouse
gaagagagctgcaaaaatga

SEQ ID NO: 812958 - DNA, 20 bp, mouse
ggagaatatagccagcttga

SEQ ID NO: 812959 - DNA, 20 bp, mouse
gagtgtgtttctataagctc

SEQ ID NO: 812960 - DNA, 20 bp, mouse
gtgcaaaaatgaaggaactc

SEQ ID NO: 812961 - DNA, 20 bp, mouse
gttgggaccagtaagctctg

SEQ ID NO: 812962 - DNA, 20 bp, mouse
gttgcacggttagagaaaac

SEQ ID NO: 812963 - DNA, 20 bp, mouse
ggacaaaagggagtgatggc

SEQ ID NO: 812964 - DNA, 20 bp, mouse
gcacttcctctgctgaaaca

SEQ ID NO: 812965 - DNA, 20 bp, mouse
ggccttccttgtttcagcag

SEQ ID NO: 812966 - DNA, 20 bp, mouse
gagaagttgagtagtatctt

SEQ ID NO: 812967 - DNA, 20 bp, mouse
ggtctgaaggggtagggaca

SEQ ID NO: 812968 - DNA, 20 bp, mouse
gtctgtgagcacagcttctt

SEQ ID NO: 812969 - DNA, 20 bp, mouse
gcatagtggtctgaaggggt

SEQ ID NO: 812970 - DNA, 20 bp, mouse
gaaagggcatagtggtctga

SEQ ID NO: 812971 - DNA, 20 bp, mouse
gtcaatagatctcatggccc

SEQ ID NO: 812972 - DNA, 20 bp, mouse
gacagggagcaggccatgat

SEQ ID NO: 812973 - DNA, 20 bp, mouse
gtctcatggcccaggaattc

SEQ ID NO: 812974 - DNA, 20 bp, mouse
gtagaaggtaaagggcatag

SEQ ID NO: 812975 - DNA, 20 bp, mouse
gaggacagaccacatttaga

SEQ ID NO: 812976 - DNA, 20 bp, mouse
ggacctccagcctgaggcat

SEQ ID NO: 812977 - DNA, 20 bp, mouse
gggcaaggtggttcctccat

SEQ ID NO: 812978 - DNA, 20 bp, mouse
gaaacaggaaaggggcaagg

SEQ ID NO: 812979 - DNA, 20 bp, mouse
gtccagcctgaggcatgggg

SEQ ID NO: 812980 - DNA, 20 bp, mouse
ggcagctgctccctagaaac

SEQ ID NO: 812981 - DNA, 20 bp, mouse
gaatagaggcggggagaatg

SEQ ID NO: 812982 - DNA, 20 bp, mouse
ggtccaagaaataaaggtat

SEQ ID NO: 812983 - DNA, 20 bp, mouse
ggctgctccggtgattcttg

SEQ ID NO: 812984 - DNA, 20 bp, mouse
gtcaggctggaggtccttct

SEQ ID NO: 812985 - DNA, 20 bp, mouse
gcgtcagaggaaatagaggc

SEQ ID NO: 812986 - DNA, 20 bp, mouse
gtgcgagcggcgggaagttc

SEQ ID NO: 812987 - DNA, 20 bp, mouse
gaggtccaatcaggcacctg

SEQ ID NO: 812988 - DNA, 20 bp, mouse
ggctcgcacttcttccgctt

SEQ ID NO: 812989 - DNA, 20 bp, mouse
gtgggtgcagacggatgccc

SEQ ID NO: 812990 - DNA, 20 bp, mouse
gcacctgaggttaggtggtg

SEQ ID NO: 812991 - DNA, 20 bp, mouse
gctggtgatggatgtgtcgt

SEQ ID NO: 812992 - DNA, 20 bp, mouse
ggcggaagaagtgcgagcgg

SEQ ID NO: 812993 - DNA, 20 bp, mouse
gcaatcaggcacctgaggtt

SEQ ID NO: 812994 - DNA, 20 bp, mouse
gtgcagacggatgcccaggg

SEQ ID NO: 812995 - DNA, 20 bp, mouse
ggcaggggaaaaacgtaccc

SEQ ID NO: 812996 - DNA, 20 bp, mouse
gcggccggaaggggtgtggt

SEQ ID NO: 812997 - DNA, 20 bp, mouse
gtggaggcggggcctgaaac

SEQ ID NO: 812998 - DNA, 20 bp, mouse
gccctgccggccagcccggt

SEQ ID NO: 812999 - DNA, 20 bp, mouse
gggtgacctcagagcgtcgg

SEQ ID NO: 813000 - DNA, 20 bp, mouse
gcggggcctgaaacgggaca

SEQ ID NO: 813001 - DNA, 20 bp, mouse
gggaggacgtggccgcccgc

SEQ ID NO: 813002 - DNA, 20 bp, mouse
gaaacgggacagggcccgga

SEQ ID NO: 813003 - DNA, 20 bp, mouse
ggacctcagagcgtcggggg

SEQ ID NO: 813004 - DNA, 20 bp, mouse
gcgctctgaggtcaccgacc

SEQ ID NO: 813005 - DNA, 20 bp, mouse
ggtcctcccccgacgctctg

SEQ ID NO: 813006 - DNA, 20 bp, mouse
gacccatgggagttgggaaa

SEQ ID NO: 813007 - DNA, 20 bp, mouse
ggggtctgaacacctgactt

SEQ ID NO: 813008 - DNA, 20 bp, mouse
gcataaatgagcaatcctgg

SEQ ID NO: 813009 - DNA, 20 bp, mouse
ggcccctttcccaactccca

SEQ ID NO: 813010 - DNA, 20 bp, mouse
gtgttcagacccatgggagt

SEQ ID NO: 813011 - DNA, 20 bp, mouse
gacaaatagaagttgagctc

SEQ ID NO: 813012 - DNA, 20 bp, mouse
gtgagacaggaagctggttc

SEQ ID NO: 813013 - DNA, 20 bp, mouse
gggattgctcatttatgatc

SEQ ID NO: 813014 - DNA, 20 bp, mouse
gttcttgagaagccaaagtc

SEQ ID NO: 813015 - DNA, 20 bp, mouse
gacgatcagagcttcttcct

SEQ ID NO: 813016 - DNA, 20 bp, mouse
gagggaacgtggaacttgaa

SEQ ID NO: 813017 - DNA, 20 bp, mouse
ggaagagctctcatcaatag

SEQ ID NO: 813018 - DNA, 20 bp, mouse
ggggctccccgtcctggcat

SEQ ID NO: 813019 - DNA, 20 bp, mouse
gcctggcataggtcttaaga

SEQ ID NO: 813020 - DNA, 20 bp, mouse
gcataagtagaaggtttttg

SEQ ID NO: 813021 - DNA, 20 bp, mouse
gctatccagcctctgcttca

SEQ ID NO: 813022 - DNA, 20 bp, mouse
gaggagtgggctccccgtcc

SEQ ID NO: 813023 - DNA, 20 bp, mouse
gctcttagcagtagggaacg

SEQ ID NO: 813024 - DNA, 20 bp, mouse
gttaagacctatgccaggac

SEQ ID NO: 813025 - DNA, 20 bp, mouse
ggagactgaagtggcaacta

SEQ ID NO: 813026 - DNA, 20 bp, mouse
gcctgtgacaacaacatcta

SEQ ID NO: 813027 - DNA, 20 bp, mouse
gtcctcagctgggattaagt

SEQ ID NO: 813028 - DNA, 20 bp, mouse
gacaggaaataggttagatg

SEQ ID NO: 813029 - DNA, 20 bp, mouse
gtcagctgggattaagtagg

SEQ ID NO: 813030 - DNA, 20 bp, mouse
gctgacatgggggggatgca

SEQ ID NO: 813031 - DNA, 20 bp, mouse
gttctgagtctagaagtaac

SEQ ID NO: 813032 - DNA, 20 bp, mouse
gcggtaataagatttccaaa

SEQ ID NO: 813033 - DNA, 20 bp, mouse
gtacttctagactcagaaac

SEQ ID NO: 813034 - DNA, 20 bp, mouse
gagaatcacacacactttgt

SEQ ID NO: 813035 - DNA, 20 bp, mouse
gacacttgttaatgttccgg

SEQ ID NO: 813036 - DNA, 20 bp, mouse
gagcagggctggatgcagaa

SEQ ID NO: 813037 - DNA, 20 bp, mouse
gtgagcctcactgggttctc

SEQ ID NO: 813038 - DNA, 20 bp, mouse
ggaggctgacttacaagaac

SEQ ID NO: 813039 - DNA, 20 bp, mouse
gtgccatgtgcacagaaagg

SEQ ID NO: 813040 - DNA, 20 bp, mouse
gtcccgggtaaagtggaagt

SEQ ID NO: 813041 - DNA, 20 bp, mouse
gtaaagtggaagttggctgc

SEQ ID NO: 813042 - DNA, 20 bp, mouse
ggaaggagctgtggtcctgc

SEQ ID NO: 813043 - DNA, 20 bp, mouse
gcacacgtgcttcttacaca

SEQ ID NO: 813044 - DNA, 20 bp, mouse
gcccaccaggctgtccttca

SEQ ID NO: 813045 - DNA, 20 bp, mouse
gtgtgacaatgatggtgatt

SEQ ID NO: 813046 - DNA, 20 bp, mouse
gtgactgttagacggaggag

SEQ ID NO: 813047 - DNA, 20 bp, mouse
gacatcatctgactgttaga

SEQ ID NO: 813048 - DNA, 20 bp, mouse
ggagaggcacatttccatga

SEQ ID NO: 813049 - DNA, 20 bp, mouse
gcagcatagaaaatactgag

SEQ ID NO: 813050 - DNA, 20 bp, mouse
gtacacattaaactcctccc

SEQ ID NO: 813051 - DNA, 20 bp, mouse
gtaaaagatagactctctca

SEQ ID NO: 813052 - DNA, 20 bp, mouse
gtgttcagagggccgacagc

SEQ ID NO: 813053 - DNA, 20 bp, mouse
ggagatttgggtttggtttg

SEQ ID NO: 813054 - DNA, 20 bp, mouse
gcttcgaactacccagctgt

SEQ ID NO: 813055 - DNA, 20 bp, mouse
gatgaagatgcgtttagcag

SEQ ID NO: 813056 - DNA, 20 bp, mouse
gcgggcgcgcagagctgaga

SEQ ID NO: 813057 - DNA, 20 bp, mouse
gcgcgcgcgggagttaccga

SEQ ID NO: 813058 - DNA, 20 bp, mouse
gcgcgcccgcctgacggacc

SEQ ID NO: 813059 - DNA, 20 bp, mouse
ggcccgcaatcccaaggctt

SEQ ID NO: 813060 - DNA, 20 bp, mouse
gtggaacagcccgactaagg

SEQ ID NO: 813061 - DNA, 20 bp, mouse
gcgggcccgagggatattgg

SEQ ID NO: 813062 - DNA, 20 bp, mouse
gcggctccaacccaagcctt

SEQ ID NO: 813063 - DNA, 20 bp, mouse
gcctaatgcggccgtccgaa

SEQ ID NO: 813064 - DNA, 20 bp, mouse
gaacccaagccttgggattg

SEQ ID NO: 813065 - DNA, 20 bp, mouse
gcgaaggggcaaccaatcag

SEQ ID NO: 813066 - DNA, 20 bp, mouse
gaagcaaagtaggggatccg

SEQ ID NO: 813067 - DNA, 20 bp, mouse
gggtacgagctccactcggc

SEQ ID NO: 813068 - DNA, 20 bp, mouse
gggagctcgtacccagcaca

SEQ ID NO: 813069 - DNA, 20 bp, mouse
gtccggggagatgaggttat

SEQ ID NO: 813070 - DNA, 20 bp, mouse
gtaggggatccggggagatg

SEQ ID NO: 813071 - DNA, 20 bp, mouse
ggctgggtacgagctccact

SEQ ID NO: 813072 - DNA, 20 bp, mouse
gtaaagaatgaaccctgtgc

SEQ ID NO: 813073 - DNA, 20 bp, mouse
ggcacaaagcaaggtctcag

SEQ ID NO: 813074 - DNA, 20 bp, mouse
ggactcactgaggataggga

SEQ ID NO: 813075 - DNA, 20 bp, mouse
ggcgtctctgagacccatcc

SEQ ID NO: 813076 - DNA, 20 bp, mouse
gctagtatgtcagtttcgag

SEQ ID NO: 813077 - DNA, 20 bp, mouse
gcatgtttcacagacttcta

SEQ ID NO: 813078 - DNA, 20 bp, mouse
gaaacgtccagagaaactac

SEQ ID NO: 813079 - DNA, 20 bp, mouse
gtcttggccagtagtttctc

SEQ ID NO: 813080 - DNA, 20 bp, mouse
gagtaccccctacttaaagt

SEQ ID NO: 813081 - DNA, 20 bp, mouse
gaatgccaggaaagtttgct

SEQ ID NO: 813082 - DNA, 20 bp, mouse
gaccccctacttaaagttgg

SEQ ID NO: 813083 - DNA, 20 bp, mouse
gaatgttccaagagttggag

SEQ ID NO: 813084 - DNA, 20 bp, mouse
gtattcccagcaaactttcc

SEQ ID NO: 813085 - DNA, 20 bp, mouse
gggacatcatagttcatata

SEQ ID NO: 813086 - DNA, 20 bp, mouse
gcacgcggatggaaccttgg

SEQ ID NO: 813087 - DNA, 20 bp, mouse
gcccctggcgggcttgtgtc

SEQ ID NO: 813088 - DNA, 20 bp, mouse
gggcgagtgcttttgtgaga

SEQ ID NO: 813089 - DNA, 20 bp, mouse
gccaacggatgtgacgtttc

SEQ ID NO: 813090 - DNA, 20 bp, mouse
gtcagataaaagtgggtgat

SEQ ID NO: 813091 - DNA, 20 bp, mouse
gagtcaggtctcacgtggta

SEQ ID NO: 813092 - DNA, 20 bp, mouse
gctgcctaagtcactggtat

SEQ ID NO: 813093 - DNA, 20 bp, mouse
gatgccaataccagtgactt

SEQ ID NO: 813094 - DNA, 20 bp, mouse
gacctgactgcctaagtcac

SEQ ID NO: 813095 - DNA, 20 bp, mouse
ggcttgtgtcaggttcccaa

SEQ ID NO: 813096 - DNA, 20 bp, mouse
gccgacaaagcccaggaggg

SEQ ID NO: 813097 - DNA, 20 bp, mouse
ggacccgacaaagcccagga

SEQ ID NO: 813098 - DNA, 20 bp, mouse
gcaaagacccgacaaagccc

SEQ ID NO: 813099 - DNA, 20 bp, mouse
gcgggtctttgttccacccc

SEQ ID NO: 813100 - DNA, 20 bp, mouse
gtaccaaagaggccgagttc

SEQ ID NO: 813101 - DNA, 20 bp, mouse
gcctctatgggtagggctgc

SEQ ID NO: 813102 - DNA, 20 bp, mouse
gcctggtgcctctatgggta

SEQ ID NO: 813103 - DNA, 20 bp, mouse
gatgaagcctggtgcctcta

SEQ ID NO: 813104 - DNA, 20 bp, mouse
gaaaatcagataaatgttta

SEQ ID NO: 813105 - DNA, 20 bp, mouse
gtggtcttctccgccctcct

SEQ ID NO: 813106 - DNA, 20 bp, mouse
ggaagtcaggaagagagatt

SEQ ID NO: 813107 - DNA, 20 bp, mouse
gagagtgtgtggtcggagag

SEQ ID NO: 813108 - DNA, 20 bp, mouse
gtgacacctgttaaatacaa

SEQ ID NO: 813109 - DNA, 20 bp, mouse
gtcactagatagttttatac

SEQ ID NO: 813110 - DNA, 20 bp, mouse
gagtatctatctgacttagg

SEQ ID NO: 813111 - DNA, 20 bp, mouse
gtgtttatccttagttaata

SEQ ID NO: 813112 - DNA, 20 bp, mouse
gaagacagaagtagtgaaat

SEQ ID NO: 813113 - DNA, 20 bp, mouse
gttacaagacagacttggtt

SEQ ID NO: 813114 - DNA, 20 bp, mouse
ggtcacaccagcatgtagtt

SEQ ID NO: 813115 - DNA, 20 bp, mouse
gataaacccttgtatttaac

SEQ ID NO: 813116 - DNA, 20 bp, mouse
ggccactgagcgttcaatgc

SEQ ID NO: 813117 - DNA, 20 bp, mouse
ggtggctagcgaaattagag

SEQ ID NO: 813118 - DNA, 20 bp, mouse
gcccagcattgaacgctcag

SEQ ID NO: 813119 - DNA, 20 bp, mouse
ggcctggcccatgtcgacag

SEQ ID NO: 813120 - DNA, 20 bp, mouse
gcaggaaacacagcaaatga

SEQ ID NO: 813121 - DNA, 20 bp, mouse
gagaggctgaggatcagttc

SEQ ID NO: 813122 - DNA, 20 bp, mouse
ggatgtgccactgtcgacat

SEQ ID NO: 813123 - DNA, 20 bp, mouse
gccggctgtcaggccggcca

SEQ ID NO: 813124 - DNA, 20 bp, mouse
gttagccaatagcaactgga

SEQ ID NO: 813125 - DNA, 20 bp, mouse
ggcagggatttcaaacagca

SEQ ID NO: 813126 - DNA, 20 bp, mouse
gaggcccgcagtgggagaga

SEQ ID NO: 813127 - DNA, 20 bp, mouse
gcgcacgccgcgggtctctc

SEQ ID NO: 813128 - DNA, 20 bp, mouse
gcgcaggggacgtaaaacgg

SEQ ID NO: 813129 - DNA, 20 bp, mouse
gcgcaagtgagacgagtcac

SEQ ID NO: 813130 - DNA, 20 bp, mouse
gacccgccgccgtgcataca

SEQ ID NO: 813131 - DNA, 20 bp, mouse
gtctctgcaaggcatgtctc

SEQ ID NO: 813132 - DNA, 20 bp, mouse
gggtgggcgcgtctattctg

SEQ ID NO: 813133 - DNA, 20 bp, mouse
gctgaggtgcgtggtagtga

SEQ ID NO: 813134 - DNA, 20 bp, mouse
gagtcacgggctgcactaac

SEQ ID NO: 813135 - DNA, 20 bp, mouse
gtagacgcgcccacccgccg

SEQ ID NO: 813136 - DNA, 20 bp, mouse
gcggaccagcacccacagaa

SEQ ID NO: 813137 - DNA, 20 bp, mouse
ggtatccaggagaggaacga

SEQ ID NO: 813138 - DNA, 20 bp, mouse
ggaacgaaggtcaaaactgt

SEQ ID NO: 813139 - DNA, 20 bp, mouse
gggtccgagtgagtaagagt

SEQ ID NO: 813140 - DNA, 20 bp, mouse
gaatggggccagacttatta

SEQ ID NO: 813141 - DNA, 20 bp, mouse
gtgaccagttgtggcggaag

SEQ ID NO: 813142 - DNA, 20 bp, mouse
gcagaagtgaccagttgtgg

SEQ ID NO: 813143 - DNA, 20 bp, mouse
ggacctaatgggattccagt

SEQ ID NO: 813144 - DNA, 20 bp, mouse
gcggcaggatactctgtgtg

SEQ ID NO: 813145 - DNA, 20 bp, mouse
gaggaaggaccagaaatcgg

SEQ ID NO: 813146 - DNA, 20 bp, mouse
gcccaggcagctcggatggg

SEQ ID NO: 813147 - DNA, 20 bp, mouse
gggagcccccctctcctgat

SEQ ID NO: 813148 - DNA, 20 bp, mouse
gcccggcggaatcacgcctc

SEQ ID NO: 813149 - DNA, 20 bp, mouse
gagcgggggcggggctgatc

SEQ ID NO: 813150 - DNA, 20 bp, mouse
gcggccggccaatcacggga

SEQ ID NO: 813151 - DNA, 20 bp, mouse
ggtggccggcggaccgggaa

SEQ ID NO: 813152 - DNA, 20 bp, mouse
gcgcccggccggccaatcac

SEQ ID NO: 813153 - DNA, 20 bp, mouse
ggggggcggggctgatccgg

SEQ ID NO: 813154 - DNA, 20 bp, mouse
gcgcccccaggcagctcgga

SEQ ID NO: 813155 - DNA, 20 bp, mouse
gaggaccgtggcgcgcccgg

SEQ ID NO: 813156 - DNA, 20 bp, mouse
gtcggcagggcaggacgtgg

SEQ ID NO: 813157 - DNA, 20 bp, mouse
gttgaccggccatgagaagg

SEQ ID NO: 813158 - DNA, 20 bp, mouse
gtaaggtaggtcaacactga

SEQ ID NO: 813159 - DNA, 20 bp, mouse
gcccctgggagttgaagctg

SEQ ID NO: 813160 - DNA, 20 bp, mouse
ggtctggaggccactcccct

SEQ ID NO: 813161 - DNA, 20 bp, mouse
ggactctgtccctgtgagaa

SEQ ID NO: 813162 - DNA, 20 bp, mouse
gcattcggcagggcaggacg

SEQ ID NO: 813163 - DNA, 20 bp, mouse
gggagttgaagctggggttc

SEQ ID NO: 813164 - DNA, 20 bp, mouse
gaccccagcttcaactccca

SEQ ID NO: 813165 - DNA, 20 bp, mouse
ggttccacctcccttctcac

SEQ ID NO: 813166 - DNA, 20 bp, mouse
ggttcctcagggctaatgac

SEQ ID NO: 813167 - DNA, 20 bp, mouse
ggggcttttcccactattcc

SEQ ID NO: 813168 - DNA, 20 bp, mouse
gaggcaagacagttagagat

SEQ ID NO: 813169 - DNA, 20 bp, mouse
gtactagttactagttgatg

SEQ ID NO: 813170 - DNA, 20 bp, mouse
gtacttacagttggttcctc

SEQ ID NO: 813171 - DNA, 20 bp, mouse
ggcgatgacttttcagtcat

SEQ ID NO: 813172 - DNA, 20 bp, mouse
gttgatgtggtacttacagt

SEQ ID NO: 813173 - DNA, 20 bp, mouse
gggttgtagcttaaactcta

SEQ ID NO: 813174 - DNA, 20 bp, mouse
gagatgggctggggagctca

SEQ ID NO: 813175 - DNA, 20 bp, mouse
ggtcattggcctggaatagt

SEQ ID NO: 813176 - DNA, 20 bp, mouse
gcagcccgggggagcatcag

SEQ ID NO: 813177 - DNA, 20 bp, mouse
gaggaggccggcgctctcca

SEQ ID NO: 813178 - DNA, 20 bp, mouse
ggcggcggcggcgcgcaggt

SEQ ID NO: 813179 - DNA, 20 bp, mouse
gccagagccgcggctaccgg

SEQ ID NO: 813180 - DNA, 20 bp, mouse
ggcaccgcagcgagcaggcg

SEQ ID NO: 813181 - DNA, 20 bp, mouse
ggctcgctgcggtgcggagg

SEQ ID NO: 813182 - DNA, 20 bp, mouse
gcgccgaccctggagagcgc

SEQ ID NO: 813183 - DNA, 20 bp, mouse
gaccgccgctgatgctcccc

SEQ ID NO: 813184 - DNA, 20 bp, mouse
gccccgcggcgctctggctg

SEQ ID NO: 813185 - DNA, 20 bp, mouse
ggctctccagggtcggcgcc

SEQ ID NO: 813186 - DNA, 20 bp, mouse
gggcaggacagcagttgcta

SEQ ID NO: 813187 - DNA, 20 bp, mouse
gaagggctactgcaggactc

SEQ ID NO: 813188 - DNA, 20 bp, mouse
gcagccctcctgctccaaat

SEQ ID NO: 813189 - DNA, 20 bp, mouse
gacaggggccaatttggagc

SEQ ID NO: 813190 - DNA, 20 bp, mouse
gggactcagggatgtggccc

SEQ ID NO: 813191 - DNA, 20 bp, mouse
gagaccctgctcacttgcca

SEQ ID NO: 813192 - DNA, 20 bp, mouse
gtgctaccctaggcttagaa

SEQ ID NO: 813193 - DNA, 20 bp, mouse
gccgcccatggcaagtgagc

SEQ ID NO: 813194 - DNA, 20 bp, mouse
ggaaagacgctgagactgtg

SEQ ID NO: 813195 - DNA, 20 bp, mouse
ggaagcagcagacatgagag

SEQ ID NO: 813196 - DNA, 20 bp, mouse
gcccccgggccgcccctcgg

SEQ ID NO: 813197 - DNA, 20 bp, mouse
gcgggtcggctcctccccga

SEQ ID NO: 813198 - DNA, 20 bp, mouse
ggagcaggaggggctcgggt

SEQ ID NO: 813199 - DNA, 20 bp, mouse
gggtcctctcatcccccctc

SEQ ID NO: 813200 - DNA, 20 bp, mouse
ggaactgagggagagaccgt

SEQ ID NO: 813201 - DNA, 20 bp, mouse
ggtggaggaagtgagcgcag

SEQ ID NO: 813202 - DNA, 20 bp, mouse
gcagcggggtggaatgcgag

SEQ ID NO: 813203 - DNA, 20 bp, mouse
gaacgaagtactctagctgc

SEQ ID NO: 813204 - DNA, 20 bp, mouse
gcccttacccaaagacacac

SEQ ID NO: 813205 - DNA, 20 bp, mouse
gccgggccgcccctcggggg

SEQ ID NO: 813206 - DNA, 20 bp, mouse
ggggggctgcgtctgctcta

SEQ ID NO: 813207 - DNA, 20 bp, mouse
gcttgcgcgggtggtatgga

SEQ ID NO: 813208 - DNA, 20 bp, mouse
gagctccggtggccccctca

SEQ ID NO: 813209 - DNA, 20 bp, mouse
gcccctcacgggaaaactgg

SEQ ID NO: 813210 - DNA, 20 bp, mouse
ggccccgcctgcgccagagt

SEQ ID NO: 813211 - DNA, 20 bp, mouse
gggccccctcacgggaaaac

SEQ ID NO: 813212 - DNA, 20 bp, mouse
ggcctcctgcatacgggatg

SEQ ID NO: 813213 - DNA, 20 bp, mouse
ggctcacgcctcctgcatac

SEQ ID NO: 813214 - DNA, 20 bp, mouse
gggggcttgcgcgggtggta

SEQ ID NO: 813215 - DNA, 20 bp, mouse
gggcgggcagagagctccgg

SEQ ID NO: 813216 - DNA, 20 bp, mouse
gcacacgcgttcagacccta

SEQ ID NO: 813217 - DNA, 20 bp, mouse
gggaactgtagtccgcccta

SEQ ID NO: 813218 - DNA, 20 bp, mouse
gtactgagtacgtggagcac

SEQ ID NO: 813219 - DNA, 20 bp, mouse
gcggaccggcgactctcacg

SEQ ID NO: 813220 - DNA, 20 bp, mouse
gccgcccggagcatgcagcg

SEQ ID NO: 813221 - DNA, 20 bp, mouse
gggaaaggggagggctgcgg

SEQ ID NO: 813222 - DNA, 20 bp, mouse
gcatgcagcgcgggagacag

SEQ ID NO: 813223 - DNA, 20 bp, mouse
gaagcagcatactgagtacg

SEQ ID NO: 813224 - DNA, 20 bp, mouse
ggcacccaaacctcccatta

SEQ ID NO: 813225 - DNA, 20 bp, mouse
ggagagtcgccggtccgcgc

SEQ ID NO: 813226 - DNA, 20 bp, mouse
gcggggcaaccctgagactg

SEQ ID NO: 813227 - DNA, 20 bp, mouse
gtacaggggcggagttttaa

SEQ ID NO: 813228 - DNA, 20 bp, mouse
gcggtcctgcggggaggaac

SEQ ID NO: 813229 - DNA, 20 bp, mouse
ggaaaagtttgcccggggcg

SEQ ID NO: 813230 - DNA, 20 bp, mouse
gcccctacgccggagtccgg

SEQ ID NO: 813231 - DNA, 20 bp, mouse
gctggtgggcgtggtcgttc

SEQ ID NO: 813232 - DNA, 20 bp, mouse
gggcggggtcgggaggcttc

SEQ ID NO: 813233 - DNA, 20 bp, mouse
gtgggcagttcattcagcgg

SEQ ID NO: 813234 - DNA, 20 bp, mouse
gctcgggaaaagtttgcccg

SEQ ID NO: 813235 - DNA, 20 bp, mouse
gggaggaggacgcggtcctg

SEQ ID NO: 813236 - DNA, 20 bp, mouse
ggcactggggaaaagagtgt

SEQ ID NO: 813237 - DNA, 20 bp, mouse
gttcaggagttcagggagta

SEQ ID NO: 813238 - DNA, 20 bp, mouse
gacaacgggaaatgatcagg

SEQ ID NO: 813239 - DNA, 20 bp, mouse
gtccctgaactcctgaatat

SEQ ID NO: 813240 - DNA, 20 bp, mouse
gtgcaggcagagtgtactgg

SEQ ID NO: 813241 - DNA, 20 bp, mouse
gccccaatattcaggagttc

SEQ ID NO: 813242 - DNA, 20 bp, mouse
gggagtagggagtgaactat

SEQ ID NO: 813243 - DNA, 20 bp, mouse
gtccccagatggggccaaca

SEQ ID NO: 813244 - DNA, 20 bp, mouse
ggggctctgaaccataaatg

SEQ ID NO: 813245 - DNA, 20 bp, mouse
gcctgtgaccccaggacaac

SEQ ID NO: 813246 - DNA, 20 bp, mouse
ggaaccgcggcacctgactc

SEQ ID NO: 813247 - DNA, 20 bp, mouse
gacccgagacgcacgtggaa

SEQ ID NO: 813248 - DNA, 20 bp, mouse
gaggcagcgtacgagagtgt

SEQ ID NO: 813249 - DNA, 20 bp, mouse
ggtgtcttttgcaaggtagt

SEQ ID NO: 813250 - DNA, 20 bp, mouse
gagacgcacgtggaacggtt

SEQ ID NO: 813251 - DNA, 20 bp, mouse
gctagcagatgcccatggtg

SEQ ID NO: 813252 - DNA, 20 bp, mouse
gctagcatcctggcaacggg

SEQ ID NO: 813253 - DNA, 20 bp, mouse
gctggcaacggggggctctg

SEQ ID NO: 813254 - DNA, 20 bp, mouse
ggattcaagccccgcctcaa

SEQ ID NO: 813255 - DNA, 20 bp, mouse
gcgtggcgactgcggaaaag

SEQ ID NO: 813256 - DNA, 20 bp, mouse
ggcggtaagtaaagatggtg

SEQ ID NO: 813257 - DNA, 20 bp, mouse
gtgagtccttaagtactctt

SEQ ID NO: 813258 - DNA, 20 bp, mouse
gataagcccaagagtactta

SEQ ID NO: 813259 - DNA, 20 bp, mouse
gctgaggcggtaagtaaaga

SEQ ID NO: 813260 - DNA, 20 bp, mouse
ggaagagaaaacggaggaac

SEQ ID NO: 813261 - DNA, 20 bp, mouse
gactaacattggtctgtctg

SEQ ID NO: 813262 - DNA, 20 bp, mouse
gaacattggtctgtctgagg

SEQ ID NO: 813263 - DNA, 20 bp, mouse
gaagccagggttcatcaaaa

SEQ ID NO: 813264 - DNA, 20 bp, mouse
gttcatcaaaaggggcagag

SEQ ID NO: 813265 - DNA, 20 bp, mouse
gtgccccttttgatgaaccc

SEQ ID NO: 813266 - DNA, 20 bp, mouse
gtccagaaggagtgaaatct

SEQ ID NO: 813267 - DNA, 20 bp, mouse
gacttagcgggagccaggga

SEQ ID NO: 813268 - DNA, 20 bp, mouse
gaaaagcttcgggttactgg

SEQ ID NO: 813269 - DNA, 20 bp, mouse
ggggaaccggacttggagtc

SEQ ID NO: 813270 - DNA, 20 bp, mouse
gtgcgggaggagtaacaacc

SEQ ID NO: 813271 - DNA, 20 bp, mouse
ggaagacttagcgggagcca

SEQ ID NO: 813272 - DNA, 20 bp, mouse
gacaaccaggaagacttagc

SEQ ID NO: 813273 - DNA, 20 bp, mouse
ggaatcaggaggtgggagta

SEQ ID NO: 813274 - DNA, 20 bp, mouse
gtcaaaggcgagaggtgggc

SEQ ID NO: 813275 - DNA, 20 bp, mouse
ggaaatcaaaggcgagaggt

SEQ ID NO: 813276 - DNA, 20 bp, mouse
gccccactctggactcacgt

SEQ ID NO: 813277 - DNA, 20 bp, mouse
gtggactcacgtgggaaatg

SEQ ID NO: 813278 - DNA, 20 bp, mouse
ggggaaatggggcaaagccc

SEQ ID NO: 813279 - DNA, 20 bp, mouse
gtagcttggtctgtccctac

SEQ ID NO: 813280 - DNA, 20 bp, mouse
gtccctacagggttggacag

SEQ ID NO: 813281 - DNA, 20 bp, mouse
ggggccgcgcctccttggtc

SEQ ID NO: 813282 - DNA, 20 bp, mouse
gcaacctccaagtctggaag

SEQ ID NO: 813283 - DNA, 20 bp, mouse
gtggtctgtccctacagggt

SEQ ID NO: 813284 - DNA, 20 bp, mouse
gtgagtccagagtggggcgc

SEQ ID NO: 813285 - DNA, 20 bp, mouse
gaaatggggcaaagcccagg

SEQ ID NO: 813286 - DNA, 20 bp, mouse
gcatcccaggggttggatgt

SEQ ID NO: 813287 - DNA, 20 bp, mouse
gcccctgctgagaccaatca

SEQ ID NO: 813288 - DNA, 20 bp, mouse
gaaaaacaagagaaccgcct

SEQ ID NO: 813289 - DNA, 20 bp, mouse
gagagcagtgctggggacgt

SEQ ID NO: 813290 - DNA, 20 bp, mouse
gccgccttcagatgcgatat

SEQ ID NO: 813291 - DNA, 20 bp, mouse
gggaagcaacagagcagtgc

SEQ ID NO: 813292 - DNA, 20 bp, mouse
gaggaagatgacccatctgg

SEQ ID NO: 813293 - DNA, 20 bp, mouse
ggccctctgccctctcccat

SEQ ID NO: 813294 - DNA, 20 bp, mouse
gtctgaaggcggcccttgat

SEQ ID NO: 813295 - DNA, 20 bp, mouse
gggacgtgggattatgctca

SEQ ID NO: 813296 - DNA, 20 bp, mouse
gccacccctcggggtctgtg

SEQ ID NO: 813297 - DNA, 20 bp, mouse
gcctccctgcggtcctgggg

SEQ ID NO: 813298 - DNA, 20 bp, mouse
gccgcggggtggcagagtcc

SEQ ID NO: 813299 - DNA, 20 bp, mouse
ggcaccagccctctatggag

SEQ ID NO: 813300 - DNA, 20 bp, mouse
ggtccagtcctctccataga

SEQ ID NO: 813301 - DNA, 20 bp, mouse
gaggcctccctgcggtcctg

SEQ ID NO: 813302 - DNA, 20 bp, mouse
gtggggcggagccacccctc

SEQ ID NO: 813303 - DNA, 20 bp, mouse
gaggaccagagcagcgccaa

SEQ ID NO: 813304 - DNA, 20 bp, mouse
gcaaacgcctcactctgccg

SEQ ID NO: 813305 - DNA, 20 bp, mouse
gactccccacagaccccgag

SEQ ID NO: 813306 - DNA, 20 bp, mouse
gtggagtccgaggctgaagt

SEQ ID NO: 813307 - DNA, 20 bp, mouse
gcaccccaacggcatcactc

SEQ ID NO: 813308 - DNA, 20 bp, mouse
gagtccgaggctgaagtggg

SEQ ID NO: 813309 - DNA, 20 bp, mouse
gcacatctgcacagcgtctc

SEQ ID NO: 813310 - DNA, 20 bp, mouse
ggttggcaccatatcaagag

SEQ ID NO: 813311 - DNA, 20 bp, mouse
ggactccagagtgatgccgt

SEQ ID NO: 813312 - DNA, 20 bp, mouse
gcaggaggcactgaagccag

SEQ ID NO: 813313 - DNA, 20 bp, mouse
ggcagatgtgacaagatggt

SEQ ID NO: 813314 - DNA, 20 bp, mouse
ggcagactgtgggtataaaa

SEQ ID NO: 813315 - DNA, 20 bp, mouse
ggaaaaggtgaacttgagtt

SEQ ID NO: 813316 - DNA, 20 bp, mouse
gaggaataccaggtaccaac

SEQ ID NO: 813317 - DNA, 20 bp, mouse
ggggcataatgaggaatacc

SEQ ID NO: 813318 - DNA, 20 bp, mouse
gcctcctgcctgttggtacc

SEQ ID NO: 813319 - DNA, 20 bp, mouse
gcaaggctcgcaagcaactg

SEQ ID NO: 813320 - DNA, 20 bp, mouse
gccgtgaggatgggaactga

SEQ ID NO: 813321 - DNA, 20 bp, mouse
gataccaggtaccaacaggc

SEQ ID NO: 813322 - DNA, 20 bp, mouse
ggtcctccagtgcgcaccca

SEQ ID NO: 813323 - DNA, 20 bp, mouse
gcattatgccccgtgaggat

SEQ ID NO: 813324 - DNA, 20 bp, mouse
gtgagggcttaccattttcc

SEQ ID NO: 813325 - DNA, 20 bp, mouse
gagccttgggtgcgcactgg

SEQ ID NO: 813326 - DNA, 20 bp, mouse
ggctgggagcagtatgtgta

SEQ ID NO: 813327 - DNA, 20 bp, mouse
gctgctcccagcatacacgt

SEQ ID NO: 813328 - DNA, 20 bp, mouse
gccacccctacgtgtatgct

SEQ ID NO: 813329 - DNA, 20 bp, mouse
gcaggtggagctaatgtcct

SEQ ID NO: 813330 - DNA, 20 bp, mouse
gagtcccaaacacctgctgt

SEQ ID NO: 813331 - DNA, 20 bp, mouse
gggtctggtgggctgacctg

SEQ ID NO: 813332 - DNA, 20 bp, mouse
gtcccatgatgccacgggtc

SEQ ID NO: 813333 - DNA, 20 bp, mouse
ggaaatgcaaacaagagggg

SEQ ID NO: 813334 - DNA, 20 bp, mouse
ggctcccacattccagggac

SEQ ID NO: 813335 - DNA, 20 bp, mouse
gggtcagcccaccagacccg

SEQ ID NO: 813336 - DNA, 20 bp, mouse
gctgggacgggagtgtgaaa

SEQ ID NO: 813337 - DNA, 20 bp, mouse
gcatggtccctcagtctgta

SEQ ID NO: 813338 - DNA, 20 bp, mouse
gggggcaagtagggactgat

SEQ ID NO: 813339 - DNA, 20 bp, mouse
gttaaagcagttccagccat

SEQ ID NO: 813340 - DNA, 20 bp, mouse
ggacgggagtgtgaaagggt

SEQ ID NO: 813341 - DNA, 20 bp, mouse
ggcggggggcggggcaagta

SEQ ID NO: 813342 - DNA, 20 bp, mouse
ggccactcagagccttgggc

SEQ ID NO: 813343 - DNA, 20 bp, mouse
ggtaccgtgtgactcggttg

SEQ ID NO: 813344 - DNA, 20 bp, mouse
gcacagcgatgcaccagtca

SEQ ID NO: 813345 - DNA, 20 bp, mouse
gccactgtagaccaattgct

SEQ ID NO: 813346 - DNA, 20 bp, mouse
gacgctggtcccagaccctc

SEQ ID NO: 813347 - DNA, 20 bp, mouse
gggaccagcgtcctagggac

SEQ ID NO: 813348 - DNA, 20 bp, mouse
ggtaacggggtgggcgtagg

SEQ ID NO: 813349 - DNA, 20 bp, mouse
gttagcctcggttccttcaa

SEQ ID NO: 813350 - DNA, 20 bp, mouse
gctgcaggatacctgtccct

SEQ ID NO: 813351 - DNA, 20 bp, mouse
gggtctgggaccagcgtcct

SEQ ID NO: 813352 - DNA, 20 bp, mouse
gctgtcccaagtaacggggt

SEQ ID NO: 813353 - DNA, 20 bp, mouse
gtacgcccaccccgttactt

SEQ ID NO: 813354 - DNA, 20 bp, mouse
ggaagctgtcccaagtaacg

SEQ ID NO: 813355 - DNA, 20 bp, mouse
gggctgggctccacccttga

SEQ ID NO: 813356 - DNA, 20 bp, mouse
gtgtgccaaaggtaaggcat

SEQ ID NO: 813357 - DNA, 20 bp, mouse
ggagcagaacttgaagctat

SEQ ID NO: 813358 - DNA, 20 bp, mouse
ggctgattgtgccaaaggta

SEQ ID NO: 813359 - DNA, 20 bp, mouse
gagtgctagagaatcgatta

SEQ ID NO: 813360 - DNA, 20 bp, mouse
gagcttcaagttctgctcta

SEQ ID NO: 813361 - DNA, 20 bp, mouse
gtcaagttctgctctaaggc

SEQ ID NO: 813362 - DNA, 20 bp, mouse
gtgcacgctgattgtgccaa

SEQ ID NO: 813363 - DNA, 20 bp, mouse
ggtagaacattatgccctgc

SEQ ID NO: 813364 - DNA, 20 bp, mouse
gcttccccatgccttacctt

SEQ ID NO: 813365 - DNA, 20 bp, mouse
gagggatagctacagcaaat

SEQ ID NO: 813366 - DNA, 20 bp, mouse
gagagggcaggcaacagtcc

SEQ ID NO: 813367 - DNA, 20 bp, mouse
gtagctggggactttggatg

SEQ ID NO: 813368 - DNA, 20 bp, mouse
gacaaagcccagtaggggtg

SEQ ID NO: 813369 - DNA, 20 bp, mouse
ggggttggagtgaaactgaa

SEQ ID NO: 813370 - DNA, 20 bp, mouse
ggcctgcagacgggctaaga

SEQ ID NO: 813371 - DNA, 20 bp, mouse
gccgtctgcaggctttccgg

SEQ ID NO: 813372 - DNA, 20 bp, mouse
ggccacagggccagtaaaaa

SEQ ID NO: 813373 - DNA, 20 bp, mouse
gagcggagaaggatgcttta

SEQ ID NO: 813374 - DNA, 20 bp, mouse
gagcccgtctgcaggctttc

SEQ ID NO: 813375 - DNA, 20 bp, mouse
gctgcccagggagccacgtg

SEQ ID NO: 813376 - DNA, 20 bp, mouse
gcgggcctttcacttgacag

SEQ ID NO: 813377 - DNA, 20 bp, mouse
gggagggatggtggttccta

SEQ ID NO: 813378 - DNA, 20 bp, mouse
gtggctggaggggttccacc

SEQ ID NO: 813379 - DNA, 20 bp, mouse
gttgttgttgagatgcgtgg

SEQ ID NO: 813380 - DNA, 20 bp, mouse
gggttccgcccccggaaatc

SEQ ID NO: 813381 - DNA, 20 bp, mouse
gtaactgggcaagctgggcg

SEQ ID NO: 813382 - DNA, 20 bp, mouse
ggccggaacctcggagtcta

SEQ ID NO: 813383 - DNA, 20 bp, mouse
ggcgtcaagtgtaacagtct

SEQ ID NO: 813384 - DNA, 20 bp, mouse
gccgccgccgccttttaact

SEQ ID NO: 813385 - DNA, 20 bp, mouse
gtagggttccagtttcccgg

SEQ ID NO: 813386 - DNA, 20 bp, mouse
ggatgaggaaacatacccac

SEQ ID NO: 813387 - DNA, 20 bp, mouse
gaccactccggggaaacttc

SEQ ID NO: 813388 - DNA, 20 bp, mouse
ggggagcgagcaagtgagca

SEQ ID NO: 813389 - DNA, 20 bp, mouse
ggggtatgtttcctcatcat

SEQ ID NO: 813390 - DNA, 20 bp, mouse
gacagtgaacaaccaaaggc

SEQ ID NO: 813391 - DNA, 20 bp, mouse
gagtgactgaattagaggga

SEQ ID NO: 813392 - DNA, 20 bp, mouse
ggtcttgaagcaagtggaag

SEQ ID NO: 813393 - DNA, 20 bp, mouse
gacaacactatcaccactcc

SEQ ID NO: 813394 - DNA, 20 bp, mouse
ggatcacagtgaacaaccaa

SEQ ID NO: 813395 - DNA, 20 bp, mouse
gtgcatacctgaagtttccc

SEQ ID NO: 813396 - DNA, 20 bp, mouse
gcaagggcatacatgcccaa

SEQ ID NO: 813397 - DNA, 20 bp, mouse
gttaactgcaccaaagttct

SEQ ID NO: 813398 - DNA, 20 bp, mouse
gtgagaaaatcgagaagcaa

SEQ ID NO: 813399 - DNA, 20 bp, mouse
gtggtttaaactggaagcgg

SEQ ID NO: 813400 - DNA, 20 bp, mouse
gtacgggagtgaagccacaa

SEQ ID NO: 813401 - DNA, 20 bp, mouse
gacagagagaagagaacctg

SEQ ID NO: 813402 - DNA, 20 bp, mouse
gagaccagtcaggaggacat

SEQ ID NO: 813403 - DNA, 20 bp, mouse
gtgggtcatgcagaccagtc

SEQ ID NO: 813404 - DNA, 20 bp, mouse
gaccaaacttgcaaattctt

SEQ ID NO: 813405 - DNA, 20 bp, mouse
gagatggtttaaactggaag

SEQ ID NO: 813406 - DNA, 20 bp, mouse
ggggccggagcatgcgcaca

SEQ ID NO: 813407 - DNA, 20 bp, mouse
ggccgagctgggagtatgta

SEQ ID NO: 813408 - DNA, 20 bp, mouse
gccgggtcacgtggcgggaa

SEQ ID NO: 813409 - DNA, 20 bp, mouse
gggtcacgtggcgggaaggg

SEQ ID NO: 813410 - DNA, 20 bp, mouse
gagcgctgataaggatgtgc

SEQ ID NO: 813411 - DNA, 20 bp, mouse
ggccctgagggcggaccctg

SEQ ID NO: 813412 - DNA, 20 bp, mouse
ggtgccggggacgccatcgt

SEQ ID NO: 813413 - DNA, 20 bp, mouse
gctcgcgcctccacacgctg

SEQ ID NO: 813414 - DNA, 20 bp, mouse
gccccctcagagcgctgata

SEQ ID NO: 813415 - DNA, 20 bp, mouse
gatcgtgggcctcacccctc

SEQ ID NO: 813416 - DNA, 20 bp, mouse
gcgcgcgcgcgggcggtcat

SEQ ID NO: 813417 - DNA, 20 bp, mouse
gtaggggcgtggccaccaga

SEQ ID NO: 813418 - DNA, 20 bp, mouse
gcgctccccaagaacttcta

SEQ ID NO: 813419 - DNA, 20 bp, mouse
gggtcattggacacccctca

SEQ ID NO: 813420 - DNA, 20 bp, mouse
gcggatgcccaatcacctgt

SEQ ID NO: 813421 - DNA, 20 bp, mouse
gcccgcgcgcgcgcgcttga

SEQ ID NO: 813422 - DNA, 20 bp, mouse
gcgccctcccgcaccgccta

SEQ ID NO: 813423 - DNA, 20 bp, mouse
ggaggggcgcttttaagagg

SEQ ID NO: 813424 - DNA, 20 bp, mouse
gtggtggccacgcccctagg

SEQ ID NO: 813425 - DNA, 20 bp, mouse
gaggtaatgcttaccctcac

SEQ ID NO: 813426 - DNA, 20 bp, mouse
gcagggctggggctcgtgtg

SEQ ID NO: 813427 - DNA, 20 bp, mouse
gccctggttggggaaccgcg

SEQ ID NO: 813428 - DNA, 20 bp, mouse
gcggttccccaaccagggct

SEQ ID NO: 813429 - DNA, 20 bp, mouse
gtcctcgcggttccccaacc

SEQ ID NO: 813430 - DNA, 20 bp, mouse
gcctgacgccgagtcccacg

SEQ ID NO: 813431 - DNA, 20 bp, mouse
gcgcgaggagtgagcgtacc

SEQ ID NO: 813432 - DNA, 20 bp, mouse
gccacctgggacacggggtg

SEQ ID NO: 813433 - DNA, 20 bp, mouse
gagagacagccaatccaccc

SEQ ID NO: 813434 - DNA, 20 bp, mouse
ggaggagtgagcgtacctgg

SEQ ID NO: 813435 - DNA, 20 bp, mouse
ggcgtgcgcagcaggtgcgt

SEQ ID NO: 813436 - DNA, 20 bp, mouse
gccccagcgcagagcggatc

SEQ ID NO: 813437 - DNA, 20 bp, mouse
gtcagtcaccgcagccccga

SEQ ID NO: 813438 - DNA, 20 bp, mouse
gcccgccggacactgtcact

SEQ ID NO: 813439 - DNA, 20 bp, mouse
gtccccgcgcccctcacccg

SEQ ID NO: 813440 - DNA, 20 bp, mouse
gggggcttgaccacgggtga

SEQ ID NO: 813441 - DNA, 20 bp, mouse
gtgaccacgggtgaggggcg

SEQ ID NO: 813442 - DNA, 20 bp, mouse
gtgagctggctcacgactcg

SEQ ID NO: 813443 - DNA, 20 bp, mouse
gagtcgtgagccagctcact

SEQ ID NO: 813444 - DNA, 20 bp, mouse
gcaaagcccgtccgccggca

SEQ ID NO: 813445 - DNA, 20 bp, mouse
ggcgctgggggcttgaccac

SEQ ID NO: 813446 - DNA, 20 bp, mouse
gagagaggggcgcatgcgta

SEQ ID NO: 813447 - DNA, 20 bp, mouse
gtaacccggccctgtgtcgg

SEQ ID NO: 813448 - DNA, 20 bp, mouse
ggacaagggacctaaccctg

SEQ ID NO: 813449 - DNA, 20 bp, mouse
ggggccacaaccctaacgag

SEQ ID NO: 813450 - DNA, 20 bp, mouse
ggggacctgccaccgacaca

SEQ ID NO: 813451 - DNA, 20 bp, mouse
gccgcagaaccctcagggtt

SEQ ID NO: 813452 - DNA, 20 bp, mouse
gggaggggcatgaggaagat

SEQ ID NO: 813453 - DNA, 20 bp, mouse
gcgaaccaagtgttggatgt

SEQ ID NO: 813454 - DNA, 20 bp, mouse
ggcagaaccgcagaaccctc

SEQ ID NO: 813455 - DNA, 20 bp, mouse
gtggagacctgcatcctaat

SEQ ID NO: 813456 - DNA, 20 bp, mouse
gggaaatgtcccgaaatcta

SEQ ID NO: 813457 - DNA, 20 bp, mouse
gtctaaggtgtgtgtagggt

SEQ ID NO: 813458 - DNA, 20 bp, mouse
gttggctgagactcatatga

SEQ ID NO: 813459 - DNA, 20 bp, mouse
ggaaatctaaggtgtgtgta

SEQ ID NO: 813460 - DNA, 20 bp, mouse
gtgaaattgcacggattgga

SEQ ID NO: 813461 - DNA, 20 bp, mouse
gcggttgaagtttatcgcct

SEQ ID NO: 813462 - DNA, 20 bp, mouse
gacttcagaaggatgagaag

SEQ ID NO: 813463 - DNA, 20 bp, mouse
ggcggagatctgaaattgca

SEQ ID NO: 813464 - DNA, 20 bp, mouse
gcactccacaaactgctttt

SEQ ID NO: 813465 - DNA, 20 bp, mouse
gaaatctgcgggctcctcac

SEQ ID NO: 813466 - DNA, 20 bp, mouse
ggagaagagcgaggttgtag

SEQ ID NO: 813467 - DNA, 20 bp, mouse
gcagcaaggctagagtaggt

SEQ ID NO: 813468 - DNA, 20 bp, mouse
gtaggtaggcgagtaagagg

SEQ ID NO: 813469 - DNA, 20 bp, mouse
ggcggcagcaaggctagagt

SEQ ID NO: 813470 - DNA, 20 bp, mouse
gagggctggggagaagagcg

SEQ ID NO: 813471 - DNA, 20 bp, mouse
ggaggagagagagatgacgt

SEQ ID NO: 813472 - DNA, 20 bp, mouse
gatgacgtggggagacgagg

SEQ ID NO: 813473 - DNA, 20 bp, mouse
gctgcctgttgaggaagagg

SEQ ID NO: 813474 - DNA, 20 bp, mouse
gaggctagaggttgatctgt

SEQ ID NO: 813475 - DNA, 20 bp, mouse
ggaggaggggggttggacgg

SEQ ID NO: 813476 - DNA, 20 bp, mouse
gcctggccgctgttccccga

SEQ ID NO: 813477 - DNA, 20 bp, mouse
gtagtcacggcccaagggcg

SEQ ID NO: 813478 - DNA, 20 bp, mouse
gaggcacgagcaaggtatgg

SEQ ID NO: 813479 - DNA, 20 bp, mouse
gagggcgccccctccggcag

SEQ ID NO: 813480 - DNA, 20 bp, mouse
ggtgggtagtcacggcccaa

SEQ ID NO: 813481 - DNA, 20 bp, mouse
gccccctccggcagcggcgc

SEQ ID NO: 813482 - DNA, 20 bp, mouse
gagaaggtctgcgttgggtg

SEQ ID NO: 813483 - DNA, 20 bp, mouse
gtccacttaacagggagacc

SEQ ID NO: 813484 - DNA, 20 bp, mouse
gacagtgagaaggtctgcgt

SEQ ID NO: 813485 - DNA, 20 bp, mouse
gccccgcgccgctgccggag

SEQ ID NO: 813486 - DNA, 20 bp, mouse
gttacccaatggcttttggc

SEQ ID NO: 813487 - DNA, 20 bp, mouse
ggagaaaatcttctcaagtc

SEQ ID NO: 813488 - DNA, 20 bp, mouse
ggaaagagctcccccgtctc

SEQ ID NO: 813489 - DNA, 20 bp, mouse
gttctccttggtttacccaa

SEQ ID NO: 813490 - DNA, 20 bp, mouse
gaaaagtcttccagagacgg

SEQ ID NO: 813491 - DNA, 20 bp, mouse
gaaagccattgggtaaacca

SEQ ID NO: 813492 - DNA, 20 bp, mouse
ggtgaaaaaagtgtaccttg

SEQ ID NO: 813493 - DNA, 20 bp, mouse
gaatcttctcaagtctggga

SEQ ID NO: 813494 - DNA, 20 bp, mouse
ggagcagcctggatttacta

SEQ ID NO: 813495 - DNA, 20 bp, mouse
gatagagtgcctgcttaacg

SEQ ID NO: 813496 - DNA, 20 bp, mouse
ggtgaccaatggtacaggta

SEQ ID NO: 813497 - DNA, 20 bp, mouse
gtggggcaggcagtgaccaa

SEQ ID NO: 813498 - DNA, 20 bp, mouse
gaggcagtgaccaatggtac

SEQ ID NO: 813499 - DNA, 20 bp, mouse
gtccctggaaattggggtaa

SEQ ID NO: 813500 - DNA, 20 bp, mouse
ggctgccctacctgtaccat

SEQ ID NO: 813501 - DNA, 20 bp, mouse
gaggctgtccctggaaattg

SEQ ID NO: 813502 - DNA, 20 bp, mouse
gtccaggaggatcagaccgt

SEQ ID NO: 813503 - DNA, 20 bp, mouse
ggggcagcagaattctctct

SEQ ID NO: 813504 - DNA, 20 bp, mouse
ggtgcccctccttgatactt

SEQ ID NO: 813505 - DNA, 20 bp, mouse
gcagccctaagtatcaagga

SEQ ID NO: 813506 - DNA, 20 bp, mouse
ggggaagagctctgagtcat

SEQ ID NO: 813507 - DNA, 20 bp, mouse
ggggtgaagtctaggaggtg

SEQ ID NO: 813508 - DNA, 20 bp, mouse
ggaggcgggtgaagtctagg

SEQ ID NO: 813509 - DNA, 20 bp, mouse
ggtcaagtgaaaggaggctt

SEQ ID NO: 813510 - DNA, 20 bp, mouse
ggagctctgagtcataggga

SEQ ID NO: 813511 - DNA, 20 bp, mouse
ggctactgtcaagtgaaagg

SEQ ID NO: 813512 - DNA, 20 bp, mouse
ggaagatctgagaacatcaa

SEQ ID NO: 813513 - DNA, 20 bp, mouse
gctggctactgtcaagtgaa

SEQ ID NO: 813514 - DNA, 20 bp, mouse
gcctgaggcgggtgaagtct

SEQ ID NO: 813515 - DNA, 20 bp, mouse
gtcccaaggtcaccttcctg

SEQ ID NO: 813516 - DNA, 20 bp, mouse
ggctcccagcacatggtcgg

SEQ ID NO: 813517 - DNA, 20 bp, mouse
gggcccgggaggaggcgaca

SEQ ID NO: 813518 - DNA, 20 bp, mouse
ggggtggccgaggctggcgt

SEQ ID NO: 813519 - DNA, 20 bp, mouse
ggcggcacgcacggcccggg

SEQ ID NO: 813520 - DNA, 20 bp, mouse
ggaggaggcgacagggttgg

SEQ ID NO: 813521 - DNA, 20 bp, mouse
gccaaggaccccagaggcgt

SEQ ID NO: 813522 - DNA, 20 bp, mouse
gcggggagcctggagtaccc

SEQ ID NO: 813523 - DNA, 20 bp, mouse
gcgggaggaggcgacagggt

SEQ ID NO: 813524 - DNA, 20 bp, mouse
gcgcgcgggcccacgtggat

SEQ ID NO: 813525 - DNA, 20 bp, mouse
gcgcgcggatgaggggatga

SEQ ID NO: 813526 - DNA, 20 bp, mouse
ggtcaaaaaggtgacgtgtc

SEQ ID NO: 813527 - DNA, 20 bp, mouse
gaagggagagcagatccccg

SEQ ID NO: 813528 - DNA, 20 bp, mouse
gcccactaaaactacacaga

SEQ ID NO: 813529 - DNA, 20 bp, mouse
gcaacagtgcaacgtaaacc

SEQ ID NO: 813530 - DNA, 20 bp, mouse
gccgtctctcctctcaaata

SEQ ID NO: 813531 - DNA, 20 bp, mouse
gcgggcttaaattatagcca

SEQ ID NO: 813532 - DNA, 20 bp, mouse
gacacagaaggaaaatccgg

SEQ ID NO: 813533 - DNA, 20 bp, mouse
gtttgagaggagagacggaa

SEQ ID NO: 813534 - DNA, 20 bp, mouse
gatgtcaaagcaagttcttc

SEQ ID NO: 813535 - DNA, 20 bp, mouse
gagcagatccccgtggcctc

SEQ ID NO: 813536 - DNA, 20 bp, mouse
gctttgccagctacagtcac

SEQ ID NO: 813537 - DNA, 20 bp, mouse
gcttcctgctacctgagcat

SEQ ID NO: 813538 - DNA, 20 bp, mouse
ggaacggaacaatgggtcac

SEQ ID NO: 813539 - DNA, 20 bp, mouse
gagactctgaacggaacaat

SEQ ID NO: 813540 - DNA, 20 bp, mouse
ggactgtagctggcaaagca

SEQ ID NO: 813541 - DNA, 20 bp, mouse
gcaaagatgcgtgtcataaa

SEQ ID NO: 813542 - DNA, 20 bp, mouse
gcataatgttagcaccctga

SEQ ID NO: 813543 - DNA, 20 bp, mouse
gaatgtacaagaacctacca

SEQ ID NO: 813544 - DNA, 20 bp, mouse
gcattatgacacaaaagagg

SEQ ID NO: 813545 - DNA, 20 bp, mouse
gtaacattatgacacaaaag

SEQ ID NO: 813546 - DNA, 20 bp, mouse
gtgggaggggtcacaatctg

SEQ ID NO: 813547 - DNA, 20 bp, mouse
ggaacccagggtatgtgtgg

SEQ ID NO: 813548 - DNA, 20 bp, mouse
gggctgacacagtgggacaa

SEQ ID NO: 813549 - DNA, 20 bp, mouse
gcataccctgggttccactg

SEQ ID NO: 813550 - DNA, 20 bp, mouse
ggcccctcctggaatgtgaa

SEQ ID NO: 813551 - DNA, 20 bp, mouse
gaaaaccttgccttatggga

SEQ ID NO: 813552 - DNA, 20 bp, mouse
gcctcctggaatgtgaaggg

SEQ ID NO: 813553 - DNA, 20 bp, mouse
ggcacaaaaccttgccttat

SEQ ID NO: 813554 - DNA, 20 bp, mouse
gtgacccctcccataaggca

SEQ ID NO: 813555 - DNA, 20 bp, mouse
gaagtgcccatgagccagca

SEQ ID NO: 813556 - DNA, 20 bp, mouse
gcaccccgggaagtcactcc

SEQ ID NO: 813557 - DNA, 20 bp, mouse
gcaccccgggagtgacttcc

SEQ ID NO: 813558 - DNA, 20 bp, mouse
gtggccagagctgtactcgt

SEQ ID NO: 813559 - DNA, 20 bp, mouse
gttaaggcccggctaggagt

SEQ ID NO: 813560 - DNA, 20 bp, mouse
gtgagactgcacgcccgctg

SEQ ID NO: 813561 - DNA, 20 bp, mouse
gggagagcttcgggagacca

SEQ ID NO: 813562 - DNA, 20 bp, mouse
ggaggcggtggaaaagccgg

SEQ ID NO: 813563 - DNA, 20 bp, mouse
ggcagaggagatctgagagt

SEQ ID NO: 813564 - DNA, 20 bp, mouse
gggaaaggcgggtgtccagg

SEQ ID NO: 813565 - DNA, 20 bp, mouse
gctagccgggccttaagcta

SEQ ID NO: 813566 - DNA, 20 bp, mouse
gcccagccttgcatcttctg

SEQ ID NO: 813567 - DNA, 20 bp, mouse
gagagggaggcgagggtaga

SEQ ID NO: 813568 - DNA, 20 bp, mouse
gctggagtcttgggatctcc

SEQ ID NO: 813569 - DNA, 20 bp, mouse
gtcctcaactgagacatcct

SEQ ID NO: 813570 - DNA, 20 bp, mouse
gatcccataccctccagctg

SEQ ID NO: 813571 - DNA, 20 bp, mouse
ggggtatgggatcagtttac

SEQ ID NO: 813572 - DNA, 20 bp, mouse
gggatcagtttacaggatct

SEQ ID NO: 813573 - DNA, 20 bp, mouse
gcgctgaggagtaggggagt

SEQ ID NO: 813574 - DNA, 20 bp, mouse
ggagttggaaggtacaggag

SEQ ID NO: 813575 - DNA, 20 bp, mouse
gtcccagaaggttctagtcc

SEQ ID NO: 813576 - DNA, 20 bp, mouse
ggacctagtgagtatctcaa

SEQ ID NO: 813577 - DNA, 20 bp, mouse
gaagaaagctctaggagcaa

SEQ ID NO: 813578 - DNA, 20 bp, mouse
ggggacagagaatctgcatt

SEQ ID NO: 813579 - DNA, 20 bp, mouse
gaaagctctaggagcaaagg

SEQ ID NO: 813580 - DNA, 20 bp, mouse
ggcaatgcccagagattgat

SEQ ID NO: 813581 - DNA, 20 bp, mouse
ggtggaatgcaagcagcagt

SEQ ID NO: 813582 - DNA, 20 bp, mouse
ggcaccccgcctgctagaac

SEQ ID NO: 813583 - DNA, 20 bp, mouse
gacttcagagattcaggcta

SEQ ID NO: 813584 - DNA, 20 bp, mouse
ggaaacgtaatgagtcacgt

SEQ ID NO: 813585 - DNA, 20 bp, mouse
gcaggaggacccagagaaaa

SEQ ID NO: 813586 - DNA, 20 bp, mouse
gaaaagtgacagtggggaat

SEQ ID NO: 813587 - DNA, 20 bp, mouse
gtgactcagtagggaggagg

SEQ ID NO: 813588 - DNA, 20 bp, mouse
gacgtgactcagtagggagg

SEQ ID NO: 813589 - DNA, 20 bp, mouse
gaacactacgtgactcagta

SEQ ID NO: 813590 - DNA, 20 bp, mouse
gcctttttccggtttgaaat

SEQ ID NO: 813591 - DNA, 20 bp, mouse
gaccccctcttttttttgtc

SEQ ID NO: 813592 - DNA, 20 bp, mouse
gactacgtgactcagtaggg

SEQ ID NO: 813593 - DNA, 20 bp, mouse
gtgagagggaaaagtgacag

SEQ ID NO: 813594 - DNA, 20 bp, mouse
gcacatgttaccatgtacaa

SEQ ID NO: 813595 - DNA, 20 bp, mouse
gaagaccagacaaaaaaaag

SEQ ID NO: 813596 - DNA, 20 bp, mouse
gcaggacccacagagaatct

SEQ ID NO: 813597 - DNA, 20 bp, mouse
ggaggaagatagagtgaaca

SEQ ID NO: 813598 - DNA, 20 bp, mouse
gatcttcccagattctctgt

SEQ ID NO: 813599 - DNA, 20 bp, mouse
ggaccttgagatcaacatgg

SEQ ID NO: 813600 - DNA, 20 bp, mouse
gcctctgagcagctcattaa

SEQ ID NO: 813601 - DNA, 20 bp, mouse
gggtaagttttcacttattg

SEQ ID NO: 813602 - DNA, 20 bp, mouse
gaccaaatggaggcttttat

SEQ ID NO: 813603 - DNA, 20 bp, mouse
gagatagagtgaacatggtc

SEQ ID NO: 813604 - DNA, 20 bp, mouse
ggagggttgacctgatagct

SEQ ID NO: 813605 - DNA, 20 bp, mouse
gcttcatcatctatgatctc

SEQ ID NO: 813606 - DNA, 20 bp, mouse
gggaacaggcaaccagatat

SEQ ID NO: 813607 - DNA, 20 bp, mouse
gcccaggacacgcccatatc

SEQ ID NO: 813608 - DNA, 20 bp, mouse
gactagtgtaacagagtcct

SEQ ID NO: 813609 - DNA, 20 bp, mouse
gcagcctgaaggcggcgatg

SEQ ID NO: 813610 - DNA, 20 bp, mouse
gatgtgtgtcaccagcggta

SEQ ID NO: 813611 - DNA, 20 bp, mouse
ggcccagccagcacggcgaa

SEQ ID NO: 813612 - DNA, 20 bp, mouse
gttcaggctgtccaatgccc

SEQ ID NO: 813613 - DNA, 20 bp, mouse
gctgtgggcagggttgggtt

SEQ ID NO: 813614 - DNA, 20 bp, mouse
gaaaatggcgccttaggaac

SEQ ID NO: 813615 - DNA, 20 bp, mouse
gcaccagcggtagggagccc

SEQ ID NO: 813616 - DNA, 20 bp, mouse
gccgcgcgcactgacgggag

SEQ ID NO: 813617 - DNA, 20 bp, mouse
gcgcactgacgggagcggtc

SEQ ID NO: 813618 - DNA, 20 bp, mouse
gccggcgtaattgtgctctg

SEQ ID NO: 813619 - DNA, 20 bp, mouse
gcgggagcggtcaggtttta

SEQ ID NO: 813620 - DNA, 20 bp, mouse
gctgaccaagggcctttcta

SEQ ID NO: 813621 - DNA, 20 bp, mouse
gcccctaggaagttggcgag

SEQ ID NO: 813622 - DNA, 20 bp, mouse
gcggcgcagtttagcatttc

SEQ ID NO: 813623 - DNA, 20 bp, mouse
gagcggtcaggttttatgga

SEQ ID NO: 813624 - DNA, 20 bp, mouse
ggtggtttaggcagcgccgg

SEQ ID NO: 813625 - DNA, 20 bp, mouse
ggatgctatggaaaccaagt

SEQ ID NO: 813626 - DNA, 20 bp, mouse
gacaggtggaggctctagga

SEQ ID NO: 813627 - DNA, 20 bp, mouse
gcaccccaaggccacgtccc

SEQ ID NO: 813628 - DNA, 20 bp, mouse
gacgtggccttggggtggac

SEQ ID NO: 813629 - DNA, 20 bp, mouse
gctcagaagcaaagagatct

SEQ ID NO: 813630 - DNA, 20 bp, mouse
gctggggagtgtattatagt

SEQ ID NO: 813631 - DNA, 20 bp, mouse
ggggtggggcctcctttggt

SEQ ID NO: 813632 - DNA, 20 bp, mouse
ggtagcctgttggaaggaga

SEQ ID NO: 813633 - DNA, 20 bp, mouse
gagtggggagcgaggcaact

SEQ ID NO: 813634 - DNA, 20 bp, mouse
ggggcatccacgcccaccaa

SEQ ID NO: 813635 - DNA, 20 bp, mouse
gagcaagccaaaggtcggat

SEQ ID NO: 813636 - DNA, 20 bp, mouse
gctacccggaagggactaaa

SEQ ID NO: 813637 - DNA, 20 bp, mouse
gcagaaaggggcaggtgtgc

SEQ ID NO: 813638 - DNA, 20 bp, mouse
gaaggccgggctgcagaaag

SEQ ID NO: 813639 - DNA, 20 bp, mouse
ggggactaaaaggcatgctg

SEQ ID NO: 813640 - DNA, 20 bp, mouse
gagagctcattcataaggcc

SEQ ID NO: 813641 - DNA, 20 bp, mouse
ggccacctgcaagctgaagg

SEQ ID NO: 813642 - DNA, 20 bp, mouse
gtaccccaggtcacaacatc

SEQ ID NO: 813643 - DNA, 20 bp, mouse
ggtggtgactgagagccagt

SEQ ID NO: 813644 - DNA, 20 bp, mouse
gcccctcccagctacccgga

SEQ ID NO: 813645 - DNA, 20 bp, mouse
gttctaaggtccagccccac

SEQ ID NO: 813646 - DNA, 20 bp, mouse
gctgcctcccgggacatcag

SEQ ID NO: 813647 - DNA, 20 bp, mouse
gtcccgggacatcagtgggg

SEQ ID NO: 813648 - DNA, 20 bp, mouse
ggggcggggactcaattccg

SEQ ID NO: 813649 - DNA, 20 bp, mouse
gggggaagagaaatccctgg

SEQ ID NO: 813650 - DNA, 20 bp, mouse
gtaagcctctagttgctcga

SEQ ID NO: 813651 - DNA, 20 bp, mouse
ggggactgacacgtggactt

SEQ ID NO: 813652 - DNA, 20 bp, mouse
gacgtcctgggagagttaga

SEQ ID NO: 813653 - DNA, 20 bp, mouse
gagacctaggacaacccaca

SEQ ID NO: 813654 - DNA, 20 bp, mouse
gggagtgacagagtgctcac

SEQ ID NO: 813655 - DNA, 20 bp, mouse
gtcccaggacgtgttgcccc

SEQ ID NO: 813656 - DNA, 20 bp, mouse
gctgatgtgggcaggccccg

SEQ ID NO: 813657 - DNA, 20 bp, mouse
gggcaggccccgcggctaga

SEQ ID NO: 813658 - DNA, 20 bp, mouse
ggggtgggactgcacgacta

SEQ ID NO: 813659 - DNA, 20 bp, mouse
gtaggtgtcctccagtgaag

SEQ ID NO: 813660 - DNA, 20 bp, mouse
ggcctgtaaaacgagagggt

SEQ ID NO: 813661 - DNA, 20 bp, mouse
gctggaggacacctagatac

SEQ ID NO: 813662 - DNA, 20 bp, mouse
gtagggaaccgcttcactgg

SEQ ID NO: 813663 - DNA, 20 bp, mouse
gagatgtggcttattctgta

SEQ ID NO: 813664 - DNA, 20 bp, mouse
ggacgcctaaggttctggaa

SEQ ID NO: 813665 - DNA, 20 bp, mouse
ggtaatgtcatcgctgatgt

SEQ ID NO: 813666 - DNA, 20 bp, mouse
gcagggctcgaaaggacaga

SEQ ID NO: 813667 - DNA, 20 bp, mouse
gtcagagacagacagggcca

SEQ ID NO: 813668 - DNA, 20 bp, mouse
ggacagggccagggctcgaa

SEQ ID NO: 813669 - DNA, 20 bp, mouse
ggggtctaaatgaaacctgt

SEQ ID NO: 813670 - DNA, 20 bp, mouse
gtctaaatgaaacctgttgg

SEQ ID NO: 813671 - DNA, 20 bp, mouse
gcacactgccctcagataac

SEQ ID NO: 813672 - DNA, 20 bp, mouse
gctctgcatcagagacagac

SEQ ID NO: 813673 - DNA, 20 bp, mouse
gaagagaaggagatgcacgc

SEQ ID NO: 813674 - DNA, 20 bp, mouse
gttcctaagcaaagagactc

SEQ ID NO: 813675 - DNA, 20 bp, mouse
gattgctgcctgttatctga

SEQ ID NO: 813676 - DNA, 20 bp, mouse
ggacgtccccagaatctgat

SEQ ID NO: 813677 - DNA, 20 bp, mouse
gcccaccctatcagattctg

SEQ ID NO: 813678 - DNA, 20 bp, mouse
gcacggacagcgctgagagg

SEQ ID NO: 813679 - DNA, 20 bp, mouse
ggcccaggacaaggagtcaa

SEQ ID NO: 813680 - DNA, 20 bp, mouse
gctggggacgtctgcagtgg

SEQ ID NO: 813681 - DNA, 20 bp, mouse
gattctggggacgtctgcag

SEQ ID NO: 813682 - DNA, 20 bp, mouse
gtccccagaatctgataggg

SEQ ID NO: 813683 - DNA, 20 bp, mouse
gcgctgagagggggcggaga

SEQ ID NO: 813684 - DNA, 20 bp, mouse
gaacacagccacaggagccc

SEQ ID NO: 813685 - DNA, 20 bp, mouse
gggctctagaacacagccac

SEQ ID NO: 813686 - DNA, 20 bp, mouse
gtggctgtggaaaccttctg

SEQ ID NO: 813687 - DNA, 20 bp, mouse
gtggagcccacgatcagcat

SEQ ID NO: 813688 - DNA, 20 bp, mouse
gttcacagctaggcttacta

SEQ ID NO: 813689 - DNA, 20 bp, mouse
gctccgcccatgctgatcgt

SEQ ID NO: 813690 - DNA, 20 bp, mouse
gcggggacccacgggagctt

SEQ ID NO: 813691 - DNA, 20 bp, mouse
ggagcttgggcgtgcagggg

SEQ ID NO: 813692 - DNA, 20 bp, mouse
gactacgacgatgacaaaaa

SEQ ID NO: 813693 - DNA, 20 bp, mouse
gcctacgcctcttgtcacta

SEQ ID NO: 813694 - DNA, 20 bp, mouse
gaagctcgtgtgcctggctg

SEQ ID NO: 813695 - DNA, 20 bp, mouse
gagcccacgatcagcatggg

SEQ ID NO: 813696 - DNA, 20 bp, mouse
gtgggcgagcgtactgaagg

SEQ ID NO: 813697 - DNA, 20 bp, mouse
gcccgcagctacttccacag

SEQ ID NO: 813698 - DNA, 20 bp, mouse
gggccagcgtggtagacagg

SEQ ID NO: 813699 - DNA, 20 bp, mouse
gcaagcgctggacgggtagg

SEQ ID NO: 813700 - DNA, 20 bp, mouse
gaccaagcaaggcccctccc

SEQ ID NO: 813701 - DNA, 20 bp, mouse
ggggaaccacaagacccacc

SEQ ID NO: 813702 - DNA, 20 bp, mouse
ggcctggagtctagagatgt

SEQ ID NO: 813703 - DNA, 20 bp, mouse
gcgcgtgcatgaaccccctg

SEQ ID NO: 813704 - DNA, 20 bp, mouse
gtccctgttaacagtcaagt

SEQ ID NO: 813705 - DNA, 20 bp, mouse
ggcagaacttccaggaggcg

SEQ ID NO: 813706 - DNA, 20 bp, mouse
ggcgaggaggaggttcccgg

SEQ ID NO: 813707 - DNA, 20 bp, mouse
ggaagcagggaggttggctc

SEQ ID NO: 813708 - DNA, 20 bp, mouse
gcgcccgggctctgacgtga

SEQ ID NO: 813709 - DNA, 20 bp, mouse
gggctcgggcgccctcccgt

SEQ ID NO: 813710 - DNA, 20 bp, mouse
gggtggcgggccagacccgg

SEQ ID NO: 813711 - DNA, 20 bp, mouse
gaaagggcgttctgcggtcg

SEQ ID NO: 813712 - DNA, 20 bp, mouse
gaacccctcacgtcagagcc

SEQ ID NO: 813713 - DNA, 20 bp, mouse
ggtgatcgtctgctgtgggt

SEQ ID NO: 813714 - DNA, 20 bp, mouse
gcgaccagggagggtgtgta

SEQ ID NO: 813715 - DNA, 20 bp, mouse
gaggcggaggcgggccagac

SEQ ID NO: 813716 - DNA, 20 bp, mouse
gctctccacgtcaacgtagt

SEQ ID NO: 813717 - DNA, 20 bp, mouse
gtggtcctgcgggactgacc

SEQ ID NO: 813718 - DNA, 20 bp, mouse
gatccggaggctagaagcag

SEQ ID NO: 813719 - DNA, 20 bp, mouse
gcataacgttggggtctgga

SEQ ID NO: 813720 - DNA, 20 bp, mouse
ggggacagtgcttataaatt

SEQ ID NO: 813721 - DNA, 20 bp, mouse
gttgaaataaacgaattcat

SEQ ID NO: 813722 - DNA, 20 bp, mouse
ggcttgaggttgctctcttc

SEQ ID NO: 813723 - DNA, 20 bp, mouse
gcaactaacaatcaggagaa

SEQ ID NO: 813724 - DNA, 20 bp, mouse
ggacctctgcttctagcctc

SEQ ID NO: 813725 - DNA, 20 bp, mouse
gcctccggatcaaagacctg

SEQ ID NO: 813726 - DNA, 20 bp, mouse
gagactggtgaggatcgtag

SEQ ID NO: 813727 - DNA, 20 bp, mouse
ggggtcagaagctcctcggt

SEQ ID NO: 813728 - DNA, 20 bp, mouse
gtgtgcgtccccaaggagac

SEQ ID NO: 813729 - DNA, 20 bp, mouse
gagccctagcccagtgcgaa

SEQ ID NO: 813730 - DNA, 20 bp, mouse
gcctccaccgggagcccaag

SEQ ID NO: 813731 - DNA, 20 bp, mouse
gccggcgggatggtgcgcgt

SEQ ID NO: 813732 - DNA, 20 bp, mouse
gggccaaccagcgagacgga

SEQ ID NO: 813733 - DNA, 20 bp, mouse
gggggcgatcaagtcccctt

SEQ ID NO: 813734 - DNA, 20 bp, mouse
gaccgggccaaccagcgaga

SEQ ID NO: 813735 - DNA, 20 bp, mouse
ggccacaaggcgagtcccta

SEQ ID NO: 813736 - DNA, 20 bp, mouse
ggccccaaatggtcccgatg

SEQ ID NO: 813737 - DNA, 20 bp, mouse
ggagagaagagggacatcaa

SEQ ID NO: 813738 - DNA, 20 bp, mouse
gcaaacacctagcaaccttg

SEQ ID NO: 813739 - DNA, 20 bp, mouse
ggggaggagcacgtgatgaa

SEQ ID NO: 813740 - DNA, 20 bp, mouse
gtcacatgctgtcctattga

SEQ ID NO: 813741 - DNA, 20 bp, mouse
gccaaatgacagccctcaat

SEQ ID NO: 813742 - DNA, 20 bp, mouse
gctagctcttggaaattcac

SEQ ID NO: 813743 - DNA, 20 bp, mouse
gagcacgtgatgaatggcta

SEQ ID NO: 813744 - DNA, 20 bp, mouse
gagcctcatcgggaccattt

SEQ ID NO: 813745 - DNA, 20 bp, mouse
ggcacagtctcaatggtctg

SEQ ID NO: 813746 - DNA, 20 bp, mouse
gaaggcgtgaacgtggtcta

SEQ ID NO: 813747 - DNA, 20 bp, mouse
gagcctgtactggggaaagg

SEQ ID NO: 813748 - DNA, 20 bp, mouse
gaggagcctgtactggggaa

SEQ ID NO: 813749 - DNA, 20 bp, mouse
gcacatggacgctggaagtc

SEQ ID NO: 813750 - DNA, 20 bp, mouse
gcgctcacacacatggacgc

SEQ ID NO: 813751 - DNA, 20 bp, mouse
gaactaacaaggcgtgaacg

SEQ ID NO: 813752 - DNA, 20 bp, mouse
gccctctgacgtcccctgaa

SEQ ID NO: 813753 - DNA, 20 bp, mouse
gtccccaatgctaaaggggt

SEQ ID NO: 813754 - DNA, 20 bp, mouse
gctgacgtcccctgaagggg

SEQ ID NO: 813755 - DNA, 20 bp, mouse
ggccataaagcgtgcttctg

SEQ ID NO: 813756 - DNA, 20 bp, mouse
ggacctgggaaacgtcaggg

SEQ ID NO: 813757 - DNA, 20 bp, mouse
gaggtggggaacggatattc

SEQ ID NO: 813758 - DNA, 20 bp, mouse
gcgggacctgggaaacgtca

SEQ ID NO: 813759 - DNA, 20 bp, mouse
gaggctgggctctcccgacg

SEQ ID NO: 813760 - DNA, 20 bp, mouse
ggctgtgcctcccggagggt

SEQ ID NO: 813761 - DNA, 20 bp, mouse
gctcccggagggtgggagaa

SEQ ID NO: 813762 - DNA, 20 bp, mouse
gggcgggcaccaacctccga

SEQ ID NO: 813763 - DNA, 20 bp, mouse
gtccccgaggcctggacagt

SEQ ID NO: 813764 - DNA, 20 bp, mouse
gtctttgctgtgcctcccgg

SEQ ID NO: 813765 - DNA, 20 bp, mouse
gtgggaaacgtcagggaggt

SEQ ID NO: 813766 - DNA, 20 bp, mouse
ggcggagccaagatcacagt

SEQ ID NO: 813767 - DNA, 20 bp, mouse
ggatcacagtgggcaaccta

SEQ ID NO: 813768 - DNA, 20 bp, mouse
gcaagggcatcgagccagaa

SEQ ID NO: 813769 - DNA, 20 bp, mouse
ggcgccaggtggcgagcgag

SEQ ID NO: 813770 - DNA, 20 bp, mouse
gccaggtggcgagcgagggg

SEQ ID NO: 813771 - DNA, 20 bp, mouse
gagggtgcaaagcctccaaa

SEQ ID NO: 813772 - DNA, 20 bp, mouse
gcgcaagcgctgattggtta

SEQ ID NO: 813773 - DNA, 20 bp, mouse
gaataacaatgcatagccag

SEQ ID NO: 813774 - DNA, 20 bp, mouse
gggaggctttgcaccctttc

SEQ ID NO: 813775 - DNA, 20 bp, mouse
gagggcgggacttgaaaagg

SEQ ID NO: 813776 - DNA, 20 bp, mouse
gcggaggcgcggctcggcgc

SEQ ID NO: 813777 - DNA, 20 bp, mouse
gggcctcggaggactcggga

SEQ ID NO: 813778 - DNA, 20 bp, mouse
ggcccctcccgagtcctccg

SEQ ID NO: 813779 - DNA, 20 bp, mouse
ggatgtgggcgctctcccag

SEQ ID NO: 813780 - DNA, 20 bp, mouse
gctgggtaccccaacatccc

SEQ ID NO: 813781 - DNA, 20 bp, mouse
ggtgaccacagccaccacgt

SEQ ID NO: 813782 - DNA, 20 bp, mouse
gtggctgtggtcacccgatg

SEQ ID NO: 813783 - DNA, 20 bp, mouse
ggggcagggggcgggctcgg

SEQ ID NO: 813784 - DNA, 20 bp, mouse
gcgctctcccagcggtaaca

SEQ ID NO: 813785 - DNA, 20 bp, mouse
gagggaagacagcccgcatc

SEQ ID NO: 813786 - DNA, 20 bp, mouse
ggcttctcttgaagagggga

SEQ ID NO: 813787 - DNA, 20 bp, mouse
gagggaccagacaccatgag

SEQ ID NO: 813788 - DNA, 20 bp, mouse
gaggagctaggagcagatta

SEQ ID NO: 813789 - DNA, 20 bp, mouse
gtactgaggtgggcggtcac

SEQ ID NO: 813790 - DNA, 20 bp, mouse
gagagcaggccacgtggtcg

SEQ ID NO: 813791 - DNA, 20 bp, mouse
gcaaatgcttctcttgaaga

SEQ ID NO: 813792 - DNA, 20 bp, mouse
gccggaaagatgtagaagca

SEQ ID NO: 813793 - DNA, 20 bp, mouse
gccactagcactactgaggt

SEQ ID NO: 813794 - DNA, 20 bp, mouse
ggcttcacctccacctattc

SEQ ID NO: 813795 - DNA, 20 bp, mouse
gatgtccactagcactactg

SEQ ID NO: 813796 - DNA, 20 bp, mouse
gaggctcggcaggtcacgtg

SEQ ID NO: 813797 - DNA, 20 bp, mouse
gtggaccagctcctcgttgg

SEQ ID NO: 813798 - DNA, 20 bp, mouse
gcggggccccggggacgtcc

SEQ ID NO: 813799 - DNA, 20 bp, mouse
ggctgcgggcggggactgtg

SEQ ID NO: 813800 - DNA, 20 bp, mouse
ggcgcctagccgggtgagct

SEQ ID NO: 813801 - DNA, 20 bp, mouse
gggcgcgcccgaccagcctg

SEQ ID NO: 813802 - DNA, 20 bp, mouse
gtaacccgggcgaggctgca

SEQ ID NO: 813803 - DNA, 20 bp, mouse
gtggtcgggcgcgcctagcc

SEQ ID NO: 813804 - DNA, 20 bp, mouse
gagacaggataacccgggcg

SEQ ID NO: 813805 - DNA, 20 bp, mouse
ggcggccagccagtcccacg

SEQ ID NO: 813806 - DNA, 20 bp, mouse
gcccgacctgggtgtctctg

SEQ ID NO: 813807 - DNA, 20 bp, mouse
ggcagcgtgcctagggtccc

SEQ ID NO: 813808 - DNA, 20 bp, mouse
gtccgcccgcagagacaccc

SEQ ID NO: 813809 - DNA, 20 bp, mouse
ggctcccgccggcgtctctg

SEQ ID NO: 813810 - DNA, 20 bp, mouse
gtctctgcgggcggagtgag

SEQ ID NO: 813811 - DNA, 20 bp, mouse
gcccgcggctgggcccggac

SEQ ID NO: 813812 - DNA, 20 bp, mouse
gcccgcagagacacccaggt

SEQ ID NO: 813813 - DNA, 20 bp, mouse
ggagcccgcagagacgccgg

SEQ ID NO: 813814 - DNA, 20 bp, mouse
gtgcgggctccggggaccct

SEQ ID NO: 813815 - DNA, 20 bp, mouse
ggcgtgcggcgtcccgtcgc

SEQ ID NO: 813816 - DNA, 20 bp, mouse
gcggggtaaaaggttgtttc

SEQ ID NO: 813817 - DNA, 20 bp, mouse
ggccagggcagggatacacg

SEQ ID NO: 813818 - DNA, 20 bp, mouse
ggcctcgtgtatccctgccc

SEQ ID NO: 813819 - DNA, 20 bp, mouse
gaagacttgtttgctcttct

SEQ ID NO: 813820 - DNA, 20 bp, mouse
gcaagcctgatacatctgga

SEQ ID NO: 813821 - DNA, 20 bp, mouse
gaaagttcttggaactgcgg

SEQ ID NO: 813822 - DNA, 20 bp, mouse
gactggtatcgcggggtaaa

SEQ ID NO: 813823 - DNA, 20 bp, mouse
gtcttctgggaagtgagcca

SEQ ID NO: 813824 - DNA, 20 bp, mouse
ggtaaaaggttgtttctggt

SEQ ID NO: 813825 - DNA, 20 bp, mouse
ggctctcacactggtatcgc

SEQ ID NO: 813826 - DNA, 20 bp, mouse
gaagatgggggcggggtggt

SEQ ID NO: 813827 - DNA, 20 bp, mouse
ggcggccccaacacacttag

SEQ ID NO: 813828 - DNA, 20 bp, mouse
gcaccccgcccccatcttca

SEQ ID NO: 813829 - DNA, 20 bp, mouse
gaggcaggagcaccgaagga

SEQ ID NO: 813830 - DNA, 20 bp, mouse
gtgcggcaagatctggacac

SEQ ID NO: 813831 - DNA, 20 bp, mouse
gaggcaggcaggagcaccga

SEQ ID NO: 813832 - DNA, 20 bp, mouse
gcatggccctggtttctgtt

SEQ ID NO: 813833 - DNA, 20 bp, mouse
gtctgccactaagtgtgttg

SEQ ID NO: 813834 - DNA, 20 bp, mouse
gtaggatcaggccagctctg

SEQ ID NO: 813835 - DNA, 20 bp, mouse
ggtggagagagaagtcactc

SEQ ID NO: 813836 - DNA, 20 bp, mouse
gagagtaagtgcaacctgga

SEQ ID NO: 813837 - DNA, 20 bp, mouse
gggaagtgggtgattgaaga

SEQ ID NO: 813838 - DNA, 20 bp, mouse
gtggaagcacaggataaaga

SEQ ID NO: 813839 - DNA, 20 bp, mouse
gtggttacagctagtagaag

SEQ ID NO: 813840 - DNA, 20 bp, mouse
gctagtagaagaggtttgat

SEQ ID NO: 813841 - DNA, 20 bp, mouse
ggaagaaggcatgccttcgg

SEQ ID NO: 813842 - DNA, 20 bp, mouse
gctcagtagtactagcaggt

SEQ ID NO: 813843 - DNA, 20 bp, mouse
gtactctcagtagtactagc

SEQ ID NO: 813844 - DNA, 20 bp, mouse
ggctacaatagctcctccga

SEQ ID NO: 813845 - DNA, 20 bp, mouse
gactgaaatgcaccccacaa

SEQ ID NO: 813846 - DNA, 20 bp, mouse
ggggagacggtgtcacaatg

SEQ ID NO: 813847 - DNA, 20 bp, mouse
ggagacaggactcacctgac

SEQ ID NO: 813848 - DNA, 20 bp, mouse
gttgggaccagaattagtta

SEQ ID NO: 813849 - DNA, 20 bp, mouse
gcagaaccctagcgttccat

SEQ ID NO: 813850 - DNA, 20 bp, mouse
ggtgtgcctggagtagaata

SEQ ID NO: 813851 - DNA, 20 bp, mouse
ggactggccacttgtgtgcc

SEQ ID NO: 813852 - DNA, 20 bp, mouse
ggactgggggttcatgtaga

SEQ ID NO: 813853 - DNA, 20 bp, mouse
gtggggtggagaaggtgacc

SEQ ID NO: 813854 - DNA, 20 bp, mouse
gggttctgcttccaaggata

SEQ ID NO: 813855 - DNA, 20 bp, mouse
gagctaccaatggaacgcta

SEQ ID NO: 813856 - DNA, 20 bp, mouse
gacaaagcggtggaatgcgg

SEQ ID NO: 813857 - DNA, 20 bp, mouse
gctactaagtggatgtctcg

SEQ ID NO: 813858 - DNA, 20 bp, mouse
gctagagccttccgagaaga

SEQ ID NO: 813859 - DNA, 20 bp, mouse
ggaaggggacagatgcctcc

SEQ ID NO: 813860 - DNA, 20 bp, mouse
gccagggcgactcacgggag

SEQ ID NO: 813861 - DNA, 20 bp, mouse
gcctagtgggcactactaag

SEQ ID NO: 813862 - DNA, 20 bp, mouse
ggctccacgccgtgtcccgc

SEQ ID NO: 813863 - DNA, 20 bp, mouse
gccactaggcccacggacaa

SEQ ID NO: 813864 - DNA, 20 bp, mouse
gaaccccgcgggacacggcg

SEQ ID NO: 813865 - DNA, 20 bp, mouse
ggccccttcgcacaaagcgg

SEQ ID NO: 813866 - DNA, 20 bp, mouse
ggagcccctggcttggtctg

SEQ ID NO: 813867 - DNA, 20 bp, mouse
gcatgggagcaggatggaga

SEQ ID NO: 813868 - DNA, 20 bp, mouse
gggcgtgtcctgctgaagat

SEQ ID NO: 813869 - DNA, 20 bp, mouse
gttaggaaatgcagagcccc

SEQ ID NO: 813870 - DNA, 20 bp, mouse
ggggaggcgtcaacacttct

SEQ ID NO: 813871 - DNA, 20 bp, mouse
gcccatgaccccacaactca

SEQ ID NO: 813872 - DNA, 20 bp, mouse
gtccactcccagagattcag

SEQ ID NO: 813873 - DNA, 20 bp, mouse
ggaagtccccagaccaagcc

SEQ ID NO: 813874 - DNA, 20 bp, mouse
gttgacgcctccctgagttg

SEQ ID NO: 813875 - DNA, 20 bp, mouse
gcacgtgcgtcaactcctgc

SEQ ID NO: 813876 - DNA, 20 bp, mouse
gggccaaggccccccgttga

SEQ ID NO: 813877 - DNA, 20 bp, mouse
gccagcccatccttcaacgg

SEQ ID NO: 813878 - DNA, 20 bp, mouse
gaccccagcccatccttcaa

SEQ ID NO: 813879 - DNA, 20 bp, mouse
gacagggaagaactggaata

SEQ ID NO: 813880 - DNA, 20 bp, mouse
ggaaggatgaacgagtgaca

SEQ ID NO: 813881 - DNA, 20 bp, mouse
ggctcccaagaaacaaacga

SEQ ID NO: 813882 - DNA, 20 bp, mouse
ggttctgctgacgtgggaag

SEQ ID NO: 813883 - DNA, 20 bp, mouse
gtaagtgcctactgtatccc

SEQ ID NO: 813884 - DNA, 20 bp, mouse
gtcccacgtcagcagaacct

SEQ ID NO: 813885 - DNA, 20 bp, mouse
gactgttcgtcagagataaa

SEQ ID NO: 813886 - DNA, 20 bp, mouse
ggaggtgatcccaggttcta

SEQ ID NO: 813887 - DNA, 20 bp, mouse
gctgccaaggggaccaaccc

SEQ ID NO: 813888 - DNA, 20 bp, mouse
gacagggaaccctagaacct

SEQ ID NO: 813889 - DNA, 20 bp, mouse
gagggcataggggtgagctc

SEQ ID NO: 813890 - DNA, 20 bp, mouse
gtgggaggcagcttcccagt

SEQ ID NO: 813891 - DNA, 20 bp, mouse
gagaaagctacttcctcttc

SEQ ID NO: 813892 - DNA, 20 bp, mouse
ggggttaggggcaaaaatag

SEQ ID NO: 813893 - DNA, 20 bp, mouse
gaggaagtgccccacccctc

SEQ ID NO: 813894 - DNA, 20 bp, mouse
ggggcacttcctggttgtga

SEQ ID NO: 813895 - DNA, 20 bp, mouse
ggaggccactgttctgccaa

SEQ ID NO: 813896 - DNA, 20 bp, mouse
gggaacctcgcaagccccgt

SEQ ID NO: 813897 - DNA, 20 bp, mouse
gcgggctagcccagatccca

SEQ ID NO: 813898 - DNA, 20 bp, mouse
gagctcgctccacccaccct

SEQ ID NO: 813899 - DNA, 20 bp, mouse
gggaaccagagtccagggca

SEQ ID NO: 813900 - DNA, 20 bp, mouse
ggggtcctcccacttcacca

SEQ ID NO: 813901 - DNA, 20 bp, mouse
gtcaggaggcgtgtcttgat

SEQ ID NO: 813902 - DNA, 20 bp, mouse
gagggctgaggcttaacact

SEQ ID NO: 813903 - DNA, 20 bp, mouse
gacctcgcaagccccgtggg

SEQ ID NO: 813904 - DNA, 20 bp, mouse
ggacccaagctattgtgggg

SEQ ID NO: 813905 - DNA, 20 bp, mouse
ggctctgggatccagaagaa

SEQ ID NO: 813906 - DNA, 20 bp, mouse
gaaacatagtaagttaactc

SEQ ID NO: 813907 - DNA, 20 bp, mouse
gaagcagcgtggcagtaggc

SEQ ID NO: 813908 - DNA, 20 bp, mouse
gactcctcttggtatctcta

SEQ ID NO: 813909 - DNA, 20 bp, mouse
gagaggagtagcctgatgat

SEQ ID NO: 813910 - DNA, 20 bp, mouse
gtccacaatccaaagtgaag

SEQ ID NO: 813911 - DNA, 20 bp, mouse
gaatgaaaaccacttcactt

SEQ ID NO: 813912 - DNA, 20 bp, mouse
gaaaactacatgttctgtta

SEQ ID NO: 813913 - DNA, 20 bp, mouse
gttcccagaaggttactatt

SEQ ID NO: 813914 - DNA, 20 bp, mouse
gtttgcagatcaatgtccac

SEQ ID NO: 813915 - DNA, 20 bp, mouse
ggcagatcaatgtccacagg

SEQ ID NO: 813916 - DNA, 20 bp, mouse
gaagcagagacgaactcaca

SEQ ID NO: 813917 - DNA, 20 bp, mouse
ggagaggtgcgattggaagt

SEQ ID NO: 813918 - DNA, 20 bp, mouse
gcagcaagatcttcccccat

SEQ ID NO: 813919 - DNA, 20 bp, mouse
gtggaagttggcctgtctga

SEQ ID NO: 813920 - DNA, 20 bp, mouse
gtccaatcgcacctctccaa

SEQ ID NO: 813921 - DNA, 20 bp, mouse
gtccccgtgggatacagaga

SEQ ID NO: 813922 - DNA, 20 bp, mouse
gaaatgcccagagcaggccc

SEQ ID NO: 813923 - DNA, 20 bp, mouse
gtgagggaagtctgacccga

SEQ ID NO: 813924 - DNA, 20 bp, mouse
gccctggtgcacattgcatt

SEQ ID NO: 813925 - DNA, 20 bp, mouse
gacactccagggcctgctct

SEQ ID NO: 813926 - DNA, 20 bp, mouse
gtgcagatgtggggacattt

SEQ ID NO: 813927 - DNA, 20 bp, mouse
gagggacacactgcagatgt

SEQ ID NO: 813928 - DNA, 20 bp, mouse
gcttgagttagcaaagtcaa

SEQ ID NO: 813929 - DNA, 20 bp, mouse
gcagggctttaatgcttcta

SEQ ID NO: 813930 - DNA, 20 bp, mouse
gggatcaagttacacctcac

SEQ ID NO: 813931 - DNA, 20 bp, mouse
gggcctgatcctctacctct

SEQ ID NO: 813932 - DNA, 20 bp, mouse
gggcactttgcagaagtcag

SEQ ID NO: 813933 - DNA, 20 bp, mouse
gcccaggaagagagattcat

SEQ ID NO: 813934 - DNA, 20 bp, mouse
ggagctggggctcgacggtt

SEQ ID NO: 813935 - DNA, 20 bp, mouse
gactgggagctggggctcga

SEQ ID NO: 813936 - DNA, 20 bp, mouse
gcacaccccccgagcgagtc

SEQ ID NO: 813937 - DNA, 20 bp, mouse
gcccccagcccgactcgctc

SEQ ID NO: 813938 - DNA, 20 bp, mouse
gcccccgagcgagtcgggct

SEQ ID NO: 813939 - DNA, 20 bp, mouse
gagccctggggaccagctcg

SEQ ID NO: 813940 - DNA, 20 bp, mouse
gggtccccagggctcctttg

SEQ ID NO: 813941 - DNA, 20 bp, mouse
gttgacttggagaaaggcgt

SEQ ID NO: 813942 - DNA, 20 bp, mouse
gtgggtgttgacttggagaa

SEQ ID NO: 813943 - DNA, 20 bp, mouse
gtgaaggagaagacttttgg

SEQ ID NO: 813944 - DNA, 20 bp, mouse
gcagtcgagagcaagcgagt

SEQ ID NO: 813945 - DNA, 20 bp, mouse
gaccaagctgggtgttgact

SEQ ID NO: 813946 - DNA, 20 bp, mouse
gctgatgtttagtcactcta

SEQ ID NO: 813947 - DNA, 20 bp, mouse
gaccccagtccactgttcat

SEQ ID NO: 813948 - DNA, 20 bp, mouse
gtggaactaagtaactgaag

SEQ ID NO: 813949 - DNA, 20 bp, mouse
gtccaatgaacagtggactg

SEQ ID NO: 813950 - DNA, 20 bp, mouse
gcaggtagaaatgtcaatgc

SEQ ID NO: 813951 - DNA, 20 bp, mouse
gacttagttccaatgaacag

SEQ ID NO: 813952 - DNA, 20 bp, mouse
gtccatcctgaaagttgtct

SEQ ID NO: 813953 - DNA, 20 bp, mouse
gttttgtcagggtatgagtg

SEQ ID NO: 813954 - DNA, 20 bp, mouse
gaaaaattatggattaccaa

SEQ ID NO: 813955 - DNA, 20 bp, mouse
ggacacaatgatcttttgtc

SEQ ID NO: 813956 - DNA, 20 bp, mouse
gaccgcccggacagacgcag

SEQ ID NO: 813957 - DNA, 20 bp, mouse
gcgggccgctgcaagatccc

SEQ ID NO: 813958 - DNA, 20 bp, mouse
gcggctgtgggacttgagac

SEQ ID NO: 813959 - DNA, 20 bp, mouse
gccagccagtgcagactcct

SEQ ID NO: 813960 - DNA, 20 bp, mouse
ggcgacacggcccggctgga

SEQ ID NO: 813961 - DNA, 20 bp, mouse
gcccggggcgaggtcccttg

SEQ ID NO: 813962 - DNA, 20 bp, mouse
gaccaccagggatcttgcag

SEQ ID NO: 813963 - DNA, 20 bp, mouse
ggcccctgcgtctgtccggg

SEQ ID NO: 813964 - DNA, 20 bp, mouse
ggggccgtgtcgccaccgcc

SEQ ID NO: 813965 - DNA, 20 bp, mouse
gcccgcccctgcgtctgtcc

SEQ ID NO: 813966 - DNA, 20 bp, mouse
gccattaaacagtttcactc

SEQ ID NO: 813967 - DNA, 20 bp, mouse
ggcatgcagtcttttgtcga

SEQ ID NO: 813968 - DNA, 20 bp, mouse
ggtcgaaggtacaacttacc

SEQ ID NO: 813969 - DNA, 20 bp, mouse
gcagaaatgacccagggggg

SEQ ID NO: 813970 - DNA, 20 bp, mouse
ggatcaaaatcaggtaggcg

SEQ ID NO: 813971 - DNA, 20 bp, mouse
gcaaaatcaggtaggcgagg

SEQ ID NO: 813972 - DNA, 20 bp, mouse
gacagattggatcaattaaa

SEQ ID NO: 813973 - DNA, 20 bp, mouse
ggaattgatcaaaatcaggt

SEQ ID NO: 813974 - DNA, 20 bp, mouse
gtaagcgagaagtttttttg

SEQ ID NO: 813975 - DNA, 20 bp, mouse
gcctttgtgaaccacccccc

SEQ ID NO: 813976 - DNA, 20 bp, mouse
gaggtgtcacaatagcgttg

SEQ ID NO: 813977 - DNA, 20 bp, mouse
gtgtcacaatagcgttgagg

SEQ ID NO: 813978 - DNA, 20 bp, mouse
gtgcctctgataatgacaat

SEQ ID NO: 813979 - DNA, 20 bp, mouse
gtaggcttccctcttgattc

SEQ ID NO: 813980 - DNA, 20 bp, mouse
gaacagctcaggactattta

SEQ ID NO: 813981 - DNA, 20 bp, mouse
gaagaattcctgaatcaaga

SEQ ID NO: 813982 - DNA, 20 bp, mouse
gcaggggaatagagatcctg

SEQ ID NO: 813983 - DNA, 20 bp, mouse
ggtgacacctcatattgcaa

SEQ ID NO: 813984 - DNA, 20 bp, mouse
gagagatcctgaggtcatct

SEQ ID NO: 813985 - DNA, 20 bp, mouse
gaaagatctagaatctccct

SEQ ID NO: 813986 - DNA, 20 bp, mouse
gagcctggcaacagtctggc

SEQ ID NO: 813987 - DNA, 20 bp, mouse
gaaggagcctggcaacagtc

SEQ ID NO: 813988 - DNA, 20 bp, mouse
gagtctggcaggcaaagtgc

SEQ ID NO: 813989 - DNA, 20 bp, mouse
gtgcctgccagactgttgcc

SEQ ID NO: 813990 - DNA, 20 bp, mouse
gctttgagtaaaaactaaaa

SEQ ID NO: 813991 - DNA, 20 bp, mouse
ggcaggacattcatcacttg

SEQ ID NO: 813992 - DNA, 20 bp, mouse
gggacattcatcacttgggg

SEQ ID NO: 813993 - DNA, 20 bp, mouse
gaaagagtgaaaagctcatt

SEQ ID NO: 813994 - DNA, 20 bp, mouse
gtgtagtgcataaatgtaat

SEQ ID NO: 813995 - DNA, 20 bp, mouse
gcaaataagaatgctccctc

SEQ ID NO: 813996 - DNA, 20 bp, mouse
gagcgggtatggctggattg

SEQ ID NO: 813997 - DNA, 20 bp, mouse
ggccaagaagcgggtatggc

SEQ ID NO: 813998 - DNA, 20 bp, mouse
gctttaaattgcacattctg

SEQ ID NO: 813999 - DNA, 20 bp, mouse
gtccagccatacccgcttct

SEQ ID NO: 814000 - DNA, 20 bp, mouse
gggagcatggggagtgggta

SEQ ID NO: 814001 - DNA, 20 bp, mouse
ggtaggggataggggattct

SEQ ID NO: 814002 - DNA, 20 bp, mouse
gtggctggattggggagcat

SEQ ID NO: 814003 - DNA, 20 bp, mouse
gcagggccaagaagcgggta

SEQ ID NO: 814004 - DNA, 20 bp, mouse
gcatggtcaactatggacat

SEQ ID NO: 814005 - DNA, 20 bp, mouse
ggattcttggagaggaatct

SEQ ID NO: 814006 - DNA, 20 bp, mouse
gtagggcaggctacaggtca

SEQ ID NO: 814007 - DNA, 20 bp, mouse
gcccgggaccggagtaaacc

SEQ ID NO: 814008 - DNA, 20 bp, mouse
gtaaacccggagagcggatt

SEQ ID NO: 814009 - DNA, 20 bp, mouse
gccggagtaaacccggagag

SEQ ID NO: 814010 - DNA, 20 bp, mouse
gacctgtagcctgccctaaa

SEQ ID NO: 814011 - DNA, 20 bp, mouse
ggaggccgggagcttggaac

SEQ ID NO: 814012 - DNA, 20 bp, mouse
gagcccggggcgggctgcca

SEQ ID NO: 814013 - DNA, 20 bp, mouse
gaatagcctccagtactctt

SEQ ID NO: 814014 - DNA, 20 bp, mouse
gtagtgtcactgtgcaccaa

SEQ ID NO: 814015 - DNA, 20 bp, mouse
ggacttggggtgtcccttta

SEQ ID NO: 814016 - DNA, 20 bp, mouse
gagcctggcaacagtctggc

SEQ ID NO: 814017 - DNA, 20 bp, mouse
gaaggagcctggcaacagtc

SEQ ID NO: 814018 - DNA, 20 bp, mouse
gagtctggcaggcaaagtgc

SEQ ID NO: 814019 - DNA, 20 bp, mouse
gtgcctgccagactgttgcc

SEQ ID NO: 814020 - DNA, 20 bp, mouse
gatcacttggggaggattgg

SEQ ID NO: 814021 - DNA, 20 bp, mouse
ggcaggacattcatcacttg

SEQ ID NO: 814022 - DNA, 20 bp, mouse
gggacattcatcacttgggg

SEQ ID NO: 814023 - DNA, 20 bp, mouse
gaaagagagaaaagctcatt

SEQ ID NO: 814024 - DNA, 20 bp, mouse
gtgtagtgcataaatgtaat

SEQ ID NO: 814025 - DNA, 20 bp, mouse
gcaaataagaatactccctc

SEQ ID NO: 814026 - DNA, 20 bp, mouse
gttgtccggccgattccggg

SEQ ID NO: 814027 - DNA, 20 bp, mouse
gcgcgtgcagctaggagctc

SEQ ID NO: 814028 - DNA, 20 bp, mouse
gtcgctctccctcccacgtg

SEQ ID NO: 814029 - DNA, 20 bp, mouse
gtgggtgcaaggaacggagc

SEQ ID NO: 814030 - DNA, 20 bp, mouse
gcaggcctcccgcccggaat

SEQ ID NO: 814031 - DNA, 20 bp, mouse
gtcccccacacaggtctctt

SEQ ID NO: 814032 - DNA, 20 bp, mouse
gcacgtggggccgagaaagc

SEQ ID NO: 814033 - DNA, 20 bp, mouse
gagagctccgcccagatcgg

SEQ ID NO: 814034 - DNA, 20 bp, mouse
gcctcccgcccggaatcggc

SEQ ID NO: 814035 - DNA, 20 bp, mouse
gttctcggccccacgtggga

SEQ ID NO: 814036 - DNA, 20 bp, mouse
gggcctgagtgacgcacagt

SEQ ID NO: 814037 - DNA, 20 bp, mouse
gcgcacgcgcggccgatggc

SEQ ID NO: 814038 - DNA, 20 bp, mouse
gtccgcctcaggcgcacgcg

SEQ ID NO: 814039 - DNA, 20 bp, mouse
gggccccgtagagactatgg

SEQ ID NO: 814040 - DNA, 20 bp, mouse
ggcttcagaactgtcagcga

SEQ ID NO: 814041 - DNA, 20 bp, mouse
gcggggcgggctctgggcat

SEQ ID NO: 814042 - DNA, 20 bp, mouse
gccgggccccgtagagacta

SEQ ID NO: 814043 - DNA, 20 bp, mouse
gacagaaggcggggctgaac

SEQ ID NO: 814044 - DNA, 20 bp, mouse
gtctctacggggcccgggtt

SEQ ID NO: 814045 - DNA, 20 bp, mouse
gagaactgtcagcgagggag

SEQ ID NO: 814046 - DNA, 20 bp, mouse
gagggaggatggatgagact

SEQ ID NO: 814047 - DNA, 20 bp, mouse
ggacacaaggaatactcaca

SEQ ID NO: 814048 - DNA, 20 bp, mouse
gttctccaattgggaatgaa

SEQ ID NO: 814049 - DNA, 20 bp, mouse
gtgcccaatagaaaaaagac

SEQ ID NO: 814050 - DNA, 20 bp, mouse
gtcaccaagggaggccattt

SEQ ID NO: 814051 - DNA, 20 bp, mouse
gttgcccaaatggcctccct

SEQ ID NO: 814052 - DNA, 20 bp, mouse
gtctgcatctgttgcccaaa

SEQ ID NO: 814053 - DNA, 20 bp, mouse
gtgagtattccttgtgtcag

SEQ ID NO: 814054 - DNA, 20 bp, mouse
gaatgtggtggccttctgaa

SEQ ID NO: 814055 - DNA, 20 bp, mouse
gcaattgggaatgaagggca

SEQ ID NO: 814056 - DNA, 20 bp, mouse
gagggccagcacagtctcag

SEQ ID NO: 814057 - DNA, 20 bp, mouse
gcaccaggacctctgaggaa

SEQ ID NO: 814058 - DNA, 20 bp, mouse
gggatcctacctaaggggaa

SEQ ID NO: 814059 - DNA, 20 bp, mouse
ggccaagggctggcatagga

SEQ ID NO: 814060 - DNA, 20 bp, mouse
gtcaatggatcctacctaag

SEQ ID NO: 814061 - DNA, 20 bp, mouse
ggtctgggccagcctctggg

SEQ ID NO: 814062 - DNA, 20 bp, mouse
gtactctggcctttacacat

SEQ ID NO: 814063 - DNA, 20 bp, mouse
gaaggtctaatcagtagctc

SEQ ID NO: 814064 - DNA, 20 bp, mouse
gtaaggtaaacaggtcccct

SEQ ID NO: 814065 - DNA, 20 bp, mouse
gagccctcatcctgagtcct

SEQ ID NO: 814066 - DNA, 20 bp, mouse
gtcagccaaggctgttgata

SEQ ID NO: 814067 - DNA, 20 bp, mouse
gtccaccctatcaacagcct

SEQ ID NO: 814068 - DNA, 20 bp, mouse
gaggctgcttgctggacaaa

SEQ ID NO: 814069 - DNA, 20 bp, mouse
ggctgttgatagggtggaga

SEQ ID NO: 814070 - DNA, 20 bp, mouse
ggaaagggctgcctcagcca

SEQ ID NO: 814071 - DNA, 20 bp, mouse
gtgtccagcaagcagcctct

SEQ ID NO: 814072 - DNA, 20 bp, mouse
ggccaaggctgttgataggg

SEQ ID NO: 814073 - DNA, 20 bp, mouse
gagaatctggaaaaggactc

SEQ ID NO: 814074 - DNA, 20 bp, mouse
gggaggcagcattcctgcaa

SEQ ID NO: 814075 - DNA, 20 bp, mouse
gaggtgctcctgcacatggg

SEQ ID NO: 814076 - DNA, 20 bp, mouse
gaacccatgcacatccgctg

SEQ ID NO: 814077 - DNA, 20 bp, mouse
ggcccccagcggatgtgcat

SEQ ID NO: 814078 - DNA, 20 bp, mouse
gtagcccaacagctcagtga

SEQ ID NO: 814079 - DNA, 20 bp, mouse
ggggcgctgcccggatacag

SEQ ID NO: 814080 - DNA, 20 bp, mouse
gaagcctcagggaaatcacc

SEQ ID NO: 814081 - DNA, 20 bp, mouse
gcacatccgctgggggccgg

SEQ ID NO: 814082 - DNA, 20 bp, mouse
gggcccctcactgagctgtt

SEQ ID NO: 814083 - DNA, 20 bp, mouse
gagtgaggggccgctgtatc

SEQ ID NO: 814084 - DNA, 20 bp, mouse
gtgttgggctatgtatactc

SEQ ID NO: 814085 - DNA, 20 bp, mouse
gcagcgcccccggcccccag

SEQ ID NO: 814086 - DNA, 20 bp, mouse
ggtaaaggccgcccaagcaa

SEQ ID NO: 814087 - DNA, 20 bp, mouse
gtagactctggccctcacta

SEQ ID NO: 814088 - DNA, 20 bp, mouse
gagagtctacagggtgaaga

SEQ ID NO: 814089 - DNA, 20 bp, mouse
gagaggtgaggtattaactc

SEQ ID NO: 814090 - DNA, 20 bp, mouse
gccagattgcgaaaggggac

SEQ ID NO: 814091 - DNA, 20 bp, mouse
gagtcaggggatgacatgtg

SEQ ID NO: 814092 - DNA, 20 bp, mouse
gaggaagtgaggttcaattc

SEQ ID NO: 814093 - DNA, 20 bp, mouse
gaacgtgccccttgcttggg

SEQ ID NO: 814094 - DNA, 20 bp, mouse
gataaacgtgccccttgctt

SEQ ID NO: 814095 - DNA, 20 bp, mouse
gactctggctccggtggtaa

SEQ ID NO: 814096 - DNA, 20 bp, mouse
gcccccggagcaggtgtgtg

SEQ ID NO: 814097 - DNA, 20 bp, mouse
gtcaccccacagctactgca

SEQ ID NO: 814098 - DNA, 20 bp, mouse
gtaggcggcccccccggagc

SEQ ID NO: 814099 - DNA, 20 bp, mouse
gtgcgagcgtcgagcatcct

SEQ ID NO: 814100 - DNA, 20 bp, mouse
gtgtggggtgacagcgagag

SEQ ID NO: 814101 - DNA, 20 bp, mouse
gaagccctgcagtagctgtg

SEQ ID NO: 814102 - DNA, 20 bp, mouse
gcccctccccgcccgacccc

SEQ ID NO: 814103 - DNA, 20 bp, mouse
gtggggaagggtctgcggct

SEQ ID NO: 814104 - DNA, 20 bp, mouse
gggtctgcggctcggcgccc

SEQ ID NO: 814105 - DNA, 20 bp, mouse
gcttccccacacacctgctc

SEQ ID NO: 814106 - DNA, 20 bp, mouse
ggactcagctgctaggttaa

SEQ ID NO: 814107 - DNA, 20 bp, mouse
gtacgtgggtggggagtcgg

SEQ ID NO: 814108 - DNA, 20 bp, mouse
ggatgaacattcttgaggga

SEQ ID NO: 814109 - DNA, 20 bp, mouse
gtggagtaagctgcctacgt

SEQ ID NO: 814110 - DNA, 20 bp, mouse
gacctggggcatgtcttgtt

SEQ ID NO: 814111 - DNA, 20 bp, mouse
ggcctacgtgggtggggagt

SEQ ID NO: 814112 - DNA, 20 bp, mouse
ggtcaatgaagcggagagaa

SEQ ID NO: 814113 - DNA, 20 bp, mouse
gggcacaaatcagaagacaa

SEQ ID NO: 814114 - DNA, 20 bp, mouse
gagtaagctgcctacgtggg

SEQ ID NO: 814115 - DNA, 20 bp, mouse
ggagcctggtctagaagcag

SEQ ID NO: 814116 - DNA, 20 bp, mouse
ggtgaaaagtctaccccctc

SEQ ID NO: 814117 - DNA, 20 bp, mouse
gggccccataacaaacccga

SEQ ID NO: 814118 - DNA, 20 bp, mouse
gtaagcatggaagccctaaa

SEQ ID NO: 814119 - DNA, 20 bp, mouse
gccccctcgggtttgttatg

SEQ ID NO: 814120 - DNA, 20 bp, mouse
gaggaattgtaggccattta

SEQ ID NO: 814121 - DNA, 20 bp, mouse
gagggcttccatgcttagac

SEQ ID NO: 814122 - DNA, 20 bp, mouse
ggaagttcccccactgactc

SEQ ID NO: 814123 - DNA, 20 bp, mouse
ggtggtctattctgtgtccc

SEQ ID NO: 814124 - DNA, 20 bp, mouse
gcccccactgactctggtgg

SEQ ID NO: 814125 - DNA, 20 bp, mouse
gaaaccaagagaaagtacgt

SEQ ID NO: 814126 - DNA, 20 bp, mouse
gagggtgtgccagcaggcaa

SEQ ID NO: 814127 - DNA, 20 bp, mouse
ggggcttcgggaagcaggta

SEQ ID NO: 814128 - DNA, 20 bp, mouse
gcagataactagagaggagg

SEQ ID NO: 814129 - DNA, 20 bp, mouse
gcctgacccggtccccactg

SEQ ID NO: 814130 - DNA, 20 bp, mouse
gccagcaggcaagggcacaa

SEQ ID NO: 814131 - DNA, 20 bp, mouse
gtactcccgcgccgccgaga

SEQ ID NO: 814132 - DNA, 20 bp, mouse
gcccgcgccgccgagaggga

SEQ ID NO: 814133 - DNA, 20 bp, mouse
gcgggcgtggcccgcgcagg

SEQ ID NO: 814134 - DNA, 20 bp, mouse
gctgggcccctccctctcgg

SEQ ID NO: 814135 - DNA, 20 bp, mouse
gcaaacttggtagcactttc

SEQ ID NO: 814136 - DNA, 20 bp, mouse
ggccgccccaggccgaacgc

SEQ ID NO: 814137 - DNA, 20 bp, mouse
gcgcgcccgcgttcggcctg

SEQ ID NO: 814138 - DNA, 20 bp, mouse
gacggcgtggagaccggcag

SEQ ID NO: 814139 - DNA, 20 bp, mouse
ggaacgcgggcgcggagcgt

SEQ ID NO: 814140 - DNA, 20 bp, mouse
ggaccccgagcgcagggagg

SEQ ID NO: 814141 - DNA, 20 bp, mouse
gcggccggccctcctctcgc

SEQ ID NO: 814142 - DNA, 20 bp, mouse
ggggaaggaccggcgagagg

SEQ ID NO: 814143 - DNA, 20 bp, mouse
gagggcgacggcgtggagac

SEQ ID NO: 814144 - DNA, 20 bp, mouse
ggcgcggagcgtgggagcca

SEQ ID NO: 814145 - DNA, 20 bp, mouse
ggcccgcgttcggcctgggg

SEQ ID NO: 814146 - DNA, 20 bp, mouse
ggggaggtgtacacgtgcag

SEQ ID NO: 814147 - DNA, 20 bp, mouse
gcacgtgtacacctccccta

SEQ ID NO: 814148 - DNA, 20 bp, mouse
gtgtacacgtgcaggggagg

SEQ ID NO: 814149 - DNA, 20 bp, mouse
gtgggcgagcgccctagggg

SEQ ID NO: 814150 - DNA, 20 bp, mouse
ggggaagggagaagcgcact

SEQ ID NO: 814151 - DNA, 20 bp, mouse
gcactgggcgagcgccctag

SEQ ID NO: 814152 - DNA, 20 bp, mouse
gtgagcctctcttgggggaa

SEQ ID NO: 814153 - DNA, 20 bp, mouse
gcccccgcagcgacccaagg

SEQ ID NO: 814154 - DNA, 20 bp, mouse
gggtcccggcgggcgtcggt

SEQ ID NO: 814155 - DNA, 20 bp, mouse
gggtcgctgcggggggtagg

SEQ ID NO: 814156 - DNA, 20 bp, mouse
gagggaagttggaagagtta

SEQ ID NO: 814157 - DNA, 20 bp, mouse
gcaaatctagaggaagtcaa

SEQ ID NO: 814158 - DNA, 20 bp, mouse
gaaacaacggctattgggaa

SEQ ID NO: 814159 - DNA, 20 bp, mouse
ggggggtgtcgcagcttagg

SEQ ID NO: 814160 - DNA, 20 bp, mouse
gccccccgcaggcactgggg

SEQ ID NO: 814161 - DNA, 20 bp, mouse
ggaggggggtgtcgcagctt

SEQ ID NO: 814162 - DNA, 20 bp, mouse
gcatgcgggactctgatggc

SEQ ID NO: 814163 - DNA, 20 bp, mouse
gggactctgatggcaggccc

SEQ ID NO: 814164 - DNA, 20 bp, mouse
gcctccccccgcaggcactg

SEQ ID NO: 814165 - DNA, 20 bp, mouse
gtcctccccagtgcctgcgg

SEQ ID NO: 814166 - DNA, 20 bp, mouse
gcctccggcgcggggttctc

SEQ ID NO: 814167 - DNA, 20 bp, mouse
gcgtgccagccgggaaactg

SEQ ID NO: 814168 - DNA, 20 bp, mouse
gctggcacggggcgtggcgt

SEQ ID NO: 814169 - DNA, 20 bp, mouse
gaggcgcagccatagcgggc

SEQ ID NO: 814170 - DNA, 20 bp, mouse
ggatgcactggggcacgcgt

SEQ ID NO: 814171 - DNA, 20 bp, mouse
gagacggagaaccccgccgg

SEQ ID NO: 814172 - DNA, 20 bp, mouse
gccgcgaggcgcagccatag

SEQ ID NO: 814173 - DNA, 20 bp, mouse
gactggggcacgcgtcgggg

SEQ ID NO: 814174 - DNA, 20 bp, mouse
ggcttgggcgggatgcactg

SEQ ID NO: 814175 - DNA, 20 bp, mouse
ggccacgccccgtgccagcc

SEQ ID NO: 814176 - DNA, 20 bp, mouse
gcccccctacatctgggcgg

SEQ ID NO: 814177 - DNA, 20 bp, mouse
gagggcataagttcagacta

SEQ ID NO: 814178 - DNA, 20 bp, mouse
gtccgcctctggtcttaaag

SEQ ID NO: 814179 - DNA, 20 bp, mouse
gcgccaccggactccagcct

SEQ ID NO: 814180 - DNA, 20 bp, mouse
gaggcggagtctcccaaggc

SEQ ID NO: 814181 - DNA, 20 bp, mouse
gaaagccatgatctggagag

SEQ ID NO: 814182 - DNA, 20 bp, mouse
gactcgctgggtgtaggcat

SEQ ID NO: 814183 - DNA, 20 bp, mouse
ggctttggtctcagttccga

SEQ ID NO: 814184 - DNA, 20 bp, mouse
ggcggcctctttaagaccag

SEQ ID NO: 814185 - DNA, 20 bp, mouse
gtcccaaggctggagtccgg

SEQ ID NO: 814186 - DNA, 20 bp, mouse
gaggcctcatagcccgaact

SEQ ID NO: 814187 - DNA, 20 bp, mouse
gccggaggggcgggaattta

SEQ ID NO: 814188 - DNA, 20 bp, mouse
ggcagccggggaataaggcg

SEQ ID NO: 814189 - DNA, 20 bp, mouse
ggggctaagatgcacgatga

SEQ ID NO: 814190 - DNA, 20 bp, mouse
gcctccggaattggaatcgc

SEQ ID NO: 814191 - DNA, 20 bp, mouse
gttagccccgccttattccc

SEQ ID NO: 814192 - DNA, 20 bp, mouse
gagggcagctccaggatctc

SEQ ID NO: 814193 - DNA, 20 bp, mouse
gtaccgtggcggccagacga

SEQ ID NO: 814194 - DNA, 20 bp, mouse
gtggcggccagacgaaggag

SEQ ID NO: 814195 - DNA, 20 bp, mouse
gcaaaggcagccggggaata

SEQ ID NO: 814196 - DNA, 20 bp, mouse
gggggcagtcgcacctcttg

SEQ ID NO: 814197 - DNA, 20 bp, mouse
gcccgctgatggatcaacca

SEQ ID NO: 814198 - DNA, 20 bp, mouse
gggtgcgcaccgagtggcct

SEQ ID NO: 814199 - DNA, 20 bp, mouse
gacaccagagctccggtcgc

SEQ ID NO: 814200 - DNA, 20 bp, mouse
gcacactgcgcgttggaatc

SEQ ID NO: 814201 - DNA, 20 bp, mouse
gtgccccgccggcccgctga

SEQ ID NO: 814202 - DNA, 20 bp, mouse
ggcagtcgcacctcttgcgg

SEQ ID NO: 814203 - DNA, 20 bp, mouse
gcaaatgagctagagcgcgt

SEQ ID NO: 814204 - DNA, 20 bp, mouse
gcaacgcgcagtgtgagcag

SEQ ID NO: 814205 - DNA, 20 bp, mouse
gtgccaggccttgggacttg

SEQ ID NO: 814206 - DNA, 20 bp, mouse
gctggccgggcccagccaat

SEQ ID NO: 814207 - DNA, 20 bp, mouse
gacccgcgccaggagggcgt

SEQ ID NO: 814208 - DNA, 20 bp, mouse
gccgggcgcgcgtgatctaa

SEQ ID NO: 814209 - DNA, 20 bp, mouse
gcctcctggcgcgggtcatg

SEQ ID NO: 814210 - DNA, 20 bp, mouse
gcaggagggcgtggggaagc

SEQ ID NO: 814211 - DNA, 20 bp, mouse
gcccggggtatacacgacaa

SEQ ID NO: 814212 - DNA, 20 bp, mouse
gtgagctgaagctgcagctt

SEQ ID NO: 814213 - DNA, 20 bp, mouse
gtcagtatgggagctactga

SEQ ID NO: 814214 - DNA, 20 bp, mouse
gtccccacgccctcctggcg

SEQ ID NO: 814215 - DNA, 20 bp, mouse
ggggacgggaagtgagtcgc

SEQ ID NO: 814216 - DNA, 20 bp, mouse
gggagagagagctaaggcgt

SEQ ID NO: 814217 - DNA, 20 bp, mouse
gctggtaaatgcagcgtggg

SEQ ID NO: 814218 - DNA, 20 bp, mouse
gtggctggtaaatgcagcgt

SEQ ID NO: 814219 - DNA, 20 bp, mouse
gtgggtggggcgtcacgtgg

SEQ ID NO: 814220 - DNA, 20 bp, mouse
gaaagcaaggcgcgaatgaa

SEQ ID NO: 814221 - DNA, 20 bp, mouse
gctaggagtgggcggagttt

SEQ ID NO: 814222 - DNA, 20 bp, mouse
gacgccttggttacttccgt

SEQ ID NO: 814223 - DNA, 20 bp, mouse
ggaatcctgtgcaaaaaggt

SEQ ID NO: 814224 - DNA, 20 bp, mouse
gtggggcgtcacgtggaggg

SEQ ID NO: 814225 - DNA, 20 bp, mouse
gaaaccgacggaagtaacca

SEQ ID NO: 814226 - DNA, 20 bp, mouse
gagagggcgggccctcagga

SEQ ID NO: 814227 - DNA, 20 bp, mouse
gtcaaggtgagtcctcccgg

SEQ ID NO: 814228 - DNA, 20 bp, mouse
ggtagggcgggacttcgaga

SEQ ID NO: 814229 - DNA, 20 bp, mouse
gccctcccgaaggctggcca

SEQ ID NO: 814230 - DNA, 20 bp, mouse
gcggaggccacgccctcctg

SEQ ID NO: 814231 - DNA, 20 bp, mouse
ggccagctcggcagtcagcg

SEQ ID NO: 814232 - DNA, 20 bp, mouse
gcccgagggccggacccaca

SEQ ID NO: 814233 - DNA, 20 bp, mouse
gtccttggccagccttcggg

SEQ ID NO: 814234 - DNA, 20 bp, mouse
gggagggcgtggcctccgga

SEQ ID NO: 814235 - DNA, 20 bp, mouse
gcgaaggctggccaaggaaa

SEQ ID NO: 814236 - DNA, 20 bp, mouse
ggaagtgggcgtcacccagg

SEQ ID NO: 814237 - DNA, 20 bp, mouse
ggagccagaccagtaaattc

SEQ ID NO: 814238 - DNA, 20 bp, mouse
gagggggtctgcgacactca

SEQ ID NO: 814239 - DNA, 20 bp, mouse
gcaagagagcaaggcggaag

SEQ ID NO: 814240 - DNA, 20 bp, mouse
gaaaccttcagcaggaaacc

SEQ ID NO: 814241 - DNA, 20 bp, mouse
gactgcaagcctgaatttac

SEQ ID NO: 814242 - DNA, 20 bp, mouse
gggacccgtccaagagagca

SEQ ID NO: 814243 - DNA, 20 bp, mouse
gaggctcgcaaaccttcagc

SEQ ID NO: 814244 - DNA, 20 bp, mouse
gcccgtccaagagagcaagg

SEQ ID NO: 814245 - DNA, 20 bp, mouse
gtctgcgacactcagggtcc

SEQ ID NO: 814246 - DNA, 20 bp, mouse
gtcgctggggagaacagccg

SEQ ID NO: 814247 - DNA, 20 bp, mouse
gaacgcccctgaacatcgat

SEQ ID NO: 814248 - DNA, 20 bp, mouse
gcggaccaatcgatgttcag

SEQ ID NO: 814249 - DNA, 20 bp, mouse
gagactgccctggttcgctg

SEQ ID NO: 814250 - DNA, 20 bp, mouse
gctggggagaacagccgggg

SEQ ID NO: 814251 - DNA, 20 bp, mouse
ggggctaggaacctttgcag

SEQ ID NO: 814252 - DNA, 20 bp, mouse
ggattggtccggatcggtca

SEQ ID NO: 814253 - DNA, 20 bp, mouse
gaacatcgattggtccggat

SEQ ID NO: 814254 - DNA, 20 bp, mouse
gtccgggtcacagactgccc

SEQ ID NO: 814255 - DNA, 20 bp, mouse
ggacccggaagcagtcgttc

SEQ ID NO: 814256 - DNA, 20 bp, mouse
ggctaccagagcgaagtggg

SEQ ID NO: 814257 - DNA, 20 bp, mouse
gcgaagtggggggtgaggac

SEQ ID NO: 814258 - DNA, 20 bp, mouse
gcaagctaccagagcgaagt

SEQ ID NO: 814259 - DNA, 20 bp, mouse
gagtgctgtagcagccaaga

SEQ ID NO: 814260 - DNA, 20 bp, mouse
ggggaatggcttatgatctg

SEQ ID NO: 814261 - DNA, 20 bp, mouse
gctcaccccccacttcgctc

SEQ ID NO: 814262 - DNA, 20 bp, mouse
gtcgtgtcatggaggcacgg

SEQ ID NO: 814263 - DNA, 20 bp, mouse
gggtgccttgagaccatttg

SEQ ID NO: 814264 - DNA, 20 bp, mouse
ggcacgggggcagggactcc

SEQ ID NO: 814265 - DNA, 20 bp, mouse
gctagctggagtcttctgga

SEQ ID NO: 814266 - DNA, 20 bp, mouse
gagaagctgcagagactcct

SEQ ID NO: 814267 - DNA, 20 bp, mouse
gtcactgtccagataccgct

SEQ ID NO: 814268 - DNA, 20 bp, mouse
gctgtggtactacacctccc

SEQ ID NO: 814269 - DNA, 20 bp, mouse
gaaagagcggatggcgaagt

SEQ ID NO: 814270 - DNA, 20 bp, mouse
gtctctgcagcttctcaagg

SEQ ID NO: 814271 - DNA, 20 bp, mouse
gggaagactacagtacctag

SEQ ID NO: 814272 - DNA, 20 bp, mouse
gacgaatcgttgtacgtcga

SEQ ID NO: 814273 - DNA, 20 bp, mouse
gaaggactggagttgggtcg

SEQ ID NO: 814274 - DNA, 20 bp, mouse
gagctgcagagactcctggg

SEQ ID NO: 814275 - DNA, 20 bp, mouse
ggagtctctgcagcttctca

SEQ ID NO: 814276 - DNA, 20 bp, mouse
gtcaacttgctgtggtactg

SEQ ID NO: 814277 - DNA, 20 bp, mouse
gagggatagaacgtgtgcct

SEQ ID NO: 814278 - DNA, 20 bp, mouse
gccactgtccccgaggacaa

SEQ ID NO: 814279 - DNA, 20 bp, mouse
ggagttgggcgtgtaagtca

SEQ ID NO: 814280 - DNA, 20 bp, mouse
gtctcccataaatacctagg

SEQ ID NO: 814281 - DNA, 20 bp, mouse
ggaaagagctgtagttaccc

SEQ ID NO: 814282 - DNA, 20 bp, mouse
gcaggaaagcgtttcctcct

SEQ ID NO: 814283 - DNA, 20 bp, mouse
gggggacagtgggatgctca

SEQ ID NO: 814284 - DNA, 20 bp, mouse
gtttcatcctcaacttgctg

SEQ ID NO: 814285 - DNA, 20 bp, mouse
gtaggtatttatgggagaag

SEQ ID NO: 814286 - DNA, 20 bp, mouse
gggggagtgcacagatgcat

SEQ ID NO: 814287 - DNA, 20 bp, mouse
gccgccctgaagtctacttc

SEQ ID NO: 814288 - DNA, 20 bp, mouse
gcagccggaagtagacttca

SEQ ID NO: 814289 - DNA, 20 bp, mouse
gagggtgtatgcgacctctg

SEQ ID NO: 814290 - DNA, 20 bp, mouse
gtgccctcctccttagtggg

SEQ ID NO: 814291 - DNA, 20 bp, mouse
gagagccccgcccactaagg

SEQ ID NO: 814292 - DNA, 20 bp, mouse
gccccgcccactaaggagga

SEQ ID NO: 814293 - DNA, 20 bp, mouse
ggaaagagccccgcccacta

SEQ ID NO: 814294 - DNA, 20 bp, mouse
ggccccgcccacctgaatgt

SEQ ID NO: 814295 - DNA, 20 bp, mouse
gcgtgggcaggtcggaaaga

SEQ ID NO: 814296 - DNA, 20 bp, mouse
gtagctggctgcttatctaa

SEQ ID NO: 814297 - DNA, 20 bp, mouse
gtagcctgcctggagggcaa

SEQ ID NO: 814298 - DNA, 20 bp, mouse
gggagggcaagggtcacccg

SEQ ID NO: 814299 - DNA, 20 bp, mouse
gtgacccttgccctccaggc

SEQ ID NO: 814300 - DNA, 20 bp, mouse
gacaaagtgcagtaactgtg

SEQ ID NO: 814301 - DNA, 20 bp, mouse
gctccaggcaggctaaaata

SEQ ID NO: 814302 - DNA, 20 bp, mouse
ggtcctgtgcccagttcaca

SEQ ID NO: 814303 - DNA, 20 bp, mouse
ggaccctgtgaactgggcac

SEQ ID NO: 814304 - DNA, 20 bp, mouse
gtgctctgatctagttgctg

SEQ ID NO: 814305 - DNA, 20 bp, mouse
gtgcgactgtgatgtagccg

SEQ ID NO: 814306 - DNA, 20 bp, mouse
gagcctcaggccacccttga

SEQ ID NO: 814307 - DNA, 20 bp, mouse
gaggccacccttgagggagt

SEQ ID NO: 814308 - DNA, 20 bp, mouse
gagaaagcccactccctcaa

SEQ ID NO: 814309 - DNA, 20 bp, mouse
gtggccactaccacagcctc

SEQ ID NO: 814310 - DNA, 20 bp, mouse
gggatgggacggtctgggga

SEQ ID NO: 814311 - DNA, 20 bp, mouse
gcatggggatgggacggtct

SEQ ID NO: 814312 - DNA, 20 bp, mouse
gaagcccactccctcaaggg

SEQ ID NO: 814313 - DNA, 20 bp, mouse
ggacaccgcccataagactc

SEQ ID NO: 814314 - DNA, 20 bp, mouse
gaagactgagaataggtagg

SEQ ID NO: 814315 - DNA, 20 bp, mouse
gaactcggggtcactcggct

SEQ ID NO: 814316 - DNA, 20 bp, mouse
gcgtggggaagcattctagg

SEQ ID NO: 814317 - DNA, 20 bp, mouse
gggcaagcagagtactaaga

SEQ ID NO: 814318 - DNA, 20 bp, mouse
ggctcggccccgcactgaag

SEQ ID NO: 814319 - DNA, 20 bp, mouse
gcccaagtaatgcgggtcgg

SEQ ID NO: 814320 - DNA, 20 bp, mouse
gaagaggctgcggtgcgggt

SEQ ID NO: 814321 - DNA, 20 bp, mouse
gtgacagcgcattcctggga

SEQ ID NO: 814322 - DNA, 20 bp, mouse
gcggaatgaagtgttgggga

SEQ ID NO: 814323 - DNA, 20 bp, mouse
gcccgccgaggccgtcgctg

SEQ ID NO: 814324 - DNA, 20 bp, mouse
gcactgaagaggctgcggtg

SEQ ID NO: 814325 - DNA, 20 bp, mouse
gaagtaatgcgggtcggagg

SEQ ID NO: 814326 - DNA, 20 bp, mouse
gcctgcgctggcgactagga

SEQ ID NO: 814327 - DNA, 20 bp, mouse
gcaggcctgcgctggcgact

SEQ ID NO: 814328 - DNA, 20 bp, mouse
gaggaactgagctccgcaca

SEQ ID NO: 814329 - DNA, 20 bp, mouse
gcctacctggttctggagtc

SEQ ID NO: 814330 - DNA, 20 bp, mouse
ggggttgtctggatcgtcgt

SEQ ID NO: 814331 - DNA, 20 bp, mouse
ggctggcgactaggagggga

SEQ ID NO: 814332 - DNA, 20 bp, mouse
ggaaggggggaatgcaagga

SEQ ID NO: 814333 - DNA, 20 bp, mouse
gggccgccgccccaccccac

SEQ ID NO: 814334 - DNA, 20 bp, mouse
gacagcagtaggtgggtatc

SEQ ID NO: 814335 - DNA, 20 bp, mouse
ggagcatcagccacccaaga

SEQ ID NO: 814336 - DNA, 20 bp, mouse
gggctccgggatcaatgagg

SEQ ID NO: 814337 - DNA, 20 bp, mouse
gaactgagggagccggggat

SEQ ID NO: 814338 - DNA, 20 bp, mouse
gcgaaggcgattcaaactga

SEQ ID NO: 814339 - DNA, 20 bp, mouse
ggatcccggagccgacatac

SEQ ID NO: 814340 - DNA, 20 bp, mouse
gcgcactgccgaccaatcat

SEQ ID NO: 814341 - DNA, 20 bp, mouse
gtccgccccctcattgatcc

SEQ ID NO: 814342 - DNA, 20 bp, mouse
gctgagaggagcgttgtgta

SEQ ID NO: 814343 - DNA, 20 bp, mouse
gaagccggccgactggaggg

SEQ ID NO: 814344 - DNA, 20 bp, mouse
gtaggccggtatgtcggctc

SEQ ID NO: 814345 - DNA, 20 bp, mouse
gcctctgcgcgccgcggggc

SEQ ID NO: 814346 - DNA, 20 bp, mouse
gtaaaggtttgtttgggcat

SEQ ID NO: 814347 - DNA, 20 bp, mouse
gtactgaggactgtgcttat

SEQ ID NO: 814348 - DNA, 20 bp, mouse
gtgctggctgcacttacagt

SEQ ID NO: 814349 - DNA, 20 bp, mouse
gaggcagcaggcactgccta

SEQ ID NO: 814350 - DNA, 20 bp, mouse
gctcagtagccggcagtatc

SEQ ID NO: 814351 - DNA, 20 bp, mouse
gttgagcaacctgatactgc

SEQ ID NO: 814352 - DNA, 20 bp, mouse
gcccaggcactgaatacttg

SEQ ID NO: 814353 - DNA, 20 bp, mouse
gtggctgcacttacagtggg

SEQ ID NO: 814354 - DNA, 20 bp, mouse
ggggttgactgccggggtaa

SEQ ID NO: 814355 - DNA, 20 bp, mouse
gggctaaccccagtgattga

SEQ ID NO: 814356 - DNA, 20 bp, mouse
ggagccggctgctgaaggac

SEQ ID NO: 814357 - DNA, 20 bp, mouse
gctggggtttggagcttctc

SEQ ID NO: 814358 - DNA, 20 bp, mouse
gtgggatctacgaaagaccc

SEQ ID NO: 814359 - DNA, 20 bp, mouse
gggggccacaggcttgtgcg

SEQ ID NO: 814360 - DNA, 20 bp, mouse
gccccagggtcctccaggaa

SEQ ID NO: 814361 - DNA, 20 bp, mouse
gtgcctagcgcctccggagc

SEQ ID NO: 814362 - DNA, 20 bp, mouse
gctccggagccggctgctga

SEQ ID NO: 814363 - DNA, 20 bp, mouse
gaggagagaccagagctggc

SEQ ID NO: 814364 - DNA, 20 bp, mouse
gagatcccatccggggccac

SEQ ID NO: 814365 - DNA, 20 bp, mouse
gacggacttggattgtgagt

SEQ ID NO: 814366 - DNA, 20 bp, mouse
ggaggcgggaacacatcctg

SEQ ID NO: 814367 - DNA, 20 bp, mouse
gggaacacatcctgaggcgg

SEQ ID NO: 814368 - DNA, 20 bp, mouse
ggcgggaacacatcctgagg

SEQ ID NO: 814369 - DNA, 20 bp, mouse
gtaaactagctgtttgcagc

SEQ ID NO: 814370 - DNA, 20 bp, mouse
gactcgagctccgccgcctc

SEQ ID NO: 814371 - DNA, 20 bp, mouse
gtttgaaagccgtgggaagg

SEQ ID NO: 814372 - DNA, 20 bp, mouse
gaaacaaagccgcacccaag

SEQ ID NO: 814373 - DNA, 20 bp, mouse
gggggactaggagattcccc

SEQ ID NO: 814374 - DNA, 20 bp, mouse
gtcacacaaaaactggggcg

SEQ ID NO: 814375 - DNA, 20 bp, mouse
gtgaaaacgtccttctccag

SEQ ID NO: 814376 - DNA, 20 bp, mouse
gaagacgcttccaagatcaa

SEQ ID NO: 814377 - DNA, 20 bp, mouse
gttccaagatcaaaggggaa

SEQ ID NO: 814378 - DNA, 20 bp, mouse
gacgctaggggcgggtcgat

SEQ ID NO: 814379 - DNA, 20 bp, mouse
gagggggcggagacacgtta

SEQ ID NO: 814380 - DNA, 20 bp, mouse
gcctccgaaacgctaggggc

SEQ ID NO: 814381 - DNA, 20 bp, mouse
gagcttgtcattagtcccgt

SEQ ID NO: 814382 - DNA, 20 bp, mouse
ggctctctgggccgcgcctg

SEQ ID NO: 814383 - DNA, 20 bp, mouse
gacgttagggcctacaccaa

SEQ ID NO: 814384 - DNA, 20 bp, mouse
gaccgccaaagtagctagag

SEQ ID NO: 814385 - DNA, 20 bp, mouse
gccagagagcccggggcctc

SEQ ID NO: 814386 - DNA, 20 bp, mouse
gtgccgccgccaagtctcat

SEQ ID NO: 814387 - DNA, 20 bp, mouse
gcccgcacggcgcaaggaag

SEQ ID NO: 814388 - DNA, 20 bp, mouse
gcaaggaaggggcagtgcgg

SEQ ID NO: 814389 - DNA, 20 bp, mouse
gtgggcgcgcctggaaggtg

SEQ ID NO: 814390 - DNA, 20 bp, mouse
gggggcagagcgcaaccaat

SEQ ID NO: 814391 - DNA, 20 bp, mouse
gtcggcctcagcccccgcgg

SEQ ID NO: 814392 - DNA, 20 bp, mouse
ggcgcaaggaaggggcagtg

SEQ ID NO: 814393 - DNA, 20 bp, mouse
ggcgcccagccaatgagact

SEQ ID NO: 814394 - DNA, 20 bp, mouse
gggcgggcgggggtgcctcc

SEQ ID NO: 814395 - DNA, 20 bp, mouse
ggacaaagactgtgcttctc

SEQ ID NO: 814396 - DNA, 20 bp, mouse
gcgcactagcagggccggaa

SEQ ID NO: 814397 - DNA, 20 bp, mouse
gaagggctggggttggacgt

SEQ ID NO: 814398 - DNA, 20 bp, mouse
gagaaaacaccggaaggtga

SEQ ID NO: 814399 - DNA, 20 bp, mouse
gcggggatagggttgctagg

SEQ ID NO: 814400 - DNA, 20 bp, mouse
gtagcagggccggaagggct

SEQ ID NO: 814401 - DNA, 20 bp, mouse
gtaggtcacctgcccgtcca

SEQ ID NO: 814402 - DNA, 20 bp, mouse
gttggacgtgggcggggata

SEQ ID NO: 814403 - DNA, 20 bp, mouse
ggtgaagggacagagtgagt

SEQ ID NO: 814404 - DNA, 20 bp, mouse
gggccctgctagtgcgcagg

SEQ ID NO: 814405 - DNA, 20 bp, mouse
gaggaggattcctactgcgc

SEQ ID NO: 814406 - DNA, 20 bp, mouse
gcaaccagactggggttctc

SEQ ID NO: 814407 - DNA, 20 bp, mouse
gcccagaagcaaccagactg

SEQ ID NO: 814408 - DNA, 20 bp, mouse
gactgctgggaaccgagctg

SEQ ID NO: 814409 - DNA, 20 bp, mouse
gtctgggacccgctcttcct

SEQ ID NO: 814410 - DNA, 20 bp, mouse
gaccaatgagaacgtggtgt

SEQ ID NO: 814411 - DNA, 20 bp, mouse
gtgtccgggcgagaagcggg

SEQ ID NO: 814412 - DNA, 20 bp, mouse
gaacgtggtgtgggcgtgtc

SEQ ID NO: 814413 - DNA, 20 bp, mouse
gaagcgggcggagccgttcc

SEQ ID NO: 814414 - DNA, 20 bp, mouse
ggctccgcccgcttctcgcc

SEQ ID NO: 814415 - DNA, 20 bp, mouse
ggtcgacaccggctccctca

SEQ ID NO: 814416 - DNA, 20 bp, mouse
gcaggcgcgcccaacggcct

SEQ ID NO: 814417 - DNA, 20 bp, mouse
gcaactggaaacacgtgtta

SEQ ID NO: 814418 - DNA, 20 bp, mouse
gctagtgtctgcacctgccg

SEQ ID NO: 814419 - DNA, 20 bp, mouse
gtgcacctgccggggattac

SEQ ID NO: 814420 - DNA, 20 bp, mouse
ggggcgcggagtgctcctgc

SEQ ID NO: 814421 - DNA, 20 bp, mouse
gttaatcaccgggttggtgt

SEQ ID NO: 814422 - DNA, 20 bp, mouse
gcaggtgcagacactagcct

SEQ ID NO: 814423 - DNA, 20 bp, mouse
gcggccttggcgcctggcgt

SEQ ID NO: 814424 - DNA, 20 bp, mouse
gcacgcctgtaatccccggc

SEQ ID NO: 814425 - DNA, 20 bp, mouse
gtgcacagcagcttttgcag

SEQ ID NO: 814426 - DNA, 20 bp, mouse
ggctgcgcgcgctcgccctc

SEQ ID NO: 814427 - DNA, 20 bp, mouse
gccgcagagtggcagccgga

SEQ ID NO: 814428 - DNA, 20 bp, mouse
gctcctagccggagagacta

SEQ ID NO: 814429 - DNA, 20 bp, mouse
gggctccgcagagtggcagc

SEQ ID NO: 814430 - DNA, 20 bp, mouse
ggtgacaggaagcccgcgga

SEQ ID NO: 814431 - DNA, 20 bp, mouse
gagcgcgcgcagctgtgggc

SEQ ID NO: 814432 - DNA, 20 bp, mouse
gcgctcgcgtcttgacccga

SEQ ID NO: 814433 - DNA, 20 bp, mouse
gggcgagcgcgcgcagctgt

SEQ ID NO: 814434 - DNA, 20 bp, mouse
gccacgtgacaggaagcccg

SEQ ID NO: 814435 - DNA, 20 bp, mouse
gacaggaagcccgcggaagg

SEQ ID NO: 814436 - DNA, 20 bp, mouse
gaggccccgaagggctgctc

SEQ ID NO: 814437 - DNA, 20 bp, mouse
gggcgggatcaggccccgaa

SEQ ID NO: 814438 - DNA, 20 bp, mouse
gggctgctcaggataataag

SEQ ID NO: 814439 - DNA, 20 bp, mouse
gaggccgggccgtgacgtcg

SEQ ID NO: 814440 - DNA, 20 bp, mouse
gtgcaacgcggggcgggatc

SEQ ID NO: 814441 - DNA, 20 bp, mouse
gcgcggcgcggcggaggtgt

SEQ ID NO: 814442 - DNA, 20 bp, mouse
gatcccgtacgcctattgga

SEQ ID NO: 814443 - DNA, 20 bp, mouse
ggctgcttggtccttctcag

SEQ ID NO: 814444 - DNA, 20 bp, mouse
ggcggtcgtgcaacgcgggg

SEQ ID NO: 814445 - DNA, 20 bp, mouse
gttatcctgagcagcccttc

SEQ ID NO: 814446 - DNA, 20 bp, mouse
ggggcctgggccatgggatc

SEQ ID NO: 814447 - DNA, 20 bp, mouse
ggccaagctagagtagggga

SEQ ID NO: 814448 - DNA, 20 bp, mouse
gaaagagccaagctagagta

SEQ ID NO: 814449 - DNA, 20 bp, mouse
gcctgggccatgggatctgg

SEQ ID NO: 814450 - DNA, 20 bp, mouse
ggatggaacaggaagtctag

SEQ ID NO: 814451 - DNA, 20 bp, mouse
gggaagtctagaggacaagg

SEQ ID NO: 814452 - DNA, 20 bp, mouse
gttgtgactggaaggacagt

SEQ ID NO: 814453 - DNA, 20 bp, mouse
gccatggcccaggcccgccc

SEQ ID NO: 814454 - DNA, 20 bp, mouse
gaggaaaggtcacttgtgac

SEQ ID NO: 814455 - DNA, 20 bp, mouse
gaaggtcacttgtgactgga

SEQ ID NO: 814456 - DNA, 20 bp, mouse
gccctcggcctcaactaaaa

SEQ ID NO: 814457 - DNA, 20 bp, mouse
gcccaggcctggcattggga

SEQ ID NO: 814458 - DNA, 20 bp, mouse
ggcctcaactaaaacgggtt

SEQ ID NO: 814459 - DNA, 20 bp, mouse
gggacagcacccatccccta

SEQ ID NO: 814460 - DNA, 20 bp, mouse
gcggctcccaggcctggcat

SEQ ID NO: 814461 - DNA, 20 bp, mouse
gcgatggcagcgcctcccat

SEQ ID NO: 814462 - DNA, 20 bp, mouse
ggggttaactctcctcgccc

SEQ ID NO: 814463 - DNA, 20 bp, mouse
ggggaggcgctgccatcggc

SEQ ID NO: 814464 - DNA, 20 bp, mouse
ggagccggctcttcgctgat

SEQ ID NO: 814465 - DNA, 20 bp, mouse
gcctggcattgggagggtgc

SEQ ID NO: 814466 - DNA, 20 bp, mouse
gaagggccgtggggcaggac

SEQ ID NO: 814467 - DNA, 20 bp, mouse
gagcgcaggttaagtggcga

SEQ ID NO: 814468 - DNA, 20 bp, mouse
ggacctgctgatcagcgcat

SEQ ID NO: 814469 - DNA, 20 bp, mouse
gaatgcttgctggtgcgtag

SEQ ID NO: 814470 - DNA, 20 bp, mouse
gccggccagcgcaggttaag

SEQ ID NO: 814471 - DNA, 20 bp, mouse
gttgctggtgcgtagtgggt

SEQ ID NO: 814472 - DNA, 20 bp, mouse
ggcaggacgggaatgcttgc

SEQ ID NO: 814473 - DNA, 20 bp, mouse
ggtcaagagccggccagcgc

SEQ ID NO: 814474 - DNA, 20 bp, mouse
gcagggggctcttcaatgaa

SEQ ID NO: 814475 - DNA, 20 bp, mouse
gctgggcgatcacgtgaaag

SEQ ID NO: 814476 - DNA, 20 bp, mouse
ggggaataatcttggagatt

SEQ ID NO: 814477 - DNA, 20 bp, mouse
ggggtggtgaccatctgcaa

SEQ ID NO: 814478 - DNA, 20 bp, mouse
gggaagttgtactacctaga

SEQ ID NO: 814479 - DNA, 20 bp, mouse
gcgggggcgagagcagacat

SEQ ID NO: 814480 - DNA, 20 bp, mouse
gagggacagtcaggtccctg

SEQ ID NO: 814481 - DNA, 20 bp, mouse
gcgaaggctggggatctggt

SEQ ID NO: 814482 - DNA, 20 bp, mouse
gagcagacattggggtgtcc

SEQ ID NO: 814483 - DNA, 20 bp, mouse
gctggggagagtcagcagaa

SEQ ID NO: 814484 - DNA, 20 bp, mouse
ggagctgcaagagcaggaga

SEQ ID NO: 814485 - DNA, 20 bp, mouse
ggtctgctctcgcccccgtc

SEQ ID NO: 814486 - DNA, 20 bp, mouse
gtccggtgacatagcgtatc

SEQ ID NO: 814487 - DNA, 20 bp, mouse
ggctctgcaactgagaatca

SEQ ID NO: 814488 - DNA, 20 bp, mouse
gagatctcatcgccacctgg

SEQ ID NO: 814489 - DNA, 20 bp, mouse
gtggctgcacttaaaactgc

SEQ ID NO: 814490 - DNA, 20 bp, mouse
gaaggaccgccgggcagtag

SEQ ID NO: 814491 - DNA, 20 bp, mouse
gggcgatgagatctcgtcgc

SEQ ID NO: 814492 - DNA, 20 bp, mouse
ggccggatacgctatgtcac

SEQ ID NO: 814493 - DNA, 20 bp, mouse
gaaaaaaagcgccgagcaga

SEQ ID NO: 814494 - DNA, 20 bp, mouse
gacgagatctcatcgccacc

SEQ ID NO: 814495 - DNA, 20 bp, mouse
gacgctatgtcaccggaagc

SEQ ID NO: 814496 - DNA, 20 bp, mouse
ggggtgaggctgctctgaaa

SEQ ID NO: 814497 - DNA, 20 bp, mouse
ggatgcagcaggcagagcga

SEQ ID NO: 814498 - DNA, 20 bp, mouse
gcaggcagagcgagggtgga

SEQ ID NO: 814499 - DNA, 20 bp, mouse
gtgcagcagctttgagaaac

SEQ ID NO: 814500 - DNA, 20 bp, mouse
gtgagggtcttcatcaggaa

SEQ ID NO: 814501 - DNA, 20 bp, mouse
gcctgtagccaactggggtg

SEQ ID NO: 814502 - DNA, 20 bp, mouse
ggagagacctgtagccaact

SEQ ID NO: 814503 - DNA, 20 bp, mouse
gtggagggtggttgccagtt

SEQ ID NO: 814504 - DNA, 20 bp, mouse
gggggtagggtgctagtgga

SEQ ID NO: 814505 - DNA, 20 bp, mouse
ggcagcaggcagagcgaggg

SEQ ID NO: 814506 - DNA, 20 bp, mouse
ggcgcaagggcggaactggg

SEQ ID NO: 814507 - DNA, 20 bp, mouse
ggcggcgcaagggcggaact

SEQ ID NO: 814508 - DNA, 20 bp, mouse
gtgggaggagggccgcgagt

SEQ ID NO: 814509 - DNA, 20 bp, mouse
gccacgcggccgcggcgcaa

SEQ ID NO: 814510 - DNA, 20 bp, mouse
ggccccgcgctccttgcggc

SEQ ID NO: 814511 - DNA, 20 bp, mouse
gcgacccgcccacgcggccg

SEQ ID NO: 814512 - DNA, 20 bp, mouse
gcggccggtcggccacgggg

SEQ ID NO: 814513 - DNA, 20 bp, mouse
gcgcaaggagcgcggggccg

SEQ ID NO: 814514 - DNA, 20 bp, mouse
ggaggagggccgcgagtggg

SEQ ID NO: 814515 - DNA, 20 bp, mouse
gcccggacaacactcctgca

SEQ ID NO: 814516 - DNA, 20 bp, mouse
gaagacgcttccgggagcta

SEQ ID NO: 814517 - DNA, 20 bp, mouse
ggggccccttgatgcttcaa

SEQ ID NO: 814518 - DNA, 20 bp, mouse
gacgccgagccggggatata

SEQ ID NO: 814519 - DNA, 20 bp, mouse
gcccccaatgccctctgcaa

SEQ ID NO: 814520 - DNA, 20 bp, mouse
gcgagccggggatataagga

SEQ ID NO: 814521 - DNA, 20 bp, mouse
gcgggagctaggggtgggtt

SEQ ID NO: 814522 - DNA, 20 bp, mouse
ggggccccctctctgtcccc

SEQ ID NO: 814523 - DNA, 20 bp, mouse
ggatggagaggggctgtcca

SEQ ID NO: 814524 - DNA, 20 bp, mouse
gttagcctggggacgacctg

SEQ ID NO: 814525 - DNA, 20 bp, mouse
gcagagacacggtgttccct

SEQ ID NO: 814526 - DNA, 20 bp, mouse
ggccggccccggcgtaggaa

SEQ ID NO: 814527 - DNA, 20 bp, mouse
gaaaacgcgtcacgcgaccg

SEQ ID NO: 814528 - DNA, 20 bp, mouse
ggaagggcggggagcgcgtc

SEQ ID NO: 814529 - DNA, 20 bp, mouse
gggagcgcgtctgggcgccg

SEQ ID NO: 814530 - DNA, 20 bp, mouse
gcgcgcttgagggccggttc

SEQ ID NO: 814531 - DNA, 20 bp, mouse
gccccggcgtaggaagggcg

SEQ ID NO: 814532 - DNA, 20 bp, mouse
gggcccgcggggcgcgaggc

SEQ ID NO: 814533 - DNA, 20 bp, mouse
ggcgaggccggccccggcgt

SEQ ID NO: 814534 - DNA, 20 bp, mouse
gggaggctcggagcaggaag

SEQ ID NO: 814535 - DNA, 20 bp, mouse
gagggccggttccggcgcgg

SEQ ID NO: 814536 - DNA, 20 bp, mouse
gagctcacaagcatgatggt

SEQ ID NO: 814537 - DNA, 20 bp, mouse
gagccatgggaactaggatg

SEQ ID NO: 814538 - DNA, 20 bp, mouse
gttcctgagccatgggaact

SEQ ID NO: 814539 - DNA, 20 bp, mouse
gctgaacagagacagaactt

SEQ ID NO: 814540 - DNA, 20 bp, mouse
gaactaggatgtggacactg

SEQ ID NO: 814541 - DNA, 20 bp, mouse
gggagagttccggagatgag

SEQ ID NO: 814542 - DNA, 20 bp, mouse
gaccattcggaggaccacac

SEQ ID NO: 814543 - DNA, 20 bp, mouse
gagttccggagatgagtggt

SEQ ID NO: 814544 - DNA, 20 bp, mouse
gtgccttgggagccggagtc

SEQ ID NO: 814545 - DNA, 20 bp, mouse
gctcctgactccggctccca

SEQ ID NO: 814546 - DNA, 20 bp, mouse
gaggggcgaggctacatgga

SEQ ID NO: 814547 - DNA, 20 bp, mouse
ggcgaggctacatggagggg

SEQ ID NO: 814548 - DNA, 20 bp, mouse
gctacatggaggggcggccc

SEQ ID NO: 814549 - DNA, 20 bp, mouse
gggcctctccgccttgtacc

SEQ ID NO: 814550 - DNA, 20 bp, mouse
gcgctggagacggcaagaat

SEQ ID NO: 814551 - DNA, 20 bp, mouse
gcaccgggtacaaggcggag

SEQ ID NO: 814552 - DNA, 20 bp, mouse
ggggtataggcggagctaag

SEQ ID NO: 814553 - DNA, 20 bp, mouse
gcgggccctaagctcgaggc

SEQ ID NO: 814554 - DNA, 20 bp, mouse
gtaaccaatcgctaaaggaa

SEQ ID NO: 814555 - DNA, 20 bp, mouse
gcgcgcgggccctaagctcg

SEQ ID NO: 814556 - DNA, 20 bp, mouse
gagggatagggtgggatcaa

SEQ ID NO: 814557 - DNA, 20 bp, mouse
gcgactctctcaggtatctg

SEQ ID NO: 814558 - DNA, 20 bp, mouse
ggagcagcgcctcagggata

SEQ ID NO: 814559 - DNA, 20 bp, mouse
ggatcaaaggcgactctctc

SEQ ID NO: 814560 - DNA, 20 bp, mouse
gagcgcctcagggatagggt

SEQ ID NO: 814561 - DNA, 20 bp, mouse
gagagaagatagacaggcga

SEQ ID NO: 814562 - DNA, 20 bp, mouse
ggaagatagacaggcgaagg

SEQ ID NO: 814563 - DNA, 20 bp, mouse
gcacacccgagcagcgcctc

SEQ ID NO: 814564 - DNA, 20 bp, mouse
gaatgcaataggcaagaccg

SEQ ID NO: 814565 - DNA, 20 bp, mouse
gcctaagaaaaacgtgatgc

SEQ ID NO: 814566 - DNA, 20 bp, mouse
gcttctagagggaggctcaa

SEQ ID NO: 814567 - DNA, 20 bp, mouse
gggactggaggatagcgcgg

SEQ ID NO: 814568 - DNA, 20 bp, mouse
gtgctaggggacttcgtaat

SEQ ID NO: 814569 - DNA, 20 bp, mouse
gaagaggcgcttctagaggg

SEQ ID NO: 814570 - DNA, 20 bp, mouse
ggccgaagaggcgcttctag

SEQ ID NO: 814571 - DNA, 20 bp, mouse
gtcttcggccatcttggatt

SEQ ID NO: 814572 - DNA, 20 bp, mouse
gacgcaaacgagtcctgcta

SEQ ID NO: 814573 - DNA, 20 bp, mouse
gggaagatgcgaaccgagtc

SEQ ID NO: 814574 - DNA, 20 bp, mouse
gtcccagcgacagccagact

SEQ ID NO: 814575 - DNA, 20 bp, mouse
gcaggactcgtttgcgtggt

SEQ ID NO: 814576 - DNA, 20 bp, mouse
ggaagaggcctgagaagtaa

SEQ ID NO: 814577 - DNA, 20 bp, mouse
gacagaaccctggatctctg

SEQ ID NO: 814578 - DNA, 20 bp, mouse
gggcccagtgcccagacctc

SEQ ID NO: 814579 - DNA, 20 bp, mouse
ggaagtaatggaatctctag

SEQ ID NO: 814580 - DNA, 20 bp, mouse
gtaatggaatctctagaggc

SEQ ID NO: 814581 - DNA, 20 bp, mouse
ggtctcagggtcacagacgt

SEQ ID NO: 814582 - DNA, 20 bp, mouse
gcccccagaagtgactcacc

SEQ ID NO: 814583 - DNA, 20 bp, mouse
gcccaggtccttgctcacta

SEQ ID NO: 814584 - DNA, 20 bp, mouse
gagtttggcgagcctctcga

SEQ ID NO: 814585 - DNA, 20 bp, mouse
ggttggctcactctcgctaa

SEQ ID NO: 814586 - DNA, 20 bp, mouse
ggggccggagagcctagttc

SEQ ID NO: 814587 - DNA, 20 bp, mouse
ggaaggggaaggatgcttgt

SEQ ID NO: 814588 - DNA, 20 bp, mouse
gtcaagggaaccctgtgtga

SEQ ID NO: 814589 - DNA, 20 bp, mouse
gggagacaaagctaggctga

SEQ ID NO: 814590 - DNA, 20 bp, mouse
gctccctagcaaccaactca

SEQ ID NO: 814591 - DNA, 20 bp, mouse
gcctggtcccaggagatgca

SEQ ID NO: 814592 - DNA, 20 bp, mouse
gcagcagccacgagtgaccg

SEQ ID NO: 814593 - DNA, 20 bp, mouse
gatgcggcttaggatggaag

SEQ ID NO: 814594 - DNA, 20 bp, mouse
gagggtgagcacctgggtga

SEQ ID NO: 814595 - DNA, 20 bp, mouse
gggtgtgtcccctgctagca

SEQ ID NO: 814596 - DNA, 20 bp, mouse
gcccggcctaatctgagtct

SEQ ID NO: 814597 - DNA, 20 bp, mouse
gcatcgggaaagcatgtgag

SEQ ID NO: 814598 - DNA, 20 bp, mouse
ggaaagcatgtgagaggtca

SEQ ID NO: 814599 - DNA, 20 bp, mouse
gtggcaccccgaaccttgtg

SEQ ID NO: 814600 - DNA, 20 bp, mouse
ggtgccaatgacccgagcat

SEQ ID NO: 814601 - DNA, 20 bp, mouse
gtggctcgaaggccccctgt

SEQ ID NO: 814602 - DNA, 20 bp, mouse
gcctccagccctaaaaggga

SEQ ID NO: 814603 - DNA, 20 bp, mouse
gtggaggtgacatgtaaagt

SEQ ID NO: 814604 - DNA, 20 bp, mouse
ggtcacctccagccctaaaa

SEQ ID NO: 814605 - DNA, 20 bp, mouse
gatagaggcagacttaggtc

SEQ ID NO: 814606 - DNA, 20 bp, mouse
gggcggggccccagtctctt

SEQ ID NO: 814607 - DNA, 20 bp, mouse
gtctcttaggggaattcctt

SEQ ID NO: 814608 - DNA, 20 bp, mouse
gctcagaagctgtactgttg

SEQ ID NO: 814609 - DNA, 20 bp, mouse
gctcgggctgtcagcgaatg

SEQ ID NO: 814610 - DNA, 20 bp, mouse
gcgacaaggtgtgatccagg

SEQ ID NO: 814611 - DNA, 20 bp, mouse
ggtacagcttctgagtcttc

SEQ ID NO: 814612 - DNA, 20 bp, mouse
gaaggcacagcacttcgaca

SEQ ID NO: 814613 - DNA, 20 bp, mouse
gaaacagggaccggttcctc

SEQ ID NO: 814614 - DNA, 20 bp, mouse
ggctgtcagcgaatgagggc

SEQ ID NO: 814615 - DNA, 20 bp, mouse
gttcatcaaaagacggaaag

SEQ ID NO: 814616 - DNA, 20 bp, mouse
gcaggtgccaagggcaagcg

SEQ ID NO: 814617 - DNA, 20 bp, mouse
gagggcaagcgaggctgaca

SEQ ID NO: 814618 - DNA, 20 bp, mouse
ggctgacagggcgacctccc

SEQ ID NO: 814619 - DNA, 20 bp, mouse
ggcaaggagtacctacaact

SEQ ID NO: 814620 - DNA, 20 bp, mouse
gtggcctgatcaggtgccaa

SEQ ID NO: 814621 - DNA, 20 bp, mouse
gtgtcagggaatagcgagga

SEQ ID NO: 814622 - DNA, 20 bp, mouse
gttgcccttggcacctgatc

SEQ ID NO: 814623 - DNA, 20 bp, mouse
gcaaggcgggcgcccagtac

SEQ ID NO: 814624 - DNA, 20 bp, mouse
gtgagtggctcgggacacgc

SEQ ID NO: 814625 - DNA, 20 bp, mouse
gtggaccctaagaagtgtca

SEQ ID NO: 814626 - DNA, 20 bp, mouse
gcacgcgctatctacagccc

SEQ ID NO: 814627 - DNA, 20 bp, mouse
gacaagagtcagtaccggac

SEQ ID NO: 814628 - DNA, 20 bp, mouse
gccggaccggacgcagtaca

SEQ ID NO: 814629 - DNA, 20 bp, mouse
ggtgcgacaagagtcagtac

SEQ ID NO: 814630 - DNA, 20 bp, mouse
gttaagctgaagttatacgg

SEQ ID NO: 814631 - DNA, 20 bp, mouse
gaggcagggccctggtcacg

SEQ ID NO: 814632 - DNA, 20 bp, mouse
gaggggggcggggagactag

SEQ ID NO: 814633 - DNA, 20 bp, mouse
gggcgcgaaagcttctgatg

SEQ ID NO: 814634 - DNA, 20 bp, mouse
gacttcagcttaagtcaggg

SEQ ID NO: 814635 - DNA, 20 bp, mouse
gcctgcctcgctcagggtct

SEQ ID NO: 814636 - DNA, 20 bp, mouse
gcctcagagctgtctgggtt

SEQ ID NO: 814637 - DNA, 20 bp, mouse
gggtagcagagtcgcagccg

SEQ ID NO: 814638 - DNA, 20 bp, mouse
gctgcagggtcgcccagcca

SEQ ID NO: 814639 - DNA, 20 bp, mouse
gaagagctgtctcacctcgt

SEQ ID NO: 814640 - DNA, 20 bp, mouse
gctctgcaggctgaaattga

SEQ ID NO: 814641 - DNA, 20 bp, mouse
gatagctgccttggaaaccg

SEQ ID NO: 814642 - DNA, 20 bp, mouse
gcacctcgtaggccttgcag

SEQ ID NO: 814643 - DNA, 20 bp, mouse
gtccctgcaaagcctgggcc

SEQ ID NO: 814644 - DNA, 20 bp, mouse
gaggctgaaattgagggcgg

SEQ ID NO: 814645 - DNA, 20 bp, mouse
gcggcctccctgcaaagcct

SEQ ID NO: 814646 - DNA, 20 bp, mouse
gtcaccggaagcttggtatg

SEQ ID NO: 814647 - DNA, 20 bp, mouse
gtcttccgagaatgcttcta

SEQ ID NO: 814648 - DNA, 20 bp, mouse
gtctagagggtcatagtctc

SEQ ID NO: 814649 - DNA, 20 bp, mouse
gaatgcttctaaggtctaga

SEQ ID NO: 814650 - DNA, 20 bp, mouse
gtgcgccaggcctctctcac

SEQ ID NO: 814651 - DNA, 20 bp, mouse
gttcccggagcctctctcaa

SEQ ID NO: 814652 - DNA, 20 bp, mouse
gggcaaggggctcgtgtctc

SEQ ID NO: 814653 - DNA, 20 bp, mouse
gtgcccccataccaagcttc

SEQ ID NO: 814654 - DNA, 20 bp, mouse
ggcactgccaggagagaacc

SEQ ID NO: 814655 - DNA, 20 bp, mouse
gaccaagcttccggtgagag

SEQ ID NO: 814656 - DNA, 20 bp, mouse
gcacctctgaggctgatctg

SEQ ID NO: 814657 - DNA, 20 bp, mouse
gcaacaggacccagaaaagg

SEQ ID NO: 814658 - DNA, 20 bp, mouse
ggcacccacccctctgtaaa

SEQ ID NO: 814659 - DNA, 20 bp, mouse
gtcttgttatgaggaagagg

SEQ ID NO: 814660 - DNA, 20 bp, mouse
gacagaggggtgggtgctcc

SEQ ID NO: 814661 - DNA, 20 bp, mouse
ggctcaccccaagtgtctag

SEQ ID NO: 814662 - DNA, 20 bp, mouse
gtccaggggcagcagtttgc

SEQ ID NO: 814663 - DNA, 20 bp, mouse
gcaagttgtactataatcag

SEQ ID NO: 814664 - DNA, 20 bp, mouse
gccaaaagatagctgagtca

SEQ ID NO: 814665 - DNA, 20 bp, mouse
ggttacctgagctgctaatc

SEQ ID NO: 814666 - DNA, 20 bp, mouse
gggtcactggaagtgactgt

SEQ ID NO: 814667 - DNA, 20 bp, mouse
gagctaagaaaggatatctg

SEQ ID NO: 814668 - DNA, 20 bp, mouse
gcgacagggtgcatggtgaa

SEQ ID NO: 814669 - DNA, 20 bp, mouse
ggcgaagcgatgagggtcac

SEQ ID NO: 814670 - DNA, 20 bp, mouse
gctgagaagcgaagcgatga

SEQ ID NO: 814671 - DNA, 20 bp, mouse
ggctctgcctaagaacctgg

SEQ ID NO: 814672 - DNA, 20 bp, mouse
gacctccttgggtcaggctt

SEQ ID NO: 814673 - DNA, 20 bp, mouse
ggaggatgttgaggaaccat

SEQ ID NO: 814674 - DNA, 20 bp, mouse
gtagagtacctccttgggtc

SEQ ID NO: 814675 - DNA, 20 bp, mouse
gggtccaatccggacctgta

SEQ ID NO: 814676 - DNA, 20 bp, mouse
ggcaacgtgctactgatagt

SEQ ID NO: 814677 - DNA, 20 bp, mouse
ggccatgcactgcccgggac

SEQ ID NO: 814678 - DNA, 20 bp, mouse
ggtggccgtgccagggacgg

SEQ ID NO: 814679 - DNA, 20 bp, mouse
ggtgcgcgccgcagagtccc

SEQ ID NO: 814680 - DNA, 20 bp, mouse
gctgccgtgcacgtgaccgt

SEQ ID NO: 814681 - DNA, 20 bp, mouse
gcggaaccgcttaccctgac

SEQ ID NO: 814682 - DNA, 20 bp, mouse
ggctcccagaagcggccact

SEQ ID NO: 814683 - DNA, 20 bp, mouse
gcaggtggccgtgccaggga

SEQ ID NO: 814684 - DNA, 20 bp, mouse
gtggtgagtgccgccgtccc

SEQ ID NO: 814685 - DNA, 20 bp, mouse
gtcagcatgggccagtggcg

SEQ ID NO: 814686 - DNA, 20 bp, mouse
ggggccccggtgattggcca

SEQ ID NO: 814687 - DNA, 20 bp, mouse
gtggcagtcacgtggcgtgg

SEQ ID NO: 814688 - DNA, 20 bp, mouse
gggcccctggccaatcaccg

SEQ ID NO: 814689 - DNA, 20 bp, mouse
ggcgtggcagtcacgtggcg

SEQ ID NO: 814690 - DNA, 20 bp, mouse
gagcccacgcagtagatcgc

SEQ ID NO: 814691 - DNA, 20 bp, mouse
gactcacagacattgacgtg

SEQ ID NO: 814692 - DNA, 20 bp, mouse
gatcccgcgatctactgcgt

SEQ ID NO: 814693 - DNA, 20 bp, mouse
gccgcggcgtggcagtcacg

SEQ ID NO: 814694 - DNA, 20 bp, mouse
gcagtagatcgcgggatcca

SEQ ID NO: 814695 - DNA, 20 bp, mouse
ggtaaaggtgcggaagtaac

SEQ ID NO: 814696 - DNA, 20 bp, mouse
gctgctgatcagagactcaa

SEQ ID NO: 814697 - DNA, 20 bp, mouse
gtcaaaggtcaagaccatat

SEQ ID NO: 814698 - DNA, 20 bp, mouse
gtgtgacagagagatttcat

SEQ ID NO: 814699 - DNA, 20 bp, mouse
gtcacctagcggcttagatg

SEQ ID NO: 814700 - DNA, 20 bp, mouse
gaacccccatctaagccgct

SEQ ID NO: 814701 - DNA, 20 bp, mouse
gtgggtggttcaatctcagc

SEQ ID NO: 814702 - DNA, 20 bp, mouse
gcaatctcagcaggaagttg

SEQ ID NO: 814703 - DNA, 20 bp, mouse
gaagttctgcggagtcatcc

SEQ ID NO: 814704 - DNA, 20 bp, mouse
gttgcagctactaagttctg

SEQ ID NO: 814705 - DNA, 20 bp, mouse
gtccctgacatttcacctag

SEQ ID NO: 814706 - DNA, 20 bp, mouse
gttgaagcacccaggttcct

SEQ ID NO: 814707 - DNA, 20 bp, mouse
ggaacctgggtgcttcaaca

SEQ ID NO: 814708 - DNA, 20 bp, mouse
gtctcacagggacaccacga

SEQ ID NO: 814709 - DNA, 20 bp, mouse
gcaggagggtaagattcgtg

SEQ ID NO: 814710 - DNA, 20 bp, mouse
gtcttaatggttgtctcaca

SEQ ID NO: 814711 - DNA, 20 bp, mouse
ggacaccttggtggaaggga

SEQ ID NO: 814712 - DNA, 20 bp, mouse
gagaaggattgaagttaatg

SEQ ID NO: 814713 - DNA, 20 bp, mouse
gtctgacagccaaggaacct

SEQ ID NO: 814714 - DNA, 20 bp, mouse
gcggtgggacgttttattta

SEQ ID NO: 814715 - DNA, 20 bp, mouse
gaacctcctgattttctagc

SEQ ID NO: 814716 - DNA, 20 bp, mouse
gtacaaggacacgggtgact

SEQ ID NO: 814717 - DNA, 20 bp, mouse
gccagggaagccggaatccc

SEQ ID NO: 814718 - DNA, 20 bp, mouse
gacaaactcgccagccacga

SEQ ID NO: 814719 - DNA, 20 bp, mouse
ggcactgggaaaactagatt

SEQ ID NO: 814720 - DNA, 20 bp, mouse
ggcctcgcagcccgggattc

SEQ ID NO: 814721 - DNA, 20 bp, mouse
gcacccccacccccgtactg

SEQ ID NO: 814722 - DNA, 20 bp, mouse
ggtcagctctcatgccgtcg

SEQ ID NO: 814723 - DNA, 20 bp, mouse
ggagcattcaatagaaagtg

SEQ ID NO: 814724 - DNA, 20 bp, mouse
ggaggagatctgtggagacc

SEQ ID NO: 814725 - DNA, 20 bp, mouse
gcccgggctgcgaggcgagg

SEQ ID NO: 814726 - DNA, 20 bp, mouse
gtaggccgacgggaaggaaa

SEQ ID NO: 814727 - DNA, 20 bp, mouse
gtctgctgagactggaggac

SEQ ID NO: 814728 - DNA, 20 bp, mouse
ggggacagaagctaggccga

SEQ ID NO: 814729 - DNA, 20 bp, mouse
gtctctgggcggggcgagcc

SEQ ID NO: 814730 - DNA, 20 bp, mouse
gtggagcattctgctgagac

SEQ ID NO: 814731 - DNA, 20 bp, mouse
ggggcacagaggcataacat

SEQ ID NO: 814732 - DNA, 20 bp, mouse
ggactggaggactggaacga

SEQ ID NO: 814733 - DNA, 20 bp, mouse
gagaagctaggccgacggga

SEQ ID NO: 814734 - DNA, 20 bp, mouse
gccgcccagagagtatgact

SEQ ID NO: 814735 - DNA, 20 bp, mouse
gagcattctgctgagactgg

SEQ ID NO: 814736 - DNA, 20 bp, mouse
gtctgcttgtaggagacgct

SEQ ID NO: 814737 - DNA, 20 bp, mouse
ggggctatgctaatgaaacc

SEQ ID NO: 814738 - DNA, 20 bp, mouse
gctgggcgtgtggtggaagt

SEQ ID NO: 814739 - DNA, 20 bp, mouse
gtaaagggaattactggcaa

SEQ ID NO: 814740 - DNA, 20 bp, mouse
gtatacctcacaaagaagtg

SEQ ID NO: 814741 - DNA, 20 bp, mouse
gggacttcgcttctgcttgt

SEQ ID NO: 814742 - DNA, 20 bp, mouse
gggaaaagtaataggttcgg

SEQ ID NO: 814743 - DNA, 20 bp, mouse
gtggttaatgaggtagttct

SEQ ID NO: 814744 - DNA, 20 bp, mouse
gcttgtaggagacgctgggc

SEQ ID NO: 814745 - DNA, 20 bp, mouse
ggcgaagtcccgactgccag

SEQ ID NO: 814746 - DNA, 20 bp, mouse
gtgtaggcatgggtggatgt

SEQ ID NO: 814747 - DNA, 20 bp, mouse
gagagtatggagaactacta

SEQ ID NO: 814748 - DNA, 20 bp, mouse
ggcatctgggccgaggagaa

SEQ ID NO: 814749 - DNA, 20 bp, mouse
gcctacaccgagcaggagaa

SEQ ID NO: 814750 - DNA, 20 bp, mouse
gtcctgctcggtgtaggcat

SEQ ID NO: 814751 - DNA, 20 bp, mouse
gggtggatgtgggttcttac

SEQ ID NO: 814752 - DNA, 20 bp, mouse
gaccctgcattcccacctag

SEQ ID NO: 814753 - DNA, 20 bp, mouse
gagcagggaccccttctcct

SEQ ID NO: 814754 - DNA, 20 bp, mouse
gagaagatccgggtatgtgg

SEQ ID NO: 814755 - DNA, 20 bp, mouse
gacgggcgaggatggcatct

SEQ ID NO: 814756 - DNA, 20 bp, mouse
gagaagccggggctcactgg

SEQ ID NO: 814757 - DNA, 20 bp, mouse
ggattggctcggaggggaag

SEQ ID NO: 814758 - DNA, 20 bp, mouse
gcagactcccccaaggcagt

SEQ ID NO: 814759 - DNA, 20 bp, mouse
gtaggaaaaggagataaggg

SEQ ID NO: 814760 - DNA, 20 bp, mouse
gcccccaaggcagtcggcag

SEQ ID NO: 814761 - DNA, 20 bp, mouse
gaaggcagtcggcagaggag

SEQ ID NO: 814762 - DNA, 20 bp, mouse
gaatgtgacctattgtcttc

SEQ ID NO: 814763 - DNA, 20 bp, mouse
gaaagggcatgaatggtgtc

SEQ ID NO: 814764 - DNA, 20 bp, mouse
gccacagagcccaacccctc

SEQ ID NO: 814765 - DNA, 20 bp, mouse
gccgagccaatcagaagccg

SEQ ID NO: 814766 - DNA, 20 bp, mouse
ggtgccaagcaaaacagcca

SEQ ID NO: 814767 - DNA, 20 bp, mouse
ggggaataggggtaacgtat

SEQ ID NO: 814768 - DNA, 20 bp, mouse
ggacagtgatgtcacaggtg

SEQ ID NO: 814769 - DNA, 20 bp, mouse
gtggcggaaagacttgacag

SEQ ID NO: 814770 - DNA, 20 bp, mouse
ggtcactcccgctgaacacc

SEQ ID NO: 814771 - DNA, 20 bp, mouse
gtggagtgccagccacgtgc

SEQ ID NO: 814772 - DNA, 20 bp, mouse
gggaaagacttgacagagga

SEQ ID NO: 814773 - DNA, 20 bp, mouse
gatgatacacacactcgccc

SEQ ID NO: 814774 - DNA, 20 bp, mouse
gtcgccctggctgttttgct

SEQ ID NO: 814775 - DNA, 20 bp, mouse
gttcgatggccttccttctc

SEQ ID NO: 814776 - DNA, 20 bp, mouse
gaccaatggcagctgcgggt

SEQ ID NO: 814777 - DNA, 20 bp, mouse
ggggagagggctggtctaga

SEQ ID NO: 814778 - DNA, 20 bp, mouse
gacagggtagaggcactcag

SEQ ID NO: 814779 - DNA, 20 bp, mouse
ggctggaagcaggccctggc

SEQ ID NO: 814780 - DNA, 20 bp, mouse
gccttcccacagctctcctt

SEQ ID NO: 814781 - DNA, 20 bp, mouse
gtgcttccagcgccactcga

SEQ ID NO: 814782 - DNA, 20 bp, mouse
ggtggtggtgatgaagatct

SEQ ID NO: 814783 - DNA, 20 bp, mouse
gtcttcccaaggagagctgt

SEQ ID NO: 814784 - DNA, 20 bp, mouse
gcccagccttggccttcgag

SEQ ID NO: 814785 - DNA, 20 bp, mouse
gctagtccgcagggtgggca

SEQ ID NO: 814786 - DNA, 20 bp, mouse
gggggcgggacctgatacta

SEQ ID NO: 814787 - DNA, 20 bp, mouse
gttggagggctgaagctcaa

SEQ ID NO: 814788 - DNA, 20 bp, mouse
ggatactaaggtacacgctg

SEQ ID NO: 814789 - DNA, 20 bp, mouse
gaagggtggagcttgaccgt

SEQ ID NO: 814790 - DNA, 20 bp, mouse
gtagccaatcccaggccttg

SEQ ID NO: 814791 - DNA, 20 bp, mouse
ggagggatgaggcgacatta

SEQ ID NO: 814792 - DNA, 20 bp, mouse
gctaaggtacacgctggggg

SEQ ID NO: 814793 - DNA, 20 bp, mouse
gtggaaaaagaacgcggcca

SEQ ID NO: 814794 - DNA, 20 bp, mouse
ggccacgtggtcagtgcttg

SEQ ID NO: 814795 - DNA, 20 bp, mouse
gccgcctcaaggcctgggat

SEQ ID NO: 814796 - DNA, 20 bp, mouse
gccacccaggctgacaggag

SEQ ID NO: 814797 - DNA, 20 bp, mouse
gcccacgttgaaaaggtcaa

SEQ ID NO: 814798 - DNA, 20 bp, mouse
gcgcacgaggagccccacga

SEQ ID NO: 814799 - DNA, 20 bp, mouse
gctgtcagcctgggtggccc

SEQ ID NO: 814800 - DNA, 20 bp, mouse
gtggggctcctcgtgcgctc

SEQ ID NO: 814801 - DNA, 20 bp, mouse
gcaaacagcccacgttgaaa

SEQ ID NO: 814802 - DNA, 20 bp, mouse
gtgggaccaaggagtggagg

SEQ ID NO: 814803 - DNA, 20 bp, mouse
gacaagtgctgtggcatcct

SEQ ID NO: 814804 - DNA, 20 bp, mouse
gggtcaaaggcgtggtgctg

SEQ ID NO: 814805 - DNA, 20 bp, mouse
gggctcctcgtgcgctcagg

SEQ ID NO: 814806 - DNA, 20 bp, mouse
gtggagggtaggcacctctt

SEQ ID NO: 814807 - DNA, 20 bp, mouse
gcatgaaaatgcacagctgt

SEQ ID NO: 814808 - DNA, 20 bp, mouse
gggtgacaaagaacaatcaa

SEQ ID NO: 814809 - DNA, 20 bp, mouse
gagccagccaatagcttagg

SEQ ID NO: 814810 - DNA, 20 bp, mouse
gcagcctgtcgggtccaaag

SEQ ID NO: 814811 - DNA, 20 bp, mouse
gccaggagtgcgagagtcgg

SEQ ID NO: 814812 - DNA, 20 bp, mouse
gataagccagccaatagctt

SEQ ID NO: 814813 - DNA, 20 bp, mouse
gccacaccgcagaagctggg

SEQ ID NO: 814814 - DNA, 20 bp, mouse
gaccccccagggaatgggtg

SEQ ID NO: 814815 - DNA, 20 bp, mouse
ggccaccagcggtcaaattc

SEQ ID NO: 814816 - DNA, 20 bp, mouse
ggatcccctggtccaggaaa

SEQ ID NO: 814817 - DNA, 20 bp, mouse
gaaggagcactgcctgacca

SEQ ID NO: 814818 - DNA, 20 bp, mouse
gcggaggcagtggtgcgcgc

SEQ ID NO: 814819 - DNA, 20 bp, mouse
gctgaacaagctagactact

SEQ ID NO: 814820 - DNA, 20 bp, mouse
gggctccagggatcatacta

SEQ ID NO: 814821 - DNA, 20 bp, mouse
gccagcgggccgggcggctg

SEQ ID NO: 814822 - DNA, 20 bp, mouse
gtcagcctaccactcccagc

SEQ ID NO: 814823 - DNA, 20 bp, mouse
gtgctgaagttgccctggtc

SEQ ID NO: 814824 - DNA, 20 bp, mouse
gaggactgacaaggtggatc

SEQ ID NO: 814825 - DNA, 20 bp, mouse
gtggtgcgcgcagggctgga

SEQ ID NO: 814826 - DNA, 20 bp, mouse
gaatgctggccctggagaag

SEQ ID NO: 814827 - DNA, 20 bp, mouse
gaggccgggtgatccggctg

SEQ ID NO: 814828 - DNA, 20 bp, mouse
gcggggcaggccgggtgatc

SEQ ID NO: 814829 - DNA, 20 bp, mouse
ggatggctggtggtgtccaa

SEQ ID NO: 814830 - DNA, 20 bp, mouse
gagcccccagccggatcacc

SEQ ID NO: 814831 - DNA, 20 bp, mouse
gtggtggtgtccaagggggc

SEQ ID NO: 814832 - DNA, 20 bp, mouse
gtcccatacctaacaggaga

SEQ ID NO: 814833 - DNA, 20 bp, mouse
gcacgtggctagagtcaggc

SEQ ID NO: 814834 - DNA, 20 bp, mouse
gtgttaggtatgggatatga

SEQ ID NO: 814835 - DNA, 20 bp, mouse
gattgtctccatctcctgtt

SEQ ID NO: 814836 - DNA, 20 bp, mouse
gacactgggaggaagatcgc

SEQ ID NO: 814837 - DNA, 20 bp, mouse
gggagccaacaggaaaccgt

SEQ ID NO: 814838 - DNA, 20 bp, mouse
gcccctgccggagtacggga

SEQ ID NO: 814839 - DNA, 20 bp, mouse
ggactggagcttgtgtagga

SEQ ID NO: 814840 - DNA, 20 bp, mouse
gcaagcccacggtttcctgt

SEQ ID NO: 814841 - DNA, 20 bp, mouse
gggagcttgtgtaggaggga

SEQ ID NO: 814842 - DNA, 20 bp, mouse
gagcaccaggggatctactt

SEQ ID NO: 814843 - DNA, 20 bp, mouse
ggggtggcgctggctgcaga

SEQ ID NO: 814844 - DNA, 20 bp, mouse
ggactgggagagggtggcgc

SEQ ID NO: 814845 - DNA, 20 bp, mouse
gcagaggcctctcatcacgt

SEQ ID NO: 814846 - DNA, 20 bp, mouse
ggagctcagggccaccgcag

SEQ ID NO: 814847 - DNA, 20 bp, mouse
gtagcctggctcactcaagc

SEQ ID NO: 814848 - DNA, 20 bp, mouse
gacagagggcaggaccacag

SEQ ID NO: 814849 - DNA, 20 bp, mouse
ggacccggcttgagtgagcc

SEQ ID NO: 814850 - DNA, 20 bp, mouse
gctcagggccaccgcagggg

SEQ ID NO: 814851 - DNA, 20 bp, mouse
gggggtccccgcccctgcgg

SEQ ID NO: 814852 - DNA, 20 bp, mouse
ggcggtggccctgagctctg

SEQ ID NO: 814853 - DNA, 20 bp, mouse
gaaccaaggtggcttcccaa

SEQ ID NO: 814854 - DNA, 20 bp, mouse
ggtaactcgggtgtcactct

SEQ ID NO: 814855 - DNA, 20 bp, mouse
gaaagcatgatggggtagcc

SEQ ID NO: 814856 - DNA, 20 bp, mouse
gtagaggtggcccttttcag

SEQ ID NO: 814857 - DNA, 20 bp, mouse
gcagatttcataaccttacc

SEQ ID NO: 814858 - DNA, 20 bp, mouse
gggtggagggactaggaaat

SEQ ID NO: 814859 - DNA, 20 bp, mouse
gaaagaagctcctcccctag

SEQ ID NO: 814860 - DNA, 20 bp, mouse
ggtggtcttttattgtccta

SEQ ID NO: 814861 - DNA, 20 bp, mouse
ggcattcttggtcctttact

SEQ ID NO: 814862 - DNA, 20 bp, mouse
gaggtggttaccactgaaaa

SEQ ID NO: 814863 - DNA, 20 bp, mouse
ggaagctcctcccctagagg

SEQ ID NO: 814864 - DNA, 20 bp, mouse
gcttgtcatagttaagccat

SEQ ID NO: 814865 - DNA, 20 bp, mouse
gaaagggccacctctagggg

SEQ ID NO: 814866 - DNA, 20 bp, mouse
ggaagtaggcgattttgcaa

SEQ ID NO: 814867 - DNA, 20 bp, mouse
gttcctgtggacggtgttgg

SEQ ID NO: 814868 - DNA, 20 bp, mouse
gggtgggcgtgctcaaaaag

SEQ ID NO: 814869 - DNA, 20 bp, mouse
gtacggggaaagacaataaa

SEQ ID NO: 814870 - DNA, 20 bp, mouse
ggatcctcggggtaaagtgg

SEQ ID NO: 814871 - DNA, 20 bp, mouse
gatccctggaaagaggaatg

SEQ ID NO: 814872 - DNA, 20 bp, mouse
gcaaaatcgcctacttcctg

SEQ ID NO: 814873 - DNA, 20 bp, mouse
gagcccccaacaccgtccac

SEQ ID NO: 814874 - DNA, 20 bp, mouse
gaacaccgtccacaggaagt

SEQ ID NO: 814875 - DNA, 20 bp, mouse
gggactacagagaaaacggc

SEQ ID NO: 814876 - DNA, 20 bp, mouse
gcctacgcctagggccgcca

SEQ ID NO: 814877 - DNA, 20 bp, mouse
gggagccggtgaactgttga

SEQ ID NO: 814878 - DNA, 20 bp, mouse
gcctcccaggctcgcgtgtc

SEQ ID NO: 814879 - DNA, 20 bp, mouse
ggggccagcgcggaaattag

SEQ ID NO: 814880 - DNA, 20 bp, mouse
gtccgggtgacagttgggaa

SEQ ID NO: 814881 - DNA, 20 bp, mouse
ggggctgctggcttcgatgg

SEQ ID NO: 814882 - DNA, 20 bp, mouse
gcgtgggcggggttcggaga

SEQ ID NO: 814883 - DNA, 20 bp, mouse
gaggcgtagggtctctgact

SEQ ID NO: 814884 - DNA, 20 bp, mouse
gcgtggaatgtgtaggagtt

SEQ ID NO: 814885 - DNA, 20 bp, mouse
gtcgaagccagcagccctgg

SEQ ID NO: 814886 - DNA, 20 bp, mouse
ggggccaaatccctcagtac

SEQ ID NO: 814887 - DNA, 20 bp, mouse
gacctccagaaggaggcaga

SEQ ID NO: 814888 - DNA, 20 bp, mouse
gaggcatcctcctaggcact

SEQ ID NO: 814889 - DNA, 20 bp, mouse
ggccacacacctccagaagg

SEQ ID NO: 814890 - DNA, 20 bp, mouse
gagaggtgtggggtgctcgg

SEQ ID NO: 814891 - DNA, 20 bp, mouse
gtatttgctgagggtctctg

SEQ ID NO: 814892 - DNA, 20 bp, mouse
ggtcacagctggtcaccctg

SEQ ID NO: 814893 - DNA, 20 bp, mouse
gctgtgggtgaaacccagac

SEQ ID NO: 814894 - DNA, 20 bp, mouse
ggcctccttctggaggtgtg

SEQ ID NO: 814895 - DNA, 20 bp, mouse
gaaagccacacacctccaga

SEQ ID NO: 814896 - DNA, 20 bp, mouse
gcacgggtccggaatctctg

SEQ ID NO: 814897 - DNA, 20 bp, mouse
gcccgtgcctaaggagaaga

SEQ ID NO: 814898 - DNA, 20 bp, mouse
ggtccggaatctctggggaa

SEQ ID NO: 814899 - DNA, 20 bp, mouse
gggcgcggaagcaagctaga

SEQ ID NO: 814900 - DNA, 20 bp, mouse
gccaccagcgaggcggagtc

SEQ ID NO: 814901 - DNA, 20 bp, mouse
gctggagagcgggcgtccgg

SEQ ID NO: 814902 - DNA, 20 bp, mouse
ggcggaacctaataccctaa

SEQ ID NO: 814903 - DNA, 20 bp, mouse
gaggactgcgcaggagggaa

SEQ ID NO: 814904 - DNA, 20 bp, mouse
gtctccagactccgcctcgc

SEQ ID NO: 814905 - DNA, 20 bp, mouse
gaagacgggtgcgaggcgaa

SEQ ID NO: 814906 - DNA, 20 bp, mouse
gaacccggaagcgctgaacg

SEQ ID NO: 814907 - DNA, 20 bp, mouse
gggcaccctagggaatgagg

SEQ ID NO: 814908 - DNA, 20 bp, mouse
ggtcctgcctgactccctat

SEQ ID NO: 814909 - DNA, 20 bp, mouse
ggaggcggtggataccaata

SEQ ID NO: 814910 - DNA, 20 bp, mouse
gtggggcaccctagggaatg

SEQ ID NO: 814911 - DNA, 20 bp, mouse
gactgccgtaggccaggaag

SEQ ID NO: 814912 - DNA, 20 bp, mouse
gtgctctggaagtattgagg

SEQ ID NO: 814913 - DNA, 20 bp, mouse
gcgcgcctcttcctggccta

SEQ ID NO: 814914 - DNA, 20 bp, mouse
gcgcctgcagttactgccgt

SEQ ID NO: 814915 - DNA, 20 bp, mouse
gagggaggagtcggcaaacc

SEQ ID NO: 814916 - DNA, 20 bp, mouse
gcctgtcccacggaacccca

SEQ ID NO: 814917 - DNA, 20 bp, mouse
gtaggcagagtgtgcacagt

SEQ ID NO: 814918 - DNA, 20 bp, mouse
gcaagagtatgcctgtccca

SEQ ID NO: 814919 - DNA, 20 bp, mouse
gtcccacggaaccccatgga

SEQ ID NO: 814920 - DNA, 20 bp, mouse
gaccttccatggggttccgt

SEQ ID NO: 814921 - DNA, 20 bp, mouse
gccccactgaccagggagta

SEQ ID NO: 814922 - DNA, 20 bp, mouse
gtcctgacgcgggactgtca

SEQ ID NO: 814923 - DNA, 20 bp, mouse
ggtcccagctaagaccatct

SEQ ID NO: 814924 - DNA, 20 bp, mouse
gactcttggtcccctataca

SEQ ID NO: 814925 - DNA, 20 bp, mouse
gaatgcatggggtcctgacg

SEQ ID NO: 814926 - DNA, 20 bp, mouse
gacaccccgcccactccaca

SEQ ID NO: 814927 - DNA, 20 bp, mouse
gagcgcaggtagagattggg

SEQ ID NO: 814928 - DNA, 20 bp, mouse
ggagagcgcaggtagagatt

SEQ ID NO: 814929 - DNA, 20 bp, mouse
gaggggcggggccacgaggg

SEQ ID NO: 814930 - DNA, 20 bp, mouse
gcccactggaggccggacct

SEQ ID NO: 814931 - DNA, 20 bp, mouse
gcggggtcatatagagtgag

SEQ ID NO: 814932 - DNA, 20 bp, mouse
gtacagagtggatgtagcgt

SEQ ID NO: 814933 - DNA, 20 bp, mouse
gggccaggggcggagagcgc

SEQ ID NO: 814934 - DNA, 20 bp, mouse
gagagtgggcagttcagagg

SEQ ID NO: 814935 - DNA, 20 bp, mouse
gactggaggccggacctggg

SEQ ID NO: 814936 - DNA, 20 bp, mouse
gggtgtgcggggcacccgtt

SEQ ID NO: 814937 - DNA, 20 bp, mouse
gggcctggggagcacgtccg

SEQ ID NO: 814938 - DNA, 20 bp, mouse
gtccggggcgggactctgag

SEQ ID NO: 814939 - DNA, 20 bp, mouse
gtctgagaggcgtggttctg

SEQ ID NO: 814940 - DNA, 20 bp, mouse
gcgggtgccccgcacaccct

SEQ ID NO: 814941 - DNA, 20 bp, mouse
gtaagccagcgctaggactc

SEQ ID NO: 814942 - DNA, 20 bp, mouse
ggaagccagagtcctagcgc

SEQ ID NO: 814943 - DNA, 20 bp, mouse
ggaggcgtggttctgtgggg

SEQ ID NO: 814944 - DNA, 20 bp, mouse
gctggggagcacgtccgggg

SEQ ID NO: 814945 - DNA, 20 bp, mouse
gacacagcgagcgcccccaa

SEQ ID NO: 814946 - DNA, 20 bp, mouse
ggggcaggccagtgaagggt

SEQ ID NO: 814947 - DNA, 20 bp, mouse
gactgtggcccacccttcac

SEQ ID NO: 814948 - DNA, 20 bp, mouse
ggagcccagcagtataagga

SEQ ID NO: 814949 - DNA, 20 bp, mouse
gtatgggtgagacctggcac

SEQ ID NO: 814950 - DNA, 20 bp, mouse
gtgtgaatatgggtgagacc

SEQ ID NO: 814951 - DNA, 20 bp, mouse
gtgtagagtgacagtttctc

SEQ ID NO: 814952 - DNA, 20 bp, mouse
gatgtcagaggtgctgagtg

SEQ ID NO: 814953 - DNA, 20 bp, mouse
gtccaagccagtgttcctgt

SEQ ID NO: 814954 - DNA, 20 bp, mouse
gtgggggtgggggtacacat

SEQ ID NO: 814955 - DNA, 20 bp, mouse
gagcagggccgccacagcat

SEQ ID NO: 814956 - DNA, 20 bp, mouse
ggggactcaaaggcagtgtt

SEQ ID NO: 814957 - DNA, 20 bp, mouse
gattccaagcagcctatcac

SEQ ID NO: 814958 - DNA, 20 bp, mouse
gtctaaaggcaaaacaatcc

SEQ ID NO: 814959 - DNA, 20 bp, mouse
gcaaaacaatcctggagaca

SEQ ID NO: 814960 - DNA, 20 bp, mouse
gcaagaggttaaaaagactt

SEQ ID NO: 814961 - DNA, 20 bp, mouse
gaagcagcctatcacaggca

SEQ ID NO: 814962 - DNA, 20 bp, mouse
ggatgcgagttggaagcaag

SEQ ID NO: 814963 - DNA, 20 bp, mouse
gacagcctgtgtcaccgaaa

SEQ ID NO: 814964 - DNA, 20 bp, mouse
gttgcccttttcggtgacac

SEQ ID NO: 814965 - DNA, 20 bp, mouse
gagtgtttggccaccggcta

SEQ ID NO: 814966 - DNA, 20 bp, mouse
gtgtgggcggggttaagcgg

SEQ ID NO: 814967 - DNA, 20 bp, mouse
gggacccacctccccctggt

SEQ ID NO: 814968 - DNA, 20 bp, mouse
gtaaccccgcccacagaggg

SEQ ID NO: 814969 - DNA, 20 bp, mouse
gagggaggtggcagcgtcca

SEQ ID NO: 814970 - DNA, 20 bp, mouse
ggggttaagcggaggtcccc

SEQ ID NO: 814971 - DNA, 20 bp, mouse
gacgctgccacctccctctg

SEQ ID NO: 814972 - DNA, 20 bp, mouse
gttgcccgcttggaggggag

SEQ ID NO: 814973 - DNA, 20 bp, mouse
gaatgggacccacctccccc

SEQ ID NO: 814974 - DNA, 20 bp, mouse
gccacctccctctgtgggcg

SEQ ID NO: 814975 - DNA, 20 bp, mouse
gtcacagcaggctaaggatc

SEQ ID NO: 814976 - DNA, 20 bp, mouse
gtgctcaagccacaagtcat

SEQ ID NO: 814977 - DNA, 20 bp, mouse
gctgaaaatgggtctgtctc

SEQ ID NO: 814978 - DNA, 20 bp, mouse
ggggtaaagggtgtattgat

SEQ ID NO: 814979 - DNA, 20 bp, mouse
ggtggcttgagcacagtagc

SEQ ID NO: 814980 - DNA, 20 bp, mouse
gagtgtggcagaaatgggac

SEQ ID NO: 814981 - DNA, 20 bp, mouse
gtggaagccgaggcatgcag

SEQ ID NO: 814982 - DNA, 20 bp, mouse
gcttccacaaaagaccccac

SEQ ID NO: 814983 - DNA, 20 bp, mouse
gcgaggcatgcagtggtgtc

SEQ ID NO: 814984 - DNA, 20 bp, mouse
gccacaagtcattggggtaa

SEQ ID NO: 814985 - DNA, 20 bp, mouse
ggggtcttttgtggaagccg

SEQ ID NO: 814986 - DNA, 20 bp, mouse
gtggttgattgcaaaggaca

SEQ ID NO: 814987 - DNA, 20 bp, mouse
gggaggatgtggtaaaaagc

SEQ ID NO: 814988 - DNA, 20 bp, mouse
gaaaacgcatccaggtgtga

SEQ ID NO: 814989 - DNA, 20 bp, mouse
ggcggtgaagatcagataag

SEQ ID NO: 814990 - DNA, 20 bp, mouse
gtgatggtggttgattgcaa

SEQ ID NO: 814991 - DNA, 20 bp, mouse
ggctgtcggctcttgaaaag

SEQ ID NO: 814992 - DNA, 20 bp, mouse
gttgcaaaggacaggggctg

SEQ ID NO: 814993 - DNA, 20 bp, mouse
gtcggctcttgaaaagggga

SEQ ID NO: 814994 - DNA, 20 bp, mouse
ggtcacaggttaaggattgg

SEQ ID NO: 814995 - DNA, 20 bp, mouse
gaatttggaagcgctttgag

SEQ ID NO: 814996 - DNA, 20 bp, mouse
gaagcaggcgggaaccttag

SEQ ID NO: 814997 - DNA, 20 bp, mouse
ggccctcccccgcctgggac

SEQ ID NO: 814998 - DNA, 20 bp, mouse
gcagcactagggctaggggt

SEQ ID NO: 814999 - DNA, 20 bp, mouse
gcccacgaggagatgatcca

SEQ ID NO: 815000 - DNA, 20 bp, mouse
gaaccagtgtagagactatg

SEQ ID NO: 815001 - DNA, 20 bp, mouse
gccagccagcactagggcta

SEQ ID NO: 815002 - DNA, 20 bp, mouse
gggccaatgggtgttgtgaa

SEQ ID NO: 815003 - DNA, 20 bp, mouse
gcagagatgcgtggaaagaa

SEQ ID NO: 815004 - DNA, 20 bp, mouse
gacacccgggacctgacatt

SEQ ID NO: 815005 - DNA, 20 bp, mouse
ggccactccgggttacttcg

SEQ ID NO: 815006 - DNA, 20 bp, mouse
gcgtccctgtgtcccctgga

SEQ ID NO: 815007 - DNA, 20 bp, mouse
ggggagctggcgattctgtc

SEQ ID NO: 815008 - DNA, 20 bp, mouse
ggaatcgccagctccctcca

SEQ ID NO: 815009 - DNA, 20 bp, mouse
ggaggggcaggagcgggtag

SEQ ID NO: 815010 - DNA, 20 bp, mouse
gagctccctccaggggacac

SEQ ID NO: 815011 - DNA, 20 bp, mouse
gtgggactgaggatgagcgt

SEQ ID NO: 815012 - DNA, 20 bp, mouse
gtcagtcccaagagcacttg

SEQ ID NO: 815013 - DNA, 20 bp, mouse
ggttgaggtgagccggggag

SEQ ID NO: 815014 - DNA, 20 bp, mouse
gctcaaccgcaagtgctctt

SEQ ID NO: 815015 - DNA, 20 bp, mouse
gtcttggagaagagagccct

SEQ ID NO: 815016 - DNA, 20 bp, mouse
gcacgcgatgggacacgccc

SEQ ID NO: 815017 - DNA, 20 bp, mouse
ggcctcaaggcgcacgcgat

SEQ ID NO: 815018 - DNA, 20 bp, mouse
ggaaacccgcttctagggca

SEQ ID NO: 815019 - DNA, 20 bp, mouse
gtcggatgcagggtgcgatc

SEQ ID NO: 815020 - DNA, 20 bp, mouse
gccggggaaacccgcttcta

SEQ ID NO: 815021 - DNA, 20 bp, mouse
ggcggccctgccctagaagc

SEQ ID NO: 815022 - DNA, 20 bp, mouse
gcgcgtgcgccttgaggcgc

SEQ ID NO: 815023 - DNA, 20 bp, mouse
gtggcgaaagggtgctcagg

SEQ ID NO: 815024 - DNA, 20 bp, mouse
ggaggcgctggattctgccg

SEQ ID NO: 815025 - DNA, 20 bp, mouse
gaggcgtgcggctgtctcat

SEQ ID NO: 815026 - DNA, 20 bp, mouse
gttgccacaaggaggggaaa

SEQ ID NO: 815027 - DNA, 20 bp, mouse
ggctgctggttggaagttgt

SEQ ID NO: 815028 - DNA, 20 bp, mouse
gtggcatccatgtgaggggt

SEQ ID NO: 815029 - DNA, 20 bp, mouse
gtccctgttgccacaaggag

SEQ ID NO: 815030 - DNA, 20 bp, mouse
gcagcctccctgttgccaca

SEQ ID NO: 815031 - DNA, 20 bp, mouse
gtcccctccttgtggcaaca

SEQ ID NO: 815032 - DNA, 20 bp, mouse
gggcaagaggatcatatggg

SEQ ID NO: 815033 - DNA, 20 bp, mouse
gggtcccctgaaatgagctc

SEQ ID NO: 815034 - DNA, 20 bp, mouse
ggaggggaaagggcactggt

SEQ ID NO: 815035 - DNA, 20 bp, mouse
ggagggcaagaggatcatat

SEQ ID NO: 815036 - DNA, 20 bp, mouse
gcggccgcggggagtcctac

SEQ ID NO: 815037 - DNA, 20 bp, mouse
gacgccagcgacccaagtaa

SEQ ID NO: 815038 - DNA, 20 bp, mouse
ggcccctgggagtcctcacc

SEQ ID NO: 815039 - DNA, 20 bp, mouse
gagccggttgcaaagctcaa

SEQ ID NO: 815040 - DNA, 20 bp, mouse
gaagctgaggggtcccagag

SEQ ID NO: 815041 - DNA, 20 bp, mouse
gacccaagtaaaggtttgca

SEQ ID NO: 815042 - DNA, 20 bp, mouse
ggtacaaggcggggcgtgag

SEQ ID NO: 815043 - DNA, 20 bp, mouse
ggggcgtgagagagtgaccg

SEQ ID NO: 815044 - DNA, 20 bp, mouse
gtccctgcaaacctttactt

SEQ ID NO: 815045 - DNA, 20 bp, mouse
gagcggcggcgaaggaagcg

SEQ ID NO: 815046 - DNA, 20 bp, mouse
gagaatcataaatggagggg

SEQ ID NO: 815047 - DNA, 20 bp, mouse
ggaagctgtctcagttgctt

SEQ ID NO: 815048 - DNA, 20 bp, mouse
gatgacttgggcgtgactcc

SEQ ID NO: 815049 - DNA, 20 bp, mouse
gaatcaaggccaaaggttgt

SEQ ID NO: 815050 - DNA, 20 bp, mouse
gagagagaatcataaatgga

SEQ ID NO: 815051 - DNA, 20 bp, mouse
gtctgtgatcatgcctgaac

SEQ ID NO: 815052 - DNA, 20 bp, mouse
gattcttaggaggtttctct

SEQ ID NO: 815053 - DNA, 20 bp, mouse
gttctccttagaagctggat

SEQ ID NO: 815054 - DNA, 20 bp, mouse
gcctctctgcaggtcctaac

SEQ ID NO: 815055 - DNA, 20 bp, mouse
gcacggccaagacttgcccg

SEQ ID NO: 815056 - DNA, 20 bp, mouse
gcacatgccaccacactcct

SEQ ID NO: 815057 - DNA, 20 bp, mouse
gaacggccgaagatgggaga

SEQ ID NO: 815058 - DNA, 20 bp, mouse
gaatgattaacggccgaaga

SEQ ID NO: 815059 - DNA, 20 bp, mouse
ggtggcatctgcctattaag

SEQ ID NO: 815060 - DNA, 20 bp, mouse
gacaagactgccaaggtcac

SEQ ID NO: 815061 - DNA, 20 bp, mouse
ggcttgccatctcccatctt

SEQ ID NO: 815062 - DNA, 20 bp, mouse
ggaaagcacacccaggagtg

SEQ ID NO: 815063 - DNA, 20 bp, mouse
gtgccctggaatttctgtcc

SEQ ID NO: 815064 - DNA, 20 bp, mouse
gggcccgaatgggcagtgat

SEQ ID NO: 815065 - DNA, 20 bp, mouse
gtgctcagacccctagtcaa

SEQ ID NO: 815066 - DNA, 20 bp, mouse
gccggcgtcccgcccttcct

SEQ ID NO: 815067 - DNA, 20 bp, mouse
gggacgccggggctgtcgtg

SEQ ID NO: 815068 - DNA, 20 bp, mouse
ggggaggcgagccgggcctg

SEQ ID NO: 815069 - DNA, 20 bp, mouse
ggggccgcggccgggtgcag

SEQ ID NO: 815070 - DNA, 20 bp, mouse
gaatagaggccgaggaaggg

SEQ ID NO: 815071 - DNA, 20 bp, mouse
gccgccgcgctagccaatag

SEQ ID NO: 815072 - DNA, 20 bp, mouse
gcgggtccgtgtgaaaacgg

SEQ ID NO: 815073 - DNA, 20 bp, mouse
ggcccggctcgcctccccat

SEQ ID NO: 815074 - DNA, 20 bp, mouse
ggccaatagaggccgaggaa

SEQ ID NO: 815075 - DNA, 20 bp, mouse
gcaggaggggcggggagtgt

SEQ ID NO: 815076 - DNA, 20 bp, mouse
gagtggccccagagtcgcaa

SEQ ID NO: 815077 - DNA, 20 bp, mouse
gtcgcaaaggccacctcccg

SEQ ID NO: 815078 - DNA, 20 bp, mouse
gtagcccaggggtgaaggcg

SEQ ID NO: 815079 - DNA, 20 bp, mouse
gtcgcgggaccagagtctgc

SEQ ID NO: 815080 - DNA, 20 bp, mouse
gtcgccgcccaagcttgatt

SEQ ID NO: 815081 - DNA, 20 bp, mouse
gtctccagcccagacctaga

SEQ ID NO: 815082 - DNA, 20 bp, mouse
gaggtggcctttgcgactct

SEQ ID NO: 815083 - DNA, 20 bp, mouse
gcgcgagctggaagcataaa

SEQ ID NO: 815084 - DNA, 20 bp, mouse
gttcagggacaggggttaac

SEQ ID NO: 815085 - DNA, 20 bp, mouse
gccccgcaacaggttggcgg

SEQ ID NO: 815086 - DNA, 20 bp, mouse
ggtcccgcgcgcaacttcga

SEQ ID NO: 815087 - DNA, 20 bp, mouse
gtgaactgggacccgatccg

SEQ ID NO: 815088 - DNA, 20 bp, mouse
ggggacccgatccgagggat

SEQ ID NO: 815089 - DNA, 20 bp, mouse
gtacgcccgagtgggacgta

SEQ ID NO: 815090 - DNA, 20 bp, mouse
gaggagggccggggataaag

SEQ ID NO: 815091 - DNA, 20 bp, mouse
ggtacaggcaggcagcgttc

SEQ ID NO: 815092 - DNA, 20 bp, mouse
gcgccctcgaagttgcgcgc

SEQ ID NO: 815093 - DNA, 20 bp, mouse
ggtgcaaaagcccgcgggga

SEQ ID NO: 815094 - DNA, 20 bp, mouse
gggccggagcggaaggtgga

SEQ ID NO: 815095 - DNA, 20 bp, mouse
gcggcggcctcgtagcctca

SEQ ID NO: 815096 - DNA, 20 bp, mouse
gccaccgcccaatcattctg

SEQ ID NO: 815097 - DNA, 20 bp, mouse
ggcgtgggagatagagactg

SEQ ID NO: 815098 - DNA, 20 bp, mouse
gagccagtctgggaactggt

SEQ ID NO: 815099 - DNA, 20 bp, mouse
gcccgcgccaaattgtgaga

SEQ ID NO: 815100 - DNA, 20 bp, mouse
gcagtctgggaactggtggg

SEQ ID NO: 815101 - DNA, 20 bp, mouse
ggccaaattgtgagatgggg

SEQ ID NO: 815102 - DNA, 20 bp, mouse
gtggggagagggcgctgtgc

SEQ ID NO: 815103 - DNA, 20 bp, mouse
gtaggtgtgaagagccagtc

SEQ ID NO: 815104 - DNA, 20 bp, mouse
gccagccagcaatcccactg

SEQ ID NO: 815105 - DNA, 20 bp, mouse
gtggaggcgggtcttaggcg

SEQ ID NO: 815106 - DNA, 20 bp, mouse
gcccgcgaggcgcgagggga

SEQ ID NO: 815107 - DNA, 20 bp, mouse
gtcggcgcgcccccaagcgg

SEQ ID NO: 815108 - DNA, 20 bp, mouse
gcgaggggaggggtcggcgc

SEQ ID NO: 815109 - DNA, 20 bp, mouse
gccctcggcgcgcccccaag

SEQ ID NO: 815110 - DNA, 20 bp, mouse
gggcacgcaggccgccgctt

SEQ ID NO: 815111 - DNA, 20 bp, mouse
gcttcccgcggcacacccgg

SEQ ID NO: 815112 - DNA, 20 bp, mouse
gtgcgcccgcgaggcgcgag

SEQ ID NO: 815113 - DNA, 20 bp, mouse
gcacgcgccgcctcgttcag

SEQ ID NO: 815114 - DNA, 20 bp, mouse
gcctcagagcccgagaggcg

SEQ ID NO: 815115 - DNA, 20 bp, mouse
gctcctccggcccctgaacg

SEQ ID NO: 815116 - DNA, 20 bp, mouse
ggctcctcccaccgctggga

SEQ ID NO: 815117 - DNA, 20 bp, mouse
gtcttgaagacgcgaggagg

SEQ ID NO: 815118 - DNA, 20 bp, mouse
gccggcagccctcactcccg

SEQ ID NO: 815119 - DNA, 20 bp, mouse
gcgctgcagggacctcttag

SEQ ID NO: 815120 - DNA, 20 bp, mouse
gacgtggcttcgcttcactc

SEQ ID NO: 815121 - DNA, 20 bp, mouse
gcggcagcgccgttccccgg

SEQ ID NO: 815122 - DNA, 20 bp, mouse
ggagccttcccagcggtggg

SEQ ID NO: 815123 - DNA, 20 bp, mouse
gctgcgcgctggtggacacg

SEQ ID NO: 815124 - DNA, 20 bp, mouse
gcgccacctaaggtccatct

SEQ ID NO: 815125 - DNA, 20 bp, mouse
ggcggagccttcccagcggt

SEQ ID NO: 815126 - DNA, 20 bp, mouse
ggggctgctcgcccagggaa

SEQ ID NO: 815127 - DNA, 20 bp, mouse
ggctcgcccagggaaagggt

SEQ ID NO: 815128 - DNA, 20 bp, mouse
ggggcggattagagctgctc

SEQ ID NO: 815129 - DNA, 20 bp, mouse
ggcggcggagaacaaaaaga

SEQ ID NO: 815130 - DNA, 20 bp, mouse
gtctccgccgcctgggaagt

SEQ ID NO: 815131 - DNA, 20 bp, mouse
ggattagagctgctctgggc

SEQ ID NO: 815132 - DNA, 20 bp, mouse
gccctcgccctgcaaccaat

SEQ ID NO: 815133 - DNA, 20 bp, mouse
gcgggccttcagaatccgat

SEQ ID NO: 815134 - DNA, 20 bp, mouse
gacaaaaagacggcgaccta

SEQ ID NO: 815135 - DNA, 20 bp, mouse
gcaccttgggaggaactttg

SEQ ID NO: 815136 - DNA, 20 bp, mouse
gcatccggggacgatagtga

SEQ ID NO: 815137 - DNA, 20 bp, mouse
gaggggaggggcttacgggg

SEQ ID NO: 815138 - DNA, 20 bp, mouse
ggggccgcgcaacgcgtcct

SEQ ID NO: 815139 - DNA, 20 bp, mouse
ggacgtggctgactggttca

SEQ ID NO: 815140 - DNA, 20 bp, mouse
gggggcggggactccggcag

SEQ ID NO: 815141 - DNA, 20 bp, mouse
gggcaggggaggggcttacg

SEQ ID NO: 815142 - DNA, 20 bp, mouse
ggatctgggtgggtgacagc

SEQ ID NO: 815143 - DNA, 20 bp, mouse
ggcgggctgcactgcatccg

SEQ ID NO: 815144 - DNA, 20 bp, mouse
gagtgatgggcgatctgggt

SEQ ID NO: 815145 - DNA, 20 bp, mouse
gaagtccgagctgaaagctt

SEQ ID NO: 815146 - DNA, 20 bp, mouse
gcaaaatgaggctagtgtag

SEQ ID NO: 815147 - DNA, 20 bp, mouse
gcatctctgaactatatccc

SEQ ID NO: 815148 - DNA, 20 bp, mouse
gcccaaatagtcctagaaga

SEQ ID NO: 815149 - DNA, 20 bp, mouse
ggtagatgaagttcactcag

SEQ ID NO: 815150 - DNA, 20 bp, mouse
gctagcaaagagtttgccaa

SEQ ID NO: 815151 - DNA, 20 bp, mouse
ggctgaaggccgtccagcca

SEQ ID NO: 815152 - DNA, 20 bp, mouse
ggagtgaacttcatctacct

SEQ ID NO: 815153 - DNA, 20 bp, mouse
gtgacctctaagcagctgtg

SEQ ID NO: 815154 - DNA, 20 bp, mouse
gtttctacaagcatttctcc

SEQ ID NO: 815155 - DNA, 20 bp, mouse
gaatcctcacagctgcttag

SEQ ID NO: 815156 - DNA, 20 bp, mouse
gccgccggggcgtgggaagc

SEQ ID NO: 815157 - DNA, 20 bp, mouse
gtcggcgacccggaagtcat

SEQ ID NO: 815158 - DNA, 20 bp, mouse
gcttcgtaagactgtctccc

SEQ ID NO: 815159 - DNA, 20 bp, mouse
gtgacggaatatgccagcgg

SEQ ID NO: 815160 - DNA, 20 bp, mouse
gacgaagcgccgccggggcg

SEQ ID NO: 815161 - DNA, 20 bp, mouse
gtgagtccgtgtcgtgtccc

SEQ ID NO: 815162 - DNA, 20 bp, mouse
gtgtctcccgggacacgaca

SEQ ID NO: 815163 - DNA, 20 bp, mouse
gtcggcagcgcacaccgtcc

SEQ ID NO: 815164 - DNA, 20 bp, mouse
gggaggttgagtgatcagca

SEQ ID NO: 815165 - DNA, 20 bp, mouse
gcacaaatgcccagcacagt

SEQ ID NO: 815166 - DNA, 20 bp, mouse
gcccagaggagacccagcgg

SEQ ID NO: 815167 - DNA, 20 bp, mouse
gggagcaaaggcaaatgagg

SEQ ID NO: 815168 - DNA, 20 bp, mouse
gaggaactccacctcctcgg

SEQ ID NO: 815169 - DNA, 20 bp, mouse
gcggcaggacaaactctctc

SEQ ID NO: 815170 - DNA, 20 bp, mouse
gagaggagacccagcggtgg

SEQ ID NO: 815171 - DNA, 20 bp, mouse
gggagacccagcggtggagg

SEQ ID NO: 815172 - DNA, 20 bp, mouse
gtcggtgtcatcctcgtctc

SEQ ID NO: 815173 - DNA, 20 bp, mouse
gggtggagcaaaggcaaatg

SEQ ID NO: 815174 - DNA, 20 bp, mouse
gaggaagttggatgttccca

SEQ ID NO: 815175 - DNA, 20 bp, mouse
gaaactctctcagggtagtg

SEQ ID NO: 815176 - DNA, 20 bp, mouse
gcaggccacgccaaccgcgg

SEQ ID NO: 815177 - DNA, 20 bp, mouse
gtgtgcgcgtgggtcccccg

SEQ ID NO: 815178 - DNA, 20 bp, mouse
gtggcgacagggagcgtcta

SEQ ID NO: 815179 - DNA, 20 bp, mouse
gaactcaggggttgtgcgcg

SEQ ID NO: 815180 - DNA, 20 bp, mouse
ggcgcgccacctcacggccc

SEQ ID NO: 815181 - DNA, 20 bp, mouse
ggagatgtcgcacaactcag

SEQ ID NO: 815182 - DNA, 20 bp, mouse
gccaaggcaaggtcaattac

SEQ ID NO: 815183 - DNA, 20 bp, mouse
gagtgaggaccacaactccc

SEQ ID NO: 815184 - DNA, 20 bp, mouse
gtgggactcgactaggattg

SEQ ID NO: 815185 - DNA, 20 bp, mouse
gccgaaatccccagcggccc

SEQ ID NO: 815186 - DNA, 20 bp, mouse
ggggtcgggaccaggaaaag

SEQ ID NO: 815187 - DNA, 20 bp, mouse
gtgcacccctgggaggtcgg

SEQ ID NO: 815188 - DNA, 20 bp, mouse
gcacgcaccgcctgactccg

SEQ ID NO: 815189 - DNA, 20 bp, mouse
gactctggaagatagttccg

SEQ ID NO: 815190 - DNA, 20 bp, mouse
gagatgctgtccagaccagg

SEQ ID NO: 815191 - DNA, 20 bp, mouse
gggagcgcgcgaaagggtgg

SEQ ID NO: 815192 - DNA, 20 bp, mouse
gtggcgcggcgcccccacgc

SEQ ID NO: 815193 - DNA, 20 bp, mouse
gaccagggggcgtgaggtgg

SEQ ID NO: 815194 - DNA, 20 bp, mouse
gcggggcccccgcacagctc

SEQ ID NO: 815195 - DNA, 20 bp, mouse
gtcaggcggtgcgtgggcgg

SEQ ID NO: 815196 - DNA, 20 bp, mouse
gccctcgattctaaccccga

SEQ ID NO: 815197 - DNA, 20 bp, mouse
gctggcgttattcctccctc

SEQ ID NO: 815198 - DNA, 20 bp, mouse
gcgcgctcacgtggcgacga

SEQ ID NO: 815199 - DNA, 20 bp, mouse
ggacgagggcccaatggccg

SEQ ID NO: 815200 - DNA, 20 bp, mouse
gggaacttgttctgattcgc

SEQ ID NO: 815201 - DNA, 20 bp, mouse
ggcgtaccgagcgtccagga

SEQ ID NO: 815202 - DNA, 20 bp, mouse
gcgcatgcgcaaacggaacc

SEQ ID NO: 815203 - DNA, 20 bp, mouse
gttgttaagacgttccgtcc

SEQ ID NO: 815204 - DNA, 20 bp, mouse
gcagaaaacccgcgctcacg

SEQ ID NO: 815205 - DNA, 20 bp, mouse
gaccgcgagcaacgtttgct

SEQ ID NO: 815206 - DNA, 20 bp, mouse
gtgtgctggtgtagtgagag

SEQ ID NO: 815207 - DNA, 20 bp, mouse
gtaactggaaggaatcttgg

SEQ ID NO: 815208 - DNA, 20 bp, mouse
gaggctgtgtatgtcttaag

SEQ ID NO: 815209 - DNA, 20 bp, mouse
gatgtctgggtcactctctg

SEQ ID NO: 815210 - DNA, 20 bp, mouse
ggagaggacagtctgaccat

SEQ ID NO: 815211 - DNA, 20 bp, mouse
gggtctgcagggctgaacaa

SEQ ID NO: 815212 - DNA, 20 bp, mouse
gagagactccgacacccctc

SEQ ID NO: 815213 - DNA, 20 bp, mouse
gctaatcttcacctctgcag

SEQ ID NO: 815214 - DNA, 20 bp, mouse
gggagtctctgtccatgacc

SEQ ID NO: 815215 - DNA, 20 bp, mouse
gccaggggagaatcccagtg

SEQ ID NO: 815216 - DNA, 20 bp, mouse
gctactgcgggcctggtctg

SEQ ID NO: 815217 - DNA, 20 bp, mouse
gaccaggcccgcagtaggaa

SEQ ID NO: 815218 - DNA, 20 bp, mouse
gcggggagaaacctcagacc

SEQ ID NO: 815219 - DNA, 20 bp, mouse
gcggtcctggaatgtgcgag

SEQ ID NO: 815220 - DNA, 20 bp, mouse
gcaggtaggcagtgccgtgg

SEQ ID NO: 815221 - DNA, 20 bp, mouse
gcgaaccgcctgcgccccgg

SEQ ID NO: 815222 - DNA, 20 bp, mouse
gcaactcccgcgtgtgaggg

SEQ ID NO: 815223 - DNA, 20 bp, mouse
gtccagccctggagacggaa

SEQ ID NO: 815224 - DNA, 20 bp, mouse
gcgcgatgggctcactaagc

SEQ ID NO: 815225 - DNA, 20 bp, mouse
gcggaacggcacagagactc

SEQ ID NO: 815226 - DNA, 20 bp, mouse
gccccagcccaactctctta

SEQ ID NO: 815227 - DNA, 20 bp, mouse
gcctagccctaggatgacaa

SEQ ID NO: 815228 - DNA, 20 bp, mouse
ggctcaggactcctagccct

SEQ ID NO: 815229 - DNA, 20 bp, mouse
ggatgacaagggtctgaata

SEQ ID NO: 815230 - DNA, 20 bp, mouse
gggtggggccagatctagaa

SEQ ID NO: 815231 - DNA, 20 bp, mouse
gttgaccaggagcaaaagag

SEQ ID NO: 815232 - DNA, 20 bp, mouse
gcaacccagaaggacggaga

SEQ ID NO: 815233 - DNA, 20 bp, mouse
gccaggcagggtctcccctt

SEQ ID NO: 815234 - DNA, 20 bp, mouse
ggtcaaatgttgcccatctc

SEQ ID NO: 815235 - DNA, 20 bp, mouse
gcagcccaactctcttaggg

SEQ ID NO: 815236 - DNA, 20 bp, mouse
gggggcccatcctctcggag

SEQ ID NO: 815237 - DNA, 20 bp, mouse
gtaaccatggaaggccgtga

SEQ ID NO: 815238 - DNA, 20 bp, mouse
gcacacgcgcgaggaggaag

SEQ ID NO: 815239 - DNA, 20 bp, mouse
gaagctagacagtgacagta

SEQ ID NO: 815240 - DNA, 20 bp, mouse
gggaggggctggtctctaga

SEQ ID NO: 815241 - DNA, 20 bp, mouse
gcgtgcggagcgacaagtct

SEQ ID NO: 815242 - DNA, 20 bp, mouse
gtgtgtgaagaccgttagag

SEQ ID NO: 815243 - DNA, 20 bp, mouse
gcttccggtcgaccgagggg

SEQ ID NO: 815244 - DNA, 20 bp, mouse
gagagaccagcccctccgag

SEQ ID NO: 815245 - DNA, 20 bp, mouse
ggcagcttccggtcgaccga

SEQ ID NO: 815246 - DNA, 20 bp, mouse
ggcgccccgggtctcctgtt

SEQ ID NO: 815247 - DNA, 20 bp, mouse
gccccccagaggtccggaaa

SEQ ID NO: 815248 - DNA, 20 bp, mouse
gcgctgcgggagaccgtctg

SEQ ID NO: 815249 - DNA, 20 bp, mouse
gagaccgtctgcggcgcccc

SEQ ID NO: 815250 - DNA, 20 bp, mouse
gagacccggggcgccgcaga

SEQ ID NO: 815251 - DNA, 20 bp, mouse
gtcccagattccatccaaac

SEQ ID NO: 815252 - DNA, 20 bp, mouse
gtcagtgaggcgggcgcatg

SEQ ID NO: 815253 - DNA, 20 bp, mouse
gcccgggtctcctgtttgga

SEQ ID NO: 815254 - DNA, 20 bp, mouse
ggtgggggggttacgggcag

SEQ ID NO: 815255 - DNA, 20 bp, mouse
gcccagcttagattctcaaa

SEQ ID NO: 815256 - DNA, 20 bp, mouse
ggggcccccggagccgaaca

SEQ ID NO: 815257 - DNA, 20 bp, mouse
gtcctgcggcagaaagtggc

SEQ ID NO: 815258 - DNA, 20 bp, mouse
gggccccagcttcgcgcttg

SEQ ID NO: 815259 - DNA, 20 bp, mouse
gcttgcgggacgcgtccctg

SEQ ID NO: 815260 - DNA, 20 bp, mouse
ggcaaacgccgttccctgtt

SEQ ID NO: 815261 - DNA, 20 bp, mouse
gggtcgccggagagtttgat

SEQ ID NO: 815262 - DNA, 20 bp, mouse
gggcgaccgtgagactgtca

SEQ ID NO: 815263 - DNA, 20 bp, mouse
gtcccgcaagcgcgaagctg

SEQ ID NO: 815264 - DNA, 20 bp, mouse
gcctgaggcgaccccaaccg

SEQ ID NO: 815265 - DNA, 20 bp, mouse
gaactctgatgagaaccggg

SEQ ID NO: 815266 - DNA, 20 bp, mouse
gtgcgcgcacgggtaaaggt

SEQ ID NO: 815267 - DNA, 20 bp, mouse
gtgggaggaccaaaagccga

SEQ ID NO: 815268 - DNA, 20 bp, mouse
gcagctccggaggtcgcgtt

SEQ ID NO: 815269 - DNA, 20 bp, mouse
gtggccgggccggcggtctc

SEQ ID NO: 815270 - DNA, 20 bp, mouse
gcgtgtgcgcgcacgggtaa

SEQ ID NO: 815271 - DNA, 20 bp, mouse
gcctgcacacggtgcaccag

SEQ ID NO: 815272 - DNA, 20 bp, mouse
gcacttccggggcatttcga

SEQ ID NO: 815273 - DNA, 20 bp, mouse
ggcgacctccggagctgcag

SEQ ID NO: 815274 - DNA, 20 bp, mouse
gcacggcaaaagatcagatg

SEQ ID NO: 815275 - DNA, 20 bp, mouse
gtctctgcgccggagaccgc

SEQ ID NO: 815276 - DNA, 20 bp, mouse
gcacgtgaggccttaggtgg

SEQ ID NO: 815277 - DNA, 20 bp, mouse
gctccactgaacaccccttc

SEQ ID NO: 815278 - DNA, 20 bp, mouse
gagaggaaggggaagccgga

SEQ ID NO: 815279 - DNA, 20 bp, mouse
gggtgttcagtggagctccg

SEQ ID NO: 815280 - DNA, 20 bp, mouse
ggcccggcccagctgtcacc

SEQ ID NO: 815281 - DNA, 20 bp, mouse
ggacaaaaggaggcccgcgg

SEQ ID NO: 815282 - DNA, 20 bp, mouse
gtggggctggagcagcgata

SEQ ID NO: 815283 - DNA, 20 bp, mouse
gtaggtggcggcggggctgt

SEQ ID NO: 815284 - DNA, 20 bp, mouse
gcacgtgactcgactctccc

SEQ ID NO: 815285 - DNA, 20 bp, mouse
gtgccccggacgtgcccgac

SEQ ID NO: 815286 - DNA, 20 bp, mouse
ggccccggcaggagcgttct

SEQ ID NO: 815287 - DNA, 20 bp, mouse
gggagacaataacctcgata

SEQ ID NO: 815288 - DNA, 20 bp, mouse
ggtcgcacgcagctcctatg

SEQ ID NO: 815289 - DNA, 20 bp, mouse
gaagctggagctcggtgggg

SEQ ID NO: 815290 - DNA, 20 bp, mouse
gaggagctgcgtgcgaccgc

SEQ ID NO: 815291 - DNA, 20 bp, mouse
gaaggaaggctttaagatct

SEQ ID NO: 815292 - DNA, 20 bp, mouse
gcgaccgccggctcgtaggc

SEQ ID NO: 815293 - DNA, 20 bp, mouse
gaggaaagccagccatatcg

SEQ ID NO: 815294 - DNA, 20 bp, mouse
gtctgagctggcatatctgg

SEQ ID NO: 815295 - DNA, 20 bp, mouse
ggtcctcggcgttgcctgat

SEQ ID NO: 815296 - DNA, 20 bp, mouse
gcccctggggaactccagtt

SEQ ID NO: 815297 - DNA, 20 bp, mouse
gaccaagcccggttcccctg

SEQ ID NO: 815298 - DNA, 20 bp, mouse
gaaagggagggagtcccaac

SEQ ID NO: 815299 - DNA, 20 bp, mouse
gggagttccccaggggaacc

SEQ ID NO: 815300 - DNA, 20 bp, mouse
gtcccaactggagttcccca

SEQ ID NO: 815301 - DNA, 20 bp, mouse
ggggccgcgtggggtcgctg

SEQ ID NO: 815302 - DNA, 20 bp, mouse
gtggccggagtgtcgcgaag

SEQ ID NO: 815303 - DNA, 20 bp, mouse
gcggccacagcgaccccacg

SEQ ID NO: 815304 - DNA, 20 bp, mouse
gcccggaggcagaccaagcc

SEQ ID NO: 815305 - DNA, 20 bp, mouse
gggtcatcatcactctgtgt

SEQ ID NO: 815306 - DNA, 20 bp, mouse
gacgccccggctcacgatcg

SEQ ID NO: 815307 - DNA, 20 bp, mouse
gcgtgagccggggcgtgtga

SEQ ID NO: 815308 - DNA, 20 bp, mouse
gggtcgcagaagccacgaga

SEQ ID NO: 815309 - DNA, 20 bp, mouse
gcatccgcgatcgtgagccg

SEQ ID NO: 815310 - DNA, 20 bp, mouse
gcacgcgcacagagacgcct

SEQ ID NO: 815311 - DNA, 20 bp, mouse
gcgcggatgtgaagtcaact

SEQ ID NO: 815312 - DNA, 20 bp, mouse
ggagaggtagaaacagccga

SEQ ID NO: 815313 - DNA, 20 bp, mouse
gggagtgagtccggagaact

SEQ ID NO: 815314 - DNA, 20 bp, mouse
gctcctgcgtgctctgagca

SEQ ID NO: 815315 - DNA, 20 bp, mouse
gaagggtcctgtccatctcg

SEQ ID NO: 815316 - DNA, 20 bp, mouse
ggacgccccctcaaatgaat

SEQ ID NO: 815317 - DNA, 20 bp, mouse
gtctgctgggacatgtagtt

SEQ ID NO: 815318 - DNA, 20 bp, mouse
ggactcacgcgagccttcgg

SEQ ID NO: 815319 - DNA, 20 bp, mouse
gcggcaggcgtgaaaaaaac

SEQ ID NO: 815320 - DNA, 20 bp, mouse
ggaccgcgcgcctttacggc

SEQ ID NO: 815321 - DNA, 20 bp, mouse
gcatttgagggggcgtccta

SEQ ID NO: 815322 - DNA, 20 bp, mouse
gtaaaggcgcgcggtctgct

SEQ ID NO: 815323 - DNA, 20 bp, mouse
gccctcaaatgaatgggacc

SEQ ID NO: 815324 - DNA, 20 bp, mouse
gtcaagacggccctcaggga

SEQ ID NO: 815325 - DNA, 20 bp, mouse
gaccgactcacgcgagcctt

SEQ ID NO: 815326 - DNA, 20 bp, mouse
ggtccccggagatcagggaa

SEQ ID NO: 815327 - DNA, 20 bp, mouse
gactcccggaagaagagggc

SEQ ID NO: 815328 - DNA, 20 bp, mouse
gggggactcccggaagaaga

SEQ ID NO: 815329 - DNA, 20 bp, mouse
gaggccgttgccacttcccg

SEQ ID NO: 815330 - DNA, 20 bp, mouse
gtctggaagcggtgaaaata

SEQ ID NO: 815331 - DNA, 20 bp, mouse
gcgggagtccccggagatca

SEQ ID NO: 815332 - DNA, 20 bp, mouse
gtggcaggaagtcgtactgg

SEQ ID NO: 815333 - DNA, 20 bp, mouse
gcggccgcgggaagtggcaa

SEQ ID NO: 815334 - DNA, 20 bp, mouse
gcacccgagggcaccgccga

SEQ ID NO: 815335 - DNA, 20 bp, mouse
gtcaggggaaaagatagtgc

SEQ ID NO: 815336 - DNA, 20 bp, mouse
gctactaataactctgtaca

SEQ ID NO: 815337 - DNA, 20 bp, mouse
gtggtgcccgtttaagggaa

SEQ ID NO: 815338 - DNA, 20 bp, mouse
ggttcctggtgcccgtttaa

SEQ ID NO: 815339 - DNA, 20 bp, mouse
gggtacagagggaccgtgtt

SEQ ID NO: 815340 - DNA, 20 bp, mouse
gagtagctgtgattcgttcc

SEQ ID NO: 815341 - DNA, 20 bp, mouse
gaagttcatcgcagaggaaa

SEQ ID NO: 815342 - DNA, 20 bp, mouse
gccaccccaccgacttccgg

SEQ ID NO: 815343 - DNA, 20 bp, mouse
gtgagcagacgccgagaact

SEQ ID NO: 815344 - DNA, 20 bp, mouse
gcgagacttccgccggaagt

SEQ ID NO: 815345 - DNA, 20 bp, mouse
gcgtcctggcaaagtgataa

SEQ ID NO: 815346 - DNA, 20 bp, mouse
gagcagccgggacactgctg

SEQ ID NO: 815347 - DNA, 20 bp, mouse
gcccgcgaggcaccatgcca

SEQ ID NO: 815348 - DNA, 20 bp, mouse
gggggctggggacccggcat

SEQ ID NO: 815349 - DNA, 20 bp, mouse
gaggctcgggaaggacccgg

SEQ ID NO: 815350 - DNA, 20 bp, mouse
ggggacgggcggcggcagtg

SEQ ID NO: 815351 - DNA, 20 bp, mouse
ggctcgcggcagggcttcgc

SEQ ID NO: 815352 - DNA, 20 bp, mouse
ggccagggcaaagtccccga

SEQ ID NO: 815353 - DNA, 20 bp, mouse
gtgctcccggagcccatgcc

SEQ ID NO: 815354 - DNA, 20 bp, mouse
ggccgcccgtccccgcccag

SEQ ID NO: 815355 - DNA, 20 bp, mouse
gggcgcgctgggtccccctg

SEQ ID NO: 815356 - DNA, 20 bp, mouse
gttagccggcacccccagaa

SEQ ID NO: 815357 - DNA, 20 bp, mouse
ggtcccgcccccagcggccc

SEQ ID NO: 815358 - DNA, 20 bp, mouse
gggcacccccagaaaggctg

SEQ ID NO: 815359 - DNA, 20 bp, mouse
gccccagcggcccgggaaga

SEQ ID NO: 815360 - DNA, 20 bp, mouse
gcgggaggtggacacctcca

SEQ ID NO: 815361 - DNA, 20 bp, mouse
gaagagggtgcggcaggaac

SEQ ID NO: 815362 - DNA, 20 bp, mouse
gtgggcgcgaactccgacca

SEQ ID NO: 815363 - DNA, 20 bp, mouse
gccaaccaccggggtagatg

SEQ ID NO: 815364 - DNA, 20 bp, mouse
gtagtgcgctctctccttgg

SEQ ID NO: 815365 - DNA, 20 bp, mouse
gcatctgtaactcactaatc

SEQ ID NO: 815366 - DNA, 20 bp, mouse
ggagacacgtcggtgctgga

SEQ ID NO: 815367 - DNA, 20 bp, mouse
ggcagcgctgagagagaccg

SEQ ID NO: 815368 - DNA, 20 bp, mouse
gcgctgagagagaccgtggg

SEQ ID NO: 815369 - DNA, 20 bp, mouse
gttaaaagaaccagctgctg

SEQ ID NO: 815370 - DNA, 20 bp, mouse
gcccaccggggtcggctctc

SEQ ID NO: 815371 - DNA, 20 bp, mouse
gtgctctgccactgtgggaa

SEQ ID NO: 815372 - DNA, 20 bp, mouse
ggtctctctcagcgctgcac

SEQ ID NO: 815373 - DNA, 20 bp, mouse
gcacgggaaatgagacacgt

SEQ ID NO: 815374 - DNA, 20 bp, mouse
gcgtctgggcatcgggtcgt

SEQ ID NO: 815375 - DNA, 20 bp, mouse
gggtggagcctgcttccctg

SEQ ID NO: 815376 - DNA, 20 bp, mouse
ggacgcgcgacgatgacgta

SEQ ID NO: 815377 - DNA, 20 bp, mouse
gacgacgtgtacgggcgcgt

SEQ ID NO: 815378 - DNA, 20 bp, mouse
ggcgagcggcgatgacgcaa

SEQ ID NO: 815379 - DNA, 20 bp, mouse
gccctcgccgacgacgtgta

SEQ ID NO: 815380 - DNA, 20 bp, mouse
gaaagcgtttaagtgagggt

SEQ ID NO: 815381 - DNA, 20 bp, mouse
ggcgacgatgacgtatgggg

SEQ ID NO: 815382 - DNA, 20 bp, mouse
gccggaaagcgtttaagtga

SEQ ID NO: 815383 - DNA, 20 bp, mouse
gcgtgcctggggcgtagaca

SEQ ID NO: 815384 - DNA, 20 bp, mouse
gacgtgtacgggcgcgtcgg

SEQ ID NO: 815385 - DNA, 20 bp, mouse
gacgatgacgtatggggcgg

SEQ ID NO: 815386 - DNA, 20 bp, mouse
gcccacaggaggccgcaagg

SEQ ID NO: 815387 - DNA, 20 bp, mouse
gtgtcctggctccccgtggt

SEQ ID NO: 815388 - DNA, 20 bp, mouse
gccaccgcaaaccacggggc

SEQ ID NO: 815389 - DNA, 20 bp, mouse
gaggtgcgaacgcgccgtga

SEQ ID NO: 815390 - DNA, 20 bp, mouse
gttccaccgcggcccaccac

SEQ ID NO: 815391 - DNA, 20 bp, mouse
ggggccagcagcatagcgac

SEQ ID NO: 815392 - DNA, 20 bp, mouse
ggggccacagcaccgccttg

SEQ ID NO: 815393 - DNA, 20 bp, mouse
gccctctaggtcagacccag

SEQ ID NO: 815394 - DNA, 20 bp, mouse
gacggggcgggcgacgatgc

SEQ ID NO: 815395 - DNA, 20 bp, mouse
gcccggcagcgtccaagact

SEQ ID NO: 815396 - DNA, 20 bp, mouse
gtcccagtaagtcggggaat

SEQ ID NO: 815397 - DNA, 20 bp, mouse
gtgcgcctcccagtaagtcg

SEQ ID NO: 815398 - DNA, 20 bp, mouse
gcctgcgcggcggaatcacg

SEQ ID NO: 815399 - DNA, 20 bp, mouse
ggcaacgtggagagtaaaac

SEQ ID NO: 815400 - DNA, 20 bp, mouse
gtcggctggagggaagccct

SEQ ID NO: 815401 - DNA, 20 bp, mouse
gacgtggagagtaaaactgg

SEQ ID NO: 815402 - DNA, 20 bp, mouse
gcctccgagcgggtccgcca

SEQ ID NO: 815403 - DNA, 20 bp, mouse
gcagggaagattagtttctg

SEQ ID NO: 815404 - DNA, 20 bp, mouse
ggggctgggaggagccgtgg

SEQ ID NO: 815405 - DNA, 20 bp, mouse
gggcgcgctcggcgctccgc

SEQ ID NO: 815406 - DNA, 20 bp, mouse
gcgggtatcagactcatcgg

SEQ ID NO: 815407 - DNA, 20 bp, mouse
gtgtaggtaggagacttcca

SEQ ID NO: 815408 - DNA, 20 bp, mouse
gctgagtaacccaagttgaa

SEQ ID NO: 815409 - DNA, 20 bp, mouse
gccgcgggtatcagactcat

SEQ ID NO: 815410 - DNA, 20 bp, mouse
gttactcagcagagatctac

SEQ ID NO: 815411 - DNA, 20 bp, mouse
gcggagtcacgaccaccaga

SEQ ID NO: 815412 - DNA, 20 bp, mouse
gaggaacgcttgcaacagtg

SEQ ID NO: 815413 - DNA, 20 bp, mouse
gtctgatttaggtctcaggt

SEQ ID NO: 815414 - DNA, 20 bp, mouse
gtgtagattcctggttcatc

SEQ ID NO: 815415 - DNA, 20 bp, mouse
ggagatctacgggttcccgc

SEQ ID NO: 815416 - DNA, 20 bp, mouse
gcctagaccaggggcctctt

SEQ ID NO: 815417 - DNA, 20 bp, mouse
ggcgccgcgccggcagaggg

SEQ ID NO: 815418 - DNA, 20 bp, mouse
gccgccagagggcgctccgg

SEQ ID NO: 815419 - DNA, 20 bp, mouse
gtctttggatgccaggagga

SEQ ID NO: 815420 - DNA, 20 bp, mouse
ggcgccggcagaggggggtg

SEQ ID NO: 815421 - DNA, 20 bp, mouse
gggcctctttggatgccagg

SEQ ID NO: 815422 - DNA, 20 bp, mouse
gtggaccaacaaactgtctc

SEQ ID NO: 815423 - DNA, 20 bp, mouse
gtctaggatgctgtgattgg

SEQ ID NO: 815424 - DNA, 20 bp, mouse
gcatcctccctgtgaaattg

SEQ ID NO: 815425 - DNA, 20 bp, mouse
gtccccgccagagggcgctc

SEQ ID NO: 815426 - DNA, 20 bp, mouse
gtgtcgcacgagcagggcgg

SEQ ID NO: 815427 - DNA, 20 bp, mouse
gcaacccaacaggtctgcga

SEQ ID NO: 815428 - DNA, 20 bp, mouse
gcggaggagtatcgggacgc

SEQ ID NO: 815429 - DNA, 20 bp, mouse
gtcagtagccgggtctatcc

SEQ ID NO: 815430 - DNA, 20 bp, mouse
gagcagggcggaggagtatc

SEQ ID NO: 815431 - DNA, 20 bp, mouse
gcatgtgggtggagttgatt

SEQ ID NO: 815432 - DNA, 20 bp, mouse
gatttgtcgcacgagcaggg

SEQ ID NO: 815433 - DNA, 20 bp, mouse
ggataagaggtgatcttggc

SEQ ID NO: 815434 - DNA, 20 bp, mouse
ggagtccgcgccgtactcac

SEQ ID NO: 815435 - DNA, 20 bp, mouse
gacacagaggcggggtcagt

SEQ ID NO: 815436 - DNA, 20 bp, mouse
gaggacgcgcctgggagcta

SEQ ID NO: 815437 - DNA, 20 bp, mouse
ggaagggctcatggagaagg

SEQ ID NO: 815438 - DNA, 20 bp, mouse
gggagctagggcgcgaccgt

SEQ ID NO: 815439 - DNA, 20 bp, mouse
gattcgctggcctcatggaa

SEQ ID NO: 815440 - DNA, 20 bp, mouse
ggcgcacagcctcctactcc

SEQ ID NO: 815441 - DNA, 20 bp, mouse
ggcagcgagccgggagtagg

SEQ ID NO: 815442 - DNA, 20 bp, mouse
gggggcctggggccgcagtc

SEQ ID NO: 815443 - DNA, 20 bp, mouse
ggctgcagggcgggcgtccc

SEQ ID NO: 815444 - DNA, 20 bp, mouse
gagccggccgggtgggcgtg

SEQ ID NO: 815445 - DNA, 20 bp, mouse
gccgcagtcaggacgcgcct

SEQ ID NO: 815446 - DNA, 20 bp, mouse
gacaaagtttagttttctta

SEQ ID NO: 815447 - DNA, 20 bp, mouse
gaagttaagtgtgaggctca

SEQ ID NO: 815448 - DNA, 20 bp, mouse
gccctaaaaagttaagtgtg

SEQ ID NO: 815449 - DNA, 20 bp, mouse
gttaaatcgcaaagcgtggg

SEQ ID NO: 815450 - DNA, 20 bp, mouse
gacaaaagctccctgtccac

SEQ ID NO: 815451 - DNA, 20 bp, mouse
gacgctgcttgtgagcattt

SEQ ID NO: 815452 - DNA, 20 bp, mouse
gcaaagcgtgggaggcttga

SEQ ID NO: 815453 - DNA, 20 bp, mouse
gtgacagtgcctagcttctg

SEQ ID NO: 815454 - DNA, 20 bp, mouse
gattcagacaggagcagcag

SEQ ID NO: 815455 - DNA, 20 bp, mouse
gtaattaaatcgcaaagcgt

SEQ ID NO: 815456 - DNA, 20 bp, mouse
gtaggtggtcaataggtcgg

SEQ ID NO: 815457 - DNA, 20 bp, mouse
ggtggagtctgactggctga

SEQ ID NO: 815458 - DNA, 20 bp, mouse
gggttggccagccgtgggat

SEQ ID NO: 815459 - DNA, 20 bp, mouse
ggtcgggggtggagtctgac

SEQ ID NO: 815460 - DNA, 20 bp, mouse
gccacggctggccaaccggc

SEQ ID NO: 815461 - DNA, 20 bp, mouse
gcccaggggcggagcttgac

SEQ ID NO: 815462 - DNA, 20 bp, mouse
gtgccaggttcgctacccag

SEQ ID NO: 815463 - DNA, 20 bp, mouse
gggggaggatgtcacctagt

SEQ ID NO: 815464 - DNA, 20 bp, mouse
ggcagctctaggtggtcaat

SEQ ID NO: 815465 - DNA, 20 bp, mouse
gcgcccctgggtagcgaacc

SEQ ID NO: 815466 - DNA, 20 bp, mouse
gcgtacgctgcagaagtaca

SEQ ID NO: 815467 - DNA, 20 bp, mouse
gagctggagaagcagagtgc

SEQ ID NO: 815468 - DNA, 20 bp, mouse
ggctgccaccggtctttggt

SEQ ID NO: 815469 - DNA, 20 bp, mouse
ggggtcatgtagagatgctt

SEQ ID NO: 815470 - DNA, 20 bp, mouse
ggctagcgggcgtggggcgt

SEQ ID NO: 815471 - DNA, 20 bp, mouse
gtacaaaccgggaggccaag

SEQ ID NO: 815472 - DNA, 20 bp, mouse
gctctcctaccaaagaccgg

SEQ ID NO: 815473 - DNA, 20 bp, mouse
gcgtggggcgtgggccagtg

SEQ ID NO: 815474 - DNA, 20 bp, mouse
gagcgcccattttacaaacc

SEQ ID NO: 815475 - DNA, 20 bp, mouse
gcaaagaccggtggcagctc

SEQ ID NO: 815476 - DNA, 20 bp, mouse
gcgctcgtgctctccggctg

SEQ ID NO: 815477 - DNA, 20 bp, mouse
gcggctgcggtggctacagc

SEQ ID NO: 815478 - DNA, 20 bp, mouse
gagcccgactgccctggggt

SEQ ID NO: 815479 - DNA, 20 bp, mouse
gcccaagacccgaggcgcca

SEQ ID NO: 815480 - DNA, 20 bp, mouse
gcgggctccccggggcggga

SEQ ID NO: 815481 - DNA, 20 bp, mouse
ggtctagcccgactgccctg

SEQ ID NO: 815482 - DNA, 20 bp, mouse
ggcggtggctacagctggcg

SEQ ID NO: 815483 - DNA, 20 bp, mouse
gcctgtctgtgcaaagacag

SEQ ID NO: 815484 - DNA, 20 bp, mouse
gtcgtgctctccggctgcgg

SEQ ID NO: 815485 - DNA, 20 bp, mouse
gggagagcacgagcgagcgc

SEQ ID NO: 815486 - DNA, 20 bp, mouse
ggcgctgcgggagtggaaga

SEQ ID NO: 815487 - DNA, 20 bp, mouse
ggggactggccctccccgag

SEQ ID NO: 815488 - DNA, 20 bp, mouse
gacgctcacgcctctcgggg

SEQ ID NO: 815489 - DNA, 20 bp, mouse
gtgggacgctcacgcctctc

SEQ ID NO: 815490 - DNA, 20 bp, mouse
gaacgccctggggcggagag

SEQ ID NO: 815491 - DNA, 20 bp, mouse
gtgcgggagtggaagacggc

SEQ ID NO: 815492 - DNA, 20 bp, mouse
ggcgtgagcgtcccaggcaa

SEQ ID NO: 815493 - DNA, 20 bp, mouse
gaggacctagtcaccctggc

SEQ ID NO: 815494 - DNA, 20 bp, mouse
gagtgggggcaggcggggtt

SEQ ID NO: 815495 - DNA, 20 bp, mouse
gactgccagccagggtgact

SEQ ID NO: 815496 - DNA, 20 bp, mouse
gagcagctttactatgaggt

SEQ ID NO: 815497 - DNA, 20 bp, mouse
gctctggtatttacactcat

SEQ ID NO: 815498 - DNA, 20 bp, mouse
gcaagagcagctttactatg

SEQ ID NO: 815499 - DNA, 20 bp, mouse
gtggctaaaagttgctcagt

SEQ ID NO: 815500 - DNA, 20 bp, mouse
ggctcagtaggttagatggc

SEQ ID NO: 815501 - DNA, 20 bp, mouse
gttgctgatgtcattttatg

SEQ ID NO: 815502 - DNA, 20 bp, mouse
gttactatgaggtgggggag

SEQ ID NO: 815503 - DNA, 20 bp, mouse
gaataccagagggcaacatt

SEQ ID NO: 815504 - DNA, 20 bp, mouse
gaagtagaggacacaggggc

SEQ ID NO: 815505 - DNA, 20 bp, mouse
gtggctggtcagagaaccca

SEQ ID NO: 815506 - DNA, 20 bp, mouse
gaggtggcgctgcagaacaa

SEQ ID NO: 815507 - DNA, 20 bp, mouse
gtgagaccaccacagagcta

SEQ ID NO: 815508 - DNA, 20 bp, mouse
gtcagccgctgcttcagaaa

SEQ ID NO: 815509 - DNA, 20 bp, mouse
ggcagacgacctagattttg

SEQ ID NO: 815510 - DNA, 20 bp, mouse
ggggccctgtcacgtgatgc

SEQ ID NO: 815511 - DNA, 20 bp, mouse
gggagactgcctcaaaatct

SEQ ID NO: 815512 - DNA, 20 bp, mouse
gacgtgacagggcccggaag

SEQ ID NO: 815513 - DNA, 20 bp, mouse
gtgcagaacaagggtccggg

SEQ ID NO: 815514 - DNA, 20 bp, mouse
gggagccagcatcacgtgac

SEQ ID NO: 815515 - DNA, 20 bp, mouse
ggtctgccttagctctgtgg

SEQ ID NO: 815516 - DNA, 20 bp, mouse
gtaactgcactgtggttgat

SEQ ID NO: 815517 - DNA, 20 bp, mouse
ggcggggtgtccatgcaggt

SEQ ID NO: 815518 - DNA, 20 bp, mouse
ggcaggtggctcaaaagttc

SEQ ID NO: 815519 - DNA, 20 bp, mouse
gggaggcggggtgtccatgc

SEQ ID NO: 815520 - DNA, 20 bp, mouse
ggagaccacgcccacctgca

SEQ ID NO: 815521 - DNA, 20 bp, mouse
gtgtataaaaacagatgcgg

SEQ ID NO: 815522 - DNA, 20 bp, mouse
ggcttgcctaatatgcttaa

SEQ ID NO: 815523 - DNA, 20 bp, mouse
gtcaggatagactggaaata

SEQ ID NO: 815524 - DNA, 20 bp, mouse
gaatgaattacaggccactt

SEQ ID NO: 815525 - DNA, 20 bp, mouse
gtagctatctaatgaattac

SEQ ID NO: 815526 - DNA, 20 bp, mouse
gtctagctggaggtaaacaa

SEQ ID NO: 815527 - DNA, 20 bp, mouse
gcctgcgcagaggatctgag

SEQ ID NO: 815528 - DNA, 20 bp, mouse
gaccaccacttagttatgaa

SEQ ID NO: 815529 - DNA, 20 bp, mouse
ggaagactagaggagtctta

SEQ ID NO: 815530 - DNA, 20 bp, mouse
gacacagtcttcctgcgcag

SEQ ID NO: 815531 - DNA, 20 bp, mouse
gtgggtgacatctgcatcct

SEQ ID NO: 815532 - DNA, 20 bp, mouse
gtcccttcataactaagtgg

SEQ ID NO: 815533 - DNA, 20 bp, mouse
gctgggtagcctccattgtg

SEQ ID NO: 815534 - DNA, 20 bp, mouse
gttgccagcccggtctgcat

SEQ ID NO: 815535 - DNA, 20 bp, mouse
gcacagctacctcacaatgg

SEQ ID NO: 815536 - DNA, 20 bp, mouse
ggcgaagcccggggattcag

SEQ ID NO: 815537 - DNA, 20 bp, mouse
gaacactgccagtcggtcgt

SEQ ID NO: 815538 - DNA, 20 bp, mouse
gccgaggcgcagacccgcgt

SEQ ID NO: 815539 - DNA, 20 bp, mouse
gttagtgtcaattggggtgg

SEQ ID NO: 815540 - DNA, 20 bp, mouse
ggcgcggcgcctacaagctg

SEQ ID NO: 815541 - DNA, 20 bp, mouse
gggtccgaggccctttcttc

SEQ ID NO: 815542 - DNA, 20 bp, mouse
gaacaaacgcagctagatgt

SEQ ID NO: 815543 - DNA, 20 bp, mouse
ggcaactcccgacgaccgac

SEQ ID NO: 815544 - DNA, 20 bp, mouse
gacagctaacactagggtta

SEQ ID NO: 815545 - DNA, 20 bp, mouse
ggcttcgcatgccggaagaa

SEQ ID NO: 815546 - DNA, 20 bp, mouse
ggggacccaggaacagctag

SEQ ID NO: 815547 - DNA, 20 bp, mouse
ggtaggcgcggggacaacgg

SEQ ID NO: 815548 - DNA, 20 bp, mouse
gcggccccgcgcgcgcccaa

SEQ ID NO: 815549 - DNA, 20 bp, mouse
gctaggagagcatgacaggc

SEQ ID NO: 815550 - DNA, 20 bp, mouse
gcccgcgcgccccctgaccc

SEQ ID NO: 815551 - DNA, 20 bp, mouse
gtcccctaggagctagcgtt

SEQ ID NO: 815552 - DNA, 20 bp, mouse
gggcaggaagcacgcgacgc

SEQ ID NO: 815553 - DNA, 20 bp, mouse
gggagagggaggagccgcac

SEQ ID NO: 815554 - DNA, 20 bp, mouse
ggcccacggcaggtgcgtgg

SEQ ID NO: 815555 - DNA, 20 bp, mouse
gcacagggtcggcgttcaca

SEQ ID NO: 815556 - DNA, 20 bp, mouse
gagtggctagtgagcacaga

SEQ ID NO: 815557 - DNA, 20 bp, mouse
gtcactacccacgaggggat

SEQ ID NO: 815558 - DNA, 20 bp, mouse
gcccctcgtgggtagtgaaa

SEQ ID NO: 815559 - DNA, 20 bp, mouse
ggcactcggcgcgacctaga

SEQ ID NO: 815560 - DNA, 20 bp, mouse
gggcaggccggtcatgttca

SEQ ID NO: 815561 - DNA, 20 bp, mouse
gtccgccccttgaacatgac

SEQ ID NO: 815562 - DNA, 20 bp, mouse
gtcggcgcgacctagagggc

SEQ ID NO: 815563 - DNA, 20 bp, mouse
gtggggcgggccagtcggcg

SEQ ID NO: 815564 - DNA, 20 bp, mouse
gccaggaaactcaagactgc

SEQ ID NO: 815565 - DNA, 20 bp, mouse
gcagttccccatcccctcgt

SEQ ID NO: 815566 - DNA, 20 bp, mouse
gagctctggccacatcccgc

SEQ ID NO: 815567 - DNA, 20 bp, mouse
gctcgcaggtaaagcggcac

SEQ ID NO: 815568 - DNA, 20 bp, mouse
gggacctagtcccttcctgc

SEQ ID NO: 815569 - DNA, 20 bp, mouse
gttacagctcgcaggtaaag

SEQ ID NO: 815570 - DNA, 20 bp, mouse
ggggatgtggccagagcttc

SEQ ID NO: 815571 - DNA, 20 bp, mouse
gctcacgtgacctcggggac

SEQ ID NO: 815572 - DNA, 20 bp, mouse
gctaggtccagaaatgttag

SEQ ID NO: 815573 - DNA, 20 bp, mouse
ggaaaaaatggtcagcctat

SEQ ID NO: 815574 - DNA, 20 bp, mouse
gacgcctcctcttgaaaaaa

SEQ ID NO: 815575 - DNA, 20 bp, mouse
gggacgctcacgtgacctcg

SEQ ID NO: 815576 - DNA, 20 bp, mouse
gttcacaggcaagaagactt

SEQ ID NO: 815577 - DNA, 20 bp, mouse
gggaagggcaagcagtcctg

SEQ ID NO: 815578 - DNA, 20 bp, mouse
gttactgagagccaaaccgg

SEQ ID NO: 815579 - DNA, 20 bp, mouse
gtgtgcagacaaaagtaatt

SEQ ID NO: 815580 - DNA, 20 bp, mouse
gaccctctcctcccccggtt

SEQ ID NO: 815581 - DNA, 20 bp, mouse
gtgaagccagctgtgattaa

SEQ ID NO: 815582 - DNA, 20 bp, mouse
ggccaaaccgggggaggaga

SEQ ID NO: 815583 - DNA, 20 bp, mouse
gaggttactgagagccaaac

SEQ ID NO: 815584 - DNA, 20 bp, mouse
gtggggaccctctcctcccc

SEQ ID NO: 815585 - DNA, 20 bp, mouse
gtcctacccgagcctcccct

SEQ ID NO: 815586 - DNA, 20 bp, mouse
gggtgcgcatgcacagagtt

SEQ ID NO: 815587 - DNA, 20 bp, mouse
gatggggcgggactcgagta

SEQ ID NO: 815588 - DNA, 20 bp, mouse
gacccctagtgggatggggc

SEQ ID NO: 815589 - DNA, 20 bp, mouse
gcgaaggaggggcgtcagtg

SEQ ID NO: 815590 - DNA, 20 bp, mouse
gtaggggtggcatgcgaagg

SEQ ID NO: 815591 - DNA, 20 bp, mouse
gggaggcggtaacccctagt

SEQ ID NO: 815592 - DNA, 20 bp, mouse
ggtcccgccccatcccacta

SEQ ID NO: 815593 - DNA, 20 bp, mouse
gtaccgcctccgtccaggta

SEQ ID NO: 815594 - DNA, 20 bp, mouse
ggccacccctacctggacgg

SEQ ID NO: 815595 - DNA, 20 bp, mouse
gcatgccacccctacctgga

SEQ ID NO: 815596 - DNA, 20 bp, mouse
gggacgcgcggggacacctt

SEQ ID NO: 815597 - DNA, 20 bp, mouse
gcaggggcggtggtggacta

SEQ ID NO: 815598 - DNA, 20 bp, mouse
gtagccccgcgacccagggg

SEQ ID NO: 815599 - DNA, 20 bp, mouse
ggggcaggagaagtaacccg

SEQ ID NO: 815600 - DNA, 20 bp, mouse
gagtgtgacaataacccaag

SEQ ID NO: 815601 - DNA, 20 bp, mouse
gctgccgcacccgcaccctc

SEQ ID NO: 815602 - DNA, 20 bp, mouse
gagggtagccccgcgaccca

SEQ ID NO: 815603 - DNA, 20 bp, mouse
ggggctccaacctgactcat

SEQ ID NO: 815604 - DNA, 20 bp, mouse
gtgggcctggaaaaaggaac

SEQ ID NO: 815605 - DNA, 20 bp, mouse
gaaccccgagggtgcgggtg

SEQ ID NO: 815606 - DNA, 20 bp, mouse
gtggggcggggtctgaatca

SEQ ID NO: 815607 - DNA, 20 bp, mouse
gaggaagtgacggtatcaaa

SEQ ID NO: 815608 - DNA, 20 bp, mouse
gtaggtgtgtatgcccgagg

SEQ ID NO: 815609 - DNA, 20 bp, mouse
ggcggagctaggcgtaactc

SEQ ID NO: 815610 - DNA, 20 bp, mouse
gtggccaataagaagtatgt

SEQ ID NO: 815611 - DNA, 20 bp, mouse
gtcagggcggggctacaatc

SEQ ID NO: 815612 - DNA, 20 bp, mouse
gagtgacggtatcaaagggc

SEQ ID NO: 815613 - DNA, 20 bp, mouse
ggcggggtctgaatcagggc

SEQ ID NO: 815614 - DNA, 20 bp, mouse
gtgcccgaggaggcgtggtt

SEQ ID NO: 815615 - DNA, 20 bp, mouse
gcgaggaggcgtggtttggg

SEQ ID NO: 815616 - DNA, 20 bp, mouse
gtgcggtgcgccctgagtga

SEQ ID NO: 815617 - DNA, 20 bp, mouse
gggaaaacgcacgctgtggg

SEQ ID NO: 815618 - DNA, 20 bp, mouse
ggggttgctaggttcttagc

SEQ ID NO: 815619 - DNA, 20 bp, mouse
gccgccccgccccgtgaagg

SEQ ID NO: 815620 - DNA, 20 bp, mouse
gtcacccgcagcagcgagca

SEQ ID NO: 815621 - DNA, 20 bp, mouse
ggcaccctgctcgctgctgc

SEQ ID NO: 815622 - DNA, 20 bp, mouse
ggtctccgccttcacggggc

SEQ ID NO: 815623 - DNA, 20 bp, mouse
gaagggaaaacgcacgctgt

SEQ ID NO: 815624 - DNA, 20 bp, mouse
gctagtgcccagcgtaccca

SEQ ID NO: 815625 - DNA, 20 bp, mouse
gcgcacgctgtgggaggaac

SEQ ID NO: 815626 - DNA, 20 bp, mouse
ggggctgggagggaatctaa

SEQ ID NO: 815627 - DNA, 20 bp, mouse
ggctgggaatggttatgggg

SEQ ID NO: 815628 - DNA, 20 bp, mouse
ggggtgcggggcaaccggga

SEQ ID NO: 815629 - DNA, 20 bp, mouse
gaaacgcagcgttggagacc

SEQ ID NO: 815630 - DNA, 20 bp, mouse
gcggggcactgcagccccgt

SEQ ID NO: 815631 - DNA, 20 bp, mouse
ggcgggtggcggccacccac

SEQ ID NO: 815632 - DNA, 20 bp, mouse
ggccccgcaccccgaatcgg

SEQ ID NO: 815633 - DNA, 20 bp, mouse
gggagggaatctaagggatc

SEQ ID NO: 815634 - DNA, 20 bp, mouse
ggcggctggccccccgattc

SEQ ID NO: 815635 - DNA, 20 bp, mouse
ggccccgagccgcggggaag

SEQ ID NO: 815636 - DNA, 20 bp, mouse
ggggagagcctgattgggga

SEQ ID NO: 815637 - DNA, 20 bp, mouse
gaggaggggctggtccgggg

SEQ ID NO: 815638 - DNA, 20 bp, mouse
gccaggctgcccgagggagg

SEQ ID NO: 815639 - DNA, 20 bp, mouse
ggacctcgaagcctataggt

SEQ ID NO: 815640 - DNA, 20 bp, mouse
gtaggcttcgaggtcaccaa

SEQ ID NO: 815641 - DNA, 20 bp, mouse
gcctggccgacttgtctcaa

SEQ ID NO: 815642 - DNA, 20 bp, mouse
gaaggcttaacttcagtgag

SEQ ID NO: 815643 - DNA, 20 bp, mouse
gatcaggctctcccacctat

SEQ ID NO: 815644 - DNA, 20 bp, mouse
ggagggaggaggggctggtc

SEQ ID NO: 815645 - DNA, 20 bp, mouse
gctcccacctataggcttcg

SEQ ID NO: 815646 - DNA, 20 bp, mouse
gcaggctgtgcagctgatat

SEQ ID NO: 815647 - DNA, 20 bp, mouse
gtgtgcagctgatataggct

SEQ ID NO: 815648 - DNA, 20 bp, mouse
gctctcttggcgtcctatcc

SEQ ID NO: 815649 - DNA, 20 bp, mouse
gcagctgatataggctgggc

SEQ ID NO: 815650 - DNA, 20 bp, mouse
gctggaggctggataggtaa

SEQ ID NO: 815651 - DNA, 20 bp, mouse
gaaaaggtacctcaccatgg

SEQ ID NO: 815652 - DNA, 20 bp, mouse
gaatgccatagagggtctgg

SEQ ID NO: 815653 - DNA, 20 bp, mouse
ggctggataggtaaaggcta

SEQ ID NO: 815654 - DNA, 20 bp, mouse
ggtctgaaatgtggaaatca

SEQ ID NO: 815655 - DNA, 20 bp, mouse
gcctggagacttagtgatga

SEQ ID NO: 815656 - DNA, 20 bp, mouse
gcagaagagaggcactgagt

SEQ ID NO: 815657 - DNA, 20 bp, mouse
gctgacgcaagctggaccga

SEQ ID NO: 815658 - DNA, 20 bp, mouse
gtggaccgagggcggtgttg

SEQ ID NO: 815659 - DNA, 20 bp, mouse
gcggtgttggggccaggtga

SEQ ID NO: 815660 - DNA, 20 bp, mouse
gcactgagttggtttgctgt

SEQ ID NO: 815661 - DNA, 20 bp, mouse
gggtcacttggcttaaacat

SEQ ID NO: 815662 - DNA, 20 bp, mouse
gcaatccgttgcgtggtcag

SEQ ID NO: 815663 - DNA, 20 bp, mouse
gacgcaagctggaccgaggg

SEQ ID NO: 815664 - DNA, 20 bp, mouse
gctggccccaacaccgccct

SEQ ID NO: 815665 - DNA, 20 bp, mouse
gcaatcccctgaccacgcaa

SEQ ID NO: 815666 - DNA, 20 bp, mouse
ggtccagctgtccttttaga

SEQ ID NO: 815667 - DNA, 20 bp, mouse
ggtggctaggctggaaggga

SEQ ID NO: 815668 - DNA, 20 bp, mouse
gtggacagctagactccacc

SEQ ID NO: 815669 - DNA, 20 bp, mouse
gaagacccagggcgggtgga

SEQ ID NO: 815670 - DNA, 20 bp, mouse
gaggcccctccacccgccct

SEQ ID NO: 815671 - DNA, 20 bp, mouse
ggaactcacaccaaactctt

SEQ ID NO: 815672 - DNA, 20 bp, mouse
gggggcctccattgctctct

SEQ ID NO: 815673 - DNA, 20 bp, mouse
gtaacaagacccagggcggg

SEQ ID NO: 815674 - DNA, 20 bp, mouse
gtagccaccaatagcagtgc

SEQ ID NO: 815675 - DNA, 20 bp, mouse
gagatgctgccccctatcac

SEQ ID NO: 815676 - DNA, 20 bp, mouse
gagggctggggtctctaaac

SEQ ID NO: 815677 - DNA, 20 bp, mouse
gggggagggcggccctagga

SEQ ID NO: 815678 - DNA, 20 bp, mouse
ggtctctaaactgggagcgg

SEQ ID NO: 815679 - DNA, 20 bp, mouse
ggtctgccccacccctccta

SEQ ID NO: 815680 - DNA, 20 bp, mouse
gaaagcagtttgcagaacta

SEQ ID NO: 815681 - DNA, 20 bp, mouse
ggtttgcagaactagggctg

SEQ ID NO: 815682 - DNA, 20 bp, mouse
gctccggctggctcttaaca

SEQ ID NO: 815683 - DNA, 20 bp, mouse
gtctaaactgggagcggggg

SEQ ID NO: 815684 - DNA, 20 bp, mouse
ggggggaaaagcctgacctg

SEQ ID NO: 815685 - DNA, 20 bp, mouse
ggatagggatccgagaaaaa

SEQ ID NO: 815686 - DNA, 20 bp, mouse
gctcggaaatagggcgtcgg

SEQ ID NO: 815687 - DNA, 20 bp, mouse
gaagagaggtgcgagtccac

SEQ ID NO: 815688 - DNA, 20 bp, mouse
gaggtgcgagtccacagggt

SEQ ID NO: 815689 - DNA, 20 bp, mouse
gctggtgcagctcggaaata

SEQ ID NO: 815690 - DNA, 20 bp, mouse
gcagctcggaaatagggcgt

SEQ ID NO: 815691 - DNA, 20 bp, mouse
ggcaccagagcatgaggtga

SEQ ID NO: 815692 - DNA, 20 bp, mouse
gggctctcgtagcaaatcgc

SEQ ID NO: 815693 - DNA, 20 bp, mouse
gaacccctcacctcatgctc

SEQ ID NO: 815694 - DNA, 20 bp, mouse
gaatcgcgggcccggaagag

SEQ ID NO: 815695 - DNA, 20 bp, mouse
gctggtgacgtcatcactgc

SEQ ID NO: 815696 - DNA, 20 bp, mouse
gctggctcagaactattgtt

SEQ ID NO: 815697 - DNA, 20 bp, mouse
gaataactggataaacgggt

SEQ ID NO: 815698 - DNA, 20 bp, mouse
gagaagctggtgtggtccga

SEQ ID NO: 815699 - DNA, 20 bp, mouse
gtaaaaataactggataaac

SEQ ID NO: 815700 - DNA, 20 bp, mouse
gctggacggtcatgtgattc

SEQ ID NO: 815701 - DNA, 20 bp, mouse
gtattgttgggttgagaagc

SEQ ID NO: 815702 - DNA, 20 bp, mouse
gtcctggaaagagcgttaag

SEQ ID NO: 815703 - DNA, 20 bp, mouse
ggaaagagcgttaagaggtt

SEQ ID NO: 815704 - DNA, 20 bp, mouse
gacaggccgcaggaaactct

SEQ ID NO: 815705 - DNA, 20 bp, mouse
gacagtgtttaatttggcca

SEQ ID NO: 815706 - DNA, 20 bp, mouse
ggggtggggtcggtttctga

SEQ ID NO: 815707 - DNA, 20 bp, mouse
gtgaccccggggtctgcggt

SEQ ID NO: 815708 - DNA, 20 bp, mouse
gcggcaaaagcccctccttg

SEQ ID NO: 815709 - DNA, 20 bp, mouse
gcccacccaccgcagacccc

SEQ ID NO: 815710 - DNA, 20 bp, mouse
gggagtgagaggacccacca

SEQ ID NO: 815711 - DNA, 20 bp, mouse
ggctctgaacaaactgaccc

SEQ ID NO: 815712 - DNA, 20 bp, mouse
gcaggggtccttccacagat

SEQ ID NO: 815713 - DNA, 20 bp, mouse
gcactggccctgtgagaggc

SEQ ID NO: 815714 - DNA, 20 bp, mouse
ggctttctcagctgctcggt

SEQ ID NO: 815715 - DNA, 20 bp, mouse
gaaagccacaccccaaggag

SEQ ID NO: 815716 - DNA, 20 bp, mouse
ggagggcggggttctttgat

SEQ ID NO: 815717 - DNA, 20 bp, mouse
gaggtgctcgaacatctgac

SEQ ID NO: 815718 - DNA, 20 bp, mouse
gccccgcctccggagctgga

SEQ ID NO: 815719 - DNA, 20 bp, mouse
gttctcctcccgaactacct

SEQ ID NO: 815720 - DNA, 20 bp, mouse
gcccgagggaagctggattg

SEQ ID NO: 815721 - DNA, 20 bp, mouse
ggaggagaagacaacccagc

SEQ ID NO: 815722 - DNA, 20 bp, mouse
gcgccctccagctccggagg

SEQ ID NO: 815723 - DNA, 20 bp, mouse
gaggtgctttacagcatcac

SEQ ID NO: 815724 - DNA, 20 bp, mouse
gctcgaacatctgaccggct

SEQ ID NO: 815725 - DNA, 20 bp, mouse
gatgatgtgcctgacgtccc

SEQ ID NO: 815726 - DNA, 20 bp, mouse
gaaaagggaaggctggtcag

SEQ ID NO: 815727 - DNA, 20 bp, mouse
ggactagcgggaagacccga

SEQ ID NO: 815728 - DNA, 20 bp, mouse
gagacgaagccagaaccggg

SEQ ID NO: 815729 - DNA, 20 bp, mouse
ggggaagacccgagggcggt

SEQ ID NO: 815730 - DNA, 20 bp, mouse
gaggcctcactcacctcccg

SEQ ID NO: 815731 - DNA, 20 bp, mouse
gtcgctggtcgcagggtcaa

SEQ ID NO: 815732 - DNA, 20 bp, mouse
gtcgcagcgcacgtcactct

SEQ ID NO: 815733 - DNA, 20 bp, mouse
ggaaccgggaggggactagc

SEQ ID NO: 815734 - DNA, 20 bp, mouse
ggcctccgcgtacccgcacg

SEQ ID NO: 815735 - DNA, 20 bp, mouse
gtgcgggtacgcggaggcgg

SEQ ID NO: 815736 - DNA, 20 bp, mouse
ggccctgcgcagccgcacct

SEQ ID NO: 815737 - DNA, 20 bp, mouse
gcgcctcagcgctacgccgg

SEQ ID NO: 815738 - DNA, 20 bp, mouse
gctgcgcagggcgcccgagc

SEQ ID NO: 815739 - DNA, 20 bp, mouse
gtccctgcgcagccgcaccc

SEQ ID NO: 815740 - DNA, 20 bp, mouse
gggcgcgtccgcgaagtgaa

SEQ ID NO: 815741 - DNA, 20 bp, mouse
gcgccgatcaggccgaggtg

SEQ ID NO: 815742 - DNA, 20 bp, mouse
gcgctgaggcggccagggtg

SEQ ID NO: 815743 - DNA, 20 bp, mouse
gagcaggctgagtgcgccgt

SEQ ID NO: 815744 - DNA, 20 bp, mouse
ggcctggcgtaggagagcgg

SEQ ID NO: 815745 - DNA, 20 bp, mouse
gcgccggcgtagcgccgatc

SEQ ID NO: 815746 - DNA, 20 bp, mouse
gtccacaaatgcaaaggcga

SEQ ID NO: 815747 - DNA, 20 bp, mouse
ggcctccccaagatttcctg

SEQ ID NO: 815748 - DNA, 20 bp, mouse
gtccgtgctcgcaggaacag

SEQ ID NO: 815749 - DNA, 20 bp, mouse
ggcctggagaataaagtctc

SEQ ID NO: 815750 - DNA, 20 bp, mouse
gcacaccccaggaaatcttg

SEQ ID NO: 815751 - DNA, 20 bp, mouse
ggtgctcgcaggaacagagg

SEQ ID NO: 815752 - DNA, 20 bp, mouse
gaccccaggaaatcttgggg

SEQ ID NO: 815753 - DNA, 20 bp, mouse
gggcggggcccggcggtgga

SEQ ID NO: 815754 - DNA, 20 bp, mouse
ggcaaccggcgaatcctgcc

SEQ ID NO: 815755 - DNA, 20 bp, mouse
gcccaagtccacaaatgcaa

SEQ ID NO: 815756 - DNA, 20 bp, mouse
ggatgaaagcggacagttgc

SEQ ID NO: 815757 - DNA, 20 bp, mouse
gcagacggtaagaatgaagg

SEQ ID NO: 815758 - DNA, 20 bp, mouse
ggctcagacggtaagaatga

SEQ ID NO: 815759 - DNA, 20 bp, mouse
gcaggataatcaaataaatg

SEQ ID NO: 815760 - DNA, 20 bp, mouse
gagcaactagaaatgtctct

SEQ ID NO: 815761 - DNA, 20 bp, mouse
gtacagtcatttgccttcca

SEQ ID NO: 815762 - DNA, 20 bp, mouse
gacaacccatgagataacca

SEQ ID NO: 815763 - DNA, 20 bp, mouse
ggaagtaagtagatacaaat

SEQ ID NO: 815764 - DNA, 20 bp, mouse
gaatcaaataaatgtggttg

SEQ ID NO: 815765 - DNA, 20 bp, mouse
ggccaatcacccattgtgtg

SEQ ID NO: 815766 - DNA, 20 bp, mouse
ggggctagacggagcgacgg

SEQ ID NO: 815767 - DNA, 20 bp, mouse
gccgctcggggcggattctg

SEQ ID NO: 815768 - DNA, 20 bp, mouse
gctagacggagcgacggcgg

SEQ ID NO: 815769 - DNA, 20 bp, mouse
ggggagagtaggacggaagt

SEQ ID NO: 815770 - DNA, 20 bp, mouse
gggtcccccatggtatgagg

SEQ ID NO: 815771 - DNA, 20 bp, mouse
gcggaagtgggtaccctcgt

SEQ ID NO: 815772 - DNA, 20 bp, mouse
ggcgggtcccccatggtatg

SEQ ID NO: 815773 - DNA, 20 bp, mouse
gagccgcgcgcgtcgggttc

SEQ ID NO: 815774 - DNA, 20 bp, mouse
gggaaccgggatcaacaggg

SEQ ID NO: 815775 - DNA, 20 bp, mouse
gcggaagtgcgctgaccgcg

SEQ ID NO: 815776 - DNA, 20 bp, mouse
gcggggatgcacaacgctgg

SEQ ID NO: 815777 - DNA, 20 bp, mouse
gtcccccgggcctgccacgt

SEQ ID NO: 815778 - DNA, 20 bp, mouse
gagccggggatgcacaacgc

SEQ ID NO: 815779 - DNA, 20 bp, mouse
gcaacgctggaggaccaggt

SEQ ID NO: 815780 - DNA, 20 bp, mouse
gagagctaggatgcgagccg

SEQ ID NO: 815781 - DNA, 20 bp, mouse
gtcccacgtggcaggcccgg

SEQ ID NO: 815782 - DNA, 20 bp, mouse
gggcctccgtgagtcaagga

SEQ ID NO: 815783 - DNA, 20 bp, mouse
ggatgaagctagagagagct

SEQ ID NO: 815784 - DNA, 20 bp, mouse
gcggtgacgcgcagggtata

SEQ ID NO: 815785 - DNA, 20 bp, mouse
ggctaggaaggacagatggg

SEQ ID NO: 815786 - DNA, 20 bp, mouse
ggggcctccagatagtggga

SEQ ID NO: 815787 - DNA, 20 bp, mouse
gaggactcttagttcatgtc

SEQ ID NO: 815788 - DNA, 20 bp, mouse
gcgtaggtagagcgtgtgga

SEQ ID NO: 815789 - DNA, 20 bp, mouse
ggggaggggcctccagatag

SEQ ID NO: 815790 - DNA, 20 bp, mouse
gttaggatagggtagagcgt

SEQ ID NO: 815791 - DNA, 20 bp, mouse
gtcaggaaggtgtaaggcag

SEQ ID NO: 815792 - DNA, 20 bp, mouse
gcaaccctcccactatctgg

SEQ ID NO: 815793 - DNA, 20 bp, mouse
gctggacctggcagggagtc

SEQ ID NO: 815794 - DNA, 20 bp, mouse
gtagtgggagggttggtgac

SEQ ID NO: 815795 - DNA, 20 bp, mouse
gggaagctcaggaaggtgta

SEQ ID NO: 815796 - DNA, 20 bp, mouse
gggtactgaatgagtgtggc

SEQ ID NO: 815797 - DNA, 20 bp, mouse
gacgcgaccctggacagctc

SEQ ID NO: 815798 - DNA, 20 bp, mouse
gctgcaacgcctactggctc

SEQ ID NO: 815799 - DNA, 20 bp, mouse
gtagcagctcgcagccccgg

SEQ ID NO: 815800 - DNA, 20 bp, mouse
ggcgtggtactgaatgagtg

SEQ ID NO: 815801 - DNA, 20 bp, mouse
ggccaagtagtgttttctat

SEQ ID NO: 815802 - DNA, 20 bp, mouse
gcaacatagttccggaagta

SEQ ID NO: 815803 - DNA, 20 bp, mouse
gtggcagcagcatcgaccaa

SEQ ID NO: 815804 - DNA, 20 bp, mouse
gctacttggcaacatagttc

SEQ ID NO: 815805 - DNA, 20 bp, mouse
ggacagaactcatagtccat

SEQ ID NO: 815806 - DNA, 20 bp, mouse
gtaacaggcgagggtgatct

SEQ ID NO: 815807 - DNA, 20 bp, mouse
gctgagaggcagctggtgaa

SEQ ID NO: 815808 - DNA, 20 bp, mouse
gtgggctcttcagggaacag

SEQ ID NO: 815809 - DNA, 20 bp, mouse
gtggcagttcagggtgtgac

SEQ ID NO: 815810 - DNA, 20 bp, mouse
gaagccgcccacctaaggac

SEQ ID NO: 815811 - DNA, 20 bp, mouse
gtctccccaggctttcgggg

SEQ ID NO: 815812 - DNA, 20 bp, mouse
gggttcaagccgcccaccta

SEQ ID NO: 815813 - DNA, 20 bp, mouse
gcaccctgaactgccagtca

SEQ ID NO: 815814 - DNA, 20 bp, mouse
ggtgggtccctgtccttagg

SEQ ID NO: 815815 - DNA, 20 bp, mouse
ggggtgatctgggctcttca

SEQ ID NO: 815816 - DNA, 20 bp, mouse
gtgggaggcaggctggacaa

SEQ ID NO: 815817 - DNA, 20 bp, mouse
gagcatcagcaggacagggg

SEQ ID NO: 815818 - DNA, 20 bp, mouse
gggggtggggcgtgagtttg

SEQ ID NO: 815819 - DNA, 20 bp, mouse
gcagaggaccctggatccca

SEQ ID NO: 815820 - DNA, 20 bp, mouse
gcagcctgcctcccacaaga

SEQ ID NO: 815821 - DNA, 20 bp, mouse
ggtggggcgtgagtttgagg

SEQ ID NO: 815822 - DNA, 20 bp, mouse
ggttagcaggtgtgcactta

SEQ ID NO: 815823 - DNA, 20 bp, mouse
ggggagggacactaccttaa

SEQ ID NO: 815824 - DNA, 20 bp, mouse
gttagggaattgtagtgccc

SEQ ID NO: 815825 - DNA, 20 bp, mouse
gtaaatgttcccactcattc

SEQ ID NO: 815826 - DNA, 20 bp, mouse
ggtaggcagggcactctcga

SEQ ID NO: 815827 - DNA, 20 bp, mouse
ggcgaatgccggagtatccg

SEQ ID NO: 815828 - DNA, 20 bp, mouse
ggggcccgatggaaccgtct

SEQ ID NO: 815829 - DNA, 20 bp, mouse
ggggtagagtagttccgctc

SEQ ID NO: 815830 - DNA, 20 bp, mouse
gtggggcggaagtgcgcggg

SEQ ID NO: 815831 - DNA, 20 bp, mouse
gcggaccggctggcgaatgc

SEQ ID NO: 815832 - DNA, 20 bp, mouse
gtacccagccgcggatactc

SEQ ID NO: 815833 - DNA, 20 bp, mouse
ggccccttcgaaatccggac

SEQ ID NO: 815834 - DNA, 20 bp, mouse
gctctggggcggaagtgcgc

SEQ ID NO: 815835 - DNA, 20 bp, mouse
gtgatgcgcgaggcgagcga

SEQ ID NO: 815836 - DNA, 20 bp, mouse
gggcccgggcgtcatgtctt

SEQ ID NO: 815837 - DNA, 20 bp, mouse
ggcgaaggggcgggagctca

SEQ ID NO: 815838 - DNA, 20 bp, mouse
gtccacctcggcgaaggggc

SEQ ID NO: 815839 - DNA, 20 bp, mouse
gcccgtctgtacaaagatgg

SEQ ID NO: 815840 - DNA, 20 bp, mouse
gcatgccgcggcgggaggaa

SEQ ID NO: 815841 - DNA, 20 bp, mouse
gggcccaagacatgacgccc

SEQ ID NO: 815842 - DNA, 20 bp, mouse
gcccttcgccgaggtggaaa

SEQ ID NO: 815843 - DNA, 20 bp, mouse
gggccgcgacgaagccgcgg

SEQ ID NO: 815844 - DNA, 20 bp, mouse
gcgcctccgcggcttcgtcg

SEQ ID NO: 815845 - DNA, 20 bp, mouse
ggggcagtgtgggccggtgg

SEQ ID NO: 815846 - DNA, 20 bp, mouse
gcagggagtaggcaccacag

SEQ ID NO: 815847 - DNA, 20 bp, mouse
ggacaccaggaagggggcta

SEQ ID NO: 815848 - DNA, 20 bp, mouse
ggggatcccaccgtggaggt

SEQ ID NO: 815849 - DNA, 20 bp, mouse
gtctgccatcccagccgctg

SEQ ID NO: 815850 - DNA, 20 bp, mouse
ggctagggatcccaccgtgg

SEQ ID NO: 815851 - DNA, 20 bp, mouse
gccccggcgtggacgcactt

SEQ ID NO: 815852 - DNA, 20 bp, mouse
ggacagagaggtaagcgccc

SEQ ID NO: 815853 - DNA, 20 bp, mouse
gagtaggcaccacagcggct

SEQ ID NO: 815854 - DNA, 20 bp, mouse
gctcccaagtgcgtccacgc

SEQ ID NO: 815855 - DNA, 20 bp, mouse
gaccgtggaggtgggctcca

SEQ ID NO: 815856 - DNA, 20 bp, mouse
gccggcgcccttaaccaaga

SEQ ID NO: 815857 - DNA, 20 bp, mouse
gtgacaggcggctaaagtga

SEQ ID NO: 815858 - DNA, 20 bp, mouse
gaagtgccctgctaaagagg

SEQ ID NO: 815859 - DNA, 20 bp, mouse
ggcagcagaggtgttagcgg

SEQ ID NO: 815860 - DNA, 20 bp, mouse
gaggaagaagagttcgtttc

SEQ ID NO: 815861 - DNA, 20 bp, mouse
gaggaggctgtgagacaatc

SEQ ID NO: 815862 - DNA, 20 bp, mouse
ggggaccccggcaaccgcta

SEQ ID NO: 815863 - DNA, 20 bp, mouse
gtggttaagggcgccgggat

SEQ ID NO: 815864 - DNA, 20 bp, mouse
gccggggtccccaacttaga

SEQ ID NO: 815865 - DNA, 20 bp, mouse
ggctcgcgctagaagggcag

SEQ ID NO: 815866 - DNA, 20 bp, mouse
gctacagtaacagtatgtga

SEQ ID NO: 815867 - DNA, 20 bp, mouse
gagactgcggagaagaggca

SEQ ID NO: 815868 - DNA, 20 bp, mouse
ggcgtaaagttcaataaagg

SEQ ID NO: 815869 - DNA, 20 bp, mouse
gataaagggggtcgggagga

SEQ ID NO: 815870 - DNA, 20 bp, mouse
gttcaataaagggggtcggg

SEQ ID NO: 815871 - DNA, 20 bp, mouse
gggaggagactgcggagaag

SEQ ID NO: 815872 - DNA, 20 bp, mouse
gaggaactgtgggaaactgt

SEQ ID NO: 815873 - DNA, 20 bp, mouse
ggctggactttgtccagcca

SEQ ID NO: 815874 - DNA, 20 bp, mouse
gaaaacagacgggtgcttgt

SEQ ID NO: 815875 - DNA, 20 bp, mouse
gttgtgaatcgcattactgt

SEQ ID NO: 815876 - DNA, 20 bp, mouse
gtaaggggccggaaggtcgg

SEQ ID NO: 815877 - DNA, 20 bp, mouse
ggggccggaaggtcggagga

SEQ ID NO: 815878 - DNA, 20 bp, mouse
gcggaccggggcggagtcct

SEQ ID NO: 815879 - DNA, 20 bp, mouse
ggggcgaagggatcacgatg

SEQ ID NO: 815880 - DNA, 20 bp, mouse
ggggtaaggggccggaaggt

SEQ ID NO: 815881 - DNA, 20 bp, mouse
gttcgccccaagcacggctc

SEQ ID NO: 815882 - DNA, 20 bp, mouse
gtagacgggagtattcagcg

SEQ ID NO: 815883 - DNA, 20 bp, mouse
gaagaggcctcgcagggtaa

SEQ ID NO: 815884 - DNA, 20 bp, mouse
gtcttgcaggaataagcgtt

SEQ ID NO: 815885 - DNA, 20 bp, mouse
ggaagggatcacgatgtgga

SEQ ID NO: 815886 - DNA, 20 bp, mouse
gtgcgagccggaggaattgt

SEQ ID NO: 815887 - DNA, 20 bp, mouse
gtagaggaatccgcccaaag

SEQ ID NO: 815888 - DNA, 20 bp, mouse
gacgcaggcgctaaggtaag

SEQ ID NO: 815889 - DNA, 20 bp, mouse
gaggactcacgcaggcgcta

SEQ ID NO: 815890 - DNA, 20 bp, mouse
gccggaggaattgtgggtag

SEQ ID NO: 815891 - DNA, 20 bp, mouse
gtaagcggtgtgcgagccgg

SEQ ID NO: 815892 - DNA, 20 bp, mouse
ggcccacgggatttggaggt

SEQ ID NO: 815893 - DNA, 20 bp, mouse
gccccgaacaaggaaaaatg

SEQ ID NO: 815894 - DNA, 20 bp, mouse
gtcccacctccaaatcccgt

SEQ ID NO: 815895 - DNA, 20 bp, mouse
ggctctccgcacgccccttt

SEQ ID NO: 815896 - DNA, 20 bp, mouse
gtgacccgcacagtaggacg

SEQ ID NO: 815897 - DNA, 20 bp, mouse
gggagctggcgcggaaaaaa

SEQ ID NO: 815898 - DNA, 20 bp, mouse
gactgtatgcggaccccgag

SEQ ID NO: 815899 - DNA, 20 bp, mouse
gaaggggtgacccgcacagt

SEQ ID NO: 815900 - DNA, 20 bp, mouse
ggtaggacggggactgtatg

SEQ ID NO: 815901 - DNA, 20 bp, mouse
gagggcggtgggagcgtagc

SEQ ID NO: 815902 - DNA, 20 bp, mouse
gggcatggagatcctgttat

SEQ ID NO: 815903 - DNA, 20 bp, mouse
gcaccccttggcttctcctg

SEQ ID NO: 815904 - DNA, 20 bp, mouse
ggggtgcagctggattcgtt

SEQ ID NO: 815905 - DNA, 20 bp, mouse
gagaaggaagctcttctctc

SEQ ID NO: 815906 - DNA, 20 bp, mouse
ggaaaacgcagcagagtgac

SEQ ID NO: 815907 - DNA, 20 bp, mouse
gaacgccggggaaatgggcg

SEQ ID NO: 815908 - DNA, 20 bp, mouse
ggacgggaactcagaattgg

SEQ ID NO: 815909 - DNA, 20 bp, mouse
gcaggccccgcccatttccc

SEQ ID NO: 815910 - DNA, 20 bp, mouse
gcccagctcaagaaacgccg

SEQ ID NO: 815911 - DNA, 20 bp, mouse
gggctcgcggtgctcaagcg

SEQ ID NO: 815912 - DNA, 20 bp, mouse
gcaagaaacgccggggaaat

SEQ ID NO: 815913 - DNA, 20 bp, mouse
ggtggagaaggaacacgcga

SEQ ID NO: 815914 - DNA, 20 bp, mouse
ggccagctggccggctcaaa

SEQ ID NO: 815915 - DNA, 20 bp, mouse
gtccccggcgtttcttgagc

SEQ ID NO: 815916 - DNA, 20 bp, mouse
gtagctgaaccgcacatagt

SEQ ID NO: 815917 - DNA, 20 bp, mouse
ggctcccaaaactcgagcgt

SEQ ID NO: 815918 - DNA, 20 bp, mouse
gtctgggaggccaaaggacg

SEQ ID NO: 815919 - DNA, 20 bp, mouse
gcccaagagtcagtgctctg

SEQ ID NO: 815920 - DNA, 20 bp, mouse
gtatgtgcggttcagctagt

SEQ ID NO: 815921 - DNA, 20 bp, mouse
ggaccctgccaggcgctcgg

SEQ ID NO: 815922 - DNA, 20 bp, mouse
gaatttgccaaggaaaatcg

SEQ ID NO: 815923 - DNA, 20 bp, mouse
gggtgcttaacaaacagtca

SEQ ID NO: 815924 - DNA, 20 bp, mouse
gggacggggaggagacgtgc

SEQ ID NO: 815925 - DNA, 20 bp, mouse
gtccctgtccccacctgaaa

SEQ ID NO: 815926 - DNA, 20 bp, mouse
ggggcggggccaatccacag

SEQ ID NO: 815927 - DNA, 20 bp, mouse
ggcggggccacaggagggga

SEQ ID NO: 815928 - DNA, 20 bp, mouse
gaggcggtgccgcttggggt

SEQ ID NO: 815929 - DNA, 20 bp, mouse
gcctaggcgtccagacagag

SEQ ID NO: 815930 - DNA, 20 bp, mouse
gagtagggcggggtcacggg

SEQ ID NO: 815931 - DNA, 20 bp, mouse
gcagctctctgatcgagcag

SEQ ID NO: 815932 - DNA, 20 bp, mouse
gatcgagcagtggggtgtgc

SEQ ID NO: 815933 - DNA, 20 bp, mouse
gcacaggaggggagggttgc

SEQ ID NO: 815934 - DNA, 20 bp, mouse
gtgggcgagtgttgtgggcg

SEQ ID NO: 815935 - DNA, 20 bp, mouse
gggtgtgcagggatgctccc

SEQ ID NO: 815936 - DNA, 20 bp, mouse
gtcgacctaaggggtgggga

SEQ ID NO: 815937 - DNA, 20 bp, mouse
gaaactcgacctaaggggtg

SEQ ID NO: 815938 - DNA, 20 bp, mouse
gagaagctgggggtcgagag

SEQ ID NO: 815939 - DNA, 20 bp, mouse
gtaggcgccccgggcgcact

SEQ ID NO: 815940 - DNA, 20 bp, mouse
ggggtcgagagtggaaattt

SEQ ID NO: 815941 - DNA, 20 bp, mouse
gaacccccgcccccaccttg

SEQ ID NO: 815942 - DNA, 20 bp, mouse
ggtgcatgaaactcgaccta

SEQ ID NO: 815943 - DNA, 20 bp, mouse
ggagcagcgccccaaggtgg

SEQ ID NO: 815944 - DNA, 20 bp, mouse
ggctgtcaaacgttagttca

SEQ ID NO: 815945 - DNA, 20 bp, mouse
gtgggagcagcgccccaagg

SEQ ID NO: 815946 - DNA, 20 bp, mouse
ggatcggggcgccctggctc

SEQ ID NO: 815947 - DNA, 20 bp, mouse
gaatccgatctggtgcctag

SEQ ID NO: 815948 - DNA, 20 bp, mouse
ggctagctgtgggccagagg

SEQ ID NO: 815949 - DNA, 20 bp, mouse
gcgatctggtgcctagaggc

SEQ ID NO: 815950 - DNA, 20 bp, mouse
gagcgagcaggaggcggaaa

SEQ ID NO: 815951 - DNA, 20 bp, mouse
gaactagaatagagggtctc

SEQ ID NO: 815952 - DNA, 20 bp, mouse
ggggaggaagttttctaccc

SEQ ID NO: 815953 - DNA, 20 bp, mouse
gggcgccccgatcccgctcc

SEQ ID NO: 815954 - DNA, 20 bp, mouse
gctagaggctggctagctgt

SEQ ID NO: 815955 - DNA, 20 bp, mouse
gaaaggcgtaactagaatag

SEQ ID NO: 815956 - DNA, 20 bp, mouse
ggggcccgatacacactggt

SEQ ID NO: 815957 - DNA, 20 bp, mouse
gtggggctggaaacaggcgt

SEQ ID NO: 815958 - DNA, 20 bp, mouse
gagggcaacgagaagggcgt

SEQ ID NO: 815959 - DNA, 20 bp, mouse
gaaggtgcatacttgtcaga

SEQ ID NO: 815960 - DNA, 20 bp, mouse
gcgggtgggtagctgctgat

SEQ ID NO: 815961 - DNA, 20 bp, mouse
gagcagaagccggttccggc

SEQ ID NO: 815962 - DNA, 20 bp, mouse
gaggaagagggcaacgagaa

SEQ ID NO: 815963 - DNA, 20 bp, mouse
gccccccggcgagcagaagc

SEQ ID NO: 815964 - DNA, 20 bp, mouse
ggggcgggcccgatacacac

SEQ ID NO: 815965 - DNA, 20 bp, mouse
gcggcagtgtttttcatctt

SEQ ID NO: 815966 - DNA, 20 bp, mouse
ggagggtcccaagctcttac

SEQ ID NO: 815967 - DNA, 20 bp, mouse
gggtcccaagctcttactgg

SEQ ID NO: 815968 - DNA, 20 bp, mouse
gtctcctccagtaagagctt

SEQ ID NO: 815969 - DNA, 20 bp, mouse
gtaggaggggccatgagagc

SEQ ID NO: 815970 - DNA, 20 bp, mouse
gggcggccaacctgaggcag

SEQ ID NO: 815971 - DNA, 20 bp, mouse
gggccggtttcccgctctca

SEQ ID NO: 815972 - DNA, 20 bp, mouse
gggtaggactggaaggatac

SEQ ID NO: 815973 - DNA, 20 bp, mouse
gcttactggaggagacaagc

SEQ ID NO: 815974 - DNA, 20 bp, mouse
gggccatgagagcgggaaac

SEQ ID NO: 815975 - DNA, 20 bp, mouse
gcgggaaaccggcccatcgc

SEQ ID NO: 815976 - DNA, 20 bp, mouse
gccgcgcggcgctgcactgg

SEQ ID NO: 815977 - DNA, 20 bp, mouse
ggcggctgcagcccgggaga

SEQ ID NO: 815978 - DNA, 20 bp, mouse
gcaagggcccggcctcgttc

SEQ ID NO: 815979 - DNA, 20 bp, mouse
gcggcgccgggcccatttcg

SEQ ID NO: 815980 - DNA, 20 bp, mouse
ggacccggcgggctcgcaga

SEQ ID NO: 815981 - DNA, 20 bp, mouse
gctccccagcggaaaggggc

SEQ ID NO: 815982 - DNA, 20 bp, mouse
gcggcgctgcactgggggcg

SEQ ID NO: 815983 - DNA, 20 bp, mouse
gcgccgggcccatttcgcgg

SEQ ID NO: 815984 - DNA, 20 bp, mouse
gacgacggcagcccagaacg

SEQ ID NO: 815985 - DNA, 20 bp, mouse
gctgggggcggggagtctga

SEQ ID NO: 815986 - DNA, 20 bp, mouse
gcggactggaaaccagaagg

SEQ ID NO: 815987 - DNA, 20 bp, mouse
gcccagggaggggcgttggg

SEQ ID NO: 815988 - DNA, 20 bp, mouse
gtaattgtccacagagagag

SEQ ID NO: 815989 - DNA, 20 bp, mouse
gtaggggcgtgcccagggag

SEQ ID NO: 815990 - DNA, 20 bp, mouse
gcgtgcccagggaggggcgt

SEQ ID NO: 815991 - DNA, 20 bp, mouse
ggtccacagagagagcggac

SEQ ID NO: 815992 - DNA, 20 bp, mouse
gtaaggggcggggctgtctt

SEQ ID NO: 815993 - DNA, 20 bp, mouse
gtgggcacgcccctaagggg

SEQ ID NO: 815994 - DNA, 20 bp, mouse
gttggggggcagccaccttc

SEQ ID NO: 815995 - DNA, 20 bp, mouse
ggtaccggaactctgtaaca

SEQ ID NO: 815996 - DNA, 20 bp, mouse
gagtctggggtgacatttta

SEQ ID NO: 815997 - DNA, 20 bp, mouse
gctgcagggtgaaatagtct

SEQ ID NO: 815998 - DNA, 20 bp, mouse
ggggcagggagggctaaatc

SEQ ID NO: 815999 - DNA, 20 bp, mouse
gagagccacctcaggttcct

SEQ ID NO: 816000 - DNA, 20 bp, mouse
gccacctcaggttcctgggt

SEQ ID NO: 816001 - DNA, 20 bp, mouse
gtagggttgagaagtgtccc

SEQ ID NO: 816002 - DNA, 20 bp, mouse
gtggctggggcctgtctgac

SEQ ID NO: 816003 - DNA, 20 bp, mouse
gaaggggagggaccgatcca

SEQ ID NO: 816004 - DNA, 20 bp, mouse
gctcatgggtaggtggaagg

SEQ ID NO: 816005 - DNA, 20 bp, mouse
ggccccagccaaagaaccaa

SEQ ID NO: 816006 - DNA, 20 bp, mouse
ggggcccaggcgtcgcacag

SEQ ID NO: 816007 - DNA, 20 bp, mouse
gccctcaggaatgatccctg

SEQ ID NO: 816008 - DNA, 20 bp, mouse
gcaggcgtcgcacagtggtc

SEQ ID NO: 816009 - DNA, 20 bp, mouse
gcctaaagccaccacggaaa

SEQ ID NO: 816010 - DNA, 20 bp, mouse
gctgcgcagcaccggttccc

SEQ ID NO: 816011 - DNA, 20 bp, mouse
gaggcctcacttctaactcc

SEQ ID NO: 816012 - DNA, 20 bp, mouse
gcacggaaagggcgtgtcta

SEQ ID NO: 816013 - DNA, 20 bp, mouse
gggtggcacctgcgcagcac

SEQ ID NO: 816014 - DNA, 20 bp, mouse
ggatgcgcctggaagagaac

SEQ ID NO: 816015 - DNA, 20 bp, mouse
ggcgcctggagttagaagtg

SEQ ID NO: 816016 - DNA, 20 bp, mouse
ggaccagcccaggggtacca

SEQ ID NO: 816017 - DNA, 20 bp, mouse
ggggtaccagggctcagaac

SEQ ID NO: 816018 - DNA, 20 bp, mouse
gggtcccaggagctgcttac

SEQ ID NO: 816019 - DNA, 20 bp, mouse
gtctgagccctggtacccct

SEQ ID NO: 816020 - DNA, 20 bp, mouse
ggggtggaagagaacagctg

SEQ ID NO: 816021 - DNA, 20 bp, mouse
gtcaactcttgaccagccca

SEQ ID NO: 816022 - DNA, 20 bp, mouse
ggggctcagaactgggtccc

SEQ ID NO: 816023 - DNA, 20 bp, mouse
gaaaccggagcactttgata

SEQ ID NO: 816024 - DNA, 20 bp, mouse
gctgcttaccgggtctgcta

SEQ ID NO: 816025 - DNA, 20 bp, mouse
gagacccggtaagcagctcc

SEQ ID NO: 816026 - DNA, 20 bp, mouse
gaccaactgtcgctggacga

SEQ ID NO: 816027 - DNA, 20 bp, mouse
gcgagcccccgcacgctctg

SEQ ID NO: 816028 - DNA, 20 bp, mouse
ggcggcgcccgtgggacgga

SEQ ID NO: 816029 - DNA, 20 bp, mouse
ggtccagcgacagttggtag

SEQ ID NO: 816030 - DNA, 20 bp, mouse
gtagaggcgccgcacagcag

SEQ ID NO: 816031 - DNA, 20 bp, mouse
gagtggggagggggacgcgt

SEQ ID NO: 816032 - DNA, 20 bp, mouse
gcccgcgcagcagagccgag

SEQ ID NO: 816033 - DNA, 20 bp, mouse
gtctggcggcgggcagctga

SEQ ID NO: 816034 - DNA, 20 bp, mouse
gggcggccccctctgctgtg

SEQ ID NO: 816035 - DNA, 20 bp, mouse
gacggagggctcggcgagtg

SEQ ID NO: 816036 - DNA, 20 bp, mouse
ggggtctataggcagaatgc

SEQ ID NO: 816037 - DNA, 20 bp, mouse
ggcacctttggggacaaccg

SEQ ID NO: 816038 - DNA, 20 bp, mouse
gtataggcagaatgcaggag

SEQ ID NO: 816039 - DNA, 20 bp, mouse
gggggacaaccggggtctat

SEQ ID NO: 816040 - DNA, 20 bp, mouse
gagaccccggttgtccccaa

SEQ ID NO: 816041 - DNA, 20 bp, mouse
ggctctgcgggacctagcgg

SEQ ID NO: 816042 - DNA, 20 bp, mouse
gagctgcagcatcaccccgt

SEQ ID NO: 816043 - DNA, 20 bp, mouse
gcatccttaaagcagccggt

SEQ ID NO: 816044 - DNA, 20 bp, mouse
ggtgcgatggcacagccaac

SEQ ID NO: 816045 - DNA, 20 bp, mouse
ggaagaacagtcacgggccc

SEQ ID NO: 816046 - DNA, 20 bp, mouse
gtagctgctgtgagccctcg

SEQ ID NO: 816047 - DNA, 20 bp, mouse
ggagaggcacaagcattcta

SEQ ID NO: 816048 - DNA, 20 bp, mouse
gtgaaggaagatctttagag

SEQ ID NO: 816049 - DNA, 20 bp, mouse
gccagcctgaccatctctgt

SEQ ID NO: 816050 - DNA, 20 bp, mouse
gagcattctaaggaccccga

SEQ ID NO: 816051 - DNA, 20 bp, mouse
gttacggtgagaagcaaagg

SEQ ID NO: 816052 - DNA, 20 bp, mouse
gtgagaagcaaagggggcgt

SEQ ID NO: 816053 - DNA, 20 bp, mouse
gcaaagggggcgttggcact

SEQ ID NO: 816054 - DNA, 20 bp, mouse
ggggtagaaagtgtgaattc

SEQ ID NO: 816055 - DNA, 20 bp, mouse
gaagttacggtgagaagcaa

SEQ ID NO: 816056 - DNA, 20 bp, mouse
ggggtggggccggtccccaa

SEQ ID NO: 816057 - DNA, 20 bp, mouse
gcagtctaggagccacgcgg

SEQ ID NO: 816058 - DNA, 20 bp, mouse
gggtccccaagggaagaaag

SEQ ID NO: 816059 - DNA, 20 bp, mouse
ggcaaggcgggtcggaggtg

SEQ ID NO: 816060 - DNA, 20 bp, mouse
gcgtccggtcgcgaccagaa

SEQ ID NO: 816061 - DNA, 20 bp, mouse
gcacgcgcgggcaatggtcg

SEQ ID NO: 816062 - DNA, 20 bp, mouse
ggcggggcaaggcgggtcgg

SEQ ID NO: 816063 - DNA, 20 bp, mouse
gggagagagcatgcgcgctg

SEQ ID NO: 816064 - DNA, 20 bp, mouse
gcccaagggaagaaagcggg

SEQ ID NO: 816065 - DNA, 20 bp, mouse
gactgccctgtcattaccta

SEQ ID NO: 816066 - DNA, 20 bp, mouse
gccagggcggggcgcggtag

SEQ ID NO: 816067 - DNA, 20 bp, mouse
gtggcaggaaaaccaggcga

SEQ ID NO: 816068 - DNA, 20 bp, mouse
ggacgtccattggtcaggag

SEQ ID NO: 816069 - DNA, 20 bp, mouse
gcccgccctgggcctgttgg

SEQ ID NO: 816070 - DNA, 20 bp, mouse
gtagggggcgggaccttcgt

SEQ ID NO: 816071 - DNA, 20 bp, mouse
gacagcgcgctacacagctg

SEQ ID NO: 816072 - DNA, 20 bp, mouse
gcctgaccaatggacgtccg

SEQ ID NO: 816073 - DNA, 20 bp, mouse
gactatgcagtggactctag

SEQ ID NO: 816074 - DNA, 20 bp, mouse
ggcggggcgcggtagggggc

SEQ ID NO: 816075 - DNA, 20 bp, mouse
gtgtggccccgcccctacga

SEQ ID NO: 816076 - DNA, 20 bp, mouse
gttccgacgcccaggaagga

SEQ ID NO: 816077 - DNA, 20 bp, mouse
ggtcgtccaaacaatccctg

SEQ ID NO: 816078 - DNA, 20 bp, mouse
gacacaccacagggattgtt

SEQ ID NO: 816079 - DNA, 20 bp, mouse
gacaacgtaactttgttctg

SEQ ID NO: 816080 - DNA, 20 bp, mouse
ggagacagtctcaaaagctt

SEQ ID NO: 816081 - DNA, 20 bp, mouse
gaagcacccgaagccggcgc

SEQ ID NO: 816082 - DNA, 20 bp, mouse
gagtgttccgacgcccagga

SEQ ID NO: 816083 - DNA, 20 bp, mouse
gtactccagtgtggcccacc

SEQ ID NO: 816084 - DNA, 20 bp, mouse
gcacccagcccagagttcag

SEQ ID NO: 816085 - DNA, 20 bp, mouse
gagagcctggtgggccacac

SEQ ID NO: 816086 - DNA, 20 bp, mouse
gtgagctgctctaggttcgt

SEQ ID NO: 816087 - DNA, 20 bp, mouse
gaccgagtgagtagcttctc

SEQ ID NO: 816088 - DNA, 20 bp, mouse
gctgctctaggttcgtgggg

SEQ ID NO: 816089 - DNA, 20 bp, mouse
gtcagagcactcgcaagcct

SEQ ID NO: 816090 - DNA, 20 bp, mouse
gcccagagaagctactcact

SEQ ID NO: 816091 - DNA, 20 bp, mouse
gtgcatgcttgactgagctt

SEQ ID NO: 816092 - DNA, 20 bp, mouse
gcgcacctgaaacacactct

SEQ ID NO: 816093 - DNA, 20 bp, mouse
gcgcagccaggcaagttcct

SEQ ID NO: 816094 - DNA, 20 bp, mouse
gagccctgaccctccaaatt

SEQ ID NO: 816095 - DNA, 20 bp, mouse
gttgaggcaggtttgggcag

SEQ ID NO: 816096 - DNA, 20 bp, mouse
ggatcccggcagctctgcga

SEQ ID NO: 816097 - DNA, 20 bp, mouse
gtcagccgctgaaccttcgg

SEQ ID NO: 816098 - DNA, 20 bp, mouse
gctcttgcacccgcccccga

SEQ ID NO: 816099 - DNA, 20 bp, mouse
gtgggcaagttgggtgatcc

SEQ ID NO: 816100 - DNA, 20 bp, mouse
gcccgagttgctgggcaagt

SEQ ID NO: 816101 - DNA, 20 bp, mouse
gcccaatcacaagcgagcta

SEQ ID NO: 816102 - DNA, 20 bp, mouse
gtgaagcgccgtggagtcat

SEQ ID NO: 816103 - DNA, 20 bp, mouse
gccggcgcccccgtagcgat

SEQ ID NO: 816104 - DNA, 20 bp, mouse
gtgcgctagaccaatcgcta

SEQ ID NO: 816105 - DNA, 20 bp, mouse
gagaaccttcgcagagctgc

SEQ ID NO: 816106 - DNA, 20 bp, mouse
gctagccagcaccctaatgt

SEQ ID NO: 816107 - DNA, 20 bp, mouse
gtgtcgttgcaagggagcag

SEQ ID NO: 816108 - DNA, 20 bp, mouse
ggctgtcgctgtcgttgcaa

SEQ ID NO: 816109 - DNA, 20 bp, mouse
gaaggcctgcgcatctccaa

SEQ ID NO: 816110 - DNA, 20 bp, mouse
gcaaaagtgctggaagcaaa

SEQ ID NO: 816111 - DNA, 20 bp, mouse
gcgtagtgggatcatgtctc

SEQ ID NO: 816112 - DNA, 20 bp, mouse
ggaaagagcgcgctgaggca

SEQ ID NO: 816113 - DNA, 20 bp, mouse
gaaaaggaaagagcgcgctg

SEQ ID NO: 816114 - DNA, 20 bp, mouse
gtcagccaaaggtccgatcg

SEQ ID NO: 816115 - DNA, 20 bp, mouse
ggcaggccttggggttgcaa

SEQ ID NO: 816116 - DNA, 20 bp, mouse
gcagcgcgcggcacaagcct

SEQ ID NO: 816117 - DNA, 20 bp, mouse
gtctataagcacccaggccg

SEQ ID NO: 816118 - DNA, 20 bp, mouse
gtacacagtggcgtttggat

SEQ ID NO: 816119 - DNA, 20 bp, mouse
gccggggcggggtggcgcgt

SEQ ID NO: 816120 - DNA, 20 bp, mouse
gcacaacaagaattaagctg

SEQ ID NO: 816121 - DNA, 20 bp, mouse
gtggggttggagtctgctac

SEQ ID NO: 816122 - DNA, 20 bp, mouse
ggcggcacaagcctcggcct

SEQ ID NO: 816123 - DNA, 20 bp, mouse
ggcagctacacagtggcgtt

SEQ ID NO: 816124 - DNA, 20 bp, mouse
gcaagaattaagctgaggga

SEQ ID NO: 816125 - DNA, 20 bp, mouse
ggcaggcaacgggaggtctc

SEQ ID NO: 816126 - DNA, 20 bp, mouse
gctagataggtggcgttctg

SEQ ID NO: 816127 - DNA, 20 bp, mouse
gggcaaaggccggcgacccc

SEQ ID NO: 816128 - DNA, 20 bp, mouse
gcgacaccgccgcttggcaa

SEQ ID NO: 816129 - DNA, 20 bp, mouse
gcaagcggcggtgtcgggag

SEQ ID NO: 816130 - DNA, 20 bp, mouse
gagcggcctccggccgggga

SEQ ID NO: 816131 - DNA, 20 bp, mouse
ggcggagcgccgggcggcag

SEQ ID NO: 816132 - DNA, 20 bp, mouse
ggtcgccggcctttgccaag

SEQ ID NO: 816133 - DNA, 20 bp, mouse
gagcccgcccccggtgccaa

SEQ ID NO: 816134 - DNA, 20 bp, mouse
ggctgtgccgttggcaccgg

SEQ ID NO: 816135 - DNA, 20 bp, mouse
gcgccgggcggcagcggctc

SEQ ID NO: 816136 - DNA, 20 bp, mouse
ggaagggcccaaagacctta

SEQ ID NO: 816137 - DNA, 20 bp, mouse
gatgcacagctgtccagatg

SEQ ID NO: 816138 - DNA, 20 bp, mouse
ggggaaggggctcccggctg

SEQ ID NO: 816139 - DNA, 20 bp, mouse
ggccaggcagacatgtccag

SEQ ID NO: 816140 - DNA, 20 bp, mouse
ggggctcccggctgtgggac

SEQ ID NO: 816141 - DNA, 20 bp, mouse
gcttagggactggacagggt

SEQ ID NO: 816142 - DNA, 20 bp, mouse
gcccggtcggagcagggcaa

SEQ ID NO: 816143 - DNA, 20 bp, mouse
gagaccttagggactggaca

SEQ ID NO: 816144 - DNA, 20 bp, mouse
gcagatcggagaaatcccca

SEQ ID NO: 816145 - DNA, 20 bp, mouse
gaccctaggggccagctctc

SEQ ID NO: 816146 - DNA, 20 bp, mouse
ggaaagtggtatggactcct

SEQ ID NO: 816147 - DNA, 20 bp, mouse
gagaaagtggtggagacccc

SEQ ID NO: 816148 - DNA, 20 bp, mouse
gttgggcagtccaaggaaag

SEQ ID NO: 816149 - DNA, 20 bp, mouse
gcccctggagcagagacccc

SEQ ID NO: 816150 - DNA, 20 bp, mouse
gtaagaccttgggcagtcca

SEQ ID NO: 816151 - DNA, 20 bp, mouse
gactgcccaaggtcttagat

SEQ ID NO: 816152 - DNA, 20 bp, mouse
gcagtccaaggaaagtggta

SEQ ID NO: 816153 - DNA, 20 bp, mouse
ggagtccataccactttcct

SEQ ID NO: 816154 - DNA, 20 bp, mouse
ggctcccccatctaagacct

SEQ ID NO: 816155 - DNA, 20 bp, mouse
gtcctggggtctctgctcca

SEQ ID NO: 816156 - DNA, 20 bp, mouse
gcaggtgtgggcagtgattc

SEQ ID NO: 816157 - DNA, 20 bp, mouse
gtatacaagtatccaggtgt

SEQ ID NO: 816158 - DNA, 20 bp, mouse
ggatgatgctacaagtccaa

SEQ ID NO: 816159 - DNA, 20 bp, mouse
gcacatggctcctactcact

SEQ ID NO: 816160 - DNA, 20 bp, mouse
gtgtcaaaatcagactgaac

SEQ ID NO: 816161 - DNA, 20 bp, mouse
gtgggcagtgattcagggct

SEQ ID NO: 816162 - DNA, 20 bp, mouse
gggaaataatagttcaaata

SEQ ID NO: 816163 - DNA, 20 bp, mouse
ggtactttatacaagtatcc

SEQ ID NO: 816164 - DNA, 20 bp, mouse
gccatgtgactctggtgagt

SEQ ID NO: 816165 - DNA, 20 bp, mouse
ggatctctcttaccggccca

SEQ ID NO: 816166 - DNA, 20 bp, mouse
gcgccagcgggtgaacacgc

SEQ ID NO: 816167 - DNA, 20 bp, mouse
gggtgaacacgcgggagcgt

SEQ ID NO: 816168 - DNA, 20 bp, mouse
gcaagtgcagaaagcggcgt

SEQ ID NO: 816169 - DNA, 20 bp, mouse
ggggcaaaggggcgcggcaa

SEQ ID NO: 816170 - DNA, 20 bp, mouse
ggccacgcccccgaccgcca

SEQ ID NO: 816171 - DNA, 20 bp, mouse
gcacgggcaagtgcagaaag

SEQ ID NO: 816172 - DNA, 20 bp, mouse
gggaccgccctggcggtcgg

SEQ ID NO: 816173 - DNA, 20 bp, mouse
ggcgcggcaagggagggttg

SEQ ID NO: 816174 - DNA, 20 bp, mouse
gcagaaagcggcgtaggcgg

SEQ ID NO: 816175 - DNA, 20 bp, mouse
gcaaaggggcgcggcaaggg

SEQ ID NO: 816176 - DNA, 20 bp, mouse
ggccccaggagtggtatacg

SEQ ID NO: 816177 - DNA, 20 bp, mouse
gtacaaggcagcaggaaaat

SEQ ID NO: 816178 - DNA, 20 bp, mouse
gggctctcagagtgctgtgc

SEQ ID NO: 816179 - DNA, 20 bp, mouse
gagagcctctccccgctttc

SEQ ID NO: 816180 - DNA, 20 bp, mouse
ggcgccgaccacaggatcct

SEQ ID NO: 816181 - DNA, 20 bp, mouse
gaaaatgggtggctctggac

SEQ ID NO: 816182 - DNA, 20 bp, mouse
gagtcacaataccagaaagc

SEQ ID NO: 816183 - DNA, 20 bp, mouse
ggtccagagaagcctcaggg

SEQ ID NO: 816184 - DNA, 20 bp, mouse
gcaccgccctgccccaggag

SEQ ID NO: 816185 - DNA, 20 bp, mouse
gcgggaacgtagagagcgag

SEQ ID NO: 816186 - DNA, 20 bp, mouse
gcgagcccggagcttcgccg

SEQ ID NO: 816187 - DNA, 20 bp, mouse
gccacccgcggcgaagctcc

SEQ ID NO: 816188 - DNA, 20 bp, mouse
gaacagccggaaggccgcgc

SEQ ID NO: 816189 - DNA, 20 bp, mouse
ggccgcgccggcggtgtcgg

SEQ ID NO: 816190 - DNA, 20 bp, mouse
ggggggggggaacagccgga

SEQ ID NO: 816191 - DNA, 20 bp, mouse
gccggcggtgtcggcggtgt

SEQ ID NO: 816192 - DNA, 20 bp, mouse
gaaggccgcgccggcggtgt

SEQ ID NO: 816193 - DNA, 20 bp, mouse
gctagctgagaggcggaaag

SEQ ID NO: 816194 - DNA, 20 bp, mouse
ggctcactaaagctaagaga

SEQ ID NO: 816195 - DNA, 20 bp, mouse
ggctttacgttggggatcga

SEQ ID NO: 816196 - DNA, 20 bp, mouse
gctccgccacaggcattctt

SEQ ID NO: 816197 - DNA, 20 bp, mouse
gtctgcagcgatcaactcca

SEQ ID NO: 816198 - DNA, 20 bp, mouse
gccgacacgcgatgcttcct

SEQ ID NO: 816199 - DNA, 20 bp, mouse
gccagtgcgtggtgagcagg

SEQ ID NO: 816200 - DNA, 20 bp, mouse
ggtgtcgggcgtctccgcca

SEQ ID NO: 816201 - DNA, 20 bp, mouse
gccgggagtcttagaaccga

SEQ ID NO: 816202 - DNA, 20 bp, mouse
gcgcgatggaaacgagtccc

SEQ ID NO: 816203 - DNA, 20 bp, mouse
ggcggactacaaagtccaac

SEQ ID NO: 816204 - DNA, 20 bp, mouse
gatgccagtgcgtggtgagc

SEQ ID NO: 816205 - DNA, 20 bp, mouse
gtagaaccgagggcccgcag

SEQ ID NO: 816206 - DNA, 20 bp, mouse
gaagggcatcagttgagctg

SEQ ID NO: 816207 - DNA, 20 bp, mouse
gcccccccccgcaatgcgtg

SEQ ID NO: 816208 - DNA, 20 bp, mouse
ggcgaagagggtctcctcca

SEQ ID NO: 816209 - DNA, 20 bp, mouse
gcccggccgcacaatgggag

SEQ ID NO: 816210 - DNA, 20 bp, mouse
ggcgccccacgcattgcggg

SEQ ID NO: 816211 - DNA, 20 bp, mouse
ggcctggtcggggtaagtca

SEQ ID NO: 816212 - DNA, 20 bp, mouse
ggtggctaaaagcaaggtgg

SEQ ID NO: 816213 - DNA, 20 bp, mouse
ggggcaggtgggatcctgcg

SEQ ID NO: 816214 - DNA, 20 bp, mouse
gcctgcggggacccgagcgc

SEQ ID NO: 816215 - DNA, 20 bp, mouse
ggcccacgctggcctggtcg

SEQ ID NO: 816216 - DNA, 20 bp, mouse
gtcagccgcccgagcttcgg

SEQ ID NO: 816217 - DNA, 20 bp, mouse
gccctcctccgaagctcggg

SEQ ID NO: 816218 - DNA, 20 bp, mouse
ggctgcgccgccctcgccgg

SEQ ID NO: 816219 - DNA, 20 bp, mouse
ggcgccctcccggggctgga

SEQ ID NO: 816220 - DNA, 20 bp, mouse
ggcgtcagccgcccgagctt

SEQ ID NO: 816221 - DNA, 20 bp, mouse
gcaaggcgagactgcggggt

SEQ ID NO: 816222 - DNA, 20 bp, mouse
gctggcaaggcgagactgcg

SEQ ID NO: 816223 - DNA, 20 bp, mouse
ggccgcccgagcttcggagg

SEQ ID NO: 816224 - DNA, 20 bp, mouse
gtcagcacgctgcgccctcc

SEQ ID NO: 816225 - DNA, 20 bp, mouse
ggaaaagttgaacctatctc

SEQ ID NO: 816226 - DNA, 20 bp, mouse
gtagcgctgaagctcaaaca

SEQ ID NO: 816227 - DNA, 20 bp, mouse
gcctccaggtctgtccggaa

SEQ ID NO: 816228 - DNA, 20 bp, mouse
gccggaagggctctagggga

SEQ ID NO: 816229 - DNA, 20 bp, mouse
gggctcgagagaaatagcga

SEQ ID NO: 816230 - DNA, 20 bp, mouse
ggtagagcagggcacctctc

SEQ ID NO: 816231 - DNA, 20 bp, mouse
gctgtccggaagggctctag

SEQ ID NO: 816232 - DNA, 20 bp, mouse
gaggctccttataaaggctg

SEQ ID NO: 816233 - DNA, 20 bp, mouse
gtcaccaaccgctgggagtt

SEQ ID NO: 816234 - DNA, 20 bp, mouse
gcctctcaggctccttataa

SEQ ID NO: 816235 - DNA, 20 bp, mouse
ggagcccttccggacagacc

SEQ ID NO: 816236 - DNA, 20 bp, mouse
gaccgcctccagtggctaag

SEQ ID NO: 816237 - DNA, 20 bp, mouse
ggctaaggggcttggaggta

SEQ ID NO: 816238 - DNA, 20 bp, mouse
ggtcgagcgaccgcctccag

SEQ ID NO: 816239 - DNA, 20 bp, mouse
gctggtgcctaacaggcagg

SEQ ID NO: 816240 - DNA, 20 bp, mouse
gacccttccgagctgctgat

SEQ ID NO: 816241 - DNA, 20 bp, mouse
gagcacgccccctgcctgtt

SEQ ID NO: 816242 - DNA, 20 bp, mouse
gaaggggcttggaggtaggg

SEQ ID NO: 816243 - DNA, 20 bp, mouse
gcgctccggcacgccccccc

SEQ ID NO: 816244 - DNA, 20 bp, mouse
gcagtggctaaggggcttgg

SEQ ID NO: 816245 - DNA, 20 bp, mouse
gacgtggtgaggagctgaat

SEQ ID NO: 816246 - DNA, 20 bp, mouse
ggagcccggaggccccctaa

SEQ ID NO: 816247 - DNA, 20 bp, mouse
gcccggaggccccctaaggg

SEQ ID NO: 816248 - DNA, 20 bp, mouse
gggccccctaaggggggagg

SEQ ID NO: 816249 - DNA, 20 bp, mouse
gaaaccgcctccccccttag

SEQ ID NO: 816250 - DNA, 20 bp, mouse
gcctgggctaccaggaagaa

SEQ ID NO: 816251 - DNA, 20 bp, mouse
ggctgctgcgggcgcctcgc

SEQ ID NO: 816252 - DNA, 20 bp, mouse
gagcacgggaggacgctgtc

SEQ ID NO: 816253 - DNA, 20 bp, mouse
gacgggaggacgctgtccgg

SEQ ID NO: 816254 - DNA, 20 bp, mouse
gtcagcgcgcggagcacggg

SEQ ID NO: 816255 - DNA, 20 bp, mouse
gcgctgtccggcggtaccct

SEQ ID NO: 816256 - DNA, 20 bp, mouse
gggggtcagagaccaaatag

SEQ ID NO: 816257 - DNA, 20 bp, mouse
ggggaacttctgaaaggtct

SEQ ID NO: 816258 - DNA, 20 bp, mouse
ggtcagagaccaaatagagg

SEQ ID NO: 816259 - DNA, 20 bp, mouse
gaccaagagcaatggaattt

SEQ ID NO: 816260 - DNA, 20 bp, mouse
ggagcaatggaatttagggt

SEQ ID NO: 816261 - DNA, 20 bp, mouse
gggctcgtggaacctaggca

SEQ ID NO: 816262 - DNA, 20 bp, mouse
gggggcacatgactaagttg

SEQ ID NO: 816263 - DNA, 20 bp, mouse
gccagattagttttacaaac

SEQ ID NO: 816264 - DNA, 20 bp, mouse
gttacaaacaggtcagcagg

SEQ ID NO: 816265 - DNA, 20 bp, mouse
ggttgataaccaaacagtcc

SEQ ID NO: 816266 - DNA, 20 bp, mouse
gtcagcacgtgacaaggcgg

SEQ ID NO: 816267 - DNA, 20 bp, mouse
ggggtaggatggggtgggac

SEQ ID NO: 816268 - DNA, 20 bp, mouse
gcaggaggaccgctgaaaat

SEQ ID NO: 816269 - DNA, 20 bp, mouse
gagcggggaagggagccaat

SEQ ID NO: 816270 - DNA, 20 bp, mouse
gcctcctggagcttgtgggt

SEQ ID NO: 816271 - DNA, 20 bp, mouse
gcgagctgcccaattttcag

SEQ ID NO: 816272 - DNA, 20 bp, mouse
ggtaaggcagctgggcgctg

SEQ ID NO: 816273 - DNA, 20 bp, mouse
gacagaactgggcagtccct

SEQ ID NO: 816274 - DNA, 20 bp, mouse
gggagcttgtgggtaggctg

SEQ ID NO: 816275 - DNA, 20 bp, mouse
gacacatggaatgagaagcg

SEQ ID NO: 816276 - DNA, 20 bp, mouse
ggcaaggggtgcgcagtgtg

SEQ ID NO: 816277 - DNA, 20 bp, mouse
gtgtgaggaggggtcggatc

SEQ ID NO: 816278 - DNA, 20 bp, mouse
gccagcacgcggcgctggtt

SEQ ID NO: 816279 - DNA, 20 bp, mouse
ggcgcagtgtgaggaggggt

SEQ ID NO: 816280 - DNA, 20 bp, mouse
ggcgccgcgtgctggccggg

SEQ ID NO: 816281 - DNA, 20 bp, mouse
gggcgcggttccacggggaa

SEQ ID NO: 816282 - DNA, 20 bp, mouse
gaacagcacgatcaggaccc

SEQ ID NO: 816283 - DNA, 20 bp, mouse
gtcggatcggggacaaatgc

SEQ ID NO: 816284 - DNA, 20 bp, mouse
ggccctcgcccgaacttcac

SEQ ID NO: 816285 - DNA, 20 bp, mouse
gcccgaacttcaccggaact

SEQ ID NO: 816286 - DNA, 20 bp, mouse
gggaccgcgcctaagctgtg

SEQ ID NO: 816287 - DNA, 20 bp, mouse
ggccttagagggttccttaa

SEQ ID NO: 816288 - DNA, 20 bp, mouse
gcctctaaggctcaactcac

SEQ ID NO: 816289 - DNA, 20 bp, mouse
gtcccttaaggaaccctcta

SEQ ID NO: 816290 - DNA, 20 bp, mouse
gtactctgggtgatcctaca

SEQ ID NO: 816291 - DNA, 20 bp, mouse
gttgtctgaaagaggtggaa

SEQ ID NO: 816292 - DNA, 20 bp, mouse
ggagtctatgcttcccctgt

SEQ ID NO: 816293 - DNA, 20 bp, mouse
gtgactcctccccacagctt

SEQ ID NO: 816294 - DNA, 20 bp, mouse
gccaacttcatgttccctta

SEQ ID NO: 816295 - DNA, 20 bp, mouse
ggttgggtagttcagctaca

SEQ ID NO: 816296 - DNA, 20 bp, mouse
gaggcctgggtgtgtgctaa

SEQ ID NO: 816297 - DNA, 20 bp, mouse
gaagagacagagaaccggag

SEQ ID NO: 816298 - DNA, 20 bp, mouse
gcggagtgggcaccccgcaa

SEQ ID NO: 816299 - DNA, 20 bp, mouse
gcgcaatggcagatcatact

SEQ ID NO: 816300 - DNA, 20 bp, mouse
gaagggcagagttaccaaat

SEQ ID NO: 816301 - DNA, 20 bp, mouse
gcaccctggactggcagcaa

SEQ ID NO: 816302 - DNA, 20 bp, mouse
gcatcgttaaccatccagga

SEQ ID NO: 816303 - DNA, 20 bp, mouse
gagtgaagctccaggacctg

SEQ ID NO: 816304 - DNA, 20 bp, mouse
ggcagatcatactgggctcc

SEQ ID NO: 816305 - DNA, 20 bp, mouse
ggcagcaaaggcatcaggcc

SEQ ID NO: 816306 - DNA, 20 bp, mouse
ggatgcgcggggccgctcgg

SEQ ID NO: 816307 - DNA, 20 bp, mouse
gtgaactaaaagcggaaggt

SEQ ID NO: 816308 - DNA, 20 bp, mouse
gctaactcgcctagaggcca

SEQ ID NO: 816309 - DNA, 20 bp, mouse
gctaaaagcggaaggtgggt

SEQ ID NO: 816310 - DNA, 20 bp, mouse
gcacgggagccatagccccc

SEQ ID NO: 816311 - DNA, 20 bp, mouse
ggggccgctcggcggaggac

SEQ ID NO: 816312 - DNA, 20 bp, mouse
gcggagccgtcgctcgatca

SEQ ID NO: 816313 - DNA, 20 bp, mouse
ggggaccgcctggcacctcg

SEQ ID NO: 816314 - DNA, 20 bp, mouse
gtcggcggaggactggtggt

SEQ ID NO: 816315 - DNA, 20 bp, mouse
gggtgcgcacgagcgcgggg

SEQ ID NO: 816316 - DNA, 20 bp, mouse
ggcaaagcctgcgtctacag

SEQ ID NO: 816317 - DNA, 20 bp, mouse
gtctacagaggtgtgttggg

SEQ ID NO: 816318 - DNA, 20 bp, mouse
gcaccgatcgcaccctggag

SEQ ID NO: 816319 - DNA, 20 bp, mouse
gtgctcttaccaccactcca

SEQ ID NO: 816320 - DNA, 20 bp, mouse
gtgcgtctacagaggtgtgt

SEQ ID NO: 816321 - DNA, 20 bp, mouse
gaggtgctgccgccccgcaa

SEQ ID NO: 816322 - DNA, 20 bp, mouse
ggtaggaagtccaggcgcga

SEQ ID NO: 816323 - DNA, 20 bp, mouse
gggacccaccgatcgcaccc

SEQ ID NO: 816324 - DNA, 20 bp, mouse
ggaagcatgaaatgtgagtg

SEQ ID NO: 816325 - DNA, 20 bp, mouse
gggtacaagggcgcaggaag

SEQ ID NO: 816326 - DNA, 20 bp, mouse
gcttccctcgggaacaagtc

SEQ ID NO: 816327 - DNA, 20 bp, mouse
gacccctgacttgttcccga

SEQ ID NO: 816328 - DNA, 20 bp, mouse
ggtagaaagctcaggtcctg

SEQ ID NO: 816329 - DNA, 20 bp, mouse
gttgttcccgagggaaggag

SEQ ID NO: 816330 - DNA, 20 bp, mouse
gtggccctgtgacagcactc

SEQ ID NO: 816331 - DNA, 20 bp, mouse
gaggaaagtgagggcttgaa

SEQ ID NO: 816332 - DNA, 20 bp, mouse
ggggaaactgagactcggga

SEQ ID NO: 816333 - DNA, 20 bp, mouse
gggcgggatgtagaaagctc

SEQ ID NO: 816334 - DNA, 20 bp, mouse
gttccaaaggcaagagtgag

SEQ ID NO: 816335 - DNA, 20 bp, mouse
ggccctggtggcaggaaggt

SEQ ID NO: 816336 - DNA, 20 bp, mouse
gcaggcgtggcaactgttcg

SEQ ID NO: 816337 - DNA, 20 bp, mouse
ggccaagcatctataggctg

SEQ ID NO: 816338 - DNA, 20 bp, mouse
gataggctggggcccatctg

SEQ ID NO: 816339 - DNA, 20 bp, mouse
gtgccacggagtcccacgtg

SEQ ID NO: 816340 - DNA, 20 bp, mouse
gaaaaggagttgctacacag

SEQ ID NO: 816341 - DNA, 20 bp, mouse
gtgggactccgtggcagacc

SEQ ID NO: 816342 - DNA, 20 bp, mouse
gcctatagatgcttggctcc

SEQ ID NO: 816343 - DNA, 20 bp, mouse
gagcagggaggggcctgcta

SEQ ID NO: 816344 - DNA, 20 bp, mouse
ggtctcctggagaaatggtc

SEQ ID NO: 816345 - DNA, 20 bp, mouse
gtgctacacagagggaccag

SEQ ID NO: 816346 - DNA, 20 bp, mouse
ggggactcgggtactctggg

SEQ ID NO: 816347 - DNA, 20 bp, mouse
gggggtaggtgaatcccaga

SEQ ID NO: 816348 - DNA, 20 bp, mouse
gtcccagagggcagggactc

SEQ ID NO: 816349 - DNA, 20 bp, mouse
gaagtctaggtgacgctaaa

SEQ ID NO: 816350 - DNA, 20 bp, mouse
gtaggtgaatcccagagggc

SEQ ID NO: 816351 - DNA, 20 bp, mouse
gccaccaaggcctgccaccc

SEQ ID NO: 816352 - DNA, 20 bp, mouse
gaggtcagcttgcagtagag

SEQ ID NO: 816353 - DNA, 20 bp, mouse
gacccgagtccctgccctct

SEQ ID NO: 816354 - DNA, 20 bp, mouse
gactctgagtgggttggaaa

SEQ ID NO: 816355 - DNA, 20 bp, mouse
gggctgatctaaactcaaga

SEQ ID NO: 816356 - DNA, 20 bp, mouse
ggggcctgctcagagttcaa

SEQ ID NO: 816357 - DNA, 20 bp, mouse
gcactggccaaggcccaatg

SEQ ID NO: 816358 - DNA, 20 bp, mouse
gggcctgccctgccctcatt

SEQ ID NO: 816359 - DNA, 20 bp, mouse
ggagactggagcctgggtcc

SEQ ID NO: 816360 - DNA, 20 bp, mouse
gagcaggccccgtgaggaaa

SEQ ID NO: 816361 - DNA, 20 bp, mouse
ggccaaggcccaatgagggc

SEQ ID NO: 816362 - DNA, 20 bp, mouse
gtgagtgagcgaggcagccc

SEQ ID NO: 816363 - DNA, 20 bp, mouse
gccagtgcccttacctggca

SEQ ID NO: 816364 - DNA, 20 bp, mouse
ggggcaggcccctttcctca

SEQ ID NO: 816365 - DNA, 20 bp, mouse
gccctgcctctccaggccat

SEQ ID NO: 816366 - DNA, 20 bp, mouse
gggcatctgtctcctgacta

SEQ ID NO: 816367 - DNA, 20 bp, mouse
gtgatgtgggcaaaggtctc

SEQ ID NO: 816368 - DNA, 20 bp, mouse
gacgccacactcccttagtc

SEQ ID NO: 816369 - DNA, 20 bp, mouse
gagggagtaggctggcccga

SEQ ID NO: 816370 - DNA, 20 bp, mouse
gtctcctgactaagggagtg

SEQ ID NO: 816371 - DNA, 20 bp, mouse
gtggagggtaaagagcaatc

SEQ ID NO: 816372 - DNA, 20 bp, mouse
gagagctgtgattgtgatgt

SEQ ID NO: 816373 - DNA, 20 bp, mouse
gatgcaaacacaactgtcag

SEQ ID NO: 816374 - DNA, 20 bp, mouse
gagtgttccaggggaagctc

SEQ ID NO: 816375 - DNA, 20 bp, mouse
gtctggggggtagagggagt

SEQ ID NO: 816376 - DNA, 20 bp, mouse
gcccctgggggaaggattaa

SEQ ID NO: 816377 - DNA, 20 bp, mouse
gtgactgtcagggggtgcta

SEQ ID NO: 816378 - DNA, 20 bp, mouse
gagaatggagcaacacgtag

SEQ ID NO: 816379 - DNA, 20 bp, mouse
gaaggctggtcctggggcgc

SEQ ID NO: 816380 - DNA, 20 bp, mouse
ggagaaggaggctgagacct

SEQ ID NO: 816381 - DNA, 20 bp, mouse
gatggatcctaaacccagga

SEQ ID NO: 816382 - DNA, 20 bp, mouse
gcctggggcgctggaccatt

SEQ ID NO: 816383 - DNA, 20 bp, mouse
gcatggcatgcgtgacagtc

SEQ ID NO: 816384 - DNA, 20 bp, mouse
gccctcaaggggctagtccc

SEQ ID NO: 816385 - DNA, 20 bp, mouse
gtagaggcaggctctgaact

SEQ ID NO: 816386 - DNA, 20 bp, mouse
gcgaggagacggcctccgac

SEQ ID NO: 816387 - DNA, 20 bp, mouse
gagcctgcggagcgtggaca

SEQ ID NO: 816388 - DNA, 20 bp, mouse
gggctcgggggacacagaca

SEQ ID NO: 816389 - DNA, 20 bp, mouse
ggtctcgagcagcccgtcgg

SEQ ID NO: 816390 - DNA, 20 bp, mouse
ggcaaggcgccctccgggag

SEQ ID NO: 816391 - DNA, 20 bp, mouse
gtccacgctccgcaggctcg

SEQ ID NO: 816392 - DNA, 20 bp, mouse
gacacagacacggcccggga

SEQ ID NO: 816393 - DNA, 20 bp, mouse
gcaagtgcaaggcgccctcc

SEQ ID NO: 816394 - DNA, 20 bp, mouse
gggcaagcaggaagccgttg

SEQ ID NO: 816395 - DNA, 20 bp, mouse
ggaggcctggaaagttccac

SEQ ID NO: 816396 - DNA, 20 bp, mouse
ggggagattaaggagaatac

SEQ ID NO: 816397 - DNA, 20 bp, mouse
gcgttcaggctctctcttca

SEQ ID NO: 816398 - DNA, 20 bp, mouse
gaccagagacagaagacaat

SEQ ID NO: 816399 - DNA, 20 bp, mouse
gtgtgaggtgggtgagtcag

SEQ ID NO: 816400 - DNA, 20 bp, mouse
gaggacaggaccaagtcagg

SEQ ID NO: 816401 - DNA, 20 bp, mouse
gttaatgatcagcctcaggt

SEQ ID NO: 816402 - DNA, 20 bp, mouse
gagagagagcctgaacgcac

SEQ ID NO: 816403 - DNA, 20 bp, mouse
gagaggtggcttctacgcac

SEQ ID NO: 816404 - DNA, 20 bp, mouse
gtgattttccaattccactc

SEQ ID NO: 816405 - DNA, 20 bp, mouse
ggatcagcctcaggtaggtg

SEQ ID NO: 816406 - DNA, 20 bp, mouse
gcaaatggagcaaggtgtca

SEQ ID NO: 816407 - DNA, 20 bp, mouse
gttcagctgcagactaggga

SEQ ID NO: 816408 - DNA, 20 bp, mouse
ggggataaaagtcagaaatg

SEQ ID NO: 816409 - DNA, 20 bp, mouse
gaaagcttggacacatacag

SEQ ID NO: 816410 - DNA, 20 bp, mouse
gtcagaaatggggtgccaat

SEQ ID NO: 816411 - DNA, 20 bp, mouse
gcaagaacaggactaacaaa

SEQ ID NO: 816412 - DNA, 20 bp, mouse
gagcacactcaagaccggac

SEQ ID NO: 816413 - DNA, 20 bp, mouse
ggggccaaggtcccaaagct

SEQ ID NO: 816414 - DNA, 20 bp, mouse
gggactaacaaagggccgaa

SEQ ID NO: 816415 - DNA, 20 bp, mouse
gacaaagggccgaagggcca

SEQ ID NO: 816416 - DNA, 20 bp, mouse
gacactttctcccacatcta

SEQ ID NO: 816417 - DNA, 20 bp, mouse
ggggtgcgggcaacggggtt

SEQ ID NO: 816418 - DNA, 20 bp, mouse
gtgcgggcaacggggttggg

SEQ ID NO: 816419 - DNA, 20 bp, mouse
gcggaacaagccctagatgt

SEQ ID NO: 816420 - DNA, 20 bp, mouse
gagacaggaagggccttgga

SEQ ID NO: 816421 - DNA, 20 bp, mouse
gccgttgcccgcacccctga

SEQ ID NO: 816422 - DNA, 20 bp, mouse
gcgctcgccccaggacggaa

SEQ ID NO: 816423 - DNA, 20 bp, mouse
gcctcccaccgggttagcaa

SEQ ID NO: 816424 - DNA, 20 bp, mouse
gccccaggacggaaagggtg

SEQ ID NO: 816425 - DNA, 20 bp, mouse
gtggggcgagcgggccttca

SEQ ID NO: 816426 - DNA, 20 bp, mouse
gccgcccggggcacgagccg

SEQ ID NO: 816427 - DNA, 20 bp, mouse
gagggtcatgcagtagctca

SEQ ID NO: 816428 - DNA, 20 bp, mouse
ggggcagggcgggtgtagga

SEQ ID NO: 816429 - DNA, 20 bp, mouse
ggctgcccgggcgtccgcac

SEQ ID NO: 816430 - DNA, 20 bp, mouse
gcatgaccctcagcccggtg

SEQ ID NO: 816431 - DNA, 20 bp, mouse
gctggcgcgtgacacgctgg

SEQ ID NO: 816432 - DNA, 20 bp, mouse
ggtcccgctgtcaccaagtc

SEQ ID NO: 816433 - DNA, 20 bp, mouse
ggggcgtccgcaccgggctg

SEQ ID NO: 816434 - DNA, 20 bp, mouse
gaactaagcgctaactggac

SEQ ID NO: 816435 - DNA, 20 bp, mouse
gaaggcaactaagcgctaac

SEQ ID NO: 816436 - DNA, 20 bp, mouse
gggtgtggcccggggtgcga

SEQ ID NO: 816437 - DNA, 20 bp, mouse
gaaagataaagtgggcaggt

SEQ ID NO: 816438 - DNA, 20 bp, mouse
gagacgacttgacttgggat

SEQ ID NO: 816439 - DNA, 20 bp, mouse
gtggtgctgggcgtgagttg

SEQ ID NO: 816440 - DNA, 20 bp, mouse
gtgggatgggaacatgaact

SEQ ID NO: 816441 - DNA, 20 bp, mouse
ggacacctcaaggcggggtt

SEQ ID NO: 816442 - DNA, 20 bp, mouse
gctgtgccctggtgtggccc

SEQ ID NO: 816443 - DNA, 20 bp, mouse
gggggcgatcgtcagagctc

SEQ ID NO: 816444 - DNA, 20 bp, mouse
gtctggagtcctccattcta

SEQ ID NO: 816445 - DNA, 20 bp, mouse
gtgaaagcaacccctctctg

SEQ ID NO: 816446 - DNA, 20 bp, mouse
gtgtgtgtttggggcggtgg

SEQ ID NO: 816447 - DNA, 20 bp, mouse
gctactgcaggctatagaaa

SEQ ID NO: 816448 - DNA, 20 bp, mouse
ggcggtgggggcggatcgaa

SEQ ID NO: 816449 - DNA, 20 bp, mouse
gatggtgggagtgacaactg

SEQ ID NO: 816450 - DNA, 20 bp, mouse
ggaggacctggactgtgaac

SEQ ID NO: 816451 - DNA, 20 bp, mouse
ggcggtaactgagatcgtag

SEQ ID NO: 816452 - DNA, 20 bp, mouse
gcgcgtccagcgaatccaca

SEQ ID NO: 816453 - DNA, 20 bp, mouse
ggtaccttccagcgaggacc

SEQ ID NO: 816454 - DNA, 20 bp, mouse
gggcaccagcgactctgggg

SEQ ID NO: 816455 - DNA, 20 bp, mouse
ggaccggcgagctactataa

SEQ ID NO: 816456 - DNA, 20 bp, mouse
gggactcctccctttctcga

SEQ ID NO: 816457 - DNA, 20 bp, mouse
gaatggcagcaggcaaagag

SEQ ID NO: 816458 - DNA, 20 bp, mouse
ggggtcaactgcatcaaggc

SEQ ID NO: 816459 - DNA, 20 bp, mouse
gattagccttcgagaaaggg

SEQ ID NO: 816460 - DNA, 20 bp, mouse
gctctacaaagcagatgttt

SEQ ID NO: 816461 - DNA, 20 bp, mouse
gtatgattagccttcgagaa

SEQ ID NO: 816462 - DNA, 20 bp, mouse
gcagaacttcacatgccagc

SEQ ID NO: 816463 - DNA, 20 bp, mouse
gaggtctatataatggcagc

SEQ ID NO: 816464 - DNA, 20 bp, mouse
gctttgtagaggaggaacta

SEQ ID NO: 816465 - DNA, 20 bp, mouse
gctggaggtgaaggtctatg

SEQ ID NO: 816466 - DNA, 20 bp, mouse
gcgggcagggcctaggaagg

SEQ ID NO: 816467 - DNA, 20 bp, mouse
gagaagaggcaaggcgggca

SEQ ID NO: 816468 - DNA, 20 bp, mouse
gcggacaagccccgcctaga

SEQ ID NO: 816469 - DNA, 20 bp, mouse
ggcaacctctcagctctcta

SEQ ID NO: 816470 - DNA, 20 bp, mouse
ggaggctgaaaggtaggggc

SEQ ID NO: 816471 - DNA, 20 bp, mouse
ggagtagggcagaggtaact

SEQ ID NO: 816472 - DNA, 20 bp, mouse
ggatggaggctgaaaggtag

SEQ ID NO: 816473 - DNA, 20 bp, mouse
ggtgggagatggaggctgaa

SEQ ID NO: 816474 - DNA, 20 bp, mouse
gaagacacgccctctaggcg

SEQ ID NO: 816475 - DNA, 20 bp, mouse
gctgtcaagacacgccctct

SEQ ID NO: 816476 - DNA, 20 bp, mouse
gcgcccacctggctaactca

SEQ ID NO: 816477 - DNA, 20 bp, mouse
gctcctgcccgcttgaatcc

SEQ ID NO: 816478 - DNA, 20 bp, mouse
gccgtgcggtccgacccggg

SEQ ID NO: 816479 - DNA, 20 bp, mouse
ggggtcggaccgcacgggac

SEQ ID NO: 816480 - DNA, 20 bp, mouse
ggggaggcgctgggcgcaca

SEQ ID NO: 816481 - DNA, 20 bp, mouse
ggcagcgcccctaccatccc

SEQ ID NO: 816482 - DNA, 20 bp, mouse
gtgccctgagttagccaggt

SEQ ID NO: 816483 - DNA, 20 bp, mouse
gcgcaaggtcaaggtattaa

SEQ ID NO: 816484 - DNA, 20 bp, mouse
gttgaatcccgggatggtag

SEQ ID NO: 816485 - DNA, 20 bp, mouse
gaaggtcaaggtattaaggg

SEQ ID NO: 816486 - DNA, 20 bp, mouse
ggcctggtaaacatgggagc

SEQ ID NO: 816487 - DNA, 20 bp, mouse
gtggtctctgattgggaggg

SEQ ID NO: 816488 - DNA, 20 bp, mouse
gctgatgccaatcttgtcct

SEQ ID NO: 816489 - DNA, 20 bp, mouse
gaaggtgtggtctctaagta

SEQ ID NO: 816490 - DNA, 20 bp, mouse
gtccagctgtaggctttcaa

SEQ ID NO: 816491 - DNA, 20 bp, mouse
gaatgtggtctctgattggg

SEQ ID NO: 816492 - DNA, 20 bp, mouse
gatcaaggcctggtaaacat

SEQ ID NO: 816493 - DNA, 20 bp, mouse
gtggcccatggaagtttcgg

SEQ ID NO: 816494 - DNA, 20 bp, mouse
ggctctggcagcctctggtc

SEQ ID NO: 816495 - DNA, 20 bp, mouse
gagggcaggtgtggccgagg

SEQ ID NO: 816496 - DNA, 20 bp, mouse
gccagggaatcactcatgtg

SEQ ID NO: 816497 - DNA, 20 bp, mouse
gggggaggggagaacgtggg

SEQ ID NO: 816498 - DNA, 20 bp, mouse
ggcaaccggctgaactgcca

SEQ ID NO: 816499 - DNA, 20 bp, mouse
gaaggcaggaggcggaatgt

SEQ ID NO: 816500 - DNA, 20 bp, mouse
ggaggggagaacgtgggagg

SEQ ID NO: 816501 - DNA, 20 bp, mouse
gtccgccctggcagttcagc

SEQ ID NO: 816502 - DNA, 20 bp, mouse
gagggtgctagggacggctg

SEQ ID NO: 816503 - DNA, 20 bp, mouse
gcccaccaacctacattctg

SEQ ID NO: 816504 - DNA, 20 bp, mouse
gcactcatgtgcggattgtc

SEQ ID NO: 816505 - DNA, 20 bp, mouse
gtagtagaatcacaagcaac

SEQ ID NO: 816506 - DNA, 20 bp, mouse
gaaaggaggcaagattgcta

SEQ ID NO: 816507 - DNA, 20 bp, mouse
gctgccctttcctagggctg

SEQ ID NO: 816508 - DNA, 20 bp, mouse
gtacctgggggaaaaaccag

SEQ ID NO: 816509 - DNA, 20 bp, mouse
ggcaaggaattgctacattc

SEQ ID NO: 816510 - DNA, 20 bp, mouse
gagacctgagaagtgaggtt

SEQ ID NO: 816511 - DNA, 20 bp, mouse
ggtcccttccggtaattgaa

SEQ ID NO: 816512 - DNA, 20 bp, mouse
gctgggagcagcattctctc

SEQ ID NO: 816513 - DNA, 20 bp, mouse
gaaggactggccgtcagcga

SEQ ID NO: 816514 - DNA, 20 bp, mouse
gcttgccccagccctaggaa

SEQ ID NO: 816515 - DNA, 20 bp, mouse
gaaaataagcccggcggatt

SEQ ID NO: 816516 - DNA, 20 bp, mouse
gaggcccgcggcgggatatt

SEQ ID NO: 816517 - DNA, 20 bp, mouse
gcacagagctaggcccgcgg

SEQ ID NO: 816518 - DNA, 20 bp, mouse
gctcccccgcagcctgtcgg

SEQ ID NO: 816519 - DNA, 20 bp, mouse
gtccccccgacaggctgcgg

SEQ ID NO: 816520 - DNA, 20 bp, mouse
ggcagtggactctgcgtcat

SEQ ID NO: 816521 - DNA, 20 bp, mouse
ggactctgcgtcatgggtga

SEQ ID NO: 816522 - DNA, 20 bp, mouse
gcggcgccaaggatcgagcc

SEQ ID NO: 816523 - DNA, 20 bp, mouse
ggcgtcatgggtgatgggag

SEQ ID NO: 816524 - DNA, 20 bp, mouse
ggggcctagctctgtgcgct

SEQ ID NO: 816525 - DNA, 20 bp, mouse
gtgcgctgggaggacgcagc

SEQ ID NO: 816526 - DNA, 20 bp, mouse
gtccatgtgtggtgtcagta

SEQ ID NO: 816527 - DNA, 20 bp, mouse
gtaagtgaagtgtgtagaca

SEQ ID NO: 816528 - DNA, 20 bp, mouse
gggtatgtatgcgatgttta

SEQ ID NO: 816529 - DNA, 20 bp, mouse
gacatcacatacactaaccc

SEQ ID NO: 816530 - DNA, 20 bp, mouse
gtgtgtggtaggagtgtctg

SEQ ID NO: 816531 - DNA, 20 bp, mouse
gtttcaaactatcttgaagg

SEQ ID NO: 816532 - DNA, 20 bp, mouse
gctattctcaggcttactta

SEQ ID NO: 816533 - DNA, 20 bp, mouse
gtgatgatgcatatcatgcc

SEQ ID NO: 816534 - DNA, 20 bp, mouse
gcatagcacatatccatgtg

SEQ ID NO: 816535 - DNA, 20 bp, mouse
gggtacatgatatctttgtg

SEQ ID NO: 816536 - DNA, 20 bp, mouse
gcggacccaaacagagtggt

SEQ ID NO: 816537 - DNA, 20 bp, mouse
ggctgcgtgcgaggctctga

SEQ ID NO: 816538 - DNA, 20 bp, mouse
gccaaacagagtggtgggta

SEQ ID NO: 816539 - DNA, 20 bp, mouse
gatggcggacccaaacagag

SEQ ID NO: 816540 - DNA, 20 bp, mouse
gggaaggggcagccaaaggt

SEQ ID NO: 816541 - DNA, 20 bp, mouse
gagagcctcgcacgcagccg

SEQ ID NO: 816542 - DNA, 20 bp, mouse
gggctccccggctgcgtgcg

SEQ ID NO: 816543 - DNA, 20 bp, mouse
gcggcggggcgccgtgacgc

SEQ ID NO: 816544 - DNA, 20 bp, mouse
ggcgtcaatgcgaggctccc

SEQ ID NO: 816545 - DNA, 20 bp, mouse
gtcacggcgccccgccgcca

SEQ ID NO: 816546 - DNA, 20 bp, mouse
ggcatctactggcctatctg

SEQ ID NO: 816547 - DNA, 20 bp, mouse
gtgggagtcctgcaagttcc

SEQ ID NO: 816548 - DNA, 20 bp, mouse
gagaagaccgcagggagctt

SEQ ID NO: 816549 - DNA, 20 bp, mouse
gatccggtctatattaagtg

SEQ ID NO: 816550 - DNA, 20 bp, mouse
gtggataaatgcctcaagga

SEQ ID NO: 816551 - DNA, 20 bp, mouse
gcaactgaactttccattct

SEQ ID NO: 816552 - DNA, 20 bp, mouse
gcatatactacttacatcac

SEQ ID NO: 816553 - DNA, 20 bp, mouse
gcaccacacttaatatagac

SEQ ID NO: 816554 - DNA, 20 bp, mouse
gctggcctggcacagtattt

SEQ ID NO: 816555 - DNA, 20 bp, mouse
gtggggtggatgagcaacac

SEQ ID NO: 816556 - DNA, 20 bp, mouse
gccaaccctggcctatgtct

SEQ ID NO: 816557 - DNA, 20 bp, mouse
gaagccaccccctccattca

SEQ ID NO: 816558 - DNA, 20 bp, mouse
gggacaggagatcctgctga

SEQ ID NO: 816559 - DNA, 20 bp, mouse
gaccccctccattcacggac

SEQ ID NO: 816560 - DNA, 20 bp, mouse
gtctcctgtccgtgaatgga

SEQ ID NO: 816561 - DNA, 20 bp, mouse
ggggtgcccaggccttcagc

SEQ ID NO: 816562 - DNA, 20 bp, mouse
gaggcgtcagcagatcctca

SEQ ID NO: 816563 - DNA, 20 bp, mouse
gtgggtttgtgcaggaggag

SEQ ID NO: 816564 - DNA, 20 bp, mouse
ggtagccagaggtcgtccga

SEQ ID NO: 816565 - DNA, 20 bp, mouse
gcctgcacaaacccagacat

SEQ ID NO: 816566 - DNA, 20 bp, mouse
ggccaggctcatagtcatca

SEQ ID NO: 816567 - DNA, 20 bp, mouse
ggggcacaaggaagatctag

SEQ ID NO: 816568 - DNA, 20 bp, mouse
gaaggaagatctagaggctg

SEQ ID NO: 816569 - DNA, 20 bp, mouse
gagatggcctagggtttaca

SEQ ID NO: 816570 - DNA, 20 bp, mouse
gcaagggcagcatgggtgtg

SEQ ID NO: 816571 - DNA, 20 bp, mouse
gtagtcatcagggaacagac

SEQ ID NO: 816572 - DNA, 20 bp, mouse
gagagggcgtctgtaagaac

SEQ ID NO: 816573 - DNA, 20 bp, mouse
gaccctgctctgaagggtat

SEQ ID NO: 816574 - DNA, 20 bp, mouse
gaggctacgcaagggcagca

SEQ ID NO: 816575 - DNA, 20 bp, mouse
gttccttgtgccctgggctg

SEQ ID NO: 816576 - DNA, 20 bp, mouse
ggggaccagagttgactcaa

SEQ ID NO: 816577 - DNA, 20 bp, mouse
gagggcccttgagtcaactc

SEQ ID NO: 816578 - DNA, 20 bp, mouse
gacagcactaggaaccttca

SEQ ID NO: 816579 - DNA, 20 bp, mouse
ggcgccccccggagctggga

SEQ ID NO: 816580 - DNA, 20 bp, mouse
ggcagagcgcactcacgtgg

SEQ ID NO: 816581 - DNA, 20 bp, mouse
gcgcgggaccggtaagtgtg

SEQ ID NO: 816582 - DNA, 20 bp, mouse
ggaaacttggcatttagggg

SEQ ID NO: 816583 - DNA, 20 bp, mouse
gccctctagagtgtccctga

SEQ ID NO: 816584 - DNA, 20 bp, mouse
ggaccggtaagtgtgcggac

SEQ ID NO: 816585 - DNA, 20 bp, mouse
gagggccctcccagctccgg

SEQ ID NO: 816586 - DNA, 20 bp, mouse
gtccccgcccgccgaggcta

SEQ ID NO: 816587 - DNA, 20 bp, mouse
gcggggaaggcgcccctcct

SEQ ID NO: 816588 - DNA, 20 bp, mouse
ggacttcagagctcggggaa

SEQ ID NO: 816589 - DNA, 20 bp, mouse
ggaggccggtgagtggggaa

SEQ ID NO: 816590 - DNA, 20 bp, mouse
gcggggcgaggccggtgagt

SEQ ID NO: 816591 - DNA, 20 bp, mouse
gagccccaccctagcctcgg

SEQ ID NO: 816592 - DNA, 20 bp, mouse
gccgcccgccgaggctaggg

SEQ ID NO: 816593 - DNA, 20 bp, mouse
gccctccagggctcacattc

SEQ ID NO: 816594 - DNA, 20 bp, mouse
gccctccttggccctgcgtg

SEQ ID NO: 816595 - DNA, 20 bp, mouse
gagggctcacattcaggtgg

SEQ ID NO: 816596 - DNA, 20 bp, mouse
ggggacgaagctcagttctc

SEQ ID NO: 816597 - DNA, 20 bp, mouse
ggggctcctcttgctgttaa

SEQ ID NO: 816598 - DNA, 20 bp, mouse
gaatgtggccaaaggttagt

SEQ ID NO: 816599 - DNA, 20 bp, mouse
gttagtgggaggatctaaac

SEQ ID NO: 816600 - DNA, 20 bp, mouse
gtctaaactggccacctgtg

SEQ ID NO: 816601 - DNA, 20 bp, mouse
gcagcttcctgggaccactc

SEQ ID NO: 816602 - DNA, 20 bp, mouse
ggctcaggatgcaccatagt

SEQ ID NO: 816603 - DNA, 20 bp, mouse
gggttgtatctgttggaggc

SEQ ID NO: 816604 - DNA, 20 bp, mouse
gaacaggatgccattatctt

SEQ ID NO: 816605 - DNA, 20 bp, mouse
gctggactgaatcatctgtg

SEQ ID NO: 816606 - DNA, 20 bp, mouse
gtagccccgcccgccgtcgg

SEQ ID NO: 816607 - DNA, 20 bp, mouse
gtagtccccaagtggtgcag

SEQ ID NO: 816608 - DNA, 20 bp, mouse
gtggggactaggatgacttc

SEQ ID NO: 816609 - DNA, 20 bp, mouse
gagcgcccctgcaccacttg

SEQ ID NO: 816610 - DNA, 20 bp, mouse
gctggccgaggagagcgaac

SEQ ID NO: 816611 - DNA, 20 bp, mouse
gcgaggagagcgaacaggga

SEQ ID NO: 816612 - DNA, 20 bp, mouse
gggtgggcggaggacgggct

SEQ ID NO: 816613 - DNA, 20 bp, mouse
gtggaaaccaactgtccctc

SEQ ID NO: 816614 - DNA, 20 bp, mouse
gcctctgttccgcccagggt

SEQ ID NO: 816615 - DNA, 20 bp, mouse
gggacagttggtttccagga

SEQ ID NO: 816616 - DNA, 20 bp, mouse
ggtcgtgcctctctagaaat

SEQ ID NO: 816617 - DNA, 20 bp, mouse
gtatcccgtgccaacctcaa

SEQ ID NO: 816618 - DNA, 20 bp, mouse
gacaggggatcaaaaagctc

SEQ ID NO: 816619 - DNA, 20 bp, mouse
gactgactcgcgtccctcag

SEQ ID NO: 816620 - DNA, 20 bp, mouse
ggcacgacatctcaaagcat

SEQ ID NO: 816621 - DNA, 20 bp, mouse
gtgggcctttgaggttggca

SEQ ID NO: 816622 - DNA, 20 bp, mouse
gggcctcgaacttaccatga

SEQ ID NO: 816623 - DNA, 20 bp, mouse
gtcaagctcttgacagttta

SEQ ID NO: 816624 - DNA, 20 bp, mouse
gtgagagcccatttctagag

SEQ ID NO: 816625 - DNA, 20 bp, mouse
gggaggtttaaagtccaaaa

SEQ ID NO: 816626 - DNA, 20 bp, mouse
gtccacgctccctgtccggt

SEQ ID NO: 816627 - DNA, 20 bp, mouse
ggccgccctcccaccggaca

SEQ ID NO: 816628 - DNA, 20 bp, mouse
gcctgcacatacagcagcca

SEQ ID NO: 816629 - DNA, 20 bp, mouse
gtgctaccgcagctggaggg

SEQ ID NO: 816630 - DNA, 20 bp, mouse
gtcccaccggacagggagcg

SEQ ID NO: 816631 - DNA, 20 bp, mouse
gggggtccacgctccctgtc

SEQ ID NO: 816632 - DNA, 20 bp, mouse
gcatacagcagccagggcgc

SEQ ID NO: 816633 - DNA, 20 bp, mouse
gagtgacgcaaaaattcttg

SEQ ID NO: 816634 - DNA, 20 bp, mouse
gtctctgctaccgcagctgg

SEQ ID NO: 816635 - DNA, 20 bp, mouse
ggtaggctgctatcgggatg

SEQ ID NO: 816636 - DNA, 20 bp, mouse
gttgtcactccggtaggagg

SEQ ID NO: 816637 - DNA, 20 bp, mouse
ggtcttgttgtcactccggt

SEQ ID NO: 816638 - DNA, 20 bp, mouse
gagagcgcaagcaaatttga

SEQ ID NO: 816639 - DNA, 20 bp, mouse
gtaggagggggctgcgtgtt

SEQ ID NO: 816640 - DNA, 20 bp, mouse
gtgtttggcgtgactcatgt

SEQ ID NO: 816641 - DNA, 20 bp, mouse
gctaaaccaaagccggtggg

SEQ ID NO: 816642 - DNA, 20 bp, mouse
gagaatgccaggcctgtctc

SEQ ID NO: 816643 - DNA, 20 bp, mouse
gcacctggctggtcagtgtg

SEQ ID NO: 816644 - DNA, 20 bp, mouse
gaaggctgggtttgcgtcag

SEQ ID NO: 816645 - DNA, 20 bp, mouse
gcaggaagatgtcaaacgaa

SEQ ID NO: 816646 - DNA, 20 bp, mouse
gcgcgcgcgcgccccgtgtg

SEQ ID NO: 816647 - DNA, 20 bp, mouse
gcgctcgacgaggcgagctc

SEQ ID NO: 816648 - DNA, 20 bp, mouse
gtcggccacgcccacacacg

SEQ ID NO: 816649 - DNA, 20 bp, mouse
gcgcgccccgtgtgtgggcg

SEQ ID NO: 816650 - DNA, 20 bp, mouse
gagggaggggcctggtctgt

SEQ ID NO: 816651 - DNA, 20 bp, mouse
gtgggcgtggccgacagacc

SEQ ID NO: 816652 - DNA, 20 bp, mouse
gagaggactcggggcaatgg

SEQ ID NO: 816653 - DNA, 20 bp, mouse
ggggaggagcagattctggt

SEQ ID NO: 816654 - DNA, 20 bp, mouse
ggtggctaatggcactgctc

SEQ ID NO: 816655 - DNA, 20 bp, mouse
gctctctaacacacccacct

SEQ ID NO: 816656 - DNA, 20 bp, mouse
gtctccctgcgcagcgccct

SEQ ID NO: 816657 - DNA, 20 bp, mouse
ggcccccgcacgcagagctg

SEQ ID NO: 816658 - DNA, 20 bp, mouse
gggcccccctttcattagtt

SEQ ID NO: 816659 - DNA, 20 bp, mouse
gtggagcggcccaagcccgt

SEQ ID NO: 816660 - DNA, 20 bp, mouse
gcacccaactaatgaaaggg

SEQ ID NO: 816661 - DNA, 20 bp, mouse
gcgcacgcagagctgcggat

SEQ ID NO: 816662 - DNA, 20 bp, mouse
gaaaccatcggtcgcagtta

SEQ ID NO: 816663 - DNA, 20 bp, mouse
gcccgcgcacgggctcggga

SEQ ID NO: 816664 - DNA, 20 bp, mouse
gtcctcacccaactaatgaa

SEQ ID NO: 816665 - DNA, 20 bp, mouse
gggcaagtgactgctatctc

SEQ ID NO: 816666 - DNA, 20 bp, mouse
ggtaggcggagtgacaggga

SEQ ID NO: 816667 - DNA, 20 bp, mouse
gaggagacgctgctccagtt

SEQ ID NO: 816668 - DNA, 20 bp, mouse
gcgcctacctcctcctctag

SEQ ID NO: 816669 - DNA, 20 bp, mouse
gctcctctagaggaggaggt

SEQ ID NO: 816670 - DNA, 20 bp, mouse
ggggagcggtcgggtcgtgg

SEQ ID NO: 816671 - DNA, 20 bp, mouse
gaggaggtaggcggagtgac

SEQ ID NO: 816672 - DNA, 20 bp, mouse
gcggtcgggtcgtgggggtg

SEQ ID NO: 816673 - DNA, 20 bp, mouse
gaagtgctggccagcgcccc

SEQ ID NO: 816674 - DNA, 20 bp, mouse
ggtgatcctggaacgaatgg

SEQ ID NO: 816675 - DNA, 20 bp, mouse
gcagccatcctgctcccaac

SEQ ID NO: 816676 - DNA, 20 bp, mouse
ggagtagtcggcacgcggga

SEQ ID NO: 816677 - DNA, 20 bp, mouse
gagtctgagtagtcggcacg

SEQ ID NO: 816678 - DNA, 20 bp, mouse
gctgaagggcagagaggcga

SEQ ID NO: 816679 - DNA, 20 bp, mouse
gtccaagtgtcccaactgaa

SEQ ID NO: 816680 - DNA, 20 bp, mouse
gtagtcggcacgcgggaggg

SEQ ID NO: 816681 - DNA, 20 bp, mouse
gttgccgagccccactccca

SEQ ID NO: 816682 - DNA, 20 bp, mouse
ggcagagaggcgaaggagaa

SEQ ID NO: 816683 - DNA, 20 bp, mouse
gatgtcctccccttcgggct

SEQ ID NO: 816684 - DNA, 20 bp, mouse
gcagggaataagattacaag

SEQ ID NO: 816685 - DNA, 20 bp, mouse
gtgctcttgacgtctctcta

SEQ ID NO: 816686 - DNA, 20 bp, mouse
ggggaggcgcccaaaccggc

SEQ ID NO: 816687 - DNA, 20 bp, mouse
gtgcggctgcggaggaccaa

SEQ ID NO: 816688 - DNA, 20 bp, mouse
gggcgcgcggctgatgaaac

SEQ ID NO: 816689 - DNA, 20 bp, mouse
gggcggggacacccgagacc

SEQ ID NO: 816690 - DNA, 20 bp, mouse
gcggcggggaagcccggtct

SEQ ID NO: 816691 - DNA, 20 bp, mouse
gccgcgcggccgcgcccctg

SEQ ID NO: 816692 - DNA, 20 bp, mouse
ggggtgcgagccccctcctg

SEQ ID NO: 816693 - DNA, 20 bp, mouse
gtctgactcaagctcagttg

SEQ ID NO: 816694 - DNA, 20 bp, mouse
ggcgcgggaggcgcccaaac

SEQ ID NO: 816695 - DNA, 20 bp, mouse
gccaaaccggcggggaagcc

SEQ ID NO: 816696 - DNA, 20 bp, mouse
gccacccccaaccctagtca

SEQ ID NO: 816697 - DNA, 20 bp, mouse
gaaccctagtcaggggagac

SEQ ID NO: 816698 - DNA, 20 bp, mouse
gcccccgggcggctggatcc

SEQ ID NO: 816699 - DNA, 20 bp, mouse
gctcccctgactagggttgg

SEQ ID NO: 816700 - DNA, 20 bp, mouse
gctcctgtctcccctgacta

SEQ ID NO: 816701 - DNA, 20 bp, mouse
gaaggggctacacccagact

SEQ ID NO: 816702 - DNA, 20 bp, mouse
gggggagttccctttaaggg

SEQ ID NO: 816703 - DNA, 20 bp, mouse
gcgggcggctggatccaggg

SEQ ID NO: 816704 - DNA, 20 bp, mouse
gctcccccaccgcccttaaa

SEQ ID NO: 816705 - DNA, 20 bp, mouse
gcccagacttgggtgaggtg

SEQ ID NO: 816706 - DNA, 20 bp, mouse
gcggagctgcttaaagtcac

SEQ ID NO: 816707 - DNA, 20 bp, mouse
gtagcctgtgggttgctcaa

SEQ ID NO: 816708 - DNA, 20 bp, mouse
gaagctggagttttctcatg

SEQ ID NO: 816709 - DNA, 20 bp, mouse
gtgagctggtgtgtaatgat

SEQ ID NO: 816710 - DNA, 20 bp, mouse
gcctgtcacaccaacttact

SEQ ID NO: 816711 - DNA, 20 bp, mouse
gggaaacacccggggaagta

SEQ ID NO: 816712 - DNA, 20 bp, mouse
gacaggcggttgcttaaata

SEQ ID NO: 816713 - DNA, 20 bp, mouse
gcctggagccggtgccacac

SEQ ID NO: 816714 - DNA, 20 bp, mouse
gaatgatagggcagcagccg

SEQ ID NO: 816715 - DNA, 20 bp, mouse
gcagggaatagacactgtcc

SEQ ID NO: 816716 - DNA, 20 bp, mouse
gccaggagaagggtagcaac

SEQ ID NO: 816717 - DNA, 20 bp, mouse
ggaatgagatgagctatgag

SEQ ID NO: 816718 - DNA, 20 bp, mouse
ggagggctatcagaggcaaa

SEQ ID NO: 816719 - DNA, 20 bp, mouse
ggagatgagctatgagagga

SEQ ID NO: 816720 - DNA, 20 bp, mouse
ggtactggcctgagagatct

SEQ ID NO: 816721 - DNA, 20 bp, mouse
gatataagttactaaaaact

SEQ ID NO: 816722 - DNA, 20 bp, mouse
gggaacctcaggtctctcaa

SEQ ID NO: 816723 - DNA, 20 bp, mouse
ggagtggggagggctatcag

SEQ ID NO: 816724 - DNA, 20 bp, mouse
gagctatgagaggatggacc

SEQ ID NO: 816725 - DNA, 20 bp, mouse
gaggttccagggagtgggga

SEQ ID NO: 816726 - DNA, 20 bp, mouse
ggacaattggacgattaact

SEQ ID NO: 816727 - DNA, 20 bp, mouse
gataaggcattcagttgaaa

SEQ ID NO: 816728 - DNA, 20 bp, mouse
ggtccaattgtccttagatg

SEQ ID NO: 816729 - DNA, 20 bp, mouse
gcaaagcagagggtgtgatc

SEQ ID NO: 816730 - DNA, 20 bp, mouse
gggaaccagagtttggaaat

SEQ ID NO: 816731 - DNA, 20 bp, mouse
ggttatgttcaccacatcta

SEQ ID NO: 816732 - DNA, 20 bp, mouse
gtattcccatttccaaactc

SEQ ID NO: 816733 - DNA, 20 bp, mouse
gtaaaatagattacctgtaa

SEQ ID NO: 816734 - DNA, 20 bp, mouse
gagtcacaagctaagatatg

SEQ ID NO: 816735 - DNA, 20 bp, mouse
gaaacagaatgaaagtacgt

SEQ ID NO: 816736 - DNA, 20 bp, mouse
gtaggactcggtaatggaaa

SEQ ID NO: 816737 - DNA, 20 bp, mouse
ggctggaggccgcacctgga

SEQ ID NO: 816738 - DNA, 20 bp, mouse
gtagccacgtgattacaagg

SEQ ID NO: 816739 - DNA, 20 bp, mouse
gccagagcatagaactgccc

SEQ ID NO: 816740 - DNA, 20 bp, mouse
ggaggccgcacctggaaggc

SEQ ID NO: 816741 - DNA, 20 bp, mouse
gtggtgctaggactcggtaa

SEQ ID NO: 816742 - DNA, 20 bp, mouse
gagtgagtgacagacccggg

SEQ ID NO: 816743 - DNA, 20 bp, mouse
gtagctgaatccaggagagg

SEQ ID NO: 816744 - DNA, 20 bp, mouse
gcgcacctggaaggcgggtg

SEQ ID NO: 816745 - DNA, 20 bp, mouse
ggggcggcgggagtggtgct

SEQ ID NO: 816746 - DNA, 20 bp, mouse
gggagggagtccaaactgaa

SEQ ID NO: 816747 - DNA, 20 bp, mouse
gggtcagtgtaactcaagaa

SEQ ID NO: 816748 - DNA, 20 bp, mouse
ggctatggacatgttgggtg

SEQ ID NO: 816749 - DNA, 20 bp, mouse
gaaggagctgatcaagcgag

SEQ ID NO: 816750 - DNA, 20 bp, mouse
ggaaaggtccgggagagaag

SEQ ID NO: 816751 - DNA, 20 bp, mouse
ggaaggggtcagaatcgcta

SEQ ID NO: 816752 - DNA, 20 bp, mouse
ggcacagcagatcagagaga

SEQ ID NO: 816753 - DNA, 20 bp, mouse
gcagtgacagggtgtttgtt

SEQ ID NO: 816754 - DNA, 20 bp, mouse
gcttgagttacactgacccg

SEQ ID NO: 816755 - DNA, 20 bp, mouse
gagactatctattggagcca

SEQ ID NO: 816756 - DNA, 20 bp, mouse
ggggtcgcgagcacgaggga

SEQ ID NO: 816757 - DNA, 20 bp, mouse
ggcgcgcagagactccagga

SEQ ID NO: 816758 - DNA, 20 bp, mouse
gggcgtgggtcggagacgca

SEQ ID NO: 816759 - DNA, 20 bp, mouse
ggggtcggagacgcagggtt

SEQ ID NO: 816760 - DNA, 20 bp, mouse
gagacgcagggtttggcaga

SEQ ID NO: 816761 - DNA, 20 bp, mouse
ggagccgtgacaaacgctcc

SEQ ID NO: 816762 - DNA, 20 bp, mouse
ggcgagggtcgcgagcacga

SEQ ID NO: 816763 - DNA, 20 bp, mouse
gcacgcttgcccgctggggt

SEQ ID NO: 816764 - DNA, 20 bp, mouse
ggggttctgccaaggaaaag

SEQ ID NO: 816765 - DNA, 20 bp, mouse
gcttctgaaaggtcagggtc

SEQ ID NO: 816766 - DNA, 20 bp, mouse
gagggagagggcttagggct

SEQ ID NO: 816767 - DNA, 20 bp, mouse
gtgtgtagggagagggctta

SEQ ID NO: 816768 - DNA, 20 bp, mouse
ggaaaggtaaggtatcttcc

SEQ ID NO: 816769 - DNA, 20 bp, mouse
ggtaaggtatcttccgggat

SEQ ID NO: 816770 - DNA, 20 bp, mouse
gtatcttccgggattggctg

SEQ ID NO: 816771 - DNA, 20 bp, mouse
ggtgttgtgtgtcatgtgta

SEQ ID NO: 816772 - DNA, 20 bp, mouse
gctaccttaggcaacgctcc

SEQ ID NO: 816773 - DNA, 20 bp, mouse
gtggaatgtctcaaagcccc

SEQ ID NO: 816774 - DNA, 20 bp, mouse
gaatgttccaacgacccgtg

SEQ ID NO: 816775 - DNA, 20 bp, mouse
gcaaaccagggggaggaaaa

SEQ ID NO: 816776 - DNA, 20 bp, mouse
gacagcaggtgggtcatagc

SEQ ID NO: 816777 - DNA, 20 bp, mouse
ggatgtgagtcgtgaggctc

SEQ ID NO: 816778 - DNA, 20 bp, mouse
gaaggagagtaattgctctg

SEQ ID NO: 816779 - DNA, 20 bp, mouse
gacgactcacatcactggtt

SEQ ID NO: 816780 - DNA, 20 bp, mouse
gcaggcttcctcacctaggg

SEQ ID NO: 816781 - DNA, 20 bp, mouse
ggggtcatagcgggtctgga

SEQ ID NO: 816782 - DNA, 20 bp, mouse
gaggggcgggccctgcacgc

SEQ ID NO: 816783 - DNA, 20 bp, mouse
gggaacgtaaatgcaagaga

SEQ ID NO: 816784 - DNA, 20 bp, mouse
ggggcacagggacatggcgg

SEQ ID NO: 816785 - DNA, 20 bp, mouse
gggagtaagccctaggaccc

SEQ ID NO: 816786 - DNA, 20 bp, mouse
gacgcggcgtgactactgat

SEQ ID NO: 816787 - DNA, 20 bp, mouse
ggcgaccccgcctccttcgc

SEQ ID NO: 816788 - DNA, 20 bp, mouse
gcacgtgctctaacagactt

SEQ ID NO: 816789 - DNA, 20 bp, mouse
gcaacagcagcggcgatggg

SEQ ID NO: 816790 - DNA, 20 bp, mouse
gactactgatgggtttatcg

SEQ ID NO: 816791 - DNA, 20 bp, mouse
gcctctgcgccgcctggggc

SEQ ID NO: 816792 - DNA, 20 bp, mouse
ggagcctggagggcgggtaa

SEQ ID NO: 816793 - DNA, 20 bp, mouse
gcggccctgacatcctgcac

SEQ ID NO: 816794 - DNA, 20 bp, mouse
gcggggtcgcgcgggctgag

SEQ ID NO: 816795 - DNA, 20 bp, mouse
gactactgatgtgtttaacg

SEQ ID NO: 816796 - DNA, 20 bp, mouse
gtccccgcgggctgtgactg

SEQ ID NO: 816797 - DNA, 20 bp, mouse
gtccgagccgggtcccctgg

SEQ ID NO: 816798 - DNA, 20 bp, mouse
gtccgggcgcggcctgctgg

SEQ ID NO: 816799 - DNA, 20 bp, mouse
gacagcccgcggggagagtc

SEQ ID NO: 816800 - DNA, 20 bp, mouse
ggcgcccggactctccccgc

SEQ ID NO: 816801 - DNA, 20 bp, mouse
gcccaggcggcgttgcttcc

SEQ ID NO: 816802 - DNA, 20 bp, mouse
ggccgccaggggacccggct

SEQ ID NO: 816803 - DNA, 20 bp, mouse
gtggggcccccgctccgagc

SEQ ID NO: 816804 - DNA, 20 bp, mouse
gggcgaggccgaggaggtga

SEQ ID NO: 816805 - DNA, 20 bp, mouse
gggcgtgggcggggcttgag

SEQ ID NO: 816806 - DNA, 20 bp, mouse
gccaacagctcacccgctgt

SEQ ID NO: 816807 - DNA, 20 bp, mouse
gtcacccacgcggaccgctg

SEQ ID NO: 816808 - DNA, 20 bp, mouse
gagtggatcgcttcccacag

SEQ ID NO: 816809 - DNA, 20 bp, mouse
gtgctggggaggttgggccg

SEQ ID NO: 816810 - DNA, 20 bp, mouse
gtgagctgttgggcttgctg

SEQ ID NO: 816811 - DNA, 20 bp, mouse
gaaaatggccgcgggagtgg

SEQ ID NO: 816812 - DNA, 20 bp, mouse
ggggagaggcaaaatggccg

SEQ ID NO: 816813 - DNA, 20 bp, mouse
gtcgacgccccacccacagt

SEQ ID NO: 816814 - DNA, 20 bp, mouse
ggggaggttgggccgtggct

SEQ ID NO: 816815 - DNA, 20 bp, mouse
gctgccgcagcggtccgcgt

SEQ ID NO: 816816 - DNA, 20 bp, mouse
gcaagctagggccacaagga

SEQ ID NO: 816817 - DNA, 20 bp, mouse
gcccggcagaggagatgccc

SEQ ID NO: 816818 - DNA, 20 bp, mouse
gaggacctccctgtctgacc

SEQ ID NO: 816819 - DNA, 20 bp, mouse
ggagactgcctggtcagaca

SEQ ID NO: 816820 - DNA, 20 bp, mouse
ggaggggccagaggacgagc

SEQ ID NO: 816821 - DNA, 20 bp, mouse
gtgggaccgaaatggaaaac

SEQ ID NO: 816822 - DNA, 20 bp, mouse
ggtggaggagaggctcggga

SEQ ID NO: 816823 - DNA, 20 bp, mouse
gcagagtggaggagaggctc

SEQ ID NO: 816824 - DNA, 20 bp, mouse
gggcagaggagatgcccggg

SEQ ID NO: 816825 - DNA, 20 bp, mouse
gtcagcaagctagggccaca

SEQ ID NO: 816826 - DNA, 20 bp, mouse
gaggagatgcggcttaagga

SEQ ID NO: 816827 - DNA, 20 bp, mouse
gctacccccaaagatcacgg

SEQ ID NO: 816828 - DNA, 20 bp, mouse
gcaagggaagggtgggccgc

SEQ ID NO: 816829 - DNA, 20 bp, mouse
gcccaaagatcacggaggaa

SEQ ID NO: 816830 - DNA, 20 bp, mouse
gagggggaagtcactagcca

SEQ ID NO: 816831 - DNA, 20 bp, mouse
gcggctgcggcgtttatttg

SEQ ID NO: 816832 - DNA, 20 bp, mouse
gagggaggagatgcggctta

SEQ ID NO: 816833 - DNA, 20 bp, mouse
ggtactaagatgtttaggtg

SEQ ID NO: 816834 - DNA, 20 bp, mouse
gtaagggcacacggttctgc

SEQ ID NO: 816835 - DNA, 20 bp, mouse
ggcgacctgagatgaagcct

SEQ ID NO: 816836 - DNA, 20 bp, mouse
gacaccgccagacacaaaat

SEQ ID NO: 816837 - DNA, 20 bp, mouse
gcacccagcccgcaattgta

SEQ ID NO: 816838 - DNA, 20 bp, mouse
gagcccagtgagatagtaaa

SEQ ID NO: 816839 - DNA, 20 bp, mouse
gagggccatgtcttgtgcct

SEQ ID NO: 816840 - DNA, 20 bp, mouse
gcctcctgccggctcccgct

SEQ ID NO: 816841 - DNA, 20 bp, mouse
gaaggtacagaggtcaacag

SEQ ID NO: 816842 - DNA, 20 bp, mouse
ggtgtctggcggtgtctatc

SEQ ID NO: 816843 - DNA, 20 bp, mouse
gcggagactgctgatagaag

SEQ ID NO: 816844 - DNA, 20 bp, mouse
gagcttggccctacaattgc

SEQ ID NO: 816845 - DNA, 20 bp, mouse
gcaggaagtagctgatctag

SEQ ID NO: 816846 - DNA, 20 bp, mouse
gtgtgtcttgctccatgaac

SEQ ID NO: 816847 - DNA, 20 bp, mouse
gaatcagcatgcattgtatt

SEQ ID NO: 816848 - DNA, 20 bp, mouse
gctacatgtagtcccgttca

SEQ ID NO: 816849 - DNA, 20 bp, mouse
gtgacttagtatgatatctt

SEQ ID NO: 816850 - DNA, 20 bp, mouse
gtgtgctcaatagaactgtg

SEQ ID NO: 816851 - DNA, 20 bp, mouse
gaatgggacttttcattttc

SEQ ID NO: 816852 - DNA, 20 bp, mouse
gagttctattgagcacatgc

SEQ ID NO: 816853 - DNA, 20 bp, mouse
gaatagaactgtgcggtaat

SEQ ID NO: 816854 - DNA, 20 bp, mouse
ggatatcatactaagtcaaa

SEQ ID NO: 816855 - DNA, 20 bp, mouse
gaagattgtttagtcactga

SEQ ID NO: 816856 - DNA, 20 bp, mouse
gtaggggaatacagcttggg

SEQ ID NO: 816857 - DNA, 20 bp, mouse
gcagtctagccccctctccg

SEQ ID NO: 816858 - DNA, 20 bp, mouse
ggggcggggacagaggaact

SEQ ID NO: 816859 - DNA, 20 bp, mouse
gtgagagagcagccccggag

SEQ ID NO: 816860 - DNA, 20 bp, mouse
ggggacagaggaactggggc

SEQ ID NO: 816861 - DNA, 20 bp, mouse
ggggctagactggagaggta

SEQ ID NO: 816862 - DNA, 20 bp, mouse
gtcagcctagactctcttaa

SEQ ID NO: 816863 - DNA, 20 bp, mouse
gagagggggctagactggag

SEQ ID NO: 816864 - DNA, 20 bp, mouse
ggggaatacagcttgggagg

SEQ ID NO: 816865 - DNA, 20 bp, mouse
ggagagcagccccggagagg

SEQ ID NO: 816866 - DNA, 20 bp, mouse
gggcccgctgagaagcgctg

SEQ ID NO: 816867 - DNA, 20 bp, mouse
gtcgacgtcaccctatcagc

SEQ ID NO: 816868 - DNA, 20 bp, mouse
gaggcctaggggaagactcg

SEQ ID NO: 816869 - DNA, 20 bp, mouse
gagggtgacgtcgagtttgg

SEQ ID NO: 816870 - DNA, 20 bp, mouse
ggatagggtgacgtcgagtt

SEQ ID NO: 816871 - DNA, 20 bp, mouse
gcctaggggaagactcgagg

SEQ ID NO: 816872 - DNA, 20 bp, mouse
gggtccgtgcttggtgtccc

SEQ ID NO: 816873 - DNA, 20 bp, mouse
gcatctgcattcaatctcct

SEQ ID NO: 816874 - DNA, 20 bp, mouse
gttccacagcgcttctcagc

SEQ ID NO: 816875 - DNA, 20 bp, mouse
gagctgtctcccagctgata

SEQ ID NO: 816876 - DNA, 20 bp, mouse
ggggcggggcgagccttaaa

SEQ ID NO: 816877 - DNA, 20 bp, mouse
gggcccgactggcaagtagg

SEQ ID NO: 816878 - DNA, 20 bp, mouse
gaggcccgagagaagtctaa

SEQ ID NO: 816879 - DNA, 20 bp, mouse
gagctcacaacccccaccct

SEQ ID NO: 816880 - DNA, 20 bp, mouse
gcagcctcccagccgagggt

SEQ ID NO: 816881 - DNA, 20 bp, mouse
gctccccttagacttctctc

SEQ ID NO: 816882 - DNA, 20 bp, mouse
gttaaagggcgtgtcttggg

SEQ ID NO: 816883 - DNA, 20 bp, mouse
gttactgagggtggtatgga

SEQ ID NO: 816884 - DNA, 20 bp, mouse
ggccttaaagggcgtgtctt

SEQ ID NO: 816885 - DNA, 20 bp, mouse
gcgtggcccgactggcaagt

SEQ ID NO: 816886 - DNA, 20 bp, mouse
gaggaagccgagacctaaat

SEQ ID NO: 816887 - DNA, 20 bp, mouse
gggcccctgtcgcccaggga

SEQ ID NO: 816888 - DNA, 20 bp, mouse
ggcaccgcgcgggcgctgac

SEQ ID NO: 816889 - DNA, 20 bp, mouse
gcagcggcccctgtcgccca

SEQ ID NO: 816890 - DNA, 20 bp, mouse
ggttatgccgccacagtcaa

SEQ ID NO: 816891 - DNA, 20 bp, mouse
gggatgggatcgtggttcag

SEQ ID NO: 816892 - DNA, 20 bp, mouse
gagaaagctgtgaaacagag

SEQ ID NO: 816893 - DNA, 20 bp, mouse
gtgctgcgcctgctactcgt

SEQ ID NO: 816894 - DNA, 20 bp, mouse
gtattggcttcccttgactg

SEQ ID NO: 816895 - DNA, 20 bp, mouse
gctcaactgtaaggtggaga

SEQ ID NO: 816896 - DNA, 20 bp, mouse
gcccgggctcccaagaacag

SEQ ID NO: 816897 - DNA, 20 bp, mouse
gtcgcccccgcgtcgactgt

SEQ ID NO: 816898 - DNA, 20 bp, mouse
gaccaagagccgctgttctt

SEQ ID NO: 816899 - DNA, 20 bp, mouse
ggcaacccacagtcgacgcg

SEQ ID NO: 816900 - DNA, 20 bp, mouse
gcagcgtcggccgtccatca

SEQ ID NO: 816901 - DNA, 20 bp, mouse
gaacagcggctcttggtccg

SEQ ID NO: 816902 - DNA, 20 bp, mouse
gtccggggcggggacagctc

SEQ ID NO: 816903 - DNA, 20 bp, mouse
gacggccgacgctgcctccg

SEQ ID NO: 816904 - DNA, 20 bp, mouse
gcctgcccggggcggcccga

SEQ ID NO: 816905 - DNA, 20 bp, mouse
gtcctcccgccccgccaccg

SEQ ID NO: 816906 - DNA, 20 bp, mouse
gcgggctctctgggtgctgt

SEQ ID NO: 816907 - DNA, 20 bp, mouse
gtaacgggtagaatcgacaa

SEQ ID NO: 816908 - DNA, 20 bp, mouse
ggctcacgcccgggctctct

SEQ ID NO: 816909 - DNA, 20 bp, mouse
ggcactgcgctccgctggga

SEQ ID NO: 816910 - DNA, 20 bp, mouse
ggcctgccctgctcacgccc

SEQ ID NO: 816911 - DNA, 20 bp, mouse
ggaaggaagcgactgccagt

SEQ ID NO: 816912 - DNA, 20 bp, mouse
gaggttctagctgctggctt

SEQ ID NO: 816913 - DNA, 20 bp, mouse
gggagtgcttctaacgcagc

SEQ ID NO: 816914 - DNA, 20 bp, mouse
ggaggaggcagcgggattaa

SEQ ID NO: 816915 - DNA, 20 bp, mouse
ggaaggccccgccctggcgc

SEQ ID NO: 816916 - DNA, 20 bp, mouse
gctaaccaatcaggagagtg

SEQ ID NO: 816917 - DNA, 20 bp, mouse
ggaaccgggctcttgcgcca

SEQ ID NO: 816918 - DNA, 20 bp, mouse
ggcgtggcctgcactcggcg

SEQ ID NO: 816919 - DNA, 20 bp, mouse
gcacgccccactctcctgat

SEQ ID NO: 816920 - DNA, 20 bp, mouse
ggcgcagggcggggattggc

SEQ ID NO: 816921 - DNA, 20 bp, mouse
gaaccagagcggagcccgtg

SEQ ID NO: 816922 - DNA, 20 bp, mouse
gaggggagcgacagttgctg

SEQ ID NO: 816923 - DNA, 20 bp, mouse
gtgaacaaatctaaccaatc

SEQ ID NO: 816924 - DNA, 20 bp, mouse
gcggcgcggcaccccgcagc

SEQ ID NO: 816925 - DNA, 20 bp, mouse
gggccccacgggctccgctc

SEQ ID NO: 816926 - DNA, 20 bp, mouse
gaggactcccagggactcga

SEQ ID NO: 816927 - DNA, 20 bp, mouse
gaaaccctaggaccaaggag

SEQ ID NO: 816928 - DNA, 20 bp, mouse
ggtgctggcgctacggaggg

SEQ ID NO: 816929 - DNA, 20 bp, mouse
gtacggagggtggccaaaat

SEQ ID NO: 816930 - DNA, 20 bp, mouse
gaggccagaggggaagtgca

SEQ ID NO: 816931 - DNA, 20 bp, mouse
gggggcttgggttagggcgg

SEQ ID NO: 816932 - DNA, 20 bp, mouse
ggctagcggggcttgggtta

SEQ ID NO: 816933 - DNA, 20 bp, mouse
gaacactcctggtaggtaga

SEQ ID NO: 816934 - DNA, 20 bp, mouse
gaaggtgctggcgctacgga

SEQ ID NO: 816935 - DNA, 20 bp, mouse
gggggtgcatcccgaggaaa

SEQ ID NO: 816936 - DNA, 20 bp, mouse
ggaacctgggccacagtggg

SEQ ID NO: 816937 - DNA, 20 bp, mouse
gagtggagacagggagtcaa

SEQ ID NO: 816938 - DNA, 20 bp, mouse
ggggaacagagacagtggat

SEQ ID NO: 816939 - DNA, 20 bp, mouse
gagggaggggaccttggctg

SEQ ID NO: 816940 - DNA, 20 bp, mouse
gggagacagggagtcaaggg

SEQ ID NO: 816941 - DNA, 20 bp, mouse
ggggacgccggacaggggag

SEQ ID NO: 816942 - DNA, 20 bp, mouse
ggacatggtggactgagtta

SEQ ID NO: 816943 - DNA, 20 bp, mouse
gtgggggggacgccggacag

SEQ ID NO: 816944 - DNA, 20 bp, mouse
ggacggaaaccaagctgggt

SEQ ID NO: 816945 - DNA, 20 bp, mouse
ggtaggacccaagggtggaa

SEQ ID NO: 816946 - DNA, 20 bp, mouse
gtgttcaggcagctcagttc

SEQ ID NO: 816947 - DNA, 20 bp, mouse
gaaacagtttcgaatgaaga

SEQ ID NO: 816948 - DNA, 20 bp, mouse
gcctctttggaaatgacttc

SEQ ID NO: 816949 - DNA, 20 bp, mouse
gtccggtgcgatgactctgc

SEQ ID NO: 816950 - DNA, 20 bp, mouse
gacaggtgagacagaatctc

SEQ ID NO: 816951 - DNA, 20 bp, mouse
gcagaggcgtggcatacatc

SEQ ID NO: 816952 - DNA, 20 bp, mouse
gcacctgtgccgcagaggcg

SEQ ID NO: 816953 - DNA, 20 bp, mouse
gtccttcctgggatccaaca

SEQ ID NO: 816954 - DNA, 20 bp, mouse
gcatcttgtgagtgtaaatt

SEQ ID NO: 816955 - DNA, 20 bp, mouse
gggtgagacagaatctcggg

SEQ ID NO: 816956 - DNA, 20 bp, mouse
gtgaaggtaggaccaaggaa

SEQ ID NO: 816957 - DNA, 20 bp, mouse
gcgcgctcgccgctcagtct

SEQ ID NO: 816958 - DNA, 20 bp, mouse
gcggacgctcgcggctcgag

SEQ ID NO: 816959 - DNA, 20 bp, mouse
gggcggagccagatgaaggt

SEQ ID NO: 816960 - DNA, 20 bp, mouse
gccagatgaaggtaggacca

SEQ ID NO: 816961 - DNA, 20 bp, mouse
ggatggggacccagtatccg

SEQ ID NO: 816962 - DNA, 20 bp, mouse
ggcccaagcgccgcctccgg

SEQ ID NO: 816963 - DNA, 20 bp, mouse
gcaagcgccgcctccggcgg

SEQ ID NO: 816964 - DNA, 20 bp, mouse
gcatttgcaggggacacaag

SEQ ID NO: 816965 - DNA, 20 bp, mouse
gcggggttaaccaccgccgg

SEQ ID NO: 816966 - DNA, 20 bp, mouse
gtggcccgaccactccccgt

SEQ ID NO: 816967 - DNA, 20 bp, mouse
gtctaggcgtgcctgtaggt

SEQ ID NO: 816968 - DNA, 20 bp, mouse
ggggtagacaagccaaagaa

SEQ ID NO: 816969 - DNA, 20 bp, mouse
ggagctctaggcgtgcctgt

SEQ ID NO: 816970 - DNA, 20 bp, mouse
ggagcccacggggagtggtc

SEQ ID NO: 816971 - DNA, 20 bp, mouse
gggccagtgtcatcagaagc

SEQ ID NO: 816972 - DNA, 20 bp, mouse
gggtgcctgcaccgccggct

SEQ ID NO: 816973 - DNA, 20 bp, mouse
ggtggctgtcactttaagag

SEQ ID NO: 816974 - DNA, 20 bp, mouse
gagagcccagccggcggtgc

SEQ ID NO: 816975 - DNA, 20 bp, mouse
gccactccccgtgggctcac

SEQ ID NO: 816976 - DNA, 20 bp, mouse
ggctcggtggcgcagtggaa

SEQ ID NO: 816977 - DNA, 20 bp, mouse
ggacacggccagcagctcgg

SEQ ID NO: 816978 - DNA, 20 bp, mouse
gcgtacctggtcagactgtc

SEQ ID NO: 816979 - DNA, 20 bp, mouse
gtgagcgtggcgctaaggac

SEQ ID NO: 816980 - DNA, 20 bp, mouse
gctagccgccctcctggcag

SEQ ID NO: 816981 - DNA, 20 bp, mouse
ggaccccagacagtctgacc

SEQ ID NO: 816982 - DNA, 20 bp, mouse
ggaagggctagccgccctcc

SEQ ID NO: 816983 - DNA, 20 bp, mouse
gcagcagctcggtggcgcag

SEQ ID NO: 816984 - DNA, 20 bp, mouse
gcaggctggctgtccgggcg

SEQ ID NO: 816985 - DNA, 20 bp, mouse
gcccgcctagaggagcagca

SEQ ID NO: 816986 - DNA, 20 bp, mouse
ggggagtgggacgacctctg

SEQ ID NO: 816987 - DNA, 20 bp, mouse
ggccccgcgtgagaatccca

SEQ ID NO: 816988 - DNA, 20 bp, mouse
ggattctcacgcggggcgga

SEQ ID NO: 816989 - DNA, 20 bp, mouse
gacagcgcagagggtcgccc

SEQ ID NO: 816990 - DNA, 20 bp, mouse
ggagccctgggattctcacg

SEQ ID NO: 816991 - DNA, 20 bp, mouse
gacagagaggacagcgcaga

SEQ ID NO: 816992 - DNA, 20 bp, mouse
gaaaaagtccggatgtccca

SEQ ID NO: 816993 - DNA, 20 bp, mouse
gagatccaggacaacttgag

SEQ ID NO: 816994 - DNA, 20 bp, mouse
gctgtgtgacgatctggcct

SEQ ID NO: 816995 - DNA, 20 bp, mouse
ggcagggctagcggggccgg

SEQ ID NO: 816996 - DNA, 20 bp, mouse
gctggacatcagcatcttgc

SEQ ID NO: 816997 - DNA, 20 bp, mouse
gaacaggagggccacgagtc

SEQ ID NO: 816998 - DNA, 20 bp, mouse
gctggcagatttgaccagtg

SEQ ID NO: 816999 - DNA, 20 bp, mouse
gctcccaggggaggattgac

SEQ ID NO: 817000 - DNA, 20 bp, mouse
gggaaagagatcttccacac

SEQ ID NO: 817001 - DNA, 20 bp, mouse
gcccttaacttcacctactc

SEQ ID NO: 817002 - DNA, 20 bp, mouse
gatgctgatgtccagactcg

SEQ ID NO: 817003 - DNA, 20 bp, mouse
gacttcgcaagcaattcaga

SEQ ID NO: 817004 - DNA, 20 bp, mouse
ggtaggtgaagttaagggtc

SEQ ID NO: 817005 - DNA, 20 bp, mouse
gtacctgtcaatcctcccct

SEQ ID NO: 817006 - DNA, 20 bp, mouse
gaacctccaggacggaaact

SEQ ID NO: 817007 - DNA, 20 bp, mouse
gttaccggaagcagaagggc

SEQ ID NO: 817008 - DNA, 20 bp, mouse
gtaggtggcttcaccatatt

SEQ ID NO: 817009 - DNA, 20 bp, mouse
gaaactgggctgggatttac

SEQ ID NO: 817010 - DNA, 20 bp, mouse
gtgaagccacctataatccc

SEQ ID NO: 817011 - DNA, 20 bp, mouse
ggaagccaataatcctaata

SEQ ID NO: 817012 - DNA, 20 bp, mouse
gagccaaggacccaacctcc

SEQ ID NO: 817013 - DNA, 20 bp, mouse
ggtgtgttgggtattgacag

SEQ ID NO: 817014 - DNA, 20 bp, mouse
gggatttaccggaagcagaa

SEQ ID NO: 817015 - DNA, 20 bp, mouse
gttcaccatattaggattat

SEQ ID NO: 817016 - DNA, 20 bp, mouse
ggctggaagctggggcgcgt

SEQ ID NO: 817017 - DNA, 20 bp, mouse
gaggtccagtggcgcggggc

SEQ ID NO: 817018 - DNA, 20 bp, mouse
gcggggcacactctcagttc

SEQ ID NO: 817019 - DNA, 20 bp, mouse
gggaaaacagggaggtccag

SEQ ID NO: 817020 - DNA, 20 bp, mouse
gactctcagtgtcttctcac

SEQ ID NO: 817021 - DNA, 20 bp, mouse
gagagtcctggaatttgcgt

SEQ ID NO: 817022 - DNA, 20 bp, mouse
ggggccggcggaaaacaggg

SEQ ID NO: 817023 - DNA, 20 bp, mouse
gtagggcggtgctgtggctg

SEQ ID NO: 817024 - DNA, 20 bp, mouse
gagggaggaagacaccaaac

SEQ ID NO: 817025 - DNA, 20 bp, mouse
gctctgctcattcagccaga

SEQ ID NO: 817026 - DNA, 20 bp, mouse
ggggttgaggacttggttct

SEQ ID NO: 817027 - DNA, 20 bp, mouse
gagtaggcacatagcagggg

SEQ ID NO: 817028 - DNA, 20 bp, mouse
ggccagtaggcacatagcag

SEQ ID NO: 817029 - DNA, 20 bp, mouse
ggggctggaagctgttttga

SEQ ID NO: 817030 - DNA, 20 bp, mouse
gggagctgtcaagctatata

SEQ ID NO: 817031 - DNA, 20 bp, mouse
gtggcagcatcacaactcct

SEQ ID NO: 817032 - DNA, 20 bp, mouse
gctcctgctgaggcatctct

SEQ ID NO: 817033 - DNA, 20 bp, mouse
gctatgtgcctactggctag

SEQ ID NO: 817034 - DNA, 20 bp, mouse
gtggacagttctggaatgag

SEQ ID NO: 817035 - DNA, 20 bp, mouse
gtccattttctgtgtattaa

SEQ ID NO: 817036 - DNA, 20 bp, mouse
gtgaaggtctagcacatggt

SEQ ID NO: 817037 - DNA, 20 bp, mouse
ggcactacatgctagatcat

SEQ ID NO: 817038 - DNA, 20 bp, mouse
ggaaggtcaagcaagtcttg

SEQ ID NO: 817039 - DNA, 20 bp, mouse
gtaggtgggtcttgtttggt

SEQ ID NO: 817040 - DNA, 20 bp, mouse
gaggtctagcacatggtagg

SEQ ID NO: 817041 - DNA, 20 bp, mouse
gatggtaggtgggtcttgtt

SEQ ID NO: 817042 - DNA, 20 bp, mouse
gtagggaggtggtggttcag

SEQ ID NO: 817043 - DNA, 20 bp, mouse
gacattcactagagtaattt

SEQ ID NO: 817044 - DNA, 20 bp, mouse
gcatgtgaaggtctagcaca

SEQ ID NO: 817045 - DNA, 20 bp, mouse
gtttgggtcttcccagtgat

SEQ ID NO: 817046 - DNA, 20 bp, mouse
gccttccaatcagaaaccaa

SEQ ID NO: 817047 - DNA, 20 bp, mouse
gggctgtctctcacagttag

SEQ ID NO: 817048 - DNA, 20 bp, mouse
gcaaaataaaatcacttgct

SEQ ID NO: 817049 - DNA, 20 bp, mouse
gatatcagataaggtttctc

SEQ ID NO: 817050 - DNA, 20 bp, mouse
gtttgccaagaaaggactta

SEQ ID NO: 817051 - DNA, 20 bp, mouse
ggacaaattgactagattgc

SEQ ID NO: 817052 - DNA, 20 bp, mouse
gactgtgagagacagcctct

SEQ ID NO: 817053 - DNA, 20 bp, mouse
gcacagttagaggcaatttg

SEQ ID NO: 817054 - DNA, 20 bp, mouse
gcatggtaaaaccatatgaa

SEQ ID NO: 817055 - DNA, 20 bp, mouse
gatttccctaagtcctttct

SEQ ID NO: 817056 - DNA, 20 bp, mouse
ggatgtgcacggaggacctg

SEQ ID NO: 817057 - DNA, 20 bp, mouse
gcaaataaatcaggagggag

SEQ ID NO: 817058 - DNA, 20 bp, mouse
gaacaggaagccacatttga

SEQ ID NO: 817059 - DNA, 20 bp, mouse
ggaaaccaaataaatcagga

SEQ ID NO: 817060 - DNA, 20 bp, mouse
ggctctgtctacactctgca

SEQ ID NO: 817061 - DNA, 20 bp, mouse
gggctccaagtggctaatct

SEQ ID NO: 817062 - DNA, 20 bp, mouse
ggcttgaaaccaaataaatc

SEQ ID NO: 817063 - DNA, 20 bp, mouse
ggcccaccccgcacaccctc

SEQ ID NO: 817064 - DNA, 20 bp, mouse
gcaggcttctcatatagaaa

SEQ ID NO: 817065 - DNA, 20 bp, mouse
gaggctccagagggtgtgcg

SEQ ID NO: 817066 - DNA, 20 bp, mouse
gctgagagctggctggtagt

SEQ ID NO: 817067 - DNA, 20 bp, mouse
ggaaatttcagggtaagctt

SEQ ID NO: 817068 - DNA, 20 bp, mouse
gactatttctctttccatgc

SEQ ID NO: 817069 - DNA, 20 bp, mouse
gttgagtatttactgagagc

SEQ ID NO: 817070 - DNA, 20 bp, mouse
gcaagtccagggtccgctca

SEQ ID NO: 817071 - DNA, 20 bp, mouse
ggtcttaagcagtccttgag

SEQ ID NO: 817072 - DNA, 20 bp, mouse
gttactaaattccaagtcca

SEQ ID NO: 817073 - DNA, 20 bp, mouse
gctgcttaagacattggtga

SEQ ID NO: 817074 - DNA, 20 bp, mouse
gggatgcaattcatctgaat

SEQ ID NO: 817075 - DNA, 20 bp, mouse
gagatgaattgcatccagca

SEQ ID NO: 817076 - DNA, 20 bp, mouse
gagcaaacaaagatctaggt

SEQ ID NO: 817077 - DNA, 20 bp, mouse
ggaactgaaaaaaagcagag

SEQ ID NO: 817078 - DNA, 20 bp, mouse
gaatgtgcaaccaatacaat

SEQ ID NO: 817079 - DNA, 20 bp, mouse
gaagcagagaggctttaaag

SEQ ID NO: 817080 - DNA, 20 bp, mouse
gaaaacaaagtttgttattt

SEQ ID NO: 817081 - DNA, 20 bp, mouse
gaactttcatccaattgtat

SEQ ID NO: 817082 - DNA, 20 bp, mouse
gcaaatggtgcaggctcacg

SEQ ID NO: 817083 - DNA, 20 bp, mouse
gttgaatgcttttaagtagt

SEQ ID NO: 817084 - DNA, 20 bp, mouse
gttttgaacatgaattaacc

SEQ ID NO: 817085 - DNA, 20 bp, mouse
gaagaagcaaacaaagatct

SEQ ID NO: 817086 - DNA, 20 bp, mouse
gcagtcctaagggacatcaa

SEQ ID NO: 817087 - DNA, 20 bp, mouse
gtctagaagcccaatggtga

SEQ ID NO: 817088 - DNA, 20 bp, mouse
gtggcagtctgcagggaatt

SEQ ID NO: 817089 - DNA, 20 bp, mouse
ggaattgggcaccctggcaa

SEQ ID NO: 817090 - DNA, 20 bp, mouse
gggctggaagactgattgga

SEQ ID NO: 817091 - DNA, 20 bp, mouse
gggctggctggaagactgat

SEQ ID NO: 817092 - DNA, 20 bp, mouse
gccagaaaacaccattccac

SEQ ID NO: 817093 - DNA, 20 bp, mouse
gtcaaggctcatagggtgtg

SEQ ID NO: 817094 - DNA, 20 bp, mouse
gcacagacagggcagattag

SEQ ID NO: 817095 - DNA, 20 bp, mouse
gtccagccagccagtcctaa

SEQ ID NO: 817096 - DNA, 20 bp, mouse
gacccaagacacctgcctgg

SEQ ID NO: 817097 - DNA, 20 bp, mouse
gaggctctgggactcgagct

SEQ ID NO: 817098 - DNA, 20 bp, mouse
gactcgagctgggtgagcct

SEQ ID NO: 817099 - DNA, 20 bp, mouse
gaggaagaggagaccgcgta

SEQ ID NO: 817100 - DNA, 20 bp, mouse
gtcctgctggccagggttga

SEQ ID NO: 817101 - DNA, 20 bp, mouse
ggtcttgggtcctggagtcg

SEQ ID NO: 817102 - DNA, 20 bp, mouse
gtacccccaaccctcaaccc

SEQ ID NO: 817103 - DNA, 20 bp, mouse
ggcggaagcccagaggctct

SEQ ID NO: 817104 - DNA, 20 bp, mouse
ggcagcacctctgacacccg

SEQ ID NO: 817105 - DNA, 20 bp, mouse
gtgcctgggggaggcgacag

SEQ ID NO: 817106 - DNA, 20 bp, mouse
gggccaggtgtaagagtcaa

SEQ ID NO: 817107 - DNA, 20 bp, mouse
gccgtgccaaagtccaaaaa

SEQ ID NO: 817108 - DNA, 20 bp, mouse
gcccctccctggctgtgggg

SEQ ID NO: 817109 - DNA, 20 bp, mouse
gggggcggaaccaggaacct

SEQ ID NO: 817110 - DNA, 20 bp, mouse
gtggttccgccccacagcca

SEQ ID NO: 817111 - DNA, 20 bp, mouse
gtctgtgagtgcctggtgag

SEQ ID NO: 817112 - DNA, 20 bp, mouse
gacactgacagactttacaa

SEQ ID NO: 817113 - DNA, 20 bp, mouse
gggccaggccacatggtcac

SEQ ID NO: 817114 - DNA, 20 bp, mouse
gacactgggaacactcccca

SEQ ID NO: 817115 - DNA, 20 bp, mouse
gtggggagggatatgtgtgc

SEQ ID NO: 817116 - DNA, 20 bp, mouse
gtaggtggcgcagatggcaa

SEQ ID NO: 817117 - DNA, 20 bp, mouse
gtcagagctcatagagggtt

SEQ ID NO: 817118 - DNA, 20 bp, mouse
gccacctagatgaaagggga

SEQ ID NO: 817119 - DNA, 20 bp, mouse
ggcaaagagactgaacattc

SEQ ID NO: 817120 - DNA, 20 bp, mouse
gggaatgtttgtctctagaa

SEQ ID NO: 817121 - DNA, 20 bp, mouse
ggtccagcccccatgcagtg

SEQ ID NO: 817122 - DNA, 20 bp, mouse
ggggaagacagcagccccac

SEQ ID NO: 817123 - DNA, 20 bp, mouse
gcagcccccatgcagtgagg

SEQ ID NO: 817124 - DNA, 20 bp, mouse
gccccatgcagtgaggaggc

SEQ ID NO: 817125 - DNA, 20 bp, mouse
gaccagcctcctcactgcat

SEQ ID NO: 817126 - DNA, 20 bp, mouse
gaagcccagcaatatgctct

SEQ ID NO: 817127 - DNA, 20 bp, mouse
gagctcctaaagagcagttt

SEQ ID NO: 817128 - DNA, 20 bp, mouse
ggggaatgagtgatcaggga

SEQ ID NO: 817129 - DNA, 20 bp, mouse
gaaagcccagagcatattgc

SEQ ID NO: 817130 - DNA, 20 bp, mouse
gctaacggacagaatgagcc

SEQ ID NO: 817131 - DNA, 20 bp, mouse
gtgagtgatcagggagggaa

SEQ ID NO: 817132 - DNA, 20 bp, mouse
gaggctgaggtggaagcttc

SEQ ID NO: 817133 - DNA, 20 bp, mouse
gtgctctcatgaacaagagc

SEQ ID NO: 817134 - DNA, 20 bp, mouse
ggagagcagccttgcaccac

SEQ ID NO: 817135 - DNA, 20 bp, mouse
gcctaaagagcagttttggc

SEQ ID NO: 817136 - DNA, 20 bp, mouse
gaacggcgagagtccgagag

SEQ ID NO: 817137 - DNA, 20 bp, mouse
ggacctgcttggggcactaa

SEQ ID NO: 817138 - DNA, 20 bp, mouse
gtccgagagaggctaggcgg

SEQ ID NO: 817139 - DNA, 20 bp, mouse
gccggcgggccaggggaagc

SEQ ID NO: 817140 - DNA, 20 bp, mouse
ggctgcgccgctactggctg

SEQ ID NO: 817141 - DNA, 20 bp, mouse
gtcgggctgtgccaatcaca

SEQ ID NO: 817142 - DNA, 20 bp, mouse
gaggaagggagctagcgcgg

SEQ ID NO: 817143 - DNA, 20 bp, mouse
gcgtccctgggaggcacgag

SEQ ID NO: 817144 - DNA, 20 bp, mouse
gcttggggcgctaggggtga

SEQ ID NO: 817145 - DNA, 20 bp, mouse
gctggctgcgggtgcgtccc

SEQ ID NO: 817146 - DNA, 20 bp, mouse
ggagcggaggggcggaactt

SEQ ID NO: 817147 - DNA, 20 bp, mouse
ggggacactctggaggttgc

SEQ ID NO: 817148 - DNA, 20 bp, mouse
gacccccatccctgcgggag

SEQ ID NO: 817149 - DNA, 20 bp, mouse
ggcctcgctgccattggtgg

SEQ ID NO: 817150 - DNA, 20 bp, mouse
gggaggggcggaacttgggc

SEQ ID NO: 817151 - DNA, 20 bp, mouse
gccctcgctactgtcacctc

SEQ ID NO: 817152 - DNA, 20 bp, mouse
gaccaatggcagcgaggctc

SEQ ID NO: 817153 - DNA, 20 bp, mouse
ggcggaacttgggcgggtca

SEQ ID NO: 817154 - DNA, 20 bp, mouse
ggccagaggtgacagtagcg

SEQ ID NO: 817155 - DNA, 20 bp, mouse
gcggggcggggccgagcgga

SEQ ID NO: 817156 - DNA, 20 bp, mouse
gtgaccgtgcagtgacagat

SEQ ID NO: 817157 - DNA, 20 bp, mouse
gcacggtcaccgcagctacc

SEQ ID NO: 817158 - DNA, 20 bp, mouse
gtgcctaggtcccggaggtc

SEQ ID NO: 817159 - DNA, 20 bp, mouse
ggagcagcgctgacacctcg

SEQ ID NO: 817160 - DNA, 20 bp, mouse
gctgacacctcgaggtgcct

SEQ ID NO: 817161 - DNA, 20 bp, mouse
ggggagtgtccgggtagctg

SEQ ID NO: 817162 - DNA, 20 bp, mouse
gccggaggtccgggagtgtc

SEQ ID NO: 817163 - DNA, 20 bp, mouse
gcctcgaggtgcctaggtcc

SEQ ID NO: 817164 - DNA, 20 bp, mouse
ggtgctgagatccctgaaag

SEQ ID NO: 817165 - DNA, 20 bp, mouse
gctccgccaggtgagagaac

SEQ ID NO: 817166 - DNA, 20 bp, mouse
gaaagcaaacgcactgttta

SEQ ID NO: 817167 - DNA, 20 bp, mouse
ggactctcgctcattgtctg

SEQ ID NO: 817168 - DNA, 20 bp, mouse
ggcactgtttaaggcaaaag

SEQ ID NO: 817169 - DNA, 20 bp, mouse
gaaagtcaaagacagcgcgt

SEQ ID NO: 817170 - DNA, 20 bp, mouse
gactttaagtaggtgtttga

SEQ ID NO: 817171 - DNA, 20 bp, mouse
gcaatgagcgagagtcttgg

SEQ ID NO: 817172 - DNA, 20 bp, mouse
ggtcaaagacagcgcgtggg

SEQ ID NO: 817173 - DNA, 20 bp, mouse
gtgtttaaggcaaaaggggc

SEQ ID NO: 817174 - DNA, 20 bp, mouse
ggcgctctgggacttaacgt

SEQ ID NO: 817175 - DNA, 20 bp, mouse
gcaagcacacaatacattcc

SEQ ID NO: 817176 - DNA, 20 bp, mouse
gaagcaaccgcagtatctca

SEQ ID NO: 817177 - DNA, 20 bp, mouse
ggatactgcggttgcttctg

SEQ ID NO: 817178 - DNA, 20 bp, mouse
gaacgaattaataagggagg

SEQ ID NO: 817179 - DNA, 20 bp, mouse
gcgtcactcaacccttctga

SEQ ID NO: 817180 - DNA, 20 bp, mouse
gaataacgaattaataaggg

SEQ ID NO: 817181 - DNA, 20 bp, mouse
gataaataacgaattaataa

SEQ ID NO: 817182 - DNA, 20 bp, mouse
gaaattcatagcattcagcc

SEQ ID NO: 817183 - DNA, 20 bp, mouse
gattttaaagaccgtcacag

SEQ ID NO: 817184 - DNA, 20 bp, mouse
ggaatctagccttggaactt

SEQ ID NO: 817185 - DNA, 20 bp, mouse
ggggaaagaaagggtaagaa

SEQ ID NO: 817186 - DNA, 20 bp, mouse
gtgaagcctggagatagtga

SEQ ID NO: 817187 - DNA, 20 bp, mouse
ggatagtgatggttggtttc

SEQ ID NO: 817188 - DNA, 20 bp, mouse
ggcggcagaagttccaagtc

SEQ ID NO: 817189 - DNA, 20 bp, mouse
gaccaaccatcactatctcc

SEQ ID NO: 817190 - DNA, 20 bp, mouse
ggcctggagatagtgatggt

SEQ ID NO: 817191 - DNA, 20 bp, mouse
ggcgtggcaacactgatgat

SEQ ID NO: 817192 - DNA, 20 bp, mouse
gcatcattctgtagggacgt

SEQ ID NO: 817193 - DNA, 20 bp, mouse
gtctgccgcatcattctgta

SEQ ID NO: 817194 - DNA, 20 bp, mouse
gagaagatggaatccagact

SEQ ID NO: 817195 - DNA, 20 bp, mouse
gtcttattgtagtgtctcta

SEQ ID NO: 817196 - DNA, 20 bp, mouse
gaactggcgatactgatggt

SEQ ID NO: 817197 - DNA, 20 bp, mouse
gggaaaactggcgatactga

SEQ ID NO: 817198 - DNA, 20 bp, mouse
gcaccacactgaaggaaaac

SEQ ID NO: 817199 - DNA, 20 bp, mouse
gaagaaagcaagtaaatagc

SEQ ID NO: 817200 - DNA, 20 bp, mouse
gaagccaaaaacaggaaggc

SEQ ID NO: 817201 - DNA, 20 bp, mouse
gagaagatagaattcagtct

SEQ ID NO: 817202 - DNA, 20 bp, mouse
ggttgtttgataatattcac

SEQ ID NO: 817203 - DNA, 20 bp, mouse
gggaacgttatttccagtgc

SEQ ID NO: 817204 - DNA, 20 bp, mouse
gttaagccaatccactgtga

SEQ ID NO: 817205 - DNA, 20 bp, mouse
gtggaagatctagaagaaca

SEQ ID NO: 817206 - DNA, 20 bp, mouse
ggtggagtggcaatcacaga

SEQ ID NO: 817207 - DNA, 20 bp, mouse
gaatccccagggcaaagctg

SEQ ID NO: 817208 - DNA, 20 bp, mouse
ggggaggaagatgattggag

SEQ ID NO: 817209 - DNA, 20 bp, mouse
gtgttgaagcctctccaggg

SEQ ID NO: 817210 - DNA, 20 bp, mouse
ggatttgagtgacgctgtaa

SEQ ID NO: 817211 - DNA, 20 bp, mouse
gagcgtcactcaaatcccca

SEQ ID NO: 817212 - DNA, 20 bp, mouse
gtgggaagatgggtttctat

SEQ ID NO: 817213 - DNA, 20 bp, mouse
ggttccaagggcaacccaag

SEQ ID NO: 817214 - DNA, 20 bp, mouse
gtggagaaccccggtttcat

SEQ ID NO: 817215 - DNA, 20 bp, mouse
gctgaaatcgggacctagag

SEQ ID NO: 817216 - DNA, 20 bp, mouse
gtcaagaagagtctgtgtca

SEQ ID NO: 817217 - DNA, 20 bp, mouse
gccactgaggaaggctgata

SEQ ID NO: 817218 - DNA, 20 bp, mouse
gcctcccaggcagatatcac

SEQ ID NO: 817219 - DNA, 20 bp, mouse
gcaggaatgaatcaggtcct

SEQ ID NO: 817220 - DNA, 20 bp, mouse
gcccctgtttcttcaatcca

SEQ ID NO: 817221 - DNA, 20 bp, mouse
gaggcctccaggaatgaatc

SEQ ID NO: 817222 - DNA, 20 bp, mouse
gtatgaaggctaagggagtc

SEQ ID NO: 817223 - DNA, 20 bp, mouse
gcagtgggtcaatgttatga

SEQ ID NO: 817224 - DNA, 20 bp, mouse
gaacatgagatccttgtgtt

SEQ ID NO: 817225 - DNA, 20 bp, mouse
ggagatccttgtgttcggtg

SEQ ID NO: 817226 - DNA, 20 bp, mouse
ggggactggagggactctaa

SEQ ID NO: 817227 - DNA, 20 bp, mouse
gactctaaaggcgttaacaa

SEQ ID NO: 817228 - DNA, 20 bp, mouse
ggctgtgcccatcttaaacc

SEQ ID NO: 817229 - DNA, 20 bp, mouse
gtgggaatcccatagagaga

SEQ ID NO: 817230 - DNA, 20 bp, mouse
gttaagaaactgattgggga

SEQ ID NO: 817231 - DNA, 20 bp, mouse
ggcacagactggtggaagac

SEQ ID NO: 817232 - DNA, 20 bp, mouse
gcagggctttcacttcctgg

SEQ ID NO: 817233 - DNA, 20 bp, mouse
gccagtcccgggtttaagat

SEQ ID NO: 817234 - DNA, 20 bp, mouse
gaaggaatctgctggcagag

SEQ ID NO: 817235 - DNA, 20 bp, mouse
gcaaatggactttgctgctt

SEQ ID NO: 817236 - DNA, 20 bp, mouse
gcaggatgcctggcactcta

SEQ ID NO: 817237 - DNA, 20 bp, mouse
gggacagcactctgtttcag

SEQ ID NO: 817238 - DNA, 20 bp, mouse
gagactggctaaacctctgt

SEQ ID NO: 817239 - DNA, 20 bp, mouse
gaggtttagccagtctgact

SEQ ID NO: 817240 - DNA, 20 bp, mouse
gtcctgcccagctccggtga

SEQ ID NO: 817241 - DNA, 20 bp, mouse
gtgaagcaagtgtcccacag

SEQ ID NO: 817242 - DNA, 20 bp, mouse
ggaacactgatgactgtgca

SEQ ID NO: 817243 - DNA, 20 bp, mouse
ggcataatccctagagtgcc

SEQ ID NO: 817244 - DNA, 20 bp, mouse
gaccctcaccggagctgggc

SEQ ID NO: 817245 - DNA, 20 bp, mouse
ggacagaacttcctggggga

SEQ ID NO: 817246 - DNA, 20 bp, mouse
gaggcactgggagggatgtg

SEQ ID NO: 817247 - DNA, 20 bp, mouse
ggagcacaggtgtaaggagc

SEQ ID NO: 817248 - DNA, 20 bp, mouse
gtcactccaggaagtataac

SEQ ID NO: 817249 - DNA, 20 bp, mouse
gcagagcagccttagctcca

SEQ ID NO: 817250 - DNA, 20 bp, mouse
gtcttcttccaggacattcc

SEQ ID NO: 817251 - DNA, 20 bp, mouse
gaggagagcccggaatgtcc

SEQ ID NO: 817252 - DNA, 20 bp, mouse
gacaggtgtaaggagcaggt

SEQ ID NO: 817253 - DNA, 20 bp, mouse
gaaagatagagactccttga

SEQ ID NO: 817254 - DNA, 20 bp, mouse
ggaagaagaaaggggcatca

SEQ ID NO: 817255 - DNA, 20 bp, mouse
gttgcactagcacaggcaga

SEQ ID NO: 817256 - DNA, 20 bp, mouse
ggtcccgtgaagggtcaagt

SEQ ID NO: 817257 - DNA, 20 bp, mouse
ggaagggtcaagtagggtcg

SEQ ID NO: 817258 - DNA, 20 bp, mouse
ggagagggaccctggagcag

SEQ ID NO: 817259 - DNA, 20 bp, mouse
ggtctgaagggtcccgtgaa

SEQ ID NO: 817260 - DNA, 20 bp, mouse
gaccctacttgacccttcac

SEQ ID NO: 817261 - DNA, 20 bp, mouse
gcagtgacatcgcatggggc

SEQ ID NO: 817262 - DNA, 20 bp, mouse
ggagcgcagtgacatcgcat

SEQ ID NO: 817263 - DNA, 20 bp, mouse
ggtagggtcggggaggtttg

SEQ ID NO: 817264 - DNA, 20 bp, mouse
gactttcaggcaccgaggag

SEQ ID NO: 817265 - DNA, 20 bp, mouse
gacagcgatcttcaggatga

SEQ ID NO: 817266 - DNA, 20 bp, mouse
gcacgaatagctaagaatgg

SEQ ID NO: 817267 - DNA, 20 bp, mouse
gagctcacttctggttttga

SEQ ID NO: 817268 - DNA, 20 bp, mouse
ggggcctcctcactgtagca

SEQ ID NO: 817269 - DNA, 20 bp, mouse
ggccagattgagctcacttc

SEQ ID NO: 817270 - DNA, 20 bp, mouse
gatagccttctcagcctgaa

SEQ ID NO: 817271 - DNA, 20 bp, mouse
ggcccacgaatagctaagaa

SEQ ID NO: 817272 - DNA, 20 bp, mouse
gataagtccttgctacagtg

SEQ ID NO: 817273 - DNA, 20 bp, mouse
gcgaaactgctcaaattttc

SEQ ID NO: 817274 - DNA, 20 bp, mouse
gactggctcagttcttcttg

SEQ ID NO: 817275 - DNA, 20 bp, mouse
gacacgaagcgttcactcac

SEQ ID NO: 817276 - DNA, 20 bp, mouse
gcgaacgcccaatatggcta

SEQ ID NO: 817277 - DNA, 20 bp, mouse
gtgacagaacactgggatat

SEQ ID NO: 817278 - DNA, 20 bp, mouse
gtgggccggtgacagaacac

SEQ ID NO: 817279 - DNA, 20 bp, mouse
gaggaagccgcccacagcca

SEQ ID NO: 817280 - DNA, 20 bp, mouse
gtggcccggtgccagaggaa

SEQ ID NO: 817281 - DNA, 20 bp, mouse
gcgcccacagccaaggatgg

SEQ ID NO: 817282 - DNA, 20 bp, mouse
gcaaacccatgctagacccg

SEQ ID NO: 817283 - DNA, 20 bp, mouse
gcctccggcccagaatcttc

SEQ ID NO: 817284 - DNA, 20 bp, mouse
ggctgtaagttcttgctata

SEQ ID NO: 817285 - DNA, 20 bp, mouse
gccggaggctgagttcggga

SEQ ID NO: 817286 - DNA, 20 bp, mouse
gggttcagacaagcagggtt

SEQ ID NO: 817287 - DNA, 20 bp, mouse
gccttctggttcagacaagc

SEQ ID NO: 817288 - DNA, 20 bp, mouse
gcagagagaatcagggtcta

SEQ ID NO: 817289 - DNA, 20 bp, mouse
gagccaaaggagatggtaag

SEQ ID NO: 817290 - DNA, 20 bp, mouse
gcaaaggagatggtaagtgg

SEQ ID NO: 817291 - DNA, 20 bp, mouse
gtttactccaagggccccat

SEQ ID NO: 817292 - DNA, 20 bp, mouse
gagagggaagaagtgtcttc

SEQ ID NO: 817293 - DNA, 20 bp, mouse
gagcagctaggtctggtcag

SEQ ID NO: 817294 - DNA, 20 bp, mouse
gggccttcgtgagatcacag

SEQ ID NO: 817295 - DNA, 20 bp, mouse
gcgatacacaccttgcccat

SEQ ID NO: 817296 - DNA, 20 bp, mouse
ggtgccccaggtaggaaagg

SEQ ID NO: 817297 - DNA, 20 bp, mouse
gtgttggcagcctcgagatg

SEQ ID NO: 817298 - DNA, 20 bp, mouse
gtgtccccggccggctctgc

SEQ ID NO: 817299 - DNA, 20 bp, mouse
gcaggtccgctgtccccggc

SEQ ID NO: 817300 - DNA, 20 bp, mouse
gtccggaaagcatcctctct

SEQ ID NO: 817301 - DNA, 20 bp, mouse
ggctctggcaggttcttccg

SEQ ID NO: 817302 - DNA, 20 bp, mouse
ggcctctgagaagtcgatga

SEQ ID NO: 817303 - DNA, 20 bp, mouse
gcagtctcgggtggcccagt

SEQ ID NO: 817304 - DNA, 20 bp, mouse
gcacaagccgtggcccgcgt

SEQ ID NO: 817305 - DNA, 20 bp, mouse
gagcccggcgtgccccaggt

SEQ ID NO: 817306 - DNA, 20 bp, mouse
ggcgggaaggagtctggccc

SEQ ID NO: 817307 - DNA, 20 bp, mouse
gcggtggtccgtgcttgggg

SEQ ID NO: 817308 - DNA, 20 bp, mouse
gggtccgtgcttggggggga

SEQ ID NO: 817309 - DNA, 20 bp, mouse
ggctgcgggggcccggggaa

SEQ ID NO: 817310 - DNA, 20 bp, mouse
gggaccacagacttccccaa

SEQ ID NO: 817311 - DNA, 20 bp, mouse
gcgggcggtggtccgtgctt

SEQ ID NO: 817312 - DNA, 20 bp, mouse
gtcagtaccctcagctacta

SEQ ID NO: 817313 - DNA, 20 bp, mouse
gcgtgcttgggggggagggc

SEQ ID NO: 817314 - DNA, 20 bp, mouse
gtcccaggcgccaagggctg

SEQ ID NO: 817315 - DNA, 20 bp, mouse
gctgctgtgaggaggaaaat

SEQ ID NO: 817316 - DNA, 20 bp, mouse
gggcgcgagcaggggcgtac

SEQ ID NO: 817317 - DNA, 20 bp, mouse
ggaaagcctgcacctcgccc

SEQ ID NO: 817318 - DNA, 20 bp, mouse
gtgctcgcgcccagactcct

SEQ ID NO: 817319 - DNA, 20 bp, mouse
gctgaggccaaggagttgtg

SEQ ID NO: 817320 - DNA, 20 bp, mouse
gggcggggcgaggcttgcgg

SEQ ID NO: 817321 - DNA, 20 bp, mouse
gacctcgcccgggagaggtg

SEQ ID NO: 817322 - DNA, 20 bp, mouse
gcctgcacctcgcccgggag

SEQ ID NO: 817323 - DNA, 20 bp, mouse
gagacccgagctcttctttc

SEQ ID NO: 817324 - DNA, 20 bp, mouse
gccaccagaaagaagagctc

SEQ ID NO: 817325 - DNA, 20 bp, mouse
ggaccagagcccagaaaccg

SEQ ID NO: 817326 - DNA, 20 bp, mouse
gccccgggaagtccggctca

SEQ ID NO: 817327 - DNA, 20 bp, mouse
gtagagagacccaactggga

SEQ ID NO: 817328 - DNA, 20 bp, mouse
ggggtcgccggtagaggtga

SEQ ID NO: 817329 - DNA, 20 bp, mouse
gcaaccaagagcctgtaggg

SEQ ID NO: 817330 - DNA, 20 bp, mouse
ggagcaaccaagagcctgta

SEQ ID NO: 817331 - DNA, 20 bp, mouse
gcctctaccggcgacccaga

SEQ ID NO: 817332 - DNA, 20 bp, mouse
ggctccctggcgctcagtcc

SEQ ID NO: 817333 - DNA, 20 bp, mouse
ggcgacccagagggacccga

SEQ ID NO: 817334 - DNA, 20 bp, mouse
ggctggggcacggagtggtc

SEQ ID NO: 817335 - DNA, 20 bp, mouse
ggggaagtccggctcagggc

SEQ ID NO: 817336 - DNA, 20 bp, mouse
gggaacgctagagctcgcgg

SEQ ID NO: 817337 - DNA, 20 bp, mouse
gtgctactgcagatcagcag

SEQ ID NO: 817338 - DNA, 20 bp, mouse
gggagcgagttgtctgaggg

SEQ ID NO: 817339 - DNA, 20 bp, mouse
ggcaaaaatccatctggtga

SEQ ID NO: 817340 - DNA, 20 bp, mouse
gaggaagagagcgcgagaaa

SEQ ID NO: 817341 - DNA, 20 bp, mouse
ggggggagcgagttgtctga

SEQ ID NO: 817342 - DNA, 20 bp, mouse
ggggcaagcgttgaaaacgt

SEQ ID NO: 817343 - DNA, 20 bp, mouse
gagttgctaagaagctctgc

SEQ ID NO: 817344 - DNA, 20 bp, mouse
gttgaaaacgtgggtattaa

SEQ ID NO: 817345 - DNA, 20 bp, mouse
ggcagtagcaaaaatccatc

SEQ ID NO: 817346 - DNA, 20 bp, mouse
gaggactaggggtgacgtca

SEQ ID NO: 817347 - DNA, 20 bp, mouse
gactaggggtgacgtcacgg

SEQ ID NO: 817348 - DNA, 20 bp, mouse
ggggtgacgtcacggaggag

SEQ ID NO: 817349 - DNA, 20 bp, mouse
gtatccagggcgcttggtgg

SEQ ID NO: 817350 - DNA, 20 bp, mouse
gtgaaggagatcactagaac

SEQ ID NO: 817351 - DNA, 20 bp, mouse
gcagggcgcttggtggggga

SEQ ID NO: 817352 - DNA, 20 bp, mouse
ggctgaggccagaaccaaag

SEQ ID NO: 817353 - DNA, 20 bp, mouse
ggatttggggagtttcgctg

SEQ ID NO: 817354 - DNA, 20 bp, mouse
gtgcaaagctttcactcaca

SEQ ID NO: 817355 - DNA, 20 bp, mouse
ggcccagccccctttggttc

SEQ ID NO: 817356 - DNA, 20 bp, mouse
gtccctgctgtgcactcggg

SEQ ID NO: 817357 - DNA, 20 bp, mouse
gcgcttctggcaaggaggga

SEQ ID NO: 817358 - DNA, 20 bp, mouse
gcccctcccgagtgcacagc

SEQ ID NO: 817359 - DNA, 20 bp, mouse
gcccagcagcgcttctggca

SEQ ID NO: 817360 - DNA, 20 bp, mouse
gggagcagcggctcctttgt

SEQ ID NO: 817361 - DNA, 20 bp, mouse
gggtagaagctgcaagagct

SEQ ID NO: 817362 - DNA, 20 bp, mouse
gcagcggctcctttgtgggc

SEQ ID NO: 817363 - DNA, 20 bp, mouse
gagggtaggaagatccttac

SEQ ID NO: 817364 - DNA, 20 bp, mouse
gccagtaaagaggggctgac

SEQ ID NO: 817365 - DNA, 20 bp, mouse
gcgctacccagcagcgcttc

SEQ ID NO: 817366 - DNA, 20 bp, mouse
gcgcggcgagaggactgcgg

SEQ ID NO: 817367 - DNA, 20 bp, mouse
gcaaactaaaggggatgggg

SEQ ID NO: 817368 - DNA, 20 bp, mouse
gaatagaaaacggagagggt

SEQ ID NO: 817369 - DNA, 20 bp, mouse
gagtcagcattctgtatcgg

SEQ ID NO: 817370 - DNA, 20 bp, mouse
gatgcgcggcgagaggactg

SEQ ID NO: 817371 - DNA, 20 bp, mouse
gtcctctcgccgcgcatcgc

SEQ ID NO: 817372 - DNA, 20 bp, mouse
gggaagtcagcattctgtat

SEQ ID NO: 817373 - DNA, 20 bp, mouse
gcgcaggcaaatccctgctt

SEQ ID NO: 817374 - DNA, 20 bp, mouse
gtacacagttggcgcggagg

SEQ ID NO: 817375 - DNA, 20 bp, mouse
gagcatgtgaactgtatcgg

SEQ ID NO: 817376 - DNA, 20 bp, mouse
gcgtctgctggagggtcaag

SEQ ID NO: 817377 - DNA, 20 bp, mouse
ggaagtgatcggtgtccgga

SEQ ID NO: 817378 - DNA, 20 bp, mouse
ggatagaagtgatcggtgtc

SEQ ID NO: 817379 - DNA, 20 bp, mouse
gttgcctaaaacatcgccta

SEQ ID NO: 817380 - DNA, 20 bp, mouse
gtagaaatggactcaagtgg

SEQ ID NO: 817381 - DNA, 20 bp, mouse
gagtgggggcgtctgctgga

SEQ ID NO: 817382 - DNA, 20 bp, mouse
gtgggtgcgcgcgcggtgtc

SEQ ID NO: 817383 - DNA, 20 bp, mouse
ggaccctgatccttgggcat

SEQ ID NO: 817384 - DNA, 20 bp, mouse
gaggttagtgcaaacacgtt

SEQ ID NO: 817385 - DNA, 20 bp, mouse
ggcacccagaccctcgcaca

SEQ ID NO: 817386 - DNA, 20 bp, mouse
ggagcccagtggccggtagg

SEQ ID NO: 817387 - DNA, 20 bp, mouse
gaggtggcagccgagggcga

SEQ ID NO: 817388 - DNA, 20 bp, mouse
gcgaaggcgtccctgggctc

SEQ ID NO: 817389 - DNA, 20 bp, mouse
gtccacgaatgtgacatcta

SEQ ID NO: 817390 - DNA, 20 bp, mouse
gctgctgggtagcgggtgca

SEQ ID NO: 817391 - DNA, 20 bp, mouse
gcgagggcgaaggcgtccct

SEQ ID NO: 817392 - DNA, 20 bp, mouse
gaccaagcctaacactgtca

SEQ ID NO: 817393 - DNA, 20 bp, mouse
gaggatgagccactccctcc

SEQ ID NO: 817394 - DNA, 20 bp, mouse
gcaggagcccagtggccggt

SEQ ID NO: 817395 - DNA, 20 bp, mouse
gatgtgcgcaactggagcgt

SEQ ID NO: 817396 - DNA, 20 bp, mouse
ggaggcactgaacagtccca

SEQ ID NO: 817397 - DNA, 20 bp, mouse
gaagcacttctgatggggaa

SEQ ID NO: 817398 - DNA, 20 bp, mouse
gtgccagtgtcatataacac

SEQ ID NO: 817399 - DNA, 20 bp, mouse
gctcctgtgttatatgacac

SEQ ID NO: 817400 - DNA, 20 bp, mouse
ggaccgtttgcagaaatagg

SEQ ID NO: 817401 - DNA, 20 bp, mouse
gagtcagattgccaaggact

SEQ ID NO: 817402 - DNA, 20 bp, mouse
gagattaaagcacttctgat

SEQ ID NO: 817403 - DNA, 20 bp, mouse
gaaagaccgtttgcagaaat

SEQ ID NO: 817404 - DNA, 20 bp, mouse
gcagattgccaaggactggg

SEQ ID NO: 817405 - DNA, 20 bp, mouse
gcgtaaataaagagacttct

SEQ ID NO: 817406 - DNA, 20 bp, mouse
gcacgcgcgctggctccgcc

SEQ ID NO: 817407 - DNA, 20 bp, mouse
gctcgcgagggcgtaccctc

SEQ ID NO: 817408 - DNA, 20 bp, mouse
gtcgtggagccacccggctc

SEQ ID NO: 817409 - DNA, 20 bp, mouse
gctgcgggccgaggctgtgt

SEQ ID NO: 817410 - DNA, 20 bp, mouse
gtccgccagcgcaatcaaca

SEQ ID NO: 817411 - DNA, 20 bp, mouse
gggtcaacgcaaaaccctcg

SEQ ID NO: 817412 - DNA, 20 bp, mouse
gcgcgctggctccgccgggc

SEQ ID NO: 817413 - DNA, 20 bp, mouse
ggcgcctgcggcgggaggtg

SEQ ID NO: 817414 - DNA, 20 bp, mouse
gggaaagcaggctatgcttg

SEQ ID NO: 817415 - DNA, 20 bp, mouse
gacccggctcgggctcgcag

SEQ ID NO: 817416 - DNA, 20 bp, mouse
gctcccgtgccgtagatagg

SEQ ID NO: 817417 - DNA, 20 bp, mouse
gacatgataccccctatcta

SEQ ID NO: 817418 - DNA, 20 bp, mouse
ggggcaagagaaactttgag

SEQ ID NO: 817419 - DNA, 20 bp, mouse
gttctggcccttaacaaaga

SEQ ID NO: 817420 - DNA, 20 bp, mouse
gttcaagggccctcctccgc

SEQ ID NO: 817421 - DNA, 20 bp, mouse
gcttaacaaagatggcgcca

SEQ ID NO: 817422 - DNA, 20 bp, mouse
gtctacggcacgggagccgg

SEQ ID NO: 817423 - DNA, 20 bp, mouse
gaaaagggtgcgcgttcccg

SEQ ID NO: 817424 - DNA, 20 bp, mouse
gcacgggagccggcggagga

SEQ ID NO: 817425 - DNA, 20 bp, mouse
gataccccctatctacggca

SEQ ID NO: 817426 - DNA, 20 bp, mouse
gactgcggcggctaaaaata

SEQ ID NO: 817427 - DNA, 20 bp, mouse
gcggctaaaaatagggaggt

SEQ ID NO: 817428 - DNA, 20 bp, mouse
gaacccagagctgccgtttg

SEQ ID NO: 817429 - DNA, 20 bp, mouse
ggcggcggctaaaaataggg

SEQ ID NO: 817430 - DNA, 20 bp, mouse
gccagcgccgcgctgccgca

SEQ ID NO: 817431 - DNA, 20 bp, mouse
gcagccacaaacggcagctc

SEQ ID NO: 817432 - DNA, 20 bp, mouse
ggcactcgcgctcgtccctg

SEQ ID NO: 817433 - DNA, 20 bp, mouse
gcaaccacacgcaaaagtga

SEQ ID NO: 817434 - DNA, 20 bp, mouse
gatgctgcgcggcgccgtgg

SEQ ID NO: 817435 - DNA, 20 bp, mouse
ggacggaggaggcggtagag

SEQ ID NO: 817436 - DNA, 20 bp, mouse
gcagtcctgcccagtcttct

SEQ ID NO: 817437 - DNA, 20 bp, mouse
gggcgcagagccgaaaagtg

SEQ ID NO: 817438 - DNA, 20 bp, mouse
gactgggcaggactgcgccg

SEQ ID NO: 817439 - DNA, 20 bp, mouse
ggcgccgagcatggggggcg

SEQ ID NO: 817440 - DNA, 20 bp, mouse
gtgctctgagccaagaagac

SEQ ID NO: 817441 - DNA, 20 bp, mouse
gactgagccttcacgaagga

SEQ ID NO: 817442 - DNA, 20 bp, mouse
gccttggcggcgggactttt

SEQ ID NO: 817443 - DNA, 20 bp, mouse
gcgcggggcggagccaaacc

SEQ ID NO: 817444 - DNA, 20 bp, mouse
gggcggagccaaacccggct

SEQ ID NO: 817445 - DNA, 20 bp, mouse
gggccggccgcctcactttt

SEQ ID NO: 817446 - DNA, 20 bp, mouse
gcatagaaatatggtagcaa

SEQ ID NO: 817447 - DNA, 20 bp, mouse
ggggaaggggataacttcta

SEQ ID NO: 817448 - DNA, 20 bp, mouse
gagggcctaatgtagtctga

SEQ ID NO: 817449 - DNA, 20 bp, mouse
gtcaaagggacaagctccaa

SEQ ID NO: 817450 - DNA, 20 bp, mouse
ggggttctggagctcggtgt

SEQ ID NO: 817451 - DNA, 20 bp, mouse
gttccagccaatttgtactg

SEQ ID NO: 817452 - DNA, 20 bp, mouse
ggagctcggtgtgggaatgt

SEQ ID NO: 817453 - DNA, 20 bp, mouse
gcagccaatttgtactgggg

SEQ ID NO: 817454 - DNA, 20 bp, mouse
gcactacatcaaaagtaggc

SEQ ID NO: 817455 - DNA, 20 bp, mouse
gctgtgttgttcatttaaat

SEQ ID NO: 817456 - DNA, 20 bp, mouse
gccaggaggcgtggccccag

SEQ ID NO: 817457 - DNA, 20 bp, mouse
gtagtgagagcaatagtctt

SEQ ID NO: 817458 - DNA, 20 bp, mouse
gtctcaggtggttactctga

SEQ ID NO: 817459 - DNA, 20 bp, mouse
ggggccaaatgcatgccact

SEQ ID NO: 817460 - DNA, 20 bp, mouse
gtgcctgtgcaagagccaca

SEQ ID NO: 817461 - DNA, 20 bp, mouse
ggaagctgagacatcacacg

SEQ ID NO: 817462 - DNA, 20 bp, mouse
gatgtctcagcttcaggtta

SEQ ID NO: 817463 - DNA, 20 bp, mouse
gaacagcggtgcaaatgatt

SEQ ID NO: 817464 - DNA, 20 bp, mouse
gggttactctgatggcctca

SEQ ID NO: 817465 - DNA, 20 bp, mouse
gtgggatttcacaatgctca

SEQ ID NO: 817466 - DNA, 20 bp, mouse
gtgcgctggagcagagtcgg

SEQ ID NO: 817467 - DNA, 20 bp, mouse
ggggcgtggtccccgtgggg

SEQ ID NO: 817468 - DNA, 20 bp, mouse
gcggggcccgggttggaagt

SEQ ID NO: 817469 - DNA, 20 bp, mouse
gcggcctctggcgtggtccc

SEQ ID NO: 817470 - DNA, 20 bp, mouse
gtgcagcggcacccggatga

SEQ ID NO: 817471 - DNA, 20 bp, mouse
ggctctaggtaagagatgag

SEQ ID NO: 817472 - DNA, 20 bp, mouse
gcgggggcgtggtccccgtg

SEQ ID NO: 817473 - DNA, 20 bp, mouse
ggacacgcggagactttccc

SEQ ID NO: 817474 - DNA, 20 bp, mouse
ggtgccgctgcaggttgcgc

SEQ ID NO: 817475 - DNA, 20 bp, mouse
gggagctcgcagcggaccgg

SEQ ID NO: 817476 - DNA, 20 bp, mouse
gtctctgcgcagccggaaga

SEQ ID NO: 817477 - DNA, 20 bp, mouse
ggctgcgcagagataacttc

SEQ ID NO: 817478 - DNA, 20 bp, mouse
gggcagtgcagctttctttc

SEQ ID NO: 817479 - DNA, 20 bp, mouse
gacccagaaaggcgaagtga

SEQ ID NO: 817480 - DNA, 20 bp, mouse
gtgcgcagccggaagaaggc

SEQ ID NO: 817481 - DNA, 20 bp, mouse
gtgccatcacttcgcctttc

SEQ ID NO: 817482 - DNA, 20 bp, mouse
ggagataacttccgggagat

SEQ ID NO: 817483 - DNA, 20 bp, mouse
ggctgcaaaggtcggcgtaa

SEQ ID NO: 817484 - DNA, 20 bp, mouse
gcgggttccctgccttcttc

SEQ ID NO: 817485 - DNA, 20 bp, mouse
gtgctaagattctgtgctgt

SEQ ID NO: 817486 - DNA, 20 bp, mouse
gacgccgagccagtgggact

SEQ ID NO: 817487 - DNA, 20 bp, mouse
gaactctccgaaacaccagt

SEQ ID NO: 817488 - DNA, 20 bp, mouse
gcaagctctcctagtcccac

SEQ ID NO: 817489 - DNA, 20 bp, mouse
gacccaactctcagatggta

SEQ ID NO: 817490 - DNA, 20 bp, mouse
ggccttaccatctgagagtt

SEQ ID NO: 817491 - DNA, 20 bp, mouse
gtctcctagtcccactggct

SEQ ID NO: 817492 - DNA, 20 bp, mouse
gagtgagcctttgtttaaag

SEQ ID NO: 817493 - DNA, 20 bp, mouse
ggggttcctcttctccccac

SEQ ID NO: 817494 - DNA, 20 bp, mouse
gtaaggcgtgctggtccttc

SEQ ID NO: 817495 - DNA, 20 bp, mouse
gtaaaaaacatgctataaat

SEQ ID NO: 817496 - DNA, 20 bp, mouse
gccagggtggggcccctcta

SEQ ID NO: 817497 - DNA, 20 bp, mouse
gtagggaggcacagggctag

SEQ ID NO: 817498 - DNA, 20 bp, mouse
gggcacagggctaggggtgt

SEQ ID NO: 817499 - DNA, 20 bp, mouse
gctgggatggtaggtgatga

SEQ ID NO: 817500 - DNA, 20 bp, mouse
gcccctctatggaccttttg

SEQ ID NO: 817501 - DNA, 20 bp, mouse
ggaccaagactcccagacag

SEQ ID NO: 817502 - DNA, 20 bp, mouse
gtgactcagtagggaggcac

SEQ ID NO: 817503 - DNA, 20 bp, mouse
gtcggcttctgggtgttggc

SEQ ID NO: 817504 - DNA, 20 bp, mouse
gatcacctaccatcccaggg

SEQ ID NO: 817505 - DNA, 20 bp, mouse
gacccagaagccgaagccgg

SEQ ID NO: 817506 - DNA, 20 bp, mouse
gtaggaagggcggaagtgag

SEQ ID NO: 817507 - DNA, 20 bp, mouse
gacttccgcccttcctaggg

SEQ ID NO: 817508 - DNA, 20 bp, mouse
gccaagtgctgggaattcaa

SEQ ID NO: 817509 - DNA, 20 bp, mouse
gcttcctagggcggcttcga

SEQ ID NO: 817510 - DNA, 20 bp, mouse
gagggcggaaagcgaggtgg

SEQ ID NO: 817511 - DNA, 20 bp, mouse
ggcggtggggaaggactcct

SEQ ID NO: 817512 - DNA, 20 bp, mouse
gtggagggcagccagtcctg

SEQ ID NO: 817513 - DNA, 20 bp, mouse
gagggcggaagtgagcggcg

SEQ ID NO: 817514 - DNA, 20 bp, mouse
gggtgtgcaagcggaaccgc

SEQ ID NO: 817515 - DNA, 20 bp, mouse
ggcagtgagggcggaaagcg

SEQ ID NO: 817516 - DNA, 20 bp, mouse
gagttggggaagcgggatga

SEQ ID NO: 817517 - DNA, 20 bp, mouse
gaaagcaactacaacgtttc

SEQ ID NO: 817518 - DNA, 20 bp, mouse
gtggtccgagttggggaagc

SEQ ID NO: 817519 - DNA, 20 bp, mouse
ggctagcagtgtagtcttgc

SEQ ID NO: 817520 - DNA, 20 bp, mouse
gtatgtacgtggtccgagtt

SEQ ID NO: 817521 - DNA, 20 bp, mouse
gcgtgtgacctcacactgcc

SEQ ID NO: 817522 - DNA, 20 bp, mouse
gcgggatgagggtcggcttc

SEQ ID NO: 817523 - DNA, 20 bp, mouse
ggctgaggagcttcggggtg

SEQ ID NO: 817524 - DNA, 20 bp, mouse
gcacgggactcagttagaga

SEQ ID NO: 817525 - DNA, 20 bp, mouse
ggttaagtgctgaggagctt

SEQ ID NO: 817526 - DNA, 20 bp, mouse
gtatcccattaccttagcca

SEQ ID NO: 817527 - DNA, 20 bp, mouse
gaagccctggctaaggtaat

SEQ ID NO: 817528 - DNA, 20 bp, mouse
ggcgcccgaagccctggcta

SEQ ID NO: 817529 - DNA, 20 bp, mouse
gccactgccagcacctacga

SEQ ID NO: 817530 - DNA, 20 bp, mouse
ggaactgcccaaacgaaaaa

SEQ ID NO: 817531 - DNA, 20 bp, mouse
ggctaaggtaatgggatagc

SEQ ID NO: 817532 - DNA, 20 bp, mouse
gctaacgtgcgaggggacgc

SEQ ID NO: 817533 - DNA, 20 bp, mouse
gacgatggcgcccgaagccc

SEQ ID NO: 817534 - DNA, 20 bp, mouse
gacagaagccatttttcgtt

SEQ ID NO: 817535 - DNA, 20 bp, mouse
gtggcattatcgacttcatt

SEQ ID NO: 817536 - DNA, 20 bp, mouse
gaggcagggactagagtcag

SEQ ID NO: 817537 - DNA, 20 bp, mouse
ggcggtgcgcgtgtgagcga

SEQ ID NO: 817538 - DNA, 20 bp, mouse
gaaggcgcgggccggtaatt

SEQ ID NO: 817539 - DNA, 20 bp, mouse
gcgcgcgcccgctgccgctt

SEQ ID NO: 817540 - DNA, 20 bp, mouse
ggaggctcatgctacatgaa

SEQ ID NO: 817541 - DNA, 20 bp, mouse
ggacgactgagtgggctcga

SEQ ID NO: 817542 - DNA, 20 bp, mouse
ggcgggccggtaatttggag

SEQ ID NO: 817543 - DNA, 20 bp, mouse
gcactgagtcagtgattgca

SEQ ID NO: 817544 - DNA, 20 bp, mouse
gagcgagggcaagcggcagg

SEQ ID NO: 817545 - DNA, 20 bp, mouse
gggctgacctgttaactact

SEQ ID NO: 817546 - DNA, 20 bp, mouse
gggcgcgcacggaagacgga

SEQ ID NO: 817547 - DNA, 20 bp, mouse
gggtgtgagcaccgcgtcgg

SEQ ID NO: 817548 - DNA, 20 bp, mouse
gaagacggagggagcacggc

SEQ ID NO: 817549 - DNA, 20 bp, mouse
gagcgggcgcgcacggaaga

SEQ ID NO: 817550 - DNA, 20 bp, mouse
gggagcacggcagggacgga

SEQ ID NO: 817551 - DNA, 20 bp, mouse
gtcacgacggaggtgggcga

SEQ ID NO: 817552 - DNA, 20 bp, mouse
gaggcgaggcgaggccgggt

SEQ ID NO: 817553 - DNA, 20 bp, mouse
gggccgcgggcgccaatcag

SEQ ID NO: 817554 - DNA, 20 bp, mouse
ggggcgccgactcccgcctc

SEQ ID NO: 817555 - DNA, 20 bp, mouse
gccacccagaggcgccgggg

SEQ ID NO: 817556 - DNA, 20 bp, mouse
gaacaggcactgtccgtcaa

SEQ ID NO: 817557 - DNA, 20 bp, mouse
ggcggcgatcgcagaggagg

SEQ ID NO: 817558 - DNA, 20 bp, mouse
gtagcgcggctgctcggccc

SEQ ID NO: 817559 - DNA, 20 bp, mouse
gccgccaagcgcgcccacgt

SEQ ID NO: 817560 - DNA, 20 bp, mouse
gcctcccccgcgccctgctc

SEQ ID NO: 817561 - DNA, 20 bp, mouse
ggaaggccgcgggtcctccc

SEQ ID NO: 817562 - DNA, 20 bp, mouse
gtgcaaggcggcgatcgcag

SEQ ID NO: 817563 - DNA, 20 bp, mouse
ggggagaggagcgggtagcg

SEQ ID NO: 817564 - DNA, 20 bp, mouse
gcccgcgccctgctccgggg

SEQ ID NO: 817565 - DNA, 20 bp, mouse
gaaggcggcgatcgcagagg

SEQ ID NO: 817566 - DNA, 20 bp, mouse
gctcccgcccagagcaggga

SEQ ID NO: 817567 - DNA, 20 bp, mouse
gcccgcctcccgcccagagc

SEQ ID NO: 817568 - DNA, 20 bp, mouse
gcgaaaaggcgactcccctc

SEQ ID NO: 817569 - DNA, 20 bp, mouse
gagagccgccgggctgcccg

SEQ ID NO: 817570 - DNA, 20 bp, mouse
gcgcgcgcggagaccacatc

SEQ ID NO: 817571 - DNA, 20 bp, mouse
gcaaactcagccagagccgc

SEQ ID NO: 817572 - DNA, 20 bp, mouse
gacagctcgggatgagcgat

SEQ ID NO: 817573 - DNA, 20 bp, mouse
gcgcactccgtgtctgaaga

SEQ ID NO: 817574 - DNA, 20 bp, mouse
gaagagggcatcctgcgaaa

SEQ ID NO: 817575 - DNA, 20 bp, mouse
ggagctgtcccacgctgctt

SEQ ID NO: 817576 - DNA, 20 bp, mouse
ggcggccggcgcatgcgcgt

SEQ ID NO: 817577 - DNA, 20 bp, mouse
gcgcccgctcgccggggacc

SEQ ID NO: 817578 - DNA, 20 bp, mouse
gcggggacccggatgatgag

SEQ ID NO: 817579 - DNA, 20 bp, mouse
gggcgcatgcgcgtcgggag

SEQ ID NO: 817580 - DNA, 20 bp, mouse
ggcggcggggaggtgagtga

SEQ ID NO: 817581 - DNA, 20 bp, mouse
ggcgccgagcgcttgtcccg

SEQ ID NO: 817582 - DNA, 20 bp, mouse
gtaacccaagtgccacttcc

SEQ ID NO: 817583 - DNA, 20 bp, mouse
ggccacttccaggctcgctg

SEQ ID NO: 817584 - DNA, 20 bp, mouse
ggacccggatgatgaggggg

SEQ ID NO: 817585 - DNA, 20 bp, mouse
ggctgcggacagcagaagcc

SEQ ID NO: 817586 - DNA, 20 bp, mouse
gaggagcgccgcggagtcat

SEQ ID NO: 817587 - DNA, 20 bp, mouse
ggcactgtcagcctcggggc

SEQ ID NO: 817588 - DNA, 20 bp, mouse
gactccgcggcgctcctccg

SEQ ID NO: 817589 - DNA, 20 bp, mouse
gtcccggggcgggccgaacg

SEQ ID NO: 817590 - DNA, 20 bp, mouse
ggagcttgagagtgagtcgc

SEQ ID NO: 817591 - DNA, 20 bp, mouse
gggccctcagtgtgcgtttg

SEQ ID NO: 817592 - DNA, 20 bp, mouse
gtgttagcgcgtgtgcggga

SEQ ID NO: 817593 - DNA, 20 bp, mouse
gtgtctagactggcatatga

SEQ ID NO: 817594 - DNA, 20 bp, mouse
gaggggcgggggcccgcgtt

SEQ ID NO: 817595 - DNA, 20 bp, mouse
gccgagggggctggttcccg

SEQ ID NO: 817596 - DNA, 20 bp, mouse
gcgggcgcgccactgcgcag

SEQ ID NO: 817597 - DNA, 20 bp, mouse
gaagcgacagggtgtctaga

SEQ ID NO: 817598 - DNA, 20 bp, mouse
ggaggggtacccacggtgga

SEQ ID NO: 817599 - DNA, 20 bp, mouse
ggtctagagaggggtaccca

SEQ ID NO: 817600 - DNA, 20 bp, mouse
gaaccagccgagcagaggga

SEQ ID NO: 817601 - DNA, 20 bp, mouse
gcgagcagagggacgggtgg

SEQ ID NO: 817602 - DNA, 20 bp, mouse
gcggctccggcctcgtcacg

SEQ ID NO: 817603 - DNA, 20 bp, mouse
ggacggccacgtgacgaggc

SEQ ID NO: 817604 - DNA, 20 bp, mouse
gcggcggatcccttggaaag

SEQ ID NO: 817605 - DNA, 20 bp, mouse
gggtacccctctctagacct

SEQ ID NO: 817606 - DNA, 20 bp, mouse
gtctcctggagcaaggggag

SEQ ID NO: 817607 - DNA, 20 bp, mouse
ggtgggaaggacattttctg

SEQ ID NO: 817608 - DNA, 20 bp, mouse
gtgagtgcgccgcgctggaa

SEQ ID NO: 817609 - DNA, 20 bp, mouse
ggagactcctctgtccctga

SEQ ID NO: 817610 - DNA, 20 bp, mouse
gagggccagtcatgcctcag

SEQ ID NO: 817611 - DNA, 20 bp, mouse
gagctcgtttagatgttctt

SEQ ID NO: 817612 - DNA, 20 bp, mouse
gcaggcatgatgtgcagagc

SEQ ID NO: 817613 - DNA, 20 bp, mouse
gactctgcggttcaggagac

SEQ ID NO: 817614 - DNA, 20 bp, mouse
ggcctacagcctgtccaggt

SEQ ID NO: 817615 - DNA, 20 bp, mouse
ggcctggcgcccttccagcg

SEQ ID NO: 817616 - DNA, 20 bp, mouse
gagcccggaccgcggtggga

SEQ ID NO: 817617 - DNA, 20 bp, mouse
ggggaggaaaggccactgtc

SEQ ID NO: 817618 - DNA, 20 bp, mouse
gccagctgtagggcgagcga

SEQ ID NO: 817619 - DNA, 20 bp, mouse
gcgggagctcagtcacgcgt

SEQ ID NO: 817620 - DNA, 20 bp, mouse
ggccctcagcaggttccccc

SEQ ID NO: 817621 - DNA, 20 bp, mouse
gcgccgagcccggaccgcgg

SEQ ID NO: 817622 - DNA, 20 bp, mouse
gccccggccgagcccggcac

SEQ ID NO: 817623 - DNA, 20 bp, mouse
gagcgaggggcgtgtcccgc

SEQ ID NO: 817624 - DNA, 20 bp, mouse
ggccgagcccggcacggggg

SEQ ID NO: 817625 - DNA, 20 bp, mouse
gaggcggtggagcgtggaga

SEQ ID NO: 817626 - DNA, 20 bp, mouse
ggggaagagccgccgcttcc

SEQ ID NO: 817627 - DNA, 20 bp, mouse
ggaagcgtctgacgctcccc

SEQ ID NO: 817628 - DNA, 20 bp, mouse
gcgcccagctgcccgcgtgc

SEQ ID NO: 817629 - DNA, 20 bp, mouse
ggctccgcccgagccggcga

SEQ ID NO: 817630 - DNA, 20 bp, mouse
ggcttctctggaatcacctt

SEQ ID NO: 817631 - DNA, 20 bp, mouse
gcgctgcgtcctcccggaag

SEQ ID NO: 817632 - DNA, 20 bp, mouse
ggacgatcaggtgtcaagag

SEQ ID NO: 817633 - DNA, 20 bp, mouse
gaggcgggacacgtcggcgc

SEQ ID NO: 817634 - DNA, 20 bp, mouse
gtccgggaggacgcagcgct

SEQ ID NO: 817635 - DNA, 20 bp, mouse
gtgggagtctcccggcacgc

SEQ ID NO: 817636 - DNA, 20 bp, mouse
ggaatgaagccgggtggaga

SEQ ID NO: 817637 - DNA, 20 bp, mouse
gttaggtggaagcggcggga

SEQ ID NO: 817638 - DNA, 20 bp, mouse
ggaaaagaatgaatgaagcc

SEQ ID NO: 817639 - DNA, 20 bp, mouse
gaagagctgccggaagtagg

SEQ ID NO: 817640 - DNA, 20 bp, mouse
gctgcactgggctctcccct

SEQ ID NO: 817641 - DNA, 20 bp, mouse
gggggcttaggtggaagcgg

SEQ ID NO: 817642 - DNA, 20 bp, mouse
gcggggcgcatgcgcgggtt

SEQ ID NO: 817643 - DNA, 20 bp, mouse
gcccccggctcttcccggat

SEQ ID NO: 817644 - DNA, 20 bp, mouse
ggcctcctaggaaccaatcc

SEQ ID NO: 817645 - DNA, 20 bp, mouse
ggagcccagtgcagcgcggt

SEQ ID NO: 817646 - DNA, 20 bp, mouse
ggactgtggggtgcactcgg

SEQ ID NO: 817647 - DNA, 20 bp, mouse
gcggaggggagggcgatggg

SEQ ID NO: 817648 - DNA, 20 bp, mouse
gggggggaggccatgacgta

SEQ ID NO: 817649 - DNA, 20 bp, mouse
ggggcggaggggagggcgat

SEQ ID NO: 817650 - DNA, 20 bp, mouse
gtctcgcgattggtgagggg

SEQ ID NO: 817651 - DNA, 20 bp, mouse
ggagtctcgcgattggtgag

SEQ ID NO: 817652 - DNA, 20 bp, mouse
ggggaactcaggctcactgt

SEQ ID NO: 817653 - DNA, 20 bp, mouse
gggtcctgtgggaccagcct

SEQ ID NO: 817654 - DNA, 20 bp, mouse
gagagcgccccaaggtacag

SEQ ID NO: 817655 - DNA, 20 bp, mouse
gggaggccatgacgtagggt

SEQ ID NO: 817656 - DNA, 20 bp, mouse
gagcgcgcggggggagcagg

SEQ ID NO: 817657 - DNA, 20 bp, mouse
gcggctcgcggggccaactg

SEQ ID NO: 817658 - DNA, 20 bp, mouse
gcagggaggagcggctcgcg

SEQ ID NO: 817659 - DNA, 20 bp, mouse
gtcgccgcctccacgggcgc

SEQ ID NO: 817660 - DNA, 20 bp, mouse
gggagcccgagtttaggaag

SEQ ID NO: 817661 - DNA, 20 bp, mouse
gcgtcttccggcgcccgtgg

SEQ ID NO: 817662 - DNA, 20 bp, mouse
gcccgagtttaggaagagga

SEQ ID NO: 817663 - DNA, 20 bp, mouse
gggggcggtgtgcaagaatg

SEQ ID NO: 817664 - DNA, 20 bp, mouse
gccaccaacccgcgccgggc

SEQ ID NO: 817665 - DNA, 20 bp, mouse
gccaactgcggcgcgtcttc

SEQ ID NO: 817666 - DNA, 20 bp, mouse
gcatgcgcgcagagagcgga

SEQ ID NO: 817667 - DNA, 20 bp, mouse
gtacgcgtgcgcacagcgaa

SEQ ID NO: 817668 - DNA, 20 bp, mouse
gcacctcctcgcgccctcaa

SEQ ID NO: 817669 - DNA, 20 bp, mouse
gcgcgcagagagcggaaggg

SEQ ID NO: 817670 - DNA, 20 bp, mouse
gtgagcatgcgcgcagagag

SEQ ID NO: 817671 - DNA, 20 bp, mouse
gctggtgcaccgcccctgtg

SEQ ID NO: 817672 - DNA, 20 bp, mouse
gtacctcccaggcacgaaac

SEQ ID NO: 817673 - DNA, 20 bp, mouse
gacgcttaaaggttggggga

SEQ ID NO: 817674 - DNA, 20 bp, mouse
gcgggtagacagggaggcgg

SEQ ID NO: 817675 - DNA, 20 bp, mouse
gcggccgggcagcggaagca

SEQ ID NO: 817676 - DNA, 20 bp, mouse
gcgggcaggtctcactcctc

SEQ ID NO: 817677 - DNA, 20 bp, mouse
gcccagctcgcgtcactcgg

SEQ ID NO: 817678 - DNA, 20 bp, mouse
gcctcgaggaagcgcgtcgg

SEQ ID NO: 817679 - DNA, 20 bp, mouse
gcggcgctcccgtaacggct

SEQ ID NO: 817680 - DNA, 20 bp, mouse
gagacccagctcgcgtcact

SEQ ID NO: 817681 - DNA, 20 bp, mouse
gctcgcgtcactcggaggag

SEQ ID NO: 817682 - DNA, 20 bp, mouse
ggtcttcggcgctcccgtaa

SEQ ID NO: 817683 - DNA, 20 bp, mouse
ggctgtcttccgccgcgcta

SEQ ID NO: 817684 - DNA, 20 bp, mouse
gcagcgagccgagccgttac

SEQ ID NO: 817685 - DNA, 20 bp, mouse
ggggcctcgaggaagcgcgt

SEQ ID NO: 817686 - DNA, 20 bp, mouse
gtctgagcgcgccgttgtca

SEQ ID NO: 817687 - DNA, 20 bp, mouse
gtgtagccggcgcggtgaaa

SEQ ID NO: 817688 - DNA, 20 bp, mouse
gggcggcgggctcccttcgg

SEQ ID NO: 817689 - DNA, 20 bp, mouse
gaattctttgagggaggcga

SEQ ID NO: 817690 - DNA, 20 bp, mouse
ggcttgggagaacaaggcct

SEQ ID NO: 817691 - DNA, 20 bp, mouse
gctgtctcacagaacacttg

SEQ ID NO: 817692 - DNA, 20 bp, mouse
gaggctcctcgttggaacaa

SEQ ID NO: 817693 - DNA, 20 bp, mouse
ggcctggccgggaccttcca

SEQ ID NO: 817694 - DNA, 20 bp, mouse
gaattctgaacgttgttctc

SEQ ID NO: 817695 - DNA, 20 bp, mouse
gatctagcagagatagatac

SEQ ID NO: 817696 - DNA, 20 bp, mouse
gttgagaggcgtaacgttgt

SEQ ID NO: 817697 - DNA, 20 bp, mouse
gtcaaggtgtggtgcaccct

SEQ ID NO: 817698 - DNA, 20 bp, mouse
ggggaaatgtagttcgacgg

SEQ ID NO: 817699 - DNA, 20 bp, mouse
gtaacgttgtgggcgggtca

SEQ ID NO: 817700 - DNA, 20 bp, mouse
gggaggttggtgaatttgag

SEQ ID NO: 817701 - DNA, 20 bp, mouse
gaagcctgcccattggaggt

SEQ ID NO: 817702 - DNA, 20 bp, mouse
gttgtgggcgggtcaaggtg

SEQ ID NO: 817703 - DNA, 20 bp, mouse
gcggctggggcttataagga

SEQ ID NO: 817704 - DNA, 20 bp, mouse
gagaggcgtaacgttgtggg

SEQ ID NO: 817705 - DNA, 20 bp, mouse
ggatcccggtcataaattgt

SEQ ID NO: 817706 - DNA, 20 bp, mouse
gcctccctgggcgggtaagg

SEQ ID NO: 817707 - DNA, 20 bp, mouse
gcgggcagaggcacagacca

SEQ ID NO: 817708 - DNA, 20 bp, mouse
gtggaagcccgagggaagct

SEQ ID NO: 817709 - DNA, 20 bp, mouse
gagaactcgggtccctttaa

SEQ ID NO: 817710 - DNA, 20 bp, mouse
gccgcagcctgcgcgactca

SEQ ID NO: 817711 - DNA, 20 bp, mouse
gaaagctaccgcctgagtca

SEQ ID NO: 817712 - DNA, 20 bp, mouse
ggcgaccgaaatagccactg

SEQ ID NO: 817713 - DNA, 20 bp, mouse
gcttcctccctgggcgggta

SEQ ID NO: 817714 - DNA, 20 bp, mouse
ggttcccgcaagcccttaaa

SEQ ID NO: 817715 - DNA, 20 bp, mouse
gcacgcatgcgcaccgaggg

SEQ ID NO: 817716 - DNA, 20 bp, mouse
gtcagtccgtaggggactac

SEQ ID NO: 817717 - DNA, 20 bp, mouse
ggggcagcctcagtccgtag

SEQ ID NO: 817718 - DNA, 20 bp, mouse
ggcgcctcggcgccggaaga

SEQ ID NO: 817719 - DNA, 20 bp, mouse
gtactagaaaaagcggtcta

SEQ ID NO: 817720 - DNA, 20 bp, mouse
gcgcgcgcgcgggtgcgaac

SEQ ID NO: 817721 - DNA, 20 bp, mouse
ggcacgccggtagtccccta

SEQ ID NO: 817722 - DNA, 20 bp, mouse
gacgaacaggcactgagagc

SEQ ID NO: 817723 - DNA, 20 bp, mouse
gttagggtccagaaggggcg

SEQ ID NO: 817724 - DNA, 20 bp, mouse
ggcagctttagggtccagaa

SEQ ID NO: 817725 - DNA, 20 bp, mouse
gccctaaagctgcaacgaac

SEQ ID NO: 817726 - DNA, 20 bp, mouse
gcggccctgcgtagcggtgg

SEQ ID NO: 817727 - DNA, 20 bp, mouse
ggacaccccggcagcagcgg

SEQ ID NO: 817728 - DNA, 20 bp, mouse
gtgcgagaccaagtcgggga

SEQ ID NO: 817729 - DNA, 20 bp, mouse
gtgccggcggccctgcgtag

SEQ ID NO: 817730 - DNA, 20 bp, mouse
ggagcgtcagggacactcgt

SEQ ID NO: 817731 - DNA, 20 bp, mouse
gagcagcggcggtgggaggc

SEQ ID NO: 817732 - DNA, 20 bp, mouse
gccgctgcgagaccaagtcg

SEQ ID NO: 817733 - DNA, 20 bp, mouse
gcggcggccctgcgtagcgg

SEQ ID NO: 817734 - DNA, 20 bp, mouse
ggcggacaccccggcagcag

SEQ ID NO: 817735 - DNA, 20 bp, mouse
ggcggagcgccccctgccgg

SEQ ID NO: 817736 - DNA, 20 bp, mouse
gagggggcgactagcgggaa

SEQ ID NO: 817737 - DNA, 20 bp, mouse
gcctcctggcccgtgaaggc

SEQ ID NO: 817738 - DNA, 20 bp, mouse
ggctcggagcagcgagacta

SEQ ID NO: 817739 - DNA, 20 bp, mouse
gctggcccgtgaaggcggga

SEQ ID NO: 817740 - DNA, 20 bp, mouse
gtgtgcggataaagaggtgc

SEQ ID NO: 817741 - DNA, 20 bp, mouse
gctccagccgccagccggat

SEQ ID NO: 817742 - DNA, 20 bp, mouse
gaagcggtgtgcggataaag

SEQ ID NO: 817743 - DNA, 20 bp, mouse
ggcagagagcccagcccatc

SEQ ID NO: 817744 - DNA, 20 bp, mouse
gtctctatggtgctccctcc

SEQ ID NO: 817745 - DNA, 20 bp, mouse
gcactccctcccgccttcac

SEQ ID NO: 817746 - DNA, 20 bp, mouse
gcctccggaggtttgatcgc

SEQ ID NO: 817747 - DNA, 20 bp, mouse
gaaaaggccgcctcccccaa

SEQ ID NO: 817748 - DNA, 20 bp, mouse
gtggcaggagcggagtcaga

SEQ ID NO: 817749 - DNA, 20 bp, mouse
gggcctctcccggcctccgg

SEQ ID NO: 817750 - DNA, 20 bp, mouse
gtcgcggcacatcccggatc

SEQ ID NO: 817751 - DNA, 20 bp, mouse
gtaaagaggcattctcgatt

SEQ ID NO: 817752 - DNA, 20 bp, mouse
gcctctgggtaactggactc

SEQ ID NO: 817753 - DNA, 20 bp, mouse
ggcgtggggtcagagttcga

SEQ ID NO: 817754 - DNA, 20 bp, mouse
ggcagggtctaggttgggcg

SEQ ID NO: 817755 - DNA, 20 bp, mouse
gggccgcgggatcctaaagc

SEQ ID NO: 817756 - DNA, 20 bp, mouse
gtgcccggaggctgcgcgat

SEQ ID NO: 817757 - DNA, 20 bp, mouse
ggccgcccggggcccatcgg

SEQ ID NO: 817758 - DNA, 20 bp, mouse
ggcgcagcctccgggcagat

SEQ ID NO: 817759 - DNA, 20 bp, mouse
gaccacgcggagtgcacagg

SEQ ID NO: 817760 - DNA, 20 bp, mouse
ggcccggggcccatcggtgg

SEQ ID NO: 817761 - DNA, 20 bp, mouse
gggtctgcctgcgacgcgcc

SEQ ID NO: 817762 - DNA, 20 bp, mouse
gcgacgcgccggggacggag

SEQ ID NO: 817763 - DNA, 20 bp, mouse
ggcactccgcgtggtccaag

SEQ ID NO: 817764 - DNA, 20 bp, mouse
gaggagggccgctccgtccc

SEQ ID NO: 817765 - DNA, 20 bp, mouse
ggctcggggagggaacacca

SEQ ID NO: 817766 - DNA, 20 bp, mouse
gaatcggcgcccgactggga

SEQ ID NO: 817767 - DNA, 20 bp, mouse
gcgcgcccggggcttcactg

SEQ ID NO: 817768 - DNA, 20 bp, mouse
gtcgccgcgtgctcactgga

SEQ ID NO: 817769 - DNA, 20 bp, mouse
gtgagcacgcggcgaggctt

SEQ ID NO: 817770 - DNA, 20 bp, mouse
gactgggacgggatccaaat

SEQ ID NO: 817771 - DNA, 20 bp, mouse
ggcggccggcagacaattcc

SEQ ID NO: 817772 - DNA, 20 bp, mouse
ggaactggccctcctgggaa

SEQ ID NO: 817773 - DNA, 20 bp, mouse
gcctcctcgccgtgacgaat

SEQ ID NO: 817774 - DNA, 20 bp, mouse
gcggggcttcactgaggcgg

SEQ ID NO: 817775 - DNA, 20 bp, mouse
gcggcgcccgcctcacgcgg

SEQ ID NO: 817776 - DNA, 20 bp, mouse
gggaggcagaagctcggctg

SEQ ID NO: 817777 - DNA, 20 bp, mouse
gggaaacaggaaatcgtgat

SEQ ID NO: 817778 - DNA, 20 bp, mouse
gggtaactacgtagaggggc

SEQ ID NO: 817779 - DNA, 20 bp, mouse
ggcccagcgcgtgctccagc

SEQ ID NO: 817780 - DNA, 20 bp, mouse
ggctgggtaactacgtagag

SEQ ID NO: 817781 - DNA, 20 bp, mouse
gaagtggccgccaactagga

SEQ ID NO: 817782 - DNA, 20 bp, mouse
gtacccagcaactgttgaag

SEQ ID NO: 817783 - DNA, 20 bp, mouse
ggagcacgcgctgggcgctc

SEQ ID NO: 817784 - DNA, 20 bp, mouse
gcccggctggagcacgcgct

SEQ ID NO: 817785 - DNA, 20 bp, mouse
gagtgctctgatcacttcgg

SEQ ID NO: 817786 - DNA, 20 bp, mouse
gaaccctgacccttaggagt

SEQ ID NO: 817787 - DNA, 20 bp, mouse
gaaccctactcctaagggtc

SEQ ID NO: 817788 - DNA, 20 bp, mouse
gaaggcaaaagcacggcgct

SEQ ID NO: 817789 - DNA, 20 bp, mouse
ggacagaggagctgaaagta

SEQ ID NO: 817790 - DNA, 20 bp, mouse
gtcaggaaccctactcctaa

SEQ ID NO: 817791 - DNA, 20 bp, mouse
gagaagtcaggagttatctc

SEQ ID NO: 817792 - DNA, 20 bp, mouse
gaaaaaagaacgtttgacag

SEQ ID NO: 817793 - DNA, 20 bp, mouse
gtgcgtatagacagtggcgt

SEQ ID NO: 817794 - DNA, 20 bp, mouse
ggcaccctgttccagaagtc

SEQ ID NO: 817795 - DNA, 20 bp, mouse
gggtggagccagtgatctca

SEQ ID NO: 817796 - DNA, 20 bp, mouse
gagcagggatccaattcccc

SEQ ID NO: 817797 - DNA, 20 bp, mouse
gttggcgttgcccggggaat

SEQ ID NO: 817798 - DNA, 20 bp, mouse
ggagagcaagtctgtcccgg

SEQ ID NO: 817799 - DNA, 20 bp, mouse
ggctgcggaaagcggaccgc

SEQ ID NO: 817800 - DNA, 20 bp, mouse
gcctgctccgctgcggaaag

SEQ ID NO: 817801 - DNA, 20 bp, mouse
gtggggtgaggcactaggga

SEQ ID NO: 817802 - DNA, 20 bp, mouse
gatgtctaaggacctacaac

SEQ ID NO: 817803 - DNA, 20 bp, mouse
gtctaaggacctacaacagg

SEQ ID NO: 817804 - DNA, 20 bp, mouse
gaagtctcgcgagactggcg

SEQ ID NO: 817805 - DNA, 20 bp, mouse
gggccaacctagccaagaag

SEQ ID NO: 817806 - DNA, 20 bp, mouse
gaacgcgcgaggcccagacc

SEQ ID NO: 817807 - DNA, 20 bp, mouse
gggaaagcgaaaatgaagat

SEQ ID NO: 817808 - DNA, 20 bp, mouse
gcgaggcccagacctggaag

SEQ ID NO: 817809 - DNA, 20 bp, mouse
gtgctcgcgccgaaattcaa

SEQ ID NO: 817810 - DNA, 20 bp, mouse
gcaaagagcgtagaccggga

SEQ ID NO: 817811 - DNA, 20 bp, mouse
gtctgggcagcacctcttcc

SEQ ID NO: 817812 - DNA, 20 bp, mouse
gaagaggaagcgcttcagtc

SEQ ID NO: 817813 - DNA, 20 bp, mouse
ggtcgtgctgacatcgcgtc

SEQ ID NO: 817814 - DNA, 20 bp, mouse
gagcgtagaccgggaggggg

SEQ ID NO: 817815 - DNA, 20 bp, mouse
gagcgcagacgcctcggagt

SEQ ID NO: 817816 - DNA, 20 bp, mouse
ggcgtcgggcggaaccacga

SEQ ID NO: 817817 - DNA, 20 bp, mouse
gctcccgcggccctcttaga

SEQ ID NO: 817818 - DNA, 20 bp, mouse
ggaagcgatgcggatcgcag

SEQ ID NO: 817819 - DNA, 20 bp, mouse
gtaagagggccgcgggagag

SEQ ID NO: 817820 - DNA, 20 bp, mouse
gcctgccggcctctggagcg

SEQ ID NO: 817821 - DNA, 20 bp, mouse
gctacgcgacagagtggaac

SEQ ID NO: 817822 - DNA, 20 bp, mouse
gtggtcgcgcccgtgagggg

SEQ ID NO: 817823 - DNA, 20 bp, mouse
gaaccacgatggaagcgatg

SEQ ID NO: 817824 - DNA, 20 bp, mouse
ggagcggggctcctccgagt

SEQ ID NO: 817825 - DNA, 20 bp, mouse
gcggaggagccccgctccag

SEQ ID NO: 817826 - DNA, 20 bp, mouse
gcgagggccaagttacgact

SEQ ID NO: 817827 - DNA, 20 bp, mouse
gcgcccgaacggcccgaaga

SEQ ID NO: 817828 - DNA, 20 bp, mouse
gcatgcgcgggctctacccc

SEQ ID NO: 817829 - DNA, 20 bp, mouse
gccctcggcgccacggtccc

SEQ ID NO: 817830 - DNA, 20 bp, mouse
gggctctaccccagggaccg

SEQ ID NO: 817831 - DNA, 20 bp, mouse
gccgaacggcccgaagatgg

SEQ ID NO: 817832 - DNA, 20 bp, mouse
ggccaagttacgactgggaa

SEQ ID NO: 817833 - DNA, 20 bp, mouse
ggagtcccaccgccatcttc

SEQ ID NO: 817834 - DNA, 20 bp, mouse
gacggcccgaagatggcggt

SEQ ID NO: 817835 - DNA, 20 bp, mouse
gcccagggaccgtggcgccg

SEQ ID NO: 817836 - DNA, 20 bp, mouse
gcaggggagtgcttaaagaa

SEQ ID NO: 817837 - DNA, 20 bp, mouse
ggcatggagtggagattcag

SEQ ID NO: 817838 - DNA, 20 bp, mouse
ggaggctagtcctaggcaaa

SEQ ID NO: 817839 - DNA, 20 bp, mouse
ggcctcgctcaggtctggag

SEQ ID NO: 817840 - DNA, 20 bp, mouse
ggagactgtaaccatcacaa

SEQ ID NO: 817841 - DNA, 20 bp, mouse
gcctaggactagcctcgctc

SEQ ID NO: 817842 - DNA, 20 bp, mouse
ggactagcctcgctcaggtc

SEQ ID NO: 817843 - DNA, 20 bp, mouse
gcactccatgccttttgcct

SEQ ID NO: 817844 - DNA, 20 bp, mouse
gaagtctaaggacacgtccc

SEQ ID NO: 817845 - DNA, 20 bp, mouse
gaatcactcaatctgataca

SEQ ID NO: 817846 - DNA, 20 bp, mouse
gcaccggggagcgttggtcg

SEQ ID NO: 817847 - DNA, 20 bp, mouse
gcacacacatcgcacctctg

SEQ ID NO: 817848 - DNA, 20 bp, mouse
gcgcacctctgaggccaccg

SEQ ID NO: 817849 - DNA, 20 bp, mouse
gcgctccccggtggcctcag

SEQ ID NO: 817850 - DNA, 20 bp, mouse
gcggaaccgcgcaagcgcat

SEQ ID NO: 817851 - DNA, 20 bp, mouse
gttggtcggggcgtggcctc

SEQ ID NO: 817852 - DNA, 20 bp, mouse
gtggcctcgggtttgcgggg

SEQ ID NO: 817853 - DNA, 20 bp, mouse
gaagcgcatcggggccgcgg

SEQ ID NO: 817854 - DNA, 20 bp, mouse
ggggagcgttggtcggggcg

SEQ ID NO: 817855 - DNA, 20 bp, mouse
ggttccgccccgcaaacccg

SEQ ID NO: 817856 - DNA, 20 bp, mouse
gcgggagcgtggggaaagcg

SEQ ID NO: 817857 - DNA, 20 bp, mouse
gctgcggcggatctagacag

SEQ ID NO: 817858 - DNA, 20 bp, mouse
gcaggcgcgggcggagtccg

SEQ ID NO: 817859 - DNA, 20 bp, mouse
gtgcccggccgacagtgaga

SEQ ID NO: 817860 - DNA, 20 bp, mouse
gcggcggatctagacagcgg

SEQ ID NO: 817861 - DNA, 20 bp, mouse
gggaggcacgcgccccgctg

SEQ ID NO: 817862 - DNA, 20 bp, mouse
gtctctctggctgaccagag

SEQ ID NO: 817863 - DNA, 20 bp, mouse
gagggcgaggcgggtctgga

SEQ ID NO: 817864 - DNA, 20 bp, mouse
gcggatctagacagcggggg

SEQ ID NO: 817865 - DNA, 20 bp, mouse
gcagagcggcgcgaaagccc

SEQ ID NO: 817866 - DNA, 20 bp, mouse
gggaccgcggggactgggga

SEQ ID NO: 817867 - DNA, 20 bp, mouse
ggctctcaggtcacggaagg

SEQ ID NO: 817868 - DNA, 20 bp, mouse
gtcctcctgcgcagcagcca

SEQ ID NO: 817869 - DNA, 20 bp, mouse
ggcggcccgctctcaggtca

SEQ ID NO: 817870 - DNA, 20 bp, mouse
ggctgctgcgcaggaggaag

SEQ ID NO: 817871 - DNA, 20 bp, mouse
gtgcgcagcagccacggcgg

SEQ ID NO: 817872 - DNA, 20 bp, mouse
gcccgctctcaggtcacgga

SEQ ID NO: 817873 - DNA, 20 bp, mouse
gggagcctgcatagaccctg

SEQ ID NO: 817874 - DNA, 20 bp, mouse
gaggacggcggacggagacc

SEQ ID NO: 817875 - DNA, 20 bp, mouse
ggggcggcggcgtacgtagc

SEQ ID NO: 817876 - DNA, 20 bp, mouse
gacacctgggttcacaccat

SEQ ID NO: 817877 - DNA, 20 bp, mouse
ggaaccgatggtgtgaaccc

SEQ ID NO: 817878 - DNA, 20 bp, mouse
gtatactggacgatgtatat

SEQ ID NO: 817879 - DNA, 20 bp, mouse
ggcactgtgacatttgcctc

SEQ ID NO: 817880 - DNA, 20 bp, mouse
ggtgccgctctgtgatagca

SEQ ID NO: 817881 - DNA, 20 bp, mouse
gttctgggcagtactgagat

SEQ ID NO: 817882 - DNA, 20 bp, mouse
gcagaagaggggaactagcc

SEQ ID NO: 817883 - DNA, 20 bp, mouse
ggcaccatgtgccagaagag

SEQ ID NO: 817884 - DNA, 20 bp, mouse
gcagacaactttgcttatac

SEQ ID NO: 817885 - DNA, 20 bp, mouse
gtagcatggtctgtttccag

SEQ ID NO: 817886 - DNA, 20 bp, mouse
gtgtgcctgaggccagttga

SEQ ID NO: 817887 - DNA, 20 bp, mouse
gccctagaggagaaaccaga

SEQ ID NO: 817888 - DNA, 20 bp, mouse
gctaactccctcccctgaga

SEQ ID NO: 817889 - DNA, 20 bp, mouse
gctcaggcacacagtgacct

SEQ ID NO: 817890 - DNA, 20 bp, mouse
gccaaggtcaaaagacagtg

SEQ ID NO: 817891 - DNA, 20 bp, mouse
gtgttgagggtcagagccat

SEQ ID NO: 817892 - DNA, 20 bp, mouse
ggtgggaggccttggagcat

SEQ ID NO: 817893 - DNA, 20 bp, mouse
ggcaggttagagctaggcag

SEQ ID NO: 817894 - DNA, 20 bp, mouse
ggagatggccctagccctag

SEQ ID NO: 817895 - DNA, 20 bp, mouse
gtcatccatcaactggcctc

SEQ ID NO: 817896 - DNA, 20 bp, mouse
gctgggtcccactgcccatc

SEQ ID NO: 817897 - DNA, 20 bp, mouse
ggaaatggctgtgaaccaga

SEQ ID NO: 817898 - DNA, 20 bp, mouse
gagcacacctagcctgggag

SEQ ID NO: 817899 - DNA, 20 bp, mouse
gagaacaaggagaagtgcat

SEQ ID NO: 817900 - DNA, 20 bp, mouse
gctcatctggaagcttctgg

SEQ ID NO: 817901 - DNA, 20 bp, mouse
gaacaggggaaccagtccgg

SEQ ID NO: 817902 - DNA, 20 bp, mouse
gagttggggacagttccttc

SEQ ID NO: 817903 - DNA, 20 bp, mouse
ggttcacagccatttctgcc

SEQ ID NO: 817904 - DNA, 20 bp, mouse
ggagggagggaacggacatc

SEQ ID NO: 817905 - DNA, 20 bp, mouse
ggtcatcaatgatactgagc

SEQ ID NO: 817906 - DNA, 20 bp, mouse
gcaacacagaagccctggct

SEQ ID NO: 817907 - DNA, 20 bp, mouse
ggagctctgtgtcggtcggt

SEQ ID NO: 817908 - DNA, 20 bp, mouse
gtaccccttacaatatctta

SEQ ID NO: 817909 - DNA, 20 bp, mouse
gaggggtatcatacaatgtc

SEQ ID NO: 817910 - DNA, 20 bp, mouse
gtgccaagtgcaggcactat

SEQ ID NO: 817911 - DNA, 20 bp, mouse
gctataggagtgtgctatca

SEQ ID NO: 817912 - DNA, 20 bp, mouse
ggattccataagatattgta

SEQ ID NO: 817913 - DNA, 20 bp, mouse
gcatggtgaagcatcagcac

SEQ ID NO: 817914 - DNA, 20 bp, mouse
ggcttgagctctgtgtcggt

SEQ ID NO: 817915 - DNA, 20 bp, mouse
gctgcttactagaactcagt

SEQ ID NO: 817916 - DNA, 20 bp, mouse
ggcaccatgcccaggcaagt

SEQ ID NO: 817917 - DNA, 20 bp, mouse
gcccatcgtgtaatctggta

SEQ ID NO: 817918 - DNA, 20 bp, mouse
gcaccaggtgatcctgagac

SEQ ID NO: 817919 - DNA, 20 bp, mouse
gcatgtctgtggagaactct

SEQ ID NO: 817920 - DNA, 20 bp, mouse
gaactgaggttctctctctc

SEQ ID NO: 817921 - DNA, 20 bp, mouse
gacatgcccatcgtgtaatc

SEQ ID NO: 817922 - DNA, 20 bp, mouse
gtgaagctattgtggtctca

SEQ ID NO: 817923 - DNA, 20 bp, mouse
gaccctaccagattacacga

SEQ ID NO: 817924 - DNA, 20 bp, mouse
gttcatgtgggcttttggga

SEQ ID NO: 817925 - DNA, 20 bp, mouse
gctggtgatcttttgttgtg

SEQ ID NO: 817926 - DNA, 20 bp, mouse
gctggctagtcagagaatct

SEQ ID NO: 817927 - DNA, 20 bp, mouse
gtgggcaaaggtgaaccagc

SEQ ID NO: 817928 - DNA, 20 bp, mouse
gctgtggcagggtcagaatg

SEQ ID NO: 817929 - DNA, 20 bp, mouse
gctaaagaacttttggactt

SEQ ID NO: 817930 - DNA, 20 bp, mouse
gtaaattgtctgcttgtcct

SEQ ID NO: 817931 - DNA, 20 bp, mouse
gtgctttaaactgtttgtgg

SEQ ID NO: 817932 - DNA, 20 bp, mouse
gagatgcaagccattcttct

SEQ ID NO: 817933 - DNA, 20 bp, mouse
gagccatataaaataggagc

SEQ ID NO: 817934 - DNA, 20 bp, mouse
gttttggactttggaaagag

SEQ ID NO: 817935 - DNA, 20 bp, mouse
ggagctcagactatatcctg

SEQ ID NO: 817936 - DNA, 20 bp, mouse
gggaggaggagaaacggtgt

SEQ ID NO: 817937 - DNA, 20 bp, mouse
gggaacgtgcacagggcatg

SEQ ID NO: 817938 - DNA, 20 bp, mouse
gtcacgcgacgctgatgctg

SEQ ID NO: 817939 - DNA, 20 bp, mouse
gtagaatacagtggggtgga

SEQ ID NO: 817940 - DNA, 20 bp, mouse
gtgttggaggaacgtgcaca

SEQ ID NO: 817941 - DNA, 20 bp, mouse
gggaggagaaacggtgttgg

SEQ ID NO: 817942 - DNA, 20 bp, mouse
gtaagcgagactcggacgtg

SEQ ID NO: 817943 - DNA, 20 bp, mouse
gacagggcatgaggcattct

SEQ ID NO: 817944 - DNA, 20 bp, mouse
ggctgctggagcaggaccta

SEQ ID NO: 817945 - DNA, 20 bp, mouse
ggaaacgctaagagggtgac

SEQ ID NO: 817946 - DNA, 20 bp, mouse
ggggcgggaacacctacaaa

SEQ ID NO: 817947 - DNA, 20 bp, mouse
gcggacgacgtagtgacgtc

SEQ ID NO: 817948 - DNA, 20 bp, mouse
ggcccctcccggactccaga

SEQ ID NO: 817949 - DNA, 20 bp, mouse
gccagagggcggggccgcca

SEQ ID NO: 817950 - DNA, 20 bp, mouse
gacgtagtgacgtcaggaga

SEQ ID NO: 817951 - DNA, 20 bp, mouse
gggccccgccctctggagtc

SEQ ID NO: 817952 - DNA, 20 bp, mouse
gatgccggtgggaaagtcct

SEQ ID NO: 817953 - DNA, 20 bp, mouse
ggtgctctgcgcaggcggga

SEQ ID NO: 817954 - DNA, 20 bp, mouse
gtgttcccgcccctcacctc

SEQ ID NO: 817955 - DNA, 20 bp, mouse
gccgccagggctccctttgt

SEQ ID NO: 817956 - DNA, 20 bp, mouse
ggagaaggctcgcacgggaa

SEQ ID NO: 817957 - DNA, 20 bp, mouse
ggtccggagaaggctcgcac

SEQ ID NO: 817958 - DNA, 20 bp, mouse
gtccctaaagcgtccggaga

SEQ ID NO: 817959 - DNA, 20 bp, mouse
gcacgggaaaggacgagctc

SEQ ID NO: 817960 - DNA, 20 bp, mouse
ggggagtcccggtccgtcac

SEQ ID NO: 817961 - DNA, 20 bp, mouse
gccgggatcagagtccagtc

SEQ ID NO: 817962 - DNA, 20 bp, mouse
gcggccgaggccttgcaccg

SEQ ID NO: 817963 - DNA, 20 bp, mouse
ggcggcttctggagccagac

SEQ ID NO: 817964 - DNA, 20 bp, mouse
gagtcgcgccggtgacggac

SEQ ID NO: 817965 - DNA, 20 bp, mouse
gcagtcggccctgggggcgc

SEQ ID NO: 817966 - DNA, 20 bp, mouse
ggggaggaagcgtgtgtaga

SEQ ID NO: 817967 - DNA, 20 bp, mouse
gtctccggaagtgtgttcgg

SEQ ID NO: 817968 - DNA, 20 bp, mouse
ggaggtgagccggccaagga

SEQ ID NO: 817969 - DNA, 20 bp, mouse
gcttggccggctcacctcgg

SEQ ID NO: 817970 - DNA, 20 bp, mouse
gcgtacgaacctgctggaag

SEQ ID NO: 817971 - DNA, 20 bp, mouse
gtcgccgaggtctgactctc

SEQ ID NO: 817972 - DNA, 20 bp, mouse
gactcctcgcgagatcgccg

SEQ ID NO: 817973 - DNA, 20 bp, mouse
gagacctcggcgatctcgcg

SEQ ID NO: 817974 - DNA, 20 bp, mouse
gcaggaagcggggccgaaag

SEQ ID NO: 817975 - DNA, 20 bp, mouse
gttgttcttcgggatttgta

SEQ ID NO: 817976 - DNA, 20 bp, mouse
ggccctaggagcctggagag

SEQ ID NO: 817977 - DNA, 20 bp, mouse
ggggcggggctcggggtgaa

SEQ ID NO: 817978 - DNA, 20 bp, mouse
gcggggctcggggtgaaagg

SEQ ID NO: 817979 - DNA, 20 bp, mouse
gcgccggcaccgcccctcct

SEQ ID NO: 817980 - DNA, 20 bp, mouse
gctaggagcctggagagggg

SEQ ID NO: 817981 - DNA, 20 bp, mouse
gagaggcggggcttatgaca

SEQ ID NO: 817982 - DNA, 20 bp, mouse
gcacggcatgctgggagcga

SEQ ID NO: 817983 - DNA, 20 bp, mouse
gtgccggcgccctaggagcc

SEQ ID NO: 817984 - DNA, 20 bp, mouse
gggctattggtcacagaata

SEQ ID NO: 817985 - DNA, 20 bp, mouse
gggggcttatgacaggggta

SEQ ID NO: 817986 - DNA, 20 bp, mouse
gcaaccgagctggttgtggg

SEQ ID NO: 817987 - DNA, 20 bp, mouse
ggctgggcttaagtcctcgg

SEQ ID NO: 817988 - DNA, 20 bp, mouse
gaagtcaaccgagctggttg

SEQ ID NO: 817989 - DNA, 20 bp, mouse
gtctctgcacgtagcagggt

SEQ ID NO: 817990 - DNA, 20 bp, mouse
gaaactgagcgttctagcgc

SEQ ID NO: 817991 - DNA, 20 bp, mouse
gaactcgctgcaggttgcct

SEQ ID NO: 817992 - DNA, 20 bp, mouse
gtccgggaagtcaaccgagc

SEQ ID NO: 817993 - DNA, 20 bp, mouse
gcggctgccgacgagctagg

SEQ ID NO: 817994 - DNA, 20 bp, mouse
ggctcatccgcctagctcgt

SEQ ID NO: 817995 - DNA, 20 bp, mouse
gctgccgccaagccgcggac

SEQ ID NO: 817996 - DNA, 20 bp, mouse
gtgcgcagaggtgtaaagct

SEQ ID NO: 817997 - DNA, 20 bp, mouse
gcagaggtgtaaagctagga

SEQ ID NO: 817998 - DNA, 20 bp, mouse
gggagcgggcgaatcggccg

SEQ ID NO: 817999 - DNA, 20 bp, mouse
gggcgaatcggccgcggaga

SEQ ID NO: 818000 - DNA, 20 bp, mouse
gcgcgcacacgccgtctccg

SEQ ID NO: 818001 - DNA, 20 bp, mouse
gcattcagcacgttcaacta

SEQ ID NO: 818002 - DNA, 20 bp, mouse
gaagctaggacggtccgccg

SEQ ID NO: 818003 - DNA, 20 bp, mouse
gtgccctccccaaacgacgg

SEQ ID NO: 818004 - DNA, 20 bp, mouse
gctccacctccgagcctcgg

SEQ ID NO: 818005 - DNA, 20 bp, mouse
gggacactgcttttgatctg

SEQ ID NO: 818006 - DNA, 20 bp, mouse
ggtggggcgcagggacgctc

SEQ ID NO: 818007 - DNA, 20 bp, mouse
gggaaagcacccagagggac

SEQ ID NO: 818008 - DNA, 20 bp, mouse
gccgctcgccgatcccaaga

SEQ ID NO: 818009 - DNA, 20 bp, mouse
ggggacgctccggctccgga

SEQ ID NO: 818010 - DNA, 20 bp, mouse
gcagcagcgccggtccctct

SEQ ID NO: 818011 - DNA, 20 bp, mouse
gggtgcccggcggcctccta

SEQ ID NO: 818012 - DNA, 20 bp, mouse
ggcggcggaaagcacccaga

SEQ ID NO: 818013 - DNA, 20 bp, mouse
ggctctgtagcgctccctct

SEQ ID NO: 818014 - DNA, 20 bp, mouse
gaggaacaggacggagcctt

SEQ ID NO: 818015 - DNA, 20 bp, mouse
gtagcgctccctcttgggat

SEQ ID NO: 818016 - DNA, 20 bp, mouse
gtagcgctaagaccttgcaa

SEQ ID NO: 818017 - DNA, 20 bp, mouse
gaagggacacgaaaaggcaa

SEQ ID NO: 818018 - DNA, 20 bp, mouse
gggtgggttgggatcagcga

SEQ ID NO: 818019 - DNA, 20 bp, mouse
gaggactaacaggcggagga

SEQ ID NO: 818020 - DNA, 20 bp, mouse
gccttgcaagggacacgaaa

SEQ ID NO: 818021 - DNA, 20 bp, mouse
gccggaactcaaggactaac

SEQ ID NO: 818022 - DNA, 20 bp, mouse
gggaggagggatttcacaat

SEQ ID NO: 818023 - DNA, 20 bp, mouse
gaatcagttggaactgttgt

SEQ ID NO: 818024 - DNA, 20 bp, mouse
gtttcacaataggaccgggt

SEQ ID NO: 818025 - DNA, 20 bp, mouse
gagctgttagaagaatcagt

SEQ ID NO: 818026 - DNA, 20 bp, mouse
gcacgcatgcggattacgga

SEQ ID NO: 818027 - DNA, 20 bp, mouse
ggcggattacggaggggcga

SEQ ID NO: 818028 - DNA, 20 bp, mouse
gactgagcatgcgtgaatgg

SEQ ID NO: 818029 - DNA, 20 bp, mouse
gcgatcggggtagggtacgg

SEQ ID NO: 818030 - DNA, 20 bp, mouse
gcgcgtgcgcattgtttctc

SEQ ID NO: 818031 - DNA, 20 bp, mouse
ggctggcttcagcacgcatg

SEQ ID NO: 818032 - DNA, 20 bp, mouse
gtagactgagcatgcgtgaa

SEQ ID NO: 818033 - DNA, 20 bp, mouse
ggcgcaggccgtgactcgtt

SEQ ID NO: 818034 - DNA, 20 bp, mouse
gtcagcacgcatgcggatta

SEQ ID NO: 818035 - DNA, 20 bp, mouse
gttgtcagaccgatcggggt

SEQ ID NO: 818036 - DNA, 20 bp, mouse
gagaaggcatattctgtggt

SEQ ID NO: 818037 - DNA, 20 bp, mouse
gaaacatcgcagcaaggcaa

SEQ ID NO: 818038 - DNA, 20 bp, mouse
ggtcagagccagtgttgaga

SEQ ID NO: 818039 - DNA, 20 bp, mouse
gaggcaatctactgcacatc

SEQ ID NO: 818040 - DNA, 20 bp, mouse
gacattcatgatgattgata

SEQ ID NO: 818041 - DNA, 20 bp, mouse
gctggctttgctatttgcac

SEQ ID NO: 818042 - DNA, 20 bp, mouse
gggttggcgtaagctggact

SEQ ID NO: 818043 - DNA, 20 bp, mouse
gtttgcacagggtggcaaga

SEQ ID NO: 818044 - DNA, 20 bp, mouse
gattgatagggcgctgatca

SEQ ID NO: 818045 - DNA, 20 bp, mouse
gcatgtcatcagcatatttg

SEQ ID NO: 818046 - DNA, 20 bp, mouse
gaagtctagtctagatgagg

SEQ ID NO: 818047 - DNA, 20 bp, mouse
ggcaccctcctctgggtcag

SEQ ID NO: 818048 - DNA, 20 bp, mouse
gaggaagtctagtctagatg

SEQ ID NO: 818049 - DNA, 20 bp, mouse
gggagagggcagggtctgaa

SEQ ID NO: 818050 - DNA, 20 bp, mouse
ggcaggctgggaaaagtccg

SEQ ID NO: 818051 - DNA, 20 bp, mouse
ggctgggaaaagtccgaggg

SEQ ID NO: 818052 - DNA, 20 bp, mouse
gcagccccctggggtgacgg

SEQ ID NO: 818053 - DNA, 20 bp, mouse
gaggaggggcggacccccct

SEQ ID NO: 818054 - DNA, 20 bp, mouse
gagcctgggcactctccaga

SEQ ID NO: 818055 - DNA, 20 bp, mouse
gcccgcccccgtcaccccag

SEQ ID NO: 818056 - DNA, 20 bp, mouse
gcccctgcggaccaccctca

SEQ ID NO: 818057 - DNA, 20 bp, mouse
gcaccctcagggttcctact

SEQ ID NO: 818058 - DNA, 20 bp, mouse
gggcttcaggccagttgcgc

SEQ ID NO: 818059 - DNA, 20 bp, mouse
gaatccaagtaggaaccctg

SEQ ID NO: 818060 - DNA, 20 bp, mouse
gagggtggtccgcaggggtt

SEQ ID NO: 818061 - DNA, 20 bp, mouse
gctactgcagaaatccaagt

SEQ ID NO: 818062 - DNA, 20 bp, mouse
gcgcaggcgctatgggcttc

SEQ ID NO: 818063 - DNA, 20 bp, mouse
gaccagtggacatgaacaaa

SEQ ID NO: 818064 - DNA, 20 bp, mouse
gcgcaggcgcagtggcttta

SEQ ID NO: 818065 - DNA, 20 bp, mouse
gaacaggagtcaatgaccag

SEQ ID NO: 818066 - DNA, 20 bp, mouse
ggggagcctccgagccgtca

SEQ ID NO: 818067 - DNA, 20 bp, mouse
gccagccagctacagaagaa

SEQ ID NO: 818068 - DNA, 20 bp, mouse
gcaggcacccgaccctgcgt

SEQ ID NO: 818069 - DNA, 20 bp, mouse
gaagcatgtggcaacgtcac

SEQ ID NO: 818070 - DNA, 20 bp, mouse
gatagtatagcgccccctga

SEQ ID NO: 818071 - DNA, 20 bp, mouse
gatagcgccccctgacggct

SEQ ID NO: 818072 - DNA, 20 bp, mouse
gcgggagcttctggaggtca

SEQ ID NO: 818073 - DNA, 20 bp, mouse
gatccgacctaggtaagtct

SEQ ID NO: 818074 - DNA, 20 bp, mouse
gtctctcggagagcagcgat

SEQ ID NO: 818075 - DNA, 20 bp, mouse
gggcccgcggggcgcgcccg

SEQ ID NO: 818076 - DNA, 20 bp, mouse
gaaggcacaggggacgggaa

SEQ ID NO: 818077 - DNA, 20 bp, mouse
gcggagcagcgttgactcct

SEQ ID NO: 818078 - DNA, 20 bp, mouse
ggggagtggtagttcgttgc

SEQ ID NO: 818079 - DNA, 20 bp, mouse
gcccagcaggcctcgcgcag

SEQ ID NO: 818080 - DNA, 20 bp, mouse
gggcggctcaagaacaccaa

SEQ ID NO: 818081 - DNA, 20 bp, mouse
gcgcagcggctgagtcgctg

SEQ ID NO: 818082 - DNA, 20 bp, mouse
ggtggtagttcgttgctggg

SEQ ID NO: 818083 - DNA, 20 bp, mouse
gcggctgagtcgctgcggag

SEQ ID NO: 818084 - DNA, 20 bp, mouse
ggcgactcagccgctgcgcg

SEQ ID NO: 818085 - DNA, 20 bp, mouse
gtggtgatgagctaccgcgg

SEQ ID NO: 818086 - DNA, 20 bp, mouse
ggggccacctgcgtcggagg

SEQ ID NO: 818087 - DNA, 20 bp, mouse
gtcgcgcgggccacctgcgt

SEQ ID NO: 818088 - DNA, 20 bp, mouse
gaccacggaagacagcacgg

SEQ ID NO: 818089 - DNA, 20 bp, mouse
gcgcccacgcacgtcagcgc

SEQ ID NO: 818090 - DNA, 20 bp, mouse
gcacgtcagcgccggagctg

SEQ ID NO: 818091 - DNA, 20 bp, mouse
gcgcgcatgctccctaggta

SEQ ID NO: 818092 - DNA, 20 bp, mouse
gctccggcgctgacgtgcgt

SEQ ID NO: 818093 - DNA, 20 bp, mouse
gccctaggtagggtcacgag

SEQ ID NO: 818094 - DNA, 20 bp, mouse
ggccgctcgtgaccctacct

SEQ ID NO: 818095 - DNA, 20 bp, mouse
ggggggaggcagttccggtg

SEQ ID NO: 818096 - DNA, 20 bp, mouse
ggtgtgctaaggagcgggga

SEQ ID NO: 818097 - DNA, 20 bp, mouse
ggctccttagcacacacctt

SEQ ID NO: 818098 - DNA, 20 bp, mouse
gcacactacagcacaatctt

SEQ ID NO: 818099 - DNA, 20 bp, mouse
gattaaaggttgtatactaa

SEQ ID NO: 818100 - DNA, 20 bp, mouse
gctttcctcttttgagggct

SEQ ID NO: 818101 - DNA, 20 bp, mouse
gttccaggcagagggaccaa

SEQ ID NO: 818102 - DNA, 20 bp, mouse
gaagggcgtgtctgcattcc

SEQ ID NO: 818103 - DNA, 20 bp, mouse
gcaacctttaatcccaaaca

SEQ ID NO: 818104 - DNA, 20 bp, mouse
gcagcacagagaaagaagaa

SEQ ID NO: 818105 - DNA, 20 bp, mouse
gtatgcccagccctcaaaag

SEQ ID NO: 818106 - DNA, 20 bp, mouse
gccaccttggctagaccctc

SEQ ID NO: 818107 - DNA, 20 bp, mouse
gaggaactgtactacaccac

SEQ ID NO: 818108 - DNA, 20 bp, mouse
gcgggtgggaggtgggacgt

SEQ ID NO: 818109 - DNA, 20 bp, mouse
gcaaacgcatcctccctgca

SEQ ID NO: 818110 - DNA, 20 bp, mouse
gagactcggaagctgcgggt

SEQ ID NO: 818111 - DNA, 20 bp, mouse
ggtactacaccacagggcac

SEQ ID NO: 818112 - DNA, 20 bp, mouse
gtaacttaattggggatgga

SEQ ID NO: 818113 - DNA, 20 bp, mouse
ggtgggaggtgggacgtggg

SEQ ID NO: 818114 - DNA, 20 bp, mouse
gttgcagtagtgacagaggc

SEQ ID NO: 818115 - DNA, 20 bp, mouse
gatagcagctgtctgcacgc

SEQ ID NO: 818116 - DNA, 20 bp, mouse
gtatgaatgatctactcctc

SEQ ID NO: 818117 - DNA, 20 bp, mouse
gtctgaacagtgtagtgcta

SEQ ID NO: 818118 - DNA, 20 bp, mouse
gaatgatctactcctcagga

SEQ ID NO: 818119 - DNA, 20 bp, mouse
gattaagtcctgccgtcctg

SEQ ID NO: 818120 - DNA, 20 bp, mouse
gtctctagaggtagttacct

SEQ ID NO: 818121 - DNA, 20 bp, mouse
gtgtcagctgcattatgcgt

SEQ ID NO: 818122 - DNA, 20 bp, mouse
gataatgcaaatgagcacag

SEQ ID NO: 818123 - DNA, 20 bp, mouse
gatctactcctcaggacggc

SEQ ID NO: 818124 - DNA, 20 bp, mouse
ggctagaacatagtctctag

SEQ ID NO: 818125 - DNA, 20 bp, mouse
gttaagctaatttttcacat

SEQ ID NO: 818126 - DNA, 20 bp, mouse
gggccggcaggaagtgacga

SEQ ID NO: 818127 - DNA, 20 bp, mouse
gccggcccgcggtttccgga

SEQ ID NO: 818128 - DNA, 20 bp, mouse
gagcgcgggccgagacccag

SEQ ID NO: 818129 - DNA, 20 bp, mouse
gcgtgctcccgggacgaagc

SEQ ID NO: 818130 - DNA, 20 bp, mouse
gaccgcgtgccgcgtgtggc

SEQ ID NO: 818131 - DNA, 20 bp, mouse
ggggctccgatcccgcacag

SEQ ID NO: 818132 - DNA, 20 bp, mouse
gcgcgcgccgcggcccgggt

SEQ ID NO: 818133 - DNA, 20 bp, mouse
gactcccggaacagcccgag

SEQ ID NO: 818134 - DNA, 20 bp, mouse
gccgatcccgcacagaggga

SEQ ID NO: 818135 - DNA, 20 bp, mouse
ggcggcacgcggtgccgccg

SEQ ID NO: 818136 - DNA, 20 bp, mouse
gcctccggctgccatcgtgg

SEQ ID NO: 818137 - DNA, 20 bp, mouse
ggtggaggccgagacactgg

SEQ ID NO: 818138 - DNA, 20 bp, mouse
ggaagggcgcggcataaggc

SEQ ID NO: 818139 - DNA, 20 bp, mouse
ggacccgcctcctcgccctc

SEQ ID NO: 818140 - DNA, 20 bp, mouse
gcagacccggggccagtaag

SEQ ID NO: 818141 - DNA, 20 bp, mouse
ggccccgcctccgagctcag

SEQ ID NO: 818142 - DNA, 20 bp, mouse
gagtgtctcggcctccacga

SEQ ID NO: 818143 - DNA, 20 bp, mouse
gggcctgggcgcctcttagt

SEQ ID NO: 818144 - DNA, 20 bp, mouse
gcttatgccgcgcccttcct

SEQ ID NO: 818145 - DNA, 20 bp, mouse
ggggcggggtcatccgagga

SEQ ID NO: 818146 - DNA, 20 bp, mouse
gtctctgctgacctgaccat

SEQ ID NO: 818147 - DNA, 20 bp, mouse
gcctagagaagaaagccaca

SEQ ID NO: 818148 - DNA, 20 bp, mouse
gacagggctgacagttgctc

SEQ ID NO: 818149 - DNA, 20 bp, mouse
gagggcggggctggttgcta

SEQ ID NO: 818150 - DNA, 20 bp, mouse
gcagcaggccctggagagga

SEQ ID NO: 818151 - DNA, 20 bp, mouse
gtgacagttgctctggaccc

SEQ ID NO: 818152 - DNA, 20 bp, mouse
gttccaagggcaaggacccc

SEQ ID NO: 818153 - DNA, 20 bp, mouse
gcaaggaccccaggctctaa

SEQ ID NO: 818154 - DNA, 20 bp, mouse
gtctctaggcccctatggtc

SEQ ID NO: 818155 - DNA, 20 bp, mouse
gggtcaggtcagcagagacc

SEQ ID NO: 818156 - DNA, 20 bp, mouse
gcgccacgcacggacgactc

SEQ ID NO: 818157 - DNA, 20 bp, mouse
gacgaagtgactaaggttac

SEQ ID NO: 818158 - DNA, 20 bp, mouse
ggggacttccgctctctgtg

SEQ ID NO: 818159 - DNA, 20 bp, mouse
gccagggctgctgtaaagaa

SEQ ID NO: 818160 - DNA, 20 bp, mouse
gcagcagccctggggaggct

SEQ ID NO: 818161 - DNA, 20 bp, mouse
gtagtcacttcgtttctcga

SEQ ID NO: 818162 - DNA, 20 bp, mouse
gcccgcatccaaactactgt

SEQ ID NO: 818163 - DNA, 20 bp, mouse
gacaggctgagtgtaatgca

SEQ ID NO: 818164 - DNA, 20 bp, mouse
gccggggcggtccccagcgg

SEQ ID NO: 818165 - DNA, 20 bp, mouse
gctggaatgcaccgccgctg

SEQ ID NO: 818166 - DNA, 20 bp, mouse
gagtcccgccacattctgat

SEQ ID NO: 818167 - DNA, 20 bp, mouse
gtgcgcacgcgcctagattc

SEQ ID NO: 818168 - DNA, 20 bp, mouse
gtggagaccccgccccccga

SEQ ID NO: 818169 - DNA, 20 bp, mouse
gagcagtgagagcaggtcga

SEQ ID NO: 818170 - DNA, 20 bp, mouse
ggagacggagaaccttcggg

SEQ ID NO: 818171 - DNA, 20 bp, mouse
gagtgagagcaggtcgaggg

SEQ ID NO: 818172 - DNA, 20 bp, mouse
gcggggccgccacgccacgt

SEQ ID NO: 818173 - DNA, 20 bp, mouse
gcgcgcctagattctggaga

SEQ ID NO: 818174 - DNA, 20 bp, mouse
ggagcctcagcagtgagagc

SEQ ID NO: 818175 - DNA, 20 bp, mouse
ggctcaaacagcactctgat

SEQ ID NO: 818176 - DNA, 20 bp, mouse
gtctaggcagggaaaggcat

SEQ ID NO: 818177 - DNA, 20 bp, mouse
ggaaaggcatagggcgtgaa

SEQ ID NO: 818178 - DNA, 20 bp, mouse
gtgaagggcaagtcaagctc

SEQ ID NO: 818179 - DNA, 20 bp, mouse
ggagagcagagtggacctct

SEQ ID NO: 818180 - DNA, 20 bp, mouse
ggttgggctaatgacagaag

SEQ ID NO: 818181 - DNA, 20 bp, mouse
ggcagagtggacctctaggc

SEQ ID NO: 818182 - DNA, 20 bp, mouse
gataagagagggagccgtct

SEQ ID NO: 818183 - DNA, 20 bp, mouse
gtggcccaagagacagacca

SEQ ID NO: 818184 - DNA, 20 bp, mouse
ggtgtcaaattacagttgtg

SEQ ID NO: 818185 - DNA, 20 bp, mouse
gcccccggggttatttccac

SEQ ID NO: 818186 - DNA, 20 bp, mouse
gtacccttctgtgatggcat

SEQ ID NO: 818187 - DNA, 20 bp, mouse
gcatcagtgaggctgacagg

SEQ ID NO: 818188 - DNA, 20 bp, mouse
gtctgagaagagtgctccca

SEQ ID NO: 818189 - DNA, 20 bp, mouse
ggagatctgagagctctgaa

SEQ ID NO: 818190 - DNA, 20 bp, mouse
gtctcttctcaccctaactc

SEQ ID NO: 818191 - DNA, 20 bp, mouse
gaggcaggtactgcggggaa

SEQ ID NO: 818192 - DNA, 20 bp, mouse
ggaggctgacaggcggcctg

SEQ ID NO: 818193 - DNA, 20 bp, mouse
gaagggtagaatcctaatgg

SEQ ID NO: 818194 - DNA, 20 bp, mouse
gaaggtgtggtcagagtatt

SEQ ID NO: 818195 - DNA, 20 bp, mouse
gcaccagagcaaacaagggt

SEQ ID NO: 818196 - DNA, 20 bp, mouse
gcgggcggctcaagggtcaa

SEQ ID NO: 818197 - DNA, 20 bp, mouse
gcccgagcggcatcaacagc

SEQ ID NO: 818198 - DNA, 20 bp, mouse
gcccttgagccgcccgtgaa

SEQ ID NO: 818199 - DNA, 20 bp, mouse
gcattggttgggttcgactg

SEQ ID NO: 818200 - DNA, 20 bp, mouse
gaccccaagctccgccctgt

SEQ ID NO: 818201 - DNA, 20 bp, mouse
gcggaagccgtgatgagggg

SEQ ID NO: 818202 - DNA, 20 bp, mouse
gcgggatcgcagttctccgt

SEQ ID NO: 818203 - DNA, 20 bp, mouse
gaacggcttggatatggata

SEQ ID NO: 818204 - DNA, 20 bp, mouse
gcaggactctcattctccgt

SEQ ID NO: 818205 - DNA, 20 bp, mouse
gcacctacagggcggagctt

SEQ ID NO: 818206 - DNA, 20 bp, mouse
gaggccgtagagcaggggtc

SEQ ID NO: 818207 - DNA, 20 bp, mouse
gctccggaggccgtagagca

SEQ ID NO: 818208 - DNA, 20 bp, mouse
gacggcctccggagcataga

SEQ ID NO: 818209 - DNA, 20 bp, mouse
gcacagcgccatctatgctc

SEQ ID NO: 818210 - DNA, 20 bp, mouse
gcaaaccagactgctcatct

SEQ ID NO: 818211 - DNA, 20 bp, mouse
gccagtgcgcgttcccgccg

SEQ ID NO: 818212 - DNA, 20 bp, mouse
gcatagatggcgctgtggtg

SEQ ID NO: 818213 - DNA, 20 bp, mouse
gtcctgcagttccaatgcca

SEQ ID NO: 818214 - DNA, 20 bp, mouse
gaggggtccgggccgagccc

SEQ ID NO: 818215 - DNA, 20 bp, mouse
ggcgggaacgcgcactggtt

SEQ ID NO: 818216 - DNA, 20 bp, mouse
gcccacatgggtgtcaaagg

SEQ ID NO: 818217 - DNA, 20 bp, mouse
gttcacactaatagtctctt

SEQ ID NO: 818218 - DNA, 20 bp, mouse
gagctcacatatgcatgctt

SEQ ID NO: 818219 - DNA, 20 bp, mouse
gtaggaaatagaggatacat

SEQ ID NO: 818220 - DNA, 20 bp, mouse
gcacaaggagattgacctta

SEQ ID NO: 818221 - DNA, 20 bp, mouse
gcacccatgtgggctctagt

SEQ ID NO: 818222 - DNA, 20 bp, mouse
gaaatagaggatacatagga

SEQ ID NO: 818223 - DNA, 20 bp, mouse
gagtatcggccagtgagaga

SEQ ID NO: 818224 - DNA, 20 bp, mouse
gctaccaactagagcccaca

SEQ ID NO: 818225 - DNA, 20 bp, mouse
gtcacatatgcatgcttggg

SEQ ID NO: 818226 - DNA, 20 bp, mouse
ggaagtgggatggtcctggt

SEQ ID NO: 818227 - DNA, 20 bp, mouse
ggcttgggaggtttactctt

SEQ ID NO: 818228 - DNA, 20 bp, mouse
gtctttgtctgacaggaagt

SEQ ID NO: 818229 - DNA, 20 bp, mouse
gggatggtcctggtaggctg

SEQ ID NO: 818230 - DNA, 20 bp, mouse
ggagcaaaggccagaacttc

SEQ ID NO: 818231 - DNA, 20 bp, mouse
gcgcatctccaggacagctt

SEQ ID NO: 818232 - DNA, 20 bp, mouse
gccagagcaaagtccacaac

SEQ ID NO: 818233 - DNA, 20 bp, mouse
gcagacaaagacgcatctcc

SEQ ID NO: 818234 - DNA, 20 bp, mouse
ggatagccgcaggtgagtgg

SEQ ID NO: 818235 - DNA, 20 bp, mouse
gtatttaaccccagcctacc

SEQ ID NO: 818236 - DNA, 20 bp, mouse
ggaagcgtgtaggaggtctc

SEQ ID NO: 818237 - DNA, 20 bp, mouse
gaactagaagacaggtggag

SEQ ID NO: 818238 - DNA, 20 bp, mouse
gggcccaaggttgaggtaag

SEQ ID NO: 818239 - DNA, 20 bp, mouse
gcgggaagctgaggtagcaa

SEQ ID NO: 818240 - DNA, 20 bp, mouse
gggtcccagaagccccatga

SEQ ID NO: 818241 - DNA, 20 bp, mouse
gtgggaccggaagagtacgg

SEQ ID NO: 818242 - DNA, 20 bp, mouse
gggatgaaccttcacaataa

SEQ ID NO: 818243 - DNA, 20 bp, mouse
gcaacccatcgtctaataat

SEQ ID NO: 818244 - DNA, 20 bp, mouse
gtagacgatgggttggtatc

SEQ ID NO: 818245 - DNA, 20 bp, mouse
gtgaaggttcatcccaaact

SEQ ID NO: 818246 - DNA, 20 bp, mouse
gggagcgggtgtggtctgat

SEQ ID NO: 818247 - DNA, 20 bp, mouse
gcagcctcggaaggcggagc

SEQ ID NO: 818248 - DNA, 20 bp, mouse
gcgggtgtggtctgatgggc

SEQ ID NO: 818249 - DNA, 20 bp, mouse
gggcaggaagtgacgtgtct

SEQ ID NO: 818250 - DNA, 20 bp, mouse
ggggccgcgccgggggcaga

SEQ ID NO: 818251 - DNA, 20 bp, mouse
gaacgggctgggagtgatgg

SEQ ID NO: 818252 - DNA, 20 bp, mouse
gttacgccgcagggaaccgg

SEQ ID NO: 818253 - DNA, 20 bp, mouse
gtgccgctcccagcacgagg

SEQ ID NO: 818254 - DNA, 20 bp, mouse
gagtttacgccgcagggaac

SEQ ID NO: 818255 - DNA, 20 bp, mouse
gtgtggtgggtgttgtcctc

SEQ ID NO: 818256 - DNA, 20 bp, mouse
gccggcccccccatccgcgg

SEQ ID NO: 818257 - DNA, 20 bp, mouse
gcccgagcgaagaaaagcaa

SEQ ID NO: 818258 - DNA, 20 bp, mouse
gcccgcgagggtcttctgta

SEQ ID NO: 818259 - DNA, 20 bp, mouse
gggagagtcagacgctggag

SEQ ID NO: 818260 - DNA, 20 bp, mouse
gtaaatgcccgaaggggctg

SEQ ID NO: 818261 - DNA, 20 bp, mouse
ggcggcctaaatgcccgaag

SEQ ID NO: 818262 - DNA, 20 bp, mouse
gagggtcttctgtagggtga

SEQ ID NO: 818263 - DNA, 20 bp, mouse
gtcggcagggagagctcagg

SEQ ID NO: 818264 - DNA, 20 bp, mouse
gcccccccatccgcggaggc

SEQ ID NO: 818265 - DNA, 20 bp, mouse
gagaggaggagccccagctt

SEQ ID NO: 818266 - DNA, 20 bp, mouse
gagatgagaggggcggttcg

SEQ ID NO: 818267 - DNA, 20 bp, mouse
gacccccccaggagctacac

SEQ ID NO: 818268 - DNA, 20 bp, mouse
gaagccagtgtagctcctgg

SEQ ID NO: 818269 - DNA, 20 bp, mouse
ggcccggagaggctgactga

SEQ ID NO: 818270 - DNA, 20 bp, mouse
gtagcagccgaccctccggc

SEQ ID NO: 818271 - DNA, 20 bp, mouse
gccctcccggggtttataac

SEQ ID NO: 818272 - DNA, 20 bp, mouse
gcctgtagcagccgaccctc

SEQ ID NO: 818273 - DNA, 20 bp, mouse
gcctctcatctctctcccat

SEQ ID NO: 818274 - DNA, 20 bp, mouse
gtccggcaggtggaagccaa

SEQ ID NO: 818275 - DNA, 20 bp, mouse
gataaaccccgggaggggag

SEQ ID NO: 818276 - DNA, 20 bp, mouse
ggctgtgaaggagacagcga

SEQ ID NO: 818277 - DNA, 20 bp, mouse
gagggcgaagagggcgggac

SEQ ID NO: 818278 - DNA, 20 bp, mouse
gcgggcgcggtggctaaggg

SEQ ID NO: 818279 - DNA, 20 bp, mouse
gctaagggaggtggggcgga

SEQ ID NO: 818280 - DNA, 20 bp, mouse
gcgccctaggccaggagggt

SEQ ID NO: 818281 - DNA, 20 bp, mouse
ggcggtggctaagggaggtg

SEQ ID NO: 818282 - DNA, 20 bp, mouse
gcgccgggcggcccctgcgc

SEQ ID NO: 818283 - DNA, 20 bp, mouse
gggaggatccggggaaacta

SEQ ID NO: 818284 - DNA, 20 bp, mouse
gtgcgggcgggagggcgaag

SEQ ID NO: 818285 - DNA, 20 bp, mouse
gaaggcgccctaggccagga

SEQ ID NO: 818286 - DNA, 20 bp, mouse
gcctgatgtccttagatctc

SEQ ID NO: 818287 - DNA, 20 bp, mouse
gagaaaggcagcagccatca

SEQ ID NO: 818288 - DNA, 20 bp, mouse
gctactcattaagaccttga

SEQ ID NO: 818289 - DNA, 20 bp, mouse
gctaaaggagggcaaggctc

SEQ ID NO: 818290 - DNA, 20 bp, mouse
gtgtaataatgtaagatgcc

SEQ ID NO: 818291 - DNA, 20 bp, mouse
gtcattttatacctgtagcc

SEQ ID NO: 818292 - DNA, 20 bp, mouse
gtatgattggccctaaagga

SEQ ID NO: 818293 - DNA, 20 bp, mouse
ggggccaatcataataacta

SEQ ID NO: 818294 - DNA, 20 bp, mouse
gatgaggattgactatgatg

SEQ ID NO: 818295 - DNA, 20 bp, mouse
gtgaccttagttattatgat

SEQ ID NO: 818296 - DNA, 20 bp, mouse
gattgggaataattggaata

SEQ ID NO: 818297 - DNA, 20 bp, mouse
gatgtataaggagccacatg

SEQ ID NO: 818298 - DNA, 20 bp, mouse
gttattcccaattatctatt

SEQ ID NO: 818299 - DNA, 20 bp, mouse
gtgcaagtaactaggagaga

SEQ ID NO: 818300 - DNA, 20 bp, mouse
gtataaggagccacatgtgg

SEQ ID NO: 818301 - DNA, 20 bp, mouse
gtacctagctgcaagtaact

SEQ ID NO: 818302 - DNA, 20 bp, mouse
gtaaattttaactttatgtg

SEQ ID NO: 818303 - DNA, 20 bp, mouse
ggtaagaataaaaatgtata

SEQ ID NO: 818304 - DNA, 20 bp, mouse
gacaacaaaaaaaatgtaca

SEQ ID NO: 818305 - DNA, 20 bp, mouse
gaagaacccaatagataatt

SEQ ID NO: 818306 - DNA, 20 bp, mouse
gggtggagcaggcacatgca

SEQ ID NO: 818307 - DNA, 20 bp, mouse
gcaggctagggagggctcgt

SEQ ID NO: 818308 - DNA, 20 bp, mouse
ggatttgctcaaactctgaa

SEQ ID NO: 818309 - DNA, 20 bp, mouse
gaggaataacacagcagcat

SEQ ID NO: 818310 - DNA, 20 bp, mouse
ggggttctgtgagctgactg

SEQ ID NO: 818311 - DNA, 20 bp, mouse
gcctgagcacccagtgtact

SEQ ID NO: 818312 - DNA, 20 bp, mouse
ggcaaggaccagaagctctg

SEQ ID NO: 818313 - DNA, 20 bp, mouse
ggttagattccgagtacact

SEQ ID NO: 818314 - DNA, 20 bp, mouse
gcatgtgcctgctccacctt

SEQ ID NO: 818315 - DNA, 20 bp, mouse
gctgccaccactagtcactg

SEQ ID NO: 818316 - DNA, 20 bp, mouse
gtggccctaaaaaagggcta

SEQ ID NO: 818317 - DNA, 20 bp, mouse
gcaaccctagccctttttta

SEQ ID NO: 818318 - DNA, 20 bp, mouse
gagggccaatctaactacta

SEQ ID NO: 818319 - DNA, 20 bp, mouse
gttagattggccctaaaaaa

SEQ ID NO: 818320 - DNA, 20 bp, mouse
gctgaccttagtagttagat

SEQ ID NO: 818321 - DNA, 20 bp, mouse
gtgtaataatgtaagacggc

SEQ ID NO: 818322 - DNA, 20 bp, mouse
gctcattaagctttatgttt

SEQ ID NO: 818323 - DNA, 20 bp, mouse
gctttatgttttggtgttcg

SEQ ID NO: 818324 - DNA, 20 bp, mouse
gaggatgtgttgatatcctt

SEQ ID NO: 818325 - DNA, 20 bp, mouse
gaacctaggtcttaatgaga

SEQ ID NO: 818326 - DNA, 20 bp, mouse
gtgctgttattatttttgct

SEQ ID NO: 818327 - DNA, 20 bp, mouse
gaaggtgtgcgccaacacac

SEQ ID NO: 818328 - DNA, 20 bp, mouse
gtggttaattgggaataatt

SEQ ID NO: 818329 - DNA, 20 bp, mouse
gaatggagaaaagaacccag

SEQ ID NO: 818330 - DNA, 20 bp, mouse
gaagaacccagtggttaatt

SEQ ID NO: 818331 - DNA, 20 bp, mouse
gattgggaataattgggata

SEQ ID NO: 818332 - DNA, 20 bp, mouse
gtaatcatttatatatttcc

SEQ ID NO: 818333 - DNA, 20 bp, mouse
gcatttatatatttcctggt

SEQ ID NO: 818334 - DNA, 20 bp, mouse
gttattcccaattaaccact

SEQ ID NO: 818335 - DNA, 20 bp, mouse
gctgcctcggcctcccgagt

SEQ ID NO: 818336 - DNA, 20 bp, mouse
gttgcgagataggggagtgc

SEQ ID NO: 818337 - DNA, 20 bp, mouse
ggcagagtctgggtaaactg

SEQ ID NO: 818338 - DNA, 20 bp, mouse
gggcccggggcggagcaccc

SEQ ID NO: 818339 - DNA, 20 bp, mouse
gccagccgccggggcctgtg

SEQ ID NO: 818340 - DNA, 20 bp, mouse
gccgccctgcaaagcagacg

SEQ ID NO: 818341 - DNA, 20 bp, mouse
gacccaggcggggtgggccg

SEQ ID NO: 818342 - DNA, 20 bp, mouse
ggcggagcacccaggcgggg

SEQ ID NO: 818343 - DNA, 20 bp, mouse
gcaaagcagacgaggtcttc

SEQ ID NO: 818344 - DNA, 20 bp, mouse
ggctctgtttctgggcggat

SEQ ID NO: 818345 - DNA, 20 bp, mouse
gccgccccgggcccgcccac

SEQ ID NO: 818346 - DNA, 20 bp, mouse
ggggctgtggctgaagaagg

SEQ ID NO: 818347 - DNA, 20 bp, mouse
gtggctgaagaaggcggatc

SEQ ID NO: 818348 - DNA, 20 bp, mouse
gaagaccgcccggggtgatt

SEQ ID NO: 818349 - DNA, 20 bp, mouse
ggcccggggtgattgggctg

SEQ ID NO: 818350 - DNA, 20 bp, mouse
gtgaagaaggcggatcaggg

SEQ ID NO: 818351 - DNA, 20 bp, mouse
gaaggggaggagctgttttg

SEQ ID NO: 818352 - DNA, 20 bp, mouse
gctcgcgcagcaatggctca

SEQ ID NO: 818353 - DNA, 20 bp, mouse
gaaggcggatcagggcgggt

SEQ ID NO: 818354 - DNA, 20 bp, mouse
ggagcggctgtcaaaacctt

SEQ ID NO: 818355 - DNA, 20 bp, mouse
gcacctgggagttccctaaa

SEQ ID NO: 818356 - DNA, 20 bp, mouse
ggaggtgcgcacggcgtctg

SEQ ID NO: 818357 - DNA, 20 bp, mouse
ggcccccagcatgtcacgtg

SEQ ID NO: 818358 - DNA, 20 bp, mouse
gctgctgggtggccatggca

SEQ ID NO: 818359 - DNA, 20 bp, mouse
gaccgcacgtgacatgctgg

SEQ ID NO: 818360 - DNA, 20 bp, mouse
ggggacctgagtgagttcgt

SEQ ID NO: 818361 - DNA, 20 bp, mouse
ggcaaccgcacgtgacatgc

SEQ ID NO: 818362 - DNA, 20 bp, mouse
gacaccgcggcagggggctg

SEQ ID NO: 818363 - DNA, 20 bp, mouse
gatgctgggggcttcgactt

SEQ ID NO: 818364 - DNA, 20 bp, mouse
gtcagcttcaggggcggctc

SEQ ID NO: 818365 - DNA, 20 bp, mouse
gcgcacggcgtctggggcga

SEQ ID NO: 818366 - DNA, 20 bp, mouse
gggggcgaggtcccaacgga

SEQ ID NO: 818367 - DNA, 20 bp, mouse
gtcccaataggcaacctcct

SEQ ID NO: 818368 - DNA, 20 bp, mouse
gaacacttgggcggtctctg

SEQ ID NO: 818369 - DNA, 20 bp, mouse
ggggaccggaacctcccaat

SEQ ID NO: 818370 - DNA, 20 bp, mouse
gcctaggcgcggaggagggt

SEQ ID NO: 818371 - DNA, 20 bp, mouse
gggcagagcaaacacttggg

SEQ ID NO: 818372 - DNA, 20 bp, mouse
gggccagagcagctcgcggg

SEQ ID NO: 818373 - DNA, 20 bp, mouse
gaggcggggtcagcggaatg

SEQ ID NO: 818374 - DNA, 20 bp, mouse
gggagacgcaggatccgccc

SEQ ID NO: 818375 - DNA, 20 bp, mouse
ggggaagtggggcaggcctt

SEQ ID NO: 818376 - DNA, 20 bp, mouse
ggtgccacgcccccttagtt

SEQ ID NO: 818377 - DNA, 20 bp, mouse
gcactgacacagaaatagcc

SEQ ID NO: 818378 - DNA, 20 bp, mouse
gctgaaatacagaagacaac

SEQ ID NO: 818379 - DNA, 20 bp, mouse
gagtttggcgggaatccgag

SEQ ID NO: 818380 - DNA, 20 bp, mouse
gcctggctatcttgaacctc

SEQ ID NO: 818381 - DNA, 20 bp, mouse
gatccgagaggatcaaagta

SEQ ID NO: 818382 - DNA, 20 bp, mouse
gtagaaagaggttgttgccc

SEQ ID NO: 818383 - DNA, 20 bp, mouse
gagtcccattttaattctcc

SEQ ID NO: 818384 - DNA, 20 bp, mouse
gggattcccgccaaactaag

SEQ ID NO: 818385 - DNA, 20 bp, mouse
gccaacacctggtttattgg

SEQ ID NO: 818386 - DNA, 20 bp, mouse
gcaaggccgaccaacgctaa

SEQ ID NO: 818387 - DNA, 20 bp, mouse
gacgcgggataaactgtaga

SEQ ID NO: 818388 - DNA, 20 bp, mouse
ggggcggcgccagacctgga

SEQ ID NO: 818389 - DNA, 20 bp, mouse
ggccgaccaacgctaagggt

SEQ ID NO: 818390 - DNA, 20 bp, mouse
ggggctgatagcagaagggg

SEQ ID NO: 818391 - DNA, 20 bp, mouse
gggtccagggaccagtaagt

SEQ ID NO: 818392 - DNA, 20 bp, mouse
gggtccctggaccagttgct

SEQ ID NO: 818393 - DNA, 20 bp, mouse
gccacacccagcatgccgga

SEQ ID NO: 818394 - DNA, 20 bp, mouse
gagggggctgatagcagaag

SEQ ID NO: 818395 - DNA, 20 bp, mouse
ggcgctctggctgcccctcc

SEQ ID NO: 818396 - DNA, 20 bp, mouse
gtcagggaaggaaacaatac

SEQ ID NO: 818397 - DNA, 20 bp, mouse
gctaaatggccctgtcaggt

SEQ ID NO: 818398 - DNA, 20 bp, mouse
gtaggcgctcctggggttca

SEQ ID NO: 818399 - DNA, 20 bp, mouse
ggaaggaaacaatacggggt

SEQ ID NO: 818400 - DNA, 20 bp, mouse
gtgagacccgcaggccctag

SEQ ID NO: 818401 - DNA, 20 bp, mouse
gccaggagcgcctacctgac

SEQ ID NO: 818402 - DNA, 20 bp, mouse
ggtactccaaggtgatagat

SEQ ID NO: 818403 - DNA, 20 bp, mouse
ggacccgcaggccctagggg

SEQ ID NO: 818404 - DNA, 20 bp, mouse
gtgacagggccatttagcag

SEQ ID NO: 818405 - DNA, 20 bp, mouse
gcagaagaactcgtgctcag

SEQ ID NO: 818406 - DNA, 20 bp, mouse
ggggacgcaccagtgagcgc

SEQ ID NO: 818407 - DNA, 20 bp, mouse
gagggcgtgcgcttgattgg

SEQ ID NO: 818408 - DNA, 20 bp, mouse
ggagcgctggaatagcttgt

SEQ ID NO: 818409 - DNA, 20 bp, mouse
ggcaccttgcaacacagatg

SEQ ID NO: 818410 - DNA, 20 bp, mouse
gcgccctgctgggcaagaga

SEQ ID NO: 818411 - DNA, 20 bp, mouse
ggcgtgcgcttgattggagg

SEQ ID NO: 818412 - DNA, 20 bp, mouse
gcaaaatgataggatcttcg

SEQ ID NO: 818413 - DNA, 20 bp, mouse
gggagaagacagtaagtcga

SEQ ID NO: 818414 - DNA, 20 bp, mouse
gtgcagagctgcaacacgga

SEQ ID NO: 818415 - DNA, 20 bp, mouse
gtacttaggagcaaaatgat

SEQ ID NO: 818416 - DNA, 20 bp, mouse
gctcctcaagaagattagga

SEQ ID NO: 818417 - DNA, 20 bp, mouse
gtctgaaaggcttgaccgtg

SEQ ID NO: 818418 - DNA, 20 bp, mouse
gggctcagatatcagcctgg

SEQ ID NO: 818419 - DNA, 20 bp, mouse
gttctctcacagttactgag

SEQ ID NO: 818420 - DNA, 20 bp, mouse
gcttgaccgtgtggaaagca

SEQ ID NO: 818421 - DNA, 20 bp, mouse
gcagcctcctcaagaagatt

SEQ ID NO: 818422 - DNA, 20 bp, mouse
gagataacgtagccacctcc

SEQ ID NO: 818423 - DNA, 20 bp, mouse
gatctagaggacagaaaatg

SEQ ID NO: 818424 - DNA, 20 bp, mouse
gtgccctcctaatcttcttg

SEQ ID NO: 818425 - DNA, 20 bp, mouse
ggctcctggctcgggctaga

SEQ ID NO: 818426 - DNA, 20 bp, mouse
gtccttctgtgttaatctag

SEQ ID NO: 818427 - DNA, 20 bp, mouse
gatggtttgtattattttat

SEQ ID NO: 818428 - DNA, 20 bp, mouse
gggttattcctttagaattc

SEQ ID NO: 818429 - DNA, 20 bp, mouse
gcagaaatgaaaaacatgca

SEQ ID NO: 818430 - DNA, 20 bp, mouse
ggaattctgggggatctgat

SEQ ID NO: 818431 - DNA, 20 bp, mouse
gagcagagggtccccaatag

SEQ ID NO: 818432 - DNA, 20 bp, mouse
gagatcccccagaattctaa

SEQ ID NO: 818433 - DNA, 20 bp, mouse
gaggattgatagagttgaaa

SEQ ID NO: 818434 - DNA, 20 bp, mouse
gtattcctttagaattctgg

SEQ ID NO: 818435 - DNA, 20 bp, mouse
gtaccattgaactgagcaga

SEQ ID NO: 818436 - DNA, 20 bp, mouse
gtttgaggggtggaagacta

SEQ ID NO: 818437 - DNA, 20 bp, mouse
ggtttcagataaatacaggg

SEQ ID NO: 818438 - DNA, 20 bp, mouse
gactcaagatattaacaaca

SEQ ID NO: 818439 - DNA, 20 bp, mouse
gatgaaataccatgagatta

SEQ ID NO: 818440 - DNA, 20 bp, mouse
gcaatggaatcaaaataaag

SEQ ID NO: 818441 - DNA, 20 bp, mouse
gttattctcattgttctagt

SEQ ID NO: 818442 - DNA, 20 bp, mouse
ggcaataaagaaacacaagt

SEQ ID NO: 818443 - DNA, 20 bp, mouse
gtgtacagtgagtcaaaatg

SEQ ID NO: 818444 - DNA, 20 bp, mouse
gtgaatatactcagtcacta

SEQ ID NO: 818445 - DNA, 20 bp, mouse
gtgtgtgaatgtatggggag

SEQ ID NO: 818446 - DNA, 20 bp, mouse
ggggccgacccgcctcttag

SEQ ID NO: 818447 - DNA, 20 bp, mouse
gacccagcgcttcaagttcg

SEQ ID NO: 818448 - DNA, 20 bp, mouse
gacttgaagcgctgggtgtg

SEQ ID NO: 818449 - DNA, 20 bp, mouse
gctcgctaatggtggaatcg

SEQ ID NO: 818450 - DNA, 20 bp, mouse
ggggccgcgggcaagcgacc

SEQ ID NO: 818451 - DNA, 20 bp, mouse
gccctggcatgcgtcaccaa

SEQ ID NO: 818452 - DNA, 20 bp, mouse
gctaacggatggcgaatggc

SEQ ID NO: 818453 - DNA, 20 bp, mouse
gagccccgaacttgaagcgc

SEQ ID NO: 818454 - DNA, 20 bp, mouse
ggggtgtgaggcctcgctaa

SEQ ID NO: 818455 - DNA, 20 bp, mouse
gcaagcgacccggggcgcgg

SEQ ID NO: 818456 - DNA, 20 bp, mouse
ggggctgtcaggaccgctca

SEQ ID NO: 818457 - DNA, 20 bp, mouse
gcaacatgcctgtacagtga

SEQ ID NO: 818458 - DNA, 20 bp, mouse
gctccagcccctcactgtac

SEQ ID NO: 818459 - DNA, 20 bp, mouse
gtgcctgtacagtgaggggc

SEQ ID NO: 818460 - DNA, 20 bp, mouse
gtcctggtgaagcccacccg

SEQ ID NO: 818461 - DNA, 20 bp, mouse
gtgaggggctggagtctttt

SEQ ID NO: 818462 - DNA, 20 bp, mouse
gcccaatgggaccagagcag

SEQ ID NO: 818463 - DNA, 20 bp, mouse
gcaggctctaagccaaagtc

SEQ ID NO: 818464 - DNA, 20 bp, mouse
ggcccctgctctggtcccat

SEQ ID NO: 818465 - DNA, 20 bp, mouse
ggcgtgtctcaacagagaat

SEQ ID NO: 818466 - DNA, 20 bp, mouse
gcgggaaggacggtgatctc

SEQ ID NO: 818467 - DNA, 20 bp, mouse
gacgctgctgcgtccctctc

SEQ ID NO: 818468 - DNA, 20 bp, mouse
gccacctgtcagatcttcgg

SEQ ID NO: 818469 - DNA, 20 bp, mouse
ggatctcaggaaagatgtta

SEQ ID NO: 818470 - DNA, 20 bp, mouse
gatgccacctgtcagatctt

SEQ ID NO: 818471 - DNA, 20 bp, mouse
gtggccagagcacttcggga

SEQ ID NO: 818472 - DNA, 20 bp, mouse
gaaagtagctgctgaggggt

SEQ ID NO: 818473 - DNA, 20 bp, mouse
gcaggggcgcatttggaacg

SEQ ID NO: 818474 - DNA, 20 bp, mouse
ggggctcagaaggtggtaac

SEQ ID NO: 818475 - DNA, 20 bp, mouse
gcgaagcccgggcctcttga

SEQ ID NO: 818476 - DNA, 20 bp, mouse
gcgacccggccagtccccag

SEQ ID NO: 818477 - DNA, 20 bp, mouse
ggggactggccgggtcggtg

SEQ ID NO: 818478 - DNA, 20 bp, mouse
ggggcggggtgtcctggaat

SEQ ID NO: 818479 - DNA, 20 bp, mouse
gcccagtcctggggctctag

SEQ ID NO: 818480 - DNA, 20 bp, mouse
gccctggggtcaagcgtgta

SEQ ID NO: 818481 - DNA, 20 bp, mouse
gtcactcagcgcccagtcct

SEQ ID NO: 818482 - DNA, 20 bp, mouse
gcaggcatcccgcaccgacc

SEQ ID NO: 818483 - DNA, 20 bp, mouse
gccccaggggcggggtgtcc

SEQ ID NO: 818484 - DNA, 20 bp, mouse
gggcgctgagtgaggaggcg

SEQ ID NO: 818485 - DNA, 20 bp, mouse
ggactgggcgctgagtgagg

SEQ ID NO: 818486 - DNA, 20 bp, mouse
gagaacacgcccaggtgggc

SEQ ID NO: 818487 - DNA, 20 bp, mouse
ggcggggcctcgcgaaagcg

SEQ ID NO: 818488 - DNA, 20 bp, mouse
gcaggactacgaatgcccat

SEQ ID NO: 818489 - DNA, 20 bp, mouse
gaggaagaacacgcccaggt

SEQ ID NO: 818490 - DNA, 20 bp, mouse
gcaacgccgcgcgacacttc

SEQ ID NO: 818491 - DNA, 20 bp, mouse
ggtttcgcgaacgtacacac

SEQ ID NO: 818492 - DNA, 20 bp, mouse
gctgtcatgccataccagta

SEQ ID NO: 818493 - DNA, 20 bp, mouse
gcgacacttccgctccgtta

SEQ ID NO: 818494 - DNA, 20 bp, mouse
gcgctccgttagggtctaaa

SEQ ID NO: 818495 - DNA, 20 bp, mouse
gtgtacgttcgcgaaaccga

SEQ ID NO: 818496 - DNA, 20 bp, mouse
gagcaagagggaaaggtctc

SEQ ID NO: 818497 - DNA, 20 bp, mouse
gaagagggaaaggtctctgg

SEQ ID NO: 818498 - DNA, 20 bp, mouse
ggtggatgaggtattgggga

SEQ ID NO: 818499 - DNA, 20 bp, mouse
gctctggtggatgaggtatt

SEQ ID NO: 818500 - DNA, 20 bp, mouse
gagagttccacgggtcgctg

SEQ ID NO: 818501 - DNA, 20 bp, mouse
gagaggcaaccgtgtggttg

SEQ ID NO: 818502 - DNA, 20 bp, mouse
gtatacctcggggcagcaag

SEQ ID NO: 818503 - DNA, 20 bp, mouse
gacagttaatggcccttgga

SEQ ID NO: 818504 - DNA, 20 bp, mouse
gcatctttgcagccctccaa

SEQ ID NO: 818505 - DNA, 20 bp, mouse
gactcgctaaaagagttcca

SEQ ID NO: 818506 - DNA, 20 bp, mouse
ggccacaccactattgtctc

SEQ ID NO: 818507 - DNA, 20 bp, mouse
ggggagtccttccaatggag

SEQ ID NO: 818508 - DNA, 20 bp, mouse
gctggtacagactgagagag

SEQ ID NO: 818509 - DNA, 20 bp, mouse
gagaaaggccaaatctggat

SEQ ID NO: 818510 - DNA, 20 bp, mouse
gccagctagaagcacttctg

SEQ ID NO: 818511 - DNA, 20 bp, mouse
ggaggggggagtccttccaa

SEQ ID NO: 818512 - DNA, 20 bp, mouse
gctctcagtctgtaccaggc

SEQ ID NO: 818513 - DNA, 20 bp, mouse
ggccagagacaatagtggtg

SEQ ID NO: 818514 - DNA, 20 bp, mouse
gactgagctattggttccaa

SEQ ID NO: 818515 - DNA, 20 bp, mouse
gggaaaatggaaagaattcc

SEQ ID NO: 818516 - DNA, 20 bp, mouse
ggcgcgcgcaagggggtctg

SEQ ID NO: 818517 - DNA, 20 bp, mouse
gtgtcctgggcgcgcgcaag

SEQ ID NO: 818518 - DNA, 20 bp, mouse
gtgtgtgtcgtctacgtgtg

SEQ ID NO: 818519 - DNA, 20 bp, mouse
gcacgcgcgcacggttcttg

SEQ ID NO: 818520 - DNA, 20 bp, mouse
gcgcggaccgcgcttgtcct

SEQ ID NO: 818521 - DNA, 20 bp, mouse
gtccgcgtagcgccgtgctc

SEQ ID NO: 818522 - DNA, 20 bp, mouse
ggtcgcacaagcaaatcagt

SEQ ID NO: 818523 - DNA, 20 bp, mouse
gcgggcgcgcgcagctcggg

SEQ ID NO: 818524 - DNA, 20 bp, mouse
gcacggtggtgtctgtttca

SEQ ID NO: 818525 - DNA, 20 bp, mouse
gtgcttgtgcgacgatttgg

SEQ ID NO: 818526 - DNA, 20 bp, mouse
gcgcctggggcgccagagga

SEQ ID NO: 818527 - DNA, 20 bp, mouse
ggcctcgcggcaccgagaag

SEQ ID NO: 818528 - DNA, 20 bp, mouse
gggcggggcggggttgcggt

SEQ ID NO: 818529 - DNA, 20 bp, mouse
gcacaagcccgccccctcgc

SEQ ID NO: 818530 - DNA, 20 bp, mouse
ggccactcgtcggctcctgg

SEQ ID NO: 818531 - DNA, 20 bp, mouse
gcggctgcggccccaggacc

SEQ ID NO: 818532 - DNA, 20 bp, mouse
gcaccgagaaggggagaccg

SEQ ID NO: 818533 - DNA, 20 bp, mouse
gccgccgggcggtgtagttc

SEQ ID NO: 818534 - DNA, 20 bp, mouse
gcctgcgcctggggcgccag

SEQ ID NO: 818535 - DNA, 20 bp, mouse
gctacaccgcccggcggcgc

SEQ ID NO: 818536 - DNA, 20 bp, mouse
gtgagggcccagctctggag

SEQ ID NO: 818537 - DNA, 20 bp, mouse
gctctggagaggagttggga

SEQ ID NO: 818538 - DNA, 20 bp, mouse
ggatgaacgagacctttgta

SEQ ID NO: 818539 - DNA, 20 bp, mouse
gctccaccactgtgtcagga

SEQ ID NO: 818540 - DNA, 20 bp, mouse
gagcaggactataaatggac

SEQ ID NO: 818541 - DNA, 20 bp, mouse
gtgacagctgaagggtccca

SEQ ID NO: 818542 - DNA, 20 bp, mouse
gccaactcctctccagagct

SEQ ID NO: 818543 - DNA, 20 bp, mouse
gcacggggagacactagggt

SEQ ID NO: 818544 - DNA, 20 bp, mouse
ggctgggagtatctttaagt

SEQ ID NO: 818545 - DNA, 20 bp, mouse
ggacacagtggtggaggggg

SEQ ID NO: 818546 - DNA, 20 bp, mouse
gctgcgctgcccggtgagga

SEQ ID NO: 818547 - DNA, 20 bp, mouse
gtcggcgctctgctcggggc

SEQ ID NO: 818548 - DNA, 20 bp, mouse
gcaccacccgggatcttagt

SEQ ID NO: 818549 - DNA, 20 bp, mouse
gcggggcgggtgctgtgccc

SEQ ID NO: 818550 - DNA, 20 bp, mouse
gtccccactaagatcccggg

SEQ ID NO: 818551 - DNA, 20 bp, mouse
gttagtggggacgctgtctg

SEQ ID NO: 818552 - DNA, 20 bp, mouse
ggggcacgcgcgtcacggga

SEQ ID NO: 818553 - DNA, 20 bp, mouse
gcaggctgcgctgcccggtg

SEQ ID NO: 818554 - DNA, 20 bp, mouse
gggaactcggcgctctgctc

SEQ ID NO: 818555 - DNA, 20 bp, mouse
gagagcgccgagttccttga

SEQ ID NO: 818556 - DNA, 20 bp, mouse
gggtaagagcccatgagtgg

SEQ ID NO: 818557 - DNA, 20 bp, mouse
gactacagctcgggatgggg

SEQ ID NO: 818558 - DNA, 20 bp, mouse
gtgtgtagcaaagactgatc

SEQ ID NO: 818559 - DNA, 20 bp, mouse
gacctactacagctcgggat

SEQ ID NO: 818560 - DNA, 20 bp, mouse
gtgcgcttgcgtacaccagg

SEQ ID NO: 818561 - DNA, 20 bp, mouse
ggtacgcaagcgcaggacgc

SEQ ID NO: 818562 - DNA, 20 bp, mouse
gggggcggagacgagcgcgc

SEQ ID NO: 818563 - DNA, 20 bp, mouse
gaggaggacctactacagct

SEQ ID NO: 818564 - DNA, 20 bp, mouse
ggcttgcgtacaccaggggg

SEQ ID NO: 818565 - DNA, 20 bp, mouse
ggcgcggaataaaatacagg

SEQ ID NO: 818566 - DNA, 20 bp, mouse
gacgccgatagccaccgcat

SEQ ID NO: 818567 - DNA, 20 bp, mouse
gcgcaccgcgctcacgctgg

SEQ ID NO: 818568 - DNA, 20 bp, mouse
ggaccccggcagagaagctc

SEQ ID NO: 818569 - DNA, 20 bp, mouse
gtgccgcgcggtagccaatg

SEQ ID NO: 818570 - DNA, 20 bp, mouse
gagcgtgagcgcggtgcgag

SEQ ID NO: 818571 - DNA, 20 bp, mouse
gacgctctcccgatcgacag

SEQ ID NO: 818572 - DNA, 20 bp, mouse
ggtaaggagacgaccctgag

SEQ ID NO: 818573 - DNA, 20 bp, mouse
ggtgagcgcggtgcgagggg

SEQ ID NO: 818574 - DNA, 20 bp, mouse
gtaggcctcgaacccggcct

SEQ ID NO: 818575 - DNA, 20 bp, mouse
gcttctctgccggggtcccg

SEQ ID NO: 818576 - DNA, 20 bp, mouse
gacggctgatggagtagctc

SEQ ID NO: 818577 - DNA, 20 bp, mouse
gcccagggcggggtaaggtg

SEQ ID NO: 818578 - DNA, 20 bp, mouse
gggatggacagcatgaatga

SEQ ID NO: 818579 - DNA, 20 bp, mouse
gtggggaagggagcgctcgc

SEQ ID NO: 818580 - DNA, 20 bp, mouse
gcacgtcccagggcggggta

SEQ ID NO: 818581 - DNA, 20 bp, mouse
gcctcccgggacggggtcaa

SEQ ID NO: 818582 - DNA, 20 bp, mouse
gacagtgggaagagcaacta

SEQ ID NO: 818583 - DNA, 20 bp, mouse
ggacggggtcaagggtcaga

SEQ ID NO: 818584 - DNA, 20 bp, mouse
gaattgctagccacgtccca

SEQ ID NO: 818585 - DNA, 20 bp, mouse
gggtgtcttggttgcttgat

SEQ ID NO: 818586 - DNA, 20 bp, mouse
gtggcgctgagattccgctt

SEQ ID NO: 818587 - DNA, 20 bp, mouse
gaagccgcgcggtccggtcc

SEQ ID NO: 818588 - DNA, 20 bp, mouse
gccgcgcggtccggtccggg

SEQ ID NO: 818589 - DNA, 20 bp, mouse
gcggagactgagaccggagc

SEQ ID NO: 818590 - DNA, 20 bp, mouse
ggggcaccgcgctcgtcgtg

SEQ ID NO: 818591 - DNA, 20 bp, mouse
gagaccggagcaggtgcgcc

SEQ ID NO: 818592 - DNA, 20 bp, mouse
gcgcggccggagactgagac

SEQ ID NO: 818593 - DNA, 20 bp, mouse
gggtccgggaggagcccaag

SEQ ID NO: 818594 - DNA, 20 bp, mouse
gtggtcacgcccctttgtca

SEQ ID NO: 818595 - DNA, 20 bp, mouse
ggaatctcagcgccacgcgg

SEQ ID NO: 818596 - DNA, 20 bp, mouse
gctggaacagctgtgaatag

SEQ ID NO: 818597 - DNA, 20 bp, mouse
gaaggcgcctccccgcccag

SEQ ID NO: 818598 - DNA, 20 bp, mouse
gtgcgcggtcccagtccgga

SEQ ID NO: 818599 - DNA, 20 bp, mouse
ggggctgcgcggtcccagtc

SEQ ID NO: 818600 - DNA, 20 bp, mouse
ggcagtgcctggcaaggcga

SEQ ID NO: 818601 - DNA, 20 bp, mouse
gtggcaaggcgagggcggga

SEQ ID NO: 818602 - DNA, 20 bp, mouse
gctagaaaaagcaacggaga

SEQ ID NO: 818603 - DNA, 20 bp, mouse
gccgcccagaggagctcagt

SEQ ID NO: 818604 - DNA, 20 bp, mouse
ggaagggcggccctccggac

SEQ ID NO: 818605 - DNA, 20 bp, mouse
ggctcatggcatttcagtgg

SEQ ID NO: 818606 - DNA, 20 bp, mouse
gacgcccaggacaggtgcgc

SEQ ID NO: 818607 - DNA, 20 bp, mouse
ggaacccgccgcgtggtcgg

SEQ ID NO: 818608 - DNA, 20 bp, mouse
gcggccggcaggtgcgagaa

SEQ ID NO: 818609 - DNA, 20 bp, mouse
ggggccagcggagtcccgtg

SEQ ID NO: 818610 - DNA, 20 bp, mouse
gccgcccgcgcacctgtcct

SEQ ID NO: 818611 - DNA, 20 bp, mouse
gggcaggtgcgagaagggtc

SEQ ID NO: 818612 - DNA, 20 bp, mouse
ggcgaagccacgcccaggac

SEQ ID NO: 818613 - DNA, 20 bp, mouse
gaaccagcgcggagcacggc

SEQ ID NO: 818614 - DNA, 20 bp, mouse
gtcggtgcgtgaccatgacg

SEQ ID NO: 818615 - DNA, 20 bp, mouse
gacaccgccgaccacgcggc

SEQ ID NO: 818616 - DNA, 20 bp, mouse
gctcccggggagaatctgta

SEQ ID NO: 818617 - DNA, 20 bp, mouse
gggagaatctgtagggttaa

SEQ ID NO: 818618 - DNA, 20 bp, mouse
gccacgcaggcggagatcct

SEQ ID NO: 818619 - DNA, 20 bp, mouse
gaaccctacagattctcccc

SEQ ID NO: 818620 - DNA, 20 bp, mouse
gggagccaatcgccgcggag

SEQ ID NO: 818621 - DNA, 20 bp, mouse
gccactggagccaatcgccg

SEQ ID NO: 818622 - DNA, 20 bp, mouse
gtgccttcagggatgatagt

SEQ ID NO: 818623 - DNA, 20 bp, mouse
gagttggaagaactcctccc

SEQ ID NO: 818624 - DNA, 20 bp, mouse
gcgcaggcgcacaagtcctc

SEQ ID NO: 818625 - DNA, 20 bp, mouse
gcggcgccctgcgactgcgc

SEQ ID NO: 818626 - DNA, 20 bp, mouse
ggggcggggaggaagtgtga

SEQ ID NO: 818627 - DNA, 20 bp, mouse
ggaacggccatctttgatga

SEQ ID NO: 818628 - DNA, 20 bp, mouse
gtcccaagacggtgctaaaa

SEQ ID NO: 818629 - DNA, 20 bp, mouse
gcggagggaggaaggtggct

SEQ ID NO: 818630 - DNA, 20 bp, mouse
gggttgctgcaaagcgctca

SEQ ID NO: 818631 - DNA, 20 bp, mouse
gcacacgtaagcaaacgcat

SEQ ID NO: 818632 - DNA, 20 bp, mouse
gtcaagcgctccgcacctcc

SEQ ID NO: 818633 - DNA, 20 bp, mouse
gggctcctcgaggggcgggg

SEQ ID NO: 818634 - DNA, 20 bp, mouse
gttaatagccggctcctcga

SEQ ID NO: 818635 - DNA, 20 bp, mouse
gtaaaagctgctgacgtcaa

SEQ ID NO: 818636 - DNA, 20 bp, mouse
gccctcccccgcactgggtg

SEQ ID NO: 818637 - DNA, 20 bp, mouse
gcctgcgcagtaaggaccgg

SEQ ID NO: 818638 - DNA, 20 bp, mouse
gggggcgtgcgctgtgatgg

SEQ ID NO: 818639 - DNA, 20 bp, mouse
gcaggccccacccagtgcgg

SEQ ID NO: 818640 - DNA, 20 bp, mouse
ggaggagtcaggtggtcagg

SEQ ID NO: 818641 - DNA, 20 bp, mouse
ggaccaggccccacccagtg

SEQ ID NO: 818642 - DNA, 20 bp, mouse
ggcggctcggggtccagctc

SEQ ID NO: 818643 - DNA, 20 bp, mouse
gacagcgcacgccccggcgc

SEQ ID NO: 818644 - DNA, 20 bp, mouse
ggcgcctgcgcagtaaggac

SEQ ID NO: 818645 - DNA, 20 bp, mouse
gtccagagccaacccggcgg

SEQ ID NO: 818646 - DNA, 20 bp, mouse
gcaccccaaatagggaccgg

SEQ ID NO: 818647 - DNA, 20 bp, mouse
gccaaggcccgcgttcctgc

SEQ ID NO: 818648 - DNA, 20 bp, mouse
gaaaccccctaaaatcagct

SEQ ID NO: 818649 - DNA, 20 bp, mouse
gtctcgctacaccccaaata

SEQ ID NO: 818650 - DNA, 20 bp, mouse
ggctagggactgggtctcgg

SEQ ID NO: 818651 - DNA, 20 bp, mouse
gtgaccccagaggcccagtc

SEQ ID NO: 818652 - DNA, 20 bp, mouse
gtcagcctccggtccctatt

SEQ ID NO: 818653 - DNA, 20 bp, mouse
gttggggtgtagcgagaagc

SEQ ID NO: 818654 - DNA, 20 bp, mouse
gcctctggggtcaggtttcc

SEQ ID NO: 818655 - DNA, 20 bp, mouse
gcgtacaagcgctcgccgag

SEQ ID NO: 818656 - DNA, 20 bp, mouse
gcatccctggcgggcgacgg

SEQ ID NO: 818657 - DNA, 20 bp, mouse
gcgcacgcgagcatccctgg

SEQ ID NO: 818658 - DNA, 20 bp, mouse
gaaagccgcggctccgaggg

SEQ ID NO: 818659 - DNA, 20 bp, mouse
gcgagcaggagcgacaggga

SEQ ID NO: 818660 - DNA, 20 bp, mouse
gggagcgcctgcgacgagtc

SEQ ID NO: 818661 - DNA, 20 bp, mouse
ggaggggcgccgcggctcta

SEQ ID NO: 818662 - DNA, 20 bp, mouse
gaggactggcccgggttcgt

SEQ ID NO: 818663 - DNA, 20 bp, mouse
gaacgcaagccatagagccg

SEQ ID NO: 818664 - DNA, 20 bp, mouse
ggacggcagccgacgaaccc

SEQ ID NO: 818665 - DNA, 20 bp, mouse
gcctccgccgtcgcccgcca

SEQ ID NO: 818666 - DNA, 20 bp, mouse
gtagtctaggaagccgaact

SEQ ID NO: 818667 - DNA, 20 bp, mouse
gtaagacccggatgaaggcg

SEQ ID NO: 818668 - DNA, 20 bp, mouse
ggcgtgtatcacaccaagtt

SEQ ID NO: 818669 - DNA, 20 bp, mouse
gacaggcgccaggtaagacc

SEQ ID NO: 818670 - DNA, 20 bp, mouse
gcactccgtgacgtactatc

SEQ ID NO: 818671 - DNA, 20 bp, mouse
gccaggtaagacccggatga

SEQ ID NO: 818672 - DNA, 20 bp, mouse
gctcgctgcatacaccggac

SEQ ID NO: 818673 - DNA, 20 bp, mouse
ggtacgtgatgtgacgtgac

SEQ ID NO: 818674 - DNA, 20 bp, mouse
gtgaaactcgctgcatacac

SEQ ID NO: 818675 - DNA, 20 bp, mouse
gcacgcgcaagaagcgccac

SEQ ID NO: 818676 - DNA, 20 bp, mouse
gggcaagcccacgtttttga

SEQ ID NO: 818677 - DNA, 20 bp, mouse
gggcggggctacggaggctg

SEQ ID NO: 818678 - DNA, 20 bp, mouse
ggcggaagttagcagaccgg

SEQ ID NO: 818679 - DNA, 20 bp, mouse
ggacgtagttcggaaatata

SEQ ID NO: 818680 - DNA, 20 bp, mouse
gcagatgccctcaaaaacgt

SEQ ID NO: 818681 - DNA, 20 bp, mouse
gcaaacgcgagccacgcccc

SEQ ID NO: 818682 - DNA, 20 bp, mouse
ggagcattaaaggttggtga

SEQ ID NO: 818683 - DNA, 20 bp, mouse
gggtctgcaagagcacttcg

SEQ ID NO: 818684 - DNA, 20 bp, mouse
gtccgtagccccgcccacta

SEQ ID NO: 818685 - DNA, 20 bp, mouse
gtggacttcatgacgtagtt

SEQ ID NO: 818686 - DNA, 20 bp, mouse
gcgaccgagccgcgcccagg

SEQ ID NO: 818687 - DNA, 20 bp, mouse
gcggctcggtcgctgtgggc

SEQ ID NO: 818688 - DNA, 20 bp, mouse
gggcgcggctcggtcgctgt

SEQ ID NO: 818689 - DNA, 20 bp, mouse
gacatggcggaggacctgca

SEQ ID NO: 818690 - DNA, 20 bp, mouse
ggttctctggacttgtccga

SEQ ID NO: 818691 - DNA, 20 bp, mouse
ggggatcgtggctgacatgg

SEQ ID NO: 818692 - DNA, 20 bp, mouse
ggctggcgagagggcgtcgc

SEQ ID NO: 818693 - DNA, 20 bp, mouse
gccacgccatagctccccaa

SEQ ID NO: 818694 - DNA, 20 bp, mouse
gactggggactgggtgctgt

SEQ ID NO: 818695 - DNA, 20 bp, mouse
ggctggctaccgcctgggcg

SEQ ID NO: 818696 - DNA, 20 bp, mouse
gtgcaccggaagtcccaccc

SEQ ID NO: 818697 - DNA, 20 bp, mouse
gcatgctaggaggtgtgctg

SEQ ID NO: 818698 - DNA, 20 bp, mouse
gcggcgcagggcatgctagg

SEQ ID NO: 818699 - DNA, 20 bp, mouse
gttcccgtgtgtgtcgtcct

SEQ ID NO: 818700 - DNA, 20 bp, mouse
ggctcctggtgttctgggtt

SEQ ID NO: 818701 - DNA, 20 bp, mouse
gaaagatgaacgcctcgcta

SEQ ID NO: 818702 - DNA, 20 bp, mouse
ggagctgctggctaagtagt

SEQ ID NO: 818703 - DNA, 20 bp, mouse
gtgctggctaagtagtgggg

SEQ ID NO: 818704 - DNA, 20 bp, mouse
ggaagtcagtaggcttgcac

SEQ ID NO: 818705 - DNA, 20 bp, mouse
ggtcctcggagcccacaacc

SEQ ID NO: 818706 - DNA, 20 bp, mouse
ggagaccagcgccgggctga

SEQ ID NO: 818707 - DNA, 20 bp, mouse
gttactgtgagggattacca

SEQ ID NO: 818708 - DNA, 20 bp, mouse
gttttctgaagggccagtag

SEQ ID NO: 818709 - DNA, 20 bp, mouse
gacttggaaagtaggtgaca

SEQ ID NO: 818710 - DNA, 20 bp, mouse
ggactgcggagaccagcgcc

SEQ ID NO: 818711 - DNA, 20 bp, mouse
gcgctggtctccgcagtcgg

SEQ ID NO: 818712 - DNA, 20 bp, mouse
gaggcagcgccctaaggaag

SEQ ID NO: 818713 - DNA, 20 bp, mouse
gtggggccaatttactgtga

SEQ ID NO: 818714 - DNA, 20 bp, mouse
gagggcctatgatggtaaaa

SEQ ID NO: 818715 - DNA, 20 bp, mouse
gatgacgtcaccgccgactg

SEQ ID NO: 818716 - DNA, 20 bp, mouse
gctctcgcggtgcacagcgg

SEQ ID NO: 818717 - DNA, 20 bp, mouse
gggtcccggcccgcttgccg

SEQ ID NO: 818718 - DNA, 20 bp, mouse
gggttccgctgctgtgtcag

SEQ ID NO: 818719 - DNA, 20 bp, mouse
gcgcttgccggggctcactg

SEQ ID NO: 818720 - DNA, 20 bp, mouse
gaccagagcctcttcttcca

SEQ ID NO: 818721 - DNA, 20 bp, mouse
ggagccccggcaagcgggcc

SEQ ID NO: 818722 - DNA, 20 bp, mouse
ggaccctcgcggcaggctga

SEQ ID NO: 818723 - DNA, 20 bp, mouse
gcagacggcagtgggatagc

SEQ ID NO: 818724 - DNA, 20 bp, mouse
ggcgtcagggcagttcgcga

SEQ ID NO: 818725 - DNA, 20 bp, mouse
gcccatggaagaagaggctc

SEQ ID NO: 818726 - DNA, 20 bp, mouse
gtacctggctggttgaggac

SEQ ID NO: 818727 - DNA, 20 bp, mouse
ggaggggacgggttggttgg

SEQ ID NO: 818728 - DNA, 20 bp, mouse
gagggccctctgaactcgag

SEQ ID NO: 818729 - DNA, 20 bp, mouse
ggccctctgaactcgagggg

SEQ ID NO: 818730 - DNA, 20 bp, mouse
gcgtgagggctgtgggtatc

SEQ ID NO: 818731 - DNA, 20 bp, mouse
gcacctgtcctcaaccagcc

SEQ ID NO: 818732 - DNA, 20 bp, mouse
gtgtcctaacttggcaggat

SEQ ID NO: 818733 - DNA, 20 bp, mouse
gtggcacctctgcagtagat

SEQ ID NO: 818734 - DNA, 20 bp, mouse
gcacgcgcagatagatgcac

SEQ ID NO: 818735 - DNA, 20 bp, mouse
gagggccctcagttttatcg

SEQ ID NO: 818736 - DNA, 20 bp, mouse
gcggggaagagccaaggcgg

SEQ ID NO: 818737 - DNA, 20 bp, mouse
gggaagaaggggccaaaagt

SEQ ID NO: 818738 - DNA, 20 bp, mouse
gcggcggaggtgaacgcgcg

SEQ ID NO: 818739 - DNA, 20 bp, mouse
gagaaggggccaaaagtggg

SEQ ID NO: 818740 - DNA, 20 bp, mouse
gggaagagccaaggcggcgg

SEQ ID NO: 818741 - DNA, 20 bp, mouse
ggggctgggccgggacgcag

SEQ ID NO: 818742 - DNA, 20 bp, mouse
gcccgcgcgcgcccgttggg

SEQ ID NO: 818743 - DNA, 20 bp, mouse
gcgggcggggacacccgggg

SEQ ID NO: 818744 - DNA, 20 bp, mouse
gcgctggccggggacaccag

SEQ ID NO: 818745 - DNA, 20 bp, mouse
ggcaccccgggccccccaac

SEQ ID NO: 818746 - DNA, 20 bp, mouse
gggtggcaatgcggcgagag

SEQ ID NO: 818747 - DNA, 20 bp, mouse
ggtccccggctgcacgtcag

SEQ ID NO: 818748 - DNA, 20 bp, mouse
gtccccgccccctgtcagtc

SEQ ID NO: 818749 - DNA, 20 bp, mouse
gggtgtagaaattatgcggt

SEQ ID NO: 818750 - DNA, 20 bp, mouse
ggactggtgtagaaattatg

SEQ ID NO: 818751 - DNA, 20 bp, mouse
gtggagaagagtagtctttg

SEQ ID NO: 818752 - DNA, 20 bp, mouse
gggcctctgacgtgcagccg

SEQ ID NO: 818753 - DNA, 20 bp, mouse
gcaatgcggcgagagaggac

SEQ ID NO: 818754 - DNA, 20 bp, mouse
gagtagtctttgaggatggt

SEQ ID NO: 818755 - DNA, 20 bp, mouse
gccctccgcctgactgacag

SEQ ID NO: 818756 - DNA, 20 bp, mouse
gctgccctgctgactcttgt

SEQ ID NO: 818757 - DNA, 20 bp, mouse
gagagaaggcatgcctcacg

SEQ ID NO: 818758 - DNA, 20 bp, mouse
ggggccaacaagagtcagca

SEQ ID NO: 818759 - DNA, 20 bp, mouse
gcatccttggaaagccctgg

SEQ ID NO: 818760 - DNA, 20 bp, mouse
gagaccaccagggctttcca

SEQ ID NO: 818761 - DNA, 20 bp, mouse
gataccagcgagcagggccc

SEQ ID NO: 818762 - DNA, 20 bp, mouse
gatagagccagtaggggccc

SEQ ID NO: 818763 - DNA, 20 bp, mouse
gccagggcacgagaccacca

SEQ ID NO: 818764 - DNA, 20 bp, mouse
gacggggataccagcgagca

SEQ ID NO: 818765 - DNA, 20 bp, mouse
gggcagaatagagccagtag

SEQ ID NO: 818766 - DNA, 20 bp, mouse
gcgccctttggtcccaaaac

SEQ ID NO: 818767 - DNA, 20 bp, mouse
ggggcctcgccctccagcgg

SEQ ID NO: 818768 - DNA, 20 bp, mouse
gcgagtagaacgtgtggcgg

SEQ ID NO: 818769 - DNA, 20 bp, mouse
gcacccgttttgggaccaaa

SEQ ID NO: 818770 - DNA, 20 bp, mouse
gttccggggaagtcttgaga

SEQ ID NO: 818771 - DNA, 20 bp, mouse
gcccgccttcggggctccca

SEQ ID NO: 818772 - DNA, 20 bp, mouse
gggagccatgggagccccga

SEQ ID NO: 818773 - DNA, 20 bp, mouse
gtggagctccgcacccgttt

SEQ ID NO: 818774 - DNA, 20 bp, mouse
gtggtgtcgggaggtgtagt

SEQ ID NO: 818775 - DNA, 20 bp, mouse
ggaggcccgccccgccttcg

SEQ ID NO: 818776 - DNA, 20 bp, mouse
gaaggcgtgaggcacgactg

SEQ ID NO: 818777 - DNA, 20 bp, mouse
gccagccggccactcgggag

SEQ ID NO: 818778 - DNA, 20 bp, mouse
ggcgacgcgagctagcggaa

SEQ ID NO: 818779 - DNA, 20 bp, mouse
gcaagagagcaaaagggcct

SEQ ID NO: 818780 - DNA, 20 bp, mouse
gcaaaagggcctcggtttgg

SEQ ID NO: 818781 - DNA, 20 bp, mouse
gggagcggagcgtagctccc

SEQ ID NO: 818782 - DNA, 20 bp, mouse
gaatgagcctcgacacagaa

SEQ ID NO: 818783 - DNA, 20 bp, mouse
gagacccgcgcagcttagga

SEQ ID NO: 818784 - DNA, 20 bp, mouse
gctgcccacaggaggagcgt

SEQ ID NO: 818785 - DNA, 20 bp, mouse
gcctgcccagccggccactc

SEQ ID NO: 818786 - DNA, 20 bp, mouse
gtccaggagcccaccttggt

SEQ ID NO: 818787 - DNA, 20 bp, mouse
ggagagcgacagatgcttca

SEQ ID NO: 818788 - DNA, 20 bp, mouse
gggaaattggcccccagcta

SEQ ID NO: 818789 - DNA, 20 bp, mouse
gcagtccccgccctagctgg

SEQ ID NO: 818790 - DNA, 20 bp, mouse
gatgcatggggaattaaaat

SEQ ID NO: 818791 - DNA, 20 bp, mouse
gaactcctcgactccgcggc

SEQ ID NO: 818792 - DNA, 20 bp, mouse
gaattggcccccagctaggg

SEQ ID NO: 818793 - DNA, 20 bp, mouse
gccatgcatcctaccaaggt

SEQ ID NO: 818794 - DNA, 20 bp, mouse
gcatgagccaccaaactcat

SEQ ID NO: 818795 - DNA, 20 bp, mouse
gggcgcgctcaaatgacgca

SEQ ID NO: 818796 - DNA, 20 bp, mouse
gccactggccagttgcgcaa

SEQ ID NO: 818797 - DNA, 20 bp, mouse
gtggaagctaggactaagga

SEQ ID NO: 818798 - DNA, 20 bp, mouse
gcatggactgatcggaagaa

SEQ ID NO: 818799 - DNA, 20 bp, mouse
gcgcaactggccagtgggcg

SEQ ID NO: 818800 - DNA, 20 bp, mouse
gaatgcttactgcgccatcg

SEQ ID NO: 818801 - DNA, 20 bp, mouse
gagtatgatagatgactaat

SEQ ID NO: 818802 - DNA, 20 bp, mouse
ggcgttctgcacatattttc

SEQ ID NO: 818803 - DNA, 20 bp, mouse
ggatcggaagaatggaagct

SEQ ID NO: 818804 - DNA, 20 bp, mouse
ggcccttgatacgatattat

SEQ ID NO: 818805 - DNA, 20 bp, mouse
ggcaaagctagatgagtata

SEQ ID NO: 818806 - DNA, 20 bp, mouse
gtgtggctggagtactgaaa

SEQ ID NO: 818807 - DNA, 20 bp, mouse
ggcagggccaaccccccggg

SEQ ID NO: 818808 - DNA, 20 bp, mouse
gaggggggccgacaccgtga

SEQ ID NO: 818809 - DNA, 20 bp, mouse
gacgccggcgcgagtggcca

SEQ ID NO: 818810 - DNA, 20 bp, mouse
gctggggccccgcccatcag

SEQ ID NO: 818811 - DNA, 20 bp, mouse
gaaggcagggccaacccccc

SEQ ID NO: 818812 - DNA, 20 bp, mouse
ggccacggggtccccgctgc

SEQ ID NO: 818813 - DNA, 20 bp, mouse
gatagcgcgctgcccggaag

SEQ ID NO: 818814 - DNA, 20 bp, mouse
gcggtgtcggcccccctgat

SEQ ID NO: 818815 - DNA, 20 bp, mouse
gtgtcggcccccctgatggg

SEQ ID NO: 818816 - DNA, 20 bp, mouse
ggggcccggaggcgcacaat

SEQ ID NO: 818817 - DNA, 20 bp, mouse
ggaggcgcacaatgggcaga

SEQ ID NO: 818818 - DNA, 20 bp, mouse
gggagtgtaagcaagggggt

SEQ ID NO: 818819 - DNA, 20 bp, mouse
gggagatcgcgctgggacgg

SEQ ID NO: 818820 - DNA, 20 bp, mouse
gcagagggagtgtaagcaag

SEQ ID NO: 818821 - DNA, 20 bp, mouse
gagcgccccgcccccaatca

SEQ ID NO: 818822 - DNA, 20 bp, mouse
gagggtcaacccaacgacag

SEQ ID NO: 818823 - DNA, 20 bp, mouse
gtgggctccgccctgattgg

SEQ ID NO: 818824 - DNA, 20 bp, mouse
ggtggagtcacgtgcgctct

SEQ ID NO: 818825 - DNA, 20 bp, mouse
gtcgcgctgggacggcgggg

SEQ ID NO: 818826 - DNA, 20 bp, mouse
ggccaaggggtgagatactg

SEQ ID NO: 818827 - DNA, 20 bp, mouse
ggggatgggaaggacttcaa

SEQ ID NO: 818828 - DNA, 20 bp, mouse
gctgccggcgagctgccgac

SEQ ID NO: 818829 - DNA, 20 bp, mouse
gactacttaatgtgtgccaa

SEQ ID NO: 818830 - DNA, 20 bp, mouse
ggagccagtcggcagctcgc

SEQ ID NO: 818831 - DNA, 20 bp, mouse
ggggaggcttacgcagctgc

SEQ ID NO: 818832 - DNA, 20 bp, mouse
gagctagttggaggtaataa

SEQ ID NO: 818833 - DNA, 20 bp, mouse
ggggtcaaaaatgtttctaa

SEQ ID NO: 818834 - DNA, 20 bp, mouse
gggtttcgctctgagagccc

SEQ ID NO: 818835 - DNA, 20 bp, mouse
ggaaggaaagtgaagacggg

SEQ ID NO: 818836 - DNA, 20 bp, mouse
gtgacgaaagcgatggggtg

SEQ ID NO: 818837 - DNA, 20 bp, mouse
ggtaggatgtgctcaggcca

SEQ ID NO: 818838 - DNA, 20 bp, mouse
gtcaagctagatgggagata

SEQ ID NO: 818839 - DNA, 20 bp, mouse
ggggcggggcggggttaacc

SEQ ID NO: 818840 - DNA, 20 bp, mouse
gccagctcagggtctactgg

SEQ ID NO: 818841 - DNA, 20 bp, mouse
gtgagggcggggccttgggt

SEQ ID NO: 818842 - DNA, 20 bp, mouse
gaggccagctcagggtctac

SEQ ID NO: 818843 - DNA, 20 bp, mouse
gcggggccttgggtcgggcg

SEQ ID NO: 818844 - DNA, 20 bp, mouse
gagaccctgagctggcctgc

SEQ ID NO: 818845 - DNA, 20 bp, mouse
ggaagagatcttggggctga

SEQ ID NO: 818846 - DNA, 20 bp, mouse
ggcacgcgcgtgtgtctcgt

SEQ ID NO: 818847 - DNA, 20 bp, mouse
gcgtgtgtctcgtcggtcaa

SEQ ID NO: 818848 - DNA, 20 bp, mouse
gagaagcagtggttagtaac

SEQ ID NO: 818849 - DNA, 20 bp, mouse
gaaaccccgcccagaagcag

SEQ ID NO: 818850 - DNA, 20 bp, mouse
gcacacgcgcgtgcaaattg

SEQ ID NO: 818851 - DNA, 20 bp, mouse
gttagcgggcgtcccggaag

SEQ ID NO: 818852 - DNA, 20 bp, mouse
gacaacgcaggacgaacgta

SEQ ID NO: 818853 - DNA, 20 bp, mouse
gtctacctgcgacagagcca

SEQ ID NO: 818854 - DNA, 20 bp, mouse
gaccagccatcctgtgaggc

SEQ ID NO: 818855 - DNA, 20 bp, mouse
gacgcttaggggttgggcct

SEQ ID NO: 818856 - DNA, 20 bp, mouse
gaaatgtgcgagtcttcggg

SEQ ID NO: 818857 - DNA, 20 bp, mouse
gcgtgcagacagcaggttat

SEQ ID NO: 818858 - DNA, 20 bp, mouse
gatagagcaggtcacgttgg

SEQ ID NO: 818859 - DNA, 20 bp, mouse
gcagacagcaggttattggc

SEQ ID NO: 818860 - DNA, 20 bp, mouse
gcctcccagcgtcaccttgt

SEQ ID NO: 818861 - DNA, 20 bp, mouse
gaagccacgcagtataccat

SEQ ID NO: 818862 - DNA, 20 bp, mouse
ggaagactcgcacatttcat

SEQ ID NO: 818863 - DNA, 20 bp, mouse
gtagccaatggtatactgcg

SEQ ID NO: 818864 - DNA, 20 bp, mouse
ggtcacgttggtggtgcgag

SEQ ID NO: 818865 - DNA, 20 bp, mouse
gtgcgagtcttcgggaggct

SEQ ID NO: 818866 - DNA, 20 bp, mouse
gggccctggggcgacttcca

SEQ ID NO: 818867 - DNA, 20 bp, mouse
gtgccctggaagtcgcccca

SEQ ID NO: 818868 - DNA, 20 bp, mouse
gctagcagagcgcgtggcga

SEQ ID NO: 818869 - DNA, 20 bp, mouse
gcgcgtggcgagggttccgg

SEQ ID NO: 818870 - DNA, 20 bp, mouse
ggctgggtggagcgatacac

SEQ ID NO: 818871 - DNA, 20 bp, mouse
gcgctctgctagtttccagc

SEQ ID NO: 818872 - DNA, 20 bp, mouse
gcagctgctccggaagttgt

SEQ ID NO: 818873 - DNA, 20 bp, mouse
ggagttctccagcaggacaa

SEQ ID NO: 818874 - DNA, 20 bp, mouse
gtggaaactagcagagcgcg

SEQ ID NO: 818875 - DNA, 20 bp, mouse
gaagagagaactgtgctggg

SEQ ID NO: 818876 - DNA, 20 bp, mouse
gccgggaggccagaagtaat

SEQ ID NO: 818877 - DNA, 20 bp, mouse
gtagagattagtgaacctgt

SEQ ID NO: 818878 - DNA, 20 bp, mouse
gctccactggaaccctttat

SEQ ID NO: 818879 - DNA, 20 bp, mouse
gaatctgctgctgccgataa

SEQ ID NO: 818880 - DNA, 20 bp, mouse
ggggaaccgaatcgggtctc

SEQ ID NO: 818881 - DNA, 20 bp, mouse
gtgggtgttgggaaccgaat

SEQ ID NO: 818882 - DNA, 20 bp, mouse
gtcaataaaaccagaatcgc

SEQ ID NO: 818883 - DNA, 20 bp, mouse
gagaagttccgacgacgtcg

SEQ ID NO: 818884 - DNA, 20 bp, mouse
gagattcgccacgacgtcgt

SEQ ID NO: 818885 - DNA, 20 bp, mouse
gtgccgataaagggttccag

SEQ ID NO: 818886 - DNA, 20 bp, mouse
gcgggcgcgcagtgcatcgt

SEQ ID NO: 818887 - DNA, 20 bp, mouse
gagaaggcgactctgggatt

SEQ ID NO: 818888 - DNA, 20 bp, mouse
ggtcacgagaaggcgactct

SEQ ID NO: 818889 - DNA, 20 bp, mouse
gcggacgcggagtgagtgtg

SEQ ID NO: 818890 - DNA, 20 bp, mouse
gatgcactgcgcgcccgagg

SEQ ID NO: 818891 - DNA, 20 bp, mouse
gagaacgagcggagcaggtt

SEQ ID NO: 818892 - DNA, 20 bp, mouse
gtaaccgcgccgccgaccgg

SEQ ID NO: 818893 - DNA, 20 bp, mouse
ggggtgagaacgagcggagc

SEQ ID NO: 818894 - DNA, 20 bp, mouse
gcgactctgggattgggtcg

SEQ ID NO: 818895 - DNA, 20 bp, mouse
gtcggcggcgcggttagtgg

SEQ ID NO: 818896 - DNA, 20 bp, mouse
gcccgtcggctcttcccgat

SEQ ID NO: 818897 - DNA, 20 bp, mouse
gcggaagcggtagttttgaa

SEQ ID NO: 818898 - DNA, 20 bp, mouse
gcgggaagagccgacgggca

SEQ ID NO: 818899 - DNA, 20 bp, mouse
ggggatggcgccagcctatc

SEQ ID NO: 818900 - DNA, 20 bp, mouse
gaaaaacatcgaaggagcag

SEQ ID NO: 818901 - DNA, 20 bp, mouse
gcggaatgatgctcaaagct

SEQ ID NO: 818902 - DNA, 20 bp, mouse
ggaagagccgacgggcaggg

SEQ ID NO: 818903 - DNA, 20 bp, mouse
gccgcttccgccctgcccgt

SEQ ID NO: 818904 - DNA, 20 bp, mouse
gacgctaatgagctggagaa

SEQ ID NO: 818905 - DNA, 20 bp, mouse
gcgagcttctgggcgcgcac

SEQ ID NO: 818906 - DNA, 20 bp, mouse
gtcagctcgcgaccagaact

SEQ ID NO: 818907 - DNA, 20 bp, mouse
gagtgtctcgcggtcatagg

SEQ ID NO: 818908 - DNA, 20 bp, mouse
gggcgcatgcgcattgcgaa

SEQ ID NO: 818909 - DNA, 20 bp, mouse
gccgcgcgggttgtgaggag

SEQ ID NO: 818910 - DNA, 20 bp, mouse
gaccgcgagacacttatgga

SEQ ID NO: 818911 - DNA, 20 bp, mouse
ggcgccgccgaagtggaagt

SEQ ID NO: 818912 - DNA, 20 bp, mouse
gtgaaatggctaaacatccg

SEQ ID NO: 818913 - DNA, 20 bp, mouse
gcagtacgacagccgggccg

SEQ ID NO: 818914 - DNA, 20 bp, mouse
gacaaggtccgggaagtgta

SEQ ID NO: 818915 - DNA, 20 bp, mouse
ggacaccctcacagcagtcc

SEQ ID NO: 818916 - DNA, 20 bp, mouse
gaagaggtgtggcttccgaa

SEQ ID NO: 818917 - DNA, 20 bp, mouse
ggaaggtcacgtgatactgg

SEQ ID NO: 818918 - DNA, 20 bp, mouse
gggaacggaccaatcaaaga

SEQ ID NO: 818919 - DNA, 20 bp, mouse
ggttgcgagttctatcacgt

SEQ ID NO: 818920 - DNA, 20 bp, mouse
gctatcacgtgggatgggaa

SEQ ID NO: 818921 - DNA, 20 bp, mouse
ggggaccccaagtgttcctt

SEQ ID NO: 818922 - DNA, 20 bp, mouse
gcacgtgatactggcggaag

SEQ ID NO: 818923 - DNA, 20 bp, mouse
gtgggacatggttagagctc

SEQ ID NO: 818924 - DNA, 20 bp, mouse
ggatgggaaaggacaggtgg

SEQ ID NO: 818925 - DNA, 20 bp, mouse
gtcccgccccctggacgcga

SEQ ID NO: 818926 - DNA, 20 bp, mouse
ggggaggcgcaggctggtgt

SEQ ID NO: 818927 - DNA, 20 bp, mouse
gcccagaagcaaagacacgg

SEQ ID NO: 818928 - DNA, 20 bp, mouse
gccccttgttgggtggagaa

SEQ ID NO: 818929 - DNA, 20 bp, mouse
gggtaaggggcaggacccgt

SEQ ID NO: 818930 - DNA, 20 bp, mouse
ggcactgtgggacacggcac

SEQ ID NO: 818931 - DNA, 20 bp, mouse
gcccgcgcagctcgaccgcc

SEQ ID NO: 818932 - DNA, 20 bp, mouse
gtcacgtcagtgaacctcaa

SEQ ID NO: 818933 - DNA, 20 bp, mouse
ggtcagtgaacctcaaggga

SEQ ID NO: 818934 - DNA, 20 bp, mouse
gcccaactacccctcccttg

SEQ ID NO: 818935 - DNA, 20 bp, mouse
ggggtcctgccccttacctg

SEQ ID NO: 818936 - DNA, 20 bp, mouse
gggagtggggtctgggacat

SEQ ID NO: 818937 - DNA, 20 bp, mouse
gtaagaacgcggtgggtagg

SEQ ID NO: 818938 - DNA, 20 bp, mouse
gtctctggaacgcaattagg

SEQ ID NO: 818939 - DNA, 20 bp, mouse
gcgctgggtgagaactggat

SEQ ID NO: 818940 - DNA, 20 bp, mouse
ggggcggcaaacatccttgg

SEQ ID NO: 818941 - DNA, 20 bp, mouse
gtactaagaacgcggtgggt

SEQ ID NO: 818942 - DNA, 20 bp, mouse
gcttgggcggcaaacatcct

SEQ ID NO: 818943 - DNA, 20 bp, mouse
ggggaggtgtctgtcctcca

SEQ ID NO: 818944 - DNA, 20 bp, mouse
ggagcattagcatcagctga

SEQ ID NO: 818945 - DNA, 20 bp, mouse
ggacctggagttccggtctc

SEQ ID NO: 818946 - DNA, 20 bp, mouse
gtgcgcacgcgcattcctgt

SEQ ID NO: 818947 - DNA, 20 bp, mouse
gtcgccccggccggccaagg

SEQ ID NO: 818948 - DNA, 20 bp, mouse
ggaaaggcttgactaacttg

SEQ ID NO: 818949 - DNA, 20 bp, mouse
gctaggaagtttgtggaaag

SEQ ID NO: 818950 - DNA, 20 bp, mouse
gttgaccaggacccatagaa

SEQ ID NO: 818951 - DNA, 20 bp, mouse
ggaggagggctcgattgaat

SEQ ID NO: 818952 - DNA, 20 bp, mouse
ggagccctcctcgccccggc

SEQ ID NO: 818953 - DNA, 20 bp, mouse
gtcctcgccccggccggcca

SEQ ID NO: 818954 - DNA, 20 bp, mouse
ggcctccacagcttggcccc

SEQ ID NO: 818955 - DNA, 20 bp, mouse
gaagggatcaaattaggacc

SEQ ID NO: 818956 - DNA, 20 bp, mouse
gagcgcggattgaacctcag

SEQ ID NO: 818957 - DNA, 20 bp, mouse
gcgtaggaactgctgactca

SEQ ID NO: 818958 - DNA, 20 bp, mouse
gggcacccacagcatccgta

SEQ ID NO: 818959 - DNA, 20 bp, mouse
gaatccgcgctcacttattc

SEQ ID NO: 818960 - DNA, 20 bp, mouse
ggccaggaactgacgcacac

SEQ ID NO: 818961 - DNA, 20 bp, mouse
gtgggtacatactagagcag

SEQ ID NO: 818962 - DNA, 20 bp, mouse
ggctgcgccgacgcgagcaa

SEQ ID NO: 818963 - DNA, 20 bp, mouse
ggcttccggcctctgcccta

SEQ ID NO: 818964 - DNA, 20 bp, mouse
ggcgagcaaaggatgcagac

SEQ ID NO: 818965 - DNA, 20 bp, mouse
gagcaaaggatgcagacagg

SEQ ID NO: 818966 - DNA, 20 bp, mouse
ggcaccttcggagggcggga

SEQ ID NO: 818967 - DNA, 20 bp, mouse
gctgccttccggccaccggg

SEQ ID NO: 818968 - DNA, 20 bp, mouse
gcgacagcggcccctagcga

SEQ ID NO: 818969 - DNA, 20 bp, mouse
ggagtgctttgcaccttcgg

SEQ ID NO: 818970 - DNA, 20 bp, mouse
gcagccctcccgccctccga

SEQ ID NO: 818971 - DNA, 20 bp, mouse
gcggacgcgcgacgagaacg

SEQ ID NO: 818972 - DNA, 20 bp, mouse
gtggaactttcacatgttaa

SEQ ID NO: 818973 - DNA, 20 bp, mouse
gagcactcctcccgtcgcta

SEQ ID NO: 818974 - DNA, 20 bp, mouse
gggggccgctgtcgccctcc

SEQ ID NO: 818975 - DNA, 20 bp, mouse
gcggaagctgcgctgccttc

SEQ ID NO: 818976 - DNA, 20 bp, mouse
ggcagcctgaagggtcgcta

SEQ ID NO: 818977 - DNA, 20 bp, mouse
gaggcccgcctccacggaag

SEQ ID NO: 818978 - DNA, 20 bp, mouse
ggtagaaaatgcctataagg

SEQ ID NO: 818979 - DNA, 20 bp, mouse
gaatagggtgtctgctcatg

SEQ ID NO: 818980 - DNA, 20 bp, mouse
gcggaagaggaccagtcaat

SEQ ID NO: 818981 - DNA, 20 bp, mouse
gccctcaagaaaagtgtccg

SEQ ID NO: 818982 - DNA, 20 bp, mouse
gcctgtagaaaatgcctata

SEQ ID NO: 818983 - DNA, 20 bp, mouse
gagggctcacccgcagatcc

SEQ ID NO: 818984 - DNA, 20 bp, mouse
gctcatgaggaaaataatac

SEQ ID NO: 818985 - DNA, 20 bp, mouse
ggactggtcctcttccgtgg

SEQ ID NO: 818986 - DNA, 20 bp, mouse
ggtaaccctgagtactgtag

SEQ ID NO: 818987 - DNA, 20 bp, mouse
gcaatcctggagcccaacaa

SEQ ID NO: 818988 - DNA, 20 bp, mouse
gtccgccactacagtactca

SEQ ID NO: 818989 - DNA, 20 bp, mouse
gccgccggaaacaccaatcc

SEQ ID NO: 818990 - DNA, 20 bp, mouse
gagtactgtagtggcggatt

SEQ ID NO: 818991 - DNA, 20 bp, mouse
gccggctaagtgagagtgaa

SEQ ID NO: 818992 - DNA, 20 bp, mouse
gagagggcccgggggaccgc

SEQ ID NO: 818993 - DNA, 20 bp, mouse
gggctctagcacaatagttc

SEQ ID NO: 818994 - DNA, 20 bp, mouse
ggtgccttatcgagactcca

SEQ ID NO: 818995 - DNA, 20 bp, mouse
gggagcccaacaagggaaca

SEQ ID NO: 818996 - DNA, 20 bp, mouse
gcacctggaggtaggctgag

SEQ ID NO: 818997 - DNA, 20 bp, mouse
gcgacctcgacttcaaagag

SEQ ID NO: 818998 - DNA, 20 bp, mouse
gtggggcccaaaacaaataa

SEQ ID NO: 818999 - DNA, 20 bp, mouse
gtgagtcggaaggccgccgg

SEQ ID NO: 819000 - DNA, 20 bp, mouse
ggggagtctgcagatggttc

SEQ ID NO: 819001 - DNA, 20 bp, mouse
gtcctggggaacgcctctct

SEQ ID NO: 819002 - DNA, 20 bp, mouse
ggcgacgcgggccggtcctg

SEQ ID NO: 819003 - DNA, 20 bp, mouse
gcagggaggtagtagtgcac

SEQ ID NO: 819004 - DNA, 20 bp, mouse
gctgctctggaatttagagg

SEQ ID NO: 819005 - DNA, 20 bp, mouse
gtatcagcatagagaaaaag

SEQ ID NO: 819006 - DNA, 20 bp, mouse
gcactgctcaagttcgaagt

SEQ ID NO: 819007 - DNA, 20 bp, mouse
gtgtcccgaagcaaagacat

SEQ ID NO: 819008 - DNA, 20 bp, mouse
gaaaccaagtccgttcgcca

SEQ ID NO: 819009 - DNA, 20 bp, mouse
gcggcgtgaggtgaaaggtc

SEQ ID NO: 819010 - DNA, 20 bp, mouse
gtcagctgaaagaacgagat

SEQ ID NO: 819011 - DNA, 20 bp, mouse
gcaacgcggcgtgaggtgaa

SEQ ID NO: 819012 - DNA, 20 bp, mouse
gcacagaagccgagacaacg

SEQ ID NO: 819013 - DNA, 20 bp, mouse
gggcacggccccccttttat

SEQ ID NO: 819014 - DNA, 20 bp, mouse
gccccaagtgctggatctat

SEQ ID NO: 819015 - DNA, 20 bp, mouse
gtaagtctcggataatgtgg

SEQ ID NO: 819016 - DNA, 20 bp, mouse
ggtgacaggccacgacggag

SEQ ID NO: 819017 - DNA, 20 bp, mouse
gcggttgcgtcgccagtgac

SEQ ID NO: 819018 - DNA, 20 bp, mouse
ggcaaccggaagcgtggctc

SEQ ID NO: 819019 - DNA, 20 bp, mouse
gcaacggcgaaggagtgagc

SEQ ID NO: 819020 - DNA, 20 bp, mouse
gcggaccagagccacgcttc

SEQ ID NO: 819021 - DNA, 20 bp, mouse
gcgagacagaagtctcgata

SEQ ID NO: 819022 - DNA, 20 bp, mouse
ggaacacagcctctccgtcg

SEQ ID NO: 819023 - DNA, 20 bp, mouse
gcgccagtgacaggccacga

SEQ ID NO: 819024 - DNA, 20 bp, mouse
gatggggatgtctgaacctg

SEQ ID NO: 819025 - DNA, 20 bp, mouse
gctgccgccgctggtcccga

SEQ ID NO: 819026 - DNA, 20 bp, mouse
gccaaaaggcagctaccaaa

SEQ ID NO: 819027 - DNA, 20 bp, mouse
gaccggaatgtcctgccaaa

SEQ ID NO: 819028 - DNA, 20 bp, mouse
gaatgctcaagcattccttt

SEQ ID NO: 819029 - DNA, 20 bp, mouse
gggcaggacattccggtcag

SEQ ID NO: 819030 - DNA, 20 bp, mouse
ggtgatgcttgcaatcactt

SEQ ID NO: 819031 - DNA, 20 bp, mouse
ggacagagacccctgcattg

SEQ ID NO: 819032 - DNA, 20 bp, mouse
ggccttttggcaggacattc

SEQ ID NO: 819033 - DNA, 20 bp, mouse
gtgcttgagcattcctactg

SEQ ID NO: 819034 - DNA, 20 bp, mouse
gtgcctgggacgcatgcgta

SEQ ID NO: 819035 - DNA, 20 bp, mouse
gctccctacgcatgcgtccc

SEQ ID NO: 819036 - DNA, 20 bp, mouse
ggcgctctgcggaacataaa

SEQ ID NO: 819037 - DNA, 20 bp, mouse
gcagcgggatcacttgggag

SEQ ID NO: 819038 - DNA, 20 bp, mouse
gatgtgcagcgggatcactt

SEQ ID NO: 819039 - DNA, 20 bp, mouse
gccctcacggccacagttag

SEQ ID NO: 819040 - DNA, 20 bp, mouse
gcctcgacggcgcacagaac

SEQ ID NO: 819041 - DNA, 20 bp, mouse
ggctacggtccaatcctcga

SEQ ID NO: 819042 - DNA, 20 bp, mouse
ggggccggattctatggatg

SEQ ID NO: 819043 - DNA, 20 bp, mouse
gcctcaacctcctctaactg

SEQ ID NO: 819044 - DNA, 20 bp, mouse
gtcggaggacaggctgtcgg

SEQ ID NO: 819045 - DNA, 20 bp, mouse
gttgagggtggggcgctctg

SEQ ID NO: 819046 - DNA, 20 bp, mouse
ggaaacccgtcgaaaataga

SEQ ID NO: 819047 - DNA, 20 bp, mouse
gtggccgctccgcagctcct

SEQ ID NO: 819048 - DNA, 20 bp, mouse
ggagcctaggagctgcggag

SEQ ID NO: 819049 - DNA, 20 bp, mouse
ggcgaacaggtgagcggctg

SEQ ID NO: 819050 - DNA, 20 bp, mouse
gagccctcgacaggggagga

SEQ ID NO: 819051 - DNA, 20 bp, mouse
gtgggagtgtgacgctgcag

SEQ ID NO: 819052 - DNA, 20 bp, mouse
ggagaggagcctaggagctg

SEQ ID NO: 819053 - DNA, 20 bp, mouse
ggtagagaatcggtaggagg

SEQ ID NO: 819054 - DNA, 20 bp, mouse
ggtctgagccagcgcgacgt

SEQ ID NO: 819055 - DNA, 20 bp, mouse
ggccaagtgctgtagagaat

SEQ ID NO: 819056 - DNA, 20 bp, mouse
gttcactgaaagctcttcgg

SEQ ID NO: 819057 - DNA, 20 bp, mouse
gcaacctcgcctcccggaag

SEQ ID NO: 819058 - DNA, 20 bp, mouse
gccgggaggcgaggttgtcc

SEQ ID NO: 819059 - DNA, 20 bp, mouse
gcgggcagctctcgtagaag

SEQ ID NO: 819060 - DNA, 20 bp, mouse
ggccacgcccactttccgga

SEQ ID NO: 819061 - DNA, 20 bp, mouse
gtacgagagctgcccgggca

SEQ ID NO: 819062 - DNA, 20 bp, mouse
gctcccggaagcggcctcgc

SEQ ID NO: 819063 - DNA, 20 bp, mouse
gaaccaaagcaaaggacggc

SEQ ID NO: 819064 - DNA, 20 bp, mouse
gtcacggagaaccaaagcaa

SEQ ID NO: 819065 - DNA, 20 bp, mouse
gaccccgccgtcctttgctt

SEQ ID NO: 819066 - DNA, 20 bp, mouse
ggcggagctaagtaacccgg

SEQ ID NO: 819067 - DNA, 20 bp, mouse
gcgcacaaaagactggatga

SEQ ID NO: 819068 - DNA, 20 bp, mouse
gggcacgaatggagtgagat

SEQ ID NO: 819069 - DNA, 20 bp, mouse
gtggatgagggtagtggatc

SEQ ID NO: 819070 - DNA, 20 bp, mouse
ggtgggcggcggaacctcgg

SEQ ID NO: 819071 - DNA, 20 bp, mouse
gaacccgggctgtaggcggt

SEQ ID NO: 819072 - DNA, 20 bp, mouse
gcgggttcccgcaggggcgg

SEQ ID NO: 819073 - DNA, 20 bp, mouse
gaacctcggcggcctcctac

SEQ ID NO: 819074 - DNA, 20 bp, mouse
gccggaccgagacgtccccc

SEQ ID NO: 819075 - DNA, 20 bp, mouse
gagtaacccgggggacgtct

SEQ ID NO: 819076 - DNA, 20 bp, mouse
gctgtcagtgaggggtgaac

SEQ ID NO: 819077 - DNA, 20 bp, mouse
ggggcggtgagcagagtagt

SEQ ID NO: 819078 - DNA, 20 bp, mouse
gaggcgtggcttgatggtaa

SEQ ID NO: 819079 - DNA, 20 bp, mouse
gcagatgcgcgcatccctta

SEQ ID NO: 819080 - DNA, 20 bp, mouse
gtccacctcctgtcagtgag

SEQ ID NO: 819081 - DNA, 20 bp, mouse
ggatggtctcagcaaggagg

SEQ ID NO: 819082 - DNA, 20 bp, mouse
gggcggggttaccgggcatg

SEQ ID NO: 819083 - DNA, 20 bp, mouse
gagctgatgggcggggttac

SEQ ID NO: 819084 - DNA, 20 bp, mouse
ggagcagagtagtaggggcc

SEQ ID NO: 819085 - DNA, 20 bp, mouse
gggcttgatggtaatgggcg

SEQ ID NO: 819086 - DNA, 20 bp, mouse
gggtgactgttgcttaggaa

SEQ ID NO: 819087 - DNA, 20 bp, mouse
ggctacatacaataacactg

SEQ ID NO: 819088 - DNA, 20 bp, mouse
gggaatggctaacattagtt

SEQ ID NO: 819089 - DNA, 20 bp, mouse
gaatcaataggacagctatc

SEQ ID NO: 819090 - DNA, 20 bp, mouse
ggatctgcaatcacaatgga

SEQ ID NO: 819091 - DNA, 20 bp, mouse
gaacatttgagtgtctctta

SEQ ID NO: 819092 - DNA, 20 bp, mouse
gctcagtatgtttactggaa

SEQ ID NO: 819093 - DNA, 20 bp, mouse
ggacaatagtaacagtgagc

SEQ ID NO: 819094 - DNA, 20 bp, mouse
gttagtctcagtatgtttac

SEQ ID NO: 819095 - DNA, 20 bp, mouse
gtaggtaagtgtttaaaatg

SEQ ID NO: 819096 - DNA, 20 bp, mouse
ggactcttctccctagggag

SEQ ID NO: 819097 - DNA, 20 bp, mouse
gtgagcgactcttctcccta

SEQ ID NO: 819098 - DNA, 20 bp, mouse
gagaagagtcgctcagttca

SEQ ID NO: 819099 - DNA, 20 bp, mouse
gggcacacccggagaggtgg

SEQ ID NO: 819100 - DNA, 20 bp, mouse
gaatctggaagcccctccct

SEQ ID NO: 819101 - DNA, 20 bp, mouse
gtactgaaggctccgtatcg

SEQ ID NO: 819102 - DNA, 20 bp, mouse
gtgcatcgcgggagttgagt

SEQ ID NO: 819103 - DNA, 20 bp, mouse
ggggcttccagatttggttt

SEQ ID NO: 819104 - DNA, 20 bp, mouse
gggcgtgtctagctccgcta

SEQ ID NO: 819105 - DNA, 20 bp, mouse
gagtttgggcacacccggag

SEQ ID NO: 819106 - DNA, 20 bp, mouse
gccaaaaggcagctaccaaa

SEQ ID NO: 819107 - DNA, 20 bp, mouse
gaccggaatgtcctgccaaa

SEQ ID NO: 819108 - DNA, 20 bp, mouse
gaatgctcaagcattccttt

SEQ ID NO: 819109 - DNA, 20 bp, mouse
gggcaggacattccggtcag

SEQ ID NO: 819110 - DNA, 20 bp, mouse
ggtgatgcttgcaatcactt

SEQ ID NO: 819111 - DNA, 20 bp, mouse
ggacagagacccctgcattg

SEQ ID NO: 819112 - DNA, 20 bp, mouse
ggccttttggcaggacattc

SEQ ID NO: 819113 - DNA, 20 bp, mouse
gtgcttgagcattcctactg

SEQ ID NO: 819114 - DNA, 20 bp, mouse
gtgcctgggacgcatgcgta

SEQ ID NO: 819115 - DNA, 20 bp, mouse
gctccctacgcatgcgtccc

SEQ ID NO: 819116 - DNA, 20 bp, mouse
gcgcaggcgctctgaccgaa

SEQ ID NO: 819117 - DNA, 20 bp, mouse
gtaactatatgcacggaggg

SEQ ID NO: 819118 - DNA, 20 bp, mouse
gtcgccgggcgagtcttgcc

SEQ ID NO: 819119 - DNA, 20 bp, mouse
gcgagtcttgcccgggaacg

SEQ ID NO: 819120 - DNA, 20 bp, mouse
gggaaaaatgctcactgcgc

SEQ ID NO: 819121 - DNA, 20 bp, mouse
gacggagggtggcttatagt

SEQ ID NO: 819122 - DNA, 20 bp, mouse
gtctgaccgaacggccctct

SEQ ID NO: 819123 - DNA, 20 bp, mouse
gttgaataggatgcaaagtc

SEQ ID NO: 819124 - DNA, 20 bp, mouse
gttcccgggcaagactcgcc

SEQ ID NO: 819125 - DNA, 20 bp, mouse
ggtagattttacaggctaca

SEQ ID NO: 819126 - DNA, 20 bp, mouse
ggcactggggcgggccaagt

SEQ ID NO: 819127 - DNA, 20 bp, mouse
gaacctgggggagggaccta

SEQ ID NO: 819128 - DNA, 20 bp, mouse
ggaaccgcaaggctgcactg

SEQ ID NO: 819129 - DNA, 20 bp, mouse
gggacccagagggaccatcg

SEQ ID NO: 819130 - DNA, 20 bp, mouse
gggaccatcggggcggaacc

SEQ ID NO: 819131 - DNA, 20 bp, mouse
ggggccgttatggacccaga

SEQ ID NO: 819132 - DNA, 20 bp, mouse
gggtccctctgggtccataa

SEQ ID NO: 819133 - DNA, 20 bp, mouse
gcccagagggaccatcgggg

SEQ ID NO: 819134 - DNA, 20 bp, mouse
ggcagggcacaaagacccgg

SEQ ID NO: 819135 - DNA, 20 bp, mouse
gccgccccagtgcagccttg

SEQ ID NO: 819136 - DNA, 20 bp, mouse
gttagcaggatctcgatgga

SEQ ID NO: 819137 - DNA, 20 bp, mouse
gccactgccagccttaacgt

SEQ ID NO: 819138 - DNA, 20 bp, mouse
gaaggctggcagtggcgggt

SEQ ID NO: 819139 - DNA, 20 bp, mouse
gtgagtgctagggcagaaga

SEQ ID NO: 819140 - DNA, 20 bp, mouse
ggatgttagcaggatctcga

SEQ ID NO: 819141 - DNA, 20 bp, mouse
ggccagccttaacgtaggaa

SEQ ID NO: 819142 - DNA, 20 bp, mouse
ggctgcgtgcgctggacgcg

SEQ ID NO: 819143 - DNA, 20 bp, mouse
gagtcatgcttgtttgttat

SEQ ID NO: 819144 - DNA, 20 bp, mouse
gtgattcctcactgctgggt

SEQ ID NO: 819145 - DNA, 20 bp, mouse
gttgagccatgcacacaggt

SEQ ID NO: 819146 - DNA, 20 bp, mouse
gtagccagctacattcttca

SEQ ID NO: 819147 - DNA, 20 bp, mouse
ggtgtgacaagaacgtccag

SEQ ID NO: 819148 - DNA, 20 bp, mouse
gaccacaccccaaacagaaa

SEQ ID NO: 819149 - DNA, 20 bp, mouse
gagggggtgtggcttgttat

SEQ ID NO: 819150 - DNA, 20 bp, mouse
gcacactgggttcttttgtc

SEQ ID NO: 819151 - DNA, 20 bp, mouse
gggcaagtgttctattcctc

SEQ ID NO: 819152 - DNA, 20 bp, mouse
ggccagaagccctttctgtt

SEQ ID NO: 819153 - DNA, 20 bp, mouse
gtgtcctgattaggcctcta

SEQ ID NO: 819154 - DNA, 20 bp, mouse
gagccaagagttaaaccatt

SEQ ID NO: 819155 - DNA, 20 bp, mouse
gcccaaacagaaagggcttc

SEQ ID NO: 819156 - DNA, 20 bp, mouse
gagtggcgatcgctggtcag

SEQ ID NO: 819157 - DNA, 20 bp, mouse
ggccccacccctgaagacca

SEQ ID NO: 819158 - DNA, 20 bp, mouse
gaagatgcggatttcagctt

SEQ ID NO: 819159 - DNA, 20 bp, mouse
ggaccccgcaaagtccactc

SEQ ID NO: 819160 - DNA, 20 bp, mouse
gacgggaggcggctcccgac

SEQ ID NO: 819161 - DNA, 20 bp, mouse
gagccctggtcttcaggggt

SEQ ID NO: 819162 - DNA, 20 bp, mouse
gggctctcagtggcgatcgc

SEQ ID NO: 819163 - DNA, 20 bp, mouse
gcaccggcgactcacccgga

SEQ ID NO: 819164 - DNA, 20 bp, mouse
ggaggctctccatcccgccc

SEQ ID NO: 819165 - DNA, 20 bp, mouse
gacactcaggattggcccgt

SEQ ID NO: 819166 - DNA, 20 bp, mouse
gtgcgcgccgccgtcgtctg

SEQ ID NO: 819167 - DNA, 20 bp, mouse
gcggggtgagccaatttctt

SEQ ID NO: 819168 - DNA, 20 bp, mouse
gggctgctaccagtaccacc

SEQ ID NO: 819169 - DNA, 20 bp, mouse
ggaagggcccgaggctcggg

SEQ ID NO: 819170 - DNA, 20 bp, mouse
gcaagcgtcattcagacttc

SEQ ID NO: 819171 - DNA, 20 bp, mouse
gggtgcttctcaaactactg

SEQ ID NO: 819172 - DNA, 20 bp, mouse
gctactggggcagtgagtat

SEQ ID NO: 819173 - DNA, 20 bp, mouse
gggcaactattcagagtgaa

SEQ ID NO: 819174 - DNA, 20 bp, mouse
gattcagagtgaagggcccg

SEQ ID NO: 819175 - DNA, 20 bp, mouse
ggttgagggacacagattgg

SEQ ID NO: 819176 - DNA, 20 bp, mouse
gcgacccgggacctcctctg

SEQ ID NO: 819177 - DNA, 20 bp, mouse
gagcccgcagaggaggtccc

SEQ ID NO: 819178 - DNA, 20 bp, mouse
gccggcgcgcgcagggtcgg

SEQ ID NO: 819179 - DNA, 20 bp, mouse
gcctctgcgggctggatccc

SEQ ID NO: 819180 - DNA, 20 bp, mouse
ggcgcgcgcagggtcggcgg

SEQ ID NO: 819181 - DNA, 20 bp, mouse
gggatcccgggccaccgtgg

SEQ ID NO: 819182 - DNA, 20 bp, mouse
gcgcaaacccgccaccacgg

SEQ ID NO: 819183 - DNA, 20 bp, mouse
gtgggtgccggcggagaaac

SEQ ID NO: 819184 - DNA, 20 bp, mouse
gaatgggagcgcacgtcgcg

SEQ ID NO: 819185 - DNA, 20 bp, mouse
ggcactctacgggctccaca

SEQ ID NO: 819186 - DNA, 20 bp, mouse
gcagactggcagaagagtgt

SEQ ID NO: 819187 - DNA, 20 bp, mouse
ggccgccgccaccatcccgc

SEQ ID NO: 819188 - DNA, 20 bp, mouse
gtcctcccgcgggatggtgg

SEQ ID NO: 819189 - DNA, 20 bp, mouse
gcgctccccagtcctcccgc

SEQ ID NO: 819190 - DNA, 20 bp, mouse
ggacttccggataaggaaag

SEQ ID NO: 819191 - DNA, 20 bp, mouse
gccatcccgcgggaggactg

SEQ ID NO: 819192 - DNA, 20 bp, mouse
gttccttatccggaagtcca

SEQ ID NO: 819193 - DNA, 20 bp, mouse
ggtggcaacgagaatccgag

SEQ ID NO: 819194 - DNA, 20 bp, mouse
gagcgctcggactgacgttc

SEQ ID NO: 819195 - DNA, 20 bp, mouse
gtcctcctctcccttaggtg

SEQ ID NO: 819196 - DNA, 20 bp, mouse
ggtaaggagggtttacgtta

SEQ ID NO: 819197 - DNA, 20 bp, mouse
ggagttctaggtagagacta

SEQ ID NO: 819198 - DNA, 20 bp, mouse
gctaggtagagactaaggat

SEQ ID NO: 819199 - DNA, 20 bp, mouse
gagactaaggattggttgtt

SEQ ID NO: 819200 - DNA, 20 bp, mouse
gtgggagaggatttaccagc

SEQ ID NO: 819201 - DNA, 20 bp, mouse
gctcaacacgcggggagcgg

SEQ ID NO: 819202 - DNA, 20 bp, mouse
gtttcggaggtctgtaagga

SEQ ID NO: 819203 - DNA, 20 bp, mouse
gcctccctgtgcggattggg

SEQ ID NO: 819204 - DNA, 20 bp, mouse
ggcagtaggctcaacacgcg

SEQ ID NO: 819205 - DNA, 20 bp, mouse
gaggctcaacacgcggggag

SEQ ID NO: 819206 - DNA, 20 bp, mouse
gggaagggacggcctcgagt

SEQ ID NO: 819207 - DNA, 20 bp, mouse
gccaggttcccgcgaaccga

SEQ ID NO: 819208 - DNA, 20 bp, mouse
gttcccgcgaaccgagggaa

SEQ ID NO: 819209 - DNA, 20 bp, mouse
gtcccagtgtgggcctccgg

SEQ ID NO: 819210 - DNA, 20 bp, mouse
ggggacggcctcgagtggga

SEQ ID NO: 819211 - DNA, 20 bp, mouse
gcgcccccggaggcccacac

SEQ ID NO: 819212 - DNA, 20 bp, mouse
gtgggcacagccacccagcc

SEQ ID NO: 819213 - DNA, 20 bp, mouse
gtcgaggccgtcccttccct

SEQ ID NO: 819214 - DNA, 20 bp, mouse
gtccctagtaataaagcctg

SEQ ID NO: 819215 - DNA, 20 bp, mouse
gtcgcgggaacctggctggg

SEQ ID NO: 819216 - DNA, 20 bp, mouse
gactccgcgggaggcatcag

SEQ ID NO: 819217 - DNA, 20 bp, mouse
gccgctggggactgactccg

SEQ ID NO: 819218 - DNA, 20 bp, mouse
gccaccgcagccatgactgt

SEQ ID NO: 819219 - DNA, 20 bp, mouse
gtcaccgcgacccgtagtcc

SEQ ID NO: 819220 - DNA, 20 bp, mouse
ggtagtgtgagtgacctcgg

SEQ ID NO: 819221 - DNA, 20 bp, mouse
ggggagctgtagtcgagcgc

SEQ ID NO: 819222 - DNA, 20 bp, mouse
gagcctaggacccacagtca

SEQ ID NO: 819223 - DNA, 20 bp, mouse
ggggtcgcggtgaggaccaa

SEQ ID NO: 819224 - DNA, 20 bp, mouse
ggttcgcgaaggtgagtgaa

SEQ ID NO: 819225 - DNA, 20 bp, mouse
ggccggagacgctcctaatt

SEQ ID NO: 819226 - DNA, 20 bp, mouse
gcgtgcctgcgccgactctg

SEQ ID NO: 819227 - DNA, 20 bp, mouse
gggcacgcggctctcggcaa

SEQ ID NO: 819228 - DNA, 20 bp, mouse
ggccgagccgagctgcacgg

SEQ ID NO: 819229 - DNA, 20 bp, mouse
ggagtgaccacgtggtgggt

SEQ ID NO: 819230 - DNA, 20 bp, mouse
ggcagcggcggccgcagagt

SEQ ID NO: 819231 - DNA, 20 bp, mouse
gtcccccccccgaacgccga

SEQ ID NO: 819232 - DNA, 20 bp, mouse
ggcttgagtgaccacgtggt

SEQ ID NO: 819233 - DNA, 20 bp, mouse
ggctgcacggagggcgagag

SEQ ID NO: 819234 - DNA, 20 bp, mouse
gggagggcgagagcggagcg

SEQ ID NO: 819235 - DNA, 20 bp, mouse
gcgccacaaggtggcagcgg

SEQ ID NO: 819236 - DNA, 20 bp, mouse
ggaggagcggtggtgacggt

SEQ ID NO: 819237 - DNA, 20 bp, mouse
gccctggtggtgaggagcgg

SEQ ID NO: 819238 - DNA, 20 bp, mouse
gccaaaacggatactcgccc

SEQ ID NO: 819239 - DNA, 20 bp, mouse
gccagagcccgtgctcacct

SEQ ID NO: 819240 - DNA, 20 bp, mouse
gttgggagctagattgatga

SEQ ID NO: 819241 - DNA, 20 bp, mouse
ggcgacccggaagctgtcgc

SEQ ID NO: 819242 - DNA, 20 bp, mouse
ggcggggtacgctgggagag

SEQ ID NO: 819243 - DNA, 20 bp, mouse
gcaccaccagggggcgtccg

SEQ ID NO: 819244 - DNA, 20 bp, mouse
gcgagtatccgttttggccc

SEQ ID NO: 819245 - DNA, 20 bp, mouse
gtggtgaggagcggtggtga

SEQ ID NO: 819246 - DNA, 20 bp, mouse
gaaagcgcggccccagtcgg

SEQ ID NO: 819247 - DNA, 20 bp, mouse
gcaggaggatcgtgaagggg

SEQ ID NO: 819248 - DNA, 20 bp, mouse
ggaggccccgcccccgactg

SEQ ID NO: 819249 - DNA, 20 bp, mouse
gcggagctctagaaaaagcg

SEQ ID NO: 819250 - DNA, 20 bp, mouse
gaagcaggaggatcgtgaag

SEQ ID NO: 819251 - DNA, 20 bp, mouse
ggcggggcctcgcgttgggc

SEQ ID NO: 819252 - DNA, 20 bp, mouse
gcggctgccagcccaacgcg

SEQ ID NO: 819253 - DNA, 20 bp, mouse
ggaaaaagcgcggccccagt

SEQ ID NO: 819254 - DNA, 20 bp, mouse
gcacgtgagcacgcaaggct

SEQ ID NO: 819255 - DNA, 20 bp, mouse
gagagagcaagccccctcgc

SEQ ID NO: 819256 - DNA, 20 bp, mouse
gggtcaaggccaccaacagg

SEQ ID NO: 819257 - DNA, 20 bp, mouse
gtaaactgtcctcctgttgg

SEQ ID NO: 819258 - DNA, 20 bp, mouse
gacagaagacgataaactga

SEQ ID NO: 819259 - DNA, 20 bp, mouse
gttggtggccttgacccacg

SEQ ID NO: 819260 - DNA, 20 bp, mouse
gcacactggtagtgtctgtg

SEQ ID NO: 819261 - DNA, 20 bp, mouse
gcaaatgccagctatcgttc

SEQ ID NO: 819262 - DNA, 20 bp, mouse
gtatctgcagtacatcatac

SEQ ID NO: 819263 - DNA, 20 bp, mouse
gtgtgacatgccatggtagg

SEQ ID NO: 819264 - DNA, 20 bp, mouse
gtacatcatacaggccacgt

SEQ ID NO: 819265 - DNA, 20 bp, mouse
gttcaggggccccagcttat

SEQ ID NO: 819266 - DNA, 20 bp, mouse
gccggcctgcgggaggaaca

SEQ ID NO: 819267 - DNA, 20 bp, mouse
gaacgcacttgggacgcggt

SEQ ID NO: 819268 - DNA, 20 bp, mouse
gtcccaagtgcgttcggggc

SEQ ID NO: 819269 - DNA, 20 bp, mouse
gcccgaacgcacttgggacg

SEQ ID NO: 819270 - DNA, 20 bp, mouse
ggcggcgccgtgagctgcct

SEQ ID NO: 819271 - DNA, 20 bp, mouse
ggccgctggggacgtgcggg

SEQ ID NO: 819272 - DNA, 20 bp, mouse
gggacccgggggcgtgtcag

SEQ ID NO: 819273 - DNA, 20 bp, mouse
gctcccgcaggcagcggctt

SEQ ID NO: 819274 - DNA, 20 bp, mouse
gccacgggccgcggccgctg

SEQ ID NO: 819275 - DNA, 20 bp, mouse
ggggcgcggccaccacgatc

SEQ ID NO: 819276 - DNA, 20 bp, mouse
gaacaccctgggcgtggcga

SEQ ID NO: 819277 - DNA, 20 bp, mouse
gggccagaagataacaccat

SEQ ID NO: 819278 - DNA, 20 bp, mouse
gggcgggctcccgtatcaga

SEQ ID NO: 819279 - DNA, 20 bp, mouse
gtatcagagggtggagcctg

SEQ ID NO: 819280 - DNA, 20 bp, mouse
ggtgagccagggaacaccct

SEQ ID NO: 819281 - DNA, 20 bp, mouse
ggacccatggtgttatcttc

SEQ ID NO: 819282 - DNA, 20 bp, mouse
ggcagccaagcagccctaag

SEQ ID NO: 819283 - DNA, 20 bp, mouse
ggtacctcggctgactacct

SEQ ID NO: 819284 - DNA, 20 bp, mouse
ggggctcccgtatcagaggg

SEQ ID NO: 819285 - DNA, 20 bp, mouse
gtatcccaggtagtcagccg

SEQ ID NO: 819286 - DNA, 20 bp, mouse
gcacccgccgatgcagactc

SEQ ID NO: 819287 - DNA, 20 bp, mouse
ggccacgcggggcgccaccc

SEQ ID NO: 819288 - DNA, 20 bp, mouse
gctgcctgcgggctccgagg

SEQ ID NO: 819289 - DNA, 20 bp, mouse
gggctccgagggggatctgt

SEQ ID NO: 819290 - DNA, 20 bp, mouse
gcggcccggaccttagtcgg

SEQ ID NO: 819291 - DNA, 20 bp, mouse
ggctcggcggggccgaggtg

SEQ ID NO: 819292 - DNA, 20 bp, mouse
gcggatcagctgggcccggg

SEQ ID NO: 819293 - DNA, 20 bp, mouse
gtggggcgctaccggagact

SEQ ID NO: 819294 - DNA, 20 bp, mouse
gagggctagggcgacccggg

SEQ ID NO: 819295 - DNA, 20 bp, mouse
gaacctcgcgccgccgacta

SEQ ID NO: 819296 - DNA, 20 bp, mouse
gaacagacgcggtccccggg

SEQ ID NO: 819297 - DNA, 20 bp, mouse
gggcggggctcgggaagtag

SEQ ID NO: 819298 - DNA, 20 bp, mouse
ggggtcgccccgcccacccg

SEQ ID NO: 819299 - DNA, 20 bp, mouse
gggggcgcgaccaatcgcag

SEQ ID NO: 819300 - DNA, 20 bp, mouse
gccaggtagcgggaccgcga

SEQ ID NO: 819301 - DNA, 20 bp, mouse
gcggggaccgcgtctgttcg

SEQ ID NO: 819302 - DNA, 20 bp, mouse
gcggggcggcggcaccgagg

SEQ ID NO: 819303 - DNA, 20 bp, mouse
gctgcggctgagtgacagtg

SEQ ID NO: 819304 - DNA, 20 bp, mouse
gaaggctggcgtctggtatg

SEQ ID NO: 819305 - DNA, 20 bp, mouse
gccggcgagggcatgagcgc

SEQ ID NO: 819306 - DNA, 20 bp, mouse
ggcgggagaagcagacggtt

SEQ ID NO: 819307 - DNA, 20 bp, mouse
gggcgcgcgccggggtcgcg

SEQ ID NO: 819308 - DNA, 20 bp, mouse
ggggtcgcgcggctgccgga

SEQ ID NO: 819309 - DNA, 20 bp, mouse
gtgcgagggggtgaggaaaa

SEQ ID NO: 819310 - DNA, 20 bp, mouse
gaccgcgctgcgagggggtg

SEQ ID NO: 819311 - DNA, 20 bp, mouse
ggtgggccaccgcgctgcga

SEQ ID NO: 819312 - DNA, 20 bp, mouse
ggcccactagctccagcggt

SEQ ID NO: 819313 - DNA, 20 bp, mouse
gcagacggttgggcgctgca

SEQ ID NO: 819314 - DNA, 20 bp, mouse
gcgcccgctccgccgaccgc

SEQ ID NO: 819315 - DNA, 20 bp, mouse
gttgcagaactacatctccc

SEQ ID NO: 819316 - DNA, 20 bp, mouse
ggggaggcattgattttgtg

SEQ ID NO: 819317 - DNA, 20 bp, mouse
gttagactgaagttcggaca

SEQ ID NO: 819318 - DNA, 20 bp, mouse
gtcgacgccccagggtagca

SEQ ID NO: 819319 - DNA, 20 bp, mouse
gtcttggctcggggattggg

SEQ ID NO: 819320 - DNA, 20 bp, mouse
gtgcccgagtattttggttc

SEQ ID NO: 819321 - DNA, 20 bp, mouse
gtctcttccctgctaccctg

SEQ ID NO: 819322 - DNA, 20 bp, mouse
gcgggcaaatcgacgcccca

SEQ ID NO: 819323 - DNA, 20 bp, mouse
gacccggaaccaaaatactc

SEQ ID NO: 819324 - DNA, 20 bp, mouse
gggcggggcgcgcgttctcc

SEQ ID NO: 819325 - DNA, 20 bp, mouse
gggaagcagtgactctccta

SEQ ID NO: 819326 - DNA, 20 bp, mouse
ggcggccccgagggacactg

SEQ ID NO: 819327 - DNA, 20 bp, mouse
gccaccccgcagtgtccctc

SEQ ID NO: 819328 - DNA, 20 bp, mouse
gtctctgcggggagggactc

SEQ ID NO: 819329 - DNA, 20 bp, mouse
gcctgcgcgtcactcggcgg

SEQ ID NO: 819330 - DNA, 20 bp, mouse
gtgacgcgcaggcgtagtag

SEQ ID NO: 819331 - DNA, 20 bp, mouse
gaggcgtagtaggggagctc

SEQ ID NO: 819332 - DNA, 20 bp, mouse
gctgtgggcgccaaggatat

SEQ ID NO: 819333 - DNA, 20 bp, mouse
gcggcggcgtcacgggactg

SEQ ID NO: 819334 - DNA, 20 bp, mouse
ggccgcggggcctgcgaacc

SEQ ID NO: 819335 - DNA, 20 bp, mouse
gaacgccgcgcccggttcgc

SEQ ID NO: 819336 - DNA, 20 bp, mouse
gcccactggcagcttcgctg

SEQ ID NO: 819337 - DNA, 20 bp, mouse
ggtggggcggagcttgaagg

SEQ ID NO: 819338 - DNA, 20 bp, mouse
ggagcctctgcccgccggga

SEQ ID NO: 819339 - DNA, 20 bp, mouse
gagggtggggcggagcttga

SEQ ID NO: 819340 - DNA, 20 bp, mouse
gcggcaggaagtgcgcccac

SEQ ID NO: 819341 - DNA, 20 bp, mouse
ggggcggggctgagagccgt

SEQ ID NO: 819342 - DNA, 20 bp, mouse
gcctctgcccgccgggaggg

SEQ ID NO: 819343 - DNA, 20 bp, mouse
gtctgcgtgtgcagtgtggc

SEQ ID NO: 819344 - DNA, 20 bp, mouse
gaaagggttacgtggctcag

SEQ ID NO: 819345 - DNA, 20 bp, mouse
gcgcacttcctgccgggagg

SEQ ID NO: 819346 - DNA, 20 bp, mouse
gagggttcagagggacctca

SEQ ID NO: 819347 - DNA, 20 bp, mouse
gcacacaatcagggttcaga

SEQ ID NO: 819348 - DNA, 20 bp, mouse
ggatgccagatctcaggcca

SEQ ID NO: 819349 - DNA, 20 bp, mouse
gctagtccagcctgagaatc

SEQ ID NO: 819350 - DNA, 20 bp, mouse
gctgccttgggtctgcgggt

SEQ ID NO: 819351 - DNA, 20 bp, mouse
gcaggccagggtcaccctgg

SEQ ID NO: 819352 - DNA, 20 bp, mouse
gaacgtgcctctgtggtgca

SEQ ID NO: 819353 - DNA, 20 bp, mouse
gggaggaaaacgtgcctctg

SEQ ID NO: 819354 - DNA, 20 bp, mouse
ggtgcctctgtggtgcaggg

SEQ ID NO: 819355 - DNA, 20 bp, mouse
ggaatcaggctgaggtttag

SEQ ID NO: 819356 - DNA, 20 bp, mouse
gggccagggcctgagggtag

SEQ ID NO: 819357 - DNA, 20 bp, mouse
gggaacggccggattcgtag

SEQ ID NO: 819358 - DNA, 20 bp, mouse
gaagaaggcgggtcccggaa

SEQ ID NO: 819359 - DNA, 20 bp, mouse
ggggacccgccttcttctaa

SEQ ID NO: 819360 - DNA, 20 bp, mouse
ggggaactcgagtgggtcag

SEQ ID NO: 819361 - DNA, 20 bp, mouse
ggccctggcctatcctggtc

SEQ ID NO: 819362 - DNA, 20 bp, mouse
gaggtggacccctacgaatc

SEQ ID NO: 819363 - DNA, 20 bp, mouse
gctggcccgggtgtgaaaac

SEQ ID NO: 819364 - DNA, 20 bp, mouse
gggtcacgtgtcagtcccgc

SEQ ID NO: 819365 - DNA, 20 bp, mouse
gcagaaagccggaccaggat

SEQ ID NO: 819366 - DNA, 20 bp, mouse
gggcaaggagggagctataa

SEQ ID NO: 819367 - DNA, 20 bp, mouse
ggagctgtgcggtccctgac

SEQ ID NO: 819368 - DNA, 20 bp, mouse
gtccaggaggcgaagctcga

SEQ ID NO: 819369 - DNA, 20 bp, mouse
gccggccaccgggactgaac

SEQ ID NO: 819370 - DNA, 20 bp, mouse
gaaggccggcggtggcaccc

SEQ ID NO: 819371 - DNA, 20 bp, mouse
gaggaggcgaagctcgaagg

SEQ ID NO: 819372 - DNA, 20 bp, mouse
gagaaccgcctcggctgcag

SEQ ID NO: 819373 - DNA, 20 bp, mouse
gctgcaggggagcagagctg

SEQ ID NO: 819374 - DNA, 20 bp, mouse
gagggagggcgcccgccaga

SEQ ID NO: 819375 - DNA, 20 bp, mouse
gcctctctccggttcagtcc

SEQ ID NO: 819376 - DNA, 20 bp, mouse
gaaagctagggcgactacag

SEQ ID NO: 819377 - DNA, 20 bp, mouse
gcctgcgaccgagggaggta

SEQ ID NO: 819378 - DNA, 20 bp, mouse
ggggaggtaggggaaagcta

SEQ ID NO: 819379 - DNA, 20 bp, mouse
gtagggcgactacagagggt

SEQ ID NO: 819380 - DNA, 20 bp, mouse
gcaagacctgcgaccgaggg

SEQ ID NO: 819381 - DNA, 20 bp, mouse
gaggggatcgccaatctgag

SEQ ID NO: 819382 - DNA, 20 bp, mouse
ggcccacagaaactcctcct

SEQ ID NO: 819383 - DNA, 20 bp, mouse
gagaaactcctcctaggcag

SEQ ID NO: 819384 - DNA, 20 bp, mouse
gcagccaagacctgcgaccg

SEQ ID NO: 819385 - DNA, 20 bp, mouse
ggcctaggaggagtttctgt

SEQ ID NO: 819386 - DNA, 20 bp, mouse
gggcgcccgcgcttctgctt

SEQ ID NO: 819387 - DNA, 20 bp, mouse
ggcccgcgcttctgcttcgg

SEQ ID NO: 819388 - DNA, 20 bp, mouse
ggaaagtacgggtcccgaga

SEQ ID NO: 819389 - DNA, 20 bp, mouse
ggcccccgaagcagaagcgc

SEQ ID NO: 819390 - DNA, 20 bp, mouse
gagggccgcgacgggaacgc

SEQ ID NO: 819391 - DNA, 20 bp, mouse
gtaaatagaaggtcggtcag

SEQ ID NO: 819392 - DNA, 20 bp, mouse
gggaggggatggcgcctcac

SEQ ID NO: 819393 - DNA, 20 bp, mouse
gtcccgagagggttgtttgc

SEQ ID NO: 819394 - DNA, 20 bp, mouse
gcgttcccgtcgcacctgtg

SEQ ID NO: 819395 - DNA, 20 bp, mouse
gaacgccgtagtgcatgctg

SEQ ID NO: 819396 - DNA, 20 bp, mouse
gccccccgcccgctctagga

SEQ ID NO: 819397 - DNA, 20 bp, mouse
ggctcactgctggcgagctc

SEQ ID NO: 819398 - DNA, 20 bp, mouse
ggggggagcagtccctgaag

SEQ ID NO: 819399 - DNA, 20 bp, mouse
gttgctccaggtaagaggga

SEQ ID NO: 819400 - DNA, 20 bp, mouse
gtcctttgctccaggtaaga

SEQ ID NO: 819401 - DNA, 20 bp, mouse
gtccaggtaagagggagggt

SEQ ID NO: 819402 - DNA, 20 bp, mouse
gctgaaggggaaaggacgca

SEQ ID NO: 819403 - DNA, 20 bp, mouse
ggagcagcgactatcgctct

SEQ ID NO: 819404 - DNA, 20 bp, mouse
ggatagtcgctgctcactgc

SEQ ID NO: 819405 - DNA, 20 bp, mouse
gactgctccccctcctagag

SEQ ID NO: 819406 - DNA, 20 bp, mouse
gccggggcgggagagcggtg

SEQ ID NO: 819407 - DNA, 20 bp, mouse
ggtgcgcagacgcggaactg

SEQ ID NO: 819408 - DNA, 20 bp, mouse
gctcccccgcgcgcgcccat

SEQ ID NO: 819409 - DNA, 20 bp, mouse
gtctccatggcccaccctgg

SEQ ID NO: 819410 - DNA, 20 bp, mouse
gcgcgtctgcgcacggccga

SEQ ID NO: 819411 - DNA, 20 bp, mouse
ggactctaggaacaccgcca

SEQ ID NO: 819412 - DNA, 20 bp, mouse
gtctgagccaggttgtggct

SEQ ID NO: 819413 - DNA, 20 bp, mouse
ggtatctccatggcccaccc

SEQ ID NO: 819414 - DNA, 20 bp, mouse
gtctaggaacaccgccaggg

SEQ ID NO: 819415 - DNA, 20 bp, mouse
gcgggctgtagatctgagcc

SEQ ID NO: 819416 - DNA, 20 bp, mouse
gtggttggggcgtggctcgt

SEQ ID NO: 819417 - DNA, 20 bp, mouse
gggcgtggcgaggttggcat

SEQ ID NO: 819418 - DNA, 20 bp, mouse
gaatggcagcgtgggtcaga

SEQ ID NO: 819419 - DNA, 20 bp, mouse
ggggcgtggctcgtgggtag

SEQ ID NO: 819420 - DNA, 20 bp, mouse
gtactgcttggggtgagcgg

SEQ ID NO: 819421 - DNA, 20 bp, mouse
ggggcgtggtcttactgctt

SEQ ID NO: 819422 - DNA, 20 bp, mouse
gctgctggctaagagcgggg

SEQ ID NO: 819423 - DNA, 20 bp, mouse
gtggctcgtgggtaggggcg

SEQ ID NO: 819424 - DNA, 20 bp, mouse
gtggctaagagcggggaggt

SEQ ID NO: 819425 - DNA, 20 bp, mouse
gcggggaggtgggtgcgcac

SEQ ID NO: 819426 - DNA, 20 bp, mouse
gacagctcagttagggaggg

SEQ ID NO: 819427 - DNA, 20 bp, mouse
gaaggattacagctcagtta

SEQ ID NO: 819428 - DNA, 20 bp, mouse
gaggcttcacctgtgtgaat

SEQ ID NO: 819429 - DNA, 20 bp, mouse
ggattacagctcagttaggg

SEQ ID NO: 819430 - DNA, 20 bp, mouse
gacaggtgaagcctcctgca

SEQ ID NO: 819431 - DNA, 20 bp, mouse
ggaagacagcagcactacga

SEQ ID NO: 819432 - DNA, 20 bp, mouse
ggtgtgaatgggtaaattca

SEQ ID NO: 819433 - DNA, 20 bp, mouse
ggccagcatagggaacgggg

SEQ ID NO: 819434 - DNA, 20 bp, mouse
gacctctggccccacactta

SEQ ID NO: 819435 - DNA, 20 bp, mouse
gtgagccagcatagggaacg

SEQ ID NO: 819436 - DNA, 20 bp, mouse
gcccggggatcaccgttctc

SEQ ID NO: 819437 - DNA, 20 bp, mouse
gcggacgggcgtcggggtcg

SEQ ID NO: 819438 - DNA, 20 bp, mouse
gccagccagggccctgcgct

SEQ ID NO: 819439 - DNA, 20 bp, mouse
gggcggctgcggggtcggac

SEQ ID NO: 819440 - DNA, 20 bp, mouse
gcggcgccgcgcccagcgaa

SEQ ID NO: 819441 - DNA, 20 bp, mouse
gccaagcctcccatggaccg

SEQ ID NO: 819442 - DNA, 20 bp, mouse
gagcgccgagagcaggactg

SEQ ID NO: 819443 - DNA, 20 bp, mouse
ggcacgccgcggtccatggg

SEQ ID NO: 819444 - DNA, 20 bp, mouse
gggctccgagcgcagggccc

SEQ ID NO: 819445 - DNA, 20 bp, mouse
ggcggggcttgctgagggat

SEQ ID NO: 819446 - DNA, 20 bp, mouse
ggggtaccctagatatggga

SEQ ID NO: 819447 - DNA, 20 bp, mouse
gacgccccctcccatatcta

SEQ ID NO: 819448 - DNA, 20 bp, mouse
gccacactggaggagagttg

SEQ ID NO: 819449 - DNA, 20 bp, mouse
ggtagctagagaagcccagt

SEQ ID NO: 819450 - DNA, 20 bp, mouse
gcatatctagggtacccact

SEQ ID NO: 819451 - DNA, 20 bp, mouse
gaggttggggcggagaacgg

SEQ ID NO: 819452 - DNA, 20 bp, mouse
gcagcctgcgagatgggaca

SEQ ID NO: 819453 - DNA, 20 bp, mouse
ggatgccattggtggtcctg

SEQ ID NO: 819454 - DNA, 20 bp, mouse
ggacgccgcaggaccaccaa

SEQ ID NO: 819455 - DNA, 20 bp, mouse
gggcctcctcgtagccacac

SEQ ID NO: 819456 - DNA, 20 bp, mouse
gaagctgatcatagtggttg

SEQ ID NO: 819457 - DNA, 20 bp, mouse
gtctgtgcatcaggttgtga

SEQ ID NO: 819458 - DNA, 20 bp, mouse
gcctccctgaccttcagtct

SEQ ID NO: 819459 - DNA, 20 bp, mouse
gagcgtgaagctgatcatag

SEQ ID NO: 819460 - DNA, 20 bp, mouse
gctaaccctcaacggggctc

SEQ ID NO: 819461 - DNA, 20 bp, mouse
ggggaagagctgacactgag

SEQ ID NO: 819462 - DNA, 20 bp, mouse
gtttctgagggcacaggatg

SEQ ID NO: 819463 - DNA, 20 bp, mouse
ggccccgttgagggttagat

SEQ ID NO: 819464 - DNA, 20 bp, mouse
gtctaccaagactgaaggtc

SEQ ID NO: 819465 - DNA, 20 bp, mouse
gcctcaacggggctccggaa

SEQ ID NO: 819466 - DNA, 20 bp, mouse
gtgagcggggaggggtccga

SEQ ID NO: 819467 - DNA, 20 bp, mouse
ggaggggtccgagggagggg

SEQ ID NO: 819468 - DNA, 20 bp, mouse
ggagcaggaggggtcgtcgc

SEQ ID NO: 819469 - DNA, 20 bp, mouse
ggggagggactgagcgggga

SEQ ID NO: 819470 - DNA, 20 bp, mouse
gggaggtggcggctccgagt

SEQ ID NO: 819471 - DNA, 20 bp, mouse
gcccgccgcccaggagcagg

SEQ ID NO: 819472 - DNA, 20 bp, mouse
gctcccgagctccgtgacgt

SEQ ID NO: 819473 - DNA, 20 bp, mouse
gacgcccgctcgcgagcggg

SEQ ID NO: 819474 - DNA, 20 bp, mouse
gcatccgcgtctacaacgac

SEQ ID NO: 819475 - DNA, 20 bp, mouse
gccgtgacgtgggctccggt

SEQ ID NO: 819476 - DNA, 20 bp, mouse
gaccccagaggtcccaatgt

SEQ ID NO: 819477 - DNA, 20 bp, mouse
gaggggcccgcacgcggctc

SEQ ID NO: 819478 - DNA, 20 bp, mouse
gcccgcgctagcatcccaca

SEQ ID NO: 819479 - DNA, 20 bp, mouse
gcgcacgcggctctggagga

SEQ ID NO: 819480 - DNA, 20 bp, mouse
gcgctagcatcccacacggc

SEQ ID NO: 819481 - DNA, 20 bp, mouse
gtcccacattgggacctctg

SEQ ID NO: 819482 - DNA, 20 bp, mouse
gcgaggcgaaaccaagttag

SEQ ID NO: 819483 - DNA, 20 bp, mouse
ggccgaatggccaacgggag

SEQ ID NO: 819484 - DNA, 20 bp, mouse
gggcccgcacgcggctctgg

SEQ ID NO: 819485 - DNA, 20 bp, mouse
gggcaggaaggaccctggca

SEQ ID NO: 819486 - DNA, 20 bp, mouse
ggggctgcggtcacgtgagg

SEQ ID NO: 819487 - DNA, 20 bp, mouse
ggccccggccgctaatgcgc

SEQ ID NO: 819488 - DNA, 20 bp, mouse
gggtgctggtggctgcgggg

SEQ ID NO: 819489 - DNA, 20 bp, mouse
ggggagcgagggaggcgcgt

SEQ ID NO: 819490 - DNA, 20 bp, mouse
gcgggggctgcggtcacgtg

SEQ ID NO: 819491 - DNA, 20 bp, mouse
gcagaggagggcggagtcgc

SEQ ID NO: 819492 - DNA, 20 bp, mouse
gacacaggggcaggtactgg

SEQ ID NO: 819493 - DNA, 20 bp, mouse
ggctaatgcgcaggcttcaa

SEQ ID NO: 819494 - DNA, 20 bp, mouse
gaaagcgctggcgggggctg

SEQ ID NO: 819495 - DNA, 20 bp, mouse
gcgggtggagagagccggtg

SEQ ID NO: 819496 - DNA, 20 bp, mouse
gccgccgagactcaccgaga

SEQ ID NO: 819497 - DNA, 20 bp, mouse
gtgtgcgcggagggcgaggg

SEQ ID NO: 819498 - DNA, 20 bp, mouse
gtctccctctcggtgagtct

SEQ ID NO: 819499 - DNA, 20 bp, mouse
gctgaaaggctgtgcgcgga

SEQ ID NO: 819500 - DNA, 20 bp, mouse
gggactcgggggacgagcat

SEQ ID NO: 819501 - DNA, 20 bp, mouse
gcggcgcgaggctgcccgac

SEQ ID NO: 819502 - DNA, 20 bp, mouse
gggagcgcgcgggcagttct

SEQ ID NO: 819503 - DNA, 20 bp, mouse
ggcgccctctggtggactcg

SEQ ID NO: 819504 - DNA, 20 bp, mouse
gctgagaaggaatgtcgact

SEQ ID NO: 819505 - DNA, 20 bp, mouse
ggtcccccgagtccaccaga

SEQ ID NO: 819506 - DNA, 20 bp, mouse
ggctgcccgtgcttgcagag

SEQ ID NO: 819507 - DNA, 20 bp, mouse
ggagccacagcacgatgcag

SEQ ID NO: 819508 - DNA, 20 bp, mouse
ggcatcgtgctgtggctcct

SEQ ID NO: 819509 - DNA, 20 bp, mouse
ggaggtacggacatacggaa

SEQ ID NO: 819510 - DNA, 20 bp, mouse
gcgcgccagagcgcgggaag

SEQ ID NO: 819511 - DNA, 20 bp, mouse
gaaggtatgtcacacacgcc

SEQ ID NO: 819512 - DNA, 20 bp, mouse
gaggactgcacggcgcggag

SEQ ID NO: 819513 - DNA, 20 bp, mouse
ggcgacctcgggccggacct

SEQ ID NO: 819514 - DNA, 20 bp, mouse
gtgagggaaacaggactgca

SEQ ID NO: 819515 - DNA, 20 bp, mouse
gggcgagcgcgccagagcgc

SEQ ID NO: 819516 - DNA, 20 bp, mouse
gtgggccacgcctctctgaa

SEQ ID NO: 819517 - DNA, 20 bp, mouse
gggaggggagagggtgacga

SEQ ID NO: 819518 - DNA, 20 bp, mouse
ggggagagaggctgacacgt

SEQ ID NO: 819519 - DNA, 20 bp, mouse
gggaatggaaaatacctccc

SEQ ID NO: 819520 - DNA, 20 bp, mouse
gccggcggccaatccagagg

SEQ ID NO: 819521 - DNA, 20 bp, mouse
gccccgcctgccattggtca

SEQ ID NO: 819522 - DNA, 20 bp, mouse
gaggcggccgggaaggggtg

SEQ ID NO: 819523 - DNA, 20 bp, mouse
gaggtgggcgggactcccgg

SEQ ID NO: 819524 - DNA, 20 bp, mouse
gaggggaggccggcgagtta

SEQ ID NO: 819525 - DNA, 20 bp, mouse
ggaaaatacctcccggggtg

SEQ ID NO: 819526 - DNA, 20 bp, mouse
ggggcggggcccgcggtcgt

SEQ ID NO: 819527 - DNA, 20 bp, mouse
gagccagagaaagtgggcga

SEQ ID NO: 819528 - DNA, 20 bp, mouse
gggtaggcggggcgtcgcgt

SEQ ID NO: 819529 - DNA, 20 bp, mouse
ggcggggcgtcgcgtgggga

SEQ ID NO: 819530 - DNA, 20 bp, mouse
ggctgctcaagagccctcgg

SEQ ID NO: 819531 - DNA, 20 bp, mouse
gcgctcgcacccacgaccgc

SEQ ID NO: 819532 - DNA, 20 bp, mouse
gtggagctcctgcaattaat

SEQ ID NO: 819533 - DNA, 20 bp, mouse
gcaagagccctcgggggaaa

SEQ ID NO: 819534 - DNA, 20 bp, mouse
gctcttgagcagctgcaacc

SEQ ID NO: 819535 - DNA, 20 bp, mouse
gcagcacagcccggtaggcg

SEQ ID NO: 819536 - DNA, 20 bp, mouse
gaaaaagcaggggtcggtgc

SEQ ID NO: 819537 - DNA, 20 bp, mouse
gccccagggtgcgcaagcgt

SEQ ID NO: 819538 - DNA, 20 bp, mouse
gtgcgcaccctggggaaagg

SEQ ID NO: 819539 - DNA, 20 bp, mouse
gtggccgtctgctgcatctg

SEQ ID NO: 819540 - DNA, 20 bp, mouse
gaggccccagatgcagcaga

SEQ ID NO: 819541 - DNA, 20 bp, mouse
gggacaggaagtgacgtcta

SEQ ID NO: 819542 - DNA, 20 bp, mouse
gagacggccaatagctacca

SEQ ID NO: 819543 - DNA, 20 bp, mouse
gtcggtgccggagaccacgg

SEQ ID NO: 819544 - DNA, 20 bp, mouse
ggcttgcgcaccctggggaa

SEQ ID NO: 819545 - DNA, 20 bp, mouse
gagtgcaggcctcgggaccc

SEQ ID NO: 819546 - DNA, 20 bp, mouse
gggccagggagctccacgaa

SEQ ID NO: 819547 - DNA, 20 bp, mouse
gcggactgagaaagttcccg

SEQ ID NO: 819548 - DNA, 20 bp, mouse
gcgcccttcgtggagctccc

SEQ ID NO: 819549 - DNA, 20 bp, mouse
gcacgcgggcctcgtgttct

SEQ ID NO: 819550 - DNA, 20 bp, mouse
gttccccgctcaggctcctc

SEQ ID NO: 819551 - DNA, 20 bp, mouse
ggcggggcacgctgggggcg

SEQ ID NO: 819552 - DNA, 20 bp, mouse
gccagcgtgccccgcggcca

SEQ ID NO: 819553 - DNA, 20 bp, mouse
gaagggcgggcggaggccgc

SEQ ID NO: 819554 - DNA, 20 bp, mouse
gggaggccgcgggtagcgat

SEQ ID NO: 819555 - DNA, 20 bp, mouse
ggcccgcgtgcgcgcctgga

SEQ ID NO: 819556 - DNA, 20 bp, mouse
ggggccaaggccgatggtgg

SEQ ID NO: 819557 - DNA, 20 bp, mouse
ggggccgccctgtccagctc

SEQ ID NO: 819558 - DNA, 20 bp, mouse
gggcccggcgcataacggag

SEQ ID NO: 819559 - DNA, 20 bp, mouse
ggaggggcggagccacaccg

SEQ ID NO: 819560 - DNA, 20 bp, mouse
gccacaccgcggggcggacg

SEQ ID NO: 819561 - DNA, 20 bp, mouse
ggcggggccaaggccgatgg

SEQ ID NO: 819562 - DNA, 20 bp, mouse
gtgcccgcagcgcccatcag

SEQ ID NO: 819563 - DNA, 20 bp, mouse
gacggagcggcatcctggga

SEQ ID NO: 819564 - DNA, 20 bp, mouse
gcataacggagcggcatcct

SEQ ID NO: 819565 - DNA, 20 bp, mouse
ggcgcccatcagcggagggg

SEQ ID NO: 819566 - DNA, 20 bp, mouse
gactgcgtctgcacgagcca

SEQ ID NO: 819567 - DNA, 20 bp, mouse
ggggaggaaggtcattgggc

SEQ ID NO: 819568 - DNA, 20 bp, mouse
gcagtgggaaagggactggg

SEQ ID NO: 819569 - DNA, 20 bp, mouse
gggagtggtcagcaaatggg

SEQ ID NO: 819570 - DNA, 20 bp, mouse
gggaggagaaaggaataaga

SEQ ID NO: 819571 - DNA, 20 bp, mouse
gcagaaccagcagtgggaaa

SEQ ID NO: 819572 - DNA, 20 bp, mouse
gcagcagggaggccagcccg

SEQ ID NO: 819573 - DNA, 20 bp, mouse
gcgggggagtggtcagcaaa

SEQ ID NO: 819574 - DNA, 20 bp, mouse
gggcaagcagaaccagcagt

SEQ ID NO: 819575 - DNA, 20 bp, mouse
gatgtctttcgtgacttccc

SEQ ID NO: 819576 - DNA, 20 bp, mouse
gccgcctcggactcccagtc

SEQ ID NO: 819577 - DNA, 20 bp, mouse
gggagctggcggggctgcgt

SEQ ID NO: 819578 - DNA, 20 bp, mouse
ggcaacagcgaccccctcga

SEQ ID NO: 819579 - DNA, 20 bp, mouse
gcggctcggcgaacaaaagg

SEQ ID NO: 819580 - DNA, 20 bp, mouse
ggggcccgcctgaccctcga

SEQ ID NO: 819581 - DNA, 20 bp, mouse
gcggactcccagtccggctg

SEQ ID NO: 819582 - DNA, 20 bp, mouse
gggacgcgagcggggagcga

SEQ ID NO: 819583 - DNA, 20 bp, mouse
ggctggcggggctgcgtggg

SEQ ID NO: 819584 - DNA, 20 bp, mouse
ggccctggcctcagccggac

SEQ ID NO: 819585 - DNA, 20 bp, mouse
ggccgagcaggctgcagtcg

SEQ ID NO: 819586 - DNA, 20 bp, mouse
ggtagccccagtacatccaa

SEQ ID NO: 819587 - DNA, 20 bp, mouse
gaccctgagccggctaggaa

SEQ ID NO: 819588 - DNA, 20 bp, mouse
gcctgctagcgggacgggga

SEQ ID NO: 819589 - DNA, 20 bp, mouse
gcaggtgcaggcggggtaga

SEQ ID NO: 819590 - DNA, 20 bp, mouse
gcgtggacgcgtgggcactc

SEQ ID NO: 819591 - DNA, 20 bp, mouse
gggcctgggcagctctgaaa

SEQ ID NO: 819592 - DNA, 20 bp, mouse
gctctgctgcgtggacgcgt

SEQ ID NO: 819593 - DNA, 20 bp, mouse
ggtgggcagcgaagcgaaga

SEQ ID NO: 819594 - DNA, 20 bp, mouse
gaggcaggagtcagatagag

SEQ ID NO: 819595 - DNA, 20 bp, mouse
gctaccaccctgagccggct

SEQ ID NO: 819596 - DNA, 20 bp, mouse
gccgctgtcccacagacaaa

SEQ ID NO: 819597 - DNA, 20 bp, mouse
gccagctcgggcggagtcct

SEQ ID NO: 819598 - DNA, 20 bp, mouse
gaataccgctgcacttcctg

SEQ ID NO: 819599 - DNA, 20 bp, mouse
gctcaagaaccctttgtctg

SEQ ID NO: 819600 - DNA, 20 bp, mouse
ggaaagagggcgggattgaa

SEQ ID NO: 819601 - DNA, 20 bp, mouse
gaagggttcttgaggagata

SEQ ID NO: 819602 - DNA, 20 bp, mouse
ggacgagcattgtctattcg

SEQ ID NO: 819603 - DNA, 20 bp, mouse
gctagagactccgctgggtc

SEQ ID NO: 819604 - DNA, 20 bp, mouse
gtggcctttagcgaggagag

SEQ ID NO: 819605 - DNA, 20 bp, mouse
gccggactgggctggaaaga

SEQ ID NO: 819606 - DNA, 20 bp, mouse
ggagctgcaagctatcacgt

SEQ ID NO: 819607 - DNA, 20 bp, mouse
gggcaagcccagcacgaagt

SEQ ID NO: 819608 - DNA, 20 bp, mouse
ggagacgcttgcataagagt

SEQ ID NO: 819609 - DNA, 20 bp, mouse
ggggctgtgatcaggtcacg

SEQ ID NO: 819610 - DNA, 20 bp, mouse
gtatcacgtgggctgtgatc

SEQ ID NO: 819611 - DNA, 20 bp, mouse
gtaggcagagtcatcttggg

SEQ ID NO: 819612 - DNA, 20 bp, mouse
gagggagtcaaacacgagaa

SEQ ID NO: 819613 - DNA, 20 bp, mouse
gagcacgaagtgggcaggtg

SEQ ID NO: 819614 - DNA, 20 bp, mouse
gaaggtctgcacgtgaagca

SEQ ID NO: 819615 - DNA, 20 bp, mouse
ggtctctagtggatttctag

SEQ ID NO: 819616 - DNA, 20 bp, mouse
gggcacgccactcaaacctc

SEQ ID NO: 819617 - DNA, 20 bp, mouse
ggcaaggctctactacgcat

SEQ ID NO: 819618 - DNA, 20 bp, mouse
gagggtgtgctgcgatgcct

SEQ ID NO: 819619 - DNA, 20 bp, mouse
gagccctgggcagagtgacg

SEQ ID NO: 819620 - DNA, 20 bp, mouse
ggtgctgcgatgcctggggt

SEQ ID NO: 819621 - DNA, 20 bp, mouse
ggcgtccccccggggactgt

SEQ ID NO: 819622 - DNA, 20 bp, mouse
ggcagggagcgcgtcccccc

SEQ ID NO: 819623 - DNA, 20 bp, mouse
gcgccactcaaacctcgggc

SEQ ID NO: 819624 - DNA, 20 bp, mouse
gcggggactgtgggagccct

SEQ ID NO: 819625 - DNA, 20 bp, mouse
ggtagctcaggagacccgga

SEQ ID NO: 819626 - DNA, 20 bp, mouse
ggtcagcagctctaccccgg

SEQ ID NO: 819627 - DNA, 20 bp, mouse
gaactcggccgccatgttag

SEQ ID NO: 819628 - DNA, 20 bp, mouse
gggcggctcagaaacagcgg

SEQ ID NO: 819629 - DNA, 20 bp, mouse
gacaggagaagtcgctcccg

SEQ ID NO: 819630 - DNA, 20 bp, mouse
gtgttcgctgattggctcgt

SEQ ID NO: 819631 - DNA, 20 bp, mouse
gtgggtggagcgagcccgtg

SEQ ID NO: 819632 - DNA, 20 bp, mouse
gcctgcgtcaaccactaaca

SEQ ID NO: 819633 - DNA, 20 bp, mouse
ggcctgcggggactcctaag

SEQ ID NO: 819634 - DNA, 20 bp, mouse
gtggcggccgagttcgtgcg

SEQ ID NO: 819635 - DNA, 20 bp, mouse
gcgggccggtgttcgctgat

SEQ ID NO: 819636 - DNA, 20 bp, mouse
gcacagattccgaggacctg

SEQ ID NO: 819637 - DNA, 20 bp, mouse
gggtgaaccggaagcctggc

SEQ ID NO: 819638 - DNA, 20 bp, mouse
gaggatgacgaagtgaagca

SEQ ID NO: 819639 - DNA, 20 bp, mouse
gggcacttggcccctgattc

SEQ ID NO: 819640 - DNA, 20 bp, mouse
ggcgagatgccccaggtcct

SEQ ID NO: 819641 - DNA, 20 bp, mouse
gagcttgcctaactatgctg

SEQ ID NO: 819642 - DNA, 20 bp, mouse
gcagccaagcactaacacag

SEQ ID NO: 819643 - DNA, 20 bp, mouse
gattgtatctaaacatcgtc

SEQ ID NO: 819644 - DNA, 20 bp, mouse
gaacaaaatactatcatcag

SEQ ID NO: 819645 - DNA, 20 bp, mouse
gaactgggggacttatcatt

SEQ ID NO: 819646 - DNA, 20 bp, mouse
gtgagcgtaggcaaaggtta

SEQ ID NO: 819647 - DNA, 20 bp, mouse
gggagtgcgctgagacgaag

SEQ ID NO: 819648 - DNA, 20 bp, mouse
gtaggggaaatattgagcgt

SEQ ID NO: 819649 - DNA, 20 bp, mouse
gtaggcaaaggttaaggcag

SEQ ID NO: 819650 - DNA, 20 bp, mouse
gtctctgactgtatccctag

SEQ ID NO: 819651 - DNA, 20 bp, mouse
ggcagccaatcagatgaaga

SEQ ID NO: 819652 - DNA, 20 bp, mouse
gaaactcgctcaacttaacc

SEQ ID NO: 819653 - DNA, 20 bp, mouse
gctggcacagattccctaat

SEQ ID NO: 819654 - DNA, 20 bp, mouse
gagtcagagaattgcccatt

SEQ ID NO: 819655 - DNA, 20 bp, mouse
gtagaccctcttcatctgat

SEQ ID NO: 819656 - DNA, 20 bp, mouse
gcggctgcagagagctcatt

SEQ ID NO: 819657 - DNA, 20 bp, mouse
gtagaaaagcaggtggggcg

SEQ ID NO: 819658 - DNA, 20 bp, mouse
gtgtctgttggctgttgcta

SEQ ID NO: 819659 - DNA, 20 bp, mouse
gctaggtgaaacatttaaaa

SEQ ID NO: 819660 - DNA, 20 bp, mouse
gaaactcatcattttttcga

SEQ ID NO: 819661 - DNA, 20 bp, mouse
ggttccaattagtgcctctc

SEQ ID NO: 819662 - DNA, 20 bp, mouse
gaggcactaattggaaccat

SEQ ID NO: 819663 - DNA, 20 bp, mouse
gtcgccagagaggcactaat

SEQ ID NO: 819664 - DNA, 20 bp, mouse
gggaccagccattttactta

SEQ ID NO: 819665 - DNA, 20 bp, mouse
gagagctcattgggttccac

SEQ ID NO: 819666 - DNA, 20 bp, mouse
gggaaggcacaggggaacta

SEQ ID NO: 819667 - DNA, 20 bp, mouse
gaggcctggggcacgagctc

SEQ ID NO: 819668 - DNA, 20 bp, mouse
gtgccagtgccgactcccag

SEQ ID NO: 819669 - DNA, 20 bp, mouse
gccgactcccagaggcacaa

SEQ ID NO: 819670 - DNA, 20 bp, mouse
gtgcctctgggagtcggcac

SEQ ID NO: 819671 - DNA, 20 bp, mouse
ggctctgggcacccgcctgc

SEQ ID NO: 819672 - DNA, 20 bp, mouse
ggatagccagctcccctcga

SEQ ID NO: 819673 - DNA, 20 bp, mouse
gtggggcacgagctctgggt

SEQ ID NO: 819674 - DNA, 20 bp, mouse
gggtgggagctcaaggaccc

SEQ ID NO: 819675 - DNA, 20 bp, mouse
gtgactcaacccactggtgg

SEQ ID NO: 819676 - DNA, 20 bp, mouse
gtgccgggaggggccaccga

SEQ ID NO: 819677 - DNA, 20 bp, mouse
gaaaggggcgggagggctgg

SEQ ID NO: 819678 - DNA, 20 bp, mouse
ggctcccgggggaccctcgg

SEQ ID NO: 819679 - DNA, 20 bp, mouse
gaggcaggagacaggcccgg

SEQ ID NO: 819680 - DNA, 20 bp, mouse
gaacaaggcaacacccgctt

SEQ ID NO: 819681 - DNA, 20 bp, mouse
gtctgactccagctttgcgg

SEQ ID NO: 819682 - DNA, 20 bp, mouse
gccggcccccaccgcaaagc

SEQ ID NO: 819683 - DNA, 20 bp, mouse
ggggccaccgagggtccccc

SEQ ID NO: 819684 - DNA, 20 bp, mouse
gccaggaggcggtgccggga

SEQ ID NO: 819685 - DNA, 20 bp, mouse
gtccctgagtgccagagccc

SEQ ID NO: 819686 - DNA, 20 bp, mouse
gactcggcgcgccttgggga

SEQ ID NO: 819687 - DNA, 20 bp, mouse
gccgagctgcgctgtgtcca

SEQ ID NO: 819688 - DNA, 20 bp, mouse
gggagccgaactgaagtcac

SEQ ID NO: 819689 - DNA, 20 bp, mouse
ggggagggcgggctctgccg

SEQ ID NO: 819690 - DNA, 20 bp, mouse
gcgcctgctccgggagcctg

SEQ ID NO: 819691 - DNA, 20 bp, mouse
ggctgctcgccccaagagga

SEQ ID NO: 819692 - DNA, 20 bp, mouse
gagaggaagggtgcttgctc

SEQ ID NO: 819693 - DNA, 20 bp, mouse
ggagacgggacgcagtgccc

SEQ ID NO: 819694 - DNA, 20 bp, mouse
gcgccggctggcgacgcggg

SEQ ID NO: 819695 - DNA, 20 bp, mouse
gagccccaggctcccggagc

SEQ ID NO: 819696 - DNA, 20 bp, mouse
ggcccagcccagagctgcgg

SEQ ID NO: 819697 - DNA, 20 bp, mouse
gcgcaagccaccgcagctct

SEQ ID NO: 819698 - DNA, 20 bp, mouse
gaagaaggaaggggtcttgg

SEQ ID NO: 819699 - DNA, 20 bp, mouse
gcgctgctggagagagtcaa

SEQ ID NO: 819700 - DNA, 20 bp, mouse
gcactcaggacatcctggcc

SEQ ID NO: 819701 - DNA, 20 bp, mouse
gtgctcccttggctgcgtgg

SEQ ID NO: 819702 - DNA, 20 bp, mouse
ggcaggtggcggtgctccct

SEQ ID NO: 819703 - DNA, 20 bp, mouse
gagtcagggaggatgaaaag

SEQ ID NO: 819704 - DNA, 20 bp, mouse
gtgagcaagagcgcagagaa

SEQ ID NO: 819705 - DNA, 20 bp, mouse
ggcgcgcggccggcaggtgg

SEQ ID NO: 819706 - DNA, 20 bp, mouse
gccagaggggaagagtgtaa

SEQ ID NO: 819707 - DNA, 20 bp, mouse
ggggagcaagcgatccagag

SEQ ID NO: 819708 - DNA, 20 bp, mouse
gacggcgtgcgggaagtata

SEQ ID NO: 819709 - DNA, 20 bp, mouse
gcaagctagcgagtgtgtca

SEQ ID NO: 819710 - DNA, 20 bp, mouse
ggaggtgcgggtccgatgga

SEQ ID NO: 819711 - DNA, 20 bp, mouse
gtgcgggtccgatggagggg

SEQ ID NO: 819712 - DNA, 20 bp, mouse
gcatcggacccgcacctcgg

SEQ ID NO: 819713 - DNA, 20 bp, mouse
ggggtgattccaaaacccaa

SEQ ID NO: 819714 - DNA, 20 bp, mouse
ggtgaaaaggagtgttcaga

SEQ ID NO: 819715 - DNA, 20 bp, mouse
gggcaacgctagctggatct

SEQ ID NO: 819716 - DNA, 20 bp, mouse
gaggcggggtcgcgcgaggt

SEQ ID NO: 819717 - DNA, 20 bp, mouse
gcagcctacggaggccgtgg

SEQ ID NO: 819718 - DNA, 20 bp, mouse
gaatcccccacggcctccgt

SEQ ID NO: 819719 - DNA, 20 bp, mouse
gaacagcaagtttaagtctg

SEQ ID NO: 819720 - DNA, 20 bp, mouse
gaagcagcctacggaggccg

SEQ ID NO: 819721 - DNA, 20 bp, mouse
gggggtcgcgcgaggtggga

SEQ ID NO: 819722 - DNA, 20 bp, mouse
gggaggccgtgggggatttg

SEQ ID NO: 819723 - DNA, 20 bp, mouse
gcccgcgcttcgccttctct

SEQ ID NO: 819724 - DNA, 20 bp, mouse
gctcgcgcgaccccgcctcc

SEQ ID NO: 819725 - DNA, 20 bp, mouse
gctgctttctctctttactc

SEQ ID NO: 819726 - DNA, 20 bp, mouse
gagcggagaaagtgcgcgaa

SEQ ID NO: 819727 - DNA, 20 bp, mouse
ggctgcgagctcacacgtga

SEQ ID NO: 819728 - DNA, 20 bp, mouse
gcggccccgccccctgggat

SEQ ID NO: 819729 - DNA, 20 bp, mouse
gagggcgaggtgtgcgcgaa

SEQ ID NO: 819730 - DNA, 20 bp, mouse
ggcgcccgccaccgcagcca

SEQ ID NO: 819731 - DNA, 20 bp, mouse
gccgccgggtcccgctcgct

SEQ ID NO: 819732 - DNA, 20 bp, mouse
ggggccgcagtcgcagcgag

SEQ ID NO: 819733 - DNA, 20 bp, mouse
gccgcagtgaagagttgcgt

SEQ ID NO: 819734 - DNA, 20 bp, mouse
gggaccacggtgccctcagg

SEQ ID NO: 819735 - DNA, 20 bp, mouse
ggtgtgcgcgaaggggacca

SEQ ID NO: 819736 - DNA, 20 bp, mouse
gacgcgagccaatgaggagt

SEQ ID NO: 819737 - DNA, 20 bp, mouse
gaggagtgggccgggaaaga

SEQ ID NO: 819738 - DNA, 20 bp, mouse
gcgggcctctcctccccaat

SEQ ID NO: 819739 - DNA, 20 bp, mouse
gggactgattggctggaacg

SEQ ID NO: 819740 - DNA, 20 bp, mouse
ggaggcgacgcgagccaatg

SEQ ID NO: 819741 - DNA, 20 bp, mouse
gtgggccgggaaagaaggac

SEQ ID NO: 819742 - DNA, 20 bp, mouse
gcgcagacgccgagcgacgg

SEQ ID NO: 819743 - DNA, 20 bp, mouse
ggcccgcagacgccgagcga

SEQ ID NO: 819744 - DNA, 20 bp, mouse
gtgacccaaccctaacccga

SEQ ID NO: 819745 - DNA, 20 bp, mouse
gaatccaggacccccgaagc

SEQ ID NO: 819746 - DNA, 20 bp, mouse
ggacccgagaacctgggtgt

SEQ ID NO: 819747 - DNA, 20 bp, mouse
gcggggctgaaggaccctga

SEQ ID NO: 819748 - DNA, 20 bp, mouse
gctggggagggcactcgcag

SEQ ID NO: 819749 - DNA, 20 bp, mouse
ggggagggcactcgcagagg

SEQ ID NO: 819750 - DNA, 20 bp, mouse
ggctgtgggaccacacaaaa

SEQ ID NO: 819751 - DNA, 20 bp, mouse
ggcgcgccagaggctgggga

SEQ ID NO: 819752 - DNA, 20 bp, mouse
ggggcgcttcgcctgctcgc

SEQ ID NO: 819753 - DNA, 20 bp, mouse
ggaggaggggtgcgcgccag

SEQ ID NO: 819754 - DNA, 20 bp, mouse
gggcccgggccggttcgctc

SEQ ID NO: 819755 - DNA, 20 bp, mouse
gcggctgcccgcggatgagg

SEQ ID NO: 819756 - DNA, 20 bp, mouse
gggaggcagaacacagatgt

SEQ ID NO: 819757 - DNA, 20 bp, mouse
gagggtaatcggtctctcct

SEQ ID NO: 819758 - DNA, 20 bp, mouse
gcgcccggtgcctgcagcgg

SEQ ID NO: 819759 - DNA, 20 bp, mouse
gtggctcttccagacgaact

SEQ ID NO: 819760 - DNA, 20 bp, mouse
gcctagggctgtaccgaatc

SEQ ID NO: 819761 - DNA, 20 bp, mouse
gcgggccgaggcgtctggtg

SEQ ID NO: 819762 - DNA, 20 bp, mouse
gtcggcagcgttccgagtcc

SEQ ID NO: 819763 - DNA, 20 bp, mouse
gccgccccgtgcacgttccc

SEQ ID NO: 819764 - DNA, 20 bp, mouse
gccgagcgggcgcgcgtgtc

SEQ ID NO: 819765 - DNA, 20 bp, mouse
gcacctccagagggccctcg

SEQ ID NO: 819766 - DNA, 20 bp, mouse
gcccacccccgtgaggagga

SEQ ID NO: 819767 - DNA, 20 bp, mouse
ggacccgaggagtgtgtgtt

SEQ ID NO: 819768 - DNA, 20 bp, mouse
gcccccaacacacactcctc

SEQ ID NO: 819769 - DNA, 20 bp, mouse
gactcctcgggtcacctggg

SEQ ID NO: 819770 - DNA, 20 bp, mouse
gactgagcttgagaagtctt

SEQ ID NO: 819771 - DNA, 20 bp, mouse
gccagtacctcccacgggca

SEQ ID NO: 819772 - DNA, 20 bp, mouse
gcacactcctcgggtcacct

SEQ ID NO: 819773 - DNA, 20 bp, mouse
gtgctccagcccgtccttat

SEQ ID NO: 819774 - DNA, 20 bp, mouse
gtcatgccagccaataagga

SEQ ID NO: 819775 - DNA, 20 bp, mouse
gccagcccgtccttattggc

SEQ ID NO: 819776 - DNA, 20 bp, mouse
gagaagacgggctgcagaag

SEQ ID NO: 819777 - DNA, 20 bp, mouse
gagtggtagcagttgtgaca

SEQ ID NO: 819778 - DNA, 20 bp, mouse
gctaggctccggagaggacc

SEQ ID NO: 819779 - DNA, 20 bp, mouse
gtgaccatgaacctaggctc

SEQ ID NO: 819780 - DNA, 20 bp, mouse
gtgcctgcgatttcagagtt

SEQ ID NO: 819781 - DNA, 20 bp, mouse
gtaaacttgaccatgaacct

SEQ ID NO: 819782 - DNA, 20 bp, mouse
ggacctggctgaggagcaag

SEQ ID NO: 819783 - DNA, 20 bp, mouse
gctacgagctgaagcaggca

SEQ ID NO: 819784 - DNA, 20 bp, mouse
gtctccggagcctaggttca

SEQ ID NO: 819785 - DNA, 20 bp, mouse
gtcaggtgtaaagttgtgta

SEQ ID NO: 819786 - DNA, 20 bp, mouse
gccactcccggttgctaggt

SEQ ID NO: 819787 - DNA, 20 bp, mouse
gatacgctgcaacatcccca

SEQ ID NO: 819788 - DNA, 20 bp, mouse
gatgttgcagcgtatgggcg

SEQ ID NO: 819789 - DNA, 20 bp, mouse
gcagcgtatgggcgaggcgt

SEQ ID NO: 819790 - DNA, 20 bp, mouse
gcactgcccccaccaattaa

SEQ ID NO: 819791 - DNA, 20 bp, mouse
gaaagcatcagacattggag

SEQ ID NO: 819792 - DNA, 20 bp, mouse
gggtactggaggctcacaag

SEQ ID NO: 819793 - DNA, 20 bp, mouse
gggaggctcacaagaggttt

SEQ ID NO: 819794 - DNA, 20 bp, mouse
gtgcccccaccaattaaagg

SEQ ID NO: 819795 - DNA, 20 bp, mouse
gctgtgtggtattgagtgca

SEQ ID NO: 819796 - DNA, 20 bp, mouse
gtccccgcgcgcaaccctgg

SEQ ID NO: 819797 - DNA, 20 bp, mouse
gaaggcggaggtactggagg

SEQ ID NO: 819798 - DNA, 20 bp, mouse
gtccccagggcgctccagga

SEQ ID NO: 819799 - DNA, 20 bp, mouse
gtcccgggataggtcggagt

SEQ ID NO: 819800 - DNA, 20 bp, mouse
gcgggagagctgttcccctc

SEQ ID NO: 819801 - DNA, 20 bp, mouse
gcacccgtccggggtgagtc

SEQ ID NO: 819802 - DNA, 20 bp, mouse
gcagaaggcggaggtactgg

SEQ ID NO: 819803 - DNA, 20 bp, mouse
gccccgcagcgaaagttccc

SEQ ID NO: 819804 - DNA, 20 bp, mouse
gtcccccagagcccaggagg

SEQ ID NO: 819805 - DNA, 20 bp, mouse
gtctggctacgcctcctcct

SEQ ID NO: 819806 - DNA, 20 bp, mouse
ggccaggcgtctacattctg

SEQ ID NO: 819807 - DNA, 20 bp, mouse
gcgacccgctctactccaag

SEQ ID NO: 819808 - DNA, 20 bp, mouse
gtagacgcctggccggtgca

SEQ ID NO: 819809 - DNA, 20 bp, mouse
gccggtgcaggggacgcaac

SEQ ID NO: 819810 - DNA, 20 bp, mouse
ggcgaactagggagagtgtg

SEQ ID NO: 819811 - DNA, 20 bp, mouse
gtgcaggggacgcaactgga

SEQ ID NO: 819812 - DNA, 20 bp, mouse
ggcaactggactccgaggga

SEQ ID NO: 819813 - DNA, 20 bp, mouse
gcctgaggtcgccgcgctcc

SEQ ID NO: 819814 - DNA, 20 bp, mouse
gtggcctcttggagtagagc

SEQ ID NO: 819815 - DNA, 20 bp, mouse
gttctggggaccagttcacc

SEQ ID NO: 819816 - DNA, 20 bp, mouse
gcggcggagcaaggaggtgg

SEQ ID NO: 819817 - DNA, 20 bp, mouse
gctggcgagtgacgtgggga

SEQ ID NO: 819818 - DNA, 20 bp, mouse
ggcgcgctcaggaagcagtg

SEQ ID NO: 819819 - DNA, 20 bp, mouse
gcgggcggggagaggcaaag

SEQ ID NO: 819820 - DNA, 20 bp, mouse
gcgcgggcggcggagcaagg

SEQ ID NO: 819821 - DNA, 20 bp, mouse
ggcgcgctggcgagtgacgt

SEQ ID NO: 819822 - DNA, 20 bp, mouse
ggggagggagtagatacact

SEQ ID NO: 819823 - DNA, 20 bp, mouse
gggagtagatacactgggcg

SEQ ID NO: 819824 - DNA, 20 bp, mouse
gagagggggggaacaagggc

SEQ ID NO: 819825 - DNA, 20 bp, mouse
gcgccgcggccaatgggaac

SEQ ID NO: 819826 - DNA, 20 bp, mouse
gggcagcagtgcgggtcaca

SEQ ID NO: 819827 - DNA, 20 bp, mouse
gccaaacccaagctgagtcc

SEQ ID NO: 819828 - DNA, 20 bp, mouse
gagtccagggagacgggcct

SEQ ID NO: 819829 - DNA, 20 bp, mouse
gctgcctaggcccgtctccc

SEQ ID NO: 819830 - DNA, 20 bp, mouse
gcagtgcgggtcacagggct

SEQ ID NO: 819831 - DNA, 20 bp, mouse
gaagctgagtccagggagac

SEQ ID NO: 819832 - DNA, 20 bp, mouse
ggggcagagtggaggcgtcc

SEQ ID NO: 819833 - DNA, 20 bp, mouse
gtggcatctggtgtgagcat

SEQ ID NO: 819834 - DNA, 20 bp, mouse
ggaccctaaaccattgccac

SEQ ID NO: 819835 - DNA, 20 bp, mouse
gggaggcgtcctgggtgttg

SEQ ID NO: 819836 - DNA, 20 bp, mouse
gtggggcccgtggttaataa

SEQ ID NO: 819837 - DNA, 20 bp, mouse
ggcaaactggccaggaggcg

SEQ ID NO: 819838 - DNA, 20 bp, mouse
ggacgccagcgcggactcaa

SEQ ID NO: 819839 - DNA, 20 bp, mouse
ggctgcgcgtgtcccccggg

SEQ ID NO: 819840 - DNA, 20 bp, mouse
gagcgcggactcaagggcgc

SEQ ID NO: 819841 - DNA, 20 bp, mouse
gccgtcctgcatccgcccgg

SEQ ID NO: 819842 - DNA, 20 bp, mouse
gcgaccgggctctagaaaga

SEQ ID NO: 819843 - DNA, 20 bp, mouse
ggggtgcccctgctcatcct

SEQ ID NO: 819844 - DNA, 20 bp, mouse
ggccccccatctttgcaaac

SEQ ID NO: 819845 - DNA, 20 bp, mouse
gccactcgcggtgcccgggt

SEQ ID NO: 819846 - DNA, 20 bp, mouse
gagggggaggtcagtggcgc

SEQ ID NO: 819847 - DNA, 20 bp, mouse
gccaaggactcgagcctcgt

SEQ ID NO: 819848 - DNA, 20 bp, mouse
ggagctctactggcccgggg

SEQ ID NO: 819849 - DNA, 20 bp, mouse
ggctcgggccgtctgtgcga

SEQ ID NO: 819850 - DNA, 20 bp, mouse
ggagcccgcaggagcccacg

SEQ ID NO: 819851 - DNA, 20 bp, mouse
gctcctgcgggctccggtcg

SEQ ID NO: 819852 - DNA, 20 bp, mouse
gcggaggagctctactggcc

SEQ ID NO: 819853 - DNA, 20 bp, mouse
gtcagtggcgcgggctcaag

SEQ ID NO: 819854 - DNA, 20 bp, mouse
gcgcgcggggagaaagacac

SEQ ID NO: 819855 - DNA, 20 bp, mouse
gcccccgcgagctgggagcg

SEQ ID NO: 819856 - DNA, 20 bp, mouse
gatgtgcgaggccctggcac

SEQ ID NO: 819857 - DNA, 20 bp, mouse
gggtggaggtacttcctggc

SEQ ID NO: 819858 - DNA, 20 bp, mouse
gtcctaaagcaggcttgtgt

SEQ ID NO: 819859 - DNA, 20 bp, mouse
gacaacgttgcaagtaccgg

SEQ ID NO: 819860 - DNA, 20 bp, mouse
gggaagccagcgtggctaac

SEQ ID NO: 819861 - DNA, 20 bp, mouse
gggcagagtgggtttataac

SEQ ID NO: 819862 - DNA, 20 bp, mouse
gaaagggtggaggtacttcc

SEQ ID NO: 819863 - DNA, 20 bp, mouse
gacttcctggcgggcagagt

SEQ ID NO: 819864 - DNA, 20 bp, mouse
gtagccacgctggcttcctc

SEQ ID NO: 819865 - DNA, 20 bp, mouse
ggacacaacgttgcaagtac

SEQ ID NO: 819866 - DNA, 20 bp, mouse
gtcagcagcagggaaggcga

SEQ ID NO: 819867 - DNA, 20 bp, mouse
gcccccatcagggacgctcc

SEQ ID NO: 819868 - DNA, 20 bp, mouse
gaacccggagcgtccctgat

SEQ ID NO: 819869 - DNA, 20 bp, mouse
ggggcggcgactccccaacc

SEQ ID NO: 819870 - DNA, 20 bp, mouse
gcaaaagcggcgaagttcaa

SEQ ID NO: 819871 - DNA, 20 bp, mouse
gaccgccaccgcgaacagag

SEQ ID NO: 819872 - DNA, 20 bp, mouse
gcaagccgctctgttcgcgg

SEQ ID NO: 819873 - DNA, 20 bp, mouse
gcctgccaactcgcgagtag

SEQ ID NO: 819874 - DNA, 20 bp, mouse
gctcgcgagtagtggaaacc

SEQ ID NO: 819875 - DNA, 20 bp, mouse
ggctgattggagcccaggtt

SEQ ID NO: 819876 - DNA, 20 bp, mouse
gctccggtggaacgttaggg

SEQ ID NO: 819877 - DNA, 20 bp, mouse
gagccactgggaggggtctg

SEQ ID NO: 819878 - DNA, 20 bp, mouse
gtgccctagggggaggtgta

SEQ ID NO: 819879 - DNA, 20 bp, mouse
gtcccaagaaggggaaccaa

SEQ ID NO: 819880 - DNA, 20 bp, mouse
gcacccccctaacgttccac

SEQ ID NO: 819881 - DNA, 20 bp, mouse
gacccctcccagtggctgtg

SEQ ID NO: 819882 - DNA, 20 bp, mouse
gaggcctccggtggaacgtt

SEQ ID NO: 819883 - DNA, 20 bp, mouse
gggggggtgtggtgccctag

SEQ ID NO: 819884 - DNA, 20 bp, mouse
gctgccgtccaggcctccgg

SEQ ID NO: 819885 - DNA, 20 bp, mouse
gtgggaagaacaagacgcct

SEQ ID NO: 819886 - DNA, 20 bp, mouse
gacctcttggggaaatagga

SEQ ID NO: 819887 - DNA, 20 bp, mouse
ggctggcgccaagacctctt

SEQ ID NO: 819888 - DNA, 20 bp, mouse
gccctcccccggcagtgttc

SEQ ID NO: 819889 - DNA, 20 bp, mouse
gcacctgccttggggaaaac

SEQ ID NO: 819890 - DNA, 20 bp, mouse
ggcggccaatggcgaggcgg

SEQ ID NO: 819891 - DNA, 20 bp, mouse
ggggcctaaggactagggtc

SEQ ID NO: 819892 - DNA, 20 bp, mouse
ggaggtgctgctcactgtaa

SEQ ID NO: 819893 - DNA, 20 bp, mouse
gctccagccagttttcccca

SEQ ID NO: 819894 - DNA, 20 bp, mouse
gaggtcttggcgccagcgcc

SEQ ID NO: 819895 - DNA, 20 bp, mouse
gtgtagccagaacactgccg

SEQ ID NO: 819896 - DNA, 20 bp, mouse
gcctgaggctcgaaaggctg

SEQ ID NO: 819897 - DNA, 20 bp, mouse
gtctagtgttgagggaagca

SEQ ID NO: 819898 - DNA, 20 bp, mouse
gtacagcagacaggcgtgcc

SEQ ID NO: 819899 - DNA, 20 bp, mouse
gaagaagcaaacatccggag

SEQ ID NO: 819900 - DNA, 20 bp, mouse
ggaggctcgctgtagaagag

SEQ ID NO: 819901 - DNA, 20 bp, mouse
gtttgagtgtgataccgctg

SEQ ID NO: 819902 - DNA, 20 bp, mouse
ggggcactcaagcagatccg

SEQ ID NO: 819903 - DNA, 20 bp, mouse
ggtggagagcaagttcatga

SEQ ID NO: 819904 - DNA, 20 bp, mouse
ggctgcggactacagcagac

SEQ ID NO: 819905 - DNA, 20 bp, mouse
gggctcgaaaggctggggca

SEQ ID NO: 819906 - DNA, 20 bp, mouse
gagagacccccgtgtgggag

SEQ ID NO: 819907 - DNA, 20 bp, mouse
ggcggggctgcccccctccg

SEQ ID NO: 819908 - DNA, 20 bp, mouse
gacccctgggcagtaatgat

SEQ ID NO: 819909 - DNA, 20 bp, mouse
gtgagacagtgggagcagat

SEQ ID NO: 819910 - DNA, 20 bp, mouse
ggggctaggtctcagaagga

SEQ ID NO: 819911 - DNA, 20 bp, mouse
gaaaaagggagccaccgcgg

SEQ ID NO: 819912 - DNA, 20 bp, mouse
gaggactgctggtgtgggct

SEQ ID NO: 819913 - DNA, 20 bp, mouse
ggatggggggctctgcgctg

SEQ ID NO: 819914 - DNA, 20 bp, mouse
gcagcagtcctctcccacac

SEQ ID NO: 819915 - DNA, 20 bp, mouse
gatcctgccgggaagaaaaa

SEQ ID NO: 819916 - DNA, 20 bp, mouse
ggggctgtcagggaataaat

SEQ ID NO: 819917 - DNA, 20 bp, mouse
gggcccgcagccggccgctg

SEQ ID NO: 819918 - DNA, 20 bp, mouse
gtgtgccccgaaccgcgcgg

SEQ ID NO: 819919 - DNA, 20 bp, mouse
gggatacaaaggttccccag

SEQ ID NO: 819920 - DNA, 20 bp, mouse
gcgggcccgcctcccccgcg

SEQ ID NO: 819921 - DNA, 20 bp, mouse
ggtgacctgttgctgaaaac

SEQ ID NO: 819922 - DNA, 20 bp, mouse
gtcggggcacagcgctctgc

SEQ ID NO: 819923 - DNA, 20 bp, mouse
gccgcctcccccgcgcggtt

SEQ ID NO: 819924 - DNA, 20 bp, mouse
ggggaaaggagctgtcgtct

SEQ ID NO: 819925 - DNA, 20 bp, mouse
gacagcccccatcacatgga

SEQ ID NO: 819926 - DNA, 20 bp, mouse
gcagcagcgctgggcagaac

SEQ ID NO: 819927 - DNA, 20 bp, mouse
gaaacagtgcgcagactccg

SEQ ID NO: 819928 - DNA, 20 bp, mouse
gaggaagagggttgagcctg

SEQ ID NO: 819929 - DNA, 20 bp, mouse
gaggagccggggagtccagg

SEQ ID NO: 819930 - DNA, 20 bp, mouse
ggatgaaagcggtacaccag

SEQ ID NO: 819931 - DNA, 20 bp, mouse
gtaggaggaggagtgttggg

SEQ ID NO: 819932 - DNA, 20 bp, mouse
gtatcctgggagtgcggagg

SEQ ID NO: 819933 - DNA, 20 bp, mouse
gaggaggagccggggagtcc

SEQ ID NO: 819934 - DNA, 20 bp, mouse
gggaaaagagcttcagaaac

SEQ ID NO: 819935 - DNA, 20 bp, mouse
ggagtgcggaggaggagccg

SEQ ID NO: 819936 - DNA, 20 bp, mouse
ggtctggagggtgaacgaaa

SEQ ID NO: 819937 - DNA, 20 bp, mouse
gcgacccaagaggggtctgg

SEQ ID NO: 819938 - DNA, 20 bp, mouse
gacgtcactcgacccaagag

SEQ ID NO: 819939 - DNA, 20 bp, mouse
gaggcccacgggtggtgagg

SEQ ID NO: 819940 - DNA, 20 bp, mouse
gccgccccctcaccacccgt

SEQ ID NO: 819941 - DNA, 20 bp, mouse
gcgtgggcctcgtgattgac

SEQ ID NO: 819942 - DNA, 20 bp, mouse
gacgaggcccacgggtggtg

SEQ ID NO: 819943 - DNA, 20 bp, mouse
gcgcgcgagcaagcgagact

SEQ ID NO: 819944 - DNA, 20 bp, mouse
gtacctgctcagatccggga

SEQ ID NO: 819945 - DNA, 20 bp, mouse
gtgaaagagcgagaaacccg

SEQ ID NO: 819946 - DNA, 20 bp, mouse
gcgcctcgcccaatcaggag

SEQ ID NO: 819947 - DNA, 20 bp, mouse
gacaccgggccgctcctgat

SEQ ID NO: 819948 - DNA, 20 bp, mouse
gcggggaacgtgcctgtgat

SEQ ID NO: 819949 - DNA, 20 bp, mouse
gcgcacgcggctagtgtgga

SEQ ID NO: 819950 - DNA, 20 bp, mouse
gcccgtctgtggagcgcgta

SEQ ID NO: 819951 - DNA, 20 bp, mouse
gggcgaggcgagcccgtctg

SEQ ID NO: 819952 - DNA, 20 bp, mouse
gcgcggctagtgtggagggt

SEQ ID NO: 819953 - DNA, 20 bp, mouse
ggggctcgcctcgcccaatc

SEQ ID NO: 819954 - DNA, 20 bp, mouse
ggtggagcgcgtagggttct

SEQ ID NO: 819955 - DNA, 20 bp, mouse
gagtgaagaggcgtggaaaa

SEQ ID NO: 819956 - DNA, 20 bp, mouse
gcgcacccagcaaaaggcgg

SEQ ID NO: 819957 - DNA, 20 bp, mouse
gcgcacgcgcatgtgtgaag

SEQ ID NO: 819958 - DNA, 20 bp, mouse
gccagcaaaaggcggaggtg

SEQ ID NO: 819959 - DNA, 20 bp, mouse
gaagccaatgggaaggacgg

SEQ ID NO: 819960 - DNA, 20 bp, mouse
ggaggaagcgttagttacag

SEQ ID NO: 819961 - DNA, 20 bp, mouse
gaacaaggggcttggagggg

SEQ ID NO: 819962 - DNA, 20 bp, mouse
gcgcgcgcgcacccagcaaa

SEQ ID NO: 819963 - DNA, 20 bp, mouse
ggcggagattattattgcat

SEQ ID NO: 819964 - DNA, 20 bp, mouse
ggcatcgggttccaagccaa

SEQ ID NO: 819965 - DNA, 20 bp, mouse
gtggagcttctcattgcacg

SEQ ID NO: 819966 - DNA, 20 bp, mouse
gagagtgtgcggctgtgcag

SEQ ID NO: 819967 - DNA, 20 bp, mouse
gcgcttggagagtcggggag

SEQ ID NO: 819968 - DNA, 20 bp, mouse
gcctgtgcgcttggagagtc

SEQ ID NO: 819969 - DNA, 20 bp, mouse
gtacacttccagcagcggtc

SEQ ID NO: 819970 - DNA, 20 bp, mouse
gggagccagccgatcatagg

SEQ ID NO: 819971 - DNA, 20 bp, mouse
gagaatggtcaaggagtcct

SEQ ID NO: 819972 - DNA, 20 bp, mouse
gaatgctcacagtttgattg

SEQ ID NO: 819973 - DNA, 20 bp, mouse
gtctcctggacatccctgaa

SEQ ID NO: 819974 - DNA, 20 bp, mouse
gacaatgatactggtggtgg

SEQ ID NO: 819975 - DNA, 20 bp, mouse
gaggtggccgctgtgacaaa

SEQ ID NO: 819976 - DNA, 20 bp, mouse
ggtagagtagcagatgaaca

SEQ ID NO: 819977 - DNA, 20 bp, mouse
ggacccaagctccaggtgaa

SEQ ID NO: 819978 - DNA, 20 bp, mouse
gtcaaagtgtgaccttccat

SEQ ID NO: 819979 - DNA, 20 bp, mouse
gtgaactactccctcctctg

SEQ ID NO: 819980 - DNA, 20 bp, mouse
gtcatctgctactctactat

SEQ ID NO: 819981 - DNA, 20 bp, mouse
ggacccttcacctggagctt

SEQ ID NO: 819982 - DNA, 20 bp, mouse
gctctactattggaagaaag

SEQ ID NO: 819983 - DNA, 20 bp, mouse
gacattcacaccacagagga

SEQ ID NO: 819984 - DNA, 20 bp, mouse
gcatgtaggatattatccca

SEQ ID NO: 819985 - DNA, 20 bp, mouse
gaaaagctatgttttcttcg

SEQ ID NO: 819986 - DNA, 20 bp, mouse
ggaggcggaggggcggacag

SEQ ID NO: 819987 - DNA, 20 bp, mouse
gggatcggggcaggctcggg

SEQ ID NO: 819988 - DNA, 20 bp, mouse
gcgacctgccggcaggggga

SEQ ID NO: 819989 - DNA, 20 bp, mouse
gggccctgcagcacctgcac

SEQ ID NO: 819990 - DNA, 20 bp, mouse
gcggacaggggcgggcaccg

SEQ ID NO: 819991 - DNA, 20 bp, mouse
gaccggagcgggatcggggc

SEQ ID NO: 819992 - DNA, 20 bp, mouse
gcagcccaacaacggaacag

SEQ ID NO: 819993 - DNA, 20 bp, mouse
gcgtccccgctgcgacctgc

SEQ ID NO: 819994 - DNA, 20 bp, mouse
ggcggagggcagcccaacaa

SEQ ID NO: 819995 - DNA, 20 bp, mouse
gctgcaccggagcgggatcg

SEQ ID NO: 819996 - DNA, 20 bp, mouse
ggccccgcagcctgatccct

SEQ ID NO: 819997 - DNA, 20 bp, mouse
ggcgcctggcccacgtggta

SEQ ID NO: 819998 - DNA, 20 bp, mouse
gaggcggggtcagagggcta

SEQ ID NO: 819999 - DNA, 20 bp, mouse
gcagcctgatccctcggctg

SEQ ID NO: 820000 - DNA, 20 bp, mouse
gcggctgaggcggggtcaga

SEQ ID NO: 820001 - DNA, 20 bp, mouse
ggcgcggaggggcactcagt

SEQ ID NO: 820002 - DNA, 20 bp, mouse
gagggtggagcggggtcgca

SEQ ID NO: 820003 - DNA, 20 bp, mouse
gtccaccctccgtaccacgt

SEQ ID NO: 820004 - DNA, 20 bp, mouse
gaactgagactgagctactg

SEQ ID NO: 820005 - DNA, 20 bp, mouse
ggtcgcgcccggtcactctg

SEQ ID NO: 820006 - DNA, 20 bp, mouse
gggaccggattttggaaggg

SEQ ID NO: 820007 - DNA, 20 bp, mouse
gccgggttgggtgacgagac

SEQ ID NO: 820008 - DNA, 20 bp, mouse
gctggggaggattgtggctc

SEQ ID NO: 820009 - DNA, 20 bp, mouse
ggaggattgtggctccgggt

SEQ ID NO: 820010 - DNA, 20 bp, mouse
gattggaccggattttggaa

SEQ ID NO: 820011 - DNA, 20 bp, mouse
ggtgttggcaagtcgctgat

SEQ ID NO: 820012 - DNA, 20 bp, mouse
gggcaagtcgctgattggac

SEQ ID NO: 820013 - DNA, 20 bp, mouse
gttacacactcggacgtccc

SEQ ID NO: 820014 - DNA, 20 bp, mouse
ggggggcgcggggcaagcgg

SEQ ID NO: 820015 - DNA, 20 bp, mouse
ggattttggaaggggggctg

SEQ ID NO: 820016 - DNA, 20 bp, mouse
gtccacgtcgcggaagtcga

SEQ ID NO: 820017 - DNA, 20 bp, mouse
gaagcgagaggggcgccctc

SEQ ID NO: 820018 - DNA, 20 bp, mouse
gacgtcgcggaagtcgatgg

SEQ ID NO: 820019 - DNA, 20 bp, mouse
ggaggggcgccctctggcag

SEQ ID NO: 820020 - DNA, 20 bp, mouse
gacttccgcgacgtggacat

SEQ ID NO: 820021 - DNA, 20 bp, mouse
ggcaaccagggagagtcccc

SEQ ID NO: 820022 - DNA, 20 bp, mouse
gtgcacgtcggttttgggag

SEQ ID NO: 820023 - DNA, 20 bp, mouse
ggaccctgagattgccctgc

SEQ ID NO: 820024 - DNA, 20 bp, mouse
gggacccgctcccgcgctgg

SEQ ID NO: 820025 - DNA, 20 bp, mouse
gacgtcgaaggtctcaatgt

SEQ ID NO: 820026 - DNA, 20 bp, mouse
ggggcggggcagtagataag

SEQ ID NO: 820027 - DNA, 20 bp, mouse
gaggactcgctctctcgctg

SEQ ID NO: 820028 - DNA, 20 bp, mouse
ggggctgcctacccaatggt

SEQ ID NO: 820029 - DNA, 20 bp, mouse
gtccaggcgggctccgtgag

SEQ ID NO: 820030 - DNA, 20 bp, mouse
gtgaaaggagggccttgcag

SEQ ID NO: 820031 - DNA, 20 bp, mouse
gctactgccccgcccaatga

SEQ ID NO: 820032 - DNA, 20 bp, mouse
gcctgggcaaagtccgtgta

SEQ ID NO: 820033 - DNA, 20 bp, mouse
gagagagcgagtcctaccat

SEQ ID NO: 820034 - DNA, 20 bp, mouse
gaaggggcggggattaggcc

SEQ ID NO: 820035 - DNA, 20 bp, mouse
gctgccccgcccaatgaggg

SEQ ID NO: 820036 - DNA, 20 bp, mouse
ggtcacttcagccagggaca

SEQ ID NO: 820037 - DNA, 20 bp, mouse
gtgctctgacccaatgtcta

SEQ ID NO: 820038 - DNA, 20 bp, mouse
gcccccaactccatagacat

SEQ ID NO: 820039 - DNA, 20 bp, mouse
ggacccaatgtctatggagt

SEQ ID NO: 820040 - DNA, 20 bp, mouse
gttgggtcagagcaagactt

SEQ ID NO: 820041 - DNA, 20 bp, mouse
gagcaggagacccaggaatg

SEQ ID NO: 820042 - DNA, 20 bp, mouse
gttgtcctggccacattcct

SEQ ID NO: 820043 - DNA, 20 bp, mouse
ggggggatgtcctcaatcct

SEQ ID NO: 820044 - DNA, 20 bp, mouse
gggtctgagaaatcttgtcc

SEQ ID NO: 820045 - DNA, 20 bp, mouse
gagtttgagtttctgtggag

SEQ ID NO: 820046 - DNA, 20 bp, mouse
ggtggagggcggaattggtg

SEQ ID NO: 820047 - DNA, 20 bp, mouse
gagggcggaattggtgtggc

SEQ ID NO: 820048 - DNA, 20 bp, mouse
gcggaattggtgtggctggc

SEQ ID NO: 820049 - DNA, 20 bp, mouse
gaggcctcgtgggtatcctg

SEQ ID NO: 820050 - DNA, 20 bp, mouse
gcacccccaggatacccacg

SEQ ID NO: 820051 - DNA, 20 bp, mouse
gatcctgggggtggggaatt

SEQ ID NO: 820052 - DNA, 20 bp, mouse
gttcaaatctaaagtcccag

SEQ ID NO: 820053 - DNA, 20 bp, mouse
gggggaattggggtgtcttg

SEQ ID NO: 820054 - DNA, 20 bp, mouse
gcatttgggaaatattagac

SEQ ID NO: 820055 - DNA, 20 bp, mouse
gcttgtggatcaaatacatt

SEQ ID NO: 820056 - DNA, 20 bp, mouse
ggccagctggctgttaggat

SEQ ID NO: 820057 - DNA, 20 bp, mouse
gctaaggccagctggctgtt

SEQ ID NO: 820058 - DNA, 20 bp, mouse
gaggtggaagggtctgtttc

SEQ ID NO: 820059 - DNA, 20 bp, mouse
ggctggctgttaggatagga

SEQ ID NO: 820060 - DNA, 20 bp, mouse
ggaacaggtcccaagagtac

SEQ ID NO: 820061 - DNA, 20 bp, mouse
gtttgcatccctgtactctt

SEQ ID NO: 820062 - DNA, 20 bp, mouse
gtcttgggacctgttcctgc

SEQ ID NO: 820063 - DNA, 20 bp, mouse
gcaggcaccgcccccgctta

SEQ ID NO: 820064 - DNA, 20 bp, mouse
gcggaagtggatcacagccg

SEQ ID NO: 820065 - DNA, 20 bp, mouse
ggtcccttaaccctaagcgg

SEQ ID NO: 820066 - DNA, 20 bp, mouse
gcctcccgccagttggctaa

SEQ ID NO: 820067 - DNA, 20 bp, mouse
ggtcgccaaccggaaatcaa

SEQ ID NO: 820068 - DNA, 20 bp, mouse
ggccaaccggaaatcaacgg

SEQ ID NO: 820069 - DNA, 20 bp, mouse
ggaagcatctagagtgacgt

SEQ ID NO: 820070 - DNA, 20 bp, mouse
gccgcctgctaggaggttga

SEQ ID NO: 820071 - DNA, 20 bp, mouse
ggtgaagtgtcattgataga

SEQ ID NO: 820072 - DNA, 20 bp, mouse
gtcccccgttgatttccggt

SEQ ID NO: 820073 - DNA, 20 bp, mouse
gcccgccaccgcccgagcga

SEQ ID NO: 820074 - DNA, 20 bp, mouse
gcaaagtcccgcctgctagg

SEQ ID NO: 820075 - DNA, 20 bp, mouse
gactctcgagaggcgatgga

SEQ ID NO: 820076 - DNA, 20 bp, mouse
gtcagaagagccctaagcaa

SEQ ID NO: 820077 - DNA, 20 bp, mouse
gaagagccctaagcaaggga

SEQ ID NO: 820078 - DNA, 20 bp, mouse
ggtaacagagataagctcct

SEQ ID NO: 820079 - DNA, 20 bp, mouse
gaggctgctctcactgtaat

SEQ ID NO: 820080 - DNA, 20 bp, mouse
gaggccaggagggaatgctc

SEQ ID NO: 820081 - DNA, 20 bp, mouse
gtaagctcctgggatccaaa

SEQ ID NO: 820082 - DNA, 20 bp, mouse
gtaaaggtgcaagcatcagc

SEQ ID NO: 820083 - DNA, 20 bp, mouse
gaacccagagcattccctcc

SEQ ID NO: 820084 - DNA, 20 bp, mouse
gtacagtgagagcagcctaa

SEQ ID NO: 820085 - DNA, 20 bp, mouse
ggttacccttcccttgctta

SEQ ID NO: 820086 - DNA, 20 bp, mouse
gcccgctcgcacaggaagta

SEQ ID NO: 820087 - DNA, 20 bp, mouse
gtgtgcgcgccctcccgggt

SEQ ID NO: 820088 - DNA, 20 bp, mouse
gcgccctcccgggtgggatc

SEQ ID NO: 820089 - DNA, 20 bp, mouse
gcctggccgcgccgccaacc

SEQ ID NO: 820090 - DNA, 20 bp, mouse
gcctcctcctccggggtctg

SEQ ID NO: 820091 - DNA, 20 bp, mouse
gcgggtgggatccggacgga

SEQ ID NO: 820092 - DNA, 20 bp, mouse
gcgtccggatcccacccggg

SEQ ID NO: 820093 - DNA, 20 bp, mouse
gcgggcctcttccctccgtc

SEQ ID NO: 820094 - DNA, 20 bp, mouse
ggccgcgggccaccgagcgc

SEQ ID NO: 820095 - DNA, 20 bp, mouse
gcctcgggcgggcagctccc

SEQ ID NO: 820096 - DNA, 20 bp, mouse
gcgccgccgctgtcaatcaa

SEQ ID NO: 820097 - DNA, 20 bp, mouse
ggaggcaggccgaggggggt

SEQ ID NO: 820098 - DNA, 20 bp, mouse
gcccgcggagcgtgccctct

SEQ ID NO: 820099 - DNA, 20 bp, mouse
gcccggccccggcaggtcgg

SEQ ID NO: 820100 - DNA, 20 bp, mouse
gggtggagagtcggcggcgc

SEQ ID NO: 820101 - DNA, 20 bp, mouse
gcccctcggcctgcctccgc

SEQ ID NO: 820102 - DNA, 20 bp, mouse
ggcgccgggaactgagtagg

SEQ ID NO: 820103 - DNA, 20 bp, mouse
gaggtcggcggccaatccgc

SEQ ID NO: 820104 - DNA, 20 bp, mouse
gagccagggcggcgcgagcg

SEQ ID NO: 820105 - DNA, 20 bp, mouse
gcgcagctagctcaccgaga

SEQ ID NO: 820106 - DNA, 20 bp, mouse
gtgggccgccagccagtcag

SEQ ID NO: 820107 - DNA, 20 bp, mouse
ggctcctatggtgtgtttgt

SEQ ID NO: 820108 - DNA, 20 bp, mouse
gggcaaggccccctttgatc

SEQ ID NO: 820109 - DNA, 20 bp, mouse
gaaaagaactgattattagg

SEQ ID NO: 820110 - DNA, 20 bp, mouse
gaggagctttgtggattcaa

SEQ ID NO: 820111 - DNA, 20 bp, mouse
gaacccaagcgcgagtctcc

SEQ ID NO: 820112 - DNA, 20 bp, mouse
gccaagcgcgagtctccagg

SEQ ID NO: 820113 - DNA, 20 bp, mouse
ggaagggaggagataaaggc

SEQ ID NO: 820114 - DNA, 20 bp, mouse
gagaccaacaaacacaccat

SEQ ID NO: 820115 - DNA, 20 bp, mouse
gcccaatcatcaaagaatag

SEQ ID NO: 820116 - DNA, 20 bp, mouse
gagagagtgcggtgagtcac

SEQ ID NO: 820117 - DNA, 20 bp, mouse
ggcccagcccagcgcgagga

SEQ ID NO: 820118 - DNA, 20 bp, mouse
ggacgggtctccgaactcgg

SEQ ID NO: 820119 - DNA, 20 bp, mouse
ggggaacaagattcagatcc

SEQ ID NO: 820120 - DNA, 20 bp, mouse
gtaacccttgcaggcttggc

SEQ ID NO: 820121 - DNA, 20 bp, mouse
gctcttaactcagaagtggt

SEQ ID NO: 820122 - DNA, 20 bp, mouse
gcctccagccaagcctgcaa

SEQ ID NO: 820123 - DNA, 20 bp, mouse
gggcggggccgcgggttcgg

SEQ ID NO: 820124 - DNA, 20 bp, mouse
gacgggtgggtcaaaagcac

SEQ ID NO: 820125 - DNA, 20 bp, mouse
gttaaaggcggccgcaggtg

SEQ ID NO: 820126 - DNA, 20 bp, mouse
ggctgctgctgctaccaccg

SEQ ID NO: 820127 - DNA, 20 bp, mouse
gactccggatccaatgagga

SEQ ID NO: 820128 - DNA, 20 bp, mouse
ggggtgggaaacaggaatat

SEQ ID NO: 820129 - DNA, 20 bp, mouse
gaggactccgagtcaagagt

SEQ ID NO: 820130 - DNA, 20 bp, mouse
ggggaggtaggtggtagtgt

SEQ ID NO: 820131 - DNA, 20 bp, mouse
gaagaaaagggggtgcccag

SEQ ID NO: 820132 - DNA, 20 bp, mouse
ggtactctctgctacccaca

SEQ ID NO: 820133 - DNA, 20 bp, mouse
gtgccaccctgaactagtgg

SEQ ID NO: 820134 - DNA, 20 bp, mouse
ggggctgctctctgtctgta

SEQ ID NO: 820135 - DNA, 20 bp, mouse
gtggcctgagggcgctggga

SEQ ID NO: 820136 - DNA, 20 bp, mouse
gggcgccggcgggagtgtgg

SEQ ID NO: 820137 - DNA, 20 bp, mouse
ggcgcgcgccgtgaggtcat

SEQ ID NO: 820138 - DNA, 20 bp, mouse
gagaaagcggaggggtaact

SEQ ID NO: 820139 - DNA, 20 bp, mouse
ggagggagctacaattgtgg

SEQ ID NO: 820140 - DNA, 20 bp, mouse
gaaaaaccgtgacctagcaa

SEQ ID NO: 820141 - DNA, 20 bp, mouse
gtgggtgcgcgcgatcgaga

SEQ ID NO: 820142 - DNA, 20 bp, mouse
ggccgtgaggtcatcggcgc

SEQ ID NO: 820143 - DNA, 20 bp, mouse
gtacactgctctctccgagg

SEQ ID NO: 820144 - DNA, 20 bp, mouse
gggcgcggccagccaatctg

SEQ ID NO: 820145 - DNA, 20 bp, mouse
ggtgaggtcatcggcgccgg

SEQ ID NO: 820146 - DNA, 20 bp, mouse
gcgcgtgccagtcaagtctg

SEQ ID NO: 820147 - DNA, 20 bp, mouse
ggcccctcggagcgtctgat

SEQ ID NO: 820148 - DNA, 20 bp, mouse
gccacgcccgcagacttgac

SEQ ID NO: 820149 - DNA, 20 bp, mouse
ggcaaggtggccagggtggt

SEQ ID NO: 820150 - DNA, 20 bp, mouse
gcaagtctgcgggcgtgggt

SEQ ID NO: 820151 - DNA, 20 bp, mouse
ggctccgaggggcccgagcc

SEQ ID NO: 820152 - DNA, 20 bp, mouse
gtgcgcctctcgcccaatga

SEQ ID NO: 820153 - DNA, 20 bp, mouse
ggctctgcctgcgccctcat

SEQ ID NO: 820154 - DNA, 20 bp, mouse
gagccaatcagacgctccga

SEQ ID NO: 820155 - DNA, 20 bp, mouse
gctggccaccttgctacgta

SEQ ID NO: 820156 - DNA, 20 bp, mouse
ggtactgaaggcttgagggt

SEQ ID NO: 820157 - DNA, 20 bp, mouse
gccgataggtagaccctccc

SEQ ID NO: 820158 - DNA, 20 bp, mouse
gcttgagggtggggcccgat

SEQ ID NO: 820159 - DNA, 20 bp, mouse
gtggtcttgcgtagtgggcg

SEQ ID NO: 820160 - DNA, 20 bp, mouse
gaggcgtggtcttgcgtagt

SEQ ID NO: 820161 - DNA, 20 bp, mouse
ggggctcttcctgaattcgg

SEQ ID NO: 820162 - DNA, 20 bp, mouse
gtcaggaagagcccctatgc

SEQ ID NO: 820163 - DNA, 20 bp, mouse
gttccccggggcctgtgttt

SEQ ID NO: 820164 - DNA, 20 bp, mouse
gatcctgcagaagatctgaa

SEQ ID NO: 820165 - DNA, 20 bp, mouse
gtaggggctcttcctgaatt

SEQ ID NO: 820166 - DNA, 20 bp, mouse
gaactcatgtgggcgggaag

SEQ ID NO: 820167 - DNA, 20 bp, mouse
ggaagtctgggcttcgaatg

SEQ ID NO: 820168 - DNA, 20 bp, mouse
gggacaacaggaactcatgt

SEQ ID NO: 820169 - DNA, 20 bp, mouse
ggaagggagggggtaggaca

SEQ ID NO: 820170 - DNA, 20 bp, mouse
gggagggggtaggacaaggg

SEQ ID NO: 820171 - DNA, 20 bp, mouse
gtacctgatgtcagttgctt

SEQ ID NO: 820172 - DNA, 20 bp, mouse
ggggcgctggaggggacaac

SEQ ID NO: 820173 - DNA, 20 bp, mouse
gaacccaagcaactgacatc

SEQ ID NO: 820174 - DNA, 20 bp, mouse
gctgcgaaccccaccgtgtc

SEQ ID NO: 820175 - DNA, 20 bp, mouse
gtattcttaacatctgactt

SEQ ID NO: 820176 - DNA, 20 bp, mouse
ggggccagggagttctagaa

SEQ ID NO: 820177 - DNA, 20 bp, mouse
gtatgctgtgctggggaaag

SEQ ID NO: 820178 - DNA, 20 bp, mouse
gagatgcaggggcattttag

SEQ ID NO: 820179 - DNA, 20 bp, mouse
gcccttcagtcataagatgc

SEQ ID NO: 820180 - DNA, 20 bp, mouse
gccaccccagcccgtgtcaa

SEQ ID NO: 820181 - DNA, 20 bp, mouse
gtcctgtaataggtcacctt

SEQ ID NO: 820182 - DNA, 20 bp, mouse
gagaaatcagacacgacttc

SEQ ID NO: 820183 - DNA, 20 bp, mouse
gtcccaaggtgacctattac

SEQ ID NO: 820184 - DNA, 20 bp, mouse
gcagaaccagctctcactca

SEQ ID NO: 820185 - DNA, 20 bp, mouse
gagacgtctcaagttgtcct

SEQ ID NO: 820186 - DNA, 20 bp, mouse
gaggtagcctggtccaccac

SEQ ID NO: 820187 - DNA, 20 bp, mouse
ggcaaggtaaggatgcttga

SEQ ID NO: 820188 - DNA, 20 bp, mouse
gggcccaaaggcttgtgagc

SEQ ID NO: 820189 - DNA, 20 bp, mouse
ggtgggccatcggtaaagtg

SEQ ID NO: 820190 - DNA, 20 bp, mouse
gggtaaagtgaggttgctgt

SEQ ID NO: 820191 - DNA, 20 bp, mouse
gggaaccaagaaccttcacc

SEQ ID NO: 820192 - DNA, 20 bp, mouse
gaagccctggtcacgtgaca

SEQ ID NO: 820193 - DNA, 20 bp, mouse
ggcgggccgagccaatgtgt

SEQ ID NO: 820194 - DNA, 20 bp, mouse
gcagggctttaacacctcca

SEQ ID NO: 820195 - DNA, 20 bp, mouse
gactctgagatgtccctcag

SEQ ID NO: 820196 - DNA, 20 bp, mouse
gcagggagaaagattggata

SEQ ID NO: 820197 - DNA, 20 bp, mouse
gtacataagctgcatggctg

SEQ ID NO: 820198 - DNA, 20 bp, mouse
gctggaatacataagctgca

SEQ ID NO: 820199 - DNA, 20 bp, mouse
gtgcatacacacataatgaa

SEQ ID NO: 820200 - DNA, 20 bp, mouse
gccctattcctgatcatcag

SEQ ID NO: 820201 - DNA, 20 bp, mouse
gtctcttggtctctaacagt

SEQ ID NO: 820202 - DNA, 20 bp, mouse
ggaaatatgagaaagatgca

SEQ ID NO: 820203 - DNA, 20 bp, mouse
gcagtatgaactgtagattc

SEQ ID NO: 820204 - DNA, 20 bp, mouse
gcagttggcattaaggaaag

SEQ ID NO: 820205 - DNA, 20 bp, mouse
gaatgaagggagataaatac

SEQ ID NO: 820206 - DNA, 20 bp, mouse
gtggggtcctgccaggtatg

SEQ ID NO: 820207 - DNA, 20 bp, mouse
gttctctgtgaggcactgtg

SEQ ID NO: 820208 - DNA, 20 bp, mouse
gatactcttcttgctctctg

SEQ ID NO: 820209 - DNA, 20 bp, mouse
gaggacaagcctggtcagtg

SEQ ID NO: 820210 - DNA, 20 bp, mouse
gggttaacatacactctaat

SEQ ID NO: 820211 - DNA, 20 bp, mouse
gaacaaaccccatacctggc

SEQ ID NO: 820212 - DNA, 20 bp, mouse
gtatccaggagtccaaggct

SEQ ID NO: 820213 - DNA, 20 bp, mouse
gtcagatcctggtgtaggag

SEQ ID NO: 820214 - DNA, 20 bp, mouse
gtcaccacagggcactgacc

SEQ ID NO: 820215 - DNA, 20 bp, mouse
gctggatacgtggaatgtgg

SEQ ID NO: 820216 - DNA, 20 bp, mouse
gtgagggcagaaattggctg

SEQ ID NO: 820217 - DNA, 20 bp, mouse
ggaggcaggcgtatctacag

SEQ ID NO: 820218 - DNA, 20 bp, mouse
gggcctgtgaagccaatcag

SEQ ID NO: 820219 - DNA, 20 bp, mouse
gcagcaggggtagccaattg

SEQ ID NO: 820220 - DNA, 20 bp, mouse
gaagccctctgacccgcaat

SEQ ID NO: 820221 - DNA, 20 bp, mouse
ggggggtctgccctctgtga

SEQ ID NO: 820222 - DNA, 20 bp, mouse
gactagacaccacttccctt

SEQ ID NO: 820223 - DNA, 20 bp, mouse
gtagccaattgcgggtcaga

SEQ ID NO: 820224 - DNA, 20 bp, mouse
gaaacagactaaatcccaag

SEQ ID NO: 820225 - DNA, 20 bp, mouse
gggcagacccccgccccctt

SEQ ID NO: 820226 - DNA, 20 bp, mouse
gccctggtgctgtggtaaga

SEQ ID NO: 820227 - DNA, 20 bp, mouse
ggcaccaagccctggtgctg

SEQ ID NO: 820228 - DNA, 20 bp, mouse
gcactggggacattggcaac

SEQ ID NO: 820229 - DNA, 20 bp, mouse
gagaatgcctgtctattttt

SEQ ID NO: 820230 - DNA, 20 bp, mouse
ggctacattgcaccaagccc

SEQ ID NO: 820231 - DNA, 20 bp, mouse
ggggtgtaaaagaacctaca

SEQ ID NO: 820232 - DNA, 20 bp, mouse
gcaggtttcacatgctacag

SEQ ID NO: 820233 - DNA, 20 bp, mouse
ggtaaaaaagagagagtagc

SEQ ID NO: 820234 - DNA, 20 bp, mouse
gtctcaactgaggtggatcc

SEQ ID NO: 820235 - DNA, 20 bp, mouse
ggctctactgagttaggctg

SEQ ID NO: 820236 - DNA, 20 bp, mouse
gtaagatgaaactcgtggag

SEQ ID NO: 820237 - DNA, 20 bp, mouse
gggcaaagataactgtgact

SEQ ID NO: 820238 - DNA, 20 bp, mouse
gtatgcctgagcagtttggg

SEQ ID NO: 820239 - DNA, 20 bp, mouse
gggtcaaaggagatgaagac

SEQ ID NO: 820240 - DNA, 20 bp, mouse
gttagctgggagtgtaggct

SEQ ID NO: 820241 - DNA, 20 bp, mouse
ggtggcaagtaaacccagag

SEQ ID NO: 820242 - DNA, 20 bp, mouse
gggctgtgcactctgtctag

SEQ ID NO: 820243 - DNA, 20 bp, mouse
gtgaaaagaaagagggtcaa

SEQ ID NO: 820244 - DNA, 20 bp, mouse
gagctctcttataacttagc

SEQ ID NO: 820245 - DNA, 20 bp, mouse
gaatttattctgggaaccgt

SEQ ID NO: 820246 - DNA, 20 bp, mouse
ggacgcgcagagggcttgac

SEQ ID NO: 820247 - DNA, 20 bp, mouse
ggtaactgcggacgcgcaga

SEQ ID NO: 820248 - DNA, 20 bp, mouse
gtgcgcgtccgcagttacta

SEQ ID NO: 820249 - DNA, 20 bp, mouse
gaagcttcctggggcgtctg

SEQ ID NO: 820250 - DNA, 20 bp, mouse
ggagtcgcgacgccagtcgg

SEQ ID NO: 820251 - DNA, 20 bp, mouse
gaatatgagtccctggttct

SEQ ID NO: 820252 - DNA, 20 bp, mouse
gggtcggggtgaggggtccc

SEQ ID NO: 820253 - DNA, 20 bp, mouse
gagacctgaagcccagaacc

SEQ ID NO: 820254 - DNA, 20 bp, mouse
gtagttaccccagacgcccc

SEQ ID NO: 820255 - DNA, 20 bp, mouse
gacccctcaccccgaccagc

SEQ ID NO: 820256 - DNA, 20 bp, mouse
gccaaactccagaaatacca

SEQ ID NO: 820257 - DNA, 20 bp, mouse
gccagaggaaacttggggcg

SEQ ID NO: 820258 - DNA, 20 bp, mouse
gcggggaagcggttgacttg

SEQ ID NO: 820259 - DNA, 20 bp, mouse
gctgcaccagaggaaacttg

SEQ ID NO: 820260 - DNA, 20 bp, mouse
gaagggagcgagatccgttc

SEQ ID NO: 820261 - DNA, 20 bp, mouse
gtactatggaaacggggaag

SEQ ID NO: 820262 - DNA, 20 bp, mouse
gggtccggaaccggtttggg

SEQ ID NO: 820263 - DNA, 20 bp, mouse
gtgacttgagggtccggaac

SEQ ID NO: 820264 - DNA, 20 bp, mouse
gtagaggttgaaaactgact

SEQ ID NO: 820265 - DNA, 20 bp, mouse
ggtaagccagctcgacccgc

SEQ ID NO: 820266 - DNA, 20 bp, mouse
gtatctcgaaagctaaggtg

SEQ ID NO: 820267 - DNA, 20 bp, mouse
ggcgcgaggcagctgaggaa

SEQ ID NO: 820268 - DNA, 20 bp, mouse
ggaaagctaaggtggggagc

SEQ ID NO: 820269 - DNA, 20 bp, mouse
gtgtggcgcggcaaccgtga

SEQ ID NO: 820270 - DNA, 20 bp, mouse
gtcccacagcgcgacttcgg

SEQ ID NO: 820271 - DNA, 20 bp, mouse
gcagaggggtagcccaggtc

SEQ ID NO: 820272 - DNA, 20 bp, mouse
gggtagcccaggtcaggatg

SEQ ID NO: 820273 - DNA, 20 bp, mouse
gagcccaggtcaggatgcgg

SEQ ID NO: 820274 - DNA, 20 bp, mouse
gctggctcccagtgacgtca

SEQ ID NO: 820275 - DNA, 20 bp, mouse
gccctgcgtgagccccgcgg

SEQ ID NO: 820276 - DNA, 20 bp, mouse
gtgccagatgggtgcttcag

SEQ ID NO: 820277 - DNA, 20 bp, mouse
ggggccgcggtacgtatggt

SEQ ID NO: 820278 - DNA, 20 bp, mouse
gcggctcactcggtaaccgg

SEQ ID NO: 820279 - DNA, 20 bp, mouse
gctccactgaagcacccatc

SEQ ID NO: 820280 - DNA, 20 bp, mouse
gtcgtggagtcctgtttcag

SEQ ID NO: 820281 - DNA, 20 bp, mouse
gtgaagaggcggttacctga

SEQ ID NO: 820282 - DNA, 20 bp, mouse
gacacaccagcctgccagat

SEQ ID NO: 820283 - DNA, 20 bp, mouse
gccgcacttcccccagggtt

SEQ ID NO: 820284 - DNA, 20 bp, mouse
gcactcggtaaccgggggaa

SEQ ID NO: 820285 - DNA, 20 bp, mouse
gggcacttaggaactccctc

SEQ ID NO: 820286 - DNA, 20 bp, mouse
gggtggggagggtgtctctt

SEQ ID NO: 820287 - DNA, 20 bp, mouse
ggggtgcaacaaccggcaag

SEQ ID NO: 820288 - DNA, 20 bp, mouse
gtgttgcacccgcctggggt

SEQ ID NO: 820289 - DNA, 20 bp, mouse
gacacaccaacccaccagag

SEQ ID NO: 820290 - DNA, 20 bp, mouse
ggtcacggccagagtgggga

SEQ ID NO: 820291 - DNA, 20 bp, mouse
gcccaggcgggtgcaacaac

SEQ ID NO: 820292 - DNA, 20 bp, mouse
gtgacgtcacggccagagtg

SEQ ID NO: 820293 - DNA, 20 bp, mouse
ggtgcgacgcctacaggttg

SEQ ID NO: 820294 - DNA, 20 bp, mouse
gtggctggtgcgacgcctac

SEQ ID NO: 820295 - DNA, 20 bp, mouse
gtcttgggcagaagactgtc

SEQ ID NO: 820296 - DNA, 20 bp, mouse
gtaaggcagcgagatgaggc

SEQ ID NO: 820297 - DNA, 20 bp, mouse
gaggtcgccacgcaagtcgc

SEQ ID NO: 820298 - DNA, 20 bp, mouse
gagagaggccggaggctagc

SEQ ID NO: 820299 - DNA, 20 bp, mouse
gctccggcctctctctgctg

SEQ ID NO: 820300 - DNA, 20 bp, mouse
ggcggagtcccgctcccgtg

SEQ ID NO: 820301 - DNA, 20 bp, mouse
gagtcccgctcccgtgggga

SEQ ID NO: 820302 - DNA, 20 bp, mouse
gatgaggccggcgacttgcg

SEQ ID NO: 820303 - DNA, 20 bp, mouse
gcacaagtagaaagtgctcg

SEQ ID NO: 820304 - DNA, 20 bp, mouse
gggccgggcgtctgattccc

SEQ ID NO: 820305 - DNA, 20 bp, mouse
gacgtaggggccaaagagga

SEQ ID NO: 820306 - DNA, 20 bp, mouse
gcggagctgggcggacccga

SEQ ID NO: 820307 - DNA, 20 bp, mouse
gtggtgctctccaatagccc

SEQ ID NO: 820308 - DNA, 20 bp, mouse
gggggcggaagtcttagact

SEQ ID NO: 820309 - DNA, 20 bp, mouse
gcaatagccccggctccaat

SEQ ID NO: 820310 - DNA, 20 bp, mouse
gggcctcacttgggctttta

SEQ ID NO: 820311 - DNA, 20 bp, mouse
ggcgcacaaccggagctggg

SEQ ID NO: 820312 - DNA, 20 bp, mouse
gagaactaatcaatcaagtt

SEQ ID NO: 820313 - DNA, 20 bp, mouse
gagctgggcggacccgaggg

SEQ ID NO: 820314 - DNA, 20 bp, mouse
gataaacaaacgctctccag

SEQ ID NO: 820315 - DNA, 20 bp, mouse
gaagcccaagtgaggccgat

SEQ ID NO: 820316 - DNA, 20 bp, mouse
gcgcgcgcggcgccgggtgt

SEQ ID NO: 820317 - DNA, 20 bp, mouse
ggcctggcggcggcgtgcgc

SEQ ID NO: 820318 - DNA, 20 bp, mouse
gcgcgctacgcgtcacccgt

SEQ ID NO: 820319 - DNA, 20 bp, mouse
gcgcgcgcgcgcggaccgag

SEQ ID NO: 820320 - DNA, 20 bp, mouse
gtgggcgttcccagaggaaa

SEQ ID NO: 820321 - DNA, 20 bp, mouse
ggcccagccaacgcagcctc

SEQ ID NO: 820322 - DNA, 20 bp, mouse
ggccaggcgcggacgagggg

SEQ ID NO: 820323 - DNA, 20 bp, mouse
ggggaggccaggcgcggacg

SEQ ID NO: 820324 - DNA, 20 bp, mouse
gtccgcgcctggcctcccgc

SEQ ID NO: 820325 - DNA, 20 bp, mouse
gcgcgggatgagccgtaaaa

SEQ ID NO: 820326 - DNA, 20 bp, mouse
ggaaaggatgggagagttga

SEQ ID NO: 820327 - DNA, 20 bp, mouse
gtatatcagccagacttcat

SEQ ID NO: 820328 - DNA, 20 bp, mouse
gaggggtggtctgtgagctt

SEQ ID NO: 820329 - DNA, 20 bp, mouse
gcaacaggaggaaaggtagc

SEQ ID NO: 820330 - DNA, 20 bp, mouse
gacatgctgcaattactgca

SEQ ID NO: 820331 - DNA, 20 bp, mouse
ggtagcaggatgctactctc

SEQ ID NO: 820332 - DNA, 20 bp, mouse
gttgtttcccctgaaaggat

SEQ ID NO: 820333 - DNA, 20 bp, mouse
gtgttaatatggcaaggttt

SEQ ID NO: 820334 - DNA, 20 bp, mouse
gaatttttgtttcccctgaa

SEQ ID NO: 820335 - DNA, 20 bp, mouse
gtcactgtcatcttctgaac

SEQ ID NO: 820336 - DNA, 20 bp, mouse
gaacttccatgaactgggaa

SEQ ID NO: 820337 - DNA, 20 bp, mouse
gcccagttcatggaagttgt

SEQ ID NO: 820338 - DNA, 20 bp, mouse
gttcatggaagttgtaggac

SEQ ID NO: 820339 - DNA, 20 bp, mouse
gaaaaaaagggggtgtgtag

SEQ ID NO: 820340 - DNA, 20 bp, mouse
gcacgcccttgagctttgat

SEQ ID NO: 820341 - DNA, 20 bp, mouse
ggtagccatagacataccat

SEQ ID NO: 820342 - DNA, 20 bp, mouse
gtggtggatccagaaaaaaa

SEQ ID NO: 820343 - DNA, 20 bp, mouse
gggctacttggatgtcacaa

SEQ ID NO: 820344 - DNA, 20 bp, mouse
gttagccaatcaaagctcaa

SEQ ID NO: 820345 - DNA, 20 bp, mouse
ggtggctctcattgttctga

SEQ ID NO: 820346 - DNA, 20 bp, mouse
gcctaccacaaggcaaggaa

SEQ ID NO: 820347 - DNA, 20 bp, mouse
gctaaacagacatgagggtc

SEQ ID NO: 820348 - DNA, 20 bp, mouse
gactcttcagtcagcagcct

SEQ ID NO: 820349 - DNA, 20 bp, mouse
gcctgcctaaacagacatga

SEQ ID NO: 820350 - DNA, 20 bp, mouse
gcacagcctaccacaaggca

SEQ ID NO: 820351 - DNA, 20 bp, mouse
ggaggagggcctttgagtgg

SEQ ID NO: 820352 - DNA, 20 bp, mouse
gctttggttctggggagaag

SEQ ID NO: 820353 - DNA, 20 bp, mouse
gcagacatgagggtcagggc

SEQ ID NO: 820354 - DNA, 20 bp, mouse
gctcaggcaagttcactcgc

SEQ ID NO: 820355 - DNA, 20 bp, mouse
gcacctgtctcatctgttct

SEQ ID NO: 820356 - DNA, 20 bp, mouse
gtcagagtcacaagccccaa

SEQ ID NO: 820357 - DNA, 20 bp, mouse
ggtatgattgggatcccttg

SEQ ID NO: 820358 - DNA, 20 bp, mouse
gtctgagagatcgtatgatt

SEQ ID NO: 820359 - DNA, 20 bp, mouse
gtagggcgactgcaaagcca

SEQ ID NO: 820360 - DNA, 20 bp, mouse
gtacagcccggtgccatcat

SEQ ID NO: 820361 - DNA, 20 bp, mouse
gacggttaaagcagccggaa

SEQ ID NO: 820362 - DNA, 20 bp, mouse
gtgccatcataggcttacag

SEQ ID NO: 820363 - DNA, 20 bp, mouse
gaagttaggagcctatgagg

SEQ ID NO: 820364 - DNA, 20 bp, mouse
gcttacactctggccaagtt

SEQ ID NO: 820365 - DNA, 20 bp, mouse
gtccagagctgcttacgagt

SEQ ID NO: 820366 - DNA, 20 bp, mouse
gtcggcttgcgatggtccca

SEQ ID NO: 820367 - DNA, 20 bp, mouse
gcacatgcgcacaagctccc

SEQ ID NO: 820368 - DNA, 20 bp, mouse
gccgggcacgcgcacgtcct

SEQ ID NO: 820369 - DNA, 20 bp, mouse
gtgcggagcgacgaacccct

SEQ ID NO: 820370 - DNA, 20 bp, mouse
gcccaggtcaacaaagacgg

SEQ ID NO: 820371 - DNA, 20 bp, mouse
ggcgaggtgccagcggccca

SEQ ID NO: 820372 - DNA, 20 bp, mouse
gggccgctggcacctcgctg

SEQ ID NO: 820373 - DNA, 20 bp, mouse
gcagcggcccaggggacaga

SEQ ID NO: 820374 - DNA, 20 bp, mouse
gaggcagtgtgtagcaattt

SEQ ID NO: 820375 - DNA, 20 bp, mouse
gcctgctatgcccctttctc

SEQ ID NO: 820376 - DNA, 20 bp, mouse
gagcccgcggccgtcccggg

SEQ ID NO: 820377 - DNA, 20 bp, mouse
gtgggcgggcggtgggcccc

SEQ ID NO: 820378 - DNA, 20 bp, mouse
ggggagcccgcggccgtccc

SEQ ID NO: 820379 - DNA, 20 bp, mouse
gcggggccgccgagagtcgg

SEQ ID NO: 820380 - DNA, 20 bp, mouse
gcaaccgcgtgaaggtgagc

SEQ ID NO: 820381 - DNA, 20 bp, mouse
gggaagcgcgagccgacacg

SEQ ID NO: 820382 - DNA, 20 bp, mouse
ggccgcccgccgactctcgg

SEQ ID NO: 820383 - DNA, 20 bp, mouse
gaacttcgtcgaagtttccg

SEQ ID NO: 820384 - DNA, 20 bp, mouse
gtggccgggctgtgggccga

SEQ ID NO: 820385 - DNA, 20 bp, mouse
gcggactcgtgtgtgttcaa

SEQ ID NO: 820386 - DNA, 20 bp, mouse
ggaggctggaccagcaagga

SEQ ID NO: 820387 - DNA, 20 bp, mouse
gaggaccccaggagcgggtt

SEQ ID NO: 820388 - DNA, 20 bp, mouse
ggcggggaatgaagtgaggt

SEQ ID NO: 820389 - DNA, 20 bp, mouse
gagaggcggggaatgaagtg

SEQ ID NO: 820390 - DNA, 20 bp, mouse
ggctgcgaggaccccaggag

SEQ ID NO: 820391 - DNA, 20 bp, mouse
ggggcgtggcttcaggggag

SEQ ID NO: 820392 - DNA, 20 bp, mouse
gtggcttcaggggagcggtg

SEQ ID NO: 820393 - DNA, 20 bp, mouse
ggcgtggctccttgaagagg

SEQ ID NO: 820394 - DNA, 20 bp, mouse
gggggcgtggctccttgaag

SEQ ID NO: 820395 - DNA, 20 bp, mouse
gtctctagcgggtagaggca

SEQ ID NO: 820396 - DNA, 20 bp, mouse
gcaggctcggcccaccatcg

SEQ ID NO: 820397 - DNA, 20 bp, mouse
ggcccaccatcggggagcta

SEQ ID NO: 820398 - DNA, 20 bp, mouse
gaggtgccgtagctccccga

SEQ ID NO: 820399 - DNA, 20 bp, mouse
ggggaaacgtagacagaatg

SEQ ID NO: 820400 - DNA, 20 bp, mouse
gggtgggcaaataccagcta

SEQ ID NO: 820401 - DNA, 20 bp, mouse
gggcacgtggtccgctaaat

SEQ ID NO: 820402 - DNA, 20 bp, mouse
ggcaaataccagctaggggt

SEQ ID NO: 820403 - DNA, 20 bp, mouse
gtagcggaccacgtgcctcc

SEQ ID NO: 820404 - DNA, 20 bp, mouse
gagcacttggttcatagtag

SEQ ID NO: 820405 - DNA, 20 bp, mouse
ggcaggtgcattcagagaga

SEQ ID NO: 820406 - DNA, 20 bp, mouse
gcccgggtgtcgttgatgtt

SEQ ID NO: 820407 - DNA, 20 bp, mouse
gagccccgcgagctgctcgc

SEQ ID NO: 820408 - DNA, 20 bp, mouse
ggggctgcgggagttggagt

SEQ ID NO: 820409 - DNA, 20 bp, mouse
gaagagctggtgagcccggc

SEQ ID NO: 820410 - DNA, 20 bp, mouse
gagccggcgagcagctcgcg

SEQ ID NO: 820411 - DNA, 20 bp, mouse
gcaccagctcttcccggcgg

SEQ ID NO: 820412 - DNA, 20 bp, mouse
gccggcgggcggttgggaac

SEQ ID NO: 820413 - DNA, 20 bp, mouse
ggctcaccagctcttcccgg

SEQ ID NO: 820414 - DNA, 20 bp, mouse
gacccgggagcgcggcctcg

SEQ ID NO: 820415 - DNA, 20 bp, mouse
gaaccgccgccgggaagagc

SEQ ID NO: 820416 - DNA, 20 bp, mouse
gaggaggtcgcggtaggggt

SEQ ID NO: 820417 - DNA, 20 bp, mouse
gtgggaggaggtcgcggtag

SEQ ID NO: 820418 - DNA, 20 bp, mouse
gctcccagcctggggacctt

SEQ ID NO: 820419 - DNA, 20 bp, mouse
gcgtaacgggcccgaggcga

SEQ ID NO: 820420 - DNA, 20 bp, mouse
ggcagccggccgccacgtca

SEQ ID NO: 820421 - DNA, 20 bp, mouse
ggcccgttacgccacggcgc

SEQ ID NO: 820422 - DNA, 20 bp, mouse
ggtgggtccccaaggtcccc

SEQ ID NO: 820423 - DNA, 20 bp, mouse
gcctcgggcccgttacgcca

SEQ ID NO: 820424 - DNA, 20 bp, mouse
gagggacccggggctagcgt

SEQ ID NO: 820425 - DNA, 20 bp, mouse
gggtctgggtgtcctccaga

SEQ ID NO: 820426 - DNA, 20 bp, mouse
gtccagggtgagagtgcaga

SEQ ID NO: 820427 - DNA, 20 bp, mouse
gcaaactgtcttcttgatgg

SEQ ID NO: 820428 - DNA, 20 bp, mouse
ggcacagcaggagtgtagaa

SEQ ID NO: 820429 - DNA, 20 bp, mouse
gcaagggtgaactcggtgag

SEQ ID NO: 820430 - DNA, 20 bp, mouse
gagtgtagaagggagacgac

SEQ ID NO: 820431 - DNA, 20 bp, mouse
gtgacctccttcaacttcca

SEQ ID NO: 820432 - DNA, 20 bp, mouse
gctctcaccctggaagttga

SEQ ID NO: 820433 - DNA, 20 bp, mouse
gtaccaaaatcagaagtctt

SEQ ID NO: 820434 - DNA, 20 bp, mouse
gcaccgagttcacccttggt

SEQ ID NO: 820435 - DNA, 20 bp, mouse
gggtgggaagggtagcccta

SEQ ID NO: 820436 - DNA, 20 bp, mouse
ggaaccggacctcactccta

SEQ ID NO: 820437 - DNA, 20 bp, mouse
ggagaggcggcggcagtagg

SEQ ID NO: 820438 - DNA, 20 bp, mouse
gaacccggaagcaaattaac

SEQ ID NO: 820439 - DNA, 20 bp, mouse
gggagtgaggtccggttcta

SEQ ID NO: 820440 - DNA, 20 bp, mouse
gagctggtgtacgcgaggaa

SEQ ID NO: 820441 - DNA, 20 bp, mouse
gggtccctaggagtgaggtc

SEQ ID NO: 820442 - DNA, 20 bp, mouse
gtgggcccaggcgtgagcgg

SEQ ID NO: 820443 - DNA, 20 bp, mouse
gtacgcgaggaacggagagg

SEQ ID NO: 820444 - DNA, 20 bp, mouse
ggggaggcacgagcggaacc

SEQ ID NO: 820445 - DNA, 20 bp, mouse
gtggggtggcggggtcaaaa

SEQ ID NO: 820446 - DNA, 20 bp, mouse
ggcctgcagtgcaaccgccc

SEQ ID NO: 820447 - DNA, 20 bp, mouse
gagggtcataatgagtagaa

SEQ ID NO: 820448 - DNA, 20 bp, mouse
ggtcacccacatgaatgcta

SEQ ID NO: 820449 - DNA, 20 bp, mouse
gtacacacagaggggaaaga

SEQ ID NO: 820450 - DNA, 20 bp, mouse
gagtgtctagacaggtcaag

SEQ ID NO: 820451 - DNA, 20 bp, mouse
gcccgtggagtgcccctccc

SEQ ID NO: 820452 - DNA, 20 bp, mouse
ggggtgacttaggaagggag

SEQ ID NO: 820453 - DNA, 20 bp, mouse
gagtgcaaccgcccagggag

SEQ ID NO: 820454 - DNA, 20 bp, mouse
gctattgctagtgtctagac

SEQ ID NO: 820455 - DNA, 20 bp, mouse
gccctgggcggttgcactgc

SEQ ID NO: 820456 - DNA, 20 bp, mouse
gctgtcagctagctacagat

SEQ ID NO: 820457 - DNA, 20 bp, mouse
gggtgggtcgggtagagatc

SEQ ID NO: 820458 - DNA, 20 bp, mouse
gaacaaaggaagggtgctaa

SEQ ID NO: 820459 - DNA, 20 bp, mouse
gtgacagattagacaaggag

SEQ ID NO: 820460 - DNA, 20 bp, mouse
ggagacggtgaacaaaggaa

SEQ ID NO: 820461 - DNA, 20 bp, mouse
ggacctgaggattccggggt

SEQ ID NO: 820462 - DNA, 20 bp, mouse
gtaagggaacagaagcccca

SEQ ID NO: 820463 - DNA, 20 bp, mouse
gggatggagacggtgaacaa

SEQ ID NO: 820464 - DNA, 20 bp, mouse
gctagctgacagattagaca

SEQ ID NO: 820465 - DNA, 20 bp, mouse
gcagactcaagggacagaac

SEQ ID NO: 820466 - DNA, 20 bp, mouse
gggtcaggcaggagacctgt

SEQ ID NO: 820467 - DNA, 20 bp, mouse
gaaggcctcgcgagagttaa

SEQ ID NO: 820468 - DNA, 20 bp, mouse
gtcacaagcgacaaggcaaa

SEQ ID NO: 820469 - DNA, 20 bp, mouse
ggcgtcgcttttgcctttat

SEQ ID NO: 820470 - DNA, 20 bp, mouse
gcgcttgtgaggtacaaagc

SEQ ID NO: 820471 - DNA, 20 bp, mouse
gtcgcgagagttaaaggaac

SEQ ID NO: 820472 - DNA, 20 bp, mouse
ggtggacaaaacagctaaag

SEQ ID NO: 820473 - DNA, 20 bp, mouse
gtaaccacgcaagcaagcgc

SEQ ID NO: 820474 - DNA, 20 bp, mouse
gtacaaagccggctcgggca

SEQ ID NO: 820475 - DNA, 20 bp, mouse
gcagaacaggtttctgtctg

SEQ ID NO: 820476 - DNA, 20 bp, mouse
gcacaagcccggctctcaag

SEQ ID NO: 820477 - DNA, 20 bp, mouse
gtccacgccccttgagagcc

SEQ ID NO: 820478 - DNA, 20 bp, mouse
gagcaccctggcaaccgggg

SEQ ID NO: 820479 - DNA, 20 bp, mouse
gactgcagcaacaaatgaca

SEQ ID NO: 820480 - DNA, 20 bp, mouse
gctctcaaggggcgtggagc

SEQ ID NO: 820481 - DNA, 20 bp, mouse
ggggacttcctctgttcgca

SEQ ID NO: 820482 - DNA, 20 bp, mouse
gaggtagggcttttatatgt

SEQ ID NO: 820483 - DNA, 20 bp, mouse
gtgcgcgcctcatccgtcgc

SEQ ID NO: 820484 - DNA, 20 bp, mouse
gtgggggatgaaatccagtc

SEQ ID NO: 820485 - DNA, 20 bp, mouse
ggacccagaaccagggaaag

SEQ ID NO: 820486 - DNA, 20 bp, mouse
gggtcaggacccacctagac

SEQ ID NO: 820487 - DNA, 20 bp, mouse
gaaaccccacctgtctaggt

SEQ ID NO: 820488 - DNA, 20 bp, mouse
gtgggcgctggaccaggatc

SEQ ID NO: 820489 - DNA, 20 bp, mouse
gaatggcagggggattaaat

SEQ ID NO: 820490 - DNA, 20 bp, mouse
gtgtagaaaactggggacga

SEQ ID NO: 820491 - DNA, 20 bp, mouse
gtggaacatacatgtcacaa

SEQ ID NO: 820492 - DNA, 20 bp, mouse
gaggtagggtccgggtgtaa

SEQ ID NO: 820493 - DNA, 20 bp, mouse
gagggggattaaatgggcgc

SEQ ID NO: 820494 - DNA, 20 bp, mouse
gtgaacaggttagtattgtg

SEQ ID NO: 820495 - DNA, 20 bp, mouse
gaccaggatctggaagttcc

SEQ ID NO: 820496 - DNA, 20 bp, mouse
gctgagtgggagtacacagt

SEQ ID NO: 820497 - DNA, 20 bp, mouse
ggccacgcccagcttcgccc

SEQ ID NO: 820498 - DNA, 20 bp, mouse
gcggctaagtaggagggtgg

SEQ ID NO: 820499 - DNA, 20 bp, mouse
ggggcgggcttgactttctg

SEQ ID NO: 820500 - DNA, 20 bp, mouse
gacagtgggtgtatgatcac

SEQ ID NO: 820501 - DNA, 20 bp, mouse
ggagtcgggtgccgcccttt

SEQ ID NO: 820502 - DNA, 20 bp, mouse
gaagatgtgcctagcggaac

SEQ ID NO: 820503 - DNA, 20 bp, mouse
ggccgccctttcggctaagt

SEQ ID NO: 820504 - DNA, 20 bp, mouse
gcccaccaacgtcacgacca

SEQ ID NO: 820505 - DNA, 20 bp, mouse
ggcgtggcctgggcgaagct

SEQ ID NO: 820506 - DNA, 20 bp, mouse
gaggctggcccctgtggcta

SEQ ID NO: 820507 - DNA, 20 bp, mouse
ggcaccggtttcctctccca

SEQ ID NO: 820508 - DNA, 20 bp, mouse
ggcctcctgccggttcaagc

SEQ ID NO: 820509 - DNA, 20 bp, mouse
gcagctgccttgttcctcca

SEQ ID NO: 820510 - DNA, 20 bp, mouse
gtgcagccgaaaggtgcctg

SEQ ID NO: 820511 - DNA, 20 bp, mouse
gggctctggtcacataatca

SEQ ID NO: 820512 - DNA, 20 bp, mouse
ggtgacctcacaggaggtat

SEQ ID NO: 820513 - DNA, 20 bp, mouse
ggtcacccatacctcctgtg

SEQ ID NO: 820514 - DNA, 20 bp, mouse
ggcccctgtggctagggctc

SEQ ID NO: 820515 - DNA, 20 bp, mouse
gctggcttttgtgacctcac

SEQ ID NO: 820516 - DNA, 20 bp, mouse
ggtaggtggaagcacccaga

SEQ ID NO: 820517 - DNA, 20 bp, mouse
gacaaagggcttctgagagt

SEQ ID NO: 820518 - DNA, 20 bp, mouse
gtgagctgagattataagac

SEQ ID NO: 820519 - DNA, 20 bp, mouse
gaattctccttcagccttct

SEQ ID NO: 820520 - DNA, 20 bp, mouse
gagtagccacataacgaact

SEQ ID NO: 820521 - DNA, 20 bp, mouse
gtaaaaaatgttggagtagg

SEQ ID NO: 820522 - DNA, 20 bp, mouse
gcaggaactcatatattacc

SEQ ID NO: 820523 - DNA, 20 bp, mouse
gacatgcctagttcgttatg

SEQ ID NO: 820524 - DNA, 20 bp, mouse
ggtctccagctctgtgttgt

SEQ ID NO: 820525 - DNA, 20 bp, mouse
ggagcaatcctgaagaaatg

SEQ ID NO: 820526 - DNA, 20 bp, mouse
ggagaagggcctagttgcca

SEQ ID NO: 820527 - DNA, 20 bp, mouse
ggatagcgcatatgtgagaa

SEQ ID NO: 820528 - DNA, 20 bp, mouse
gcagctgtgttgggaccacg

SEQ ID NO: 820529 - DNA, 20 bp, mouse
ggctgagatattcacagcct

SEQ ID NO: 820530 - DNA, 20 bp, mouse
gatatgcgctatctgcagaa

SEQ ID NO: 820531 - DNA, 20 bp, mouse
gattcacagccttggcaact

SEQ ID NO: 820532 - DNA, 20 bp, mouse
gaggcttttgattatgctcc

SEQ ID NO: 820533 - DNA, 20 bp, mouse
ggttgggaccacgtggtgcc

SEQ ID NO: 820534 - DNA, 20 bp, mouse
gtggtcagctcatgtattct

SEQ ID NO: 820535 - DNA, 20 bp, mouse
gaaataaatataataggcag

SEQ ID NO: 820536 - DNA, 20 bp, mouse
gagggacagccattgtgtat

SEQ ID NO: 820537 - DNA, 20 bp, mouse
gagttacagacccatgttaa

SEQ ID NO: 820538 - DNA, 20 bp, mouse
gcacggcaaagtaaagtccc

SEQ ID NO: 820539 - DNA, 20 bp, mouse
gcctgggacagtaaatgtca

SEQ ID NO: 820540 - DNA, 20 bp, mouse
gtaaagtcccaggcatcacg

SEQ ID NO: 820541 - DNA, 20 bp, mouse
gctgtcccttcccttaacat

SEQ ID NO: 820542 - DNA, 20 bp, mouse
gaacatgggtctgtaactcg

SEQ ID NO: 820543 - DNA, 20 bp, mouse
gcacaagggtttctgagggt

SEQ ID NO: 820544 - DNA, 20 bp, mouse
gtatgatgacgctactatcc

SEQ ID NO: 820545 - DNA, 20 bp, mouse
gctgggaccacgtgatgcct

SEQ ID NO: 820546 - DNA, 20 bp, mouse
ggtaacaagaaagttccctg

SEQ ID NO: 820547 - DNA, 20 bp, mouse
ggcaaacactaaaggggaat

SEQ ID NO: 820548 - DNA, 20 bp, mouse
gaggaacataaagtgaagta

SEQ ID NO: 820549 - DNA, 20 bp, mouse
gacactaaaggggaatgggt

SEQ ID NO: 820550 - DNA, 20 bp, mouse
gacagcagtctcaaagttga

SEQ ID NO: 820551 - DNA, 20 bp, mouse
gcaagagctgcaaacactaa

SEQ ID NO: 820552 - DNA, 20 bp, mouse
gcagacctaggcctacagtg

SEQ ID NO: 820553 - DNA, 20 bp, mouse
gggtctgcatcacagagcaa

SEQ ID NO: 820554 - DNA, 20 bp, mouse
gagtgaaggagcttggagga

SEQ ID NO: 820555 - DNA, 20 bp, mouse
gatgccttgaagtttagctt

SEQ ID NO: 820556 - DNA, 20 bp, mouse
ggtgaagccccagacacaga

SEQ ID NO: 820557 - DNA, 20 bp, mouse
ggtaggcaggagaactacgt

SEQ ID NO: 820558 - DNA, 20 bp, mouse
ggaagtgatgaaatcagggt

SEQ ID NO: 820559 - DNA, 20 bp, mouse
gagccattgtgagggcgggg

SEQ ID NO: 820560 - DNA, 20 bp, mouse
ggtgtctggggcttcaccac

SEQ ID NO: 820561 - DNA, 20 bp, mouse
gagtcatagagccattgtga

SEQ ID NO: 820562 - DNA, 20 bp, mouse
gctgtagaagtgatgaaatc

SEQ ID NO: 820563 - DNA, 20 bp, mouse
gatcagggtgggggcatgaa

SEQ ID NO: 820564 - DNA, 20 bp, mouse
gtcaaggaagatcccatgtc

SEQ ID NO: 820565 - DNA, 20 bp, mouse
gaggcaagctgaatagacat

SEQ ID NO: 820566 - DNA, 20 bp, mouse
ggtaaggacggggtaggtgg

SEQ ID NO: 820567 - DNA, 20 bp, mouse
gcccccccggaccaagactt

SEQ ID NO: 820568 - DNA, 20 bp, mouse
gtgccccaagtcttggtccg

SEQ ID NO: 820569 - DNA, 20 bp, mouse
gacgttcaggccaggggata

SEQ ID NO: 820570 - DNA, 20 bp, mouse
gtggacagcggtcttgggta

SEQ ID NO: 820571 - DNA, 20 bp, mouse
gggccagctgccccaagtct

SEQ ID NO: 820572 - DNA, 20 bp, mouse
ggcggtcttgggtaaggacg

SEQ ID NO: 820573 - DNA, 20 bp, mouse
gtacctggcctactgtggcg

SEQ ID NO: 820574 - DNA, 20 bp, mouse
gtggcatgtaggaaacttga

SEQ ID NO: 820575 - DNA, 20 bp, mouse
gggccacgccacagtaggcc

SEQ ID NO: 820576 - DNA, 20 bp, mouse
ggaagccctcgcggagacag

SEQ ID NO: 820577 - DNA, 20 bp, mouse
ggggtcggagcgggagtctg

SEQ ID NO: 820578 - DNA, 20 bp, mouse
ggtctccgcgagggcttccg

SEQ ID NO: 820579 - DNA, 20 bp, mouse
gaccggccatggacggtaag

SEQ ID NO: 820580 - DNA, 20 bp, mouse
gctgaagcccggggcgggtc

SEQ ID NO: 820581 - DNA, 20 bp, mouse
gcgggtccggctgggttatg

SEQ ID NO: 820582 - DNA, 20 bp, mouse
gtcccgctccgaccccgaag

SEQ ID NO: 820583 - DNA, 20 bp, mouse
gagaagatagctccggggcg

SEQ ID NO: 820584 - DNA, 20 bp, mouse
ggcgaccccggaagccctcg

SEQ ID NO: 820585 - DNA, 20 bp, mouse
gccggaagcggtggcgaccc

SEQ ID NO: 820586 - DNA, 20 bp, mouse
ggatcagctgggggctgata

SEQ ID NO: 820587 - DNA, 20 bp, mouse
ggcgtcgaagggcggggctt

SEQ ID NO: 820588 - DNA, 20 bp, mouse
gcatgaacgttaacagtctg

SEQ ID NO: 820589 - DNA, 20 bp, mouse
gggggcttcggcctccaaga

SEQ ID NO: 820590 - DNA, 20 bp, mouse
gaggatgtgactcaatgttt

SEQ ID NO: 820591 - DNA, 20 bp, mouse
gaggctttagcgtcgaaggg

SEQ ID NO: 820592 - DNA, 20 bp, mouse
gggcttcacttgcactgtgt

SEQ ID NO: 820593 - DNA, 20 bp, mouse
gataaggtctgctggaatcg

SEQ ID NO: 820594 - DNA, 20 bp, mouse
ggggggctgataaggtctgc

SEQ ID NO: 820595 - DNA, 20 bp, mouse
gtcgaggctttagcgtcgaa

SEQ ID NO: 820596 - DNA, 20 bp, mouse
gaggcggaggcggagagcga

SEQ ID NO: 820597 - DNA, 20 bp, mouse
gagcgccacccacgaggcgg

SEQ ID NO: 820598 - DNA, 20 bp, mouse
gtgcacggggtcacgagagt

SEQ ID NO: 820599 - DNA, 20 bp, mouse
ggccgaagtccacttttcaa

SEQ ID NO: 820600 - DNA, 20 bp, mouse
ggtctcgcaagacaccgttt

SEQ ID NO: 820601 - DNA, 20 bp, mouse
gagaaagaagggctaggcgt

SEQ ID NO: 820602 - DNA, 20 bp, mouse
gtccgcctccgcctcgtggg

SEQ ID NO: 820603 - DNA, 20 bp, mouse
gtgactgtcctcgacgggtc

SEQ ID NO: 820604 - DNA, 20 bp, mouse
gcaagggttcataacgtcaa

SEQ ID NO: 820605 - DNA, 20 bp, mouse
gtcccgaagcgaatgtggtt

SEQ ID NO: 820606 - DNA, 20 bp, mouse
gggaacagctagctgtgctg

SEQ ID NO: 820607 - DNA, 20 bp, mouse
ggcggggcccggattgtggt

SEQ ID NO: 820608 - DNA, 20 bp, mouse
ggcccggattgtggtgggag

SEQ ID NO: 820609 - DNA, 20 bp, mouse
gaacccagggttctcagttc

SEQ ID NO: 820610 - DNA, 20 bp, mouse
gactacggagcaagaggcag

SEQ ID NO: 820611 - DNA, 20 bp, mouse
ggagtgcaaatcataggaaa

SEQ ID NO: 820612 - DNA, 20 bp, mouse
gacgccaaggccggacacta

SEQ ID NO: 820613 - DNA, 20 bp, mouse
ggcccctcccaccacaatcc

SEQ ID NO: 820614 - DNA, 20 bp, mouse
gaacccagaactgagaaccc

SEQ ID NO: 820615 - DNA, 20 bp, mouse
gttcatgagcaaattcagtt

SEQ ID NO: 820616 - DNA, 20 bp, mouse
ggatcccagaacaacagatt

SEQ ID NO: 820617 - DNA, 20 bp, mouse
gggtcccaatctgttgttct

SEQ ID NO: 820618 - DNA, 20 bp, mouse
gtcggtaagcaggagtgcct

SEQ ID NO: 820619 - DNA, 20 bp, mouse
ggaaagtgccagcagccggc

SEQ ID NO: 820620 - DNA, 20 bp, mouse
gccagcagccggcgggagga

SEQ ID NO: 820621 - DNA, 20 bp, mouse
gcaaacttggggtttggggc

SEQ ID NO: 820622 - DNA, 20 bp, mouse
gtcgccagggcggttgctaa

SEQ ID NO: 820623 - DNA, 20 bp, mouse
gccggcgggaggatggccac

SEQ ID NO: 820624 - DNA, 20 bp, mouse
gcaggagtgcctgggggcgt

SEQ ID NO: 820625 - DNA, 20 bp, mouse
gttcactctggataactgcc

SEQ ID NO: 820626 - DNA, 20 bp, mouse
gacagtgagaaacctaggga

SEQ ID NO: 820627 - DNA, 20 bp, mouse
gaggcaagagtagacgagtg

SEQ ID NO: 820628 - DNA, 20 bp, mouse
gagctctagcccccttccct

SEQ ID NO: 820629 - DNA, 20 bp, mouse
gaagggtcatattgaggagt

SEQ ID NO: 820630 - DNA, 20 bp, mouse
gaccttcatgatagtttcag

SEQ ID NO: 820631 - DNA, 20 bp, mouse
ggtgagaaacctagggaagg

SEQ ID NO: 820632 - DNA, 20 bp, mouse
ggcctctgaaactatcatga

SEQ ID NO: 820633 - DNA, 20 bp, mouse
gtcctttaggacaaagttta

SEQ ID NO: 820634 - DNA, 20 bp, mouse
gctgaaaaatagatcacatt

SEQ ID NO: 820635 - DNA, 20 bp, mouse
ggccctaaactttgtcctaa

SEQ ID NO: 820636 - DNA, 20 bp, mouse
gctgtggaaagccgatgagg

SEQ ID NO: 820637 - DNA, 20 bp, mouse
ggggccaattgtacagacaa

SEQ ID NO: 820638 - DNA, 20 bp, mouse
ggtaaagacaacagccgaag

SEQ ID NO: 820639 - DNA, 20 bp, mouse
gacccagagcctactagacc

SEQ ID NO: 820640 - DNA, 20 bp, mouse
gagcctgcaatgtcttgaca

SEQ ID NO: 820641 - DNA, 20 bp, mouse
gccccttgttgtagtctgga

SEQ ID NO: 820642 - DNA, 20 bp, mouse
ggcaaccgtgaaattataat

SEQ ID NO: 820643 - DNA, 20 bp, mouse
gatctgaagggaaagtccag

SEQ ID NO: 820644 - DNA, 20 bp, mouse
gcagagcctgttagagcaga

SEQ ID NO: 820645 - DNA, 20 bp, mouse
ggaccttgtcaagacattgc

SEQ ID NO: 820646 - DNA, 20 bp, mouse
gctgctggaaggtactagaa

SEQ ID NO: 820647 - DNA, 20 bp, mouse
ggagagatgtctgggagcag

SEQ ID NO: 820648 - DNA, 20 bp, mouse
gctagaaggcagcctagaca

SEQ ID NO: 820649 - DNA, 20 bp, mouse
gtgtatcaccaggtccaggt

SEQ ID NO: 820650 - DNA, 20 bp, mouse
gaggcggcgccacaaagcca

SEQ ID NO: 820651 - DNA, 20 bp, mouse
ggaggaagaaggacgttcct

SEQ ID NO: 820652 - DNA, 20 bp, mouse
gtctgtgtatcaccaggtcc

SEQ ID NO: 820653 - DNA, 20 bp, mouse
gtaagggtaacgacatcaca

SEQ ID NO: 820654 - DNA, 20 bp, mouse
gtgaacactcaatccctctg

SEQ ID NO: 820655 - DNA, 20 bp, mouse
gcagatgaatacaagtatgt

SEQ ID NO: 820656 - DNA, 20 bp, mouse
ggcgccgggtgcaggaagat

SEQ ID NO: 820657 - DNA, 20 bp, mouse
gaaaaggagcggtaagtggt

SEQ ID NO: 820658 - DNA, 20 bp, mouse
ggtaaggcagagagcaacgg

SEQ ID NO: 820659 - DNA, 20 bp, mouse
ggcacccggcgctccggcct

SEQ ID NO: 820660 - DNA, 20 bp, mouse
gaagtagcaatgacagttgt

SEQ ID NO: 820661 - DNA, 20 bp, mouse
gcggcctgggttgaggatgg

SEQ ID NO: 820662 - DNA, 20 bp, mouse
gtcaacccaggccggagcgc

SEQ ID NO: 820663 - DNA, 20 bp, mouse
gcatctgcaagctctgtaga

SEQ ID NO: 820664 - DNA, 20 bp, mouse
ggcctgcaaggctcggtcca

SEQ ID NO: 820665 - DNA, 20 bp, mouse
ggggtgaatcctgtctaatc

SEQ ID NO: 820666 - DNA, 20 bp, mouse
gcgaagggagagcgcctgag

SEQ ID NO: 820667 - DNA, 20 bp, mouse
gagaccggagccgaggggac

SEQ ID NO: 820668 - DNA, 20 bp, mouse
gggctccggtctcccgcgtg

SEQ ID NO: 820669 - DNA, 20 bp, mouse
gcctgagaggagcggtaacc

SEQ ID NO: 820670 - DNA, 20 bp, mouse
gctcccgcgtgcggcgcatc

SEQ ID NO: 820671 - DNA, 20 bp, mouse
gggtcaggggccaaacggga

SEQ ID NO: 820672 - DNA, 20 bp, mouse
gtgcgccgcacgcgggagac

SEQ ID NO: 820673 - DNA, 20 bp, mouse
gggttcgcgcgcctgagttg

SEQ ID NO: 820674 - DNA, 20 bp, mouse
gcggaggcgggcaaagttaa

SEQ ID NO: 820675 - DNA, 20 bp, mouse
ggccaaacgggaaggaacgg

SEQ ID NO: 820676 - DNA, 20 bp, mouse
gaaacccagggaggcgtgat

SEQ ID NO: 820677 - DNA, 20 bp, mouse
gtgagcggatacaaaaccca

SEQ ID NO: 820678 - DNA, 20 bp, mouse
gtgtgtgcaagcccgagcga

SEQ ID NO: 820679 - DNA, 20 bp, mouse
gccgccggcgcccctcgctc

SEQ ID NO: 820680 - DNA, 20 bp, mouse
gcccagggaggcgtgatcgg

SEQ ID NO: 820681 - DNA, 20 bp, mouse
gaagtgctgaagctgtatgg

SEQ ID NO: 820682 - DNA, 20 bp, mouse
ggctagggagggcgtgtgga

SEQ ID NO: 820683 - DNA, 20 bp, mouse
gggagggcgtgtggagggac

SEQ ID NO: 820684 - DNA, 20 bp, mouse
gcccctccgtgtcactcacc

SEQ ID NO: 820685 - DNA, 20 bp, mouse
gaagcccgagcgaggggcgc

SEQ ID NO: 820686 - DNA, 20 bp, mouse
gtgtgaggatcaatcatcgt

SEQ ID NO: 820687 - DNA, 20 bp, mouse
ggaactccggggagagtcca

SEQ ID NO: 820688 - DNA, 20 bp, mouse
gtgcaggactcaatcagcga

SEQ ID NO: 820689 - DNA, 20 bp, mouse
gggaaggagcggccattttg

SEQ ID NO: 820690 - DNA, 20 bp, mouse
gtacgcgtgcgtcgattgtc

SEQ ID NO: 820691 - DNA, 20 bp, mouse
ggatcaatcatcgtaggcgg

SEQ ID NO: 820692 - DNA, 20 bp, mouse
gaatcatcgtaggcggggga

SEQ ID NO: 820693 - DNA, 20 bp, mouse
gtaccaggccaatcgcaaac

SEQ ID NO: 820694 - DNA, 20 bp, mouse
ggacagaagaaatttcgcac

SEQ ID NO: 820695 - DNA, 20 bp, mouse
gagacttatgcgctctgggg

SEQ ID NO: 820696 - DNA, 20 bp, mouse
gggtctatagtgaagtagaa

SEQ ID NO: 820697 - DNA, 20 bp, mouse
ggaattctcgcggacaacta

SEQ ID NO: 820698 - DNA, 20 bp, mouse
gtgcaaggattggttgatat

SEQ ID NO: 820699 - DNA, 20 bp, mouse
gttgtccgcgagaattccgc

SEQ ID NO: 820700 - DNA, 20 bp, mouse
gagggcagactctccgtgca

SEQ ID NO: 820701 - DNA, 20 bp, mouse
gagaagacggagttgaaggg

SEQ ID NO: 820702 - DNA, 20 bp, mouse
gctgtcagccaatcagaaga

SEQ ID NO: 820703 - DNA, 20 bp, mouse
ggctgagacagcttgggacg

SEQ ID NO: 820704 - DNA, 20 bp, mouse
gaatcagaagacggagttga

SEQ ID NO: 820705 - DNA, 20 bp, mouse
gagactctccgtgcaaggat

SEQ ID NO: 820706 - DNA, 20 bp, mouse
gccctcgtgagcagtgtaca

SEQ ID NO: 820707 - DNA, 20 bp, mouse
gacactgctcacgagggctg

SEQ ID NO: 820708 - DNA, 20 bp, mouse
ggggaggcacagtcaaacta

SEQ ID NO: 820709 - DNA, 20 bp, mouse
gccgcccggagctgtaattg

SEQ ID NO: 820710 - DNA, 20 bp, mouse
gcgccccgcgccatcgacaa

SEQ ID NO: 820711 - DNA, 20 bp, mouse
gcggaagcggatgtctccga

SEQ ID NO: 820712 - DNA, 20 bp, mouse
ggagcagtgtacagggttct

SEQ ID NO: 820713 - DNA, 20 bp, mouse
gtgaccggtgcacgatgctc

SEQ ID NO: 820714 - DNA, 20 bp, mouse
ggctggggcagcgacctggc

SEQ ID NO: 820715 - DNA, 20 bp, mouse
gcgccggcggccgttaaact

SEQ ID NO: 820716 - DNA, 20 bp, mouse
gaggatgtggctagcaacgg

SEQ ID NO: 820717 - DNA, 20 bp, mouse
gagggctgaaagaggccgcg

SEQ ID NO: 820718 - DNA, 20 bp, mouse
gatgtggctagcaacggagg

SEQ ID NO: 820719 - DNA, 20 bp, mouse
ggcctccgcgggctcttcgg

SEQ ID NO: 820720 - DNA, 20 bp, mouse
gctcgcggttactaaggagt

SEQ ID NO: 820721 - DNA, 20 bp, mouse
gcggaggcggcaaccggcga

SEQ ID NO: 820722 - DNA, 20 bp, mouse
gtagtctggtgtgctgatga

SEQ ID NO: 820723 - DNA, 20 bp, mouse
gcgactccgagattcccgtg

SEQ ID NO: 820724 - DNA, 20 bp, mouse
gcggaggcgatgtccctgtc

SEQ ID NO: 820725 - DNA, 20 bp, mouse
gaggcgatgtccctgtcagg

SEQ ID NO: 820726 - DNA, 20 bp, mouse
gtgcacggccgcccagtggg

SEQ ID NO: 820727 - DNA, 20 bp, mouse
gcgcacgctcccacaccctc

SEQ ID NO: 820728 - DNA, 20 bp, mouse
gcccgtcggaggaccggaaa

SEQ ID NO: 820729 - DNA, 20 bp, mouse
gccccgtgctctttgatgat

SEQ ID NO: 820730 - DNA, 20 bp, mouse
gggagcgtgcgcgctcccgt

SEQ ID NO: 820731 - DNA, 20 bp, mouse
ggcgtgcgcgctcccgtcgg

SEQ ID NO: 820732 - DNA, 20 bp, mouse
ggggttgggctttgccacgg

SEQ ID NO: 820733 - DNA, 20 bp, mouse
gccctctgggtcccacccac

SEQ ID NO: 820734 - DNA, 20 bp, mouse
gcgcgctcccgtcggaggac

SEQ ID NO: 820735 - DNA, 20 bp, mouse
gccactgctcagttgttcca

SEQ ID NO: 820736 - DNA, 20 bp, mouse
ggactcagagggatcatccc

SEQ ID NO: 820737 - DNA, 20 bp, mouse
ggctgcctgcggtctgaggt

SEQ ID NO: 820738 - DNA, 20 bp, mouse
gcaggccaagggagtcagtg

SEQ ID NO: 820739 - DNA, 20 bp, mouse
gggcaatggtcatttaaagg

SEQ ID NO: 820740 - DNA, 20 bp, mouse
gggaaggagcgtatttgttc

SEQ ID NO: 820741 - DNA, 20 bp, mouse
gaggagctgcctgcggtctg

SEQ ID NO: 820742 - DNA, 20 bp, mouse
gtcctgagggaaggaggatt

SEQ ID NO: 820743 - DNA, 20 bp, mouse
ggctaatttggtcccgtcct

SEQ ID NO: 820744 - DNA, 20 bp, mouse
ggaagcctcactgactccct

SEQ ID NO: 820745 - DNA, 20 bp, mouse
gaggccctcaagggttaacc

SEQ ID NO: 820746 - DNA, 20 bp, mouse
gcctccggggcaaacgagtg

SEQ ID NO: 820747 - DNA, 20 bp, mouse
ggacccggcgacactggcgt

SEQ ID NO: 820748 - DNA, 20 bp, mouse
gttaccaacgccagtgtcgc

SEQ ID NO: 820749 - DNA, 20 bp, mouse
gactgcaggcgggccagcga

SEQ ID NO: 820750 - DNA, 20 bp, mouse
gaaggcgttgagtctcacca

SEQ ID NO: 820751 - DNA, 20 bp, mouse
gccagtgtcgccgggtcgga

SEQ ID NO: 820752 - DNA, 20 bp, mouse
gctaactggggcgagcccag

SEQ ID NO: 820753 - DNA, 20 bp, mouse
gcgcccaaaagcccaagtcg

SEQ ID NO: 820754 - DNA, 20 bp, mouse
gtcctctgcgcaaagtgcaa

SEQ ID NO: 820755 - DNA, 20 bp, mouse
gtgtgcatgctccgcgactt

SEQ ID NO: 820756 - DNA, 20 bp, mouse
ggggctgccctgaaggacca

SEQ ID NO: 820757 - DNA, 20 bp, mouse
ggaggcgacccggtcagcga

SEQ ID NO: 820758 - DNA, 20 bp, mouse
gcgacccggtcagcgagggg

SEQ ID NO: 820759 - DNA, 20 bp, mouse
ggagagctggagcggaataa

SEQ ID NO: 820760 - DNA, 20 bp, mouse
gccgcacagccagcgttcga

SEQ ID NO: 820761 - DNA, 20 bp, mouse
gagagcacgggaaccgccga

SEQ ID NO: 820762 - DNA, 20 bp, mouse
ggagccccggacaggacgag

SEQ ID NO: 820763 - DNA, 20 bp, mouse
gtggctgtgcggagcggttg

SEQ ID NO: 820764 - DNA, 20 bp, mouse
ggaacgctggctgtgcggag

SEQ ID NO: 820765 - DNA, 20 bp, mouse
ggtccaaggcgcgagcagag

SEQ ID NO: 820766 - DNA, 20 bp, mouse
gggagaatggtcttggaaaa

SEQ ID NO: 820767 - DNA, 20 bp, mouse
ggggatgagtgtaagagaca

SEQ ID NO: 820768 - DNA, 20 bp, mouse
gggaaggccgatgacatcat

SEQ ID NO: 820769 - DNA, 20 bp, mouse
gggagaaatgatgtataatg

SEQ ID NO: 820770 - DNA, 20 bp, mouse
gattgcagagagaacaaaca

SEQ ID NO: 820771 - DNA, 20 bp, mouse
ggagaatctaccacgtttca

SEQ ID NO: 820772 - DNA, 20 bp, mouse
gagagactaaggttgcaaat

SEQ ID NO: 820773 - DNA, 20 bp, mouse
gcggatgcctatgatgtcat

SEQ ID NO: 820774 - DNA, 20 bp, mouse
gttcacttatccctgaaacg

SEQ ID NO: 820775 - DNA, 20 bp, mouse
gaactggttgccagattgga

SEQ ID NO: 820776 - DNA, 20 bp, mouse
gcagaatggtggtagggttt

SEQ ID NO: 820777 - DNA, 20 bp, mouse
gcacacaaaggtagcatttt

SEQ ID NO: 820778 - DNA, 20 bp, mouse
gcacagatgccaccacagaa

SEQ ID NO: 820779 - DNA, 20 bp, mouse
gagatgccaccacagaatgg

SEQ ID NO: 820780 - DNA, 20 bp, mouse
gccctaccaccattctgtgg

SEQ ID NO: 820781 - DNA, 20 bp, mouse
ggccaccacagaatggtggt

SEQ ID NO: 820782 - DNA, 20 bp, mouse
gaccgcccggctctctgaat

SEQ ID NO: 820783 - DNA, 20 bp, mouse
gatggtggtagggtttaggc

SEQ ID NO: 820784 - DNA, 20 bp, mouse
gtgtttttacacctctgaac

SEQ ID NO: 820785 - DNA, 20 bp, mouse
gaacacccattcagagagcc

SEQ ID NO: 820786 - DNA, 20 bp, mouse
gcatgcgcggggagtagaag

SEQ ID NO: 820787 - DNA, 20 bp, mouse
gcccagggaggcgccgatca

SEQ ID NO: 820788 - DNA, 20 bp, mouse
gcacgcgctgtgctagtcgg

SEQ ID NO: 820789 - DNA, 20 bp, mouse
ggggcggcaccggtggataa

SEQ ID NO: 820790 - DNA, 20 bp, mouse
gcctgcgcagtagcagccca

SEQ ID NO: 820791 - DNA, 20 bp, mouse
ggagtagaagggggcggcac

SEQ ID NO: 820792 - DNA, 20 bp, mouse
gcggagggcgggagccgcaa

SEQ ID NO: 820793 - DNA, 20 bp, mouse
ggactagcacagcgcgtgcg

SEQ ID NO: 820794 - DNA, 20 bp, mouse
gaggccggactcaacggacc

SEQ ID NO: 820795 - DNA, 20 bp, mouse
ggcaccggtggataaggggc

SEQ ID NO: 820796 - DNA, 20 bp, mouse
gagggcgattgcggggatag

SEQ ID NO: 820797 - DNA, 20 bp, mouse
gcgattgcggggataggggt

SEQ ID NO: 820798 - DNA, 20 bp, mouse
gtgacaccaacctttgacag

SEQ ID NO: 820799 - DNA, 20 bp, mouse
gcagaggcacatctctccac

SEQ ID NO: 820800 - DNA, 20 bp, mouse
gctttgacagagggcgattg

SEQ ID NO: 820801 - DNA, 20 bp, mouse
gatcaaacaaaaatatgcag

SEQ ID NO: 820802 - DNA, 20 bp, mouse
gcacaggaacagtgtctgtt

SEQ ID NO: 820803 - DNA, 20 bp, mouse
gtggagcagagactcaagga

SEQ ID NO: 820804 - DNA, 20 bp, mouse
gtcaagaggcacttgcagac

SEQ ID NO: 820805 - DNA, 20 bp, mouse
ggaaatggagcagagactca

SEQ ID NO: 820806 - DNA, 20 bp, mouse
gaaaatggctatagccatac

SEQ ID NO: 820807 - DNA, 20 bp, mouse
gtggctatagccatactggt

SEQ ID NO: 820808 - DNA, 20 bp, mouse
gaggcttatacccaccagta

SEQ ID NO: 820809 - DNA, 20 bp, mouse
gaggcgatgtcaatcaatac

SEQ ID NO: 820810 - DNA, 20 bp, mouse
gcatgtattgatgatgttat

SEQ ID NO: 820811 - DNA, 20 bp, mouse
gaaaactcagttatatacat

SEQ ID NO: 820812 - DNA, 20 bp, mouse
ggtgtcccaggaaagtcccc

SEQ ID NO: 820813 - DNA, 20 bp, mouse
gaggaaaggttgtctgtttg

SEQ ID NO: 820814 - DNA, 20 bp, mouse
gcagcaacaatctgaaatag

SEQ ID NO: 820815 - DNA, 20 bp, mouse
gaacaatctgaaatagtggc

SEQ ID NO: 820816 - DNA, 20 bp, mouse
gggcccaggggaaggtaaca

SEQ ID NO: 820817 - DNA, 20 bp, mouse
ggggtcagtgattgttcagc

SEQ ID NO: 820818 - DNA, 20 bp, mouse
gattgttcagcaggtggtgt

SEQ ID NO: 820819 - DNA, 20 bp, mouse
gctgggcccaagctctgaaa

SEQ ID NO: 820820 - DNA, 20 bp, mouse
gcaagtagcgacggttgcta

SEQ ID NO: 820821 - DNA, 20 bp, mouse
gccaatggtgacttgtgtgg

SEQ ID NO: 820822 - DNA, 20 bp, mouse
gaccccaatggtgacttgtg

SEQ ID NO: 820823 - DNA, 20 bp, mouse
ggcaaccgtcgctacttgct

SEQ ID NO: 820824 - DNA, 20 bp, mouse
gtcagtgattgttcagcagg

SEQ ID NO: 820825 - DNA, 20 bp, mouse
gaacaatcactgacccattc

SEQ ID NO: 820826 - DNA, 20 bp, mouse
gcaggctggagctaggtcgc

SEQ ID NO: 820827 - DNA, 20 bp, mouse
gctaggtcgccggctcagag

SEQ ID NO: 820828 - DNA, 20 bp, mouse
gggtcttacaagccagtagg

SEQ ID NO: 820829 - DNA, 20 bp, mouse
gggtcgccggctcagagagg

SEQ ID NO: 820830 - DNA, 20 bp, mouse
gccagggcaaccagttgcta

SEQ ID NO: 820831 - DNA, 20 bp, mouse
gctgtgctagtgcaaaaaga

SEQ ID NO: 820832 - DNA, 20 bp, mouse
gaatgctgctcacactcttt

SEQ ID NO: 820833 - DNA, 20 bp, mouse
gtcaggtcttacaagccagt

SEQ ID NO: 820834 - DNA, 20 bp, mouse
ggataactacggctatgcag

SEQ ID NO: 820835 - DNA, 20 bp, mouse
gaaagagcttccttagcaac

SEQ ID NO: 820836 - DNA, 20 bp, mouse
gggcctcaggagccgaggtg

SEQ ID NO: 820837 - DNA, 20 bp, mouse
ggggcccgaaaggcagatgt

SEQ ID NO: 820838 - DNA, 20 bp, mouse
gcaggctggcggaggaaggg

SEQ ID NO: 820839 - DNA, 20 bp, mouse
ggcgtcgggtggtatttcgt

SEQ ID NO: 820840 - DNA, 20 bp, mouse
gcgaggtgggggtaagatga

SEQ ID NO: 820841 - DNA, 20 bp, mouse
gccgggggcgagttggggag

SEQ ID NO: 820842 - DNA, 20 bp, mouse
ggcgaggaggggacaggcgg

SEQ ID NO: 820843 - DNA, 20 bp, mouse
gagcaggcgagtgctgtccc

SEQ ID NO: 820844 - DNA, 20 bp, mouse
ggcggggccgggggcgagtt

SEQ ID NO: 820845 - DNA, 20 bp, mouse
ggggtgcagggtctcagcgt

SEQ ID NO: 820846 - DNA, 20 bp, mouse
ggcccctggagtggtggaat

SEQ ID NO: 820847 - DNA, 20 bp, mouse
ggagtggtggaataggaacg

SEQ ID NO: 820848 - DNA, 20 bp, mouse
ggaagtgagcctaggagcgg

SEQ ID NO: 820849 - DNA, 20 bp, mouse
gcagcaggcaggcgctggct

SEQ ID NO: 820850 - DNA, 20 bp, mouse
gggtggaataggaacggggg

SEQ ID NO: 820851 - DNA, 20 bp, mouse
gtcctattccaccactccag

SEQ ID NO: 820852 - DNA, 20 bp, mouse
ggtccccacacctgtagtct

SEQ ID NO: 820853 - DNA, 20 bp, mouse
ggtcctcagaggggtctaag

SEQ ID NO: 820854 - DNA, 20 bp, mouse
gtagtctaggcgctactgat

SEQ ID NO: 820855 - DNA, 20 bp, mouse
gtggggaccccggtcctcag

SEQ ID NO: 820856 - DNA, 20 bp, mouse
gccagccttagcccaggcct

SEQ ID NO: 820857 - DNA, 20 bp, mouse
gccttagcccaggcctcggc

SEQ ID NO: 820858 - DNA, 20 bp, mouse
gccccccccagccttagccc

SEQ ID NO: 820859 - DNA, 20 bp, mouse
ggagtgaccgggtcacaatg

SEQ ID NO: 820860 - DNA, 20 bp, mouse
gctggctcctgccgaggcct

SEQ ID NO: 820861 - DNA, 20 bp, mouse
ggcctgggctaaggctgggg

SEQ ID NO: 820862 - DNA, 20 bp, mouse
gaagggtctggctcctgccg

SEQ ID NO: 820863 - DNA, 20 bp, mouse
gtgctaagatgatactctca

SEQ ID NO: 820864 - DNA, 20 bp, mouse
gccccaacctcattgtgacc

SEQ ID NO: 820865 - DNA, 20 bp, mouse
gtctcaaggtgcaaggccca

SEQ ID NO: 820866 - DNA, 20 bp, mouse
gcaggcgcgcggagctcgga

SEQ ID NO: 820867 - DNA, 20 bp, mouse
gcgcgccggtgggaagcgtc

SEQ ID NO: 820868 - DNA, 20 bp, mouse
gaggccctccgcgtcggggc

SEQ ID NO: 820869 - DNA, 20 bp, mouse
gcgggcggccgcgactacga

SEQ ID NO: 820870 - DNA, 20 bp, mouse
gccgccggaggcgtcggggt

SEQ ID NO: 820871 - DNA, 20 bp, mouse
gcgcggagctcggaaggggg

SEQ ID NO: 820872 - DNA, 20 bp, mouse
ggctccgcgcgcctgcgcgc

SEQ ID NO: 820873 - DNA, 20 bp, mouse
gcgtccggcagccacagcgc

SEQ ID NO: 820874 - DNA, 20 bp, mouse
gtgggaggccctccgcgtcg

SEQ ID NO: 820875 - DNA, 20 bp, mouse
gggggcgagcgagacccggg

SEQ ID NO: 820876 - DNA, 20 bp, mouse
gtagcagccaaaccctcccc

SEQ ID NO: 820877 - DNA, 20 bp, mouse
gtacttcaactgcattactt

SEQ ID NO: 820878 - DNA, 20 bp, mouse
gcatgtagctagtgtcagag

SEQ ID NO: 820879 - DNA, 20 bp, mouse
gtgactctggctagccacgt

SEQ ID NO: 820880 - DNA, 20 bp, mouse
gttgaagtagatgacagctc

SEQ ID NO: 820881 - DNA, 20 bp, mouse
ggtcggggttcaaaccagcc

SEQ ID NO: 820882 - DNA, 20 bp, mouse
ggggctgaacccctaacttc

SEQ ID NO: 820883 - DNA, 20 bp, mouse
gctaaggtggcagcagagga

SEQ ID NO: 820884 - DNA, 20 bp, mouse
gaagaagcaagcagctcagt

SEQ ID NO: 820885 - DNA, 20 bp, mouse
gctgctcacgcctcactgcc

SEQ ID NO: 820886 - DNA, 20 bp, mouse
ggctagagaagctcgataag

SEQ ID NO: 820887 - DNA, 20 bp, mouse
gcctaccctaggacctgtag

SEQ ID NO: 820888 - DNA, 20 bp, mouse
gggcactctatggcactccc

SEQ ID NO: 820889 - DNA, 20 bp, mouse
ggactgctcagactaggaag

SEQ ID NO: 820890 - DNA, 20 bp, mouse
ggaagtggctcgatggcgat

SEQ ID NO: 820891 - DNA, 20 bp, mouse
gagactaggaagtggctcga

SEQ ID NO: 820892 - DNA, 20 bp, mouse
gtgggccgctacaggtccta

SEQ ID NO: 820893 - DNA, 20 bp, mouse
gctcgataagtggcactcta

SEQ ID NO: 820894 - DNA, 20 bp, mouse
gtgaaggatcaattgcaaga

SEQ ID NO: 820895 - DNA, 20 bp, mouse
gacttctgtgcaacggctga

SEQ ID NO: 820896 - DNA, 20 bp, mouse
ggggtggaggcggctctaaa

SEQ ID NO: 820897 - DNA, 20 bp, mouse
gtctaccggaaggaccgccc

SEQ ID NO: 820898 - DNA, 20 bp, mouse
gttggcctgggcggtccttc

SEQ ID NO: 820899 - DNA, 20 bp, mouse
gaggaccgcccaggccaaga

SEQ ID NO: 820900 - DNA, 20 bp, mouse
ggggcaggcgtggtttttgc

SEQ ID NO: 820901 - DNA, 20 bp, mouse
gcacctgccttagaaatctt

SEQ ID NO: 820902 - DNA, 20 bp, mouse
gcaagatggctgcccagcca

SEQ ID NO: 820903 - DNA, 20 bp, mouse
ggtgactctcacgagagagg

SEQ ID NO: 820904 - DNA, 20 bp, mouse
ggaggcgcccgaatgcgtca

SEQ ID NO: 820905 - DNA, 20 bp, mouse
gcgagaaatcggcccctcta

SEQ ID NO: 820906 - DNA, 20 bp, mouse
ggcactgcgggtcccttcgg

SEQ ID NO: 820907 - DNA, 20 bp, mouse
gacagcttccggccgccagg

SEQ ID NO: 820908 - DNA, 20 bp, mouse
ggggtcgggcactgaggatt

SEQ ID NO: 820909 - DNA, 20 bp, mouse
gggccccagggcagccggta

SEQ ID NO: 820910 - DNA, 20 bp, mouse
gctgccctggggccgccgaa

SEQ ID NO: 820911 - DNA, 20 bp, mouse
gagacctgggtcgggcactg

SEQ ID NO: 820912 - DNA, 20 bp, mouse
gcccgacccaggtctccccc

SEQ ID NO: 820913 - DNA, 20 bp, mouse
ggggcgtcccggggtggacc

SEQ ID NO: 820914 - DNA, 20 bp, mouse
ggggcggggccggacctaga

SEQ ID NO: 820915 - DNA, 20 bp, mouse
gcgcccacgcgtcaccacac

SEQ ID NO: 820916 - DNA, 20 bp, mouse
ggcgacggggctggcaaggg

SEQ ID NO: 820917 - DNA, 20 bp, mouse
gtctgacaggagcatggagg

SEQ ID NO: 820918 - DNA, 20 bp, mouse
gtggaggctggtggtggata

SEQ ID NO: 820919 - DNA, 20 bp, mouse
ggaagtcagaagcacatccc

SEQ ID NO: 820920 - DNA, 20 bp, mouse
gtgcggtgtcctagaggctg

SEQ ID NO: 820921 - DNA, 20 bp, mouse
gatggcgacggggctggcaa

SEQ ID NO: 820922 - DNA, 20 bp, mouse
gctcccgcttccgggttccg

SEQ ID NO: 820923 - DNA, 20 bp, mouse
ggggaccagatggcgaggaa

SEQ ID NO: 820924 - DNA, 20 bp, mouse
ggaggcgggaccagatggcg

SEQ ID NO: 820925 - DNA, 20 bp, mouse
gccagatggcgaggaagggg

SEQ ID NO: 820926 - DNA, 20 bp, mouse
gtaaccttgcggataccaga

SEQ ID NO: 820927 - DNA, 20 bp, mouse
gtacgtgaacccgcaggctg

SEQ ID NO: 820928 - DNA, 20 bp, mouse
ggaaccgtctggtatccgca

SEQ ID NO: 820929 - DNA, 20 bp, mouse
gtgtctctacgtgaacccgc

SEQ ID NO: 820930 - DNA, 20 bp, mouse
gctaacggtcaggtttttga

SEQ ID NO: 820931 - DNA, 20 bp, mouse
gcgcaccctgctgactctcg

SEQ ID NO: 820932 - DNA, 20 bp, mouse
ggaaacctcgagagtcagca

SEQ ID NO: 820933 - DNA, 20 bp, mouse
gtgcgcttgcgcggggttga

SEQ ID NO: 820934 - DNA, 20 bp, mouse
gcgtacaggaaggacggaag

SEQ ID NO: 820935 - DNA, 20 bp, mouse
gctgcgcggtccgaaccgtc

SEQ ID NO: 820936 - DNA, 20 bp, mouse
gtgccccggtgtatgcgctt

SEQ ID NO: 820937 - DNA, 20 bp, mouse
gatcgcccgaaggggtgggg

SEQ ID NO: 820938 - DNA, 20 bp, mouse
gcccccagggaacactatca

SEQ ID NO: 820939 - DNA, 20 bp, mouse
gaggaagtccgcaagaggtg

SEQ ID NO: 820940 - DNA, 20 bp, mouse
gcaccgaagcgcatacaccg

SEQ ID NO: 820941 - DNA, 20 bp, mouse
gtgaaaatgcacacgtgccc

SEQ ID NO: 820942 - DNA, 20 bp, mouse
gcaccccttcgggcgatctc

SEQ ID NO: 820943 - DNA, 20 bp, mouse
ggcggcgactgtgttcgggg

SEQ ID NO: 820944 - DNA, 20 bp, mouse
gagatgaggggcaggatccc

SEQ ID NO: 820945 - DNA, 20 bp, mouse
gcacgatcctcaccgactgg

SEQ ID NO: 820946 - DNA, 20 bp, mouse
gctacgagcgggacttgctg

SEQ ID NO: 820947 - DNA, 20 bp, mouse
gggaactgcgggacaggcta

SEQ ID NO: 820948 - DNA, 20 bp, mouse
ggcagcggatgggccactcg

SEQ ID NO: 820949 - DNA, 20 bp, mouse
gcggaaagacggaaccgcgc

SEQ ID NO: 820950 - DNA, 20 bp, mouse
gcccgctcgtagcgcgacgg

SEQ ID NO: 820951 - DNA, 20 bp, mouse
gtcggccaggtccggaaaga

SEQ ID NO: 820952 - DNA, 20 bp, mouse
gggaaccgcgccggagtggg

SEQ ID NO: 820953 - DNA, 20 bp, mouse
gcgtcacgagtgcgtctcgc

SEQ ID NO: 820954 - DNA, 20 bp, mouse
ggctgaggatggcagcggat

SEQ ID NO: 820955 - DNA, 20 bp, mouse
gagtcccgctcgtagcgcga

SEQ ID NO: 820956 - DNA, 20 bp, mouse
gccccggcgcgtagttatga

SEQ ID NO: 820957 - DNA, 20 bp, mouse
ggcggcggtcgacggaaatc

SEQ ID NO: 820958 - DNA, 20 bp, mouse
gggggctaggcggcggtcga

SEQ ID NO: 820959 - DNA, 20 bp, mouse
gactacgcgccggggctagg

SEQ ID NO: 820960 - DNA, 20 bp, mouse
ggcggtcgacggaaatcggg

SEQ ID NO: 820961 - DNA, 20 bp, mouse
gagtgtgccctcacttataa

SEQ ID NO: 820962 - DNA, 20 bp, mouse
ggggagctgcctagctcggc

SEQ ID NO: 820963 - DNA, 20 bp, mouse
gcggcgcgtagttatgaagg

SEQ ID NO: 820964 - DNA, 20 bp, mouse
gggcagcagatgaaaggacg

SEQ ID NO: 820965 - DNA, 20 bp, mouse
ggcagctcccattataagtg

SEQ ID NO: 820966 - DNA, 20 bp, mouse
gcgggactggactaagggga

SEQ ID NO: 820967 - DNA, 20 bp, mouse
gagtcccccgagacctggga

SEQ ID NO: 820968 - DNA, 20 bp, mouse
gagcagggagcaacagcgaa

SEQ ID NO: 820969 - DNA, 20 bp, mouse
gtgggagggaggcgggaatt

SEQ ID NO: 820970 - DNA, 20 bp, mouse
gaggcgggaattaggctgaa

SEQ ID NO: 820971 - DNA, 20 bp, mouse
gaggggcgggactggactaa

SEQ ID NO: 820972 - DNA, 20 bp, mouse
gcctccctcccaggtctcgg

SEQ ID NO: 820973 - DNA, 20 bp, mouse
gcaacagcgaaaggcacaga

SEQ ID NO: 820974 - DNA, 20 bp, mouse
gcgctgcagagatgtcctgg

SEQ ID NO: 820975 - DNA, 20 bp, mouse
gagtcagtcccccgagacct

SEQ ID NO: 820976 - DNA, 20 bp, mouse
gagcacgttgctaaccgcga

SEQ ID NO: 820977 - DNA, 20 bp, mouse
gcaaactgttagcagatgga

SEQ ID NO: 820978 - DNA, 20 bp, mouse
gggtaagcagacgagctgac

SEQ ID NO: 820979 - DNA, 20 bp, mouse
gcagagatgtgtagacggat

SEQ ID NO: 820980 - DNA, 20 bp, mouse
ggacggatgggtggtgtgat

SEQ ID NO: 820981 - DNA, 20 bp, mouse
ggacaaggataggaaaacag

SEQ ID NO: 820982 - DNA, 20 bp, mouse
gtgatgtacggacagacaag

SEQ ID NO: 820983 - DNA, 20 bp, mouse
gaatacaaactgttagcaga

SEQ ID NO: 820984 - DNA, 20 bp, mouse
ggctcgtctgcttaccctcg

SEQ ID NO: 820985 - DNA, 20 bp, mouse
gtgtatgtgtagacaaatga

SEQ ID NO: 820986 - DNA, 20 bp, mouse
ggcacaaccctctagtcaca

SEQ ID NO: 820987 - DNA, 20 bp, mouse
gccccaccattggggatgga

SEQ ID NO: 820988 - DNA, 20 bp, mouse
ggtcagccttccatccccaa

SEQ ID NO: 820989 - DNA, 20 bp, mouse
gggggatccccaaatccaga

SEQ ID NO: 820990 - DNA, 20 bp, mouse
ggtgaccaggacaggatggc

SEQ ID NO: 820991 - DNA, 20 bp, mouse
gcctgggggtaggtaggcgg

SEQ ID NO: 820992 - DNA, 20 bp, mouse
gaggggcaaaacagagtagt

SEQ ID NO: 820993 - DNA, 20 bp, mouse
gcaaaaatcccctctgggag

SEQ ID NO: 820994 - DNA, 20 bp, mouse
gtacccccaggggcgggcca

SEQ ID NO: 820995 - DNA, 20 bp, mouse
ggcagcccctagcacacctc

SEQ ID NO: 820996 - DNA, 20 bp, mouse
ggggggggggagaatgttgt

SEQ ID NO: 820997 - DNA, 20 bp, mouse
gggagaatgttgtggggact

SEQ ID NO: 820998 - DNA, 20 bp, mouse
gggagtgagtggagtgttgg

SEQ ID NO: 820999 - DNA, 20 bp, mouse
gagcagctcagaggagtgag

SEQ ID NO: 821000 - DNA, 20 bp, mouse
ggaggggtggctaaggtcag

SEQ ID NO: 821001 - DNA, 20 bp, mouse
gaaggtcagaggtttctgga

SEQ ID NO: 821002 - DNA, 20 bp, mouse
gtgtggggagcctgatctaa

SEQ ID NO: 821003 - DNA, 20 bp, mouse
ggactcaagagggagtttaa

SEQ ID NO: 821004 - DNA, 20 bp, mouse
gggctaaggtcagaggtttc

SEQ ID NO: 821005 - DNA, 20 bp, mouse
ggtgaccaagtaagacacca

SEQ ID NO: 821006 - DNA, 20 bp, mouse
gaagtgcggtatgtggaggt

SEQ ID NO: 821007 - DNA, 20 bp, mouse
gcggatgtacgcaaaggcgt

SEQ ID NO: 821008 - DNA, 20 bp, mouse
gctcctccgaggcgacccag

SEQ ID NO: 821009 - DNA, 20 bp, mouse
gggcgacccagaggcggtac

SEQ ID NO: 821010 - DNA, 20 bp, mouse
gctccgaggcgacccagagg

SEQ ID NO: 821011 - DNA, 20 bp, mouse
gtcgcctcggaggagctcgc

SEQ ID NO: 821012 - DNA, 20 bp, mouse
gcatccggcgagctcctccg

SEQ ID NO: 821013 - DNA, 20 bp, mouse
gcccagaggcggtactggcg

SEQ ID NO: 821014 - DNA, 20 bp, mouse
gcacccgggcgccgagaccc

SEQ ID NO: 821015 - DNA, 20 bp, mouse
gagcccgccacgggggaacg

SEQ ID NO: 821016 - DNA, 20 bp, mouse
ggcgcgggaaggggcgtctc

SEQ ID NO: 821017 - DNA, 20 bp, mouse
ggggcggggcgcgtgatggg

SEQ ID NO: 821018 - DNA, 20 bp, mouse
ggacctgtagatcagctctc

SEQ ID NO: 821019 - DNA, 20 bp, mouse
gcccgtggaacttgagacga

SEQ ID NO: 821020 - DNA, 20 bp, mouse
gcgggaaggggcgtctccgg

SEQ ID NO: 821021 - DNA, 20 bp, mouse
gaggctccctaaagagcgag

SEQ ID NO: 821022 - DNA, 20 bp, mouse
ggagacgacggctttcgcaa

SEQ ID NO: 821023 - DNA, 20 bp, mouse
gacggctttcgcaaggggcg

SEQ ID NO: 821024 - DNA, 20 bp, mouse
ggggaaggggcgtcgccaga

SEQ ID NO: 821025 - DNA, 20 bp, mouse
ggggcgtctccggaggaaag

SEQ ID NO: 821026 - DNA, 20 bp, mouse
ggtggggcgcgcacccggag

SEQ ID NO: 821027 - DNA, 20 bp, mouse
gggtgcgcgccccaccctcc

SEQ ID NO: 821028 - DNA, 20 bp, mouse
gagcggcgaggtacacgctg

SEQ ID NO: 821029 - DNA, 20 bp, mouse
ggccgccggacgcactgcgc

SEQ ID NO: 821030 - DNA, 20 bp, mouse
gtgcgcccgccgaactgcga

SEQ ID NO: 821031 - DNA, 20 bp, mouse
gcgcgcctgcgcagtgcgtc

SEQ ID NO: 821032 - DNA, 20 bp, mouse
gacagcagacgtaaggtccc

SEQ ID NO: 821033 - DNA, 20 bp, mouse
ggagcacgagcgaaccacgg

SEQ ID NO: 821034 - DNA, 20 bp, mouse
ggccccgggcgcattgtccg

SEQ ID NO: 821035 - DNA, 20 bp, mouse
ggcagggtcgggaagacgaa

SEQ ID NO: 821036 - DNA, 20 bp, mouse
gtagaaccacggtgtggagt

SEQ ID NO: 821037 - DNA, 20 bp, mouse
gcgcaagaagggttgtgtgg

SEQ ID NO: 821038 - DNA, 20 bp, mouse
gggaagggttggcgtgtgtg

SEQ ID NO: 821039 - DNA, 20 bp, mouse
ggggaacctgaactgaagga

SEQ ID NO: 821040 - DNA, 20 bp, mouse
gtaggagctgtgcgcaagaa

SEQ ID NO: 821041 - DNA, 20 bp, mouse
gaagctacgctaggaaaaga

SEQ ID NO: 821042 - DNA, 20 bp, mouse
gacaccgtggttctaagctg

SEQ ID NO: 821043 - DNA, 20 bp, mouse
gggtggggaacctgaactga

SEQ ID NO: 821044 - DNA, 20 bp, mouse
gaaagtgtagagttgcaggt

SEQ ID NO: 821045 - DNA, 20 bp, mouse
gactgctggaagctcttaag

SEQ ID NO: 821046 - DNA, 20 bp, mouse
gggttctggtgggaatgaac

SEQ ID NO: 821047 - DNA, 20 bp, mouse
gggggcagccacactgacac

SEQ ID NO: 821048 - DNA, 20 bp, mouse
gaaggcaggacggaagcggg

SEQ ID NO: 821049 - DNA, 20 bp, mouse
gactcccgtggccccccagc

SEQ ID NO: 821050 - DNA, 20 bp, mouse
gtgccccaggagcggaaggc

SEQ ID NO: 821051 - DNA, 20 bp, mouse
gtggggggccacgggagtaa

SEQ ID NO: 821052 - DNA, 20 bp, mouse
gggtgggaatgaaccggctg

SEQ ID NO: 821053 - DNA, 20 bp, mouse
ggtcctgccttccgctcctg

SEQ ID NO: 821054 - DNA, 20 bp, mouse
ggcggaaggcaggacggaag

SEQ ID NO: 821055 - DNA, 20 bp, mouse
gaacacccctcctcccctgc

SEQ ID NO: 821056 - DNA, 20 bp, mouse
gcggaagcgctgcggaggtg

SEQ ID NO: 821057 - DNA, 20 bp, mouse
ggacgcggtgaggcccgccc

SEQ ID NO: 821058 - DNA, 20 bp, mouse
gacgctagaggcggcggaag

SEQ ID NO: 821059 - DNA, 20 bp, mouse
gtccgaagaagtgtcatcga

SEQ ID NO: 821060 - DNA, 20 bp, mouse
gcggaagacgctagaggcgg

SEQ ID NO: 821061 - DNA, 20 bp, mouse
gggcggaagcggaagcgctg

SEQ ID NO: 821062 - DNA, 20 bp, mouse
gtccctcgatgacacttctt

SEQ ID NO: 821063 - DNA, 20 bp, mouse
gggaagcggaagcgctgcgg

SEQ ID NO: 821064 - DNA, 20 bp, mouse
ggcctcaccgcgtccatgtt

SEQ ID NO: 821065 - DNA, 20 bp, mouse
ggcctgggaggctgtcgcga

SEQ ID NO: 821066 - DNA, 20 bp, mouse
gggcctgaaatgagtttctt

SEQ ID NO: 821067 - DNA, 20 bp, mouse
ggggctactgagctaataac

SEQ ID NO: 821068 - DNA, 20 bp, mouse
gtggtgcacaggagaaattt

SEQ ID NO: 821069 - DNA, 20 bp, mouse
gtattagctcagtagcccta

SEQ ID NO: 821070 - DNA, 20 bp, mouse
gcaccaaagaaactcatttc

SEQ ID NO: 821071 - DNA, 20 bp, mouse
gtgtctgtaatagagcctta

SEQ ID NO: 821072 - DNA, 20 bp, mouse
gaattgcacaataagggtgg

SEQ ID NO: 821073 - DNA, 20 bp, mouse
ggcaagggattgtgaggtca

SEQ ID NO: 821074 - DNA, 20 bp, mouse
ggaaatcaattgcacaataa

SEQ ID NO: 821075 - DNA, 20 bp, mouse
ggttgatgcaagggattgtg

SEQ ID NO: 821076 - DNA, 20 bp, mouse
ggctgctgctagctcagtgc

SEQ ID NO: 821077 - DNA, 20 bp, mouse
gcagaggggcccctgccaac

SEQ ID NO: 821078 - DNA, 20 bp, mouse
gaactggctgggcttgctgc

SEQ ID NO: 821079 - DNA, 20 bp, mouse
gactgagctagcagcagcca

SEQ ID NO: 821080 - DNA, 20 bp, mouse
gatgcctatgatatgacaga

SEQ ID NO: 821081 - DNA, 20 bp, mouse
gacttaacaccattcgtgac

SEQ ID NO: 821082 - DNA, 20 bp, mouse
gacaaatgtcattctaacct

SEQ ID NO: 821083 - DNA, 20 bp, mouse
gggggcccctgccaactggc

SEQ ID NO: 821084 - DNA, 20 bp, mouse
gtatcacctcaaactcaaca

SEQ ID NO: 821085 - DNA, 20 bp, mouse
gtttccctctgtcatatcat

SEQ ID NO: 821086 - DNA, 20 bp, mouse
gaagaactggtcactggaaa

SEQ ID NO: 821087 - DNA, 20 bp, mouse
gacagtagctgcgtaggaga

SEQ ID NO: 821088 - DNA, 20 bp, mouse
gaagtgttggggcttctcga

SEQ ID NO: 821089 - DNA, 20 bp, mouse
gtgcgtaggagaaggcactg

SEQ ID NO: 821090 - DNA, 20 bp, mouse
ggtatgctcacatgctactc

SEQ ID NO: 821091 - DNA, 20 bp, mouse
ggaggggacagtagctgcgt

SEQ ID NO: 821092 - DNA, 20 bp, mouse
ggggaagccttcactcttag

SEQ ID NO: 821093 - DNA, 20 bp, mouse
gcactgaggcattgtgtgct

SEQ ID NO: 821094 - DNA, 20 bp, mouse
gtgctcctaccaactgcagc

SEQ ID NO: 821095 - DNA, 20 bp, mouse
ggacctcagcaggggatttt

SEQ ID NO: 821096 - DNA, 20 bp, mouse
gaatactgagaaaatagatg

SEQ ID NO: 821097 - DNA, 20 bp, mouse
gtactggagcaatagggaga

SEQ ID NO: 821098 - DNA, 20 bp, mouse
ggcttcaagagtaaatatct

SEQ ID NO: 821099 - DNA, 20 bp, mouse
gtttactcttgaagcgtggt

SEQ ID NO: 821100 - DNA, 20 bp, mouse
gaaaaaggcagtgatactac

SEQ ID NO: 821101 - DNA, 20 bp, mouse
gtcttgaagcgtggtgggat

SEQ ID NO: 821102 - DNA, 20 bp, mouse
gggtgggataggttttaaag

SEQ ID NO: 821103 - DNA, 20 bp, mouse
gtatatgtgaatagaattta

SEQ ID NO: 821104 - DNA, 20 bp, mouse
gttaaagtggagtttgcagt

SEQ ID NO: 821105 - DNA, 20 bp, mouse
gtatactaaaatagtacaat

SEQ ID NO: 821106 - DNA, 20 bp, mouse
ggaacggaagttgcaggaga

SEQ ID NO: 821107 - DNA, 20 bp, mouse
gctagaggctagtccgaaga

SEQ ID NO: 821108 - DNA, 20 bp, mouse
ggaagaggaacggaagttgc

SEQ ID NO: 821109 - DNA, 20 bp, mouse
ggcaccgcgcgggagtgcga

SEQ ID NO: 821110 - DNA, 20 bp, mouse
gcaggcgtggtactgtgtga

SEQ ID NO: 821111 - DNA, 20 bp, mouse
ggagggttggccagggaaaa

SEQ ID NO: 821112 - DNA, 20 bp, mouse
gaaaaggcgtgaggggtgtc

SEQ ID NO: 821113 - DNA, 20 bp, mouse
gtgtgtgagggttgtgtgaa

SEQ ID NO: 821114 - DNA, 20 bp, mouse
gtagtccgaagaagggagcg

SEQ ID NO: 821115 - DNA, 20 bp, mouse
gccgcgcgggagtgcgaagg

SEQ ID NO: 821116 - DNA, 20 bp, mouse
ggctggggaaaatgtaacct

SEQ ID NO: 821117 - DNA, 20 bp, mouse
ggggaaaatgtaacctaggt

SEQ ID NO: 821118 - DNA, 20 bp, mouse
gtcagtagttctgaatggat

SEQ ID NO: 821119 - DNA, 20 bp, mouse
gagaaaacctcaccccagga

SEQ ID NO: 821120 - DNA, 20 bp, mouse
gagaactactgaagagacaa

SEQ ID NO: 821121 - DNA, 20 bp, mouse
gtttcctaaaagaggatgtc

SEQ ID NO: 821122 - DNA, 20 bp, mouse
gacccactgtgccctataat

SEQ ID NO: 821123 - DNA, 20 bp, mouse
gtataggcagatggtaatac

SEQ ID NO: 821124 - DNA, 20 bp, mouse
gaccaaagatacctattata

SEQ ID NO: 821125 - DNA, 20 bp, mouse
gaagaattggagcagaagaa

SEQ ID NO: 821126 - DNA, 20 bp, mouse
ggggccctagggcagagctg

SEQ ID NO: 821127 - DNA, 20 bp, mouse
gtgtccagagcaagcaaaaa

SEQ ID NO: 821128 - DNA, 20 bp, mouse
gacaacaggggatgaaagta

SEQ ID NO: 821129 - DNA, 20 bp, mouse
gcagccccagctctgcccta

SEQ ID NO: 821130 - DNA, 20 bp, mouse
gtcaggatgaagagattaac

SEQ ID NO: 821131 - DNA, 20 bp, mouse
gcaggcccttcccaggtgtc

SEQ ID NO: 821132 - DNA, 20 bp, mouse
gcccaggggagccctaggat

SEQ ID NO: 821133 - DNA, 20 bp, mouse
gagagcaagcaaaaagggtt

SEQ ID NO: 821134 - DNA, 20 bp, mouse
gaagcaaaaagggtttggac

SEQ ID NO: 821135 - DNA, 20 bp, mouse
gtgtctattaaagcaagaag

SEQ ID NO: 821136 - DNA, 20 bp, mouse
gatcacaagggaactcacat

SEQ ID NO: 821137 - DNA, 20 bp, mouse
gtccccctctcacttatgaa

SEQ ID NO: 821138 - DNA, 20 bp, mouse
gactaaactggtgttctcta

SEQ ID NO: 821139 - DNA, 20 bp, mouse
gcacacagaaccagttgttc

SEQ ID NO: 821140 - DNA, 20 bp, mouse
gttggcaggatctcacaaga

SEQ ID NO: 821141 - DNA, 20 bp, mouse
gtgagttcccttgtgatacc

SEQ ID NO: 821142 - DNA, 20 bp, mouse
gagggaagtcaattagagag

SEQ ID NO: 821143 - DNA, 20 bp, mouse
gcacaagatggaaactaaac

SEQ ID NO: 821144 - DNA, 20 bp, mouse
gttctctagacttatgagga

SEQ ID NO: 821145 - DNA, 20 bp, mouse
gtaacatgagcctgaacaac

SEQ ID NO: 821146 - DNA, 20 bp, mouse
ggcaccttagatcttattaa

SEQ ID NO: 821147 - DNA, 20 bp, mouse
gagacagcatgaagggagtt

SEQ ID NO: 821148 - DNA, 20 bp, mouse
gaaaggcaggggggatgtat

SEQ ID NO: 821149 - DNA, 20 bp, mouse
gtaaggctccactacattaa

SEQ ID NO: 821150 - DNA, 20 bp, mouse
gaatgtagtggagccttaga

SEQ ID NO: 821151 - DNA, 20 bp, mouse
gagtctcatcaatcttaaga

SEQ ID NO: 821152 - DNA, 20 bp, mouse
gacgaggcatttctttaagc

SEQ ID NO: 821153 - DNA, 20 bp, mouse
ggggggatgtattggttgtt

SEQ ID NO: 821154 - DNA, 20 bp, mouse
gagccttagagggaaaaggc

SEQ ID NO: 821155 - DNA, 20 bp, mouse
gcccctgccttttccctcta

SEQ ID NO: 821156 - DNA, 20 bp, mouse
gctgacaggtgggtgatctg

SEQ ID NO: 821157 - DNA, 20 bp, mouse
gtgagtagggacccagaatt

SEQ ID NO: 821158 - DNA, 20 bp, mouse
gcacccacctgtcagtgagt

SEQ ID NO: 821159 - DNA, 20 bp, mouse
gtgggtccctactcactgac

SEQ ID NO: 821160 - DNA, 20 bp, mouse
gagtcagcataggacccgag

SEQ ID NO: 821161 - DNA, 20 bp, mouse
ggtccctactcactgacagg

SEQ ID NO: 821162 - DNA, 20 bp, mouse
gaggtgtggcagcaccattc

SEQ ID NO: 821163 - DNA, 20 bp, mouse
gacacctgtcagccaaattc

SEQ ID NO: 821164 - DNA, 20 bp, mouse
ggacccagaatttggctgac

SEQ ID NO: 821165 - DNA, 20 bp, mouse
gaggaaaggtggagaaaccg

SEQ ID NO: 821166 - DNA, 20 bp, mouse
gctcccccagagaacggaga

SEQ ID NO: 821167 - DNA, 20 bp, mouse
gccagagaacggagagggta

SEQ ID NO: 821168 - DNA, 20 bp, mouse
gtgtgactcgtgtctgttgc

SEQ ID NO: 821169 - DNA, 20 bp, mouse
gtggatgggattgccatcat

SEQ ID NO: 821170 - DNA, 20 bp, mouse
gcagtgttaaagacgtcaga

SEQ ID NO: 821171 - DNA, 20 bp, mouse
gctgtggtttgctcttacgt

SEQ ID NO: 821172 - DNA, 20 bp, mouse
gactacttttctctacactg

SEQ ID NO: 821173 - DNA, 20 bp, mouse
gtgcagatggttatcacaga

SEQ ID NO: 821174 - DNA, 20 bp, mouse
gtctcagggccgactaagtc

SEQ ID NO: 821175 - DNA, 20 bp, mouse
ggcagcgtctctatctctgc

SEQ ID NO: 821176 - DNA, 20 bp, mouse
gtaactctgtgtgactctat

SEQ ID NO: 821177 - DNA, 20 bp, mouse
gacctccagtcacatttata

SEQ ID NO: 821178 - DNA, 20 bp, mouse
ggaggtaatgcaaatagcca

SEQ ID NO: 821179 - DNA, 20 bp, mouse
ggttgatatgtctcatgcat

SEQ ID NO: 821180 - DNA, 20 bp, mouse
gcctagaaaatggattcaga

SEQ ID NO: 821181 - DNA, 20 bp, mouse
gcagaacatatccaggcact

SEQ ID NO: 821182 - DNA, 20 bp, mouse
gaaacttatctgaatttatc

SEQ ID NO: 821183 - DNA, 20 bp, mouse
gtagttgtcatccaagtgcc

SEQ ID NO: 821184 - DNA, 20 bp, mouse
gctgcaatgccagacacact

SEQ ID NO: 821185 - DNA, 20 bp, mouse
gtccttataaatgtgactgg

SEQ ID NO: 821186 - DNA, 20 bp, mouse
ggctgcggctgggtctgggg

SEQ ID NO: 821187 - DNA, 20 bp, mouse
gtccgaacgcccagcggcgt

SEQ ID NO: 821188 - DNA, 20 bp, mouse
ggggtgtcgcggcccaatgt

SEQ ID NO: 821189 - DNA, 20 bp, mouse
gccaccttgcaggggtgtcg

SEQ ID NO: 821190 - DNA, 20 bp, mouse
ggggcctcacccacgccgct

SEQ ID NO: 821191 - DNA, 20 bp, mouse
gtctgctgggcaggaccggt

SEQ ID NO: 821192 - DNA, 20 bp, mouse
gtccggctggacccgccggg

SEQ ID NO: 821193 - DNA, 20 bp, mouse
gggaccggtgggagtacaac

SEQ ID NO: 821194 - DNA, 20 bp, mouse
ggcacctgcgccaccttgca

SEQ ID NO: 821195 - DNA, 20 bp, mouse
gaacttccggctggacccgc

SEQ ID NO: 821196 - DNA, 20 bp, mouse
gctcccgcaaggtccggctg

SEQ ID NO: 821197 - DNA, 20 bp, mouse
gcggaccttgcgggaggcgt

SEQ ID NO: 821198 - DNA, 20 bp, mouse
gaccgcccccggctcctggg

SEQ ID NO: 821199 - DNA, 20 bp, mouse
gtcctgggaggaggcgtggt

SEQ ID NO: 821200 - DNA, 20 bp, mouse
gcgaaggcgcaaggacgtcg

SEQ ID NO: 821201 - DNA, 20 bp, mouse
ggcaaggtccggctggggcg

SEQ ID NO: 821202 - DNA, 20 bp, mouse
ggcgggaggcgtgggtctgt

SEQ ID NO: 821203 - DNA, 20 bp, mouse
ggccaaccacgcctcctccc

SEQ ID NO: 821204 - DNA, 20 bp, mouse
gacgcctcctcccaggagcc

SEQ ID NO: 821205 - DNA, 20 bp, mouse
gctgcacctggcaccgcccc

SEQ ID NO: 821206 - DNA, 20 bp, mouse
gggtgtgccccagcagtgag

SEQ ID NO: 821207 - DNA, 20 bp, mouse
gtgtccaggaggaaagagac

SEQ ID NO: 821208 - DNA, 20 bp, mouse
gacaacaagagactaagagg

SEQ ID NO: 821209 - DNA, 20 bp, mouse
gacctgccatgaggtctaac

SEQ ID NO: 821210 - DNA, 20 bp, mouse
gtctgtaatgaaacggtggt

SEQ ID NO: 821211 - DNA, 20 bp, mouse
gccaacaacaagagactaag

SEQ ID NO: 821212 - DNA, 20 bp, mouse
gtctcttgttgttggaaacc

SEQ ID NO: 821213 - DNA, 20 bp, mouse
gggcttctgtaatgaaacgg

SEQ ID NO: 821214 - DNA, 20 bp, mouse
gacccagttcatgttagtcg

SEQ ID NO: 821215 - DNA, 20 bp, mouse
gggttagtgagcaaggtttg

SEQ ID NO: 821216 - DNA, 20 bp, mouse
gtgcacatgtgtaaccatgg

SEQ ID NO: 821217 - DNA, 20 bp, mouse
gtggaaacaaagcaagctta

SEQ ID NO: 821218 - DNA, 20 bp, mouse
gtgctcttatacttcgggtt

SEQ ID NO: 821219 - DNA, 20 bp, mouse
gtacccagctgtgaagctaa

SEQ ID NO: 821220 - DNA, 20 bp, mouse
ggccagggttcagcattact

SEQ ID NO: 821221 - DNA, 20 bp, mouse
gagggagggcttaatgccga

SEQ ID NO: 821222 - DNA, 20 bp, mouse
gctgggtactcatgcactca

SEQ ID NO: 821223 - DNA, 20 bp, mouse
gaaagcaagcttagggacca

SEQ ID NO: 821224 - DNA, 20 bp, mouse
gccaatggtccaaccctcca

SEQ ID NO: 821225 - DNA, 20 bp, mouse
gtcaggagttgaatcagtct

SEQ ID NO: 821226 - DNA, 20 bp, mouse
gggtggggggttcctcctca

SEQ ID NO: 821227 - DNA, 20 bp, mouse
ggtttgacagagccctgagg

SEQ ID NO: 821228 - DNA, 20 bp, mouse
ggggtgtggcatgaagacag

SEQ ID NO: 821229 - DNA, 20 bp, mouse
gaacgagtacagaaagcaat

SEQ ID NO: 821230 - DNA, 20 bp, mouse
gtggaccataaaacctgaga

SEQ ID NO: 821231 - DNA, 20 bp, mouse
gatgaagacagaggggttaa

SEQ ID NO: 821232 - DNA, 20 bp, mouse
gctttctctctcttcaacta

SEQ ID NO: 821233 - DNA, 20 bp, mouse
gttgaagaaagaagtaccgt

SEQ ID NO: 821234 - DNA, 20 bp, mouse
gaagtatgaaaattctatga

SEQ ID NO: 821235 - DNA, 20 bp, mouse
ggtctttcaaactccatggc

SEQ ID NO: 821236 - DNA, 20 bp, mouse
gcccagggattcaataacct

SEQ ID NO: 821237 - DNA, 20 bp, mouse
gttaaaaacagggtggtaaa

SEQ ID NO: 821238 - DNA, 20 bp, mouse
gacctaggagcattaaaaac

SEQ ID NO: 821239 - DNA, 20 bp, mouse
gaatctaagaaagtatgaga

SEQ ID NO: 821240 - DNA, 20 bp, mouse
gaggagcattaaaaacaggg

SEQ ID NO: 821241 - DNA, 20 bp, mouse
gttcagtttcagatacttcg

SEQ ID NO: 821242 - DNA, 20 bp, mouse
ggaaaggtttttcctgagag

SEQ ID NO: 821243 - DNA, 20 bp, mouse
gacaatatagcaagtcagct

SEQ ID NO: 821244 - DNA, 20 bp, mouse
gttataaataataattccca

SEQ ID NO: 821245 - DNA, 20 bp, mouse
gtgcaatgaacaatctatac

SEQ ID NO: 821246 - DNA, 20 bp, mouse
gagggaagggaagaccggta

SEQ ID NO: 821247 - DNA, 20 bp, mouse
gctaggaggggcagccggag

SEQ ID NO: 821248 - DNA, 20 bp, mouse
gaggaggctaatggtcaaag

SEQ ID NO: 821249 - DNA, 20 bp, mouse
gaggctaatggtcaaagagg

SEQ ID NO: 821250 - DNA, 20 bp, mouse
gcgcgggcagatgcaggtga

SEQ ID NO: 821251 - DNA, 20 bp, mouse
gagggaagaccggtagggag

SEQ ID NO: 821252 - DNA, 20 bp, mouse
ggacccgccccctcgctcgg

SEQ ID NO: 821253 - DNA, 20 bp, mouse
gtgagggcgggggctgatgg

SEQ ID NO: 821254 - DNA, 20 bp, mouse
ggcaggacaagagaggacta

SEQ ID NO: 821255 - DNA, 20 bp, mouse
gaggaaaagctgactgaaga

SEQ ID NO: 821256 - DNA, 20 bp, mouse
ggttgcttgtggggacccaa

SEQ ID NO: 821257 - DNA, 20 bp, mouse
gggtccagacgggaattctt

SEQ ID NO: 821258 - DNA, 20 bp, mouse
gtggggacccaagggttcag

SEQ ID NO: 821259 - DNA, 20 bp, mouse
gggttcagtggaggcatgaa

SEQ ID NO: 821260 - DNA, 20 bp, mouse
gtggagtggaagatatggag

SEQ ID NO: 821261 - DNA, 20 bp, mouse
gggacccaagggttcagtgg

SEQ ID NO: 821262 - DNA, 20 bp, mouse
gaggcatgaaaggatgctcg

SEQ ID NO: 821263 - DNA, 20 bp, mouse
gagatgagtgatggggagta

SEQ ID NO: 821264 - DNA, 20 bp, mouse
gtactcccatagttgcttgt

SEQ ID NO: 821265 - DNA, 20 bp, mouse
gaggatgctcggggtccaga

SEQ ID NO: 821266 - DNA, 20 bp, mouse
ggaagcctccagggtttcta

SEQ ID NO: 821267 - DNA, 20 bp, mouse
gaaaccctggaggcttccgt

SEQ ID NO: 821268 - DNA, 20 bp, mouse
ggccccctggaggctactgg

SEQ ID NO: 821269 - DNA, 20 bp, mouse
gtccaccagtagcctccagg

SEQ ID NO: 821270 - DNA, 20 bp, mouse
gggaggctactggtggaagt

SEQ ID NO: 821271 - DNA, 20 bp, mouse
gctactacgcccgactctat

SEQ ID NO: 821272 - DNA, 20 bp, mouse
gagcttgcgaggccccctgg

SEQ ID NO: 821273 - DNA, 20 bp, mouse
gggaagtaggaacgagcgtc

SEQ ID NO: 821274 - DNA, 20 bp, mouse
ggagcgtcgggttaccatag

SEQ ID NO: 821275 - DNA, 20 bp, mouse
gccgcctacggaagcctcca

SEQ ID NO: 821276 - DNA, 20 bp, mouse
gccccccggggcagcacgtg

SEQ ID NO: 821277 - DNA, 20 bp, mouse
ggggtcctctcccatcgcag

SEQ ID NO: 821278 - DNA, 20 bp, mouse
ggcagggtggaagttgagta

SEQ ID NO: 821279 - DNA, 20 bp, mouse
gcccgcacgtgctgccccgg

SEQ ID NO: 821280 - DNA, 20 bp, mouse
ggggagctgcagcaccgatt

SEQ ID NO: 821281 - DNA, 20 bp, mouse
gcgcccccgtcaggcgggtg

SEQ ID NO: 821282 - DNA, 20 bp, mouse
gtgcggccacggaaccctcg

SEQ ID NO: 821283 - DNA, 20 bp, mouse
gagccccacccgcctgacgg

SEQ ID NO: 821284 - DNA, 20 bp, mouse
gatcgcttcctgatccccga

SEQ ID NO: 821285 - DNA, 20 bp, mouse
gaagtcacgcagtagcgctg

SEQ ID NO: 821286 - DNA, 20 bp, mouse
ggggcctgatccctcactca

SEQ ID NO: 821287 - DNA, 20 bp, mouse
gtatctgaggactttgtaaa

SEQ ID NO: 821288 - DNA, 20 bp, mouse
gcaaccctgagtgagggatc

SEQ ID NO: 821289 - DNA, 20 bp, mouse
gcctctgtggtaactcagtg

SEQ ID NO: 821290 - DNA, 20 bp, mouse
ggtggctcaaccctgagtga

SEQ ID NO: 821291 - DNA, 20 bp, mouse
gaggctggagaaggtcatag

SEQ ID NO: 821292 - DNA, 20 bp, mouse
gagcacttggctaagagcta

SEQ ID NO: 821293 - DNA, 20 bp, mouse
gatggaaaagactagtggct

SEQ ID NO: 821294 - DNA, 20 bp, mouse
gactcagtgaggttgacctt

SEQ ID NO: 821295 - DNA, 20 bp, mouse
gccacagtggaaagcaaagg

SEQ ID NO: 821296 - DNA, 20 bp, mouse
gacagcgcagccacactggt

SEQ ID NO: 821297 - DNA, 20 bp, mouse
gccaccaagtcacttcctgt

SEQ ID NO: 821298 - DNA, 20 bp, mouse
gttaaaggggcagcctgttg

SEQ ID NO: 821299 - DNA, 20 bp, mouse
ggagcacagcgcagccacac

SEQ ID NO: 821300 - DNA, 20 bp, mouse
gcagccataggctagattga

SEQ ID NO: 821301 - DNA, 20 bp, mouse
ggcagcctgttgaggttgag

SEQ ID NO: 821302 - DNA, 20 bp, mouse
gttaccccagcagggctaag

SEQ ID NO: 821303 - DNA, 20 bp, mouse
gaggcctcttagccctgctg

SEQ ID NO: 821304 - DNA, 20 bp, mouse
gaaccaggttagatacagga

SEQ ID NO: 821305 - DNA, 20 bp, mouse
gtgatgaaatcccaccagtg

SEQ ID NO: 821306 - DNA, 20 bp, mouse
gtggtcctgtctcccatcgt

SEQ ID NO: 821307 - DNA, 20 bp, mouse
gcagccccacgatgggagac

SEQ ID NO: 821308 - DNA, 20 bp, mouse
gctgtgctgtgtgagcattg

SEQ ID NO: 821309 - DNA, 20 bp, mouse
gtctgttccgagaggagtag

SEQ ID NO: 821310 - DNA, 20 bp, mouse
gctggcgaagagaagctgtc

SEQ ID NO: 821311 - DNA, 20 bp, mouse
gtacagcacctgcacttcaa

SEQ ID NO: 821312 - DNA, 20 bp, mouse
gtgcctcgttctgttccgag

SEQ ID NO: 821313 - DNA, 20 bp, mouse
gaagcctcagccagcactgc

SEQ ID NO: 821314 - DNA, 20 bp, mouse
ggggatgaaaaggtctcagc

SEQ ID NO: 821315 - DNA, 20 bp, mouse
gctcctctcggaacagaacg

SEQ ID NO: 821316 - DNA, 20 bp, mouse
gacccaggtgacgagagcca

SEQ ID NO: 821317 - DNA, 20 bp, mouse
gtccctgctcgcctggggta

SEQ ID NO: 821318 - DNA, 20 bp, mouse
gcaaaagaatggggctccta

SEQ ID NO: 821319 - DNA, 20 bp, mouse
gggggctcctagggccatga

SEQ ID NO: 821320 - DNA, 20 bp, mouse
gccaggggacaacaaggaaa

SEQ ID NO: 821321 - DNA, 20 bp, mouse
gagggtgagactccaccccc

SEQ ID NO: 821322 - DNA, 20 bp, mouse
gcccctggctctcgtcacct

SEQ ID NO: 821323 - DNA, 20 bp, mouse
ggcggaacctcatcagcaga

SEQ ID NO: 821324 - DNA, 20 bp, mouse
gccgagagagatgagtatag

SEQ ID NO: 821325 - DNA, 20 bp, mouse
gtcaccctgctccacacttc

SEQ ID NO: 821326 - DNA, 20 bp, mouse
gaggcctcggctaggagctc

SEQ ID NO: 821327 - DNA, 20 bp, mouse
ggggtgtatggcttgaacca

SEQ ID NO: 821328 - DNA, 20 bp, mouse
gattcattcgcagctctaca

SEQ ID NO: 821329 - DNA, 20 bp, mouse
gcaccgtagagattctgaga

SEQ ID NO: 821330 - DNA, 20 bp, mouse
gtctcaacgagtaagtgctt

SEQ ID NO: 821331 - DNA, 20 bp, mouse
ggacacagatttcaagctca

SEQ ID NO: 821332 - DNA, 20 bp, mouse
gaagcctgagctcctagccg

SEQ ID NO: 821333 - DNA, 20 bp, mouse
gtgcgaatgaatcacgctcc

SEQ ID NO: 821334 - DNA, 20 bp, mouse
gtccacaggactcttagggg

SEQ ID NO: 821335 - DNA, 20 bp, mouse
ggccacccctaagagtcctg

SEQ ID NO: 821336 - DNA, 20 bp, mouse
ggtccctgctgtctatctaa

SEQ ID NO: 821337 - DNA, 20 bp, mouse
gggctccggggtctttcata

SEQ ID NO: 821338 - DNA, 20 bp, mouse
gccctgcgctgcggcttggc

SEQ ID NO: 821339 - DNA, 20 bp, mouse
gcgctgcggcttggctggct

SEQ ID NO: 821340 - DNA, 20 bp, mouse
gggacagcaaagaagggctc

SEQ ID NO: 821341 - DNA, 20 bp, mouse
gcttgcgcagccctgcgctg

SEQ ID NO: 821342 - DNA, 20 bp, mouse
gtagacagcagggacatctc

SEQ ID NO: 821343 - DNA, 20 bp, mouse
ggcagccctgcgctgcggct

SEQ ID NO: 821344 - DNA, 20 bp, mouse
gagggggagcaatagttcag

SEQ ID NO: 821345 - DNA, 20 bp, mouse
gtctcaaggagttgcaagcc

SEQ ID NO: 821346 - DNA, 20 bp, mouse
gaagcgaggggagctggcga

SEQ ID NO: 821347 - DNA, 20 bp, mouse
ggcgagggataggcgcgggg

SEQ ID NO: 821348 - DNA, 20 bp, mouse
gctgggattcagggagagga

SEQ ID NO: 821349 - DNA, 20 bp, mouse
gtcccagctgcagcaagttc

SEQ ID NO: 821350 - DNA, 20 bp, mouse
ggcatcctctggctccagcc

SEQ ID NO: 821351 - DNA, 20 bp, mouse
gagctggcgagggataggcg

SEQ ID NO: 821352 - DNA, 20 bp, mouse
ggggagatgccttgcttcac

SEQ ID NO: 821353 - DNA, 20 bp, mouse
ggagtggacggctgagacgg

SEQ ID NO: 821354 - DNA, 20 bp, mouse
gtccagccaggcttcgcatc

SEQ ID NO: 821355 - DNA, 20 bp, mouse
gcttccccaaggccttatgg

SEQ ID NO: 821356 - DNA, 20 bp, mouse
ggggatacgcagacacgtgc

SEQ ID NO: 821357 - DNA, 20 bp, mouse
ggaggaagcagcctcgttgg

SEQ ID NO: 821358 - DNA, 20 bp, mouse
gttgtgaagctggattccca

SEQ ID NO: 821359 - DNA, 20 bp, mouse
gaccgaggaagcagcctcgt

SEQ ID NO: 821360 - DNA, 20 bp, mouse
gaagcagcctcgttggtggc

SEQ ID NO: 821361 - DNA, 20 bp, mouse
ggaccacagtgctctgagga

SEQ ID NO: 821362 - DNA, 20 bp, mouse
gtggattcccagggtctggt

SEQ ID NO: 821363 - DNA, 20 bp, mouse
gctgctgcaaggtttccccg

SEQ ID NO: 821364 - DNA, 20 bp, mouse
gaagctggattcccagggtc

SEQ ID NO: 821365 - DNA, 20 bp, mouse
gtggtccacaggacccaagc

SEQ ID NO: 821366 - DNA, 20 bp, mouse
gttcagacagggcaccaatg

SEQ ID NO: 821367 - DNA, 20 bp, mouse
gtgttcagagataggagtct

SEQ ID NO: 821368 - DNA, 20 bp, mouse
gctgtggcaaagttcagaca

SEQ ID NO: 821369 - DNA, 20 bp, mouse
gagggcagcagttagcccga

SEQ ID NO: 821370 - DNA, 20 bp, mouse
gcagtccaaaggaacaccag

SEQ ID NO: 821371 - DNA, 20 bp, mouse
ggtctctgggtggtgctgca

SEQ ID NO: 821372 - DNA, 20 bp, mouse
gtgagaaagaggtgtctggc

SEQ ID NO: 821373 - DNA, 20 bp, mouse
gcaaagaaaggggtgcggca

SEQ ID NO: 821374 - DNA, 20 bp, mouse
gctgaactttgccacagatg

SEQ ID NO: 821375 - DNA, 20 bp, mouse
gggcccacttggccagccga

SEQ ID NO: 821376 - DNA, 20 bp, mouse
ggacgcttgcgcactaggga

SEQ ID NO: 821377 - DNA, 20 bp, mouse
ggcgcactagggaaggtagg

SEQ ID NO: 821378 - DNA, 20 bp, mouse
ggtaggcggagtcttaaaag

SEQ ID NO: 821379 - DNA, 20 bp, mouse
gcgcccaggccggtgtgtgt

SEQ ID NO: 821380 - DNA, 20 bp, mouse
gctgaggtgcgaggccagaa

SEQ ID NO: 821381 - DNA, 20 bp, mouse
gcttgcgcactagggaaggt

SEQ ID NO: 821382 - DNA, 20 bp, mouse
ggagctggagagtcttgagc

SEQ ID NO: 821383 - DNA, 20 bp, mouse
gtcgcgacgcttgcgcacta

SEQ ID NO: 821384 - DNA, 20 bp, mouse
ggtcttgagcgggacggggt

SEQ ID NO: 821385 - DNA, 20 bp, mouse
ggaaagaggcgggaactcgg

SEQ ID NO: 821386 - DNA, 20 bp, mouse
gcacgcgccctgatgactgg

SEQ ID NO: 821387 - DNA, 20 bp, mouse
gatacctcgcaactaccgat

SEQ ID NO: 821388 - DNA, 20 bp, mouse
gctcggggaaaacttcctat

SEQ ID NO: 821389 - DNA, 20 bp, mouse
gcggtagttgcgaggtatat

SEQ ID NO: 821390 - DNA, 20 bp, mouse
gtccgccccgccagtcatca

SEQ ID NO: 821391 - DNA, 20 bp, mouse
gtatcgctccgggcatccct

SEQ ID NO: 821392 - DNA, 20 bp, mouse
gaagccgccgccggaagttc

SEQ ID NO: 821393 - DNA, 20 bp, mouse
ggccctgatgactggcgggg

SEQ ID NO: 821394 - DNA, 20 bp, mouse
ggcgcacgcgccctgatgac

SEQ ID NO: 821395 - DNA, 20 bp, mouse
gtgactggcggggcggaaac

SEQ ID NO: 821396 - DNA, 20 bp, mouse
gaaaccagaggaggaagtgt

SEQ ID NO: 821397 - DNA, 20 bp, mouse
gatcagggatccataaggaa

SEQ ID NO: 821398 - DNA, 20 bp, mouse
gcatcactccacctcctgat

SEQ ID NO: 821399 - DNA, 20 bp, mouse
gcactccacctcctgattgg

SEQ ID NO: 821400 - DNA, 20 bp, mouse
ggaatcccggaagagcatca

SEQ ID NO: 821401 - DNA, 20 bp, mouse
gcagacagtctccaccaatc

SEQ ID NO: 821402 - DNA, 20 bp, mouse
gtggaccagcatttaaattc

SEQ ID NO: 821403 - DNA, 20 bp, mouse
ggagcaggtgggccgggtag

SEQ ID NO: 821404 - DNA, 20 bp, mouse
gtggatccctgatgctcttc

SEQ ID NO: 821405 - DNA, 20 bp, mouse
gtaggttggccgggccacag

SEQ ID NO: 821406 - DNA, 20 bp, mouse
gggactctggcattgagagg

SEQ ID NO: 821407 - DNA, 20 bp, mouse
ggctgtgggataaagtccct

SEQ ID NO: 821408 - DNA, 20 bp, mouse
gcagcaggagacattcagag

SEQ ID NO: 821409 - DNA, 20 bp, mouse
ggggataaagtccctcggag

SEQ ID NO: 821410 - DNA, 20 bp, mouse
gtgaggccacttttgaagtt

SEQ ID NO: 821411 - DNA, 20 bp, mouse
gagagtaatgaagcatgcag

SEQ ID NO: 821412 - DNA, 20 bp, mouse
gtctggcattgagaggtgga

SEQ ID NO: 821413 - DNA, 20 bp, mouse
gacctccactacagaggcca

SEQ ID NO: 821414 - DNA, 20 bp, mouse
gggaggactctggcattgag

SEQ ID NO: 821415 - DNA, 20 bp, mouse
gagaagataaacattataca

SEQ ID NO: 821416 - DNA, 20 bp, mouse
gggcggcggccgcagttagg

SEQ ID NO: 821417 - DNA, 20 bp, mouse
gtgcccgcctggagggtctg

SEQ ID NO: 821418 - DNA, 20 bp, mouse
gcctccaggcgggcagtctc

SEQ ID NO: 821419 - DNA, 20 bp, mouse
gtaaatcctgggttctcgtt

SEQ ID NO: 821420 - DNA, 20 bp, mouse
ggggctgcaccctagaggtc

SEQ ID NO: 821421 - DNA, 20 bp, mouse
ggacgtaaacttagcagcag

SEQ ID NO: 821422 - DNA, 20 bp, mouse
gggcggcacccggacctcta

SEQ ID NO: 821423 - DNA, 20 bp, mouse
gctgaaacccgaagctccag

SEQ ID NO: 821424 - DNA, 20 bp, mouse
gggaccggaagaggaagtcg

SEQ ID NO: 821425 - DNA, 20 bp, mouse
gacgctaggccgggactctg

SEQ ID NO: 821426 - DNA, 20 bp, mouse
gccgcgggatcgagggtctg

SEQ ID NO: 821427 - DNA, 20 bp, mouse
gagcagggccgcgggatcga

SEQ ID NO: 821428 - DNA, 20 bp, mouse
gggtgagcatgtctagatcg

SEQ ID NO: 821429 - DNA, 20 bp, mouse
ggtgacggacgccctagagt

SEQ ID NO: 821430 - DNA, 20 bp, mouse
gaccctgtctccctactcta

SEQ ID NO: 821431 - DNA, 20 bp, mouse
gtgaaggatgggagccacgt

SEQ ID NO: 821432 - DNA, 20 bp, mouse
ggaagccatgggtacagacc

SEQ ID NO: 821433 - DNA, 20 bp, mouse
gaggcctccgcgttagaaaa

SEQ ID NO: 821434 - DNA, 20 bp, mouse
gatcgtggaaagcagggccg

SEQ ID NO: 821435 - DNA, 20 bp, mouse
gcgccctagagtagggagac

SEQ ID NO: 821436 - DNA, 20 bp, mouse
ggctagctgtactgaggcct

SEQ ID NO: 821437 - DNA, 20 bp, mouse
gtcccaatcctggctccagt

SEQ ID NO: 821438 - DNA, 20 bp, mouse
gagagcactcagtgggacac

SEQ ID NO: 821439 - DNA, 20 bp, mouse
gtctgagctgggagaggtca

SEQ ID NO: 821440 - DNA, 20 bp, mouse
ggattgggagatgatctgag

SEQ ID NO: 821441 - DNA, 20 bp, mouse
gctccctccctactggagcc

SEQ ID NO: 821442 - DNA, 20 bp, mouse
gtccctactggagccaggat

SEQ ID NO: 821443 - DNA, 20 bp, mouse
gagctctattaccctcccag

SEQ ID NO: 821444 - DNA, 20 bp, mouse
gaggttgaagtgtgtgtgga

SEQ ID NO: 821445 - DNA, 20 bp, mouse
gggtgaggatgaggagtagt

SEQ ID NO: 821446 - DNA, 20 bp, mouse
gggtcctccccggtgcgcgg

SEQ ID NO: 821447 - DNA, 20 bp, mouse
gcgcgcgcgctgcccatgcg

SEQ ID NO: 821448 - DNA, 20 bp, mouse
gaggacccagggacagccga

SEQ ID NO: 821449 - DNA, 20 bp, mouse
gcgtagccccgagccgacct

SEQ ID NO: 821450 - DNA, 20 bp, mouse
gacccagggacagccgacgg

SEQ ID NO: 821451 - DNA, 20 bp, mouse
gcaaccgccgcgcaccgggg

SEQ ID NO: 821452 - DNA, 20 bp, mouse
ggccgcgcgctaggcccctt

SEQ ID NO: 821453 - DNA, 20 bp, mouse
gcatgggcagcgcgcgcgag

SEQ ID NO: 821454 - DNA, 20 bp, mouse
ggacagccgacggtggatga

SEQ ID NO: 821455 - DNA, 20 bp, mouse
ggggctacggttagctgcag

SEQ ID NO: 821456 - DNA, 20 bp, mouse
gagaaaggggctgagtttgt

SEQ ID NO: 821457 - DNA, 20 bp, mouse
gaagcgctgggaaggggatt

SEQ ID NO: 821458 - DNA, 20 bp, mouse
gaacccggaagcgctgggaa

SEQ ID NO: 821459 - DNA, 20 bp, mouse
gttgtgggagtggcgctcaa

SEQ ID NO: 821460 - DNA, 20 bp, mouse
gctactgaaccaggacgggg

SEQ ID NO: 821461 - DNA, 20 bp, mouse
ggtggcgctcaaggggaacc

SEQ ID NO: 821462 - DNA, 20 bp, mouse
ggaacgcgcctctcagaaag

SEQ ID NO: 821463 - DNA, 20 bp, mouse
gacggggcggagcctattct

SEQ ID NO: 821464 - DNA, 20 bp, mouse
gaaggggaacccggaagcgc

SEQ ID NO: 821465 - DNA, 20 bp, mouse
ggctctacacacttcatcca

SEQ ID NO: 821466 - DNA, 20 bp, mouse
gagaaaggggctgaacttat

SEQ ID NO: 821467 - DNA, 20 bp, mouse
gaacttagaagcactaggaa

SEQ ID NO: 821468 - DNA, 20 bp, mouse
gtatgggagtggcgttcaag

SEQ ID NO: 821469 - DNA, 20 bp, mouse
gaagcactaggaaggggact

SEQ ID NO: 821470 - DNA, 20 bp, mouse
ggggaccacaagctctacgc

SEQ ID NO: 821471 - DNA, 20 bp, mouse
ggataggctccgccccacgc

SEQ ID NO: 821472 - DNA, 20 bp, mouse
ggccagcatccactcgtgtt

SEQ ID NO: 821473 - DNA, 20 bp, mouse
ggctccgccccacgctggtt

SEQ ID NO: 821474 - DNA, 20 bp, mouse
gaaaaagtgacgaatagcca

SEQ ID NO: 821475 - DNA, 20 bp, mouse
gctacctaaccagcgtgggg

SEQ ID NO: 821476 - DNA, 20 bp, mouse
ggcacccgcgcgagccccgg

SEQ ID NO: 821477 - DNA, 20 bp, mouse
gggtgcggctgggcggacgt

SEQ ID NO: 821478 - DNA, 20 bp, mouse
gggcggcccagaagtcgcga

SEQ ID NO: 821479 - DNA, 20 bp, mouse
gcactgcagctctggatcgt

SEQ ID NO: 821480 - DNA, 20 bp, mouse
ggggcctctgaggggtcggg

SEQ ID NO: 821481 - DNA, 20 bp, mouse
ggggcgcggctgcaagccgg

SEQ ID NO: 821482 - DNA, 20 bp, mouse
gggctcgcgcgggtgcggct

SEQ ID NO: 821483 - DNA, 20 bp, mouse
gtcccgctgcccgacgattt

SEQ ID NO: 821484 - DNA, 20 bp, mouse
ggaggcgcggggcctctgag

SEQ ID NO: 821485 - DNA, 20 bp, mouse
ggtggggcgcggctgcaagc

SEQ ID NO: 821486 - DNA, 20 bp, mouse
gtcccagcggccagaggtgg

SEQ ID NO: 821487 - DNA, 20 bp, mouse
gactggaagctagcgggagg

SEQ ID NO: 821488 - DNA, 20 bp, mouse
ggtggcggagggcggagatg

SEQ ID NO: 821489 - DNA, 20 bp, mouse
gagcaccggagacaaggatt

SEQ ID NO: 821490 - DNA, 20 bp, mouse
gcaaggggggaggtggcgga

SEQ ID NO: 821491 - DNA, 20 bp, mouse
gaggggcacgctcagtaggc

SEQ ID NO: 821492 - DNA, 20 bp, mouse
gaaggagggagggacaaaac

SEQ ID NO: 821493 - DNA, 20 bp, mouse
ggaagaggggcacgctcagt

SEQ ID NO: 821494 - DNA, 20 bp, mouse
gtcccgctagcttccagtca

SEQ ID NO: 821495 - DNA, 20 bp, mouse
gggaagggaagacgggtcgg

SEQ ID NO: 821496 - DNA, 20 bp, mouse
ggggtcctagagcccggcta

SEQ ID NO: 821497 - DNA, 20 bp, mouse
gagaaggtggtccacggtca

SEQ ID NO: 821498 - DNA, 20 bp, mouse
ggtccctgatgatatgagaa

SEQ ID NO: 821499 - DNA, 20 bp, mouse
ggtcagggctctgaatggga

SEQ ID NO: 821500 - DNA, 20 bp, mouse
gaaagtggggattcccttct

SEQ ID NO: 821501 - DNA, 20 bp, mouse
ggcctggcagggttcgaaaa

SEQ ID NO: 821502 - DNA, 20 bp, mouse
ggaccaaccgttcagataag

SEQ ID NO: 821503 - DNA, 20 bp, mouse
ggaacctggaagatgtgtgt

SEQ ID NO: 821504 - DNA, 20 bp, mouse
gctagagagaaggtggtcca

SEQ ID NO: 821505 - DNA, 20 bp, mouse
gagagggtgcgtcacggaag

SEQ ID NO: 821506 - DNA, 20 bp, mouse
gcagccccgggagacgtgaa

SEQ ID NO: 821507 - DNA, 20 bp, mouse
ggggggccgggcaacgagaa

SEQ ID NO: 821508 - DNA, 20 bp, mouse
ggatgggaagatggggggat

SEQ ID NO: 821509 - DNA, 20 bp, mouse
ggctggggctagtggccata

SEQ ID NO: 821510 - DNA, 20 bp, mouse
gcataggggaaagagagatt

SEQ ID NO: 821511 - DNA, 20 bp, mouse
ggtgtgcagtgcagcgagga

SEQ ID NO: 821512 - DNA, 20 bp, mouse
gattgggcagggctgtggcg

SEQ ID NO: 821513 - DNA, 20 bp, mouse
gtcgatgcggtgggcaggta

SEQ ID NO: 821514 - DNA, 20 bp, mouse
ggctggcgaagaggagtaag

SEQ ID NO: 821515 - DNA, 20 bp, mouse
gcgggcaacgagaagggctg

SEQ ID NO: 821516 - DNA, 20 bp, mouse
ggagtcagagggtgaactag

SEQ ID NO: 821517 - DNA, 20 bp, mouse
gagggtgaactaggggagga

SEQ ID NO: 821518 - DNA, 20 bp, mouse
gcacctgggcctgaggagga

SEQ ID NO: 821519 - DNA, 20 bp, mouse
gtcagagggtgaactagggg

SEQ ID NO: 821520 - DNA, 20 bp, mouse
gggggaggagggtgagtcat

SEQ ID NO: 821521 - DNA, 20 bp, mouse
gataactaaagctgagtcag

SEQ ID NO: 821522 - DNA, 20 bp, mouse
gggagggtgacagagaaccc

SEQ ID NO: 821523 - DNA, 20 bp, mouse
gcataggtgactggtaagaa

SEQ ID NO: 821524 - DNA, 20 bp, mouse
gtgtcattatatcagctggg

SEQ ID NO: 821525 - DNA, 20 bp, mouse
gggaccagccagccaactta

SEQ ID NO: 821526 - DNA, 20 bp, mouse
gaaccctataaacatctcac

SEQ ID NO: 821527 - DNA, 20 bp, mouse
gaaaagctggaccaataagt

SEQ ID NO: 821528 - DNA, 20 bp, mouse
gaggatgaatcatgtctgac

SEQ ID NO: 821529 - DNA, 20 bp, mouse
gttcagatgggcttattggg

SEQ ID NO: 821530 - DNA, 20 bp, mouse
gaaacatctcactggaaaac

SEQ ID NO: 821531 - DNA, 20 bp, mouse
gaggtgctccacccacttat

SEQ ID NO: 821532 - DNA, 20 bp, mouse
gagctggaccaataagtggg

SEQ ID NO: 821533 - DNA, 20 bp, mouse
gaataagcccatctgaactg

SEQ ID NO: 821534 - DNA, 20 bp, mouse
gaggaatgagacctgcctga

SEQ ID NO: 821535 - DNA, 20 bp, mouse
gttccagtgagatgtttata

SEQ ID NO: 821536 - DNA, 20 bp, mouse
gctcttgcttccagtaactg

SEQ ID NO: 821537 - DNA, 20 bp, mouse
gaacttgcttggcaagggaa

SEQ ID NO: 821538 - DNA, 20 bp, mouse
gtaaggaacttgcttggcaa

SEQ ID NO: 821539 - DNA, 20 bp, mouse
gttcacgagttcccactaaa

SEQ ID NO: 821540 - DNA, 20 bp, mouse
gctgaggcccaacctgcctg

SEQ ID NO: 821541 - DNA, 20 bp, mouse
gtacttctaaggaacttgct

SEQ ID NO: 821542 - DNA, 20 bp, mouse
gaacatgctttgtaaagaaa

SEQ ID NO: 821543 - DNA, 20 bp, mouse
ggctgaactatctacttcta

SEQ ID NO: 821544 - DNA, 20 bp, mouse
gaagacaagcttcctgttca

SEQ ID NO: 821545 - DNA, 20 bp, mouse
ggctgaatgagttctcttca

SEQ ID NO: 821546 - DNA, 20 bp, mouse
gctcttgcttccagtaactg

SEQ ID NO: 821547 - DNA, 20 bp, mouse
gaacttgcttggcaagggaa

SEQ ID NO: 821548 - DNA, 20 bp, mouse
gtaaggaacttgcttggcaa

SEQ ID NO: 821549 - DNA, 20 bp, mouse
gttcacgagttcccactaaa

SEQ ID NO: 821550 - DNA, 20 bp, mouse
gctgaggcccaacctgcctg

SEQ ID NO: 821551 - DNA, 20 bp, mouse
gtacttctaaggaacttgct

SEQ ID NO: 821552 - DNA, 20 bp, mouse
gaacatgctttgtaaagaaa

SEQ ID NO: 821553 - DNA, 20 bp, mouse
ggctgaactatctacttcta

SEQ ID NO: 821554 - DNA, 20 bp, mouse
gaagacaagcttcctgttca

SEQ ID NO: 821555 - DNA, 20 bp, mouse
ggctgaatgagttctcttca

SEQ ID NO: 821556 - DNA, 20 bp, mouse
gaacttgcttggcaagggaa

SEQ ID NO: 821557 - DNA, 20 bp, mouse
gacagagctgggttctattc

SEQ ID NO: 821558 - DNA, 20 bp, mouse
gctgaggcccaacctgcctg

SEQ ID NO: 821559 - DNA, 20 bp, mouse
gtaaggaacttgcttggcaa

SEQ ID NO: 821560 - DNA, 20 bp, mouse
gttcacgagttcccactaaa

SEQ ID NO: 821561 - DNA, 20 bp, mouse
gctggtacaggtgttgtgtc

SEQ ID NO: 821562 - DNA, 20 bp, mouse
gggccagcagatcacagagc

SEQ ID NO: 821563 - DNA, 20 bp, mouse
gagggaaatccactccccat

SEQ ID NO: 821564 - DNA, 20 bp, mouse
gttgaacaggaagcttgtct

SEQ ID NO: 821565 - DNA, 20 bp, mouse
gtgcctcaccccatggggag

SEQ ID NO: 821566 - DNA, 20 bp, mouse
gtatttctgtttcacaccat

SEQ ID NO: 821567 - DNA, 20 bp, mouse
ggaaacagaaatagattctt

SEQ ID NO: 821568 - DNA, 20 bp, mouse
gggcatgagattttcaaaac

SEQ ID NO: 821569 - DNA, 20 bp, mouse
gtaagtaaaagaggcaatcc

SEQ ID NO: 821570 - DNA, 20 bp, mouse
gggacctcctaaaatagtat

SEQ ID NO: 821571 - DNA, 20 bp, mouse
gtatgcacacataggtacac

SEQ ID NO: 821572 - DNA, 20 bp, mouse
gatattccagatggaatgag

SEQ ID NO: 821573 - DNA, 20 bp, mouse
gaatagattcttaggggaaa

SEQ ID NO: 821574 - DNA, 20 bp, mouse
gatggagaaactacgctttt

SEQ ID NO: 821575 - DNA, 20 bp, mouse
ggaaatttgtatgcacacat

SEQ ID NO: 821576 - DNA, 20 bp, mouse
gcatccgtaactggctggac

SEQ ID NO: 821577 - DNA, 20 bp, mouse
ggcccccctcagtaagccat

SEQ ID NO: 821578 - DNA, 20 bp, mouse
gtgcctcacccagtgggaag

SEQ ID NO: 821579 - DNA, 20 bp, mouse
gaccccatggcttactgagg

SEQ ID NO: 821580 - DNA, 20 bp, mouse
gagggagatccacttcccac

SEQ ID NO: 821581 - DNA, 20 bp, mouse
ggtccctgtccagccagtta

SEQ ID NO: 821582 - DNA, 20 bp, mouse
gatccacttcccactgggtg

SEQ ID NO: 821583 - DNA, 20 bp, mouse
gataggaaatatcccaccca

SEQ ID NO: 821584 - DNA, 20 bp, mouse
gtcagtaagccatggggtca

SEQ ID NO: 821585 - DNA, 20 bp, mouse
gttcttgcttccagtaattg

SEQ ID NO: 821586 - DNA, 20 bp, mouse
gaacaaatctgactgataat

SEQ ID NO: 821587 - DNA, 20 bp, mouse
gatgcaaatgcatgtatgac

SEQ ID NO: 821588 - DNA, 20 bp, mouse
gagtttcggtgagatctcac

SEQ ID NO: 821589 - DNA, 20 bp, mouse
gcattagtctctgctatgaa

SEQ ID NO: 821590 - DNA, 20 bp, mouse
gagtcagatttgttcctact

SEQ ID NO: 821591 - DNA, 20 bp, mouse
gaatctgactgataatgggc

SEQ ID NO: 821592 - DNA, 20 bp, mouse
gtaatcacaaaagattacat

SEQ ID NO: 821593 - DNA, 20 bp, mouse
gcctgctttctaaggataat

SEQ ID NO: 821594 - DNA, 20 bp, mouse
gcagaaaaatcagcattgtc

SEQ ID NO: 821595 - DNA, 20 bp, mouse
gaaaatcagcattgtcagga

SEQ ID NO: 821596 - DNA, 20 bp, mouse
gagcaacactgactgatagt

SEQ ID NO: 821597 - DNA, 20 bp, mouse
gactatctggccagtcgagt

SEQ ID NO: 821598 - DNA, 20 bp, mouse
gtatatgacctgcactgggg

SEQ ID NO: 821599 - DNA, 20 bp, mouse
gctaggtataatttgcctat

SEQ ID NO: 821600 - DNA, 20 bp, mouse
gctactagccaccccagtgc

SEQ ID NO: 821601 - DNA, 20 bp, mouse
gatgaactaactcaaggtag

SEQ ID NO: 821602 - DNA, 20 bp, mouse
gagtgttgctcccactcgac

SEQ ID NO: 821603 - DNA, 20 bp, mouse
gttaatttaggatataagag

SEQ ID NO: 821604 - DNA, 20 bp, mouse
gcaaattatacctagaaaaa

SEQ ID NO: 821605 - DNA, 20 bp, mouse
gtggggtggctagtagccct

SEQ ID NO: 821606 - DNA, 20 bp, mouse
gagcagaaccgactgatagt

SEQ ID NO: 821607 - DNA, 20 bp, mouse
gactgtctgtcaagccaagt

SEQ ID NO: 821608 - DNA, 20 bp, mouse
gctcaacaatgataatatcc

SEQ ID NO: 821609 - DNA, 20 bp, mouse
gaaaaaaaatattgtcctta

SEQ ID NO: 821610 - DNA, 20 bp, mouse
gagtcggttctgctcccact

SEQ ID NO: 821611 - DNA, 20 bp, mouse
gtcaatattcagtttcagtg

SEQ ID NO: 821612 - DNA, 20 bp, mouse
gggcaagcatcctcccctaa

SEQ ID NO: 821613 - DNA, 20 bp, mouse
gaatatacaccctttagggg

SEQ ID NO: 821614 - DNA, 20 bp, mouse
gaggttaatgcatcacagat

SEQ ID NO: 821615 - DNA, 20 bp, mouse
ggcgcacagaaggaaattaa

SEQ ID NO: 821616 - DNA, 20 bp, mouse
gaaccagaacagttgctcag

SEQ ID NO: 821617 - DNA, 20 bp, mouse
gtgtagaactaactgagagt

SEQ ID NO: 821618 - DNA, 20 bp, mouse
gagtagagcttgatgatctt

SEQ ID NO: 821619 - DNA, 20 bp, mouse
gcatcaagctctactctgta

SEQ ID NO: 821620 - DNA, 20 bp, mouse
gagttagttctacatctact

SEQ ID NO: 821621 - DNA, 20 bp, mouse
gttcctctgagcaactgttc

SEQ ID NO: 821622 - DNA, 20 bp, mouse
ggaactaactgagagtgggc

SEQ ID NO: 821623 - DNA, 20 bp, mouse
gtgtgtaccacataatacca

SEQ ID NO: 821624 - DNA, 20 bp, mouse
gctgaaaaaaaggaattaaa

SEQ ID NO: 821625 - DNA, 20 bp, mouse
gttcctaagtgctgaaaaaa

SEQ ID NO: 821626 - DNA, 20 bp, mouse
gttcctggacacatagtcac

SEQ ID NO: 821627 - DNA, 20 bp, mouse
gacccagtgactatgtgtcc

SEQ ID NO: 821628 - DNA, 20 bp, mouse
gactggctgccccgccctgt

SEQ ID NO: 821629 - DNA, 20 bp, mouse
gggggtaaaggtggtataat

SEQ ID NO: 821630 - DNA, 20 bp, mouse
gaaccaggactctcaaaaat

SEQ ID NO: 821631 - DNA, 20 bp, mouse
gtagttggaaaagcttgtgg

SEQ ID NO: 821632 - DNA, 20 bp, mouse
ggaaaagcttgtgggggtaa

SEQ ID NO: 821633 - DNA, 20 bp, mouse
gaaaacacacaattaagatg

SEQ ID NO: 821634 - DNA, 20 bp, mouse
gaagcttgtgggggtaaagg

SEQ ID NO: 821635 - DNA, 20 bp, mouse
gttcctatttttgagagtcc

SEQ ID NO: 821636 - DNA, 20 bp, mouse
gagcacttgtgactgataga

SEQ ID NO: 821637 - DNA, 20 bp, mouse
gctgaacaatgatgatgtcc

SEQ ID NO: 821638 - DNA, 20 bp, mouse
gtcaactaattggtatccta

SEQ ID NO: 821639 - DNA, 20 bp, mouse
gagtcacaagtgcttccatt

SEQ ID NO: 821640 - DNA, 20 bp, mouse
gggaaattaaaggggaccat

SEQ ID NO: 821641 - DNA, 20 bp, mouse
gaaatgggccaatgcaccat

SEQ ID NO: 821642 - DNA, 20 bp, mouse
gcactggatttgaagacaga

SEQ ID NO: 821643 - DNA, 20 bp, mouse
gttgcctatgggatgaaaga

SEQ ID NO: 821644 - DNA, 20 bp, mouse
gttaggtgtaacttgcctat

SEQ ID NO: 821645 - DNA, 20 bp, mouse
ggatgctgaaattatgccta

SEQ ID NO: 821646 - DNA, 20 bp, mouse
gtactgaaactgtaaaaagg

SEQ ID NO: 821647 - DNA, 20 bp, mouse
gtgccagcctccccttggaa

SEQ ID NO: 821648 - DNA, 20 bp, mouse
gtgcccttccaaggggaggc

SEQ ID NO: 821649 - DNA, 20 bp, mouse
gaattctggataagccagtt

SEQ ID NO: 821650 - DNA, 20 bp, mouse
gtatgtgcccttccaagggg

SEQ ID NO: 821651 - DNA, 20 bp, mouse
ggagttgaagtgtaacaact

SEQ ID NO: 821652 - DNA, 20 bp, mouse
gctaaaagcaagaatgtaaa

SEQ ID NO: 821653 - DNA, 20 bp, mouse
gaagtgtggagttttcttac

SEQ ID NO: 821654 - DNA, 20 bp, mouse
gttgttacacttcaactcat

SEQ ID NO: 821655 - DNA, 20 bp, mouse
ggaagggcacatatttttta

SEQ ID NO: 821656 - DNA, 20 bp, mouse
gcttgcagctggaaaatcgg

SEQ ID NO: 821657 - DNA, 20 bp, mouse
ggcggtagttgtggtataat

SEQ ID NO: 821658 - DNA, 20 bp, mouse
gaagaaggactcccccaaat

SEQ ID NO: 821659 - DNA, 20 bp, mouse
gtgtaaagctaattcattgt

SEQ ID NO: 821660 - DNA, 20 bp, mouse
gggggtggaggcggtagttg

SEQ ID NO: 821661 - DNA, 20 bp, mouse
ggcagctggaaaatcggggg

SEQ ID NO: 821662 - DNA, 20 bp, mouse
gataggaaatatcttgttct

SEQ ID NO: 821663 - DNA, 20 bp, mouse
gaatgacaagcagctagaat

SEQ ID NO: 821664 - DNA, 20 bp, mouse
gaagctaattcattgtgggc

SEQ ID NO: 821665 - DNA, 20 bp, mouse
gacaagatatttcctatttg

SEQ ID NO: 821666 - DNA, 20 bp, mouse
gaagggtggacaatggaatc

SEQ ID NO: 821667 - DNA, 20 bp, mouse
ggatggggatcaatcttctt

SEQ ID NO: 821668 - DNA, 20 bp, mouse
gagcagccacaccataaggg

SEQ ID NO: 821669 - DNA, 20 bp, mouse
gaagtgctacctagacgccc

SEQ ID NO: 821670 - DNA, 20 bp, mouse
ggaactcagtggaatgtctg

SEQ ID NO: 821671 - DNA, 20 bp, mouse
ggatcaatcttcttgggagg

SEQ ID NO: 821672 - DNA, 20 bp, mouse
gtacgggagagggtaatatg

SEQ ID NO: 821673 - DNA, 20 bp, mouse
gctgtggagtcatacgggag

SEQ ID NO: 821674 - DNA, 20 bp, mouse
gaaaaactgaactggattag

SEQ ID NO: 821675 - DNA, 20 bp, mouse
gaatctacttccttaaggaa

SEQ ID NO: 821676 - DNA, 20 bp, mouse
gaaaaggcccttgagaagaa

SEQ ID NO: 821677 - DNA, 20 bp, mouse
gactgcttgatgagacaggg

SEQ ID NO: 821678 - DNA, 20 bp, mouse
gcgtctgggtaactgccagt

SEQ ID NO: 821679 - DNA, 20 bp, mouse
gatgcagatgtatgaggaag

SEQ ID NO: 821680 - DNA, 20 bp, mouse
ggaattcataataacacaaa

SEQ ID NO: 821681 - DNA, 20 bp, mouse
gacaggggggaggatacatg

SEQ ID NO: 821682 - DNA, 20 bp, mouse
gaatactgcttgatgagaca

SEQ ID NO: 821683 - DNA, 20 bp, mouse
gtaaatgatgcagatgtatg

SEQ ID NO: 821684 - DNA, 20 bp, mouse
gtattttgcactagcgccca

SEQ ID NO: 821685 - DNA, 20 bp, mouse
ggcttgatgagacagggggg

SEQ ID NO: 821686 - DNA, 20 bp, mouse
gtccgggccccacccgagcc

SEQ ID NO: 821687 - DNA, 20 bp, mouse
gcacccgagcccggtggaga

SEQ ID NO: 821688 - DNA, 20 bp, mouse
ggcaatgcagcgctcggctc

SEQ ID NO: 821689 - DNA, 20 bp, mouse
ggccgcgggagcaagacgag

SEQ ID NO: 821690 - DNA, 20 bp, mouse
gcaggcgctggcagaggaga

SEQ ID NO: 821691 - DNA, 20 bp, mouse
gcctccgctgccttctccac

SEQ ID NO: 821692 - DNA, 20 bp, mouse
gactgcgcctgcgcccgggg

SEQ ID NO: 821693 - DNA, 20 bp, mouse
gagtgcgagcggctcgactc

SEQ ID NO: 821694 - DNA, 20 bp, mouse
gggctccggcgcaggcgttt

SEQ ID NO: 821695 - DNA, 20 bp, mouse
gcggaggcagctggagtcgg

SEQ ID NO: 821696 - DNA, 20 bp, mouse
gcctgcgagcgcaactgggg

SEQ ID NO: 821697 - DNA, 20 bp, mouse
gagtcctgcgagcgcaactg

SEQ ID NO: 821698 - DNA, 20 bp, mouse
gggtcccggcgtggaggtgg

SEQ ID NO: 821699 - DNA, 20 bp, mouse
gtgtcagcctccaatttaag

SEQ ID NO: 821700 - DNA, 20 bp, mouse
ggacagctcacgactgacag

SEQ ID NO: 821701 - DNA, 20 bp, mouse
gagcaggatttcagcgatcg

SEQ ID NO: 821702 - DNA, 20 bp, mouse
gacaccgtgcccccagataa

SEQ ID NO: 821703 - DNA, 20 bp, mouse
gtcacgactgacaggggccc

SEQ ID NO: 821704 - DNA, 20 bp, mouse
gggggaggagcgggcattcc

SEQ ID NO: 821705 - DNA, 20 bp, mouse
gtgcaccagtccccttaaat

SEQ ID NO: 821706 - DNA, 20 bp, mouse
gcggccgcggcagcagtaaa

SEQ ID NO: 821707 - DNA, 20 bp, mouse
ggcgtcatgtggatccgagg

SEQ ID NO: 821708 - DNA, 20 bp, mouse
ggcctcctccggaaaggcga

SEQ ID NO: 821709 - DNA, 20 bp, mouse
gccgcaggaggcattcaaaa

SEQ ID NO: 821710 - DNA, 20 bp, mouse
gctccctgcctcctccggaa

SEQ ID NO: 821711 - DNA, 20 bp, mouse
gtgcgccctcgcctttccgg

SEQ ID NO: 821712 - DNA, 20 bp, mouse
gacgccatttactgctgccg

SEQ ID NO: 821713 - DNA, 20 bp, mouse
gcccgcggagccaatgagct

SEQ ID NO: 821714 - DNA, 20 bp, mouse
ggccctcgcctttccggagg

SEQ ID NO: 821715 - DNA, 20 bp, mouse
ggcatccggtcccagctcat

SEQ ID NO: 821716 - DNA, 20 bp, mouse
gagccggccccagcaatcac

SEQ ID NO: 821717 - DNA, 20 bp, mouse
gcaagcccgcagtggcgtga

SEQ ID NO: 821718 - DNA, 20 bp, mouse
gccggctgttgctcctcctg

SEQ ID NO: 821719 - DNA, 20 bp, mouse
gaacccgtgattgctggggc

SEQ ID NO: 821720 - DNA, 20 bp, mouse
gcacgattctatgaatgggt

SEQ ID NO: 821721 - DNA, 20 bp, mouse
ggcttaacccgtgattgctg

SEQ ID NO: 821722 - DNA, 20 bp, mouse
gcaccgcaggcgatggggag

SEQ ID NO: 821723 - DNA, 20 bp, mouse
gcgctcacgattctatgaat

SEQ ID NO: 821724 - DNA, 20 bp, mouse
ggccccccattcataaaaaa

SEQ ID NO: 821725 - DNA, 20 bp, mouse
ggctccgttttttatgaatg

SEQ ID NO: 821726 - DNA, 20 bp, mouse
gaggaaccctggtgtcggga

SEQ ID NO: 821727 - DNA, 20 bp, mouse
gagctcagggaggcggtcaa

SEQ ID NO: 821728 - DNA, 20 bp, mouse
gtcaaggggcggctcccttg

SEQ ID NO: 821729 - DNA, 20 bp, mouse
gcagggaggcggtcaagggg

SEQ ID NO: 821730 - DNA, 20 bp, mouse
ggccaatcgcagggcacagg

SEQ ID NO: 821731 - DNA, 20 bp, mouse
gtaacactcggcggcgtctg

SEQ ID NO: 821732 - DNA, 20 bp, mouse
gtctgaggaaccctggtgtc

SEQ ID NO: 821733 - DNA, 20 bp, mouse
gaaccctggtgtcgggaggg

SEQ ID NO: 821734 - DNA, 20 bp, mouse
gaccgcctgtgccctgcgat

SEQ ID NO: 821735 - DNA, 20 bp, mouse
ggagctgggtacctaacact

SEQ ID NO: 821736 - DNA, 20 bp, mouse
gcgcgagtgtcgtgagaaat

SEQ ID NO: 821737 - DNA, 20 bp, mouse
gtctgtttacacaggctctc

SEQ ID NO: 821738 - DNA, 20 bp, mouse
gccgggcgcggaccagtcat

SEQ ID NO: 821739 - DNA, 20 bp, mouse
gggtccgcgcccggagcacg

SEQ ID NO: 821740 - DNA, 20 bp, mouse
ggtctcgcaccacgtgctcc

SEQ ID NO: 821741 - DNA, 20 bp, mouse
gatctcggtgatttctagtc

SEQ ID NO: 821742 - DNA, 20 bp, mouse
gtcagagactctgtttacac

SEQ ID NO: 821743 - DNA, 20 bp, mouse
gcattggtcggtgtcccctg

SEQ ID NO: 821744 - DNA, 20 bp, mouse
gccaggccaatccaggctac

SEQ ID NO: 821745 - DNA, 20 bp, mouse
ggcaccacgtgctccgggcg

SEQ ID NO: 821746 - DNA, 20 bp, mouse
gtggcctgacgcctggaaga

SEQ ID NO: 821747 - DNA, 20 bp, mouse
gggcctgactgacatggggt

SEQ ID NO: 821748 - DNA, 20 bp, mouse
gggcttgactgactgaaaga

SEQ ID NO: 821749 - DNA, 20 bp, mouse
ggggccagtggcctgacgcc

SEQ ID NO: 821750 - DNA, 20 bp, mouse
gtcaagcccgggcccctgct

SEQ ID NO: 821751 - DNA, 20 bp, mouse
gcggccagcccaagtcaaag

SEQ ID NO: 821752 - DNA, 20 bp, mouse
gggcgtgcgcaggcgtgctg

SEQ ID NO: 821753 - DNA, 20 bp, mouse
gtcaaagagggtgtggcggg

SEQ ID NO: 821754 - DNA, 20 bp, mouse
gctggaagagggcggagttg

SEQ ID NO: 821755 - DNA, 20 bp, mouse
gcagcacggagctactacgg

SEQ ID NO: 821756 - DNA, 20 bp, mouse
gtggtgaaggagcgtgacat

SEQ ID NO: 821757 - DNA, 20 bp, mouse
gctgaggcggggcgtggtga

SEQ ID NO: 821758 - DNA, 20 bp, mouse
gtgaggagcgccaggcagaa

SEQ ID NO: 821759 - DNA, 20 bp, mouse
gtaagcgggaaagtgcggag

SEQ ID NO: 821760 - DNA, 20 bp, mouse
gataaaaagggcgtgacctg

SEQ ID NO: 821761 - DNA, 20 bp, mouse
gaggaaacccagcgctgggt

SEQ ID NO: 821762 - DNA, 20 bp, mouse
ggggagggttgcgataaaaa

SEQ ID NO: 821763 - DNA, 20 bp, mouse
gcgctgggtcggaaagtaga

SEQ ID NO: 821764 - DNA, 20 bp, mouse
gggagaaggggcgtggtgta

SEQ ID NO: 821765 - DNA, 20 bp, mouse
gaaaagggcgtgacctgagg

SEQ ID NO: 821766 - DNA, 20 bp, mouse
ggggttctcaaggcggtaag

SEQ ID NO: 821767 - DNA, 20 bp, mouse
ggtcacctcccagaccacgg

SEQ ID NO: 821768 - DNA, 20 bp, mouse
gacgccagggagtcctggga

SEQ ID NO: 821769 - DNA, 20 bp, mouse
gggtctgggaggtgacgata

SEQ ID NO: 821770 - DNA, 20 bp, mouse
gtaccgccttgagaacccac

SEQ ID NO: 821771 - DNA, 20 bp, mouse
gggaagcagtggctggtcag

SEQ ID NO: 821772 - DNA, 20 bp, mouse
ggacaagcgcgcatgctttg

SEQ ID NO: 821773 - DNA, 20 bp, mouse
ggtggccgccgtggtctggg

SEQ ID NO: 821774 - DNA, 20 bp, mouse
gggtgtggccgccgtggtct

SEQ ID NO: 821775 - DNA, 20 bp, mouse
ggtaagtggtgtggccgccg

SEQ ID NO: 821776 - DNA, 20 bp, mouse
gagacaggactgctgtcaag

SEQ ID NO: 821777 - DNA, 20 bp, mouse
gggggcgggtctcgcgagac

SEQ ID NO: 821778 - DNA, 20 bp, mouse
gtggcccggcagccgaaggc

SEQ ID NO: 821779 - DNA, 20 bp, mouse
gcagccgaaggcgggctcta

SEQ ID NO: 821780 - DNA, 20 bp, mouse
gctgccatagagcccgcctt

SEQ ID NO: 821781 - DNA, 20 bp, mouse
gggccggcgcggctcacctg

SEQ ID NO: 821782 - DNA, 20 bp, mouse
gcggtcaaacgcgaggggtt

SEQ ID NO: 821783 - DNA, 20 bp, mouse
gtcgcggccggaacggaaag

SEQ ID NO: 821784 - DNA, 20 bp, mouse
ggcaggtcggtcaaacgcga

SEQ ID NO: 821785 - DNA, 20 bp, mouse
gctatggcagcttcgcgcgg

SEQ ID NO: 821786 - DNA, 20 bp, mouse
gcggccggggcgcgggatgg

SEQ ID NO: 821787 - DNA, 20 bp, mouse
ggcccgagctgggacggccg

SEQ ID NO: 821788 - DNA, 20 bp, mouse
ggacgccattcactcatctg

SEQ ID NO: 821789 - DNA, 20 bp, mouse
gcccctgggccgaagtggcg

SEQ ID NO: 821790 - DNA, 20 bp, mouse
gccacttcggcccaggggcg

SEQ ID NO: 821791 - DNA, 20 bp, mouse
gagctgggacggccggggcg

SEQ ID NO: 821792 - DNA, 20 bp, mouse
ggccaccagctggcgggaaa

SEQ ID NO: 821793 - DNA, 20 bp, mouse
gctgcagctgaaagccgatc

SEQ ID NO: 821794 - DNA, 20 bp, mouse
gctccagaaggtggcagagc

SEQ ID NO: 821795 - DNA, 20 bp, mouse
gaaggtggcagagccggcag

SEQ ID NO: 821796 - DNA, 20 bp, mouse
ggaagctgccacaacctggt

SEQ ID NO: 821797 - DNA, 20 bp, mouse
gaacctggtaggtgtgtaac

SEQ ID NO: 821798 - DNA, 20 bp, mouse
ggaaaggagagtacagacat

SEQ ID NO: 821799 - DNA, 20 bp, mouse
gttctcttgtgtgaggcacg

SEQ ID NO: 821800 - DNA, 20 bp, mouse
ggtaagggccatcctatcac

SEQ ID NO: 821801 - DNA, 20 bp, mouse
gttcctgttacacacctacc

SEQ ID NO: 821802 - DNA, 20 bp, mouse
gccttactgaatatacactg

SEQ ID NO: 821803 - DNA, 20 bp, mouse
gttcttggagtttataagta

SEQ ID NO: 821804 - DNA, 20 bp, mouse
gcactttccctgtgatagga

SEQ ID NO: 821805 - DNA, 20 bp, mouse
gttcaaagtattagagacaa

SEQ ID NO: 821806 - DNA, 20 bp, mouse
gggtgactcagcagtttggg

SEQ ID NO: 821807 - DNA, 20 bp, mouse
gtggctctctggacctcagt

SEQ ID NO: 821808 - DNA, 20 bp, mouse
ggaaaggcaagtgcctgtat

SEQ ID NO: 821809 - DNA, 20 bp, mouse
gacaatctgcattatctcca

SEQ ID NO: 821810 - DNA, 20 bp, mouse
gagtgtgaaatcagaagaaa

SEQ ID NO: 821811 - DNA, 20 bp, mouse
gcaggggacatattcagttg

SEQ ID NO: 821812 - DNA, 20 bp, mouse
ggtaaaacacagcccaatac

SEQ ID NO: 821813 - DNA, 20 bp, mouse
gcttgcctttcaaatgtcac

SEQ ID NO: 821814 - DNA, 20 bp, mouse
gttcagatgcaaaagtttgg

SEQ ID NO: 821815 - DNA, 20 bp, mouse
ggcagattgtctacgcttgg

SEQ ID NO: 821816 - DNA, 20 bp, mouse
gaggaccgagcgcgtccgga

SEQ ID NO: 821817 - DNA, 20 bp, mouse
ggacgggaacgcgcttgcga

SEQ ID NO: 821818 - DNA, 20 bp, mouse
gccaccccgccccgcagctt

SEQ ID NO: 821819 - DNA, 20 bp, mouse
gaacgcgcttgcgaggggtg

SEQ ID NO: 821820 - DNA, 20 bp, mouse
gtcgctgctccactgcagta

SEQ ID NO: 821821 - DNA, 20 bp, mouse
gccgcagcttcggctccttc

SEQ ID NO: 821822 - DNA, 20 bp, mouse
gggtcctctccgtactgcag

SEQ ID NO: 821823 - DNA, 20 bp, mouse
gtgggcggggcaggattgct

SEQ ID NO: 821824 - DNA, 20 bp, mouse
gcttcgccgcagtctcggaa

SEQ ID NO: 821825 - DNA, 20 bp, mouse
gggagaggaccgagcgcgtc

SEQ ID NO: 821826 - DNA, 20 bp, mouse
gcccgggcgcgcagtctgat

SEQ ID NO: 821827 - DNA, 20 bp, mouse
ggcgtcccaggtcccagcgg

SEQ ID NO: 821828 - DNA, 20 bp, mouse
gcggctaggcaggtgccccc

SEQ ID NO: 821829 - DNA, 20 bp, mouse
gcccccgccgcgggactatc

SEQ ID NO: 821830 - DNA, 20 bp, mouse
gagccccttgccacgggaag

SEQ ID NO: 821831 - DNA, 20 bp, mouse
gggcgcgcagtctgattggc

SEQ ID NO: 821832 - DNA, 20 bp, mouse
gggaccagatagtcccgcgg

SEQ ID NO: 821833 - DNA, 20 bp, mouse
gtgaggagggacattcctgc

SEQ ID NO: 821834 - DNA, 20 bp, mouse
gcagggacgctaggcgggaa

SEQ ID NO: 821835 - DNA, 20 bp, mouse
ggcggcgctagcggctaggc

SEQ ID NO: 821836 - DNA, 20 bp, mouse
ggggctgcgcgcaggacgga

SEQ ID NO: 821837 - DNA, 20 bp, mouse
gcgacagggagaagccgcgg

SEQ ID NO: 821838 - DNA, 20 bp, mouse
gcgcggggaggctcggtcgc

SEQ ID NO: 821839 - DNA, 20 bp, mouse
gcgagcgcgtgcacgctctc

SEQ ID NO: 821840 - DNA, 20 bp, mouse
gcccagagatggttcggatg

SEQ ID NO: 821841 - DNA, 20 bp, mouse
gcgcagcactcaagcctccg

SEQ ID NO: 821842 - DNA, 20 bp, mouse
ggggctgtagggctgcgcgc

SEQ ID NO: 821843 - DNA, 20 bp, mouse
gcgaaccatctctgggtggg

SEQ ID NO: 821844 - DNA, 20 bp, mouse
gaggacggagggcgcgcgac

SEQ ID NO: 821845 - DNA, 20 bp, mouse
ggcagccgcccacccagaga

SEQ ID NO: 821846 - DNA, 20 bp, mouse
gaaagggcctagctcttctc

SEQ ID NO: 821847 - DNA, 20 bp, mouse
ggctcagggaggtaccagaa

SEQ ID NO: 821848 - DNA, 20 bp, mouse
gacactaggaatgcctgaga

SEQ ID NO: 821849 - DNA, 20 bp, mouse
gtcaggagtatagaacccaa

SEQ ID NO: 821850 - DNA, 20 bp, mouse
gtactttcagagctggagtg

SEQ ID NO: 821851 - DNA, 20 bp, mouse
gagttagctctccaatctgg

SEQ ID NO: 821852 - DNA, 20 bp, mouse
gacagagtgggtgctagcag

SEQ ID NO: 821853 - DNA, 20 bp, mouse
gaagtactgttcctccagat

SEQ ID NO: 821854 - DNA, 20 bp, mouse
ggcattcctagtgtatgaaa

SEQ ID NO: 821855 - DNA, 20 bp, mouse
gtgtgcatttgctctgattt

SEQ ID NO: 821856 - DNA, 20 bp, mouse
gcgtgcgggaggggtcccgg

SEQ ID NO: 821857 - DNA, 20 bp, mouse
ggcggggcggcgtgcgggag

SEQ ID NO: 821858 - DNA, 20 bp, mouse
gcggctgtgcatcacacgcg

SEQ ID NO: 821859 - DNA, 20 bp, mouse
gcaggggcccggtgtgtgag

SEQ ID NO: 821860 - DNA, 20 bp, mouse
gtgagtgtcactgtcagtgg

SEQ ID NO: 821861 - DNA, 20 bp, mouse
gtcacagtgaatgaccctgc

SEQ ID NO: 821862 - DNA, 20 bp, mouse
gcgcccgcgctgtcacacac

SEQ ID NO: 821863 - DNA, 20 bp, mouse
ggcccggtgtgtgacagcgc

SEQ ID NO: 821864 - DNA, 20 bp, mouse
gcgtgtgacagacagttaga

SEQ ID NO: 821865 - DNA, 20 bp, mouse
ggtcccgggggcgtgcggag

SEQ ID NO: 821866 - DNA, 20 bp, mouse
gaccctcccacccttccaga

SEQ ID NO: 821867 - DNA, 20 bp, mouse
gtccctctggaagggtggga

SEQ ID NO: 821868 - DNA, 20 bp, mouse
gccaggagggatgagagcga

SEQ ID NO: 821869 - DNA, 20 bp, mouse
gagaagagcctaacccagga

SEQ ID NO: 821870 - DNA, 20 bp, mouse
gtgggctaatctccaacaag

SEQ ID NO: 821871 - DNA, 20 bp, mouse
ggggaaagcaaccacaatct

SEQ ID NO: 821872 - DNA, 20 bp, mouse
ggctgagtgccccaagattg

SEQ ID NO: 821873 - DNA, 20 bp, mouse
gatactccctctggaagggt

SEQ ID NO: 821874 - DNA, 20 bp, mouse
gctcttgtgactgctccctt

SEQ ID NO: 821875 - DNA, 20 bp, mouse
ggataattttatactccctc

SEQ ID NO: 821876 - DNA, 20 bp, mouse
gtctcctagcacaaagtcca

SEQ ID NO: 821877 - DNA, 20 bp, mouse
gtgtcgctatacaagtctca

SEQ ID NO: 821878 - DNA, 20 bp, mouse
ggggcggggcctcctcgttc

SEQ ID NO: 821879 - DNA, 20 bp, mouse
gtcgttcgggtgtgctcgtt

SEQ ID NO: 821880 - DNA, 20 bp, mouse
gagctcgtggtccttgtcct

SEQ ID NO: 821881 - DNA, 20 bp, mouse
gaggcgggactgccggaagt

SEQ ID NO: 821882 - DNA, 20 bp, mouse
gtgaagtgcttggactcgat

SEQ ID NO: 821883 - DNA, 20 bp, mouse
gagtgacgcaatgaagcggg

SEQ ID NO: 821884 - DNA, 20 bp, mouse
gcagacgactgcccaggaca

SEQ ID NO: 821885 - DNA, 20 bp, mouse
gaggccgggcatggcggtac

SEQ ID NO: 821886 - DNA, 20 bp, mouse
gccgaagcccggcagccgga

SEQ ID NO: 821887 - DNA, 20 bp, mouse
gagccggagggaacatgggg

SEQ ID NO: 821888 - DNA, 20 bp, mouse
gcggcagccggagggaacat

SEQ ID NO: 821889 - DNA, 20 bp, mouse
gaacatggggcggggtctat

SEQ ID NO: 821890 - DNA, 20 bp, mouse
gcggggccacccgagaagac

SEQ ID NO: 821891 - DNA, 20 bp, mouse
gcggtccggccgtcacgcga

SEQ ID NO: 821892 - DNA, 20 bp, mouse
gaccaatccaaaggcgagag

SEQ ID NO: 821893 - DNA, 20 bp, mouse
gccgctgccaattcccggtc

SEQ ID NO: 821894 - DNA, 20 bp, mouse
gcggcgagccccgtcttctc

SEQ ID NO: 821895 - DNA, 20 bp, mouse
gtccacctacgacctggcta

SEQ ID NO: 821896 - DNA, 20 bp, mouse
gggacaaatactgaggaggc

SEQ ID NO: 821897 - DNA, 20 bp, mouse
ggaggaggcgggctgagagg

SEQ ID NO: 821898 - DNA, 20 bp, mouse
gccagggacaaatactgagg

SEQ ID NO: 821899 - DNA, 20 bp, mouse
gtgggtaccaggtttcaatt

SEQ ID NO: 821900 - DNA, 20 bp, mouse
gactggagtagactagtaaa

SEQ ID NO: 821901 - DNA, 20 bp, mouse
gaaagatctagtcaatagat

SEQ ID NO: 821902 - DNA, 20 bp, mouse
gggagcagtgaattggtcag

SEQ ID NO: 821903 - DNA, 20 bp, mouse
gggacaaaggagcagtgaat

SEQ ID NO: 821904 - DNA, 20 bp, mouse
gtctaggagctacaggacaa

SEQ ID NO: 821905 - DNA, 20 bp, mouse
gtgtagggcagagcctttaa

SEQ ID NO: 821906 - DNA, 20 bp, mouse
ggggacaggagcacacgaag

SEQ ID NO: 821907 - DNA, 20 bp, mouse
gtggccaataagcgcaagcc

SEQ ID NO: 821908 - DNA, 20 bp, mouse
ggcacccgagcggccaccgc

SEQ ID NO: 821909 - DNA, 20 bp, mouse
gaaacccagaccgtttccca

SEQ ID NO: 821910 - DNA, 20 bp, mouse
gccaataagcgcaagccagg

SEQ ID NO: 821911 - DNA, 20 bp, mouse
gctcgggtgcgcgcggggtt

SEQ ID NO: 821912 - DNA, 20 bp, mouse
gagcacacgaagtggccgct

SEQ ID NO: 821913 - DNA, 20 bp, mouse
gcagccctgggaaacggtct

SEQ ID NO: 821914 - DNA, 20 bp, mouse
gctcgctccgggcgaggcgc

SEQ ID NO: 821915 - DNA, 20 bp, mouse
ggcaggctcggcaggaccaa

SEQ ID NO: 821916 - DNA, 20 bp, mouse
gtgggaccttagagtgaagg

SEQ ID NO: 821917 - DNA, 20 bp, mouse
gtatcagcgcataggaagtt

SEQ ID NO: 821918 - DNA, 20 bp, mouse
ggggccgaacacctaactct

SEQ ID NO: 821919 - DNA, 20 bp, mouse
ggcccgcattctcttctgga

SEQ ID NO: 821920 - DNA, 20 bp, mouse
gggagtcgctgcaagccctg

SEQ ID NO: 821921 - DNA, 20 bp, mouse
ggcaggggttctgagagcta

SEQ ID NO: 821922 - DNA, 20 bp, mouse
gagttgggaccttagagtga

SEQ ID NO: 821923 - DNA, 20 bp, mouse
gcgggagcctaggcagagat

SEQ ID NO: 821924 - DNA, 20 bp, mouse
gtgcagcccgcattctcttc

SEQ ID NO: 821925 - DNA, 20 bp, mouse
ggagattgggttgttctcgg

SEQ ID NO: 821926 - DNA, 20 bp, mouse
gtcgaggggcggcgagagaa

SEQ ID NO: 821927 - DNA, 20 bp, mouse
gtctcgccgcgaagatcctc

SEQ ID NO: 821928 - DNA, 20 bp, mouse
gtcagtgtgagatccgggga

SEQ ID NO: 821929 - DNA, 20 bp, mouse
gcggaagtgtcggtgtcgag

SEQ ID NO: 821930 - DNA, 20 bp, mouse
gggcgttggctcaaatgggt

SEQ ID NO: 821931 - DNA, 20 bp, mouse
gggtacgtggccgttggcgt

SEQ ID NO: 821932 - DNA, 20 bp, mouse
gacgcaaaatggcagtttag

SEQ ID NO: 821933 - DNA, 20 bp, mouse
gtgtgagatccggggagggt

SEQ ID NO: 821934 - DNA, 20 bp, mouse
gaaaacgggtacgtggccgt

SEQ ID NO: 821935 - DNA, 20 bp, mouse
gcaaatacttgcgagcgctg

SEQ ID NO: 821936 - DNA, 20 bp, mouse
gcatgtgggaggagtaaggt

SEQ ID NO: 821937 - DNA, 20 bp, mouse
gttgtgggacaggaatctaa

SEQ ID NO: 821938 - DNA, 20 bp, mouse
ggctgtggtgtctgagttgt

SEQ ID NO: 821939 - DNA, 20 bp, mouse
ggtgtggtgtggtaaggcag

SEQ ID NO: 821940 - DNA, 20 bp, mouse
gggaacaccgtggttgtggt

SEQ ID NO: 821941 - DNA, 20 bp, mouse
gtggttggctcgatgtggtg

SEQ ID NO: 821942 - DNA, 20 bp, mouse
gggaggagtaaggttggctg

SEQ ID NO: 821943 - DNA, 20 bp, mouse
gaggtggaacaccgtggttg

SEQ ID NO: 821944 - DNA, 20 bp, mouse
gaccctcaggtggaacaccg

SEQ ID NO: 821945 - DNA, 20 bp, mouse
gggtgtctgagttgtgggac

SEQ ID NO: 821946 - DNA, 20 bp, mouse
gagagcgcgcaccgcgcggt

SEQ ID NO: 821947 - DNA, 20 bp, mouse
gcggggccggtgggtgaatg

SEQ ID NO: 821948 - DNA, 20 bp, mouse
ggcgcggtgcgcgctctcat

SEQ ID NO: 821949 - DNA, 20 bp, mouse
ggccagtcgcagaggcgcta

SEQ ID NO: 821950 - DNA, 20 bp, mouse
gtggtgcggggcgggtgcgt

SEQ ID NO: 821951 - DNA, 20 bp, mouse
gcgcgcggcgccagtcgcag

SEQ ID NO: 821952 - DNA, 20 bp, mouse
gggagtgcgccgcccgccat

SEQ ID NO: 821953 - DNA, 20 bp, mouse
gtggccgccgcggggtcctc

SEQ ID NO: 821954 - DNA, 20 bp, mouse
gaccgcgcggtaggctgaga

SEQ ID NO: 821955 - DNA, 20 bp, mouse
gggaggcggggtccgctcaa

SEQ ID NO: 821956 - DNA, 20 bp, mouse
gggaatgcgcaccttggagc

SEQ ID NO: 821957 - DNA, 20 bp, mouse
ggggacagtcgcaggacatg

SEQ ID NO: 821958 - DNA, 20 bp, mouse
gcccctccgggtttgttgtt

SEQ ID NO: 821959 - DNA, 20 bp, mouse
gttggagcaggcacggacac

SEQ ID NO: 821960 - DNA, 20 bp, mouse
ggagcaggcacggacaccgg

SEQ ID NO: 821961 - DNA, 20 bp, mouse
gaaggtgcgcattcccctcc

SEQ ID NO: 821962 - DNA, 20 bp, mouse
gcgctacccaacaacaaacc

SEQ ID NO: 821963 - DNA, 20 bp, mouse
gcggacaccggaggcatggg

SEQ ID NO: 821964 - DNA, 20 bp, mouse
gccaacctccggaggaggaa

SEQ ID NO: 821965 - DNA, 20 bp, mouse
gtacccaacaacaaacccgg

SEQ ID NO: 821966 - DNA, 20 bp, mouse
ggggacccttgaaaggtacg

SEQ ID NO: 821967 - DNA, 20 bp, mouse
gccgctggagcccccttgat

SEQ ID NO: 821968 - DNA, 20 bp, mouse
gtggtcacccatgtattcgg

SEQ ID NO: 821969 - DNA, 20 bp, mouse
gtcccaacgacttgaggctg

SEQ ID NO: 821970 - DNA, 20 bp, mouse
gggaggggcggggctcatag

SEQ ID NO: 821971 - DNA, 20 bp, mouse
gccaagccaggggggatgta

SEQ ID NO: 821972 - DNA, 20 bp, mouse
gagcctcagcctcaagtcgt

SEQ ID NO: 821973 - DNA, 20 bp, mouse
gccgccccagcctaggggag

SEQ ID NO: 821974 - DNA, 20 bp, mouse
ggctccgcccccacgaggcg

SEQ ID NO: 821975 - DNA, 20 bp, mouse
gtgagccccgcccctcccct

SEQ ID NO: 821976 - DNA, 20 bp, mouse
gcataaggatgtagtagctg

SEQ ID NO: 821977 - DNA, 20 bp, mouse
gaaagaattgtgggcactgt

SEQ ID NO: 821978 - DNA, 20 bp, mouse
gccaacagagcatacagatt

SEQ ID NO: 821979 - DNA, 20 bp, mouse
ggacacggccggccagcata

SEQ ID NO: 821980 - DNA, 20 bp, mouse
gaggatgtagtagctggggc

SEQ ID NO: 821981 - DNA, 20 bp, mouse
gtcaacctcaatgcctagag

SEQ ID NO: 821982 - DNA, 20 bp, mouse
gatacagattaggacacggc

SEQ ID NO: 821983 - DNA, 20 bp, mouse
gactacatccttatgctggc

SEQ ID NO: 821984 - DNA, 20 bp, mouse
ggagcatacagattaggaca

SEQ ID NO: 821985 - DNA, 20 bp, mouse
gctagagctatgtggttctg

SEQ ID NO: 821986 - DNA, 20 bp, mouse
gcccctcccccgttcattaa

SEQ ID NO: 821987 - DNA, 20 bp, mouse
gaaaggacaactgactaatc

SEQ ID NO: 821988 - DNA, 20 bp, mouse
gtaatctggaactttatcac

SEQ ID NO: 821989 - DNA, 20 bp, mouse
gactgatgtgacccttccag

SEQ ID NO: 821990 - DNA, 20 bp, mouse
gtcacgtcgcctggtggtat

SEQ ID NO: 821991 - DNA, 20 bp, mouse
gtgtctgtccacctctggaa

SEQ ID NO: 821992 - DNA, 20 bp, mouse
gagtgagtgagctaccgccc

SEQ ID NO: 821993 - DNA, 20 bp, mouse
gctaaccaggaattatcaga

SEQ ID NO: 821994 - DNA, 20 bp, mouse
gcagctcctcctataccacc

SEQ ID NO: 821995 - DNA, 20 bp, mouse
ggatgtgacccttccagagg

SEQ ID NO: 821996 - DNA, 20 bp, mouse
gagccggtgcggtccagggg

SEQ ID NO: 821997 - DNA, 20 bp, mouse
gccccgcccctggaccgcac

SEQ ID NO: 821998 - DNA, 20 bp, mouse
ggggcggggcggggtaggac

SEQ ID NO: 821999 - DNA, 20 bp, mouse
gccgccccgccccggtagtg

SEQ ID NO: 822000 - DNA, 20 bp, mouse
gtgtcgctaccctaggggag

SEQ ID NO: 822001 - DNA, 20 bp, mouse
gacaggggccagggcgaggc

SEQ ID NO: 822002 - DNA, 20 bp, mouse
ggacaaacacaaattccctg

SEQ ID NO: 822003 - DNA, 20 bp, mouse
gcttgagccggtgcggtcca

SEQ ID NO: 822004 - DNA, 20 bp, mouse
gtggagccacactaccgggg

SEQ ID NO: 822005 - DNA, 20 bp, mouse
gggcggggcttgagccggtg

SEQ ID NO: 822006 - DNA, 20 bp, mouse
ggccgccgcgagccggagaa

SEQ ID NO: 822007 - DNA, 20 bp, mouse
ggccgcgagccggagaaagg

SEQ ID NO: 822008 - DNA, 20 bp, mouse
gcgagcccggcgcgtggcgt

SEQ ID NO: 822009 - DNA, 20 bp, mouse
gggcgcgtggcgtggggttg

SEQ ID NO: 822010 - DNA, 20 bp, mouse
gtgaacgctaacgtggtccc

SEQ ID NO: 822011 - DNA, 20 bp, mouse
gaaaggaggaagcgcggacc

SEQ ID NO: 822012 - DNA, 20 bp, mouse
gagcaggtctcccgggtcgc

SEQ ID NO: 822013 - DNA, 20 bp, mouse
gtgcgtagctcaggtagcta

SEQ ID NO: 822014 - DNA, 20 bp, mouse
gaggtctcccgggtcgccgg

SEQ ID NO: 822015 - DNA, 20 bp, mouse
ggggacagggaaatagtgag

SEQ ID NO: 822016 - DNA, 20 bp, mouse
ggggctgtgtgcacaagaat

SEQ ID NO: 822017 - DNA, 20 bp, mouse
gcctggaatgaccaattctg

SEQ ID NO: 822018 - DNA, 20 bp, mouse
gaacagaaagggagtcaagt

SEQ ID NO: 822019 - DNA, 20 bp, mouse
gcttggactcaggagaagta

SEQ ID NO: 822020 - DNA, 20 bp, mouse
gaagctgagagcatccccaa

SEQ ID NO: 822021 - DNA, 20 bp, mouse
gggagacacaagactagcca

SEQ ID NO: 822022 - DNA, 20 bp, mouse
gtggtaaccccaggagagat

SEQ ID NO: 822023 - DNA, 20 bp, mouse
ggggatgctctcagcttcca

SEQ ID NO: 822024 - DNA, 20 bp, mouse
gcagaaggcggggtagaagc

SEQ ID NO: 822025 - DNA, 20 bp, mouse
gccaacctccccttggactc

SEQ ID NO: 822026 - DNA, 20 bp, mouse
gtgtggccggatggtacaaa

SEQ ID NO: 822027 - DNA, 20 bp, mouse
gggcgggagcgcgcacgatg

SEQ ID NO: 822028 - DNA, 20 bp, mouse
gcgccctccagcagcacacc

SEQ ID NO: 822029 - DNA, 20 bp, mouse
gcgggtgtgtcactgcgggc

SEQ ID NO: 822030 - DNA, 20 bp, mouse
ggcagcgcgccgcccggact

SEQ ID NO: 822031 - DNA, 20 bp, mouse
gtggtacaaagggccgccgg

SEQ ID NO: 822032 - DNA, 20 bp, mouse
gccccgcaccctagtccggg

SEQ ID NO: 822033 - DNA, 20 bp, mouse
gcaggaggaccgctgagggt

SEQ ID NO: 822034 - DNA, 20 bp, mouse
gcgcgccccgcaccctagtc

SEQ ID NO: 822035 - DNA, 20 bp, mouse
gaggaggcgcgaccatagag

SEQ ID NO: 822036 - DNA, 20 bp, mouse
gggagctgcggtggaggaat

SEQ ID NO: 822037 - DNA, 20 bp, mouse
gatagcaggagctgcggtgg

SEQ ID NO: 822038 - DNA, 20 bp, mouse
ggaagtattgcacatagcag

SEQ ID NO: 822039 - DNA, 20 bp, mouse
gggaaggcgaaagtgaagca

SEQ ID NO: 822040 - DNA, 20 bp, mouse
gcgaaagtgaagcagggcac

SEQ ID NO: 822041 - DNA, 20 bp, mouse
gaagcagggcacagggtttg

SEQ ID NO: 822042 - DNA, 20 bp, mouse
ggtgactagggcgcggtcaa

SEQ ID NO: 822043 - DNA, 20 bp, mouse
gggcgggcctgaatcaggag

SEQ ID NO: 822044 - DNA, 20 bp, mouse
gagtggggccgagtctgagg

SEQ ID NO: 822045 - DNA, 20 bp, mouse
ggaggggtgggtatcctgta

SEQ ID NO: 822046 - DNA, 20 bp, mouse
gaggctctggtgctccgctg

SEQ ID NO: 822047 - DNA, 20 bp, mouse
gcgggcggagacaggagcac

SEQ ID NO: 822048 - DNA, 20 bp, mouse
gaggggcgagccacctgctc

SEQ ID NO: 822049 - DNA, 20 bp, mouse
gggcgtggttgcaagttagg

SEQ ID NO: 822050 - DNA, 20 bp, mouse
ggggcggggctctgaggagc

SEQ ID NO: 822051 - DNA, 20 bp, mouse
gggctcgcgaaaagttctgc

SEQ ID NO: 822052 - DNA, 20 bp, mouse
gcttggagcgctacacacat

SEQ ID NO: 822053 - DNA, 20 bp, mouse
gctccgctgtggcgctgagg

SEQ ID NO: 822054 - DNA, 20 bp, mouse
gctggagcgctggcccttgt

SEQ ID NO: 822055 - DNA, 20 bp, mouse
gggactttgtgggtgatgcg

SEQ ID NO: 822056 - DNA, 20 bp, mouse
ggggagggaaccctggtccg

SEQ ID NO: 822057 - DNA, 20 bp, mouse
gcgggctgcgccaaggtggg

SEQ ID NO: 822058 - DNA, 20 bp, mouse
gagaaccagacgggagaaat

SEQ ID NO: 822059 - DNA, 20 bp, mouse
ggaagtcaaaagaaccagac

SEQ ID NO: 822060 - DNA, 20 bp, mouse
gtgggaggcacgcggaaggg

SEQ ID NO: 822061 - DNA, 20 bp, mouse
gaaggtgggaggcacgcgga

SEQ ID NO: 822062 - DNA, 20 bp, mouse
ggggagggctataatgggga

SEQ ID NO: 822063 - DNA, 20 bp, mouse
gacgggagaaatgggcattg

SEQ ID NO: 822064 - DNA, 20 bp, mouse
ggagctgagggtgtgcgtaa

SEQ ID NO: 822065 - DNA, 20 bp, mouse
gggcacgcggaagggggggt

SEQ ID NO: 822066 - DNA, 20 bp, mouse
gtgggagcccaagacagctt

SEQ ID NO: 822067 - DNA, 20 bp, mouse
ggtagccggctcccgggcta

SEQ ID NO: 822068 - DNA, 20 bp, mouse
gtcccgggctatggctgggt

SEQ ID NO: 822069 - DNA, 20 bp, mouse
gtggctaggcgctcaggagc

SEQ ID NO: 822070 - DNA, 20 bp, mouse
gagcgtccgcagggggttca

SEQ ID NO: 822071 - DNA, 20 bp, mouse
ggagctatgccaagaggtgt

SEQ ID NO: 822072 - DNA, 20 bp, mouse
gggcgcgcttggcggtgacg

SEQ ID NO: 822073 - DNA, 20 bp, mouse
gccagccacagcgtccgcag

SEQ ID NO: 822074 - DNA, 20 bp, mouse
gccagccatagcccgggagc

SEQ ID NO: 822075 - DNA, 20 bp, mouse
gctcctgcagaacttcaagt

SEQ ID NO: 822076 - DNA, 20 bp, mouse
gctggcgcagacgcggttaa

SEQ ID NO: 822077 - DNA, 20 bp, mouse
gggtgggcggggccctaatg

SEQ ID NO: 822078 - DNA, 20 bp, mouse
ggggccccgcccacccccga

SEQ ID NO: 822079 - DNA, 20 bp, mouse
gtgcctgtgcggcaggggtt

SEQ ID NO: 822080 - DNA, 20 bp, mouse
gtctgcgccagcgcgcgctg

SEQ ID NO: 822081 - DNA, 20 bp, mouse
ggcgcagacgcggttaaagg

SEQ ID NO: 822082 - DNA, 20 bp, mouse
gcgcgcgctggggttactgg

SEQ ID NO: 822083 - DNA, 20 bp, mouse
ggccgcgccgcgccccatta

SEQ ID NO: 822084 - DNA, 20 bp, mouse
gaaacccgagctgccgccgt

SEQ ID NO: 822085 - DNA, 20 bp, mouse
gttctcccggtgctctgaat

SEQ ID NO: 822086 - DNA, 20 bp, mouse
gcaggcagtctcaacccgct

SEQ ID NO: 822087 - DNA, 20 bp, mouse
gtgggctgggtctagtcctg

SEQ ID NO: 822088 - DNA, 20 bp, mouse
gagtggaggggccccactgc

SEQ ID NO: 822089 - DNA, 20 bp, mouse
gctggtgggcggggcttgat

SEQ ID NO: 822090 - DNA, 20 bp, mouse
gtagtcctgtggcttccatt

SEQ ID NO: 822091 - DNA, 20 bp, mouse
ggagactgcctgcccgagcc

SEQ ID NO: 822092 - DNA, 20 bp, mouse
ggatggggggcccagcatga

SEQ ID NO: 822093 - DNA, 20 bp, mouse
gggccaagggagggaccgaa

SEQ ID NO: 822094 - DNA, 20 bp, mouse
gtcctgacagctcgcctagc

SEQ ID NO: 822095 - DNA, 20 bp, mouse
gcaggagattgctagaaacc

SEQ ID NO: 822096 - DNA, 20 bp, mouse
gggcgcgcgaagcggctcat

SEQ ID NO: 822097 - DNA, 20 bp, mouse
gggcgcttggatgccgtgag

SEQ ID NO: 822098 - DNA, 20 bp, mouse
gagccgcttcgcgcgccgat

SEQ ID NO: 822099 - DNA, 20 bp, mouse
gagccaatcggcgcgcgaag

SEQ ID NO: 822100 - DNA, 20 bp, mouse
gtcggggcgcagctcaaaca

SEQ ID NO: 822101 - DNA, 20 bp, mouse
ggggcgcagctcaaacatgg

SEQ ID NO: 822102 - DNA, 20 bp, mouse
ggcgccccgactccacggaa

SEQ ID NO: 822103 - DNA, 20 bp, mouse
gcggtgaggcggtaccaggt

SEQ ID NO: 822104 - DNA, 20 bp, mouse
gcccgactccacggaagggg

SEQ ID NO: 822105 - DNA, 20 bp, mouse
ggggggctgtcgggtgtcat

SEQ ID NO: 822106 - DNA, 20 bp, mouse
ggggagccgccgcgttgcca

SEQ ID NO: 822107 - DNA, 20 bp, mouse
gccggccggaagcgtcgccc

SEQ ID NO: 822108 - DNA, 20 bp, mouse
gcggccgcagccctggggtc

SEQ ID NO: 822109 - DNA, 20 bp, mouse
gcgtcgccctggcaacgcgg

SEQ ID NO: 822110 - DNA, 20 bp, mouse
gtcccggcgacctgacccca

SEQ ID NO: 822111 - DNA, 20 bp, mouse
ggcaacgcggcggctccccg

SEQ ID NO: 822112 - DNA, 20 bp, mouse
gctgcggccgccaggacccg

SEQ ID NO: 822113 - DNA, 20 bp, mouse
gcgcaactctcctgctccgg

SEQ ID NO: 822114 - DNA, 20 bp, mouse
gagccctggggtcaggtcgc

SEQ ID NO: 822115 - DNA, 20 bp, mouse
gtgacgcctagcaacagtcc

SEQ ID NO: 822116 - DNA, 20 bp, mouse
gggccaatccgtaaatcccg

SEQ ID NO: 822117 - DNA, 20 bp, mouse
gccggggctgcgtccaggtc

SEQ ID NO: 822118 - DNA, 20 bp, mouse
gctcccgaagcgggccgaaa

SEQ ID NO: 822119 - DNA, 20 bp, mouse
gtagggttggcggaactaag

SEQ ID NO: 822120 - DNA, 20 bp, mouse
ggacgcagccccgggattta

SEQ ID NO: 822121 - DNA, 20 bp, mouse
ggacgccgccatgttgctcc

SEQ ID NO: 822122 - DNA, 20 bp, mouse
gacatggcggcgtccatgat

SEQ ID NO: 822123 - DNA, 20 bp, mouse
gtcaccgtgtccaggaggta

SEQ ID NO: 822124 - DNA, 20 bp, mouse
gagccccgggatttacggat

SEQ ID NO: 822125 - DNA, 20 bp, mouse
gagcactcacctcccgaagc

SEQ ID NO: 822126 - DNA, 20 bp, mouse
ggggatgacagcagcgagtt

SEQ ID NO: 822127 - DNA, 20 bp, mouse
gggaatcgcggtctgacgcg

SEQ ID NO: 822128 - DNA, 20 bp, mouse
gcccctgggttggagagtag

SEQ ID NO: 822129 - DNA, 20 bp, mouse
gagaccgcgattccgtggga

SEQ ID NO: 822130 - DNA, 20 bp, mouse
gcctccctcccacggaatcg

SEQ ID NO: 822131 - DNA, 20 bp, mouse
gcaacccaggggggcggaac

SEQ ID NO: 822132 - DNA, 20 bp, mouse
gggaggagccaactccttaa

SEQ ID NO: 822133 - DNA, 20 bp, mouse
gaagcgcggaccaatggggc

SEQ ID NO: 822134 - DNA, 20 bp, mouse
ggctccccattggcccgaag

SEQ ID NO: 822135 - DNA, 20 bp, mouse
gtgccggaagcgcggaccaa

SEQ ID NO: 822136 - DNA, 20 bp, mouse
gcggaagaggcctcccgggg

SEQ ID NO: 822137 - DNA, 20 bp, mouse
gaagtgggaacggtgacttc

SEQ ID NO: 822138 - DNA, 20 bp, mouse
gtgggcggaagaggcctccc

SEQ ID NO: 822139 - DNA, 20 bp, mouse
gttccggcagtgccgcaagt

SEQ ID NO: 822140 - DNA, 20 bp, mouse
gttcccacttgcggcactgc

SEQ ID NO: 822141 - DNA, 20 bp, mouse
gccggaaaatcccaacgttt

SEQ ID NO: 822142 - DNA, 20 bp, mouse
gccaaggaaacgctcaattc

SEQ ID NO: 822143 - DNA, 20 bp, mouse
gactgcaaagcgcactagct

SEQ ID NO: 822144 - DNA, 20 bp, mouse
gttaggtccttccagcacaa

SEQ ID NO: 822145 - DNA, 20 bp, mouse
gcggctagtcgtacacgcgc

SEQ ID NO: 822146 - DNA, 20 bp, mouse
ggccctgcctaagtcctcag

SEQ ID NO: 822147 - DNA, 20 bp, mouse
gctccctgcaagcgaggtct

SEQ ID NO: 822148 - DNA, 20 bp, mouse
ggcagggccaggttagagaa

SEQ ID NO: 822149 - DNA, 20 bp, mouse
gcccacgcgggtgcgatcgg

SEQ ID NO: 822150 - DNA, 20 bp, mouse
gggcagcagcggccagtggg

SEQ ID NO: 822151 - DNA, 20 bp, mouse
gagcccagacctcgcttgca

SEQ ID NO: 822152 - DNA, 20 bp, mouse
ggagggacattcatcctcta

SEQ ID NO: 822153 - DNA, 20 bp, mouse
gcagggcggggtcctgtcgc

SEQ ID NO: 822154 - DNA, 20 bp, mouse
gaggcagcggaggaccctcg

SEQ ID NO: 822155 - DNA, 20 bp, mouse
gcggggtcctgtcgctggag

SEQ ID NO: 822156 - DNA, 20 bp, mouse
gcggggctgacgaaacttag

SEQ ID NO: 822157 - DNA, 20 bp, mouse
ggacgccaggagtagaggcg

SEQ ID NO: 822158 - DNA, 20 bp, mouse
gccggggaggagctcactct

SEQ ID NO: 822159 - DNA, 20 bp, mouse
gctgacgaaacttagaggtg

SEQ ID NO: 822160 - DNA, 20 bp, mouse
gcgcctaatagcgactgacg

SEQ ID NO: 822161 - DNA, 20 bp, mouse
gaagacgggaccaatcggac

SEQ ID NO: 822162 - DNA, 20 bp, mouse
gcctctactcctggcgtcta

SEQ ID NO: 822163 - DNA, 20 bp, mouse
ggaccaatcggaccgggaaa

SEQ ID NO: 822164 - DNA, 20 bp, mouse
gcacaccccgagtttcttat

SEQ ID NO: 822165 - DNA, 20 bp, mouse
gcggtgattggcaaaggggt

SEQ ID NO: 822166 - DNA, 20 bp, mouse
ggcggcaggagggggaaatc

SEQ ID NO: 822167 - DNA, 20 bp, mouse
gaggcggagtctagtgacga

SEQ ID NO: 822168 - DNA, 20 bp, mouse
gggaagaaacgctcacaaaa

SEQ ID NO: 822169 - DNA, 20 bp, mouse
ggaaacgctcacaaaaggga

SEQ ID NO: 822170 - DNA, 20 bp, mouse
gaactagctgcaagcaaaaa

SEQ ID NO: 822171 - DNA, 20 bp, mouse
gagtctagtgacgagggcgg

SEQ ID NO: 822172 - DNA, 20 bp, mouse
gcagagagatctggcagaca

SEQ ID NO: 822173 - DNA, 20 bp, mouse
gactcgagctagtagtagtt

SEQ ID NO: 822174 - DNA, 20 bp, mouse
gaatcaggttgggaaggcct

SEQ ID NO: 822175 - DNA, 20 bp, mouse
gtaagacgagggagtcagaa

SEQ ID NO: 822176 - DNA, 20 bp, mouse
gaccacacagcaaacgccta

SEQ ID NO: 822177 - DNA, 20 bp, mouse
gtccggtggagtttcatcat

SEQ ID NO: 822178 - DNA, 20 bp, mouse
gacccatgatgaaactccac

SEQ ID NO: 822179 - DNA, 20 bp, mouse
gaactgtgacgtgtgttctt

SEQ ID NO: 822180 - DNA, 20 bp, mouse
gaacggagaccgctcatcct

SEQ ID NO: 822181 - DNA, 20 bp, mouse
gacgcctagggggagtccgg

SEQ ID NO: 822182 - DNA, 20 bp, mouse
ggtgacgtgtgttcttgggc

SEQ ID NO: 822183 - DNA, 20 bp, mouse
gtgggcagggtctgaggttt

SEQ ID NO: 822184 - DNA, 20 bp, mouse
ggctgggcgcgcacagagtc

SEQ ID NO: 822185 - DNA, 20 bp, mouse
gtaaacatgcaaatgacaga

SEQ ID NO: 822186 - DNA, 20 bp, mouse
gtacccaactgtgagggtgg

SEQ ID NO: 822187 - DNA, 20 bp, mouse
gcggtcagctgaccctctgt

SEQ ID NO: 822188 - DNA, 20 bp, mouse
gacctaggagggcttctgag

SEQ ID NO: 822189 - DNA, 20 bp, mouse
gaggggtggcggtggaagtc

SEQ ID NO: 822190 - DNA, 20 bp, mouse
gacccctccaccctcacagt

SEQ ID NO: 822191 - DNA, 20 bp, mouse
gcctctgtcggatcagacag

SEQ ID NO: 822192 - DNA, 20 bp, mouse
gacaaaggcagtggtaccat

SEQ ID NO: 822193 - DNA, 20 bp, mouse
gccataaaggagagggacct

SEQ ID NO: 822194 - DNA, 20 bp, mouse
ggcctacccaactgtgaggg

SEQ ID NO: 822195 - DNA, 20 bp, mouse
gcaaggcctacccaactgtg

SEQ ID NO: 822196 - DNA, 20 bp, mouse
gcccgagtgtgggtcgcaga

SEQ ID NO: 822197 - DNA, 20 bp, mouse
gcacactcgggcgatgaccc

SEQ ID NO: 822198 - DNA, 20 bp, mouse
gtaaactcgtctggggtcct

SEQ ID NO: 822199 - DNA, 20 bp, mouse
ggggatgccgcggggcgatc

SEQ ID NO: 822200 - DNA, 20 bp, mouse
gactaggtcgagagggagaa

SEQ ID NO: 822201 - DNA, 20 bp, mouse
ggccgcggggcgatcggggt

SEQ ID NO: 822202 - DNA, 20 bp, mouse
ggcaccacgccgccccgcgg

SEQ ID NO: 822203 - DNA, 20 bp, mouse
ggccgtctgcgacccacact

SEQ ID NO: 822204 - DNA, 20 bp, mouse
ggatgtcggaatgtgccact

SEQ ID NO: 822205 - DNA, 20 bp, mouse
gtccacgcacagctagggga

SEQ ID NO: 822206 - DNA, 20 bp, mouse
ggcaactgggcaaacacgat

SEQ ID NO: 822207 - DNA, 20 bp, mouse
gaagggtcacacagtcacta

SEQ ID NO: 822208 - DNA, 20 bp, mouse
ggggctaaggtccaggagtt

SEQ ID NO: 822209 - DNA, 20 bp, mouse
gcaggcacggcaggaggtgg

SEQ ID NO: 822210 - DNA, 20 bp, mouse
gcccagggttatttagttca

SEQ ID NO: 822211 - DNA, 20 bp, mouse
gagacccccaagggctactg

SEQ ID NO: 822212 - DNA, 20 bp, mouse
gaaagaagcccagaccccca

SEQ ID NO: 822213 - DNA, 20 bp, mouse
gggcctctcccaacatgccc

SEQ ID NO: 822214 - DNA, 20 bp, mouse
ggttgggagaggccactact

SEQ ID NO: 822215 - DNA, 20 bp, mouse
gaaagatggcccttgggcta

SEQ ID NO: 822216 - DNA, 20 bp, mouse
gggcgcccagcggtggtagg

SEQ ID NO: 822217 - DNA, 20 bp, mouse
ggcgtggctaatcccggaag

SEQ ID NO: 822218 - DNA, 20 bp, mouse
gaggggcgtgaacgcgccaa

SEQ ID NO: 822219 - DNA, 20 bp, mouse
ggtcccatggtccagaggcg

SEQ ID NO: 822220 - DNA, 20 bp, mouse
gcggtctcttgagaaggctg

SEQ ID NO: 822221 - DNA, 20 bp, mouse
gctcttgtcccatggtccag

SEQ ID NO: 822222 - DNA, 20 bp, mouse
ggaaaatcgctggcgcccag

SEQ ID NO: 822223 - DNA, 20 bp, mouse
ggctggcgcccagcggtggt

SEQ ID NO: 822224 - DNA, 20 bp, mouse
ggctccctctgttgatgctc

SEQ ID NO: 822225 - DNA, 20 bp, mouse
gtccttctcaggaaaatcgc

SEQ ID NO: 822226 - DNA, 20 bp, mouse
gcgccggcgcagcggttcga

SEQ ID NO: 822227 - DNA, 20 bp, mouse
gtggggagaggccctggcgg

SEQ ID NO: 822228 - DNA, 20 bp, mouse
ggaccccggctctccaatgg

SEQ ID NO: 822229 - DNA, 20 bp, mouse
gcgggaccccggctctccaa

SEQ ID NO: 822230 - DNA, 20 bp, mouse
ggccggctgccgggccacgt

SEQ ID NO: 822231 - DNA, 20 bp, mouse
gcggcgggagggttccgggg

SEQ ID NO: 822232 - DNA, 20 bp, mouse
gcaactagcagtgattggtt

SEQ ID NO: 822233 - DNA, 20 bp, mouse
gtggcggcgggagggttccg

SEQ ID NO: 822234 - DNA, 20 bp, mouse
gccccgagcgggttaggttg

SEQ ID NO: 822235 - DNA, 20 bp, mouse
gggctgcaactagcagtgat

SEQ ID NO: 822236 - DNA, 20 bp, mouse
gtgggagaggggtcaacaaa

SEQ ID NO: 822237 - DNA, 20 bp, mouse
gcaacctgcgtctgttagtg

SEQ ID NO: 822238 - DNA, 20 bp, mouse
gagcagccgccttgggagag

SEQ ID NO: 822239 - DNA, 20 bp, mouse
gactagggtgagagagagtt

SEQ ID NO: 822240 - DNA, 20 bp, mouse
gtgggcggagtctgcgggaa

SEQ ID NO: 822241 - DNA, 20 bp, mouse
gcgggaagggcggtgtaggg

SEQ ID NO: 822242 - DNA, 20 bp, mouse
gctgcgggaagggcggtgta

SEQ ID NO: 822243 - DNA, 20 bp, mouse
gtctgttagtggggatgaaa

SEQ ID NO: 822244 - DNA, 20 bp, mouse
gctaacagacgcaggttgca

SEQ ID NO: 822245 - DNA, 20 bp, mouse
gcgtgtcccagtaggctact

SEQ ID NO: 822246 - DNA, 20 bp, mouse
gcctcctcccgcgtctatcc

SEQ ID NO: 822247 - DNA, 20 bp, mouse
gcgagcgaagcgaggattga

SEQ ID NO: 822248 - DNA, 20 bp, mouse
gccagcgcgagcgagttttc

SEQ ID NO: 822249 - DNA, 20 bp, mouse
ggacccagaagcaacgcctg

SEQ ID NO: 822250 - DNA, 20 bp, mouse
gcgttgtcaagctacaccgt

SEQ ID NO: 822251 - DNA, 20 bp, mouse
gctacaccgtaggctgtagg

SEQ ID NO: 822252 - DNA, 20 bp, mouse
gcaagcgtcactcctcatcc

SEQ ID NO: 822253 - DNA, 20 bp, mouse
ggagtgacgcttgctttcgg

SEQ ID NO: 822254 - DNA, 20 bp, mouse
gggaagacgtgcaactaaag

SEQ ID NO: 822255 - DNA, 20 bp, mouse
gcacctccggggctcgtggc

SEQ ID NO: 822256 - DNA, 20 bp, mouse
ggggctgaggtgactaagac

SEQ ID NO: 822257 - DNA, 20 bp, mouse
ggccacggaactcttctcgc

SEQ ID NO: 822258 - DNA, 20 bp, mouse
gttccctcgcaggttggttc

SEQ ID NO: 822259 - DNA, 20 bp, mouse
ggagtgacgtggcatgtaga

SEQ ID NO: 822260 - DNA, 20 bp, mouse
gtacagagactccgtcccct

SEQ ID NO: 822261 - DNA, 20 bp, mouse
gggtaccggccccgcacggc

SEQ ID NO: 822262 - DNA, 20 bp, mouse
gagccggggctcttcaccca

SEQ ID NO: 822263 - DNA, 20 bp, mouse
gcgctctcccggtgtagccg

SEQ ID NO: 822264 - DNA, 20 bp, mouse
gtgaagagccccggctacac

SEQ ID NO: 822265 - DNA, 20 bp, mouse
ggggctcttcacccagggga

SEQ ID NO: 822266 - DNA, 20 bp, mouse
ggcacaaagccccgcgtcta

SEQ ID NO: 822267 - DNA, 20 bp, mouse
ggctcccccgaaaggataga

SEQ ID NO: 822268 - DNA, 20 bp, mouse
ggggtcgcagcgcgcgtgtc

SEQ ID NO: 822269 - DNA, 20 bp, mouse
gcgtctacggctcccccgaa

SEQ ID NO: 822270 - DNA, 20 bp, mouse
gaccccttctatcctttcgg

SEQ ID NO: 822271 - DNA, 20 bp, mouse
ggcgggaggcggggtcccgg

SEQ ID NO: 822272 - DNA, 20 bp, mouse
gcctaggccgcgcgcccttg

SEQ ID NO: 822273 - DNA, 20 bp, mouse
gagagtgcagaactccgcaa

SEQ ID NO: 822274 - DNA, 20 bp, mouse
gcgggggagccgtagacgcg

SEQ ID NO: 822275 - DNA, 20 bp, mouse
ggacgcggggctttgtgccc

SEQ ID NO: 822276 - DNA, 20 bp, mouse
ggggtcgcagcgcgctcgtc

SEQ ID NO: 822277 - DNA, 20 bp, mouse
gctcagtgaaaacctgctcc

SEQ ID NO: 822278 - DNA, 20 bp, mouse
ggggaggcggggtttccgga

SEQ ID NO: 822279 - DNA, 20 bp, mouse
gcgaagtgagcggacaagcc

SEQ ID NO: 822280 - DNA, 20 bp, mouse
ggagcggacaagccaggagc

SEQ ID NO: 822281 - DNA, 20 bp, mouse
gccgcgggaggcggggtttc

SEQ ID NO: 822282 - DNA, 20 bp, mouse
gtacgagtaactgaacaaag

SEQ ID NO: 822283 - DNA, 20 bp, mouse
gaaaaagctctgtgcaagat

SEQ ID NO: 822284 - DNA, 20 bp, mouse
gggcggggtttccggagggg

SEQ ID NO: 822285 - DNA, 20 bp, mouse
ggagctttttcaagtagtat

SEQ ID NO: 822286 - DNA, 20 bp, mouse
gtctaattagatatgtaaat

SEQ ID NO: 822287 - DNA, 20 bp, mouse
gtgtccaatagtatctgttg

SEQ ID NO: 822288 - DNA, 20 bp, mouse
gaattagatatgtaaatggg

SEQ ID NO: 822289 - DNA, 20 bp, mouse
gccaaacttatcttttggac

SEQ ID NO: 822290 - DNA, 20 bp, mouse
ggtattaaagttgcaggttg

SEQ ID NO: 822291 - DNA, 20 bp, mouse
gagctggagttctgtaacgt

SEQ ID NO: 822292 - DNA, 20 bp, mouse
gcataaccaaacttatcttt

SEQ ID NO: 822293 - DNA, 20 bp, mouse
gatgaggatgagtaactgaa

SEQ ID NO: 822294 - DNA, 20 bp, mouse
gtcttctgcacatgctcatg

SEQ ID NO: 822295 - DNA, 20 bp, mouse
gaggaatgtattaaagttgc

SEQ ID NO: 822296 - DNA, 20 bp, mouse
gtgggccgatggtacactga

SEQ ID NO: 822297 - DNA, 20 bp, mouse
gcatccttgcacccagagaa

SEQ ID NO: 822298 - DNA, 20 bp, mouse
gaattcaacccaggaggcgc

SEQ ID NO: 822299 - DNA, 20 bp, mouse
gagagagagcggcactttcc

SEQ ID NO: 822300 - DNA, 20 bp, mouse
gcagaggcccaagacatccg

SEQ ID NO: 822301 - DNA, 20 bp, mouse
gaggctaatccttagaaatg

SEQ ID NO: 822302 - DNA, 20 bp, mouse
gccaagacatccgcggtctg

SEQ ID NO: 822303 - DNA, 20 bp, mouse
ggcctcctgggttgaattcg

SEQ ID NO: 822304 - DNA, 20 bp, mouse
gcaaatctaccaaggatagg

SEQ ID NO: 822305 - DNA, 20 bp, mouse
gacagccacgaattcaaccc

SEQ ID NO: 822306 - DNA, 20 bp, mouse
gcggaagaggatctcgaagt

SEQ ID NO: 822307 - DNA, 20 bp, mouse
ggtggccgggcgacagtctt

SEQ ID NO: 822308 - DNA, 20 bp, mouse
gccaagccgccggcattctg

SEQ ID NO: 822309 - DNA, 20 bp, mouse
gggtctccccagaatgccgg

SEQ ID NO: 822310 - DNA, 20 bp, mouse
ggacccctgtgctccgactg

SEQ ID NO: 822311 - DNA, 20 bp, mouse
gactgtcgcccggccacagt

SEQ ID NO: 822312 - DNA, 20 bp, mouse
gggccacagtcggagcacag

SEQ ID NO: 822313 - DNA, 20 bp, mouse
gcagagctagcgtcagaaat

SEQ ID NO: 822314 - DNA, 20 bp, mouse
gctaatccaaaggtgactgg

SEQ ID NO: 822315 - DNA, 20 bp, mouse
gctcgaagttggctcggcga

SEQ ID NO: 822316 - DNA, 20 bp, mouse
ggggcaggaggcgtgatgtc

SEQ ID NO: 822317 - DNA, 20 bp, mouse
gtgccacagcgccgcctgca

SEQ ID NO: 822318 - DNA, 20 bp, mouse
gcggccgcgcgcctgtccaa

SEQ ID NO: 822319 - DNA, 20 bp, mouse
gaggtgagacaaactgaata

SEQ ID NO: 822320 - DNA, 20 bp, mouse
ggctgcctttccaaagacta

SEQ ID NO: 822321 - DNA, 20 bp, mouse
gcgctctgagaggtcgggag

SEQ ID NO: 822322 - DNA, 20 bp, mouse
gggcctccgctctgagaggt

SEQ ID NO: 822323 - DNA, 20 bp, mouse
gggtacccaagtcacagtcg

SEQ ID NO: 822324 - DNA, 20 bp, mouse
gcacagtcgtggtgatgaca

SEQ ID NO: 822325 - DNA, 20 bp, mouse
gagctccttagtctttggaa

SEQ ID NO: 822326 - DNA, 20 bp, mouse
gggaccgagggatcctgaat

SEQ ID NO: 822327 - DNA, 20 bp, mouse
gcggggtgtacgagagtgga

SEQ ID NO: 822328 - DNA, 20 bp, mouse
ggctccggggtgtacgagag

SEQ ID NO: 822329 - DNA, 20 bp, mouse
gacgccgtgtggggcgtggt

SEQ ID NO: 822330 - DNA, 20 bp, mouse
ggtggagggcaagggaccga

SEQ ID NO: 822331 - DNA, 20 bp, mouse
gcaggcgcgcgacgccgtgt

SEQ ID NO: 822332 - DNA, 20 bp, mouse
gcagagcctaccacctgctc

SEQ ID NO: 822333 - DNA, 20 bp, mouse
gaagccgcgcgctttatggc

SEQ ID NO: 822334 - DNA, 20 bp, mouse
gcagggctccgcagtcagtc

SEQ ID NO: 822335 - DNA, 20 bp, mouse
gcgcgccgggaggaagagct

SEQ ID NO: 822336 - DNA, 20 bp, mouse
gctccccgggttttattaaa

SEQ ID NO: 822337 - DNA, 20 bp, mouse
gtcctgaaggtgttagggac

SEQ ID NO: 822338 - DNA, 20 bp, mouse
gtcactgagccatatttttt

SEQ ID NO: 822339 - DNA, 20 bp, mouse
gttagcaaggcctggtgcct

SEQ ID NO: 822340 - DNA, 20 bp, mouse
gtctcttcctgaaggtgtta

SEQ ID NO: 822341 - DNA, 20 bp, mouse
gtagagaagtctcttcctga

SEQ ID NO: 822342 - DNA, 20 bp, mouse
gtaccacttcttttaagcag

SEQ ID NO: 822343 - DNA, 20 bp, mouse
gaaaccctttaataaaaccc

SEQ ID NO: 822344 - DNA, 20 bp, mouse
gcagtgaacaagcagtgccc

SEQ ID NO: 822345 - DNA, 20 bp, mouse
gcccctctgcttaaaagaag

SEQ ID NO: 822346 - DNA, 20 bp, mouse
gaaaacagagcaggggtgtt

SEQ ID NO: 822347 - DNA, 20 bp, mouse
gggagggggtagtgcactga

SEQ ID NO: 822348 - DNA, 20 bp, mouse
ggggcaaggtatgcagaaca

SEQ ID NO: 822349 - DNA, 20 bp, mouse
gactgtggggaatcagccta

SEQ ID NO: 822350 - DNA, 20 bp, mouse
gcagagcatggggtttaggt

SEQ ID NO: 822351 - DNA, 20 bp, mouse
gctgggccccacaggaacag

SEQ ID NO: 822352 - DNA, 20 bp, mouse
gcttaggggctggactctcc

SEQ ID NO: 822353 - DNA, 20 bp, mouse
ggggtgtttggcttaggggc

SEQ ID NO: 822354 - DNA, 20 bp, mouse
gcagagggagccatcaagct

SEQ ID NO: 822355 - DNA, 20 bp, mouse
gttcctgtggggcccagccg

SEQ ID NO: 822356 - DNA, 20 bp, mouse
ggaggctcgtagcggaagtg

SEQ ID NO: 822357 - DNA, 20 bp, mouse
ggaaaggggcgggaccacgg

SEQ ID NO: 822358 - DNA, 20 bp, mouse
gggagcctgaagagcactgc

SEQ ID NO: 822359 - DNA, 20 bp, mouse
ggccctgagcgggaaagggg

SEQ ID NO: 822360 - DNA, 20 bp, mouse
gcccctatagcgtggagggg

SEQ ID NO: 822361 - DNA, 20 bp, mouse
gtccacccctccacgctata

SEQ ID NO: 822362 - DNA, 20 bp, mouse
gagctcccctatagcgtgga

SEQ ID NO: 822363 - DNA, 20 bp, mouse
gcgcgcgccctgagcgggaa

SEQ ID NO: 822364 - DNA, 20 bp, mouse
gaggacagagtcggcttgag

SEQ ID NO: 822365 - DNA, 20 bp, mouse
gggaccacggaggctcgtag

SEQ ID NO: 822366 - DNA, 20 bp, mouse
gttagcgagtgtattcatat

SEQ ID NO: 822367 - DNA, 20 bp, mouse
ggtggggcgcggggcatcac

SEQ ID NO: 822368 - DNA, 20 bp, mouse
ggggagttgtagtcccttag

SEQ ID NO: 822369 - DNA, 20 bp, mouse
gtagtcccttaggggtatct

SEQ ID NO: 822370 - DNA, 20 bp, mouse
gttagccgagatacccctaa

SEQ ID NO: 822371 - DNA, 20 bp, mouse
gctaagtgcctgatgggagt

SEQ ID NO: 822372 - DNA, 20 bp, mouse
gggctctaggctccacgccg

SEQ ID NO: 822373 - DNA, 20 bp, mouse
ggatgggagttggagttttt

SEQ ID NO: 822374 - DNA, 20 bp, mouse
gcccgcgccccaccacggcg

SEQ ID NO: 822375 - DNA, 20 bp, mouse
gtctcggctaagtgcctgat

SEQ ID NO: 822376 - DNA, 20 bp, mouse
gagggggtgggcaaatgatg

SEQ ID NO: 822377 - DNA, 20 bp, mouse
gaggggtggcacaaaaaaga

SEQ ID NO: 822378 - DNA, 20 bp, mouse
gagggcaggccctgactaga

SEQ ID NO: 822379 - DNA, 20 bp, mouse
gtggaacgcagagtggttca

SEQ ID NO: 822380 - DNA, 20 bp, mouse
gtagctggagacctccgagg

SEQ ID NO: 822381 - DNA, 20 bp, mouse
gaaccggggccgttccccct

SEQ ID NO: 822382 - DNA, 20 bp, mouse
gcggggccgttccccctcgg

SEQ ID NO: 822383 - DNA, 20 bp, mouse
gaggaggccaagagaccgag

SEQ ID NO: 822384 - DNA, 20 bp, mouse
ggcaggccctgactagaggg

SEQ ID NO: 822385 - DNA, 20 bp, mouse
ggtgggcaaatgatggggcg

SEQ ID NO: 822386 - DNA, 20 bp, mouse
ggaaaggtgggtacgatctg

SEQ ID NO: 822387 - DNA, 20 bp, mouse
gacagcataggaaaaatcta

SEQ ID NO: 822388 - DNA, 20 bp, mouse
ggctccagagaggggacaca

SEQ ID NO: 822389 - DNA, 20 bp, mouse
gctcccggggtatgctccca

SEQ ID NO: 822390 - DNA, 20 bp, mouse
ggctccatgtgtcccctctc

SEQ ID NO: 822391 - DNA, 20 bp, mouse
gaggtgggtacgatctgagg

SEQ ID NO: 822392 - DNA, 20 bp, mouse
gacgatctgagggggactgg

SEQ ID NO: 822393 - DNA, 20 bp, mouse
gtagcataggacctccagag

SEQ ID NO: 822394 - DNA, 20 bp, mouse
gacatcgggattgaaagaaa

SEQ ID NO: 822395 - DNA, 20 bp, mouse
gttgtcacgtgtatgataca

SEQ ID NO: 822396 - DNA, 20 bp, mouse
gccctccgccatcttcgcgg

SEQ ID NO: 822397 - DNA, 20 bp, mouse
gcgggcgcactgttggggaa

SEQ ID NO: 822398 - DNA, 20 bp, mouse
ggtagcagccgccgcgaaga

SEQ ID NO: 822399 - DNA, 20 bp, mouse
gcgcagccaggaaaccacga

SEQ ID NO: 822400 - DNA, 20 bp, mouse
ggcgcgccgcccgtccgtcg

SEQ ID NO: 822401 - DNA, 20 bp, mouse
ggcgaagatggcggaggggt

SEQ ID NO: 822402 - DNA, 20 bp, mouse
gcggcgccgtggttgttctc

SEQ ID NO: 822403 - DNA, 20 bp, mouse
gaggcccgggcgcactgttg

SEQ ID NO: 822404 - DNA, 20 bp, mouse
gcggcccctgggagacagcg

SEQ ID NO: 822405 - DNA, 20 bp, mouse
gctccgcatcggaactgcga

SEQ ID NO: 822406 - DNA, 20 bp, mouse
gcggcccgatcgcgtggatc

SEQ ID NO: 822407 - DNA, 20 bp, mouse
ggggcgggcgcaggtatcgg

SEQ ID NO: 822408 - DNA, 20 bp, mouse
gacaccctaagagtacaggc

SEQ ID NO: 822409 - DNA, 20 bp, mouse
ggccgtgccgccgacgtcac

SEQ ID NO: 822410 - DNA, 20 bp, mouse
gcagagcccggggtcccggt

SEQ ID NO: 822411 - DNA, 20 bp, mouse
gtgggtccgcgcgtgatcgc

SEQ ID NO: 822412 - DNA, 20 bp, mouse
gacggagggaagtccctcgc

SEQ ID NO: 822413 - DNA, 20 bp, mouse
gtccccctgcctgtactctt

SEQ ID NO: 822414 - DNA, 20 bp, mouse
gagcccggggtcccggtggg

SEQ ID NO: 822415 - DNA, 20 bp, mouse
gcgggaccccgggctctgtc

SEQ ID NO: 822416 - DNA, 20 bp, mouse
gcgcctcccctcctagcgaa

SEQ ID NO: 822417 - DNA, 20 bp, mouse
ggctaggaggggaggcgagc

SEQ ID NO: 822418 - DNA, 20 bp, mouse
gcgcatgcgcgtcgttctcg

SEQ ID NO: 822419 - DNA, 20 bp, mouse
gtacacccgccccgctccgg

SEQ ID NO: 822420 - DNA, 20 bp, mouse
gatgcgcaagcgcaccaggg

SEQ ID NO: 822421 - DNA, 20 bp, mouse
gcgcatgcgcaagcgcacca

SEQ ID NO: 822422 - DNA, 20 bp, mouse
gtagcgaaaggctgccgccc

SEQ ID NO: 822423 - DNA, 20 bp, mouse
gggaggatgtggggagttga

SEQ ID NO: 822424 - DNA, 20 bp, mouse
ggcagaagggagcccagcgc

SEQ ID NO: 822425 - DNA, 20 bp, mouse
gcggcagcctttcgctagga

SEQ ID NO: 822426 - DNA, 20 bp, mouse
gaagccacaaggaggacctt

SEQ ID NO: 822427 - DNA, 20 bp, mouse
gggcactgcggggaaaggcg

SEQ ID NO: 822428 - DNA, 20 bp, mouse
gcttccgcgcacagagttct

SEQ ID NO: 822429 - DNA, 20 bp, mouse
gaaaaaccccgagtcccgtc

SEQ ID NO: 822430 - DNA, 20 bp, mouse
gagctactcccgggtgttgt

SEQ ID NO: 822431 - DNA, 20 bp, mouse
gcagtgcccgacgggactcg

SEQ ID NO: 822432 - DNA, 20 bp, mouse
gacgcactacggttcccaga

SEQ ID NO: 822433 - DNA, 20 bp, mouse
gcgtcgggcactgcggggaa

SEQ ID NO: 822434 - DNA, 20 bp, mouse
gctgacgcgcaacgctgccc

SEQ ID NO: 822435 - DNA, 20 bp, mouse
gtcgcctaaggtcctccttg

SEQ ID NO: 822436 - DNA, 20 bp, mouse
gggaccaggcaggctgtgta

SEQ ID NO: 822437 - DNA, 20 bp, mouse
ggtacctgatgctgcggata

SEQ ID NO: 822438 - DNA, 20 bp, mouse
gcggatacgggaccagcagg

SEQ ID NO: 822439 - DNA, 20 bp, mouse
gttaggaagcgcgggggaag

SEQ ID NO: 822440 - DNA, 20 bp, mouse
gaatgactgcctttgctctt

SEQ ID NO: 822441 - DNA, 20 bp, mouse
gtctggagtacctgatgctg

SEQ ID NO: 822442 - DNA, 20 bp, mouse
gcggaattgggcgtggccct

SEQ ID NO: 822443 - DNA, 20 bp, mouse
gtaaggactctagataccca

SEQ ID NO: 822444 - DNA, 20 bp, mouse
ggcaaaggcagtcattaatt

SEQ ID NO: 822445 - DNA, 20 bp, mouse
gtcctgtggctggaccaggc

SEQ ID NO: 822446 - DNA, 20 bp, mouse
gacaaaagcccgcaggtctg

SEQ ID NO: 822447 - DNA, 20 bp, mouse
gggaaggcctgcgacgatgg

SEQ ID NO: 822448 - DNA, 20 bp, mouse
gcccgggagtgcgcatgtaa

SEQ ID NO: 822449 - DNA, 20 bp, mouse
gggtcagagtcgcaactctg

SEQ ID NO: 822450 - DNA, 20 bp, mouse
gagagaaggaggggttgctg

SEQ ID NO: 822451 - DNA, 20 bp, mouse
gagtgcgcatgtaagggttg

SEQ ID NO: 822452 - DNA, 20 bp, mouse
gcatgtaagggttgagggga

SEQ ID NO: 822453 - DNA, 20 bp, mouse
ggcctgcgacgatggaggaa

SEQ ID NO: 822454 - DNA, 20 bp, mouse
gccagaagtggggtgggtga

SEQ ID NO: 822455 - DNA, 20 bp, mouse
gaggggaaggcctgcgacga

SEQ ID NO: 822456 - DNA, 20 bp, mouse
gcctacccaggataccttac

SEQ ID NO: 822457 - DNA, 20 bp, mouse
gcacctcttgacctcctcaa

SEQ ID NO: 822458 - DNA, 20 bp, mouse
gtaaaagaatgacgggaaga

SEQ ID NO: 822459 - DNA, 20 bp, mouse
gaggcacgagcacgttcaga

SEQ ID NO: 822460 - DNA, 20 bp, mouse
gtgctcgtgcctacttgaaa

SEQ ID NO: 822461 - DNA, 20 bp, mouse
gcgtgcctacttgaaaagga

SEQ ID NO: 822462 - DNA, 20 bp, mouse
gcgcccttgaggaggtcaag

SEQ ID NO: 822463 - DNA, 20 bp, mouse
gccccagcttctcggagcta

SEQ ID NO: 822464 - DNA, 20 bp, mouse
gtggggacgatggatgtcta

SEQ ID NO: 822465 - DNA, 20 bp, mouse
gcactcccgtaaggtatcct

SEQ ID NO: 822466 - DNA, 20 bp, mouse
gtcaacccgccaggacgcga

SEQ ID NO: 822467 - DNA, 20 bp, mouse
gcgcaggcgcacgcctctaa

SEQ ID NO: 822468 - DNA, 20 bp, mouse
gacgtcaccctccgcacgga

SEQ ID NO: 822469 - DNA, 20 bp, mouse
gcgcgacgtcaccctccgca

SEQ ID NO: 822470 - DNA, 20 bp, mouse
gaagtccctcgcgtcctggc

SEQ ID NO: 822471 - DNA, 20 bp, mouse
gcggcgcactgataccgggg

SEQ ID NO: 822472 - DNA, 20 bp, mouse
gccactgagtccagaatcgt

SEQ ID NO: 822473 - DNA, 20 bp, mouse
gggactttttcccctccgtg

SEQ ID NO: 822474 - DNA, 20 bp, mouse
ggcttctcagcacccgttag

SEQ ID NO: 822475 - DNA, 20 bp, mouse
gtaccaccgcggagcatggt

SEQ ID NO: 822476 - DNA, 20 bp, mouse
gcgcacgcccagagatctcg

SEQ ID NO: 822477 - DNA, 20 bp, mouse
ggggctcggccgggcgggaa

SEQ ID NO: 822478 - DNA, 20 bp, mouse
gaggccgcggtgcgcgcgtc

SEQ ID NO: 822479 - DNA, 20 bp, mouse
gcggcctcgctgccgttcat

SEQ ID NO: 822480 - DNA, 20 bp, mouse
gggtgcgcgcgtcaggccgg

SEQ ID NO: 822481 - DNA, 20 bp, mouse
gtcggccgggcgggaaaggg

SEQ ID NO: 822482 - DNA, 20 bp, mouse
ggtgctgcggggcgggaggt

SEQ ID NO: 822483 - DNA, 20 bp, mouse
gcaccggcggagggggacaa

SEQ ID NO: 822484 - DNA, 20 bp, mouse
gtccccctccgccggtgctg

SEQ ID NO: 822485 - DNA, 20 bp, mouse
gaggctcccgagcccggtca

SEQ ID NO: 822486 - DNA, 20 bp, mouse
gacaccggaagccccgacca

SEQ ID NO: 822487 - DNA, 20 bp, mouse
ggtgcgggattccacgcgga

SEQ ID NO: 822488 - DNA, 20 bp, mouse
gagcgcgcgcagctagggca

SEQ ID NO: 822489 - DNA, 20 bp, mouse
gcgcacgagggtcaaaccta

SEQ ID NO: 822490 - DNA, 20 bp, mouse
gcaggcgcgggtgggtgcac

SEQ ID NO: 822491 - DNA, 20 bp, mouse
gcgcgtggaatcccgcacga

SEQ ID NO: 822492 - DNA, 20 bp, mouse
gacgcggagggcaaggacag

SEQ ID NO: 822493 - DNA, 20 bp, mouse
gaggaacctcggggaaggtg

SEQ ID NO: 822494 - DNA, 20 bp, mouse
gttggcgggaaggaacctcg

SEQ ID NO: 822495 - DNA, 20 bp, mouse
gcaaggcccggattactgtg

SEQ ID NO: 822496 - DNA, 20 bp, mouse
gcgcgctcccgcaactgtcc

SEQ ID NO: 822497 - DNA, 20 bp, mouse
gtctttgctggaggtttcag

SEQ ID NO: 822498 - DNA, 20 bp, mouse
gcgcgcatgcgcccatatcc

SEQ ID NO: 822499 - DNA, 20 bp, mouse
gggcgggcgtgtggaattgt

SEQ ID NO: 822500 - DNA, 20 bp, mouse
gggcgcagccgggacagttg

SEQ ID NO: 822501 - DNA, 20 bp, mouse
gggtgctatgtggagtaagc

SEQ ID NO: 822502 - DNA, 20 bp, mouse
gggtttcagcggctaggtgg

SEQ ID NO: 822503 - DNA, 20 bp, mouse
gcgaactggacgcgtacttc

SEQ ID NO: 822504 - DNA, 20 bp, mouse
gcagttgcgggagcgcgaac

SEQ ID NO: 822505 - DNA, 20 bp, mouse
gcagctgggtgggcgcagcc

SEQ ID NO: 822506 - DNA, 20 bp, mouse
gctcccttggagcacctagc

SEQ ID NO: 822507 - DNA, 20 bp, mouse
ggccactgcccgggcctcta

SEQ ID NO: 822508 - DNA, 20 bp, mouse
gcgccccccgcccgcgtctg

SEQ ID NO: 822509 - DNA, 20 bp, mouse
gcctagctggcctgcagcga

SEQ ID NO: 822510 - DNA, 20 bp, mouse
ggggaagaaagactgaacac

SEQ ID NO: 822511 - DNA, 20 bp, mouse
gtccctagaggcccgggcag

SEQ ID NO: 822512 - DNA, 20 bp, mouse
gcagccgcagacgcgggcgg

SEQ ID NO: 822513 - DNA, 20 bp, mouse
gaaagactgaacacgggcgt

SEQ ID NO: 822514 - DNA, 20 bp, mouse
ggcctgcagcgatgggggat

SEQ ID NO: 822515 - DNA, 20 bp, mouse
gagaaaaagatctcatgaca

SEQ ID NO: 822516 - DNA, 20 bp, mouse
gggaaagcgcgcagtcactg

SEQ ID NO: 822517 - DNA, 20 bp, mouse
gtgcgcaggcgcacctggga

SEQ ID NO: 822518 - DNA, 20 bp, mouse
gagtcactgcggtggggcgg

SEQ ID NO: 822519 - DNA, 20 bp, mouse
gcgcccgccgcgcggtgcgc

SEQ ID NO: 822520 - DNA, 20 bp, mouse
gaagcgcgcagtcactgcgg

SEQ ID NO: 822521 - DNA, 20 bp, mouse
gggagcccgggcattggcgt

SEQ ID NO: 822522 - DNA, 20 bp, mouse
gaagaacgaggctctatgga

SEQ ID NO: 822523 - DNA, 20 bp, mouse
gcgcagtcactgcggtgggg

SEQ ID NO: 822524 - DNA, 20 bp, mouse
gcccgccaaatgctctaccg

SEQ ID NO: 822525 - DNA, 20 bp, mouse
gttacgcaacacggccgaat

SEQ ID NO: 822526 - DNA, 20 bp, mouse
gcgagctcgtcgccgcgtgc

SEQ ID NO: 822527 - DNA, 20 bp, mouse
gcgcgcgctcccagtaaccg

SEQ ID NO: 822528 - DNA, 20 bp, mouse
gagcctgcgccgcctctgat

SEQ ID NO: 822529 - DNA, 20 bp, mouse
ggctgcagccgccatcgccc

SEQ ID NO: 822530 - DNA, 20 bp, mouse
ggcgcgccggccgttccgtc

SEQ ID NO: 822531 - DNA, 20 bp, mouse
gcaggtgggtggggtacgcg

SEQ ID NO: 822532 - DNA, 20 bp, mouse
gccgttccgtcaggtgggtg

SEQ ID NO: 822533 - DNA, 20 bp, mouse
gcgccggccgttccgtcagg

SEQ ID NO: 822534 - DNA, 20 bp, mouse
gtctgcgcggctcgcgggga

SEQ ID NO: 822535 - DNA, 20 bp, mouse
gacccaatcagaggcggcgc

SEQ ID NO: 822536 - DNA, 20 bp, mouse
gcccgcgcaggcacttccgg

SEQ ID NO: 822537 - DNA, 20 bp, mouse
gcccgcttcccgcctggtca

SEQ ID NO: 822538 - DNA, 20 bp, mouse
gccggcggaggggaacggga

SEQ ID NO: 822539 - DNA, 20 bp, mouse
ggccacggcgagctcgcgag

SEQ ID NO: 822540 - DNA, 20 bp, mouse
gcccccccggcggaggggaa

SEQ ID NO: 822541 - DNA, 20 bp, mouse
gcccccgcccctgaccaggc

SEQ ID NO: 822542 - DNA, 20 bp, mouse
gcccctgaccaggcgggaag

SEQ ID NO: 822543 - DNA, 20 bp, mouse
gggcgggggcggggctttac

SEQ ID NO: 822544 - DNA, 20 bp, mouse
ggtggcagcggcacttcccc

SEQ ID NO: 822545 - DNA, 20 bp, mouse
gcgcgcgcccgcttcccgcc

SEQ ID NO: 822546 - DNA, 20 bp, mouse
gggcgagagcagtgggtggt

SEQ ID NO: 822547 - DNA, 20 bp, mouse
gggagccggaagttctagta

SEQ ID NO: 822548 - DNA, 20 bp, mouse
gctcgccaggggtcgcggta

SEQ ID NO: 822549 - DNA, 20 bp, mouse
ggacccctggcgagagcagt

SEQ ID NO: 822550 - DNA, 20 bp, mouse
gcacccactgctctcgccag

SEQ ID NO: 822551 - DNA, 20 bp, mouse
gatacaccgggacacttctt

SEQ ID NO: 822552 - DNA, 20 bp, mouse
gcccgccctactagaacttc

SEQ ID NO: 822553 - DNA, 20 bp, mouse
gcgagcttctggcaccgccc

SEQ ID NO: 822554 - DNA, 20 bp, mouse
gagctcggggaccgcccact

SEQ ID NO: 822555 - DNA, 20 bp, mouse
gacgtcctggcgtcacttcc

SEQ ID NO: 822556 - DNA, 20 bp, mouse
gcccgcgccgcgggccgctc

SEQ ID NO: 822557 - DNA, 20 bp, mouse
gggccgctccggatgtgttg

SEQ ID NO: 822558 - DNA, 20 bp, mouse
ggatggctgcacagcgccag

SEQ ID NO: 822559 - DNA, 20 bp, mouse
gcgggccgccccaacacatc

SEQ ID NO: 822560 - DNA, 20 bp, mouse
gggcgcgtgccgtgcttgct

SEQ ID NO: 822561 - DNA, 20 bp, mouse
gtcgctactgtcatgtcccc

SEQ ID NO: 822562 - DNA, 20 bp, mouse
gggcacaagaacagtttatt

SEQ ID NO: 822563 - DNA, 20 bp, mouse
gcgccccaacacatccggag

SEQ ID NO: 822564 - DNA, 20 bp, mouse
gtcgccgcggccgttcacaa

SEQ ID NO: 822565 - DNA, 20 bp, mouse
gaggcacgactcaaaaggtc

SEQ ID NO: 822566 - DNA, 20 bp, mouse
gactctgcgagcggagcgga

SEQ ID NO: 822567 - DNA, 20 bp, mouse
gtagagcgagactctgcgag

SEQ ID NO: 822568 - DNA, 20 bp, mouse
gcggagggatacgtttccat

SEQ ID NO: 822569 - DNA, 20 bp, mouse
gggcggaaacagcctagagg

SEQ ID NO: 822570 - DNA, 20 bp, mouse
ggagaccgccggaaggccac

SEQ ID NO: 822571 - DNA, 20 bp, mouse
gagcgcgagtagcacggaag

SEQ ID NO: 822572 - DNA, 20 bp, mouse
gacccacagggttcaggaaa

SEQ ID NO: 822573 - DNA, 20 bp, mouse
gaaacagcctagaggcgggg

SEQ ID NO: 822574 - DNA, 20 bp, mouse
gagcctagaggcggggcgga

SEQ ID NO: 822575 - DNA, 20 bp, mouse
ggtcgcgcttatataggcgg

SEQ ID NO: 822576 - DNA, 20 bp, mouse
gcaagcgcacctcgcggcgg

SEQ ID NO: 822577 - DNA, 20 bp, mouse
gtatcctggccctcggtctc

SEQ ID NO: 822578 - DNA, 20 bp, mouse
ggatgcgagcggaaggttcc

SEQ ID NO: 822579 - DNA, 20 bp, mouse
ggcgcaagcgcacctcgcgg

SEQ ID NO: 822580 - DNA, 20 bp, mouse
gggcgctcgggtcccacctc

SEQ ID NO: 822581 - DNA, 20 bp, mouse
gggccaggatagcccagcgc

SEQ ID NO: 822582 - DNA, 20 bp, mouse
gagcggaaggttcccggagg

SEQ ID NO: 822583 - DNA, 20 bp, mouse
gactacagacctgagaccga

SEQ ID NO: 822584 - DNA, 20 bp, mouse
ggcgagcggaaggttcccgg

SEQ ID NO: 822585 - DNA, 20 bp, mouse
ggcactgcattgtgggaacg

SEQ ID NO: 822586 - DNA, 20 bp, mouse
gcctggcttgacatgagtac

SEQ ID NO: 822587 - DNA, 20 bp, mouse
gaatgcttccccaggagctt

SEQ ID NO: 822588 - DNA, 20 bp, mouse
gagttccagaggtgagtcat

SEQ ID NO: 822589 - DNA, 20 bp, mouse
ggaaatttccaaagctcctg

SEQ ID NO: 822590 - DNA, 20 bp, mouse
ggaatatccaatgcttcccc

SEQ ID NO: 822591 - DNA, 20 bp, mouse
gattggatatcacatgtcct

SEQ ID NO: 822592 - DNA, 20 bp, mouse
gatatccaatgactcacctc

SEQ ID NO: 822593 - DNA, 20 bp, mouse
gcagaaattgcaagttccag

SEQ ID NO: 822594 - DNA, 20 bp, mouse
ggacattgtcaaatgctcta

SEQ ID NO: 822595 - DNA, 20 bp, mouse
gggaaaggcaaggatccaaa

SEQ ID NO: 822596 - DNA, 20 bp, mouse
gctgcccagagaggatgagt

SEQ ID NO: 822597 - DNA, 20 bp, mouse
ggcgcccggccgctgactca

SEQ ID NO: 822598 - DNA, 20 bp, mouse
ggggcggcagagcgccacgg

SEQ ID NO: 822599 - DNA, 20 bp, mouse
gggaggggcggcgagtcaag

SEQ ID NO: 822600 - DNA, 20 bp, mouse
gtgagacacgcagggaggga

SEQ ID NO: 822601 - DNA, 20 bp, mouse
gaggtcagagtgagacacgc

SEQ ID NO: 822602 - DNA, 20 bp, mouse
gaagcggctcggggacaggt

SEQ ID NO: 822603 - DNA, 20 bp, mouse
gagggggcggcagagcgcca

SEQ ID NO: 822604 - DNA, 20 bp, mouse
gtggtgactcaggccctccg

SEQ ID NO: 822605 - DNA, 20 bp, mouse
gagagtgagacacgcaggga

SEQ ID NO: 822606 - DNA, 20 bp, mouse
gtggactagggaggtcctga

SEQ ID NO: 822607 - DNA, 20 bp, mouse
gtagttgggctggactaggg

SEQ ID NO: 822608 - DNA, 20 bp, mouse
gtgaagaagagacaagtttt

SEQ ID NO: 822609 - DNA, 20 bp, mouse
gcatcacatctctgtctttt

SEQ ID NO: 822610 - DNA, 20 bp, mouse
ggattagttgggctggacta

SEQ ID NO: 822611 - DNA, 20 bp, mouse
gggcttcaaagtagattagt

SEQ ID NO: 822612 - DNA, 20 bp, mouse
gaagatatcatgtggctgta

SEQ ID NO: 822613 - DNA, 20 bp, mouse
gcagagtttaagatatcatg

SEQ ID NO: 822614 - DNA, 20 bp, mouse
gagtatctaggttcatgaga

SEQ ID NO: 822615 - DNA, 20 bp, mouse
gaaaaagcgatatattttta

SEQ ID NO: 822616 - DNA, 20 bp, mouse
gacgctcactgctgccggtg

SEQ ID NO: 822617 - DNA, 20 bp, mouse
gcatcagcgcagggacgcgg

SEQ ID NO: 822618 - DNA, 20 bp, mouse
ggggcggaccgcggcgggac

SEQ ID NO: 822619 - DNA, 20 bp, mouse
gcccgggccgcgtccctcgc

SEQ ID NO: 822620 - DNA, 20 bp, mouse
gcgagcccccggtcccgccg

SEQ ID NO: 822621 - DNA, 20 bp, mouse
gctaaggtggaactgcccgg

SEQ ID NO: 822622 - DNA, 20 bp, mouse
ggcggcgctaccatcagcgc

SEQ ID NO: 822623 - DNA, 20 bp, mouse
gtgagcgcgtgagggcagcg

SEQ ID NO: 822624 - DNA, 20 bp, mouse
ggtaagacgctcactgctgc

SEQ ID NO: 822625 - DNA, 20 bp, mouse
gtgcccggacgctcaggaaa

SEQ ID NO: 822626 - DNA, 20 bp, mouse
gaggcagtcgcgtaaggcgt

SEQ ID NO: 822627 - DNA, 20 bp, mouse
gcccccgctctgcggagaat

SEQ ID NO: 822628 - DNA, 20 bp, mouse
gtggacgaagagcgcaggcc

SEQ ID NO: 822629 - DNA, 20 bp, mouse
gccggctggacgaagagcgc

SEQ ID NO: 822630 - DNA, 20 bp, mouse
gctgctggcgtctggcgtca

SEQ ID NO: 822631 - DNA, 20 bp, mouse
gcctgggaggcagtcgcgta

SEQ ID NO: 822632 - DNA, 20 bp, mouse
gactgcggacgcactagctc

SEQ ID NO: 822633 - DNA, 20 bp, mouse
gtccgcgcggtatcctgacc

SEQ ID NO: 822634 - DNA, 20 bp, mouse
gcgcaggaggcggtcaaaaa

SEQ ID NO: 822635 - DNA, 20 bp, mouse
gtgtccccgcccccgctctg

SEQ ID NO: 822636 - DNA, 20 bp, mouse
ggggcgggactcctcctccg

SEQ ID NO: 822637 - DNA, 20 bp, mouse
gcagaatgttaggggctgac

SEQ ID NO: 822638 - DNA, 20 bp, mouse
gctcctccgaggattgtggg

SEQ ID NO: 822639 - DNA, 20 bp, mouse
gactcctcctccgaggattg

SEQ ID NO: 822640 - DNA, 20 bp, mouse
gctgacaggaagtgtttttg

SEQ ID NO: 822641 - DNA, 20 bp, mouse
gaagcgctacagaagaaaga

SEQ ID NO: 822642 - DNA, 20 bp, mouse
gaacaatttctcgggcggga

SEQ ID NO: 822643 - DNA, 20 bp, mouse
gcgagtgtctcagcagaggc

SEQ ID NO: 822644 - DNA, 20 bp, mouse
gcccggcagcccttgcggac

SEQ ID NO: 822645 - DNA, 20 bp, mouse
gagtgctggcattattaaag

SEQ ID NO: 822646 - DNA, 20 bp, mouse
gggcgcgtgcggggctcggg

SEQ ID NO: 822647 - DNA, 20 bp, mouse
gccgcctggacagaagttcc

SEQ ID NO: 822648 - DNA, 20 bp, mouse
ggggctctgcgtgtccggtg

SEQ ID NO: 822649 - DNA, 20 bp, mouse
gtgccgccggctgatgtcgc

SEQ ID NO: 822650 - DNA, 20 bp, mouse
gggggccactaccggagcga

SEQ ID NO: 822651 - DNA, 20 bp, mouse
ggccactaccggagcgaggg

SEQ ID NO: 822652 - DNA, 20 bp, mouse
gtgcgtgtccggtgagggag

SEQ ID NO: 822653 - DNA, 20 bp, mouse
ggatcaacgatgccacctgt

SEQ ID NO: 822654 - DNA, 20 bp, mouse
gaccgccagcggctcgcttc

SEQ ID NO: 822655 - DNA, 20 bp, mouse
gtcctggcacttctaaattg

SEQ ID NO: 822656 - DNA, 20 bp, mouse
gagggaggagactgccgctt

SEQ ID NO: 822657 - DNA, 20 bp, mouse
gcgcgctccggcaggccgga

SEQ ID NO: 822658 - DNA, 20 bp, mouse
gagggcggagctctggcgtg

SEQ ID NO: 822659 - DNA, 20 bp, mouse
gggagcgcggcggagaggga

SEQ ID NO: 822660 - DNA, 20 bp, mouse
gagggggagcgcggcggaga

SEQ ID NO: 822661 - DNA, 20 bp, mouse
ggtggggcggccaatggtgg

SEQ ID NO: 822662 - DNA, 20 bp, mouse
gtcagtctcgcgcgttgcca

SEQ ID NO: 822663 - DNA, 20 bp, mouse
gtagcgcccgggttcggagg

SEQ ID NO: 822664 - DNA, 20 bp, mouse
gctccggcaggccggaggga

SEQ ID NO: 822665 - DNA, 20 bp, mouse
gcccccctagcgcccgggtt

SEQ ID NO: 822666 - DNA, 20 bp, mouse
ggggtggggcggtgactcga

SEQ ID NO: 822667 - DNA, 20 bp, mouse
gccggggcacgagcgggcag

SEQ ID NO: 822668 - DNA, 20 bp, mouse
ggctcgcggaggaggcgcag

SEQ ID NO: 822669 - DNA, 20 bp, mouse
gccccggccggggcacgagc

SEQ ID NO: 822670 - DNA, 20 bp, mouse
ggcggtgactcgaggggctc

SEQ ID NO: 822671 - DNA, 20 bp, mouse
ggccccgcgacggacggccg

SEQ ID NO: 822672 - DNA, 20 bp, mouse
gctggcgcggccgtgctgac

SEQ ID NO: 822673 - DNA, 20 bp, mouse
gccgccgcggccgtccgtcg

SEQ ID NO: 822674 - DNA, 20 bp, mouse
gctgccggggcagccacgtt

SEQ ID NO: 822675 - DNA, 20 bp, mouse
ggaggggctcgggcgtggac

SEQ ID NO: 822676 - DNA, 20 bp, mouse
gcgcacgcgcagagcccgcg

SEQ ID NO: 822677 - DNA, 20 bp, mouse
gggctcgcagagagtgtcct

SEQ ID NO: 822678 - DNA, 20 bp, mouse
gggcggcactgcccaccaat

SEQ ID NO: 822679 - DNA, 20 bp, mouse
gcgggcttgaatatctttgg

SEQ ID NO: 822680 - DNA, 20 bp, mouse
gcgcgcagagcccgcggggg

SEQ ID NO: 822681 - DNA, 20 bp, mouse
gacagcccgcagcgctgtat

SEQ ID NO: 822682 - DNA, 20 bp, mouse
ggctcccagcgcgcgcgcgg

SEQ ID NO: 822683 - DNA, 20 bp, mouse
gttggtgcgcagcctattgg

SEQ ID NO: 822684 - DNA, 20 bp, mouse
gtcccgggcttgaatatctt

SEQ ID NO: 822685 - DNA, 20 bp, mouse
gcctgggagtagaatgtcat

SEQ ID NO: 822686 - DNA, 20 bp, mouse
gtgggagtggacagattttg

SEQ ID NO: 822687 - DNA, 20 bp, mouse
ggtgctcagagatgcttatg

SEQ ID NO: 822688 - DNA, 20 bp, mouse
ggactgaggggtcaaggctt

SEQ ID NO: 822689 - DNA, 20 bp, mouse
gggccgcctccctccagtgt

SEQ ID NO: 822690 - DNA, 20 bp, mouse
ggcggccagccaggctccag

SEQ ID NO: 822691 - DNA, 20 bp, mouse
gtgcctggctggacaataag

SEQ ID NO: 822692 - DNA, 20 bp, mouse
gggatgcagcaggggacagg

SEQ ID NO: 822693 - DNA, 20 bp, mouse
gtaccacagtgggtgacaaa

SEQ ID NO: 822694 - DNA, 20 bp, mouse
gaggagggagagaggctgca

SEQ ID NO: 822695 - DNA, 20 bp, mouse
gaggggtcaaggcttcggtc

SEQ ID NO: 822696 - DNA, 20 bp, mouse
gagggcgtggcctccgtcgt

SEQ ID NO: 822697 - DNA, 20 bp, mouse
gaggccacgccctcttccgg

SEQ ID NO: 822698 - DNA, 20 bp, mouse
gcaagaccgccaccggaaga

SEQ ID NO: 822699 - DNA, 20 bp, mouse
gaggctggactgtgcattag

SEQ ID NO: 822700 - DNA, 20 bp, mouse
gctcccggcaagaccgccac

SEQ ID NO: 822701 - DNA, 20 bp, mouse
gcgggcgctcggcgcctacc

SEQ ID NO: 822702 - DNA, 20 bp, mouse
ggggaggtgaggacgagagt

SEQ ID NO: 822703 - DNA, 20 bp, mouse
gtggctccggcaagccgggt

SEQ ID NO: 822704 - DNA, 20 bp, mouse
ggggcggggcacgtcctgac

SEQ ID NO: 822705 - DNA, 20 bp, mouse
gctgtgcgccacgcccacga

SEQ ID NO: 822706 - DNA, 20 bp, mouse
gcccgccccaggccggtcac

SEQ ID NO: 822707 - DNA, 20 bp, mouse
gccaacgcctgcaccaccaa

SEQ ID NO: 822708 - DNA, 20 bp, mouse
gggactccggagccggggaa

SEQ ID NO: 822709 - DNA, 20 bp, mouse
gctgcccgcgagtctagcgg

SEQ ID NO: 822710 - DNA, 20 bp, mouse
ggagtctagcggcggaggag

SEQ ID NO: 822711 - DNA, 20 bp, mouse
gagtggacgtgaccgcgcgg

SEQ ID NO: 822712 - DNA, 20 bp, mouse
gtagactcgcgggcagcgta

SEQ ID NO: 822713 - DNA, 20 bp, mouse
gcccgcgagtctagcggcgg

SEQ ID NO: 822714 - DNA, 20 bp, mouse
gatgcgcatgcgccagtgac

SEQ ID NO: 822715 - DNA, 20 bp, mouse
gcatgcgccagtgaccggcc

SEQ ID NO: 822716 - DNA, 20 bp, mouse
gcgcctgagccgagccccat

SEQ ID NO: 822717 - DNA, 20 bp, mouse
gagcccatggggctcggctc

SEQ ID NO: 822718 - DNA, 20 bp, mouse
gggcggctgagacagaaata

SEQ ID NO: 822719 - DNA, 20 bp, mouse
gcccgcttgctgtgttatct

SEQ ID NO: 822720 - DNA, 20 bp, mouse
gttggcatggagagggcagg

SEQ ID NO: 822721 - DNA, 20 bp, mouse
gaaaaactccatcccaaaga

SEQ ID NO: 822722 - DNA, 20 bp, mouse
gagggggtgtgtctcgaaca

SEQ ID NO: 822723 - DNA, 20 bp, mouse
gcctggctccacaaagaaat

SEQ ID NO: 822724 - DNA, 20 bp, mouse
gccatgggctctgtttccca

SEQ ID NO: 822725 - DNA, 20 bp, mouse
gctcagaggaacaacacatc

SEQ ID NO: 822726 - DNA, 20 bp, mouse
gagccgcaggggcagcagta

SEQ ID NO: 822727 - DNA, 20 bp, mouse
gtcgagagctgacccgggag

SEQ ID NO: 822728 - DNA, 20 bp, mouse
gaaccgagggtcctgatctg

SEQ ID NO: 822729 - DNA, 20 bp, mouse
gtgtccccgctgcgcggcgt

SEQ ID NO: 822730 - DNA, 20 bp, mouse
gcccgcttccggcaacttaa

SEQ ID NO: 822731 - DNA, 20 bp, mouse
ggagctgacccgggagggga

SEQ ID NO: 822732 - DNA, 20 bp, mouse
gaaggcagccagccaaccga

SEQ ID NO: 822733 - DNA, 20 bp, mouse
ggggagaggcggttgctgac

SEQ ID NO: 822734 - DNA, 20 bp, mouse
gcgcgcgccgaggggagagg

SEQ ID NO: 822735 - DNA, 20 bp, mouse
ggcgtggggcgagctggcca

SEQ ID NO: 822736 - DNA, 20 bp, mouse
ggcgctagaggcgtggtcaa

SEQ ID NO: 822737 - DNA, 20 bp, mouse
gttactgggtgcagcaagaa

SEQ ID NO: 822738 - DNA, 20 bp, mouse
gtgaaccgagaccgcagggg

SEQ ID NO: 822739 - DNA, 20 bp, mouse
gggccccgcccctgcggtct

SEQ ID NO: 822740 - DNA, 20 bp, mouse
gcctctagcgcggtcggggc

SEQ ID NO: 822741 - DNA, 20 bp, mouse
gcccgaccgcgctagaggcg

SEQ ID NO: 822742 - DNA, 20 bp, mouse
gaccacgcctctagcgcggt

SEQ ID NO: 822743 - DNA, 20 bp, mouse
gagctggtaccgagcgacag

SEQ ID NO: 822744 - DNA, 20 bp, mouse
gagaggcgtggtcaagggcg

SEQ ID NO: 822745 - DNA, 20 bp, mouse
gagctgaaccgagaccgcag

SEQ ID NO: 822746 - DNA, 20 bp, mouse
ggatgggcagatctatctag

SEQ ID NO: 822747 - DNA, 20 bp, mouse
gggacctctaagagagttga

SEQ ID NO: 822748 - DNA, 20 bp, mouse
gcacggagggaaatcgttcc

SEQ ID NO: 822749 - DNA, 20 bp, mouse
gaagttgtcctaggtcacgg

SEQ ID NO: 822750 - DNA, 20 bp, mouse
gagatagatctgcccatcta

SEQ ID NO: 822751 - DNA, 20 bp, mouse
gacactcagtgtggtctgga

SEQ ID NO: 822752 - DNA, 20 bp, mouse
gggccccaaggatcgaatgc

SEQ ID NO: 822753 - DNA, 20 bp, mouse
gcgtatgatgccaaggcatg

SEQ ID NO: 822754 - DNA, 20 bp, mouse
ggttcttagatgccttagat

SEQ ID NO: 822755 - DNA, 20 bp, mouse
ggagatggcagtaaaggata

SEQ ID NO: 822756 - DNA, 20 bp, mouse
ggaggccgagggtgtggcgg

SEQ ID NO: 822757 - DNA, 20 bp, mouse
ggccgccaccgccacaccct

SEQ ID NO: 822758 - DNA, 20 bp, mouse
gaggccggggaaaggttgtc

SEQ ID NO: 822759 - DNA, 20 bp, mouse
gcgcgggctggtgaacgtca

SEQ ID NO: 822760 - DNA, 20 bp, mouse
gggcctagagtcgcagtcat

SEQ ID NO: 822761 - DNA, 20 bp, mouse
gctagagtcgcagtcatcgg

SEQ ID NO: 822762 - DNA, 20 bp, mouse
gactgggcgggtctgttttg

SEQ ID NO: 822763 - DNA, 20 bp, mouse
gggacagtgatggaggccga

SEQ ID NO: 822764 - DNA, 20 bp, mouse
gatggaggccgagggtgtgg

SEQ ID NO: 822765 - DNA, 20 bp, mouse
ggcactgcccacaaagcgcg

SEQ ID NO: 822766 - DNA, 20 bp, mouse
gcacagggacctggcgccca

SEQ ID NO: 822767 - DNA, 20 bp, mouse
gtggcaggagggggacccga

SEQ ID NO: 822768 - DNA, 20 bp, mouse
ggcgccaggtccctgtgcgt

SEQ ID NO: 822769 - DNA, 20 bp, mouse
ggctggcattcccatcacac

SEQ ID NO: 822770 - DNA, 20 bp, mouse
gggaaacaaaaaagtaaagc

SEQ ID NO: 822771 - DNA, 20 bp, mouse
gcaggagggggacccgaggg

SEQ ID NO: 822772 - DNA, 20 bp, mouse
gtcgccaactgccaacgcac

SEQ ID NO: 822773 - DNA, 20 bp, mouse
gccaaccgacaaggaagaaa

SEQ ID NO: 822774 - DNA, 20 bp, mouse
gactgaatccaaaatgggct

SEQ ID NO: 822775 - DNA, 20 bp, mouse
ggtccctgtgcgttggcagt

SEQ ID NO: 822776 - DNA, 20 bp, mouse
gtagccctgcagtttttgga

SEQ ID NO: 822777 - DNA, 20 bp, mouse
gccaccctccaaaaactgca

SEQ ID NO: 822778 - DNA, 20 bp, mouse
gcccctcagctcaggtgcac

SEQ ID NO: 822779 - DNA, 20 bp, mouse
ggcacctgagctgaggggac

SEQ ID NO: 822780 - DNA, 20 bp, mouse
gaacaccataataaaggcaa

SEQ ID NO: 822781 - DNA, 20 bp, mouse
gtctctagccctgcagtttt

SEQ ID NO: 822782 - DNA, 20 bp, mouse
gaagggtggaataagagcgg

SEQ ID NO: 822783 - DNA, 20 bp, mouse
gaggcccatctgtgcagcct

SEQ ID NO: 822784 - DNA, 20 bp, mouse
ggggccctcagaaaaaccac

SEQ ID NO: 822785 - DNA, 20 bp, mouse
gtgaaaggatccaggaagat

SEQ ID NO: 822786 - DNA, 20 bp, mouse
gggccgggagatcacgtggc

SEQ ID NO: 822787 - DNA, 20 bp, mouse
gcgcttagaggccacgtcga

SEQ ID NO: 822788 - DNA, 20 bp, mouse
gcgccggccacgtgatctcc

SEQ ID NO: 822789 - DNA, 20 bp, mouse
gtgcgggccgggagatcacg

SEQ ID NO: 822790 - DNA, 20 bp, mouse
gccggcggtggcggggacca

SEQ ID NO: 822791 - DNA, 20 bp, mouse
gggctctcgcgggagcccgt

SEQ ID NO: 822792 - DNA, 20 bp, mouse
gatcacgtggccggcggtgg

SEQ ID NO: 822793 - DNA, 20 bp, mouse
ggcctctaagcgcccagggg

SEQ ID NO: 822794 - DNA, 20 bp, mouse
ggctttgaggggccaaggag

SEQ ID NO: 822795 - DNA, 20 bp, mouse
gccttggcccctcaaagcaa

SEQ ID NO: 822796 - DNA, 20 bp, mouse
gcccaccttcccctttatgg

SEQ ID NO: 822797 - DNA, 20 bp, mouse
ggggtatcagccgccataaa

SEQ ID NO: 822798 - DNA, 20 bp, mouse
gatggcggctgataccccaa

SEQ ID NO: 822799 - DNA, 20 bp, mouse
gtcagccgccataaagggga

SEQ ID NO: 822800 - DNA, 20 bp, mouse
ggcctccgaaagaccggaaa

SEQ ID NO: 822801 - DNA, 20 bp, mouse
gtccctgggccacagacaac

SEQ ID NO: 822802 - DNA, 20 bp, mouse
gtggcccagggaggcgtttg

SEQ ID NO: 822803 - DNA, 20 bp, mouse
gggaaagagtcaaggactct

SEQ ID NO: 822804 - DNA, 20 bp, mouse
gaacagaggggttttccatg

SEQ ID NO: 822805 - DNA, 20 bp, mouse
gggaggctgacgttgttttc

SEQ ID NO: 822806 - DNA, 20 bp, mouse
ggaggcgccacgtaccctga

SEQ ID NO: 822807 - DNA, 20 bp, mouse
gcaagcgtcgaggtacgatt

SEQ ID NO: 822808 - DNA, 20 bp, mouse
gaagacttccgcatccttca

SEQ ID NO: 822809 - DNA, 20 bp, mouse
gacccgtcagcgcaacgcgg

SEQ ID NO: 822810 - DNA, 20 bp, mouse
gcccgaagcagcgtaccctg

SEQ ID NO: 822811 - DNA, 20 bp, mouse
ggggtacgctgcttcgggat

SEQ ID NO: 822812 - DNA, 20 bp, mouse
gcgtcagcgcaacgcggagg

SEQ ID NO: 822813 - DNA, 20 bp, mouse
gtgcgctgacgggtcgcggg

SEQ ID NO: 822814 - DNA, 20 bp, mouse
gcgttgcgctgacgggtcgc

SEQ ID NO: 822815 - DNA, 20 bp, mouse
gctcgacgcttgtgaaacga

SEQ ID NO: 822816 - DNA, 20 bp, mouse
gagaaggagggaagtgcgac

SEQ ID NO: 822817 - DNA, 20 bp, mouse
ggcactgttccgccatcttg

SEQ ID NO: 822818 - DNA, 20 bp, mouse
gagtgctctaggcaccggaa

SEQ ID NO: 822819 - DNA, 20 bp, mouse
gcgcacgcgcacagtcacac

SEQ ID NO: 822820 - DNA, 20 bp, mouse
gggaacagtgctctaggcac

SEQ ID NO: 822821 - DNA, 20 bp, mouse
ggggaccctggctagggaag

SEQ ID NO: 822822 - DNA, 20 bp, mouse
ggcacccaatcgtgcgtcgg

SEQ ID NO: 822823 - DNA, 20 bp, mouse
ggttccgccatcttggggag

SEQ ID NO: 822824 - DNA, 20 bp, mouse
gagcgagaaatccggggtat

SEQ ID NO: 822825 - DNA, 20 bp, mouse
gaggaagcgcgacgcgtaag

SEQ ID NO: 822826 - DNA, 20 bp, mouse
gcgtcggcactccccctggt

SEQ ID NO: 822827 - DNA, 20 bp, mouse
gaaaccgcataatttccctt

SEQ ID NO: 822828 - DNA, 20 bp, mouse
gggcgaatgtacccgttggt

SEQ ID NO: 822829 - DNA, 20 bp, mouse
gagagcgtcggcactccccc

SEQ ID NO: 822830 - DNA, 20 bp, mouse
gtaaagcgagaggcttgcta

SEQ ID NO: 822831 - DNA, 20 bp, mouse
gtcgcgcacggaccatagag

SEQ ID NO: 822832 - DNA, 20 bp, mouse
ggtacattcgcctagagcgt

SEQ ID NO: 822833 - DNA, 20 bp, mouse
gtctaggcgaatgtacccgt

SEQ ID NO: 822834 - DNA, 20 bp, mouse
gcacgcgggaaaagcttccc

SEQ ID NO: 822835 - DNA, 20 bp, mouse
gcatcatccgggccgaccaa

SEQ ID NO: 822836 - DNA, 20 bp, mouse
gtgaccctgacctacgggct

SEQ ID NO: 822837 - DNA, 20 bp, mouse
gcggctggtggccagagcta

SEQ ID NO: 822838 - DNA, 20 bp, mouse
gcagccgagcccgtaggtca

SEQ ID NO: 822839 - DNA, 20 bp, mouse
gtggcgctttagtcaaaggg

SEQ ID NO: 822840 - DNA, 20 bp, mouse
gtatctgaggcaagtagaaa

SEQ ID NO: 822841 - DNA, 20 bp, mouse
gtgggaggcggggccgtagt

SEQ ID NO: 822842 - DNA, 20 bp, mouse
gtgtggaaagacaaccctga

SEQ ID NO: 822843 - DNA, 20 bp, mouse
gtggtacccaaccatagctc

SEQ ID NO: 822844 - DNA, 20 bp, mouse
gcacatgtggtagctgaggg

SEQ ID NO: 822845 - DNA, 20 bp, mouse
gcggccccgcctcccacatg

SEQ ID NO: 822846 - DNA, 20 bp, mouse
gaccgtggagagctccatag

SEQ ID NO: 822847 - DNA, 20 bp, mouse
ggaggcgacacgatctaaag

SEQ ID NO: 822848 - DNA, 20 bp, mouse
gcaatcacagaagtgagggg

SEQ ID NO: 822849 - DNA, 20 bp, mouse
gagaaagcctgcacccacgc

SEQ ID NO: 822850 - DNA, 20 bp, mouse
gtaaaagcactggtgagatc

SEQ ID NO: 822851 - DNA, 20 bp, mouse
gaaatcaatcacagaagtga

SEQ ID NO: 822852 - DNA, 20 bp, mouse
gagatctgggggcgcctcct

SEQ ID NO: 822853 - DNA, 20 bp, mouse
gtaatggtgcgtaaaagcac

SEQ ID NO: 822854 - DNA, 20 bp, mouse
gcatgtgcctgcgtgggtgc

SEQ ID NO: 822855 - DNA, 20 bp, mouse
gtctctgacgtcagccaagg

SEQ ID NO: 822856 - DNA, 20 bp, mouse
ggaccacagtggtgtgttaa

SEQ ID NO: 822857 - DNA, 20 bp, mouse
gtctgcagcagggagtgttc

SEQ ID NO: 822858 - DNA, 20 bp, mouse
gtctgctgttgatattccta

SEQ ID NO: 822859 - DNA, 20 bp, mouse
gaatagcggtatgagcacga

SEQ ID NO: 822860 - DNA, 20 bp, mouse
gactgccccaggaacctgcc

SEQ ID NO: 822861 - DNA, 20 bp, mouse
gacggcgccaggcaggttcc

SEQ ID NO: 822862 - DNA, 20 bp, mouse
gtgcgtgggcacttgtgcag

SEQ ID NO: 822863 - DNA, 20 bp, mouse
gtgcccacgcaaacactaag

SEQ ID NO: 822864 - DNA, 20 bp, mouse
gctttgttagagagtcgcaa

SEQ ID NO: 822865 - DNA, 20 bp, mouse
gggaaccctaaggaaaacta

SEQ ID NO: 822866 - DNA, 20 bp, mouse
gcacgcgcgccctcataggg

SEQ ID NO: 822867 - DNA, 20 bp, mouse
gccctcatagggaggagtcg

SEQ ID NO: 822868 - DNA, 20 bp, mouse
gcgtggggaagtgtgcccag

SEQ ID NO: 822869 - DNA, 20 bp, mouse
gcagaccgagtcactgaaat

SEQ ID NO: 822870 - DNA, 20 bp, mouse
gaagccacgcgcgccctcat

SEQ ID NO: 822871 - DNA, 20 bp, mouse
ggaaaacctgcgggtggccc

SEQ ID NO: 822872 - DNA, 20 bp, mouse
gtggcccggggcctccagtt

SEQ ID NO: 822873 - DNA, 20 bp, mouse
gaggtctgctgtcttatcct

SEQ ID NO: 822874 - DNA, 20 bp, mouse
gtccgcctgccgggtcctgt

SEQ ID NO: 822875 - DNA, 20 bp, mouse
gcagctgcctggaatttgtt

SEQ ID NO: 822876 - DNA, 20 bp, mouse
ggggaagaggaactgagcac

SEQ ID NO: 822877 - DNA, 20 bp, mouse
gaggggccgcaggttagggg

SEQ ID NO: 822878 - DNA, 20 bp, mouse
gtgggtggctgaaatctccc

SEQ ID NO: 822879 - DNA, 20 bp, mouse
gaacctgcggcccctcagtc

SEQ ID NO: 822880 - DNA, 20 bp, mouse
gacagcaggtgccagactga

SEQ ID NO: 822881 - DNA, 20 bp, mouse
gctgaggggccgcaggttag

SEQ ID NO: 822882 - DNA, 20 bp, mouse
gagagagccagcagacgcgg

SEQ ID NO: 822883 - DNA, 20 bp, mouse
gccagcagacgcggggggtg

SEQ ID NO: 822884 - DNA, 20 bp, mouse
ggaactgagcaccggacagc

SEQ ID NO: 822885 - DNA, 20 bp, mouse
gggcctccgcccctaacctg

SEQ ID NO: 822886 - DNA, 20 bp, mouse
gggcaaaggcacctgaggtt

SEQ ID NO: 822887 - DNA, 20 bp, mouse
ggttgggcgcgcgaagggaa

SEQ ID NO: 822888 - DNA, 20 bp, mouse
gagatctagcggcacacggt

SEQ ID NO: 822889 - DNA, 20 bp, mouse
gccttcgcgcgcccaacctc

SEQ ID NO: 822890 - DNA, 20 bp, mouse
ggaaactggcaacatggcag

SEQ ID NO: 822891 - DNA, 20 bp, mouse
gcccccgcgcacttcttagg

SEQ ID NO: 822892 - DNA, 20 bp, mouse
gcgggcaaatggagctcccg

SEQ ID NO: 822893 - DNA, 20 bp, mouse
ggggcccccgcgcacttctt

SEQ ID NO: 822894 - DNA, 20 bp, mouse
gaacatggcagaggtggcgc

SEQ ID NO: 822895 - DNA, 20 bp, mouse
gttgcccgaagagctcttgt

SEQ ID NO: 822896 - DNA, 20 bp, mouse
gtggccgagagcctccggtg

SEQ ID NO: 822897 - DNA, 20 bp, mouse
ggggtcggggcattagagtc

SEQ ID NO: 822898 - DNA, 20 bp, mouse
gcgagagcctccggtggggt

SEQ ID NO: 822899 - DNA, 20 bp, mouse
gtagaaagggcgagctccca

SEQ ID NO: 822900 - DNA, 20 bp, mouse
gagggcgagctcccatggcc

SEQ ID NO: 822901 - DNA, 20 bp, mouse
gcccatggccaggtcgagaa

SEQ ID NO: 822902 - DNA, 20 bp, mouse
gggcgcccgccctcaggcta

SEQ ID NO: 822903 - DNA, 20 bp, mouse
gcaggctggccgagagcctc

SEQ ID NO: 822904 - DNA, 20 bp, mouse
gatggccaggtcgagaatgg

SEQ ID NO: 822905 - DNA, 20 bp, mouse
ggaaacccccattctcgacc

SEQ ID NO: 822906 - DNA, 20 bp, mouse
ggagccccgccctatgtccc

SEQ ID NO: 822907 - DNA, 20 bp, mouse
ggcctcttatgggactctca

SEQ ID NO: 822908 - DNA, 20 bp, mouse
gggacctgggacatagggcg

SEQ ID NO: 822909 - DNA, 20 bp, mouse
ggagtcttggctgggaacaa

SEQ ID NO: 822910 - DNA, 20 bp, mouse
gctgaatgtagcagggaccc

SEQ ID NO: 822911 - DNA, 20 bp, mouse
gtgctctgatggacatatgg

SEQ ID NO: 822912 - DNA, 20 bp, mouse
gtcggtaacaatgggctggg

SEQ ID NO: 822913 - DNA, 20 bp, mouse
gcaagtaaaaggcctcttat

SEQ ID NO: 822914 - DNA, 20 bp, mouse
gctcaaggacctgggacata

SEQ ID NO: 822915 - DNA, 20 bp, mouse
gaagtcggagcacgcggaac

SEQ ID NO: 822916 - DNA, 20 bp, mouse
ggcgcctagcgcgtcatccg

SEQ ID NO: 822917 - DNA, 20 bp, mouse
gcctgcgccggcaactggag

SEQ ID NO: 822918 - DNA, 20 bp, mouse
ggagtctcaagtcctttccg

SEQ ID NO: 822919 - DNA, 20 bp, mouse
gccggctgcagtacgagccc

SEQ ID NO: 822920 - DNA, 20 bp, mouse
ggccggcctcggctgctctc

SEQ ID NO: 822921 - DNA, 20 bp, mouse
gtcctaatgtaccgtcgcct

SEQ ID NO: 822922 - DNA, 20 bp, mouse
gaggccgacggtgctctcct

SEQ ID NO: 822923 - DNA, 20 bp, mouse
gtggcagagtgaccacctgg

SEQ ID NO: 822924 - DNA, 20 bp, mouse
gggtcgtggaccaccttcgc

SEQ ID NO: 822925 - DNA, 20 bp, mouse
gagcgcgtcatccgaggcga

SEQ ID NO: 822926 - DNA, 20 bp, mouse
gaccccgggtgtaacaggtg

SEQ ID NO: 822927 - DNA, 20 bp, mouse
ggtctgctgggggttgtcgg

SEQ ID NO: 822928 - DNA, 20 bp, mouse
gagcggcttggcgtctgctg

SEQ ID NO: 822929 - DNA, 20 bp, mouse
ggggtgaccccgggtgtaac

SEQ ID NO: 822930 - DNA, 20 bp, mouse
gagtcctcgctggaccaatg

SEQ ID NO: 822931 - DNA, 20 bp, mouse
ggccaggcgacgaacaaccg

SEQ ID NO: 822932 - DNA, 20 bp, mouse
ggctctcccccgcgcagctg

SEQ ID NO: 822933 - DNA, 20 bp, mouse
ggggcgcccgccgaggaaag

SEQ ID NO: 822934 - DNA, 20 bp, mouse
gagcagcggccgggtgaccc

SEQ ID NO: 822935 - DNA, 20 bp, mouse
gccccagaacggagagacac

SEQ ID NO: 822936 - DNA, 20 bp, mouse
gtagtttagtgactcaccta

SEQ ID NO: 822937 - DNA, 20 bp, mouse
ggtaacacagggtagttggg

SEQ ID NO: 822938 - DNA, 20 bp, mouse
gcctgtaacacagggtagtt

SEQ ID NO: 822939 - DNA, 20 bp, mouse
gaggcataagaagggaactc

SEQ ID NO: 822940 - DNA, 20 bp, mouse
gtgtgttacaggcataagaa

SEQ ID NO: 822941 - DNA, 20 bp, mouse
gcagggtagttgggaggctg

SEQ ID NO: 822942 - DNA, 20 bp, mouse
gcacctagggtgagtttgta

SEQ ID NO: 822943 - DNA, 20 bp, mouse
gagctccaaatacaacagag

SEQ ID NO: 822944 - DNA, 20 bp, mouse
gtcttcctctctgttgtatt

SEQ ID NO: 822945 - DNA, 20 bp, mouse
gtatccttgattaggtctac

SEQ ID NO: 822946 - DNA, 20 bp, mouse
gacctgggtgtggccagtga

SEQ ID NO: 822947 - DNA, 20 bp, mouse
gccaatcagggtcaggaacc

SEQ ID NO: 822948 - DNA, 20 bp, mouse
gaacttgcttctggtaagac

SEQ ID NO: 822949 - DNA, 20 bp, mouse
gactggcgatcaaccaatca

SEQ ID NO: 822950 - DNA, 20 bp, mouse
ggtgggagagagttgggtag

SEQ ID NO: 822951 - DNA, 20 bp, mouse
gaaaacgactgtggtctttt

SEQ ID NO: 822952 - DNA, 20 bp, mouse
gcaatgggctaaaacgactg

SEQ ID NO: 822953 - DNA, 20 bp, mouse
ggaatatgaactagccaatc

SEQ ID NO: 822954 - DNA, 20 bp, mouse
gtgtcaactgctttgccctc

SEQ ID NO: 822955 - DNA, 20 bp, mouse
gcttaatcccagctcaccag

SEQ ID NO: 822956 - DNA, 20 bp, mouse
gaaagttagaaaggggccag

SEQ ID NO: 822957 - DNA, 20 bp, mouse
gccctagcattgcttactca

SEQ ID NO: 822958 - DNA, 20 bp, mouse
ggaatgactaagctagacag

SEQ ID NO: 822959 - DNA, 20 bp, mouse
gtagcttagtcattctaata

SEQ ID NO: 822960 - DNA, 20 bp, mouse
gtatctatacaacactctac

SEQ ID NO: 822961 - DNA, 20 bp, mouse
gtccatgagtaagcaatgct

SEQ ID NO: 822962 - DNA, 20 bp, mouse
gccaagtgcttctgttaaga

SEQ ID NO: 822963 - DNA, 20 bp, mouse
ggttgattttgctatttaaa

SEQ ID NO: 822964 - DNA, 20 bp, mouse
gaattagtttgtgcctccac

SEQ ID NO: 822965 - DNA, 20 bp, mouse
ggttagaaaggggccagtgg

SEQ ID NO: 822966 - DNA, 20 bp, mouse
ggaaacaactgcctagtaga

SEQ ID NO: 822967 - DNA, 20 bp, mouse
gagtagaaaacaaagctctt

SEQ ID NO: 822968 - DNA, 20 bp, mouse
gccaagtgcttctgttaggg

SEQ ID NO: 822969 - DNA, 20 bp, mouse
gaaatagtatgtgcctcctc

SEQ ID NO: 822970 - DNA, 20 bp, mouse
gggagctcaggactccaggc

SEQ ID NO: 822971 - DNA, 20 bp, mouse
gcaaagtcagaaagcattaa

SEQ ID NO: 822972 - DNA, 20 bp, mouse
gttcccaagtgcttctgtta

SEQ ID NO: 822973 - DNA, 20 bp, mouse
gagcattaaggggccagagg

SEQ ID NO: 822974 - DNA, 20 bp, mouse
gtgttggagctcaggactcc

SEQ ID NO: 822975 - DNA, 20 bp, mouse
ggaaagcattaaggggccag

SEQ ID NO: 822976 - DNA, 20 bp, mouse
gtacttcctgcctagaatcc

SEQ ID NO: 822977 - DNA, 20 bp, mouse
gggagcccaggattctaggc

SEQ ID NO: 822978 - DNA, 20 bp, mouse
gtgttggagcccaggattct

SEQ ID NO: 822979 - DNA, 20 bp, mouse
gcaaagtcagaaagcattaa

SEQ ID NO: 822980 - DNA, 20 bp, mouse
gagcattaaggggccagtgg

SEQ ID NO: 822981 - DNA, 20 bp, mouse
gagttgtttctctgaaaaat

SEQ ID NO: 822982 - DNA, 20 bp, mouse
ggaaagcattaaggggccag

SEQ ID NO: 822983 - DNA, 20 bp, mouse
gaaatagtatgtgcctccac

SEQ ID NO: 822984 - DNA, 20 bp, mouse
gtgcatttctctggatactt

SEQ ID NO: 822985 - DNA, 20 bp, mouse
gagaagagcaaaatttgaag

SEQ ID NO: 822986 - DNA, 20 bp, mouse
gttcctaaaagaagcacttt

SEQ ID NO: 822987 - DNA, 20 bp, mouse
gagcattaaggggccagtgg

SEQ ID NO: 822988 - DNA, 20 bp, mouse
gcatagcattaaggggccag

SEQ ID NO: 822989 - DNA, 20 bp, mouse
gatcccaaagtgcttctttt

SEQ ID NO: 822990 - DNA, 20 bp, mouse
gaaatattttatgcctccac

SEQ ID NO: 822991 - DNA, 20 bp, mouse
gtcccaggttagaaagacta

SEQ ID NO: 822992 - DNA, 20 bp, mouse
gtgcatgtgattagagttca

SEQ ID NO: 822993 - DNA, 20 bp, mouse
gtcaacagtcaaatatatcc

SEQ ID NO: 822994 - DNA, 20 bp, mouse
gagaggagaaaattttgaag

SEQ ID NO: 822995 - DNA, 20 bp, mouse
gggagcccagtgttccaggc

SEQ ID NO: 822996 - DNA, 20 bp, mouse
gtctcccatagacctagtcc

SEQ ID NO: 822997 - DNA, 20 bp, mouse
gagatcatctatcctggact

SEQ ID NO: 822998 - DNA, 20 bp, mouse
gatggatcttgtaaaactct

SEQ ID NO: 822999 - DNA, 20 bp, mouse
gtccaaaaaaaattcactct

SEQ ID NO: 823000 - DNA, 20 bp, mouse
gctatcctggactaggtcta

SEQ ID NO: 823001 - DNA, 20 bp, mouse
gcacttcagggcaactaatc

SEQ ID NO: 823002 - DNA, 20 bp, mouse
ggtaacacagggtagttggg

SEQ ID NO: 823003 - DNA, 20 bp, mouse
gcctgtaacacagggtagtt

SEQ ID NO: 823004 - DNA, 20 bp, mouse
gaggcataagaagggaactc

SEQ ID NO: 823005 - DNA, 20 bp, mouse
gtgtgttacaggcataagaa

SEQ ID NO: 823006 - DNA, 20 bp, mouse
gaggatagatgatctcgggg

SEQ ID NO: 823007 - DNA, 20 bp, mouse
gtggtgagaagttcaaaaga

SEQ ID NO: 823008 - DNA, 20 bp, mouse
gtaggtctatggagagttgg

SEQ ID NO: 823009 - DNA, 20 bp, mouse
ggtaacacagggtagttggg

SEQ ID NO: 823010 - DNA, 20 bp, mouse
gctatggagagttggtggtt

SEQ ID NO: 823011 - DNA, 20 bp, mouse
gaggcataagaagggaactc

SEQ ID NO: 823012 - DNA, 20 bp, mouse
gcctgtaacacagggtagtt

SEQ ID NO: 823013 - DNA, 20 bp, mouse
gttgggaggctgaggtagaa

SEQ ID NO: 823014 - DNA, 20 bp, mouse
gggttaggtctatggagagt

SEQ ID NO: 823015 - DNA, 20 bp, mouse
gtgtgttacaggcataagaa

SEQ ID NO: 823016 - DNA, 20 bp, mouse
gggaagggggagtacaattg

SEQ ID NO: 823017 - DNA, 20 bp, mouse
gtcctcccctcatctaatca

SEQ ID NO: 823018 - DNA, 20 bp, mouse
gattagatgaggggaggact

SEQ ID NO: 823019 - DNA, 20 bp, mouse
gtccttgattagatgagggg

SEQ ID NO: 823020 - DNA, 20 bp, mouse
gcaatccttgattagatgag

SEQ ID NO: 823021 - DNA, 20 bp, mouse
gaggtacaggagaagtgtat

SEQ ID NO: 823022 - DNA, 20 bp, mouse
gtttaagaaaagaccgttct

SEQ ID NO: 823023 - DNA, 20 bp, mouse
gacttggaagagagaaggaa

SEQ ID NO: 823024 - DNA, 20 bp, mouse
gggaggacttggaagagaga

SEQ ID NO: 823025 - DNA, 20 bp, mouse
ggaaaccatcagttggggag

SEQ ID NO: 823026 - DNA, 20 bp, mouse
gcaagcacaccttttcactc

SEQ ID NO: 823027 - DNA, 20 bp, mouse
gacaccttttcactcaggtg

SEQ ID NO: 823028 - DNA, 20 bp, mouse
gtttcctcacctgagtgaaa

SEQ ID NO: 823029 - DNA, 20 bp, mouse
gaagcaccaaatacaaaaac

SEQ ID NO: 823030 - DNA, 20 bp, mouse
gcccttcagggcaactaaac

SEQ ID NO: 823031 - DNA, 20 bp, mouse
gacctatggtgagtttgtaa

SEQ ID NO: 823032 - DNA, 20 bp, mouse
gtcccttacaaactcaccat

SEQ ID NO: 823033 - DNA, 20 bp, mouse
gactagtttgtagctaccta

SEQ ID NO: 823034 - DNA, 20 bp, mouse
gtcaaggatagatgatcttg

SEQ ID NO: 823035 - DNA, 20 bp, mouse
gcatgcataaacatatatga

SEQ ID NO: 823036 - DNA, 20 bp, mouse
gagcattaaggggccagtgg

SEQ ID NO: 823037 - DNA, 20 bp, mouse
gcatagcattaaggggccag

SEQ ID NO: 823038 - DNA, 20 bp, mouse
gaaagtctacatagcattaa

SEQ ID NO: 823039 - DNA, 20 bp, mouse
gaaatattttatgcctccac

SEQ ID NO: 823040 - DNA, 20 bp, mouse
gtacttcctgccttgaacac

SEQ ID NO: 823041 - DNA, 20 bp, mouse
gggagcccagtgttcaaggc

SEQ ID NO: 823042 - DNA, 20 bp, mouse
ggatcccaagtgcttctttt

SEQ ID NO: 823043 - DNA, 20 bp, mouse
gagaggagaaaattttgaag

SEQ ID NO: 823044 - DNA, 20 bp, mouse
gtttctctacaaaaaaaata

SEQ ID NO: 823045 - DNA, 20 bp, mouse
gtcaagagtcaaacatatcc

SEQ ID NO: 823046 - DNA, 20 bp, mouse
gtcgaagcaggcattgtcac

SEQ ID NO: 823047 - DNA, 20 bp, mouse
gggagcacaggtccagaggt

SEQ ID NO: 823048 - DNA, 20 bp, mouse
ggggcagctacacttctaga

SEQ ID NO: 823049 - DNA, 20 bp, mouse
gggtcacgaggccgttgggg

SEQ ID NO: 823050 - DNA, 20 bp, mouse
gaggcggagcacaggtccag

SEQ ID NO: 823051 - DNA, 20 bp, mouse
gtcaacgtgaccaagtggaa

SEQ ID NO: 823052 - DNA, 20 bp, mouse
gacttctagaaggttctagg

SEQ ID NO: 823053 - DNA, 20 bp, mouse
gtcccggggaattaggtcag

SEQ ID NO: 823054 - DNA, 20 bp, mouse
gaatgagcgagcgaaggccc

SEQ ID NO: 823055 - DNA, 20 bp, mouse
gagaacgggagccagcttgg

SEQ ID NO: 823056 - DNA, 20 bp, mouse
gggcgcccgcacacctgttg

SEQ ID NO: 823057 - DNA, 20 bp, mouse
ggagagatggccagtatcaa

SEQ ID NO: 823058 - DNA, 20 bp, mouse
gaccggccgcaacaggtgtg

SEQ ID NO: 823059 - DNA, 20 bp, mouse
ggggcacaggccactgtcag

SEQ ID NO: 823060 - DNA, 20 bp, mouse
gatcaaaggaccggactgaa

SEQ ID NO: 823061 - DNA, 20 bp, mouse
ggattgtagggaaagatcca

SEQ ID NO: 823062 - DNA, 20 bp, mouse
gactctgtggtgctcctttt

SEQ ID NO: 823063 - DNA, 20 bp, mouse
gatggccagtatcaaaggac

SEQ ID NO: 823064 - DNA, 20 bp, mouse
gagagccacccgtgacaaag

SEQ ID NO: 823065 - DNA, 20 bp, mouse
gggctctgacagcgaagaag

SEQ ID NO: 823066 - DNA, 20 bp, mouse
gcctctgcagcagatggcca

SEQ ID NO: 823067 - DNA, 20 bp, mouse
gaatagggaggtgtgacgta

SEQ ID NO: 823068 - DNA, 20 bp, mouse
ggcacacacagatttttttt

SEQ ID NO: 823069 - DNA, 20 bp, mouse
gtggccagggatgataacaa

SEQ ID NO: 823070 - DNA, 20 bp, mouse
gttgccgtggcgataaagtc

SEQ ID NO: 823071 - DNA, 20 bp, mouse
gtgcatgatgactgatatat

SEQ ID NO: 823072 - DNA, 20 bp, mouse
gagtcatcatgcaaatgaga

SEQ ID NO: 823073 - DNA, 20 bp, mouse
gaatgggctgagttaaaaag

SEQ ID NO: 823074 - DNA, 20 bp, mouse
gatgatgactgatatatggg

SEQ ID NO: 823075 - DNA, 20 bp, mouse
gtgagaaggtctgaataggg

SEQ ID NO: 823076 - DNA, 20 bp, mouse
gattgtccaggggttcgctc

SEQ ID NO: 823077 - DNA, 20 bp, mouse
gctaggctgttccaaggaat

SEQ ID NO: 823078 - DNA, 20 bp, mouse
gggagaacactgctcttccc

SEQ ID NO: 823079 - DNA, 20 bp, mouse
gcaaggaatggggactgaaa

SEQ ID NO: 823080 - DNA, 20 bp, mouse
gttgatccccgtttgagctg

SEQ ID NO: 823081 - DNA, 20 bp, mouse
ggttctccccagctcaaacg

SEQ ID NO: 823082 - DNA, 20 bp, mouse
ggcatctcctggaaggcata

SEQ ID NO: 823083 - DNA, 20 bp, mouse
gaccttttacagattgtcca

SEQ ID NO: 823084 - DNA, 20 bp, mouse
gtgtctcctaggctgttcca

SEQ ID NO: 823085 - DNA, 20 bp, mouse
gcccctggacaatctgtaaa

SEQ ID NO: 823086 - DNA, 20 bp, mouse
gagggaggggagagccccgg

SEQ ID NO: 823087 - DNA, 20 bp, mouse
gagccccggaggatgtgaat

SEQ ID NO: 823088 - DNA, 20 bp, mouse
gcacccctacccaagctaaa

SEQ ID NO: 823089 - DNA, 20 bp, mouse
gcccccaccaccactcgctc

SEQ ID NO: 823090 - DNA, 20 bp, mouse
gcctacccaagctaaaggga

SEQ ID NO: 823091 - DNA, 20 bp, mouse
gccaagctaaagggaagggt

SEQ ID NO: 823092 - DNA, 20 bp, mouse
gccggaggatgtgaatgggg

SEQ ID NO: 823093 - DNA, 20 bp, mouse
gagaccatgagcccagatat

SEQ ID NO: 823094 - DNA, 20 bp, mouse
ggatgctggcgggtcctgcc

SEQ ID NO: 823095 - DNA, 20 bp, mouse
ggggactggcccgaggctgg

SEQ ID NO: 823096 - DNA, 20 bp, mouse
gcatccccgggctatagctg

SEQ ID NO: 823097 - DNA, 20 bp, mouse
ggatggggaggggatggatt

SEQ ID NO: 823098 - DNA, 20 bp, mouse
gacagcagagtggtgaagta

SEQ ID NO: 823099 - DNA, 20 bp, mouse
gccggaccccggagacccaa

SEQ ID NO: 823100 - DNA, 20 bp, mouse
gaggttaccaccagcgtcag

SEQ ID NO: 823101 - DNA, 20 bp, mouse
ggggctgcccggctgcggtc

SEQ ID NO: 823102 - DNA, 20 bp, mouse
gcaagccccagctatagccc

SEQ ID NO: 823103 - DNA, 20 bp, mouse
gaggggatggattcggcctc

SEQ ID NO: 823104 - DNA, 20 bp, mouse
gctgcggcgaagcctcgcat

SEQ ID NO: 823105 - DNA, 20 bp, mouse
gcgccaggcaggccaatgcg

SEQ ID NO: 823106 - DNA, 20 bp, mouse
ggaacgccgcgctggaggga

SEQ ID NO: 823107 - DNA, 20 bp, mouse
ggggagggcgcaccgagaga

SEQ ID NO: 823108 - DNA, 20 bp, mouse
gcacgcttgcgcacacggtc

SEQ ID NO: 823109 - DNA, 20 bp, mouse
gagagggagggcgcggagaa

SEQ ID NO: 823110 - DNA, 20 bp, mouse
gagggcgcgccgaaggaggg

SEQ ID NO: 823111 - DNA, 20 bp, mouse
gtgaggccgcggggagactg

SEQ ID NO: 823112 - DNA, 20 bp, mouse
ggggagggcgcagaggaagg

SEQ ID NO: 823113 - DNA, 20 bp, mouse
gcaccgagagagggagggcg

SEQ ID NO: 823114 - DNA, 20 bp, mouse
ggccgcgaacgccgcgctgg

SEQ ID NO: 823115 - DNA, 20 bp, mouse
gaggagggagggcgcgccga

SEQ ID NO: 823116 - DNA, 20 bp, mouse
gcgcggggcaccctcatcct

SEQ ID NO: 823117 - DNA, 20 bp, mouse
gcccccgcgcggatgctgag

SEQ ID NO: 823118 - DNA, 20 bp, mouse
gcgggggagcggactgtccg

SEQ ID NO: 823119 - DNA, 20 bp, mouse
gtcgcactagcagtcggagg

SEQ ID NO: 823120 - DNA, 20 bp, mouse
gtggcgccccacctacttct

SEQ ID NO: 823121 - DNA, 20 bp, mouse
gtcggagctggggaactaag

SEQ ID NO: 823122 - DNA, 20 bp, mouse
gacaactccagccgagaagt

SEQ ID NO: 823123 - DNA, 20 bp, mouse
gggcctcggcgcactctgat

SEQ ID NO: 823124 - DNA, 20 bp, mouse
ggggacagtccgctcgcagg

SEQ ID NO: 823125 - DNA, 20 bp, mouse
gtcgcgcgtcacgaggataa

SEQ ID NO: 823126 - DNA, 20 bp, mouse
gctgcccggtggctgccggt

SEQ ID NO: 823127 - DNA, 20 bp, mouse
ggggcggtagccgtgctctc

SEQ ID NO: 823128 - DNA, 20 bp, mouse
gagcacggctaccgccccgg

SEQ ID NO: 823129 - DNA, 20 bp, mouse
gggctcagagacccccgggg

SEQ ID NO: 823130 - DNA, 20 bp, mouse
ggactcccagcgagagcaag

SEQ ID NO: 823131 - DNA, 20 bp, mouse
gaccgccccgccctaaaggt

SEQ ID NO: 823132 - DNA, 20 bp, mouse
gggtgggctcagagaccccc

SEQ ID NO: 823133 - DNA, 20 bp, mouse
gctcgctgggagtccccgac

SEQ ID NO: 823134 - DNA, 20 bp, mouse
gcaaaggcgggaggctgtaa

SEQ ID NO: 823135 - DNA, 20 bp, mouse
gcgaagggagggccgggaaa

SEQ ID NO: 823136 - DNA, 20 bp, mouse
gggctcctggttgactggaa

SEQ ID NO: 823137 - DNA, 20 bp, mouse
gaaaagctgagacactagag

SEQ ID NO: 823138 - DNA, 20 bp, mouse
gaacagcgcggtcttttgat

SEQ ID NO: 823139 - DNA, 20 bp, mouse
gagttcccaggaacagacct

SEQ ID NO: 823140 - DNA, 20 bp, mouse
gacctcccttccagtcaacc

SEQ ID NO: 823141 - DNA, 20 bp, mouse
gaaaagaccgcgctgtttca

SEQ ID NO: 823142 - DNA, 20 bp, mouse
gtcctggttgactggaaggg

SEQ ID NO: 823143 - DNA, 20 bp, mouse
gcgtgtgtgcagcctaggac

SEQ ID NO: 823144 - DNA, 20 bp, mouse
gtggaagaatccctgccaaa

SEQ ID NO: 823145 - DNA, 20 bp, mouse
ggttgttgcagcaagttccc

SEQ ID NO: 823146 - DNA, 20 bp, mouse
gcaccccctgcgtgtcccga

SEQ ID NO: 823147 - DNA, 20 bp, mouse
gctcgctagcgacctccaga

SEQ ID NO: 823148 - DNA, 20 bp, mouse
gtggggcggagcaatgcggc

SEQ ID NO: 823149 - DNA, 20 bp, mouse
gcaatccatcgggacacgca

SEQ ID NO: 823150 - DNA, 20 bp, mouse
gtagggctccccgtaatgca

SEQ ID NO: 823151 - DNA, 20 bp, mouse
gaggcaggacccggttacaa

SEQ ID NO: 823152 - DNA, 20 bp, mouse
gaaagagcaagcctttgggg

SEQ ID NO: 823153 - DNA, 20 bp, mouse
gcgagcaggctcaaggttaa

SEQ ID NO: 823154 - DNA, 20 bp, mouse
gcgaaggagcggccagatgg

SEQ ID NO: 823155 - DNA, 20 bp, mouse
gtacgcaggcaggcaggacc

SEQ ID NO: 823156 - DNA, 20 bp, mouse
gcacaggaatgtcccggtgg

SEQ ID NO: 823157 - DNA, 20 bp, mouse
ggcggccggtggcattccag

SEQ ID NO: 823158 - DNA, 20 bp, mouse
ggggcacaggaatgtcccgg

SEQ ID NO: 823159 - DNA, 20 bp, mouse
gccgccctgcccaccaccgg

SEQ ID NO: 823160 - DNA, 20 bp, mouse
ggtacctggcacccgggcac

SEQ ID NO: 823161 - DNA, 20 bp, mouse
ggcggcgcggctgcctaaaa

SEQ ID NO: 823162 - DNA, 20 bp, mouse
ggaagtgagtctttgtgtgc

SEQ ID NO: 823163 - DNA, 20 bp, mouse
ggcagggcggtctgggaagc

SEQ ID NO: 823164 - DNA, 20 bp, mouse
ggtctgggaagctggccggg

SEQ ID NO: 823165 - DNA, 20 bp, mouse
gaagccattcggggagccct

SEQ ID NO: 823166 - DNA, 20 bp, mouse
ggcgggtgttagcctctctg

SEQ ID NO: 823167 - DNA, 20 bp, mouse
gtctacttatggatgaggct

SEQ ID NO: 823168 - DNA, 20 bp, mouse
gcccgcgatgatgactttgt

SEQ ID NO: 823169 - DNA, 20 bp, mouse
gtgtctctgaagccaaattc

SEQ ID NO: 823170 - DNA, 20 bp, mouse
gaagcacaggtgaaaatgag

SEQ ID NO: 823171 - DNA, 20 bp, mouse
gaaacagcctcgcttttatc

SEQ ID NO: 823172 - DNA, 20 bp, mouse
gaaatgaccagataaaagcg

SEQ ID NO: 823173 - DNA, 20 bp, mouse
gacacttggctgttcatggg

SEQ ID NO: 823174 - DNA, 20 bp, mouse
gccataagtagaagaagcag

SEQ ID NO: 823175 - DNA, 20 bp, mouse
gttatggatgaggctgggag

SEQ ID NO: 823176 - DNA, 20 bp, mouse
gtaaggccgtcgtgcagctg

SEQ ID NO: 823177 - DNA, 20 bp, mouse
gtctggaataggtacatccg

SEQ ID NO: 823178 - DNA, 20 bp, mouse
gaggcctggcgaggacacag

SEQ ID NO: 823179 - DNA, 20 bp, mouse
gggcaagcatgtgcagtgaa

SEQ ID NO: 823180 - DNA, 20 bp, mouse
gtgtccccgggggacttcga

SEQ ID NO: 823181 - DNA, 20 bp, mouse
gagccgcgagcgctgttcca

SEQ ID NO: 823182 - DNA, 20 bp, mouse
gtcgatggcggctacccctg

SEQ ID NO: 823183 - DNA, 20 bp, mouse
gccctgcccgactctggaat

SEQ ID NO: 823184 - DNA, 20 bp, mouse
gtccgcgggtcccactggga

SEQ ID NO: 823185 - DNA, 20 bp, mouse
gcagagactgagcgtctcta

SEQ ID NO: 823186 - DNA, 20 bp, mouse
gcaggcatggggcccatcac

SEQ ID NO: 823187 - DNA, 20 bp, mouse
gtgggcgagtgcagctggaa

SEQ ID NO: 823188 - DNA, 20 bp, mouse
gcagttgcgggctgcacgga

SEQ ID NO: 823189 - DNA, 20 bp, mouse
ggcacggagggcacgtgact

SEQ ID NO: 823190 - DNA, 20 bp, mouse
gcaaacccttctgcagatgg

SEQ ID NO: 823191 - DNA, 20 bp, mouse
gagggcacgtgactaggggc

SEQ ID NO: 823192 - DNA, 20 bp, mouse
gttaacctgaggacagaagg

SEQ ID NO: 823193 - DNA, 20 bp, mouse
gcagaagggtttggaaaaaa

SEQ ID NO: 823194 - DNA, 20 bp, mouse
gcctcaggttaagcagatct

SEQ ID NO: 823195 - DNA, 20 bp, mouse
gcacccccgagccccgccac

SEQ ID NO: 823196 - DNA, 20 bp, mouse
gggcgaggtctcgacgtcga

SEQ ID NO: 823197 - DNA, 20 bp, mouse
gaggtctcgacgtcgagggc

SEQ ID NO: 823198 - DNA, 20 bp, mouse
gggcggggcctgcgcagcgc

SEQ ID NO: 823199 - DNA, 20 bp, mouse
gccgctagccggcgctgcgc

SEQ ID NO: 823200 - DNA, 20 bp, mouse
gccagtagccatcacacggg

SEQ ID NO: 823201 - DNA, 20 bp, mouse
gtctcagagacctccgggct

SEQ ID NO: 823202 - DNA, 20 bp, mouse
ggaaccgggccccgggtagg

SEQ ID NO: 823203 - DNA, 20 bp, mouse
gggatgtctcagagacctcc

SEQ ID NO: 823204 - DNA, 20 bp, mouse
gatcacacaaggactagagt

SEQ ID NO: 823205 - DNA, 20 bp, mouse
gaagagagccacccgtgtga

SEQ ID NO: 823206 - DNA, 20 bp, mouse
gtcactgagaagatggtttg

SEQ ID NO: 823207 - DNA, 20 bp, mouse
gcagtgaagtggaatttctg

SEQ ID NO: 823208 - DNA, 20 bp, mouse
ggcctggcaaatgtgatcat

SEQ ID NO: 823209 - DNA, 20 bp, mouse
gtggatcgctaagactcgga

SEQ ID NO: 823210 - DNA, 20 bp, mouse
gggcggcaggcggcagtgtg

SEQ ID NO: 823211 - DNA, 20 bp, mouse
gaggaatgggtgcaccttta

SEQ ID NO: 823212 - DNA, 20 bp, mouse
gtgtgtggatcgctaagact

SEQ ID NO: 823213 - DNA, 20 bp, mouse
gaccgtgttcaggatcaaac

SEQ ID NO: 823214 - DNA, 20 bp, mouse
gggcaagactgttaccataa

SEQ ID NO: 823215 - DNA, 20 bp, mouse
gataataaatcttcaaacta

SEQ ID NO: 823216 - DNA, 20 bp, mouse
gccccagggaggtgccagag

SEQ ID NO: 823217 - DNA, 20 bp, mouse
ggacaccaggacctcggatg

SEQ ID NO: 823218 - DNA, 20 bp, mouse
gggcgctcgcagtcccgtta

SEQ ID NO: 823219 - DNA, 20 bp, mouse
ggatggggcgcggggcacga

SEQ ID NO: 823220 - DNA, 20 bp, mouse
gggagagcgtctctcctctc

SEQ ID NO: 823221 - DNA, 20 bp, mouse
gctgcctaggggatggttac

SEQ ID NO: 823222 - DNA, 20 bp, mouse
gcggggcacgagggtgctgt

SEQ ID NO: 823223 - DNA, 20 bp, mouse
gcgaggtcctggtgtccatt

SEQ ID NO: 823224 - DNA, 20 bp, mouse
gccgttagggccgagcgaga

SEQ ID NO: 823225 - DNA, 20 bp, mouse
gccgaaacgcggagatcact

SEQ ID NO: 823226 - DNA, 20 bp, mouse
gccacgaaggccaccggcgg

SEQ ID NO: 823227 - DNA, 20 bp, mouse
gtcctggggtgatagacgga

SEQ ID NO: 823228 - DNA, 20 bp, mouse
gttaaagtggagtcagaatt

SEQ ID NO: 823229 - DNA, 20 bp, mouse
ggcaacagttgccaggtcct

SEQ ID NO: 823230 - DNA, 20 bp, mouse
gctcgcccggcgcccggatg

SEQ ID NO: 823231 - DNA, 20 bp, mouse
gaatggcccgggagagtgca

SEQ ID NO: 823232 - DNA, 20 bp, mouse
gcactgacgtaacagctcgc

SEQ ID NO: 823233 - DNA, 20 bp, mouse
gacgtcagtgggtccctcgg

SEQ ID NO: 823234 - DNA, 20 bp, mouse
gcaggtcctggggtgataga

SEQ ID NO: 823235 - DNA, 20 bp, mouse
gaaagtgtgtggagcacgcc

SEQ ID NO: 823236 - DNA, 20 bp, mouse
gagggcggggaagcatctga

SEQ ID NO: 823237 - DNA, 20 bp, mouse
ggctacctagtcctctagga

SEQ ID NO: 823238 - DNA, 20 bp, mouse
gaactggctggagatctgga

SEQ ID NO: 823239 - DNA, 20 bp, mouse
gagcgcggtggccgactgag

SEQ ID NO: 823240 - DNA, 20 bp, mouse
gagtcggcgctctaggaagt

SEQ ID NO: 823241 - DNA, 20 bp, mouse
ggaagcgtcccggggccaga

SEQ ID NO: 823242 - DNA, 20 bp, mouse
gaggggctacctagtcctct

SEQ ID NO: 823243 - DNA, 20 bp, mouse
gtcaagtccgccactatccc

SEQ ID NO: 823244 - DNA, 20 bp, mouse
gcacccgcgcggaactgaca

SEQ ID NO: 823245 - DNA, 20 bp, mouse
ggggccggaaacccggagtc

SEQ ID NO: 823246 - DNA, 20 bp, mouse
gcgtgaggggcgcggagtga

SEQ ID NO: 823247 - DNA, 20 bp, mouse
ggagtccagggcgcagcaga

SEQ ID NO: 823248 - DNA, 20 bp, mouse
ggggccgcgacgctagccca

SEQ ID NO: 823249 - DNA, 20 bp, mouse
gccggagtatgcacagattg

SEQ ID NO: 823250 - DNA, 20 bp, mouse
gcgcgtgtctgcggagtcca

SEQ ID NO: 823251 - DNA, 20 bp, mouse
ggccccaagcaggtcacggg

SEQ ID NO: 823252 - DNA, 20 bp, mouse
gggcgaggggcctgcaccct

SEQ ID NO: 823253 - DNA, 20 bp, mouse
ggcctcccgtgacctgcttg

SEQ ID NO: 823254 - DNA, 20 bp, mouse
ggcggccccaagcaggtcac

SEQ ID NO: 823255 - DNA, 20 bp, mouse
gatcccggggcgcgtgtctg

SEQ ID NO: 823256 - DNA, 20 bp, mouse
gggccgctagagttagtggg

SEQ ID NO: 823257 - DNA, 20 bp, mouse
gggtggccgctagagttagt

SEQ ID NO: 823258 - DNA, 20 bp, mouse
gagcttgccactcccggcct

SEQ ID NO: 823259 - DNA, 20 bp, mouse
gtgccactcccggcctagga

SEQ ID NO: 823260 - DNA, 20 bp, mouse
gtccctgagccctctcgggc

SEQ ID NO: 823261 - DNA, 20 bp, mouse
gcctggagcccagtgcgggg

SEQ ID NO: 823262 - DNA, 20 bp, mouse
gaagctccctgagccctctc

SEQ ID NO: 823263 - DNA, 20 bp, mouse
gagacaactcggagcacccg

SEQ ID NO: 823264 - DNA, 20 bp, mouse
gctcctcccactaactctag

SEQ ID NO: 823265 - DNA, 20 bp, mouse
ggcaccttggggacggtctc

SEQ ID NO: 823266 - DNA, 20 bp, mouse
gcagcaaataagatggagta

SEQ ID NO: 823267 - DNA, 20 bp, mouse
gaccctgtagcctatgtact

SEQ ID NO: 823268 - DNA, 20 bp, mouse
gaaccaagtacataggctac

SEQ ID NO: 823269 - DNA, 20 bp, mouse
ggaagaataaccaagtacat

SEQ ID NO: 823270 - DNA, 20 bp, mouse
gccccccccaagtttaagaa

SEQ ID NO: 823271 - DNA, 20 bp, mouse
gaagggagttgcttagagat

SEQ ID NO: 823272 - DNA, 20 bp, mouse
gttccattcttaaacttggg

SEQ ID NO: 823273 - DNA, 20 bp, mouse
gattgtagcaatgaatgacc

SEQ ID NO: 823274 - DNA, 20 bp, mouse
gttctcttgtaaagttgaag

SEQ ID NO: 823275 - DNA, 20 bp, mouse
gtctaaggtcaattttcccg

SEQ ID NO: 823276 - DNA, 20 bp, mouse
gcggagagtcgttgtgagct

SEQ ID NO: 823277 - DNA, 20 bp, mouse
ggccccctcagcacggtgat

SEQ ID NO: 823278 - DNA, 20 bp, mouse
gcggtctgcactatgccggg

SEQ ID NO: 823279 - DNA, 20 bp, mouse
gccagccaatcaccgtgctg

SEQ ID NO: 823280 - DNA, 20 bp, mouse
gcagaggaacgcaatggcta

SEQ ID NO: 823281 - DNA, 20 bp, mouse
gtgaatgctggtgtcgaagc

SEQ ID NO: 823282 - DNA, 20 bp, mouse
gctaggacgcccaaacgtca

SEQ ID NO: 823283 - DNA, 20 bp, mouse
gagctcggtctgcactatgc

SEQ ID NO: 823284 - DNA, 20 bp, mouse
gggaagctcacagtcgcacg

SEQ ID NO: 823285 - DNA, 20 bp, mouse
gggcgtcctaggagatagtg

SEQ ID NO: 823286 - DNA, 20 bp, mouse
gagtctcggcccagcctcgc

SEQ ID NO: 823287 - DNA, 20 bp, mouse
ggaccagacgcgctgttccc

SEQ ID NO: 823288 - DNA, 20 bp, mouse
gccgcagcccgggagtgcga

SEQ ID NO: 823289 - DNA, 20 bp, mouse
gctcgcctccgcagcatcgg

SEQ ID NO: 823290 - DNA, 20 bp, mouse
ggatccgggccggcgaggct

SEQ ID NO: 823291 - DNA, 20 bp, mouse
gtcccgagccagcccagagt

SEQ ID NO: 823292 - DNA, 20 bp, mouse
ggagaactgcgtggtcaaga

SEQ ID NO: 823293 - DNA, 20 bp, mouse
gtgggctggctcgggattcg

SEQ ID NO: 823294 - DNA, 20 bp, mouse
ggtgacgaccaatggggatc

SEQ ID NO: 823295 - DNA, 20 bp, mouse
ggcccactctgggctggctc

SEQ ID NO: 823296 - DNA, 20 bp, mouse
gcaagcgcgcactcgggcga

SEQ ID NO: 823297 - DNA, 20 bp, mouse
ggagtcgcaatgtgattggg

SEQ ID NO: 823298 - DNA, 20 bp, mouse
gagcagagtcgcaatgtgat

SEQ ID NO: 823299 - DNA, 20 bp, mouse
gcggggtcacctgaaggttg

SEQ ID NO: 823300 - DNA, 20 bp, mouse
gcagcgaccagagcccgcag

SEQ ID NO: 823301 - DNA, 20 bp, mouse
ggtgagagcagctgaaaagt

SEQ ID NO: 823302 - DNA, 20 bp, mouse
gtggggccaagcgcgcactc

SEQ ID NO: 823303 - DNA, 20 bp, mouse
gtggcagctttcaggcacgt

SEQ ID NO: 823304 - DNA, 20 bp, mouse
gactgtccacggaacgtcgt

SEQ ID NO: 823305 - DNA, 20 bp, mouse
gtccacggaacgtcgtggga

SEQ ID NO: 823306 - DNA, 20 bp, mouse
gacgacctgggccctgttca

SEQ ID NO: 823307 - DNA, 20 bp, mouse
gggcccaggtcgtccatgtg

SEQ ID NO: 823308 - DNA, 20 bp, mouse
gtgccagggagcagcgtcct

SEQ ID NO: 823309 - DNA, 20 bp, mouse
gccctggcaccatagtctag

SEQ ID NO: 823310 - DNA, 20 bp, mouse
gacccccacatggacgacct

SEQ ID NO: 823311 - DNA, 20 bp, mouse
gcaggcggaagggaagacgc

SEQ ID NO: 823312 - DNA, 20 bp, mouse
gtggctgcagagttaggggt

SEQ ID NO: 823313 - DNA, 20 bp, mouse
gaggtggctaatggtgggtc

SEQ ID NO: 823314 - DNA, 20 bp, mouse
gggtctggacctctagacta

SEQ ID NO: 823315 - DNA, 20 bp, mouse
ggggagcagcgtcctgggcc

SEQ ID NO: 823316 - DNA, 20 bp, mouse
ggtgcctagcggaacaacta

SEQ ID NO: 823317 - DNA, 20 bp, mouse
ggcagatccgccacagcgat

SEQ ID NO: 823318 - DNA, 20 bp, mouse
gagttctctgtggtgtggta

SEQ ID NO: 823319 - DNA, 20 bp, mouse
gtggtcccctcctatcgctg

SEQ ID NO: 823320 - DNA, 20 bp, mouse
ggatccgccacagcgatagg

SEQ ID NO: 823321 - DNA, 20 bp, mouse
gcgctgtggcggatctgcac

SEQ ID NO: 823322 - DNA, 20 bp, mouse
gtgagtctatgcacagtgat

SEQ ID NO: 823323 - DNA, 20 bp, mouse
gtcccctcctatcgctgtgg

SEQ ID NO: 823324 - DNA, 20 bp, mouse
gttctgtagggagaatctgt

SEQ ID NO: 823325 - DNA, 20 bp, mouse
gctagcggaacaactaggga

SEQ ID NO: 823326 - DNA, 20 bp, mouse
gcgcggatctcccacactgt

SEQ ID NO: 823327 - DNA, 20 bp, mouse
ggccgcctcccgtcctcgga

SEQ ID NO: 823328 - DNA, 20 bp, mouse
ggggcggcagtcacgactag

SEQ ID NO: 823329 - DNA, 20 bp, mouse
gcccacccgcccgctgcggt

SEQ ID NO: 823330 - DNA, 20 bp, mouse
ggacgggaggcggcggcttg

SEQ ID NO: 823331 - DNA, 20 bp, mouse
gcagggccgccagggatgaa

SEQ ID NO: 823332 - DNA, 20 bp, mouse
gtgactgccgcccaccgcag

SEQ ID NO: 823333 - DNA, 20 bp, mouse
gcggggaacccagggcggga

SEQ ID NO: 823334 - DNA, 20 bp, mouse
ggcccgggctggcccctccg

SEQ ID NO: 823335 - DNA, 20 bp, mouse
gcgtgcggggaacccagggc

SEQ ID NO: 823336 - DNA, 20 bp, mouse
gcagctgggtggagtcttgg

SEQ ID NO: 823337 - DNA, 20 bp, mouse
gggtggggagacaaaattga

SEQ ID NO: 823338 - DNA, 20 bp, mouse
gcggaggggtagttttacaa

SEQ ID NO: 823339 - DNA, 20 bp, mouse
ggggagacaaaattgaagga

SEQ ID NO: 823340 - DNA, 20 bp, mouse
ggctgcggtggtggctagga

SEQ ID NO: 823341 - DNA, 20 bp, mouse
gtggggggctcgacaagatg

SEQ ID NO: 823342 - DNA, 20 bp, mouse
gacaatggaaagcccgaaat

SEQ ID NO: 823343 - DNA, 20 bp, mouse
gggggctcgacaagatgggg

SEQ ID NO: 823344 - DNA, 20 bp, mouse
gagaagcgcacgtgtgagtt

SEQ ID NO: 823345 - DNA, 20 bp, mouse
ggccgccgggtgcaaggctg

SEQ ID NO: 823346 - DNA, 20 bp, mouse
gagcccagggagggtaagat

SEQ ID NO: 823347 - DNA, 20 bp, mouse
ggagtggggtgctactgtat

SEQ ID NO: 823348 - DNA, 20 bp, mouse
ggaaccttaaggggagagta

SEQ ID NO: 823349 - DNA, 20 bp, mouse
ggcaccccactccaagtacc

SEQ ID NO: 823350 - DNA, 20 bp, mouse
gacagggagaaattggaacc

SEQ ID NO: 823351 - DNA, 20 bp, mouse
gacagctgacagggagaaat

SEQ ID NO: 823352 - DNA, 20 bp, mouse
gctcggagaagagctgttct

SEQ ID NO: 823353 - DNA, 20 bp, mouse
gaggtcagttctggcttatc

SEQ ID NO: 823354 - DNA, 20 bp, mouse
gacgtgactgcgtcttgaac

SEQ ID NO: 823355 - DNA, 20 bp, mouse
gtcaagacgcagtcacgtga

SEQ ID NO: 823356 - DNA, 20 bp, mouse
gggcctgcccggaaagggga

SEQ ID NO: 823357 - DNA, 20 bp, mouse
gcgcggagacgtctggacga

SEQ ID NO: 823358 - DNA, 20 bp, mouse
gggcgcgcggccccgtccga

SEQ ID NO: 823359 - DNA, 20 bp, mouse
gcggagcaggagcctcgcag

SEQ ID NO: 823360 - DNA, 20 bp, mouse
ggccccccggaggcgagcga

SEQ ID NO: 823361 - DNA, 20 bp, mouse
gcgctcgcctggggcggccc

SEQ ID NO: 823362 - DNA, 20 bp, mouse
ggcgagcaggggccctcgga

SEQ ID NO: 823363 - DNA, 20 bp, mouse
gcgtctccgcggctcgccat

SEQ ID NO: 823364 - DNA, 20 bp, mouse
ggggagctgaggcgcgagca

SEQ ID NO: 823365 - DNA, 20 bp, mouse
gcgccatcgctcgcctccgg

SEQ ID NO: 823366 - DNA, 20 bp, mouse
ggtggtgctgggaacccggg

SEQ ID NO: 823367 - DNA, 20 bp, mouse
gaaggaagcgagcaagatgg

SEQ ID NO: 823368 - DNA, 20 bp, mouse
ggggaaggaagcgagcaaga

SEQ ID NO: 823369 - DNA, 20 bp, mouse
gcgcgctggagatgatgggg

SEQ ID NO: 823370 - DNA, 20 bp, mouse
gcttcccgaggccccgactt

SEQ ID NO: 823371 - DNA, 20 bp, mouse
ggcccggtggcgtgtggtgg

SEQ ID NO: 823372 - DNA, 20 bp, mouse
gcgccgtggtggtgcgggga

SEQ ID NO: 823373 - DNA, 20 bp, mouse
gctcggaccgagggaggcga

SEQ ID NO: 823374 - DNA, 20 bp, mouse
ggcgcagcggcgcaagatgg

SEQ ID NO: 823375 - DNA, 20 bp, mouse
gggcaaacccggggaggcca

SEQ ID NO: 823376 - DNA, 20 bp, mouse
ggcgctggagcccacgtgac

SEQ ID NO: 823377 - DNA, 20 bp, mouse
ggcgctgagaggcaggaacg

SEQ ID NO: 823378 - DNA, 20 bp, mouse
gaacacggcccgcacggcgg

SEQ ID NO: 823379 - DNA, 20 bp, mouse
gtgcacagctacatgcctgg

SEQ ID NO: 823380 - DNA, 20 bp, mouse
gaaaggaggcgtgaccagga

SEQ ID NO: 823381 - DNA, 20 bp, mouse
gtggaacggcaactcggcag

SEQ ID NO: 823382 - DNA, 20 bp, mouse
gagccaatggaaggggacat

SEQ ID NO: 823383 - DNA, 20 bp, mouse
ggccaagcgcgctgagaggc

SEQ ID NO: 823384 - DNA, 20 bp, mouse
gggagcgactccgcacgcgc

SEQ ID NO: 823385 - DNA, 20 bp, mouse
gcgaagccaagcgcgctgag

SEQ ID NO: 823386 - DNA, 20 bp, mouse
gcggggcgtgtcgggaatgt

SEQ ID NO: 823387 - DNA, 20 bp, mouse
ggcagaggaagagacagcgg

SEQ ID NO: 823388 - DNA, 20 bp, mouse
gcagcggcggctcatcgcgt

SEQ ID NO: 823389 - DNA, 20 bp, mouse
gaacctagccgctaacccca

SEQ ID NO: 823390 - DNA, 20 bp, mouse
gcgcgtgcccgtggggttag

SEQ ID NO: 823391 - DNA, 20 bp, mouse
ggccgcctctgttgctgggg

SEQ ID NO: 823392 - DNA, 20 bp, mouse
gctcatcgcgtgggcctcgg

SEQ ID NO: 823393 - DNA, 20 bp, mouse
ggggttagcggctaggttct

SEQ ID NO: 823394 - DNA, 20 bp, mouse
ggccgccgcctctgttgctg

SEQ ID NO: 823395 - DNA, 20 bp, mouse
gacactgcccgctccgggtc

SEQ ID NO: 823396 - DNA, 20 bp, mouse
ggtcgtgcggccccaccggt

SEQ ID NO: 823397 - DNA, 20 bp, mouse
ggccgtgtctgatcaggcgt

SEQ ID NO: 823398 - DNA, 20 bp, mouse
gtgatcaggcgtcggatcgg

SEQ ID NO: 823399 - DNA, 20 bp, mouse
gcgcagggcaggcacggcgg

SEQ ID NO: 823400 - DNA, 20 bp, mouse
ggcggctgccgtgtctgatc

SEQ ID NO: 823401 - DNA, 20 bp, mouse
gcgggggctgccacgtcttt

SEQ ID NO: 823402 - DNA, 20 bp, mouse
gggctccagccccaccggtg

SEQ ID NO: 823403 - DNA, 20 bp, mouse
gggtggggccgcacgacgct

SEQ ID NO: 823404 - DNA, 20 bp, mouse
gctctctcgggtcctcactg

SEQ ID NO: 823405 - DNA, 20 bp, mouse
ggagctctaacaccctgtag

SEQ ID NO: 823406 - DNA, 20 bp, mouse
gagcggggagtgcaacggta

SEQ ID NO: 823407 - DNA, 20 bp, mouse
ggggagagcggggagtgcaa

SEQ ID NO: 823408 - DNA, 20 bp, mouse
gctgcagcgctccctctcat

SEQ ID NO: 823409 - DNA, 20 bp, mouse
ggagtgggatatccagaggg

SEQ ID NO: 823410 - DNA, 20 bp, mouse
gcagcgctccctctcattgg

SEQ ID NO: 823411 - DNA, 20 bp, mouse
gttggtaaagaaaacgaacc

SEQ ID NO: 823412 - DNA, 20 bp, mouse
gagcgctgcagcgctccttt

SEQ ID NO: 823413 - DNA, 20 bp, mouse
gaagggaacctagtgaaaga

SEQ ID NO: 823414 - DNA, 20 bp, mouse
gtaaagaaaacgaaccagga

SEQ ID NO: 823415 - DNA, 20 bp, mouse
gcgaacgggacccacagaca

SEQ ID NO: 823416 - DNA, 20 bp, mouse
gtggccataggccctccgca

SEQ ID NO: 823417 - DNA, 20 bp, mouse
ggggtggcgggtccctgcgg

SEQ ID NO: 823418 - DNA, 20 bp, mouse
ggcacccaggggccggggaa

SEQ ID NO: 823419 - DNA, 20 bp, mouse
gggtccctgcggagggccta

SEQ ID NO: 823420 - DNA, 20 bp, mouse
ggtccaggtggtccaaccta

SEQ ID NO: 823421 - DNA, 20 bp, mouse
gtgctgcaaaaaaacctctg

SEQ ID NO: 823422 - DNA, 20 bp, mouse
ggagtatgcaggtagaccgg

SEQ ID NO: 823423 - DNA, 20 bp, mouse
gctggggtggcgggtccctg

SEQ ID NO: 823424 - DNA, 20 bp, mouse
gcggagggcctatggccaga

SEQ ID NO: 823425 - DNA, 20 bp, mouse
gaacgagtatgcaggtagac

SEQ ID NO: 823426 - DNA, 20 bp, mouse
ggtgtaaacttcatgtgctt

SEQ ID NO: 823427 - DNA, 20 bp, mouse
ggaaaagctaagtgtgtcgt

SEQ ID NO: 823428 - DNA, 20 bp, mouse
gaccatctcctaatgatgaa

SEQ ID NO: 823429 - DNA, 20 bp, mouse
gacttcacaataactgaagg

SEQ ID NO: 823430 - DNA, 20 bp, mouse
ggtgctgttggtggaagggt

SEQ ID NO: 823431 - DNA, 20 bp, mouse
ggtgtgtgctgttggtggaa

SEQ ID NO: 823432 - DNA, 20 bp, mouse
gtttacttcacaataactga

SEQ ID NO: 823433 - DNA, 20 bp, mouse
gtcacatatcttcgaaataa

SEQ ID NO: 823434 - DNA, 20 bp, mouse
gggtctcatttttgtagccg

SEQ ID NO: 823435 - DNA, 20 bp, mouse
gatttttgtattgatcctat

SEQ ID NO: 823436 - DNA, 20 bp, mouse
gcggccaaaaaaccaaccca

SEQ ID NO: 823437 - DNA, 20 bp, mouse
ggcaaagacagagacctgtt

SEQ ID NO: 823438 - DNA, 20 bp, mouse
gtccctccctgactgactgt

SEQ ID NO: 823439 - DNA, 20 bp, mouse
gcggaaatcccggtagttct

SEQ ID NO: 823440 - DNA, 20 bp, mouse
ggtgacagctgactgagttg

SEQ ID NO: 823441 - DNA, 20 bp, mouse
gcaggtctctgtctttgctt

SEQ ID NO: 823442 - DNA, 20 bp, mouse
gcgcccagaactgctagaga

SEQ ID NO: 823443 - DNA, 20 bp, mouse
gaaaaacacgggaacgacac

SEQ ID NO: 823444 - DNA, 20 bp, mouse
ggacaggagcccagaactac

SEQ ID NO: 823445 - DNA, 20 bp, mouse
gagcctacagtcagtcaggg

SEQ ID NO: 823446 - DNA, 20 bp, mouse
gaaagcaggggtcacggaga

SEQ ID NO: 823447 - DNA, 20 bp, mouse
gagggagcagactgtgtaaa

SEQ ID NO: 823448 - DNA, 20 bp, mouse
ggagcagactgtgtaaaggg

SEQ ID NO: 823449 - DNA, 20 bp, mouse
gaggaccagactctgcaggt

SEQ ID NO: 823450 - DNA, 20 bp, mouse
gtggccagcactgcaggatg

SEQ ID NO: 823451 - DNA, 20 bp, mouse
gttactgggcatttaagcgg

SEQ ID NO: 823452 - DNA, 20 bp, mouse
gtggtggcacatactctccc

SEQ ID NO: 823453 - DNA, 20 bp, mouse
gagggaggaccagactctgc

SEQ ID NO: 823454 - DNA, 20 bp, mouse
gggcatttaagcggaggaca

SEQ ID NO: 823455 - DNA, 20 bp, mouse
gagaagctctggccaagaga

SEQ ID NO: 823456 - DNA, 20 bp, mouse
ggagagatgtagactatcag

SEQ ID NO: 823457 - DNA, 20 bp, mouse
gagccccgagcctagcggga

SEQ ID NO: 823458 - DNA, 20 bp, mouse
gcccgtaagccccggggaag

SEQ ID NO: 823459 - DNA, 20 bp, mouse
gagcctgggctctcagagta

SEQ ID NO: 823460 - DNA, 20 bp, mouse
gggctctcagagtaaggttg

SEQ ID NO: 823461 - DNA, 20 bp, mouse
gggggaaggggcaaagtccg

SEQ ID NO: 823462 - DNA, 20 bp, mouse
gcccgcccccgtaagccccg

SEQ ID NO: 823463 - DNA, 20 bp, mouse
gcgaagtaacaaagtagcct

SEQ ID NO: 823464 - DNA, 20 bp, mouse
ggtagactatcagaggaccg

SEQ ID NO: 823465 - DNA, 20 bp, mouse
gggaccggggacctgtgagc

SEQ ID NO: 823466 - DNA, 20 bp, mouse
ggacctcgtgagccaatcat

SEQ ID NO: 823467 - DNA, 20 bp, mouse
gacagcctcgcggtcgcgtt

SEQ ID NO: 823468 - DNA, 20 bp, mouse
gccggccgaacgcgaccgcg

SEQ ID NO: 823469 - DNA, 20 bp, mouse
gggtcacatgagagccccga

SEQ ID NO: 823470 - DNA, 20 bp, mouse
gagagaattggaagcgcctg

SEQ ID NO: 823471 - DNA, 20 bp, mouse
gccaaccccagagctgaaag

SEQ ID NO: 823472 - DNA, 20 bp, mouse
gagctttaagcgcagcttga

SEQ ID NO: 823473 - DNA, 20 bp, mouse
ggtcgaacaagccctggcat

SEQ ID NO: 823474 - DNA, 20 bp, mouse
gagctgctggtacagcctcg

SEQ ID NO: 823475 - DNA, 20 bp, mouse
gcatgagagccccgaagggt

SEQ ID NO: 823476 - DNA, 20 bp, mouse
gggaccggggcggagcttca

SEQ ID NO: 823477 - DNA, 20 bp, mouse
gccccggtccgcccctctct

SEQ ID NO: 823478 - DNA, 20 bp, mouse
gcgcccctctctcggagacg

SEQ ID NO: 823479 - DNA, 20 bp, mouse
gggacctcgtctccgagaga

SEQ ID NO: 823480 - DNA, 20 bp, mouse
gagcaagggataaaacccca

SEQ ID NO: 823481 - DNA, 20 bp, mouse
gtccgagagaggggcggacc

SEQ ID NO: 823482 - DNA, 20 bp, mouse
ggggtcacacgaatcccgat

SEQ ID NO: 823483 - DNA, 20 bp, mouse
gtgaccctgaagctccgccc

SEQ ID NO: 823484 - DNA, 20 bp, mouse
gctgacactgtggagtgaag

SEQ ID NO: 823485 - DNA, 20 bp, mouse
ggtcttacacagtttaactt

SEQ ID NO: 823486 - DNA, 20 bp, mouse
gtggtcacgcaaagacgctg

SEQ ID NO: 823487 - DNA, 20 bp, mouse
ggaaaagtgaatagtggcag

SEQ ID NO: 823488 - DNA, 20 bp, mouse
gttttcggacgaccagtaga

SEQ ID NO: 823489 - DNA, 20 bp, mouse
gaaagcctgctgttagaagc

SEQ ID NO: 823490 - DNA, 20 bp, mouse
gggcagaggagacggcgggt

SEQ ID NO: 823491 - DNA, 20 bp, mouse
gtggctcataaaggaggcag

SEQ ID NO: 823492 - DNA, 20 bp, mouse
gtagtggcagaggagacggc

SEQ ID NO: 823493 - DNA, 20 bp, mouse
gagaagctggataccttaac

SEQ ID NO: 823494 - DNA, 20 bp, mouse
ggcgcctccaaagcctgtta

SEQ ID NO: 823495 - DNA, 20 bp, mouse
gcaaagacgctgcggcttgc

SEQ ID NO: 823496 - DNA, 20 bp, mouse
gcctgcccgaatcctcggag

SEQ ID NO: 823497 - DNA, 20 bp, mouse
gggaatcggtccatcctcgg

SEQ ID NO: 823498 - DNA, 20 bp, mouse
gcagccttctgccttctgat

SEQ ID NO: 823499 - DNA, 20 bp, mouse
gaacctccgtggggtgttag

SEQ ID NO: 823500 - DNA, 20 bp, mouse
gagaaggcagaaggctgcct

SEQ ID NO: 823501 - DNA, 20 bp, mouse
gctcggaggggaacctccgt

SEQ ID NO: 823502 - DNA, 20 bp, mouse
gcccgccctgcccgaatcct

SEQ ID NO: 823503 - DNA, 20 bp, mouse
gggagtaacgtgtgttcgct

SEQ ID NO: 823504 - DNA, 20 bp, mouse
gaggttcccctccgaggatt

SEQ ID NO: 823505 - DNA, 20 bp, mouse
gtggcagcagccaatgggcg

SEQ ID NO: 823506 - DNA, 20 bp, mouse
gagggactgggcgggaaaag

SEQ ID NO: 823507 - DNA, 20 bp, mouse
gagtaagcgtcatctctggg

SEQ ID NO: 823508 - DNA, 20 bp, mouse
gtcatctctgggcgggtctc

SEQ ID NO: 823509 - DNA, 20 bp, mouse
gaacccacctctggggtcca

SEQ ID NO: 823510 - DNA, 20 bp, mouse
gtcgggctggaagaagtgtc

SEQ ID NO: 823511 - DNA, 20 bp, mouse
gggcgggccaatatcaagaa

SEQ ID NO: 823512 - DNA, 20 bp, mouse
gctgggagcctgcacgttgg

SEQ ID NO: 823513 - DNA, 20 bp, mouse
ggctcccagctgtgccacac

SEQ ID NO: 823514 - DNA, 20 bp, mouse
gggtctggagactgctcgca

SEQ ID NO: 823515 - DNA, 20 bp, mouse
gcagggtggcccggagaatg

SEQ ID NO: 823516 - DNA, 20 bp, mouse
gtgtcccggtgagtcctctg

SEQ ID NO: 823517 - DNA, 20 bp, mouse
gtctccctcctgctgcggga

SEQ ID NO: 823518 - DNA, 20 bp, mouse
gtccccgcagaggactcacc

SEQ ID NO: 823519 - DNA, 20 bp, mouse
gccggggtgcggtgactcga

SEQ ID NO: 823520 - DNA, 20 bp, mouse
gaccaggcgccgggagggat

SEQ ID NO: 823521 - DNA, 20 bp, mouse
gtgctgggatagagggacgg

SEQ ID NO: 823522 - DNA, 20 bp, mouse
gcgggcgtccggccttcctg

SEQ ID NO: 823523 - DNA, 20 bp, mouse
gcatccttcccgcagcagga

SEQ ID NO: 823524 - DNA, 20 bp, mouse
gggaaggcggtgacgcgctc

SEQ ID NO: 823525 - DNA, 20 bp, mouse
ggacgcgggtgctgggatag

SEQ ID NO: 823526 - DNA, 20 bp, mouse
gcagcccggagcaagggcgg

SEQ ID NO: 823527 - DNA, 20 bp, mouse
ggctgcaccgccgggtccga

SEQ ID NO: 823528 - DNA, 20 bp, mouse
gaccaggcagcccggagcaa

SEQ ID NO: 823529 - DNA, 20 bp, mouse
ggcgcctggagagtgaccct

SEQ ID NO: 823530 - DNA, 20 bp, mouse
gcgggtgagacgtccctaaa

SEQ ID NO: 823531 - DNA, 20 bp, mouse
gggagaggcacggtcaggtg

SEQ ID NO: 823532 - DNA, 20 bp, mouse
gaggcagcccggagcaaggg

SEQ ID NO: 823533 - DNA, 20 bp, mouse
gccggaggagaggcacggtc

SEQ ID NO: 823534 - DNA, 20 bp, mouse
gtgcctggtagcaagctagg

SEQ ID NO: 823535 - DNA, 20 bp, mouse
ggcggggccccggagaggaa

SEQ ID NO: 823536 - DNA, 20 bp, mouse
gtgacctgagggaaaggcag

SEQ ID NO: 823537 - DNA, 20 bp, mouse
gaaagcggtccaaatggggt

SEQ ID NO: 823538 - DNA, 20 bp, mouse
gggtccaaatggggtgggcg

SEQ ID NO: 823539 - DNA, 20 bp, mouse
gcagaggctcagggcattgg

SEQ ID NO: 823540 - DNA, 20 bp, mouse
gagctggaggcaaaaaccca

SEQ ID NO: 823541 - DNA, 20 bp, mouse
gcccaaaagcggtccaaatg

SEQ ID NO: 823542 - DNA, 20 bp, mouse
gggtctggggacctgtaggt

SEQ ID NO: 823543 - DNA, 20 bp, mouse
gtggaccgcttttggggagg

SEQ ID NO: 823544 - DNA, 20 bp, mouse
ggctgagtgacctgagggaa

SEQ ID NO: 823545 - DNA, 20 bp, mouse
gggtgggcggagcaccacta

SEQ ID NO: 823546 - DNA, 20 bp, mouse
gtgcaaggaaacgccagaca

SEQ ID NO: 823547 - DNA, 20 bp, mouse
gaggaaacgccagacagggg

SEQ ID NO: 823548 - DNA, 20 bp, mouse
gaggacagtcagcggtgcga

SEQ ID NO: 823549 - DNA, 20 bp, mouse
gagccaatcctgaggcaggt

SEQ ID NO: 823550 - DNA, 20 bp, mouse
gggagccttagccaatcctg

SEQ ID NO: 823551 - DNA, 20 bp, mouse
gcgaggggtagaacgagacc

SEQ ID NO: 823552 - DNA, 20 bp, mouse
ggccccctagggcgaggctt

SEQ ID NO: 823553 - DNA, 20 bp, mouse
ggcccaagcctcgccctagg

SEQ ID NO: 823554 - DNA, 20 bp, mouse
gacgctcccgcccgagtgca

SEQ ID NO: 823555 - DNA, 20 bp, mouse
gaaagtggagcctatcgtag

SEQ ID NO: 823556 - DNA, 20 bp, mouse
gggtccgcgcgctccctacc

SEQ ID NO: 823557 - DNA, 20 bp, mouse
gaggccaagcagccgagggg

SEQ ID NO: 823558 - DNA, 20 bp, mouse
gctacccggcgtgcgaaact

SEQ ID NO: 823559 - DNA, 20 bp, mouse
gactgcgggattcagaattg

SEQ ID NO: 823560 - DNA, 20 bp, mouse
gcgcaccgtcccccccccct

SEQ ID NO: 823561 - DNA, 20 bp, mouse
gaaaaccgaaagtaccgggc

SEQ ID NO: 823562 - DNA, 20 bp, mouse
gccaagcagccgaggggggg

SEQ ID NO: 823563 - DNA, 20 bp, mouse
gaggaaggccaagcagccga

SEQ ID NO: 823564 - DNA, 20 bp, mouse
gggtgcaaaccgcagacagg

SEQ ID NO: 823565 - DNA, 20 bp, mouse
ggggggggacggtgcgctga

SEQ ID NO: 823566 - DNA, 20 bp, mouse
gcgctcccgcccccctagtc

SEQ ID NO: 823567 - DNA, 20 bp, mouse
gcgccaatcactgaagtcgg

SEQ ID NO: 823568 - DNA, 20 bp, mouse
gcctggctaagactttagtt

SEQ ID NO: 823569 - DNA, 20 bp, mouse
gtgggctccgcccgactagg

SEQ ID NO: 823570 - DNA, 20 bp, mouse
gtcccgcccccctagtcggg

SEQ ID NO: 823571 - DNA, 20 bp, mouse
gcaccgccgacttcagtgat

SEQ ID NO: 823572 - DNA, 20 bp, mouse
gaaccgaaccgtgagttcta

SEQ ID NO: 823573 - DNA, 20 bp, mouse
ggacctgcgtcccttaggat

SEQ ID NO: 823574 - DNA, 20 bp, mouse
gcacctaggactccatagaa

SEQ ID NO: 823575 - DNA, 20 bp, mouse
ggcgtcccttaggataggga

SEQ ID NO: 823576 - DNA, 20 bp, mouse
gcgctcgcccggaggcctca

SEQ ID NO: 823577 - DNA, 20 bp, mouse
gtcgcccggaggcctcaggg

SEQ ID NO: 823578 - DNA, 20 bp, mouse
gcggagctgcagtgtagaca

SEQ ID NO: 823579 - DNA, 20 bp, mouse
gaaggcggggtcgagagctc

SEQ ID NO: 823580 - DNA, 20 bp, mouse
gtgggcacacctccctgagt

SEQ ID NO: 823581 - DNA, 20 bp, mouse
gggcgtgtcttggccagtgg

SEQ ID NO: 823582 - DNA, 20 bp, mouse
gaggaagtacagcgctcgcc

SEQ ID NO: 823583 - DNA, 20 bp, mouse
gtccatgcataattaaggaa

SEQ ID NO: 823584 - DNA, 20 bp, mouse
gcagaacagccaactcaggg

SEQ ID NO: 823585 - DNA, 20 bp, mouse
gaagtacagcgctcgcccgg

SEQ ID NO: 823586 - DNA, 20 bp, mouse
ggcacaggaaagcctcaagt

SEQ ID NO: 823587 - DNA, 20 bp, mouse
gacaaatgcaaattgtccca

SEQ ID NO: 823588 - DNA, 20 bp, mouse
gagtaagaggtacacactga

SEQ ID NO: 823589 - DNA, 20 bp, mouse
gagagtggctactagggatg

SEQ ID NO: 823590 - DNA, 20 bp, mouse
gtgagaagacaggcttacac

SEQ ID NO: 823591 - DNA, 20 bp, mouse
gaggggagcacacagactac

SEQ ID NO: 823592 - DNA, 20 bp, mouse
ggagttatgtctaggaaaac

SEQ ID NO: 823593 - DNA, 20 bp, mouse
gacagagctgggtggaacct

SEQ ID NO: 823594 - DNA, 20 bp, mouse
gagaaacgctttacaaagtc

SEQ ID NO: 823595 - DNA, 20 bp, mouse
gggggcggtgctctgccaag

SEQ ID NO: 823596 - DNA, 20 bp, mouse
gccggggcgccggtaatcga

SEQ ID NO: 823597 - DNA, 20 bp, mouse
gcgccctggcgcactcgccg

SEQ ID NO: 823598 - DNA, 20 bp, mouse
ggggcgccggtaatcgaggg

SEQ ID NO: 823599 - DNA, 20 bp, mouse
gggagcgaccgctgctggga

SEQ ID NO: 823600 - DNA, 20 bp, mouse
gaatgagggaggagcgtcct

SEQ ID NO: 823601 - DNA, 20 bp, mouse
gcgccccggcgagtgcgcca

SEQ ID NO: 823602 - DNA, 20 bp, mouse
gtgctcccctgcggctccgg

SEQ ID NO: 823603 - DNA, 20 bp, mouse
gagggggcaccccgctgtag

SEQ ID NO: 823604 - DNA, 20 bp, mouse
gccgcaggggagcacagacc

SEQ ID NO: 823605 - DNA, 20 bp, mouse
gatcgagggcggaggcaagg

SEQ ID NO: 823606 - DNA, 20 bp, mouse
gcccctgcgcgaccgccctg

SEQ ID NO: 823607 - DNA, 20 bp, mouse
gagcctcgagggggtgtcca

SEQ ID NO: 823608 - DNA, 20 bp, mouse
gggggcgcggagggaccttg

SEQ ID NO: 823609 - DNA, 20 bp, mouse
ggggcaggaaccaggaagcg

SEQ ID NO: 823610 - DNA, 20 bp, mouse
gcggagggaccttggggctg

SEQ ID NO: 823611 - DNA, 20 bp, mouse
gcgccctggacaccccctcg

SEQ ID NO: 823612 - DNA, 20 bp, mouse
gccccgcagggcggtcgcgc

SEQ ID NO: 823613 - DNA, 20 bp, mouse
gcctgcgcgcagtggagcgc

SEQ ID NO: 823614 - DNA, 20 bp, mouse
gcggcccaagccgtcacccc

SEQ ID NO: 823615 - DNA, 20 bp, mouse
gccggcgggaggagagtcgg

SEQ ID NO: 823616 - DNA, 20 bp, mouse
gtgggccatggcatacgtgt

SEQ ID NO: 823617 - DNA, 20 bp, mouse
gttcagccgagacccttcag

SEQ ID NO: 823618 - DNA, 20 bp, mouse
gcttcagtggcagagattgt

SEQ ID NO: 823619 - DNA, 20 bp, mouse
gctagctgcggaggggaagt

SEQ ID NO: 823620 - DNA, 20 bp, mouse
gtctcggctgaagctgaaag

SEQ ID NO: 823621 - DNA, 20 bp, mouse
gtgtgattgcgtactagctg

SEQ ID NO: 823622 - DNA, 20 bp, mouse
ggaactcacagctttctgtt

SEQ ID NO: 823623 - DNA, 20 bp, mouse
gaagcctcacgctttctaaa

SEQ ID NO: 823624 - DNA, 20 bp, mouse
ggtaaaatgtaggaatgggg

SEQ ID NO: 823625 - DNA, 20 bp, mouse
gaagggcaccattaagaacc

SEQ ID NO: 823626 - DNA, 20 bp, mouse
ggggaagcacgtagtgggga

SEQ ID NO: 823627 - DNA, 20 bp, mouse
gggtggggaagcacgtagtg

SEQ ID NO: 823628 - DNA, 20 bp, mouse
gtccctccagtgtggttcaa

SEQ ID NO: 823629 - DNA, 20 bp, mouse
gaacctgtatgtacccggtg

SEQ ID NO: 823630 - DNA, 20 bp, mouse
ggggtgaacctgtatgtacc

SEQ ID NO: 823631 - DNA, 20 bp, mouse
gtccccgaggtcccaatctc

SEQ ID NO: 823632 - DNA, 20 bp, mouse
gacctcggggaactgtgcta

SEQ ID NO: 823633 - DNA, 20 bp, mouse
ggctaaggggattagagtaa

SEQ ID NO: 823634 - DNA, 20 bp, mouse
ggtagctaggcagttcgggg

SEQ ID NO: 823635 - DNA, 20 bp, mouse
gctccattgaaccacactgg

SEQ ID NO: 823636 - DNA, 20 bp, mouse
gcacggctgcgctgggtccg

SEQ ID NO: 823637 - DNA, 20 bp, mouse
gcggtctcggcagggaatac

SEQ ID NO: 823638 - DNA, 20 bp, mouse
ggggaaaaaggggtgactgt

SEQ ID NO: 823639 - DNA, 20 bp, mouse
ggcctggcaggaagtgacgg

SEQ ID NO: 823640 - DNA, 20 bp, mouse
gaaaaggggtgactgtagga

SEQ ID NO: 823641 - DNA, 20 bp, mouse
gaggcacgcaaggcccacaa

SEQ ID NO: 823642 - DNA, 20 bp, mouse
gcgtcccgcatgcgctctct

SEQ ID NO: 823643 - DNA, 20 bp, mouse
ggtggggccggcatggaggc

SEQ ID NO: 823644 - DNA, 20 bp, mouse
gctgccgagaccgagctcct

SEQ ID NO: 823645 - DNA, 20 bp, mouse
gtcctgccgcggtgtgtagg

SEQ ID NO: 823646 - DNA, 20 bp, mouse
gcgagagagagctggcgcgg

SEQ ID NO: 823647 - DNA, 20 bp, mouse
gacgccgcctgctccctcct

SEQ ID NO: 823648 - DNA, 20 bp, mouse
ggggtcccagaagccgccag

SEQ ID NO: 823649 - DNA, 20 bp, mouse
ggccgctcgaccgcgaaggg

SEQ ID NO: 823650 - DNA, 20 bp, mouse
gcgctcccgccgcgccctcc

SEQ ID NO: 823651 - DNA, 20 bp, mouse
gggaacggcgcggcgaacaa

SEQ ID NO: 823652 - DNA, 20 bp, mouse
ggcgcgagagagagctggcg

SEQ ID NO: 823653 - DNA, 20 bp, mouse
ggcagcgccccgggatgcgg

SEQ ID NO: 823654 - DNA, 20 bp, mouse
ggcgcggcgggagcgcaggg

SEQ ID NO: 823655 - DNA, 20 bp, mouse
gaatggccgctcgaccgcga

SEQ ID NO: 823656 - DNA, 20 bp, mouse
ggggccaggaaaattcgcgg

SEQ ID NO: 823657 - DNA, 20 bp, mouse
gccggcagcggtgatgggag

SEQ ID NO: 823658 - DNA, 20 bp, mouse
ggaagggccggcagcggtga

SEQ ID NO: 823659 - DNA, 20 bp, mouse
ggcggggccaggaaaattcg

SEQ ID NO: 823660 - DNA, 20 bp, mouse
gagagccgggttgcggggcg

SEQ ID NO: 823661 - DNA, 20 bp, mouse
ggatgggagtgggcgagagc

SEQ ID NO: 823662 - DNA, 20 bp, mouse
gggagaaggctctcactgga

SEQ ID NO: 823663 - DNA, 20 bp, mouse
gctcgccccgccccgcaacc

SEQ ID NO: 823664 - DNA, 20 bp, mouse
ggggcgagagccgggttgcg

SEQ ID NO: 823665 - DNA, 20 bp, mouse
gggacggttagcacaattag

SEQ ID NO: 823666 - DNA, 20 bp, mouse
gtgtgtgcacagggattgtg

SEQ ID NO: 823667 - DNA, 20 bp, mouse
gggcccaagagctgcaccca

SEQ ID NO: 823668 - DNA, 20 bp, mouse
gaagacggctataaaatccc

SEQ ID NO: 823669 - DNA, 20 bp, mouse
gggctaaacggaccagttga

SEQ ID NO: 823670 - DNA, 20 bp, mouse
gaataagcgtgcctgcctat

SEQ ID NO: 823671 - DNA, 20 bp, mouse
gtgcctgcctattggctaaa

SEQ ID NO: 823672 - DNA, 20 bp, mouse
gatcctgaggaccgataaga

SEQ ID NO: 823673 - DNA, 20 bp, mouse
gtatactgaaagcttaggtg

SEQ ID NO: 823674 - DNA, 20 bp, mouse
gcactaggaggaatgcatgt

SEQ ID NO: 823675 - DNA, 20 bp, mouse
gatccctgggtgcagctctt

SEQ ID NO: 823676 - DNA, 20 bp, mouse
ggggcctgcgccaacttcta

SEQ ID NO: 823677 - DNA, 20 bp, mouse
gcaaacgcgtggccgccgcc

SEQ ID NO: 823678 - DNA, 20 bp, mouse
gcaaacgcgtgccattgccc

SEQ ID NO: 823679 - DNA, 20 bp, mouse
gcaactttgtggggcgatcg

SEQ ID NO: 823680 - DNA, 20 bp, mouse
gcgcttcctcccgtagaagt

SEQ ID NO: 823681 - DNA, 20 bp, mouse
gtcccgctgtgttgtcaaac

SEQ ID NO: 823682 - DNA, 20 bp, mouse
gtcccggaggctggaccaat

SEQ ID NO: 823683 - DNA, 20 bp, mouse
gtgacaacacagcgggaggc

SEQ ID NO: 823684 - DNA, 20 bp, mouse
gaggagaagtcggtcttcac

SEQ ID NO: 823685 - DNA, 20 bp, mouse
gaaagttgcagacctggcgg

SEQ ID NO: 823686 - DNA, 20 bp, mouse
gggacccagggtcaccagca

SEQ ID NO: 823687 - DNA, 20 bp, mouse
ggccgtgggaggggcgtcgc

SEQ ID NO: 823688 - DNA, 20 bp, mouse
ggtgggaggggcgtcgccgg

SEQ ID NO: 823689 - DNA, 20 bp, mouse
ggagccctgctggtgaccct

SEQ ID NO: 823690 - DNA, 20 bp, mouse
gcggccgcagcgaagcccct

SEQ ID NO: 823691 - DNA, 20 bp, mouse
gacacccaggggcttcgctg

SEQ ID NO: 823692 - DNA, 20 bp, mouse
gtcgctgcggccgccgtggg

SEQ ID NO: 823693 - DNA, 20 bp, mouse
ggtgctgggcagcgagattc

SEQ ID NO: 823694 - DNA, 20 bp, mouse
ggaagcccctgggtgtgagc

SEQ ID NO: 823695 - DNA, 20 bp, mouse
ggcttcgctgcggccgccgt

SEQ ID NO: 823696 - DNA, 20 bp, mouse
gcgcgggcgggatccacgta

SEQ ID NO: 823697 - DNA, 20 bp, mouse
gcggtcggggcagagtgcgt

SEQ ID NO: 823698 - DNA, 20 bp, mouse
gaggtagtggagtgtaaacg

SEQ ID NO: 823699 - DNA, 20 bp, mouse
gcgcgcaggcgtggggaccg

SEQ ID NO: 823700 - DNA, 20 bp, mouse
gcaagatcgcgcgcaggcgt

SEQ ID NO: 823701 - DNA, 20 bp, mouse
gggtgcccccgagctctgtg

SEQ ID NO: 823702 - DNA, 20 bp, mouse
gggctgtaggggttagtctg

SEQ ID NO: 823703 - DNA, 20 bp, mouse
gcacgtagggctgctcccac

SEQ ID NO: 823704 - DNA, 20 bp, mouse
ggtgacgcgcaggggggcgc

SEQ ID NO: 823705 - DNA, 20 bp, mouse
gtctccgcaagatcgcgcgc

SEQ ID NO: 823706 - DNA, 20 bp, mouse
gtaggggaacggctggtgga

SEQ ID NO: 823707 - DNA, 20 bp, mouse
gggaacggctggtggagggt

SEQ ID NO: 823708 - DNA, 20 bp, mouse
gctgagactccctaggggaa

SEQ ID NO: 823709 - DNA, 20 bp, mouse
gcgccctgcactacaagtgg

SEQ ID NO: 823710 - DNA, 20 bp, mouse
gcaggctctgagactcccta

SEQ ID NO: 823711 - DNA, 20 bp, mouse
gccgcccgtggggccggacc

SEQ ID NO: 823712 - DNA, 20 bp, mouse
gtccctaggggaacggctgg

SEQ ID NO: 823713 - DNA, 20 bp, mouse
gggtggcactgctggataaa

SEQ ID NO: 823714 - DNA, 20 bp, mouse
gcctcctcgtccatggtggt

SEQ ID NO: 823715 - DNA, 20 bp, mouse
ggccggacctggcggggtag

SEQ ID NO: 823716 - DNA, 20 bp, mouse
ggccaagcggggtataaaag

SEQ ID NO: 823717 - DNA, 20 bp, mouse
gggaatcccgcacagctgga

SEQ ID NO: 823718 - DNA, 20 bp, mouse
gtccgggaagagttcaacct

SEQ ID NO: 823719 - DNA, 20 bp, mouse
ggacgttctccgctgccaag

SEQ ID NO: 823720 - DNA, 20 bp, mouse
gtaagccaaagagcggagga

SEQ ID NO: 823721 - DNA, 20 bp, mouse
gcaggtcagctgcagcctag

SEQ ID NO: 823722 - DNA, 20 bp, mouse
gagagctgcacaataagttc

SEQ ID NO: 823723 - DNA, 20 bp, mouse
gagctgtgaagcaaagtttc

SEQ ID NO: 823724 - DNA, 20 bp, mouse
gtgcagctctggctcgcaga

SEQ ID NO: 823725 - DNA, 20 bp, mouse
ggggtataaaaggggttttc

SEQ ID NO: 823726 - DNA, 20 bp, mouse
gacactagaggaggagcttt

SEQ ID NO: 823727 - DNA, 20 bp, mouse
gaaatgtggtgggggacatg

SEQ ID NO: 823728 - DNA, 20 bp, mouse
gctaacctaatcacagtgtg

SEQ ID NO: 823729 - DNA, 20 bp, mouse
ggtgaggctgaagacatcca

SEQ ID NO: 823730 - DNA, 20 bp, mouse
gtcagcctcacactgtgatt

SEQ ID NO: 823731 - DNA, 20 bp, mouse
ggtcttactgcatccattac

SEQ ID NO: 823732 - DNA, 20 bp, mouse
ggagttgggggtaaatgtgg

SEQ ID NO: 823733 - DNA, 20 bp, mouse
gtggcacagagactgcaggg

SEQ ID NO: 823734 - DNA, 20 bp, mouse
gagcatgtgtgcccagactc

SEQ ID NO: 823735 - DNA, 20 bp, mouse
gttgggggtaaatgtggtgg

SEQ ID NO: 823736 - DNA, 20 bp, mouse
gttggtggaagtgagcaagt

SEQ ID NO: 823737 - DNA, 20 bp, mouse
gataatagccagtctttctg

SEQ ID NO: 823738 - DNA, 20 bp, mouse
ggccagtctttctgaggaac

SEQ ID NO: 823739 - DNA, 20 bp, mouse
gcccagttcctcagaaagac

SEQ ID NO: 823740 - DNA, 20 bp, mouse
gctattatacattacagagg

SEQ ID NO: 823741 - DNA, 20 bp, mouse
ggaaatatttatcctgtaca

SEQ ID NO: 823742 - DNA, 20 bp, mouse
gtgagcaagtgggtgtgccc

SEQ ID NO: 823743 - DNA, 20 bp, mouse
gtggctattatacattacag

SEQ ID NO: 823744 - DNA, 20 bp, mouse
gggggaatgagtgtgacctc

SEQ ID NO: 823745 - DNA, 20 bp, mouse
ggggaaatgctgagtagagt

SEQ ID NO: 823746 - DNA, 20 bp, mouse
gttgggggaagtgagcaaat

SEQ ID NO: 823747 - DNA, 20 bp, mouse
gacagtatcagaggaactgg

SEQ ID NO: 823748 - DNA, 20 bp, mouse
gtggaaataatacatgatag

SEQ ID NO: 823749 - DNA, 20 bp, mouse
gataacctaagtttctaaat

SEQ ID NO: 823750 - DNA, 20 bp, mouse
gaatgggtgtgccaagactc

SEQ ID NO: 823751 - DNA, 20 bp, mouse
gtggcacagagattgcagag

SEQ ID NO: 823752 - DNA, 20 bp, mouse
gtccacagtatcagaggaac

SEQ ID NO: 823753 - DNA, 20 bp, mouse
gaaataatacatgatagagg

SEQ ID NO: 823754 - DNA, 20 bp, mouse
gttgttgtgtttttagagtc

SEQ ID NO: 823755 - DNA, 20 bp, mouse
gggggaatgagtgtgatctc

SEQ ID NO: 823756 - DNA, 20 bp, mouse
gttgggagaaaatgagttga

SEQ ID NO: 823757 - DNA, 20 bp, mouse
gggagtgtgtgcccaggact

SEQ ID NO: 823758 - DNA, 20 bp, mouse
gagggaacgaggcacagcag

SEQ ID NO: 823759 - DNA, 20 bp, mouse
gactcagcatttcctctcag

SEQ ID NO: 823760 - DNA, 20 bp, mouse
gtggcacagagcgtgcagga

SEQ ID NO: 823761 - DNA, 20 bp, mouse
gttattggcacagagcgtgc

SEQ ID NO: 823762 - DNA, 20 bp, mouse
gcttatctctgcaatatctg

SEQ ID NO: 823763 - DNA, 20 bp, mouse
ggaattgctgggtgtcaagg

SEQ ID NO: 823764 - DNA, 20 bp, mouse
gtagaaactctggttgtgca

SEQ ID NO: 823765 - DNA, 20 bp, mouse
ggagattagtcaataatgtc

SEQ ID NO: 823766 - DNA, 20 bp, mouse
gcgagcgctaatcccaggct

SEQ ID NO: 823767 - DNA, 20 bp, mouse
gtagggcgagcgctaatccc

SEQ ID NO: 823768 - DNA, 20 bp, mouse
gtagtgacacagagctgcga

SEQ ID NO: 823769 - DNA, 20 bp, mouse
ggactgctgtgacgaccaat

SEQ ID NO: 823770 - DNA, 20 bp, mouse
gcgctgcaggggcggtacca

SEQ ID NO: 823771 - DNA, 20 bp, mouse
ggcggcaagcgctcgctgga

SEQ ID NO: 823772 - DNA, 20 bp, mouse
gctcgctggagggaaccaaa

SEQ ID NO: 823773 - DNA, 20 bp, mouse
gtcccaggctgggctccgat

SEQ ID NO: 823774 - DNA, 20 bp, mouse
ggctctgtgtcactactcag

SEQ ID NO: 823775 - DNA, 20 bp, mouse
gccctgcagcgggactggcc

SEQ ID NO: 823776 - DNA, 20 bp, mouse
ggcaactggcggggtctctt

SEQ ID NO: 823777 - DNA, 20 bp, mouse
gagaccccgccagttgcggg

SEQ ID NO: 823778 - DNA, 20 bp, mouse
gcggccccgcgacaaggatg

SEQ ID NO: 823779 - DNA, 20 bp, mouse
gagagccccccgcaactggc

SEQ ID NO: 823780 - DNA, 20 bp, mouse
ggctggggtgcgcacggcag

SEQ ID NO: 823781 - DNA, 20 bp, mouse
gcgggcccgggcttcgctgg

SEQ ID NO: 823782 - DNA, 20 bp, mouse
ggggcgggcccgggcttcgc

SEQ ID NO: 823783 - DNA, 20 bp, mouse
gctctccaacaggttattcc

SEQ ID NO: 823784 - DNA, 20 bp, mouse
gtcctgacgaccaccagcgc

SEQ ID NO: 823785 - DNA, 20 bp, mouse
gccggcccccagcgaagccc

SEQ ID NO: 823786 - DNA, 20 bp, mouse
ggccgagcgtggtactacgg

SEQ ID NO: 823787 - DNA, 20 bp, mouse
gccggccgagcgtggtacta

SEQ ID NO: 823788 - DNA, 20 bp, mouse
gggtctgggaacgcccctag

SEQ ID NO: 823789 - DNA, 20 bp, mouse
gggggcggggggatgcgccg

SEQ ID NO: 823790 - DNA, 20 bp, mouse
gcccgccgtagtaccacgct

SEQ ID NO: 823791 - DNA, 20 bp, mouse
gactgcgcgtgcgtggtcgt

SEQ ID NO: 823792 - DNA, 20 bp, mouse
gacaccgggatccgctgctc

SEQ ID NO: 823793 - DNA, 20 bp, mouse
gcagctgccgcggcgacacc

SEQ ID NO: 823794 - DNA, 20 bp, mouse
ggtcgtgggccccgccccta

SEQ ID NO: 823795 - DNA, 20 bp, mouse
gggggcgttcccagaccgat

SEQ ID NO: 823796 - DNA, 20 bp, mouse
gtcagggctaggctaactga

SEQ ID NO: 823797 - DNA, 20 bp, mouse
ggcaagtcccgcctatttca

SEQ ID NO: 823798 - DNA, 20 bp, mouse
gaggaaggggcggtaacctg

SEQ ID NO: 823799 - DNA, 20 bp, mouse
gctcctctgcacctccggat

SEQ ID NO: 823800 - DNA, 20 bp, mouse
gtgagcaggcgaggaagggg

SEQ ID NO: 823801 - DNA, 20 bp, mouse
ggggtcttgacgacacggat

SEQ ID NO: 823802 - DNA, 20 bp, mouse
gaaataggcgggacttgccg

SEQ ID NO: 823803 - DNA, 20 bp, mouse
gggagcgggtcttgacgaca

SEQ ID NO: 823804 - DNA, 20 bp, mouse
gggtcccggcagcttctagt

SEQ ID NO: 823805 - DNA, 20 bp, mouse
gcgcggagtgtccaatccgg

SEQ ID NO: 823806 - DNA, 20 bp, mouse
gcgccccgagacccctcaat

SEQ ID NO: 823807 - DNA, 20 bp, mouse
gagctcccgcagccaattga

SEQ ID NO: 823808 - DNA, 20 bp, mouse
gggcccaggggccggccacc

SEQ ID NO: 823809 - DNA, 20 bp, mouse
gccaggggccggccacccgg

SEQ ID NO: 823810 - DNA, 20 bp, mouse
gcccgcgccgcggggcactc

SEQ ID NO: 823811 - DNA, 20 bp, mouse
gcagccaattgaggggtctc

SEQ ID NO: 823812 - DNA, 20 bp, mouse
gtctcggggcgccgcagagc

SEQ ID NO: 823813 - DNA, 20 bp, mouse
ggacaccagctgaaccccgg

SEQ ID NO: 823814 - DNA, 20 bp, mouse
gacccactcggcaccgacgg

SEQ ID NO: 823815 - DNA, 20 bp, mouse
ggcacagaactctcccgctg

SEQ ID NO: 823816 - DNA, 20 bp, mouse
ggggctatttggatctaggt

SEQ ID NO: 823817 - DNA, 20 bp, mouse
gtgggcgcccgagctgacat

SEQ ID NO: 823818 - DNA, 20 bp, mouse
gagggcggtaaacaagatgg

SEQ ID NO: 823819 - DNA, 20 bp, mouse
gagtaagcaagcgactgtaa

SEQ ID NO: 823820 - DNA, 20 bp, mouse
gccgtcgtcgcacgtcgcaa

SEQ ID NO: 823821 - DNA, 20 bp, mouse
ggaggcgggtccgaaaggtg

SEQ ID NO: 823822 - DNA, 20 bp, mouse
ggcgtgatctaaattctcat

SEQ ID NO: 823823 - DNA, 20 bp, mouse
gtgtctgagacgcccgtcaa

SEQ ID NO: 823824 - DNA, 20 bp, mouse
gtgtcggtctaggaaagggg

SEQ ID NO: 823825 - DNA, 20 bp, mouse
gactgtaagggagcggccgt

SEQ ID NO: 823826 - DNA, 20 bp, mouse
gagacctggggccccgttag

SEQ ID NO: 823827 - DNA, 20 bp, mouse
gcggctctgggtggcccctt

SEQ ID NO: 823828 - DNA, 20 bp, mouse
gctaccggaagccacgccct

SEQ ID NO: 823829 - DNA, 20 bp, mouse
gcagagccgagctagacctg

SEQ ID NO: 823830 - DNA, 20 bp, mouse
gtgacacatcggctcgccca

SEQ ID NO: 823831 - DNA, 20 bp, mouse
gcccgttaggggcttaatcc

SEQ ID NO: 823832 - DNA, 20 bp, mouse
gggcgagccgatgtgtcagt

SEQ ID NO: 823833 - DNA, 20 bp, mouse
gagccgatgtgtcagtagga

SEQ ID NO: 823834 - DNA, 20 bp, mouse
ggcgtggcttccggtagcga

SEQ ID NO: 823835 - DNA, 20 bp, mouse
gcagtctgcaaacaagagtc

SEQ ID NO: 823836 - DNA, 20 bp, mouse
gtggggcccggctagacctg

SEQ ID NO: 823837 - DNA, 20 bp, mouse
ggtggggacccggaagtgag

SEQ ID NO: 823838 - DNA, 20 bp, mouse
gacccggaagtgagaggctg

SEQ ID NO: 823839 - DNA, 20 bp, mouse
gagggccaagtgggaaccct

SEQ ID NO: 823840 - DNA, 20 bp, mouse
gagaggcggcaagaggatgt

SEQ ID NO: 823841 - DNA, 20 bp, mouse
gacgcagggactagtaccaa

SEQ ID NO: 823842 - DNA, 20 bp, mouse
ggcgtcttgacccttactga

SEQ ID NO: 823843 - DNA, 20 bp, mouse
gggtttctctatctcgccga

SEQ ID NO: 823844 - DNA, 20 bp, mouse
gctcgccgagggttcccact

SEQ ID NO: 823845 - DNA, 20 bp, mouse
gggccccagcctctcacttc

SEQ ID NO: 823846 - DNA, 20 bp, mouse
gggagcgattacggagggtg

SEQ ID NO: 823847 - DNA, 20 bp, mouse
ggcagcgcgtgctgtgaggc

SEQ ID NO: 823848 - DNA, 20 bp, mouse
ggagggtggggttgtcacgt

SEQ ID NO: 823849 - DNA, 20 bp, mouse
ggccggcagcgcgtgctgtg

SEQ ID NO: 823850 - DNA, 20 bp, mouse
gtgaggccgggcctcaggag

SEQ ID NO: 823851 - DNA, 20 bp, mouse
gcatcccggaactactctga

SEQ ID NO: 823852 - DNA, 20 bp, mouse
gcaatcggagcgattacgga

SEQ ID NO: 823853 - DNA, 20 bp, mouse
gtgtgcaggccgggttgggg

SEQ ID NO: 823854 - DNA, 20 bp, mouse
gcgcctgaagacttggttgc

SEQ ID NO: 823855 - DNA, 20 bp, mouse
gtgctgtgaggccgggcctc

SEQ ID NO: 823856 - DNA, 20 bp, mouse
gggtgcgggcgacggaagtg

SEQ ID NO: 823857 - DNA, 20 bp, mouse
ggtcgggagccaatcagcag

SEQ ID NO: 823858 - DNA, 20 bp, mouse
gccccagtgagcgctctggt

SEQ ID NO: 823859 - DNA, 20 bp, mouse
gaggaggtggaggtcggtca

SEQ ID NO: 823860 - DNA, 20 bp, mouse
gccgccctcagcgtcggagt

SEQ ID NO: 823861 - DNA, 20 bp, mouse
gcgcccgcaccgctgctgat

SEQ ID NO: 823862 - DNA, 20 bp, mouse
gcgcgccccagtgagcgctc

SEQ ID NO: 823863 - DNA, 20 bp, mouse
gaggtccgtctgcaccggag

SEQ ID NO: 823864 - DNA, 20 bp, mouse
ggcgccggggcccgtgagag

SEQ ID NO: 823865 - DNA, 20 bp, mouse
ggggcgaggtccgtctgcac

SEQ ID NO: 823866 - DNA, 20 bp, mouse
gcgggcaggcgggcgctctc

SEQ ID NO: 823867 - DNA, 20 bp, mouse
ggggccagggcgggtggaga

SEQ ID NO: 823868 - DNA, 20 bp, mouse
ggctgtgcgccggggtcctt

SEQ ID NO: 823869 - DNA, 20 bp, mouse
gccgcagggaggcgcgactg

SEQ ID NO: 823870 - DNA, 20 bp, mouse
ggaggcgcgactgcggccta

SEQ ID NO: 823871 - DNA, 20 bp, mouse
gaggagccgccgggcgccct

SEQ ID NO: 823872 - DNA, 20 bp, mouse
gtgcggcctagggcgcccgg

SEQ ID NO: 823873 - DNA, 20 bp, mouse
gcgcctgcgcgcccgcaggg

SEQ ID NO: 823874 - DNA, 20 bp, mouse
gcgcggaagagagctgagtt

SEQ ID NO: 823875 - DNA, 20 bp, mouse
ggcccaccccgcggttccga

SEQ ID NO: 823876 - DNA, 20 bp, mouse
gccagctcgggcatatctca

SEQ ID NO: 823877 - DNA, 20 bp, mouse
gtcccaggagaacttgcggt

SEQ ID NO: 823878 - DNA, 20 bp, mouse
gaggtgttacgcaagtgctc

SEQ ID NO: 823879 - DNA, 20 bp, mouse
ggcccaccgcaagttctcct

SEQ ID NO: 823880 - DNA, 20 bp, mouse
gcaggctgcgcggtaggatg

SEQ ID NO: 823881 - DNA, 20 bp, mouse
gctgggctgcccctcctgtc

SEQ ID NO: 823882 - DNA, 20 bp, mouse
gaagtgctccggggccctga

SEQ ID NO: 823883 - DNA, 20 bp, mouse
gtcccagcaggctgcgcggt

SEQ ID NO: 823884 - DNA, 20 bp, mouse
gcggtgggcggtcagtggag

SEQ ID NO: 823885 - DNA, 20 bp, mouse
gcgtgcccggggtacggggc

SEQ ID NO: 823886 - DNA, 20 bp, mouse
gggtgggcggagcgtgtccc

SEQ ID NO: 823887 - DNA, 20 bp, mouse
ggagcgtgtcccgggaaagt

SEQ ID NO: 823888 - DNA, 20 bp, mouse
ggagcgcggacagggagggt

SEQ ID NO: 823889 - DNA, 20 bp, mouse
gctagcgcggtccagaagag

SEQ ID NO: 823890 - DNA, 20 bp, mouse
ggacggagcgcggacaggga

SEQ ID NO: 823891 - DNA, 20 bp, mouse
gcgtgtcccgggaaagtggg

SEQ ID NO: 823892 - DNA, 20 bp, mouse
gaaggcccgcccgccttcca

SEQ ID NO: 823893 - DNA, 20 bp, mouse
gtcagccagggatagtgaac

SEQ ID NO: 823894 - DNA, 20 bp, mouse
gaggccggcgcagcgagggt

SEQ ID NO: 823895 - DNA, 20 bp, mouse
gaggatgcgccctggaaggc

SEQ ID NO: 823896 - DNA, 20 bp, mouse
gcgtagcgaccgaaccgagg

SEQ ID NO: 823897 - DNA, 20 bp, mouse
gtcaacatcgttacattctc

SEQ ID NO: 823898 - DNA, 20 bp, mouse
ggctggggagcgttaggatc

SEQ ID NO: 823899 - DNA, 20 bp, mouse
ggaacgcccctccctcctaa

SEQ ID NO: 823900 - DNA, 20 bp, mouse
ggcggtgcagcctgccgcct

SEQ ID NO: 823901 - DNA, 20 bp, mouse
ggcaccgcgcatgcgtgaac

SEQ ID NO: 823902 - DNA, 20 bp, mouse
gtacgcatgcgcaaaggaga

SEQ ID NO: 823903 - DNA, 20 bp, mouse
gcaaccgccagacccttagg

SEQ ID NO: 823904 - DNA, 20 bp, mouse
gtagcaaccgccagaccctt

SEQ ID NO: 823905 - DNA, 20 bp, mouse
gagtgagtaggcgaccttgg

SEQ ID NO: 823906 - DNA, 20 bp, mouse
gcgcgtgcgtggaccgtggg

SEQ ID NO: 823907 - DNA, 20 bp, mouse
ggagcgcgtgcgtggaccgt

SEQ ID NO: 823908 - DNA, 20 bp, mouse
gaggcgcagtgcgtgccctg

SEQ ID NO: 823909 - DNA, 20 bp, mouse
gagcgcagccaggccgccca

SEQ ID NO: 823910 - DNA, 20 bp, mouse
gagcgcagccctggtcacgt

SEQ ID NO: 823911 - DNA, 20 bp, mouse
gcacggtcttacatcactgg

SEQ ID NO: 823912 - DNA, 20 bp, mouse
ggctgctgcgctatagcgga

SEQ ID NO: 823913 - DNA, 20 bp, mouse
ggcagccctggtcacgtggg

SEQ ID NO: 823914 - DNA, 20 bp, mouse
ggatcggtggggactgggat

SEQ ID NO: 823915 - DNA, 20 bp, mouse
ggctgctttcgggagcagag

SEQ ID NO: 823916 - DNA, 20 bp, mouse
gcaggacgagcgccccagga

SEQ ID NO: 823917 - DNA, 20 bp, mouse
gccaggggactgtgcgtcgc

SEQ ID NO: 823918 - DNA, 20 bp, mouse
gactgtgcgtcgctggctgg

SEQ ID NO: 823919 - DNA, 20 bp, mouse
gcgccaggggcgtccccaga

SEQ ID NO: 823920 - DNA, 20 bp, mouse
gggattagagccagtcgcca

SEQ ID NO: 823921 - DNA, 20 bp, mouse
gtgccaggggtcaaggtcga

SEQ ID NO: 823922 - DNA, 20 bp, mouse
ggaaagcaggagggcgtggc

SEQ ID NO: 823923 - DNA, 20 bp, mouse
ggctggaaagcaggagggcg

SEQ ID NO: 823924 - DNA, 20 bp, mouse
gtcccaaggtaatacttgga

SEQ ID NO: 823925 - DNA, 20 bp, mouse
gtgcgtcgctggctgggggc

SEQ ID NO: 823926 - DNA, 20 bp, mouse
gccgagggaaggggcctccc

SEQ ID NO: 823927 - DNA, 20 bp, mouse
gccccacttcacagtcgggt

SEQ ID NO: 823928 - DNA, 20 bp, mouse
ggggtaggcggggactccga

SEQ ID NO: 823929 - DNA, 20 bp, mouse
gaggcggggactccgaggga

SEQ ID NO: 823930 - DNA, 20 bp, mouse
gcgggaacccagcagctcca

SEQ ID NO: 823931 - DNA, 20 bp, mouse
gggcggtggcttctaactct

SEQ ID NO: 823932 - DNA, 20 bp, mouse
gcagaactgcgctcacccac

SEQ ID NO: 823933 - DNA, 20 bp, mouse
gcacccactggctccgccac

SEQ ID NO: 823934 - DNA, 20 bp, mouse
gactgtcaaacgctgcgggt

SEQ ID NO: 823935 - DNA, 20 bp, mouse
gctaactcttggctgagatc

SEQ ID NO: 823936 - DNA, 20 bp, mouse
gcgtgcgcagcacacagagt

SEQ ID NO: 823937 - DNA, 20 bp, mouse
gggccggaggggtggactca

SEQ ID NO: 823938 - DNA, 20 bp, mouse
gtgggcacttcaagatagga

SEQ ID NO: 823939 - DNA, 20 bp, mouse
gcggaaaagggtctagttcg

SEQ ID NO: 823940 - DNA, 20 bp, mouse
gaaaagggtctagttcgcgg

SEQ ID NO: 823941 - DNA, 20 bp, mouse
gagtgggctacccgcggaaa

SEQ ID NO: 823942 - DNA, 20 bp, mouse
gacacagagtgggctacccg

SEQ ID NO: 823943 - DNA, 20 bp, mouse
gcggaggggtggactcaggg

SEQ ID NO: 823944 - DNA, 20 bp, mouse
gctcttgggcacttcaagat

SEQ ID NO: 823945 - DNA, 20 bp, mouse
gctcgacccttgcaccgaaa

SEQ ID NO: 823946 - DNA, 20 bp, mouse
gaccccgccccacaacctgg

SEQ ID NO: 823947 - DNA, 20 bp, mouse
gacccggccaccaggttgtg

SEQ ID NO: 823948 - DNA, 20 bp, mouse
gctagccggctgcactggat

SEQ ID NO: 823949 - DNA, 20 bp, mouse
gtagacgctgggttgggttg

SEQ ID NO: 823950 - DNA, 20 bp, mouse
gcgggagtagacgctgggtt

SEQ ID NO: 823951 - DNA, 20 bp, mouse
ggtggggcggggtcacagtc

SEQ ID NO: 823952 - DNA, 20 bp, mouse
gcggggcagccgacgtgtca

SEQ ID NO: 823953 - DNA, 20 bp, mouse
ggcgggcgggagtagacgct

SEQ ID NO: 823954 - DNA, 20 bp, mouse
gtggccgcacctgggaagat

SEQ ID NO: 823955 - DNA, 20 bp, mouse
ggggtcccatccagtgcagc

SEQ ID NO: 823956 - DNA, 20 bp, mouse
gccgacccaggaggtggacg

SEQ ID NO: 823957 - DNA, 20 bp, mouse
gctgactcgccctaccctga

SEQ ID NO: 823958 - DNA, 20 bp, mouse
gtctttaggtgtggcgttcg

SEQ ID NO: 823959 - DNA, 20 bp, mouse
gggcgggctgcccctgacag

SEQ ID NO: 823960 - DNA, 20 bp, mouse
gcccgggagcctggtctccg

SEQ ID NO: 823961 - DNA, 20 bp, mouse
gaggtggacggggtctgcac

SEQ ID NO: 823962 - DNA, 20 bp, mouse
ggcaccccagacacggagcg

SEQ ID NO: 823963 - DNA, 20 bp, mouse
gaccacgttcacatcgtatg

SEQ ID NO: 823964 - DNA, 20 bp, mouse
gcccgggatgccgacccagg

SEQ ID NO: 823965 - DNA, 20 bp, mouse
ggcgaggccactcaccacaa

SEQ ID NO: 823966 - DNA, 20 bp, mouse
ggtacgatgcaggtcaagtc

SEQ ID NO: 823967 - DNA, 20 bp, mouse
gacagcccggaaccaatcac

SEQ ID NO: 823968 - DNA, 20 bp, mouse
ggagtgcaggcgcctcgcga

SEQ ID NO: 823969 - DNA, 20 bp, mouse
gggcacttgatgctgattgg

SEQ ID NO: 823970 - DNA, 20 bp, mouse
gaagtccggaaaggcgtttg

SEQ ID NO: 823971 - DNA, 20 bp, mouse
gtgtaccgagggccttcgcg

SEQ ID NO: 823972 - DNA, 20 bp, mouse
ggggcgtagaggtacgatgc

SEQ ID NO: 823973 - DNA, 20 bp, mouse
gaggcggcgcggctctccgc

SEQ ID NO: 823974 - DNA, 20 bp, mouse
gagcatcaagtgccgagtgc

SEQ ID NO: 823975 - DNA, 20 bp, mouse
gcactccgcaaacgcctttc

SEQ ID NO: 823976 - DNA, 20 bp, mouse
gctactggaccgggaacgga

SEQ ID NO: 823977 - DNA, 20 bp, mouse
gtagaggcggaaaactaggg

SEQ ID NO: 823978 - DNA, 20 bp, mouse
gtgagaagggactgggtcta

SEQ ID NO: 823979 - DNA, 20 bp, mouse
gagggtggatcaaggggcga

SEQ ID NO: 823980 - DNA, 20 bp, mouse
gagttcccggcaccagatcc

SEQ ID NO: 823981 - DNA, 20 bp, mouse
gcccgtagtagggagcaatg

SEQ ID NO: 823982 - DNA, 20 bp, mouse
gagggacgctgatctgagaa

SEQ ID NO: 823983 - DNA, 20 bp, mouse
ggggagcaatggggtcgata

SEQ ID NO: 823984 - DNA, 20 bp, mouse
ggatcctaggggcacgagga

SEQ ID NO: 823985 - DNA, 20 bp, mouse
gggaagaggactggtaactt

SEQ ID NO: 823986 - DNA, 20 bp, mouse
gaggccctacgagtgcagag

SEQ ID NO: 823987 - DNA, 20 bp, mouse
gtacgagtgcagagcggggc

SEQ ID NO: 823988 - DNA, 20 bp, mouse
ggctaggcgcagtcgggtga

SEQ ID NO: 823989 - DNA, 20 bp, mouse
gtgcactcgtagggcctcct

SEQ ID NO: 823990 - DNA, 20 bp, mouse
gcgactgcgcctagccgagg

SEQ ID NO: 823991 - DNA, 20 bp, mouse
gcagagcggggcgggctccc

SEQ ID NO: 823992 - DNA, 20 bp, mouse
gctgtggagaggggccgccg

SEQ ID NO: 823993 - DNA, 20 bp, mouse
gcgcgacaggacaggacaaa

SEQ ID NO: 823994 - DNA, 20 bp, mouse
gcaactgccggaaaagacgg

SEQ ID NO: 823995 - DNA, 20 bp, mouse
gcccctctccacagtctgag

SEQ ID NO: 823996 - DNA, 20 bp, mouse
gcgaaggtgggggtcggtac

SEQ ID NO: 823997 - DNA, 20 bp, mouse
gcggaagtgtaggttggtcc

SEQ ID NO: 823998 - DNA, 20 bp, mouse
gcagaaggacacttccgcct

SEQ ID NO: 823999 - DNA, 20 bp, mouse
gccgtgaggcggtgccaaag

SEQ ID NO: 824000 - DNA, 20 bp, mouse
gccttcgcgggcggaagtgt

SEQ ID NO: 824001 - DNA, 20 bp, mouse
gcgcgggcggaagtgtaggt

SEQ ID NO: 824002 - DNA, 20 bp, mouse
ggacgtcatacgcacccagg

SEQ ID NO: 824003 - DNA, 20 bp, mouse
gcttccgcccgcgaaggtgg

SEQ ID NO: 824004 - DNA, 20 bp, mouse
gtggcaccgcctcacggggc

SEQ ID NO: 824005 - DNA, 20 bp, mouse
gtactggcgctgacgccaga

SEQ ID NO: 824006 - DNA, 20 bp, mouse
gcgcgtggaaacttccctgg

SEQ ID NO: 824007 - DNA, 20 bp, mouse
ggggagccgggcggcttcgg

SEQ ID NO: 824008 - DNA, 20 bp, mouse
ggggagagtgcgattgtcta

SEQ ID NO: 824009 - DNA, 20 bp, mouse
gagtcccaggggggcttctt

SEQ ID NO: 824010 - DNA, 20 bp, mouse
gcgagggcggggtcgttgaa

SEQ ID NO: 824011 - DNA, 20 bp, mouse
gagggggcggcggttcccct

SEQ ID NO: 824012 - DNA, 20 bp, mouse
gggagcctgccacgagggga

SEQ ID NO: 824013 - DNA, 20 bp, mouse
gaccccgccctcggagtccc

SEQ ID NO: 824014 - DNA, 20 bp, mouse
ggcttcggggggtgatttcg

SEQ ID NO: 824015 - DNA, 20 bp, mouse
gtcgctcggggagagttagc

SEQ ID NO: 824016 - DNA, 20 bp, mouse
gcgcccgagaggcacctctt

SEQ ID NO: 824017 - DNA, 20 bp, mouse
gagtcacgtggcacagtggc

SEQ ID NO: 824018 - DNA, 20 bp, mouse
gagagggtgtcgctgacact

SEQ ID NO: 824019 - DNA, 20 bp, mouse
gccactagaggccgcccgag

SEQ ID NO: 824020 - DNA, 20 bp, mouse
gagccgaagaggtgcctctc

SEQ ID NO: 824021 - DNA, 20 bp, mouse
gcggagcggcgggagtcacg

SEQ ID NO: 824022 - DNA, 20 bp, mouse
gcaaaggcaagtcaaggaga

SEQ ID NO: 824023 - DNA, 20 bp, mouse
gagaaactggagaaccctca

SEQ ID NO: 824024 - DNA, 20 bp, mouse
gcgggagtcacgtggcacag

SEQ ID NO: 824025 - DNA, 20 bp, mouse
gaggaggctgggcggagcgg

SEQ ID NO: 824026 - DNA, 20 bp, mouse
gcgccccctcgcctgagttt

SEQ ID NO: 824027 - DNA, 20 bp, mouse
gaggttctgcagagccaagg

SEQ ID NO: 824028 - DNA, 20 bp, mouse
gcaaccccaaactcaggcga

SEQ ID NO: 824029 - DNA, 20 bp, mouse
ggggactgggacagaggcgc

SEQ ID NO: 824030 - DNA, 20 bp, mouse
gccgccgccgcctccctcca

SEQ ID NO: 824031 - DNA, 20 bp, mouse
gccaattggcgatcttatct

SEQ ID NO: 824032 - DNA, 20 bp, mouse
ggggttggtgcgccatcttc

SEQ ID NO: 824033 - DNA, 20 bp, mouse
ggacaacggaagtgacgcat

SEQ ID NO: 824034 - DNA, 20 bp, mouse
gaggatgggcggaagccttc

SEQ ID NO: 824035 - DNA, 20 bp, mouse
gaagatcgccaattggttct

SEQ ID NO: 824036 - DNA, 20 bp, mouse
ggggcaggaggacaatgcta

SEQ ID NO: 824037 - DNA, 20 bp, mouse
ggtggggcactcctggtggg

SEQ ID NO: 824038 - DNA, 20 bp, mouse
ggaggacaatgctaggggtg

SEQ ID NO: 824039 - DNA, 20 bp, mouse
gtagtccgggccaggggggc

SEQ ID NO: 824040 - DNA, 20 bp, mouse
gcacccacccacgctagtcc

SEQ ID NO: 824041 - DNA, 20 bp, mouse
ggggaattgtagtccgggcc

SEQ ID NO: 824042 - DNA, 20 bp, mouse
gcagaccaggcgctccgcat

SEQ ID NO: 824043 - DNA, 20 bp, mouse
gcagagaggcggtgctctcc

SEQ ID NO: 824044 - DNA, 20 bp, mouse
gagggtagaggatcgtgcag

SEQ ID NO: 824045 - DNA, 20 bp, mouse
gtgttagccgggactagcgt

SEQ ID NO: 824046 - DNA, 20 bp, mouse
gccacccctctaccctgagg

SEQ ID NO: 824047 - DNA, 20 bp, mouse
ggccctcaaaagaaacctag

SEQ ID NO: 824048 - DNA, 20 bp, mouse
gtcgatgcatacatgggcgg

SEQ ID NO: 824049 - DNA, 20 bp, mouse
gaacctctaggtttcttttg

SEQ ID NO: 824050 - DNA, 20 bp, mouse
gtcagcctcctcagggtaga

SEQ ID NO: 824051 - DNA, 20 bp, mouse
gggcagggtctacttaatcc

SEQ ID NO: 824052 - DNA, 20 bp, mouse
gcccatgtatgcatcgaaca

SEQ ID NO: 824053 - DNA, 20 bp, mouse
gaccccacccctctaccctg

SEQ ID NO: 824054 - DNA, 20 bp, mouse
gtgaagttgtatgaacctct

SEQ ID NO: 824055 - DNA, 20 bp, mouse
gaataggacttgaatatcat

SEQ ID NO: 824056 - DNA, 20 bp, mouse
gtctgcgggagtcatgtcag

SEQ ID NO: 824057 - DNA, 20 bp, mouse
gccagtccttagctccaagg

SEQ ID NO: 824058 - DNA, 20 bp, mouse
gctcaagcagattggctctc

SEQ ID NO: 824059 - DNA, 20 bp, mouse
gcccaatagtacagtccaag

SEQ ID NO: 824060 - DNA, 20 bp, mouse
ggctaaggcaccactccact

SEQ ID NO: 824061 - DNA, 20 bp, mouse
gtccacttggactgtactat

SEQ ID NO: 824062 - DNA, 20 bp, mouse
gtggaagctcccccccattt

SEQ ID NO: 824063 - DNA, 20 bp, mouse
gcgcagaagctcaagcagat

SEQ ID NO: 824064 - DNA, 20 bp, mouse
ggtactattgggctccaaaa

SEQ ID NO: 824065 - DNA, 20 bp, mouse
gcaaggaggcttccaggcta

SEQ ID NO: 824066 - DNA, 20 bp, mouse
gcgggcgcggcaagaggggg

SEQ ID NO: 824067 - DNA, 20 bp, mouse
gaggagaagggccagagtat

SEQ ID NO: 824068 - DNA, 20 bp, mouse
gacagtggacgaacaaacgc

SEQ ID NO: 824069 - DNA, 20 bp, mouse
ggctgcggcagatgaaatat

SEQ ID NO: 824070 - DNA, 20 bp, mouse
gggtgacagaggctgctaga

SEQ ID NO: 824071 - DNA, 20 bp, mouse
gctatcaaagacaagacagt

SEQ ID NO: 824072 - DNA, 20 bp, mouse
gaagggcgggcgcggcaaga

SEQ ID NO: 824073 - DNA, 20 bp, mouse
gggagtgtcatccatggctg

SEQ ID NO: 824074 - DNA, 20 bp, mouse
gtgtcctacaagaatatctg

SEQ ID NO: 824075 - DNA, 20 bp, mouse
gtgggcttgtctcatagtca

SEQ ID NO: 824076 - DNA, 20 bp, mouse
gcctgagtgagtaacttaga

SEQ ID NO: 824077 - DNA, 20 bp, mouse
ggcaaccccggctccaccaa

SEQ ID NO: 824078 - DNA, 20 bp, mouse
gacccccgccccacacgcac

SEQ ID NO: 824079 - DNA, 20 bp, mouse
gagccggtgcgtgtggggcg

SEQ ID NO: 824080 - DNA, 20 bp, mouse
gcaggcagccggtgcgtgtg

SEQ ID NO: 824081 - DNA, 20 bp, mouse
gcacgcaccggctgcctgtg

SEQ ID NO: 824082 - DNA, 20 bp, mouse
ggggaaggatggatgacttg

SEQ ID NO: 824083 - DNA, 20 bp, mouse
gctaacctcacaggtgtccc

SEQ ID NO: 824084 - DNA, 20 bp, mouse
gagtgagtaacttagaaggc

SEQ ID NO: 824085 - DNA, 20 bp, mouse
gttactcactcaggcaaccc

SEQ ID NO: 824086 - DNA, 20 bp, mouse
ggaaccagataaggggtatg

SEQ ID NO: 824087 - DNA, 20 bp, mouse
gagggctgagtctaagcaac

SEQ ID NO: 824088 - DNA, 20 bp, mouse
gtctaagcaaccggctggac

SEQ ID NO: 824089 - DNA, 20 bp, mouse
gcctgcctcactcaggtccc

SEQ ID NO: 824090 - DNA, 20 bp, mouse
ggatgcctgaaccagataag

SEQ ID NO: 824091 - DNA, 20 bp, mouse
gctccctcctagaagagaat

SEQ ID NO: 824092 - DNA, 20 bp, mouse
gctcctagaagagaattgga

SEQ ID NO: 824093 - DNA, 20 bp, mouse
gctgagtctaagcaaccggc

SEQ ID NO: 824094 - DNA, 20 bp, mouse
gaggaccacaaatagctctg

SEQ ID NO: 824095 - DNA, 20 bp, mouse
gaatgagtgtccagtccagc

SEQ ID NO: 824096 - DNA, 20 bp, mouse
gcctcagagtgcgtgaccgg

SEQ ID NO: 824097 - DNA, 20 bp, mouse
gtctcgctccagcttccagt

SEQ ID NO: 824098 - DNA, 20 bp, mouse
ggtgttggcaggcagatact

SEQ ID NO: 824099 - DNA, 20 bp, mouse
gagaagctgtgagaacaggg

SEQ ID NO: 824100 - DNA, 20 bp, mouse
ggcccgcccaataggtgccc

SEQ ID NO: 824101 - DNA, 20 bp, mouse
ggcctgaagggggtgttggc

SEQ ID NO: 824102 - DNA, 20 bp, mouse
gtggcaggcagatactagga

SEQ ID NO: 824103 - DNA, 20 bp, mouse
gaataggtgcccgggaatgg

SEQ ID NO: 824104 - DNA, 20 bp, mouse
gctaggagggtaagacagtg

SEQ ID NO: 824105 - DNA, 20 bp, mouse
gcgccctcagagtgcgtgac

SEQ ID NO: 824106 - DNA, 20 bp, mouse
gcctaaggccaggtaggagg

SEQ ID NO: 824107 - DNA, 20 bp, mouse
gacggcgggagcacagtttg

SEQ ID NO: 824108 - DNA, 20 bp, mouse
gccacagcaccccctgcgct

SEQ ID NO: 824109 - DNA, 20 bp, mouse
gactccgtcactaacaacag

SEQ ID NO: 824110 - DNA, 20 bp, mouse
gtcggtcctcccagcgcagg

SEQ ID NO: 824111 - DNA, 20 bp, mouse
gcgctgggaggaccgaacgg

SEQ ID NO: 824112 - DNA, 20 bp, mouse
gaagcagtgggaacgaggag

SEQ ID NO: 824113 - DNA, 20 bp, mouse
gtacctggccttaggaaagg

SEQ ID NO: 824114 - DNA, 20 bp, mouse
gacagtggctgagtaggatc

SEQ ID NO: 824115 - DNA, 20 bp, mouse
gctgagtaggatcaggaatc

SEQ ID NO: 824116 - DNA, 20 bp, mouse
gccgactagtggggatggga

SEQ ID NO: 824117 - DNA, 20 bp, mouse
gtgacggacgccgactagtg

SEQ ID NO: 824118 - DNA, 20 bp, mouse
gacgccggaagtacgtcggg

SEQ ID NO: 824119 - DNA, 20 bp, mouse
gaatacgccggaagtacgtc

SEQ ID NO: 824120 - DNA, 20 bp, mouse
gggagggtggactaatacgc

SEQ ID NO: 824121 - DNA, 20 bp, mouse
gcgagagtgcaagtttgttc

SEQ ID NO: 824122 - DNA, 20 bp, mouse
ggacgccgactagtggggat

SEQ ID NO: 824123 - DNA, 20 bp, mouse
gtaaactgagtcacggctgt

SEQ ID NO: 824124 - DNA, 20 bp, mouse
gcgtccgtcaaatcgttccc

SEQ ID NO: 824125 - DNA, 20 bp, mouse
gcggctgtgggtacagaatt

SEQ ID NO: 824126 - DNA, 20 bp, mouse
gagggtgtacgccaaggaga

SEQ ID NO: 824127 - DNA, 20 bp, mouse
gcaggaaccatatagcatat

SEQ ID NO: 824128 - DNA, 20 bp, mouse
gacactgagggcaggagtcc

SEQ ID NO: 824129 - DNA, 20 bp, mouse
gctcctcagggtgtacgcca

SEQ ID NO: 824130 - DNA, 20 bp, mouse
gtcacactgtctttgttcaa

SEQ ID NO: 824131 - DNA, 20 bp, mouse
gagataatgagttacacagg

SEQ ID NO: 824132 - DNA, 20 bp, mouse
gagaggaattgatacatggt

SEQ ID NO: 824133 - DNA, 20 bp, mouse
gctaatcttgtcatacccta

SEQ ID NO: 824134 - DNA, 20 bp, mouse
gacaaagacagtgtgatgtc

SEQ ID NO: 824135 - DNA, 20 bp, mouse
ggcaaagtttgaaagtacgg

SEQ ID NO: 824136 - DNA, 20 bp, mouse
gcaagaagggaggatcccgc

SEQ ID NO: 824137 - DNA, 20 bp, mouse
gagggcccgggcgactggcg

SEQ ID NO: 824138 - DNA, 20 bp, mouse
ggatcccgcaggaaaagaga

SEQ ID NO: 824139 - DNA, 20 bp, mouse
gtggaggccctcgtagatag

SEQ ID NO: 824140 - DNA, 20 bp, mouse
gccggcgtccacagcgaagg

SEQ ID NO: 824141 - DNA, 20 bp, mouse
gtggaagcctctatctacga

SEQ ID NO: 824142 - DNA, 20 bp, mouse
gcccaccccgccagtcgccc

SEQ ID NO: 824143 - DNA, 20 bp, mouse
gggcctgactgcaaagaaaa

SEQ ID NO: 824144 - DNA, 20 bp, mouse
gccaagacagctgattcctg

SEQ ID NO: 824145 - DNA, 20 bp, mouse
gtctgtagtccctaaaaagg

SEQ ID NO: 824146 - DNA, 20 bp, mouse
ggggagggctgggaccctca

SEQ ID NO: 824147 - DNA, 20 bp, mouse
gaccctcagggttggtactc

SEQ ID NO: 824148 - DNA, 20 bp, mouse
ggggctgggaccctcagggt

SEQ ID NO: 824149 - DNA, 20 bp, mouse
gtcctgagtaccaaccctga

SEQ ID NO: 824150 - DNA, 20 bp, mouse
gaatatccgcttggcttcat

SEQ ID NO: 824151 - DNA, 20 bp, mouse
gttggctgccctcccaaata

SEQ ID NO: 824152 - DNA, 20 bp, mouse
gtttgtaaccagatggaccc

SEQ ID NO: 824153 - DNA, 20 bp, mouse
gaatctgagagttccttatt

SEQ ID NO: 824154 - DNA, 20 bp, mouse
gccccatctaggtcactcca

SEQ ID NO: 824155 - DNA, 20 bp, mouse
ggggaaaacttccctgggac

SEQ ID NO: 824156 - DNA, 20 bp, mouse
gaagctcccggggcaagaag

SEQ ID NO: 824157 - DNA, 20 bp, mouse
gcccggggcaagaagtggct

SEQ ID NO: 824158 - DNA, 20 bp, mouse
ggcaagaagtggctgggact

SEQ ID NO: 824159 - DNA, 20 bp, mouse
gggcaactaaggtctgcgag

SEQ ID NO: 824160 - DNA, 20 bp, mouse
ggtgccctgtgcacccaatg

SEQ ID NO: 824161 - DNA, 20 bp, mouse
gtcccaccgcacctggggcc

SEQ ID NO: 824162 - DNA, 20 bp, mouse
gctcctggccccaggtgcgg

SEQ ID NO: 824163 - DNA, 20 bp, mouse
gccaggtgcggtgggaacca

SEQ ID NO: 824164 - DNA, 20 bp, mouse
gtaaccccattgggtgcaca

SEQ ID NO: 824165 - DNA, 20 bp, mouse
gtgcggtgggaaccaaggcc

SEQ ID NO: 824166 - DNA, 20 bp, mouse
ggaggacccaggtcgcgcgt

SEQ ID NO: 824167 - DNA, 20 bp, mouse
gcgcgcgtgggaggtgaccc

SEQ ID NO: 824168 - DNA, 20 bp, mouse
ggccagagaactagcctgag

SEQ ID NO: 824169 - DNA, 20 bp, mouse
gaaaagaaggggatacacta

SEQ ID NO: 824170 - DNA, 20 bp, mouse
gcggccccgcccccctcaga

SEQ ID NO: 824171 - DNA, 20 bp, mouse
gacctctcaggctagttctc

SEQ ID NO: 824172 - DNA, 20 bp, mouse
ggacccaggtcgcgcgtggg

SEQ ID NO: 824173 - DNA, 20 bp, mouse
gggtggggcggggctttcta

SEQ ID NO: 824174 - DNA, 20 bp, mouse
gtcctccgggcactgcgggt

SEQ ID NO: 824175 - DNA, 20 bp, mouse
ggaggtcaggaacggagcag

SEQ ID NO: 824176 - DNA, 20 bp, mouse
gtggtggataagaatgggag

SEQ ID NO: 824177 - DNA, 20 bp, mouse
gaatggggaggtgagagtgg

SEQ ID NO: 824178 - DNA, 20 bp, mouse
gaggccgggcgcctttaact

SEQ ID NO: 824179 - DNA, 20 bp, mouse
gtttggcaacccaaatgggg

SEQ ID NO: 824180 - DNA, 20 bp, mouse
gcgaggtcacgccgagttaa

SEQ ID NO: 824181 - DNA, 20 bp, mouse
gggggcgcgggccagacgcg

SEQ ID NO: 824182 - DNA, 20 bp, mouse
ggcagtcggagggccctaaa

SEQ ID NO: 824183 - DNA, 20 bp, mouse
gaaggcaatgagatctagaa

SEQ ID NO: 824184 - DNA, 20 bp, mouse
gcatttttggcaacccaaat

SEQ ID NO: 824185 - DNA, 20 bp, mouse
ggcgttttgagctctaaaca

SEQ ID NO: 824186 - DNA, 20 bp, mouse
ggcaactggctaactagcca

SEQ ID NO: 824187 - DNA, 20 bp, mouse
gtggatgggtaggaacactt

SEQ ID NO: 824188 - DNA, 20 bp, mouse
gccctcccgcccggtcgcta

SEQ ID NO: 824189 - DNA, 20 bp, mouse
ggggctgtggctaggcactg

SEQ ID NO: 824190 - DNA, 20 bp, mouse
gaaggagaacctgttaggca

SEQ ID NO: 824191 - DNA, 20 bp, mouse
gaggcagggaactaactatt

SEQ ID NO: 824192 - DNA, 20 bp, mouse
ggagtccggcggcaggcaac

SEQ ID NO: 824193 - DNA, 20 bp, mouse
gctaacattccagagtccgg

SEQ ID NO: 824194 - DNA, 20 bp, mouse
gaaagctgttgaccaatcgt

SEQ ID NO: 824195 - DNA, 20 bp, mouse
gatgctaaggagaacctgtt

SEQ ID NO: 824196 - DNA, 20 bp, mouse
ggagccagagccggaagttc

SEQ ID NO: 824197 - DNA, 20 bp, mouse
gcctcggcacagaggtaaag

SEQ ID NO: 824198 - DNA, 20 bp, mouse
gggctggcgggcgggtcctc

SEQ ID NO: 824199 - DNA, 20 bp, mouse
ggcagaggccggaaggactc

SEQ ID NO: 824200 - DNA, 20 bp, mouse
gtgagcgctgaattgaacgc

SEQ ID NO: 824201 - DNA, 20 bp, mouse
gccagagccggaagttcagg

SEQ ID NO: 824202 - DNA, 20 bp, mouse
gtggcgaggacagcagccag

SEQ ID NO: 824203 - DNA, 20 bp, mouse
ggcacagaggtaaagtggcg

SEQ ID NO: 824204 - DNA, 20 bp, mouse
gcccttccaaggtttccggg

SEQ ID NO: 824205 - DNA, 20 bp, mouse
gggaccggaaactagacagg

SEQ ID NO: 824206 - DNA, 20 bp, mouse
gtcccaggaggcattgcgga

SEQ ID NO: 824207 - DNA, 20 bp, mouse
ggggccacagggccagacta

SEQ ID NO: 824208 - DNA, 20 bp, mouse
gacccgaggctacgtcgcga

SEQ ID NO: 824209 - DNA, 20 bp, mouse
gtggggaacgcttggatgat

SEQ ID NO: 824210 - DNA, 20 bp, mouse
gtcctcgcgcctcagtatcc

SEQ ID NO: 824211 - DNA, 20 bp, mouse
gttggagcgcagcagaacac

SEQ ID NO: 824212 - DNA, 20 bp, mouse
gcaggaagagtgtggtgcgc

SEQ ID NO: 824213 - DNA, 20 bp, mouse
ggtggtgcgccgggaaggat

SEQ ID NO: 824214 - DNA, 20 bp, mouse
gaacgtggaacgcgaccctg

SEQ ID NO: 824215 - DNA, 20 bp, mouse
gagagtgtggtgcgccggga

SEQ ID NO: 824216 - DNA, 20 bp, mouse
gggggctggaacaagaacag

SEQ ID NO: 824217 - DNA, 20 bp, mouse
gaaaaccctcaccccttcac

SEQ ID NO: 824218 - DNA, 20 bp, mouse
gttgttccagccccggtgaa

SEQ ID NO: 824219 - DNA, 20 bp, mouse
gagccccggtgaaggggtga

SEQ ID NO: 824220 - DNA, 20 bp, mouse
ggctcagacctgacattctg

SEQ ID NO: 824221 - DNA, 20 bp, mouse
gccgtggcccaaatcccctg

SEQ ID NO: 824222 - DNA, 20 bp, mouse
gatcccctgcggagtactga

SEQ ID NO: 824223 - DNA, 20 bp, mouse
gccacaggctgggccaggga

SEQ ID NO: 824224 - DNA, 20 bp, mouse
ggaagataactcacccccac

SEQ ID NO: 824225 - DNA, 20 bp, mouse
gggggtccagctcctctggg

SEQ ID NO: 824226 - DNA, 20 bp, mouse
gaccaatggggatgcatggt

SEQ ID NO: 824227 - DNA, 20 bp, mouse
gcttgccacaggttgcaaga

SEQ ID NO: 824228 - DNA, 20 bp, mouse
gcaatggggagcgtggacat

SEQ ID NO: 824229 - DNA, 20 bp, mouse
gggcgctagccgcctggatg

SEQ ID NO: 824230 - DNA, 20 bp, mouse
gccgcctggatggggtgaaa

SEQ ID NO: 824231 - DNA, 20 bp, mouse
ggcatggtggggcgccaatg

SEQ ID NO: 824232 - DNA, 20 bp, mouse
gtggcattgccctggttgag

SEQ ID NO: 824233 - DNA, 20 bp, mouse
gcactgccaccatgaccaat

SEQ ID NO: 824234 - DNA, 20 bp, mouse
gcatgcatccccattggtca

SEQ ID NO: 824235 - DNA, 20 bp, mouse
gagaactggcgctagccgcc

SEQ ID NO: 824236 - DNA, 20 bp, mouse
gaggggcgggacttcctccg

SEQ ID NO: 824237 - DNA, 20 bp, mouse
gagggcttctccgtagggga

SEQ ID NO: 824238 - DNA, 20 bp, mouse
ggaggggtacagagactcga

SEQ ID NO: 824239 - DNA, 20 bp, mouse
ggaagcagaagctctctctg

SEQ ID NO: 824240 - DNA, 20 bp, mouse
gtggagggacccagggagac

SEQ ID NO: 824241 - DNA, 20 bp, mouse
gaaagcagggcttctccgta

SEQ ID NO: 824242 - DNA, 20 bp, mouse
gacgaagcagagtccttagt

SEQ ID NO: 824243 - DNA, 20 bp, mouse
gggagctcccttcttgggtg

SEQ ID NO: 824244 - DNA, 20 bp, mouse
gaggggcttgttccgtgaag

SEQ ID NO: 824245 - DNA, 20 bp, mouse
ggaggcggagctcccttctt

SEQ ID NO: 824246 - DNA, 20 bp, mouse
gggcagcccccacccagcta

SEQ ID NO: 824247 - DNA, 20 bp, mouse
ggccaccgagctaacccccc

SEQ ID NO: 824248 - DNA, 20 bp, mouse
gcacgcgggagcttactcac

SEQ ID NO: 824249 - DNA, 20 bp, mouse
ggggccctcgagctgtaggc

SEQ ID NO: 824250 - DNA, 20 bp, mouse
gtaacccccccgggcgtggc

SEQ ID NO: 824251 - DNA, 20 bp, mouse
gagaagctggaggcgcggtg

SEQ ID NO: 824252 - DNA, 20 bp, mouse
gggaagctgccaatcttcag

SEQ ID NO: 824253 - DNA, 20 bp, mouse
gccccgaccccgctggggtg

SEQ ID NO: 824254 - DNA, 20 bp, mouse
gttagcttccctagctgggt

SEQ ID NO: 824255 - DNA, 20 bp, mouse
gccagctagggaagctaaaa

SEQ ID NO: 824256 - DNA, 20 bp, mouse
gctacaagggacggactcgg

SEQ ID NO: 824257 - DNA, 20 bp, mouse
gactcggcggctcccaacac

SEQ ID NO: 824258 - DNA, 20 bp, mouse
ggacgtcgtcagagcagcat

SEQ ID NO: 824259 - DNA, 20 bp, mouse
gcgtcagagcagcatgggtt

SEQ ID NO: 824260 - DNA, 20 bp, mouse
ggggaaggagagcgacagaa

SEQ ID NO: 824261 - DNA, 20 bp, mouse
gtcccaacactgggtagcaa

SEQ ID NO: 824262 - DNA, 20 bp, mouse
gccggctgacgcgacgcgtc

SEQ ID NO: 824263 - DNA, 20 bp, mouse
gcgcgagaagcagtgtgcgc

SEQ ID NO: 824264 - DNA, 20 bp, mouse
gcccgttgctacccagtgtt

SEQ ID NO: 824265 - DNA, 20 bp, mouse
gacgtcctgccgctaccggt

SEQ ID NO: 824266 - DNA, 20 bp, mouse
ggggcgcgcggagggcgatg

SEQ ID NO: 824267 - DNA, 20 bp, mouse
gggcgctggccggagctctc

SEQ ID NO: 824268 - DNA, 20 bp, mouse
ggcggcagagcgcgcgtgca

SEQ ID NO: 824269 - DNA, 20 bp, mouse
gagggggagcgaatcaagga

SEQ ID NO: 824270 - DNA, 20 bp, mouse
ggggaagccggctctcattg

SEQ ID NO: 824271 - DNA, 20 bp, mouse
gacgcccattggccgatcca

SEQ ID NO: 824272 - DNA, 20 bp, mouse
gaagcgccgcaatgcctccc

SEQ ID NO: 824273 - DNA, 20 bp, mouse
gacgcagaacctggggaagc

SEQ ID NO: 824274 - DNA, 20 bp, mouse
ggggacgcagtttacgtaag

SEQ ID NO: 824275 - DNA, 20 bp, mouse
gagccccgctgtgcctgcgg

SEQ ID NO: 824276 - DNA, 20 bp, mouse
gtccttgggtaatactctga

SEQ ID NO: 824277 - DNA, 20 bp, mouse
gaccaatgacaggggatctc

SEQ ID NO: 824278 - DNA, 20 bp, mouse
gccccgagatcccctgtcat

SEQ ID NO: 824279 - DNA, 20 bp, mouse
gttagagggaccaatgacag

SEQ ID NO: 824280 - DNA, 20 bp, mouse
ggccctcagagtattaccca

SEQ ID NO: 824281 - DNA, 20 bp, mouse
gcggtgacaggtgtgatgtc

SEQ ID NO: 824282 - DNA, 20 bp, mouse
gagggtgtacttctgttaga

SEQ ID NO: 824283 - DNA, 20 bp, mouse
gactctggatagtgtgtcta

SEQ ID NO: 824284 - DNA, 20 bp, mouse
gttaactcatgccgtctcct

SEQ ID NO: 824285 - DNA, 20 bp, mouse
ggcagactaaaaatataatc

SEQ ID NO: 824286 - DNA, 20 bp, mouse
ggagcccagccgcacgtctc

SEQ ID NO: 824287 - DNA, 20 bp, mouse
ggaactaagccggagacgtg

SEQ ID NO: 824288 - DNA, 20 bp, mouse
gcgtctccggcttagttcca

SEQ ID NO: 824289 - DNA, 20 bp, mouse
gccttcccgtggaactaagc

SEQ ID NO: 824290 - DNA, 20 bp, mouse
gcacctcccaaggtctttcc

SEQ ID NO: 824291 - DNA, 20 bp, mouse
gaagccggagacgtgcggct

SEQ ID NO: 824292 - DNA, 20 bp, mouse
ggacgtgcggctgggctcgc

SEQ ID NO: 824293 - DNA, 20 bp, mouse
gcaaagccaggaaagacctt

SEQ ID NO: 824294 - DNA, 20 bp, mouse
gcaggatgaaaggggaaatt

SEQ ID NO: 824295 - DNA, 20 bp, mouse
gaaagaccttgggaggtgat

SEQ ID NO: 824296 - DNA, 20 bp, mouse
gaagagcccccgcctctgga

SEQ ID NO: 824297 - DNA, 20 bp, mouse
gaaaatgccgggggtccatg

SEQ ID NO: 824298 - DNA, 20 bp, mouse
gtgagcagtaaaaatgccgg

SEQ ID NO: 824299 - DNA, 20 bp, mouse
gtggctgtaactactctccg

SEQ ID NO: 824300 - DNA, 20 bp, mouse
gccccgccccgagatgcgat

SEQ ID NO: 824301 - DNA, 20 bp, mouse
gacagcgcgcgcccgggacc

SEQ ID NO: 824302 - DNA, 20 bp, mouse
gcgtggagtctactagtccc

SEQ ID NO: 824303 - DNA, 20 bp, mouse
gttggaccagggatggacta

SEQ ID NO: 824304 - DNA, 20 bp, mouse
gcaggaaaaggctgctatgt

SEQ ID NO: 824305 - DNA, 20 bp, mouse
gccgccccctgaactccgat

SEQ ID NO: 824306 - DNA, 20 bp, mouse
gccgcggagccgtcagggga

SEQ ID NO: 824307 - DNA, 20 bp, mouse
gaaagggcgtggcttcggtc

SEQ ID NO: 824308 - DNA, 20 bp, mouse
ggaaacccgcggagccgtca

SEQ ID NO: 824309 - DNA, 20 bp, mouse
gcgacccgaggggcatcggc

SEQ ID NO: 824310 - DNA, 20 bp, mouse
gggccgggcgagcccgtgac

SEQ ID NO: 824311 - DNA, 20 bp, mouse
gccgggaagtgggtcaactg

SEQ ID NO: 824312 - DNA, 20 bp, mouse
gggcgcgacccgaggggcat

SEQ ID NO: 824313 - DNA, 20 bp, mouse
ggcgaaccccgcttgcctgt

SEQ ID NO: 824314 - DNA, 20 bp, mouse
gccgtgacgggccgggaagt

SEQ ID NO: 824315 - DNA, 20 bp, mouse
gctgccgaagaggaaacccg

SEQ ID NO: 824316 - DNA, 20 bp, mouse
ggggcccggcgcccgagttg

SEQ ID NO: 824317 - DNA, 20 bp, mouse
gcacgcaggcgcactgagga

SEQ ID NO: 824318 - DNA, 20 bp, mouse
gagtgcgcctgcgtggggtg

SEQ ID NO: 824319 - DNA, 20 bp, mouse
ggtccggcctcaccccacgc

SEQ ID NO: 824320 - DNA, 20 bp, mouse
gcggagagccaaaaagagtc

SEQ ID NO: 824321 - DNA, 20 bp, mouse
gctcttcgggaggcggggaa

SEQ ID NO: 824322 - DNA, 20 bp, mouse
gcctgggccccgccccaact

SEQ ID NO: 824323 - DNA, 20 bp, mouse
ggccgctgcaagccgcactc

SEQ ID NO: 824324 - DNA, 20 bp, mouse
gtggggaagcgcgtgggcgt

SEQ ID NO: 824325 - DNA, 20 bp, mouse
gcccggcgcccgagttgggg

SEQ ID NO: 824326 - DNA, 20 bp, mouse
gcgcaccaccggggtcgacc

SEQ ID NO: 824327 - DNA, 20 bp, mouse
gcgggggtgctgacagggag

SEQ ID NO: 824328 - DNA, 20 bp, mouse
ggggagcggggacaagcacg

SEQ ID NO: 824329 - DNA, 20 bp, mouse
gcacccacccgggtcgaccc

SEQ ID NO: 824330 - DNA, 20 bp, mouse
gccaccggggtcgacccggg

SEQ ID NO: 824331 - DNA, 20 bp, mouse
gcaggcgcgcgaggtacagc

SEQ ID NO: 824332 - DNA, 20 bp, mouse
gccgcccgcgcgcaccaccg

SEQ ID NO: 824333 - DNA, 20 bp, mouse
ggcaaaggagacaattgcga

SEQ ID NO: 824334 - DNA, 20 bp, mouse
gcgcgggcgggggtgctgac

SEQ ID NO: 824335 - DNA, 20 bp, mouse
gtacgtaggcaaaggaccca

SEQ ID NO: 824336 - DNA, 20 bp, mouse
gcgagggcgtggatcgagtc

SEQ ID NO: 824337 - DNA, 20 bp, mouse
ggttctgtctgtcatttcga

SEQ ID NO: 824338 - DNA, 20 bp, mouse
gcggcctatcacagttcggt

SEQ ID NO: 824339 - DNA, 20 bp, mouse
gcatagtcacgcctctcaac

SEQ ID NO: 824340 - DNA, 20 bp, mouse
ggagccgagcagtgacgtgt

SEQ ID NO: 824341 - DNA, 20 bp, mouse
gctccctgcccgctccgcat

SEQ ID NO: 824342 - DNA, 20 bp, mouse
gaactgtgataggccggcgc

SEQ ID NO: 824343 - DNA, 20 bp, mouse
gggaaggagcggcgatagga

SEQ ID NO: 824344 - DNA, 20 bp, mouse
gcaggggaccgacaggataa

SEQ ID NO: 824345 - DNA, 20 bp, mouse
gagccaatgcggagcgggca

SEQ ID NO: 824346 - DNA, 20 bp, mouse
gacggtcgcggccactgttg

SEQ ID NO: 824347 - DNA, 20 bp, mouse
ggggacacggatggctagtg

SEQ ID NO: 824348 - DNA, 20 bp, mouse
gcagccgcgaggagcacaaa

SEQ ID NO: 824349 - DNA, 20 bp, mouse
gcgtgtcccccgtgcggctg

SEQ ID NO: 824350 - DNA, 20 bp, mouse
gtcccggcctcgcggtgctg

SEQ ID NO: 824351 - DNA, 20 bp, mouse
gtggggcgcaggggcctttt

SEQ ID NO: 824352 - DNA, 20 bp, mouse
ggacgagggcgccagaggag

SEQ ID NO: 824353 - DNA, 20 bp, mouse
gaccgcgaggccgggacact

SEQ ID NO: 824354 - DNA, 20 bp, mouse
gactgttgaggcggagactt

SEQ ID NO: 824355 - DNA, 20 bp, mouse
ggccccgctcgcgctcctat

SEQ ID NO: 824356 - DNA, 20 bp, mouse
gtggggaggagcttcttcaa

SEQ ID NO: 824357 - DNA, 20 bp, mouse
gaggacccgggcctagtgac

SEQ ID NO: 824358 - DNA, 20 bp, mouse
ggggcttgagcgccgatggg

SEQ ID NO: 824359 - DNA, 20 bp, mouse
gacctaccctgctcagacca

SEQ ID NO: 824360 - DNA, 20 bp, mouse
ggtaggtctcggttactgta

SEQ ID NO: 824361 - DNA, 20 bp, mouse
gcggcggtccagacgttccc

SEQ ID NO: 824362 - DNA, 20 bp, mouse
gagaccaaggctccgcccat

SEQ ID NO: 824363 - DNA, 20 bp, mouse
ggggtcctagcgcaccacca

SEQ ID NO: 824364 - DNA, 20 bp, mouse
ggagcccgtgtgtgccctgg

SEQ ID NO: 824365 - DNA, 20 bp, mouse
gcggaagcttctcagagcta

SEQ ID NO: 824366 - DNA, 20 bp, mouse
ggcatctcggggtgcacagg

SEQ ID NO: 824367 - DNA, 20 bp, mouse
ggggaagaaggctcgtgctt

SEQ ID NO: 824368 - DNA, 20 bp, mouse
ggcgctgaggggttttcccg

SEQ ID NO: 824369 - DNA, 20 bp, mouse
gccgtcgcccgcagcatctc

SEQ ID NO: 824370 - DNA, 20 bp, mouse
gtggcgaccccagtcgggac

SEQ ID NO: 824371 - DNA, 20 bp, mouse
gaagctgcgcgcctagccga

SEQ ID NO: 824372 - DNA, 20 bp, mouse
gttgcctggcaccctactgg

SEQ ID NO: 824373 - DNA, 20 bp, mouse
gtgtgcaccccgagatgctg

SEQ ID NO: 824374 - DNA, 20 bp, mouse
gcccgccccggggacgccct

SEQ ID NO: 824375 - DNA, 20 bp, mouse
ggactggggtcgccacgctg

SEQ ID NO: 824376 - DNA, 20 bp, mouse
gcacacgcgcactgcaggat

SEQ ID NO: 824377 - DNA, 20 bp, mouse
gtgcggctggaattggcggt

SEQ ID NO: 824378 - DNA, 20 bp, mouse
gcgcgccgtctgtagacgac

SEQ ID NO: 824379 - DNA, 20 bp, mouse
gcatgcgcaccgcgatgggc

SEQ ID NO: 824380 - DNA, 20 bp, mouse
gtgtgaagccagtacaggac

SEQ ID NO: 824381 - DNA, 20 bp, mouse
gacgacaggctgaagaagtc

SEQ ID NO: 824382 - DNA, 20 bp, mouse
ggccggaaggtcgtggaatg

SEQ ID NO: 824383 - DNA, 20 bp, mouse
gaagaagtccggtcctgtac

SEQ ID NO: 824384 - DNA, 20 bp, mouse
gtcccagaatcccttgaagt

SEQ ID NO: 824385 - DNA, 20 bp, mouse
gtcagcctgtcgtctacaga

SEQ ID NO: 824386 - DNA, 20 bp, mouse
gtcccggggcagggcaataa

SEQ ID NO: 824387 - DNA, 20 bp, mouse
gggagtgctccgccctctct

SEQ ID NO: 824388 - DNA, 20 bp, mouse
ggaaagagaggggtcaggtc

SEQ ID NO: 824389 - DNA, 20 bp, mouse
gagcactcccatcccggggc

SEQ ID NO: 824390 - DNA, 20 bp, mouse
gccagagtctgtacactctt

SEQ ID NO: 824391 - DNA, 20 bp, mouse
ggagccgaagaccaccactg

SEQ ID NO: 824392 - DNA, 20 bp, mouse
ggggcggagcactcccatcc

SEQ ID NO: 824393 - DNA, 20 bp, mouse
ggcacccgcgaggaacggac

SEQ ID NO: 824394 - DNA, 20 bp, mouse
gctctctgggacagttcccg

SEQ ID NO: 824395 - DNA, 20 bp, mouse
gggcctccacgaggacctca

SEQ ID NO: 824396 - DNA, 20 bp, mouse
ggggcggggaaggatggcac

SEQ ID NO: 824397 - DNA, 20 bp, mouse
gtctccaggggcgggatatg

SEQ ID NO: 824398 - DNA, 20 bp, mouse
gtgcgcagacgcgagagggg

SEQ ID NO: 824399 - DNA, 20 bp, mouse
gcacactgcgcagacgcgag

SEQ ID NO: 824400 - DNA, 20 bp, mouse
gtcctcgccaacaaaattca

SEQ ID NO: 824401 - DNA, 20 bp, mouse
gcgccccctacccggccagt

SEQ ID NO: 824402 - DNA, 20 bp, mouse
gagcccctgagtgactggct

SEQ ID NO: 824403 - DNA, 20 bp, mouse
gacgcccactggccgggtag

SEQ ID NO: 824404 - DNA, 20 bp, mouse
gttcaaggaacacaatgtgc

SEQ ID NO: 824405 - DNA, 20 bp, mouse
gactcctagccagtcactca

SEQ ID NO: 824406 - DNA, 20 bp, mouse
gaaggggtgccgatgcactg

SEQ ID NO: 824407 - DNA, 20 bp, mouse
gggagagtggagaaaggttc

SEQ ID NO: 824408 - DNA, 20 bp, mouse
gtgcactgcgggtagctgtc

SEQ ID NO: 824409 - DNA, 20 bp, mouse
gtgcgggtagctgtctggaa

SEQ ID NO: 824410 - DNA, 20 bp, mouse
ggcactccgcccgtgtaacg

SEQ ID NO: 824411 - DNA, 20 bp, mouse
ggggcggtttggttgacagg

SEQ ID NO: 824412 - DNA, 20 bp, mouse
ggaacggagaattccggctc

SEQ ID NO: 824413 - DNA, 20 bp, mouse
gtccactctccgcgttacac

SEQ ID NO: 824414 - DNA, 20 bp, mouse
gggtacgtgtacagaggtag

SEQ ID NO: 824415 - DNA, 20 bp, mouse
gggcgggcggtttggttgac

SEQ ID NO: 824416 - DNA, 20 bp, mouse
gtgctcttgtagctagacaa

SEQ ID NO: 824417 - DNA, 20 bp, mouse
gctgcaggttatgtagacta

SEQ ID NO: 824418 - DNA, 20 bp, mouse
gtacaagagcatttttcaca

SEQ ID NO: 824419 - DNA, 20 bp, mouse
ggtagagatggaataaagca

SEQ ID NO: 824420 - DNA, 20 bp, mouse
gcacgcggctccttggtaac

SEQ ID NO: 824421 - DNA, 20 bp, mouse
gaaggaagatggttttcacg

SEQ ID NO: 824422 - DNA, 20 bp, mouse
gaagtagccatatgtagaga

SEQ ID NO: 824423 - DNA, 20 bp, mouse
gaggagaatttaatcataac

SEQ ID NO: 824424 - DNA, 20 bp, mouse
gagaagactaacaggcaaag

SEQ ID NO: 824425 - DNA, 20 bp, mouse
gctctgtttggaaatcccat

SEQ ID NO: 824426 - DNA, 20 bp, mouse
ggggaggaaccaggtcccga

SEQ ID NO: 824427 - DNA, 20 bp, mouse
gggcgtggccagctggggtt

SEQ ID NO: 824428 - DNA, 20 bp, mouse
gccgcctacggggagcgcaa

SEQ ID NO: 824429 - DNA, 20 bp, mouse
gccgggcgtggaagcatgat

SEQ ID NO: 824430 - DNA, 20 bp, mouse
ggaaccaggtcccgagggct

SEQ ID NO: 824431 - DNA, 20 bp, mouse
gcccggatatatcccgccca

SEQ ID NO: 824432 - DNA, 20 bp, mouse
gccgcccagggctccgccta

SEQ ID NO: 824433 - DNA, 20 bp, mouse
gcgtggaagcatgatgggcg

SEQ ID NO: 824434 - DNA, 20 bp, mouse
ggccctgggcgggatatatc

SEQ ID NO: 824435 - DNA, 20 bp, mouse
gcgcgccccgccccagtccc

SEQ ID NO: 824436 - DNA, 20 bp, mouse
gacagatggggctaaattta

SEQ ID NO: 824437 - DNA, 20 bp, mouse
gtatctacaggggaagggag

SEQ ID NO: 824438 - DNA, 20 bp, mouse
ggcaagcagagacacccacc

SEQ ID NO: 824439 - DNA, 20 bp, mouse
gccccatctgttatctacag

SEQ ID NO: 824440 - DNA, 20 bp, mouse
ggagaggtgaacagaggtaa

SEQ ID NO: 824441 - DNA, 20 bp, mouse
gtaacgggtgccgtgtgccg

SEQ ID NO: 824442 - DNA, 20 bp, mouse
gggctggtcggccctcgctg

SEQ ID NO: 824443 - DNA, 20 bp, mouse
gttcccctgtagataacaga

SEQ ID NO: 824444 - DNA, 20 bp, mouse
ggaagggcagctttgtgaag

SEQ ID NO: 824445 - DNA, 20 bp, mouse
gccaccaggctgaagcacag

SEQ ID NO: 824446 - DNA, 20 bp, mouse
ggcacccaagggaggggcac

SEQ ID NO: 824447 - DNA, 20 bp, mouse
gggaggggcacccaagggag

SEQ ID NO: 824448 - DNA, 20 bp, mouse
gggcccagaagttgggaggg

SEQ ID NO: 824449 - DNA, 20 bp, mouse
gcccaggcgcccccagcccg

SEQ ID NO: 824450 - DNA, 20 bp, mouse
gtccccagtgcccctccctt

SEQ ID NO: 824451 - DNA, 20 bp, mouse
gggggcatgcgcagcgcccc

SEQ ID NO: 824452 - DNA, 20 bp, mouse
ggctgggtaaactgcagttg

SEQ ID NO: 824453 - DNA, 20 bp, mouse
gctggggaggcccagaagtt

SEQ ID NO: 824454 - DNA, 20 bp, mouse
gataaaaggaagtcctgcgt

SEQ ID NO: 824455 - DNA, 20 bp, mouse
gcatgcgcagcgccccgggc

SEQ ID NO: 824456 - DNA, 20 bp, mouse
gcctgggcgggtcgtcgcga

SEQ ID NO: 824457 - DNA, 20 bp, mouse
gcacgcagcgagaggacttt

SEQ ID NO: 824458 - DNA, 20 bp, mouse
gcgggtcgtcgcgaggggtg

SEQ ID NO: 824459 - DNA, 20 bp, mouse
gacgacccgcccaggtgcct

SEQ ID NO: 824460 - DNA, 20 bp, mouse
gtgggtgtggttccatctag

SEQ ID NO: 824461 - DNA, 20 bp, mouse
gccgcgggacccaaggcacc

SEQ ID NO: 824462 - DNA, 20 bp, mouse
gtgccttgggtcccgcggga

SEQ ID NO: 824463 - DNA, 20 bp, mouse
gccccctcccgcgggaccca

SEQ ID NO: 824464 - DNA, 20 bp, mouse
gctgttgggctttaaatcta

SEQ ID NO: 824465 - DNA, 20 bp, mouse
gcccaggtgtggagctctca

SEQ ID NO: 824466 - DNA, 20 bp, mouse
gcggcgccgcgctccaaatc

SEQ ID NO: 824467 - DNA, 20 bp, mouse
ggagcggcccaggtatgggg

SEQ ID NO: 824468 - DNA, 20 bp, mouse
gcggggagcggcccaggtat

SEQ ID NO: 824469 - DNA, 20 bp, mouse
gcctgggcccgccccatacc

SEQ ID NO: 824470 - DNA, 20 bp, mouse
gtaagcaggagctcggggag

SEQ ID NO: 824471 - DNA, 20 bp, mouse
gccagcgccggaagcattcc

SEQ ID NO: 824472 - DNA, 20 bp, mouse
gccccgagctcctgcttaaa

SEQ ID NO: 824473 - DNA, 20 bp, mouse
ggggcgggcgagccctgagc

SEQ ID NO: 824474 - DNA, 20 bp, mouse
ggcggcgcggcggacctcgg

SEQ ID NO: 824475 - DNA, 20 bp, mouse
gaaggcgggggtggtctgtc

SEQ ID NO: 824476 - DNA, 20 bp, mouse
gagatgttccggtagtgggg

SEQ ID NO: 824477 - DNA, 20 bp, mouse
ggacgcattcccaacccttt

SEQ ID NO: 824478 - DNA, 20 bp, mouse
gtctagttgcccaaagggtt

SEQ ID NO: 824479 - DNA, 20 bp, mouse
gtggcagccgaacggaagcg

SEQ ID NO: 824480 - DNA, 20 bp, mouse
gactccgagcatgcgcgcga

SEQ ID NO: 824481 - DNA, 20 bp, mouse
gaggccgggcccagctccgc

SEQ ID NO: 824482 - DNA, 20 bp, mouse
gctaccggaacatctcatat

SEQ ID NO: 824483 - DNA, 20 bp, mouse
gtggggtgatgtgagatacg

SEQ ID NO: 824484 - DNA, 20 bp, mouse
gggaagcagtggcagccgaa

SEQ ID NO: 824485 - DNA, 20 bp, mouse
gaggcagcctcgcttccgtt

SEQ ID NO: 824486 - DNA, 20 bp, mouse
ggaggaggcggcaacgatct

SEQ ID NO: 824487 - DNA, 20 bp, mouse
gaccacacacaggctcttta

SEQ ID NO: 824488 - DNA, 20 bp, mouse
gtgaccgcgaggactcccga

SEQ ID NO: 824489 - DNA, 20 bp, mouse
ggatctgggaagagtggcgg

SEQ ID NO: 824490 - DNA, 20 bp, mouse
gtgttctcgcacttcagggg

SEQ ID NO: 824491 - DNA, 20 bp, mouse
gtgcaggaacgcaaacatga

SEQ ID NO: 824492 - DNA, 20 bp, mouse
gagaacaaatctggacctgc

SEQ ID NO: 824493 - DNA, 20 bp, mouse
gaagcaggacaatcagatgc

SEQ ID NO: 824494 - DNA, 20 bp, mouse
gaggctctgagaccacacac

SEQ ID NO: 824495 - DNA, 20 bp, mouse
ggtacgtctaggtgacgtgg

SEQ ID NO: 824496 - DNA, 20 bp, mouse
ggccctgcgccggagagggg

SEQ ID NO: 824497 - DNA, 20 bp, mouse
ggggcctagtgacgcaagct

SEQ ID NO: 824498 - DNA, 20 bp, mouse
gcaggccctgcgccggagag

SEQ ID NO: 824499 - DNA, 20 bp, mouse
gtcactaggcccgagaggcg

SEQ ID NO: 824500 - DNA, 20 bp, mouse
ggcggggctctggatagtgg

SEQ ID NO: 824501 - DNA, 20 bp, mouse
ggaggcggggctctggatag

SEQ ID NO: 824502 - DNA, 20 bp, mouse
gtccgcccctctccggcgca

SEQ ID NO: 824503 - DNA, 20 bp, mouse
gcacgtgacccagatcgccc

SEQ ID NO: 824504 - DNA, 20 bp, mouse
gggtagtggcgaaggttctg

SEQ ID NO: 824505 - DNA, 20 bp, mouse
ggcgcagggcctgggcgatc

SEQ ID NO: 824506 - DNA, 20 bp, mouse
gctggggagccaagctctga

SEQ ID NO: 824507 - DNA, 20 bp, mouse
ggggactggcaaaattgctg

SEQ ID NO: 824508 - DNA, 20 bp, mouse
gggtgacaaagtgatgtcta

SEQ ID NO: 824509 - DNA, 20 bp, mouse
gagagtgctccctcagtcca

SEQ ID NO: 824510 - DNA, 20 bp, mouse
ggggcttgcgtctctcccat

SEQ ID NO: 824511 - DNA, 20 bp, mouse
gagctgaagcttggagggac

SEQ ID NO: 824512 - DNA, 20 bp, mouse
ggccagactccctggactga

SEQ ID NO: 824513 - DNA, 20 bp, mouse
ggggcacagccccaggaagg

SEQ ID NO: 824514 - DNA, 20 bp, mouse
gaagtctaccacagagctga

SEQ ID NO: 824515 - DNA, 20 bp, mouse
gtcggaggcgccagactccc

SEQ ID NO: 824516 - DNA, 20 bp, mouse
gacccagagcgcacccctaa

SEQ ID NO: 824517 - DNA, 20 bp, mouse
gtagcggggacgtcgttctg

SEQ ID NO: 824518 - DNA, 20 bp, mouse
gagcgcacccctaagggagt

SEQ ID NO: 824519 - DNA, 20 bp, mouse
gaggggtgcgctctgggtag

SEQ ID NO: 824520 - DNA, 20 bp, mouse
gtcccttaggggtgcgctct

SEQ ID NO: 824521 - DNA, 20 bp, mouse
gaatggaaacgcgtcaaccc

SEQ ID NO: 824522 - DNA, 20 bp, mouse
gcggctcattccccgcagtt

SEQ ID NO: 824523 - DNA, 20 bp, mouse
gctgactacggcggcccgtg

SEQ ID NO: 824524 - DNA, 20 bp, mouse
ggtagtcagctgctacgagc

SEQ ID NO: 824525 - DNA, 20 bp, mouse
gcttgctacccactccctta

SEQ ID NO: 824526 - DNA, 20 bp, mouse
gagcgcgcgggtgacgatga

SEQ ID NO: 824527 - DNA, 20 bp, mouse
gccggagcctgcatcccgga

SEQ ID NO: 824528 - DNA, 20 bp, mouse
gcgagcgtgaggcgcagggg

SEQ ID NO: 824529 - DNA, 20 bp, mouse
gaggccctggcgcgagcgtg

SEQ ID NO: 824530 - DNA, 20 bp, mouse
gaccccgccctccgggatgc

SEQ ID NO: 824531 - DNA, 20 bp, mouse
ggacctgggcagcccgtgca

SEQ ID NO: 824532 - DNA, 20 bp, mouse
ggccaatagaagcgcggccc

SEQ ID NO: 824533 - DNA, 20 bp, mouse
ggcgcgagcgtgaggcgcag

SEQ ID NO: 824534 - DNA, 20 bp, mouse
ggcgcgagaccccgccctcc

SEQ ID NO: 824535 - DNA, 20 bp, mouse
ggctgccgccaatagaagcg

SEQ ID NO: 824536 - DNA, 20 bp, mouse
gaggggaaggcacaatgaca

SEQ ID NO: 824537 - DNA, 20 bp, mouse
gagagagagaacagatggac

SEQ ID NO: 824538 - DNA, 20 bp, mouse
gtggaccgaacccacggggt

SEQ ID NO: 824539 - DNA, 20 bp, mouse
gcacgtgggccccaccccgt

SEQ ID NO: 824540 - DNA, 20 bp, mouse
gacaatgacagggactcgaa

SEQ ID NO: 824541 - DNA, 20 bp, mouse
gccacttggctccacttcag

SEQ ID NO: 824542 - DNA, 20 bp, mouse
ggggtcccagcagcaccact

SEQ ID NO: 824543 - DNA, 20 bp, mouse
gagggcgtggaccgaaccca

SEQ ID NO: 824544 - DNA, 20 bp, mouse
gggcggaccaggtgcgcaga

SEQ ID NO: 824545 - DNA, 20 bp, mouse
ggggccccaccccgtgggtt

SEQ ID NO: 824546 - DNA, 20 bp, mouse
gacgtcacgcgcatcaacta

SEQ ID NO: 824547 - DNA, 20 bp, mouse
gtgagggcgcggcccgcgga

SEQ ID NO: 824548 - DNA, 20 bp, mouse
gggcgtgtcccgcctgtgcc

SEQ ID NO: 824549 - DNA, 20 bp, mouse
gggactgcggctgcgtagtg

SEQ ID NO: 824550 - DNA, 20 bp, mouse
gcacctgagggcgcggcccg

SEQ ID NO: 824551 - DNA, 20 bp, mouse
ggccgcagtccaggcacagg

SEQ ID NO: 824552 - DNA, 20 bp, mouse
gactgtctggcgccccctag

SEQ ID NO: 824553 - DNA, 20 bp, mouse
ggaggctccgccccctccgc

SEQ ID NO: 824554 - DNA, 20 bp, mouse
gtgcgcgtgacgtcacctga

SEQ ID NO: 824555 - DNA, 20 bp, mouse
gcatcccaagacccacactg

SEQ ID NO: 824556 - DNA, 20 bp, mouse
gtagaaacatcattaccagg

SEQ ID NO: 824557 - DNA, 20 bp, mouse
gaaacatcattaccaggggg

SEQ ID NO: 824558 - DNA, 20 bp, mouse
gtattagaaacatcattacc

SEQ ID NO: 824559 - DNA, 20 bp, mouse
ggctgcagtcagtaaaacac

SEQ ID NO: 824560 - DNA, 20 bp, mouse
gaactaagacagagttgtct

SEQ ID NO: 824561 - DNA, 20 bp, mouse
gaggataatatctacaacct

SEQ ID NO: 824562 - DNA, 20 bp, mouse
gaaagactacccaaaattag

SEQ ID NO: 824563 - DNA, 20 bp, mouse
gacccccagacagtaaattt

SEQ ID NO: 824564 - DNA, 20 bp, mouse
gcaatgaggacagattgtag

SEQ ID NO: 824565 - DNA, 20 bp, mouse
ggtgctaatgcagctcattt

SEQ ID NO: 824566 - DNA, 20 bp, mouse
gcctccgagcccatcccacc

SEQ ID NO: 824567 - DNA, 20 bp, mouse
gctggtgcttaggcccgggt

SEQ ID NO: 824568 - DNA, 20 bp, mouse
gcgggcgcttccatgtcccg

SEQ ID NO: 824569 - DNA, 20 bp, mouse
ggggctcggaggcgcggagc

SEQ ID NO: 824570 - DNA, 20 bp, mouse
gtggcggcggcggaacaaga

SEQ ID NO: 824571 - DNA, 20 bp, mouse
ggaagcgcccgtgcggggtc

SEQ ID NO: 824572 - DNA, 20 bp, mouse
ggaacgcagagctggtgctt

SEQ ID NO: 824573 - DNA, 20 bp, mouse
gtggtggcttcgtgtggccg

SEQ ID NO: 824574 - DNA, 20 bp, mouse
gggacatggaagcgcccgtg

SEQ ID NO: 824575 - DNA, 20 bp, mouse
gactgtggtgaacgcagagc

SEQ ID NO: 824576 - DNA, 20 bp, mouse
gagctgctgcccctggtcct

SEQ ID NO: 824577 - DNA, 20 bp, mouse
gacaactaagagacacccaa

SEQ ID NO: 824578 - DNA, 20 bp, mouse
gtgcccctggtcctcggcgg

SEQ ID NO: 824579 - DNA, 20 bp, mouse
gtgctgcccctggtcctcgg

SEQ ID NO: 824580 - DNA, 20 bp, mouse
ggggcggctgcgctgaacgg

SEQ ID NO: 824581 - DNA, 20 bp, mouse
gcagcagctggcggacccgc

SEQ ID NO: 824582 - DNA, 20 bp, mouse
ggcggccggcgctggaaccg

SEQ ID NO: 824583 - DNA, 20 bp, mouse
gaaacccgaaaccacactgc

SEQ ID NO: 824584 - DNA, 20 bp, mouse
gcatccggggagagagcgac

SEQ ID NO: 824585 - DNA, 20 bp, mouse
gccgcctgtcgctctctccc

SEQ ID NO: 824586 - DNA, 20 bp, mouse
gccggcgcgagagtctggga

SEQ ID NO: 824587 - DNA, 20 bp, mouse
ggggcactctgggcaccagg

SEQ ID NO: 824588 - DNA, 20 bp, mouse
ggcccccggcgcgagagtct

SEQ ID NO: 824589 - DNA, 20 bp, mouse
gggcctacctcccacggcgg

SEQ ID NO: 824590 - DNA, 20 bp, mouse
gggagcttgtgattggcgag

SEQ ID NO: 824591 - DNA, 20 bp, mouse
ggccgggggcggggcactct

SEQ ID NO: 824592 - DNA, 20 bp, mouse
gcctggaatccctaagactt

SEQ ID NO: 824593 - DNA, 20 bp, mouse
gggtcagtggagcttgtgat

SEQ ID NO: 824594 - DNA, 20 bp, mouse
ggagcgggcgggtctgtctc

SEQ ID NO: 824595 - DNA, 20 bp, mouse
gccttggcgccgtgctttgg

SEQ ID NO: 824596 - DNA, 20 bp, mouse
gggctccggggccccgccac

SEQ ID NO: 824597 - DNA, 20 bp, mouse
gtgggcgagccacaacgacc

SEQ ID NO: 824598 - DNA, 20 bp, mouse
gagagcccgggggacaagtg

SEQ ID NO: 824599 - DNA, 20 bp, mouse
gcagcactgggcatgctcac

SEQ ID NO: 824600 - DNA, 20 bp, mouse
gaaagcggtgagagtcccat

SEQ ID NO: 824601 - DNA, 20 bp, mouse
gccgccacaggcccagagcc

SEQ ID NO: 824602 - DNA, 20 bp, mouse
gcgggttagcaagtgcaaag

SEQ ID NO: 824603 - DNA, 20 bp, mouse
gggcaaagatcggtagccca

SEQ ID NO: 824604 - DNA, 20 bp, mouse
gaagtgggggcgagcccttg

SEQ ID NO: 824605 - DNA, 20 bp, mouse
ggggcgagcccttggggcgc

SEQ ID NO: 824606 - DNA, 20 bp, mouse
ggagggcgtgagtgtcgttc

SEQ ID NO: 824607 - DNA, 20 bp, mouse
gttactaggtagccacaggc

SEQ ID NO: 824608 - DNA, 20 bp, mouse
gggtgcaagtaaatcagaat

SEQ ID NO: 824609 - DNA, 20 bp, mouse
gcaggagttaggtgtaatac

SEQ ID NO: 824610 - DNA, 20 bp, mouse
ggagttaggtgtaatacagg

SEQ ID NO: 824611 - DNA, 20 bp, mouse
gggtagacagggaacttact

SEQ ID NO: 824612 - DNA, 20 bp, mouse
gagaagtggtataaccatcc

SEQ ID NO: 824613 - DNA, 20 bp, mouse
gatgatgacaaaataataca

SEQ ID NO: 824614 - DNA, 20 bp, mouse
gcacacatactaaggtagac

SEQ ID NO: 824615 - DNA, 20 bp, mouse
gcacctaactcctggtaaca

SEQ ID NO: 824616 - DNA, 20 bp, mouse
ggggccaaggccttcccaaa

SEQ ID NO: 824617 - DNA, 20 bp, mouse
gagtgtggaggacactttga

SEQ ID NO: 824618 - DNA, 20 bp, mouse
gggagctgcggccgtagggg

SEQ ID NO: 824619 - DNA, 20 bp, mouse
gcgtaggggaggagcggtcg

SEQ ID NO: 824620 - DNA, 20 bp, mouse
gagggcggagctgcggccgt

SEQ ID NO: 824621 - DNA, 20 bp, mouse
ggggggaggagcttcccgca

SEQ ID NO: 824622 - DNA, 20 bp, mouse
gggcgagcgtgggctgggat

SEQ ID NO: 824623 - DNA, 20 bp, mouse
ggcgggccgtcggcgagcgt

SEQ ID NO: 824624 - DNA, 20 bp, mouse
ggaggcgcgctgacacctgg

SEQ ID NO: 824625 - DNA, 20 bp, mouse
gaaggccttcccaaatggga

SEQ ID NO: 824626 - DNA, 20 bp, mouse
gctgacgtcacgattctctc

SEQ ID NO: 824627 - DNA, 20 bp, mouse
ggcctcgctcgccgggtcta

SEQ ID NO: 824628 - DNA, 20 bp, mouse
ggcgagatctcggaagtggc

SEQ ID NO: 824629 - DNA, 20 bp, mouse
gagagcggacagcatggcta

SEQ ID NO: 824630 - DNA, 20 bp, mouse
ggccctagacccggcgagcg

SEQ ID NO: 824631 - DNA, 20 bp, mouse
gagtgggcaaagctaacggt

SEQ ID NO: 824632 - DNA, 20 bp, mouse
gtctcgcgagatctcggaag

SEQ ID NO: 824633 - DNA, 20 bp, mouse
gcggaagtgggcaaagctaa

SEQ ID NO: 824634 - DNA, 20 bp, mouse
gagcgctaggtcccggaagt

SEQ ID NO: 824635 - DNA, 20 bp, mouse
gggcctctctcgcgagatct

SEQ ID NO: 824636 - DNA, 20 bp, mouse
ggctccgcccaatggcacga

SEQ ID NO: 824637 - DNA, 20 bp, mouse
gtggactcccgcattcagta

SEQ ID NO: 824638 - DNA, 20 bp, mouse
gggcacgaaggccacgtgaa

SEQ ID NO: 824639 - DNA, 20 bp, mouse
gcgccagccggccctttcca

SEQ ID NO: 824640 - DNA, 20 bp, mouse
gcctttccagggccttaaag

SEQ ID NO: 824641 - DNA, 20 bp, mouse
gaaagggccggctggcggtt

SEQ ID NO: 824642 - DNA, 20 bp, mouse
gtgtatgaagctctaaacaa

SEQ ID NO: 824643 - DNA, 20 bp, mouse
gactggagacagaaaccggg

SEQ ID NO: 824644 - DNA, 20 bp, mouse
gaggccctggctccgcccaa

SEQ ID NO: 824645 - DNA, 20 bp, mouse
ggaggaggatgctgcggaaa

SEQ ID NO: 824646 - DNA, 20 bp, mouse
gttcacttgtgaggccacta

SEQ ID NO: 824647 - DNA, 20 bp, mouse
gctgccggaggagccgggtt

SEQ ID NO: 824648 - DNA, 20 bp, mouse
gttaaccccgtcgctgccgg

SEQ ID NO: 824649 - DNA, 20 bp, mouse
gcagcgacggggttaacgcg

SEQ ID NO: 824650 - DNA, 20 bp, mouse
gagacaaggacaatcctcgg

SEQ ID NO: 824651 - DNA, 20 bp, mouse
gtctctaggaagcgttctga

SEQ ID NO: 824652 - DNA, 20 bp, mouse
ggcgctcccggcccgagaca

SEQ ID NO: 824653 - DNA, 20 bp, mouse
gctgccaaacccggctcctc

SEQ ID NO: 824654 - DNA, 20 bp, mouse
gccgagacaaggacaatcct

SEQ ID NO: 824655 - DNA, 20 bp, mouse
gtggtgagctgtctgacatg

SEQ ID NO: 824656 - DNA, 20 bp, mouse
gcgccggccgggcctctcat

SEQ ID NO: 824657 - DNA, 20 bp, mouse
ggaccccgggaccttggcat

SEQ ID NO: 824658 - DNA, 20 bp, mouse
gggtcctgagagtgtcattg

SEQ ID NO: 824659 - DNA, 20 bp, mouse
gggctcaggctcgcgcagaa

SEQ ID NO: 824660 - DNA, 20 bp, mouse
gaaacagtgaacgttacaag

SEQ ID NO: 824661 - DNA, 20 bp, mouse
gtgtttgagaagagactccg

SEQ ID NO: 824662 - DNA, 20 bp, mouse
gcgcgcagaaaggtgtctag

SEQ ID NO: 824663 - DNA, 20 bp, mouse
gagcccatgccaaggtcccg

SEQ ID NO: 824664 - DNA, 20 bp, mouse
gagcccatgagaggcccggc

SEQ ID NO: 824665 - DNA, 20 bp, mouse
gtgggtaaccataaacataa

SEQ ID NO: 824666 - DNA, 20 bp, mouse
gtgggagcatctaacgtgct

SEQ ID NO: 824667 - DNA, 20 bp, mouse
gcgtgggaggaaccactcca

SEQ ID NO: 824668 - DNA, 20 bp, mouse
gaaagcctgctgactgtgaa

SEQ ID NO: 824669 - DNA, 20 bp, mouse
gggtgtgcagttggacaaag

SEQ ID NO: 824670 - DNA, 20 bp, mouse
gagtacggcaccaaactcgt

SEQ ID NO: 824671 - DNA, 20 bp, mouse
gcagaaactggttttattgg

SEQ ID NO: 824672 - DNA, 20 bp, mouse
gtccaactgcacacccatga

SEQ ID NO: 824673 - DNA, 20 bp, mouse
gagcacaagaaccatgaaag

SEQ ID NO: 824674 - DNA, 20 bp, mouse
gctgagtggaagaaagggct

SEQ ID NO: 824675 - DNA, 20 bp, mouse
gttggcagcagtttactgag

SEQ ID NO: 824676 - DNA, 20 bp, mouse
gggcggggcgggagaaaggg

SEQ ID NO: 824677 - DNA, 20 bp, mouse
gcgggtgcagtagagagctg

SEQ ID NO: 824678 - DNA, 20 bp, mouse
gcgggcccaggcctcgggag

SEQ ID NO: 824679 - DNA, 20 bp, mouse
ggggtaacaaggtgaggagt

SEQ ID NO: 824680 - DNA, 20 bp, mouse
ggggtaggggtaacaaggtg

SEQ ID NO: 824681 - DNA, 20 bp, mouse
ggtgaaggtagtggggggta

SEQ ID NO: 824682 - DNA, 20 bp, mouse
gagatggtgaaggtagtggg

SEQ ID NO: 824683 - DNA, 20 bp, mouse
ggtggggggtaggggtaaca

SEQ ID NO: 824684 - DNA, 20 bp, mouse
gggtgagatggtgaaggtag

SEQ ID NO: 824685 - DNA, 20 bp, mouse
ggaccttgacactgcagtga

SEQ ID NO: 824686 - DNA, 20 bp, mouse
ggaactgtgtacgcacattt

SEQ ID NO: 824687 - DNA, 20 bp, mouse
gggaactcctgaaaagccga

SEQ ID NO: 824688 - DNA, 20 bp, mouse
gaatgcttctatgttgtttt

SEQ ID NO: 824689 - DNA, 20 bp, mouse
gaaacctccaagtcattcag

SEQ ID NO: 824690 - DNA, 20 bp, mouse
ggaactatgacatgagtact

SEQ ID NO: 824691 - DNA, 20 bp, mouse
ggagaacagcaaacatttta

SEQ ID NO: 824692 - DNA, 20 bp, mouse
ggttcctctgaatgacttgg

SEQ ID NO: 824693 - DNA, 20 bp, mouse
gtatgacatgagtacttgga

SEQ ID NO: 824694 - DNA, 20 bp, mouse
gtgtgtgccttcggcttttc

SEQ ID NO: 824695 - DNA, 20 bp, mouse
gtatgcaaatcagactgcac

SEQ ID NO: 824696 - DNA, 20 bp, mouse
gtggcccgcgctgtgacttg

SEQ ID NO: 824697 - DNA, 20 bp, mouse
gcgcgagccgagagggacgt

SEQ ID NO: 824698 - DNA, 20 bp, mouse
gctccgcgcacgggtatctg

SEQ ID NO: 824699 - DNA, 20 bp, mouse
ggctccacaagtcacagcgc

SEQ ID NO: 824700 - DNA, 20 bp, mouse
ggcgtcacccacgtccctct

SEQ ID NO: 824701 - DNA, 20 bp, mouse
gacctgcgcaggttgggcgg

SEQ ID NO: 824702 - DNA, 20 bp, mouse
gtgtggagcgcgagccgaga

SEQ ID NO: 824703 - DNA, 20 bp, mouse
gcctctcagcagccaatccc

SEQ ID NO: 824704 - DNA, 20 bp, mouse
gggagctttgtcagcggagg

SEQ ID NO: 824705 - DNA, 20 bp, mouse
gggcgcgtgccagcgagagt

SEQ ID NO: 824706 - DNA, 20 bp, mouse
ggggcggaggcgggagtctc

SEQ ID NO: 824707 - DNA, 20 bp, mouse
ggccgccgtgtcagaaaccg

SEQ ID NO: 824708 - DNA, 20 bp, mouse
gagacggtaggtgagacgcc

SEQ ID NO: 824709 - DNA, 20 bp, mouse
gcgcccgcgctgggcaacgg

SEQ ID NO: 824710 - DNA, 20 bp, mouse
gcgcgatcggccacggcgga

SEQ ID NO: 824711 - DNA, 20 bp, mouse
ggtgagacgccggggctcca

SEQ ID NO: 824712 - DNA, 20 bp, mouse
gaggccgtcctcgagacggt

SEQ ID NO: 824713 - DNA, 20 bp, mouse
gtcacctaccgtctcgagga

SEQ ID NO: 824714 - DNA, 20 bp, mouse
gccggctacttccgggtcgt

SEQ ID NO: 824715 - DNA, 20 bp, mouse
gaggaccccggagttggagg

SEQ ID NO: 824716 - DNA, 20 bp, mouse
gggaccgcggggagctccaa

SEQ ID NO: 824717 - DNA, 20 bp, mouse
gtgggacgctcccaacccag

SEQ ID NO: 824718 - DNA, 20 bp, mouse
gactccgcctccctgcccct

SEQ ID NO: 824719 - DNA, 20 bp, mouse
gacactagccaataggtgtc

SEQ ID NO: 824720 - DNA, 20 bp, mouse
ggccaataggtgtcaggaaa

SEQ ID NO: 824721 - DNA, 20 bp, mouse
ggggggaggccaagatcctt

SEQ ID NO: 824722 - DNA, 20 bp, mouse
gttggcctccccctagtgtt

SEQ ID NO: 824723 - DNA, 20 bp, mouse
gcgcctccctgcccctgggt

SEQ ID NO: 824724 - DNA, 20 bp, mouse
gcgctcccaacccaggggca

SEQ ID NO: 824725 - DNA, 20 bp, mouse
ggggttcctcctaacactag

SEQ ID NO: 824726 - DNA, 20 bp, mouse
gacgcccggtgtcctagaag

SEQ ID NO: 824727 - DNA, 20 bp, mouse
ggcagccgagtcgtggtatc

SEQ ID NO: 824728 - DNA, 20 bp, mouse
gaagatggcggcacaggcgg

SEQ ID NO: 824729 - DNA, 20 bp, mouse
gtccgggcctcgatccgctg

SEQ ID NO: 824730 - DNA, 20 bp, mouse
gcggaagcaccttgaggggc

SEQ ID NO: 824731 - DNA, 20 bp, mouse
ggaggcggaagcaccttgag

SEQ ID NO: 824732 - DNA, 20 bp, mouse
gcggtgtcctagaagggggt

SEQ ID NO: 824733 - DNA, 20 bp, mouse
gtggacgagattgtcggaga

SEQ ID NO: 824734 - DNA, 20 bp, mouse
ggcgccacctgagaagaggg

SEQ ID NO: 824735 - DNA, 20 bp, mouse
gccgagctgcaggtgcgtcc

SEQ ID NO: 824736 - DNA, 20 bp, mouse
gtggctgcgtagacccggtg

SEQ ID NO: 824737 - DNA, 20 bp, mouse
gagtgggcgccgcggggtcg

SEQ ID NO: 824738 - DNA, 20 bp, mouse
ggagcctctcggctgaagga

SEQ ID NO: 824739 - DNA, 20 bp, mouse
gctctcgcggacttggtttg

SEQ ID NO: 824740 - DNA, 20 bp, mouse
gcaccggccgcctgtgcttg

SEQ ID NO: 824741 - DNA, 20 bp, mouse
gtgcgcttgcgcttatatgg

SEQ ID NO: 824742 - DNA, 20 bp, mouse
gcgggtctacgcagccacgt

SEQ ID NO: 824743 - DNA, 20 bp, mouse
gacgcagccacgtggggaaa

SEQ ID NO: 824744 - DNA, 20 bp, mouse
gcacctgagcacctgctaca

SEQ ID NO: 824745 - DNA, 20 bp, mouse
ggcgcgctgctcacttctca

SEQ ID NO: 824746 - DNA, 20 bp, mouse
gcacggccacgccctcgggg

SEQ ID NO: 824747 - DNA, 20 bp, mouse
ggccccgccgtacgcccgtg

SEQ ID NO: 824748 - DNA, 20 bp, mouse
gcttggctgcgtcacgggta

SEQ ID NO: 824749 - DNA, 20 bp, mouse
gcggcggggcgcgggactca

SEQ ID NO: 824750 - DNA, 20 bp, mouse
ggctgcgtcacgggtagggg

SEQ ID NO: 824751 - DNA, 20 bp, mouse
gggtaggcgcggggccggct

SEQ ID NO: 824752 - DNA, 20 bp, mouse
gagggtgggcaggtaggcgc

SEQ ID NO: 824753 - DNA, 20 bp, mouse
ggactcacggccacgccctc

SEQ ID NO: 824754 - DNA, 20 bp, mouse
gatccccagtaccttacagt

SEQ ID NO: 824755 - DNA, 20 bp, mouse
gcgtacgcccgtgggggatc

SEQ ID NO: 824756 - DNA, 20 bp, mouse
gctgcccaatccaattgctg

SEQ ID NO: 824757 - DNA, 20 bp, mouse
gtggggctgagagtctctta

SEQ ID NO: 824758 - DNA, 20 bp, mouse
gggagggctgggcagggacg

SEQ ID NO: 824759 - DNA, 20 bp, mouse
gaaagaactgctacaaaagg

SEQ ID NO: 824760 - DNA, 20 bp, mouse
ggtctcttacggattggagg

SEQ ID NO: 824761 - DNA, 20 bp, mouse
gggtggagggggttctcggt

SEQ ID NO: 824762 - DNA, 20 bp, mouse
gcagccccagcaattggatt

SEQ ID NO: 824763 - DNA, 20 bp, mouse
gctgctacaaaaggaggagt

SEQ ID NO: 824764 - DNA, 20 bp, mouse
gggattggaggcggagggct

SEQ ID NO: 824765 - DNA, 20 bp, mouse
gctgagagtctcttacggat

SEQ ID NO: 824766 - DNA, 20 bp, mouse
gcctctggtggcttcgggga

SEQ ID NO: 824767 - DNA, 20 bp, mouse
gactttctgaagctactggt

SEQ ID NO: 824768 - DNA, 20 bp, mouse
gcgccctgggcgcggagttg

SEQ ID NO: 824769 - DNA, 20 bp, mouse
gagacgcgtgggaaggtccc

SEQ ID NO: 824770 - DNA, 20 bp, mouse
gcaagcctctggtggcttcg

SEQ ID NO: 824771 - DNA, 20 bp, mouse
ggccgagcgcgcaccctcgc

SEQ ID NO: 824772 - DNA, 20 bp, mouse
gaccctgcggtggaacgggg

SEQ ID NO: 824773 - DNA, 20 bp, mouse
ggggaaggtcccaggcgcgt

SEQ ID NO: 824774 - DNA, 20 bp, mouse
ggctactggtgggctctgtg

SEQ ID NO: 824775 - DNA, 20 bp, mouse
ggaacggggcgggcctcgga

SEQ ID NO: 824776 - DNA, 20 bp, mouse
gaggccacagcatggacagt

SEQ ID NO: 824777 - DNA, 20 bp, mouse
gtaaccatactgtggactgt

SEQ ID NO: 824778 - DNA, 20 bp, mouse
gggttctgttaaccatactg

SEQ ID NO: 824779 - DNA, 20 bp, mouse
gaggaagtggaaacagtgct

SEQ ID NO: 824780 - DNA, 20 bp, mouse
ggaggaggtggagtagggca

SEQ ID NO: 824781 - DNA, 20 bp, mouse
ggagttggaggggtgttcat

SEQ ID NO: 824782 - DNA, 20 bp, mouse
gcccaaggtgtcctcaagac

SEQ ID NO: 824783 - DNA, 20 bp, mouse
gatgggaaggagcaaggtca

SEQ ID NO: 824784 - DNA, 20 bp, mouse
gtggctccaagccagtcttg

SEQ ID NO: 824785 - DNA, 20 bp, mouse
ggtccatgctgtggcctgat

SEQ ID NO: 824786 - DNA, 20 bp, mouse
gtaacactacagactggcaa

SEQ ID NO: 824787 - DNA, 20 bp, mouse
ggtacacacggaaacacgaa

SEQ ID NO: 824788 - DNA, 20 bp, mouse
gaacacgaagggtaacttgt

SEQ ID NO: 824789 - DNA, 20 bp, mouse
gtgcccacacatgcaactgt

SEQ ID NO: 824790 - DNA, 20 bp, mouse
gaagaggacaaaatgtatgc

SEQ ID NO: 824791 - DNA, 20 bp, mouse
gaataagcttttaagagaag

SEQ ID NO: 824792 - DNA, 20 bp, mouse
gaagcctacagttgcatgtg

SEQ ID NO: 824793 - DNA, 20 bp, mouse
ggctaatattttagtgtaaa

SEQ ID NO: 824794 - DNA, 20 bp, mouse
gggctttatcacagtacaca

SEQ ID NO: 824795 - DNA, 20 bp, mouse
gcaaaatacctctaattcca

SEQ ID NO: 824796 - DNA, 20 bp, mouse
gtaacaaagggacataactc

SEQ ID NO: 824797 - DNA, 20 bp, mouse
gaagggaatgcggagctctc

SEQ ID NO: 824798 - DNA, 20 bp, mouse
ggcacaggtaaaaaaggaaa

SEQ ID NO: 824799 - DNA, 20 bp, mouse
ggcggagctctcaggtagtc

SEQ ID NO: 824800 - DNA, 20 bp, mouse
gcagtgagtcagatattaac

SEQ ID NO: 824801 - DNA, 20 bp, mouse
ggtggcattcatataaaagt

SEQ ID NO: 824802 - DNA, 20 bp, mouse
gagcaatgcacaggtaaaaa

SEQ ID NO: 824803 - DNA, 20 bp, mouse
gtacaggagcctgcttaggg

SEQ ID NO: 824804 - DNA, 20 bp, mouse
gggacataactctggctcca

SEQ ID NO: 824805 - DNA, 20 bp, mouse
gagtcagatattaacgggca

SEQ ID NO: 824806 - DNA, 20 bp, mouse
ggtgaaagttacttcctcat

SEQ ID NO: 824807 - DNA, 20 bp, mouse
gagtcaggtggtcttagaat

SEQ ID NO: 824808 - DNA, 20 bp, mouse
gtagaagcttgcacatagtg

SEQ ID NO: 824809 - DNA, 20 bp, mouse
ggccttaatcaacagagtcg

SEQ ID NO: 824810 - DNA, 20 bp, mouse
gagatcgattgctaaaggtt

SEQ ID NO: 824811 - DNA, 20 bp, mouse
ggcctcgactctgttgatta

SEQ ID NO: 824812 - DNA, 20 bp, mouse
gtccagtgcttgcagactca

SEQ ID NO: 824813 - DNA, 20 bp, mouse
gcaggtggtcttagaatggg

SEQ ID NO: 824814 - DNA, 20 bp, mouse
gcttcgagatcgattgctaa

SEQ ID NO: 824815 - DNA, 20 bp, mouse
gccttggcatcagcccaatg

SEQ ID NO: 824816 - DNA, 20 bp, mouse
gaacaacacgcaaaacatgg

SEQ ID NO: 824817 - DNA, 20 bp, mouse
gaaacaggggagcggcctta

SEQ ID NO: 824818 - DNA, 20 bp, mouse
gctcatggggcattttcagt

SEQ ID NO: 824819 - DNA, 20 bp, mouse
gtcaattattaactgatcag

SEQ ID NO: 824820 - DNA, 20 bp, mouse
gacagttcaccagtaggttc

SEQ ID NO: 824821 - DNA, 20 bp, mouse
gtatagtctcctgaacctac

SEQ ID NO: 824822 - DNA, 20 bp, mouse
gccatgagtataaactcccc

SEQ ID NO: 824823 - DNA, 20 bp, mouse
ggttaacaacacgcaaaaca

SEQ ID NO: 824824 - DNA, 20 bp, mouse
ggtcttataattatcaccct

SEQ ID NO: 824825 - DNA, 20 bp, mouse
gtgcaaaagatttatgtact

SEQ ID NO: 824826 - DNA, 20 bp, mouse
gaggggagaaacagctgtag

SEQ ID NO: 824827 - DNA, 20 bp, mouse
gcggacaaggagattagagg

SEQ ID NO: 824828 - DNA, 20 bp, mouse
gtggactatgatgtaatgga

SEQ ID NO: 824829 - DNA, 20 bp, mouse
gggaatggactatgatgtaa

SEQ ID NO: 824830 - DNA, 20 bp, mouse
gactatgatgtaatggatgg

SEQ ID NO: 824831 - DNA, 20 bp, mouse
gacagctgtttctccccttt

SEQ ID NO: 824832 - DNA, 20 bp, mouse
gaaggagattagaggaggcc

SEQ ID NO: 824833 - DNA, 20 bp, mouse
gaatagctttgggaactgat

SEQ ID NO: 824834 - DNA, 20 bp, mouse
gaatgaatgatataatgaat

SEQ ID NO: 824835 - DNA, 20 bp, mouse
gggaggcagagactaacttg

SEQ ID NO: 824836 - DNA, 20 bp, mouse
gttactgagtttccagtttg

SEQ ID NO: 824837 - DNA, 20 bp, mouse
gcaagttcattaccccaaac

SEQ ID NO: 824838 - DNA, 20 bp, mouse
gaggttagaaaaatcaatgt

SEQ ID NO: 824839 - DNA, 20 bp, mouse
gatcctgaggcatgcagttg

SEQ ID NO: 824840 - DNA, 20 bp, mouse
gaacctcaactgcatgcctc

SEQ ID NO: 824841 - DNA, 20 bp, mouse
gcctccttttcccatatttt

SEQ ID NO: 824842 - DNA, 20 bp, mouse
gtcatacagaaccattccaa

SEQ ID NO: 824843 - DNA, 20 bp, mouse
ggctttgagtggaagaagaa

SEQ ID NO: 824844 - DNA, 20 bp, mouse
gtaaaacaaagaaattccat

SEQ ID NO: 824845 - DNA, 20 bp, mouse
gcaaagaaattccattggaa

SEQ ID NO: 824846 - DNA, 20 bp, mouse
gcagagacgcagtaagagta

SEQ ID NO: 824847 - DNA, 20 bp, mouse
gagtaaggcaaggtacctcg

SEQ ID NO: 824848 - DNA, 20 bp, mouse
gacgcagtaagagtaaggca

SEQ ID NO: 824849 - DNA, 20 bp, mouse
gagggcttgtgccccaggtt

SEQ ID NO: 824850 - DNA, 20 bp, mouse
gtcgggcgagtccgctagca

SEQ ID NO: 824851 - DNA, 20 bp, mouse
gtgatttcgagtcatgaact

SEQ ID NO: 824852 - DNA, 20 bp, mouse
gatcctgtgtgggtccgtgt

SEQ ID NO: 824853 - DNA, 20 bp, mouse
ggcgctgtgttccactcacc

SEQ ID NO: 824854 - DNA, 20 bp, mouse
ggtgggtccgtgtgggtgtc

SEQ ID NO: 824855 - DNA, 20 bp, mouse
ggagaggtaagatttagtgc

SEQ ID NO: 824856 - DNA, 20 bp, mouse
gagactcaggaaaacataat

SEQ ID NO: 824857 - DNA, 20 bp, mouse
gaagaagagatcaaaaatat

SEQ ID NO: 824858 - DNA, 20 bp, mouse
ggctttgaggggaagaaaaa

SEQ ID NO: 824859 - DNA, 20 bp, mouse
gaaagggcagttaatgtact

SEQ ID NO: 824860 - DNA, 20 bp, mouse
gaatctcaactgtacacctc

SEQ ID NO: 824861 - DNA, 20 bp, mouse
gtcaaaaatatgggaaaagt

SEQ ID NO: 824862 - DNA, 20 bp, mouse
gttgtatgcgatgtatcctg

SEQ ID NO: 824863 - DNA, 20 bp, mouse
ggcatacaagctcaaatgca

SEQ ID NO: 824864 - DNA, 20 bp, mouse
gaatatgggaaaagtaggga

SEQ ID NO: 824865 - DNA, 20 bp, mouse
gaaaagtagggaaggctttg

SEQ ID NO: 824866 - DNA, 20 bp, mouse
gggtttgtggtcatgaactc

SEQ ID NO: 824867 - DNA, 20 bp, mouse
ggaaaggagggcgggctttg

SEQ ID NO: 824868 - DNA, 20 bp, mouse
ggctttgagggtaagaagaa

SEQ ID NO: 824869 - DNA, 20 bp, mouse
gatacagtaaccgttgacta

SEQ ID NO: 824870 - DNA, 20 bp, mouse
gtgggacagacagttgaaat

SEQ ID NO: 824871 - DNA, 20 bp, mouse
gtgaccacaaaccagaaact

SEQ ID NO: 824872 - DNA, 20 bp, mouse
gtattataatccatagtcaa

SEQ ID NO: 824873 - DNA, 20 bp, mouse
gtgtgaaactagctactgat

SEQ ID NO: 824874 - DNA, 20 bp, mouse
gttacttcttaccaagtttc

SEQ ID NO: 824875 - DNA, 20 bp, mouse
gaagaagagaccataaatac

SEQ ID NO: 824876 - DNA, 20 bp, mouse
gtggtttcacaacaaactga

SEQ ID NO: 824877 - DNA, 20 bp, mouse
gtacagagataggcatagat

SEQ ID NO: 824878 - DNA, 20 bp, mouse
gtgtgaaaccacttactgat

SEQ ID NO: 824879 - DNA, 20 bp, mouse
gtaaaaattggattgatgat

SEQ ID NO: 824880 - DNA, 20 bp, mouse
ggtagtaccattacagagat

SEQ ID NO: 824881 - DNA, 20 bp, mouse
gatttcttcctatcagtaag

SEQ ID NO: 824882 - DNA, 20 bp, mouse
gattgcacacgtcaacattt

SEQ ID NO: 824883 - DNA, 20 bp, mouse
gtaaaatctaactttcaaac

SEQ ID NO: 824884 - DNA, 20 bp, mouse
gcatacatataaataaaaat

SEQ ID NO: 824885 - DNA, 20 bp, mouse
gaattggattgatgatgggc

SEQ ID NO: 824886 - DNA, 20 bp, mouse
ggggctgcggtggccactca

SEQ ID NO: 824887 - DNA, 20 bp, mouse
gggccagcagtggggacttc

SEQ ID NO: 824888 - DNA, 20 bp, mouse
gtaccagccggcccagggga

SEQ ID NO: 824889 - DNA, 20 bp, mouse
ggccctggactctggtcgtg

SEQ ID NO: 824890 - DNA, 20 bp, mouse
gtgcccacgcctcctgccgg

SEQ ID NO: 824891 - DNA, 20 bp, mouse
gctgaggcgggcagccaggc

SEQ ID NO: 824892 - DNA, 20 bp, mouse
gcttccggctgtaccctgag

SEQ ID NO: 824893 - DNA, 20 bp, mouse
gctccaccctcgccctggga

SEQ ID NO: 824894 - DNA, 20 bp, mouse
ggagcctccaccctcgccct

SEQ ID NO: 824895 - DNA, 20 bp, mouse
gagagtccagggccagcagt

SEQ ID NO: 824896 - DNA, 20 bp, mouse
gggtattaggtcttcttcat

SEQ ID NO: 824897 - DNA, 20 bp, mouse
gtgctgcactaagacccatc

SEQ ID NO: 824898 - DNA, 20 bp, mouse
gtgaaaagggacacataaca

SEQ ID NO: 824899 - DNA, 20 bp, mouse
gcagatgcaaatgttaaaag

SEQ ID NO: 824900 - DNA, 20 bp, mouse
gccttagccagacaaacaag

SEQ ID NO: 824901 - DNA, 20 bp, mouse
gctaagacccatctggtcct

SEQ ID NO: 824902 - DNA, 20 bp, mouse
gctgtaccctcttgtttgtc

SEQ ID NO: 824903 - DNA, 20 bp, mouse
gataaaatcagaaagtgaaa

SEQ ID NO: 824904 - DNA, 20 bp, mouse
gtcccaaccaaaaatagccc

SEQ ID NO: 824905 - DNA, 20 bp, mouse
gtcctgggctatttttggtt

SEQ ID NO: 824906 - DNA, 20 bp, mouse
gcagacccagggcgagcctc

SEQ ID NO: 824907 - DNA, 20 bp, mouse
gcaccctagagcaaaaaagg

SEQ ID NO: 824908 - DNA, 20 bp, mouse
gcctgccgcaaaggtgcgtc

SEQ ID NO: 824909 - DNA, 20 bp, mouse
gcacgccgcgcccctgacgt

SEQ ID NO: 824910 - DNA, 20 bp, mouse
gcctcggcaaccgacgtcag

SEQ ID NO: 824911 - DNA, 20 bp, mouse
ggcaaccgacgtcaggggcg

SEQ ID NO: 824912 - DNA, 20 bp, mouse
gaggcgtctgcgcagaccca

SEQ ID NO: 824913 - DNA, 20 bp, mouse
gggccccgcgcctgccgcaa

SEQ ID NO: 824914 - DNA, 20 bp, mouse
gcggacccgacgcacctttg

SEQ ID NO: 824915 - DNA, 20 bp, mouse
gggaccccgaggctcgccct

SEQ ID NO: 824916 - DNA, 20 bp, mouse
gccagggccctgcaacgcta

SEQ ID NO: 824917 - DNA, 20 bp, mouse
gctgggaagagcgcccccat

SEQ ID NO: 824918 - DNA, 20 bp, mouse
gaggggagcattgttgaaac

SEQ ID NO: 824919 - DNA, 20 bp, mouse
gccctggggcagaagactgc

SEQ ID NO: 824920 - DNA, 20 bp, mouse
ggggccctgcaacgctaggg

SEQ ID NO: 824921 - DNA, 20 bp, mouse
ggtggagcactggccaggaa

SEQ ID NO: 824922 - DNA, 20 bp, mouse
gcccaaccagacccatttgg

SEQ ID NO: 824923 - DNA, 20 bp, mouse
ggcccccaaccagacccatt

SEQ ID NO: 824924 - DNA, 20 bp, mouse
ggcaataagcggataatctt

SEQ ID NO: 824925 - DNA, 20 bp, mouse
gtgcatggtgggtcctaggg

SEQ ID NO: 824926 - DNA, 20 bp, mouse
ggtgaggcccaggtgcggac

SEQ ID NO: 824927 - DNA, 20 bp, mouse
gtcaggagctgttactctag

SEQ ID NO: 824928 - DNA, 20 bp, mouse
ggccaggaggatattcaaac

SEQ ID NO: 824929 - DNA, 20 bp, mouse
gcctgagcctgtccgcacct

SEQ ID NO: 824930 - DNA, 20 bp, mouse
ggagttaggcatcccacccc

SEQ ID NO: 824931 - DNA, 20 bp, mouse
gacaaatagtcactccacct

SEQ ID NO: 824932 - DNA, 20 bp, mouse
ggcttcttatattacgagtt

SEQ ID NO: 824933 - DNA, 20 bp, mouse
gctgggcctcaccttttgcc

SEQ ID NO: 824934 - DNA, 20 bp, mouse
gtgaatatcctcctggcaaa

SEQ ID NO: 824935 - DNA, 20 bp, mouse
gcatggacgtactgctaaat

SEQ ID NO: 824936 - DNA, 20 bp, mouse
ggagaggggcacattgtctg

SEQ ID NO: 824937 - DNA, 20 bp, mouse
gcaaccacgaaactagagag

SEQ ID NO: 824938 - DNA, 20 bp, mouse
gggggcacattgtctgcgga

SEQ ID NO: 824939 - DNA, 20 bp, mouse
gactacctggaagcagtctc

SEQ ID NO: 824940 - DNA, 20 bp, mouse
ggtgcccctctctagtttcg

SEQ ID NO: 824941 - DNA, 20 bp, mouse
gcaaactctggctaactacc

SEQ ID NO: 824942 - DNA, 20 bp, mouse
gccgctgctttaagcaccac

SEQ ID NO: 824943 - DNA, 20 bp, mouse
gaacattagcaggcaaactc

SEQ ID NO: 824944 - DNA, 20 bp, mouse
gacaggtcacgtgatctcca

SEQ ID NO: 824945 - DNA, 20 bp, mouse
gatagcctgagactgcttcc

SEQ ID NO: 824946 - DNA, 20 bp, mouse
gcccgcccatgaatgaacac

SEQ ID NO: 824947 - DNA, 20 bp, mouse
gcctgacaggcaagctccca

SEQ ID NO: 824948 - DNA, 20 bp, mouse
gtgggcctgtgttcattcat

SEQ ID NO: 824949 - DNA, 20 bp, mouse
gagtcagataaaatcagagt

SEQ ID NO: 824950 - DNA, 20 bp, mouse
gaatcagagtaggatgggtg

SEQ ID NO: 824951 - DNA, 20 bp, mouse
gagttagtgcccagcaccgt

SEQ ID NO: 824952 - DNA, 20 bp, mouse
gtgaatagaggaaaatatct

SEQ ID NO: 824953 - DNA, 20 bp, mouse
gcagcacattggacctgcaa

SEQ ID NO: 824954 - DNA, 20 bp, mouse
gccagacatgggaacacaag

SEQ ID NO: 824955 - DNA, 20 bp, mouse
gagaagttgcccacggtgct

SEQ ID NO: 824956 - DNA, 20 bp, mouse
gagaactgctaggacttcgg

SEQ ID NO: 824957 - DNA, 20 bp, mouse
gcccgctgccgcagccctca

SEQ ID NO: 824958 - DNA, 20 bp, mouse
gtggcaacagcaagcatgag

SEQ ID NO: 824959 - DNA, 20 bp, mouse
gtgctaggacttcggaggga

SEQ ID NO: 824960 - DNA, 20 bp, mouse
gacgccgtaaggaaggccgg

SEQ ID NO: 824961 - DNA, 20 bp, mouse
ggaagcgggaaaacgccgta

SEQ ID NO: 824962 - DNA, 20 bp, mouse
gagttagcgaagacgggaaa

SEQ ID NO: 824963 - DNA, 20 bp, mouse
ggaagtgacgcaagacgtag

SEQ ID NO: 824964 - DNA, 20 bp, mouse
gtgcttaggctcctcccggt

SEQ ID NO: 824965 - DNA, 20 bp, mouse
gcgggaaaacgccgtaagga

SEQ ID NO: 824966 - DNA, 20 bp, mouse
gcaggcgcccgccaggtcgg

SEQ ID NO: 824967 - DNA, 20 bp, mouse
gcctcttcccgccgacctgg

SEQ ID NO: 824968 - DNA, 20 bp, mouse
gggcgcgcctggctctgggc

SEQ ID NO: 824969 - DNA, 20 bp, mouse
gtaggctcaccccacgtcta

SEQ ID NO: 824970 - DNA, 20 bp, mouse
gcgcaccagtcccgccgcgg

SEQ ID NO: 824971 - DNA, 20 bp, mouse
gagcatccggggcttctcat

SEQ ID NO: 824972 - DNA, 20 bp, mouse
gggccaggcgcccgccaggt

SEQ ID NO: 824973 - DNA, 20 bp, mouse
gtggtggagcataatcaaaa

SEQ ID NO: 824974 - DNA, 20 bp, mouse
gggtgagcctaggtcgagaa

SEQ ID NO: 824975 - DNA, 20 bp, mouse
gggcgcgtggccttagacgt

SEQ ID NO: 824976 - DNA, 20 bp, mouse
gggccagccgcgattcagga

SEQ ID NO: 824977 - DNA, 20 bp, mouse
gacgcgcgactcaaggtcct

SEQ ID NO: 824978 - DNA, 20 bp, mouse
gtgcgaatgcgtcacggggc

SEQ ID NO: 824979 - DNA, 20 bp, mouse
gaccttgagtcgcgcgtccc

SEQ ID NO: 824980 - DNA, 20 bp, mouse
gcgggtgcgcgcagagcccc

SEQ ID NO: 824981 - DNA, 20 bp, mouse
gggaggcacgggaggagtgg

SEQ ID NO: 824982 - DNA, 20 bp, mouse
gcgctggccagccgcgattc

SEQ ID NO: 824983 - DNA, 20 bp, mouse
gactgcgcgtccacgcaggg

SEQ ID NO: 824984 - DNA, 20 bp, mouse
gcccggggacgcgcgactca

SEQ ID NO: 824985 - DNA, 20 bp, mouse
ggacggttgcgaatgcgtca

SEQ ID NO: 824986 - DNA, 20 bp, mouse
ggacgtgtggcgtcagtggg

SEQ ID NO: 824987 - DNA, 20 bp, mouse
ggggtcagcggcctccccat

SEQ ID NO: 824988 - DNA, 20 bp, mouse
gcgggcgcgctgggacttga

SEQ ID NO: 824989 - DNA, 20 bp, mouse
ggcgggacgtgtggcgtcag

SEQ ID NO: 824990 - DNA, 20 bp, mouse
gcagggccgtggcgggtcag

SEQ ID NO: 824991 - DNA, 20 bp, mouse
gtgaggggccgcacctaggg

SEQ ID NO: 824992 - DNA, 20 bp, mouse
gcaggcgcgcttgggattga

SEQ ID NO: 824993 - DNA, 20 bp, mouse
ggccgcgccgggatcggagg

SEQ ID NO: 824994 - DNA, 20 bp, mouse
gacttgaggggccgcaccta

SEQ ID NO: 824995 - DNA, 20 bp, mouse
gtagggaggctgctcctctc

SEQ ID NO: 824996 - DNA, 20 bp, mouse
gactacagggcccacgcgga

SEQ ID NO: 824997 - DNA, 20 bp, mouse
gcgtgggcacggatgcgcga

SEQ ID NO: 824998 - DNA, 20 bp, mouse
gggccctgtagtccgcgcgt

SEQ ID NO: 824999 - DNA, 20 bp, mouse
gctcccacgcgcggactaca

SEQ ID NO: 825000 - DNA, 20 bp, mouse
ggatgcgcgagggaacgctc

SEQ ID NO: 825001 - DNA, 20 bp, mouse
gagtccgcgcgtgggaggcg

SEQ ID NO: 825002 - DNA, 20 bp, mouse
gctcggcccgccctccgcgt

SEQ ID NO: 825003 - DNA, 20 bp, mouse
gggcccggccaatgacttgt

SEQ ID NO: 825004 - DNA, 20 bp, mouse
ggcggactacagggcccacg

SEQ ID NO: 825005 - DNA, 20 bp, mouse
gagtacgacctccaggctgt

SEQ ID NO: 825006 - DNA, 20 bp, mouse
gctacctcagaggggaaaag

SEQ ID NO: 825007 - DNA, 20 bp, mouse
gaagtcctgtcattgagccc

SEQ ID NO: 825008 - DNA, 20 bp, mouse
gagtactaaacgcaactaag

SEQ ID NO: 825009 - DNA, 20 bp, mouse
gagcatgatcaagtagaggg

SEQ ID NO: 825010 - DNA, 20 bp, mouse
gaatcccacaggctatgtga

SEQ ID NO: 825011 - DNA, 20 bp, mouse
gacagccagggctcaatgac

SEQ ID NO: 825012 - DNA, 20 bp, mouse
ggagaaatgctacctcagag

SEQ ID NO: 825013 - DNA, 20 bp, mouse
gcgaaaccacggtgtgaaga

SEQ ID NO: 825014 - DNA, 20 bp, mouse
gaacaagtatgatgtcaact

SEQ ID NO: 825015 - DNA, 20 bp, mouse
gtaaagccttcttcacaccg

SEQ ID NO: 825016 - DNA, 20 bp, mouse
gtccctgcggtgagtgagga

SEQ ID NO: 825017 - DNA, 20 bp, mouse
gtccttgctggtgttcctca

SEQ ID NO: 825018 - DNA, 20 bp, mouse
ggctatgagcaagtccgcgt

SEQ ID NO: 825019 - DNA, 20 bp, mouse
gggggtggtaaaagttggaa

SEQ ID NO: 825020 - DNA, 20 bp, mouse
gcccagataaccagagaacc

SEQ ID NO: 825021 - DNA, 20 bp, mouse
gcgctgccaatccgcctgat

SEQ ID NO: 825022 - DNA, 20 bp, mouse
gccactgccaagcaagatgt

SEQ ID NO: 825023 - DNA, 20 bp, mouse
gacggacacatcaaaagcag

SEQ ID NO: 825024 - DNA, 20 bp, mouse
gacccatcctcactcaccgc

SEQ ID NO: 825025 - DNA, 20 bp, mouse
gcccgggttctctggttatc

SEQ ID NO: 825026 - DNA, 20 bp, mouse
gctaactgagacaaagtttc

SEQ ID NO: 825027 - DNA, 20 bp, mouse
gacctcatagagtacttgga

SEQ ID NO: 825028 - DNA, 20 bp, mouse
gaaggtgaagctgtaagcca

SEQ ID NO: 825029 - DNA, 20 bp, mouse
gaatggcatcctctgaggga

SEQ ID NO: 825030 - DNA, 20 bp, mouse
ggccagaggctgggcaagaa

SEQ ID NO: 825031 - DNA, 20 bp, mouse
ggtcacaatggcatcctctg

SEQ ID NO: 825032 - DNA, 20 bp, mouse
ggacaacatttagtaaaggc

SEQ ID NO: 825033 - DNA, 20 bp, mouse
gcatcctctgagggagggtt

SEQ ID NO: 825034 - DNA, 20 bp, mouse
ggtgaagctgtaagccaggg

SEQ ID NO: 825035 - DNA, 20 bp, mouse
gtccatccaagtactctatg

SEQ ID NO: 825036 - DNA, 20 bp, mouse
ggggccaatagctgcggagc

SEQ ID NO: 825037 - DNA, 20 bp, mouse
gtcaactgtcgcccggtcgc

SEQ ID NO: 825038 - DNA, 20 bp, mouse
gctagagcggcccagagcgg

SEQ ID NO: 825039 - DNA, 20 bp, mouse
ggcgtcctgacgcccctcgc

SEQ ID NO: 825040 - DNA, 20 bp, mouse
gggggaccggggtcacacac

SEQ ID NO: 825041 - DNA, 20 bp, mouse
ggtgacaaggccttgaaagg

SEQ ID NO: 825042 - DNA, 20 bp, mouse
ggcggggcgtcgccgggtcc

SEQ ID NO: 825043 - DNA, 20 bp, mouse
gggtcgcggggttgcgaagc

SEQ ID NO: 825044 - DNA, 20 bp, mouse
gcctctgcctcccggggacc

SEQ ID NO: 825045 - DNA, 20 bp, mouse
gggcgtcgccgggtcctgga

SEQ ID NO: 825046 - DNA, 20 bp, mouse
ggggctctggaagctctctc

SEQ ID NO: 825047 - DNA, 20 bp, mouse
gcgcccggagctcggaaagt

SEQ ID NO: 825048 - DNA, 20 bp, mouse
ggcgagcccgcgctgcacct

SEQ ID NO: 825049 - DNA, 20 bp, mouse
gaccctacggaacgagcggt

SEQ ID NO: 825050 - DNA, 20 bp, mouse
gaagtgggcgggtcacgtga

SEQ ID NO: 825051 - DNA, 20 bp, mouse
gccctctggggtgcagtgtt

SEQ ID NO: 825052 - DNA, 20 bp, mouse
gcggagctcggaaagtgggc

SEQ ID NO: 825053 - DNA, 20 bp, mouse
gaagctctctccggcgccag

SEQ ID NO: 825054 - DNA, 20 bp, mouse
ggcccagagcgcccggagct

SEQ ID NO: 825055 - DNA, 20 bp, mouse
gcggtcactggcctgccctg

SEQ ID NO: 825056 - DNA, 20 bp, mouse
gcggcggccgctcttctgat

SEQ ID NO: 825057 - DNA, 20 bp, mouse
gcggccgctcttctgattgg

SEQ ID NO: 825058 - DNA, 20 bp, mouse
gctgtgggcggggttggaag

SEQ ID NO: 825059 - DNA, 20 bp, mouse
gggcggggttggaagcgggg

SEQ ID NO: 825060 - DNA, 20 bp, mouse
ggcggactgggcggggctgt

SEQ ID NO: 825061 - DNA, 20 bp, mouse
gggtggctggacattttgga

SEQ ID NO: 825062 - DNA, 20 bp, mouse
gaaggctggagcaagttgtc

SEQ ID NO: 825063 - DNA, 20 bp, mouse
gagtccgccaatcagaagag

SEQ ID NO: 825064 - DNA, 20 bp, mouse
gtagcgcagccgaggaaccc

SEQ ID NO: 825065 - DNA, 20 bp, mouse
gcatgagcgttaactttcgt

SEQ ID NO: 825066 - DNA, 20 bp, mouse
gaagccccgcccccggagtg

SEQ ID NO: 825067 - DNA, 20 bp, mouse
gggagcctggggtgactaga

SEQ ID NO: 825068 - DNA, 20 bp, mouse
gggccagcgcgcgcggtcgc

SEQ ID NO: 825069 - DNA, 20 bp, mouse
gcgggccgctccgtacgccg

SEQ ID NO: 825070 - DNA, 20 bp, mouse
gcccgcctcggcgtacggag

SEQ ID NO: 825071 - DNA, 20 bp, mouse
gggcgagagcgccactatga

SEQ ID NO: 825072 - DNA, 20 bp, mouse
ggcggcccgcagccacgcgg

SEQ ID NO: 825073 - DNA, 20 bp, mouse
gagagcgccactatgagggg

SEQ ID NO: 825074 - DNA, 20 bp, mouse
gaggctccgccgcgtggctg

SEQ ID NO: 825075 - DNA, 20 bp, mouse
gctcctcgggctcactccta

SEQ ID NO: 825076 - DNA, 20 bp, mouse
gcggggccgcccggtcacct

SEQ ID NO: 825077 - DNA, 20 bp, mouse
gcgcgcgcggcccaggtgac

SEQ ID NO: 825078 - DNA, 20 bp, mouse
ggggagctgatgcgcccgta

SEQ ID NO: 825079 - DNA, 20 bp, mouse
gctctcgcgaaccaggtgac

SEQ ID NO: 825080 - DNA, 20 bp, mouse
gcgtaggggcggggcagctg

SEQ ID NO: 825081 - DNA, 20 bp, mouse
gccgctcgctctcgcgaacc

SEQ ID NO: 825082 - DNA, 20 bp, mouse
gagaagatggttcctcccgc

SEQ ID NO: 825083 - DNA, 20 bp, mouse
gtgcgcaggaagcgtggagc

SEQ ID NO: 825084 - DNA, 20 bp, mouse
gctgatgcgcccgtaggggc

SEQ ID NO: 825085 - DNA, 20 bp, mouse
ggttcctcccgcgggagcgc

SEQ ID NO: 825086 - DNA, 20 bp, mouse
ggtggccaaagtggtttacg

SEQ ID NO: 825087 - DNA, 20 bp, mouse
gctcttggagccgccatctc

SEQ ID NO: 825088 - DNA, 20 bp, mouse
ggctgaatcgggtgaactgt

SEQ ID NO: 825089 - DNA, 20 bp, mouse
gtacggccgccatcttgaga

SEQ ID NO: 825090 - DNA, 20 bp, mouse
ggagaaggtcgaaaagtaat

SEQ ID NO: 825091 - DNA, 20 bp, mouse
gggagccgccatctccggag

SEQ ID NO: 825092 - DNA, 20 bp, mouse
gtaggggcctgctctgaggg

SEQ ID NO: 825093 - DNA, 20 bp, mouse
gtaaaccactttggccactc

SEQ ID NO: 825094 - DNA, 20 bp, mouse
gaggtgacgggacagagatt

SEQ ID NO: 825095 - DNA, 20 bp, mouse
gacctccgagggaagtttag

SEQ ID NO: 825096 - DNA, 20 bp, mouse
gtgtactgggtgctctgtgg

SEQ ID NO: 825097 - DNA, 20 bp, mouse
gccccggaaccggaagccga

SEQ ID NO: 825098 - DNA, 20 bp, mouse
ggggactcaccgctctgggt

SEQ ID NO: 825099 - DNA, 20 bp, mouse
gctaggcagcccacccagag

SEQ ID NO: 825100 - DNA, 20 bp, mouse
ggagcacccagtacaaagtg

SEQ ID NO: 825101 - DNA, 20 bp, mouse
ggctgtgggagcgtccaaca

SEQ ID NO: 825102 - DNA, 20 bp, mouse
ggcggggcctcggagtctga

SEQ ID NO: 825103 - DNA, 20 bp, mouse
gaccacgccctcagactccg

SEQ ID NO: 825104 - DNA, 20 bp, mouse
ggggacgggcctaattttct

SEQ ID NO: 825105 - DNA, 20 bp, mouse
gaaagccctagacgccggag

SEQ ID NO: 825106 - DNA, 20 bp, mouse
gagagcctctccccgctttc

SEQ ID NO: 825107 - DNA, 20 bp, mouse
ggtccagagaagcctcaggg

SEQ ID NO: 825108 - DNA, 20 bp, mouse
gcgggaacgtagagagcgag

SEQ ID NO: 825109 - DNA, 20 bp, mouse
gggctctcagagtgctgtgc

SEQ ID NO: 825110 - DNA, 20 bp, mouse
gagctggcgcatctagctga

SEQ ID NO: 825111 - DNA, 20 bp, mouse
gaacgtagagagcgaggggt

SEQ ID NO: 825112 - DNA, 20 bp, mouse
gtctgtccagagaagcctca

SEQ ID NO: 825113 - DNA, 20 bp, mouse
ggcagtacggggtaaggctc

SEQ ID NO: 825114 - DNA, 20 bp, mouse
gagtcacaataccagaaagc

SEQ ID NO: 825115 - DNA, 20 bp, mouse
gagagaagcctcagggaggt

SEQ ID NO: 825116 - DNA, 20 bp, mouse
gtgggagcgcgcctcttcgt

SEQ ID NO: 825117 - DNA, 20 bp, mouse
gaggtcgtgctcccacgaag

SEQ ID NO: 825118 - DNA, 20 bp, mouse
gccggcgcccgcggagcgaa

SEQ ID NO: 825119 - DNA, 20 bp, mouse
gaaaggacccagagagacac

SEQ ID NO: 825120 - DNA, 20 bp, mouse
gcgcgtgcgcctgaaggaaa

SEQ ID NO: 825121 - DNA, 20 bp, mouse
gtgcccccgcgtgcgcctga

SEQ ID NO: 825122 - DNA, 20 bp, mouse
ggatctgctacagatcaaga

SEQ ID NO: 825123 - DNA, 20 bp, mouse
gccgctcggtgacgtagctc

SEQ ID NO: 825124 - DNA, 20 bp, mouse
gcgacctctgtacgttacag

SEQ ID NO: 825125 - DNA, 20 bp, mouse
gctgccactgtaacgtacag

SEQ ID NO: 825126 - DNA, 20 bp, mouse
gaaccgtgaccggaagagta

SEQ ID NO: 825127 - DNA, 20 bp, mouse
ggggcagtagtctcaagctg

SEQ ID NO: 825128 - DNA, 20 bp, mouse
ggggaggagcggaacctcgg

SEQ ID NO: 825129 - DNA, 20 bp, mouse
ggtcggaagagaaccgtgac

SEQ ID NO: 825130 - DNA, 20 bp, mouse
gcgacagtggccagaaagga

SEQ ID NO: 825131 - DNA, 20 bp, mouse
gaacctcggaggaccgacag

SEQ ID NO: 825132 - DNA, 20 bp, mouse
gcctggaaagcgtgggacct

SEQ ID NO: 825133 - DNA, 20 bp, mouse
gtgcccaacacccgcaaggt

SEQ ID NO: 825134 - DNA, 20 bp, mouse
gggtggctgcggcgtcagat

SEQ ID NO: 825135 - DNA, 20 bp, mouse
ggacccgggagtattgtgcc

SEQ ID NO: 825136 - DNA, 20 bp, mouse
gacgcgggacgggtaagcgg

SEQ ID NO: 825137 - DNA, 20 bp, mouse
gtcaagaagagggatctgga

SEQ ID NO: 825138 - DNA, 20 bp, mouse
gatgacgcggtggtcgcaat

SEQ ID NO: 825139 - DNA, 20 bp, mouse
gccgggcccggagtggagtg

SEQ ID NO: 825140 - DNA, 20 bp, mouse
gaggatcctgctcaagaaga

SEQ ID NO: 825141 - DNA, 20 bp, mouse
gtcccggaagtgctcaaaga

SEQ ID NO: 825142 - DNA, 20 bp, mouse
gaagagggatctggagggcc

SEQ ID NO: 825143 - DNA, 20 bp, mouse
gcctacgcgggacgggtaag

SEQ ID NO: 825144 - DNA, 20 bp, mouse
gtggtcgcaatgggcctacg

SEQ ID NO: 825145 - DNA, 20 bp, mouse
ggggcctgcggggaccagac

SEQ ID NO: 825146 - DNA, 20 bp, mouse
gtccgccgcgcgcccttcac

SEQ ID NO: 825147 - DNA, 20 bp, mouse
ggggccgcaagtactacggg

SEQ ID NO: 825148 - DNA, 20 bp, mouse
ggggctaggggtggtccgta

SEQ ID NO: 825149 - DNA, 20 bp, mouse
gaggcggggcctgttcgtga

SEQ ID NO: 825150 - DNA, 20 bp, mouse
ggggaggcgcggtcccttta

SEQ ID NO: 825151 - DNA, 20 bp, mouse
gtcgggttctagaggctgaa

SEQ ID NO: 825152 - DNA, 20 bp, mouse
gggcggggccgcaagtacta

SEQ ID NO: 825153 - DNA, 20 bp, mouse
gtggtccgtaggggctggag

SEQ ID NO: 825154 - DNA, 20 bp, mouse
gtctacctgtgaagggcgcg

SEQ ID NO: 825155 - DNA, 20 bp, mouse
gcccgcccctccagccccta

SEQ ID NO: 825156 - DNA, 20 bp, mouse
ggaggagtagccggcccgtc

SEQ ID NO: 825157 - DNA, 20 bp, mouse
ggtagccggcccgtcaggca

SEQ ID NO: 825158 - DNA, 20 bp, mouse
gtgctagcggatttacactg

SEQ ID NO: 825159 - DNA, 20 bp, mouse
ggcaccggaagccaccccca

SEQ ID NO: 825160 - DNA, 20 bp, mouse
gtctgcgcataagatacttc

SEQ ID NO: 825161 - DNA, 20 bp, mouse
gctagcagctgctttcctct

SEQ ID NO: 825162 - DNA, 20 bp, mouse
ggaaagagctatagtagccc

SEQ ID NO: 825163 - DNA, 20 bp, mouse
gggccggctactcctcaatc

SEQ ID NO: 825164 - DNA, 20 bp, mouse
gtggctaattgagctccgag

SEQ ID NO: 825165 - DNA, 20 bp, mouse
gcccagccctctcaggttac

SEQ ID NO: 825166 - DNA, 20 bp, mouse
gactggacgggtcagagagt

SEQ ID NO: 825167 - DNA, 20 bp, mouse
ggagaaagcggactgtgcta

SEQ ID NO: 825168 - DNA, 20 bp, mouse
ggggcccgcccaagtgcagg

SEQ ID NO: 825169 - DNA, 20 bp, mouse
gggcgtgaggggatccggga

SEQ ID NO: 825170 - DNA, 20 bp, mouse
ggacgggtcagagagttggg

SEQ ID NO: 825171 - DNA, 20 bp, mouse
gggcacgttaggaatcgaac

SEQ ID NO: 825172 - DNA, 20 bp, mouse
gacaggaaagggtctctgac

SEQ ID NO: 825173 - DNA, 20 bp, mouse
gacgccctccttggcacgtt

SEQ ID NO: 825174 - DNA, 20 bp, mouse
gcggcggggagcagggtccc

SEQ ID NO: 825175 - DNA, 20 bp, mouse
gcaccaggcgcacctagatc

SEQ ID NO: 825176 - DNA, 20 bp, mouse
gggaccctgtgtgagaatga

SEQ ID NO: 825177 - DNA, 20 bp, mouse
gtccacaggtgccgatagac

SEQ ID NO: 825178 - DNA, 20 bp, mouse
gctaggggaagcagaggtct

SEQ ID NO: 825179 - DNA, 20 bp, mouse
gctacaagaatgtgctaact

SEQ ID NO: 825180 - DNA, 20 bp, mouse
ggcgagacagctcagaccct

SEQ ID NO: 825181 - DNA, 20 bp, mouse
gtcgggctctgcctgtctat

SEQ ID NO: 825182 - DNA, 20 bp, mouse
gcagcccctcattctcacac

SEQ ID NO: 825183 - DNA, 20 bp, mouse
ggaaacctcacacacaagac

SEQ ID NO: 825184 - DNA, 20 bp, mouse
gaggtctaggtctgccctaa

SEQ ID NO: 825185 - DNA, 20 bp, mouse
gagtgatgccgcagaacgct

SEQ ID NO: 825186 - DNA, 20 bp, mouse
gtgggattggacacctggag

SEQ ID NO: 825187 - DNA, 20 bp, mouse
gcagagaatggggagcctcc

SEQ ID NO: 825188 - DNA, 20 bp, mouse
gaggaggctgtcactctcca

SEQ ID NO: 825189 - DNA, 20 bp, mouse
gtccaaaggtgagtcgggag

SEQ ID NO: 825190 - DNA, 20 bp, mouse
gactccagaagagaatgagg

SEQ ID NO: 825191 - DNA, 20 bp, mouse
ggccacccagtgcaaggggt

SEQ ID NO: 825192 - DNA, 20 bp, mouse
gacctggaggggcagagaat

SEQ ID NO: 825193 - DNA, 20 bp, mouse
gcccgccaaccccttgcact

SEQ ID NO: 825194 - DNA, 20 bp, mouse
gtgcaaggggttggcgggac

SEQ ID NO: 825195 - DNA, 20 bp, mouse
gggagggcgcgacctgggtg

SEQ ID NO: 825196 - DNA, 20 bp, mouse
ggggcctgcacgcgcctcgg

SEQ ID NO: 825197 - DNA, 20 bp, mouse
gcgctcccgagctcaggtag

SEQ ID NO: 825198 - DNA, 20 bp, mouse
gcccgcccccggccactcgg

SEQ ID NO: 825199 - DNA, 20 bp, mouse
ggccccgtgtgtgccaccag

SEQ ID NO: 825200 - DNA, 20 bp, mouse
gaggggtaaggggatggcgt

SEQ ID NO: 825201 - DNA, 20 bp, mouse
gggtaaggggatggcgtggg

SEQ ID NO: 825202 - DNA, 20 bp, mouse
gagcgagacggaagcctcgg

SEQ ID NO: 825203 - DNA, 20 bp, mouse
gagggagcgcgcggcgggac

SEQ ID NO: 825204 - DNA, 20 bp, mouse
gggccactggtgaaggatcg

SEQ ID NO: 825205 - DNA, 20 bp, mouse
ggcgcgcgcgggaagggcag

SEQ ID NO: 825206 - DNA, 20 bp, mouse
ggggagctgtggtgccaaaa

SEQ ID NO: 825207 - DNA, 20 bp, mouse
ggggcagtgggtacccccga

SEQ ID NO: 825208 - DNA, 20 bp, mouse
gccaaaaggggctgcacccg

SEQ ID NO: 825209 - DNA, 20 bp, mouse
ggggacctgcgaactcccgg

SEQ ID NO: 825210 - DNA, 20 bp, mouse
ggcacccggggcctggaggg

SEQ ID NO: 825211 - DNA, 20 bp, mouse
ggggaggaccgtcgtcacgc

SEQ ID NO: 825212 - DNA, 20 bp, mouse
gtgacgacggtcctcccctc

SEQ ID NO: 825213 - DNA, 20 bp, mouse
gagtgggtacccccgagggg

SEQ ID NO: 825214 - DNA, 20 bp, mouse
gcacccaggcggctgccgtc

SEQ ID NO: 825215 - DNA, 20 bp, mouse
gcgcagggttggctgggcgc

SEQ ID NO: 825216 - DNA, 20 bp, mouse
ggcccggccgagtagaatgg

SEQ ID NO: 825217 - DNA, 20 bp, mouse
gggcgtcagccagtcataaa

SEQ ID NO: 825218 - DNA, 20 bp, mouse
gctccggctcggaccaaccg

SEQ ID NO: 825219 - DNA, 20 bp, mouse
gcgagaccactcctggtgac

SEQ ID NO: 825220 - DNA, 20 bp, mouse
gaagaagcgagtgatggaaa

SEQ ID NO: 825221 - DNA, 20 bp, mouse
ggccggcgcggcaaacgtgg

SEQ ID NO: 825222 - DNA, 20 bp, mouse
gtgaataaaggcagcgagca

SEQ ID NO: 825223 - DNA, 20 bp, mouse
ggaccactcctggtgacggg

SEQ ID NO: 825224 - DNA, 20 bp, mouse
ggacctagagccatatatat

SEQ ID NO: 825225 - DNA, 20 bp, mouse
gtatggctctaggtccaccc

SEQ ID NO: 825226 - DNA, 20 bp, mouse
gcgcctgcgccgcacggtgg

SEQ ID NO: 825227 - DNA, 20 bp, mouse
gcccgccagggactccggag

SEQ ID NO: 825228 - DNA, 20 bp, mouse
gaactggccctgcccgtcgc

SEQ ID NO: 825229 - DNA, 20 bp, mouse
gaaaagtagtggggcttcgt

SEQ ID NO: 825230 - DNA, 20 bp, mouse
gccttcccgcccccaccgtg

SEQ ID NO: 825231 - DNA, 20 bp, mouse
gcagggactccggagcgggg

SEQ ID NO: 825232 - DNA, 20 bp, mouse
gcccggcccgccagggactc

SEQ ID NO: 825233 - DNA, 20 bp, mouse
ggggaccgcatgaagaatca

SEQ ID NO: 825234 - DNA, 20 bp, mouse
gcggagaccgacccctgcgg

SEQ ID NO: 825235 - DNA, 20 bp, mouse
gcgagtaacaagccagcgac

SEQ ID NO: 825236 - DNA, 20 bp, mouse
gcgggcccgctgtgcctccg

SEQ ID NO: 825237 - DNA, 20 bp, mouse
gaagcggccggggtactagg

SEQ ID NO: 825238 - DNA, 20 bp, mouse
ggacggaattctgcgggaag

SEQ ID NO: 825239 - DNA, 20 bp, mouse
gcagggaacttcattctctc

SEQ ID NO: 825240 - DNA, 20 bp, mouse
gtccgcgctagtggccgcga

SEQ ID NO: 825241 - DNA, 20 bp, mouse
gtgcctccggggtgcactga

SEQ ID NO: 825242 - DNA, 20 bp, mouse
gtggggcggaagatccggag

SEQ ID NO: 825243 - DNA, 20 bp, mouse
gtgggcgccacctagtaccc

SEQ ID NO: 825244 - DNA, 20 bp, mouse
gccgcggcacccgacagcgg

SEQ ID NO: 825245 - DNA, 20 bp, mouse
ggtggccgcgatggcttcga

SEQ ID NO: 825246 - DNA, 20 bp, mouse
gaaactcgcgctgttcttat

SEQ ID NO: 825247 - DNA, 20 bp, mouse
ggcgtggaggggttttgtca

SEQ ID NO: 825248 - DNA, 20 bp, mouse
gggaggcgcggcggctgtgt

SEQ ID NO: 825249 - DNA, 20 bp, mouse
gagcaacggaagagtgacgg

SEQ ID NO: 825250 - DNA, 20 bp, mouse
gagcgcgagtttcatagcaa

SEQ ID NO: 825251 - DNA, 20 bp, mouse
gtgacagagtgggcgtggag

SEQ ID NO: 825252 - DNA, 20 bp, mouse
gcagccgccgcgcctcccct

SEQ ID NO: 825253 - DNA, 20 bp, mouse
ggctcgggtcgctgtcattc

SEQ ID NO: 825254 - DNA, 20 bp, mouse
ggggcggaggccttaacgaa

SEQ ID NO: 825255 - DNA, 20 bp, mouse
gtgacggcgggttgggccaa

SEQ ID NO: 825256 - DNA, 20 bp, mouse
gtcccccgtcagtcacgcgg

SEQ ID NO: 825257 - DNA, 20 bp, mouse
gagcgccgggcggggaaagt

SEQ ID NO: 825258 - DNA, 20 bp, mouse
gtgactgacgggggactctg

SEQ ID NO: 825259 - DNA, 20 bp, mouse
gcgcctccgcgtgactgacg

SEQ ID NO: 825260 - DNA, 20 bp, mouse
gcgtgcgcgctgccgaccgc

SEQ ID NO: 825261 - DNA, 20 bp, mouse
gaagctctcaaggcgagaaa

SEQ ID NO: 825262 - DNA, 20 bp, mouse
gtcgcgggaaaatgaggggt

SEQ ID NO: 825263 - DNA, 20 bp, mouse
ggccgggccgcccagcccgt

SEQ ID NO: 825264 - DNA, 20 bp, mouse
ggggacctctgcccccctgg

SEQ ID NO: 825265 - DNA, 20 bp, mouse
gcacgcggaggcgcttctcg

SEQ ID NO: 825266 - DNA, 20 bp, mouse
ggaactggaggggactgtca

SEQ ID NO: 825267 - DNA, 20 bp, mouse
gcccccgcgccagtgagcag

SEQ ID NO: 825268 - DNA, 20 bp, mouse
gtggcgaaagaaaagatgat

SEQ ID NO: 825269 - DNA, 20 bp, mouse
gggactgtcagggtgacagc

SEQ ID NO: 825270 - DNA, 20 bp, mouse
gagaaaagatgatggggcgg

SEQ ID NO: 825271 - DNA, 20 bp, mouse
gggtctctcccgctgctcac

SEQ ID NO: 825272 - DNA, 20 bp, mouse
gagcgggagagaccattgtg

SEQ ID NO: 825273 - DNA, 20 bp, mouse
gaaagacactagcagtggtt

SEQ ID NO: 825274 - DNA, 20 bp, mouse
ggtaagtggaggaaatagac

SEQ ID NO: 825275 - DNA, 20 bp, mouse
gtggttaggggagtaagtgg

SEQ ID NO: 825276 - DNA, 20 bp, mouse
gagactcaggagccccggga

SEQ ID NO: 825277 - DNA, 20 bp, mouse
ggctttgggaaaatcttccc

SEQ ID NO: 825278 - DNA, 20 bp, mouse
gacctgctggctctggactg

SEQ ID NO: 825279 - DNA, 20 bp, mouse
gggcgtgggagccgtttctt

SEQ ID NO: 825280 - DNA, 20 bp, mouse
gtgttgagggcgccctccgc

SEQ ID NO: 825281 - DNA, 20 bp, mouse
gaaggagaggagttccggat

SEQ ID NO: 825282 - DNA, 20 bp, mouse
ggcgccttggcgccttaggt

SEQ ID NO: 825283 - DNA, 20 bp, mouse
gggccagcggagggtccggg

SEQ ID NO: 825284 - DNA, 20 bp, mouse
gaatacgtgcccacacctgc

SEQ ID NO: 825285 - DNA, 20 bp, mouse
ggggcgccctccgcgggcgt

SEQ ID NO: 825286 - DNA, 20 bp, mouse
ggggaggagggcgctgtgca

SEQ ID NO: 825287 - DNA, 20 bp, mouse
gccactgcagcaccgaaggg

SEQ ID NO: 825288 - DNA, 20 bp, mouse
gtgttgctgcggttcgggtc

SEQ ID NO: 825289 - DNA, 20 bp, mouse
gggagggcgctgtgcaaggc

SEQ ID NO: 825290 - DNA, 20 bp, mouse
gacaagcgatgcgcagggag

SEQ ID NO: 825291 - DNA, 20 bp, mouse
gagctcccggtatgatgcgg

SEQ ID NO: 825292 - DNA, 20 bp, mouse
gaacacctccgcatcatacc

SEQ ID NO: 825293 - DNA, 20 bp, mouse
ggctcccggcggccacgctg

SEQ ID NO: 825294 - DNA, 20 bp, mouse
gctagtcggcagcgagagga

SEQ ID NO: 825295 - DNA, 20 bp, mouse
gcccgccactgcagcaccga

SEQ ID NO: 825296 - DNA, 20 bp, mouse
gttcagatgaaacttcaaaa

SEQ ID NO: 825297 - DNA, 20 bp, mouse
ggctaagatgatcagatgtt

SEQ ID NO: 825298 - DNA, 20 bp, mouse
gagaacattctaatctctta

SEQ ID NO: 825299 - DNA, 20 bp, mouse
gcaaagagtgtgaaactgga

SEQ ID NO: 825300 - DNA, 20 bp, mouse
gtctttagaaaaattggaac

SEQ ID NO: 825301 - DNA, 20 bp, mouse
ggaactgaatctagggccct

SEQ ID NO: 825302 - DNA, 20 bp, mouse
gagatcttctttagaaaaat

SEQ ID NO: 825303 - DNA, 20 bp, mouse
gctgaatctagggcccttgg

SEQ ID NO: 825304 - DNA, 20 bp, mouse
gagagttgtttaagaagcaa

SEQ ID NO: 825305 - DNA, 20 bp, mouse
gtgttctaagattattagaa

SEQ ID NO: 825306 - DNA, 20 bp, mouse
gtccagctggaacctcagaa

SEQ ID NO: 825307 - DNA, 20 bp, mouse
gggcaggtctagtcagttaa

SEQ ID NO: 825308 - DNA, 20 bp, mouse
gggaagacagtgaaacagat

SEQ ID NO: 825309 - DNA, 20 bp, mouse
gagaacaaacaggatggtag

SEQ ID NO: 825310 - DNA, 20 bp, mouse
gacaagggtgagtatccagc

SEQ ID NO: 825311 - DNA, 20 bp, mouse
gttatcagggaggtgaggca

SEQ ID NO: 825312 - DNA, 20 bp, mouse
gcaaacaggatggtagtggg

SEQ ID NO: 825313 - DNA, 20 bp, mouse
gagaaaattcttggattatt

SEQ ID NO: 825314 - DNA, 20 bp, mouse
gtatgagattagaaaattct

SEQ ID NO: 825315 - DNA, 20 bp, mouse
gtctaatctcatactgaaag

SEQ ID NO: 825316 - DNA, 20 bp, mouse
gtccagctggatcttcaaag

SEQ ID NO: 825317 - DNA, 20 bp, mouse
gatgagattagggtgttctt

SEQ ID NO: 825318 - DNA, 20 bp, mouse
gttgggactctgagttatca

SEQ ID NO: 825319 - DNA, 20 bp, mouse
gtaaacaatgtggcaatggg

SEQ ID NO: 825320 - DNA, 20 bp, mouse
gtcacgatggagcagttgcc

SEQ ID NO: 825321 - DNA, 20 bp, mouse
gggtacagggagggttctgt

SEQ ID NO: 825322 - DNA, 20 bp, mouse
ggattagaaaaaaatgggac

SEQ ID NO: 825323 - DNA, 20 bp, mouse
gccatagtaacagcagatta

SEQ ID NO: 825324 - DNA, 20 bp, mouse
ggtacctcaggatgcaaatc

SEQ ID NO: 825325 - DNA, 20 bp, mouse
gctttcgtcagtatgagatt

SEQ ID NO: 825326 - DNA, 20 bp, mouse
gggaacttcaaaatggagta

SEQ ID NO: 825327 - DNA, 20 bp, mouse
gtccagctggaacttcaaaa

SEQ ID NO: 825328 - DNA, 20 bp, mouse
gaaaacaaacaagaggtcag

SEQ ID NO: 825329 - DNA, 20 bp, mouse
gactgagctaaaatcatcat

SEQ ID NO: 825330 - DNA, 20 bp, mouse
gcaaacaagaggtcagtgga

SEQ ID NO: 825331 - DNA, 20 bp, mouse
gggaacacaatgaagcagat

SEQ ID NO: 825332 - DNA, 20 bp, mouse
gctacctaggaacactaatc

SEQ ID NO: 825333 - DNA, 20 bp, mouse
ggcagaatatatttgagctg

SEQ ID NO: 825334 - DNA, 20 bp, mouse
gagggcggtttaggaagcaa

SEQ ID NO: 825335 - DNA, 20 bp, mouse
gttcacagcaagggcggttt

SEQ ID NO: 825336 - DNA, 20 bp, mouse
gttgacagcatgacaggcga

SEQ ID NO: 825337 - DNA, 20 bp, mouse
gtggatcccaggcaagagag

SEQ ID NO: 825338 - DNA, 20 bp, mouse
gcatgacaggcgaggggttc

SEQ ID NO: 825339 - DNA, 20 bp, mouse
gcggaggaatgcgctggaga

SEQ ID NO: 825340 - DNA, 20 bp, mouse
gccgagagtgccacagtaat

SEQ ID NO: 825341 - DNA, 20 bp, mouse
gggaatgttgacagcatgac

SEQ ID NO: 825342 - DNA, 20 bp, mouse
gtatgtctggcaaggagctg

SEQ ID NO: 825343 - DNA, 20 bp, mouse
ggcgaggggttctggtgtca

SEQ ID NO: 825344 - DNA, 20 bp, mouse
ggaagggtctgtctggtgag

SEQ ID NO: 825345 - DNA, 20 bp, mouse
gagaagaaaacacacacgcg

SEQ ID NO: 825346 - DNA, 20 bp, mouse
gcacgcgccccgctgctccc

SEQ ID NO: 825347 - DNA, 20 bp, mouse
gcggaggtgagtatcgtctc

SEQ ID NO: 825348 - DNA, 20 bp, mouse
gcagccgctctgtgactcgg

SEQ ID NO: 825349 - DNA, 20 bp, mouse
gttcgggtaaatagagccca

SEQ ID NO: 825350 - DNA, 20 bp, mouse
gtcacctccgagtcacagag

SEQ ID NO: 825351 - DNA, 20 bp, mouse
gctcccgcccaggccgggtc

SEQ ID NO: 825352 - DNA, 20 bp, mouse
gaattcccggtggttgtggt

SEQ ID NO: 825353 - DNA, 20 bp, mouse
gagcagcggggcgcgtgcgc

SEQ ID NO: 825354 - DNA, 20 bp, mouse
gtctggctcccggaagcttc

SEQ ID NO: 825355 - DNA, 20 bp, mouse
ggggccccacaattaatacc

SEQ ID NO: 825356 - DNA, 20 bp, mouse
ggggacaaggcttgttgcta

SEQ ID NO: 825357 - DNA, 20 bp, mouse
ggtaagacccaccccatctg

SEQ ID NO: 825358 - DNA, 20 bp, mouse
gggcgcttgcgcctcagatg

SEQ ID NO: 825359 - DNA, 20 bp, mouse
gcccgagcccggtgagtaga

SEQ ID NO: 825360 - DNA, 20 bp, mouse
gagcttgtggtggtgttcgc

SEQ ID NO: 825361 - DNA, 20 bp, mouse
gggaacccgaatcctcgctg

SEQ ID NO: 825362 - DNA, 20 bp, mouse
gacaaggcttgttgctaggg

SEQ ID NO: 825363 - DNA, 20 bp, mouse
ggtagggtggggtctgccaa

SEQ ID NO: 825364 - DNA, 20 bp, mouse
gtactcaccgggctcgggga

SEQ ID NO: 825365 - DNA, 20 bp, mouse
gcccacccctgtcctgccct

SEQ ID NO: 825366 - DNA, 20 bp, mouse
gagcccacggtcctctgatt

SEQ ID NO: 825367 - DNA, 20 bp, mouse
gccaccgccgggagaccgac

SEQ ID NO: 825368 - DNA, 20 bp, mouse
gccgggagaccgacaggagt

SEQ ID NO: 825369 - DNA, 20 bp, mouse
gaggagtgggcggaggacga

SEQ ID NO: 825370 - DNA, 20 bp, mouse
gaccccaatcagaggaccgt

SEQ ID NO: 825371 - DNA, 20 bp, mouse
gcagggagggaggcttcttc

SEQ ID NO: 825372 - DNA, 20 bp, mouse
ggtgcctggtggcacctaat

SEQ ID NO: 825373 - DNA, 20 bp, mouse
gggtactgaaggctagaagg

SEQ ID NO: 825374 - DNA, 20 bp, mouse
gaggcactgtagcacgctga

SEQ ID NO: 825375 - DNA, 20 bp, mouse
ggtcctccgcccactcctgt

SEQ ID NO: 825376 - DNA, 20 bp, mouse
gttaacaagggatccggtga

SEQ ID NO: 825377 - DNA, 20 bp, mouse
gcggtgagggctgttttgga

SEQ ID NO: 825378 - DNA, 20 bp, mouse
ggtaagacctgggcagtgga

SEQ ID NO: 825379 - DNA, 20 bp, mouse
gctctctagactatagaaga

SEQ ID NO: 825380 - DNA, 20 bp, mouse
gtctggagaagtgagatgaa

SEQ ID NO: 825381 - DNA, 20 bp, mouse
ggatccggtgagggctgttt

SEQ ID NO: 825382 - DNA, 20 bp, mouse
gatctaaagaaggcactcgg

SEQ ID NO: 825383 - DNA, 20 bp, mouse
gctccagactggattcatta

SEQ ID NO: 825384 - DNA, 20 bp, mouse
gcctgtgtcaagattgactg

SEQ ID NO: 825385 - DNA, 20 bp, mouse
ggtggcaataggagagccat

SEQ ID NO: 825386 - DNA, 20 bp, mouse
gtgaggaagcacaagggcgg

SEQ ID NO: 825387 - DNA, 20 bp, mouse
ggtgtctaaaggagcgtggg

SEQ ID NO: 825388 - DNA, 20 bp, mouse
gtgggagtgctcaggctaat

SEQ ID NO: 825389 - DNA, 20 bp, mouse
gtaaatgggtgggagtgctc

SEQ ID NO: 825390 - DNA, 20 bp, mouse
gcttgtgcttcctcatgatg

SEQ ID NO: 825391 - DNA, 20 bp, mouse
ggatgtgtctaaaggagcgt

SEQ ID NO: 825392 - DNA, 20 bp, mouse
gaaaccatctaatactctgg

SEQ ID NO: 825393 - DNA, 20 bp, mouse
ggaacctccagagtattaga

SEQ ID NO: 825394 - DNA, 20 bp, mouse
gatgcagtccccacatcatg

SEQ ID NO: 825395 - DNA, 20 bp, mouse
gtgagaaagcaaatgcctgc

SEQ ID NO: 825396 - DNA, 20 bp, mouse
gagtcacagcagcggagcct

SEQ ID NO: 825397 - DNA, 20 bp, mouse
gaagcacttctgttctggaa

SEQ ID NO: 825398 - DNA, 20 bp, mouse
gctgcctgggataaagtcct

SEQ ID NO: 825399 - DNA, 20 bp, mouse
ggctccgctgctgtgactca

SEQ ID NO: 825400 - DNA, 20 bp, mouse
gacgccatgagtcacagcag

SEQ ID NO: 825401 - DNA, 20 bp, mouse
gctgtgactcatggcgttcc

SEQ ID NO: 825402 - DNA, 20 bp, mouse
gtcatagtcagtgaggacca

SEQ ID NO: 825403 - DNA, 20 bp, mouse
gggggaccagactatcatca

SEQ ID NO: 825404 - DNA, 20 bp, mouse
gttctggaaaggcaggggcc

SEQ ID NO: 825405 - DNA, 20 bp, mouse
gttgaacagtcacactaaat

SEQ ID NO: 825406 - DNA, 20 bp, mouse
ggggatgcgataaagtcaga

SEQ ID NO: 825407 - DNA, 20 bp, mouse
gttcccaggtaatgtgtaca

SEQ ID NO: 825408 - DNA, 20 bp, mouse
ggctggatgtagcatggata

SEQ ID NO: 825409 - DNA, 20 bp, mouse
gcgtccctgtacacattacc

SEQ ID NO: 825410 - DNA, 20 bp, mouse
ggtaaagcaagcaatttcgt

SEQ ID NO: 825411 - DNA, 20 bp, mouse
gactgcacagttggggacat

SEQ ID NO: 825412 - DNA, 20 bp, mouse
gggacattggtaatgttccc

SEQ ID NO: 825413 - DNA, 20 bp, mouse
gtgactaggaacattagatc

SEQ ID NO: 825414 - DNA, 20 bp, mouse
gaaagatctactgaggctta

SEQ ID NO: 825415 - DNA, 20 bp, mouse
gatatggctgaagctacaaa

SEQ ID NO: 825416 - DNA, 20 bp, mouse
gtctgtgtgagactccccca

SEQ ID NO: 825417 - DNA, 20 bp, mouse
gtagtgacaggaaaccctgg

SEQ ID NO: 825418 - DNA, 20 bp, mouse
gatgcagagtaattttttga

SEQ ID NO: 825419 - DNA, 20 bp, mouse
gctcacacagatcaatagta

SEQ ID NO: 825420 - DNA, 20 bp, mouse
gcatatcctggtaggagagc

SEQ ID NO: 825421 - DNA, 20 bp, mouse
gcttgtatgcaggtaaacct

SEQ ID NO: 825422 - DNA, 20 bp, mouse
gtcctagagactggagatac

SEQ ID NO: 825423 - DNA, 20 bp, mouse
gagtgcccccatatcctggt

SEQ ID NO: 825424 - DNA, 20 bp, mouse
gtcagagtgcccccatatcc

SEQ ID NO: 825425 - DNA, 20 bp, mouse
gttctttgctaggtgaagaa

SEQ ID NO: 825426 - DNA, 20 bp, mouse
gtctgtgtgagactacccca

SEQ ID NO: 825427 - DNA, 20 bp, mouse
gttttctgggtgcagaaagg

SEQ ID NO: 825428 - DNA, 20 bp, mouse
gctcacacagaacagtagta

SEQ ID NO: 825429 - DNA, 20 bp, mouse
gctagtgacaggaaaccctg

SEQ ID NO: 825430 - DNA, 20 bp, mouse
gttcttttctgggtgcagaa

SEQ ID NO: 825431 - DNA, 20 bp, mouse
gcatcaaagctactagtgac

SEQ ID NO: 825432 - DNA, 20 bp, mouse
gtgcttcttttcatatgaga

SEQ ID NO: 825433 - DNA, 20 bp, mouse
gaaaatttcaaaaataatcg

SEQ ID NO: 825434 - DNA, 20 bp, mouse
gttttttttgcaggacactg

SEQ ID NO: 825435 - DNA, 20 bp, mouse
gttatttttgaaattttctt

SEQ ID NO: 825436 - DNA, 20 bp, mouse
gaataccccctgcatagcac

SEQ ID NO: 825437 - DNA, 20 bp, mouse
gaagattggctggaagttgg

SEQ ID NO: 825438 - DNA, 20 bp, mouse
gtcttcccctgtgctatgca

SEQ ID NO: 825439 - DNA, 20 bp, mouse
ggggcagctagaagaacttc

SEQ ID NO: 825440 - DNA, 20 bp, mouse
ggggtattgtcattatttcc

SEQ ID NO: 825441 - DNA, 20 bp, mouse
gccgacatgacccattctgt

SEQ ID NO: 825442 - DNA, 20 bp, mouse
ggaagaagactgccccttca

SEQ ID NO: 825443 - DNA, 20 bp, mouse
ggctgtggaaatattgatta

SEQ ID NO: 825444 - DNA, 20 bp, mouse
gagtgttgataaagattggc

SEQ ID NO: 825445 - DNA, 20 bp, mouse
gtgtactgacaaatggcaca

SEQ ID NO: 825446 - DNA, 20 bp, mouse
gctaccgtgctagggaatga

SEQ ID NO: 825447 - DNA, 20 bp, mouse
gaaggggagcccgtggtgag

SEQ ID NO: 825448 - DNA, 20 bp, mouse
ggttggtagcaaatcgttga

SEQ ID NO: 825449 - DNA, 20 bp, mouse
gcagaagcaaggggagcccg

SEQ ID NO: 825450 - DNA, 20 bp, mouse
gtgcttctgtcaccagaacg

SEQ ID NO: 825451 - DNA, 20 bp, mouse
gttgaaggctagaagctctg

SEQ ID NO: 825452 - DNA, 20 bp, mouse
gcttacattgctcctcgttc

SEQ ID NO: 825453 - DNA, 20 bp, mouse
gtctgttagggagatgctct

SEQ ID NO: 825454 - DNA, 20 bp, mouse
ggttctggtttaagtcttga

SEQ ID NO: 825455 - DNA, 20 bp, mouse
ggtcacaagtattcaaggta

SEQ ID NO: 825456 - DNA, 20 bp, mouse
gaagacctggttttagatga

SEQ ID NO: 825457 - DNA, 20 bp, mouse
gtgtctgccttcaaacctga

SEQ ID NO: 825458 - DNA, 20 bp, mouse
gagctccagaaagtctagct

SEQ ID NO: 825459 - DNA, 20 bp, mouse
ggaacatcagagctgtatgc

SEQ ID NO: 825460 - DNA, 20 bp, mouse
gcacaattcaagttgttggt

SEQ ID NO: 825461 - DNA, 20 bp, mouse
ggtaaccctcatctaaaacc

SEQ ID NO: 825462 - DNA, 20 bp, mouse
ggtgtctttcaatctcttgg

SEQ ID NO: 825463 - DNA, 20 bp, mouse
gcagaaagtctagctgggtc

SEQ ID NO: 825464 - DNA, 20 bp, mouse
gaacatatttcaattcagag

SEQ ID NO: 825465 - DNA, 20 bp, mouse
gatctaaaaccaggtcttca

SEQ ID NO: 825466 - DNA, 20 bp, mouse
ggtgggcagagggtatccca

SEQ ID NO: 825467 - DNA, 20 bp, mouse
gataccctctgcccactacg

SEQ ID NO: 825468 - DNA, 20 bp, mouse
gggctggttggtaagacgga

SEQ ID NO: 825469 - DNA, 20 bp, mouse
gggctggtgggcattccttt

SEQ ID NO: 825470 - DNA, 20 bp, mouse
ggcagagggtatcccagggc

SEQ ID NO: 825471 - DNA, 20 bp, mouse
gcacgcaaagtccttgtggt

SEQ ID NO: 825472 - DNA, 20 bp, mouse
gcacatgcgagctttgaaaa

SEQ ID NO: 825473 - DNA, 20 bp, mouse
gcccgaggaacactcaagac

SEQ ID NO: 825474 - DNA, 20 bp, mouse
gcaggccccgccctcccaaa

SEQ ID NO: 825475 - DNA, 20 bp, mouse
gcggcgggccgagtcttctg

SEQ ID NO: 825476 - DNA, 20 bp, mouse
gagaacgatgaacgacaggg

SEQ ID NO: 825477 - DNA, 20 bp, mouse
gaaactgcttccggaagcta

SEQ ID NO: 825478 - DNA, 20 bp, mouse
gggagaaggtaggtcacgct

SEQ ID NO: 825479 - DNA, 20 bp, mouse
gacccctcacagcggcctat

SEQ ID NO: 825480 - DNA, 20 bp, mouse
gtccggaagcagtttcgcgg

SEQ ID NO: 825481 - DNA, 20 bp, mouse
gaggccgctgtgaggggtca

SEQ ID NO: 825482 - DNA, 20 bp, mouse
gcagccatgacccctcacag

SEQ ID NO: 825483 - DNA, 20 bp, mouse
gagctacggcttctctacaa

SEQ ID NO: 825484 - DNA, 20 bp, mouse
gcaatgggcttggagaaggt

SEQ ID NO: 825485 - DNA, 20 bp, mouse
ggaaaccaggcagagcaaat

SEQ ID NO: 825486 - DNA, 20 bp, mouse
ggaggaagtgggtactttga

SEQ ID NO: 825487 - DNA, 20 bp, mouse
gtaaaaggaaaggaaggtcg

SEQ ID NO: 825488 - DNA, 20 bp, mouse
gaggtcggagctgtagagaa

SEQ ID NO: 825489 - DNA, 20 bp, mouse
gatcaaaacacggagcgtgg

SEQ ID NO: 825490 - DNA, 20 bp, mouse
gcacagactaagttcgtcgc

SEQ ID NO: 825491 - DNA, 20 bp, mouse
ggtgctccaaagagacgccc

SEQ ID NO: 825492 - DNA, 20 bp, mouse
gcacggagcgtggaggaagt

SEQ ID NO: 825493 - DNA, 20 bp, mouse
gcgtctctttggagcacgtt

SEQ ID NO: 825494 - DNA, 20 bp, mouse
gcgcggggccataaatatat

SEQ ID NO: 825495 - DNA, 20 bp, mouse
gagccgtgtgatcgattaaa

SEQ ID NO: 825496 - DNA, 20 bp, mouse
gcacacagggctggatccaa

SEQ ID NO: 825497 - DNA, 20 bp, mouse
gaggcatcgcgcctcatggg

SEQ ID NO: 825498 - DNA, 20 bp, mouse
gcaagggcggggaagcaatt

SEQ ID NO: 825499 - DNA, 20 bp, mouse
ggaactgagcaccgcccatg

SEQ ID NO: 825500 - DNA, 20 bp, mouse
gactgcgcagaagcgtgtgg

SEQ ID NO: 825501 - DNA, 20 bp, mouse
gggaaggggaagccggcgaa

SEQ ID NO: 825502 - DNA, 20 bp, mouse
gaggaggcatcgcgcctcat

SEQ ID NO: 825503 - DNA, 20 bp, mouse
ggggtgttgtagtcttattt

SEQ ID NO: 825504 - DNA, 20 bp, mouse
gggctcggaggccgtaacta

SEQ ID NO: 825505 - DNA, 20 bp, mouse
gaaggaggaggcccaggtca

SEQ ID NO: 825506 - DNA, 20 bp, mouse
gcatgcgtcatgtccggcta

SEQ ID NO: 825507 - DNA, 20 bp, mouse
gaggcggggagtcgatgcag

SEQ ID NO: 825508 - DNA, 20 bp, mouse
gcggggagtcgatgcagagg

SEQ ID NO: 825509 - DNA, 20 bp, mouse
gctggggaaaatagaaaagt

SEQ ID NO: 825510 - DNA, 20 bp, mouse
gggcccaccctctctgacgg

SEQ ID NO: 825511 - DNA, 20 bp, mouse
gagccgccgtcagagagggt

SEQ ID NO: 825512 - DNA, 20 bp, mouse
ggccgcgcatgcgtcatgtc

SEQ ID NO: 825513 - DNA, 20 bp, mouse
gaagctggggaaaataagcc

SEQ ID NO: 825514 - DNA, 20 bp, mouse
ggagagcaagaagagctcag

SEQ ID NO: 825515 - DNA, 20 bp, mouse
gagagggtgggccaagcttc

SEQ ID NO: 825516 - DNA, 20 bp, mouse
gggggcccagagagtacttg

SEQ ID NO: 825517 - DNA, 20 bp, mouse
gcactcacacaagctcttac

SEQ ID NO: 825518 - DNA, 20 bp, mouse
gtccctggtaagaaaaatat

SEQ ID NO: 825519 - DNA, 20 bp, mouse
gtagatgctgtaaactgtga

SEQ ID NO: 825520 - DNA, 20 bp, mouse
gtctctgggcccccctcctc

SEQ ID NO: 825521 - DNA, 20 bp, mouse
gtacgcaagatcactccctg

SEQ ID NO: 825522 - DNA, 20 bp, mouse
gcacacatacaataagagga

SEQ ID NO: 825523 - DNA, 20 bp, mouse
gtctgccccaagtactctct

SEQ ID NO: 825524 - DNA, 20 bp, mouse
ggacccatatttttcttacc

SEQ ID NO: 825525 - DNA, 20 bp, mouse
gcaagatcactccctgagga

SEQ ID NO: 825526 - DNA, 20 bp, mouse
gacgacctaacctttgtaga

SEQ ID NO: 825527 - DNA, 20 bp, mouse
gaaactggccaaacactgct

SEQ ID NO: 825528 - DNA, 20 bp, mouse
gctgcgcggggaaacacgag

SEQ ID NO: 825529 - DNA, 20 bp, mouse
gcccgcgcagcgtactgcgc

SEQ ID NO: 825530 - DNA, 20 bp, mouse
ggaaacacgagaggaccgcg

SEQ ID NO: 825531 - DNA, 20 bp, mouse
gacagaacggtgatcctgag

SEQ ID NO: 825532 - DNA, 20 bp, mouse
gggtcgtcaaagttagagtt

SEQ ID NO: 825533 - DNA, 20 bp, mouse
gccgatttaaacgtgatagt

SEQ ID NO: 825534 - DNA, 20 bp, mouse
gctcaccctctacaaaggtt

SEQ ID NO: 825535 - DNA, 20 bp, mouse
gaaatcggacttgtatttgg

SEQ ID NO: 825536 - DNA, 20 bp, mouse
gccggcccaaggatgaagtc

SEQ ID NO: 825537 - DNA, 20 bp, mouse
gtataagagggctggaagcc

SEQ ID NO: 825538 - DNA, 20 bp, mouse
gcgagtctctataagagggc

SEQ ID NO: 825539 - DNA, 20 bp, mouse
ggtgagcacaagctctttaa

SEQ ID NO: 825540 - DNA, 20 bp, mouse
gaggtagtgagaagttgagg

SEQ ID NO: 825541 - DNA, 20 bp, mouse
ggccaggtagtgagaagttg

SEQ ID NO: 825542 - DNA, 20 bp, mouse
gtaaacaaacggacaggggt

SEQ ID NO: 825543 - DNA, 20 bp, mouse
gacctgtaaacaaacggaca

SEQ ID NO: 825544 - DNA, 20 bp, mouse
gcacgcatgcgcgcaaccac

SEQ ID NO: 825545 - DNA, 20 bp, mouse
ggaaaaatgatggggacgga

SEQ ID NO: 825546 - DNA, 20 bp, mouse
gagcaccagcatagcccaaa

SEQ ID NO: 825547 - DNA, 20 bp, mouse
gcgggactcggggtcacctg

SEQ ID NO: 825548 - DNA, 20 bp, mouse
gaaactgtagatcgaagggg

SEQ ID NO: 825549 - DNA, 20 bp, mouse
gtatgagctcagacgcccac

SEQ ID NO: 825550 - DNA, 20 bp, mouse
gcacacaaactgtagatcga

SEQ ID NO: 825551 - DNA, 20 bp, mouse
gccaaaaggcagagccagtt

SEQ ID NO: 825552 - DNA, 20 bp, mouse
gaaggcagagccagttcgga

SEQ ID NO: 825553 - DNA, 20 bp, mouse
gactcgaaggccctccgaac

SEQ ID NO: 825554 - DNA, 20 bp, mouse
gggggcgtggcgtgcgcaga

SEQ ID NO: 825555 - DNA, 20 bp, mouse
gtgcgtaggtgcgggactcg

SEQ ID NO: 825556 - DNA, 20 bp, mouse
gtacccgaggcacgtaagaa

SEQ ID NO: 825557 - DNA, 20 bp, mouse
gcaaaccccagggtaagacc

SEQ ID NO: 825558 - DNA, 20 bp, mouse
gaggccagccccagtgggcg

SEQ ID NO: 825559 - DNA, 20 bp, mouse
gtccggccacccaaacccca

SEQ ID NO: 825560 - DNA, 20 bp, mouse
gcttacctggtcttaccctg

SEQ ID NO: 825561 - DNA, 20 bp, mouse
gaagtcgaagaccacggaac

SEQ ID NO: 825562 - DNA, 20 bp, mouse
gaaggccaagtcgaagacca

SEQ ID NO: 825563 - DNA, 20 bp, mouse
ggctggcctctcgccctcat

SEQ ID NO: 825564 - DNA, 20 bp, mouse
gagacaaggccctgcccatg

SEQ ID NO: 825565 - DNA, 20 bp, mouse
ggtagagatgaggaggccct

SEQ ID NO: 825566 - DNA, 20 bp, mouse
gaaaccctaacgccttggac

SEQ ID NO: 825567 - DNA, 20 bp, mouse
gccagtgagcgccaaggaca

SEQ ID NO: 825568 - DNA, 20 bp, mouse
gactctgtaaacaatggcaa

SEQ ID NO: 825569 - DNA, 20 bp, mouse
gtaaccagtccaaggcgtta

SEQ ID NO: 825570 - DNA, 20 bp, mouse
gactgtctttaaccagtcca

SEQ ID NO: 825571 - DNA, 20 bp, mouse
ggatcccaaatacatcccca

SEQ ID NO: 825572 - DNA, 20 bp, mouse
gaaagccctggggatgtatt

SEQ ID NO: 825573 - DNA, 20 bp, mouse
gcctagcactcgtaaaacct

SEQ ID NO: 825574 - DNA, 20 bp, mouse
gggtctctggtgccaaggac

SEQ ID NO: 825575 - DNA, 20 bp, mouse
gtgaatagtaaatacaagat

SEQ ID NO: 825576 - DNA, 20 bp, mouse
ggcaccacgtgcagcgtcct

SEQ ID NO: 825577 - DNA, 20 bp, mouse
ggacgctgcacgtggtgcac

SEQ ID NO: 825578 - DNA, 20 bp, mouse
gctgcgctcaaaattgtcgg

SEQ ID NO: 825579 - DNA, 20 bp, mouse
gggtagagaacccggcacgt

SEQ ID NO: 825580 - DNA, 20 bp, mouse
gagtctgcgctcaaaattgt

SEQ ID NO: 825581 - DNA, 20 bp, mouse
gagaacccggcacgtgggaa

SEQ ID NO: 825582 - DNA, 20 bp, mouse
gaatggctatacaccaacga

SEQ ID NO: 825583 - DNA, 20 bp, mouse
gcaaaattgtcggaggatgc

SEQ ID NO: 825584 - DNA, 20 bp, mouse
gagtgctgcgcgcgagatcc

SEQ ID NO: 825585 - DNA, 20 bp, mouse
gggttgctgggtgctaaaga

SEQ ID NO: 825586 - DNA, 20 bp, mouse
gtggacagggcaggggtcat

SEQ ID NO: 825587 - DNA, 20 bp, mouse
gggcaggggtcatcggaagt

SEQ ID NO: 825588 - DNA, 20 bp, mouse
gacttccggctgacccatcg

SEQ ID NO: 825589 - DNA, 20 bp, mouse
gatgggtcagccggaagtga

SEQ ID NO: 825590 - DNA, 20 bp, mouse
gggctgacccatcgtggaca

SEQ ID NO: 825591 - DNA, 20 bp, mouse
gtctgggcggggctcagaat

SEQ ID NO: 825592 - DNA, 20 bp, mouse
gcacgcagcgcttctgggaa

SEQ ID NO: 825593 - DNA, 20 bp, mouse
ggcttctgggaagggtcggt

SEQ ID NO: 825594 - DNA, 20 bp, mouse
ggacccatcgtggacagggc

SEQ ID NO: 825595 - DNA, 20 bp, mouse
ggcagcatcaccactctggg

SEQ ID NO: 825596 - DNA, 20 bp, mouse
gacagcaccacgggaggtgg

SEQ ID NO: 825597 - DNA, 20 bp, mouse
gggagacaagagttcagcct

SEQ ID NO: 825598 - DNA, 20 bp, mouse
gttgtctccaccacctcccg

SEQ ID NO: 825599 - DNA, 20 bp, mouse
gttaaaccttgcggattcgg

SEQ ID NO: 825600 - DNA, 20 bp, mouse
gaggggaattcatgttcaga

SEQ ID NO: 825601 - DNA, 20 bp, mouse
gggatccggggctcaagatc

SEQ ID NO: 825602 - DNA, 20 bp, mouse
gggcacctgatcttgagccc

SEQ ID NO: 825603 - DNA, 20 bp, mouse
ggcccttttccttctgacta

SEQ ID NO: 825604 - DNA, 20 bp, mouse
gtaccttagtcagaaggaaa

SEQ ID NO: 825605 - DNA, 20 bp, mouse
gggtgcccaggctttaaagc

SEQ ID NO: 825606 - DNA, 20 bp, mouse
gccaacggcagggacacgat

SEQ ID NO: 825607 - DNA, 20 bp, mouse
ggggcggggcacttccatga

SEQ ID NO: 825608 - DNA, 20 bp, mouse
gcacgtgggagccaacggca

SEQ ID NO: 825609 - DNA, 20 bp, mouse
gttggctcccacgtgagaac

SEQ ID NO: 825610 - DNA, 20 bp, mouse
gacggcagggacacgatggg

SEQ ID NO: 825611 - DNA, 20 bp, mouse
gctccatgcccgttctcacg

SEQ ID NO: 825612 - DNA, 20 bp, mouse
gatggccaggtcaggtggga

SEQ ID NO: 825613 - DNA, 20 bp, mouse
gggagcacgtgctaggaggc

SEQ ID NO: 825614 - DNA, 20 bp, mouse
gttaccatggggcttgaagt

SEQ ID NO: 825615 - DNA, 20 bp, mouse
gtcccacgtgagaacgggca

SEQ ID NO: 825616 - DNA, 20 bp, mouse
gggccgggaggggacatgat

SEQ ID NO: 825617 - DNA, 20 bp, mouse
gaggggacatgatggggtgc

SEQ ID NO: 825618 - DNA, 20 bp, mouse
gggcccgagcaggcgatgct

SEQ ID NO: 825619 - DNA, 20 bp, mouse
gctgggagatgtagtcgcct

SEQ ID NO: 825620 - DNA, 20 bp, mouse
gggcatgcagcacattctgt

SEQ ID NO: 825621 - DNA, 20 bp, mouse
gcatcgcctgctcgggccgc

SEQ ID NO: 825622 - DNA, 20 bp, mouse
gaaccatcctccttgtgtga

SEQ ID NO: 825623 - DNA, 20 bp, mouse
gactatgaatgtcatggcat

SEQ ID NO: 825624 - DNA, 20 bp, mouse
gacacaaggaggatggttat

SEQ ID NO: 825625 - DNA, 20 bp, mouse
gtgtgccttggatgcggttt

SEQ ID NO: 825626 - DNA, 20 bp, mouse
ggcctgcgcggctgcagaga

SEQ ID NO: 825627 - DNA, 20 bp, mouse
ggggaaaggtggagcgggtc

SEQ ID NO: 825628 - DNA, 20 bp, mouse
gcccccggagcgcccacctc

SEQ ID NO: 825629 - DNA, 20 bp, mouse
gccaacacgcggcgttcccg

SEQ ID NO: 825630 - DNA, 20 bp, mouse
gaggggccggggcggttggc

SEQ ID NO: 825631 - DNA, 20 bp, mouse
ggccaccccgccaaccgccc

SEQ ID NO: 825632 - DNA, 20 bp, mouse
ggcggcgggtcggtagaggg

SEQ ID NO: 825633 - DNA, 20 bp, mouse
gctgccccctgcgcgaggcg

SEQ ID NO: 825634 - DNA, 20 bp, mouse
gttcccgaggtgggcgctcc

SEQ ID NO: 825635 - DNA, 20 bp, mouse
gcacgcggcgttcccgaggt

SEQ ID NO: 825636 - DNA, 20 bp, mouse
ggggcccgggagggacgaca

SEQ ID NO: 825637 - DNA, 20 bp, mouse
gcgcaggcgcaaacggggcg

SEQ ID NO: 825638 - DNA, 20 bp, mouse
ggggagggacgacaaggatg

SEQ ID NO: 825639 - DNA, 20 bp, mouse
gccactaaaaggagcgtgag

SEQ ID NO: 825640 - DNA, 20 bp, mouse
gtaaaaggagcgtgagaggc

SEQ ID NO: 825641 - DNA, 20 bp, mouse
gtcccattctatgtggtgac

SEQ ID NO: 825642 - DNA, 20 bp, mouse
ggctatgcgcaggcgcaaac

SEQ ID NO: 825643 - DNA, 20 bp, mouse
gagaatgggacgcctggttg

SEQ ID NO: 825644 - DNA, 20 bp, mouse
gagtgggagggactgacgcg

SEQ ID NO: 825645 - DNA, 20 bp, mouse
ggcgtggtatggctatgcgc

SEQ ID NO: 825646 - DNA, 20 bp, mouse
gagaatcagcgtgacaatcc

SEQ ID NO: 825647 - DNA, 20 bp, mouse
gtgccagtggaggaggatct

SEQ ID NO: 825648 - DNA, 20 bp, mouse
gttggcacacagttttagcc

SEQ ID NO: 825649 - DNA, 20 bp, mouse
gtagccaggttgtgtagctt

SEQ ID NO: 825650 - DNA, 20 bp, mouse
gagacctaagctacacaacc

SEQ ID NO: 825651 - DNA, 20 bp, mouse
gaggccacgatggtcaaagg

SEQ ID NO: 825652 - DNA, 20 bp, mouse
gatcttggcgattcttgacc

SEQ ID NO: 825653 - DNA, 20 bp, mouse
gaaactctgaagccaaaaat

SEQ ID NO: 825654 - DNA, 20 bp, mouse
gcatccttgcctaaaactat

SEQ ID NO: 825655 - DNA, 20 bp, mouse
ggaagttacagtcagaaggc

SEQ ID NO: 825656 - DNA, 20 bp, mouse
gcgggcggacgggagaactg

SEQ ID NO: 825657 - DNA, 20 bp, mouse
ggtagctcgagttcagggtg

SEQ ID NO: 825658 - DNA, 20 bp, mouse
ggggcgctgcctaaccctgc

SEQ ID NO: 825659 - DNA, 20 bp, mouse
ggcagcgcccagaacggagc

SEQ ID NO: 825660 - DNA, 20 bp, mouse
gggctggcccggctccgttc

SEQ ID NO: 825661 - DNA, 20 bp, mouse
ggtggggggtgttactatat

SEQ ID NO: 825662 - DNA, 20 bp, mouse
gcctaaccctgctgggttct

SEQ ID NO: 825663 - DNA, 20 bp, mouse
gtactgccccggctaggttt

SEQ ID NO: 825664 - DNA, 20 bp, mouse
gctgaactcgagctacaatc

SEQ ID NO: 825665 - DNA, 20 bp, mouse
gaccctgctgggttctgggc

SEQ ID NO: 825666 - DNA, 20 bp, mouse
gcggacggaaatgggaacga

SEQ ID NO: 825667 - DNA, 20 bp, mouse
gcgcaggcgccggacggaaa

SEQ ID NO: 825668 - DNA, 20 bp, mouse
gcccctaaggcgtgccgcgt

SEQ ID NO: 825669 - DNA, 20 bp, mouse
gcgtctagggagagggactc

SEQ ID NO: 825670 - DNA, 20 bp, mouse
gcggccggtccccgccccta

SEQ ID NO: 825671 - DNA, 20 bp, mouse
gggcgctcgaaggccggaaa

SEQ ID NO: 825672 - DNA, 20 bp, mouse
ggccgctccggtggacgccc

SEQ ID NO: 825673 - DNA, 20 bp, mouse
ggctcgaaggccggaaatgg

SEQ ID NO: 825674 - DNA, 20 bp, mouse
gtcggcggtggaaaggctca

SEQ ID NO: 825675 - DNA, 20 bp, mouse
gcgcaggcgctgcactagta

SEQ ID NO: 825676 - DNA, 20 bp, mouse
ggaggcgaaggctctgaccg

SEQ ID NO: 825677 - DNA, 20 bp, mouse
gtggtggtgcgcgccggcag

SEQ ID NO: 825678 - DNA, 20 bp, mouse
ggggaggtggtggtgcgcgc

SEQ ID NO: 825679 - DNA, 20 bp, mouse
gaggggaagaggttgcggcg

SEQ ID NO: 825680 - DNA, 20 bp, mouse
gagcatggacgcgaccaagg

SEQ ID NO: 825681 - DNA, 20 bp, mouse
ggcgaccaaggcggcgagga

SEQ ID NO: 825682 - DNA, 20 bp, mouse
ggtaaacagggtaggatcgt

SEQ ID NO: 825683 - DNA, 20 bp, mouse
gaccacgagaggtgcaagat

SEQ ID NO: 825684 - DNA, 20 bp, mouse
gggcagcatggacgcgacca

SEQ ID NO: 825685 - DNA, 20 bp, mouse
gtcccctccccctctgatgg

SEQ ID NO: 825686 - DNA, 20 bp, mouse
ggggacgcgcgagtaggcgg

SEQ ID NO: 825687 - DNA, 20 bp, mouse
gcacctgagcgtgactgtgt

SEQ ID NO: 825688 - DNA, 20 bp, mouse
gggctctggcgcaaagagaa

SEQ ID NO: 825689 - DNA, 20 bp, mouse
gtcacgctcaggtggcggga

SEQ ID NO: 825690 - DNA, 20 bp, mouse
gccagagcctgaaaaggcgg

SEQ ID NO: 825691 - DNA, 20 bp, mouse
gaggagctctcgcagtgtgg

SEQ ID NO: 825692 - DNA, 20 bp, mouse
gttcccacacagtcacgctc

SEQ ID NO: 825693 - DNA, 20 bp, mouse
gggagcgagcctgttagcga

SEQ ID NO: 825694 - DNA, 20 bp, mouse
gttagcgagggagcagtggg

SEQ ID NO: 825695 - DNA, 20 bp, mouse
gacagtcacgctcaggtggc

SEQ ID NO: 825696 - DNA, 20 bp, mouse
gttccctcgccagccaggta

SEQ ID NO: 825697 - DNA, 20 bp, mouse
gaggggcatctcaatcctcc

SEQ ID NO: 825698 - DNA, 20 bp, mouse
gttccctacctggctggcga

SEQ ID NO: 825699 - DNA, 20 bp, mouse
gcctacgccggagagcccat

SEQ ID NO: 825700 - DNA, 20 bp, mouse
gaggggcgggcctggatgca

SEQ ID NO: 825701 - DNA, 20 bp, mouse
gctggcctcaagtggccaag

SEQ ID NO: 825702 - DNA, 20 bp, mouse
gggcgctcacgtactgtgca

SEQ ID NO: 825703 - DNA, 20 bp, mouse
gccctgttggcccagccaat

SEQ ID NO: 825704 - DNA, 20 bp, mouse
gagaacacaaaagggatgtc

SEQ ID NO: 825705 - DNA, 20 bp, mouse
gcagactggtctccctacgc

SEQ ID NO: 825706 - DNA, 20 bp, mouse
gggggctagtcttagtgtta

SEQ ID NO: 825707 - DNA, 20 bp, mouse
gaagtcaaagctcaaaagtg

SEQ ID NO: 825708 - DNA, 20 bp, mouse
ggcccaaggctacacctagg

SEQ ID NO: 825709 - DNA, 20 bp, mouse
gctactttggtggttagcta

SEQ ID NO: 825710 - DNA, 20 bp, mouse
gtagccttgggctactttgg

SEQ ID NO: 825711 - DNA, 20 bp, mouse
gagccccctaggtgtagcct

SEQ ID NO: 825712 - DNA, 20 bp, mouse
gcctgcctttagcaagagaa

SEQ ID NO: 825713 - DNA, 20 bp, mouse
gtaggtgagtagaaacaaag

SEQ ID NO: 825714 - DNA, 20 bp, mouse
gtaaccaccaaagtagccca

SEQ ID NO: 825715 - DNA, 20 bp, mouse
gaagagggggagggtcatca

SEQ ID NO: 825716 - DNA, 20 bp, mouse
ggaaaagtgactggcggagg

SEQ ID NO: 825717 - DNA, 20 bp, mouse
gaactttgaaaagtgactgg

SEQ ID NO: 825718 - DNA, 20 bp, mouse
gtttgaaaagtgactggcgg

SEQ ID NO: 825719 - DNA, 20 bp, mouse
gcataactttgaaaagtgac

SEQ ID NO: 825720 - DNA, 20 bp, mouse
gtggagagacgatggctcaa

SEQ ID NO: 825721 - DNA, 20 bp, mouse
gcaaaagtgggagtcctcag

SEQ ID NO: 825722 - DNA, 20 bp, mouse
gctatgagccacctgacatg

SEQ ID NO: 825723 - DNA, 20 bp, mouse
gggagtcctcaggggagagt

SEQ ID NO: 825724 - DNA, 20 bp, mouse
gatcgtctctccagcaccat

SEQ ID NO: 825725 - DNA, 20 bp, mouse
gtgtatacaagtgcccatgg

SEQ ID NO: 825726 - DNA, 20 bp, mouse
gcaaccagggccagaaggaa

SEQ ID NO: 825727 - DNA, 20 bp, mouse
gcggctccaagcccttgcgt

SEQ ID NO: 825728 - DNA, 20 bp, mouse
gtggccggacgattacccgc

SEQ ID NO: 825729 - DNA, 20 bp, mouse
gcgggacgcgcccacttggc

SEQ ID NO: 825730 - DNA, 20 bp, mouse
gtctcctcaccatgcaacca

SEQ ID NO: 825731 - DNA, 20 bp, mouse
gtgccccccgagttcaatga

SEQ ID NO: 825732 - DNA, 20 bp, mouse
gcctcccgcgggtaatcgtc

SEQ ID NO: 825733 - DNA, 20 bp, mouse
ggatccagcgcccctcgtgt

SEQ ID NO: 825734 - DNA, 20 bp, mouse
ggcaaggcgcctgctggaga

SEQ ID NO: 825735 - DNA, 20 bp, mouse
gccaagcccttgcgtgggtg

SEQ ID NO: 825736 - DNA, 20 bp, mouse
gccgccgcggcgacagcgag

SEQ ID NO: 825737 - DNA, 20 bp, mouse
gccccgcccgcggagcgaga

SEQ ID NO: 825738 - DNA, 20 bp, mouse
gggagtgtccgcacagaggg

SEQ ID NO: 825739 - DNA, 20 bp, mouse
gccggcggtggggcggtggg

SEQ ID NO: 825740 - DNA, 20 bp, mouse
gagaccccgcccttccgccg

SEQ ID NO: 825741 - DNA, 20 bp, mouse
gcctaactcccggtcggggg

SEQ ID NO: 825742 - DNA, 20 bp, mouse
gagagcgggcagccaacgtc

SEQ ID NO: 825743 - DNA, 20 bp, mouse
gccgaccgggagttaggggc

SEQ ID NO: 825744 - DNA, 20 bp, mouse
gcgaggcgaggcagacaatg

SEQ ID NO: 825745 - DNA, 20 bp, mouse
gtcgccgcggcggaagggcg

SEQ ID NO: 825746 - DNA, 20 bp, mouse
gagaggaccgggttctggaa

SEQ ID NO: 825747 - DNA, 20 bp, mouse
gcctaggggccaagaggacc

SEQ ID NO: 825748 - DNA, 20 bp, mouse
gaagggcgcgggctgaacta

SEQ ID NO: 825749 - DNA, 20 bp, mouse
gggccaagaggaccgggttc

SEQ ID NO: 825750 - DNA, 20 bp, mouse
gggcgccgcagccctgtgtt

SEQ ID NO: 825751 - DNA, 20 bp, mouse
gtgtgctcctaggggccaag

SEQ ID NO: 825752 - DNA, 20 bp, mouse
gggctgaactaggggtgacc

SEQ ID NO: 825753 - DNA, 20 bp, mouse
ggcgccacccttccagaacc

SEQ ID NO: 825754 - DNA, 20 bp, mouse
gcgctggcagtgatccaagg

SEQ ID NO: 825755 - DNA, 20 bp, mouse
gggaccgggttctggaaggg

SEQ ID NO: 825756 - DNA, 20 bp, mouse
ggggtgcgcgagaggaggca

SEQ ID NO: 825757 - DNA, 20 bp, mouse
gcgcgcgcgcatcgcttctg

SEQ ID NO: 825758 - DNA, 20 bp, mouse
gaggggcgcgcagctggaac

SEQ ID NO: 825759 - DNA, 20 bp, mouse
gccctcccgggagctgggtc

SEQ ID NO: 825760 - DNA, 20 bp, mouse
gcactccggacccagctccc

SEQ ID NO: 825761 - DNA, 20 bp, mouse
gaaagctggagaagagggtt

SEQ ID NO: 825762 - DNA, 20 bp, mouse
gtgggtccggagtgcctggt

SEQ ID NO: 825763 - DNA, 20 bp, mouse
gttctggggtgcgcgagagg

SEQ ID NO: 825764 - DNA, 20 bp, mouse
ggagaagagggtttggctcc

SEQ ID NO: 825765 - DNA, 20 bp, mouse
gcgcttctggggtgcgcgag

SEQ ID NO: 825766 - DNA, 20 bp, mouse
gaaccatgccccccaggaat

SEQ ID NO: 825767 - DNA, 20 bp, mouse
gcacacgcgctgctctgcgc

SEQ ID NO: 825768 - DNA, 20 bp, mouse
gtgtgcgccaaccccatcac

SEQ ID NO: 825769 - DNA, 20 bp, mouse
gcaagccattaagaggtagg

SEQ ID NO: 825770 - DNA, 20 bp, mouse
gctgctggggcgacctccgc

SEQ ID NO: 825771 - DNA, 20 bp, mouse
gcatgattggaactctggaa

SEQ ID NO: 825772 - DNA, 20 bp, mouse
ggacctgcatatcctggggt

SEQ ID NO: 825773 - DNA, 20 bp, mouse
ggcagagagtggttggcaga

SEQ ID NO: 825774 - DNA, 20 bp, mouse
gcactctctgcccattcctg

SEQ ID NO: 825775 - DNA, 20 bp, mouse
gccccgcccctagctctgtg

SEQ ID NO: 825776 - DNA, 20 bp, mouse
ggcccggagcagcgcactgg

SEQ ID NO: 825777 - DNA, 20 bp, mouse
gtcactcccgccacctgcaa

SEQ ID NO: 825778 - DNA, 20 bp, mouse
gcgggtaggcacggaggcgg

SEQ ID NO: 825779 - DNA, 20 bp, mouse
ggcaagggtctgtaaggcgg

SEQ ID NO: 825780 - DNA, 20 bp, mouse
gccacctgcaagggtctgta

SEQ ID NO: 825781 - DNA, 20 bp, mouse
gcggagcagcgcactggggg

SEQ ID NO: 825782 - DNA, 20 bp, mouse
gcagctgcgggtaggcacgg

SEQ ID NO: 825783 - DNA, 20 bp, mouse
gggcgagcgcgggactgggc

SEQ ID NO: 825784 - DNA, 20 bp, mouse
gcctgcaagggtctgtaagg

SEQ ID NO: 825785 - DNA, 20 bp, mouse
gtaaggcggagggaaagttg

SEQ ID NO: 825786 - DNA, 20 bp, mouse
gctcccgcagggccctgcaa

SEQ ID NO: 825787 - DNA, 20 bp, mouse
ggtagtccctgtgtgttgga

SEQ ID NO: 825788 - DNA, 20 bp, mouse
ggccctgcaagggcattgtt

SEQ ID NO: 825789 - DNA, 20 bp, mouse
gctgcagggtagaaccctgt

SEQ ID NO: 825790 - DNA, 20 bp, mouse
ggctgattgactgggagcta

SEQ ID NO: 825791 - DNA, 20 bp, mouse
ggacctgcttcagaccattg

SEQ ID NO: 825792 - DNA, 20 bp, mouse
gagccctcaccccagggtaa

SEQ ID NO: 825793 - DNA, 20 bp, mouse
gacctgtagtccctgtgtgt

SEQ ID NO: 825794 - DNA, 20 bp, mouse
gagccacaatggtctgaagc

SEQ ID NO: 825795 - DNA, 20 bp, mouse
gcgcctttaccctggggtga

SEQ ID NO: 825796 - DNA, 20 bp, mouse
gccacccgctcgccatcgtg

SEQ ID NO: 825797 - DNA, 20 bp, mouse
ggggacgggccctgagacac

SEQ ID NO: 825798 - DNA, 20 bp, mouse
ggcgagcgggtggtattgga

SEQ ID NO: 825799 - DNA, 20 bp, mouse
gggatccaaggtcttgagat

SEQ ID NO: 825800 - DNA, 20 bp, mouse
ggatggcgagcgggtggtat

SEQ ID NO: 825801 - DNA, 20 bp, mouse
gaaagccccacgatggcgag

SEQ ID NO: 825802 - DNA, 20 bp, mouse
ggagacacaggtgtccctga

SEQ ID NO: 825803 - DNA, 20 bp, mouse
gctgaaggtgacaggatcca

SEQ ID NO: 825804 - DNA, 20 bp, mouse
gctgatgcctggctgaggtg

SEQ ID NO: 825805 - DNA, 20 bp, mouse
gttctctcaaagccccacga

SEQ ID NO: 825806 - DNA, 20 bp, mouse
gccggaaaaggagagaacga

SEQ ID NO: 825807 - DNA, 20 bp, mouse
gctgctgccgctgctgccgt

SEQ ID NO: 825808 - DNA, 20 bp, mouse
gacccagggagacccggaaa

SEQ ID NO: 825809 - DNA, 20 bp, mouse
gccctggtgtgtatgagtca

SEQ ID NO: 825810 - DNA, 20 bp, mouse
gggtcttgggtcagcttcta

SEQ ID NO: 825811 - DNA, 20 bp, mouse
ggtggtgagtatctttctct

SEQ ID NO: 825812 - DNA, 20 bp, mouse
gagcttctacgggacttccc

SEQ ID NO: 825813 - DNA, 20 bp, mouse
gcccctgactcatacacacc

SEQ ID NO: 825814 - DNA, 20 bp, mouse
gtccttttccgggtctccct

SEQ ID NO: 825815 - DNA, 20 bp, mouse
gagacccaatttgttgagta

SEQ ID NO: 825816 - DNA, 20 bp, mouse
gggcgcgtgcatgacatcat

SEQ ID NO: 825817 - DNA, 20 bp, mouse
gtgcaaagaggtcaccccgc

SEQ ID NO: 825818 - DNA, 20 bp, mouse
gcagaaagcgggtgcttctt

SEQ ID NO: 825819 - DNA, 20 bp, mouse
gtgggagcgcgccccacacc

SEQ ID NO: 825820 - DNA, 20 bp, mouse
ggcttcttggggtcccggtg

SEQ ID NO: 825821 - DNA, 20 bp, mouse
ggaagctcgcgctcagaaag

SEQ ID NO: 825822 - DNA, 20 bp, mouse
ggcttccgaaagcggggatg

SEQ ID NO: 825823 - DNA, 20 bp, mouse
gggcgcgctcccagccagcg

SEQ ID NO: 825824 - DNA, 20 bp, mouse
gtgccggggctcccgccagg

SEQ ID NO: 825825 - DNA, 20 bp, mouse
gtcagagggcttccgaaagc

SEQ ID NO: 825826 - DNA, 20 bp, mouse
gggcgccagggtgcggaagg

SEQ ID NO: 825827 - DNA, 20 bp, mouse
ggagctcgcaggaggcgcca

SEQ ID NO: 825828 - DNA, 20 bp, mouse
gcgcaggaggcgccagggtg

SEQ ID NO: 825829 - DNA, 20 bp, mouse
gtgggcggggcggggcaatc

SEQ ID NO: 825830 - DNA, 20 bp, mouse
ggggaggaaaagctcacccc

SEQ ID NO: 825831 - DNA, 20 bp, mouse
gcggccggacccgcccccgt

SEQ ID NO: 825832 - DNA, 20 bp, mouse
gccccaagaagagacatcct

SEQ ID NO: 825833 - DNA, 20 bp, mouse
gaaagccaaagggctctgaa

SEQ ID NO: 825834 - DNA, 20 bp, mouse
gcaagaagagacatcctagg

SEQ ID NO: 825835 - DNA, 20 bp, mouse
ggccagggtgcggaaggggg

SEQ ID NO: 825836 - DNA, 20 bp, mouse
gcccttatggggtttagagg

SEQ ID NO: 825837 - DNA, 20 bp, mouse
ggtatgacagagttggagat

SEQ ID NO: 825838 - DNA, 20 bp, mouse
gaagcccttatggggtttag

SEQ ID NO: 825839 - DNA, 20 bp, mouse
ggtgggaaggatccagggca

SEQ ID NO: 825840 - DNA, 20 bp, mouse
gctcccccgtatgacagagt

SEQ ID NO: 825841 - DNA, 20 bp, mouse
gacagaacgaagcccttatg

SEQ ID NO: 825842 - DNA, 20 bp, mouse
gtgagccagcgcccccgact

SEQ ID NO: 825843 - DNA, 20 bp, mouse
gggcgcatggacctagtcgg

SEQ ID NO: 825844 - DNA, 20 bp, mouse
gcatacgggggagagcgagt

SEQ ID NO: 825845 - DNA, 20 bp, mouse
gagcgcgcgtcggctgcgac

SEQ ID NO: 825846 - DNA, 20 bp, mouse
gcgcacgcgctgaagacgtg

SEQ ID NO: 825847 - DNA, 20 bp, mouse
gggaaagggcgtggtctcgg

SEQ ID NO: 825848 - DNA, 20 bp, mouse
gctcgcgcgcgcccggccaa

SEQ ID NO: 825849 - DNA, 20 bp, mouse
gtatggaaagggcgtggtct

SEQ ID NO: 825850 - DNA, 20 bp, mouse
gtccgaactgactatggaaa

SEQ ID NO: 825851 - DNA, 20 bp, mouse
ggcgtggtctcggcggacgt

SEQ ID NO: 825852 - DNA, 20 bp, mouse
gacgttgggcgggtcgccgt

SEQ ID NO: 825853 - DNA, 20 bp, mouse
gggtctcggcggacgttggg

SEQ ID NO: 825854 - DNA, 20 bp, mouse
gccgacccagctccaaatag

SEQ ID NO: 825855 - DNA, 20 bp, mouse
gcgcctatccgaactgacta

SEQ ID NO: 825856 - DNA, 20 bp, mouse
gcggcagcacggtcccgcgt

SEQ ID NO: 825857 - DNA, 20 bp, mouse
gcgcggcggccgcaggaacc

SEQ ID NO: 825858 - DNA, 20 bp, mouse
gggtcccgcgtgggcggaaa

SEQ ID NO: 825859 - DNA, 20 bp, mouse
gcctgggcagcggcgcaatg

SEQ ID NO: 825860 - DNA, 20 bp, mouse
ggccccttagggtgaaaggg

SEQ ID NO: 825861 - DNA, 20 bp, mouse
gcctccgtcgccccgggagt

SEQ ID NO: 825862 - DNA, 20 bp, mouse
gtccccgcgggcgacaggga

SEQ ID NO: 825863 - DNA, 20 bp, mouse
gtggagcggaagtgacgctt

SEQ ID NO: 825864 - DNA, 20 bp, mouse
gaggggcgggccttccgcct

SEQ ID NO: 825865 - DNA, 20 bp, mouse
gcccgccccttagggtgaaa

SEQ ID NO: 825866 - DNA, 20 bp, mouse
ggaggctgtcgtggtgttag

SEQ ID NO: 825867 - DNA, 20 bp, mouse
ggctgtcgtggtgttagggg

SEQ ID NO: 825868 - DNA, 20 bp, mouse
ggggggagcgcggtcgtcgt

SEQ ID NO: 825869 - DNA, 20 bp, mouse
gaacccagactgcgcccggt

SEQ ID NO: 825870 - DNA, 20 bp, mouse
gctcccccaagcggcgaggc

SEQ ID NO: 825871 - DNA, 20 bp, mouse
gtcacctgctcggggcagtg

SEQ ID NO: 825872 - DNA, 20 bp, mouse
gccgccgcactgccccgagc

SEQ ID NO: 825873 - DNA, 20 bp, mouse
gagcgcggtcgtcgtcggag

SEQ ID NO: 825874 - DNA, 20 bp, mouse
gccagcagggaggaccgtcc

SEQ ID NO: 825875 - DNA, 20 bp, mouse
ggaggaggaggaggctgtcg

SEQ ID NO: 825876 - DNA, 20 bp, mouse
ggaaggagagagggtaataa

SEQ ID NO: 825877 - DNA, 20 bp, mouse
gggtaccggaaaacgctggt

SEQ ID NO: 825878 - DNA, 20 bp, mouse
gtgggaacgtggaggatgct

SEQ ID NO: 825879 - DNA, 20 bp, mouse
ggtacctcgcactgttctca

SEQ ID NO: 825880 - DNA, 20 bp, mouse
gcggccttgagaacagtgcg

SEQ ID NO: 825881 - DNA, 20 bp, mouse
gtgcccgcggtttccttttc

SEQ ID NO: 825882 - DNA, 20 bp, mouse
ggcgaggtaccggaaaacgc

SEQ ID NO: 825883 - DNA, 20 bp, mouse
gcctttcatagagtggtttg

SEQ ID NO: 825884 - DNA, 20 bp, mouse
gaccgcgggcactgggaacg

SEQ ID NO: 825885 - DNA, 20 bp, mouse
ggttctcaaggccgatcctg

SEQ ID NO: 825886 - DNA, 20 bp, mouse
ggcccagggtaatcccacgt

SEQ ID NO: 825887 - DNA, 20 bp, mouse
ggccccctgccggacagatc

SEQ ID NO: 825888 - DNA, 20 bp, mouse
ggtaatcccacgtgggttgt

SEQ ID NO: 825889 - DNA, 20 bp, mouse
ggtaatccgacaacccacgt

SEQ ID NO: 825890 - DNA, 20 bp, mouse
ggcgaccgggccactaagtg

SEQ ID NO: 825891 - DNA, 20 bp, mouse
gcccgcgcggccactgcggc

SEQ ID NO: 825892 - DNA, 20 bp, mouse
gtggcccgatctgtccggca

SEQ ID NO: 825893 - DNA, 20 bp, mouse
gccaccaggggggccagtgc

SEQ ID NO: 825894 - DNA, 20 bp, mouse
gctccccgttgctactccta

SEQ ID NO: 825895 - DNA, 20 bp, mouse
gacccacgtgggattaccct

SEQ ID NO: 825896 - DNA, 20 bp, mouse
ggcgctgaggggcggcgcta

SEQ ID NO: 825897 - DNA, 20 bp, mouse
gctcctgccgagcgctcccc

SEQ ID NO: 825898 - DNA, 20 bp, mouse
gaggggcggcgctagggccc

SEQ ID NO: 825899 - DNA, 20 bp, mouse
ggggacccaagcgggagccg

SEQ ID NO: 825900 - DNA, 20 bp, mouse
gggctgaaggggacccaagc

SEQ ID NO: 825901 - DNA, 20 bp, mouse
ggggcggggtgcagggatct

SEQ ID NO: 825902 - DNA, 20 bp, mouse
ggggtcgtaccccggggtgg

SEQ ID NO: 825903 - DNA, 20 bp, mouse
gagaaaggggggtcgtaccc

SEQ ID NO: 825904 - DNA, 20 bp, mouse
ggggtgcagggatctcgggg

SEQ ID NO: 825905 - DNA, 20 bp, mouse
gtagccgctagaggctgaag

SEQ ID NO: 825906 - DNA, 20 bp, mouse
gaggagggcagggtgtcagg

SEQ ID NO: 825907 - DNA, 20 bp, mouse
ggggggccagccaagcccaa

SEQ ID NO: 825908 - DNA, 20 bp, mouse
ggcctcaggtggctctagga

SEQ ID NO: 825909 - DNA, 20 bp, mouse
gtagccgtctatatttttaa

SEQ ID NO: 825910 - DNA, 20 bp, mouse
ggagcccttaaaaatataga

SEQ ID NO: 825911 - DNA, 20 bp, mouse
gggaggggaccgagttccag

SEQ ID NO: 825912 - DNA, 20 bp, mouse
gagggcagggtgtcaggggg

SEQ ID NO: 825913 - DNA, 20 bp, mouse
ggtcactggggccatttctc

SEQ ID NO: 825914 - DNA, 20 bp, mouse
gctgaagtgtctggtgtcac

SEQ ID NO: 825915 - DNA, 20 bp, mouse
ggggtcctgagaaaggggat

SEQ ID NO: 825916 - DNA, 20 bp, mouse
ggggccaatggagagcgggg

SEQ ID NO: 825917 - DNA, 20 bp, mouse
gccctgtttgggacagaatg

SEQ ID NO: 825918 - DNA, 20 bp, mouse
gatggggccaatggagagcg

SEQ ID NO: 825919 - DNA, 20 bp, mouse
gacgcaagagagggcggtac

SEQ ID NO: 825920 - DNA, 20 bp, mouse
gaaagagcgtgacgcaagag

SEQ ID NO: 825921 - DNA, 20 bp, mouse
gagcgtgacgcaagagaggg

SEQ ID NO: 825922 - DNA, 20 bp, mouse
gtgtcctccccgctctccat

SEQ ID NO: 825923 - DNA, 20 bp, mouse
gcaaccctttaaggggtggg

SEQ ID NO: 825924 - DNA, 20 bp, mouse
ggccccattctgtcccaaac

SEQ ID NO: 825925 - DNA, 20 bp, mouse
gagagggcggtacaggtgct

SEQ ID NO: 825926 - DNA, 20 bp, mouse
gcagacctcacagttgagag

SEQ ID NO: 825927 - DNA, 20 bp, mouse
gtgggcaagagtctatgcaa

SEQ ID NO: 825928 - DNA, 20 bp, mouse
gccaccccctctcaactgtg

SEQ ID NO: 825929 - DNA, 20 bp, mouse
gcatgatgcgaagggagggg

SEQ ID NO: 825930 - DNA, 20 bp, mouse
gagagtctatgcaatggctc

SEQ ID NO: 825931 - DNA, 20 bp, mouse
gagaattggggggtaagtgt

SEQ ID NO: 825932 - DNA, 20 bp, mouse
gcagcatgatgcgaagggag

SEQ ID NO: 825933 - DNA, 20 bp, mouse
gggggtgctaaaatgagaat

SEQ ID NO: 825934 - DNA, 20 bp, mouse
ggcagctgaatgagctcact

SEQ ID NO: 825935 - DNA, 20 bp, mouse
ggggacaaaggggctttaaa

SEQ ID NO: 825936 - DNA, 20 bp, mouse
gtctaggagtaacacagttg

SEQ ID NO: 825937 - DNA, 20 bp, mouse
ggagtaacacagttggggga

SEQ ID NO: 825938 - DNA, 20 bp, mouse
gaaaaggtccatgcagtaaa

SEQ ID NO: 825939 - DNA, 20 bp, mouse
gatactgagtcctgactaaa

SEQ ID NO: 825940 - DNA, 20 bp, mouse
gcgctcccacaagctcctca

SEQ ID NO: 825941 - DNA, 20 bp, mouse
gccatgcagtaaaagggaca

SEQ ID NO: 825942 - DNA, 20 bp, mouse
gttaggttcatgatccttgg

SEQ ID NO: 825943 - DNA, 20 bp, mouse
ggttcatgatccttggagga

SEQ ID NO: 825944 - DNA, 20 bp, mouse
gaggcaggcaacttggccct

SEQ ID NO: 825945 - DNA, 20 bp, mouse
gctggactgtaccgatccca

SEQ ID NO: 825946 - DNA, 20 bp, mouse
ggatctggaccaatgtgcga

SEQ ID NO: 825947 - DNA, 20 bp, mouse
gcgggcgcgcaatctgctcc

SEQ ID NO: 825948 - DNA, 20 bp, mouse
gaggctccggggaaactttg

SEQ ID NO: 825949 - DNA, 20 bp, mouse
gtggctagccgcaagctcca

SEQ ID NO: 825950 - DNA, 20 bp, mouse
gaggcaagccgagctagaga

SEQ ID NO: 825951 - DNA, 20 bp, mouse
gaggcacagccttcgcacat

SEQ ID NO: 825952 - DNA, 20 bp, mouse
gaatgacagcctggccctga

SEQ ID NO: 825953 - DNA, 20 bp, mouse
gaaaagagcaccaatgtcag

SEQ ID NO: 825954 - DNA, 20 bp, mouse
ggggagagagggctggacat

SEQ ID NO: 825955 - DNA, 20 bp, mouse
gcgcgcccgcgcgcaggatc

SEQ ID NO: 825956 - DNA, 20 bp, mouse
gcacgagcggcgcgccccgg

SEQ ID NO: 825957 - DNA, 20 bp, mouse
gcgccccggtggcattctgc

SEQ ID NO: 825958 - DNA, 20 bp, mouse
gcgcagccccgccccgtcgt

SEQ ID NO: 825959 - DNA, 20 bp, mouse
gcatggcccccgggcacgag

SEQ ID NO: 825960 - DNA, 20 bp, mouse
gacaccgccccaccaagtcg

SEQ ID NO: 825961 - DNA, 20 bp, mouse
gcaagtcggggccgacgacg

SEQ ID NO: 825962 - DNA, 20 bp, mouse
ggggggccatgaagtcacgt

SEQ ID NO: 825963 - DNA, 20 bp, mouse
gtgtgcattagtgcagatcc

SEQ ID NO: 825964 - DNA, 20 bp, mouse
gtcggggccgacgacggggc

SEQ ID NO: 825965 - DNA, 20 bp, mouse
gcgtcggccccgacttggtg

SEQ ID NO: 825966 - DNA, 20 bp, mouse
gtggggcgggcgaggagtat

SEQ ID NO: 825967 - DNA, 20 bp, mouse
gcgcctgcggccattccatt

SEQ ID NO: 825968 - DNA, 20 bp, mouse
ggcgggcgaggagtatgggg

SEQ ID NO: 825969 - DNA, 20 bp, mouse
ggccgcaggcgagttggggc

SEQ ID NO: 825970 - DNA, 20 bp, mouse
gactctgggtctctgagcga

SEQ ID NO: 825971 - DNA, 20 bp, mouse
ggtcggaacagcccagtcgg

SEQ ID NO: 825972 - DNA, 20 bp, mouse
ggcgaggagtatggggcggg

SEQ ID NO: 825973 - DNA, 20 bp, mouse
gggaatggccgcaggcgagt

SEQ ID NO: 825974 - DNA, 20 bp, mouse
gaggcgcttgctcaaaagat

SEQ ID NO: 825975 - DNA, 20 bp, mouse
gatcgtcggaacagcccagt

SEQ ID NO: 825976 - DNA, 20 bp, mouse
ggacgaaggggcatcggggc

SEQ ID NO: 825977 - DNA, 20 bp, mouse
gaaggggcatcggggcggga

SEQ ID NO: 825978 - DNA, 20 bp, mouse
gaccaggccgaggagggact

SEQ ID NO: 825979 - DNA, 20 bp, mouse
gtggggacgaaggggcatcg

SEQ ID NO: 825980 - DNA, 20 bp, mouse
gtccctcctcggcctggtct

SEQ ID NO: 825981 - DNA, 20 bp, mouse
gagccgagaccaggccgagg

SEQ ID NO: 825982 - DNA, 20 bp, mouse
gcggccccgccttaaaggcc

SEQ ID NO: 825983 - DNA, 20 bp, mouse
gccgcccggccccgccttaa

SEQ ID NO: 825984 - DNA, 20 bp, mouse
gaaggccggaaaagagtctg

SEQ ID NO: 825985 - DNA, 20 bp, mouse
gctcctgggcgcggactcaa

SEQ ID NO: 825986 - DNA, 20 bp, mouse
ggagccttctggcagcccga

SEQ ID NO: 825987 - DNA, 20 bp, mouse
ggggctgccagaaggctccg

SEQ ID NO: 825988 - DNA, 20 bp, mouse
gcagctgggctgttctagtg

SEQ ID NO: 825989 - DNA, 20 bp, mouse
gtgcttcaacgccacggcca

SEQ ID NO: 825990 - DNA, 20 bp, mouse
ggaacctacacgggatgcgt

SEQ ID NO: 825991 - DNA, 20 bp, mouse
ggtggagcctgctagccgtc

SEQ ID NO: 825992 - DNA, 20 bp, mouse
gggctccacaggtcccttta

SEQ ID NO: 825993 - DNA, 20 bp, mouse
ggccctacgcgcggaaaaag

SEQ ID NO: 825994 - DNA, 20 bp, mouse
ggagcccacgcatcccgtgt

SEQ ID NO: 825995 - DNA, 20 bp, mouse
gtagccgtcgggctgccaga

SEQ ID NO: 825996 - DNA, 20 bp, mouse
ggggcattgcgcagacgcag

SEQ ID NO: 825997 - DNA, 20 bp, mouse
gagagggcgcgcaagaccca

SEQ ID NO: 825998 - DNA, 20 bp, mouse
gaaccctacacgccatccaa

SEQ ID NO: 825999 - DNA, 20 bp, mouse
gaggacccgccggcctagag

SEQ ID NO: 826000 - DNA, 20 bp, mouse
gctgctcgcaagggcccctt

SEQ ID NO: 826001 - DNA, 20 bp, mouse
gtccggggacggcaaccgag

SEQ ID NO: 826002 - DNA, 20 bp, mouse
gctgcacatgcgtaagatga

SEQ ID NO: 826003 - DNA, 20 bp, mouse
gcatgtgcagagtttatttc

SEQ ID NO: 826004 - DNA, 20 bp, mouse
gaaatgaggcacaaaaccgt

SEQ ID NO: 826005 - DNA, 20 bp, mouse
gtgcgtaagatgaaggatga

SEQ ID NO: 826006 - DNA, 20 bp, mouse
gagagagcactgataatagg

SEQ ID NO: 826007 - DNA, 20 bp, mouse
gcggccgcctcctcactgga

SEQ ID NO: 826008 - DNA, 20 bp, mouse
gagccggggccgggagatga

SEQ ID NO: 826009 - DNA, 20 bp, mouse
gggggccgggagatgatggg

SEQ ID NO: 826010 - DNA, 20 bp, mouse
gaatccctccagtgaggagg

SEQ ID NO: 826011 - DNA, 20 bp, mouse
ggagagactctaacagtact

SEQ ID NO: 826012 - DNA, 20 bp, mouse
ggacctgaggagaggggttt

SEQ ID NO: 826013 - DNA, 20 bp, mouse
gtggaaccaatcaagagccg

SEQ ID NO: 826014 - DNA, 20 bp, mouse
ggggggtggggtgaactaag

SEQ ID NO: 826015 - DNA, 20 bp, mouse
gtccatccccacagcggaca

SEQ ID NO: 826016 - DNA, 20 bp, mouse
ggctcagaaaggtgtatgga

SEQ ID NO: 826017 - DNA, 20 bp, mouse
ggggcggcgcggccaatggc

SEQ ID NO: 826018 - DNA, 20 bp, mouse
gaagaatcggggagggacca

SEQ ID NO: 826019 - DNA, 20 bp, mouse
ggaccagggagtagcaaagt

SEQ ID NO: 826020 - DNA, 20 bp, mouse
ggggggctcagaaaggtgta

SEQ ID NO: 826021 - DNA, 20 bp, mouse
ggtgtgacgggggctcagaa

SEQ ID NO: 826022 - DNA, 20 bp, mouse
ggccaatggcaggctggcgc

SEQ ID NO: 826023 - DNA, 20 bp, mouse
gtagcaaagttggattgaaa

SEQ ID NO: 826024 - DNA, 20 bp, mouse
ggcccgcgccagcctgccat

SEQ ID NO: 826025 - DNA, 20 bp, mouse
ggaaatgaaaagagtgtgac

SEQ ID NO: 826026 - DNA, 20 bp, mouse
gagggccgttcgggaagagg

SEQ ID NO: 826027 - DNA, 20 bp, mouse
gcttctgccgagggccgttc

SEQ ID NO: 826028 - DNA, 20 bp, mouse
gccgagggccgttcgggaag

SEQ ID NO: 826029 - DNA, 20 bp, mouse
gggctccgcctcttcccgaa

SEQ ID NO: 826030 - DNA, 20 bp, mouse
gaaacacctacacttcttaa

SEQ ID NO: 826031 - DNA, 20 bp, mouse
gaaagtcggctgggcagtag

SEQ ID NO: 826032 - DNA, 20 bp, mouse
gaataataaagacttaaagt

SEQ ID NO: 826033 - DNA, 20 bp, mouse
gataaagacttaaagtcggc

SEQ ID NO: 826034 - DNA, 20 bp, mouse
ggtctctgcttttctgagat

SEQ ID NO: 826035 - DNA, 20 bp, mouse
gcttgttatacacgtcagac

SEQ ID NO: 826036 - DNA, 20 bp, mouse
ggggacctgtcccttgttcc

SEQ ID NO: 826037 - DNA, 20 bp, mouse
ggggcagccaagttggaccc

SEQ ID NO: 826038 - DNA, 20 bp, mouse
gagcgctgcgaggatctagt

SEQ ID NO: 826039 - DNA, 20 bp, mouse
ggcagcgctgctctgctcct

SEQ ID NO: 826040 - DNA, 20 bp, mouse
gcaagcgcgtgagggtcctg

SEQ ID NO: 826041 - DNA, 20 bp, mouse
gtctgcaatgacctcatcgg

SEQ ID NO: 826042 - DNA, 20 bp, mouse
gggagtagagagagcgctcg

SEQ ID NO: 826043 - DNA, 20 bp, mouse
gcttgtggatgtgttgggta

SEQ ID NO: 826044 - DNA, 20 bp, mouse
gagactgcgcgggcagggag

SEQ ID NO: 826045 - DNA, 20 bp, mouse
gtcagagaagggaatactgc

SEQ ID NO: 826046 - DNA, 20 bp, mouse
ggtaaggacgtcagaggcgg

SEQ ID NO: 826047 - DNA, 20 bp, mouse
gtgacccgccccctattgcc

SEQ ID NO: 826048 - DNA, 20 bp, mouse
ggctgtaaggacgtcagagg

SEQ ID NO: 826049 - DNA, 20 bp, mouse
gggcggggacgcagccagct

SEQ ID NO: 826050 - DNA, 20 bp, mouse
ggggaggaaggatggctgta

SEQ ID NO: 826051 - DNA, 20 bp, mouse
gatggctgtaaggacgtcag

SEQ ID NO: 826052 - DNA, 20 bp, mouse
gcctgctctcctggcaatag

SEQ ID NO: 826053 - DNA, 20 bp, mouse
gggtcacatggtggcgagga

SEQ ID NO: 826054 - DNA, 20 bp, mouse
gctctcctggcaataggggg

SEQ ID NO: 826055 - DNA, 20 bp, mouse
gtctctcaggtgataatctc

SEQ ID NO: 826056 - DNA, 20 bp, mouse
gggggcctgggaaggtagat

SEQ ID NO: 826057 - DNA, 20 bp, mouse
ggccccgccccagctcctgg

SEQ ID NO: 826058 - DNA, 20 bp, mouse
gcgctctggaagcctggtga

SEQ ID NO: 826059 - DNA, 20 bp, mouse
ggggcggtgtcacgtgccga

SEQ ID NO: 826060 - DNA, 20 bp, mouse
ggcggggcctagaggggccg

SEQ ID NO: 826061 - DNA, 20 bp, mouse
ggacggtgcgcgaccgtgga

SEQ ID NO: 826062 - DNA, 20 bp, mouse
ggctccggagcaggcggcgc

SEQ ID NO: 826063 - DNA, 20 bp, mouse
gtggtgaaggctggctgctg

SEQ ID NO: 826064 - DNA, 20 bp, mouse
gtgccgacggtgcgcgaccg

SEQ ID NO: 826065 - DNA, 20 bp, mouse
gcggggttgtggatatttcg

SEQ ID NO: 826066 - DNA, 20 bp, mouse
ggcagtggacaaggtggctc

SEQ ID NO: 826067 - DNA, 20 bp, mouse
gctgctctaccctcagtgat

SEQ ID NO: 826068 - DNA, 20 bp, mouse
gtgccagacgctggtgaaga

SEQ ID NO: 826069 - DNA, 20 bp, mouse
gagctctcgaaggacatcag

SEQ ID NO: 826070 - DNA, 20 bp, mouse
gcgggaggggtaggtcctag

SEQ ID NO: 826071 - DNA, 20 bp, mouse
gggaggcgctgctgcaagtc

SEQ ID NO: 826072 - DNA, 20 bp, mouse
ggcggggcgtcgctgtgacc

SEQ ID NO: 826073 - DNA, 20 bp, mouse
gcgtctggcagtggacaagg

SEQ ID NO: 826074 - DNA, 20 bp, mouse
ggcttcctgcggcccctgcc

SEQ ID NO: 826075 - DNA, 20 bp, mouse
ggcaagtccggaaagcggga

SEQ ID NO: 826076 - DNA, 20 bp, mouse
gggcagggcaggttcggtgg

SEQ ID NO: 826077 - DNA, 20 bp, mouse
ggccgccccgagccccgtgg

SEQ ID NO: 826078 - DNA, 20 bp, mouse
gtcggctccgctagggtgtg

SEQ ID NO: 826079 - DNA, 20 bp, mouse
gcagcgtccccacaccctag

SEQ ID NO: 826080 - DNA, 20 bp, mouse
ggtggcggtcggctccgcta

SEQ ID NO: 826081 - DNA, 20 bp, mouse
ggggcaggttcggtggcggt

SEQ ID NO: 826082 - DNA, 20 bp, mouse
gctgggcagggcaggttcgg

SEQ ID NO: 826083 - DNA, 20 bp, mouse
gacccagctggcagccacca

SEQ ID NO: 826084 - DNA, 20 bp, mouse
ggctcggggcggcgcgacgg

SEQ ID NO: 826085 - DNA, 20 bp, mouse
gagggatgatgctacgggct

SEQ ID NO: 826086 - DNA, 20 bp, mouse
gcccacgcaaagcctagcga

SEQ ID NO: 826087 - DNA, 20 bp, mouse
gtcgggcgactgcgaggcgg

SEQ ID NO: 826088 - DNA, 20 bp, mouse
ggttctaggcgcatcgggtg

SEQ ID NO: 826089 - DNA, 20 bp, mouse
gggagtgtatagaggctgaa

SEQ ID NO: 826090 - DNA, 20 bp, mouse
gccggctgtggagtgtatag

SEQ ID NO: 826091 - DNA, 20 bp, mouse
ggaaagccctgctgtcgatc

SEQ ID NO: 826092 - DNA, 20 bp, mouse
gaggggatgggacctcaaag

SEQ ID NO: 826093 - DNA, 20 bp, mouse
gtagctgtgggtctggagtt

SEQ ID NO: 826094 - DNA, 20 bp, mouse
ggtgcccgggtcagcgctgc

SEQ ID NO: 826095 - DNA, 20 bp, mouse
gtgcgcctagaacccggctg

SEQ ID NO: 826096 - DNA, 20 bp, mouse
gcgcgcgtgcggcccctcgg

SEQ ID NO: 826097 - DNA, 20 bp, mouse
gagtcaggacagtccgcgga

SEQ ID NO: 826098 - DNA, 20 bp, mouse
gtgactcaagaacagggtgt

SEQ ID NO: 826099 - DNA, 20 bp, mouse
ggggccgcacgcgcgtgtgc

SEQ ID NO: 826100 - DNA, 20 bp, mouse
gtcagaagttgcaggctggg

SEQ ID NO: 826101 - DNA, 20 bp, mouse
ggctgagaaggggccgcccc

SEQ ID NO: 826102 - DNA, 20 bp, mouse
gctgcagagcgcgcgagcga

SEQ ID NO: 826103 - DNA, 20 bp, mouse
gctgtcctgactcaagaaca

SEQ ID NO: 826104 - DNA, 20 bp, mouse
gcccgcgccggccagcgctg

SEQ ID NO: 826105 - DNA, 20 bp, mouse
gccggcgcgggagtgggaag

SEQ ID NO: 826106 - DNA, 20 bp, mouse
gagccgaggagctgcgacag

SEQ ID NO: 826107 - DNA, 20 bp, mouse
gctaaccttctagttccctc

SEQ ID NO: 826108 - DNA, 20 bp, mouse
gtccagggaggtgcacacta

SEQ ID NO: 826109 - DNA, 20 bp, mouse
ggggatgctaagagtctcaa

SEQ ID NO: 826110 - DNA, 20 bp, mouse
gcggaggtcggtgcaaatag

SEQ ID NO: 826111 - DNA, 20 bp, mouse
gcgaggagctgcgacagggg

SEQ ID NO: 826112 - DNA, 20 bp, mouse
ggggccgcccccttgggatg

SEQ ID NO: 826113 - DNA, 20 bp, mouse
ggcccccttgggatgaggtt

SEQ ID NO: 826114 - DNA, 20 bp, mouse
gaccccagatgaccccggtg

SEQ ID NO: 826115 - DNA, 20 bp, mouse
gggcacgtggccctggaaaa

SEQ ID NO: 826116 - DNA, 20 bp, mouse
gtgccagaaggagggcgagg

SEQ ID NO: 826117 - DNA, 20 bp, mouse
ggacgcaatcctgacgctac

SEQ ID NO: 826118 - DNA, 20 bp, mouse
ggcgtcctgaaacgtatcct

SEQ ID NO: 826119 - DNA, 20 bp, mouse
gaccaattattttaactgtt

SEQ ID NO: 826120 - DNA, 20 bp, mouse
gcatgcatgccatacttatt

SEQ ID NO: 826121 - DNA, 20 bp, mouse
gtacagtgggtcatttgata

SEQ ID NO: 826122 - DNA, 20 bp, mouse
ggtcaggattgcgtcaattc

SEQ ID NO: 826123 - DNA, 20 bp, mouse
gcaaggatgcatattacagt

SEQ ID NO: 826124 - DNA, 20 bp, mouse
ggctgaatcctcaagagagg

SEQ ID NO: 826125 - DNA, 20 bp, mouse
ggcccaacagttaaaataat

SEQ ID NO: 826126 - DNA, 20 bp, mouse
ggcaaggggtcccatgcgat

SEQ ID NO: 826127 - DNA, 20 bp, mouse
gtgttgccaaggcaacggga

SEQ ID NO: 826128 - DNA, 20 bp, mouse
gcggtcgctcagggcaacag

SEQ ID NO: 826129 - DNA, 20 bp, mouse
gtccgggcggtgccggtcca

SEQ ID NO: 826130 - DNA, 20 bp, mouse
gtcccgtggcacagcgagag

SEQ ID NO: 826131 - DNA, 20 bp, mouse
gcgaccgccaggctccaggc

SEQ ID NO: 826132 - DNA, 20 bp, mouse
ggacgcacagaaacgaagtc

SEQ ID NO: 826133 - DNA, 20 bp, mouse
gggtccatgggacccaggtc

SEQ ID NO: 826134 - DNA, 20 bp, mouse
ggtgatctgtgcatctacag

SEQ ID NO: 826135 - DNA, 20 bp, mouse
gcacagaaacgaagtccggg

SEQ ID NO: 826136 - DNA, 20 bp, mouse
gaggggaatggagacgtcct

SEQ ID NO: 826137 - DNA, 20 bp, mouse
ggttcaggatctaggatcca

SEQ ID NO: 826138 - DNA, 20 bp, mouse
gaccctggccaatcgctcct

SEQ ID NO: 826139 - DNA, 20 bp, mouse
gccgcgggatgccacgtgag

SEQ ID NO: 826140 - DNA, 20 bp, mouse
ggcctcggaccgcaagattg

SEQ ID NO: 826141 - DNA, 20 bp, mouse
gcgcagggagagattcgaag

SEQ ID NO: 826142 - DNA, 20 bp, mouse
ggaggggcggggaccctgcg

SEQ ID NO: 826143 - DNA, 20 bp, mouse
ggggatgagcccaagacaca

SEQ ID NO: 826144 - DNA, 20 bp, mouse
gtggcggtgccactgggctt

SEQ ID NO: 826145 - DNA, 20 bp, mouse
gggactggggcggggtaaga

SEQ ID NO: 826146 - DNA, 20 bp, mouse
gtgggccccgcctggaagga

SEQ ID NO: 826147 - DNA, 20 bp, mouse
ggagtcagagggcacctcgg

SEQ ID NO: 826148 - DNA, 20 bp, mouse
gccaccgagcggaaaatctg

SEQ ID NO: 826149 - DNA, 20 bp, mouse
ggggcggcggccgtgccctc

SEQ ID NO: 826150 - DNA, 20 bp, mouse
gtcactgggccccgcctgga

SEQ ID NO: 826151 - DNA, 20 bp, mouse
gccctcgagtagccaccgag

SEQ ID NO: 826152 - DNA, 20 bp, mouse
gtcagagggcacctcggagg

SEQ ID NO: 826153 - DNA, 20 bp, mouse
gggcggcggcggccagtcta

SEQ ID NO: 826154 - DNA, 20 bp, mouse
ggtaaactagacgagcatag

SEQ ID NO: 826155 - DNA, 20 bp, mouse
ggccgcccggagccgccccg

SEQ ID NO: 826156 - DNA, 20 bp, mouse
gggctccagaacattctctg

SEQ ID NO: 826157 - DNA, 20 bp, mouse
ggaactcagcacaaagaggg

SEQ ID NO: 826158 - DNA, 20 bp, mouse
gggtggcagcgaagtcagtc

SEQ ID NO: 826159 - DNA, 20 bp, mouse
gcaagggaataggtccggat

SEQ ID NO: 826160 - DNA, 20 bp, mouse
gttgcacaaaagggggtgat

SEQ ID NO: 826161 - DNA, 20 bp, mouse
gagagggtggaaccctgtaa

SEQ ID NO: 826162 - DNA, 20 bp, mouse
ggaaactcccttgagagcga

SEQ ID NO: 826163 - DNA, 20 bp, mouse
ggggagccccacctaatgac

SEQ ID NO: 826164 - DNA, 20 bp, mouse
gaggtgttcctcaaggctgg

SEQ ID NO: 826165 - DNA, 20 bp, mouse
ggctgggctgacctctgtgc

SEQ ID NO: 826166 - DNA, 20 bp, mouse
gcccgtcccgggtccctacc

SEQ ID NO: 826167 - DNA, 20 bp, mouse
gacctggcgcgcctgctctg

SEQ ID NO: 826168 - DNA, 20 bp, mouse
gcacagcgcagggtccggag

SEQ ID NO: 826169 - DNA, 20 bp, mouse
gcccggcggccgcgagtagc

SEQ ID NO: 826170 - DNA, 20 bp, mouse
ggcaaacctagcatccctca

SEQ ID NO: 826171 - DNA, 20 bp, mouse
gagcggccgcgcccaggatc

SEQ ID NO: 826172 - DNA, 20 bp, mouse
gccggaccctgcgctgtgag

SEQ ID NO: 826173 - DNA, 20 bp, mouse
ggccaggtagggacccggga

SEQ ID NO: 826174 - DNA, 20 bp, mouse
ggcggcgcgcacccctgacc

SEQ ID NO: 826175 - DNA, 20 bp, mouse
gtgcatctgggcggagaaat

SEQ ID NO: 826176 - DNA, 20 bp, mouse
gcagtcgggcccaaccacag

SEQ ID NO: 826177 - DNA, 20 bp, mouse
gaacccagggccagttttgt

SEQ ID NO: 826178 - DNA, 20 bp, mouse
gccacaggggcccacaaaac

SEQ ID NO: 826179 - DNA, 20 bp, mouse
gcgagctagccctgtaggtg

SEQ ID NO: 826180 - DNA, 20 bp, mouse
gtccacagatggaccaacca

SEQ ID NO: 826181 - DNA, 20 bp, mouse
gggccccgagctagccctgt

SEQ ID NO: 826182 - DNA, 20 bp, mouse
gggttctctaacagctgttg

SEQ ID NO: 826183 - DNA, 20 bp, mouse
gcagggcctggtgcaaaacc

SEQ ID NO: 826184 - DNA, 20 bp, mouse
gatagcaaacctcacctaca

SEQ ID NO: 826185 - DNA, 20 bp, mouse
gtttgtgggcccctgtggtt

SEQ ID NO: 826186 - DNA, 20 bp, mouse
gcctctacggtgaagagcta

SEQ ID NO: 826187 - DNA, 20 bp, mouse
gcggggcgggtggatgatca

SEQ ID NO: 826188 - DNA, 20 bp, mouse
gtccagcctcaattcctcta

SEQ ID NO: 826189 - DNA, 20 bp, mouse
ggagcatgcggtcaagagag

SEQ ID NO: 826190 - DNA, 20 bp, mouse
gacagtgggaagcttcccta

SEQ ID NO: 826191 - DNA, 20 bp, mouse
gctacggtgaagagctaggg

SEQ ID NO: 826192 - DNA, 20 bp, mouse
gcaagagaggggccgagccc

SEQ ID NO: 826193 - DNA, 20 bp, mouse
gaactcccctgcaagatcca

SEQ ID NO: 826194 - DNA, 20 bp, mouse
ggatgatcagggtccccata

SEQ ID NO: 826195 - DNA, 20 bp, mouse
gaccgtagaggaattgaggc

SEQ ID NO: 826196 - DNA, 20 bp, mouse
gaggtccctcaaggtagcag

SEQ ID NO: 826197 - DNA, 20 bp, mouse
gaggatgaacaggtctcagg

SEQ ID NO: 826198 - DNA, 20 bp, mouse
ggtgacagcaaggtccctca

SEQ ID NO: 826199 - DNA, 20 bp, mouse
ggagatactgtgtctaagac

SEQ ID NO: 826200 - DNA, 20 bp, mouse
gaggaggctgttgctcaaga

SEQ ID NO: 826201 - DNA, 20 bp, mouse
gtctgctaaagacccaagca

SEQ ID NO: 826202 - DNA, 20 bp, mouse
ggttgctcaagatggtgatg

SEQ ID NO: 826203 - DNA, 20 bp, mouse
gtggtggtgaaagtcttatc

SEQ ID NO: 826204 - DNA, 20 bp, mouse
gacagaccgctgctaccttg

SEQ ID NO: 826205 - DNA, 20 bp, mouse
gagcggtctgtaggatgaac

SEQ ID NO: 826206 - DNA, 20 bp, mouse
gggctctgctgggcgtttgg

SEQ ID NO: 826207 - DNA, 20 bp, mouse
ggggccccttgattcaattg

SEQ ID NO: 826208 - DNA, 20 bp, mouse
gctgggctctgctgggcgtt

SEQ ID NO: 826209 - DNA, 20 bp, mouse
ggaaacccacaattgaatca

SEQ ID NO: 826210 - DNA, 20 bp, mouse
gtcaccaaggacccagacag

SEQ ID NO: 826211 - DNA, 20 bp, mouse
ggaaacacactgggctctgc

SEQ ID NO: 826212 - DNA, 20 bp, mouse
gtctccgctgtctgggtcct

SEQ ID NO: 826213 - DNA, 20 bp, mouse
gacgccaaggagctcacatg

SEQ ID NO: 826214 - DNA, 20 bp, mouse
gaccgtcatgggcatttcca

SEQ ID NO: 826215 - DNA, 20 bp, mouse
gaccctggaaatgcccatga

SEQ ID NO: 826216 - DNA, 20 bp, mouse
gcagaggagggacatccagt

SEQ ID NO: 826217 - DNA, 20 bp, mouse
gaaccaaagccttaaggcac

SEQ ID NO: 826218 - DNA, 20 bp, mouse
gaagatagactagacggaaa

SEQ ID NO: 826219 - DNA, 20 bp, mouse
gtgagcaaagatagactaga

SEQ ID NO: 826220 - DNA, 20 bp, mouse
gaaggggccgcactgagcgc

SEQ ID NO: 826221 - DNA, 20 bp, mouse
gctccagtgccttaaggctt

SEQ ID NO: 826222 - DNA, 20 bp, mouse
gcgcagggctatttgagcag

SEQ ID NO: 826223 - DNA, 20 bp, mouse
gaactctctactgtactagt

SEQ ID NO: 826224 - DNA, 20 bp, mouse
gaggagctggactcttaaag

SEQ ID NO: 826225 - DNA, 20 bp, mouse
gccagctcctccccgctcca

SEQ ID NO: 826226 - DNA, 20 bp, mouse
gaacaggactcaattcctcc

SEQ ID NO: 826227 - DNA, 20 bp, mouse
gtctcaaaaagcttcagaac

SEQ ID NO: 826228 - DNA, 20 bp, mouse
ggttgaacaagtgctatgtg

SEQ ID NO: 826229 - DNA, 20 bp, mouse
gttctacattctgggcccgg

SEQ ID NO: 826230 - DNA, 20 bp, mouse
gtgaaagttgtgtttgagct

SEQ ID NO: 826231 - DNA, 20 bp, mouse
gcttggacactaggttgagc

SEQ ID NO: 826232 - DNA, 20 bp, mouse
gagttttgttgacaagtgct

SEQ ID NO: 826233 - DNA, 20 bp, mouse
gtccaagatgttcaatttaa

SEQ ID NO: 826234 - DNA, 20 bp, mouse
gtttaaagggttttctttca

SEQ ID NO: 826235 - DNA, 20 bp, mouse
gtaataaaaatacacagact

SEQ ID NO: 826236 - DNA, 20 bp, mouse
gaccaggagagcagcgggaa

SEQ ID NO: 826237 - DNA, 20 bp, mouse
ggagcgagagctgtgacgtg

SEQ ID NO: 826238 - DNA, 20 bp, mouse
ggggcccgtgcgcgagcaac

SEQ ID NO: 826239 - DNA, 20 bp, mouse
gggagcgcgcaaagagaact

SEQ ID NO: 826240 - DNA, 20 bp, mouse
ggcacgggccccagaagcgc

SEQ ID NO: 826241 - DNA, 20 bp, mouse
gggccgagccatttggacgg

SEQ ID NO: 826242 - DNA, 20 bp, mouse
ggtgacgtgtggtcgcgacc

SEQ ID NO: 826243 - DNA, 20 bp, mouse
gacggcgactagcaagtggc

SEQ ID NO: 826244 - DNA, 20 bp, mouse
ggatctcgcctgcgcttctg

SEQ ID NO: 826245 - DNA, 20 bp, mouse
gccccgcgccgccggaagtg

SEQ ID NO: 826246 - DNA, 20 bp, mouse
gccctcccccagcccggaag

SEQ ID NO: 826247 - DNA, 20 bp, mouse
ggagggcagggaagtcagat

SEQ ID NO: 826248 - DNA, 20 bp, mouse
gtggtctgccatcttggaag

SEQ ID NO: 826249 - DNA, 20 bp, mouse
gctggccgggcgcctcttcc

SEQ ID NO: 826250 - DNA, 20 bp, mouse
gttgacctcatgaaagatgg

SEQ ID NO: 826251 - DNA, 20 bp, mouse
gcacgcagggctttcctcaa

SEQ ID NO: 826252 - DNA, 20 bp, mouse
gctcgcctggtctgccatct

SEQ ID NO: 826253 - DNA, 20 bp, mouse
ggggcgcctcttccgggctg

SEQ ID NO: 826254 - DNA, 20 bp, mouse
ggtattgacctcatgaaaga

SEQ ID NO: 826255 - DNA, 20 bp, mouse
gtggaaccatcgtttcttaa

SEQ ID NO: 826256 - DNA, 20 bp, mouse
gcgctggcgggagggtgatt

SEQ ID NO: 826257 - DNA, 20 bp, mouse
ggagttggggctgtgagcgg

SEQ ID NO: 826258 - DNA, 20 bp, mouse
ggctcacagccccaactccc

SEQ ID NO: 826259 - DNA, 20 bp, mouse
gcgggagggtgattgggctg

SEQ ID NO: 826260 - DNA, 20 bp, mouse
gcccgctgatgtgagaaggt

SEQ ID NO: 826261 - DNA, 20 bp, mouse
gtgaggacaccggggagttg

SEQ ID NO: 826262 - DNA, 20 bp, mouse
gccgtgcgagaaaccggaaa

SEQ ID NO: 826263 - DNA, 20 bp, mouse
gcctcccgccagcggctata

SEQ ID NO: 826264 - DNA, 20 bp, mouse
gcagctggcctcgctctctc

SEQ ID NO: 826265 - DNA, 20 bp, mouse
ggcaggaaccggaagttgtt

SEQ ID NO: 826266 - DNA, 20 bp, mouse
ggaggctgggggccaacaat

SEQ ID NO: 826267 - DNA, 20 bp, mouse
gccagcgcgcgcttcctgta

SEQ ID NO: 826268 - DNA, 20 bp, mouse
gcagctgctcggtacttcaa

SEQ ID NO: 826269 - DNA, 20 bp, mouse
gcccccctgcgaggccacct

SEQ ID NO: 826270 - DNA, 20 bp, mouse
ggcgcgctggagcccattgt

SEQ ID NO: 826271 - DNA, 20 bp, mouse
gcacctgagagggacttcgg

SEQ ID NO: 826272 - DNA, 20 bp, mouse
gaaagcggcggggcggaccc

SEQ ID NO: 826273 - DNA, 20 bp, mouse
gggagtggagagtttagcag

SEQ ID NO: 826274 - DNA, 20 bp, mouse
gacagccgaggtggcctcgc

SEQ ID NO: 826275 - DNA, 20 bp, mouse
gttcctgtaaggaaagcgtc

SEQ ID NO: 826276 - DNA, 20 bp, mouse
gggcgagccggtccccgcag

SEQ ID NO: 826277 - DNA, 20 bp, mouse
gggcggggtcggagagcggt

SEQ ID NO: 826278 - DNA, 20 bp, mouse
ggaggccggaacatggagga

SEQ ID NO: 826279 - DNA, 20 bp, mouse
ggggtctttccgagtgggga

SEQ ID NO: 826280 - DNA, 20 bp, mouse
gttgtctggccccggagcct

SEQ ID NO: 826281 - DNA, 20 bp, mouse
gcggtccccgcaggggtttg

SEQ ID NO: 826282 - DNA, 20 bp, mouse
gcgggtggcgggcgagcgaa

SEQ ID NO: 826283 - DNA, 20 bp, mouse
gcacgggcaaaggcgggtgg

SEQ ID NO: 826284 - DNA, 20 bp, mouse
ggcagcgcgttgtctggccc

SEQ ID NO: 826285 - DNA, 20 bp, mouse
gaaggacgcgcgaggagcag

SEQ ID NO: 826286 - DNA, 20 bp, mouse
gtggtgaagagtatctgctt

SEQ ID NO: 826287 - DNA, 20 bp, mouse
gatactcttcaccaagaatg

SEQ ID NO: 826288 - DNA, 20 bp, mouse
gtccaactaggtattaaaca

SEQ ID NO: 826289 - DNA, 20 bp, mouse
ggggaatagactttgtctga

SEQ ID NO: 826290 - DNA, 20 bp, mouse
ggactgagttagttgctgac

SEQ ID NO: 826291 - DNA, 20 bp, mouse
gtcagagttacctgagcaga

SEQ ID NO: 826292 - DNA, 20 bp, mouse
ggacgttgatagagtattga

SEQ ID NO: 826293 - DNA, 20 bp, mouse
gtggtaatacaatagtaagt

SEQ ID NO: 826294 - DNA, 20 bp, mouse
gtaccatatttccacattct

SEQ ID NO: 826295 - DNA, 20 bp, mouse
gacaaagtctattcccttga

SEQ ID NO: 826296 - DNA, 20 bp, mouse
gactacccctctgtcctttt

SEQ ID NO: 826297 - DNA, 20 bp, mouse
ggaactccttcagttatcgg

SEQ ID NO: 826298 - DNA, 20 bp, mouse
gaagggcattggatgtgtgc

SEQ ID NO: 826299 - DNA, 20 bp, mouse
gagagcattcagtgtgccgg

SEQ ID NO: 826300 - DNA, 20 bp, mouse
gttcagcgttagcattcaca

SEQ ID NO: 826301 - DNA, 20 bp, mouse
gttaaacttcagaatgacca

SEQ ID NO: 826302 - DNA, 20 bp, mouse
gctgcaccctagccaaatac

SEQ ID NO: 826303 - DNA, 20 bp, mouse
gcaattggtctcaagggcat

SEQ ID NO: 826304 - DNA, 20 bp, mouse
ggagagcctccgataactga

SEQ ID NO: 826305 - DNA, 20 bp, mouse
gtaaaacagctagcctgtaa

SEQ ID NO: 826306 - DNA, 20 bp, mouse
gcaatatagcagagtgaagg

SEQ ID NO: 826307 - DNA, 20 bp, mouse
ggagttcaattccaagtaac

SEQ ID NO: 826308 - DNA, 20 bp, mouse
gtattctattcttcatgtat

SEQ ID NO: 826309 - DNA, 20 bp, mouse
gaagcaatatagcagagtga

SEQ ID NO: 826310 - DNA, 20 bp, mouse
ggaggtgacttccggttact

SEQ ID NO: 826311 - DNA, 20 bp, mouse
gaatttaaaaattcagaact

SEQ ID NO: 826312 - DNA, 20 bp, mouse
gttgaacatgaatgtactcc

SEQ ID NO: 826313 - DNA, 20 bp, mouse
gggtatttagtgtgaattta

SEQ ID NO: 826314 - DNA, 20 bp, mouse
gtgcagaaaataagcacagt

SEQ ID NO: 826315 - DNA, 20 bp, mouse
gctttatttttgtagtgaac

SEQ ID NO: 826316 - DNA, 20 bp, mouse
gcatatgcacacgaagtgtg

SEQ ID NO: 826317 - DNA, 20 bp, mouse
gaaacgaattctggtcagta

SEQ ID NO: 826318 - DNA, 20 bp, mouse
ggtgtgggggaaacgaattc

SEQ ID NO: 826319 - DNA, 20 bp, mouse
gagatctacgcaaggttcaa

SEQ ID NO: 826320 - DNA, 20 bp, mouse
gtgccctgccaatgatttta

SEQ ID NO: 826321 - DNA, 20 bp, mouse
ggggtaacagtatcaatctg

SEQ ID NO: 826322 - DNA, 20 bp, mouse
gattgtaggaatgccgactt

SEQ ID NO: 826323 - DNA, 20 bp, mouse
gtcctctctcaagagattgt

SEQ ID NO: 826324 - DNA, 20 bp, mouse
gtcagtctcagatctacgca

SEQ ID NO: 826325 - DNA, 20 bp, mouse
gtgacattgcattcctaagt

SEQ ID NO: 826326 - DNA, 20 bp, mouse
gaagtgcatcgctggagaac

SEQ ID NO: 826327 - DNA, 20 bp, mouse
gatagaccggccagcagtgt

SEQ ID NO: 826328 - DNA, 20 bp, mouse
gctggccggtctatcacaca

SEQ ID NO: 826329 - DNA, 20 bp, mouse
gtgaaaatcaagtgcatcgc

SEQ ID NO: 826330 - DNA, 20 bp, mouse
gctgactggtccctgagtac

SEQ ID NO: 826331 - DNA, 20 bp, mouse
gaaagggtgatggaactgac

SEQ ID NO: 826332 - DNA, 20 bp, mouse
gaagacacacttccctttga

SEQ ID NO: 826333 - DNA, 20 bp, mouse
gagagccttgtgtgatagac

SEQ ID NO: 826334 - DNA, 20 bp, mouse
gtcacacaatgagatagaag

SEQ ID NO: 826335 - DNA, 20 bp, mouse
gggcaagagtcttatcaaga

SEQ ID NO: 826336 - DNA, 20 bp, mouse
gctctgtcatcctgttggat

SEQ ID NO: 826337 - DNA, 20 bp, mouse
ggaccataggagcatttatt

SEQ ID NO: 826338 - DNA, 20 bp, mouse
ggagttggagggtcacctgt

SEQ ID NO: 826339 - DNA, 20 bp, mouse
gacaatcttctaatattctc

SEQ ID NO: 826340 - DNA, 20 bp, mouse
gaacccaataaatgctccta

SEQ ID NO: 826341 - DNA, 20 bp, mouse
gtgttcttttggcagcagtc

SEQ ID NO: 826342 - DNA, 20 bp, mouse
gtcaatactgtaaggagaag

SEQ ID NO: 826343 - DNA, 20 bp, mouse
gtgctgccaaaagaacacag

SEQ ID NO: 826344 - DNA, 20 bp, mouse
ggagaaccgaattcaattac

SEQ ID NO: 826345 - DNA, 20 bp, mouse
gctaaatagacatcaccgaa

SEQ ID NO: 826346 - DNA, 20 bp, mouse
gtaacatggtgtataacaat

SEQ ID NO: 826347 - DNA, 20 bp, mouse
ggacgacttaagccttagag

SEQ ID NO: 826348 - DNA, 20 bp, mouse
ggtacaaattaagtttatct

SEQ ID NO: 826349 - DNA, 20 bp, mouse
gaacaaacgcctgtcttcca

SEQ ID NO: 826350 - DNA, 20 bp, mouse
gatcacacaacagagcaccg

SEQ ID NO: 826351 - DNA, 20 bp, mouse
gaattattttagccatgctt

SEQ ID NO: 826352 - DNA, 20 bp, mouse
ggtgtgctttgggcattcct

SEQ ID NO: 826353 - DNA, 20 bp, mouse
gtacccaactttacagaccc

SEQ ID NO: 826354 - DNA, 20 bp, mouse
ggccctgaagattgaatccc

SEQ ID NO: 826355 - DNA, 20 bp, mouse
gcaaagcacacctcccccgc

SEQ ID NO: 826356 - DNA, 20 bp, mouse
ggtgcttggggcattaatgt

SEQ ID NO: 826357 - DNA, 20 bp, mouse
gtgtacggtgaggcaagtga

SEQ ID NO: 826358 - DNA, 20 bp, mouse
gccaagcacccctaaccctc

SEQ ID NO: 826359 - DNA, 20 bp, mouse
gtcttcgtcttgtgttaaga

SEQ ID NO: 826360 - DNA, 20 bp, mouse
gggtgctttcctgagggtta

SEQ ID NO: 826361 - DNA, 20 bp, mouse
gttgcctcaccgtacaccgt

SEQ ID NO: 826362 - DNA, 20 bp, mouse
gacacagaaaagtcagttgt

SEQ ID NO: 826363 - DNA, 20 bp, mouse
gatgcagcctttatataata

SEQ ID NO: 826364 - DNA, 20 bp, mouse
gactgaatccccacggtgta

SEQ ID NO: 826365 - DNA, 20 bp, mouse
gccgtggggattcagtccta

SEQ ID NO: 826366 - DNA, 20 bp, mouse
gggggtattaaggttaaata

SEQ ID NO: 826367 - DNA, 20 bp, mouse
gaaagagccttcatggaatt

SEQ ID NO: 826368 - DNA, 20 bp, mouse
gcattaggacactttcctgg

SEQ ID NO: 826369 - DNA, 20 bp, mouse
gaagagtgcttggggtatta

SEQ ID NO: 826370 - DNA, 20 bp, mouse
gtatctcacctcacaccatt

SEQ ID NO: 826371 - DNA, 20 bp, mouse
gctgggggtaaagagtgctt

SEQ ID NO: 826372 - DNA, 20 bp, mouse
gacctcacaccattgggatt

SEQ ID NO: 826373 - DNA, 20 bp, mouse
gccacctacattatacagaa

SEQ ID NO: 826374 - DNA, 20 bp, mouse
gtctagggacaacctgtatt

SEQ ID NO: 826375 - DNA, 20 bp, mouse
ggtcaccatccaattagcag

SEQ ID NO: 826376 - DNA, 20 bp, mouse
ggcattagtaggcttatggt

SEQ ID NO: 826377 - DNA, 20 bp, mouse
gtatggcattagtaggctta

SEQ ID NO: 826378 - DNA, 20 bp, mouse
gggcactagcaaattggcag

SEQ ID NO: 826379 - DNA, 20 bp, mouse
gtctaggtaaagttccagta

SEQ ID NO: 826380 - DNA, 20 bp, mouse
ggcaggggacaatttcgctg

SEQ ID NO: 826381 - DNA, 20 bp, mouse
gaccatggggatttagagct

SEQ ID NO: 826382 - DNA, 20 bp, mouse
ggagtgcttatggcattagt

SEQ ID NO: 826383 - DNA, 20 bp, mouse
gtcacctaacctgataccat

SEQ ID NO: 826384 - DNA, 20 bp, mouse
ggactgagtatgataatgac

SEQ ID NO: 826385 - DNA, 20 bp, mouse
ggtcaacggcactagcaaat

SEQ ID NO: 826386 - DNA, 20 bp, mouse
gccaagcattcctaaccctc

SEQ ID NO: 826387 - DNA, 20 bp, mouse
gaccatggggattcactcct

SEQ ID NO: 826388 - DNA, 20 bp, mouse
gccaaatacagtgtgttcct

SEQ ID NO: 826389 - DNA, 20 bp, mouse
gagtcttcttgtcattagga

SEQ ID NO: 826390 - DNA, 20 bp, mouse
gactgtatttggcatcacta

SEQ ID NO: 826391 - DNA, 20 bp, mouse
gcactagggaggttttcctg

SEQ ID NO: 826392 - DNA, 20 bp, mouse
gggaaggtatactgtgaatt

SEQ ID NO: 826393 - DNA, 20 bp, mouse
gggaggttttcctgagggtt

SEQ ID NO: 826394 - DNA, 20 bp, mouse
gcattgtagcaaattagcag

SEQ ID NO: 826395 - DNA, 20 bp, mouse
gtgtgcatctcagaatacac

SEQ ID NO: 826396 - DNA, 20 bp, mouse
gtgggaaaattgattttctg

SEQ ID NO: 826397 - DNA, 20 bp, mouse
ggagcctacagcagatggag

SEQ ID NO: 826398 - DNA, 20 bp, mouse
gactgtagggactcctcatg

SEQ ID NO: 826399 - DNA, 20 bp, mouse
gcaaaaaggatttataaccg

SEQ ID NO: 826400 - DNA, 20 bp, mouse
gatgtggagcctacagcaga

SEQ ID NO: 826401 - DNA, 20 bp, mouse
gtaattgtgtgaccatcaat

SEQ ID NO: 826402 - DNA, 20 bp, mouse
gaaaagatgatgacttataa

SEQ ID NO: 826403 - DNA, 20 bp, mouse
gtattaaaatcaatttgcct

SEQ ID NO: 826404 - DNA, 20 bp, mouse
gcttataatggcacattcaa

SEQ ID NO: 826405 - DNA, 20 bp, mouse
gaatccactccatctgctgt

SEQ ID NO: 826406 - DNA, 20 bp, mouse
ggtggctccccaaacatcag

SEQ ID NO: 826407 - DNA, 20 bp, mouse
gattcaggtaatatgttttc

SEQ ID NO: 826408 - DNA, 20 bp, mouse
gaatctactgtcagttattc

SEQ ID NO: 826409 - DNA, 20 bp, mouse
gataatggcttgtaataaaa

SEQ ID NO: 826410 - DNA, 20 bp, mouse
gggccttgaaacactattaa

SEQ ID NO: 826411 - DNA, 20 bp, mouse
gtacagtgattggagtggat

SEQ ID NO: 826412 - DNA, 20 bp, mouse
gaagtttacagtgattggag

SEQ ID NO: 826413 - DNA, 20 bp, mouse
gcacctttaatagtgtttca

SEQ ID NO: 826414 - DNA, 20 bp, mouse
gcattgctaatttgttcaat

SEQ ID NO: 826415 - DNA, 20 bp, mouse
ggatgaatccctacagtctg

SEQ ID NO: 826416 - DNA, 20 bp, mouse
gagtataatggtacattcaa

SEQ ID NO: 826417 - DNA, 20 bp, mouse
gtaattaacaacagtgattg

SEQ ID NO: 826418 - DNA, 20 bp, mouse
gtactgtaaagttcacatga

SEQ ID NO: 826419 - DNA, 20 bp, mouse
gaactttacagtagatggag

SEQ ID NO: 826420 - DNA, 20 bp, mouse
gatgtgaactttacagtaga

SEQ ID NO: 826421 - DNA, 20 bp, mouse
gagatgatgacatagtataa

SEQ ID NO: 826422 - DNA, 20 bp, mouse
gagagtagtcaaaaaattct

SEQ ID NO: 826423 - DNA, 20 bp, mouse
ggtcaaaaaattcttggttc

SEQ ID NO: 826424 - DNA, 20 bp, mouse
ggagggatccctacagtgta

SEQ ID NO: 826425 - DNA, 20 bp, mouse
gtgatgtttaacatagttat

SEQ ID NO: 826426 - DNA, 20 bp, mouse
gtatcacagagcttcagtcg

SEQ ID NO: 826427 - DNA, 20 bp, mouse
gacaaaaaacacgtagtaaa

SEQ ID NO: 826428 - DNA, 20 bp, mouse
gctttcccaaaagtgctcta

SEQ ID NO: 826429 - DNA, 20 bp, mouse
gcaacaacttaaaaatctcc

SEQ ID NO: 826430 - DNA, 20 bp, mouse
gtgagggtgggaccatgtct

SEQ ID NO: 826431 - DNA, 20 bp, mouse
gttttgggaaagagtaaaat

SEQ ID NO: 826432 - DNA, 20 bp, mouse
ggatttttaagttgttgtac

SEQ ID NO: 826433 - DNA, 20 bp, mouse
gagaactctatttaaagtaa

SEQ ID NO: 826434 - DNA, 20 bp, mouse
gtttttctttatgtttcccc

SEQ ID NO: 826435 - DNA, 20 bp, mouse
gggaaaggctccttgagggt

SEQ ID NO: 826436 - DNA, 20 bp, mouse
gaaagtaggctgatggggtt

SEQ ID NO: 826437 - DNA, 20 bp, mouse
gtcgaagaaagtaggctgat

SEQ ID NO: 826438 - DNA, 20 bp, mouse
gagcggaggaggcgcagcag

SEQ ID NO: 826439 - DNA, 20 bp, mouse
gcacagcgcccccggcggag

SEQ ID NO: 826440 - DNA, 20 bp, mouse
ggaggcgccttgagcaagcg

SEQ ID NO: 826441 - DNA, 20 bp, mouse
gcaagagccgcgcttgctca

SEQ ID NO: 826442 - DNA, 20 bp, mouse
gtctcggagtggcgggatga

SEQ ID NO: 826443 - DNA, 20 bp, mouse
ggcgggatgaggggctagag

SEQ ID NO: 826444 - DNA, 20 bp, mouse
ggatctcaggatctccatcg

SEQ ID NO: 826445 - DNA, 20 bp, mouse
gagcttatccacagcgcccc

SEQ ID NO: 826446 - DNA, 20 bp, mouse
ggagccgggagtggggacgg

SEQ ID NO: 826447 - DNA, 20 bp, mouse
gacgctcggacggggaggga

SEQ ID NO: 826448 - DNA, 20 bp, mouse
gacggcggctggcggaggtg

SEQ ID NO: 826449 - DNA, 20 bp, mouse
ggacgcgtcccctccggcca

SEQ ID NO: 826450 - DNA, 20 bp, mouse
gggtccctcacgctcggacg

SEQ ID NO: 826451 - DNA, 20 bp, mouse
gccctcacgctcggacgggg

SEQ ID NO: 826452 - DNA, 20 bp, mouse
gcgccgggacgcgtcccctc

SEQ ID NO: 826453 - DNA, 20 bp, mouse
gcacgcgggtccctcacgct

SEQ ID NO: 826454 - DNA, 20 bp, mouse
gccacggcgagccgggagtg

SEQ ID NO: 826455 - DNA, 20 bp, mouse
ggcgcggcccggctccaagg

SEQ ID NO: 826456 - DNA, 20 bp, mouse
gccgccctctggttcccgtg

SEQ ID NO: 826457 - DNA, 20 bp, mouse
gcacaaagatggcaccgccc

SEQ ID NO: 826458 - DNA, 20 bp, mouse
gcgctcgccagacacaaaga

SEQ ID NO: 826459 - DNA, 20 bp, mouse
gcctgggcgagccctcgcgg

SEQ ID NO: 826460 - DNA, 20 bp, mouse
ggcggggcccagctcggacc

SEQ ID NO: 826461 - DNA, 20 bp, mouse
gaatacgaggcgggcttcag

SEQ ID NO: 826462 - DNA, 20 bp, mouse
gccgacggaagccctgaagc

SEQ ID NO: 826463 - DNA, 20 bp, mouse
ggcggtgccatctttgtgtc

SEQ ID NO: 826464 - DNA, 20 bp, mouse
gagaacccacggtctcgcgc

SEQ ID NO: 826465 - DNA, 20 bp, mouse
gagatcgcttacagcaggcc

SEQ ID NO: 826466 - DNA, 20 bp, mouse
gttccgagacggtaacccgt

SEQ ID NO: 826467 - DNA, 20 bp, mouse
gtcacgcaagcgaaaggcga

SEQ ID NO: 826468 - DNA, 20 bp, mouse
gcgtcggagtccataacatc

SEQ ID NO: 826469 - DNA, 20 bp, mouse
ggaaccttgttcggaagaag

SEQ ID NO: 826470 - DNA, 20 bp, mouse
ggaaaagttcccaaagtccg

SEQ ID NO: 826471 - DNA, 20 bp, mouse
gtcccctcttcttccgaaca

SEQ ID NO: 826472 - DNA, 20 bp, mouse
gtgatgtagagtttccgaga

SEQ ID NO: 826473 - DNA, 20 bp, mouse
gttgagcagaaagtcgcgtg

SEQ ID NO: 826474 - DNA, 20 bp, mouse
gtctacatcacgcaagcgaa

SEQ ID NO: 826475 - DNA, 20 bp, mouse
gctccgacgggttaccgtct

SEQ ID NO: 826476 - DNA, 20 bp, mouse
gcctccagccaccctgggat

SEQ ID NO: 826477 - DNA, 20 bp, mouse
gacaacctcagcttactgct

SEQ ID NO: 826478 - DNA, 20 bp, mouse
gctggtaggggagaaaatgc

SEQ ID NO: 826479 - DNA, 20 bp, mouse
ggctgagagtcaccaatccc

SEQ ID NO: 826480 - DNA, 20 bp, mouse
gttggctgcctctggaaagt

SEQ ID NO: 826481 - DNA, 20 bp, mouse
gttgggggagtcaaggggag

SEQ ID NO: 826482 - DNA, 20 bp, mouse
gagtcccagctccctgataa

SEQ ID NO: 826483 - DNA, 20 bp, mouse
gagaggggctgatgagttat

SEQ ID NO: 826484 - DNA, 20 bp, mouse
gagggtttgggggagtcaag

SEQ ID NO: 826485 - DNA, 20 bp, mouse
gcctctggaaagtgggctgc

SEQ ID NO: 826486 - DNA, 20 bp, mouse
gaggagggaactctgccaaa

SEQ ID NO: 826487 - DNA, 20 bp, mouse
ggggaagagagagggcggta

SEQ ID NO: 826488 - DNA, 20 bp, mouse
gtgcacaatggcacagtatg

SEQ ID NO: 826489 - DNA, 20 bp, mouse
gtggaggttacagcttgcca

SEQ ID NO: 826490 - DNA, 20 bp, mouse
gaaatgttggggtggcaatg

SEQ ID NO: 826491 - DNA, 20 bp, mouse
gtggcacagtatgtgggacc

SEQ ID NO: 826492 - DNA, 20 bp, mouse
gggtggcaatggggaggtct

SEQ ID NO: 826493 - DNA, 20 bp, mouse
ggtcccatgaagcagtgcaa

SEQ ID NO: 826494 - DNA, 20 bp, mouse
gccagggatgacaaccccca

SEQ ID NO: 826495 - DNA, 20 bp, mouse
gtcactggctctatcagcca

SEQ ID NO: 826496 - DNA, 20 bp, mouse
gcacgctcggaaatggacgg

SEQ ID NO: 826497 - DNA, 20 bp, mouse
ggcaggaaacacagataaaa

SEQ ID NO: 826498 - DNA, 20 bp, mouse
ggcgcgcacacgctcggaaa

SEQ ID NO: 826499 - DNA, 20 bp, mouse
gggcgcggatcccgcgggga

SEQ ID NO: 826500 - DNA, 20 bp, mouse
gcaggggcgcggctccgcgg

SEQ ID NO: 826501 - DNA, 20 bp, mouse
gagcccagcgacgcggagca

SEQ ID NO: 826502 - DNA, 20 bp, mouse
ggggaagaggaacagcgccg

SEQ ID NO: 826503 - DNA, 20 bp, mouse
gccagtagttcggtccgagg

SEQ ID NO: 826504 - DNA, 20 bp, mouse
ggcacacgctcggaaatgga

SEQ ID NO: 826505 - DNA, 20 bp, mouse
ggctcggaaatggacggcgg

SEQ ID NO: 826506 - DNA, 20 bp, mouse
gctccggaaactgctgggag

SEQ ID NO: 826507 - DNA, 20 bp, mouse
gcgtggagctgcccgaaagg

SEQ ID NO: 826508 - DNA, 20 bp, mouse
gcaggcgtcaggccgcttgg

SEQ ID NO: 826509 - DNA, 20 bp, mouse
gggcttagtgtgtgagtaga

SEQ ID NO: 826510 - DNA, 20 bp, mouse
ggcgtcaggccgcttggtgg

SEQ ID NO: 826511 - DNA, 20 bp, mouse
gaacacagaggctgaaccgg

SEQ ID NO: 826512 - DNA, 20 bp, mouse
gtgagcgtggccgatacgcg

SEQ ID NO: 826513 - DNA, 20 bp, mouse
ggcagtgtgagcccaagcac

SEQ ID NO: 826514 - DNA, 20 bp, mouse
gacgcgtggagctgcccgaa

SEQ ID NO: 826515 - DNA, 20 bp, mouse
gtccgacctcgccagtgctt

SEQ ID NO: 826516 - DNA, 20 bp, mouse
ggctacttggcatttgcggt

SEQ ID NO: 826517 - DNA, 20 bp, mouse
gagaagctgcagccaaccct

SEQ ID NO: 826518 - DNA, 20 bp, mouse
ggttggctgcagcttctgaa

SEQ ID NO: 826519 - DNA, 20 bp, mouse
gcctgggagcgctgtacccc

SEQ ID NO: 826520 - DNA, 20 bp, mouse
gctgcagccaaccctgggcg

SEQ ID NO: 826521 - DNA, 20 bp, mouse
gcccctcggcagcttcatat

SEQ ID NO: 826522 - DNA, 20 bp, mouse
ggaaaacaccagcccgtatt

SEQ ID NO: 826523 - DNA, 20 bp, mouse
gttcactccccgcccagggt

SEQ ID NO: 826524 - DNA, 20 bp, mouse
gccgtattgggaaagatgtc

SEQ ID NO: 826525 - DNA, 20 bp, mouse
gattgggaaagatgtctgga

SEQ ID NO: 826526 - DNA, 20 bp, mouse
gaagaagggcgggaccagta

SEQ ID NO: 826527 - DNA, 20 bp, mouse
gaactgtggtctagcatcgg

SEQ ID NO: 826528 - DNA, 20 bp, mouse
gtgggagcgttggggcgtat

SEQ ID NO: 826529 - DNA, 20 bp, mouse
ggggaactgtggtctagcat

SEQ ID NO: 826530 - DNA, 20 bp, mouse
gctagcatcgggggccgaga

SEQ ID NO: 826531 - DNA, 20 bp, mouse
gactccctgcgcaagaaggg

SEQ ID NO: 826532 - DNA, 20 bp, mouse
ggcccagaaaatctcatggt

SEQ ID NO: 826533 - DNA, 20 bp, mouse
gttggggcgtatgggaactg

SEQ ID NO: 826534 - DNA, 20 bp, mouse
gggaactccctgcgcaagaa

SEQ ID NO: 826535 - DNA, 20 bp, mouse
gaatcagcgcgttggagaag

SEQ ID NO: 826536 - DNA, 20 bp, mouse
gtcagtcacctgaatctctc

SEQ ID NO: 826537 - DNA, 20 bp, mouse
gtgggcaaatcgcttctcgt

SEQ ID NO: 826538 - DNA, 20 bp, mouse
gcaccttcccggagagattc

SEQ ID NO: 826539 - DNA, 20 bp, mouse
gcgtcactcctggcaggggc

SEQ ID NO: 826540 - DNA, 20 bp, mouse
gagcaaccgggagcaaagaa

SEQ ID NO: 826541 - DNA, 20 bp, mouse
ggttgcgtcactcctggcag

SEQ ID NO: 826542 - DNA, 20 bp, mouse
gaacgagtaccgcgaggcag

SEQ ID NO: 826543 - DNA, 20 bp, mouse
gtggacttgctcagttagga

SEQ ID NO: 826544 - DNA, 20 bp, mouse
gttcccggattctgcaaagt

SEQ ID NO: 826545 - DNA, 20 bp, mouse
gaaacgacagatcaccttcc

SEQ ID NO: 826546 - DNA, 20 bp, mouse
gcctgcagaacgcccacagc

SEQ ID NO: 826547 - DNA, 20 bp, mouse
gtggaatcgcggtcatacca

SEQ ID NO: 826548 - DNA, 20 bp, mouse
ggcggagtgctggattcgtc

SEQ ID NO: 826549 - DNA, 20 bp, mouse
gactccgcgagggggcgaca

SEQ ID NO: 826550 - DNA, 20 bp, mouse
gccaccttgtcgccccctcg

SEQ ID NO: 826551 - DNA, 20 bp, mouse
ggcagagacgtcacggggaa

SEQ ID NO: 826552 - DNA, 20 bp, mouse
gtcgccccctcgcggagtgc

SEQ ID NO: 826553 - DNA, 20 bp, mouse
ggcagaaggcgtggtggctg

SEQ ID NO: 826554 - DNA, 20 bp, mouse
ggcaggtcacgagcagcaga

SEQ ID NO: 826555 - DNA, 20 bp, mouse
gaacagagctaggtgtctgg

SEQ ID NO: 826556 - DNA, 20 bp, mouse
gagcgaggcacagtgtgggt

SEQ ID NO: 826557 - DNA, 20 bp, mouse
gtgggtgggggtggcctaga

SEQ ID NO: 826558 - DNA, 20 bp, mouse
gtggggagcgaggcacagtg

SEQ ID NO: 826559 - DNA, 20 bp, mouse
ggggaacgagggactcgggc

SEQ ID NO: 826560 - DNA, 20 bp, mouse
gctcccagctcctccctgaa

SEQ ID NO: 826561 - DNA, 20 bp, mouse
gcaggcaagggccttggcag

SEQ ID NO: 826562 - DNA, 20 bp, mouse
gggcccagccatccaagcag

SEQ ID NO: 826563 - DNA, 20 bp, mouse
gcttccaccccctgcttgga

SEQ ID NO: 826564 - DNA, 20 bp, mouse
gggagagaccttggggagcg

SEQ ID NO: 826565 - DNA, 20 bp, mouse
gtgcaaatacgcaaatactg

SEQ ID NO: 826566 - DNA, 20 bp, mouse
gagggatgaaacccagagtg

SEQ ID NO: 826567 - DNA, 20 bp, mouse
gacgtcgcgggttgcaagac

SEQ ID NO: 826568 - DNA, 20 bp, mouse
gcacggaagctggggactcc

SEQ ID NO: 826569 - DNA, 20 bp, mouse
gagagaagcaggagcttgct

SEQ ID NO: 826570 - DNA, 20 bp, mouse
gaagcaggagcttgctgggt

SEQ ID NO: 826571 - DNA, 20 bp, mouse
gagctgacagctgacagcac

SEQ ID NO: 826572 - DNA, 20 bp, mouse
gtcgcgggttgcaagactgg

SEQ ID NO: 826573 - DNA, 20 bp, mouse
gcgcgacgtcacggaagctg

SEQ ID NO: 826574 - DNA, 20 bp, mouse
gtgttcactagggagagcta

SEQ ID NO: 826575 - DNA, 20 bp, mouse
gcagaaagactgtgattcca

SEQ ID NO: 826576 - DNA, 20 bp, mouse
gggtgcggccaggtaagtac

SEQ ID NO: 826577 - DNA, 20 bp, mouse
ggggctgccggcttcttccg

SEQ ID NO: 826578 - DNA, 20 bp, mouse
gtggttctgagctatgagga

SEQ ID NO: 826579 - DNA, 20 bp, mouse
gtatggggtctggaattgta

SEQ ID NO: 826580 - DNA, 20 bp, mouse
gtccgcgggacctgggaata

SEQ ID NO: 826581 - DNA, 20 bp, mouse
ggctgaccaaaaccccatag

SEQ ID NO: 826582 - DNA, 20 bp, mouse
ggccctggttctgagctatg

SEQ ID NO: 826583 - DNA, 20 bp, mouse
gtaggaaaggtgggacgccc

SEQ ID NO: 826584 - DNA, 20 bp, mouse
gtccctattcccaggtcccg

SEQ ID NO: 826585 - DNA, 20 bp, mouse
ggaggtgcactaggaaaggt

SEQ ID NO: 826586 - DNA, 20 bp, mouse
ggccccgcccccatccgcta

SEQ ID NO: 826587 - DNA, 20 bp, mouse
gcgctagggagacgttgcgt

SEQ ID NO: 826588 - DNA, 20 bp, mouse
gaagaggcgggagttggcga

SEQ ID NO: 826589 - DNA, 20 bp, mouse
ggcaacgtctccctagcgga

SEQ ID NO: 826590 - DNA, 20 bp, mouse
ggggccgcgcggtctacggt

SEQ ID NO: 826591 - DNA, 20 bp, mouse
gcctgcgcgccggacgctgg

SEQ ID NO: 826592 - DNA, 20 bp, mouse
gtctccctagcggatggggg

SEQ ID NO: 826593 - DNA, 20 bp, mouse
ggggcaggcgggcgtaggtt

SEQ ID NO: 826594 - DNA, 20 bp, mouse
gcgcgcccaccaggggaagc

SEQ ID NO: 826595 - DNA, 20 bp, mouse
gggtcacgtgagccaagagg

SEQ ID NO: 826596 - DNA, 20 bp, mouse
gggcccggtggcatgtgcta

SEQ ID NO: 826597 - DNA, 20 bp, mouse
ggtacctggctgctagtcgg

SEQ ID NO: 826598 - DNA, 20 bp, mouse
ggacccgcccgctgccagac

SEQ ID NO: 826599 - DNA, 20 bp, mouse
gggatggggagcgtggtacc

SEQ ID NO: 826600 - DNA, 20 bp, mouse
gcggcctcgactcacgtgcg

SEQ ID NO: 826601 - DNA, 20 bp, mouse
gccgcccgctgccagactgg

SEQ ID NO: 826602 - DNA, 20 bp, mouse
gtaccacgctccccatcccg

SEQ ID NO: 826603 - DNA, 20 bp, mouse
gccggtggcatgtgctaagg

SEQ ID NO: 826604 - DNA, 20 bp, mouse
gcatcccggggcggcgccac

SEQ ID NO: 826605 - DNA, 20 bp, mouse
gagtccgggtaatccatgag

SEQ ID NO: 826606 - DNA, 20 bp, mouse
gctcccgcggcctcatggac

SEQ ID NO: 826607 - DNA, 20 bp, mouse
gccggctgacaggcttaggg

SEQ ID NO: 826608 - DNA, 20 bp, mouse
gggcgcctcccgcggcctca

SEQ ID NO: 826609 - DNA, 20 bp, mouse
gggcccgcacggcctacttc

SEQ ID NO: 826610 - DNA, 20 bp, mouse
gaagatctgcgaacaggtga

SEQ ID NO: 826611 - DNA, 20 bp, mouse
gcgatgcggcggggagacag

SEQ ID NO: 826612 - DNA, 20 bp, mouse
gcggggcgcggaccggaagt

SEQ ID NO: 826613 - DNA, 20 bp, mouse
gcccgccggctgacaggctt

SEQ ID NO: 826614 - DNA, 20 bp, mouse
gccgcggcctcatggactgg

SEQ ID NO: 826615 - DNA, 20 bp, mouse
gcgtgcgggccacgcctctc

SEQ ID NO: 826616 - DNA, 20 bp, mouse
gccacctcccggagattcgt

SEQ ID NO: 826617 - DNA, 20 bp, mouse
gacctgctatgagacagtag

SEQ ID NO: 826618 - DNA, 20 bp, mouse
ggaaccctacggttgcaaat

SEQ ID NO: 826619 - DNA, 20 bp, mouse
gctaggaagcagcccggggc

SEQ ID NO: 826620 - DNA, 20 bp, mouse
gggaggagcccggagaggat

SEQ ID NO: 826621 - DNA, 20 bp, mouse
gtgtactattgtcacacggg

SEQ ID NO: 826622 - DNA, 20 bp, mouse
gaagcagcccggggctgggg

SEQ ID NO: 826623 - DNA, 20 bp, mouse
ggctacccggccgaacccta

SEQ ID NO: 826624 - DNA, 20 bp, mouse
gccccctgcagttgacgcga

SEQ ID NO: 826625 - DNA, 20 bp, mouse
gcccagagcccaaatctcaa

SEQ ID NO: 826626 - DNA, 20 bp, mouse
ggacccgcgcagttgatggg

SEQ ID NO: 826627 - DNA, 20 bp, mouse
gcaactgcgcgggtccgttc

SEQ ID NO: 826628 - DNA, 20 bp, mouse
gggtccgcccaagatcaggc

SEQ ID NO: 826629 - DNA, 20 bp, mouse
ggaccaatcaaacacatcaa

SEQ ID NO: 826630 - DNA, 20 bp, mouse
ggtagccatcccgacatcaa

SEQ ID NO: 826631 - DNA, 20 bp, mouse
gcgctccctgacccaaccag

SEQ ID NO: 826632 - DNA, 20 bp, mouse
ggtagcctctggttgggtca

SEQ ID NO: 826633 - DNA, 20 bp, mouse
gcgacatcaaaggatcacgt

SEQ ID NO: 826634 - DNA, 20 bp, mouse
gccaccccgggcccatgggc

SEQ ID NO: 826635 - DNA, 20 bp, mouse
gtatccagcctgatcttggg

SEQ ID NO: 826636 - DNA, 20 bp, mouse
gccaccctgcggttccaccc

SEQ ID NO: 826637 - DNA, 20 bp, mouse
gcgggccggggtggaaccgc

SEQ ID NO: 826638 - DNA, 20 bp, mouse
gatgctctgcggccccaccc

SEQ ID NO: 826639 - DNA, 20 bp, mouse
gggtccggcacccctggtgt

SEQ ID NO: 826640 - DNA, 20 bp, mouse
gtctgcggccccacccgggc

SEQ ID NO: 826641 - DNA, 20 bp, mouse
gggtgtagacttcaaggcgg

SEQ ID NO: 826642 - DNA, 20 bp, mouse
ggttccaccccggcccgggt

SEQ ID NO: 826643 - DNA, 20 bp, mouse
ggccgcgggcgaccttaggt

SEQ ID NO: 826644 - DNA, 20 bp, mouse
ggcagcttagagtggtgggc

SEQ ID NO: 826645 - DNA, 20 bp, mouse
gggatgaggtgtagacttca

SEQ ID NO: 826646 - DNA, 20 bp, mouse
gacgtcacgcccacggatcc

SEQ ID NO: 826647 - DNA, 20 bp, mouse
ggacccctcccaggatccgt

SEQ ID NO: 826648 - DNA, 20 bp, mouse
gcagcccaaagtcggggaac

SEQ ID NO: 826649 - DNA, 20 bp, mouse
gtggcattacattcccagga

SEQ ID NO: 826650 - DNA, 20 bp, mouse
gaaacgcttctgccctgaag

SEQ ID NO: 826651 - DNA, 20 bp, mouse
gcgtgggcgtgacgtcatcg

SEQ ID NO: 826652 - DNA, 20 bp, mouse
gacgcccacggatcctggga

SEQ ID NO: 826653 - DNA, 20 bp, mouse
gtactccttcagcccaaagt

SEQ ID NO: 826654 - DNA, 20 bp, mouse
ggaaggaaaaagaagtctct

SEQ ID NO: 826655 - DNA, 20 bp, mouse
gctccctgttccccgacttt

SEQ ID NO: 826656 - DNA, 20 bp, mouse
ggcgtccccggccggtttga

SEQ ID NO: 826657 - DNA, 20 bp, mouse
gcacccctcggacctcaacc

SEQ ID NO: 826658 - DNA, 20 bp, mouse
ggcacccctcaaaccggccg

SEQ ID NO: 826659 - DNA, 20 bp, mouse
gagccttgcagagcctgctc

SEQ ID NO: 826660 - DNA, 20 bp, mouse
gacgcgccgccagggagtgg

SEQ ID NO: 826661 - DNA, 20 bp, mouse
ggcccggagacggaaagttt

SEQ ID NO: 826662 - DNA, 20 bp, mouse
gagacggaaagtttcggagc

SEQ ID NO: 826663 - DNA, 20 bp, mouse
gggcaacgcacccctcaaac

SEQ ID NO: 826664 - DNA, 20 bp, mouse
gccgaggggtggcggtcctg

SEQ ID NO: 826665 - DNA, 20 bp, mouse
gcggaagtgacgcgccgcca

SEQ ID NO: 826666 - DNA, 20 bp, mouse
gagggattcacgccgtggta

SEQ ID NO: 826667 - DNA, 20 bp, mouse
gacctgccaagccaggcgct

SEQ ID NO: 826668 - DNA, 20 bp, mouse
gtcgggctttctgctctgtg

SEQ ID NO: 826669 - DNA, 20 bp, mouse
ggcgcgcgcctcactagcgc

SEQ ID NO: 826670 - DNA, 20 bp, mouse
gtactctgcgtcccctacca

SEQ ID NO: 826671 - DNA, 20 bp, mouse
gtgtggcttgctggtggcgt

SEQ ID NO: 826672 - DNA, 20 bp, mouse
gcggaagagccgcgcgtttc

SEQ ID NO: 826673 - DNA, 20 bp, mouse
gggactgtgagcccagcgcc

SEQ ID NO: 826674 - DNA, 20 bp, mouse
gctccgaggccgtcggttac

SEQ ID NO: 826675 - DNA, 20 bp, mouse
gagcggtgccggaagtgctt

SEQ ID NO: 826676 - DNA, 20 bp, mouse
gccagccaatcccaaggccg

SEQ ID NO: 826677 - DNA, 20 bp, mouse
gcccaaggccggggttgggt

SEQ ID NO: 826678 - DNA, 20 bp, mouse
gcaggcgtggtatactacgc

SEQ ID NO: 826679 - DNA, 20 bp, mouse
gccaatcccaaggccggggt

SEQ ID NO: 826680 - DNA, 20 bp, mouse
gcttacgtgtggaatcctga

SEQ ID NO: 826681 - DNA, 20 bp, mouse
gtggccagcgttgcgcagag

SEQ ID NO: 826682 - DNA, 20 bp, mouse
gaatttgtgcatacttacgg

SEQ ID NO: 826683 - DNA, 20 bp, mouse
gcacaaatgcctgtaaaaat

SEQ ID NO: 826684 - DNA, 20 bp, mouse
gtgcgcaacgctggccaggc

SEQ ID NO: 826685 - DNA, 20 bp, mouse
gggatgactttttgcctctg

SEQ ID NO: 826686 - DNA, 20 bp, mouse
gccactgcgccgaagccgga

SEQ ID NO: 826687 - DNA, 20 bp, mouse
gaaggctcggcggaacggag

SEQ ID NO: 826688 - DNA, 20 bp, mouse
gcgcggaggggagatccggg

SEQ ID NO: 826689 - DNA, 20 bp, mouse
gcggtcgcggaggggagatc

SEQ ID NO: 826690 - DNA, 20 bp, mouse
gtggcgtggaatcacccctc

SEQ ID NO: 826691 - DNA, 20 bp, mouse
ggctgctggagctgctctga

SEQ ID NO: 826692 - DNA, 20 bp, mouse
gactctaaggctcggcggaa

SEQ ID NO: 826693 - DNA, 20 bp, mouse
gaataatggtacggtcgcgg

SEQ ID NO: 826694 - DNA, 20 bp, mouse
gcccggtaaaactagaactg

SEQ ID NO: 826695 - DNA, 20 bp, mouse
gggaggactctaaggctcgg

SEQ ID NO: 826696 - DNA, 20 bp, mouse
ggcaaagtcgagtgtgacaa

SEQ ID NO: 826697 - DNA, 20 bp, mouse
gttgacttccgcctccccat

SEQ ID NO: 826698 - DNA, 20 bp, mouse
ggaagtcaacatccacttcc

SEQ ID NO: 826699 - DNA, 20 bp, mouse
gtccacttccgggcctcgtc

SEQ ID NO: 826700 - DNA, 20 bp, mouse
gcccacaggagcgttacctg

SEQ ID NO: 826701 - DNA, 20 bp, mouse
gagcctcttcagagctggat

SEQ ID NO: 826702 - DNA, 20 bp, mouse
gcaatctgggccaaaccaat

SEQ ID NO: 826703 - DNA, 20 bp, mouse
gcccacaggtaacgctcctg

SEQ ID NO: 826704 - DNA, 20 bp, mouse
gtacctccagaattaacaca

SEQ ID NO: 826705 - DNA, 20 bp, mouse
ggaggcttccggacgaggcc

SEQ ID NO: 826706 - DNA, 20 bp, mouse
gcagaggcaggtggggttca

SEQ ID NO: 826707 - DNA, 20 bp, mouse
gttggtctggggatgttcag

SEQ ID NO: 826708 - DNA, 20 bp, mouse
gaaccacagaaaatcctcgt

SEQ ID NO: 826709 - DNA, 20 bp, mouse
gtactgcctgccagaaacct

SEQ ID NO: 826710 - DNA, 20 bp, mouse
gtcagctcaggagactacac

SEQ ID NO: 826711 - DNA, 20 bp, mouse
gtggcgagcatgcactagga

SEQ ID NO: 826712 - DNA, 20 bp, mouse
ggactcaagacccaggtttc

SEQ ID NO: 826713 - DNA, 20 bp, mouse
gctttcccggaactcagctc

SEQ ID NO: 826714 - DNA, 20 bp, mouse
gcttgtgggactcaagaccc

SEQ ID NO: 826715 - DNA, 20 bp, mouse
gagcatgcactaggagggtt

SEQ ID NO: 826716 - DNA, 20 bp, mouse
gacagtgcgtggctcatcgg

SEQ ID NO: 826717 - DNA, 20 bp, mouse
gaagcggattctaggacttg

SEQ ID NO: 826718 - DNA, 20 bp, mouse
ggactcggttagatgatctg

SEQ ID NO: 826719 - DNA, 20 bp, mouse
gaatacagtgcgtggctcat

SEQ ID NO: 826720 - DNA, 20 bp, mouse
ggggccaatatgcatggtcg

SEQ ID NO: 826721 - DNA, 20 bp, mouse
gcccagaggtgtctatgaag

SEQ ID NO: 826722 - DNA, 20 bp, mouse
ggcgccacgaccatgcatat

SEQ ID NO: 826723 - DNA, 20 bp, mouse
gagctgagggccaatatgca

SEQ ID NO: 826724 - DNA, 20 bp, mouse
ggggtaataaatacagtgcg

SEQ ID NO: 826725 - DNA, 20 bp, mouse
gtgtctatgaagcggattct

SEQ ID NO: 826726 - DNA, 20 bp, mouse
gctaggccaagggagagccg

SEQ ID NO: 826727 - DNA, 20 bp, mouse
gtggtgggcgggcctccggg

SEQ ID NO: 826728 - DNA, 20 bp, mouse
ggcaagtgggaggacactgc

SEQ ID NO: 826729 - DNA, 20 bp, mouse
gcggtaccccggctctccct

SEQ ID NO: 826730 - DNA, 20 bp, mouse
gtgtcctcccacttgcagga

SEQ ID NO: 826731 - DNA, 20 bp, mouse
gaagctctctgtcagactaa

SEQ ID NO: 826732 - DNA, 20 bp, mouse
gcgcgtgagtacacgttggt

SEQ ID NO: 826733 - DNA, 20 bp, mouse
gtccactcaggttcgaacac

SEQ ID NO: 826734 - DNA, 20 bp, mouse
gctaagggtggcatgtgtta

SEQ ID NO: 826735 - DNA, 20 bp, mouse
gggggtaccgcccctcccgg

SEQ ID NO: 826736 - DNA, 20 bp, mouse
gagggactaggacctagtaa

SEQ ID NO: 826737 - DNA, 20 bp, mouse
gggaagggacgttaagtgtt

SEQ ID NO: 826738 - DNA, 20 bp, mouse
gcacgcccggacaagacttc

SEQ ID NO: 826739 - DNA, 20 bp, mouse
gagaacccggaagtcttgtc

SEQ ID NO: 826740 - DNA, 20 bp, mouse
ggttaggcgaatcgtgcttg

SEQ ID NO: 826741 - DNA, 20 bp, mouse
ggggtttgcacgataagttt

SEQ ID NO: 826742 - DNA, 20 bp, mouse
gtaaaccacaaggtccaaat

SEQ ID NO: 826743 - DNA, 20 bp, mouse
gatggaaggggcgagggact

SEQ ID NO: 826744 - DNA, 20 bp, mouse
gaaccccgcccactcacgcc

SEQ ID NO: 826745 - DNA, 20 bp, mouse
gttgtccgggcgtgagtggg

SEQ ID NO: 826746 - DNA, 20 bp, mouse
ggggaggagagcgatcgtct

SEQ ID NO: 826747 - DNA, 20 bp, mouse
gggccggaagccgagtgact

SEQ ID NO: 826748 - DNA, 20 bp, mouse
gggcccaggctccgcccagt

SEQ ID NO: 826749 - DNA, 20 bp, mouse
gttgcccctgaacacaccga

SEQ ID NO: 826750 - DNA, 20 bp, mouse
ggtgaccctcggtgtgttca

SEQ ID NO: 826751 - DNA, 20 bp, mouse
gaaaagtaagaggtgaccct

SEQ ID NO: 826752 - DNA, 20 bp, mouse
ggactctagagcctggacgc

SEQ ID NO: 826753 - DNA, 20 bp, mouse
ggcgaggcagtacgagcaga

SEQ ID NO: 826754 - DNA, 20 bp, mouse
gcagaaggccgagagatagg

SEQ ID NO: 826755 - DNA, 20 bp, mouse
gtgctcgtactgcctcgccc

SEQ ID NO: 826756 - DNA, 20 bp, mouse
gcgcccctgtggcctccgat

SEQ ID NO: 826757 - DNA, 20 bp, mouse
ggaggggcggcccactgcgc

SEQ ID NO: 826758 - DNA, 20 bp, mouse
ggccacaggggcgcgggcgt

SEQ ID NO: 826759 - DNA, 20 bp, mouse
ggggcgtgggcggtgcgtgt

SEQ ID NO: 826760 - DNA, 20 bp, mouse
gcacgaaggcgctttcgggg

SEQ ID NO: 826761 - DNA, 20 bp, mouse
ggcagccaatcggaggccac

SEQ ID NO: 826762 - DNA, 20 bp, mouse
ggctgcgagcgccagaggcc

SEQ ID NO: 826763 - DNA, 20 bp, mouse
gccggctgccgcgacccacc

SEQ ID NO: 826764 - DNA, 20 bp, mouse
gtgtctgcacccttccaaaa

SEQ ID NO: 826765 - DNA, 20 bp, mouse
gttggaagggtgcagacaaa

SEQ ID NO: 826766 - DNA, 20 bp, mouse
gacgtcacgctgggcggctc

SEQ ID NO: 826767 - DNA, 20 bp, mouse
gctagtgacgtcacgctggg

SEQ ID NO: 826768 - DNA, 20 bp, mouse
ggcaaggcgcgccctgtcgc

SEQ ID NO: 826769 - DNA, 20 bp, mouse
gtgccagggcgcgtgcgcaa

SEQ ID NO: 826770 - DNA, 20 bp, mouse
gtgcgagcggctagcagcac

SEQ ID NO: 826771 - DNA, 20 bp, mouse
gcgcgctagtgacgtcacgc

SEQ ID NO: 826772 - DNA, 20 bp, mouse
gcaccgggcgacctgcgaca

SEQ ID NO: 826773 - DNA, 20 bp, mouse
gttaggccggggcaagccag

SEQ ID NO: 826774 - DNA, 20 bp, mouse
ggctcagaggcgcaggttcc

SEQ ID NO: 826775 - DNA, 20 bp, mouse
gcgccctgtcgcaggtcgcc

SEQ ID NO: 826776 - DNA, 20 bp, mouse
ggcaataaacggtaattagc

SEQ ID NO: 826777 - DNA, 20 bp, mouse
gtcaaaaccgagcgaaaggc

SEQ ID NO: 826778 - DNA, 20 bp, mouse
gttcctgcctgcctttcgct

SEQ ID NO: 826779 - DNA, 20 bp, mouse
gagccggggcaggccattta

SEQ ID NO: 826780 - DNA, 20 bp, mouse
gaaaacgcagtcacgcttga

SEQ ID NO: 826781 - DNA, 20 bp, mouse
ggcagtgggaggagctagcg

SEQ ID NO: 826782 - DNA, 20 bp, mouse
gctcctcccactgccgtaaa

SEQ ID NO: 826783 - DNA, 20 bp, mouse
gggcaggccatttacggcag

SEQ ID NO: 826784 - DNA, 20 bp, mouse
gactttcaaaaccgagcgaa

SEQ ID NO: 826785 - DNA, 20 bp, mouse
ggccgtctgtaaagactcca

SEQ ID NO: 826786 - DNA, 20 bp, mouse
gggcggcgagccacatgtga

SEQ ID NO: 826787 - DNA, 20 bp, mouse
ggaagcgcctccctcacatg

SEQ ID NO: 826788 - DNA, 20 bp, mouse
gcagccggttccctcctgtt

SEQ ID NO: 826789 - DNA, 20 bp, mouse
gtcgccgccgtggaggtccc

SEQ ID NO: 826790 - DNA, 20 bp, mouse
gtcacctgggacctccacgg

SEQ ID NO: 826791 - DNA, 20 bp, mouse
gtcccaggtgagcggacggt

SEQ ID NO: 826792 - DNA, 20 bp, mouse
ggaggtcccaggtgagcgga

SEQ ID NO: 826793 - DNA, 20 bp, mouse
gccggcgtgcccgctccgtc

SEQ ID NO: 826794 - DNA, 20 bp, mouse
gggcacgccgggctaggccg

SEQ ID NO: 826795 - DNA, 20 bp, mouse
gcccgagggagttcccgcta

SEQ ID NO: 826796 - DNA, 20 bp, mouse
gtcagagccagcccgaaagt

SEQ ID NO: 826797 - DNA, 20 bp, mouse
ggctccacccactttcgggc

SEQ ID NO: 826798 - DNA, 20 bp, mouse
gtgggctgaggcgacaaaag

SEQ ID NO: 826799 - DNA, 20 bp, mouse
ggagccagcccgaaagtggg

SEQ ID NO: 826800 - DNA, 20 bp, mouse
gccctgacaggagtaggtcc

SEQ ID NO: 826801 - DNA, 20 bp, mouse
ggctgaggcgacaaaagagg

SEQ ID NO: 826802 - DNA, 20 bp, mouse
gcccgctgccttccagaagt

SEQ ID NO: 826803 - DNA, 20 bp, mouse
gaaatgcgaaggtacagaaa

SEQ ID NO: 826804 - DNA, 20 bp, mouse
gttctgaaggtcctgacagc

SEQ ID NO: 826805 - DNA, 20 bp, mouse
gctggcagcgtacggtgctt

SEQ ID NO: 826806 - DNA, 20 bp, mouse
gtgtgcgggtaaagccacta

SEQ ID NO: 826807 - DNA, 20 bp, mouse
ggcgacgttggtcacgtgag

SEQ ID NO: 826808 - DNA, 20 bp, mouse
gctaacaggtgtgtgttccc

SEQ ID NO: 826809 - DNA, 20 bp, mouse
gaaagccactagggcgacgt

SEQ ID NO: 826810 - DNA, 20 bp, mouse
gcatatgcggagccaatcgg

SEQ ID NO: 826811 - DNA, 20 bp, mouse
gtggctccgcatatggaggg

SEQ ID NO: 826812 - DNA, 20 bp, mouse
gcacctgttagctaacccaa

SEQ ID NO: 826813 - DNA, 20 bp, mouse
ggggcggaaaactcagtaga

SEQ ID NO: 826814 - DNA, 20 bp, mouse
ggtgaccaacgtcgccctag

SEQ ID NO: 826815 - DNA, 20 bp, mouse
ggagcctgggcgcggagaga

SEQ ID NO: 826816 - DNA, 20 bp, mouse
ggggctggccgccgctcttc

SEQ ID NO: 826817 - DNA, 20 bp, mouse
gcgcgcgccgctagtacttc

SEQ ID NO: 826818 - DNA, 20 bp, mouse
gagtacttccggaagagcgg

SEQ ID NO: 826819 - DNA, 20 bp, mouse
ggaccggaagcagacacgga

SEQ ID NO: 826820 - DNA, 20 bp, mouse
ggtgagaacttgccctgtat

SEQ ID NO: 826821 - DNA, 20 bp, mouse
ggcggcgctacgtcacagac

SEQ ID NO: 826822 - DNA, 20 bp, mouse
gaggccgactgggtacgccc

SEQ ID NO: 826823 - DNA, 20 bp, mouse
ggctcttccggaagtactag

SEQ ID NO: 826824 - DNA, 20 bp, mouse
gtcgtaaagtgctgtcttac

SEQ ID NO: 826825 - DNA, 20 bp, mouse
gtcggcctccgctaaaacat

SEQ ID NO: 826826 - DNA, 20 bp, mouse
ggggctgcccgtcaatcaga

SEQ ID NO: 826827 - DNA, 20 bp, mouse
gcgcgcatgcgcgcccggtc

SEQ ID NO: 826828 - DNA, 20 bp, mouse
gggactagccatccgctccc

SEQ ID NO: 826829 - DNA, 20 bp, mouse
gagcctggaggctacgcgca

SEQ ID NO: 826830 - DNA, 20 bp, mouse
gcccccgccccgggtcccac

SEQ ID NO: 826831 - DNA, 20 bp, mouse
gcccgtcaatcagagggctg

SEQ ID NO: 826832 - DNA, 20 bp, mouse
gaggcaggcagctcagagcc

SEQ ID NO: 826833 - DNA, 20 bp, mouse
gcccgggctgtgagagcatg

SEQ ID NO: 826834 - DNA, 20 bp, mouse
gccacctgtgggacccgggg

SEQ ID NO: 826835 - DNA, 20 bp, mouse
ggccttgcaggcgcctgacc

SEQ ID NO: 826836 - DNA, 20 bp, mouse
gccaacaagtatacttctag

SEQ ID NO: 826837 - DNA, 20 bp, mouse
ggaaatgattgtacaagtct

SEQ ID NO: 826838 - DNA, 20 bp, mouse
gcccgggtttagtattttag

SEQ ID NO: 826839 - DNA, 20 bp, mouse
gtctgtcacgtggtataaga

SEQ ID NO: 826840 - DNA, 20 bp, mouse
gcctccataaagtacattgg

SEQ ID NO: 826841 - DNA, 20 bp, mouse
gcagcctccataaagtacat

SEQ ID NO: 826842 - DNA, 20 bp, mouse
gggcggcgagttctgtcacg

SEQ ID NO: 826843 - DNA, 20 bp, mouse
gaatccaccaatgtacttta

SEQ ID NO: 826844 - DNA, 20 bp, mouse
ggcataacgctcgagcattc

SEQ ID NO: 826845 - DNA, 20 bp, mouse
gtggtggactctgatacctc

SEQ ID NO: 826846 - DNA, 20 bp, mouse
gaacacgtgtgagtctgggg

SEQ ID NO: 826847 - DNA, 20 bp, mouse
ggggatagcccaagctcacg

SEQ ID NO: 826848 - DNA, 20 bp, mouse
ggggacttgtagttgcgggg

SEQ ID NO: 826849 - DNA, 20 bp, mouse
gacgaacacgtgtgagtctg

SEQ ID NO: 826850 - DNA, 20 bp, mouse
ggtagctgtagcaattgatc

SEQ ID NO: 826851 - DNA, 20 bp, mouse
ggggctatgcaatgaattaa

SEQ ID NO: 826852 - DNA, 20 bp, mouse
gcacaacgccacgtgagctt

SEQ ID NO: 826853 - DNA, 20 bp, mouse
gtgtgtgacccaagctttct

SEQ ID NO: 826854 - DNA, 20 bp, mouse
gccagaggatctagagttcc

SEQ ID NO: 826855 - DNA, 20 bp, mouse
gtgctaggattacagacggc

SEQ ID NO: 826856 - DNA, 20 bp, mouse
gtcctggtgcgtgccgaggt

SEQ ID NO: 826857 - DNA, 20 bp, mouse
gcacgcaccaggaactccgc

SEQ ID NO: 826858 - DNA, 20 bp, mouse
gccgggccggggtttgccga

SEQ ID NO: 826859 - DNA, 20 bp, mouse
ggcaagcgagcaagggacgt

SEQ ID NO: 826860 - DNA, 20 bp, mouse
ggatggaagcgtaggacccg

SEQ ID NO: 826861 - DNA, 20 bp, mouse
ggcccggcggagggcctcga

SEQ ID NO: 826862 - DNA, 20 bp, mouse
gttagggcgcgcaacggggt

SEQ ID NO: 826863 - DNA, 20 bp, mouse
gtccctcgaggccctccgcc

SEQ ID NO: 826864 - DNA, 20 bp, mouse
gtcctccctggcaagcgcgt

SEQ ID NO: 826865 - DNA, 20 bp, mouse
gggcgcgtgagcggaggctt

SEQ ID NO: 826866 - DNA, 20 bp, mouse
ggcccatgcaggttcggagg

SEQ ID NO: 826867 - DNA, 20 bp, mouse
gggggcccatgcaggttcgg

SEQ ID NO: 826868 - DNA, 20 bp, mouse
gaggaccagtgggcattaag

SEQ ID NO: 826869 - DNA, 20 bp, mouse
gtgggagtgaggatggtcgg

SEQ ID NO: 826870 - DNA, 20 bp, mouse
gtagccaagtccacacaggt

SEQ ID NO: 826871 - DNA, 20 bp, mouse
gcccggggcccatgcaggtt

SEQ ID NO: 826872 - DNA, 20 bp, mouse
gcagcggccgagtggaggaa

SEQ ID NO: 826873 - DNA, 20 bp, mouse
gtccacctccgaacctgcat

SEQ ID NO: 826874 - DNA, 20 bp, mouse
ggggtggagccagaccgagg

SEQ ID NO: 826875 - DNA, 20 bp, mouse
gccgccagcccccacctgtg

SEQ ID NO: 826876 - DNA, 20 bp, mouse
ggggccggaaggaacatcat

SEQ ID NO: 826877 - DNA, 20 bp, mouse
gcgctgccctaaaaggaatg

SEQ ID NO: 826878 - DNA, 20 bp, mouse
gggtgggaattaggggggtt

SEQ ID NO: 826879 - DNA, 20 bp, mouse
gacatattgaacataggcag

SEQ ID NO: 826880 - DNA, 20 bp, mouse
ggtgagagcagagcagtctc

SEQ ID NO: 826881 - DNA, 20 bp, mouse
gtggctctggttgatgtcaa

SEQ ID NO: 826882 - DNA, 20 bp, mouse
ggaaccggcgctgccctaaa

SEQ ID NO: 826883 - DNA, 20 bp, mouse
gggaaactcagaatattact

SEQ ID NO: 826884 - DNA, 20 bp, mouse
gcctggatggagaggatggt

SEQ ID NO: 826885 - DNA, 20 bp, mouse
gaatggggggggtgggaatt

SEQ ID NO: 826886 - DNA, 20 bp, mouse
gcggcggggtctgctgtctc

SEQ ID NO: 826887 - DNA, 20 bp, mouse
gccccgccgccgagcaaaac

SEQ ID NO: 826888 - DNA, 20 bp, mouse
gttaagccggttttgctcgg

SEQ ID NO: 826889 - DNA, 20 bp, mouse
gagcttaagccggttttgct

SEQ ID NO: 826890 - DNA, 20 bp, mouse
gagccggttttgctcggcgg

SEQ ID NO: 826891 - DNA, 20 bp, mouse
gtgaccccgccccgtgtcca

SEQ ID NO: 826892 - DNA, 20 bp, mouse
gacgcggggaagaagaccta

SEQ ID NO: 826893 - DNA, 20 bp, mouse
ggggcggagccatggacacg

SEQ ID NO: 826894 - DNA, 20 bp, mouse
gcggagccatggacacgggg

SEQ ID NO: 826895 - DNA, 20 bp, mouse
gtcagcgtgtcgtttatggg

SEQ ID NO: 826896 - DNA, 20 bp, mouse
gagttggagcagtctgtcgg

SEQ ID NO: 826897 - DNA, 20 bp, mouse
gagcctgtgtggagtgagtg

SEQ ID NO: 826898 - DNA, 20 bp, mouse
gagcatgcagagaatgtctc

SEQ ID NO: 826899 - DNA, 20 bp, mouse
gttaaagccttgcaagaagg

SEQ ID NO: 826900 - DNA, 20 bp, mouse
ggagccaagcagacttccat

SEQ ID NO: 826901 - DNA, 20 bp, mouse
ggaagagcagacccaagtcc

SEQ ID NO: 826902 - DNA, 20 bp, mouse
gcccaaatatggagcctgtg

SEQ ID NO: 826903 - DNA, 20 bp, mouse
gttggggaaagacaccaagt

SEQ ID NO: 826904 - DNA, 20 bp, mouse
ggtaacaaggaagggtttca

SEQ ID NO: 826905 - DNA, 20 bp, mouse
ggacccaagtccgggtaaca

SEQ ID NO: 826906 - DNA, 20 bp, mouse
gctggagcgcttaagatagg

SEQ ID NO: 826907 - DNA, 20 bp, mouse
gcggaccaggggcggggcaa

SEQ ID NO: 826908 - DNA, 20 bp, mouse
gggcggggcaagggccaaga

SEQ ID NO: 826909 - DNA, 20 bp, mouse
ggcgccgccgcgtggaatgc

SEQ ID NO: 826910 - DNA, 20 bp, mouse
gctagctagctcaggatcgc

SEQ ID NO: 826911 - DNA, 20 bp, mouse
gatgctggagcgcttaagat

SEQ ID NO: 826912 - DNA, 20 bp, mouse
gaggcaggaatgagccgtaa

SEQ ID NO: 826913 - DNA, 20 bp, mouse
ggcaaaaggtctccgcccag

SEQ ID NO: 826914 - DNA, 20 bp, mouse
gctcagacggggcggaccag

SEQ ID NO: 826915 - DNA, 20 bp, mouse
gggactccgcaggtccttta

SEQ ID NO: 826916 - DNA, 20 bp, mouse
gcccccagacagacggtggg

SEQ ID NO: 826917 - DNA, 20 bp, mouse
gaagccctggccagcccacg

SEQ ID NO: 826918 - DNA, 20 bp, mouse
gtaagcccccagacagacgg

SEQ ID NO: 826919 - DNA, 20 bp, mouse
gaggagaagaaaggattgtg

SEQ ID NO: 826920 - DNA, 20 bp, mouse
ggggggttccagccccccgt

SEQ ID NO: 826921 - DNA, 20 bp, mouse
ggcagaccggatgatgtaca

SEQ ID NO: 826922 - DNA, 20 bp, mouse
ggtctggcctgtctaggaga

SEQ ID NO: 826923 - DNA, 20 bp, mouse
gcccagagcaggtaattaac

SEQ ID NO: 826924 - DNA, 20 bp, mouse
gacaggcaggactgagaaag

SEQ ID NO: 826925 - DNA, 20 bp, mouse
ggacggtgggtggtgggcga

SEQ ID NO: 826926 - DNA, 20 bp, mouse
gccaacaacaacagcctctc

SEQ ID NO: 826927 - DNA, 20 bp, mouse
gtgggcgcggcagaccgcgc

SEQ ID NO: 826928 - DNA, 20 bp, mouse
gaacacctgcaagttggagg

SEQ ID NO: 826929 - DNA, 20 bp, mouse
gtctgggcagcctgccggag

SEQ ID NO: 826930 - DNA, 20 bp, mouse
gtgggatggcggggcacacg

SEQ ID NO: 826931 - DNA, 20 bp, mouse
ggcgcccaaagcgagtttcc

SEQ ID NO: 826932 - DNA, 20 bp, mouse
ggcccccacaaccttagccc

SEQ ID NO: 826933 - DNA, 20 bp, mouse
ggctccaaacacctgcaagt

SEQ ID NO: 826934 - DNA, 20 bp, mouse
gaaagccatttgctattctt

SEQ ID NO: 826935 - DNA, 20 bp, mouse
gaagcctgggctaaggttgt

SEQ ID NO: 826936 - DNA, 20 bp, mouse
ggagggcgagcgagagatcg

SEQ ID NO: 826937 - DNA, 20 bp, mouse
gatggtccaggcccagagga

SEQ ID NO: 826938 - DNA, 20 bp, mouse
gctgtcccacaagccggtgt

SEQ ID NO: 826939 - DNA, 20 bp, mouse
gtatgccggtctgcctacac

SEQ ID NO: 826940 - DNA, 20 bp, mouse
gtggccttggacaaagtgtt

SEQ ID NO: 826941 - DNA, 20 bp, mouse
gacacatggtccaggcccag

SEQ ID NO: 826942 - DNA, 20 bp, mouse
gcaagccggtgtaggcagac

SEQ ID NO: 826943 - DNA, 20 bp, mouse
gctggtgggggcgtcagcat

SEQ ID NO: 826944 - DNA, 20 bp, mouse
gcataggactcttgttggac

SEQ ID NO: 826945 - DNA, 20 bp, mouse
gctagctctgtcccacaagc

SEQ ID NO: 826946 - DNA, 20 bp, mouse
gagggctgacgggacaaggt

SEQ ID NO: 826947 - DNA, 20 bp, mouse
gttggctgctgcacttggga

SEQ ID NO: 826948 - DNA, 20 bp, mouse
gtgacgggacaaggtgggga

SEQ ID NO: 826949 - DNA, 20 bp, mouse
gaaagggcggtgtcctataa

SEQ ID NO: 826950 - DNA, 20 bp, mouse
gaaggacccctctttgtcta

SEQ ID NO: 826951 - DNA, 20 bp, mouse
gtgggagggctgacgggaca

SEQ ID NO: 826952 - DNA, 20 bp, mouse
gactcattaaggggatctgg

SEQ ID NO: 826953 - DNA, 20 bp, mouse
gtggaggtggccatttggat

SEQ ID NO: 826954 - DNA, 20 bp, mouse
ggactggcgggagtcctcgg

SEQ ID NO: 826955 - DNA, 20 bp, mouse
gcggtgtcctataaaggctg

SEQ ID NO: 826956 - DNA, 20 bp, mouse
ggtagggaatgcacagttgg

SEQ ID NO: 826957 - DNA, 20 bp, mouse
gtgacacggggcgtggtcta

SEQ ID NO: 826958 - DNA, 20 bp, mouse
gccgtagtccgtggggtctg

SEQ ID NO: 826959 - DNA, 20 bp, mouse
ggcaaggtctccaagtacat

SEQ ID NO: 826960 - DNA, 20 bp, mouse
gcccgctcaaggattagcat

SEQ ID NO: 826961 - DNA, 20 bp, mouse
gctacgcatccgagctctag

SEQ ID NO: 826962 - DNA, 20 bp, mouse
gtctaccagtccaaggagag

SEQ ID NO: 826963 - DNA, 20 bp, mouse
ggaactccgaccgtgacacg

SEQ ID NO: 826964 - DNA, 20 bp, mouse
ggaaactaaccactcgctac

SEQ ID NO: 826965 - DNA, 20 bp, mouse
gcacttctgaagcccctgta

SEQ ID NO: 826966 - DNA, 20 bp, mouse
ggcaacctgcggggaggccg

SEQ ID NO: 826967 - DNA, 20 bp, mouse
gcagctggcaacctgcgggg

SEQ ID NO: 826968 - DNA, 20 bp, mouse
gctccgtagcgccctctagc

SEQ ID NO: 826969 - DNA, 20 bp, mouse
gtgctcctccgccggctaga

SEQ ID NO: 826970 - DNA, 20 bp, mouse
gctctatagcaggttgtcac

SEQ ID NO: 826971 - DNA, 20 bp, mouse
gcgtagttttagtgctacaa

SEQ ID NO: 826972 - DNA, 20 bp, mouse
ggggcagctggcaacctgcg

SEQ ID NO: 826973 - DNA, 20 bp, mouse
gagcgccctctagccggcgg

SEQ ID NO: 826974 - DNA, 20 bp, mouse
gtgaagcgcgcgtgcgtgga

SEQ ID NO: 826975 - DNA, 20 bp, mouse
gagagggcgctacggagcct

SEQ ID NO: 826976 - DNA, 20 bp, mouse
gaaggcgccgggaggaaagt

SEQ ID NO: 826977 - DNA, 20 bp, mouse
gagccggggcagctccggtc

SEQ ID NO: 826978 - DNA, 20 bp, mouse
gcccttgcgcgtgttccgga

SEQ ID NO: 826979 - DNA, 20 bp, mouse
gccagcgggtcccagagccg

SEQ ID NO: 826980 - DNA, 20 bp, mouse
ggggcagctccggtcgggag

SEQ ID NO: 826981 - DNA, 20 bp, mouse
gtccctgtgcgcgcccgccg

SEQ ID NO: 826982 - DNA, 20 bp, mouse
gtcacccagcatgtcctctg

SEQ ID NO: 826983 - DNA, 20 bp, mouse
ggcctcgcctggaccccagt

SEQ ID NO: 826984 - DNA, 20 bp, mouse
gctcccgcgcccctcccgac

SEQ ID NO: 826985 - DNA, 20 bp, mouse
ggggactcgcgctgccaatg

SEQ ID NO: 826986 - DNA, 20 bp, mouse
gccgcccccaggccgtggag

SEQ ID NO: 826987 - DNA, 20 bp, mouse
gagggagagcgcgtgcgtgg

SEQ ID NO: 826988 - DNA, 20 bp, mouse
gcccccaggccgtggagggg

SEQ ID NO: 826989 - DNA, 20 bp, mouse
ggaggcgttgcgagagctgg

SEQ ID NO: 826990 - DNA, 20 bp, mouse
ggggtcgaaggcatttggta

SEQ ID NO: 826991 - DNA, 20 bp, mouse
gccaggccgtggaggggcgg

SEQ ID NO: 826992 - DNA, 20 bp, mouse
gccggctccgcgctgacaga

SEQ ID NO: 826993 - DNA, 20 bp, mouse
gctccccaacccggcccgga

SEQ ID NO: 826994 - DNA, 20 bp, mouse
gggcgcgcgctgctccggcg

SEQ ID NO: 826995 - DNA, 20 bp, mouse
gaggaaaggcccccagaagt

SEQ ID NO: 826996 - DNA, 20 bp, mouse
gtgggcgcagcagcgaaggg

SEQ ID NO: 826997 - DNA, 20 bp, mouse
gcccgcagctgcaccaagac

SEQ ID NO: 826998 - DNA, 20 bp, mouse
gagagataacccacaggctg

SEQ ID NO: 826999 - DNA, 20 bp, mouse
gccaacaaggccgcggttct

SEQ ID NO: 827000 - DNA, 20 bp, mouse
gtctcacagagataacccac

SEQ ID NO: 827001 - DNA, 20 bp, mouse
gacagcacatacggccaaca

SEQ ID NO: 827002 - DNA, 20 bp, mouse
gctattgggcgcagcagcga

SEQ ID NO: 827003 - DNA, 20 bp, mouse
gaagacttggaggcgacaaa

SEQ ID NO: 827004 - DNA, 20 bp, mouse
ggggtgcggcacccggaagt

SEQ ID NO: 827005 - DNA, 20 bp, mouse
gctctaagcgacagcacata

SEQ ID NO: 827006 - DNA, 20 bp, mouse
gtgcaggctggtgtctgata

SEQ ID NO: 827007 - DNA, 20 bp, mouse
gagggcggggcccaagacct

SEQ ID NO: 827008 - DNA, 20 bp, mouse
gcggggcccaagacctgggg

SEQ ID NO: 827009 - DNA, 20 bp, mouse
gaggcgtgtcctctgctgga

SEQ ID NO: 827010 - DNA, 20 bp, mouse
gaattgaactggggcgctct

SEQ ID NO: 827011 - DNA, 20 bp, mouse
gttgctggacctgagtttgc

SEQ ID NO: 827012 - DNA, 20 bp, mouse
ggtctggaacgccccttctc

SEQ ID NO: 827013 - DNA, 20 bp, mouse
gggtgtctgatagggatgct

SEQ ID NO: 827014 - DNA, 20 bp, mouse
ggcggccgccattttgaatg

SEQ ID NO: 827015 - DNA, 20 bp, mouse
ggcctccgccacattcaaaa

SEQ ID NO: 827016 - DNA, 20 bp, mouse
gtggcggggcggggctttgt

SEQ ID NO: 827017 - DNA, 20 bp, mouse
ggccccgccaagctccttgg

SEQ ID NO: 827018 - DNA, 20 bp, mouse
gcccgggcctccaaggagct

SEQ ID NO: 827019 - DNA, 20 bp, mouse
gtggaggcccggggccatac

SEQ ID NO: 827020 - DNA, 20 bp, mouse
gcccgccccgccaagctcct

SEQ ID NO: 827021 - DNA, 20 bp, mouse
gcagtcgctgccctctgaac

SEQ ID NO: 827022 - DNA, 20 bp, mouse
gggcctccaaggagcttggc

SEQ ID NO: 827023 - DNA, 20 bp, mouse
gggctggccctgaggatgga

SEQ ID NO: 827024 - DNA, 20 bp, mouse
gcctgcagaggcgggacgtg

SEQ ID NO: 827025 - DNA, 20 bp, mouse
ggctgccctctgaactggaa

SEQ ID NO: 827026 - DNA, 20 bp, mouse
gaagtcagagttatagtcac

SEQ ID NO: 827027 - DNA, 20 bp, mouse
gtcaacacaagggagagctc

SEQ ID NO: 827028 - DNA, 20 bp, mouse
gtcagagttatagtcacggg

SEQ ID NO: 827029 - DNA, 20 bp, mouse
gacttggagtaaggctaaaa

SEQ ID NO: 827030 - DNA, 20 bp, mouse
gagtccccagttcaacacaa

SEQ ID NO: 827031 - DNA, 20 bp, mouse
ggctctcccttgtgttgaac

SEQ ID NO: 827032 - DNA, 20 bp, mouse
ggagagaggtaaagcaaaaa

SEQ ID NO: 827033 - DNA, 20 bp, mouse
ggatgagcacatttcggccc

SEQ ID NO: 827034 - DNA, 20 bp, mouse
gagtacctatagtcccattc

SEQ ID NO: 827035 - DNA, 20 bp, mouse
gaaaaatatactcaaatttg

SEQ ID NO: 827036 - DNA, 20 bp, mouse
gggcgcgcgggcgtcctctc

SEQ ID NO: 827037 - DNA, 20 bp, mouse
ggcgaaggcgagctgagggt

SEQ ID NO: 827038 - DNA, 20 bp, mouse
gtgaggctgagatgtctgtc

SEQ ID NO: 827039 - DNA, 20 bp, mouse
gctcaagcgggcggcggcac

SEQ ID NO: 827040 - DNA, 20 bp, mouse
gcccgcttgaggagagagga

SEQ ID NO: 827041 - DNA, 20 bp, mouse
gcgggccactcgggccactc

SEQ ID NO: 827042 - DNA, 20 bp, mouse
gggaccaagcctagcactcc

SEQ ID NO: 827043 - DNA, 20 bp, mouse
gtgcgcgaatacttaaagct

SEQ ID NO: 827044 - DNA, 20 bp, mouse
ggagcagtcgcgaacctccc

SEQ ID NO: 827045 - DNA, 20 bp, mouse
ggcccgaccctgcgcgagac

SEQ ID NO: 827046 - DNA, 20 bp, mouse
gcacgccgggccaaaggggt

SEQ ID NO: 827047 - DNA, 20 bp, mouse
gccgccacgcggatccttgg

SEQ ID NO: 827048 - DNA, 20 bp, mouse
gccctcgccagtagccgccg

SEQ ID NO: 827049 - DNA, 20 bp, mouse
ggctaggggaagctctgagg

SEQ ID NO: 827050 - DNA, 20 bp, mouse
ggcggggcgcgcgcgcactt

SEQ ID NO: 827051 - DNA, 20 bp, mouse
gcgcgcgcacttgggctcga

SEQ ID NO: 827052 - DNA, 20 bp, mouse
gagcccaagcgcgcggtcca

SEQ ID NO: 827053 - DNA, 20 bp, mouse
gtcgcagcgcgaaagcgtgg

SEQ ID NO: 827054 - DNA, 20 bp, mouse
gcgcgcggtccaaggactgc

SEQ ID NO: 827055 - DNA, 20 bp, mouse
gtatgcacgccgggccaaag

SEQ ID NO: 827056 - DNA, 20 bp, mouse
gtggctgtgggcggagtcga

SEQ ID NO: 827057 - DNA, 20 bp, mouse
gtcaatcgagcgcctatata

SEQ ID NO: 827058 - DNA, 20 bp, mouse
gcgagagcggcgatcaggga

SEQ ID NO: 827059 - DNA, 20 bp, mouse
gaccccgagagcggcgatca

SEQ ID NO: 827060 - DNA, 20 bp, mouse
gacggcctggaccccgagag

SEQ ID NO: 827061 - DNA, 20 bp, mouse
ggattggcggagctggtggt

SEQ ID NO: 827062 - DNA, 20 bp, mouse
ggtggtgggcgggtccaggt

SEQ ID NO: 827063 - DNA, 20 bp, mouse
gcgagggcggggtcgagtgg

SEQ ID NO: 827064 - DNA, 20 bp, mouse
gtcgaccgctcggacttccc

SEQ ID NO: 827065 - DNA, 20 bp, mouse
ggagcggtcgatggatccag

SEQ ID NO: 827066 - DNA, 20 bp, mouse
gcctaatgaacctttctggg

SEQ ID NO: 827067 - DNA, 20 bp, mouse
gtcaactagtgatcacctga

SEQ ID NO: 827068 - DNA, 20 bp, mouse
ggtgcctaatgaacctttct

SEQ ID NO: 827069 - DNA, 20 bp, mouse
ggggccccgatagcaccgtg

SEQ ID NO: 827070 - DNA, 20 bp, mouse
gatgctcctggtgttggtag

SEQ ID NO: 827071 - DNA, 20 bp, mouse
ggaggcacatgcacctgcaa

SEQ ID NO: 827072 - DNA, 20 bp, mouse
gtctcaggttgagcccaggg

SEQ ID NO: 827073 - DNA, 20 bp, mouse
ggaagctgtgtctttgaata

SEQ ID NO: 827074 - DNA, 20 bp, mouse
gtctaggacactaccaccct

SEQ ID NO: 827075 - DNA, 20 bp, mouse
gccaggagcatctaggatct

SEQ ID NO: 827076 - DNA, 20 bp, mouse
gggcgtgcgcgtaaagtccc

SEQ ID NO: 827077 - DNA, 20 bp, mouse
ggggtcctgccctcaatctg

SEQ ID NO: 827078 - DNA, 20 bp, mouse
gtcagcgggtggagtgatca

SEQ ID NO: 827079 - DNA, 20 bp, mouse
gctgccctcaatctggggtg

SEQ ID NO: 827080 - DNA, 20 bp, mouse
gactccaactacagcttcag

SEQ ID NO: 827081 - DNA, 20 bp, mouse
ggagttctgcctagcagccc

SEQ ID NO: 827082 - DNA, 20 bp, mouse
ggtgtctagtgattcgaggt

SEQ ID NO: 827083 - DNA, 20 bp, mouse
gcaggccccaccccagattg

SEQ ID NO: 827084 - DNA, 20 bp, mouse
gttcacgcaagcaagttaag

SEQ ID NO: 827085 - DNA, 20 bp, mouse
gcccgggaacccgctcgagc

SEQ ID NO: 827086 - DNA, 20 bp, mouse
ggctactagcaaaactcttg

SEQ ID NO: 827087 - DNA, 20 bp, mouse
ggcgccccaggttcccaaaa

SEQ ID NO: 827088 - DNA, 20 bp, mouse
gccaggcgcgctccccgcga

SEQ ID NO: 827089 - DNA, 20 bp, mouse
ggagcctttttgggaacctg

SEQ ID NO: 827090 - DNA, 20 bp, mouse
gttggagggcgagccttttt

SEQ ID NO: 827091 - DNA, 20 bp, mouse
gaacccacccgcaaattgac

SEQ ID NO: 827092 - DNA, 20 bp, mouse
gatggcgcctgtcaatttgc

SEQ ID NO: 827093 - DNA, 20 bp, mouse
ggcgcctgtcaatttgcggg

SEQ ID NO: 827094 - DNA, 20 bp, mouse
gcgggtgggttgagcgcccc

SEQ ID NO: 827095 - DNA, 20 bp, mouse
gcctactggcagcgaaccct

SEQ ID NO: 827096 - DNA, 20 bp, mouse
gccccgatctggtcaggtga

SEQ ID NO: 827097 - DNA, 20 bp, mouse
gtccggtgagccaagggggt

SEQ ID NO: 827098 - DNA, 20 bp, mouse
ggcgcagtccggtgagccaa

SEQ ID NO: 827099 - DNA, 20 bp, mouse
ggtgcagggcgaggagtggc

SEQ ID NO: 827100 - DNA, 20 bp, mouse
gcgccctgcacccaccccct

SEQ ID NO: 827101 - DNA, 20 bp, mouse
gtggcacaggtctgggaacg

SEQ ID NO: 827102 - DNA, 20 bp, mouse
gtggaggaacgccgcccaca

SEQ ID NO: 827103 - DNA, 20 bp, mouse
ggcggagtctaggctgataa

SEQ ID NO: 827104 - DNA, 20 bp, mouse
gtcctcaccccagccttaga

SEQ ID NO: 827105 - DNA, 20 bp, mouse
gcgcgggagtgtggttttaa

SEQ ID NO: 827106 - DNA, 20 bp, mouse
gtccagccctctcatagttg

SEQ ID NO: 827107 - DNA, 20 bp, mouse
gtaccggggaatctatcttc

SEQ ID NO: 827108 - DNA, 20 bp, mouse
gcatcagccccaactatgag

SEQ ID NO: 827109 - DNA, 20 bp, mouse
gtgggtgcggggtggacctt

SEQ ID NO: 827110 - DNA, 20 bp, mouse
ggaagaagggtccagagtac

SEQ ID NO: 827111 - DNA, 20 bp, mouse
gaagctgatgtggtgatacc

SEQ ID NO: 827112 - DNA, 20 bp, mouse
gagccagaagatagattccc

SEQ ID NO: 827113 - DNA, 20 bp, mouse
ggaacagacgagatggggtg

SEQ ID NO: 827114 - DNA, 20 bp, mouse
gtgatcgaacagacgagatg

SEQ ID NO: 827115 - DNA, 20 bp, mouse
ggcccgcccgaggccagtaa

SEQ ID NO: 827116 - DNA, 20 bp, mouse
gccgccgcgcgccacggcga

SEQ ID NO: 827117 - DNA, 20 bp, mouse
gcgcgcgccattggcgtcag

SEQ ID NO: 827118 - DNA, 20 bp, mouse
gcacgcgccgctgacgccaa

SEQ ID NO: 827119 - DNA, 20 bp, mouse
gcccccaccgcgcgacccgg

SEQ ID NO: 827120 - DNA, 20 bp, mouse
gccggccggcgggctacgga

SEQ ID NO: 827121 - DNA, 20 bp, mouse
gtcgcgcggtgggggacggt

SEQ ID NO: 827122 - DNA, 20 bp, mouse
ggacccggcggcatggagcc

SEQ ID NO: 827123 - DNA, 20 bp, mouse
ggccggcgggctacggatgg

SEQ ID NO: 827124 - DNA, 20 bp, mouse
gggagccccttgtgcccgtg

SEQ ID NO: 827125 - DNA, 20 bp, mouse
ggccaccgcacgggcacaag

SEQ ID NO: 827126 - DNA, 20 bp, mouse
gcccgggcgagtctcgctga

SEQ ID NO: 827127 - DNA, 20 bp, mouse
gaggcggtgcgcaaggagga

SEQ ID NO: 827128 - DNA, 20 bp, mouse
gagtctcgctgagggttgtg

SEQ ID NO: 827129 - DNA, 20 bp, mouse
gcccggccctagctcctcgg

SEQ ID NO: 827130 - DNA, 20 bp, mouse
gagggctccggcactactac

SEQ ID NO: 827131 - DNA, 20 bp, mouse
gtctgggaggagcagaccct

SEQ ID NO: 827132 - DNA, 20 bp, mouse
ggtacaccgccgaggagcta

SEQ ID NO: 827133 - DNA, 20 bp, mouse
ggtggcgcccgcggggacgg

SEQ ID NO: 827134 - DNA, 20 bp, mouse
gggaaggcgggaatgacatt

SEQ ID NO: 827135 - DNA, 20 bp, mouse
gaagacacaaggagccgagt

SEQ ID NO: 827136 - DNA, 20 bp, mouse
gttacgtagggggactcgga

SEQ ID NO: 827137 - DNA, 20 bp, mouse
gcaggaggggcgctctccga

SEQ ID NO: 827138 - DNA, 20 bp, mouse
gcgcgcgagctcctcgacta

SEQ ID NO: 827139 - DNA, 20 bp, mouse
gcggatgctagcaggctctt

SEQ ID NO: 827140 - DNA, 20 bp, mouse
gggagagcgcccctcctgca

SEQ ID NO: 827141 - DNA, 20 bp, mouse
gcagaggctcggatgctagc

SEQ ID NO: 827142 - DNA, 20 bp, mouse
gtgggaggagagagcgcctg

SEQ ID NO: 827143 - DNA, 20 bp, mouse
gggccctagcgccattttgt

SEQ ID NO: 827144 - DNA, 20 bp, mouse
gaacgcgtaagggcttgggg

SEQ ID NO: 827145 - DNA, 20 bp, mouse
gctctctcctcccagaggct

SEQ ID NO: 827146 - DNA, 20 bp, mouse
ggtgaggcaagtctctgaag

SEQ ID NO: 827147 - DNA, 20 bp, mouse
ggaggcagatcatctctagt

SEQ ID NO: 827148 - DNA, 20 bp, mouse
gtatcatagtcactagacgt

SEQ ID NO: 827149 - DNA, 20 bp, mouse
ggatctgcctctccttactg

SEQ ID NO: 827150 - DNA, 20 bp, mouse
gaacggaagaggaccaagtg

SEQ ID NO: 827151 - DNA, 20 bp, mouse
gagtctctgaaggggtttat

SEQ ID NO: 827152 - DNA, 20 bp, mouse
gagatcatctctagtaggaa

SEQ ID NO: 827153 - DNA, 20 bp, mouse
gctgaaatttgaaacggaag

SEQ ID NO: 827154 - DNA, 20 bp, mouse
gtcctgcgagtgaacgtgtg

SEQ ID NO: 827155 - DNA, 20 bp, mouse
gtctagtaggaaaggaatat

SEQ ID NO: 827156 - DNA, 20 bp, mouse
gagttccagactgtgtagtg

SEQ ID NO: 827157 - DNA, 20 bp, mouse
gcagctcaagttcactacgg

SEQ ID NO: 827158 - DNA, 20 bp, mouse
gaattgctggatatggtctc

SEQ ID NO: 827159 - DNA, 20 bp, mouse
gcgcgcctcactacacagtc

SEQ ID NO: 827160 - DNA, 20 bp, mouse
gcatgcaagctacagtcaga

SEQ ID NO: 827161 - DNA, 20 bp, mouse
gaatgggctacgcggagagg

SEQ ID NO: 827162 - DNA, 20 bp, mouse
ggccaatgggctacgcggag

SEQ ID NO: 827163 - DNA, 20 bp, mouse
gacgcgcagtgcggaattgt

SEQ ID NO: 827164 - DNA, 20 bp, mouse
gctcgtgtccaggtagggcg

SEQ ID NO: 827165 - DNA, 20 bp, mouse
gattctattggccaaggaaa

SEQ ID NO: 827166 - DNA, 20 bp, mouse
gacccccaggaactccgctg

SEQ ID NO: 827167 - DNA, 20 bp, mouse
gccggccgggcaccaccccc

SEQ ID NO: 827168 - DNA, 20 bp, mouse
gaggacagggcatacctcct

SEQ ID NO: 827169 - DNA, 20 bp, mouse
gctacctcagcggagttcct

SEQ ID NO: 827170 - DNA, 20 bp, mouse
ggccgctctgggaaaggttc

SEQ ID NO: 827171 - DNA, 20 bp, mouse
ggggtggtgcccggccggaa

SEQ ID NO: 827172 - DNA, 20 bp, mouse
ggggaaaggttccggttgac

SEQ ID NO: 827173 - DNA, 20 bp, mouse
gtggtgcccggccggaatgg

SEQ ID NO: 827174 - DNA, 20 bp, mouse
gggttcccaaagtgacaaga

SEQ ID NO: 827175 - DNA, 20 bp, mouse
gacacagcagcagccgctct

SEQ ID NO: 827176 - DNA, 20 bp, mouse
gcaagaggcggggccatatc

SEQ ID NO: 827177 - DNA, 20 bp, mouse
gtgtgcagaggccaggcgat

SEQ ID NO: 827178 - DNA, 20 bp, mouse
gaggcgatgggcaaagaaga

SEQ ID NO: 827179 - DNA, 20 bp, mouse
gggagctgaaggacttcggg

SEQ ID NO: 827180 - DNA, 20 bp, mouse
gtcgggaggcggggtgaagt

SEQ ID NO: 827181 - DNA, 20 bp, mouse
gcatggggcggagcgatgca

SEQ ID NO: 827182 - DNA, 20 bp, mouse
ggatgcacgggcaagaggcg

SEQ ID NO: 827183 - DNA, 20 bp, mouse
gactatatggggcggggcga

SEQ ID NO: 827184 - DNA, 20 bp, mouse
gcatcgctccgccccatgca

SEQ ID NO: 827185 - DNA, 20 bp, mouse
gcagcgcggcatcatcgctg

SEQ ID NO: 827186 - DNA, 20 bp, mouse
ggtccagaggatggggtctc

SEQ ID NO: 827187 - DNA, 20 bp, mouse
gagggctcccttcctgagac

SEQ ID NO: 827188 - DNA, 20 bp, mouse
gtcctccctgaaaaccagca

SEQ ID NO: 827189 - DNA, 20 bp, mouse
ggggactggagcccagttgt

SEQ ID NO: 827190 - DNA, 20 bp, mouse
gaggtgagcctgagcaagga

SEQ ID NO: 827191 - DNA, 20 bp, mouse
gcccctgaaaggggtgggac

SEQ ID NO: 827192 - DNA, 20 bp, mouse
gccgggctgtggtctctctc

SEQ ID NO: 827193 - DNA, 20 bp, mouse
gactgggcagggccaggacg

SEQ ID NO: 827194 - DNA, 20 bp, mouse
gccacaagcgtccagaggat

SEQ ID NO: 827195 - DNA, 20 bp, mouse
ggccctgctggttttcaggg

SEQ ID NO: 827196 - DNA, 20 bp, mouse
gtggccattggctgtgaagg

SEQ ID NO: 827197 - DNA, 20 bp, mouse
gaggtatgagctcaggcaga

SEQ ID NO: 827198 - DNA, 20 bp, mouse
gagccatggtggtcacacaa

SEQ ID NO: 827199 - DNA, 20 bp, mouse
ggctgggctcactgtgacca

SEQ ID NO: 827200 - DNA, 20 bp, mouse
gtggagcaggatatatttgt

SEQ ID NO: 827201 - DNA, 20 bp, mouse
gtcacagccaatggccacac

SEQ ID NO: 827202 - DNA, 20 bp, mouse
gctgcccccacccacccaat

SEQ ID NO: 827203 - DNA, 20 bp, mouse
gcaaatgaatggatgaggct

SEQ ID NO: 827204 - DNA, 20 bp, mouse
gctcatacctgtgtggccat

SEQ ID NO: 827205 - DNA, 20 bp, mouse
ggatcctgcccggggatgag

SEQ ID NO: 827206 - DNA, 20 bp, mouse
gatgtactgcgtcaagggga

SEQ ID NO: 827207 - DNA, 20 bp, mouse
gaggttgctctaggaatgaa

SEQ ID NO: 827208 - DNA, 20 bp, mouse
gggacagagtttgttagata

SEQ ID NO: 827209 - DNA, 20 bp, mouse
gatacacaaggcatcaggcg

SEQ ID NO: 827210 - DNA, 20 bp, mouse
gtgccgagaggcttgggcgt

SEQ ID NO: 827211 - DNA, 20 bp, mouse
ggtgacaagaccacagttag

SEQ ID NO: 827212 - DNA, 20 bp, mouse
gatggagtggagtatacaca

SEQ ID NO: 827213 - DNA, 20 bp, mouse
gcagctgtgaccactaactg

SEQ ID NO: 827214 - DNA, 20 bp, mouse
gaggaatgaagggtgccgag

SEQ ID NO: 827215 - DNA, 20 bp, mouse
gtgcctacgcccaagcctct

SEQ ID NO: 827216 - DNA, 20 bp, mouse
gaatatttaggatatggtaa

SEQ ID NO: 827217 - DNA, 20 bp, mouse
gagtttaaggaaatttggtt

SEQ ID NO: 827218 - DNA, 20 bp, mouse
gtcctaagtccttaatggca

SEQ ID NO: 827219 - DNA, 20 bp, mouse
ggggccagtttgcattgtga

SEQ ID NO: 827220 - DNA, 20 bp, mouse
gaagttgaatatttcctgtt

SEQ ID NO: 827221 - DNA, 20 bp, mouse
gataccctcacaatgcaaac

SEQ ID NO: 827222 - DNA, 20 bp, mouse
gcagagacttcaaaaggagc

SEQ ID NO: 827223 - DNA, 20 bp, mouse
ggccttgccattaaggactt

SEQ ID NO: 827224 - DNA, 20 bp, mouse
gtgtcaattaaatgccaaac

SEQ ID NO: 827225 - DNA, 20 bp, mouse
gctcaatgtgtgggaaatat

SEQ ID NO: 827226 - DNA, 20 bp, mouse
gcttcagactgctgtataca

SEQ ID NO: 827227 - DNA, 20 bp, mouse
gatacagggcatgaagcatc

SEQ ID NO: 827228 - DNA, 20 bp, mouse
gcacaaaaaattgttgtcaa

SEQ ID NO: 827229 - DNA, 20 bp, mouse
gctttctgcagcaactactg

SEQ ID NO: 827230 - DNA, 20 bp, mouse
ggattgtattaacacatctt

SEQ ID NO: 827231 - DNA, 20 bp, mouse
gtagataactgacaatatgt

SEQ ID NO: 827232 - DNA, 20 bp, mouse
gtaagtataactttaatagc

SEQ ID NO: 827233 - DNA, 20 bp, mouse
gattagtgaaatttggcttt

SEQ ID NO: 827234 - DNA, 20 bp, mouse
gactttgtatatacagcatt

SEQ ID NO: 827235 - DNA, 20 bp, mouse
gccatttcattagtgaaatt

SEQ ID NO: 827236 - DNA, 20 bp, mouse
gctagtctacagaatgtgtc

SEQ ID NO: 827237 - DNA, 20 bp, mouse
gagaggacatcaagaatatg

SEQ ID NO: 827238 - DNA, 20 bp, mouse
gaaatgcaaaatagtctcag

SEQ ID NO: 827239 - DNA, 20 bp, mouse
gtctggagtcattatttaag

SEQ ID NO: 827240 - DNA, 20 bp, mouse
ggaactcgcttgaatctcct

SEQ ID NO: 827241 - DNA, 20 bp, mouse
gacgctgctaccatgagaag

SEQ ID NO: 827242 - DNA, 20 bp, mouse
ggaccctaacctaaggttaa

SEQ ID NO: 827243 - DNA, 20 bp, mouse
gtgagaaggggtgtttagac

SEQ ID NO: 827244 - DNA, 20 bp, mouse
gaaggagagaccctaaccta

SEQ ID NO: 827245 - DNA, 20 bp, mouse
gatctcctagggagctagtc

SEQ ID NO: 827246 - DNA, 20 bp, mouse
gttaagtcttacagggaaag

SEQ ID NO: 827247 - DNA, 20 bp, mouse
gtagataagttaagtcttac

SEQ ID NO: 827248 - DNA, 20 bp, mouse
gtatgaagaactcaatatag

SEQ ID NO: 827249 - DNA, 20 bp, mouse
gcttaacttatctacagaat

SEQ ID NO: 827250 - DNA, 20 bp, mouse
gcacatcaaaattatgttgt

SEQ ID NO: 827251 - DNA, 20 bp, mouse
gcccaagaaactgctactgt

SEQ ID NO: 827252 - DNA, 20 bp, mouse
ggcctacagtagcagtttct

SEQ ID NO: 827253 - DNA, 20 bp, mouse
gataagtctagtagttgagt

SEQ ID NO: 827254 - DNA, 20 bp, mouse
gtcacagctataaaactaaa

SEQ ID NO: 827255 - DNA, 20 bp, mouse
gttcttctttccttaaataa

SEQ ID NO: 827256 - DNA, 20 bp, mouse
gacccagtaacggcttttgg

SEQ ID NO: 827257 - DNA, 20 bp, mouse
gaagcctaggggatccagac

SEQ ID NO: 827258 - DNA, 20 bp, mouse
ggtgacccagtaacggcttt

SEQ ID NO: 827259 - DNA, 20 bp, mouse
gggaatcagaagtatcttta

SEQ ID NO: 827260 - DNA, 20 bp, mouse
gatgaacggaatggagatac

SEQ ID NO: 827261 - DNA, 20 bp, mouse
gaatgcaaaacagtgtcaaa

SEQ ID NO: 827262 - DNA, 20 bp, mouse
gataagcaatattctgcagc

SEQ ID NO: 827263 - DNA, 20 bp, mouse
gatgctagacatatactgac

SEQ ID NO: 827264 - DNA, 20 bp, mouse
gaaaccagtctggatcccct

SEQ ID NO: 827265 - DNA, 20 bp, mouse
gcctgaacctttaactcctt

SEQ ID NO: 827266 - DNA, 20 bp, mouse
ggatagattcagaactttat

SEQ ID NO: 827267 - DNA, 20 bp, mouse
ggaatctatcacatgacaat

SEQ ID NO: 827268 - DNA, 20 bp, mouse
gagaggaggcagggcaatgt

SEQ ID NO: 827269 - DNA, 20 bp, mouse
gcttgcaggtctagctcctt

SEQ ID NO: 827270 - DNA, 20 bp, mouse
gacatgggttatgtagaaaa

SEQ ID NO: 827271 - DNA, 20 bp, mouse
gaaaatatattaaaaatggg

SEQ ID NO: 827272 - DNA, 20 bp, mouse
gatccaggggtttgagacat

SEQ ID NO: 827273 - DNA, 20 bp, mouse
ggtatcactgtcaaatacac

SEQ ID NO: 827274 - DNA, 20 bp, mouse
gtgaaattacttgaatccag

SEQ ID NO: 827275 - DNA, 20 bp, mouse
gcatcatcatcaactgggca

SEQ ID NO: 827276 - DNA, 20 bp, mouse
ggaaagactagtggatgttg

SEQ ID NO: 827277 - DNA, 20 bp, mouse
gccatggaggcgagggaggt

SEQ ID NO: 827278 - DNA, 20 bp, mouse
gaggatagagcactctggtt

SEQ ID NO: 827279 - DNA, 20 bp, mouse
gaaaaaggagacctctttcc

SEQ ID NO: 827280 - DNA, 20 bp, mouse
gctagtctttctgctcttgg

SEQ ID NO: 827281 - DNA, 20 bp, mouse
ggaaataagtaagcagacac

SEQ ID NO: 827282 - DNA, 20 bp, mouse
ggaataggccatggaggcga

SEQ ID NO: 827283 - DNA, 20 bp, mouse
gggtttgggttcgaagttct

SEQ ID NO: 827284 - DNA, 20 bp, mouse
ggtctcaggatagagcactc

SEQ ID NO: 827285 - DNA, 20 bp, mouse
gacaccatttctggtctaag

SEQ ID NO: 827286 - DNA, 20 bp, mouse
gtgggactctcttagctata

SEQ ID NO: 827287 - DNA, 20 bp, mouse
gattattagaggaacaaata

SEQ ID NO: 827288 - DNA, 20 bp, mouse
ggaaattcatatgttttcct

SEQ ID NO: 827289 - DNA, 20 bp, mouse
gccaatgataaagaaaatat

SEQ ID NO: 827290 - DNA, 20 bp, mouse
gtgtgtgagcaaagcacttc

SEQ ID NO: 827291 - DNA, 20 bp, mouse
gctctcacatacattattag

SEQ ID NO: 827292 - DNA, 20 bp, mouse
ggtgacaagacacatttttg

SEQ ID NO: 827293 - DNA, 20 bp, mouse
ggagagataaggacatcata

SEQ ID NO: 827294 - DNA, 20 bp, mouse
gcagaaatttaaatagattt

SEQ ID NO: 827295 - DNA, 20 bp, mouse
ggataagaatatgagagata

SEQ ID NO: 827296 - DNA, 20 bp, mouse
gggatattagacacagtgtc

SEQ ID NO: 827297 - DNA, 20 bp, mouse
gaatttatgaaacaattcct

SEQ ID NO: 827298 - DNA, 20 bp, mouse
gaacaaatataaacaatccc

SEQ ID NO: 827299 - DNA, 20 bp, mouse
gtagtcagtaatgtataagt

SEQ ID NO: 827300 - DNA, 20 bp, mouse
gagaaatgtggtacttcctt

SEQ ID NO: 827301 - DNA, 20 bp, mouse
gttattcaacttcagaaaac

SEQ ID NO: 827302 - DNA, 20 bp, mouse
gagatattcaggtactatgt

SEQ ID NO: 827303 - DNA, 20 bp, mouse
gaaatttgcagataggcaaa

SEQ ID NO: 827304 - DNA, 20 bp, mouse
gatatataaattgttaccaa

SEQ ID NO: 827305 - DNA, 20 bp, mouse
gaagcagaggtgatctcttt

SEQ ID NO: 827306 - DNA, 20 bp, mouse
gaatgctgaaggaaatatcg

SEQ ID NO: 827307 - DNA, 20 bp, mouse
gggtctctagataatgctga

SEQ ID NO: 827308 - DNA, 20 bp, mouse
ggaaatcaagacttcttaag

SEQ ID NO: 827309 - DNA, 20 bp, mouse
gaaggaacaatatgttttaa

SEQ ID NO: 827310 - DNA, 20 bp, mouse
gaattacactcatattttga

SEQ ID NO: 827311 - DNA, 20 bp, mouse
gatagaaattcttagataca

SEQ ID NO: 827312 - DNA, 20 bp, mouse
gtattttaaattgttccaaa

SEQ ID NO: 827313 - DNA, 20 bp, mouse
gagcttgaattattctaaaa

SEQ ID NO: 827314 - DNA, 20 bp, mouse
gtggaacaatttaaaatatc

SEQ ID NO: 827315 - DNA, 20 bp, mouse
gatacaaaatttttcccctt

SEQ ID NO: 827316 - DNA, 20 bp, mouse
gtaaggacaggagcaactga

SEQ ID NO: 827317 - DNA, 20 bp, mouse
gctgtagacaagctaaggac

SEQ ID NO: 827318 - DNA, 20 bp, mouse
gagaaaggtcactggagggt

SEQ ID NO: 827319 - DNA, 20 bp, mouse
ggaagaagtgtcaggttgtg

SEQ ID NO: 827320 - DNA, 20 bp, mouse
gactggagggtgggaagttg

SEQ ID NO: 827321 - DNA, 20 bp, mouse
gagggtaggtatatacctgc

SEQ ID NO: 827322 - DNA, 20 bp, mouse
gtagcatataggatgcaaaa

SEQ ID NO: 827323 - DNA, 20 bp, mouse
ggaaatctgaaaggtcttca

SEQ ID NO: 827324 - DNA, 20 bp, mouse
gtagatgaagccttcagggt

SEQ ID NO: 827325 - DNA, 20 bp, mouse
gttattgaacagcaatagat

SEQ ID NO: 827326 - DNA, 20 bp, mouse
gtaaacttgatacttgattt

SEQ ID NO: 827327 - DNA, 20 bp, mouse
gtccatggcttattatgctt

SEQ ID NO: 827328 - DNA, 20 bp, mouse
ggtagaattggtgaaatcag

SEQ ID NO: 827329 - DNA, 20 bp, mouse
gaagtttacctgcacagaca

SEQ ID NO: 827330 - DNA, 20 bp, mouse
gaaatcagaattagtagaat

SEQ ID NO: 827331 - DNA, 20 bp, mouse
gcttcttcccttgtctgtgc

SEQ ID NO: 827332 - DNA, 20 bp, mouse
gttaagattgtagcatacat

SEQ ID NO: 827333 - DNA, 20 bp, mouse
gatatattacaaatgctgaa

SEQ ID NO: 827334 - DNA, 20 bp, mouse
ggccaaagcataataagcca

SEQ ID NO: 827335 - DNA, 20 bp, mouse
gtcattcttagtacatttag

SEQ ID NO: 827336 - DNA, 20 bp, mouse
ggcaaactacatctagatgg

SEQ ID NO: 827337 - DNA, 20 bp, mouse
gtagacctgtacattgttta

SEQ ID NO: 827338 - DNA, 20 bp, mouse
gaggtcagttcttctctata

SEQ ID NO: 827339 - DNA, 20 bp, mouse
gaaccattagcaaggcttaa

SEQ ID NO: 827340 - DNA, 20 bp, mouse
gcaaggcttaatggcttgtt

SEQ ID NO: 827341 - DNA, 20 bp, mouse
gaatgcaaactacatctaga

SEQ ID NO: 827342 - DNA, 20 bp, mouse
gatacaaaggacttttatga

SEQ ID NO: 827343 - DNA, 20 bp, mouse
gcaaaatttgcaatgtctct

SEQ ID NO: 827344 - DNA, 20 bp, mouse
gtctctgtaaacatgagtat

SEQ ID NO: 827345 - DNA, 20 bp, mouse
gtgttccataaacaatgtac

SEQ ID NO: 827346 - DNA, 20 bp, mouse
gtgtgtgagcaaaagaattc

SEQ ID NO: 827347 - DNA, 20 bp, mouse
ggagcaaaagaattctggtc

SEQ ID NO: 827348 - DNA, 20 bp, mouse
gaaaaatttggaaactcaca

SEQ ID NO: 827349 - DNA, 20 bp, mouse
gttccccaacacactaacag

SEQ ID NO: 827350 - DNA, 20 bp, mouse
gtgtaacaatgtatatagtt

SEQ ID NO: 827351 - DNA, 20 bp, mouse
gcagctcctgtagaattttc

SEQ ID NO: 827352 - DNA, 20 bp, mouse
gtgctcctctgttagtgtgt

SEQ ID NO: 827353 - DNA, 20 bp, mouse
gtgggactttcttgcctata

SEQ ID NO: 827354 - DNA, 20 bp, mouse
gggtacttataaagccttat

SEQ ID NO: 827355 - DNA, 20 bp, mouse
gtgtcagaatgtgagtgtta

SEQ ID NO: 827356 - DNA, 20 bp, mouse
gcagacaaatgctgtagata

SEQ ID NO: 827357 - DNA, 20 bp, mouse
gtatagagctgttgagtctt

SEQ ID NO: 827358 - DNA, 20 bp, mouse
gataagagggcacttctttg

SEQ ID NO: 827359 - DNA, 20 bp, mouse
gagcaaatctcattcaggtg

SEQ ID NO: 827360 - DNA, 20 bp, mouse
ggttaggtcaaattcacaca

SEQ ID NO: 827361 - DNA, 20 bp, mouse
gcccaagcatttcaacagtt

SEQ ID NO: 827362 - DNA, 20 bp, mouse
gaaacaacatgcgtacatga

SEQ ID NO: 827363 - DNA, 20 bp, mouse
gccactttccgaatatgaaa

SEQ ID NO: 827364 - DNA, 20 bp, mouse
gcattgcaaccgaattgtta

SEQ ID NO: 827365 - DNA, 20 bp, mouse
gttactgtgcattaatgccc

SEQ ID NO: 827366 - DNA, 20 bp, mouse
ggatgccaacccaaagacaa

SEQ ID NO: 827367 - DNA, 20 bp, mouse
gaggaagcagaaatcataca

SEQ ID NO: 827368 - DNA, 20 bp, mouse
gaaggcacagttcgtttcta

SEQ ID NO: 827369 - DNA, 20 bp, mouse
ggtcctcactaggtacctgg

SEQ ID NO: 827370 - DNA, 20 bp, mouse
gactcaatgtcagtcaaata

SEQ ID NO: 827371 - DNA, 20 bp, mouse
ggaaccttggtctagttgaa

SEQ ID NO: 827372 - DNA, 20 bp, mouse
ggtaaggcaaggcatgaagg

SEQ ID NO: 827373 - DNA, 20 bp, mouse
gagagtgacgtcacggaggt

SEQ ID NO: 827374 - DNA, 20 bp, mouse
gagcctccaggtacctagtg

SEQ ID NO: 827375 - DNA, 20 bp, mouse
gcgtgcaaccagaagcctcc

SEQ ID NO: 827376 - DNA, 20 bp, mouse
gaatagcaatgtgttgtaat

SEQ ID NO: 827377 - DNA, 20 bp, mouse
gtatgcaattggagacatta

SEQ ID NO: 827378 - DNA, 20 bp, mouse
gactgaaatataccagtcaa

SEQ ID NO: 827379 - DNA, 20 bp, mouse
gtgctaagagtcaaataaag

SEQ ID NO: 827380 - DNA, 20 bp, mouse
gtcaagacgtggagcatgta

SEQ ID NO: 827381 - DNA, 20 bp, mouse
gtttcagtgctgctcttgaa

SEQ ID NO: 827382 - DNA, 20 bp, mouse
gtatttgactcttagcaaat

SEQ ID NO: 827383 - DNA, 20 bp, mouse
ggagtaaaaaagtatgcaat

SEQ ID NO: 827384 - DNA, 20 bp, mouse
gtgactgccataaataatga

SEQ ID NO: 827385 - DNA, 20 bp, mouse
gggctgtttcatataatgac

SEQ ID NO: 827386 - DNA, 20 bp, mouse
gggtcagtcactacataaga

SEQ ID NO: 827387 - DNA, 20 bp, mouse
gggtctgtcaatattaatcc

SEQ ID NO: 827388 - DNA, 20 bp, mouse
gctgatatctttcaagacta

SEQ ID NO: 827389 - DNA, 20 bp, mouse
gatctagttcagtctttaga

SEQ ID NO: 827390 - DNA, 20 bp, mouse
gttacctaaatgacatcttt

SEQ ID NO: 827391 - DNA, 20 bp, mouse
gctctgctctccaattcacc

SEQ ID NO: 827392 - DNA, 20 bp, mouse
gaatattaatcctggtgaat

SEQ ID NO: 827393 - DNA, 20 bp, mouse
gtaatatactcatcgacatt

SEQ ID NO: 827394 - DNA, 20 bp, mouse
gatgtcatttaggtaaattt

SEQ ID NO: 827395 - DNA, 20 bp, mouse
gcttatgttctagagcacaa

SEQ ID NO: 827396 - DNA, 20 bp, mouse
gcagttgagagcatacattt

SEQ ID NO: 827397 - DNA, 20 bp, mouse
gtgtgaatccaaatcttaaa

SEQ ID NO: 827398 - DNA, 20 bp, mouse
gagcaaaccaacaattatca

SEQ ID NO: 827399 - DNA, 20 bp, mouse
gtgatagccttgataattgt

SEQ ID NO: 827400 - DNA, 20 bp, mouse
gtggtttgctcaagaaaaat

SEQ ID NO: 827401 - DNA, 20 bp, mouse
gtcacacatctacatcaatg

SEQ ID NO: 827402 - DNA, 20 bp, mouse
gtacatttagggttttacag

SEQ ID NO: 827403 - DNA, 20 bp, mouse
ggtatactttaacatttaat

SEQ ID NO: 827404 - DNA, 20 bp, mouse
gtcattgcccatttaagatt

SEQ ID NO: 827405 - DNA, 20 bp, mouse
gttattgttaccaaataatg

SEQ ID NO: 827406 - DNA, 20 bp, mouse
gaaacccaagattttcatgg

SEQ ID NO: 827407 - DNA, 20 bp, mouse
gtgactaaaatgtgtataca

SEQ ID NO: 827408 - DNA, 20 bp, mouse
gaaaattagatgtgaaatac

SEQ ID NO: 827409 - DNA, 20 bp, mouse
gccatttacacattactctt

SEQ ID NO: 827410 - DNA, 20 bp, mouse
gtgtgtaaatgggattttaa

SEQ ID NO: 827411 - DNA, 20 bp, mouse
gtaggaaacatcaattttcc

SEQ ID NO: 827412 - DNA, 20 bp, mouse
gatttatatgtcatctactc

SEQ ID NO: 827413 - DNA, 20 bp, mouse
gatttaaaaagtctacatat

SEQ ID NO: 827414 - DNA, 20 bp, mouse
gaaagcagagttcatctctt

SEQ ID NO: 827415 - DNA, 20 bp, mouse
gattcctccatgaaaatctt

SEQ ID NO: 827416 - DNA, 20 bp, mouse
gaaaaatgtaacaagaatgt

SEQ ID NO: 827417 - DNA, 20 bp, mouse
gaggcagattaaatgccaaa

SEQ ID NO: 827418 - DNA, 20 bp, mouse
gtccccttatactgattgaa

SEQ ID NO: 827419 - DNA, 20 bp, mouse
gcagacattgcagaaggagg

SEQ ID NO: 827420 - DNA, 20 bp, mouse
gaagccgttcaatcagtata

SEQ ID NO: 827421 - DNA, 20 bp, mouse
gaatcagacattgcagaagg

SEQ ID NO: 827422 - DNA, 20 bp, mouse
gaaaggacaacccatttttg

SEQ ID NO: 827423 - DNA, 20 bp, mouse
gtgattgaacggcttgtatg

SEQ ID NO: 827424 - DNA, 20 bp, mouse
ggatttccataccacaaaaa

SEQ ID NO: 827425 - DNA, 20 bp, mouse
ggcagatgatttagaaacaa

SEQ ID NO: 827426 - DNA, 20 bp, mouse
gaatctgtatgtaactcagt

SEQ ID NO: 827427 - DNA, 20 bp, mouse
gcagctacattcacctacat

SEQ ID NO: 827428 - DNA, 20 bp, mouse
gcaagaagatgtaccaatgt

SEQ ID NO: 827429 - DNA, 20 bp, mouse
gaaggcatgttgatttgcat

SEQ ID NO: 827430 - DNA, 20 bp, mouse
ggcagattccaggctacgat

SEQ ID NO: 827431 - DNA, 20 bp, mouse
gtctgctgccactgatgatg

SEQ ID NO: 827432 - DNA, 20 bp, mouse
gcatgtgtcctatcgtagcc

SEQ ID NO: 827433 - DNA, 20 bp, mouse
ggtaaaagaggtttggtgat

SEQ ID NO: 827434 - DNA, 20 bp, mouse
gtgagtattacttattgaca

SEQ ID NO: 827435 - DNA, 20 bp, mouse
gtcttgcttgtcattatatt

SEQ ID NO: 827436 - DNA, 20 bp, mouse
gtcccgggctcgggtaccat

SEQ ID NO: 827437 - DNA, 20 bp, mouse
gagggagtgtcagggactgt

SEQ ID NO: 827438 - DNA, 20 bp, mouse
gtgctcaggcagtagataaa

SEQ ID NO: 827439 - DNA, 20 bp, mouse
gtctccagaagggagtgtca

SEQ ID NO: 827440 - DNA, 20 bp, mouse
ggccccatggtacccgagcc

SEQ ID NO: 827441 - DNA, 20 bp, mouse
gggtcacaacctgcaatgat

SEQ ID NO: 827442 - DNA, 20 bp, mouse
gagtgtcagggactgtgggt

SEQ ID NO: 827443 - DNA, 20 bp, mouse
gagggactgtgggtaggggc

SEQ ID NO: 827444 - DNA, 20 bp, mouse
gctacctactgacacctaat

SEQ ID NO: 827445 - DNA, 20 bp, mouse
gtaggtgtcagtaggtaggt

SEQ ID NO: 827446 - DNA, 20 bp, mouse
gggtctacagtgtgtatatt

SEQ ID NO: 827447 - DNA, 20 bp, mouse
gatacacactgtagaccaag

SEQ ID NO: 827448 - DNA, 20 bp, mouse
gagttggttgaactgaaaag

SEQ ID NO: 827449 - DNA, 20 bp, mouse
gactctgtgcagtaacaaat

SEQ ID NO: 827450 - DNA, 20 bp, mouse
gaggagctttctgagtataa

SEQ ID NO: 827451 - DNA, 20 bp, mouse
gtagtcagatgaaaatgttg

SEQ ID NO: 827452 - DNA, 20 bp, mouse
gaagctcctgatacaagtct

SEQ ID NO: 827453 - DNA, 20 bp, mouse
gcatctgactactgtagtta

SEQ ID NO: 827454 - DNA, 20 bp, mouse
gaaatgttgtggcagaatca

SEQ ID NO: 827455 - DNA, 20 bp, mouse
gcagaacctagacttgtatc

SEQ ID NO: 827456 - DNA, 20 bp, mouse
ggacctgcggagaagataaa

SEQ ID NO: 827457 - DNA, 20 bp, mouse
ggagaccatggaaagtaatt

SEQ ID NO: 827458 - DNA, 20 bp, mouse
ggataaacagcttgagacca

SEQ ID NO: 827459 - DNA, 20 bp, mouse
gttctacacacagttaattt

SEQ ID NO: 827460 - DNA, 20 bp, mouse
gacatacaatatccaggcta

SEQ ID NO: 827461 - DNA, 20 bp, mouse
gtggcagcagctgaaatttg

SEQ ID NO: 827462 - DNA, 20 bp, mouse
gctaggaaattctggagagt

SEQ ID NO: 827463 - DNA, 20 bp, mouse
gaaatggacatacaatatcc

SEQ ID NO: 827464 - DNA, 20 bp, mouse
ggggtgtcctgtgtgatatt

SEQ ID NO: 827465 - DNA, 20 bp, mouse
gtgtttggcaatccttagcc

SEQ ID NO: 827466 - DNA, 20 bp, mouse
gggcacacaagtgatgatgt

SEQ ID NO: 827467 - DNA, 20 bp, mouse
gattggaaacttcctccatt

SEQ ID NO: 827468 - DNA, 20 bp, mouse
gctacagagtgcagtgtttc

SEQ ID NO: 827469 - DNA, 20 bp, mouse
gacatcaatgggaattttga

SEQ ID NO: 827470 - DNA, 20 bp, mouse
gttaagtatgagattaaagt

SEQ ID NO: 827471 - DNA, 20 bp, mouse
gtgcagtgtttcaggtgagg

SEQ ID NO: 827472 - DNA, 20 bp, mouse
gcaaatgcagtgcatgttta

SEQ ID NO: 827473 - DNA, 20 bp, mouse
ggtgaatatcaacctaatgg

SEQ ID NO: 827474 - DNA, 20 bp, mouse
gagtctcaataagttagtta

SEQ ID NO: 827475 - DNA, 20 bp, mouse
gctgtaatttcagctttgat

SEQ ID NO: 827476 - DNA, 20 bp, mouse
ggggaggctcatggttacca

SEQ ID NO: 827477 - DNA, 20 bp, mouse
gcaggcaccagggaggctca

SEQ ID NO: 827478 - DNA, 20 bp, mouse
gtgtcccaggacttagggat

SEQ ID NO: 827479 - DNA, 20 bp, mouse
ggtagcaatgtgcagggtgt

SEQ ID NO: 827480 - DNA, 20 bp, mouse
gactcctatccctaagtcct

SEQ ID NO: 827481 - DNA, 20 bp, mouse
gtggatacatgcaaaagccc

SEQ ID NO: 827482 - DNA, 20 bp, mouse
gcagcagatatgcccatccc

SEQ ID NO: 827483 - DNA, 20 bp, mouse
ggaggattcagcaaggtgat

SEQ ID NO: 827484 - DNA, 20 bp, mouse
gattctcagttcagtgacac

SEQ ID NO: 827485 - DNA, 20 bp, mouse
ggggaaaggtagcaatgtgc

SEQ ID NO: 827486 - DNA, 20 bp, mouse
gtaagagacaccatatgcaa

SEQ ID NO: 827487 - DNA, 20 bp, mouse
gttgacaatgggtaggggat

SEQ ID NO: 827488 - DNA, 20 bp, mouse
gggggtaagaggtaattgtt

SEQ ID NO: 827489 - DNA, 20 bp, mouse
gggatgttgacaatgggtag

SEQ ID NO: 827490 - DNA, 20 bp, mouse
gcatgcaccctactgaatat

SEQ ID NO: 827491 - DNA, 20 bp, mouse
gcagtagggtgcatgccctg

SEQ ID NO: 827492 - DNA, 20 bp, mouse
gagagagcaggcaaattcac

SEQ ID NO: 827493 - DNA, 20 bp, mouse
ggagctcatgtcaatgatgg

SEQ ID NO: 827494 - DNA, 20 bp, mouse
gccaagcagccccaggtgtg

SEQ ID NO: 827495 - DNA, 20 bp, mouse
gtcggagctcatgtcaatga

SEQ ID NO: 827496 - DNA, 20 bp, mouse
gctacagcatttcagagctg

SEQ ID NO: 827497 - DNA, 20 bp, mouse
gcccatggccattttcaagt

SEQ ID NO: 827498 - DNA, 20 bp, mouse
ggtgtgctaatggatgaata

SEQ ID NO: 827499 - DNA, 20 bp, mouse
gtaatggatgaatatggtac

SEQ ID NO: 827500 - DNA, 20 bp, mouse
gtaatagcaaatcagttcaa

SEQ ID NO: 827501 - DNA, 20 bp, mouse
gagagctttgacaatttttt

SEQ ID NO: 827502 - DNA, 20 bp, mouse
gtcctacttgaaaatggcca

SEQ ID NO: 827503 - DNA, 20 bp, mouse
gatgctttcctacttgaaaa

SEQ ID NO: 827504 - DNA, 20 bp, mouse
gcattgcatattgtgtatac

SEQ ID NO: 827505 - DNA, 20 bp, mouse
gatgttttgtagaaatccca

SEQ ID NO: 827506 - DNA, 20 bp, mouse
ggcccagtgtcacaaggaca

SEQ ID NO: 827507 - DNA, 20 bp, mouse
gaaggacaaggaaggtatct

SEQ ID NO: 827508 - DNA, 20 bp, mouse
gcatgactgctactagggat

SEQ ID NO: 827509 - DNA, 20 bp, mouse
gtgccaggttctacctcctt

SEQ ID NO: 827510 - DNA, 20 bp, mouse
gactgccctgatgctccctc

SEQ ID NO: 827511 - DNA, 20 bp, mouse
ggactcaatttcagagggac

SEQ ID NO: 827512 - DNA, 20 bp, mouse
gactgagactcaatttcaga

SEQ ID NO: 827513 - DNA, 20 bp, mouse
gcccgacaaaagcattgtaa

SEQ ID NO: 827514 - DNA, 20 bp, mouse
gggtacagtaaagtaacaag

SEQ ID NO: 827515 - DNA, 20 bp, mouse
gaggtacatgactgctacta

SEQ ID NO: 827516 - DNA, 20 bp, mouse
gccccaataggaaacctgga

SEQ ID NO: 827517 - DNA, 20 bp, mouse
ggtaagggaggagtaatgat

SEQ ID NO: 827518 - DNA, 20 bp, mouse
gtggggatttgggttcataa

SEQ ID NO: 827519 - DNA, 20 bp, mouse
ggcacgaaagcttatggtaa

SEQ ID NO: 827520 - DNA, 20 bp, mouse
gcgaaagcttatggtaaggg

SEQ ID NO: 827521 - DNA, 20 bp, mouse
gggttcataaggggaaattc

SEQ ID NO: 827522 - DNA, 20 bp, mouse
gtcccctccaggtttcctat

SEQ ID NO: 827523 - DNA, 20 bp, mouse
gatgaacccaaatccccaat

SEQ ID NO: 827524 - DNA, 20 bp, mouse
gtcacccaccagagcaggaa

SEQ ID NO: 827525 - DNA, 20 bp, mouse
gtaatgatcggcctacctct

SEQ ID NO: 827526 - DNA, 20 bp, mouse
gacctgctgggtgaacttca

SEQ ID NO: 827527 - DNA, 20 bp, mouse
gtaagtcataggagttgtca

SEQ ID NO: 827528 - DNA, 20 bp, mouse
ggagttgtcagggacctgct

SEQ ID NO: 827529 - DNA, 20 bp, mouse
gcacatccaaatctagggag

SEQ ID NO: 827530 - DNA, 20 bp, mouse
gatccaggaaagcacctgta

SEQ ID NO: 827531 - DNA, 20 bp, mouse
gataaacacatccaaatcta

SEQ ID NO: 827532 - DNA, 20 bp, mouse
gtccctgaagttcacccagc

SEQ ID NO: 827533 - DNA, 20 bp, mouse
gaggtgctttcctggatttc

SEQ ID NO: 827534 - DNA, 20 bp, mouse
gtatgaaactgaagccatac

SEQ ID NO: 827535 - DNA, 20 bp, mouse
gtactgtggaccagaaatcc

SEQ ID NO: 827536 - DNA, 20 bp, mouse
ggcccagaataattttgtct

SEQ ID NO: 827537 - DNA, 20 bp, mouse
gcatataaaacactgaaaat

SEQ ID NO: 827538 - DNA, 20 bp, mouse
ggggctttcttggacaaaaa

SEQ ID NO: 827539 - DNA, 20 bp, mouse
gaaattattctgggctttct

SEQ ID NO: 827540 - DNA, 20 bp, mouse
ggatgattgattcatatgat

SEQ ID NO: 827541 - DNA, 20 bp, mouse
gtcaaaattcactaataact

SEQ ID NO: 827542 - DNA, 20 bp, mouse
gaatatagctaaaatgtacc

SEQ ID NO: 827543 - DNA, 20 bp, mouse
gtctatgtagatgattctat

SEQ ID NO: 827544 - DNA, 20 bp, mouse
gacctagacaaaattattct

SEQ ID NO: 827545 - DNA, 20 bp, mouse
gatcatctacatagaacttc

SEQ ID NO: 827546 - DNA, 20 bp, mouse
ggggacaggagtcattgaac

SEQ ID NO: 827547 - DNA, 20 bp, mouse
gcacctggctgtggcagagt

SEQ ID NO: 827548 - DNA, 20 bp, mouse
gggagtgatttccatgtctg

SEQ ID NO: 827549 - DNA, 20 bp, mouse
gcagcaaaactccagtacct

SEQ ID NO: 827550 - DNA, 20 bp, mouse
gaatacaggttatacaaatt

SEQ ID NO: 827551 - DNA, 20 bp, mouse
gtggagttttgctgctaggt

SEQ ID NO: 827552 - DNA, 20 bp, mouse
gtggcagagtaggcaaatac

SEQ ID NO: 827553 - DNA, 20 bp, mouse
gaaaaccaggagctatgaag

SEQ ID NO: 827554 - DNA, 20 bp, mouse
gctacagccaaaccactatt

SEQ ID NO: 827555 - DNA, 20 bp, mouse
ggtactggagttttgctgct

SEQ ID NO: 827556 - DNA, 20 bp, mouse
gtgacggtgggaagattaca

SEQ ID NO: 827557 - DNA, 20 bp, mouse
gtcacatgactaaaagtaag

SEQ ID NO: 827558 - DNA, 20 bp, mouse
gagagcttttagaaatgcac

SEQ ID NO: 827559 - DNA, 20 bp, mouse
gttgcagcatcactgacggt

SEQ ID NO: 827560 - DNA, 20 bp, mouse
gtatgaaaggatttggttac

SEQ ID NO: 827561 - DNA, 20 bp, mouse
gaataactctcaatgaagag

SEQ ID NO: 827562 - DNA, 20 bp, mouse
gttgatatgcaaattatgaa

SEQ ID NO: 827563 - DNA, 20 bp, mouse
gctcttgcccctaaatagca

SEQ ID NO: 827564 - DNA, 20 bp, mouse
gaggtgaaaagataatgggc

SEQ ID NO: 827565 - DNA, 20 bp, mouse
ggaccctgagattcctaatt

SEQ ID NO: 827566 - DNA, 20 bp, mouse
gctcgcggggcgtctgcttc

SEQ ID NO: 827567 - DNA, 20 bp, mouse
ggcggacagcgtcagaacga

SEQ ID NO: 827568 - DNA, 20 bp, mouse
gtgcacgtcgaccaatggaa

SEQ ID NO: 827569 - DNA, 20 bp, mouse
gtggcgtaaagcctttccat

SEQ ID NO: 827570 - DNA, 20 bp, mouse
ggcaacgccctcatcaatga

SEQ ID NO: 827571 - DNA, 20 bp, mouse
ggcctaggcgattaggactc

SEQ ID NO: 827572 - DNA, 20 bp, mouse
gacgtgtgcacgtcgaccaa

SEQ ID NO: 827573 - DNA, 20 bp, mouse
gagtcgttcgcccgttgcca

SEQ ID NO: 827574 - DNA, 20 bp, mouse
ggtcaaggctacatggatga

SEQ ID NO: 827575 - DNA, 20 bp, mouse
ggtcgacgtgcacacgtggc

SEQ ID NO: 827576 - DNA, 20 bp, mouse
ggctccgagttcatagaaat

SEQ ID NO: 827577 - DNA, 20 bp, mouse
gtgacctgaggccggcaagt

SEQ ID NO: 827578 - DNA, 20 bp, mouse
gaggccggcaagtcggacac

SEQ ID NO: 827579 - DNA, 20 bp, mouse
ggccggcctcaggtcacata

SEQ ID NO: 827580 - DNA, 20 bp, mouse
gccaccgcacactgacaccg

SEQ ID NO: 827581 - DNA, 20 bp, mouse
gcctggccatatgtgacctg

SEQ ID NO: 827582 - DNA, 20 bp, mouse
gtaaccacagcttcctgcca

SEQ ID NO: 827583 - DNA, 20 bp, mouse
gcgcacactgacaccgtggc

SEQ ID NO: 827584 - DNA, 20 bp, mouse
ggcacctgtgtccgacttgc

SEQ ID NO: 827585 - DNA, 20 bp, mouse
gcagtgtgcggtggaaatgc

SEQ ID NO: 827586 - DNA, 20 bp, mouse
gctgggccaccatccaatct

SEQ ID NO: 827587 - DNA, 20 bp, mouse
ggaaactgtggagggcagtt

SEQ ID NO: 827588 - DNA, 20 bp, mouse
gcaaatcccagattggatgg

SEQ ID NO: 827589 - DNA, 20 bp, mouse
ggtgtggacaaatcccagat

SEQ ID NO: 827590 - DNA, 20 bp, mouse
gcctgaagcccttatgctat

SEQ ID NO: 827591 - DNA, 20 bp, mouse
ggaggactaagcccctcccc

SEQ ID NO: 827592 - DNA, 20 bp, mouse
gcttcaggcccaacgcccat

SEQ ID NO: 827593 - DNA, 20 bp, mouse
gatgctattggttgagagtg

SEQ ID NO: 827594 - DNA, 20 bp, mouse
gagtttcagccaatgggcgt

SEQ ID NO: 827595 - DNA, 20 bp, mouse
gcagtctcactcctggacat

SEQ ID NO: 827596 - DNA, 20 bp, mouse
gggtgggtcaggtaggccgg

SEQ ID NO: 827597 - DNA, 20 bp, mouse
ggaaggtgagccggacgcta

SEQ ID NO: 827598 - DNA, 20 bp, mouse
ggggacccggggctcgggga

SEQ ID NO: 827599 - DNA, 20 bp, mouse
ggggacccgggttcaagggc

SEQ ID NO: 827600 - DNA, 20 bp, mouse
ggctgccgggaacccggaag

SEQ ID NO: 827601 - DNA, 20 bp, mouse
gtacctgacccaccagcaga

SEQ ID NO: 827602 - DNA, 20 bp, mouse
gtgtatccacaggtggggag

SEQ ID NO: 827603 - DNA, 20 bp, mouse
gggaagccgaggggccccgt

SEQ ID NO: 827604 - DNA, 20 bp, mouse
gcatcgggacccgggttcaa

SEQ ID NO: 827605 - DNA, 20 bp, mouse
ggctggtgggtcaggtaggc

SEQ ID NO: 827606 - DNA, 20 bp, mouse
gggcccttcgcgcggatcca

SEQ ID NO: 827607 - DNA, 20 bp, mouse
gacagagcttcgtgaggcgt

SEQ ID NO: 827608 - DNA, 20 bp, mouse
gacggcgccgattgctccaa

SEQ ID NO: 827609 - DNA, 20 bp, mouse
gggccctggatccgcgcgaa

SEQ ID NO: 827610 - DNA, 20 bp, mouse
gcgggagccgaaaataccga

SEQ ID NO: 827611 - DNA, 20 bp, mouse
gcgggagaggggcgtgactt

SEQ ID NO: 827612 - DNA, 20 bp, mouse
ggagccgaaaataccgatgg

SEQ ID NO: 827613 - DNA, 20 bp, mouse
ggattgctccaacgggagag

SEQ ID NO: 827614 - DNA, 20 bp, mouse
gccgatggagggtaacttgg

SEQ ID NO: 827615 - DNA, 20 bp, mouse
gcgaagctctgtggttggtt

SEQ ID NO: 827616 - DNA, 20 bp, mouse
gcgcactcggaagtcctcta

SEQ ID NO: 827617 - DNA, 20 bp, mouse
gtgggcatcgtggtcctgcg

SEQ ID NO: 827618 - DNA, 20 bp, mouse
ggtggcctgagggtctgagg

SEQ ID NO: 827619 - DNA, 20 bp, mouse
ggcatcgtggtcctgcgggg

SEQ ID NO: 827620 - DNA, 20 bp, mouse
gaacccgaggcggaaccttg

SEQ ID NO: 827621 - DNA, 20 bp, mouse
ggggaatcgctgagaccgga

SEQ ID NO: 827622 - DNA, 20 bp, mouse
gagtctgctgccgtggcctg

SEQ ID NO: 827623 - DNA, 20 bp, mouse
ggcgctgcgggacgcacagt

SEQ ID NO: 827624 - DNA, 20 bp, mouse
ggtgcgctgcaccttgaaga

SEQ ID NO: 827625 - DNA, 20 bp, mouse
gcgagctcgcggacgtcctc

SEQ ID NO: 827626 - DNA, 20 bp, mouse
gacagaggaaaaagctgtca

SEQ ID NO: 827627 - DNA, 20 bp, mouse
ggcggaggccctgaccggta

SEQ ID NO: 827628 - DNA, 20 bp, mouse
ggccgcgccccgaacctccg

SEQ ID NO: 827629 - DNA, 20 bp, mouse
gggtctacgctgagaggcag

SEQ ID NO: 827630 - DNA, 20 bp, mouse
ggcggaagcgagcctccctg

SEQ ID NO: 827631 - DNA, 20 bp, mouse
ggcggggcggaggccctgac

SEQ ID NO: 827632 - DNA, 20 bp, mouse
gctacgctgagaggcagtgg

SEQ ID NO: 827633 - DNA, 20 bp, mouse
gctgtcagggaaaccactaa

SEQ ID NO: 827634 - DNA, 20 bp, mouse
gcgtcacttccgccccaggg

SEQ ID NO: 827635 - DNA, 20 bp, mouse
gcggggcgcggcgtagcgtg

SEQ ID NO: 827636 - DNA, 20 bp, mouse
ggcgcaagcgtaggagggtg

SEQ ID NO: 827637 - DNA, 20 bp, mouse
ggggagggctcggtttgcgc

SEQ ID NO: 827638 - DNA, 20 bp, mouse
ggggacttgtgtgctgaagt

SEQ ID NO: 827639 - DNA, 20 bp, mouse
gcccgaggcgcaagcgtagg

SEQ ID NO: 827640 - DNA, 20 bp, mouse
ggcgcccgaggcgcaagcgt

SEQ ID NO: 827641 - DNA, 20 bp, mouse
ggcccccagcacggcgtcgg

SEQ ID NO: 827642 - DNA, 20 bp, mouse
gcgggaggggagagcgcccg

SEQ ID NO: 827643 - DNA, 20 bp, mouse
ggtaactccgcgagcctgtc

SEQ ID NO: 827644 - DNA, 20 bp, mouse
ggtgctgaagtggggcggga

SEQ ID NO: 827645 - DNA, 20 bp, mouse
gcctgtctgagggaacacga

SEQ ID NO: 827646 - DNA, 20 bp, mouse
gctgaagctacgcaagtcgt

SEQ ID NO: 827647 - DNA, 20 bp, mouse
gccctcccccgtcaaggttt

SEQ ID NO: 827648 - DNA, 20 bp, mouse
ggacgcagcactgcttaagg

SEQ ID NO: 827649 - DNA, 20 bp, mouse
gtacgcaagtcgtaggctgg

SEQ ID NO: 827650 - DNA, 20 bp, mouse
gggagccaaaaccttgacgg

SEQ ID NO: 827651 - DNA, 20 bp, mouse
gtaaccggatacacatcggg

SEQ ID NO: 827652 - DNA, 20 bp, mouse
ggatacacatcgggtgggac

SEQ ID NO: 827653 - DNA, 20 bp, mouse
gtccggcccctcccccgtca

SEQ ID NO: 827654 - DNA, 20 bp, mouse
gtgaaggctcacacagagac

SEQ ID NO: 827655 - DNA, 20 bp, mouse
gggctggcgtagacccgccc

SEQ ID NO: 827656 - DNA, 20 bp, mouse
gtcactgggaaaggattctg

SEQ ID NO: 827657 - DNA, 20 bp, mouse
gcttcccaccacggcatctt

SEQ ID NO: 827658 - DNA, 20 bp, mouse
ggggaccagatggcatcact

SEQ ID NO: 827659 - DNA, 20 bp, mouse
gagagcagatggaacctccc

SEQ ID NO: 827660 - DNA, 20 bp, mouse
ggggccccagcttcccacca

SEQ ID NO: 827661 - DNA, 20 bp, mouse
gagaaagcggggatcctggg

SEQ ID NO: 827662 - DNA, 20 bp, mouse
gtgggggagggaggttcata

SEQ ID NO: 827663 - DNA, 20 bp, mouse
gcggcatcttaggaagacag

SEQ ID NO: 827664 - DNA, 20 bp, mouse
gtctgggggaaccaagattg

SEQ ID NO: 827665 - DNA, 20 bp, mouse
gtcttcctaagatgccgtgg

SEQ ID NO: 827666 - DNA, 20 bp, mouse
gtcccccgggagccaagaac

SEQ ID NO: 827667 - DNA, 20 bp, mouse
gcctccgcaccaagcgactc

SEQ ID NO: 827668 - DNA, 20 bp, mouse
gatggaccgctggggagcga

SEQ ID NO: 827669 - DNA, 20 bp, mouse
ggcccagactggcgagtcac

SEQ ID NO: 827670 - DNA, 20 bp, mouse
gctgcagtgcgggtcctccg

SEQ ID NO: 827671 - DNA, 20 bp, mouse
gggactcactagggagattc

SEQ ID NO: 827672 - DNA, 20 bp, mouse
gtcgcctagccagagtcgct

SEQ ID NO: 827673 - DNA, 20 bp, mouse
gtagccagagtcgcttggtg

SEQ ID NO: 827674 - DNA, 20 bp, mouse
gcgactctggctaggcgact

SEQ ID NO: 827675 - DNA, 20 bp, mouse
ggctcccgggggactcacta

SEQ ID NO: 827676 - DNA, 20 bp, mouse
gccaagtggaccgacgtgag

SEQ ID NO: 827677 - DNA, 20 bp, mouse
gctctctggcagaaggtcta

SEQ ID NO: 827678 - DNA, 20 bp, mouse
ggggcgaggctcgggaccct

SEQ ID NO: 827679 - DNA, 20 bp, mouse
ggggaccctcggcacccatt

SEQ ID NO: 827680 - DNA, 20 bp, mouse
gaccaagggcccgccttccc

SEQ ID NO: 827681 - DNA, 20 bp, mouse
gctcccaccacgcgcccaat

SEQ ID NO: 827682 - DNA, 20 bp, mouse
gtggaccgacgtgagggggc

SEQ ID NO: 827683 - DNA, 20 bp, mouse
gttgtcccgccccctcacgt

SEQ ID NO: 827684 - DNA, 20 bp, mouse
gaatgggcacagtgcgtggg

SEQ ID NO: 827685 - DNA, 20 bp, mouse
gcacccattgggcgcgtggt

SEQ ID NO: 827686 - DNA, 20 bp, mouse
gagcgcgcgagtagggtgag

SEQ ID NO: 827687 - DNA, 20 bp, mouse
gcaggcggggcaagggtcga

SEQ ID NO: 827688 - DNA, 20 bp, mouse
gtcggcagccggcccctcgc

SEQ ID NO: 827689 - DNA, 20 bp, mouse
gcccctctataagaccagga

SEQ ID NO: 827690 - DNA, 20 bp, mouse
gcaggcgcgacgtcggcagc

SEQ ID NO: 827691 - DNA, 20 bp, mouse
gcgcgagtagggtgagaggc

SEQ ID NO: 827692 - DNA, 20 bp, mouse
gcggcgcgagcgcgcgagta

SEQ ID NO: 827693 - DNA, 20 bp, mouse
gagccggcccctcgctggga

SEQ ID NO: 827694 - DNA, 20 bp, mouse
ggccgccccctcccagcgag

SEQ ID NO: 827695 - DNA, 20 bp, mouse
gcgctcgcgccggggtctcc

SEQ ID NO: 827696 - DNA, 20 bp, mouse
gaggggtgggatgacattaa

SEQ ID NO: 827697 - DNA, 20 bp, mouse
gacacccagcatcctctgga

SEQ ID NO: 827698 - DNA, 20 bp, mouse
gggcccaaattgaagatgac

SEQ ID NO: 827699 - DNA, 20 bp, mouse
ggctgggtgtattgattccc

SEQ ID NO: 827700 - DNA, 20 bp, mouse
gctcccatccagaggatgct

SEQ ID NO: 827701 - DNA, 20 bp, mouse
gacgacctcctcccatccag

SEQ ID NO: 827702 - DNA, 20 bp, mouse
ggaagaacctcacagaggaa

SEQ ID NO: 827703 - DNA, 20 bp, mouse
gggtcgtggctctggcacta

SEQ ID NO: 827704 - DNA, 20 bp, mouse
gcccggggcagggggttgga

SEQ ID NO: 827705 - DNA, 20 bp, mouse
gtggcctgtcatcttcaatt

SEQ ID NO: 827706 - DNA, 20 bp, mouse
gacggcagctagagcgaccc

SEQ ID NO: 827707 - DNA, 20 bp, mouse
gcgtccccgaaccatagaga

SEQ ID NO: 827708 - DNA, 20 bp, mouse
gaaatcgccgtcaagtgata

SEQ ID NO: 827709 - DNA, 20 bp, mouse
gcggcctccggcaactgccc

SEQ ID NO: 827710 - DNA, 20 bp, mouse
gggtgggaggggtgggtccg

SEQ ID NO: 827711 - DNA, 20 bp, mouse
gtggacaacgaagccctgaa

SEQ ID NO: 827712 - DNA, 20 bp, mouse
gactgccccggccgccgggt

SEQ ID NO: 827713 - DNA, 20 bp, mouse
gcggccggggcagttgccgg

SEQ ID NO: 827714 - DNA, 20 bp, mouse
ggggtccggggacgtcgcgg

SEQ ID NO: 827715 - DNA, 20 bp, mouse
gccagcgcgtgcccggcctc

SEQ ID NO: 827716 - DNA, 20 bp, mouse
gccgcgctgggtccgcccaa

SEQ ID NO: 827717 - DNA, 20 bp, mouse
gtgactgtcagtgatcccgc

SEQ ID NO: 827718 - DNA, 20 bp, mouse
gcgtcctgacgctcaactga

SEQ ID NO: 827719 - DNA, 20 bp, mouse
gtaactgcggtacagttgtt

SEQ ID NO: 827720 - DNA, 20 bp, mouse
gcgcccaagggtcacgtgac

SEQ ID NO: 827721 - DNA, 20 bp, mouse
ggcgggagactcatagccag

SEQ ID NO: 827722 - DNA, 20 bp, mouse
gggcgctgggcaaaagcctc

SEQ ID NO: 827723 - DNA, 20 bp, mouse
gagtaatcagaaactgaggg

SEQ ID NO: 827724 - DNA, 20 bp, mouse
gcccctccctccggggacac

SEQ ID NO: 827725 - DNA, 20 bp, mouse
gaaaccgtcagttgagcgtc

SEQ ID NO: 827726 - DNA, 20 bp, mouse
gtaggggtacacgtgagcgc

SEQ ID NO: 827727 - DNA, 20 bp, mouse
gtacccctaaatactcccgt

SEQ ID NO: 827728 - DNA, 20 bp, mouse
gataccgggagggcattcca

SEQ ID NO: 827729 - DNA, 20 bp, mouse
gagcccacgggagtatttag

SEQ ID NO: 827730 - DNA, 20 bp, mouse
ggacaggctaaggctatacc

SEQ ID NO: 827731 - DNA, 20 bp, mouse
gtgaccttggaatgccctcc

SEQ ID NO: 827732 - DNA, 20 bp, mouse
ggagcggcggagcgcatcga

SEQ ID NO: 827733 - DNA, 20 bp, mouse
gactcccccagctgctggac

SEQ ID NO: 827734 - DNA, 20 bp, mouse
gcagcgcatggggctgatcc

SEQ ID NO: 827735 - DNA, 20 bp, mouse
ggggagtcttaacagcccac

SEQ ID NO: 827736 - DNA, 20 bp, mouse
gagccctggcggaagagcag

SEQ ID NO: 827737 - DNA, 20 bp, mouse
ggtcccccggagtgtgacta

SEQ ID NO: 827738 - DNA, 20 bp, mouse
gagcagcggtagtaaatagc

SEQ ID NO: 827739 - DNA, 20 bp, mouse
ggtccctagtcacactccgg

SEQ ID NO: 827740 - DNA, 20 bp, mouse
ggcgtggctagggagcgtga

SEQ ID NO: 827741 - DNA, 20 bp, mouse
gaagagcagtggaagcttag

SEQ ID NO: 827742 - DNA, 20 bp, mouse
ggtggctagtgagctctcgg

SEQ ID NO: 827743 - DNA, 20 bp, mouse
gtggctagggagcgtgaggg

SEQ ID NO: 827744 - DNA, 20 bp, mouse
gtagggacgagcgtggggtg

SEQ ID NO: 827745 - DNA, 20 bp, mouse
gttccactgctcttccgcca

SEQ ID NO: 827746 - DNA, 20 bp, mouse
gtggctgtggagcacctgtg

SEQ ID NO: 827747 - DNA, 20 bp, mouse
gctagtgcctgccgtcggtg

SEQ ID NO: 827748 - DNA, 20 bp, mouse
gcagacgcagctagaaaaca

SEQ ID NO: 827749 - DNA, 20 bp, mouse
gaaacaaggaaaagtggctg

SEQ ID NO: 827750 - DNA, 20 bp, mouse
gccgacggcaggcactagct

SEQ ID NO: 827751 - DNA, 20 bp, mouse
ggaagacaaaagccacaagg

SEQ ID NO: 827752 - DNA, 20 bp, mouse
gatgctgtaccctgtctctg

SEQ ID NO: 827753 - DNA, 20 bp, mouse
gtctcacccccaccgacggc

SEQ ID NO: 827754 - DNA, 20 bp, mouse
gacagggtacagcatggctc

SEQ ID NO: 827755 - DNA, 20 bp, mouse
gcgtttctcacccccaccga

SEQ ID NO: 827756 - DNA, 20 bp, mouse
gcgtggtgaggatgctaaga

SEQ ID NO: 827757 - DNA, 20 bp, mouse
gggtgaggatgctaagaggg

SEQ ID NO: 827758 - DNA, 20 bp, mouse
gaggagcgggaacagcagtt

SEQ ID NO: 827759 - DNA, 20 bp, mouse
gaacggctggcgagtctctt

SEQ ID NO: 827760 - DNA, 20 bp, mouse
gcacgcgcagtacggcacga

SEQ ID NO: 827761 - DNA, 20 bp, mouse
ggttaggcgcatgcgtggtg

SEQ ID NO: 827762 - DNA, 20 bp, mouse
ggtctcttgggtgtgatgga

SEQ ID NO: 827763 - DNA, 20 bp, mouse
gcagcagttaggcgcatgcg

SEQ ID NO: 827764 - DNA, 20 bp, mouse
gagcacgcgcacgcgcagta

SEQ ID NO: 827765 - DNA, 20 bp, mouse
gtaacatccgggcgggaaag

SEQ ID NO: 827766 - DNA, 20 bp, mouse
gagccccgagcaggggtcga

SEQ ID NO: 827767 - DNA, 20 bp, mouse
gtcagcagaaagccccgagc

SEQ ID NO: 827768 - DNA, 20 bp, mouse
gcaggggtcgacggatgcgc

SEQ ID NO: 827769 - DNA, 20 bp, mouse
gccatccagggcagggtccg

SEQ ID NO: 827770 - DNA, 20 bp, mouse
gcaaggggtgagcgcataca

SEQ ID NO: 827771 - DNA, 20 bp, mouse
gcatccgtcgacccctgctc

SEQ ID NO: 827772 - DNA, 20 bp, mouse
ggccctgcctttcggatcga

SEQ ID NO: 827773 - DNA, 20 bp, mouse
gagtaccccggaccctgccc

SEQ ID NO: 827774 - DNA, 20 bp, mouse
gacggatgcgcaggaccctg

SEQ ID NO: 827775 - DNA, 20 bp, mouse
gaggcactaactccaacctc

SEQ ID NO: 827776 - DNA, 20 bp, mouse
gtcccgagcgatcacgagtt

SEQ ID NO: 827777 - DNA, 20 bp, mouse
gagggtcagcgggacggcgc

SEQ ID NO: 827778 - DNA, 20 bp, mouse
gtagaacgcaaagttggcaa

SEQ ID NO: 827779 - DNA, 20 bp, mouse
ggtagtgccccgcattaaca

SEQ ID NO: 827780 - DNA, 20 bp, mouse
ggagaaaaacggcacagtat

SEQ ID NO: 827781 - DNA, 20 bp, mouse
gttggcaagggtcagcggga

SEQ ID NO: 827782 - DNA, 20 bp, mouse
ggcccaactcgtgatcgctc

SEQ ID NO: 827783 - DNA, 20 bp, mouse
ggaggtgtagaacgcaaagt

SEQ ID NO: 827784 - DNA, 20 bp, mouse
gctgaggggctcgggataaa

SEQ ID NO: 827785 - DNA, 20 bp, mouse
gtctcgaggacaaaccagag

SEQ ID NO: 827786 - DNA, 20 bp, mouse
gcgagggcggaaagagacca

SEQ ID NO: 827787 - DNA, 20 bp, mouse
gggcggaaagagaccagggc

SEQ ID NO: 827788 - DNA, 20 bp, mouse
gacctcgcacatgcgttccg

SEQ ID NO: 827789 - DNA, 20 bp, mouse
gaggtctttcagatgcggag

SEQ ID NO: 827790 - DNA, 20 bp, mouse
ggtgcgaggtctttcagatg

SEQ ID NO: 827791 - DNA, 20 bp, mouse
gccgtgcgtccgtccctctc

SEQ ID NO: 827792 - DNA, 20 bp, mouse
gcgcacatgcgttccgaggg

SEQ ID NO: 827793 - DNA, 20 bp, mouse
gcagcagcaattgtgttcac

SEQ ID NO: 827794 - DNA, 20 bp, mouse
gggttacaccccaaaattat

SEQ ID NO: 827795 - DNA, 20 bp, mouse
ggaaatctacttcccggccc

SEQ ID NO: 827796 - DNA, 20 bp, mouse
gcggaggaaaagccggaagt

SEQ ID NO: 827797 - DNA, 20 bp, mouse
gcggtccagcccctagaaga

SEQ ID NO: 827798 - DNA, 20 bp, mouse
ggcgggcgaacgaagcaaca

SEQ ID NO: 827799 - DNA, 20 bp, mouse
gcgttcgcccgcggcgcgtg

SEQ ID NO: 827800 - DNA, 20 bp, mouse
gggcgctttaagcgtgggga

SEQ ID NO: 827801 - DNA, 20 bp, mouse
gtgctctccgccttcttcta

SEQ ID NO: 827802 - DNA, 20 bp, mouse
gcgcctccacgcgaacccca

SEQ ID NO: 827803 - DNA, 20 bp, mouse
ggcacccgtagagtggcggc

SEQ ID NO: 827804 - DNA, 20 bp, mouse
gcgcggcacccgtagagtgg

SEQ ID NO: 827805 - DNA, 20 bp, mouse
ggaagccaggccaagctacg

SEQ ID NO: 827806 - DNA, 20 bp, mouse
gcagcagcaaaactacgacc

SEQ ID NO: 827807 - DNA, 20 bp, mouse
gcgcgcatgcagtttgacag

SEQ ID NO: 827808 - DNA, 20 bp, mouse
gccgcccaaccccgaaacgt

SEQ ID NO: 827809 - DNA, 20 bp, mouse
ggcacgcatgcgcgtacaag

SEQ ID NO: 827810 - DNA, 20 bp, mouse
gcggaaagctcaggtgcgga

SEQ ID NO: 827811 - DNA, 20 bp, mouse
gcccacgtgacctacgtttc

SEQ ID NO: 827812 - DNA, 20 bp, mouse
gtatctgagggacgacccta

SEQ ID NO: 827813 - DNA, 20 bp, mouse
ggcggggacaactctgggga

SEQ ID NO: 827814 - DNA, 20 bp, mouse
ggcttcacacaactcggtga

SEQ ID NO: 827815 - DNA, 20 bp, mouse
gtgctcatagagatagatat

SEQ ID NO: 827816 - DNA, 20 bp, mouse
gtacacaggctatgtgtcag

SEQ ID NO: 827817 - DNA, 20 bp, mouse
gtacactgtaatctggagag

SEQ ID NO: 827818 - DNA, 20 bp, mouse
gctagctggggcggacttcc

SEQ ID NO: 827819 - DNA, 20 bp, mouse
ggttgagttaatggatccag

SEQ ID NO: 827820 - DNA, 20 bp, mouse
ggctggggcggacttcctgg

SEQ ID NO: 827821 - DNA, 20 bp, mouse
gtccagattacagtgtacac

SEQ ID NO: 827822 - DNA, 20 bp, mouse
gtgatctggagaccaagagt

SEQ ID NO: 827823 - DNA, 20 bp, mouse
ggatgtgtgtcacaaggccc

SEQ ID NO: 827824 - DNA, 20 bp, mouse
gcattgtgatggcagttcca

SEQ ID NO: 827825 - DNA, 20 bp, mouse
ggcctgtgtacactgtaatc

SEQ ID NO: 827826 - DNA, 20 bp, mouse
ggatcccggcctctgatccc

SEQ ID NO: 827827 - DNA, 20 bp, mouse
ggatccccggccatgaactc

SEQ ID NO: 827828 - DNA, 20 bp, mouse
ggttcatggccggggatcag

SEQ ID NO: 827829 - DNA, 20 bp, mouse
gcgagctgcgtatgttctgg

SEQ ID NO: 827830 - DNA, 20 bp, mouse
gtgagagcgctcgggtcgag

SEQ ID NO: 827831 - DNA, 20 bp, mouse
gcgacgctgggatatgtgcg

SEQ ID NO: 827832 - DNA, 20 bp, mouse
ggctccggagttcatggccg

SEQ ID NO: 827833 - DNA, 20 bp, mouse
gggtcgagcggcacggactg

SEQ ID NO: 827834 - DNA, 20 bp, mouse
gtgtgcgtggctgtagcgca

SEQ ID NO: 827835 - DNA, 20 bp, mouse
gctgcgagctgcgtatgttc

SEQ ID NO: 827836 - DNA, 20 bp, mouse
gaaggcccgcggcaacgtca

SEQ ID NO: 827837 - DNA, 20 bp, mouse
gcggggaggcggggcttaga

SEQ ID NO: 827838 - DNA, 20 bp, mouse
gaggggctgggcacacaggt

SEQ ID NO: 827839 - DNA, 20 bp, mouse
gaggcggggcttagatgggc

SEQ ID NO: 827840 - DNA, 20 bp, mouse
gactgcgaggaagaagtaga

SEQ ID NO: 827841 - DNA, 20 bp, mouse
ggggttgtcttggtggagag

SEQ ID NO: 827842 - DNA, 20 bp, mouse
ggaaagttcctactccccgg

SEQ ID NO: 827843 - DNA, 20 bp, mouse
ggcacacaggtgggccgggg

SEQ ID NO: 827844 - DNA, 20 bp, mouse
gtgggcacacaggtgggccg

SEQ ID NO: 827845 - DNA, 20 bp, mouse
gcgcggcaacgtcaggggct

SEQ ID NO: 827846 - DNA, 20 bp, mouse
gagcccggagctttgcgaga

SEQ ID NO: 827847 - DNA, 20 bp, mouse
gcaacgtcaccacgtctcta

SEQ ID NO: 827848 - DNA, 20 bp, mouse
gggcccgcgaacggagtggg

SEQ ID NO: 827849 - DNA, 20 bp, mouse
gtgcgagagggagaagatta

SEQ ID NO: 827850 - DNA, 20 bp, mouse
ggatgccaagggcccgcgaa

SEQ ID NO: 827851 - DNA, 20 bp, mouse
gaagggcccgcgaacggagt

SEQ ID NO: 827852 - DNA, 20 bp, mouse
gccagctagtggagagagga

SEQ ID NO: 827853 - DNA, 20 bp, mouse
gtcaccagagcgaaagaggg

SEQ ID NO: 827854 - DNA, 20 bp, mouse
gatggaagaccacaaatccc

SEQ ID NO: 827855 - DNA, 20 bp, mouse
gcgcgggcccttggcatcct

SEQ ID NO: 827856 - DNA, 20 bp, mouse
gcttgagcggatagagtgta

SEQ ID NO: 827857 - DNA, 20 bp, mouse
gttcccgcgctaaggggcgg

SEQ ID NO: 827858 - DNA, 20 bp, mouse
gggggctcgcctaaagaggt

SEQ ID NO: 827859 - DNA, 20 bp, mouse
gcggttcccgcgctaagggg

SEQ ID NO: 827860 - DNA, 20 bp, mouse
gagcccccgccccttagcgc

SEQ ID NO: 827861 - DNA, 20 bp, mouse
gcgcccggcggcggccaagt

SEQ ID NO: 827862 - DNA, 20 bp, mouse
ggaccctagcgcctggtgta

SEQ ID NO: 827863 - DNA, 20 bp, mouse
gcaagactggacgtcgagaa

SEQ ID NO: 827864 - DNA, 20 bp, mouse
gggaccagaggcgacttcca

SEQ ID NO: 827865 - DNA, 20 bp, mouse
gctgagacgcggggcactcg

SEQ ID NO: 827866 - DNA, 20 bp, mouse
gtcctgcctggcccggtccg

SEQ ID NO: 827867 - DNA, 20 bp, mouse
gggaaccccgcctcccagag

SEQ ID NO: 827868 - DNA, 20 bp, mouse
gggccaggcaggacctggac

SEQ ID NO: 827869 - DNA, 20 bp, mouse
gtaaaattctccactctggg

SEQ ID NO: 827870 - DNA, 20 bp, mouse
gccaccttgcaccagagcgc

SEQ ID NO: 827871 - DNA, 20 bp, mouse
gcagcccaagccaggtggga

SEQ ID NO: 827872 - DNA, 20 bp, mouse
gtggtgacagatgatgtcat

SEQ ID NO: 827873 - DNA, 20 bp, mouse
ggaccgggccaggcaggacc

SEQ ID NO: 827874 - DNA, 20 bp, mouse
ggccacggaccgggccaggc

SEQ ID NO: 827875 - DNA, 20 bp, mouse
gcgcgggcgcccgcactgtt

SEQ ID NO: 827876 - DNA, 20 bp, mouse
gaaaacaactagtagaggac

SEQ ID NO: 827877 - DNA, 20 bp, mouse
ggggcgggactacaagtccc

SEQ ID NO: 827878 - DNA, 20 bp, mouse
gacaactagtagaggacggg

SEQ ID NO: 827879 - DNA, 20 bp, mouse
gtcaaggtccgccctatccc

SEQ ID NO: 827880 - DNA, 20 bp, mouse
gacccaggctacccacgctg

SEQ ID NO: 827881 - DNA, 20 bp, mouse
gcaggctacccacgctgcgg

SEQ ID NO: 827882 - DNA, 20 bp, mouse
gcgagcgtggattccacgag

SEQ ID NO: 827883 - DNA, 20 bp, mouse
gtccgtgtccagccagtcat

SEQ ID NO: 827884 - DNA, 20 bp, mouse
gaaagcttattcggagttca

SEQ ID NO: 827885 - DNA, 20 bp, mouse
gcgcgccacggccctgcgga

SEQ ID NO: 827886 - DNA, 20 bp, mouse
gtctcccaggcttagacgtg

SEQ ID NO: 827887 - DNA, 20 bp, mouse
gtcagaccgccttgctgctc

SEQ ID NO: 827888 - DNA, 20 bp, mouse
ggcgcctcggcacccaatcc

SEQ ID NO: 827889 - DNA, 20 bp, mouse
gagctggctccggggctccg

SEQ ID NO: 827890 - DNA, 20 bp, mouse
gccagcacgaagcagacctc

SEQ ID NO: 827891 - DNA, 20 bp, mouse
gtatcctcacgtctaagcct

SEQ ID NO: 827892 - DNA, 20 bp, mouse
gtgccagcttctctgccccg

SEQ ID NO: 827893 - DNA, 20 bp, mouse
gcaggctgataaaaccaagt

SEQ ID NO: 827894 - DNA, 20 bp, mouse
gttgctgctcaggctgatgc

SEQ ID NO: 827895 - DNA, 20 bp, mouse
gggtctgcttcgtgctggag

SEQ ID NO: 827896 - DNA, 20 bp, mouse
gggaccacaagagcggaggt

SEQ ID NO: 827897 - DNA, 20 bp, mouse
ggcggccgctcgaatttccc

SEQ ID NO: 827898 - DNA, 20 bp, mouse
gtgattggcacagtccttgg

SEQ ID NO: 827899 - DNA, 20 bp, mouse
gggactgctgggtagctctc

SEQ ID NO: 827900 - DNA, 20 bp, mouse
ggtccctccactctggacaa

SEQ ID NO: 827901 - DNA, 20 bp, mouse
gccaacccgggaaattcgag

SEQ ID NO: 827902 - DNA, 20 bp, mouse
gtcttgtggtccctccactc

SEQ ID NO: 827903 - DNA, 20 bp, mouse
ggagtctagagagaagccgt

SEQ ID NO: 827904 - DNA, 20 bp, mouse
gggacaatggaaacaaccaa

SEQ ID NO: 827905 - DNA, 20 bp, mouse
gaggactgtgccaatcacgc

SEQ ID NO: 827906 - DNA, 20 bp, mouse
gaacttgctgaggctaacgt

SEQ ID NO: 827907 - DNA, 20 bp, mouse
gtggcgatgtgctggaagac

SEQ ID NO: 827908 - DNA, 20 bp, mouse
gagcctcagcaagttctcgg

SEQ ID NO: 827909 - DNA, 20 bp, mouse
gccaggggaggggttaatcc

SEQ ID NO: 827910 - DNA, 20 bp, mouse
ggaccaccgagaacttgctg

SEQ ID NO: 827911 - DNA, 20 bp, mouse
gcggttgagtggcgatgtgc

SEQ ID NO: 827912 - DNA, 20 bp, mouse
gaaaccacagcgcgagtcca

SEQ ID NO: 827913 - DNA, 20 bp, mouse
gtctgctgggagggcctaac

SEQ ID NO: 827914 - DNA, 20 bp, mouse
gcacagcgcgagtccaaggg

SEQ ID NO: 827915 - DNA, 20 bp, mouse
ggggcggggccgcggttgag

SEQ ID NO: 827916 - DNA, 20 bp, mouse
gagctgggctgcagaatcgg

SEQ ID NO: 827917 - DNA, 20 bp, mouse
gccccccgaggcgagatgag

SEQ ID NO: 827918 - DNA, 20 bp, mouse
gctctgcgcccgtagactag

SEQ ID NO: 827919 - DNA, 20 bp, mouse
gtcctggagaactagtccaa

SEQ ID NO: 827920 - DNA, 20 bp, mouse
gcggctgtcacctggaaggt

SEQ ID NO: 827921 - DNA, 20 bp, mouse
gtgcgaatggcccctctcca

SEQ ID NO: 827922 - DNA, 20 bp, mouse
ggggcgggaaggggcgactg

SEQ ID NO: 827923 - DNA, 20 bp, mouse
gcgggcacccccgaccttcc

SEQ ID NO: 827924 - DNA, 20 bp, mouse
gctactccgcctctagtcta

SEQ ID NO: 827925 - DNA, 20 bp, mouse
gtgcgcccgtagactagagg

SEQ ID NO: 827926 - DNA, 20 bp, mouse
gtcacccgctggctcgtccc

SEQ ID NO: 827927 - DNA, 20 bp, mouse
gccagagcgcgggtcacccg

SEQ ID NO: 827928 - DNA, 20 bp, mouse
gcgcctgcgcacgggtcccc

SEQ ID NO: 827929 - DNA, 20 bp, mouse
ggccccgcgcgcatgcgcat

SEQ ID NO: 827930 - DNA, 20 bp, mouse
gaaggccggctcccactgta

SEQ ID NO: 827931 - DNA, 20 bp, mouse
ggggcgcgcggggttactag

SEQ ID NO: 827932 - DNA, 20 bp, mouse
gcgcgcggggttactagagg

SEQ ID NO: 827933 - DNA, 20 bp, mouse
gcgagccagcgggtgagccg

SEQ ID NO: 827934 - DNA, 20 bp, mouse
gacaccaggctcccagagcg

SEQ ID NO: 827935 - DNA, 20 bp, mouse
gtagaggtggagcgccggga

SEQ ID NO: 827936 - DNA, 20 bp, mouse
ggacagacgtggatactcaa

SEQ ID NO: 827937 - DNA, 20 bp, mouse
gcggccgctaccacctctca

SEQ ID NO: 827938 - DNA, 20 bp, mouse
gccacacgtggatgttaacc

SEQ ID NO: 827939 - DNA, 20 bp, mouse
gactcaagggcgcacagact

SEQ ID NO: 827940 - DNA, 20 bp, mouse
ggaaggggagacgatcacca

SEQ ID NO: 827941 - DNA, 20 bp, mouse
ggtccggcggcgggagttag

SEQ ID NO: 827942 - DNA, 20 bp, mouse
gttaacatccacgtgtgggt

SEQ ID NO: 827943 - DNA, 20 bp, mouse
ggccggacgtgacgtcgccc

SEQ ID NO: 827944 - DNA, 20 bp, mouse
gacctcgcccggtggaaaat

SEQ ID NO: 827945 - DNA, 20 bp, mouse
gagcaagcactctgaacgaa

SEQ ID NO: 827946 - DNA, 20 bp, mouse
gcggctcccggccagggttc

SEQ ID NO: 827947 - DNA, 20 bp, mouse
ggccgggagccgcagagact

SEQ ID NO: 827948 - DNA, 20 bp, mouse
ggccactggagcctcgggga

SEQ ID NO: 827949 - DNA, 20 bp, mouse
gagactcgtccgggactaga

SEQ ID NO: 827950 - DNA, 20 bp, mouse
gcccggccagggttccggag

SEQ ID NO: 827951 - DNA, 20 bp, mouse
gagaccctgcccaccagccg

SEQ ID NO: 827952 - DNA, 20 bp, mouse
gggctccagtggcgcctccc

SEQ ID NO: 827953 - DNA, 20 bp, mouse
gaccctccccgaggctccag

SEQ ID NO: 827954 - DNA, 20 bp, mouse
gggaccgcggctggtgggca

SEQ ID NO: 827955 - DNA, 20 bp, mouse
gagagactaggaaaccaggg

SEQ ID NO: 827956 - DNA, 20 bp, mouse
gagaccgggtacgggaaaag

SEQ ID NO: 827957 - DNA, 20 bp, mouse
gcactgggttactagttggg

SEQ ID NO: 827958 - DNA, 20 bp, mouse
gttgtgggaaatgtagtcta

SEQ ID NO: 827959 - DNA, 20 bp, mouse
gcccaagaggaggtgaagcg

SEQ ID NO: 827960 - DNA, 20 bp, mouse
gtgggagagaaggcacggtt

SEQ ID NO: 827961 - DNA, 20 bp, mouse
gggtggcgggagcgcctcaa

SEQ ID NO: 827962 - DNA, 20 bp, mouse
gatgcactgggttactagtt

SEQ ID NO: 827963 - DNA, 20 bp, mouse
ggctatattagaccgggtac

SEQ ID NO: 827964 - DNA, 20 bp, mouse
gttactagttgggtgggttg

SEQ ID NO: 827965 - DNA, 20 bp, mouse
gtctagggctatattagacc

SEQ ID NO: 827966 - DNA, 20 bp, mouse
gttagcgcgtgacttgatcc

SEQ ID NO: 827967 - DNA, 20 bp, mouse
ggaaggggagtggccaccgg

SEQ ID NO: 827968 - DNA, 20 bp, mouse
gctaaacttgtcaccaccgg

SEQ ID NO: 827969 - DNA, 20 bp, mouse
gccaaggtggacgcagccaa

SEQ ID NO: 827970 - DNA, 20 bp, mouse
gcccaatataggaacagctg

SEQ ID NO: 827971 - DNA, 20 bp, mouse
ggcgctaaacttgtcaccac

SEQ ID NO: 827972 - DNA, 20 bp, mouse
ggacagcgccacccctgccc

SEQ ID NO: 827973 - DNA, 20 bp, mouse
gtgggccactttaattacaa

SEQ ID NO: 827974 - DNA, 20 bp, mouse
gcccggaaacgtgtgttccc

SEQ ID NO: 827975 - DNA, 20 bp, mouse
gtgcgtccaccttggactcc

SEQ ID NO: 827976 - DNA, 20 bp, mouse
ggccaggccaggagaggtcg

SEQ ID NO: 827977 - DNA, 20 bp, mouse
gctgctgccgctgtccagtt

SEQ ID NO: 827978 - DNA, 20 bp, mouse
gcagcccaggcgagttaatg

SEQ ID NO: 827979 - DNA, 20 bp, mouse
gagccagcgcggccgctagg

SEQ ID NO: 827980 - DNA, 20 bp, mouse
ggcaaaaagcgtctggagaa

SEQ ID NO: 827981 - DNA, 20 bp, mouse
ggagacgtcggcccgaaggt

SEQ ID NO: 827982 - DNA, 20 bp, mouse
ggccgctgtccagtttggag

SEQ ID NO: 827983 - DNA, 20 bp, mouse
gcatgcgatcccctccaaac

SEQ ID NO: 827984 - DNA, 20 bp, mouse
gtcccctccaaactggacag

SEQ ID NO: 827985 - DNA, 20 bp, mouse
gctccccctagcggccgcgc

SEQ ID NO: 827986 - DNA, 20 bp, mouse
ggggagaagcagctggtata

SEQ ID NO: 827987 - DNA, 20 bp, mouse
ggcagaaggggcggtggagt

SEQ ID NO: 827988 - DNA, 20 bp, mouse
gtcgcctcccgactcttacc

SEQ ID NO: 827989 - DNA, 20 bp, mouse
gaggcggggtcgggctctcc

SEQ ID NO: 827990 - DNA, 20 bp, mouse
gtaagagtcgggaggcgagg

SEQ ID NO: 827991 - DNA, 20 bp, mouse
gattccaggtaagagtcggg

SEQ ID NO: 827992 - DNA, 20 bp, mouse
gcggcgcgccggcgcagaag

SEQ ID NO: 827993 - DNA, 20 bp, mouse
gaacaggattagctgcttaa

SEQ ID NO: 827994 - DNA, 20 bp, mouse
ggactgctggtacctagagc

SEQ ID NO: 827995 - DNA, 20 bp, mouse
gcggaagagggggcatggat

SEQ ID NO: 827996 - DNA, 20 bp, mouse
gcgtgcacgggaagcaggag

SEQ ID NO: 827997 - DNA, 20 bp, mouse
gcgtgcacggaaggcctctc

SEQ ID NO: 827998 - DNA, 20 bp, mouse
gcctgcttcccgtgcacgga

SEQ ID NO: 827999 - DNA, 20 bp, mouse
gaggccgaagccgggaagaa

SEQ ID NO: 828000 - DNA, 20 bp, mouse
gaaggcctctcgggattggt

SEQ ID NO: 828001 - DNA, 20 bp, mouse
gcacggacaggcggattctc

SEQ ID NO: 828002 - DNA, 20 bp, mouse
ggagaaagaacagcagcgat

SEQ ID NO: 828003 - DNA, 20 bp, mouse
gacggaaggcctctcgggat

SEQ ID NO: 828004 - DNA, 20 bp, mouse
gacgtccaaccaatcccgag

SEQ ID NO: 828005 - DNA, 20 bp, mouse
gggtccgccgagtgtaagtt

SEQ ID NO: 828006 - DNA, 20 bp, mouse
ggcggggccggctgacagga

SEQ ID NO: 828007 - DNA, 20 bp, mouse
gccaacgcgaagaaaccaat

SEQ ID NO: 828008 - DNA, 20 bp, mouse
gggtggggagacaaaggtcc

SEQ ID NO: 828009 - DNA, 20 bp, mouse
ggacaaaggtcctggtggat

SEQ ID NO: 828010 - DNA, 20 bp, mouse
gtaggcgaggagaatatgga

SEQ ID NO: 828011 - DNA, 20 bp, mouse
ggcgaagaaaccaataggcg

SEQ ID NO: 828012 - DNA, 20 bp, mouse
ggagggcggggccggctgac

SEQ ID NO: 828013 - DNA, 20 bp, mouse
gcaccaacgcgcgctgtgat

SEQ ID NO: 828014 - DNA, 20 bp, mouse
ggacttatatccgggattgt

SEQ ID NO: 828015 - DNA, 20 bp, mouse
ggtggggtgagttgcagcag

SEQ ID NO: 828016 - DNA, 20 bp, mouse
gggttcgcgccgcccggaag

SEQ ID NO: 828017 - DNA, 20 bp, mouse
gcccggaagcggctgagaac

SEQ ID NO: 828018 - DNA, 20 bp, mouse
gctgagaaccggagagagtt

SEQ ID NO: 828019 - DNA, 20 bp, mouse
gcggccgcgtgtgatgtccc

SEQ ID NO: 828020 - DNA, 20 bp, mouse
gccggcgagcagccaggcgt

SEQ ID NO: 828021 - DNA, 20 bp, mouse
gtgggaagagaaaacgtcag

SEQ ID NO: 828022 - DNA, 20 bp, mouse
gactccgcagccaatcagcg

SEQ ID NO: 828023 - DNA, 20 bp, mouse
gccgccggggacatcacacg

SEQ ID NO: 828024 - DNA, 20 bp, mouse
gagaaagagcgcgctgctgt

SEQ ID NO: 828025 - DNA, 20 bp, mouse
gtcaagcaattggtcggaat

SEQ ID NO: 828026 - DNA, 20 bp, mouse
gagtgggtggagcccaaaag

SEQ ID NO: 828027 - DNA, 20 bp, mouse
ggtggagcccaaaagaggtg

SEQ ID NO: 828028 - DNA, 20 bp, mouse
gaaaacagctcacgcgaagt

SEQ ID NO: 828029 - DNA, 20 bp, mouse
gagcctcaacagggagtggg

SEQ ID NO: 828030 - DNA, 20 bp, mouse
ggggtggtgtatgaacgcag

SEQ ID NO: 828031 - DNA, 20 bp, mouse
gaatgtctacagcctcaaca

SEQ ID NO: 828032 - DNA, 20 bp, mouse
gaaaagaggtggggctaagg

SEQ ID NO: 828033 - DNA, 20 bp, mouse
gatgatgcttgcgtgagtga

SEQ ID NO: 828034 - DNA, 20 bp, mouse
gctacagcctcaacagggag

SEQ ID NO: 828035 - DNA, 20 bp, mouse
gtggagcttgagtgtgtgta

SEQ ID NO: 828036 - DNA, 20 bp, mouse
gaccggaactgcaaccccga

SEQ ID NO: 828037 - DNA, 20 bp, mouse
gaggtcgaggcaagagagat

SEQ ID NO: 828038 - DNA, 20 bp, mouse
gtcgaggcaagagagatggg

SEQ ID NO: 828039 - DNA, 20 bp, mouse
gttgtcgcgaagtgctggta

SEQ ID NO: 828040 - DNA, 20 bp, mouse
gcgaactaaaagttcatagc

SEQ ID NO: 828041 - DNA, 20 bp, mouse
gtgcaaccccgaaggactgt

SEQ ID NO: 828042 - DNA, 20 bp, mouse
gggaagtcccacctccgcag

SEQ ID NO: 828043 - DNA, 20 bp, mouse
gtccttcggggttgcagttc

SEQ ID NO: 828044 - DNA, 20 bp, mouse
gggcggaagtatctggagac

SEQ ID NO: 828045 - DNA, 20 bp, mouse
gctggtcccacagtccttcg

SEQ ID NO: 828046 - DNA, 20 bp, mouse
gccaccattcccggttgcca

SEQ ID NO: 828047 - DNA, 20 bp, mouse
gttgccatggcaaccgggaa

SEQ ID NO: 828048 - DNA, 20 bp, mouse
ggcagcggacgtgacacgtg

SEQ ID NO: 828049 - DNA, 20 bp, mouse
gtggtggcattcacctagag

SEQ ID NO: 828050 - DNA, 20 bp, mouse
ggcccctcccaatcacgcag

SEQ ID NO: 828051 - DNA, 20 bp, mouse
ggagaagcatccttggagaa

SEQ ID NO: 828052 - DNA, 20 bp, mouse
ggtccgctgcgtgattggga

SEQ ID NO: 828053 - DNA, 20 bp, mouse
gtgagtcaggccaagattgc

SEQ ID NO: 828054 - DNA, 20 bp, mouse
gagtagggttacactgagtc

SEQ ID NO: 828055 - DNA, 20 bp, mouse
gctgagaggctcgtctcctc

SEQ ID NO: 828056 - DNA, 20 bp, mouse
ggtgacctctgcattgctgt

SEQ ID NO: 828057 - DNA, 20 bp, mouse
gcctggtgagtcaccaaggg

SEQ ID NO: 828058 - DNA, 20 bp, mouse
ggggctaccgttttgtgttc

SEQ ID NO: 828059 - DNA, 20 bp, mouse
gagagaggctgtaggcagtt

SEQ ID NO: 828060 - DNA, 20 bp, mouse
ggccaaacctgaacacaaaa

SEQ ID NO: 828061 - DNA, 20 bp, mouse
gagcaagattaggtacagca

SEQ ID NO: 828062 - DNA, 20 bp, mouse
gagaggtcacccctctgaac

SEQ ID NO: 828063 - DNA, 20 bp, mouse
ggagaaggcccggtctcatt

SEQ ID NO: 828064 - DNA, 20 bp, mouse
gtattagcaacctgttcaga

SEQ ID NO: 828065 - DNA, 20 bp, mouse
gcggaaggctgctgggtgat

SEQ ID NO: 828066 - DNA, 20 bp, mouse
gcgccgagacgcaaccccgg

SEQ ID NO: 828067 - DNA, 20 bp, mouse
ggggaagaccccaaaacttc

SEQ ID NO: 828068 - DNA, 20 bp, mouse
gtgggagctcagtgtggtac

SEQ ID NO: 828069 - DNA, 20 bp, mouse
ggcagcggacggccgatgag

SEQ ID NO: 828070 - DNA, 20 bp, mouse
gagcagtggccgacccgagg

SEQ ID NO: 828071 - DNA, 20 bp, mouse
gcctcagccgggagaaggaa

SEQ ID NO: 828072 - DNA, 20 bp, mouse
ggccagcctcccgcagtccc

SEQ ID NO: 828073 - DNA, 20 bp, mouse
ggatgtgacgtcatgagcag

SEQ ID NO: 828074 - DNA, 20 bp, mouse
gccccgccgccgcctcgggt

SEQ ID NO: 828075 - DNA, 20 bp, mouse
gcagtccccggcagcgagaa

SEQ ID NO: 828076 - DNA, 20 bp, mouse
gcggccagcccgctgtccac

SEQ ID NO: 828077 - DNA, 20 bp, mouse
gtgcgggcgggaggagctaa

SEQ ID NO: 828078 - DNA, 20 bp, mouse
gactctgcgaaagcgatcgg

SEQ ID NO: 828079 - DNA, 20 bp, mouse
gcctgcgcgtgcgtactccg

SEQ ID NO: 828080 - DNA, 20 bp, mouse
gccagcccgctgtccacggg

SEQ ID NO: 828081 - DNA, 20 bp, mouse
gcacggccacccgtggacag

SEQ ID NO: 828082 - DNA, 20 bp, mouse
gcggccggcgtgcggcaagg

SEQ ID NO: 828083 - DNA, 20 bp, mouse
ggggagccgggagtggttaa

SEQ ID NO: 828084 - DNA, 20 bp, mouse
gttcgcagagtagatggggc

SEQ ID NO: 828085 - DNA, 20 bp, mouse
ggaggagctaagggagtgcg

SEQ ID NO: 828086 - DNA, 20 bp, mouse
gcagacctacaggaagtcct

SEQ ID NO: 828087 - DNA, 20 bp, mouse
gggggctgtggcaaccgtcc

SEQ ID NO: 828088 - DNA, 20 bp, mouse
gcgtccaggcgcagacctac

SEQ ID NO: 828089 - DNA, 20 bp, mouse
gtcagccaaggacttcctgt

SEQ ID NO: 828090 - DNA, 20 bp, mouse
gaggcagcaaactgggcaag

SEQ ID NO: 828091 - DNA, 20 bp, mouse
gtgcctccccaagtgcgccg

SEQ ID NO: 828092 - DNA, 20 bp, mouse
gggagaaccgagaccattaa

SEQ ID NO: 828093 - DNA, 20 bp, mouse
gtgcctgcactcagggaaat

SEQ ID NO: 828094 - DNA, 20 bp, mouse
ggagtctcccttaatggtct

SEQ ID NO: 828095 - DNA, 20 bp, mouse
gagtgtcagaggcagcaaac

SEQ ID NO: 828096 - DNA, 20 bp, mouse
gcggcccccgcggtgcggtc

SEQ ID NO: 828097 - DNA, 20 bp, mouse
ggcccctcgccacgtggtgg

SEQ ID NO: 828098 - DNA, 20 bp, mouse
gccgcggtgcggtccggctg

SEQ ID NO: 828099 - DNA, 20 bp, mouse
gccgaccggcgcagtgtctg

SEQ ID NO: 828100 - DNA, 20 bp, mouse
gtcctcctccccggctgctc

SEQ ID NO: 828101 - DNA, 20 bp, mouse
gaccacgtggcgaggggcgg

SEQ ID NO: 828102 - DNA, 20 bp, mouse
gcacgtggtggtggcaaccg

SEQ ID NO: 828103 - DNA, 20 bp, mouse
gcgcacggcggggagctggt

SEQ ID NO: 828104 - DNA, 20 bp, mouse
ggcgcctcggggcaggactt

SEQ ID NO: 828105 - DNA, 20 bp, mouse
ggtggcaaccgcggggtccc

SEQ ID NO: 828106 - DNA, 20 bp, mouse
ggacgcgagcaagcctaccc

SEQ ID NO: 828107 - DNA, 20 bp, mouse
ggctgggagacgtgccaaga

SEQ ID NO: 828108 - DNA, 20 bp, mouse
gcccccaaggagctcgggga

SEQ ID NO: 828109 - DNA, 20 bp, mouse
gacggcgggagggaccgaca

SEQ ID NO: 828110 - DNA, 20 bp, mouse
gtgctcgcgtccgctcccag

SEQ ID NO: 828111 - DNA, 20 bp, mouse
gcgagcaagcctacccaggc

SEQ ID NO: 828112 - DNA, 20 bp, mouse
gggcgcgctgtcgaccctct

SEQ ID NO: 828113 - DNA, 20 bp, mouse
gcggaggtcactggccgtgt

SEQ ID NO: 828114 - DNA, 20 bp, mouse
gccaagcccaaggtggagga

SEQ ID NO: 828115 - DNA, 20 bp, mouse
gcgctcccagcggaggtcac

SEQ ID NO: 828116 - DNA, 20 bp, mouse
ggggaggggaggaggacccg

SEQ ID NO: 828117 - DNA, 20 bp, mouse
gaggaggggagctgttacta

SEQ ID NO: 828118 - DNA, 20 bp, mouse
ggggaacagggagcgaggag

SEQ ID NO: 828119 - DNA, 20 bp, mouse
gcgcgagcggccaacggctc

SEQ ID NO: 828120 - DNA, 20 bp, mouse
gagccgggtggtggaagaga

SEQ ID NO: 828121 - DNA, 20 bp, mouse
gggggaggaggacccgagga

SEQ ID NO: 828122 - DNA, 20 bp, mouse
gaacccgagcggcctgcgcc

SEQ ID NO: 828123 - DNA, 20 bp, mouse
gacgaggggagcggaggggt

SEQ ID NO: 828124 - DNA, 20 bp, mouse
gtggggaaacgggttgtgga

SEQ ID NO: 828125 - DNA, 20 bp, mouse
ggcgcagcaccgaggcagga

SEQ ID NO: 828126 - DNA, 20 bp, mouse
gggccaggtcgcttcccata

SEQ ID NO: 828127 - DNA, 20 bp, mouse
ggccctgcagagcgctccaa

SEQ ID NO: 828128 - DNA, 20 bp, mouse
gggagcgctctgcagggcgg

SEQ ID NO: 828129 - DNA, 20 bp, mouse
ggtcccaagcgcacctcgga

SEQ ID NO: 828130 - DNA, 20 bp, mouse
gggcgcgcttggagggactg

SEQ ID NO: 828131 - DNA, 20 bp, mouse
ggggacagttgcaagtactg

SEQ ID NO: 828132 - DNA, 20 bp, mouse
gacgtgcgcgcctcgagggg

SEQ ID NO: 828133 - DNA, 20 bp, mouse
gagtcgttacgatgccctat

SEQ ID NO: 828134 - DNA, 20 bp, mouse
gctcgaggcgcgcacgtccc

SEQ ID NO: 828135 - DNA, 20 bp, mouse
gggcagttggaactctataa

SEQ ID NO: 828136 - DNA, 20 bp, mouse
gaaaaaggacaggacagtta

SEQ ID NO: 828137 - DNA, 20 bp, mouse
gccaccacgcccggcgatag

SEQ ID NO: 828138 - DNA, 20 bp, mouse
gcggctgctgccactgggag

SEQ ID NO: 828139 - DNA, 20 bp, mouse
gctcccggcgcgcatgttga

SEQ ID NO: 828140 - DNA, 20 bp, mouse
gacgccatcaacatgcgcgc

SEQ ID NO: 828141 - DNA, 20 bp, mouse
ggccgaaggcatatccagtg

SEQ ID NO: 828142 - DNA, 20 bp, mouse
gtccacactggatatgcctt

SEQ ID NO: 828143 - DNA, 20 bp, mouse
gcactgggagtgggagccga

SEQ ID NO: 828144 - DNA, 20 bp, mouse
gtgatggcgtcaaggagttg

SEQ ID NO: 828145 - DNA, 20 bp, mouse
gggcacgcggtgatgacgtc

SEQ ID NO: 828146 - DNA, 20 bp, mouse
gggccgggtaccagcagttc

SEQ ID NO: 828147 - DNA, 20 bp, mouse
gacactgggaaggaaacgag

SEQ ID NO: 828148 - DNA, 20 bp, mouse
gtaccagcagttccggggcg

SEQ ID NO: 828149 - DNA, 20 bp, mouse
gtgtgtagcggaaacagttg

SEQ ID NO: 828150 - DNA, 20 bp, mouse
gagctagaaagggccgtcgg

SEQ ID NO: 828151 - DNA, 20 bp, mouse
gcagtcaagagcgcaactgg

SEQ ID NO: 828152 - DNA, 20 bp, mouse
gggccccgccccggaactgc

SEQ ID NO: 828153 - DNA, 20 bp, mouse
ggggaaggaaacgagcgggc

SEQ ID NO: 828154 - DNA, 20 bp, mouse
ggcgttcggtggatcgagtc

SEQ ID NO: 828155 - DNA, 20 bp, mouse
gtctctttgacagctagaaa

SEQ ID NO: 828156 - DNA, 20 bp, mouse
gcggaaggagctaggggttg

SEQ ID NO: 828157 - DNA, 20 bp, mouse
ggggaaggcggaaggagcta

SEQ ID NO: 828158 - DNA, 20 bp, mouse
gttcgccagcggcttcggga

SEQ ID NO: 828159 - DNA, 20 bp, mouse
gaccccggggtcacgactaa

SEQ ID NO: 828160 - DNA, 20 bp, mouse
gaggaggaggacttcgccag

SEQ ID NO: 828161 - DNA, 20 bp, mouse
gagaggggagcagcgagaac

SEQ ID NO: 828162 - DNA, 20 bp, mouse
gccggctagccactcacttc

SEQ ID NO: 828163 - DNA, 20 bp, mouse
gctaggggttggggcggaga

SEQ ID NO: 828164 - DNA, 20 bp, mouse
gaggacttcgccagcggctt

SEQ ID NO: 828165 - DNA, 20 bp, mouse
gcgaggcggaagtggccgga

SEQ ID NO: 828166 - DNA, 20 bp, mouse
gctactggaagcactagtct

SEQ ID NO: 828167 - DNA, 20 bp, mouse
ggtgaatgagctgaggagtc

SEQ ID NO: 828168 - DNA, 20 bp, mouse
gtcggccctcctcttcttct

SEQ ID NO: 828169 - DNA, 20 bp, mouse
ggctccctgaggctgataaa

SEQ ID NO: 828170 - DNA, 20 bp, mouse
gccaccagctgtgtcttgcc

SEQ ID NO: 828171 - DNA, 20 bp, mouse
gcctcagggagcacgcagtg

SEQ ID NO: 828172 - DNA, 20 bp, mouse
ggagccaggcaagacacagc

SEQ ID NO: 828173 - DNA, 20 bp, mouse
gtggactacatgagaagaga

SEQ ID NO: 828174 - DNA, 20 bp, mouse
gccagtagagtagcatgata

SEQ ID NO: 828175 - DNA, 20 bp, mouse
ggagaaggagttgatgagcc

SEQ ID NO: 828176 - DNA, 20 bp, mouse
gactgtcagcagctaaccaa

SEQ ID NO: 828177 - DNA, 20 bp, mouse
gacgatcatggcaaattgaa

SEQ ID NO: 828178 - DNA, 20 bp, mouse
gctcctggtcgcgacgatca

SEQ ID NO: 828179 - DNA, 20 bp, mouse
gaaggggatgattttattgt

SEQ ID NO: 828180 - DNA, 20 bp, mouse
gactatgcagcaatcagaaa

SEQ ID NO: 828181 - DNA, 20 bp, mouse
gatgaaacggctcttgccat

SEQ ID NO: 828182 - DNA, 20 bp, mouse
gtgccatgatcgtcgcgacc

SEQ ID NO: 828183 - DNA, 20 bp, mouse
ggcccctcctctctaaagag

SEQ ID NO: 828184 - DNA, 20 bp, mouse
gtttccctgggagaagagat

SEQ ID NO: 828185 - DNA, 20 bp, mouse
ggcttatgcagccgatgaaa

SEQ ID NO: 828186 - DNA, 20 bp, mouse
gtgggctgggaggacgggtg

SEQ ID NO: 828187 - DNA, 20 bp, mouse
gggaaagaaccggtcctacc

SEQ ID NO: 828188 - DNA, 20 bp, mouse
ggctcaggcaggtgccctca

SEQ ID NO: 828189 - DNA, 20 bp, mouse
ggctgatagccagcgaagta

SEQ ID NO: 828190 - DNA, 20 bp, mouse
gtgtggacgtgcattccctg

SEQ ID NO: 828191 - DNA, 20 bp, mouse
ggctatcagccgggtaggac

SEQ ID NO: 828192 - DNA, 20 bp, mouse
ggtggttcggacctagcggt

SEQ ID NO: 828193 - DNA, 20 bp, mouse
gaaactcttccctacttcgc

SEQ ID NO: 828194 - DNA, 20 bp, mouse
gcaacctgggaaagcagatg

SEQ ID NO: 828195 - DNA, 20 bp, mouse
gaccgccacgtgtaacttcc

SEQ ID NO: 828196 - DNA, 20 bp, mouse
gtggtcgtgggaaacgtaga

SEQ ID NO: 828197 - DNA, 20 bp, mouse
gaacgtagacgggaaggaga

SEQ ID NO: 828198 - DNA, 20 bp, mouse
ggtagtgagatcctggtcgt

SEQ ID NO: 828199 - DNA, 20 bp, mouse
gagcctgagcgcaacaaaga

SEQ ID NO: 828200 - DNA, 20 bp, mouse
gctacacggcagggcacgtc

SEQ ID NO: 828201 - DNA, 20 bp, mouse
gcgactgcggaaggggcgga

SEQ ID NO: 828202 - DNA, 20 bp, mouse
gtcactacacttcccagtac

SEQ ID NO: 828203 - DNA, 20 bp, mouse
gagggtgaattctacacggc

SEQ ID NO: 828204 - DNA, 20 bp, mouse
ggtgggaaacgtagacggga

SEQ ID NO: 828205 - DNA, 20 bp, mouse
gtgtgaaaggcccaagggag

SEQ ID NO: 828206 - DNA, 20 bp, mouse
gcgaccgctccgaccggctc

SEQ ID NO: 828207 - DNA, 20 bp, mouse
ggccccccgaccgctccgac

SEQ ID NO: 828208 - DNA, 20 bp, mouse
gcgcaccggcccgtcgtccc

SEQ ID NO: 828209 - DNA, 20 bp, mouse
ggggtggggcggtgcggccc

SEQ ID NO: 828210 - DNA, 20 bp, mouse
gtccccggagccggtcggag

SEQ ID NO: 828211 - DNA, 20 bp, mouse
gcgaccggctccggggacga

SEQ ID NO: 828212 - DNA, 20 bp, mouse
gggcccgcggagcctcggcg

SEQ ID NO: 828213 - DNA, 20 bp, mouse
gaaaagccagagcgcgctgg

SEQ ID NO: 828214 - DNA, 20 bp, mouse
gaggaagaagttagacggaa

SEQ ID NO: 828215 - DNA, 20 bp, mouse
ggtagaggaagaagaacttg

SEQ ID NO: 828216 - DNA, 20 bp, mouse
ggccccgggaggagagacca

SEQ ID NO: 828217 - DNA, 20 bp, mouse
gcggactcctgggctaatat

SEQ ID NO: 828218 - DNA, 20 bp, mouse
gccgccggtccagggcccaa

SEQ ID NO: 828219 - DNA, 20 bp, mouse
ggacagagagcttacaaggc

SEQ ID NO: 828220 - DNA, 20 bp, mouse
gtgtccctggtctctcctcc

SEQ ID NO: 828221 - DNA, 20 bp, mouse
gggagggccctgaatttcca

SEQ ID NO: 828222 - DNA, 20 bp, mouse
gggagcaccctggaaattca

SEQ ID NO: 828223 - DNA, 20 bp, mouse
gcacctgggtaagagagctc

SEQ ID NO: 828224 - DNA, 20 bp, mouse
gcaagggcagggctagactc

SEQ ID NO: 828225 - DNA, 20 bp, mouse
gaaggggcgttggtcacaca

SEQ ID NO: 828226 - DNA, 20 bp, mouse
gaggctctgcctagatggaa

SEQ ID NO: 828227 - DNA, 20 bp, mouse
ggcactggggcccattgatc

SEQ ID NO: 828228 - DNA, 20 bp, mouse
gaatgggccccagtgcatgt

SEQ ID NO: 828229 - DNA, 20 bp, mouse
gcctagatggaagggcggaa

SEQ ID NO: 828230 - DNA, 20 bp, mouse
gcccgcccccacatgcactg

SEQ ID NO: 828231 - DNA, 20 bp, mouse
gtgtccctgcaatggagagg

SEQ ID NO: 828232 - DNA, 20 bp, mouse
gctctgcctagatggaaggg

SEQ ID NO: 828233 - DNA, 20 bp, mouse
gcccagctattcctgatcaa

SEQ ID NO: 828234 - DNA, 20 bp, mouse
gggggcggggtgccatcttg

SEQ ID NO: 828235 - DNA, 20 bp, mouse
ggggacaatatcagtaggca

SEQ ID NO: 828236 - DNA, 20 bp, mouse
gggaagccaggggttaaagt

SEQ ID NO: 828237 - DNA, 20 bp, mouse
gctcgggccaatggggagaa

SEQ ID NO: 828238 - DNA, 20 bp, mouse
gcgggaagaacgagtgggga

SEQ ID NO: 828239 - DNA, 20 bp, mouse
gttggcagagaagcatcctg

SEQ ID NO: 828240 - DNA, 20 bp, mouse
ggagactgaggctcgggcca

SEQ ID NO: 828241 - DNA, 20 bp, mouse
gccgagagctcgggccaatg

SEQ ID NO: 828242 - DNA, 20 bp, mouse
gaggacgggaagaacgagtg

SEQ ID NO: 828243 - DNA, 20 bp, mouse
gctgtgcgctggccatcccc

SEQ ID NO: 828244 - DNA, 20 bp, mouse
gtggacttgtagagtctata

SEQ ID NO: 828245 - DNA, 20 bp, mouse
ggcagtgagctcctgtccga

SEQ ID NO: 828246 - DNA, 20 bp, mouse
ggcccacttccttacaaggt

SEQ ID NO: 828247 - DNA, 20 bp, mouse
gcttgtaaggaagtgggcgc

SEQ ID NO: 828248 - DNA, 20 bp, mouse
ggcagagacgagccagatgg

SEQ ID NO: 828249 - DNA, 20 bp, mouse
gtgagaagcgactgggttgg

SEQ ID NO: 828250 - DNA, 20 bp, mouse
gaccgaaaagcgccgccatc

SEQ ID NO: 828251 - DNA, 20 bp, mouse
gtggcgggtgtcagcaaaag

SEQ ID NO: 828252 - DNA, 20 bp, mouse
ggagctgtccatcaccgaaa

SEQ ID NO: 828253 - DNA, 20 bp, mouse
ggcctgagaagcgactgggt

SEQ ID NO: 828254 - DNA, 20 bp, mouse
gcggtgatggacagctccat

SEQ ID NO: 828255 - DNA, 20 bp, mouse
gtccgaccttgtaaggaagt

SEQ ID NO: 828256 - DNA, 20 bp, mouse
gtaaacgtctactgtaggca

SEQ ID NO: 828257 - DNA, 20 bp, mouse
ggtacctgaagaggtctaat

SEQ ID NO: 828258 - DNA, 20 bp, mouse
gtgactgattgttgcagtcc

SEQ ID NO: 828259 - DNA, 20 bp, mouse
gcgctctcttaattactcac

SEQ ID NO: 828260 - DNA, 20 bp, mouse
gtgcccagacagcaagtttg

SEQ ID NO: 828261 - DNA, 20 bp, mouse
gtgtaggcagggcggccaat

SEQ ID NO: 828262 - DNA, 20 bp, mouse
gcatgtctgcgtataaattg

SEQ ID NO: 828263 - DNA, 20 bp, mouse
ggatcaggtgggagtcagcc

SEQ ID NO: 828264 - DNA, 20 bp, mouse
gggcggccaatgggaaagcc

SEQ ID NO: 828265 - DNA, 20 bp, mouse
gacaagagcagtctatgctg

SEQ ID NO: 828266 - DNA, 20 bp, mouse
gcccgccgctgcctgggcga

SEQ ID NO: 828267 - DNA, 20 bp, mouse
ggggcccgctggcccgtcat

SEQ ID NO: 828268 - DNA, 20 bp, mouse
ggccaagctctggacgggag

SEQ ID NO: 828269 - DNA, 20 bp, mouse
gcgggcgcgggcggcgaggt

SEQ ID NO: 828270 - DNA, 20 bp, mouse
gtagcgcaggggatccgaac

SEQ ID NO: 828271 - DNA, 20 bp, mouse
ggacagctcaggccaagctc

SEQ ID NO: 828272 - DNA, 20 bp, mouse
ggcttccgacaccttctccc

SEQ ID NO: 828273 - DNA, 20 bp, mouse
gcaggggatccgaacagggc

SEQ ID NO: 828274 - DNA, 20 bp, mouse
gggcggggttttgacagctc

SEQ ID NO: 828275 - DNA, 20 bp, mouse
gtcccggcgcgggagggaaa

SEQ ID NO: 828276 - DNA, 20 bp, mouse
ggagtggcccaagtccgagg

SEQ ID NO: 828277 - DNA, 20 bp, mouse
gagaagacgcacagtgaaca

SEQ ID NO: 828278 - DNA, 20 bp, mouse
gcgcagggagagagcgccta

SEQ ID NO: 828279 - DNA, 20 bp, mouse
gatcggcgtgggactctaga

SEQ ID NO: 828280 - DNA, 20 bp, mouse
gaggaggtgacgatcggcgt

SEQ ID NO: 828281 - DNA, 20 bp, mouse
gactctgggcggaggcggtc

SEQ ID NO: 828282 - DNA, 20 bp, mouse
gtgcgctcccggtggagagc

SEQ ID NO: 828283 - DNA, 20 bp, mouse
gcaggagggcgcagtgccct

SEQ ID NO: 828284 - DNA, 20 bp, mouse
gcgtgggactctagagggtg

SEQ ID NO: 828285 - DNA, 20 bp, mouse
gcagactgtgcggagtgggg

SEQ ID NO: 828286 - DNA, 20 bp, mouse
ggcgccgctagtgacagcgc

SEQ ID NO: 828287 - DNA, 20 bp, mouse
gggccaaggtggcggggtga

SEQ ID NO: 828288 - DNA, 20 bp, mouse
gcagcccgcgctgtcactag

SEQ ID NO: 828289 - DNA, 20 bp, mouse
ggggcggggccaaggtggcg

SEQ ID NO: 828290 - DNA, 20 bp, mouse
gaggactggcggaacttcct

SEQ ID NO: 828291 - DNA, 20 bp, mouse
ggagacttacacttaggagt

SEQ ID NO: 828292 - DNA, 20 bp, mouse
gaggcgtgagaatgctcaga

SEQ ID NO: 828293 - DNA, 20 bp, mouse
gcgcgaattcgcttttggtg

SEQ ID NO: 828294 - DNA, 20 bp, mouse
gcgacaagagacttacactt

SEQ ID NO: 828295 - DNA, 20 bp, mouse
ggctcagatggtcccatctg

SEQ ID NO: 828296 - DNA, 20 bp, mouse
ggctgcagggacctcatctc

SEQ ID NO: 828297 - DNA, 20 bp, mouse
gggtccctgcagcaccccca

SEQ ID NO: 828298 - DNA, 20 bp, mouse
gttaggttggcatacttaga

SEQ ID NO: 828299 - DNA, 20 bp, mouse
ggggccttgggggtgctgca

SEQ ID NO: 828300 - DNA, 20 bp, mouse
ggctgaccttgagtcaaagc

SEQ ID NO: 828301 - DNA, 20 bp, mouse
gatacttagagggaatggta

SEQ ID NO: 828302 - DNA, 20 bp, mouse
gacgtggatgaggacatctg

SEQ ID NO: 828303 - DNA, 20 bp, mouse
gtaaaccagtgagcccaaga

SEQ ID NO: 828304 - DNA, 20 bp, mouse
gcttaccagacaaccttctt

SEQ ID NO: 828305 - DNA, 20 bp, mouse
gtgagcccaagaaggttgtc

SEQ ID NO: 828306 - DNA, 20 bp, mouse
gcaccaaagtcgcctctagg

SEQ ID NO: 828307 - DNA, 20 bp, mouse
ggagcccgaggcttgttgat

SEQ ID NO: 828308 - DNA, 20 bp, mouse
gggagggcggggagccacca

SEQ ID NO: 828309 - DNA, 20 bp, mouse
gttcacaggtcgagtgctgg

SEQ ID NO: 828310 - DNA, 20 bp, mouse
gtgagcgcgcggcgccctgg

SEQ ID NO: 828311 - DNA, 20 bp, mouse
gaaaagaaggtgtcggaaac

SEQ ID NO: 828312 - DNA, 20 bp, mouse
ggctgcgccgcgcggtacta

SEQ ID NO: 828313 - DNA, 20 bp, mouse
ggacggtccggcagcgctgt

SEQ ID NO: 828314 - DNA, 20 bp, mouse
gcaagccgggggatccgggg

SEQ ID NO: 828315 - DNA, 20 bp, mouse
ggacaggccgtagtaccgcg

SEQ ID NO: 828316 - DNA, 20 bp, mouse
gcagaccccaagcctcaatt

SEQ ID NO: 828317 - DNA, 20 bp, mouse
gccggagagggggaattcta

SEQ ID NO: 828318 - DNA, 20 bp, mouse
ggggaggaccgaagagtccc

SEQ ID NO: 828319 - DNA, 20 bp, mouse
ggcaggggagtgcaaggagg

SEQ ID NO: 828320 - DNA, 20 bp, mouse
ggaatcccgcagcccaattg

SEQ ID NO: 828321 - DNA, 20 bp, mouse
gtgtcctcgccttggtccta

SEQ ID NO: 828322 - DNA, 20 bp, mouse
gagggggaattctagggtcc

SEQ ID NO: 828323 - DNA, 20 bp, mouse
gccgcagcccaattgaggct

SEQ ID NO: 828324 - DNA, 20 bp, mouse
ggcgacgtcagcacggaggg

SEQ ID NO: 828325 - DNA, 20 bp, mouse
gcccaggcctaggagtaggc

SEQ ID NO: 828326 - DNA, 20 bp, mouse
gtgactgcccccaaggcttg

SEQ ID NO: 828327 - DNA, 20 bp, mouse
gccccggtccagaacctgaa

SEQ ID NO: 828328 - DNA, 20 bp, mouse
gatacagccccaagccttgg

SEQ ID NO: 828329 - DNA, 20 bp, mouse
gagggtctacgtgcagttta

SEQ ID NO: 828330 - DNA, 20 bp, mouse
gactgcacgtagaccctccc

SEQ ID NO: 828331 - DNA, 20 bp, mouse
gagctgagaccatgcctaga

SEQ ID NO: 828332 - DNA, 20 bp, mouse
gactgtagttgaaagaggga

SEQ ID NO: 828333 - DNA, 20 bp, mouse
gctcccttcaggttctggac

SEQ ID NO: 828334 - DNA, 20 bp, mouse
gttggggctgtatgaggagt

SEQ ID NO: 828335 - DNA, 20 bp, mouse
gttagactgtagttgaaaga

SEQ ID NO: 828336 - DNA, 20 bp, mouse
gaacagccagcgagcagtgg

SEQ ID NO: 828337 - DNA, 20 bp, mouse
gactgagatcgtagggttta

SEQ ID NO: 828338 - DNA, 20 bp, mouse
gaagttgtcgggctccagaa

SEQ ID NO: 828339 - DNA, 20 bp, mouse
ggggctccagaacggcttag

SEQ ID NO: 828340 - DNA, 20 bp, mouse
gggagacttgagagagactt

SEQ ID NO: 828341 - DNA, 20 bp, mouse
gaagactaaatagcagatct

SEQ ID NO: 828342 - DNA, 20 bp, mouse
gcagtggaggaggtgtgtgc

SEQ ID NO: 828343 - DNA, 20 bp, mouse
gcccccagagaagaaaaact

SEQ ID NO: 828344 - DNA, 20 bp, mouse
ggctgggaggctctagtggt

SEQ ID NO: 828345 - DNA, 20 bp, mouse
ggaggtgggcagtcgctggg

SEQ ID NO: 828346 - DNA, 20 bp, mouse
ggggactagtgaagctgcga

SEQ ID NO: 828347 - DNA, 20 bp, mouse
gagacccctggggcctagaa

SEQ ID NO: 828348 - DNA, 20 bp, mouse
ggtgaagctgcgagggagag

SEQ ID NO: 828349 - DNA, 20 bp, mouse
gtccttggggccctggaggt

SEQ ID NO: 828350 - DNA, 20 bp, mouse
ggatccctagggctaagaca

SEQ ID NO: 828351 - DNA, 20 bp, mouse
gggggaggggctgtgatctc

SEQ ID NO: 828352 - DNA, 20 bp, mouse
gctagaaggggtccaagagg

SEQ ID NO: 828353 - DNA, 20 bp, mouse
gtcggtctgattgatcccta

SEQ ID NO: 828354 - DNA, 20 bp, mouse
gtctgcccccaccgtgggaa

SEQ ID NO: 828355 - DNA, 20 bp, mouse
ggtgctgtgagctataaagg

SEQ ID NO: 828356 - DNA, 20 bp, mouse
gacccagagggaggccatgt

SEQ ID NO: 828357 - DNA, 20 bp, mouse
gaagagctgggaggccaaat

SEQ ID NO: 828358 - DNA, 20 bp, mouse
gagagacatcagttgttgaa

SEQ ID NO: 828359 - DNA, 20 bp, mouse
gttcccacatggcctccctc

SEQ ID NO: 828360 - DNA, 20 bp, mouse
ggggtggggctgacgagagt

SEQ ID NO: 828361 - DNA, 20 bp, mouse
gtcatcctgggcaactgtca

SEQ ID NO: 828362 - DNA, 20 bp, mouse
ggctagggtgggaaccaagc

SEQ ID NO: 828363 - DNA, 20 bp, mouse
gctgggaggccaaatggggc

SEQ ID NO: 828364 - DNA, 20 bp, mouse
gggaaccaagcagggcacaa

SEQ ID NO: 828365 - DNA, 20 bp, mouse
gctgacccaatatccctgga

SEQ ID NO: 828366 - DNA, 20 bp, mouse
gctgtctgctcctgtttctg

SEQ ID NO: 828367 - DNA, 20 bp, mouse
gctgaagtacagatcgacaa

SEQ ID NO: 828368 - DNA, 20 bp, mouse
gacctggcccccagaatcca

SEQ ID NO: 828369 - DNA, 20 bp, mouse
gtcacccgaggtaagatctg

SEQ ID NO: 828370 - DNA, 20 bp, mouse
gctcactcgtagtcgtgtgt

SEQ ID NO: 828371 - DNA, 20 bp, mouse
gagcagacaggcgggcctca

SEQ ID NO: 828372 - DNA, 20 bp, mouse
ggatcgacaaaggtgtagag

SEQ ID NO: 828373 - DNA, 20 bp, mouse
ggtatttgagaagcagtcaa

SEQ ID NO: 828374 - DNA, 20 bp, mouse
gcaatgcactgggaggtggt

SEQ ID NO: 828375 - DNA, 20 bp, mouse
ggggcactctgaatgttcca

SEQ ID NO: 828376 - DNA, 20 bp, mouse
ggagaccggtacctctgggg

SEQ ID NO: 828377 - DNA, 20 bp, mouse
gacagccccggccctccttg

SEQ ID NO: 828378 - DNA, 20 bp, mouse
gctggagaccggtacctctg

SEQ ID NO: 828379 - DNA, 20 bp, mouse
ggggcacctgacggggtgag

SEQ ID NO: 828380 - DNA, 20 bp, mouse
gggaggaggggcacctgacg

SEQ ID NO: 828381 - DNA, 20 bp, mouse
gcccacagggccgtgagggg

SEQ ID NO: 828382 - DNA, 20 bp, mouse
gctcgcggcacccaccgcca

SEQ ID NO: 828383 - DNA, 20 bp, mouse
gtcctccaccccagaggtac

SEQ ID NO: 828384 - DNA, 20 bp, mouse
ggggcccacagggccgtgag

SEQ ID NO: 828385 - DNA, 20 bp, mouse
gcagggaagcatgagaggag

SEQ ID NO: 828386 - DNA, 20 bp, mouse
gcagctgagtgtgaaagatc

SEQ ID NO: 828387 - DNA, 20 bp, mouse
gcgcacgcgcagcccctggt

SEQ ID NO: 828388 - DNA, 20 bp, mouse
ggtgaaagatccggttcctc

SEQ ID NO: 828389 - DNA, 20 bp, mouse
ggcgcagcccctggtgggga

SEQ ID NO: 828390 - DNA, 20 bp, mouse
ggaaggggcggagctatgca

SEQ ID NO: 828391 - DNA, 20 bp, mouse
gagccgttggtagtcttggt

SEQ ID NO: 828392 - DNA, 20 bp, mouse
gagcctaccaagactaccaa

SEQ ID NO: 828393 - DNA, 20 bp, mouse
gtgtaatcaaagcacgtagg

SEQ ID NO: 828394 - DNA, 20 bp, mouse
gagcaaaggtaaaggagtag

SEQ ID NO: 828395 - DNA, 20 bp, mouse
gcagacaaaggacacgatgt

SEQ ID NO: 828396 - DNA, 20 bp, mouse
ggtgcttcggaagaagagta

SEQ ID NO: 828397 - DNA, 20 bp, mouse
gtcctgcttcgaaaggagtg

SEQ ID NO: 828398 - DNA, 20 bp, mouse
ggagtccgtgctcctgtaag

SEQ ID NO: 828399 - DNA, 20 bp, mouse
gtacaggagcacggactcaa

SEQ ID NO: 828400 - DNA, 20 bp, mouse
gtcccataagcaagggttat

SEQ ID NO: 828401 - DNA, 20 bp, mouse
gcaccagctcccataagcaa

SEQ ID NO: 828402 - DNA, 20 bp, mouse
gtgggcagatcaggggactt

SEQ ID NO: 828403 - DNA, 20 bp, mouse
gcgctcgaaaccaccacgtg

SEQ ID NO: 828404 - DNA, 20 bp, mouse
gaggtcatgccttgatactt

SEQ ID NO: 828405 - DNA, 20 bp, mouse
gacccataacccttgcttat

SEQ ID NO: 828406 - DNA, 20 bp, mouse
gggttggggtacccagattc

SEQ ID NO: 828407 - DNA, 20 bp, mouse
gaagactcactggtggtgat

SEQ ID NO: 828408 - DNA, 20 bp, mouse
gggtgatggggctctgagtc

SEQ ID NO: 828409 - DNA, 20 bp, mouse
gggaagaaggggctatttaa

SEQ ID NO: 828410 - DNA, 20 bp, mouse
gcctgcaagatgctctgttg

SEQ ID NO: 828411 - DNA, 20 bp, mouse
gtgtcctccctgagcaaggg

SEQ ID NO: 828412 - DNA, 20 bp, mouse
gcctgggagcaaccagaatc

SEQ ID NO: 828413 - DNA, 20 bp, mouse
gtctgctccccccttgctca

SEQ ID NO: 828414 - DNA, 20 bp, mouse
gagtagcacctctgggtgtc

SEQ ID NO: 828415 - DNA, 20 bp, mouse
ggggcagcctcgtgccacct

SEQ ID NO: 828416 - DNA, 20 bp, mouse
gcagcaacgcgagtccggat

SEQ ID NO: 828417 - DNA, 20 bp, mouse
gggatcaggcagtaggcggt

SEQ ID NO: 828418 - DNA, 20 bp, mouse
gctcgccagcaacgcgagtc

SEQ ID NO: 828419 - DNA, 20 bp, mouse
ggcctactgcctgatccctc

SEQ ID NO: 828420 - DNA, 20 bp, mouse
gcctccggcagagcgttctc

SEQ ID NO: 828421 - DNA, 20 bp, mouse
ggtcccagagaacgctctgc

SEQ ID NO: 828422 - DNA, 20 bp, mouse
gtctgccggaggggtttcga

SEQ ID NO: 828423 - DNA, 20 bp, mouse
gtggaacttccggccctatc

SEQ ID NO: 828424 - DNA, 20 bp, mouse
gctggcgagctggagttgga

SEQ ID NO: 828425 - DNA, 20 bp, mouse
gagttccatcgaaacccctc

SEQ ID NO: 828426 - DNA, 20 bp, mouse
gggcacgtggggccgtggtc

SEQ ID NO: 828427 - DNA, 20 bp, mouse
gcctccccctggcattcggt

SEQ ID NO: 828428 - DNA, 20 bp, mouse
gaaggcgcgaccggccgcca

SEQ ID NO: 828429 - DNA, 20 bp, mouse
ggtgcccaccgaatgccagg

SEQ ID NO: 828430 - DNA, 20 bp, mouse
gcggtgggcacgtggggccg

SEQ ID NO: 828431 - DNA, 20 bp, mouse
gcagggcaagctgctcagat

SEQ ID NO: 828432 - DNA, 20 bp, mouse
ggagtgagctgagtgactct

SEQ ID NO: 828433 - DNA, 20 bp, mouse
gagggggagggaggacctag

SEQ ID NO: 828434 - DNA, 20 bp, mouse
gacgtggggccgtggtccgg

SEQ ID NO: 828435 - DNA, 20 bp, mouse
gggagtggggagaactattc

SEQ ID NO: 828436 - DNA, 20 bp, mouse
gtgggaggggaggaccaatc

SEQ ID NO: 828437 - DNA, 20 bp, mouse
gcctcagggggtgtgtaagt

SEQ ID NO: 828438 - DNA, 20 bp, mouse
gggggcacccctaggagagt

SEQ ID NO: 828439 - DNA, 20 bp, mouse
gctggcgggtcgtgcctcag

SEQ ID NO: 828440 - DNA, 20 bp, mouse
gtagacttcaaggactgccc

SEQ ID NO: 828441 - DNA, 20 bp, mouse
gcgcccctcccatcgctggg

SEQ ID NO: 828442 - DNA, 20 bp, mouse
gccctcccggctcgagtgtc

SEQ ID NO: 828443 - DNA, 20 bp, mouse
gcctccccccagcgatggga

SEQ ID NO: 828444 - DNA, 20 bp, mouse
gggaggaccaatctggaaga

SEQ ID NO: 828445 - DNA, 20 bp, mouse
gggcgcgcccctcccatcgc

SEQ ID NO: 828446 - DNA, 20 bp, mouse
ggacgccaaagtggttacta

SEQ ID NO: 828447 - DNA, 20 bp, mouse
gggaagagggaataatcctg

SEQ ID NO: 828448 - DNA, 20 bp, mouse
gaggggagcgcgtcacagct

SEQ ID NO: 828449 - DNA, 20 bp, mouse
gggaaaaggtaagaatcccg

SEQ ID NO: 828450 - DNA, 20 bp, mouse
gagagtggaaagggagtagg

SEQ ID NO: 828451 - DNA, 20 bp, mouse
gcctggggaacaagggagca

SEQ ID NO: 828452 - DNA, 20 bp, mouse
gaggctcctggtcacgtgag

SEQ ID NO: 828453 - DNA, 20 bp, mouse
ggaataatcctggggaacaa

SEQ ID NO: 828454 - DNA, 20 bp, mouse
ggagggacttgggcagacat

SEQ ID NO: 828455 - DNA, 20 bp, mouse
ggtctgaggtaaggcgattc

SEQ ID NO: 828456 - DNA, 20 bp, mouse
gaagaagactgggaggctac

SEQ ID NO: 828457 - DNA, 20 bp, mouse
ggggcgggcaagcggacgtg

SEQ ID NO: 828458 - DNA, 20 bp, mouse
ggatgcccgagaagaagact

SEQ ID NO: 828459 - DNA, 20 bp, mouse
ggtgccaagaccagaccgta

SEQ ID NO: 828460 - DNA, 20 bp, mouse
ggcccgagaagaagactggg

SEQ ID NO: 828461 - DNA, 20 bp, mouse
ggagatgggtcaggcaagtg

SEQ ID NO: 828462 - DNA, 20 bp, mouse
ggacgcggtgttcacgtgac

SEQ ID NO: 828463 - DNA, 20 bp, mouse
gtgctcatcttagtccccca

SEQ ID NO: 828464 - DNA, 20 bp, mouse
gggcacctccaccagctaca

SEQ ID NO: 828465 - DNA, 20 bp, mouse
gaccggccaggcgcagacgt

SEQ ID NO: 828466 - DNA, 20 bp, mouse
gtgcttgggaggggaactaa

SEQ ID NO: 828467 - DNA, 20 bp, mouse
gaaagtggtgggggtagtga

SEQ ID NO: 828468 - DNA, 20 bp, mouse
gaaactgaacgacagagggg

SEQ ID NO: 828469 - DNA, 20 bp, mouse
ggacgcactttcttgtgctt

SEQ ID NO: 828470 - DNA, 20 bp, mouse
gagtgagggggaaagtaggc

SEQ ID NO: 828471 - DNA, 20 bp, mouse
gcggtggctaagagatgaag

SEQ ID NO: 828472 - DNA, 20 bp, mouse
gtgacaaggcctcatgctgt

SEQ ID NO: 828473 - DNA, 20 bp, mouse
gggcctcatgctgtggggga

SEQ ID NO: 828474 - DNA, 20 bp, mouse
gtaccagctccttatctccg

SEQ ID NO: 828475 - DNA, 20 bp, mouse
gagtcctctgagatcttaac

SEQ ID NO: 828476 - DNA, 20 bp, mouse
gggtagcaatgcacagttag

SEQ ID NO: 828477 - DNA, 20 bp, mouse
gaagggagcgtccactgaga

SEQ ID NO: 828478 - DNA, 20 bp, mouse
gggaggtggggagacaattg

SEQ ID NO: 828479 - DNA, 20 bp, mouse
gggggagatggatttagcta

SEQ ID NO: 828480 - DNA, 20 bp, mouse
gtaggctgtcataactggtg

SEQ ID NO: 828481 - DNA, 20 bp, mouse
ggaggatgcgcatctcactg

SEQ ID NO: 828482 - DNA, 20 bp, mouse
gtggacgctcccttcatgga

SEQ ID NO: 828483 - DNA, 20 bp, mouse
gcagatcctccagggatggg

SEQ ID NO: 828484 - DNA, 20 bp, mouse
gtacctaagtacagagccta

SEQ ID NO: 828485 - DNA, 20 bp, mouse
gtgacagcctaattgggcgg

SEQ ID NO: 828486 - DNA, 20 bp, mouse
gaaggcaaaaatgagtgaca

SEQ ID NO: 828487 - DNA, 20 bp, mouse
gtgacagggcctggtgtgct

SEQ ID NO: 828488 - DNA, 20 bp, mouse
gctgatgggaggggaaagta

SEQ ID NO: 828489 - DNA, 20 bp, mouse
gagccctaaaaaaggaatga

SEQ ID NO: 828490 - DNA, 20 bp, mouse
ggcagtagtgctgatgggag

SEQ ID NO: 828491 - DNA, 20 bp, mouse
gggccccttctccttatgga

SEQ ID NO: 828492 - DNA, 20 bp, mouse
gctccctggtaatcagagaa

SEQ ID NO: 828493 - DNA, 20 bp, mouse
gttgcctttgctaatttcag

SEQ ID NO: 828494 - DNA, 20 bp, mouse
gcttctgcagtagtgctgat

SEQ ID NO: 828495 - DNA, 20 bp, mouse
gctctcaagagccctaaaaa

SEQ ID NO: 828496 - DNA, 20 bp, mouse
gtgggctttggggaagaggt

SEQ ID NO: 828497 - DNA, 20 bp, mouse
gtcttgcttcttaggagtaa

SEQ ID NO: 828498 - DNA, 20 bp, mouse
gccacaagataccatcagaa

SEQ ID NO: 828499 - DNA, 20 bp, mouse
gacagctggctcccttctga

SEQ ID NO: 828500 - DNA, 20 bp, mouse
gtgcacctagaggaggtcgc

SEQ ID NO: 828501 - DNA, 20 bp, mouse
gtcaaccctcttgagagcta

SEQ ID NO: 828502 - DNA, 20 bp, mouse
gtctcaagagggttgaaatc

SEQ ID NO: 828503 - DNA, 20 bp, mouse
gaggtccgtagctctcaaga

SEQ ID NO: 828504 - DNA, 20 bp, mouse
ggctacggacctttcagatg

SEQ ID NO: 828505 - DNA, 20 bp, mouse
gtagatgggacctgatgcag

SEQ ID NO: 828506 - DNA, 20 bp, mouse
ggggcgggctgcatgttaat

SEQ ID NO: 828507 - DNA, 20 bp, mouse
gggctgcatgttaatgggag

SEQ ID NO: 828508 - DNA, 20 bp, mouse
gaaggtgaatagatactact

SEQ ID NO: 828509 - DNA, 20 bp, mouse
gattgacagtatctagtgaa

SEQ ID NO: 828510 - DNA, 20 bp, mouse
ggtggactgtaggatttggt

SEQ ID NO: 828511 - DNA, 20 bp, mouse
gtaatgggaggggtaaccaa

SEQ ID NO: 828512 - DNA, 20 bp, mouse
gtctagtgaagggaatgtag

SEQ ID NO: 828513 - DNA, 20 bp, mouse
gtgaagggaatgtagggggc

SEQ ID NO: 828514 - DNA, 20 bp, mouse
gtttcctggtaatctgagta

SEQ ID NO: 828515 - DNA, 20 bp, mouse
gtcaccttactcagattacc

SEQ ID NO: 828516 - DNA, 20 bp, mouse
gggcgagccaacgtgggcgt

SEQ ID NO: 828517 - DNA, 20 bp, mouse
gagagcctgcaccagtccta

SEQ ID NO: 828518 - DNA, 20 bp, mouse
gggttccggcgagccaacgt

SEQ ID NO: 828519 - DNA, 20 bp, mouse
gggaaccttaggactggtgc

SEQ ID NO: 828520 - DNA, 20 bp, mouse
gaggaggcggcaccgcccac

SEQ ID NO: 828521 - DNA, 20 bp, mouse
gcagagtggtcccttgagag

SEQ ID NO: 828522 - DNA, 20 bp, mouse
ggccttagctcctctctcaa

SEQ ID NO: 828523 - DNA, 20 bp, mouse
gtccaatcccacgcccacgt

SEQ ID NO: 828524 - DNA, 20 bp, mouse
ggccaacgtgggcgtgggat

SEQ ID NO: 828525 - DNA, 20 bp, mouse
ggaccactctgcgaggcccg

SEQ ID NO: 828526 - DNA, 20 bp, mouse
gtggggccagtagttctcgg

SEQ ID NO: 828527 - DNA, 20 bp, mouse
ggggacggaaaacctctcgt

SEQ ID NO: 828528 - DNA, 20 bp, mouse
gcggcctggcacggagaaag

SEQ ID NO: 828529 - DNA, 20 bp, mouse
gctgcctcctggccggtctc

SEQ ID NO: 828530 - DNA, 20 bp, mouse
gccgccccggtccgcccaat

SEQ ID NO: 828531 - DNA, 20 bp, mouse
gctactggccccagtcggcc

SEQ ID NO: 828532 - DNA, 20 bp, mouse
ggcgaggcgtgcggaagctg

SEQ ID NO: 828533 - DNA, 20 bp, mouse
gggccaggaggcagccgatt

SEQ ID NO: 828534 - DNA, 20 bp, mouse
gtctccgtgccaggccgact

SEQ ID NO: 828535 - DNA, 20 bp, mouse
gtcctggccggtctctggga

SEQ ID NO: 828536 - DNA, 20 bp, mouse
gtctggaggaagtgcgttgt

SEQ ID NO: 828537 - DNA, 20 bp, mouse
gcatctcattggttgggatt

SEQ ID NO: 828538 - DNA, 20 bp, mouse
gtcctccagacgcaagttac

SEQ ID NO: 828539 - DNA, 20 bp, mouse
gaggccgagacgcgatctgc

SEQ ID NO: 828540 - DNA, 20 bp, mouse
ggcgttgtgggcagtaaaac

SEQ ID NO: 828541 - DNA, 20 bp, mouse
gccccagcggcctacccctg

SEQ ID NO: 828542 - DNA, 20 bp, mouse
gggggggcggccctgaatag

SEQ ID NO: 828543 - DNA, 20 bp, mouse
gtcccgcgcgttacagaaag

SEQ ID NO: 828544 - DNA, 20 bp, mouse
gggtagcgatgtctcttaaa

SEQ ID NO: 828545 - DNA, 20 bp, mouse
gtctgtaacgcgcgggagac

SEQ ID NO: 828546 - DNA, 20 bp, mouse
gtataacccagacaccgaga

SEQ ID NO: 828547 - DNA, 20 bp, mouse
gtgggaggggctgcaggata

SEQ ID NO: 828548 - DNA, 20 bp, mouse
gtggccgcaacggcgtggga

SEQ ID NO: 828549 - DNA, 20 bp, mouse
gaacccagacaccgagatgg

SEQ ID NO: 828550 - DNA, 20 bp, mouse
gaagatggccgcaacggcgt

SEQ ID NO: 828551 - DNA, 20 bp, mouse
gtgcaccacggatccgagac

SEQ ID NO: 828552 - DNA, 20 bp, mouse
gcgcccgctcaccatcccgg

SEQ ID NO: 828553 - DNA, 20 bp, mouse
gagcacgctgggtcgcgctt

SEQ ID NO: 828554 - DNA, 20 bp, mouse
gaagcacaggaagtggcttc

SEQ ID NO: 828555 - DNA, 20 bp, mouse
gtcggtgtctgggttatagg

SEQ ID NO: 828556 - DNA, 20 bp, mouse
gtccgccgggccctcacgga

SEQ ID NO: 828557 - DNA, 20 bp, mouse
gccccagcggaggcccggaa

SEQ ID NO: 828558 - DNA, 20 bp, mouse
gtctgggttgggcgtgtcgg

SEQ ID NO: 828559 - DNA, 20 bp, mouse
gtgggtggagtcagtgatca

SEQ ID NO: 828560 - DNA, 20 bp, mouse
gagtgggcgtggtctggcgc

SEQ ID NO: 828561 - DNA, 20 bp, mouse
gttgcagaatacaggcttgg

SEQ ID NO: 828562 - DNA, 20 bp, mouse
ggaccacgcccactatatca

SEQ ID NO: 828563 - DNA, 20 bp, mouse
ggagagttaaagccagagtt

SEQ ID NO: 828564 - DNA, 20 bp, mouse
gcgtgagggcccggcggaga

SEQ ID NO: 828565 - DNA, 20 bp, mouse
gcgccgtgatatagtgggcg

SEQ ID NO: 828566 - DNA, 20 bp, mouse
gctaacgtagccacgtgtcc

SEQ ID NO: 828567 - DNA, 20 bp, mouse
gaacaagtggcgccctcttg

SEQ ID NO: 828568 - DNA, 20 bp, mouse
gccggcgttcccaattggtc

SEQ ID NO: 828569 - DNA, 20 bp, mouse
gtggaaggcgcccggacacg

SEQ ID NO: 828570 - DNA, 20 bp, mouse
gtctcggcttgcgctattag

SEQ ID NO: 828571 - DNA, 20 bp, mouse
gagtcccaccttatgtgcgt

SEQ ID NO: 828572 - DNA, 20 bp, mouse
gcacgtggctacgttaggct

SEQ ID NO: 828573 - DNA, 20 bp, mouse
ggttaggctgggcggaactt

SEQ ID NO: 828574 - DNA, 20 bp, mouse
gtggccgcttagaggcttta

SEQ ID NO: 828575 - DNA, 20 bp, mouse
ggcacataaggtgggactag

SEQ ID NO: 828576 - DNA, 20 bp, mouse
ggggacacagcgcggcacga

SEQ ID NO: 828577 - DNA, 20 bp, mouse
gggggtgctcccaacccagc

SEQ ID NO: 828578 - DNA, 20 bp, mouse
ggcgacaacggagtgggcta

SEQ ID NO: 828579 - DNA, 20 bp, mouse
gggtgcgcacggagggtcca

SEQ ID NO: 828580 - DNA, 20 bp, mouse
gcgctgtgtccccgcctcgg

SEQ ID NO: 828581 - DNA, 20 bp, mouse
gtggccaccagtagcgacaa

SEQ ID NO: 828582 - DNA, 20 bp, mouse
ggggtccggatctgtgggcg

SEQ ID NO: 828583 - DNA, 20 bp, mouse
ggatctgtgggcggggactg

SEQ ID NO: 828584 - DNA, 20 bp, mouse
gtgtccccgcctcgggggtc

SEQ ID NO: 828585 - DNA, 20 bp, mouse
gccgccgccggcccgcacct

SEQ ID NO: 828586 - DNA, 20 bp, mouse
gagtccgcccaccacagctg

SEQ ID NO: 828587 - DNA, 20 bp, mouse
gtccccgtcgcggcacttcg

SEQ ID NO: 828588 - DNA, 20 bp, mouse
ggaggcgcggagggatccgg

SEQ ID NO: 828589 - DNA, 20 bp, mouse
gagaacttgtgggtctcctc

SEQ ID NO: 828590 - DNA, 20 bp, mouse
gtcgcctcccgcgtccggcg

SEQ ID NO: 828591 - DNA, 20 bp, mouse
ggcgccccgaagtgccgcga

SEQ ID NO: 828592 - DNA, 20 bp, mouse
gagcccgcccggggagccac

SEQ ID NO: 828593 - DNA, 20 bp, mouse
ggagccgcagctgtggtggg

SEQ ID NO: 828594 - DNA, 20 bp, mouse
gcagccacgccggacgcggg

SEQ ID NO: 828595 - DNA, 20 bp, mouse
gctgccacccgcagccattc

SEQ ID NO: 828596 - DNA, 20 bp, mouse
gagtccgcccaccacagctg

SEQ ID NO: 828597 - DNA, 20 bp, mouse
gcaggtgggacggcacgctc

SEQ ID NO: 828598 - DNA, 20 bp, mouse
ggagccgcagctgtggtggg

SEQ ID NO: 828599 - DNA, 20 bp, mouse
gctgtggtgggcggactctg

SEQ ID NO: 828600 - DNA, 20 bp, mouse
gtccccgtcgcggcacttcg

SEQ ID NO: 828601 - DNA, 20 bp, mouse
ggtgagcaagctgatgagcg

SEQ ID NO: 828602 - DNA, 20 bp, mouse
gctgatgagcgcggcgtgag

SEQ ID NO: 828603 - DNA, 20 bp, mouse
ggaggcgcggagggatccgg

SEQ ID NO: 828604 - DNA, 20 bp, mouse
gtcgcctcccgcgtccggcg

SEQ ID NO: 828605 - DNA, 20 bp, mouse
gtgcagcgcggggctcaggt

SEQ ID NO: 828606 - DNA, 20 bp, mouse
gaacccagagcgtacggtga

SEQ ID NO: 828607 - DNA, 20 bp, mouse
ggaccctcaccgtacgctct

SEQ ID NO: 828608 - DNA, 20 bp, mouse
ggtgagggtcagaagctccg

SEQ ID NO: 828609 - DNA, 20 bp, mouse
gagcgcagatctggattcct

SEQ ID NO: 828610 - DNA, 20 bp, mouse
gccggggccactctctactt

SEQ ID NO: 828611 - DNA, 20 bp, mouse
ggacctaccagcggtctcct

SEQ ID NO: 828612 - DNA, 20 bp, mouse
ggaggcaggcgcatagttat

SEQ ID NO: 828613 - DNA, 20 bp, mouse
gagctcaaacccagagcgta

SEQ ID NO: 828614 - DNA, 20 bp, mouse
gcaggcgcatagttattggc

SEQ ID NO: 828615 - DNA, 20 bp, mouse
gggaggagccaatcacgaga

SEQ ID NO: 828616 - DNA, 20 bp, mouse
gcgtgccggccaatcagaag

SEQ ID NO: 828617 - DNA, 20 bp, mouse
gggaacccgggaaaacgtgc

SEQ ID NO: 828618 - DNA, 20 bp, mouse
gagggcgcggagaaagtttg

SEQ ID NO: 828619 - DNA, 20 bp, mouse
gcaaatgggtgcaactcaga

SEQ ID NO: 828620 - DNA, 20 bp, mouse
gaatcagaagtggcggagag

SEQ ID NO: 828621 - DNA, 20 bp, mouse
gtgtaaggggcgtggcaaga

SEQ ID NO: 828622 - DNA, 20 bp, mouse
ggcaactcccccctgcgcat

SEQ ID NO: 828623 - DNA, 20 bp, mouse
gcccgccggctgcttctgat

SEQ ID NO: 828624 - DNA, 20 bp, mouse
ggggctcgcgggcgcgaagt

SEQ ID NO: 828625 - DNA, 20 bp, mouse
gcgggcgcgaagtcggaccc

SEQ ID NO: 828626 - DNA, 20 bp, mouse
gcagaggtgtgatccggcag

SEQ ID NO: 828627 - DNA, 20 bp, mouse
gtaagggcgaaggagggatc

SEQ ID NO: 828628 - DNA, 20 bp, mouse
gtgcagttaagggcgaagga

SEQ ID NO: 828629 - DNA, 20 bp, mouse
ggcaggggccgtgatgtcag

SEQ ID NO: 828630 - DNA, 20 bp, mouse
gagagctagtgccagtgttg

SEQ ID NO: 828631 - DNA, 20 bp, mouse
gtcagctgatgtcaccgccc

SEQ ID NO: 828632 - DNA, 20 bp, mouse
gtctctgcagttaagggcga

SEQ ID NO: 828633 - DNA, 20 bp, mouse
gaagtgaagtcacagggccg

SEQ ID NO: 828634 - DNA, 20 bp, mouse
gccaatgcccaccgcaggtg

SEQ ID NO: 828635 - DNA, 20 bp, mouse
gggatcacacctctgcaggg

SEQ ID NO: 828636 - DNA, 20 bp, mouse
gggtacaggcatgttgcaat

SEQ ID NO: 828637 - DNA, 20 bp, mouse
gggaagaaggaatccggtac

SEQ ID NO: 828638 - DNA, 20 bp, mouse
ggatccatgcagcccagggg

SEQ ID NO: 828639 - DNA, 20 bp, mouse
gaggagatgagtctcggcaa

SEQ ID NO: 828640 - DNA, 20 bp, mouse
ggagacttcacgctcagacc

SEQ ID NO: 828641 - DNA, 20 bp, mouse
gggccttaggagatgagtct

SEQ ID NO: 828642 - DNA, 20 bp, mouse
ggactgtgagatgttttagg

SEQ ID NO: 828643 - DNA, 20 bp, mouse
gtgtgcttgtgaaaggggtc

SEQ ID NO: 828644 - DNA, 20 bp, mouse
gagtgactgtgagatgtttt

SEQ ID NO: 828645 - DNA, 20 bp, mouse
gtggctaacacagaagtcat

SEQ ID NO: 828646 - DNA, 20 bp, mouse
gtctctggcaaaaggggtgg

SEQ ID NO: 828647 - DNA, 20 bp, mouse
gaggcggaggctttttgcgg

SEQ ID NO: 828648 - DNA, 20 bp, mouse
ggggtggaggcactgcatgc

SEQ ID NO: 828649 - DNA, 20 bp, mouse
ggtcagggtcagtcatggcg

SEQ ID NO: 828650 - DNA, 20 bp, mouse
gtgcctcccattccggctga

SEQ ID NO: 828651 - DNA, 20 bp, mouse
gcggaatgggaggcaggcgg

SEQ ID NO: 828652 - DNA, 20 bp, mouse
gggccaagcccatgcttaga

SEQ ID NO: 828653 - DNA, 20 bp, mouse
gtccacccctcagccggaat

SEQ ID NO: 828654 - DNA, 20 bp, mouse
gggacagtctctggcaaaag

SEQ ID NO: 828655 - DNA, 20 bp, mouse
gtgacacctgacagagtacg

SEQ ID NO: 828656 - DNA, 20 bp, mouse
ggacggggacgcacacgcga

SEQ ID NO: 828657 - DNA, 20 bp, mouse
gcccgctcgcccacaggctc

SEQ ID NO: 828658 - DNA, 20 bp, mouse
gctgcagcccgtggcggacg

SEQ ID NO: 828659 - DNA, 20 bp, mouse
gtatcccggttcagagaatc

SEQ ID NO: 828660 - DNA, 20 bp, mouse
ggcgagaaccgcgtccgcca

SEQ ID NO: 828661 - DNA, 20 bp, mouse
gcggttcagagaatctggct

SEQ ID NO: 828662 - DNA, 20 bp, mouse
ggtggcgggtctctaggtca

SEQ ID NO: 828663 - DNA, 20 bp, mouse
gcccgccccctctggccgga

SEQ ID NO: 828664 - DNA, 20 bp, mouse
gcagctgggacgggacccgg

SEQ ID NO: 828665 - DNA, 20 bp, mouse
gctgcagcactgagtcccgc

SEQ ID NO: 828666 - DNA, 20 bp, mouse
gcctagcggcggccgtggtg

SEQ ID NO: 828667 - DNA, 20 bp, mouse
gggtgcttcggctttggaga

SEQ ID NO: 828668 - DNA, 20 bp, mouse
ggagagtcgggccctagcgg

SEQ ID NO: 828669 - DNA, 20 bp, mouse
gactctcgcgagagctccct

SEQ ID NO: 828670 - DNA, 20 bp, mouse
ggcggcgggcagcaacgcgc

SEQ ID NO: 828671 - DNA, 20 bp, mouse
gcgcgagagtcgggccctag

SEQ ID NO: 828672 - DNA, 20 bp, mouse
gttgctgcccgccgcacagc

SEQ ID NO: 828673 - DNA, 20 bp, mouse
ggggaattgggaggaagttc

SEQ ID NO: 828674 - DNA, 20 bp, mouse
gcggccgtggtgcggtgctt

SEQ ID NO: 828675 - DNA, 20 bp, mouse
gcccgggaatcgcgttcgtg

SEQ ID NO: 828676 - DNA, 20 bp, mouse
gcgcctcaagaggtagtgga

SEQ ID NO: 828677 - DNA, 20 bp, mouse
gggcgcggctgcagcgactt

SEQ ID NO: 828678 - DNA, 20 bp, mouse
gtgcgtgtataccgccgcgt

SEQ ID NO: 828679 - DNA, 20 bp, mouse
gggctgcagcgacttagggg

SEQ ID NO: 828680 - DNA, 20 bp, mouse
gagtgggcgtggtcacttgg

SEQ ID NO: 828681 - DNA, 20 bp, mouse
gtgtgtatccggtcggggcg

SEQ ID NO: 828682 - DNA, 20 bp, mouse
gtctggcagtgactgttgtg

SEQ ID NO: 828683 - DNA, 20 bp, mouse
gatagtctctatcaaaccga

SEQ ID NO: 828684 - DNA, 20 bp, mouse
gtgcagcgacttaggggagg

SEQ ID NO: 828685 - DNA, 20 bp, mouse
gaaactcaacgggaaggcgg

SEQ ID NO: 828686 - DNA, 20 bp, mouse
gcagacgctcaagttcgcgc

SEQ ID NO: 828687 - DNA, 20 bp, mouse
gctcggctgcggcgctgcac

SEQ ID NO: 828688 - DNA, 20 bp, mouse
gaggaagagaccattcctgg

SEQ ID NO: 828689 - DNA, 20 bp, mouse
gcaagttcgcgcaggctgga

SEQ ID NO: 828690 - DNA, 20 bp, mouse
ggatctcgagtgctcggctg

SEQ ID NO: 828691 - DNA, 20 bp, mouse
gtgcagcgatctcgagtgct

SEQ ID NO: 828692 - DNA, 20 bp, mouse
gtaagaatcgacattattcg

SEQ ID NO: 828693 - DNA, 20 bp, mouse
ggctgcggcgctgcacaggc

SEQ ID NO: 828694 - DNA, 20 bp, mouse
gtcgctgcaacttttccgag

SEQ ID NO: 828695 - DNA, 20 bp, mouse
ggagcgtctgacagcagcgc

SEQ ID NO: 828696 - DNA, 20 bp, mouse
ggggctccggcggggagacg

SEQ ID NO: 828697 - DNA, 20 bp, mouse
gtgtaactggcgatctgagg

SEQ ID NO: 828698 - DNA, 20 bp, mouse
ggcaagttcagcaaagaaat

SEQ ID NO: 828699 - DNA, 20 bp, mouse
gcctcccgggagaagagagt

SEQ ID NO: 828700 - DNA, 20 bp, mouse
ggagcgccgcgtctccccgc

SEQ ID NO: 828701 - DNA, 20 bp, mouse
gcccgtcttgagaaagagag

SEQ ID NO: 828702 - DNA, 20 bp, mouse
gggggagggggaacacggcg

SEQ ID NO: 828703 - DNA, 20 bp, mouse
gtttcccaggcagcccgggc

SEQ ID NO: 828704 - DNA, 20 bp, mouse
gagggggaaaatgaggtgct

SEQ ID NO: 828705 - DNA, 20 bp, mouse
gtgcctccgatggatgaacc

SEQ ID NO: 828706 - DNA, 20 bp, mouse
gtgggaggggctaacgtccc

SEQ ID NO: 828707 - DNA, 20 bp, mouse
gtgtcccggtctctccaggg

SEQ ID NO: 828708 - DNA, 20 bp, mouse
gggcctgtcccggtctctcc

SEQ ID NO: 828709 - DNA, 20 bp, mouse
gcggcgggtcggaacatcaa

SEQ ID NO: 828710 - DNA, 20 bp, mouse
ggcggcgagcccagggtgcg

SEQ ID NO: 828711 - DNA, 20 bp, mouse
gtcctcgtgggtcccatctc

SEQ ID NO: 828712 - DNA, 20 bp, mouse
gaggggccatgaggagcgga

SEQ ID NO: 828713 - DNA, 20 bp, mouse
gccactgggaataatcttaa

SEQ ID NO: 828714 - DNA, 20 bp, mouse
gccccgcccgagtccagctg

SEQ ID NO: 828715 - DNA, 20 bp, mouse
gagaccgggacaggcccact

SEQ ID NO: 828716 - DNA, 20 bp, mouse
ggggatctggataagttcga

SEQ ID NO: 828717 - DNA, 20 bp, mouse
gccggaaggtgcaagcgagc

SEQ ID NO: 828718 - DNA, 20 bp, mouse
gtggataagttcgaggggta

SEQ ID NO: 828719 - DNA, 20 bp, mouse
ggggccagactcttagaggg

SEQ ID NO: 828720 - DNA, 20 bp, mouse
ggagttcactggaggggatc

SEQ ID NO: 828721 - DNA, 20 bp, mouse
ggcacgaggagggtagttgt

SEQ ID NO: 828722 - DNA, 20 bp, mouse
gtagggtggtcgcacgagga

SEQ ID NO: 828723 - DNA, 20 bp, mouse
gtgcgagaaaggacttccca

SEQ ID NO: 828724 - DNA, 20 bp, mouse
gaaaatctggctgagtagaa

SEQ ID NO: 828725 - DNA, 20 bp, mouse
ggaacccgcgcggagttctg

SEQ ID NO: 828726 - DNA, 20 bp, mouse
gcggaggaacggagtagtct

SEQ ID NO: 828727 - DNA, 20 bp, mouse
ggggagcggagattattgac

SEQ ID NO: 828728 - DNA, 20 bp, mouse
ggggaagccgaagacaccga

SEQ ID NO: 828729 - DNA, 20 bp, mouse
gacggtgcgggcctcgctcc

SEQ ID NO: 828730 - DNA, 20 bp, mouse
gagcgaggcccgcaccgtcc

SEQ ID NO: 828731 - DNA, 20 bp, mouse
gtccctctcccggcgcccaa

SEQ ID NO: 828732 - DNA, 20 bp, mouse
gtgcgggcctcgctcctgga

SEQ ID NO: 828733 - DNA, 20 bp, mouse
gcggccaacaatgatccttt

SEQ ID NO: 828734 - DNA, 20 bp, mouse
gccgggcgcccggacggtgc

SEQ ID NO: 828735 - DNA, 20 bp, mouse
gtgcgagccgggcgcccgga

SEQ ID NO: 828736 - DNA, 20 bp, mouse
ggaggggcgtggcccaaaag

SEQ ID NO: 828737 - DNA, 20 bp, mouse
ggggtcggcgggtaacggag

SEQ ID NO: 828738 - DNA, 20 bp, mouse
ggtggccggcgcgtcgtctg

SEQ ID NO: 828739 - DNA, 20 bp, mouse
ggcgtggcccaaaaggggtg

SEQ ID NO: 828740 - DNA, 20 bp, mouse
ggcggggcgtggcctgtcca

SEQ ID NO: 828741 - DNA, 20 bp, mouse
gcgggcgcgccgttggggga

SEQ ID NO: 828742 - DNA, 20 bp, mouse
ggaactcaaggccactgggg

SEQ ID NO: 828743 - DNA, 20 bp, mouse
gcaccgcgggcgcgccgttg

SEQ ID NO: 828744 - DNA, 20 bp, mouse
gtaaactgggcgtggccacg

SEQ ID NO: 828745 - DNA, 20 bp, mouse
gagtgggcgtgtctttatga

SEQ ID NO: 828746 - DNA, 20 bp, mouse
ggaatactatattcaggaag

SEQ ID NO: 828747 - DNA, 20 bp, mouse
gtagtatgaaggtgatttct

SEQ ID NO: 828748 - DNA, 20 bp, mouse
gatgctgaaatgaaaacagg

SEQ ID NO: 828749 - DNA, 20 bp, mouse
gtgactgtaatatagtatga

SEQ ID NO: 828750 - DNA, 20 bp, mouse
gcacttaaagttgagcacaa

SEQ ID NO: 828751 - DNA, 20 bp, mouse
gattgcaacaaacagaacgg

SEQ ID NO: 828752 - DNA, 20 bp, mouse
gtatggatagtctacactga

SEQ ID NO: 828753 - DNA, 20 bp, mouse
gtgaaatgaaaacaggggga

SEQ ID NO: 828754 - DNA, 20 bp, mouse
gaatctctgcttctgacttt

SEQ ID NO: 828755 - DNA, 20 bp, mouse
ggcagagaatggagtgatga

SEQ ID NO: 828756 - DNA, 20 bp, mouse
gtaaaggaggaatcatccca

SEQ ID NO: 828757 - DNA, 20 bp, mouse
gtctgccttcagctctccct

SEQ ID NO: 828758 - DNA, 20 bp, mouse
gtcatcccagggagagctga

SEQ ID NO: 828759 - DNA, 20 bp, mouse
ggggacaaggttgaagatac

SEQ ID NO: 828760 - DNA, 20 bp, mouse
gttagaaggagacaccctct

SEQ ID NO: 828761 - DNA, 20 bp, mouse
gacaaatcataaggctggca

SEQ ID NO: 828762 - DNA, 20 bp, mouse
gtcaaggttaggtcaatcag

SEQ ID NO: 828763 - DNA, 20 bp, mouse
gaaagtatttccagggcttc

SEQ ID NO: 828764 - DNA, 20 bp, mouse
gggttgacaaatcataaggc

SEQ ID NO: 828765 - DNA, 20 bp, mouse
gttccatgtactgatagctt

SEQ ID NO: 828766 - DNA, 20 bp, mouse
ggtgacccagtcaggatgat

SEQ ID NO: 828767 - DNA, 20 bp, mouse
gtggggttaccggaggaagg

SEQ ID NO: 828768 - DNA, 20 bp, mouse
gggacaacggagcacggcga

SEQ ID NO: 828769 - DNA, 20 bp, mouse
gccgccgctctccaggaaaa

SEQ ID NO: 828770 - DNA, 20 bp, mouse
gacccagtcaggatgatggg

SEQ ID NO: 828771 - DNA, 20 bp, mouse
gtagtccttgatgtagggta

SEQ ID NO: 828772 - DNA, 20 bp, mouse
gtgtgtcccgtaggcaacgg

SEQ ID NO: 828773 - DNA, 20 bp, mouse
gccccacccatcatcctgac

SEQ ID NO: 828774 - DNA, 20 bp, mouse
ggggtgtgtcccgtaggcaa

SEQ ID NO: 828775 - DNA, 20 bp, mouse
gatccgcgggtgtgtcccgt

SEQ ID NO: 828776 - DNA, 20 bp, mouse
ggtacgtactaggaaggtga

SEQ ID NO: 828777 - DNA, 20 bp, mouse
gcccccactgagttcgggcg

SEQ ID NO: 828778 - DNA, 20 bp, mouse
gcccgcgcccgaactcagtg

SEQ ID NO: 828779 - DNA, 20 bp, mouse
gtgggggtgagggcggtgtc

SEQ ID NO: 828780 - DNA, 20 bp, mouse
gtcccgggattaaacgattc

SEQ ID NO: 828781 - DNA, 20 bp, mouse
ggaagcagattgtacgtact

SEQ ID NO: 828782 - DNA, 20 bp, mouse
gggagaggggcccatagcgt

SEQ ID NO: 828783 - DNA, 20 bp, mouse
gtaagggtgggcccacgcta

SEQ ID NO: 828784 - DNA, 20 bp, mouse
gacccagcatagtctgagct

SEQ ID NO: 828785 - DNA, 20 bp, mouse
gcccggaatcgtttaatccc

SEQ ID NO: 828786 - DNA, 20 bp, mouse
gtggaacaggggcaaggtct

SEQ ID NO: 828787 - DNA, 20 bp, mouse
ggggcggggcagagtagtgt

SEQ ID NO: 828788 - DNA, 20 bp, mouse
ggggcagagtagtgtgggtg

SEQ ID NO: 828789 - DNA, 20 bp, mouse
gactaggggtctcaccataa

SEQ ID NO: 828790 - DNA, 20 bp, mouse
ggtggggcgaaccacaagga

SEQ ID NO: 828791 - DNA, 20 bp, mouse
gaagaaccctaggtttgatg

SEQ ID NO: 828792 - DNA, 20 bp, mouse
gaggcagggcggaacggggc

SEQ ID NO: 828793 - DNA, 20 bp, mouse
gaacgtggacttctggaaca

SEQ ID NO: 828794 - DNA, 20 bp, mouse
ggtgacagagagaacccggg

SEQ ID NO: 828795 - DNA, 20 bp, mouse
gccacaggaaaggtcctgtc

SEQ ID NO: 828796 - DNA, 20 bp, mouse
gagaagctcaactcaccagg

SEQ ID NO: 828797 - DNA, 20 bp, mouse
gttcctgaaacctgaccctg

SEQ ID NO: 828798 - DNA, 20 bp, mouse
gatgactgagaactcaacac

SEQ ID NO: 828799 - DNA, 20 bp, mouse
gtgagggttaccacagtaca

SEQ ID NO: 828800 - DNA, 20 bp, mouse
gatccacagggtcaggtttc

SEQ ID NO: 828801 - DNA, 20 bp, mouse
gccctgtggatctagcatag

SEQ ID NO: 828802 - DNA, 20 bp, mouse
gaccactatgctagatccac

SEQ ID NO: 828803 - DNA, 20 bp, mouse
gagagaaagctctgcagcgg

SEQ ID NO: 828804 - DNA, 20 bp, mouse
gcacaggtagagcaagggtg

SEQ ID NO: 828805 - DNA, 20 bp, mouse
gatgctagatccacagggtc

SEQ ID NO: 828806 - DNA, 20 bp, mouse
gacaggcatctgaggttcgt

SEQ ID NO: 828807 - DNA, 20 bp, mouse
gcaggagaggaatttagctc

SEQ ID NO: 828808 - DNA, 20 bp, mouse
gcaggaacaaaattacagat

SEQ ID NO: 828809 - DNA, 20 bp, mouse
gcaaacatgaaattattttg

SEQ ID NO: 828810 - DNA, 20 bp, mouse
ggttcgtgggctttttttcc

SEQ ID NO: 828811 - DNA, 20 bp, mouse
gttacattataattcatagc

SEQ ID NO: 828812 - DNA, 20 bp, mouse
gtgggctttttttccaggag

SEQ ID NO: 828813 - DNA, 20 bp, mouse
gtgagactctcaggcaaccg

SEQ ID NO: 828814 - DNA, 20 bp, mouse
gaggcaaggttgagactctc

SEQ ID NO: 828815 - DNA, 20 bp, mouse
ggccctgagagtctcaggct

SEQ ID NO: 828816 - DNA, 20 bp, mouse
gggcaagaatgagactctca

SEQ ID NO: 828817 - DNA, 20 bp, mouse
ggggcaccgaggtctgcagt

SEQ ID NO: 828818 - DNA, 20 bp, mouse
ggggcaagtctgagattctc

SEQ ID NO: 828819 - DNA, 20 bp, mouse
gagagtctcattcttgcctt

SEQ ID NO: 828820 - DNA, 20 bp, mouse
gtgagactctcagggcaccg

SEQ ID NO: 828821 - DNA, 20 bp, mouse
gagggcaccgagctttgcag

SEQ ID NO: 828822 - DNA, 20 bp, mouse
ggcttgccctctgcaaagct

SEQ ID NO: 828823 - DNA, 20 bp, mouse
gggcaagcctgaaactctca

SEQ ID NO: 828824 - DNA, 20 bp, mouse
gacttgcccactgcagacct

SEQ ID NO: 828825 - DNA, 20 bp, mouse
gaaagagaaagttcttccga

SEQ ID NO: 828826 - DNA, 20 bp, mouse
gacaggcatctgagggttgt

SEQ ID NO: 828827 - DNA, 20 bp, mouse
gtgctcaaccttcctaacac

SEQ ID NO: 828828 - DNA, 20 bp, mouse
gcttgatcacaggcatctga

SEQ ID NO: 828829 - DNA, 20 bp, mouse
gggccgagcctgagagtctc

SEQ ID NO: 828830 - DNA, 20 bp, mouse
gcaggtgccctgagactctc

SEQ ID NO: 828831 - DNA, 20 bp, mouse
gtgagactctcaggcaaccg

SEQ ID NO: 828832 - DNA, 20 bp, mouse
gaggcaaggttgagactctc

SEQ ID NO: 828833 - DNA, 20 bp, mouse
ggccctgagactctcaggct

SEQ ID NO: 828834 - DNA, 20 bp, mouse
ggaaagttcttccgcaggca

SEQ ID NO: 828835 - DNA, 20 bp, mouse
gtggaggtcactacagcagg

SEQ ID NO: 828836 - DNA, 20 bp, mouse
ggggacgggcaagggacata

SEQ ID NO: 828837 - DNA, 20 bp, mouse
gacaggcatcggagggtcat

SEQ ID NO: 828838 - DNA, 20 bp, mouse
ggctcaaccttctcaacatt

SEQ ID NO: 828839 - DNA, 20 bp, mouse
gcttgatcacaggcatcgga

SEQ ID NO: 828840 - DNA, 20 bp, mouse
gaagggtcccaatgttgaga

SEQ ID NO: 828841 - DNA, 20 bp, mouse
gaggctgatggggacgggca

SEQ ID NO: 828842 - DNA, 20 bp, mouse
gtatggaggctgatggggac

SEQ ID NO: 828843 - DNA, 20 bp, mouse
gtgtgatcaagatattatgg

SEQ ID NO: 828844 - DNA, 20 bp, mouse
gccaaacataaaattatttc

SEQ ID NO: 828845 - DNA, 20 bp, mouse
gagatattatggaggctgat

SEQ ID NO: 828846 - DNA, 20 bp, mouse
ggccagagcagcaacggtgc

SEQ ID NO: 828847 - DNA, 20 bp, mouse
ggctctggctgcagacattc

SEQ ID NO: 828848 - DNA, 20 bp, mouse
ggcggggcagctgctggacc

SEQ ID NO: 828849 - DNA, 20 bp, mouse
gggtcagagctgggaaactg

SEQ ID NO: 828850 - DNA, 20 bp, mouse
gcacagcctgggtttccttg

SEQ ID NO: 828851 - DNA, 20 bp, mouse
gtgactctcggggtcagagc

SEQ ID NO: 828852 - DNA, 20 bp, mouse
gcctaccgggtgcacttcac

SEQ ID NO: 828853 - DNA, 20 bp, mouse
ggggctacttgccctgaact

SEQ ID NO: 828854 - DNA, 20 bp, mouse
gtctgcagccagagcagcaa

SEQ ID NO: 828855 - DNA, 20 bp, mouse
gtagcaagttgcaaaacctt

SEQ ID NO: 828856 - DNA, 20 bp, mouse
gtgggcaatcccatccaaga

SEQ ID NO: 828857 - DNA, 20 bp, mouse
gcagagggcgggtctagatc

SEQ ID NO: 828858 - DNA, 20 bp, mouse
gagctctgccattggctcga

SEQ ID NO: 828859 - DNA, 20 bp, mouse
gcgagggaagcggctagcgg

SEQ ID NO: 828860 - DNA, 20 bp, mouse
gggacacgccttcgagccaa

SEQ ID NO: 828861 - DNA, 20 bp, mouse
gaagcggctagcgggggcga

SEQ ID NO: 828862 - DNA, 20 bp, mouse
ggccgcgcggcccggtgacg

SEQ ID NO: 828863 - DNA, 20 bp, mouse
ggcgcgagggaagcggctag

SEQ ID NO: 828864 - DNA, 20 bp, mouse
gtgaggaacatgaggttcta

SEQ ID NO: 828865 - DNA, 20 bp, mouse
gacttccggctccgcgtcac

SEQ ID NO: 828866 - DNA, 20 bp, mouse
gtgaaaacgccggaagtagg

SEQ ID NO: 828867 - DNA, 20 bp, mouse
gggtagggattgacagacga

SEQ ID NO: 828868 - DNA, 20 bp, mouse
gaccgcagacgttgaggcgg

SEQ ID NO: 828869 - DNA, 20 bp, mouse
ggcaaggtctgccgggaaag

SEQ ID NO: 828870 - DNA, 20 bp, mouse
gaaagtggaaaacggaagtc

SEQ ID NO: 828871 - DNA, 20 bp, mouse
gtagaagaaaggcgcgaaag

SEQ ID NO: 828872 - DNA, 20 bp, mouse
gtcccgcagccccctacttc

SEQ ID NO: 828873 - DNA, 20 bp, mouse
gtagggggctgcgggacgct

SEQ ID NO: 828874 - DNA, 20 bp, mouse
ggacagacgagggctgggcg

SEQ ID NO: 828875 - DNA, 20 bp, mouse
ggagtggccgagtgagcgat

SEQ ID NO: 828876 - DNA, 20 bp, mouse
gtatttaaaggcaaacaggg

SEQ ID NO: 828877 - DNA, 20 bp, mouse
gaaatatttaaaggcaaaca

SEQ ID NO: 828878 - DNA, 20 bp, mouse
gggcttaaacaggagatacg

SEQ ID NO: 828879 - DNA, 20 bp, mouse
ggggtaagaagtgatggctg

SEQ ID NO: 828880 - DNA, 20 bp, mouse
gtctctccagtcctctatat

SEQ ID NO: 828881 - DNA, 20 bp, mouse
ggtcaattgagcagagagtc

SEQ ID NO: 828882 - DNA, 20 bp, mouse
gctcatgtcaacccatatag

SEQ ID NO: 828883 - DNA, 20 bp, mouse
gaatgcgtgctgagaaaatt

SEQ ID NO: 828884 - DNA, 20 bp, mouse
gacagagagtcggtttagaa

SEQ ID NO: 828885 - DNA, 20 bp, mouse
ggccctttaagacagagagt

SEQ ID NO: 828886 - DNA, 20 bp, mouse
ggggatcctggggacataga

SEQ ID NO: 828887 - DNA, 20 bp, mouse
gtacctacctggggatcctg

SEQ ID NO: 828888 - DNA, 20 bp, mouse
ggtccccaggatccccaggt

SEQ ID NO: 828889 - DNA, 20 bp, mouse
gagtgtgtcattacctacct

SEQ ID NO: 828890 - DNA, 20 bp, mouse
gtatttaaaggcaaacaggg

SEQ ID NO: 828891 - DNA, 20 bp, mouse
gaaatatttaaaggcaaaca

SEQ ID NO: 828892 - DNA, 20 bp, mouse
gaccagatggacaatttagt

SEQ ID NO: 828893 - DNA, 20 bp, mouse
ggtttttgtgatcatggaca

SEQ ID NO: 828894 - DNA, 20 bp, mouse
gtctctccagtcctctatat

SEQ ID NO: 828895 - DNA, 20 bp, mouse
ggtcaattgagcagagagtc

SEQ ID NO: 828896 - DNA, 20 bp, mouse
gtacctacctggggatcctg

SEQ ID NO: 828897 - DNA, 20 bp, mouse
gagcgtgtcattacctacct

SEQ ID NO: 828898 - DNA, 20 bp, mouse
gtatttaaaggcaaacaggg

SEQ ID NO: 828899 - DNA, 20 bp, mouse
gaaatatttaaaggcaaaca

SEQ ID NO: 828900 - DNA, 20 bp, mouse
gggcttaaacaggagattcg

SEQ ID NO: 828901 - DNA, 20 bp, mouse
gaggagaatataatctctat

SEQ ID NO: 828902 - DNA, 20 bp, mouse
ggggcaagaagtgatggccg

SEQ ID NO: 828903 - DNA, 20 bp, mouse
gtctctccagtcctctatat

SEQ ID NO: 828904 - DNA, 20 bp, mouse
ggtcaattgagcagagagtc

SEQ ID NO: 828905 - DNA, 20 bp, mouse
gctcatgtcaacccatatag

SEQ ID NO: 828906 - DNA, 20 bp, mouse
ggtcgcgatgctggtgggga

SEQ ID NO: 828907 - DNA, 20 bp, mouse
ggtgtgacagcatcgacgtg

SEQ ID NO: 828908 - DNA, 20 bp, mouse
gcccaccctgcgaactgagc

SEQ ID NO: 828909 - DNA, 20 bp, mouse
gggtggcggcagatggtcgg

SEQ ID NO: 828910 - DNA, 20 bp, mouse
gggcatggaagggacctcat

SEQ ID NO: 828911 - DNA, 20 bp, mouse
gtcggtctcacccaaggtgg

SEQ ID NO: 828912 - DNA, 20 bp, mouse
gcactcctgctcagttcgca

SEQ ID NO: 828913 - DNA, 20 bp, mouse
gaggcaggggcggcgtggct

SEQ ID NO: 828914 - DNA, 20 bp, mouse
gggcgggtcgcgatgctggt

SEQ ID NO: 828915 - DNA, 20 bp, mouse
gcggtggcgggtcgcgatgc

SEQ ID NO: 828916 - DNA, 20 bp, mouse
gctgatgcgggcccggggag

SEQ ID NO: 828917 - DNA, 20 bp, mouse
ggaggcgccatgttgaggtt

SEQ ID NO: 828918 - DNA, 20 bp, mouse
ggcagggaaagtagcttcta

SEQ ID NO: 828919 - DNA, 20 bp, mouse
ggaaggcaagggagtgagat

SEQ ID NO: 828920 - DNA, 20 bp, mouse
gtgtgtggaaaggctgatgc

SEQ ID NO: 828921 - DNA, 20 bp, mouse
gtgcgcctgcccagcgtggg

SEQ ID NO: 828922 - DNA, 20 bp, mouse
gtaaaagtgtggtaaagcgc

SEQ ID NO: 828923 - DNA, 20 bp, mouse
gtcgctccggccgcacaggg

SEQ ID NO: 828924 - DNA, 20 bp, mouse
gggctctcccgctgtcacca

SEQ ID NO: 828925 - DNA, 20 bp, mouse
ggggggcggccgagggagtg

SEQ ID NO: 828926 - DNA, 20 bp, mouse
gaccgcggcgccagaatcca

SEQ ID NO: 828927 - DNA, 20 bp, mouse
gcattcgggaaggaactgga

SEQ ID NO: 828928 - DNA, 20 bp, mouse
gagaatccagggcagggttc

SEQ ID NO: 828929 - DNA, 20 bp, mouse
gctatcgtgaaggctgaaga

SEQ ID NO: 828930 - DNA, 20 bp, mouse
gtgggcgcgaccattcggga

SEQ ID NO: 828931 - DNA, 20 bp, mouse
ggcggggcctggctgtgtaa

SEQ ID NO: 828932 - DNA, 20 bp, mouse
gcctacggccgggagcgcct

SEQ ID NO: 828933 - DNA, 20 bp, mouse
gggccctttaaataccgcgt

SEQ ID NO: 828934 - DNA, 20 bp, mouse
gcggcgccagaatccagggc

SEQ ID NO: 828935 - DNA, 20 bp, mouse
gagaggagtgaacacggaat

SEQ ID NO: 828936 - DNA, 20 bp, mouse
ggccagagaccaaagtaaaa

SEQ ID NO: 828937 - DNA, 20 bp, mouse
gacatagttccattttactt

SEQ ID NO: 828938 - DNA, 20 bp, mouse
gaccacagcagaaacatgga

SEQ ID NO: 828939 - DNA, 20 bp, mouse
gtacactatgagagaaccaa

SEQ ID NO: 828940 - DNA, 20 bp, mouse
gatgttgtaaataaagcaat

SEQ ID NO: 828941 - DNA, 20 bp, mouse
gtccattttactttggtctc

SEQ ID NO: 828942 - DNA, 20 bp, mouse
gtccttccatgtttctgctg

SEQ ID NO: 828943 - DNA, 20 bp, mouse
gcagaaccacagcagaaaca

SEQ ID NO: 828944 - DNA, 20 bp, mouse
gtgcctactaagtaagacaa

SEQ ID NO: 828945 - DNA, 20 bp, mouse
gttcctttgtcttacttagt

SEQ ID NO: 828946 - DNA, 20 bp, mouse
gtagcaagtctattacttcg

SEQ ID NO: 828947 - DNA, 20 bp, mouse
gtagctgtgagagagcaagc

SEQ ID NO: 828948 - DNA, 20 bp, mouse
gaaagacaaggcctccaatt

SEQ ID NO: 828949 - DNA, 20 bp, mouse
gaagcaaaatccaaaatggg

SEQ ID NO: 828950 - DNA, 20 bp, mouse
gcagtgtcttatgctaagtg

SEQ ID NO: 828951 - DNA, 20 bp, mouse
gtcttcctacctcacaggta

SEQ ID NO: 828952 - DNA, 20 bp, mouse
gtcgtgcttcagatcctaat

SEQ ID NO: 828953 - DNA, 20 bp, mouse
gtgattgttgtgataagcta

SEQ ID NO: 828954 - DNA, 20 bp, mouse
ggcaagtcttcctacctcac

SEQ ID NO: 828955 - DNA, 20 bp, mouse
gtaatccatacctgtgaggt

SEQ ID NO: 828956 - DNA, 20 bp, mouse
ggcaatgcaaataagattct

SEQ ID NO: 828957 - DNA, 20 bp, mouse
gaataagattctaggtttgt

SEQ ID NO: 828958 - DNA, 20 bp, mouse
gcactctctctctcctggaa

SEQ ID NO: 828959 - DNA, 20 bp, mouse
gatcttatttgcattgccta

SEQ ID NO: 828960 - DNA, 20 bp, mouse
gtcagacctagtttcagatc

SEQ ID NO: 828961 - DNA, 20 bp, mouse
gagctgactaaacaggcaat

SEQ ID NO: 828962 - DNA, 20 bp, mouse
gcttgattcttctctgaatc

SEQ ID NO: 828963 - DNA, 20 bp, mouse
gttctaataaatccctttcc

SEQ ID NO: 828964 - DNA, 20 bp, mouse
gtctgcctctgcttctgtgt

SEQ ID NO: 828965 - DNA, 20 bp, mouse
ggattcttctctgaatcagg

SEQ ID NO: 828966 - DNA, 20 bp, mouse
gccccaccctgcttgcttaa

SEQ ID NO: 828967 - DNA, 20 bp, mouse
gcagacgcgtggagcatgac

SEQ ID NO: 828968 - DNA, 20 bp, mouse
gagtgcgcacgcgtaataca

SEQ ID NO: 828969 - DNA, 20 bp, mouse
gggggagcgcgagcgaacga

SEQ ID NO: 828970 - DNA, 20 bp, mouse
ggagcatgacgggaacaccg

SEQ ID NO: 828971 - DNA, 20 bp, mouse
ggttaagcgtctagctctca

SEQ ID NO: 828972 - DNA, 20 bp, mouse
gcaaggacgggcagctccgt

SEQ ID NO: 828973 - DNA, 20 bp, mouse
ggggcggggagcgacgtgcg

SEQ ID NO: 828974 - DNA, 20 bp, mouse
gaaggatgagtgattcggtg

SEQ ID NO: 828975 - DNA, 20 bp, mouse
ggcgaagtgttggcagtttg

SEQ ID NO: 828976 - DNA, 20 bp, mouse
gagccagaaagcacgagcgg

SEQ ID NO: 828977 - DNA, 20 bp, mouse
ggaccacaggggaattccag

SEQ ID NO: 828978 - DNA, 20 bp, mouse
gcgccaacgcccagggcgga

SEQ ID NO: 828979 - DNA, 20 bp, mouse
gaggagggcgccaacgccca

SEQ ID NO: 828980 - DNA, 20 bp, mouse
ggcactaggggcaaccgagg

SEQ ID NO: 828981 - DNA, 20 bp, mouse
gcttctgataaggagttggg

SEQ ID NO: 828982 - DNA, 20 bp, mouse
gagccctccgccctgggcgt

SEQ ID NO: 828983 - DNA, 20 bp, mouse
gaggggctccccagcagagt

SEQ ID NO: 828984 - DNA, 20 bp, mouse
gtaggggcaaccgaggagga

SEQ ID NO: 828985 - DNA, 20 bp, mouse
ggcgttggcgccctcctcct

SEQ ID NO: 828986 - DNA, 20 bp, mouse
gctagcccggcggggtccgg

SEQ ID NO: 828987 - DNA, 20 bp, mouse
gaagcgttctggacgatctt

SEQ ID NO: 828988 - DNA, 20 bp, mouse
gtaccgccagcgcacggggc

SEQ ID NO: 828989 - DNA, 20 bp, mouse
gttggtaccggggagactgt

SEQ ID NO: 828990 - DNA, 20 bp, mouse
gcggtcacgtggcctcggag

SEQ ID NO: 828991 - DNA, 20 bp, mouse
gtgcgctggcggtacgcagc

SEQ ID NO: 828992 - DNA, 20 bp, mouse
ggtaccggggagactgtcgg

SEQ ID NO: 828993 - DNA, 20 bp, mouse
gaagtcctgggtatagtgtg

SEQ ID NO: 828994 - DNA, 20 bp, mouse
gggggctgcgggaagcgttc

SEQ ID NO: 828995 - DNA, 20 bp, mouse
gcgcgtgcgttctagcccgg

SEQ ID NO: 828996 - DNA, 20 bp, mouse
gagagcgccgcgacccgagc

SEQ ID NO: 828997 - DNA, 20 bp, mouse
ggccggaagcgatggaggta

SEQ ID NO: 828998 - DNA, 20 bp, mouse
ggaacagcaactcagaataa

SEQ ID NO: 828999 - DNA, 20 bp, mouse
gcccgagccggaagcgatgg

SEQ ID NO: 829000 - DNA, 20 bp, mouse
gcgacccgagccggaagcga

SEQ ID NO: 829001 - DNA, 20 bp, mouse
ggcaactcagaataagggat

SEQ ID NO: 829002 - DNA, 20 bp, mouse
ggccctacctccatcgcttc

SEQ ID NO: 829003 - DNA, 20 bp, mouse
ggctgcgggcctgccaggac

SEQ ID NO: 829004 - DNA, 20 bp, mouse
gctcacgcgcccctccttcc

SEQ ID NO: 829005 - DNA, 20 bp, mouse
ggaggcacgtgagtcatcag

SEQ ID NO: 829006 - DNA, 20 bp, mouse
ggactgtgacgtcattaacg

SEQ ID NO: 829007 - DNA, 20 bp, mouse
gtctcccttcctttcgtttt

SEQ ID NO: 829008 - DNA, 20 bp, mouse
gacgtcattaacgaggggtg

SEQ ID NO: 829009 - DNA, 20 bp, mouse
gtattccaaaaacgaaagga

SEQ ID NO: 829010 - DNA, 20 bp, mouse
gcatctattccaaaaacgaa

SEQ ID NO: 829011 - DNA, 20 bp, mouse
ggtgatgctggatgtgtttg

SEQ ID NO: 829012 - DNA, 20 bp, mouse
gtctgcactggaaatatggc

SEQ ID NO: 829013 - DNA, 20 bp, mouse
gactggaaatatggcagggc

SEQ ID NO: 829014 - DNA, 20 bp, mouse
ggaaggacagttttgtgcgc

SEQ ID NO: 829015 - DNA, 20 bp, mouse
gttgaataaacacttttcct

SEQ ID NO: 829016 - DNA, 20 bp, mouse
gttctgagggtcagggttaa

SEQ ID NO: 829017 - DNA, 20 bp, mouse
gttcacagatggagggaatt

SEQ ID NO: 829018 - DNA, 20 bp, mouse
gcctccatctgtgaagatgg

SEQ ID NO: 829019 - DNA, 20 bp, mouse
gaaaaaagatagcctttact

SEQ ID NO: 829020 - DNA, 20 bp, mouse
ggagttagaccaggctatat

SEQ ID NO: 829021 - DNA, 20 bp, mouse
ggagagcattgcctttgaaa

SEQ ID NO: 829022 - DNA, 20 bp, mouse
ggggttaaaggcgtacaccg

SEQ ID NO: 829023 - DNA, 20 bp, mouse
gctgacaaaggcagccagaa

SEQ ID NO: 829024 - DNA, 20 bp, mouse
gaaaacaagtaagctggcca

SEQ ID NO: 829025 - DNA, 20 bp, mouse
gaataagaaagagttagacc

SEQ ID NO: 829026 - DNA, 20 bp, mouse
ggggtctcacacgtgacgtg

SEQ ID NO: 829027 - DNA, 20 bp, mouse
gtggaggccgtgagcccgct

SEQ ID NO: 829028 - DNA, 20 bp, mouse
ggctccgaagatcccggcac

SEQ ID NO: 829029 - DNA, 20 bp, mouse
gttatcggtgccaagttcta

SEQ ID NO: 829030 - DNA, 20 bp, mouse
gagatggaggcaggaattag

SEQ ID NO: 829031 - DNA, 20 bp, mouse
gatcccggcacaggtcgcta

SEQ ID NO: 829032 - DNA, 20 bp, mouse
gtctgcctctcagtggcaag

SEQ ID NO: 829033 - DNA, 20 bp, mouse
gcagtgcgcaggcgcagcgg

SEQ ID NO: 829034 - DNA, 20 bp, mouse
gttccagcacccatagaact

SEQ ID NO: 829035 - DNA, 20 bp, mouse
ggcacaggtcgctagggcaa

SEQ ID NO: 829036 - DNA, 20 bp, mouse
gagggagagagggtccacgg

SEQ ID NO: 829037 - DNA, 20 bp, mouse
gtggagttctagggcatcac

SEQ ID NO: 829038 - DNA, 20 bp, mouse
gaggggaaggatttctggga

SEQ ID NO: 829039 - DNA, 20 bp, mouse
gaccagggagagagggtcca

SEQ ID NO: 829040 - DNA, 20 bp, mouse
gtggacctgtgaattagagg

SEQ ID NO: 829041 - DNA, 20 bp, mouse
gaggctagctaagggtgaag

SEQ ID NO: 829042 - DNA, 20 bp, mouse
gctagggcatcacaggctaa

SEQ ID NO: 829043 - DNA, 20 bp, mouse
gcatcacaggctaagggagc

SEQ ID NO: 829044 - DNA, 20 bp, mouse
gagggagccggtgccgagag

SEQ ID NO: 829045 - DNA, 20 bp, mouse
gagtgcacctctctcggcac

SEQ ID NO: 829046 - DNA, 20 bp, mouse
gggcggggcctgggcggaat

SEQ ID NO: 829047 - DNA, 20 bp, mouse
gtgggcggaatcggagagga

SEQ ID NO: 829048 - DNA, 20 bp, mouse
gggcctgggcggaatcggag

SEQ ID NO: 829049 - DNA, 20 bp, mouse
ggaatcggagaggaggggcg

SEQ ID NO: 829050 - DNA, 20 bp, mouse
gctggtctgcggaagaaggt

SEQ ID NO: 829051 - DNA, 20 bp, mouse
gtcagacccgcgaatggggc

SEQ ID NO: 829052 - DNA, 20 bp, mouse
ggcgaggccaaactggtctg

SEQ ID NO: 829053 - DNA, 20 bp, mouse
gcagctcccgccccattcgc

SEQ ID NO: 829054 - DNA, 20 bp, mouse
gctgggcgaggctataggcg

SEQ ID NO: 829055 - DNA, 20 bp, mouse
gtatgagacagctctttcta

SEQ ID NO: 829056 - DNA, 20 bp, mouse
gggtcctcccgctccatgat

SEQ ID NO: 829057 - DNA, 20 bp, mouse
gcagcattgcctggtgtgtt

SEQ ID NO: 829058 - DNA, 20 bp, mouse
ggcaaccaccaatcaatgat

SEQ ID NO: 829059 - DNA, 20 bp, mouse
gcaggcaatgctgatttggg

SEQ ID NO: 829060 - DNA, 20 bp, mouse
gaaaaaacaccacactgcgg

SEQ ID NO: 829061 - DNA, 20 bp, mouse
gaccgctggaggttactgat

SEQ ID NO: 829062 - DNA, 20 bp, mouse
gggaccaatcatggagcggg

SEQ ID NO: 829063 - DNA, 20 bp, mouse
gaacgtgtattcccggatca

SEQ ID NO: 829064 - DNA, 20 bp, mouse
gacaccaggcaatgctgatt

SEQ ID NO: 829065 - DNA, 20 bp, mouse
ggatcagggcccaacacacc

SEQ ID NO: 829066 - DNA, 20 bp, mouse
ggaaccacgcgccgctaagg

SEQ ID NO: 829067 - DNA, 20 bp, mouse
gcaaccgctgggagcctcgg

SEQ ID NO: 829068 - DNA, 20 bp, mouse
gtcgcccccgaggctcccag

SEQ ID NO: 829069 - DNA, 20 bp, mouse
gcgggaaccacgcgccgcta

SEQ ID NO: 829070 - DNA, 20 bp, mouse
gagcagcatgaaggacgctc

SEQ ID NO: 829071 - DNA, 20 bp, mouse
ggctagatggcagctggcag

SEQ ID NO: 829072 - DNA, 20 bp, mouse
gtacgcgactcttcttccca

SEQ ID NO: 829073 - DNA, 20 bp, mouse
ggccatctagcggcgggatc

SEQ ID NO: 829074 - DNA, 20 bp, mouse
ggggtctccagatacgtccc

SEQ ID NO: 829075 - DNA, 20 bp, mouse
gcccgccgctagatggcagc

SEQ ID NO: 829076 - DNA, 20 bp, mouse
gcggtcggggcgccccgaaa

SEQ ID NO: 829077 - DNA, 20 bp, mouse
ggggctctaagtttccttga

SEQ ID NO: 829078 - DNA, 20 bp, mouse
ggctctgtgagccccaagtc

SEQ ID NO: 829079 - DNA, 20 bp, mouse
gggcgaggatggggagcgcc

SEQ ID NO: 829080 - DNA, 20 bp, mouse
gcggctgacgtcagcttttg

SEQ ID NO: 829081 - DNA, 20 bp, mouse
gttaaaagctacctgacttg

SEQ ID NO: 829082 - DNA, 20 bp, mouse
gtgtaagcgtgggactgggt

SEQ ID NO: 829083 - DNA, 20 bp, mouse
gagcccctgttccacttgta

SEQ ID NO: 829084 - DNA, 20 bp, mouse
gccccacttgggtaagactc

SEQ ID NO: 829085 - DNA, 20 bp, mouse
ggagatccacgtttcccgaa

SEQ ID NO: 829086 - DNA, 20 bp, mouse
gctaggccaggaagctccga

SEQ ID NO: 829087 - DNA, 20 bp, mouse
ggggcgtggggccccgtaat

SEQ ID NO: 829088 - DNA, 20 bp, mouse
gagcttcctggcctagtaat

SEQ ID NO: 829089 - DNA, 20 bp, mouse
gtcgggagggatttgagtct

SEQ ID NO: 829090 - DNA, 20 bp, mouse
gggcaggcagaagatctctt

SEQ ID NO: 829091 - DNA, 20 bp, mouse
gcgagggaagtgaactagtt

SEQ ID NO: 829092 - DNA, 20 bp, mouse
gtaggaccctcaggtgggcg

SEQ ID NO: 829093 - DNA, 20 bp, mouse
gccacgcccattactaggcc

SEQ ID NO: 829094 - DNA, 20 bp, mouse
gcacttccctcggagcttcc

SEQ ID NO: 829095 - DNA, 20 bp, mouse
gccgtctccccgcccacctg

SEQ ID NO: 829096 - DNA, 20 bp, mouse
gcacaagcgtcctggggcgg

SEQ ID NO: 829097 - DNA, 20 bp, mouse
gaaccccagtcaattgtgga

SEQ ID NO: 829098 - DNA, 20 bp, mouse
gcggaggtgccaccagacac

SEQ ID NO: 829099 - DNA, 20 bp, mouse
gaccccttccacaattgact

SEQ ID NO: 829100 - DNA, 20 bp, mouse
gggcacctccgccaagaact

SEQ ID NO: 829101 - DNA, 20 bp, mouse
ggatggggcagcatcttgga

SEQ ID NO: 829102 - DNA, 20 bp, mouse
ggggcagcatcttggaagga

SEQ ID NO: 829103 - DNA, 20 bp, mouse
gcagctggaaagatctgcta

SEQ ID NO: 829104 - DNA, 20 bp, mouse
gcgaccaaagggctcccatc

SEQ ID NO: 829105 - DNA, 20 bp, mouse
gggtcgggtgtgcacactgg

SEQ ID NO: 829106 - DNA, 20 bp, mouse
gaactgagcctctgtaactt

SEQ ID NO: 829107 - DNA, 20 bp, mouse
gcgggctaagagtgtaagct

SEQ ID NO: 829108 - DNA, 20 bp, mouse
gctcaacttggcaagttaga

SEQ ID NO: 829109 - DNA, 20 bp, mouse
gtgggggtggatttttgttg

SEQ ID NO: 829110 - DNA, 20 bp, mouse
gcccggatctcatttcgtac

SEQ ID NO: 829111 - DNA, 20 bp, mouse
ggtgtaagctgggtgctgat

SEQ ID NO: 829112 - DNA, 20 bp, mouse
gagcctctgtaacttggggg

SEQ ID NO: 829113 - DNA, 20 bp, mouse
gcacagcttgtttgctagca

SEQ ID NO: 829114 - DNA, 20 bp, mouse
gatccacccccaagttacag

SEQ ID NO: 829115 - DNA, 20 bp, mouse
gagtcaggagactacactac

SEQ ID NO: 829116 - DNA, 20 bp, mouse
gagagagtgaggcgttcatt

SEQ ID NO: 829117 - DNA, 20 bp, mouse
ggaaggcgatgcctgacgtg

SEQ ID NO: 829118 - DNA, 20 bp, mouse
gttctggtcctcttggtctc

SEQ ID NO: 829119 - DNA, 20 bp, mouse
gcggctggctagctaggcgg

SEQ ID NO: 829120 - DNA, 20 bp, mouse
gaggcagcttcaggctctca

SEQ ID NO: 829121 - DNA, 20 bp, mouse
gccttccggaagccccccac

SEQ ID NO: 829122 - DNA, 20 bp, mouse
gctaagacagcggcgtgctc

SEQ ID NO: 829123 - DNA, 20 bp, mouse
ggcggcgtgctctgggagat

SEQ ID NO: 829124 - DNA, 20 bp, mouse
gcctaaaagcatccccagaa

SEQ ID NO: 829125 - DNA, 20 bp, mouse
gagccagccgcttccccttc

SEQ ID NO: 829126 - DNA, 20 bp, mouse
gctggggcgctaaagagtga

SEQ ID NO: 829127 - DNA, 20 bp, mouse
gggccagcgaggcgcagatg

SEQ ID NO: 829128 - DNA, 20 bp, mouse
gcctggtcctagatgatcac

SEQ ID NO: 829129 - DNA, 20 bp, mouse
gcaaacgcaggggaagtgcg

SEQ ID NO: 829130 - DNA, 20 bp, mouse
gcgcggacggggaccagaga

SEQ ID NO: 829131 - DNA, 20 bp, mouse
gcgaacgccggaacctgcgc

SEQ ID NO: 829132 - DNA, 20 bp, mouse
gccgctgtcgcgtcgtgctc

SEQ ID NO: 829133 - DNA, 20 bp, mouse
gcgcaaccttcaggcctcct

SEQ ID NO: 829134 - DNA, 20 bp, mouse
ggctctgcgagaatgaactc

SEQ ID NO: 829135 - DNA, 20 bp, mouse
gcgcgtccgcgtcaaccttc

SEQ ID NO: 829136 - DNA, 20 bp, mouse
gtgaggtagggtaacctggt

SEQ ID NO: 829137 - DNA, 20 bp, mouse
gatggtgaggtagggtaacc

SEQ ID NO: 829138 - DNA, 20 bp, mouse
gtccacaggacaccacaggg

SEQ ID NO: 829139 - DNA, 20 bp, mouse
ggccaccctgtggtgtcctg

SEQ ID NO: 829140 - DNA, 20 bp, mouse
gctaaaatgaggagtcagca

SEQ ID NO: 829141 - DNA, 20 bp, mouse
gtccatccacaggacaccac

SEQ ID NO: 829142 - DNA, 20 bp, mouse
ggaggacaatcataaagact

SEQ ID NO: 829143 - DNA, 20 bp, mouse
gtgggactgtctccatccac

SEQ ID NO: 829144 - DNA, 20 bp, mouse
gaaatgaggagtcagcaagg

SEQ ID NO: 829145 - DNA, 20 bp, mouse
ggagaaaatgtgctaaaatg

SEQ ID NO: 829146 - DNA, 20 bp, mouse
gatttatttacttctactta

SEQ ID NO: 829147 - DNA, 20 bp, mouse
gaacacgaaggaaagaagaa

SEQ ID NO: 829148 - DNA, 20 bp, mouse
gcagagccccaaaactatta

SEQ ID NO: 829149 - DNA, 20 bp, mouse
gaggcaccttaatagttttg

SEQ ID NO: 829150 - DNA, 20 bp, mouse
gtctgattagaataacacga

SEQ ID NO: 829151 - DNA, 20 bp, mouse
ggggaagagctcctatatgg

SEQ ID NO: 829152 - DNA, 20 bp, mouse
gagtctcaaagctggattaa

SEQ ID NO: 829153 - DNA, 20 bp, mouse
gtataggcttagagcaggtg

SEQ ID NO: 829154 - DNA, 20 bp, mouse
ggcaggtgtggcccagttga

SEQ ID NO: 829155 - DNA, 20 bp, mouse
gttaacctgagttttgaggc

SEQ ID NO: 829156 - DNA, 20 bp, mouse
gctaatcttggtacctgagg

SEQ ID NO: 829157 - DNA, 20 bp, mouse
ggcctcagcgtggacactcc

SEQ ID NO: 829158 - DNA, 20 bp, mouse
gatactaatcttggtacctg

SEQ ID NO: 829159 - DNA, 20 bp, mouse
gacaatgaccagtgtgagag

SEQ ID NO: 829160 - DNA, 20 bp, mouse
gtaagttccctctctcacac

SEQ ID NO: 829161 - DNA, 20 bp, mouse
gtaaatatcccctggttcca

SEQ ID NO: 829162 - DNA, 20 bp, mouse
gcatccctcccttggaacca

SEQ ID NO: 829163 - DNA, 20 bp, mouse
gggtcattgtaaatatcccc

SEQ ID NO: 829164 - DNA, 20 bp, mouse
gccctggagtgtccacgctg

SEQ ID NO: 829165 - DNA, 20 bp, mouse
gtcctgttggatataagtat

SEQ ID NO: 829166 - DNA, 20 bp, mouse
gtgtgtaggggtgagaagtc

SEQ ID NO: 829167 - DNA, 20 bp, mouse
gtagggagtggtactgtggt

SEQ ID NO: 829168 - DNA, 20 bp, mouse
gccccctgaagagatatgac

SEQ ID NO: 829169 - DNA, 20 bp, mouse
gaatcctgtcatatctcttc

SEQ ID NO: 829170 - DNA, 20 bp, mouse
gagggaggagagttgtgtag

SEQ ID NO: 829171 - DNA, 20 bp, mouse
gtaacactgatgttgtgact

SEQ ID NO: 829172 - DNA, 20 bp, mouse
ggtgttagaaaatgaaatcc

SEQ ID NO: 829173 - DNA, 20 bp, mouse
gctcggatttgaaaaattgc

SEQ ID NO: 829174 - DNA, 20 bp, mouse
gtttttgttttagccaggta

SEQ ID NO: 829175 - DNA, 20 bp, mouse
gggatatttttgttttagcc

SEQ ID NO: 829176 - DNA, 20 bp, mouse
gagggggcttatcaatttga

SEQ ID NO: 829177 - DNA, 20 bp, mouse
gctgaccagtgtcagagagg

SEQ ID NO: 829178 - DNA, 20 bp, mouse
gacactgaccagtgtcagag

SEQ ID NO: 829179 - DNA, 20 bp, mouse
gggaaagttcatatggcagc

SEQ ID NO: 829180 - DNA, 20 bp, mouse
gtaagccccctctctgacac

SEQ ID NO: 829181 - DNA, 20 bp, mouse
ggttagctggaaagttcata

SEQ ID NO: 829182 - DNA, 20 bp, mouse
gtagcaagcgatctgttagc

SEQ ID NO: 829183 - DNA, 20 bp, mouse
gttatcaatttgatggtgtt

SEQ ID NO: 829184 - DNA, 20 bp, mouse
ggtcatatggctgattcctc

SEQ ID NO: 829185 - DNA, 20 bp, mouse
ggagggtgagagtggtgcca

SEQ ID NO: 829186 - DNA, 20 bp, mouse
gtatttactcttcatcccgt

SEQ ID NO: 829187 - DNA, 20 bp, mouse
ggatctgaaaagaagaatta

SEQ ID NO: 829188 - DNA, 20 bp, mouse
gtttcaagctcttacacagt

SEQ ID NO: 829189 - DNA, 20 bp, mouse
ggtcagatctcgtgatcaga

SEQ ID NO: 829190 - DNA, 20 bp, mouse
gggtctatggtaattcgttt

SEQ ID NO: 829191 - DNA, 20 bp, mouse
gagaaagagaaataaggagc

SEQ ID NO: 829192 - DNA, 20 bp, mouse
gtgtttagatggtttgcagg

SEQ ID NO: 829193 - DNA, 20 bp, mouse
gccttatttctctttcttta

SEQ ID NO: 829194 - DNA, 20 bp, mouse
gtattataattgtaaccaac

SEQ ID NO: 829195 - DNA, 20 bp, mouse
ggattgtttagatggtttgc

SEQ ID NO: 829196 - DNA, 20 bp, mouse
ggccgcgctgagagtcactg

SEQ ID NO: 829197 - DNA, 20 bp, mouse
gtgcactgggcgcgtgggtg

SEQ ID NO: 829198 - DNA, 20 bp, mouse
gcgggccccgcaccacgcgg

SEQ ID NO: 829199 - DNA, 20 bp, mouse
gctctagaaaggtgtcccgg

SEQ ID NO: 829200 - DNA, 20 bp, mouse
gttccagaggaggcaggccc

SEQ ID NO: 829201 - DNA, 20 bp, mouse
gcggcggctttgagcgtccg

SEQ ID NO: 829202 - DNA, 20 bp, mouse
ggactctcagcgcggcctcc

SEQ ID NO: 829203 - DNA, 20 bp, mouse
gtccgcaggctcggctgcac

SEQ ID NO: 829204 - DNA, 20 bp, mouse
gtcggctgcactgggcgcgt

SEQ ID NO: 829205 - DNA, 20 bp, mouse
gtcaagaagtgactgtttgg

SEQ ID NO: 829206 - DNA, 20 bp, mouse
gcaagctggtccaaggggag

SEQ ID NO: 829207 - DNA, 20 bp, mouse
gaggctgggcggtgaactac

SEQ ID NO: 829208 - DNA, 20 bp, mouse
ggtgaactacagggctagga

SEQ ID NO: 829209 - DNA, 20 bp, mouse
gagtcactccatggggggga

SEQ ID NO: 829210 - DNA, 20 bp, mouse
gtgcatgcagtcactccatg

SEQ ID NO: 829211 - DNA, 20 bp, mouse
gactgcgccaccctcaggct

SEQ ID NO: 829212 - DNA, 20 bp, mouse
gaggatgcaagctggtccaa

SEQ ID NO: 829213 - DNA, 20 bp, mouse
gtacaagtgtgggtagaacc

SEQ ID NO: 829214 - DNA, 20 bp, mouse
gggaagacacaaaatctggg

SEQ ID NO: 829215 - DNA, 20 bp, mouse
gcaccacgctcctgcgcaca

SEQ ID NO: 829216 - DNA, 20 bp, mouse
gctgggccggggatcggaca

SEQ ID NO: 829217 - DNA, 20 bp, mouse
gcgctcctgctgccggggac

SEQ ID NO: 829218 - DNA, 20 bp, mouse
gtgcctgcggggacccagag

SEQ ID NO: 829219 - DNA, 20 bp, mouse
gccaaacgcggcctgggccg

SEQ ID NO: 829220 - DNA, 20 bp, mouse
gcggcgccgtgtccgatccc

SEQ ID NO: 829221 - DNA, 20 bp, mouse
ggccagctcgggtgcagaat

SEQ ID NO: 829222 - DNA, 20 bp, mouse
gggacggcgctaggctaggc

SEQ ID NO: 829223 - DNA, 20 bp, mouse
gcagcccggtccccggcagc

SEQ ID NO: 829224 - DNA, 20 bp, mouse
ggaccaagcagcccggtccc

SEQ ID NO: 829225 - DNA, 20 bp, mouse
gagcggcgagccgccaaacg

SEQ ID NO: 829226 - DNA, 20 bp, mouse
ggggcggcgccgcagggctc

SEQ ID NO: 829227 - DNA, 20 bp, mouse
gccgcccccaggcacctgcg

SEQ ID NO: 829228 - DNA, 20 bp, mouse
gaccgcggcggaggcacatg

SEQ ID NO: 829229 - DNA, 20 bp, mouse
gaataagcgcagacctacgg

SEQ ID NO: 829230 - DNA, 20 bp, mouse
gcgaagccgcgggaagacgc

SEQ ID NO: 829231 - DNA, 20 bp, mouse
gcggcgccgcagggctcagg

SEQ ID NO: 829232 - DNA, 20 bp, mouse
gaagctcgcctcgcccccgt

SEQ ID NO: 829233 - DNA, 20 bp, mouse
ggcgaggcgagcttccggcg

SEQ ID NO: 829234 - DNA, 20 bp, mouse
gtaggtctgcgcttatttgg

SEQ ID NO: 829235 - DNA, 20 bp, mouse
gttcccgcggcttcgggagg

SEQ ID NO: 829236 - DNA, 20 bp, mouse
gagcaagcctgtgcgggaca

SEQ ID NO: 829237 - DNA, 20 bp, mouse
gagatccagtaggatcgcag

SEQ ID NO: 829238 - DNA, 20 bp, mouse
gtgagcctgcgaggcactgt

SEQ ID NO: 829239 - DNA, 20 bp, mouse
ggcgccaggaagccacccct

SEQ ID NO: 829240 - DNA, 20 bp, mouse
gctgacaagggtgatagaag

SEQ ID NO: 829241 - DNA, 20 bp, mouse
gcgaccaaggggtggcttcc

SEQ ID NO: 829242 - DNA, 20 bp, mouse
gctggcgcaggggacgcctg

SEQ ID NO: 829243 - DNA, 20 bp, mouse
gccagcccctgcgatcctac

SEQ ID NO: 829244 - DNA, 20 bp, mouse
gactaccagcaagcctgtgc

SEQ ID NO: 829245 - DNA, 20 bp, mouse
gaccgcccacagtgcctcgc

SEQ ID NO: 829246 - DNA, 20 bp, mouse
gcacacgcggacctcgaagt

SEQ ID NO: 829247 - DNA, 20 bp, mouse
gagaaaccgctaggcggcgt

SEQ ID NO: 829248 - DNA, 20 bp, mouse
gcacgccgtcctgacgctcg

SEQ ID NO: 829249 - DNA, 20 bp, mouse
gcgcacgcgcagaaaccgct

SEQ ID NO: 829250 - DNA, 20 bp, mouse
gcacaccccgagcgtcagga

SEQ ID NO: 829251 - DNA, 20 bp, mouse
gcgaggtccgcgtgtgagaa

SEQ ID NO: 829252 - DNA, 20 bp, mouse
gacctcgaagtgggcagccg

SEQ ID NO: 829253 - DNA, 20 bp, mouse
ggccacggctgcccacttcg

SEQ ID NO: 829254 - DNA, 20 bp, mouse
ggggcggggcgtggtgcgac

SEQ ID NO: 829255 - DNA, 20 bp, mouse
gctgaagagaacgaactttg

SEQ ID NO: 829256 - DNA, 20 bp, mouse
gaagtctgtaagctggagtc

SEQ ID NO: 829257 - DNA, 20 bp, mouse
gaggctcccacgtgcatgca

SEQ ID NO: 829258 - DNA, 20 bp, mouse
gggaggggaagccaagacac

SEQ ID NO: 829259 - DNA, 20 bp, mouse
gaagccaagacacgggactg

SEQ ID NO: 829260 - DNA, 20 bp, mouse
gacttcgcgcatgctccaga

SEQ ID NO: 829261 - DNA, 20 bp, mouse
ggatggcctcagtgaggggt

SEQ ID NO: 829262 - DNA, 20 bp, mouse
gcataaacacgtgcctgtcc

SEQ ID NO: 829263 - DNA, 20 bp, mouse
ggagcagggcagcgctcata

SEQ ID NO: 829264 - DNA, 20 bp, mouse
gttgtgccacgcaagagagt

SEQ ID NO: 829265 - DNA, 20 bp, mouse
ggacacgggactggggagga

SEQ ID NO: 829266 - DNA, 20 bp, mouse
ggccgcagccaatccttctg

SEQ ID NO: 829267 - DNA, 20 bp, mouse
gactggctgtggacgtgggc

SEQ ID NO: 829268 - DNA, 20 bp, mouse
gcggactgccgtgagcgacg

SEQ ID NO: 829269 - DNA, 20 bp, mouse
gtccgcagaaggattggctg

SEQ ID NO: 829270 - DNA, 20 bp, mouse
gggcttccccgggctctaac

SEQ ID NO: 829271 - DNA, 20 bp, mouse
gcggcagtccgcagaaggat

SEQ ID NO: 829272 - DNA, 20 bp, mouse
ggactccagaagcctctaat

SEQ ID NO: 829273 - DNA, 20 bp, mouse
gggagcgccaaagtccctcg

SEQ ID NO: 829274 - DNA, 20 bp, mouse
gggccgcggaatgactccgt

SEQ ID NO: 829275 - DNA, 20 bp, mouse
ggcaccagccacgtcgctca

SEQ ID NO: 829276 - DNA, 20 bp, mouse
ggacccgcgggctgagtgtc

SEQ ID NO: 829277 - DNA, 20 bp, mouse
gggagaagtaggggacccgc

SEQ ID NO: 829278 - DNA, 20 bp, mouse
ggcgggctgagtgtcagggt

SEQ ID NO: 829279 - DNA, 20 bp, mouse
gggcccgctgattccctggg

SEQ ID NO: 829280 - DNA, 20 bp, mouse
gtccctggggggcctactta

SEQ ID NO: 829281 - DNA, 20 bp, mouse
gaggccccccagggaatcag

SEQ ID NO: 829282 - DNA, 20 bp, mouse
ggagcggtcctggagaagta

SEQ ID NO: 829283 - DNA, 20 bp, mouse
gtccctaagtaggcccccca

SEQ ID NO: 829284 - DNA, 20 bp, mouse
ggggccgagtgctttaccaa

SEQ ID NO: 829285 - DNA, 20 bp, mouse
gtcagggtgggggaggacca

SEQ ID NO: 829286 - DNA, 20 bp, mouse
gtgacgtcatggtgtggggc

SEQ ID NO: 829287 - DNA, 20 bp, mouse
ggagccgcgcgcgatggcgg

SEQ ID NO: 829288 - DNA, 20 bp, mouse
gggtgtggggcgggacgcgt

SEQ ID NO: 829289 - DNA, 20 bp, mouse
ggcgcggctcgctcccccgt

SEQ ID NO: 829290 - DNA, 20 bp, mouse
ggagcccccgccatcgcgcg

SEQ ID NO: 829291 - DNA, 20 bp, mouse
gcgcggtgacgtcatggtgt

SEQ ID NO: 829292 - DNA, 20 bp, mouse
gaggaccgaactcgctccgg

SEQ ID NO: 829293 - DNA, 20 bp, mouse
gcatgccgccgggtcctgga

SEQ ID NO: 829294 - DNA, 20 bp, mouse
gcgggacttggcgcccacgg

SEQ ID NO: 829295 - DNA, 20 bp, mouse
gaactcgctccggaggggtg

SEQ ID NO: 829296 - DNA, 20 bp, mouse
gggtaggcttggaatctcac

SEQ ID NO: 829297 - DNA, 20 bp, mouse
gccggccccggggcagaaaa

SEQ ID NO: 829298 - DNA, 20 bp, mouse
gctggggtccctaggagaga

SEQ ID NO: 829299 - DNA, 20 bp, mouse
gctggcctcgcccacagcag

SEQ ID NO: 829300 - DNA, 20 bp, mouse
gggactgggtagggttgctg

SEQ ID NO: 829301 - DNA, 20 bp, mouse
ggggccctatggctctccct

SEQ ID NO: 829302 - DNA, 20 bp, mouse
gggaaagtcgatgggaactt

SEQ ID NO: 829303 - DNA, 20 bp, mouse
gtaggagagaaggtggttat

SEQ ID NO: 829304 - DNA, 20 bp, mouse
gaccctacccagtccttaga

SEQ ID NO: 829305 - DNA, 20 bp, mouse
ggctgcgaggtgcttgcttt

SEQ ID NO: 829306 - DNA, 20 bp, mouse
gcacagctacgggcgttctt

SEQ ID NO: 829307 - DNA, 20 bp, mouse
gagacgacgagcgaggaatg

SEQ ID NO: 829308 - DNA, 20 bp, mouse
gggcgggcgggcccacgggt

SEQ ID NO: 829309 - DNA, 20 bp, mouse
gtggggggagtgatctaagg

SEQ ID NO: 829310 - DNA, 20 bp, mouse
gcagcggagtacccacaagg

SEQ ID NO: 829311 - DNA, 20 bp, mouse
gcgggtgggcggtgctattt

SEQ ID NO: 829312 - DNA, 20 bp, mouse
gcgggaggggcgggaccggt

SEQ ID NO: 829313 - DNA, 20 bp, mouse
gcccacaagggggttgtgta

SEQ ID NO: 829314 - DNA, 20 bp, mouse
gtacgggcgttcttgggact

SEQ ID NO: 829315 - DNA, 20 bp, mouse
gcaacggcgggcgggcccac

SEQ ID NO: 829316 - DNA, 20 bp, mouse
ggcggccacgggacaggaca

SEQ ID NO: 829317 - DNA, 20 bp, mouse
ggccacgggacaggacacgg

SEQ ID NO: 829318 - DNA, 20 bp, mouse
ggaggcgcgccccaccccgg

SEQ ID NO: 829319 - DNA, 20 bp, mouse
ggtggagcccagcctctctc

SEQ ID NO: 829320 - DNA, 20 bp, mouse
ggagacacccgggaaccccg

SEQ ID NO: 829321 - DNA, 20 bp, mouse
gaggcgccgaggggtccgcg

SEQ ID NO: 829322 - DNA, 20 bp, mouse
gtggcccggtctcctcccaa

SEQ ID NO: 829323 - DNA, 20 bp, mouse
gaggactcaacgcaacccgg

SEQ ID NO: 829324 - DNA, 20 bp, mouse
gggacacggcggagacaccc

SEQ ID NO: 829325 - DNA, 20 bp, mouse
ggggaaccgcgggcggccac

SEQ ID NO: 829326 - DNA, 20 bp, mouse
ggtcctgcggccgaagttcc

SEQ ID NO: 829327 - DNA, 20 bp, mouse
gaccccacgccgcgtctgtc

SEQ ID NO: 829328 - DNA, 20 bp, mouse
gaaaaatgctccttcgtccc

SEQ ID NO: 829329 - DNA, 20 bp, mouse
gtagcaatagcacttgtggg

SEQ ID NO: 829330 - DNA, 20 bp, mouse
gtggcgctgtgggcagcgga

SEQ ID NO: 829331 - DNA, 20 bp, mouse
gcaaagccaaagggaagaat

SEQ ID NO: 829332 - DNA, 20 bp, mouse
ggaaatcgcggaaggaaggt

SEQ ID NO: 829333 - DNA, 20 bp, mouse
ggagctccgattcttccctt

SEQ ID NO: 829334 - DNA, 20 bp, mouse
gaagcgctgaccaaacccat

SEQ ID NO: 829335 - DNA, 20 bp, mouse
gagcccctcgcgggcgaaac

SEQ ID NO: 829336 - DNA, 20 bp, mouse
ggcgctctgtgctagtcggg

SEQ ID NO: 829337 - DNA, 20 bp, mouse
gacccgcggagtcctgagag

SEQ ID NO: 829338 - DNA, 20 bp, mouse
gcacgcgcgccaccccgagc

SEQ ID NO: 829339 - DNA, 20 bp, mouse
gccccgagccggagaaattg

SEQ ID NO: 829340 - DNA, 20 bp, mouse
ggggacgtgccggagaaggt

SEQ ID NO: 829341 - DNA, 20 bp, mouse
ggcgcgcgtgcgcactctcg

SEQ ID NO: 829342 - DNA, 20 bp, mouse
gctgcctggaagctcacgat

SEQ ID NO: 829343 - DNA, 20 bp, mouse
gacagagcgccgctggctag

SEQ ID NO: 829344 - DNA, 20 bp, mouse
gctgtgctagtcgggaggaa

SEQ ID NO: 829345 - DNA, 20 bp, mouse
gggttgctacgtcccctctc

SEQ ID NO: 829346 - DNA, 20 bp, mouse
ggcggcagagccacaagtgt

SEQ ID NO: 829347 - DNA, 20 bp, mouse
gagtagcagtgactccgcgg

SEQ ID NO: 829348 - DNA, 20 bp, mouse
ggtcgtggacgtggtcatga

SEQ ID NO: 829349 - DNA, 20 bp, mouse
gtggacgtggtcatgagggg

SEQ ID NO: 829350 - DNA, 20 bp, mouse
gacctgcagcccccacaact

SEQ ID NO: 829351 - DNA, 20 bp, mouse
ggatgtgcgtgaagtgtcag

SEQ ID NO: 829352 - DNA, 20 bp, mouse
ggtgtgggcgggcccaagga

SEQ ID NO: 829353 - DNA, 20 bp, mouse
ggggtcagtgcgttagcgta

SEQ ID NO: 829354 - DNA, 20 bp, mouse
ggggcgcgcctggacctcgt

SEQ ID NO: 829355 - DNA, 20 bp, mouse
ggggctgcaggtcgtggacg

SEQ ID NO: 829356 - DNA, 20 bp, mouse
gtcaggctgaggggtcaatg

SEQ ID NO: 829357 - DNA, 20 bp, mouse
gtccaccgcaacactgcaat

SEQ ID NO: 829358 - DNA, 20 bp, mouse
gcggccacccaccaatcaaa

SEQ ID NO: 829359 - DNA, 20 bp, mouse
gggcccggagagccaggctt

SEQ ID NO: 829360 - DNA, 20 bp, mouse
gtgcaatgggcggagccaga

SEQ ID NO: 829361 - DNA, 20 bp, mouse
ggacaggagctgttttagga

SEQ ID NO: 829362 - DNA, 20 bp, mouse
ggtggaaatccagcgacgtc

SEQ ID NO: 829363 - DNA, 20 bp, mouse
ggcccaggcttccttttgat

SEQ ID NO: 829364 - DNA, 20 bp, mouse
gcatcaccaggacccttgaa

SEQ ID NO: 829365 - DNA, 20 bp, mouse
gctcgatccaaggagcgcag

SEQ ID NO: 829366 - DNA, 20 bp, mouse
ggcatgccacttgacctcca

SEQ ID NO: 829367 - DNA, 20 bp, mouse
gactgctgtggacgccctgg

SEQ ID NO: 829368 - DNA, 20 bp, mouse
gcggtctagttttatttagc

SEQ ID NO: 829369 - DNA, 20 bp, mouse
gaagtggcatgccattccag

SEQ ID NO: 829370 - DNA, 20 bp, mouse
gtgcctgttaaacactgctg

SEQ ID NO: 829371 - DNA, 20 bp, mouse
ggggaatctggcatgtaaac

SEQ ID NO: 829372 - DNA, 20 bp, mouse
gtaaaactagaccgctggaa

SEQ ID NO: 829373 - DNA, 20 bp, mouse
gaacactgctgtggacgccc

SEQ ID NO: 829374 - DNA, 20 bp, mouse
ggtccacagcagtgtttaac

SEQ ID NO: 829375 - DNA, 20 bp, mouse
gagcagggtgacaccatata

SEQ ID NO: 829376 - DNA, 20 bp, mouse
gagtcctgcactagagtcgg

SEQ ID NO: 829377 - DNA, 20 bp, mouse
ggggagaaacccgacaaagg

SEQ ID NO: 829378 - DNA, 20 bp, mouse
ggggggaggtctagtttttc

SEQ ID NO: 829379 - DNA, 20 bp, mouse
gtgccgggagccccctttgt

SEQ ID NO: 829380 - DNA, 20 bp, mouse
gcatgggagaaacccgacaa

SEQ ID NO: 829381 - DNA, 20 bp, mouse
gctctctattgattaaggag

SEQ ID NO: 829382 - DNA, 20 bp, mouse
gaaaaaaaagtggattcaga

SEQ ID NO: 829383 - DNA, 20 bp, mouse
gctagacagttgccttcttt

SEQ ID NO: 829384 - DNA, 20 bp, mouse
gggattcagatggaaatgtc

SEQ ID NO: 829385 - DNA, 20 bp, mouse
gagttgctctctattgatta

SEQ ID NO: 829386 - DNA, 20 bp, mouse
gttgtggcggtcaagggtgg

SEQ ID NO: 829387 - DNA, 20 bp, mouse
gtcctggttgtggcggtcaa

SEQ ID NO: 829388 - DNA, 20 bp, mouse
gtccacggcaggggaataaa

SEQ ID NO: 829389 - DNA, 20 bp, mouse
gccagcttctctctcagtcc

SEQ ID NO: 829390 - DNA, 20 bp, mouse
gtggtaactgagcttcccat

SEQ ID NO: 829391 - DNA, 20 bp, mouse
gtggttgtggcggtcaaggg

SEQ ID NO: 829392 - DNA, 20 bp, mouse
ggcttggtacagtaatccga

SEQ ID NO: 829393 - DNA, 20 bp, mouse
gctctcagtcctggttgtgg

SEQ ID NO: 829394 - DNA, 20 bp, mouse
gcacacattatccacggcag

SEQ ID NO: 829395 - DNA, 20 bp, mouse
gtagcagccaaatacaatat

SEQ ID NO: 829396 - DNA, 20 bp, mouse
ggggaactgagtgggttctt

SEQ ID NO: 829397 - DNA, 20 bp, mouse
gaggaaggaaacttgagccg

SEQ ID NO: 829398 - DNA, 20 bp, mouse
gacatctctgccaactgtgt

SEQ ID NO: 829399 - DNA, 20 bp, mouse
gcagcaccaggcaggatgag

SEQ ID NO: 829400 - DNA, 20 bp, mouse
gcccctctgtggtgagcagt

SEQ ID NO: 829401 - DNA, 20 bp, mouse
gtgagacaagcccacacagt

SEQ ID NO: 829402 - DNA, 20 bp, mouse
gcacccactgctcaccacag

SEQ ID NO: 829403 - DNA, 20 bp, mouse
gatcctgcctggtgctgagt

SEQ ID NO: 829404 - DNA, 20 bp, mouse
gggaaacttgagccggggac

SEQ ID NO: 829405 - DNA, 20 bp, mouse
ggtgagcagtgggtgaagtg

SEQ ID NO: 829406 - DNA, 20 bp, mouse
gggtgcgcgctgcgtaaggg

SEQ ID NO: 829407 - DNA, 20 bp, mouse
gtccgcctgcccgggagcgt

SEQ ID NO: 829408 - DNA, 20 bp, mouse
gcagctcttcaggctaggat

SEQ ID NO: 829409 - DNA, 20 bp, mouse
ggggcacagctcttcaggct

SEQ ID NO: 829410 - DNA, 20 bp, mouse
gggagcgtcgggcccttctg

SEQ ID NO: 829411 - DNA, 20 bp, mouse
ggaggggtgcggatggagag

SEQ ID NO: 829412 - DNA, 20 bp, mouse
gcaatcggaagccacgctat

SEQ ID NO: 829413 - DNA, 20 bp, mouse
gaaacctgtagtcacgaaag

SEQ ID NO: 829414 - DNA, 20 bp, mouse
gcccgctccgccttcctctg

SEQ ID NO: 829415 - DNA, 20 bp, mouse
gagcacgtgtctacatcgtt

SEQ ID NO: 829416 - DNA, 20 bp, mouse
gaggccgggttctctgtcag

SEQ ID NO: 829417 - DNA, 20 bp, mouse
gccctgccaagcagcgagaa

SEQ ID NO: 829418 - DNA, 20 bp, mouse
ggccaagcagcgagaaggga

SEQ ID NO: 829419 - DNA, 20 bp, mouse
ggggttctctgtcagaggat

SEQ ID NO: 829420 - DNA, 20 bp, mouse
gagtctgggaaccataacca

SEQ ID NO: 829421 - DNA, 20 bp, mouse
gctcggccacctgccagcta

SEQ ID NO: 829422 - DNA, 20 bp, mouse
gtgtcagaggattggtgctg

SEQ ID NO: 829423 - DNA, 20 bp, mouse
ggcccacagcaagtgagcac

SEQ ID NO: 829424 - DNA, 20 bp, mouse
gcaggcggggtgtgagcctg

SEQ ID NO: 829425 - DNA, 20 bp, mouse
gagccacaggctagggaggc

SEQ ID NO: 829426 - DNA, 20 bp, mouse
gcgggatcgccgagatgcat

SEQ ID NO: 829427 - DNA, 20 bp, mouse
gggagaaagtgtggccgttc

SEQ ID NO: 829428 - DNA, 20 bp, mouse
ggggataaggccaatgtatg

SEQ ID NO: 829429 - DNA, 20 bp, mouse
gaggagactcgccccaaaac

SEQ ID NO: 829430 - DNA, 20 bp, mouse
ggcatctcggcgatcccgaa

SEQ ID NO: 829431 - DNA, 20 bp, mouse
gcggcgaaagcgacagtctc

SEQ ID NO: 829432 - DNA, 20 bp, mouse
gcctgtccggagttgagagg

SEQ ID NO: 829433 - DNA, 20 bp, mouse
ggggctgggcagaagggttc

SEQ ID NO: 829434 - DNA, 20 bp, mouse
ggttgagaggaggagtatct

SEQ ID NO: 829435 - DNA, 20 bp, mouse
gaaccctgtccggagttgag

SEQ ID NO: 829436 - DNA, 20 bp, mouse
gccatcttgcccttcatcca

SEQ ID NO: 829437 - DNA, 20 bp, mouse
gaagataagccttggatgaa

SEQ ID NO: 829438 - DNA, 20 bp, mouse
gaataggggtatcctctcat

SEQ ID NO: 829439 - DNA, 20 bp, mouse
ggatgaagggcaagatggat

SEQ ID NO: 829440 - DNA, 20 bp, mouse
gctcctgctcctgccttaac

SEQ ID NO: 829441 - DNA, 20 bp, mouse
ggggaaaggctgtatcttaa

SEQ ID NO: 829442 - DNA, 20 bp, mouse
gcataccatacataggtgga

SEQ ID NO: 829443 - DNA, 20 bp, mouse
gctgccttaactggattgtg

SEQ ID NO: 829444 - DNA, 20 bp, mouse
gaaggcacttggtatcagca

SEQ ID NO: 829445 - DNA, 20 bp, mouse
gctgccccacaatccagtta

SEQ ID NO: 829446 - DNA, 20 bp, mouse
gccgacccgctgtgcatcta

SEQ ID NO: 829447 - DNA, 20 bp, mouse
gtgtggtcccgggtcatcta

SEQ ID NO: 829448 - DNA, 20 bp, mouse
gaaacacggggcaggagatt

SEQ ID NO: 829449 - DNA, 20 bp, mouse
gaatgtgagagtggtgctaa

SEQ ID NO: 829450 - DNA, 20 bp, mouse
ggcaggagattgggtcactc

SEQ ID NO: 829451 - DNA, 20 bp, mouse
gctatggagtcagagactcg

SEQ ID NO: 829452 - DNA, 20 bp, mouse
gagtcagagactcggggaac

SEQ ID NO: 829453 - DNA, 20 bp, mouse
ggagaaaactgcggtctcta

SEQ ID NO: 829454 - DNA, 20 bp, mouse
gcccgggtcatctacggctc

SEQ ID NO: 829455 - DNA, 20 bp, mouse
gctgagaaaacgtcaaaaca

SEQ ID NO: 829456 - DNA, 20 bp, mouse
ggaaaccaggtgaggggatg

SEQ ID NO: 829457 - DNA, 20 bp, mouse
ggaggcccaggtgacagcgc

SEQ ID NO: 829458 - DNA, 20 bp, mouse
gcaaccgccccctcctcgcg

SEQ ID NO: 829459 - DNA, 20 bp, mouse
gtgggccctgagggcgtgag

SEQ ID NO: 829460 - DNA, 20 bp, mouse
ggccccgcctggtatggagg

SEQ ID NO: 829461 - DNA, 20 bp, mouse
gccaggcaaccgcgcagctg

SEQ ID NO: 829462 - DNA, 20 bp, mouse
gtgcccctgcgctgtcacct

SEQ ID NO: 829463 - DNA, 20 bp, mouse
ggggcacaggtgaccacgcg

SEQ ID NO: 829464 - DNA, 20 bp, mouse
gaatacccgggcctgaaaac

SEQ ID NO: 829465 - DNA, 20 bp, mouse
gcacaggtgaccacgcgagg

SEQ ID NO: 829466 - DNA, 20 bp, mouse
gaaaagagggaagatcccaa

SEQ ID NO: 829467 - DNA, 20 bp, mouse
ggaactccctatccattcca

SEQ ID NO: 829468 - DNA, 20 bp, mouse
gtgcaaggatagcgggtgtt

SEQ ID NO: 829469 - DNA, 20 bp, mouse
ggtgcgccttggaatggata

SEQ ID NO: 829470 - DNA, 20 bp, mouse
ggacttgtaagtaaaacatg

SEQ ID NO: 829471 - DNA, 20 bp, mouse
gggaagatcccaaaggtagc

SEQ ID NO: 829472 - DNA, 20 bp, mouse
gtagctggtgcgccttggaa

SEQ ID NO: 829473 - DNA, 20 bp, mouse
gaaaggtagctggtgcgcct

SEQ ID NO: 829474 - DNA, 20 bp, mouse
gtagagcgtccaggaggcac

SEQ ID NO: 829475 - DNA, 20 bp, mouse
gttagggatgctctaccact

SEQ ID NO: 829476 - DNA, 20 bp, mouse
ggagcaacagggtcactcaa

SEQ ID NO: 829477 - DNA, 20 bp, mouse
gaaagggccaagcagtgtct

SEQ ID NO: 829478 - DNA, 20 bp, mouse
gtttcccaggacacaggtgg

SEQ ID NO: 829479 - DNA, 20 bp, mouse
gagtgtctgggaacatagct

SEQ ID NO: 829480 - DNA, 20 bp, mouse
ggggaacatagctgggtaaa

SEQ ID NO: 829481 - DNA, 20 bp, mouse
gggcagaaacggttaatctg

SEQ ID NO: 829482 - DNA, 20 bp, mouse
gctgtcccaagcaaggttcc

SEQ ID NO: 829483 - DNA, 20 bp, mouse
gggtgtatacaatgttcctt

SEQ ID NO: 829484 - DNA, 20 bp, mouse
ggcaaccaggaaccttgctt

SEQ ID NO: 829485 - DNA, 20 bp, mouse
gtgcactgggacggcagaaa

SEQ ID NO: 829486 - DNA, 20 bp, mouse
gcccgcggctcctagctctt

SEQ ID NO: 829487 - DNA, 20 bp, mouse
ggaacttagctccttcggtt

SEQ ID NO: 829488 - DNA, 20 bp, mouse
gtgctggtgtcataaagcat

SEQ ID NO: 829489 - DNA, 20 bp, mouse
ggggttagggtctttgtgcc

SEQ ID NO: 829490 - DNA, 20 bp, mouse
gctaagtcacagaggccccg

SEQ ID NO: 829491 - DNA, 20 bp, mouse
gggcctctgtgacttagtgc

SEQ ID NO: 829492 - DNA, 20 bp, mouse
ggtgtcataaagcatgggtt

SEQ ID NO: 829493 - DNA, 20 bp, mouse
gtgtgcatgggctcctgtgg

SEQ ID NO: 829494 - DNA, 20 bp, mouse
gtacaaagcaagctccatcc

SEQ ID NO: 829495 - DNA, 20 bp, mouse
gtcccaagagctaggagccg

SEQ ID NO: 829496 - DNA, 20 bp, mouse
gcgacccaaggcagcatagt

SEQ ID NO: 829497 - DNA, 20 bp, mouse
gtggcctaagagcctacggt

SEQ ID NO: 829498 - DNA, 20 bp, mouse
ggtggctagggacgaatcag

SEQ ID NO: 829499 - DNA, 20 bp, mouse
gtaagagcctacggtgggca

SEQ ID NO: 829500 - DNA, 20 bp, mouse
gaggcctgagggcaggactc

SEQ ID NO: 829501 - DNA, 20 bp, mouse
gctgagggcaggactccggt

SEQ ID NO: 829502 - DNA, 20 bp, mouse
gtctgcgcctgcgcaagagg

SEQ ID NO: 829503 - DNA, 20 bp, mouse
gccctgagggaaacagaata

SEQ ID NO: 829504 - DNA, 20 bp, mouse
gaagccaggaacagcggata

SEQ ID NO: 829505 - DNA, 20 bp, mouse
gaactctctaggcgccctga

SEQ ID NO: 829506 - DNA, 20 bp, mouse
gcgcagatcgggattcatga

SEQ ID NO: 829507 - DNA, 20 bp, mouse
gtccgctcatagggcctggt

SEQ ID NO: 829508 - DNA, 20 bp, mouse
gcatgacggagaccagtgct

SEQ ID NO: 829509 - DNA, 20 bp, mouse
gagacaggttgtcatcgctt

SEQ ID NO: 829510 - DNA, 20 bp, mouse
gctgtctcgctccgctcata

SEQ ID NO: 829511 - DNA, 20 bp, mouse
gaggctcaccgatttctcga

SEQ ID NO: 829512 - DNA, 20 bp, mouse
gaactctggattgaaggtgg

SEQ ID NO: 829513 - DNA, 20 bp, mouse
gagcggagcgagacagccct

SEQ ID NO: 829514 - DNA, 20 bp, mouse
gcccgctccttgcgcagatc

SEQ ID NO: 829515 - DNA, 20 bp, mouse
gtggggcctctggagttgag

SEQ ID NO: 829516 - DNA, 20 bp, mouse
gggggagagccagagatctt

SEQ ID NO: 829517 - DNA, 20 bp, mouse
ggggaggcagctccagagat

SEQ ID NO: 829518 - DNA, 20 bp, mouse
gtcccagcagggtagatcct

SEQ ID NO: 829519 - DNA, 20 bp, mouse
gagtgtcagcctaagatctc

SEQ ID NO: 829520 - DNA, 20 bp, mouse
ggattccagggctggatctc

SEQ ID NO: 829521 - DNA, 20 bp, mouse
gccagtgggccactgtgtgc

SEQ ID NO: 829522 - DNA, 20 bp, mouse
gtaggctgacactcccagca

SEQ ID NO: 829523 - DNA, 20 bp, mouse
gctcccttgggatttcctgt

SEQ ID NO: 829524 - DNA, 20 bp, mouse
gtggcacagggtgggaattc

SEQ ID NO: 829525 - DNA, 20 bp, mouse
ggtcgctgctccaggaagtg

SEQ ID NO: 829526 - DNA, 20 bp, mouse
gagaccttgaagtgataaac

SEQ ID NO: 829527 - DNA, 20 bp, mouse
ggggaaaaatcagtattgat

SEQ ID NO: 829528 - DNA, 20 bp, mouse
gccctgcagtaatagggtgt

SEQ ID NO: 829529 - DNA, 20 bp, mouse
gcacatatctacaatgccat

SEQ ID NO: 829530 - DNA, 20 bp, mouse
gttgaagtgataaactggac

SEQ ID NO: 829531 - DNA, 20 bp, mouse
gggaaagaatgaaacattat

SEQ ID NO: 829532 - DNA, 20 bp, mouse
gcatgctatgatttattttg

SEQ ID NO: 829533 - DNA, 20 bp, mouse
gggtgatgaaaacttaaatt

SEQ ID NO: 829534 - DNA, 20 bp, mouse
gactcagccctgcagtaata

SEQ ID NO: 829535 - DNA, 20 bp, mouse
gataaatcatagcatgctag

SEQ ID NO: 829536 - DNA, 20 bp, mouse
gggcctgctaatactatcaa

SEQ ID NO: 829537 - DNA, 20 bp, mouse
gcatctggcagattcacaat

SEQ ID NO: 829538 - DNA, 20 bp, mouse
gatgacatgaagctagccgg

SEQ ID NO: 829539 - DNA, 20 bp, mouse
gacaaagggcactatttctt

SEQ ID NO: 829540 - DNA, 20 bp, mouse
ggaaataaagtgtgcttgag

SEQ ID NO: 829541 - DNA, 20 bp, mouse
gtgcattggaatgcaaacaa

SEQ ID NO: 829542 - DNA, 20 bp, mouse
gatgtgaagggctctgaatg

SEQ ID NO: 829543 - DNA, 20 bp, mouse
gaaagtgtgcttgaggggac

SEQ ID NO: 829544 - DNA, 20 bp, mouse
gatgggatttggaaatggcc

SEQ ID NO: 829545 - DNA, 20 bp, mouse
ggcatttaggatgaagctag

SEQ ID NO: 829546 - DNA, 20 bp, mouse
gagggcgggcggccgtagag

SEQ ID NO: 829547 - DNA, 20 bp, mouse
gctagagcgcgcacaggccc

SEQ ID NO: 829548 - DNA, 20 bp, mouse
gtcccgcgctgtccctccgt

SEQ ID NO: 829549 - DNA, 20 bp, mouse
ggaaacgcccggctggaaga

SEQ ID NO: 829550 - DNA, 20 bp, mouse
gagcgcgcacaggcccgggc

SEQ ID NO: 829551 - DNA, 20 bp, mouse
gggctctcacttcccacgga

SEQ ID NO: 829552 - DNA, 20 bp, mouse
gctggtaaagaggggcgcta

SEQ ID NO: 829553 - DNA, 20 bp, mouse
gcgcacactcgcgcacacag

SEQ ID NO: 829554 - DNA, 20 bp, mouse
gcccggaaagggttcttggc

SEQ ID NO: 829555 - DNA, 20 bp, mouse
gtcccacggagggacagcgc

SEQ ID NO: 829556 - DNA, 20 bp, mouse
gccagtgaggagtcagtctg
